United States Patent 8,822,426 (PREVENTION AND TREATMENT OF NOSEMA DISEASE IN BEES) - sequence listing, part 4

SEQ ID NO: 97491 - DNA, 20 bp, Artificial sequence
  SiRNA target sequence
aaatacagcaaaatttaagt

SEQ ID NO: 97492 - DNA, 20 bp, Artificial sequence
  SiRNA target sequence
aatacagcaaaatttaagtg

SEQ ID NO: 97493 - DNA, 20 bp, Artificial sequence
  SiRNA target sequence
atacagcaaaatttaagtgt

SEQ ID NO: 97494 - DNA, 20 bp, Artificial sequence
  SiRNA target sequence
tacagcaaaatttaagtgtt

SEQ ID NO: 97495 - DNA, 20 bp, Artificial sequence
  SiRNA target sequence
acagcaaaatttaagtgttg

SEQ ID NO: 97496 - DNA, 20 bp, Artificial sequence
  SiRNA target sequence
cagcaaaatttaagtgttgt

SEQ ID NO: 97497 - DNA, 20 bp, Artificial sequence
  SiRNA target sequence
agcaaaatttaagtgttgta

SEQ ID NO: 97498 - DNA, 20 bp, Artificial sequence
  SiRNA target sequence
gcaaaatttaagtgttgtaa

SEQ ID NO: 97499 - DNA, 20 bp, Artificial sequence
  SiRNA target sequence
caaaatttaagtgttgtaaa

SEQ ID NO: 97500 - DNA, 20 bp, Artificial sequence
  SiRNA target sequence
aaaatttaagtgttgtaaaa

SEQ ID NO: 97501 - DNA, 20 bp, Artificial sequence
  SiRNA target sequence
aaatttaagtgttgtaaaaa

SEQ ID NO: 97502 - DNA, 20 bp, Artificial sequence
  SiRNA target sequence
aatttaagtgttgtaaaaaa

SEQ ID NO: 97503 - DNA, 20 bp, Artificial sequence
  SiRNA target sequence
atttaagtgttgtaaaaaat

SEQ ID NO: 97504 - DNA, 20 bp, Artificial sequence
  SiRNA target sequence
tttaagtgttgtaaaaaatt

SEQ ID NO: 97505 - DNA, 20 bp, Artificial sequence
  SiRNA target sequence
ttaagtgttgtaaaaaattt

SEQ ID NO: 97506 - DNA, 20 bp, Artificial sequence
  SiRNA target sequence
taagtgttgtaaaaaatttg

SEQ ID NO: 97507 - DNA, 20 bp, Artificial sequence
  SiRNA target sequence
aagtgttgtaaaaaatttgt

SEQ ID NO: 97508 - DNA, 20 bp, Artificial sequence
  SiRNA target sequence
agtgttgtaaaaaatttgta

SEQ ID NO: 97509 - DNA, 20 bp, Artificial sequence
  SiRNA target sequence
gtgttgtaaaaaatttgtag

SEQ ID NO: 97510 - DNA, 20 bp, Artificial sequence
  SiRNA target sequence
tgttgtaaaaaatttgtagg

SEQ ID NO: 97511 - DNA, 20 bp, Artificial sequence
  SiRNA target sequence
gttgtaaaaaatttgtaggc

SEQ ID NO: 97512 - DNA, 20 bp, Artificial sequence
  SiRNA target sequence
ttgtaaaaaatttgtaggca

SEQ ID NO: 97513 - DNA, 20 bp, Artificial sequence
  SiRNA target sequence
tgtaaaaaatttgtaggcag

SEQ ID NO: 97514 - DNA, 20 bp, Artificial sequence
  SiRNA target sequence
gtaaaaaatttgtaggcaga

SEQ ID NO: 97515 - DNA, 20 bp, Artificial sequence
  SiRNA target sequence
taaaaaatttgtaggcagat

SEQ ID NO: 97516 - DNA, 20 bp, Artificial sequence
  SiRNA target sequence
aaaaaatttgtaggcagatt

SEQ ID NO: 97517 - DNA, 20 bp, Artificial sequence
  SiRNA target sequence
aaaaatttgtaggcagattt

SEQ ID NO: 97518 - DNA, 20 bp, Artificial sequence
  SiRNA target sequence
aaaatttgtaggcagatttt

SEQ ID NO: 97519 - DNA, 20 bp, Artificial sequence
  SiRNA target sequence
aaatttgtaggcagattttt

SEQ ID NO: 97520 - DNA, 20 bp, Artificial sequence
  SiRNA target sequence
aatttgtaggcagatttttt

SEQ ID NO: 97521 - DNA, 20 bp, Artificial sequence
  SiRNA target sequence
atttgtaggcagattttttt

SEQ ID NO: 97522 - DNA, 20 bp, Artificial sequence
  SiRNA target sequence
tttgtaggcagatttttttt

SEQ ID NO: 97523 - DNA, 20 bp, Artificial sequence
  SiRNA target sequence
ttgtaggcagattttttttg

SEQ ID NO: 97524 - DNA, 20 bp, Artificial sequence
  SiRNA target sequence
tgtaggcagattttttttgc

SEQ ID NO: 97525 - DNA, 20 bp, Artificial sequence
  SiRNA target sequence
gtaggcagattttttttgcg

SEQ ID NO: 97526 - DNA, 20 bp, Artificial sequence
  SiRNA target sequence
taggcagattttttttgcgc

SEQ ID NO: 97527 - DNA, 20 bp, Artificial sequence
  SiRNA target sequence
aggcagattttttttgcgca

SEQ ID NO: 97528 - DNA, 20 bp, Artificial sequence
  SiRNA target sequence
ggcagattttttttgcgcaa

SEQ ID NO: 97529 - DNA, 20 bp, Artificial sequence
  SiRNA target sequence
gcagattttttttgcgcaaa

SEQ ID NO: 97530 - DNA, 20 bp, Artificial sequence
  SiRNA target sequence
cagattttttttgcgcaaaa

SEQ ID NO: 97531 - DNA, 20 bp, Artificial sequence
  SiRNA target sequence
agattttttttgcgcaaaaa

SEQ ID NO: 97532 - DNA, 20 bp, Artificial sequence
  SiRNA target sequence
gattttttttgcgcaaaaat

SEQ ID NO: 97533 - DNA, 20 bp, Artificial sequence
  SiRNA target sequence
attttttttgcgcaaaaatt

SEQ ID NO: 97534 - DNA, 20 bp, Artificial sequence
  SiRNA target sequence
ttttttttgcgcaaaaattt

SEQ ID NO: 97535 - DNA, 20 bp, Artificial sequence
  SiRNA target sequence
tttttttgcgcaaaaatttc

SEQ ID NO: 97536 - DNA, 20 bp, Artificial sequence
  SiRNA target sequence
ttttttgcgcaaaaatttcc

SEQ ID NO: 97537 - DNA, 20 bp, Artificial sequence
  SiRNA target sequence
tttttgcgcaaaaatttcca

SEQ ID NO: 97538 - DNA, 20 bp, Artificial sequence
  SiRNA target sequence
ttttgcgcaaaaatttccaa

SEQ ID NO: 97539 - DNA, 20 bp, Artificial sequence
  SiRNA target sequence
tttgcgcaaaaatttccaaa

SEQ ID NO: 97540 - DNA, 20 bp, Artificial sequence
  SiRNA target sequence
ttgcgcaaaaatttccaaaa

SEQ ID NO: 97541 - DNA, 20 bp, Artificial sequence
  SiRNA target sequence
tgcgcaaaaatttccaaaat

SEQ ID NO: 97542 - DNA, 20 bp, Artificial sequence
  SiRNA target sequence
gcgcaaaaatttccaaaatt

SEQ ID NO: 97543 - DNA, 20 bp, Artificial sequence
  SiRNA target sequence
cgcaaaaatttccaaaattt

SEQ ID NO: 97544 - DNA, 20 bp, Artificial sequence
  SiRNA target sequence
gcaaaaatttccaaaattta

SEQ ID NO: 97545 - DNA, 20 bp, Artificial sequence
  SiRNA target sequence
caaaaatttccaaaatttag

SEQ ID NO: 97546 - DNA, 20 bp, Artificial sequence
  SiRNA target sequence
aaaaatttccaaaatttagt

SEQ ID NO: 97547 - DNA, 20 bp, Artificial sequence
  SiRNA target sequence
aaaatttccaaaatttagtc

SEQ ID NO: 97548 - DNA, 20 bp, Artificial sequence
  SiRNA target sequence
aaatttccaaaatttagtca

SEQ ID NO: 97549 - DNA, 20 bp, Artificial sequence
  SiRNA target sequence
aatttccaaaatttagtcat

SEQ ID NO: 97550 - DNA, 20 bp, Artificial sequence
  SiRNA target sequence
atttccaaaatttagtcatg

SEQ ID NO: 97551 - DNA, 20 bp, Artificial sequence
  SiRNA target sequence
tttccaaaatttagtcatgt

SEQ ID NO: 97552 - DNA, 20 bp, Artificial sequence
  SiRNA target sequence
ttccaaaatttagtcatgtt

SEQ ID NO: 97553 - DNA, 20 bp, Artificial sequence
  SiRNA target sequence
tccaaaatttagtcatgtta

SEQ ID NO: 97554 - DNA, 20 bp, Artificial sequence
  SiRNA target sequence
ccaaaatttagtcatgttaa

SEQ ID NO: 97555 - DNA, 20 bp, Artificial sequence
  SiRNA target sequence
caaaatttagtcatgttaaa

SEQ ID NO: 97556 - DNA, 20 bp, Artificial sequence
  SiRNA target sequence
aaaatttagtcatgttaaaa

SEQ ID NO: 97557 - DNA, 20 bp, Artificial sequence
  SiRNA target sequence
aaatttagtcatgttaaaag

SEQ ID NO: 97558 - DNA, 20 bp, Artificial sequence
  SiRNA target sequence
aatttagtcatgttaaaagg

SEQ ID NO: 97559 - DNA, 20 bp, Artificial sequence
  SiRNA target sequence
atttagtcatgttaaaaggt

SEQ ID NO: 97560 - DNA, 20 bp, Artificial sequence
  SiRNA target sequence
tttagtcatgttaaaaggtt

SEQ ID NO: 97561 - DNA, 20 bp, Artificial sequence
  SiRNA target sequence
ttagtcatgttaaaaggttc

SEQ ID NO: 97562 - DNA, 20 bp, Artificial sequence
  SiRNA target sequence
tagtcatgttaaaaggttca

SEQ ID NO: 97563 - DNA, 20 bp, Artificial sequence
  SiRNA target sequence
agtcatgttaaaaggttcag

SEQ ID NO: 97564 - DNA, 20 bp, Artificial sequence
  SiRNA target sequence
gtcatgttaaaaggttcaga

SEQ ID NO: 97565 - DNA, 20 bp, Artificial sequence
  SiRNA target sequence
tcatgttaaaaggttcagaa

SEQ ID NO: 97566 - DNA, 20 bp, Artificial sequence
  SiRNA target sequence
catgttaaaaggttcagaac

SEQ ID NO: 97567 - DNA, 20 bp, Artificial sequence
  SiRNA target sequence
atgttaaaaggttcagaacc

SEQ ID NO: 97568 - DNA, 20 bp, Artificial sequence
  SiRNA target sequence
tgttaaaaggttcagaacca

SEQ ID NO: 97569 - DNA, 20 bp, Artificial sequence
  SiRNA target sequence
gttaaaaggttcagaaccat

SEQ ID NO: 97570 - DNA, 20 bp, Artificial sequence
  SiRNA target sequence
ttaaaaggttcagaaccatt

SEQ ID NO: 97571 - DNA, 20 bp, Artificial sequence
  SiRNA target sequence
taaaaggttcagaaccattc

SEQ ID NO: 97572 - DNA, 20 bp, Artificial sequence
  SiRNA target sequence
aaaaggttcagaaccattcc

SEQ ID NO: 97573 - DNA, 20 bp, Artificial sequence
  SiRNA target sequence
aaaggttcagaaccattccc

SEQ ID NO: 97574 - DNA, 20 bp, Artificial sequence
  SiRNA target sequence
aaggttcagaaccattccca

SEQ ID NO: 97575 - DNA, 20 bp, Artificial sequence
  SiRNA target sequence
aggttcagaaccattcccat

SEQ ID NO: 97576 - DNA, 20 bp, Artificial sequence
  SiRNA target sequence
ggttcagaaccattcccatg

SEQ ID NO: 97577 - DNA, 20 bp, Artificial sequence
  SiRNA target sequence
gttcagaaccattcccatga

SEQ ID NO: 97578 - DNA, 20 bp, Artificial sequence
  SiRNA target sequence
ttcagaaccattcccatgag

SEQ ID NO: 97579 - DNA, 20 bp, Artificial sequence
  SiRNA target sequence
tcagaaccattcccatgagt

SEQ ID NO: 97580 - DNA, 20 bp, Artificial sequence
  SiRNA target sequence
cagaaccattcccatgagtc

SEQ ID NO: 97581 - DNA, 20 bp, Artificial sequence
  SiRNA target sequence
agaaccattcccatgagtcg

SEQ ID NO: 97582 - DNA, 20 bp, Artificial sequence
  SiRNA target sequence
gaaccattcccatgagtcga

SEQ ID NO: 97583 - DNA, 20 bp, Artificial sequence
  SiRNA target sequence
aaccattcccatgagtcgaa

SEQ ID NO: 97584 - DNA, 20 bp, Artificial sequence
  SiRNA target sequence
accattcccatgagtcgaac

SEQ ID NO: 97585 - DNA, 20 bp, Artificial sequence
  SiRNA target sequence
ccattcccatgagtcgaaca

SEQ ID NO: 97586 - DNA, 20 bp, Artificial sequence
  SiRNA target sequence
cattcccatgagtcgaacat

SEQ ID NO: 97587 - DNA, 20 bp, Artificial sequence
  SiRNA target sequence
attcccatgagtcgaacata

SEQ ID NO: 97588 - DNA, 20 bp, Artificial sequence
  SiRNA target sequence
ttcccatgagtcgaacatac

SEQ ID NO: 97589 - DNA, 20 bp, Artificial sequence
  SiRNA target sequence
tcccatgagtcgaacataca

SEQ ID NO: 97590 - DNA, 20 bp, Artificial sequence
  SiRNA target sequence
cccatgagtcgaacatacaa

SEQ ID NO: 97591 - DNA, 20 bp, Artificial sequence
  SiRNA target sequence
ccatgagtcgaacatacaaa

SEQ ID NO: 97592 - DNA, 20 bp, Artificial sequence
  SiRNA target sequence
catgagtcgaacatacaaat

SEQ ID NO: 97593 - DNA, 20 bp, Artificial sequence
  SiRNA target sequence
atgagtcgaacatacaaata

SEQ ID NO: 97594 - DNA, 20 bp, Artificial sequence
  SiRNA target sequence
tgagtcgaacatacaaatat

SEQ ID NO: 97595 - DNA, 20 bp, Artificial sequence
  SiRNA target sequence
gagtcgaacatacaaatata

SEQ ID NO: 97596 - DNA, 20 bp, Artificial sequence
  SiRNA target sequence
agtcgaacatacaaatataa

SEQ ID NO: 97597 - DNA, 20 bp, Artificial sequence
  SiRNA target sequence
gtcgaacatacaaatataat

SEQ ID NO: 97598 - DNA, 20 bp, Artificial sequence
  SiRNA target sequence
tcgaacatacaaatataatc

SEQ ID NO: 97599 - DNA, 20 bp, Artificial sequence
  SiRNA target sequence
cgaacatacaaatataatca

SEQ ID NO: 97600 - DNA, 20 bp, Artificial sequence
  SiRNA target sequence
gaacatacaaatataatcat

SEQ ID NO: 97601 - DNA, 20 bp, Artificial sequence
  SiRNA target sequence
aacatacaaatataatcata

SEQ ID NO: 97602 - DNA, 20 bp, Artificial sequence
  SiRNA target sequence
acatacaaatataatcatat

SEQ ID NO: 97603 - DNA, 20 bp, Artificial sequence
  SiRNA target sequence
catacaaatataatcatatc

SEQ ID NO: 97604 - DNA, 20 bp, Artificial sequence
  SiRNA target sequence
atacaaatataatcatatca

SEQ ID NO: 97605 - DNA, 20 bp, Artificial sequence
  SiRNA target sequence
tacaaatataatcatatcaa

SEQ ID NO: 97606 - DNA, 20 bp, Artificial sequence
  SiRNA target sequence
acaaatataatcatatcaat

SEQ ID NO: 97607 - DNA, 20 bp, Artificial sequence
  SiRNA target sequence
caaatataatcatatcaata

SEQ ID NO: 97608 - DNA, 20 bp, Artificial sequence
  SiRNA target sequence
aaatataatcatatcaatat

SEQ ID NO: 97609 - DNA, 20 bp, Artificial sequence
  SiRNA target sequence
aatataatcatatcaatatc

SEQ ID NO: 97610 - DNA, 20 bp, Artificial sequence
  SiRNA target sequence
atataatcatatcaatatct

SEQ ID NO: 97611 - DNA, 20 bp, Artificial sequence
  SiRNA target sequence
tataatcatatcaatatcta

SEQ ID NO: 97612 - DNA, 20 bp, Artificial sequence
  SiRNA target sequence
ataatcatatcaatatctaa

SEQ ID NO: 97613 - DNA, 20 bp, Artificial sequence
  SiRNA target sequence
taatcatatcaatatctaat

SEQ ID NO: 97614 - DNA, 20 bp, Artificial sequence
  SiRNA target sequence
aatcatatcaatatctaata

SEQ ID NO: 97615 - DNA, 20 bp, Artificial sequence
  SiRNA target sequence
atcatatcaatatctaatat

SEQ ID NO: 97616 - DNA, 20 bp, Artificial sequence
  SiRNA target sequence
tcatatcaatatctaatatt

SEQ ID NO: 97617 - DNA, 20 bp, Artificial sequence
  SiRNA target sequence
catatcaatatctaatattt

SEQ ID NO: 97618 - DNA, 20 bp, Artificial sequence
  SiRNA target sequence
atatcaatatctaatatttt

SEQ ID NO: 97619 - DNA, 20 bp, Artificial sequence
  SiRNA target sequence
tatcaatatctaatattttt

SEQ ID NO: 97620 - DNA, 20 bp, Artificial sequence
  SiRNA target sequence
atcaatatctaatatttttt

SEQ ID NO: 97621 - DNA, 20 bp, Artificial sequence
  SiRNA target sequence
tcaatatctaatattttttc

SEQ ID NO: 97622 - DNA, 20 bp, Artificial sequence
  SiRNA target sequence
caatatctaatattttttcg

SEQ ID NO: 97623 - DNA, 20 bp, Artificial sequence
  SiRNA target sequence
aatatctaatattttttcga

SEQ ID NO: 97624 - DNA, 20 bp, Artificial sequence
  SiRNA target sequence
atatctaatattttttcgaa

SEQ ID NO: 97625 - DNA, 20 bp, Artificial sequence
  SiRNA target sequence
tatctaatattttttcgaaa

SEQ ID NO: 97626 - DNA, 20 bp, Artificial sequence
  SiRNA target sequence
atctaatattttttcgaaat

SEQ ID NO: 97627 - DNA, 20 bp, Artificial sequence
  SiRNA target sequence
tctaatattttttcgaaatc

SEQ ID NO: 97628 - DNA, 20 bp, Artificial sequence
  SiRNA target sequence
ctaatattttttcgaaatca

SEQ ID NO: 97629 - DNA, 20 bp, Artificial sequence
  SiRNA target sequence
taatattttttcgaaatcaa

SEQ ID NO: 97630 - DNA, 20 bp, Artificial sequence
  SiRNA target sequence
aatattttttcgaaatcaaa

SEQ ID NO: 97631 - DNA, 20 bp, Artificial sequence
  SiRNA target sequence
atattttttcgaaatcaaaa

SEQ ID NO: 97632 - DNA, 20 bp, Artificial sequence
  SiRNA target sequence
tattttttcgaaatcaaaac

SEQ ID NO: 97633 - DNA, 20 bp, Artificial sequence
  SiRNA target sequence
attttttcgaaatcaaaact

SEQ ID NO: 97634 - DNA, 20 bp, Artificial sequence
  SiRNA target sequence
ttttttcgaaatcaaaactg

SEQ ID NO: 97635 - DNA, 20 bp, Artificial sequence
  SiRNA target sequence
tttttcgaaatcaaaactgt

SEQ ID NO: 97636 - DNA, 20 bp, Artificial sequence
  SiRNA target sequence
ttttcgaaatcaaaactgtc

SEQ ID NO: 97637 - DNA, 20 bp, Artificial sequence
  SiRNA target sequence
tttcgaaatcaaaactgtcc

SEQ ID NO: 97638 - DNA, 20 bp, Artificial sequence
  SiRNA target sequence
ttcgaaatcaaaactgtcca

SEQ ID NO: 97639 - DNA, 20 bp, Artificial sequence
  SiRNA target sequence
tcgaaatcaaaactgtccat

SEQ ID NO: 97640 - DNA, 20 bp, Artificial sequence
  SiRNA target sequence
cgaaatcaaaactgtccata

SEQ ID NO: 97641 - DNA, 20 bp, Artificial sequence
  SiRNA target sequence
gaaatcaaaactgtccatat

SEQ ID NO: 97642 - DNA, 20 bp, Artificial sequence
  SiRNA target sequence
aaatcaaaactgtccatatc

SEQ ID NO: 97643 - DNA, 20 bp, Artificial sequence
  SiRNA target sequence
aatcaaaactgtccatatct

SEQ ID NO: 97644 - DNA, 20 bp, Artificial sequence
  SiRNA target sequence
atcaaaactgtccatatcta

SEQ ID NO: 97645 - DNA, 20 bp, Artificial sequence
  SiRNA target sequence
tcaaaactgtccatatctaa

SEQ ID NO: 97646 - DNA, 20 bp, Artificial sequence
  SiRNA target sequence
caaaactgtccatatctaaa

SEQ ID NO: 97647 - DNA, 20 bp, Artificial sequence
  SiRNA target sequence
aaaactgtccatatctaaag

SEQ ID NO: 97648 - DNA, 20 bp, Artificial sequence
  SiRNA target sequence
aaactgtccatatctaaagt

SEQ ID NO: 97649 - DNA, 20 bp, Artificial sequence
  SiRNA target sequence
aactgtccatatctaaagta

SEQ ID NO: 97650 - DNA, 20 bp, Artificial sequence
  SiRNA target sequence
actgtccatatctaaagtaa

SEQ ID NO: 97651 - DNA, 20 bp, Artificial sequence
  SiRNA target sequence
ctgtccatatctaaagtaaa

SEQ ID NO: 97652 - DNA, 20 bp, Artificial sequence
  SiRNA target sequence
tgtccatatctaaagtaaaa

SEQ ID NO: 97653 - DNA, 20 bp, Artificial sequence
  SiRNA target sequence
gtccatatctaaagtaaaat

SEQ ID NO: 97654 - DNA, 20 bp, Artificial sequence
  SiRNA target sequence
tccatatctaaagtaaaatc

SEQ ID NO: 97655 - DNA, 20 bp, Artificial sequence
  SiRNA target sequence
ccatatctaaagtaaaatct

SEQ ID NO: 97656 - DNA, 20 bp, Artificial sequence
  SiRNA target sequence
catatctaaagtaaaatctg

SEQ ID NO: 97657 - DNA, 20 bp, Artificial sequence
  SiRNA target sequence
atatctaaagtaaaatctgt

SEQ ID NO: 97658 - DNA, 20 bp, Artificial sequence
  SiRNA target sequence
tatctaaagtaaaatctgtt

SEQ ID NO: 97659 - DNA, 20 bp, Artificial sequence
  SiRNA target sequence
atctaaagtaaaatctgttg

SEQ ID NO: 97660 - DNA, 20 bp, Artificial sequence
  SiRNA target sequence
tctaaagtaaaatctgttgg

SEQ ID NO: 97661 - DNA, 20 bp, Artificial sequence
  SiRNA target sequence
ctaaagtaaaatctgttgga

SEQ ID NO: 97662 - DNA, 20 bp, Artificial sequence
  SiRNA target sequence
taaagtaaaatctgttggaa

SEQ ID NO: 97663 - DNA, 20 bp, Artificial sequence
  SiRNA target sequence
aaagtaaaatctgttggaag

SEQ ID NO: 97664 - DNA, 20 bp, Artificial sequence
  SiRNA target sequence
aagtaaaatctgttggaagc

SEQ ID NO: 97665 - DNA, 20 bp, Artificial sequence
  SiRNA target sequence
agtaaaatctgttggaagca

SEQ ID NO: 97666 - DNA, 20 bp, Artificial sequence
  SiRNA target sequence
gtaaaatctgttggaagcaa

SEQ ID NO: 97667 - DNA, 20 bp, Artificial sequence
  SiRNA target sequence
taaaatctgttggaagcaat

SEQ ID NO: 97668 - DNA, 20 bp, Artificial sequence
  SiRNA target sequence
aaaatctgttggaagcaatt

SEQ ID NO: 97669 - DNA, 20 bp, Artificial sequence
  SiRNA target sequence
aaatctgttggaagcaattc

SEQ ID NO: 97670 - DNA, 20 bp, Artificial sequence
  SiRNA target sequence
aatctgttggaagcaattct

SEQ ID NO: 97671 - DNA, 20 bp, Artificial sequence
  SiRNA target sequence
atctgttggaagcaattctt

SEQ ID NO: 97672 - DNA, 20 bp, Artificial sequence
  SiRNA target sequence
tctgttggaagcaattcttt

SEQ ID NO: 97673 - DNA, 20 bp, Artificial sequence
  SiRNA target sequence
ctgttggaagcaattcttta

SEQ ID NO: 97674 - DNA, 20 bp, Artificial sequence
  SiRNA target sequence
tgttggaagcaattctttat

SEQ ID NO: 97675 - DNA, 20 bp, Artificial sequence
  SiRNA target sequence
gttggaagcaattctttatc

SEQ ID NO: 97676 - DNA, 20 bp, Artificial sequence
  SiRNA target sequence
ttggaagcaattctttatca

SEQ ID NO: 97677 - DNA, 20 bp, Artificial sequence
  SiRNA target sequence
tggaagcaattctttatcaa

SEQ ID NO: 97678 - DNA, 20 bp, Artificial sequence
  SiRNA target sequence
ggaagcaattctttatcaac

SEQ ID NO: 97679 - DNA, 20 bp, Artificial sequence
  SiRNA target sequence
gaagcaattctttatcaacg

SEQ ID NO: 97680 - DNA, 20 bp, Artificial sequence
  SiRNA target sequence
aagcaattctttatcaacgt

SEQ ID NO: 97681 - DNA, 20 bp, Artificial sequence
  SiRNA target sequence
agcaattctttatcaacgtt

SEQ ID NO: 97682 - DNA, 20 bp, Artificial sequence
  SiRNA target sequence
gcaattctttatcaacgtta

SEQ ID NO: 97683 - DNA, 20 bp, Artificial sequence
  SiRNA target sequence
caattctttatcaacgttat

SEQ ID NO: 97684 - DNA, 20 bp, Artificial sequence
  SiRNA target sequence
aattctttatcaacgttata

SEQ ID NO: 97685 - DNA, 20 bp, Artificial sequence
  SiRNA target sequence
attctttatcaacgttataa

SEQ ID NO: 97686 - DNA, 20 bp, Artificial sequence
  SiRNA target sequence
ttctttatcaacgttataaa

SEQ ID NO: 97687 - DNA, 20 bp, Artificial sequence
  SiRNA target sequence
tctttatcaacgttataaat

SEQ ID NO: 97688 - DNA, 20 bp, Artificial sequence
  SiRNA target sequence
ctttatcaacgttataaatc

SEQ ID NO: 97689 - DNA, 20 bp, Artificial sequence
  SiRNA target sequence
tttatcaacgttataaatca

SEQ ID NO: 97690 - DNA, 20 bp, Artificial sequence
  SiRNA target sequence
ttatcaacgttataaatcaa

SEQ ID NO: 97691 - DNA, 20 bp, Artificial sequence
  SiRNA target sequence
tatcaacgttataaatcaaa

SEQ ID NO: 97692 - DNA, 20 bp, Artificial sequence
  SiRNA target sequence
atcaacgttataaatcaaat

SEQ ID NO: 97693 - DNA, 20 bp, Artificial sequence
  SiRNA target sequence
tcaacgttataaatcaaatc

SEQ ID NO: 97694 - DNA, 20 bp, Artificial sequence
  SiRNA target sequence
caacgttataaatcaaatct

SEQ ID NO: 97695 - DNA, 20 bp, Artificial sequence
  SiRNA target sequence
aacgttataaatcaaatctt

SEQ ID NO: 97696 - DNA, 20 bp, Artificial sequence
  SiRNA target sequence
acgttataaatcaaatcttt

SEQ ID NO: 97697 - DNA, 20 bp, Artificial sequence
  SiRNA target sequence
cgttataaatcaaatcttta

SEQ ID NO: 97698 - DNA, 20 bp, Artificial sequence
  SiRNA target sequence
gttataaatcaaatctttat

SEQ ID NO: 97699 - DNA, 20 bp, Artificial sequence
  SiRNA target sequence
ttataaatcaaatctttatt

SEQ ID NO: 97700 - DNA, 20 bp, Artificial sequence
  SiRNA target sequence
tataaatcaaatctttattg

SEQ ID NO: 97701 - DNA, 20 bp, Artificial sequence
  SiRNA target sequence
ataaatcaaatctttattgt

SEQ ID NO: 97702 - DNA, 20 bp, Artificial sequence
  SiRNA target sequence
taaatcaaatctttattgta

SEQ ID NO: 97703 - DNA, 20 bp, Artificial sequence
  SiRNA target sequence
aaatcaaatctttattgtat

SEQ ID NO: 97704 - DNA, 20 bp, Artificial sequence
  SiRNA target sequence
aatcaaatctttattgtatc

SEQ ID NO: 97705 - DNA, 20 bp, Artificial sequence
  SiRNA target sequence
atcaaatctttattgtatcc

SEQ ID NO: 97706 - DNA, 20 bp, Artificial sequence
  SiRNA target sequence
tcaaatctttattgtatccg

SEQ ID NO: 97707 - DNA, 20 bp, Artificial sequence
  SiRNA target sequence
caaatctttattgtatccgt

SEQ ID NO: 97708 - DNA, 20 bp, Artificial sequence
  SiRNA target sequence
aaatctttattgtatccgta

SEQ ID NO: 97709 - DNA, 20 bp, Artificial sequence
  SiRNA target sequence
aatctttattgtatccgtat

SEQ ID NO: 97710 - DNA, 20 bp, Artificial sequence
  SiRNA target sequence
atctttattgtatccgtata

SEQ ID NO: 97711 - DNA, 20 bp, Artificial sequence
  SiRNA target sequence
tctttattgtatccgtatag

SEQ ID NO: 97712 - DNA, 20 bp, Artificial sequence
  SiRNA target sequence
ctttattgtatccgtatagt

SEQ ID NO: 97713 - DNA, 20 bp, Artificial sequence
  SiRNA target sequence
tttattgtatccgtatagta

SEQ ID NO: 97714 - DNA, 20 bp, Artificial sequence
  SiRNA target sequence
ttattgtatccgtatagtat

SEQ ID NO: 97715 - DNA, 20 bp, Artificial sequence
  SiRNA target sequence
tattgtatccgtatagtata

SEQ ID NO: 97716 - DNA, 20 bp, Artificial sequence
  SiRNA target sequence
attgtatccgtatagtataa

SEQ ID NO: 97717 - DNA, 20 bp, Artificial sequence
  SiRNA target sequence
ttgtatccgtatagtataac

SEQ ID NO: 97718 - DNA, 20 bp, Artificial sequence
  SiRNA target sequence
tgtatccgtatagtataaca

SEQ ID NO: 97719 - DNA, 20 bp, Artificial sequence
  SiRNA target sequence
gtatccgtatagtataacat

SEQ ID NO: 97720 - DNA, 20 bp, Artificial sequence
  SiRNA target sequence
tatccgtatagtataacatt

SEQ ID NO: 97721 - DNA, 20 bp, Artificial sequence
  SiRNA target sequence
atccgtatagtataacattt

SEQ ID NO: 97722 - DNA, 20 bp, Artificial sequence
  SiRNA target sequence
tccgtatagtataacatttt

SEQ ID NO: 97723 - DNA, 20 bp, Artificial sequence
  SiRNA target sequence
ccgtatagtataacattttg

SEQ ID NO: 97724 - DNA, 20 bp, Artificial sequence
  SiRNA target sequence
cgtatagtataacattttga

SEQ ID NO: 97725 - DNA, 20 bp, Artificial sequence
  SiRNA target sequence
gtatagtataacattttgaa

SEQ ID NO: 97726 - DNA, 20 bp, Artificial sequence
  SiRNA target sequence
tatagtataacattttgaat

SEQ ID NO: 97727 - DNA, 20 bp, Artificial sequence
  SiRNA target sequence
atagtataacattttgaata

SEQ ID NO: 97728 - DNA, 20 bp, Artificial sequence
  SiRNA target sequence
tagtataacattttgaataa

SEQ ID NO: 97729 - DNA, 20 bp, Artificial sequence
  SiRNA target sequence
agtataacattttgaataag

SEQ ID NO: 97730 - DNA, 20 bp, Artificial sequence
  SiRNA target sequence
gtataacattttgaataagt

SEQ ID NO: 97731 - DNA, 20 bp, Artificial sequence
  SiRNA target sequence
tataacattttgaataagtt

SEQ ID NO: 97732 - DNA, 20 bp, Artificial sequence
  SiRNA target sequence
ataacattttgaataagttt

SEQ ID NO: 97733 - DNA, 20 bp, Artificial sequence
  SiRNA target sequence
taacattttgaataagttta

SEQ ID NO: 97734 - DNA, 20 bp, Artificial sequence
  SiRNA target sequence
aacattttgaataagtttag

SEQ ID NO: 97735 - DNA, 20 bp, Artificial sequence
  SiRNA target sequence
acattttgaataagtttagc

SEQ ID NO: 97736 - DNA, 20 bp, Artificial sequence
  SiRNA target sequence
cattttgaataagtttagca

SEQ ID NO: 97737 - DNA, 20 bp, Artificial sequence
  SiRNA target sequence
attttgaataagtttagcaa

SEQ ID NO: 97738 - DNA, 20 bp, Artificial sequence
  SiRNA target sequence
ttttgaataagtttagcaat

SEQ ID NO: 97739 - DNA, 20 bp, Artificial sequence
  SiRNA target sequence
tttgaataagtttagcaata

SEQ ID NO: 97740 - DNA, 20 bp, Artificial sequence
  SiRNA target sequence
ttgaataagtttagcaatat

SEQ ID NO: 97741 - DNA, 20 bp, Artificial sequence
  SiRNA target sequence
tgaataagtttagcaatatg

SEQ ID NO: 97742 - DNA, 20 bp, Artificial sequence
  SiRNA target sequence
gaataagtttagcaatatgt

SEQ ID NO: 97743 - DNA, 20 bp, Artificial sequence
  SiRNA target sequence
aataagtttagcaatatgta

SEQ ID NO: 97744 - DNA, 20 bp, Artificial sequence
  SiRNA target sequence
ataagtttagcaatatgtat

SEQ ID NO: 97745 - DNA, 20 bp, Artificial sequence
  SiRNA target sequence
taagtttagcaatatgtata

SEQ ID NO: 97746 - DNA, 20 bp, Artificial sequence
  SiRNA target sequence
aagtttagcaatatgtatag

SEQ ID NO: 97747 - DNA, 20 bp, Artificial sequence
  SiRNA target sequence
agtttagcaatatgtataga

SEQ ID NO: 97748 - DNA, 20 bp, Artificial sequence
  SiRNA target sequence
gtttagcaatatgtatagaa

SEQ ID NO: 97749 - DNA, 20 bp, Artificial sequence
  SiRNA target sequence
tttagcaatatgtatagaat

SEQ ID NO: 97750 - DNA, 20 bp, Artificial sequence
  SiRNA target sequence
ttagcaatatgtatagaatt

SEQ ID NO: 97751 - DNA, 20 bp, Artificial sequence
  SiRNA target sequence
tagcaatatgtatagaattt

SEQ ID NO: 97752 - DNA, 20 bp, Artificial sequence
  SiRNA target sequence
agcaatatgtatagaatttc

SEQ ID NO: 97753 - DNA, 20 bp, Artificial sequence
  SiRNA target sequence
gcaatatgtatagaatttcc

SEQ ID NO: 97754 - DNA, 20 bp, Artificial sequence
  SiRNA target sequence
caatatgtatagaatttcct

SEQ ID NO: 97755 - DNA, 20 bp, Artificial sequence
  SiRNA target sequence
aatatgtatagaatttcctg

SEQ ID NO: 97756 - DNA, 20 bp, Artificial sequence
  SiRNA target sequence
atatgtatagaatttcctgt

SEQ ID NO: 97757 - DNA, 20 bp, Artificial sequence
  SiRNA target sequence
tatgtatagaatttcctgtt

SEQ ID NO: 97758 - DNA, 20 bp, Artificial sequence
  SiRNA target sequence
atgtatagaatttcctgttt

SEQ ID NO: 97759 - DNA, 20 bp, Artificial sequence
  SiRNA target sequence
tgtatagaatttcctgtttg

SEQ ID NO: 97760 - DNA, 20 bp, Artificial sequence
  SiRNA target sequence
gtatagaatttcctgtttgg

SEQ ID NO: 97761 - DNA, 20 bp, Artificial sequence
  SiRNA target sequence
tatagaatttcctgtttggg

SEQ ID NO: 97762 - DNA, 20 bp, Artificial sequence
  SiRNA target sequence
atagaatttcctgtttggga

SEQ ID NO: 97763 - DNA, 20 bp, Artificial sequence
  SiRNA target sequence
tagaatttcctgtttgggag

SEQ ID NO: 97764 - DNA, 20 bp, Artificial sequence
  SiRNA target sequence
agaatttcctgtttgggagc

SEQ ID NO: 97765 - DNA, 20 bp, Artificial sequence
  SiRNA target sequence
gaatttcctgtttgggagcc

SEQ ID NO: 97766 - DNA, 20 bp, Artificial sequence
  SiRNA target sequence
aatttcctgtttgggagcca

SEQ ID NO: 97767 - DNA, 20 bp, Artificial sequence
  SiRNA target sequence
atttcctgtttgggagccat

SEQ ID NO: 97768 - DNA, 20 bp, Artificial sequence
  SiRNA target sequence
tttcctgtttgggagccata

SEQ ID NO: 97769 - DNA, 20 bp, Artificial sequence
  SiRNA target sequence
ttcctgtttgggagccatat

SEQ ID NO: 97770 - DNA, 20 bp, Artificial sequence
  SiRNA target sequence
tcctgtttgggagccatata

SEQ ID NO: 97771 - DNA, 20 bp, Artificial sequence
  SiRNA target sequence
cctgtttgggagccatataa

SEQ ID NO: 97772 - DNA, 20 bp, Artificial sequence
  SiRNA target sequence
ctgtttgggagccatataag

SEQ ID NO: 97773 - DNA, 20 bp, Artificial sequence
  SiRNA target sequence
tgtttgggagccatataaga

SEQ ID NO: 97774 - DNA, 20 bp, Artificial sequence
  SiRNA target sequence
gtttgggagccatataagat

SEQ ID NO: 97775 - DNA, 20 bp, Artificial sequence
  SiRNA target sequence
tttgggagccatataagatt

SEQ ID NO: 97776 - DNA, 20 bp, Artificial sequence
  SiRNA target sequence
ttgggagccatataagatta

SEQ ID NO: 97777 - DNA, 20 bp, Artificial sequence
  SiRNA target sequence
tgggagccatataagattat

SEQ ID NO: 97778 - DNA, 20 bp, Artificial sequence
  SiRNA target sequence
gggagccatataagattatc

SEQ ID NO: 97779 - DNA, 20 bp, Artificial sequence
  SiRNA target sequence
ggagccatataagattatca

SEQ ID NO: 97780 - DNA, 20 bp, Artificial sequence
  SiRNA target sequence
gagccatataagattatcat

SEQ ID NO: 97781 - DNA, 21 bp, Artificial sequence
  SiRNA target sequence
ttaccaagtttctgcctgaaa

SEQ ID NO: 97782 - DNA, 21 bp, Artificial sequence
  SiRNA target sequence
taccaagtttctgcctgaaaa

SEQ ID NO: 97783 - DNA, 21 bp, Artificial sequence
  SiRNA target sequence
accaagtttctgcctgaaaat

SEQ ID NO: 97784 - DNA, 21 bp, Artificial sequence
  SiRNA target sequence
ccaagtttctgcctgaaaata

SEQ ID NO: 97785 - DNA, 21 bp, Artificial sequence
  SiRNA target sequence
caagtttctgcctgaaaatat

SEQ ID NO: 97786 - DNA, 21 bp, Artificial sequence
  SiRNA target sequence
aagtttctgcctgaaaatata

SEQ ID NO: 97787 - DNA, 21 bp, Artificial sequence
  SiRNA target sequence
agtttctgcctgaaaatatat

SEQ ID NO: 97788 - DNA, 21 bp, Artificial sequence
  SiRNA target sequence
gtttctgcctgaaaatatatt

SEQ ID NO: 97789 - DNA, 21 bp, Artificial sequence
  SiRNA target sequence
tttctgcctgaaaatatattt

SEQ ID NO: 97790 - DNA, 21 bp, Artificial sequence
  SiRNA target sequence
ttctgcctgaaaatatatttt

SEQ ID NO: 97791 - DNA, 21 bp, Artificial sequence
  SiRNA target sequence
tctgcctgaaaatatattttc

SEQ ID NO: 97792 - DNA, 21 bp, Artificial sequence
  SiRNA target sequence
ctgcctgaaaatatattttct

SEQ ID NO: 97793 - DNA, 21 bp, Artificial sequence
  SiRNA target sequence
tgcctgaaaatatattttctt

SEQ ID NO: 97794 - DNA, 21 bp, Artificial sequence
  SiRNA target sequence
gcctgaaaatatattttcttt

SEQ ID NO: 97795 - DNA, 21 bp, Artificial sequence
  SiRNA target sequence
cctgaaaatatattttctttt

SEQ ID NO: 97796 - DNA, 21 bp, Artificial sequence
  SiRNA target sequence
ctgaaaatatattttcttttt

SEQ ID NO: 97797 - DNA, 21 bp, Artificial sequence
  SiRNA target sequence
tgaaaatatattttcttttta

SEQ ID NO: 97798 - DNA, 21 bp, Artificial sequence
  SiRNA target sequence
gaaaatatattttctttttat

SEQ ID NO: 97799 - DNA, 21 bp, Artificial sequence
  SiRNA target sequence
aaaatatattttctttttata

SEQ ID NO: 97800 - DNA, 21 bp, Artificial sequence
  SiRNA target sequence
aaatatattttctttttataa

SEQ ID NO: 97801 - DNA, 21 bp, Artificial sequence
  SiRNA target sequence
aatatattttctttttataaa

SEQ ID NO: 97802 - DNA, 21 bp, Artificial sequence
  SiRNA target sequence
atatattttctttttataaat

SEQ ID NO: 97803 - DNA, 21 bp, Artificial sequence
  SiRNA target sequence
tatattttctttttataaata

SEQ ID NO: 97804 - DNA, 21 bp, Artificial sequence
  SiRNA target sequence
atattttctttttataaatat

SEQ ID NO: 97805 - DNA, 21 bp, Artificial sequence
  SiRNA target sequence
tattttctttttataaatatc

SEQ ID NO: 97806 - DNA, 21 bp, Artificial sequence
  SiRNA target sequence
attttctttttataaatatct

SEQ ID NO: 97807 - DNA, 21 bp, Artificial sequence
  SiRNA target sequence
ttttctttttataaatatcta

SEQ ID NO: 97808 - DNA, 21 bp, Artificial sequence
  SiRNA target sequence
tttctttttataaatatctaa

SEQ ID NO: 97809 - DNA, 21 bp, Artificial sequence
  SiRNA target sequence
ttctttttataaatatctaat

SEQ ID NO: 97810 - DNA, 21 bp, Artificial sequence
  SiRNA target sequence
tctttttataaatatctaata

SEQ ID NO: 97811 - DNA, 21 bp, Artificial sequence
  SiRNA target sequence
ctttttataaatatctaataa

SEQ ID NO: 97812 - DNA, 21 bp, Artificial sequence
  SiRNA target sequence
tttttataaatatctaataac

SEQ ID NO: 97813 - DNA, 21 bp, Artificial sequence
  SiRNA target sequence
ttttataaatatctaataaca

SEQ ID NO: 97814 - DNA, 21 bp, Artificial sequence
  SiRNA target sequence
tttataaatatctaataacat

SEQ ID NO: 97815 - DNA, 21 bp, Artificial sequence
  SiRNA target sequence
ttataaatatctaataacatt

SEQ ID NO: 97816 - DNA, 21 bp, Artificial sequence
  SiRNA target sequence
tataaatatctaataacattt

SEQ ID NO: 97817 - DNA, 21 bp, Artificial sequence
  SiRNA target sequence
ataaatatctaataacatttt

SEQ ID NO: 97818 - DNA, 21 bp, Artificial sequence
  SiRNA target sequence
taaatatctaataacattttt

SEQ ID NO: 97819 - DNA, 21 bp, Artificial sequence
  SiRNA target sequence
aaatatctaataacatttttt

SEQ ID NO: 97820 - DNA, 21 bp, Artificial sequence
  SiRNA target sequence
aatatctaataacattttttc

SEQ ID NO: 97821 - DNA, 21 bp, Artificial sequence
  SiRNA target sequence
atatctaataacattttttca

SEQ ID NO: 97822 - DNA, 21 bp, Artificial sequence
  SiRNA target sequence
tatctaataacattttttcaa

SEQ ID NO: 97823 - DNA, 21 bp, Artificial sequence
  SiRNA target sequence
atctaataacattttttcaat

SEQ ID NO: 97824 - DNA, 21 bp, Artificial sequence
  SiRNA target sequence
tctaataacattttttcaata

SEQ ID NO: 97825 - DNA, 21 bp, Artificial sequence
  SiRNA target sequence
ctaataacattttttcaataa

SEQ ID NO: 97826 - DNA, 21 bp, Artificial sequence
  SiRNA target sequence
taataacattttttcaataat

SEQ ID NO: 97827 - DNA, 21 bp, Artificial sequence
  SiRNA target sequence
aataacattttttcaataata

SEQ ID NO: 97828 - DNA, 21 bp, Artificial sequence
  SiRNA target sequence
ataacattttttcaataatat

SEQ ID NO: 97829 - DNA, 21 bp, Artificial sequence
  SiRNA target sequence
taacattttttcaataatatt

SEQ ID NO: 97830 - DNA, 21 bp, Artificial sequence
  SiRNA target sequence
aacattttttcaataatatta

SEQ ID NO: 97831 - DNA, 21 bp, Artificial sequence
  SiRNA target sequence
acattttttcaataatattat

SEQ ID NO: 97832 - DNA, 21 bp, Artificial sequence
  SiRNA target sequence
cattttttcaataatattatt

SEQ ID NO: 97833 - DNA, 21 bp, Artificial sequence
  SiRNA target sequence
attttttcaataatattatta

SEQ ID NO: 97834 - DNA, 21 bp, Artificial sequence
  SiRNA target sequence
ttttttcaataatattattaa

SEQ ID NO: 97835 - DNA, 21 bp, Artificial sequence
  SiRNA target sequence
tttttcaataatattattaag

SEQ ID NO: 97836 - DNA, 21 bp, Artificial sequence
  SiRNA target sequence
ttttcaataatattattaagt

SEQ ID NO: 97837 - DNA, 21 bp, Artificial sequence
  SiRNA target sequence
tttcaataatattattaagtc

SEQ ID NO: 97838 - DNA, 21 bp, Artificial sequence
  SiRNA target sequence
ttcaataatattattaagtct

SEQ ID NO: 97839 - DNA, 21 bp, Artificial sequence
  SiRNA target sequence
tcaataatattattaagtcta

SEQ ID NO: 97840 - DNA, 21 bp, Artificial sequence
  SiRNA target sequence
caataatattattaagtctag

SEQ ID NO: 97841 - DNA, 21 bp, Artificial sequence
  SiRNA target sequence
aataatattattaagtctaga

SEQ ID NO: 97842 - DNA, 21 bp, Artificial sequence
  SiRNA target sequence
ataatattattaagtctagaa

SEQ ID NO: 97843 - DNA, 21 bp, Artificial sequence
  SiRNA target sequence
taatattattaagtctagaat

SEQ ID NO: 97844 - DNA, 21 bp, Artificial sequence
  SiRNA target sequence
aatattattaagtctagaatt

SEQ ID NO: 97845 - DNA, 21 bp, Artificial sequence
  SiRNA target sequence
atattattaagtctagaattt

SEQ ID NO: 97846 - DNA, 21 bp, Artificial sequence
  SiRNA target sequence
tattattaagtctagaatttc

SEQ ID NO: 97847 - DNA, 21 bp, Artificial sequence
  SiRNA target sequence
attattaagtctagaatttcc

SEQ ID NO: 97848 - DNA, 21 bp, Artificial sequence
  SiRNA target sequence
ttattaagtctagaatttcca

SEQ ID NO: 97849 - DNA, 21 bp, Artificial sequence
  SiRNA target sequence
tattaagtctagaatttccac

SEQ ID NO: 97850 - DNA, 21 bp, Artificial sequence
  SiRNA target sequence
attaagtctagaatttccact

SEQ ID NO: 97851 - DNA, 21 bp, Artificial sequence
  SiRNA target sequence
ttaagtctagaatttccactt

SEQ ID NO: 97852 - DNA, 21 bp, Artificial sequence
  SiRNA target sequence
taagtctagaatttccactta

SEQ ID NO: 97853 - DNA, 21 bp, Artificial sequence
  SiRNA target sequence
aagtctagaatttccacttac

SEQ ID NO: 97854 - DNA, 21 bp, Artificial sequence
  SiRNA target sequence
agtctagaatttccacttaca

SEQ ID NO: 97855 - DNA, 21 bp, Artificial sequence
  SiRNA target sequence
gtctagaatttccacttacaa

SEQ ID NO: 97856 - DNA, 21 bp, Artificial sequence
  SiRNA target sequence
tctagaatttccacttacaaa

SEQ ID NO: 97857 - DNA, 21 bp, Artificial sequence
  SiRNA target sequence
ctagaatttccacttacaaat

SEQ ID NO: 97858 - DNA, 21 bp, Artificial sequence
  SiRNA target sequence
tagaatttccacttacaaata

SEQ ID NO: 97859 - DNA, 21 bp, Artificial sequence
  SiRNA target sequence
agaatttccacttacaaatat

SEQ ID NO: 97860 - DNA, 21 bp, Artificial sequence
  SiRNA target sequence
gaatttccacttacaaatatt

SEQ ID NO: 97861 - DNA, 21 bp, Artificial sequence
  SiRNA target sequence
aatttccacttacaaatatta

SEQ ID NO: 97862 - DNA, 21 bp, Artificial sequence
  SiRNA target sequence
atttccacttacaaatattaa

SEQ ID NO: 97863 - DNA, 21 bp, Artificial sequence
  SiRNA target sequence
tttccacttacaaatattaac

SEQ ID NO: 97864 - DNA, 21 bp, Artificial sequence
  SiRNA target sequence
ttccacttacaaatattaacc

SEQ ID NO: 97865 - DNA, 21 bp, Artificial sequence
  SiRNA target sequence
tccacttacaaatattaacca

SEQ ID NO: 97866 - DNA, 21 bp, Artificial sequence
  SiRNA target sequence
ccacttacaaatattaaccaa

SEQ ID NO: 97867 - DNA, 21 bp, Artificial sequence
  SiRNA target sequence
cacttacaaatattaaccaat

SEQ ID NO: 97868 - DNA, 21 bp, Artificial sequence
  SiRNA target sequence
acttacaaatattaaccaatc

SEQ ID NO: 97869 - DNA, 21 bp, Artificial sequence
  SiRNA target sequence
cttacaaatattaaccaatca

SEQ ID NO: 97870 - DNA, 21 bp, Artificial sequence
  SiRNA target sequence
ttacaaatattaaccaatcat

SEQ ID NO: 97871 - DNA, 21 bp, Artificial sequence
  SiRNA target sequence
tacaaatattaaccaatcatc

SEQ ID NO: 97872 - DNA, 21 bp, Artificial sequence
  SiRNA target sequence
acaaatattaaccaatcatca

SEQ ID NO: 97873 - DNA, 21 bp, Artificial sequence
  SiRNA target sequence
caaatattaaccaatcatcaa

SEQ ID NO: 97874 - DNA, 21 bp, Artificial sequence
  SiRNA target sequence
aaatattaaccaatcatcaat

SEQ ID NO: 97875 - DNA, 21 bp, Artificial sequence
  SiRNA target sequence
aatattaaccaatcatcaata

SEQ ID NO: 97876 - DNA, 21 bp, Artificial sequence
  SiRNA target sequence
atattaaccaatcatcaatat

SEQ ID NO: 97877 - DNA, 21 bp, Artificial sequence
  SiRNA target sequence
tattaaccaatcatcaatatt

SEQ ID NO: 97878 - DNA, 21 bp, Artificial sequence
  SiRNA target sequence
attaaccaatcatcaatattt

SEQ ID NO: 97879 - DNA, 21 bp, Artificial sequence
  SiRNA target sequence
ttaaccaatcatcaatatttt

SEQ ID NO: 97880 - DNA, 21 bp, Artificial sequence
  SiRNA target sequence
taaccaatcatcaatattttc

SEQ ID NO: 97881 - DNA, 21 bp, Artificial sequence
  SiRNA target sequence
aaccaatcatcaatattttct

SEQ ID NO: 97882 - DNA, 21 bp, Artificial sequence
  SiRNA target sequence
accaatcatcaatattttcta

SEQ ID NO: 97883 - DNA, 21 bp, Artificial sequence
  SiRNA target sequence
ccaatcatcaatattttctag

SEQ ID NO: 97884 - DNA, 21 bp, Artificial sequence
  SiRNA target sequence
caatcatcaatattttctagc

SEQ ID NO: 97885 - DNA, 21 bp, Artificial sequence
  SiRNA target sequence
aatcatcaatattttctagcc

SEQ ID NO: 97886 - DNA, 21 bp, Artificial sequence
  SiRNA target sequence
atcatcaatattttctagccc

SEQ ID NO: 97887 - DNA, 21 bp, Artificial sequence
  SiRNA target sequence
tcatcaatattttctagccct

SEQ ID NO: 97888 - DNA, 21 bp, Artificial sequence
  SiRNA target sequence
catcaatattttctagccctt

SEQ ID NO: 97889 - DNA, 21 bp, Artificial sequence
  SiRNA target sequence
atcaatattttctagcccttt

SEQ ID NO: 97890 - DNA, 21 bp, Artificial sequence
  SiRNA target sequence
tcaatattttctagccctttt

SEQ ID NO: 97891 - DNA, 21 bp, Artificial sequence
  SiRNA target sequence
caatattttctagccctttta

SEQ ID NO: 97892 - DNA, 21 bp, Artificial sequence
  SiRNA target sequence
aatattttctagcccttttat

SEQ ID NO: 97893 - DNA, 21 bp, Artificial sequence
  SiRNA target sequence
atattttctagcccttttata

SEQ ID NO: 97894 - DNA, 21 bp, Artificial sequence
  SiRNA target sequence
tattttctagcccttttatag

SEQ ID NO: 97895 - DNA, 21 bp, Artificial sequence
  SiRNA target sequence
attttctagcccttttatagt

SEQ ID NO: 97896 - DNA, 21 bp, Artificial sequence
  SiRNA target sequence
ttttctagcccttttatagtc

SEQ ID NO: 97897 - DNA, 21 bp, Artificial sequence
  SiRNA target sequence
tttctagcccttttatagtct

SEQ ID NO: 97898 - DNA, 21 bp, Artificial sequence
  SiRNA target sequence
ttctagcccttttatagtctt

SEQ ID NO: 97899 - DNA, 21 bp, Artificial sequence
  SiRNA target sequence
tctagcccttttatagtctta

SEQ ID NO: 97900 - DNA, 21 bp, Artificial sequence
  SiRNA target sequence
ctagcccttttatagtcttat

SEQ ID NO: 97901 - DNA, 21 bp, Artificial sequence
  SiRNA target sequence
tagcccttttatagtcttata

SEQ ID NO: 97902 - DNA, 21 bp, Artificial sequence
  SiRNA target sequence
agcccttttatagtcttataa

SEQ ID NO: 97903 - DNA, 21 bp, Artificial sequence
  SiRNA target sequence
gcccttttatagtcttataaa

SEQ ID NO: 97904 - DNA, 21 bp, Artificial sequence
  SiRNA target sequence
cccttttatagtcttataaat

SEQ ID NO: 97905 - DNA, 21 bp, Artificial sequence
  SiRNA target sequence
ccttttatagtcttataaata

SEQ ID NO: 97906 - DNA, 21 bp, Artificial sequence
  SiRNA target sequence
cttttatagtcttataaatat

SEQ ID NO: 97907 - DNA, 21 bp, Artificial sequence
  SiRNA target sequence
ttttatagtcttataaatatc

SEQ ID NO: 97908 - DNA, 21 bp, Artificial sequence
  SiRNA target sequence
tttatagtcttataaatatct

SEQ ID NO: 97909 - DNA, 21 bp, Artificial sequence
  SiRNA target sequence
ttatagtcttataaatatctt

SEQ ID NO: 97910 - DNA, 21 bp, Artificial sequence
  SiRNA target sequence
tatagtcttataaatatcttg

SEQ ID NO: 97911 - DNA, 21 bp, Artificial sequence
  SiRNA target sequence
atagtcttataaatatcttgt

SEQ ID NO: 97912 - DNA, 21 bp, Artificial sequence
  SiRNA target sequence
tagtcttataaatatcttgta

SEQ ID NO: 97913 - DNA, 21 bp, Artificial sequence
  SiRNA target sequence
agtcttataaatatcttgtat

SEQ ID NO: 97914 - DNA, 21 bp, Artificial sequence
  SiRNA target sequence
gtcttataaatatcttgtatg

SEQ ID NO: 97915 - DNA, 21 bp, Artificial sequence
  SiRNA target sequence
tcttataaatatcttgtatgt

SEQ ID NO: 97916 - DNA, 21 bp, Artificial sequence
  SiRNA target sequence
cttataaatatcttgtatgta

SEQ ID NO: 97917 - DNA, 21 bp, Artificial sequence
  SiRNA target sequence
ttataaatatcttgtatgtat

SEQ ID NO: 97918 - DNA, 21 bp, Artificial sequence
  SiRNA target sequence
tataaatatcttgtatgtatt

SEQ ID NO: 97919 - DNA, 21 bp, Artificial sequence
  SiRNA target sequence
ataaatatcttgtatgtattt

SEQ ID NO: 97920 - DNA, 21 bp, Artificial sequence
  SiRNA target sequence
taaatatcttgtatgtattta

SEQ ID NO: 97921 - DNA, 21 bp, Artificial sequence
  SiRNA target sequence
aaatatcttgtatgtatttat

SEQ ID NO: 97922 - DNA, 21 bp, Artificial sequence
  SiRNA target sequence
aatatcttgtatgtatttatt

SEQ ID NO: 97923 - DNA, 21 bp, Artificial sequence
  SiRNA target sequence
atatcttgtatgtatttatta

SEQ ID NO: 97924 - DNA, 21 bp, Artificial sequence
  SiRNA target sequence
tatcttgtatgtatttattat

SEQ ID NO: 97925 - DNA, 21 bp, Artificial sequence
  SiRNA target sequence
atcttgtatgtatttattatc

SEQ ID NO: 97926 - DNA, 21 bp, Artificial sequence
  SiRNA target sequence
tcttgtatgtatttattatct

SEQ ID NO: 97927 - DNA, 21 bp, Artificial sequence
  SiRNA target sequence
cttgtatgtatttattatctt

SEQ ID NO: 97928 - DNA, 21 bp, Artificial sequence
  SiRNA target sequence
ttgtatgtatttattatcttc

SEQ ID NO: 97929 - DNA, 21 bp, Artificial sequence
  SiRNA target sequence
tgtatgtatttattatcttcc

SEQ ID NO: 97930 - DNA, 21 bp, Artificial sequence
  SiRNA target sequence
gtatgtatttattatcttccc

SEQ ID NO: 97931 - DNA, 21 bp, Artificial sequence
  SiRNA target sequence
tatgtatttattatcttccct

SEQ ID NO: 97932 - DNA, 21 bp, Artificial sequence
  SiRNA target sequence
atgtatttattatcttccctt

SEQ ID NO: 97933 - DNA, 21 bp, Artificial sequence
  SiRNA target sequence
tgtatttattatcttcccttg

SEQ ID NO: 97934 - DNA, 21 bp, Artificial sequence
  SiRNA target sequence
gtatttattatcttcccttga

SEQ ID NO: 97935 - DNA, 21 bp, Artificial sequence
  SiRNA target sequence
tatttattatcttcccttgaa

SEQ ID NO: 97936 - DNA, 21 bp, Artificial sequence
  SiRNA target sequence
atttattatcttcccttgaaa

SEQ ID NO: 97937 - DNA, 21 bp, Artificial sequence
  SiRNA target sequence
tttattatcttcccttgaaac

SEQ ID NO: 97938 - DNA, 21 bp, Artificial sequence
  SiRNA target sequence
ttattatcttcccttgaaaca

SEQ ID NO: 97939 - DNA, 21 bp, Artificial sequence
  SiRNA target sequence
tattatcttcccttgaaacag

SEQ ID NO: 97940 - DNA, 21 bp, Artificial sequence
  SiRNA target sequence
attatcttcccttgaaacagc

SEQ ID NO: 97941 - DNA, 21 bp, Artificial sequence
  SiRNA target sequence
ttatcttcccttgaaacagcg

SEQ ID NO: 97942 - DNA, 21 bp, Artificial sequence
  SiRNA target sequence
tatcttcccttgaaacagcgg

SEQ ID NO: 97943 - DNA, 21 bp, Artificial sequence
  SiRNA target sequence
atcttcccttgaaacagcggg

SEQ ID NO: 97944 - DNA, 21 bp, Artificial sequence
  SiRNA target sequence
tcttcccttgaaacagcgggg

SEQ ID NO: 97945 - DNA, 21 bp, Artificial sequence
  SiRNA target sequence
cttcccttgaaacagcggggt

SEQ ID NO: 97946 - DNA, 21 bp, Artificial sequence
  SiRNA target sequence
ttcccttgaaacagcggggta

SEQ ID NO: 97947 - DNA, 21 bp, Artificial sequence
  SiRNA target sequence
tcccttgaaacagcggggtaa

SEQ ID NO: 97948 - DNA, 21 bp, Artificial sequence
  SiRNA target sequence
cccttgaaacagcggggtaaa

SEQ ID NO: 97949 - DNA, 21 bp, Artificial sequence
  SiRNA target sequence
ccttgaaacagcggggtaaat

SEQ ID NO: 97950 - DNA, 21 bp, Artificial sequence
  SiRNA target sequence
cttgaaacagcggggtaaatt

SEQ ID NO: 97951 - DNA, 21 bp, Artificial sequence
  SiRNA target sequence
ttgaaacagcggggtaaattt

SEQ ID NO: 97952 - DNA, 21 bp, Artificial sequence
  SiRNA target sequence
tgaaacagcggggtaaatttc

SEQ ID NO: 97953 - DNA, 21 bp, Artificial sequence
  SiRNA target sequence
gaaacagcggggtaaatttca

SEQ ID NO: 97954 - DNA, 21 bp, Artificial sequence
  SiRNA target sequence
aaacagcggggtaaatttcaa

SEQ ID NO: 97955 - DNA, 21 bp, Artificial sequence
  SiRNA target sequence
aacagcggggtaaatttcaat

SEQ ID NO: 97956 - DNA, 21 bp, Artificial sequence
  SiRNA target sequence
acagcggggtaaatttcaatg

SEQ ID NO: 97957 - DNA, 21 bp, Artificial sequence
  SiRNA target sequence
cagcggggtaaatttcaatgc

SEQ ID NO: 97958 - DNA, 21 bp, Artificial sequence
  SiRNA target sequence
agcggggtaaatttcaatgcc

SEQ ID NO: 97959 - DNA, 21 bp, Artificial sequence
  SiRNA target sequence
gcggggtaaatttcaatgcct

SEQ ID NO: 97960 - DNA, 21 bp, Artificial sequence
  SiRNA target sequence
cggggtaaatttcaatgcctt

SEQ ID NO: 97961 - DNA, 21 bp, Artificial sequence
  SiRNA target sequence
ggggtaaatttcaatgccttt

SEQ ID NO: 97962 - DNA, 21 bp, Artificial sequence
  SiRNA target sequence
gggtaaatttcaatgccttta

SEQ ID NO: 97963 - DNA, 21 bp, Artificial sequence
  SiRNA target sequence
ggtaaatttcaatgcctttat

SEQ ID NO: 97964 - DNA, 21 bp, Artificial sequence
  SiRNA target sequence
gtaaatttcaatgcctttatt

SEQ ID NO: 97965 - DNA, 21 bp, Artificial sequence
  SiRNA target sequence
taaatttcaatgcctttattt

SEQ ID NO: 97966 - DNA, 21 bp, Artificial sequence
  SiRNA target sequence
aaatttcaatgcctttatttt

SEQ ID NO: 97967 - DNA, 21 bp, Artificial sequence
  SiRNA target sequence
aatttcaatgcctttattttc

SEQ ID NO: 97968 - DNA, 21 bp, Artificial sequence
  SiRNA target sequence
atttcaatgcctttattttca

SEQ ID NO: 97969 - DNA, 21 bp, Artificial sequence
  SiRNA target sequence
tttcaatgcctttattttcaa

SEQ ID NO: 97970 - DNA, 21 bp, Artificial sequence
  SiRNA target sequence
ttcaatgcctttattttcaaa

SEQ ID NO: 97971 - DNA, 21 bp, Artificial sequence
  SiRNA target sequence
tcaatgcctttattttcaaac

SEQ ID NO: 97972 - DNA, 21 bp, Artificial sequence
  SiRNA target sequence
caatgcctttattttcaaact

SEQ ID NO: 97973 - DNA, 21 bp, Artificial sequence
  SiRNA target sequence
aatgcctttattttcaaactc

SEQ ID NO: 97974 - DNA, 21 bp, Artificial sequence
  SiRNA target sequence
atgcctttattttcaaactct

SEQ ID NO: 97975 - DNA, 21 bp, Artificial sequence
  SiRNA target sequence
tgcctttattttcaaactctt

SEQ ID NO: 97976 - DNA, 21 bp, Artificial sequence
  SiRNA target sequence
gcctttattttcaaactcttc

SEQ ID NO: 97977 - DNA, 21 bp, Artificial sequence
  SiRNA target sequence
cctttattttcaaactcttct

SEQ ID NO: 97978 - DNA, 21 bp, Artificial sequence
  SiRNA target sequence
ctttattttcaaactcttctt

SEQ ID NO: 97979 - DNA, 21 bp, Artificial sequence
  SiRNA target sequence
tttattttcaaactcttcttt

SEQ ID NO: 97980 - DNA, 21 bp, Artificial sequence
  SiRNA target sequence
ttattttcaaactcttcttta

SEQ ID NO: 97981 - DNA, 21 bp, Artificial sequence
  SiRNA target sequence
tattttcaaactcttctttat

SEQ ID NO: 97982 - DNA, 21 bp, Artificial sequence
  SiRNA target sequence
attttcaaactcttctttata

SEQ ID NO: 97983 - DNA, 21 bp, Artificial sequence
  SiRNA target sequence
ttttcaaactcttctttatat

SEQ ID NO: 97984 - DNA, 21 bp, Artificial sequence
  SiRNA target sequence
tttcaaactcttctttatata

SEQ ID NO: 97985 - DNA, 21 bp, Artificial sequence
  SiRNA target sequence
ttcaaactcttctttatataa

SEQ ID NO: 97986 - DNA, 21 bp, Artificial sequence
  SiRNA target sequence
tcaaactcttctttatataaa

SEQ ID NO: 97987 - DNA, 21 bp, Artificial sequence
  SiRNA target sequence
caaactcttctttatataaaa

SEQ ID NO: 97988 - DNA, 21 bp, Artificial sequence
  SiRNA target sequence
aaactcttctttatataaaaa

SEQ ID NO: 97989 - DNA, 21 bp, Artificial sequence
  SiRNA target sequence
aactcttctttatataaaaaa

SEQ ID NO: 97990 - DNA, 21 bp, Artificial sequence
  SiRNA target sequence
actcttctttatataaaaaat

SEQ ID NO: 97991 - DNA, 21 bp, Artificial sequence
  SiRNA target sequence
ctcttctttatataaaaaatc

SEQ ID NO: 97992 - DNA, 21 bp, Artificial sequence
  SiRNA target sequence
tcttctttatataaaaaatct

SEQ ID NO: 97993 - DNA, 21 bp, Artificial sequence
  SiRNA target sequence
cttctttatataaaaaatcta

SEQ ID NO: 97994 - DNA, 21 bp, Artificial sequence
  SiRNA target sequence
ttctttatataaaaaatctac

SEQ ID NO: 97995 - DNA, 21 bp, Artificial sequence
  SiRNA target sequence
tctttatataaaaaatctaca

SEQ ID NO: 97996 - DNA, 21 bp, Artificial sequence
  SiRNA target sequence
ctttatataaaaaatctacat

SEQ ID NO: 97997 - DNA, 21 bp, Artificial sequence
  SiRNA target sequence
tttatataaaaaatctacatc

SEQ ID NO: 97998 - DNA, 21 bp, Artificial sequence
  SiRNA target sequence
ttatataaaaaatctacatct

SEQ ID NO: 97999 - DNA, 21 bp, Artificial sequence
  SiRNA target sequence
tatataaaaaatctacatctc

SEQ ID NO: 98000 - DNA, 21 bp, Artificial sequence
  SiRNA target sequence
atataaaaaatctacatctct

SEQ ID NO: 98001 - DNA, 21 bp, Artificial sequence
  SiRNA target sequence
tataaaaaatctacatctcta

SEQ ID NO: 98002 - DNA, 21 bp, Artificial sequence
  SiRNA target sequence
ataaaaaatctacatctctaa

SEQ ID NO: 98003 - DNA, 21 bp, Artificial sequence
  SiRNA target sequence
taaaaaatctacatctctaaa

SEQ ID NO: 98004 - DNA, 21 bp, Artificial sequence
  SiRNA target sequence
aaaaaatctacatctctaaat

SEQ ID NO: 98005 - DNA, 21 bp, Artificial sequence
  SiRNA target sequence
aaaaatctacatctctaaatc

SEQ ID NO: 98006 - DNA, 21 bp, Artificial sequence
  SiRNA target sequence
aaaatctacatctctaaatct

SEQ ID NO: 98007 - DNA, 21 bp, Artificial sequence
  SiRNA target sequence
aaatctacatctctaaatcta

SEQ ID NO: 98008 - DNA, 21 bp, Artificial sequence
  SiRNA target sequence
aatctacatctctaaatctaa

SEQ ID NO: 98009 - DNA, 21 bp, Artificial sequence
  SiRNA target sequence
atctacatctctaaatctaaa

SEQ ID NO: 98010 - DNA, 21 bp, Artificial sequence
  SiRNA target sequence
tctacatctctaaatctaaaa

SEQ ID NO: 98011 - DNA, 21 bp, Artificial sequence
  SiRNA target sequence
ctacatctctaaatctaaaac

SEQ ID NO: 98012 - DNA, 21 bp, Artificial sequence
  SiRNA target sequence
tacatctctaaatctaaaacc

SEQ ID NO: 98013 - DNA, 21 bp, Artificial sequence
  SiRNA target sequence
acatctctaaatctaaaacca

SEQ ID NO: 98014 - DNA, 21 bp, Artificial sequence
  SiRNA target sequence
catctctaaatctaaaaccat

SEQ ID NO: 98015 - DNA, 21 bp, Artificial sequence
  SiRNA target sequence
atctctaaatctaaaaccata

SEQ ID NO: 98016 - DNA, 21 bp, Artificial sequence
  SiRNA target sequence
tctctaaatctaaaaccatat

SEQ ID NO: 98017 - DNA, 21 bp, Artificial sequence
  SiRNA target sequence
ctctaaatctaaaaccatata

SEQ ID NO: 98018 - DNA, 21 bp, Artificial sequence
  SiRNA target sequence
tctaaatctaaaaccatataa

SEQ ID NO: 98019 - DNA, 21 bp, Artificial sequence
  SiRNA target sequence
ctaaatctaaaaccatataat

SEQ ID NO: 98020 - DNA, 21 bp, Artificial sequence
  SiRNA target sequence
taaatctaaaaccatataata

SEQ ID NO: 98021 - DNA, 21 bp, Artificial sequence
  SiRNA target sequence
aaatctaaaaccatataataa

SEQ ID NO: 98022 - DNA, 21 bp, Artificial sequence
  SiRNA target sequence
aatctaaaaccatataataaa

SEQ ID NO: 98023 - DNA, 21 bp, Artificial sequence
  SiRNA target sequence
atctaaaaccatataataaaa

SEQ ID NO: 98024 - DNA, 21 bp, Artificial sequence
  SiRNA target sequence
tctaaaaccatataataaaat

SEQ ID NO: 98025 - DNA, 21 bp, Artificial sequence
  SiRNA target sequence
ctaaaaccatataataaaata

SEQ ID NO: 98026 - DNA, 21 bp, Artificial sequence
  SiRNA target sequence
taaaaccatataataaaataa

SEQ ID NO: 98027 - DNA, 21 bp, Artificial sequence
  SiRNA target sequence
aaaaccatataataaaataac

SEQ ID NO: 98028 - DNA, 21 bp, Artificial sequence
  SiRNA target sequence
aaaccatataataaaataact

SEQ ID NO: 98029 - DNA, 21 bp, Artificial sequence
  SiRNA target sequence
aaccatataataaaataactt

SEQ ID NO: 98030 - DNA, 21 bp, Artificial sequence
  SiRNA target sequence
accatataataaaataacttt

SEQ ID NO: 98031 - DNA, 21 bp, Artificial sequence
  SiRNA target sequence
ccatataataaaataactttt

SEQ ID NO: 98032 - DNA, 21 bp, Artificial sequence
  SiRNA target sequence
catataataaaataacttttt

SEQ ID NO: 98033 - DNA, 21 bp, Artificial sequence
  SiRNA target sequence
atataataaaataactttttt

SEQ ID NO: 98034 - DNA, 21 bp, Artificial sequence
  SiRNA target sequence
tataataaaataactttttta

SEQ ID NO: 98035 - DNA, 21 bp, Artificial sequence
  SiRNA target sequence
ataataaaataacttttttaa

SEQ ID NO: 98036 - DNA, 21 bp, Artificial sequence
  SiRNA target sequence
taataaaataacttttttaaa

SEQ ID NO: 98037 - DNA, 21 bp, Artificial sequence
  SiRNA target sequence
aataaaataacttttttaaaa

SEQ ID NO: 98038 - DNA, 21 bp, Artificial sequence
  SiRNA target sequence
ataaaataacttttttaaaaa

SEQ ID NO: 98039 - DNA, 21 bp, Artificial sequence
  SiRNA target sequence
taaaataacttttttaaaaaa

SEQ ID NO: 98040 - DNA, 21 bp, Artificial sequence
  SiRNA target sequence
aaaataacttttttaaaaaaa

SEQ ID NO: 98041 - DNA, 21 bp, Artificial sequence
  SiRNA target sequence
aaataacttttttaaaaaaat

SEQ ID NO: 98042 - DNA, 21 bp, Artificial sequence
  SiRNA target sequence
aataacttttttaaaaaaatt

SEQ ID NO: 98043 - DNA, 21 bp, Artificial sequence
  SiRNA target sequence
ataacttttttaaaaaaattt

SEQ ID NO: 98044 - DNA, 21 bp, Artificial sequence
  SiRNA target sequence
taacttttttaaaaaaattta

SEQ ID NO: 98045 - DNA, 21 bp, Artificial sequence
  SiRNA target sequence
aacttttttaaaaaaatttaa

SEQ ID NO: 98046 - DNA, 21 bp, Artificial sequence
  SiRNA target sequence
acttttttaaaaaaatttaaa

SEQ ID NO: 98047 - DNA, 21 bp, Artificial sequence
  SiRNA target sequence
cttttttaaaaaaatttaaat

SEQ ID NO: 98048 - DNA, 21 bp, Artificial sequence
  SiRNA target sequence
ttttttaaaaaaatttaaatc

SEQ ID NO: 98049 - DNA, 21 bp, Artificial sequence
  SiRNA target sequence
tttttaaaaaaatttaaatca

SEQ ID NO: 98050 - DNA, 21 bp, Artificial sequence
  SiRNA target sequence
ttttaaaaaaatttaaatcag

SEQ ID NO: 98051 - DNA, 21 bp, Artificial sequence
  SiRNA target sequence
tttaaaaaaatttaaatcaga

SEQ ID NO: 98052 - DNA, 21 bp, Artificial sequence
  SiRNA target sequence
ttaaaaaaatttaaatcagaa

SEQ ID NO: 98053 - DNA, 21 bp, Artificial sequence
  SiRNA target sequence
taaaaaaatttaaatcagaat

SEQ ID NO: 98054 - DNA, 21 bp, Artificial sequence
  SiRNA target sequence
aaaaaaatttaaatcagaata

SEQ ID NO: 98055 - DNA, 21 bp, Artificial sequence
  SiRNA target sequence
aaaaaatttaaatcagaatag

SEQ ID NO: 98056 - DNA, 21 bp, Artificial sequence
  SiRNA target sequence
aaaaatttaaatcagaatagt

SEQ ID NO: 98057 - DNA, 21 bp, Artificial sequence
  SiRNA target sequence
aaaatttaaatcagaatagta

SEQ ID NO: 98058 - DNA, 21 bp, Artificial sequence
  SiRNA target sequence
aaatttaaatcagaatagtaa

SEQ ID NO: 98059 - DNA, 21 bp, Artificial sequence
  SiRNA target sequence
aatttaaatcagaatagtaat

SEQ ID NO: 98060 - DNA, 21 bp, Artificial sequence
  SiRNA target sequence
atttaaatcagaatagtaatt

SEQ ID NO: 98061 - DNA, 21 bp, Artificial sequence
  SiRNA target sequence
tttaaatcagaatagtaatta

SEQ ID NO: 98062 - DNA, 21 bp, Artificial sequence
  SiRNA target sequence
ttaaatcagaatagtaattaa

SEQ ID NO: 98063 - DNA, 21 bp, Artificial sequence
  SiRNA target sequence
taaatcagaatagtaattaac

SEQ ID NO: 98064 - DNA, 21 bp, Artificial sequence
  SiRNA target sequence
aaatcagaatagtaattaaca

SEQ ID NO: 98065 - DNA, 21 bp, Artificial sequence
  SiRNA target sequence
aatcagaatagtaattaacaa

SEQ ID NO: 98066 - DNA, 21 bp, Artificial sequence
  SiRNA target sequence
atcagaatagtaattaacaaa

SEQ ID NO: 98067 - DNA, 21 bp, Artificial sequence
  SiRNA target sequence
tcagaatagtaattaacaaat

SEQ ID NO: 98068 - DNA, 21 bp, Artificial sequence
  SiRNA target sequence
cagaatagtaattaacaaatg

SEQ ID NO: 98069 - DNA, 21 bp, Artificial sequence
  SiRNA target sequence
agaatagtaattaacaaatgc

SEQ ID NO: 98070 - DNA, 21 bp, Artificial sequence
  SiRNA target sequence
gaatagtaattaacaaatgcc

SEQ ID NO: 98071 - DNA, 21 bp, Artificial sequence
  SiRNA target sequence
aatagtaattaacaaatgccc

SEQ ID NO: 98072 - DNA, 21 bp, Artificial sequence
  SiRNA target sequence
atagtaattaacaaatgccct

SEQ ID NO: 98073 - DNA, 21 bp, Artificial sequence
  SiRNA target sequence
tagtaattaacaaatgccctg

SEQ ID NO: 98074 - DNA, 21 bp, Artificial sequence
  SiRNA target sequence
agtaattaacaaatgccctgg

SEQ ID NO: 98075 - DNA, 21 bp, Artificial sequence
  SiRNA target sequence
gtaattaacaaatgccctggg

SEQ ID NO: 98076 - DNA, 21 bp, Artificial sequence
  SiRNA target sequence
taattaacaaatgccctggga

SEQ ID NO: 98077 - DNA, 21 bp, Artificial sequence
  SiRNA target sequence
aattaacaaatgccctgggaa

SEQ ID NO: 98078 - DNA, 21 bp, Artificial sequence
  SiRNA target sequence
attaacaaatgccctgggaag

SEQ ID NO: 98079 - DNA, 21 bp, Artificial sequence
  SiRNA target sequence
ttaacaaatgccctgggaagt

SEQ ID NO: 98080 - DNA, 21 bp, Artificial sequence
  SiRNA target sequence
taacaaatgccctgggaagtg

SEQ ID NO: 98081 - DNA, 21 bp, Artificial sequence
  SiRNA target sequence
aacaaatgccctgggaagtgt

SEQ ID NO: 98082 - DNA, 21 bp, Artificial sequence
  SiRNA target sequence
acaaatgccctgggaagtgta

SEQ ID NO: 98083 - DNA, 21 bp, Artificial sequence
  SiRNA target sequence
caaatgccctgggaagtgtaa

SEQ ID NO: 98084 - DNA, 21 bp, Artificial sequence
  SiRNA target sequence
aaatgccctgggaagtgtaat

SEQ ID NO: 98085 - DNA, 21 bp, Artificial sequence
  SiRNA target sequence
aatgccctgggaagtgtaata

SEQ ID NO: 98086 - DNA, 21 bp, Artificial sequence
  SiRNA target sequence
atgccctgggaagtgtaatac

SEQ ID NO: 98087 - DNA, 21 bp, Artificial sequence
  SiRNA target sequence
tgccctgggaagtgtaatacc

SEQ ID NO: 98088 - DNA, 21 bp, Artificial sequence
  SiRNA target sequence
gccctgggaagtgtaatacca

SEQ ID NO: 98089 - DNA, 21 bp, Artificial sequence
  SiRNA target sequence
ccctgggaagtgtaataccag

SEQ ID NO: 98090 - DNA, 21 bp, Artificial sequence
  SiRNA target sequence
cctgggaagtgtaataccagt

SEQ ID NO: 98091 - DNA, 21 bp, Artificial sequence
  SiRNA target sequence
ctgggaagtgtaataccagta

SEQ ID NO: 98092 - DNA, 21 bp, Artificial sequence
  SiRNA target sequence
tgggaagtgtaataccagtac

SEQ ID NO: 98093 - DNA, 21 bp, Artificial sequence
  SiRNA target sequence
gggaagtgtaataccagtacc

SEQ ID NO: 98094 - DNA, 21 bp, Artificial sequence
  SiRNA target sequence
ggaagtgtaataccagtacca

SEQ ID NO: 98095 - DNA, 21 bp, Artificial sequence
  SiRNA target sequence
gaagtgtaataccagtaccag

SEQ ID NO: 98096 - DNA, 21 bp, Artificial sequence
  SiRNA target sequence
aagtgtaataccagtaccagt

SEQ ID NO: 98097 - DNA, 21 bp, Artificial sequence
  SiRNA target sequence
agtgtaataccagtaccagtg

SEQ ID NO: 98098 - DNA, 21 bp, Artificial sequence
  SiRNA target sequence
gtgtaataccagtaccagtgc

SEQ ID NO: 98099 - DNA, 21 bp, Artificial sequence
  SiRNA target sequence
tgtaataccagtaccagtgca

SEQ ID NO: 98100 - DNA, 21 bp, Artificial sequence
  SiRNA target sequence
gtaataccagtaccagtgcac

SEQ ID NO: 98101 - DNA, 21 bp, Artificial sequence
  SiRNA target sequence
taataccagtaccagtgcaca

SEQ ID NO: 98102 - DNA, 21 bp, Artificial sequence
  SiRNA target sequence
aataccagtaccagtgcacat

SEQ ID NO: 98103 - DNA, 21 bp, Artificial sequence
  SiRNA target sequence
ataccagtaccagtgcacata

SEQ ID NO: 98104 - DNA, 21 bp, Artificial sequence
  SiRNA target sequence
taccagtaccagtgcacataa

SEQ ID NO: 98105 - DNA, 21 bp, Artificial sequence
  SiRNA target sequence
accagtaccagtgcacataaa

SEQ ID NO: 98106 - DNA, 21 bp, Artificial sequence
  SiRNA target sequence
ccagtaccagtgcacataaac

SEQ ID NO: 98107 - DNA, 21 bp, Artificial sequence
  SiRNA target sequence
cagtaccagtgcacataaaca

SEQ ID NO: 98108 - DNA, 21 bp, Artificial sequence
  SiRNA target sequence
agtaccagtgcacataaacaa

SEQ ID NO: 98109 - DNA, 21 bp, Artificial sequence
  SiRNA target sequence
gtaccagtgcacataaacaaa

SEQ ID NO: 98110 - DNA, 21 bp, Artificial sequence
  SiRNA target sequence
taccagtgcacataaacaaaa

SEQ ID NO: 98111 - DNA, 21 bp, Artificial sequence
  SiRNA target sequence
accagtgcacataaacaaaat

SEQ ID NO: 98112 - DNA, 21 bp, Artificial sequence
  SiRNA target sequence
ccagtgcacataaacaaaatc

SEQ ID NO: 98113 - DNA, 21 bp, Artificial sequence
  SiRNA target sequence
cagtgcacataaacaaaatct

SEQ ID NO: 98114 - DNA, 21 bp, Artificial sequence
  SiRNA target sequence
agtgcacataaacaaaatctt

SEQ ID NO: 98115 - DNA, 21 bp, Artificial sequence
  SiRNA target sequence
gtgcacataaacaaaatcttt

SEQ ID NO: 98116 - DNA, 21 bp, Artificial sequence
  SiRNA target sequence
tgcacataaacaaaatctttt

SEQ ID NO: 98117 - DNA, 21 bp, Artificial sequence
  SiRNA target sequence
gcacataaacaaaatcttttt

SEQ ID NO: 98118 - DNA, 21 bp, Artificial sequence
  SiRNA target sequence
cacataaacaaaatcttttta

SEQ ID NO: 98119 - DNA, 21 bp, Artificial sequence
  SiRNA target sequence
acataaacaaaatctttttac

SEQ ID NO: 98120 - DNA, 21 bp, Artificial sequence
  SiRNA target sequence
cataaacaaaatctttttacc

SEQ ID NO: 98121 - DNA, 21 bp, Artificial sequence
  SiRNA target sequence
ataaacaaaatctttttacca

SEQ ID NO: 98122 - DNA, 21 bp, Artificial sequence
  SiRNA target sequence
taaacaaaatctttttaccac

SEQ ID NO: 98123 - DNA, 21 bp, Artificial sequence
  SiRNA target sequence
aaacaaaatctttttaccact

SEQ ID NO: 98124 - DNA, 21 bp, Artificial sequence
  SiRNA target sequence
aacaaaatctttttaccacta

SEQ ID NO: 98125 - DNA, 21 bp, Artificial sequence
  SiRNA target sequence
acaaaatctttttaccactaa

SEQ ID NO: 98126 - DNA, 21 bp, Artificial sequence
  SiRNA target sequence
caaaatctttttaccactaaa

SEQ ID NO: 98127 - DNA, 21 bp, Artificial sequence
  SiRNA target sequence
aaaatctttttaccactaaaa

SEQ ID NO: 98128 - DNA, 21 bp, Artificial sequence
  SiRNA target sequence
aaatctttttaccactaaaat

SEQ ID NO: 98129 - DNA, 21 bp, Artificial sequence
  SiRNA target sequence
aatctttttaccactaaaatt

SEQ ID NO: 98130 - DNA, 21 bp, Artificial sequence
  SiRNA target sequence
atctttttaccactaaaatta

SEQ ID NO: 98131 - DNA, 21 bp, Artificial sequence
  SiRNA target sequence
tctttttaccactaaaattaa

SEQ ID NO: 98132 - DNA, 21 bp, Artificial sequence
  SiRNA target sequence
ctttttaccactaaaattaag

SEQ ID NO: 98133 - DNA, 21 bp, Artificial sequence
  SiRNA target sequence
tttttaccactaaaattaagt

SEQ ID NO: 98134 - DNA, 21 bp, Artificial sequence
  SiRNA target sequence
ttttaccactaaaattaagtc

SEQ ID NO: 98135 - DNA, 21 bp, Artificial sequence
  SiRNA target sequence
tttaccactaaaattaagtct

SEQ ID NO: 98136 - DNA, 21 bp, Artificial sequence
  SiRNA target sequence
ttaccactaaaattaagtcta

SEQ ID NO: 98137 - DNA, 21 bp, Artificial sequence
  SiRNA target sequence
taccactaaaattaagtctat

SEQ ID NO: 98138 - DNA, 21 bp, Artificial sequence
  SiRNA target sequence
accactaaaattaagtctatt

SEQ ID NO: 98139 - DNA, 21 bp, Artificial sequence
  SiRNA target sequence
ccactaaaattaagtctattt

SEQ ID NO: 98140 - DNA, 21 bp, Artificial sequence
  SiRNA target sequence
cactaaaattaagtctatttt

SEQ ID NO: 98141 - DNA, 21 bp, Artificial sequence
  SiRNA target sequence
actaaaattaagtctattttg

SEQ ID NO: 98142 - DNA, 21 bp, Artificial sequence
  SiRNA target sequence
ctaaaattaagtctattttgt

SEQ ID NO: 98143 - DNA, 21 bp, Artificial sequence
  SiRNA target sequence
taaaattaagtctattttgta

SEQ ID NO: 98144 - DNA, 21 bp, Artificial sequence
  SiRNA target sequence
aaaattaagtctattttgtac

SEQ ID NO: 98145 - DNA, 21 bp, Artificial sequence
  SiRNA target sequence
aaattaagtctattttgtact

SEQ ID NO: 98146 - DNA, 21 bp, Artificial sequence
  SiRNA target sequence
aattaagtctattttgtacta

SEQ ID NO: 98147 - DNA, 21 bp, Artificial sequence
  SiRNA target sequence
attaagtctattttgtactat

SEQ ID NO: 98148 - DNA, 21 bp, Artificial sequence
  SiRNA target sequence
ttaagtctattttgtactatg

SEQ ID NO: 98149 - DNA, 21 bp, Artificial sequence
  SiRNA target sequence
taagtctattttgtactatgt

SEQ ID NO: 98150 - DNA, 21 bp, Artificial sequence
  SiRNA target sequence
aagtctattttgtactatgtt

SEQ ID NO: 98151 - DNA, 21 bp, Artificial sequence
  SiRNA target sequence
agtctattttgtactatgtta

SEQ ID NO: 98152 - DNA, 21 bp, Artificial sequence
  SiRNA target sequence
gtctattttgtactatgttaa

SEQ ID NO: 98153 - DNA, 21 bp, Artificial sequence
  SiRNA target sequence
tctattttgtactatgttaac

SEQ ID NO: 98154 - DNA, 21 bp, Artificial sequence
  SiRNA target sequence
ctattttgtactatgttaaca

SEQ ID NO: 98155 - DNA, 21 bp, Artificial sequence
  SiRNA target sequence
tattttgtactatgttaacat

SEQ ID NO: 98156 - DNA, 21 bp, Artificial sequence
  SiRNA target sequence
attttgtactatgttaacatg

SEQ ID NO: 98157 - DNA, 21 bp, Artificial sequence
  SiRNA target sequence
ttttgtactatgttaacatga

SEQ ID NO: 98158 - DNA, 21 bp, Artificial sequence
  SiRNA target sequence
tttgtactatgttaacatgaa

SEQ ID NO: 98159 - DNA, 21 bp, Artificial sequence
  SiRNA target sequence
ttgtactatgttaacatgaat

SEQ ID NO: 98160 - DNA, 21 bp, Artificial sequence
  SiRNA target sequence
tgtactatgttaacatgaata

SEQ ID NO: 98161 - DNA, 21 bp, Artificial sequence
  SiRNA target sequence
gtactatgttaacatgaatag

SEQ ID NO: 98162 - DNA, 21 bp, Artificial sequence
  SiRNA target sequence
tactatgttaacatgaatagt

SEQ ID NO: 98163 - DNA, 21 bp, Artificial sequence
  SiRNA target sequence
actatgttaacatgaatagta

SEQ ID NO: 98164 - DNA, 21 bp, Artificial sequence
  SiRNA target sequence
ctatgttaacatgaatagtag

SEQ ID NO: 98165 - DNA, 21 bp, Artificial sequence
  SiRNA target sequence
tatgttaacatgaatagtaga

SEQ ID NO: 98166 - DNA, 21 bp, Artificial sequence
  SiRNA target sequence
atgttaacatgaatagtagac

SEQ ID NO: 98167 - DNA, 21 bp, Artificial sequence
  SiRNA target sequence
tgttaacatgaatagtagacc

SEQ ID NO: 98168 - DNA, 21 bp, Artificial sequence
  SiRNA target sequence
gttaacatgaatagtagaccc

SEQ ID NO: 98169 - DNA, 21 bp, Artificial sequence
  SiRNA target sequence
ttaacatgaatagtagaccct

SEQ ID NO: 98170 - DNA, 21 bp, Artificial sequence
  SiRNA target sequence
taacatgaatagtagaccctt

SEQ ID NO: 98171 - DNA, 21 bp, Artificial sequence
  SiRNA target sequence
aacatgaatagtagacccttt

SEQ ID NO: 98172 - DNA, 21 bp, Artificial sequence
  SiRNA target sequence
acatgaatagtagacccttta

SEQ ID NO: 98173 - DNA, 21 bp, Artificial sequence
  SiRNA target sequence
catgaatagtagaccctttag

SEQ ID NO: 98174 - DNA, 21 bp, Artificial sequence
  SiRNA target sequence
atgaatagtagaccctttagt

SEQ ID NO: 98175 - DNA, 21 bp, Artificial sequence
  SiRNA target sequence
tgaatagtagaccctttagta

SEQ ID NO: 98176 - DNA, 21 bp, Artificial sequence
  SiRNA target sequence
gaatagtagaccctttagtaa

SEQ ID NO: 98177 - DNA, 21 bp, Artificial sequence
  SiRNA target sequence
aatagtagaccctttagtaag

SEQ ID NO: 98178 - DNA, 21 bp, Artificial sequence
  SiRNA target sequence
atagtagaccctttagtaagt

SEQ ID NO: 98179 - DNA, 21 bp, Artificial sequence
  SiRNA target sequence
tagtagaccctttagtaagta

SEQ ID NO: 98180 - DNA, 21 bp, Artificial sequence
  SiRNA target sequence
agtagaccctttagtaagtaa

SEQ ID NO: 98181 - DNA, 21 bp, Artificial sequence
  SiRNA target sequence
gtagaccctttagtaagtaat

SEQ ID NO: 98182 - DNA, 21 bp, Artificial sequence
  SiRNA target sequence
tagaccctttagtaagtaatt

SEQ ID NO: 98183 - DNA, 21 bp, Artificial sequence
  SiRNA target sequence
agaccctttagtaagtaattt

SEQ ID NO: 98184 - DNA, 21 bp, Artificial sequence
  SiRNA target sequence
gaccctttagtaagtaatttt

SEQ ID NO: 98185 - DNA, 21 bp, Artificial sequence
  SiRNA target sequence
accctttagtaagtaatttta

SEQ ID NO: 98186 - DNA, 21 bp, Artificial sequence
  SiRNA target sequence
ccctttagtaagtaattttaa

SEQ ID NO: 98187 - DNA, 21 bp, Artificial sequence
  SiRNA target sequence
cctttagtaagtaattttaaa

SEQ ID NO: 98188 - DNA, 21 bp, Artificial sequence
  SiRNA target sequence
ctttagtaagtaattttaaat

SEQ ID NO: 98189 - DNA, 21 bp, Artificial sequence
  SiRNA target sequence
tttagtaagtaattttaaata

SEQ ID NO: 98190 - DNA, 21 bp, Artificial sequence
  SiRNA target sequence
ttagtaagtaattttaaatac

SEQ ID NO: 98191 - DNA, 21 bp, Artificial sequence
  SiRNA target sequence
tagtaagtaattttaaatact

SEQ ID NO: 98192 - DNA, 21 bp, Artificial sequence
  SiRNA target sequence
agtaagtaattttaaatactc

SEQ ID NO: 98193 - DNA, 21 bp, Artificial sequence
  SiRNA target sequence
gtaagtaattttaaatactct

SEQ ID NO: 98194 - DNA, 21 bp, Artificial sequence
  SiRNA target sequence
taagtaattttaaatactctg

SEQ ID NO: 98195 - DNA, 21 bp, Artificial sequence
  SiRNA target sequence
aagtaattttaaatactctga

SEQ ID NO: 98196 - DNA, 21 bp, Artificial sequence
  SiRNA target sequence
agtaattttaaatactctgaa

SEQ ID NO: 98197 - DNA, 21 bp, Artificial sequence
  SiRNA target sequence
gtaattttaaatactctgaac

SEQ ID NO: 98198 - DNA, 21 bp, Artificial sequence
  SiRNA target sequence
taattttaaatactctgaaca

SEQ ID NO: 98199 - DNA, 21 bp, Artificial sequence
  SiRNA target sequence
aattttaaatactctgaacaa

SEQ ID NO: 98200 - DNA, 21 bp, Artificial sequence
  SiRNA target sequence
attttaaatactctgaacaaa

SEQ ID NO: 98201 - DNA, 21 bp, Artificial sequence
  SiRNA target sequence
ttttaaatactctgaacaaag

SEQ ID NO: 98202 - DNA, 21 bp, Artificial sequence
  SiRNA target sequence
tttaaatactctgaacaaaga

SEQ ID NO: 98203 - DNA, 21 bp, Artificial sequence
  SiRNA target sequence
ttaaatactctgaacaaagac

SEQ ID NO: 98204 - DNA, 21 bp, Artificial sequence
  SiRNA target sequence
taaatactctgaacaaagacc

SEQ ID NO: 98205 - DNA, 21 bp, Artificial sequence
  SiRNA target sequence
aaatactctgaacaaagacct

SEQ ID NO: 98206 - DNA, 21 bp, Artificial sequence
  SiRNA target sequence
aatactctgaacaaagacctt

SEQ ID NO: 98207 - DNA, 21 bp, Artificial sequence
  SiRNA target sequence
atactctgaacaaagaccttt

SEQ ID NO: 98208 - DNA, 21 bp, Artificial sequence
  SiRNA target sequence
tactctgaacaaagacctttt

SEQ ID NO: 98209 - DNA, 21 bp, Artificial sequence
  SiRNA target sequence
actctgaacaaagaccttttc

SEQ ID NO: 98210 - DNA, 21 bp, Artificial sequence
  SiRNA target sequence
ctctgaacaaagaccttttcg

SEQ ID NO: 98211 - DNA, 21 bp, Artificial sequence
  SiRNA target sequence
tctgaacaaagaccttttcgt

SEQ ID NO: 98212 - DNA, 21 bp, Artificial sequence
  SiRNA target sequence
ctgaacaaagaccttttcgtt

SEQ ID NO: 98213 - DNA, 21 bp, Artificial sequence
  SiRNA target sequence
tgaacaaagaccttttcgttc

SEQ ID NO: 98214 - DNA, 21 bp, Artificial sequence
  SiRNA target sequence
gaacaaagaccttttcgttct

SEQ ID NO: 98215 - DNA, 21 bp, Artificial sequence
  SiRNA target sequence
aacaaagaccttttcgttctt

SEQ ID NO: 98216 - DNA, 21 bp, Artificial sequence
  SiRNA target sequence
acaaagaccttttcgttcttc

SEQ ID NO: 98217 - DNA, 21 bp, Artificial sequence
  SiRNA target sequence
caaagaccttttcgttcttct

SEQ ID NO: 98218 - DNA, 21 bp, Artificial sequence
  SiRNA target sequence
aaagaccttttcgttcttctt

SEQ ID NO: 98219 - DNA, 21 bp, Artificial sequence
  SiRNA target sequence
aagaccttttcgttcttcttt

SEQ ID NO: 98220 - DNA, 21 bp, Artificial sequence
  SiRNA target sequence
agaccttttcgttcttctttt

SEQ ID NO: 98221 - DNA, 21 bp, Artificial sequence
  SiRNA target sequence
gaccttttcgttcttctttta

SEQ ID NO: 98222 - DNA, 21 bp, Artificial sequence
  SiRNA target sequence
accttttcgttcttcttttaa

SEQ ID NO: 98223 - DNA, 21 bp, Artificial sequence
  SiRNA target sequence
ccttttcgttcttcttttaaa

SEQ ID NO: 98224 - DNA, 21 bp, Artificial sequence
  SiRNA target sequence
cttttcgttcttcttttaaac

SEQ ID NO: 98225 - DNA, 21 bp, Artificial sequence
  SiRNA target sequence
ttttcgttcttcttttaaact

SEQ ID NO: 98226 - DNA, 21 bp, Artificial sequence
  SiRNA target sequence
tttcgttcttcttttaaactt

SEQ ID NO: 98227 - DNA, 21 bp, Artificial sequence
  SiRNA target sequence
ttcgttcttcttttaaacttg

SEQ ID NO: 98228 - DNA, 21 bp, Artificial sequence
  SiRNA target sequence
tcgttcttcttttaaacttgt

SEQ ID NO: 98229 - DNA, 21 bp, Artificial sequence
  SiRNA target sequence
cgttcttcttttaaacttgtt

SEQ ID NO: 98230 - DNA, 21 bp, Artificial sequence
  SiRNA target sequence
gttcttcttttaaacttgttt

SEQ ID NO: 98231 - DNA, 21 bp, Artificial sequence
  SiRNA target sequence
ttcttcttttaaacttgtttt

SEQ ID NO: 98232 - DNA, 21 bp, Artificial sequence
  SiRNA target sequence
tcttcttttaaacttgtttta

SEQ ID NO: 98233 - DNA, 21 bp, Artificial sequence
  SiRNA target sequence
cttcttttaaacttgttttaa

SEQ ID NO: 98234 - DNA, 21 bp, Artificial sequence
  SiRNA target sequence
ttcttttaaacttgttttaaa

SEQ ID NO: 98235 - DNA, 21 bp, Artificial sequence
  SiRNA target sequence
tcttttaaacttgttttaaaa

SEQ ID NO: 98236 - DNA, 21 bp, Artificial sequence
  SiRNA target sequence
cttttaaacttgttttaaaag

SEQ ID NO: 98237 - DNA, 21 bp, Artificial sequence
  SiRNA target sequence
ttttaaacttgttttaaaaga

SEQ ID NO: 98238 - DNA, 21 bp, Artificial sequence
  SiRNA target sequence
tttaaacttgttttaaaagaa

SEQ ID NO: 98239 - DNA, 21 bp, Artificial sequence
  SiRNA target sequence
ttaaacttgttttaaaagaaa

SEQ ID NO: 98240 - DNA, 21 bp, Artificial sequence
  SiRNA target sequence
taaacttgttttaaaagaaac

SEQ ID NO: 98241 - DNA, 21 bp, Artificial sequence
  SiRNA target sequence
aaacttgttttaaaagaaaca

SEQ ID NO: 98242 - DNA, 21 bp, Artificial sequence
  SiRNA target sequence
aacttgttttaaaagaaacaa

SEQ ID NO: 98243 - DNA, 21 bp, Artificial sequence
  SiRNA target sequence
acttgttttaaaagaaacaag

SEQ ID NO: 98244 - DNA, 21 bp, Artificial sequence
  SiRNA target sequence
cttgttttaaaagaaacaaga

SEQ ID NO: 98245 - DNA, 21 bp, Artificial sequence
  SiRNA target sequence
ttgttttaaaagaaacaagag

SEQ ID NO: 98246 - DNA, 21 bp, Artificial sequence
  SiRNA target sequence
tgttttaaaagaaacaagaga

SEQ ID NO: 98247 - DNA, 21 bp, Artificial sequence
  SiRNA target sequence
gttttaaaagaaacaagagag

SEQ ID NO: 98248 - DNA, 21 bp, Artificial sequence
  SiRNA target sequence
ttttaaaagaaacaagagaga

SEQ ID NO: 98249 - DNA, 21 bp, Artificial sequence
  SiRNA target sequence
tttaaaagaaacaagagagac

SEQ ID NO: 98250 - DNA, 21 bp, Artificial sequence
  SiRNA target sequence
ttaaaagaaacaagagagacg

SEQ ID NO: 98251 - DNA, 21 bp, Artificial sequence
  SiRNA target sequence
taaaagaaacaagagagacgg

SEQ ID NO: 98252 - DNA, 21 bp, Artificial sequence
  SiRNA target sequence
aaaagaaacaagagagacggt

SEQ ID NO: 98253 - DNA, 21 bp, Artificial sequence
  SiRNA target sequence
aaagaaacaagagagacggtg

SEQ ID NO: 98254 - DNA, 21 bp, Artificial sequence
  SiRNA target sequence
aagaaacaagagagacggtga

SEQ ID NO: 98255 - DNA, 21 bp, Artificial sequence
  SiRNA target sequence
agaaacaagagagacggtgac

SEQ ID NO: 98256 - DNA, 21 bp, Artificial sequence
  SiRNA target sequence
gaaacaagagagacggtgaca

SEQ ID NO: 98257 - DNA, 21 bp, Artificial sequence
  SiRNA target sequence
aaacaagagagacggtgacaa

SEQ ID NO: 98258 - DNA, 21 bp, Artificial sequence
  SiRNA target sequence
aacaagagagacggtgacaaa

SEQ ID NO: 98259 - DNA, 21 bp, Artificial sequence
  SiRNA target sequence
acaagagagacggtgacaaag

SEQ ID NO: 98260 - DNA, 21 bp, Artificial sequence
  SiRNA target sequence
caagagagacggtgacaaagt

SEQ ID NO: 98261 - DNA, 21 bp, Artificial sequence
  SiRNA target sequence
aagagagacggtgacaaagta

SEQ ID NO: 98262 - DNA, 21 bp, Artificial sequence
  SiRNA target sequence
agagagacggtgacaaagtaa

SEQ ID NO: 98263 - DNA, 21 bp, Artificial sequence
  SiRNA target sequence
gagagacggtgacaaagtaac

SEQ ID NO: 98264 - DNA, 21 bp, Artificial sequence
  SiRNA target sequence
agagacggtgacaaagtaaca

SEQ ID NO: 98265 - DNA, 21 bp, Artificial sequence
  SiRNA target sequence
gagacggtgacaaagtaacaa

SEQ ID NO: 98266 - DNA, 21 bp, Artificial sequence
  SiRNA target sequence
agacggtgacaaagtaacaaa

SEQ ID NO: 98267 - DNA, 21 bp, Artificial sequence
  SiRNA target sequence
gacggtgacaaagtaacaaaa

SEQ ID NO: 98268 - DNA, 21 bp, Artificial sequence
  SiRNA target sequence
acggtgacaaagtaacaaaaa

SEQ ID NO: 98269 - DNA, 21 bp, Artificial sequence
  SiRNA target sequence
cggtgacaaagtaacaaaaat

SEQ ID NO: 98270 - DNA, 21 bp, Artificial sequence
  SiRNA target sequence
ggtgacaaagtaacaaaaatc

SEQ ID NO: 98271 - DNA, 21 bp, Artificial sequence
  SiRNA target sequence
gtgacaaagtaacaaaaatct

SEQ ID NO: 98272 - DNA, 21 bp, Artificial sequence
  SiRNA target sequence
tgacaaagtaacaaaaatctt

SEQ ID NO: 98273 - DNA, 21 bp, Artificial sequence
  SiRNA target sequence
gacaaagtaacaaaaatcttt

SEQ ID NO: 98274 - DNA, 21 bp, Artificial sequence
  SiRNA target sequence
acaaagtaacaaaaatctttt

SEQ ID NO: 98275 - DNA, 21 bp, Artificial sequence
  SiRNA target sequence
caaagtaacaaaaatcttttt

SEQ ID NO: 98276 - DNA, 21 bp, Artificial sequence
  SiRNA target sequence
aaagtaacaaaaatctttttt

SEQ ID NO: 98277 - DNA, 21 bp, Artificial sequence
  SiRNA target sequence
aagtaacaaaaatcttttttc

SEQ ID NO: 98278 - DNA, 21 bp, Artificial sequence
  SiRNA target sequence
agtaacaaaaatcttttttcg

SEQ ID NO: 98279 - DNA, 21 bp, Artificial sequence
  SiRNA target sequence
gtaacaaaaatcttttttcgt

SEQ ID NO: 98280 - DNA, 21 bp, Artificial sequence
  SiRNA target sequence
taacaaaaatcttttttcgtt

SEQ ID NO: 98281 - DNA, 21 bp, Artificial sequence
  SiRNA target sequence
aacaaaaatcttttttcgtta

SEQ ID NO: 98282 - DNA, 21 bp, Artificial sequence
  SiRNA target sequence
acaaaaatcttttttcgttaa

SEQ ID NO: 98283 - DNA, 21 bp, Artificial sequence
  SiRNA target sequence
caaaaatcttttttcgttaat

SEQ ID NO: 98284 - DNA, 21 bp, Artificial sequence
  SiRNA target sequence
aaaaatcttttttcgttaatg

SEQ ID NO: 98285 - DNA, 21 bp, Artificial sequence
  SiRNA target sequence
aaaatcttttttcgttaatgt

SEQ ID NO: 98286 - DNA, 21 bp, Artificial sequence
  SiRNA target sequence
aaatcttttttcgttaatgta

SEQ ID NO: 98287 - DNA, 21 bp, Artificial sequence
  SiRNA target sequence
aatcttttttcgttaatgtaa

SEQ ID NO: 98288 - DNA, 21 bp, Artificial sequence
  SiRNA target sequence
atcttttttcgttaatgtaaa

SEQ ID NO: 98289 - DNA, 21 bp, Artificial sequence
  SiRNA target sequence
tcttttttcgttaatgtaaaa

SEQ ID NO: 98290 - DNA, 21 bp, Artificial sequence
  SiRNA target sequence
cttttttcgttaatgtaaaat

SEQ ID NO: 98291 - DNA, 21 bp, Artificial sequence
  SiRNA target sequence
ttttttcgttaatgtaaaata

SEQ ID NO: 98292 - DNA, 21 bp, Artificial sequence
  SiRNA target sequence
tttttcgttaatgtaaaatat

SEQ ID NO: 98293 - DNA, 21 bp, Artificial sequence
  SiRNA target sequence
ttttcgttaatgtaaaatatc

SEQ ID NO: 98294 - DNA, 21 bp, Artificial sequence
  SiRNA target sequence
tttcgttaatgtaaaatatct

SEQ ID NO: 98295 - DNA, 21 bp, Artificial sequence
  SiRNA target sequence
ttcgttaatgtaaaatatctt

SEQ ID NO: 98296 - DNA, 21 bp, Artificial sequence
  SiRNA target sequence
tcgttaatgtaaaatatcttg

SEQ ID NO: 98297 - DNA, 21 bp, Artificial sequence
  SiRNA target sequence
cgttaatgtaaaatatcttgg

SEQ ID NO: 98298 - DNA, 21 bp, Artificial sequence
  SiRNA target sequence
gttaatgtaaaatatcttgga

SEQ ID NO: 98299 - DNA, 21 bp, Artificial sequence
  SiRNA target sequence
ttaatgtaaaatatcttggat

SEQ ID NO: 98300 - DNA, 21 bp, Artificial sequence
  SiRNA target sequence
taatgtaaaatatcttggatt

SEQ ID NO: 98301 - DNA, 21 bp, Artificial sequence
  SiRNA target sequence
aatgtaaaatatcttggatta

SEQ ID NO: 98302 - DNA, 21 bp, Artificial sequence
  SiRNA target sequence
atgtaaaatatcttggattaa

SEQ ID NO: 98303 - DNA, 21 bp, Artificial sequence
  SiRNA target sequence
tgtaaaatatcttggattaat

SEQ ID NO: 98304 - DNA, 21 bp, Artificial sequence
  SiRNA target sequence
gtaaaatatcttggattaatt

SEQ ID NO: 98305 - DNA, 21 bp, Artificial sequence
  SiRNA target sequence
taaaatatcttggattaatta

SEQ ID NO: 98306 - DNA, 21 bp, Artificial sequence
  SiRNA target sequence
aaaatatcttggattaattac

SEQ ID NO: 98307 - DNA, 21 bp, Artificial sequence
  SiRNA target sequence
aaatatcttggattaattaca

SEQ ID NO: 98308 - DNA, 21 bp, Artificial sequence
  SiRNA target sequence
aatatcttggattaattacag

SEQ ID NO: 98309 - DNA, 21 bp, Artificial sequence
  SiRNA target sequence
atatcttggattaattacagg

SEQ ID NO: 98310 - DNA, 21 bp, Artificial sequence
  SiRNA target sequence
tatcttggattaattacaggg

SEQ ID NO: 98311 - DNA, 21 bp, Artificial sequence
  SiRNA target sequence
atcttggattaattacaggga

SEQ ID NO: 98312 - DNA, 21 bp, Artificial sequence
  SiRNA target sequence
tcttggattaattacagggat

SEQ ID NO: 98313 - DNA, 21 bp, Artificial sequence
  SiRNA target sequence
cttggattaattacagggata

SEQ ID NO: 98314 - DNA, 21 bp, Artificial sequence
  SiRNA target sequence
ttggattaattacagggatat

SEQ ID NO: 98315 - DNA, 21 bp, Artificial sequence
  SiRNA target sequence
tggattaattacagggatata

SEQ ID NO: 98316 - DNA, 21 bp, Artificial sequence
  SiRNA target sequence
ggattaattacagggatatac

SEQ ID NO: 98317 - DNA, 21 bp, Artificial sequence
  SiRNA target sequence
gattaattacagggatatact

SEQ ID NO: 98318 - DNA, 21 bp, Artificial sequence
  SiRNA target sequence
attaattacagggatatactt

SEQ ID NO: 98319 - DNA, 21 bp, Artificial sequence
  SiRNA target sequence
ttaattacagggatatacttg

SEQ ID NO: 98320 - DNA, 21 bp, Artificial sequence
  SiRNA target sequence
taattacagggatatacttgt

SEQ ID NO: 98321 - DNA, 21 bp, Artificial sequence
  SiRNA target sequence
aattacagggatatacttgta

SEQ ID NO: 98322 - DNA, 21 bp, Artificial sequence
  SiRNA target sequence
attacagggatatacttgtac

SEQ ID NO: 98323 - DNA, 21 bp, Artificial sequence
  SiRNA target sequence
ttacagggatatacttgtaca

SEQ ID NO: 98324 - DNA, 21 bp, Artificial sequence
  SiRNA target sequence
tacagggatatacttgtacat

SEQ ID NO: 98325 - DNA, 21 bp, Artificial sequence
  SiRNA target sequence
acagggatatacttgtacata

SEQ ID NO: 98326 - DNA, 21 bp, Artificial sequence
  SiRNA target sequence
cagggatatacttgtacataa

SEQ ID NO: 98327 - DNA, 21 bp, Artificial sequence
  SiRNA target sequence
agggatatacttgtacataaa

SEQ ID NO: 98328 - DNA, 21 bp, Artificial sequence
  SiRNA target sequence
gggatatacttgtacataaaa

SEQ ID NO: 98329 - DNA, 21 bp, Artificial sequence
  SiRNA target sequence
ggatatacttgtacataaaat

SEQ ID NO: 98330 - DNA, 21 bp, Artificial sequence
  SiRNA target sequence
gatatacttgtacataaaatt

SEQ ID NO: 98331 - DNA, 21 bp, Artificial sequence
  SiRNA target sequence
atatacttgtacataaaattt

SEQ ID NO: 98332 - DNA, 21 bp, Artificial sequence
  SiRNA target sequence
tatacttgtacataaaatttg

SEQ ID NO: 98333 - DNA, 21 bp, Artificial sequence
  SiRNA target sequence
atacttgtacataaaatttga

SEQ ID NO: 98334 - DNA, 21 bp, Artificial sequence
  SiRNA target sequence
tacttgtacataaaatttgag

SEQ ID NO: 98335 - DNA, 21 bp, Artificial sequence
  SiRNA target sequence
acttgtacataaaatttgagg

SEQ ID NO: 98336 - DNA, 21 bp, Artificial sequence
  SiRNA target sequence
cttgtacataaaatttgaggt

SEQ ID NO: 98337 - DNA, 21 bp, Artificial sequence
  SiRNA target sequence
ttgtacataaaatttgaggta

SEQ ID NO: 98338 - DNA, 21 bp, Artificial sequence
  SiRNA target sequence
tgtacataaaatttgaggtaa

SEQ ID NO: 98339 - DNA, 21 bp, Artificial sequence
  SiRNA target sequence
gtacataaaatttgaggtaag

SEQ ID NO: 98340 - DNA, 21 bp, Artificial sequence
  SiRNA target sequence
tacataaaatttgaggtaagt

SEQ ID NO: 98341 - DNA, 21 bp, Artificial sequence
  SiRNA target sequence
acataaaatttgaggtaagtt

SEQ ID NO: 98342 - DNA, 21 bp, Artificial sequence
  SiRNA target sequence
cataaaatttgaggtaagttt

SEQ ID NO: 98343 - DNA, 21 bp, Artificial sequence
  SiRNA target sequence
ataaaatttgaggtaagtttt

SEQ ID NO: 98344 - DNA, 21 bp, Artificial sequence
  SiRNA target sequence
taaaatttgaggtaagtttta

SEQ ID NO: 98345 - DNA, 21 bp, Artificial sequence
  SiRNA target sequence
aaaatttgaggtaagttttat

SEQ ID NO: 98346 - DNA, 21 bp, Artificial sequence
  SiRNA target sequence
aaatttgaggtaagttttatc

SEQ ID NO: 98347 - DNA, 21 bp, Artificial sequence
  SiRNA target sequence
aatttgaggtaagttttatct

SEQ ID NO: 98348 - DNA, 21 bp, Artificial sequence
  SiRNA target sequence
atttgaggtaagttttatctt

SEQ ID NO: 98349 - DNA, 21 bp, Artificial sequence
  SiRNA target sequence
tttgaggtaagttttatctta

SEQ ID NO: 98350 - DNA, 21 bp, Artificial sequence
  SiRNA target sequence
ttgaggtaagttttatcttaa

SEQ ID NO: 98351 - DNA, 21 bp, Artificial sequence
  SiRNA target sequence
tgaggtaagttttatcttaaa

SEQ ID NO: 98352 - DNA, 21 bp, Artificial sequence
  SiRNA target sequence
gaggtaagttttatcttaaaa

SEQ ID NO: 98353 - DNA, 21 bp, Artificial sequence
  SiRNA target sequence
aggtaagttttatcttaaaat

SEQ ID NO: 98354 - DNA, 21 bp, Artificial sequence
  SiRNA target sequence
ggtaagttttatcttaaaatc

SEQ ID NO: 98355 - DNA, 21 bp, Artificial sequence
  SiRNA target sequence
gtaagttttatcttaaaatct

SEQ ID NO: 98356 - DNA, 21 bp, Artificial sequence
  SiRNA target sequence
taagttttatcttaaaatctt

SEQ ID NO: 98357 - DNA, 21 bp, Artificial sequence
  SiRNA target sequence
aagttttatcttaaaatcttt

SEQ ID NO: 98358 - DNA, 21 bp, Artificial sequence
  SiRNA target sequence
agttttatcttaaaatctttt

SEQ ID NO: 98359 - DNA, 21 bp, Artificial sequence
  SiRNA target sequence
gttttatcttaaaatctttta

SEQ ID NO: 98360 - DNA, 21 bp, Artificial sequence
  SiRNA target sequence
ttttatcttaaaatcttttag

SEQ ID NO: 98361 - DNA, 21 bp, Artificial sequence
  SiRNA target sequence
tttatcttaaaatcttttaga

SEQ ID NO: 98362 - DNA, 21 bp, Artificial sequence
  SiRNA target sequence
ttatcttaaaatcttttagaa

SEQ ID NO: 98363 - DNA, 21 bp, Artificial sequence
  SiRNA target sequence
tatcttaaaatcttttagaac

SEQ ID NO: 98364 - DNA, 21 bp, Artificial sequence
  SiRNA target sequence
atcttaaaatcttttagaacc

SEQ ID NO: 98365 - DNA, 21 bp, Artificial sequence
  SiRNA target sequence
tcttaaaatcttttagaacct

SEQ ID NO: 98366 - DNA, 21 bp, Artificial sequence
  SiRNA target sequence
cttaaaatcttttagaacctc

SEQ ID NO: 98367 - DNA, 21 bp, Artificial sequence
  SiRNA target sequence
ttaaaatcttttagaacctca

SEQ ID NO: 98368 - DNA, 21 bp, Artificial sequence
  SiRNA target sequence
taaaatcttttagaacctcaa

SEQ ID NO: 98369 - DNA, 21 bp, Artificial sequence
  SiRNA target sequence
aaaatcttttagaacctcaaa

SEQ ID NO: 98370 - DNA, 21 bp, Artificial sequence
  SiRNA target sequence
aaatcttttagaacctcaaaa

SEQ ID NO: 98371 - DNA, 21 bp, Artificial sequence
  SiRNA target sequence
aatcttttagaacctcaaaaa

SEQ ID NO: 98372 - DNA, 21 bp, Artificial sequence
  SiRNA target sequence
atcttttagaacctcaaaaat

SEQ ID NO: 98373 - DNA, 21 bp, Artificial sequence
  SiRNA target sequence
tcttttagaacctcaaaaata

SEQ ID NO: 98374 - DNA, 21 bp, Artificial sequence
  SiRNA target sequence
cttttagaacctcaaaaatag

SEQ ID NO: 98375 - DNA, 21 bp, Artificial sequence
  SiRNA target sequence
ttttagaacctcaaaaatagt

SEQ ID NO: 98376 - DNA, 21 bp, Artificial sequence
  SiRNA target sequence
tttagaacctcaaaaatagtg

SEQ ID NO: 98377 - DNA, 21 bp, Artificial sequence
  SiRNA target sequence
ttagaacctcaaaaatagtgc

SEQ ID NO: 98378 - DNA, 21 bp, Artificial sequence
  SiRNA target sequence
tagaacctcaaaaatagtgcg

SEQ ID NO: 98379 - DNA, 21 bp, Artificial sequence
  SiRNA target sequence
agaacctcaaaaatagtgcgc

SEQ ID NO: 98380 - DNA, 21 bp, Artificial sequence
  SiRNA target sequence
gaacctcaaaaatagtgcgct

SEQ ID NO: 98381 - DNA, 21 bp, Artificial sequence
  SiRNA target sequence
aacctcaaaaatagtgcgctt

SEQ ID NO: 98382 - DNA, 21 bp, Artificial sequence
  SiRNA target sequence
acctcaaaaatagtgcgcttc

SEQ ID NO: 98383 - DNA, 21 bp, Artificial sequence
  SiRNA target sequence
cctcaaaaatagtgcgcttcg

SEQ ID NO: 98384 - DNA, 21 bp, Artificial sequence
  SiRNA target sequence
ctcaaaaatagtgcgcttcgg

SEQ ID NO: 98385 - DNA, 21 bp, Artificial sequence
  SiRNA target sequence
tcaaaaatagtgcgcttcggt

SEQ ID NO: 98386 - DNA, 21 bp, Artificial sequence
  SiRNA target sequence
caaaaatagtgcgcttcggta

SEQ ID NO: 98387 - DNA, 21 bp, Artificial sequence
  SiRNA target sequence
aaaaatagtgcgcttcggtag

SEQ ID NO: 98388 - DNA, 21 bp, Artificial sequence
  SiRNA target sequence
aaaatagtgcgcttcggtagt

SEQ ID NO: 98389 - DNA, 21 bp, Artificial sequence
  SiRNA target sequence
aaatagtgcgcttcggtagta

SEQ ID NO: 98390 - DNA, 21 bp, Artificial sequence
  SiRNA target sequence
aatagtgcgcttcggtagtaa

SEQ ID NO: 98391 - DNA, 21 bp, Artificial sequence
  SiRNA target sequence
atagtgcgcttcggtagtaaa

SEQ ID NO: 98392 - DNA, 21 bp, Artificial sequence
  SiRNA target sequence
tagtgcgcttcggtagtaaaa

SEQ ID NO: 98393 - DNA, 21 bp, Artificial sequence
  SiRNA target sequence
agtgcgcttcggtagtaaaat

SEQ ID NO: 98394 - DNA, 21 bp, Artificial sequence
  SiRNA target sequence
gtgcgcttcggtagtaaaatg

SEQ ID NO: 98395 - DNA, 21 bp, Artificial sequence
  SiRNA target sequence
tgcgcttcggtagtaaaatgt

SEQ ID NO: 98396 - DNA, 21 bp, Artificial sequence
  SiRNA target sequence
gcgcttcggtagtaaaatgta

SEQ ID NO: 98397 - DNA, 21 bp, Artificial sequence
  SiRNA target sequence
cgcttcggtagtaaaatgtaa

SEQ ID NO: 98398 - DNA, 21 bp, Artificial sequence
  SiRNA target sequence
gcttcggtagtaaaatgtaat

SEQ ID NO: 98399 - DNA, 21 bp, Artificial sequence
  SiRNA target sequence
cttcggtagtaaaatgtaatc

SEQ ID NO: 98400 - DNA, 21 bp, Artificial sequence
  SiRNA target sequence
ttcggtagtaaaatgtaatca

SEQ ID NO: 98401 - DNA, 21 bp, Artificial sequence
  SiRNA target sequence
tcggtagtaaaatgtaatcat

SEQ ID NO: 98402 - DNA, 21 bp, Artificial sequence
  SiRNA target sequence
cggtagtaaaatgtaatcata

SEQ ID NO: 98403 - DNA, 21 bp, Artificial sequence
  SiRNA target sequence
ggtagtaaaatgtaatcatag

SEQ ID NO: 98404 - DNA, 21 bp, Artificial sequence
  SiRNA target sequence
gtagtaaaatgtaatcatagt

SEQ ID NO: 98405 - DNA, 21 bp, Artificial sequence
  SiRNA target sequence
tagtaaaatgtaatcatagta

SEQ ID NO: 98406 - DNA, 21 bp, Artificial sequence
  SiRNA target sequence
agtaaaatgtaatcatagtac

SEQ ID NO: 98407 - DNA, 21 bp, Artificial sequence
  SiRNA target sequence
gtaaaatgtaatcatagtaca

SEQ ID NO: 98408 - DNA, 21 bp, Artificial sequence
  SiRNA target sequence
taaaatgtaatcatagtacag

SEQ ID NO: 98409 - DNA, 21 bp, Artificial sequence
  SiRNA target sequence
aaaatgtaatcatagtacaga

SEQ ID NO: 98410 - DNA, 21 bp, Artificial sequence
  SiRNA target sequence
aaatgtaatcatagtacagat

SEQ ID NO: 98411 - DNA, 21 bp, Artificial sequence
  SiRNA target sequence
aatgtaatcatagtacagatc

SEQ ID NO: 98412 - DNA, 21 bp, Artificial sequence
  SiRNA target sequence
atgtaatcatagtacagatcg

SEQ ID NO: 98413 - DNA, 21 bp, Artificial sequence
  SiRNA target sequence
tgtaatcatagtacagatcgt

SEQ ID NO: 98414 - DNA, 21 bp, Artificial sequence
  SiRNA target sequence
gtaatcatagtacagatcgta

SEQ ID NO: 98415 - DNA, 21 bp, Artificial sequence
  SiRNA target sequence
taatcatagtacagatcgtaa

SEQ ID NO: 98416 - DNA, 21 bp, Artificial sequence
  SiRNA target sequence
aatcatagtacagatcgtaat

SEQ ID NO: 98417 - DNA, 21 bp, Artificial sequence
  SiRNA target sequence
atcatagtacagatcgtaatt

SEQ ID NO: 98418 - DNA, 21 bp, Artificial sequence
  SiRNA target sequence
tcatagtacagatcgtaattt

SEQ ID NO: 98419 - DNA, 21 bp, Artificial sequence
  SiRNA target sequence
catagtacagatcgtaattta

SEQ ID NO: 98420 - DNA, 21 bp, Artificial sequence
  SiRNA target sequence
atagtacagatcgtaatttag

SEQ ID NO: 98421 - DNA, 21 bp, Artificial sequence
  SiRNA target sequence
tagtacagatcgtaatttaga

SEQ ID NO: 98422 - DNA, 21 bp, Artificial sequence
  SiRNA target sequence
agtacagatcgtaatttagat

SEQ ID NO: 98423 - DNA, 21 bp, Artificial sequence
  SiRNA target sequence
gtacagatcgtaatttagata

SEQ ID NO: 98424 - DNA, 21 bp, Artificial sequence
  SiRNA target sequence
tacagatcgtaatttagataa

SEQ ID NO: 98425 - DNA, 21 bp, Artificial sequence
  SiRNA target sequence
acagatcgtaatttagataaa

SEQ ID NO: 98426 - DNA, 21 bp, Artificial sequence
  SiRNA target sequence
cagatcgtaatttagataaat

SEQ ID NO: 98427 - DNA, 21 bp, Artificial sequence
  SiRNA target sequence
agatcgtaatttagataaatt

SEQ ID NO: 98428 - DNA, 21 bp, Artificial sequence
  SiRNA target sequence
gatcgtaatttagataaattt

SEQ ID NO: 98429 - DNA, 21 bp, Artificial sequence
  SiRNA target sequence
atcgtaatttagataaatttc

SEQ ID NO: 98430 - DNA, 21 bp, Artificial sequence
  SiRNA target sequence
tcgtaatttagataaatttct

SEQ ID NO: 98431 - DNA, 21 bp, Artificial sequence
  SiRNA target sequence
cgtaatttagataaatttctt

SEQ ID NO: 98432 - DNA, 21 bp, Artificial sequence
  SiRNA target sequence
gtaatttagataaatttcttt

SEQ ID NO: 98433 - DNA, 21 bp, Artificial sequence
  SiRNA target sequence
taatttagataaatttcttta

SEQ ID NO: 98434 - DNA, 21 bp, Artificial sequence
  SiRNA target sequence
aatttagataaatttctttac

SEQ ID NO: 98435 - DNA, 21 bp, Artificial sequence
  SiRNA target sequence
atttagataaatttctttaca

SEQ ID NO: 98436 - DNA, 21 bp, Artificial sequence
  SiRNA target sequence
tttagataaatttctttacat

SEQ ID NO: 98437 - DNA, 21 bp, Artificial sequence
  SiRNA target sequence
ttagataaatttctttacatt

SEQ ID NO: 98438 - DNA, 21 bp, Artificial sequence
  SiRNA target sequence
tagataaatttctttacattt

SEQ ID NO: 98439 - DNA, 21 bp, Artificial sequence
  SiRNA target sequence
agataaatttctttacatttc

SEQ ID NO: 98440 - DNA, 21 bp, Artificial sequence
  SiRNA target sequence
gataaatttctttacatttct

SEQ ID NO: 98441 - DNA, 21 bp, Artificial sequence
  SiRNA target sequence
ataaatttctttacatttctc

SEQ ID NO: 98442 - DNA, 21 bp, Artificial sequence
  SiRNA target sequence
taaatttctttacatttctca

SEQ ID NO: 98443 - DNA, 21 bp, Artificial sequence
  SiRNA target sequence
aaatttctttacatttctcac

SEQ ID NO: 98444 - DNA, 21 bp, Artificial sequence
  SiRNA target sequence
aatttctttacatttctcacg

SEQ ID NO: 98445 - DNA, 21 bp, Artificial sequence
  SiRNA target sequence
atttctttacatttctcacga

SEQ ID NO: 98446 - DNA, 21 bp, Artificial sequence
  SiRNA target sequence
tttctttacatttctcacgat

SEQ ID NO: 98447 - DNA, 21 bp, Artificial sequence
  SiRNA target sequence
ttctttacatttctcacgata

SEQ ID NO: 98448 - DNA, 21 bp, Artificial sequence
  SiRNA target sequence
tctttacatttctcacgatat

SEQ ID NO: 98449 - DNA, 21 bp, Artificial sequence
  SiRNA target sequence
ctttacatttctcacgatatt

SEQ ID NO: 98450 - DNA, 21 bp, Artificial sequence
  SiRNA target sequence
tttacatttctcacgatattc

SEQ ID NO: 98451 - DNA, 21 bp, Artificial sequence
  SiRNA target sequence
ttacatttctcacgatattcc

SEQ ID NO: 98452 - DNA, 21 bp, Artificial sequence
  SiRNA target sequence
tacatttctcacgatattcct

SEQ ID NO: 98453 - DNA, 21 bp, Artificial sequence
  SiRNA target sequence
acatttctcacgatattcctc

SEQ ID NO: 98454 - DNA, 21 bp, Artificial sequence
  SiRNA target sequence
catttctcacgatattcctca

SEQ ID NO: 98455 - DNA, 21 bp, Artificial sequence
  SiRNA target sequence
atttctcacgatattcctcag

SEQ ID NO: 98456 - DNA, 21 bp, Artificial sequence
  SiRNA target sequence
tttctcacgatattcctcagc

SEQ ID NO: 98457 - DNA, 21 bp, Artificial sequence
  SiRNA target sequence
ttctcacgatattcctcagca

SEQ ID NO: 98458 - DNA, 21 bp, Artificial sequence
  SiRNA target sequence
tctcacgatattcctcagcaa

SEQ ID NO: 98459 - DNA, 21 bp, Artificial sequence
  SiRNA target sequence
ctcacgatattcctcagcaat

SEQ ID NO: 98460 - DNA, 21 bp, Artificial sequence
  SiRNA target sequence
tcacgatattcctcagcaatg

SEQ ID NO: 98461 - DNA, 21 bp, Artificial sequence
  SiRNA target sequence
cacgatattcctcagcaatgg

SEQ ID NO: 98462 - DNA, 21 bp, Artificial sequence
  SiRNA target sequence
acgatattcctcagcaatggt

SEQ ID NO: 98463 - DNA, 21 bp, Artificial sequence
  SiRNA target sequence
cgatattcctcagcaatggta

SEQ ID NO: 98464 - DNA, 21 bp, Artificial sequence
  SiRNA target sequence
gatattcctcagcaatggtat

SEQ ID NO: 98465 - DNA, 21 bp, Artificial sequence
  SiRNA target sequence
atattcctcagcaatggtatc

SEQ ID NO: 98466 - DNA, 21 bp, Artificial sequence
  SiRNA target sequence
tattcctcagcaatggtatct

SEQ ID NO: 98467 - DNA, 21 bp, Artificial sequence
  SiRNA target sequence
attcctcagcaatggtatctg

SEQ ID NO: 98468 - DNA, 21 bp, Artificial sequence
  SiRNA target sequence
ttcctcagcaatggtatctgt

SEQ ID NO: 98469 - DNA, 21 bp, Artificial sequence
  SiRNA target sequence
tcctcagcaatggtatctgtg

SEQ ID NO: 98470 - DNA, 21 bp, Artificial sequence
  SiRNA target sequence
cctcagcaatggtatctgtga

SEQ ID NO: 98471 - DNA, 21 bp, Artificial sequence
  SiRNA target sequence
ctcagcaatggtatctgtgat

SEQ ID NO: 98472 - DNA, 21 bp, Artificial sequence
  SiRNA target sequence
tcagcaatggtatctgtgata

SEQ ID NO: 98473 - DNA, 21 bp, Artificial sequence
  SiRNA target sequence
cagcaatggtatctgtgataa

SEQ ID NO: 98474 - DNA, 21 bp, Artificial sequence
  SiRNA target sequence
agcaatggtatctgtgataag

SEQ ID NO: 98475 - DNA, 21 bp, Artificial sequence
  SiRNA target sequence
gcaatggtatctgtgataagc

SEQ ID NO: 98476 - DNA, 21 bp, Artificial sequence
  SiRNA target sequence
caatggtatctgtgataagcg

SEQ ID NO: 98477 - DNA, 21 bp, Artificial sequence
  SiRNA target sequence
aatggtatctgtgataagcga

SEQ ID NO: 98478 - DNA, 21 bp, Artificial sequence
  SiRNA target sequence
atggtatctgtgataagcgaa

SEQ ID NO: 98479 - DNA, 21 bp, Artificial sequence
  SiRNA target sequence
tggtatctgtgataagcgaaa

SEQ ID NO: 98480 - DNA, 21 bp, Artificial sequence
  SiRNA target sequence
ggtatctgtgataagcgaaag

SEQ ID NO: 98481 - DNA, 21 bp, Artificial sequence
  SiRNA target sequence
gtatctgtgataagcgaaagt

SEQ ID NO: 98482 - DNA, 21 bp, Artificial sequence
  SiRNA target sequence
tatctgtgataagcgaaagtt

SEQ ID NO: 98483 - DNA, 21 bp, Artificial sequence
  SiRNA target sequence
atctgtgataagcgaaagttg

SEQ ID NO: 98484 - DNA, 21 bp, Artificial sequence
  SiRNA target sequence
tctgtgataagcgaaagttgt

SEQ ID NO: 98485 - DNA, 21 bp, Artificial sequence
  SiRNA target sequence
ctgtgataagcgaaagttgta

SEQ ID NO: 98486 - DNA, 21 bp, Artificial sequence
  SiRNA target sequence
tgtgataagcgaaagttgtag

SEQ ID NO: 98487 - DNA, 21 bp, Artificial sequence
  SiRNA target sequence
gtgataagcgaaagttgtaga

SEQ ID NO: 98488 - DNA, 21 bp, Artificial sequence
  SiRNA target sequence
tgataagcgaaagttgtagaa

SEQ ID NO: 98489 - DNA, 21 bp, Artificial sequence
  SiRNA target sequence
gataagcgaaagttgtagaaa

SEQ ID NO: 98490 - DNA, 21 bp, Artificial sequence
  SiRNA target sequence
ataagcgaaagttgtagaaaa

SEQ ID NO: 98491 - DNA, 21 bp, Artificial sequence
  SiRNA target sequence
taagcgaaagttgtagaaaaa

SEQ ID NO: 98492 - DNA, 21 bp, Artificial sequence
  SiRNA target sequence
aagcgaaagttgtagaaaaaa

SEQ ID NO: 98493 - DNA, 21 bp, Artificial sequence
  SiRNA target sequence
agcgaaagttgtagaaaaaaa

SEQ ID NO: 98494 - DNA, 21 bp, Artificial sequence
  SiRNA target sequence
gcgaaagttgtagaaaaaaat

SEQ ID NO: 98495 - DNA, 21 bp, Artificial sequence
  SiRNA target sequence
cgaaagttgtagaaaaaaata

SEQ ID NO: 98496 - DNA, 21 bp, Artificial sequence
  SiRNA target sequence
gaaagttgtagaaaaaaatag

SEQ ID NO: 98497 - DNA, 21 bp, Artificial sequence
  SiRNA target sequence
aaagttgtagaaaaaaataga

SEQ ID NO: 98498 - DNA, 21 bp, Artificial sequence
  SiRNA target sequence
aagttgtagaaaaaaatagat

SEQ ID NO: 98499 - DNA, 21 bp, Artificial sequence
  SiRNA target sequence
agttgtagaaaaaaatagatt

SEQ ID NO: 98500 - DNA, 21 bp, Artificial sequence
  SiRNA target sequence
gttgtagaaaaaaatagattt

SEQ ID NO: 98501 - DNA, 21 bp, Artificial sequence
  SiRNA target sequence
ttgtagaaaaaaatagatttg

SEQ ID NO: 98502 - DNA, 21 bp, Artificial sequence
  SiRNA target sequence
tgtagaaaaaaatagatttga

SEQ ID NO: 98503 - DNA, 21 bp, Artificial sequence
  SiRNA target sequence
gtagaaaaaaatagatttgag

SEQ ID NO: 98504 - DNA, 21 bp, Artificial sequence
  SiRNA target sequence
tagaaaaaaatagatttgagg

SEQ ID NO: 98505 - DNA, 21 bp, Artificial sequence
  SiRNA target sequence
agaaaaaaatagatttgagga

SEQ ID NO: 98506 - DNA, 21 bp, Artificial sequence
  SiRNA target sequence
gaaaaaaatagatttgaggaa

SEQ ID NO: 98507 - DNA, 21 bp, Artificial sequence
  SiRNA target sequence
aaaaaaatagatttgaggaat

SEQ ID NO: 98508 - DNA, 21 bp, Artificial sequence
  SiRNA target sequence
aaaaaatagatttgaggaata

SEQ ID NO: 98509 - DNA, 21 bp, Artificial sequence
  SiRNA target sequence
aaaaatagatttgaggaatag

SEQ ID NO: 98510 - DNA, 21 bp, Artificial sequence
  SiRNA target sequence
aaaatagatttgaggaataga

SEQ ID NO: 98511 - DNA, 21 bp, Artificial sequence
  SiRNA target sequence
aaatagatttgaggaatagaa

SEQ ID NO: 98512 - DNA, 21 bp, Artificial sequence
  SiRNA target sequence
aatagatttgaggaatagaat

SEQ ID NO: 98513 - DNA, 21 bp, Artificial sequence
  SiRNA target sequence
atagatttgaggaatagaatt

SEQ ID NO: 98514 - DNA, 21 bp, Artificial sequence
  SiRNA target sequence
tagatttgaggaatagaatta

SEQ ID NO: 98515 - DNA, 21 bp, Artificial sequence
  SiRNA target sequence
agatttgaggaatagaattaa

SEQ ID NO: 98516 - DNA, 21 bp, Artificial sequence
  SiRNA target sequence
gatttgaggaatagaattaaa

SEQ ID NO: 98517 - DNA, 21 bp, Artificial sequence
  SiRNA target sequence
atttgaggaatagaattaaaa

SEQ ID NO: 98518 - DNA, 21 bp, Artificial sequence
  SiRNA target sequence
tttgaggaatagaattaaaat

SEQ ID NO: 98519 - DNA, 21 bp, Artificial sequence
  SiRNA target sequence
ttgaggaatagaattaaaatc

SEQ ID NO: 98520 - DNA, 21 bp, Artificial sequence
  SiRNA target sequence
tgaggaatagaattaaaatca

SEQ ID NO: 98521 - DNA, 21 bp, Artificial sequence
  SiRNA target sequence
gaggaatagaattaaaatcac

SEQ ID NO: 98522 - DNA, 21 bp, Artificial sequence
  SiRNA target sequence
aggaatagaattaaaatcaca

SEQ ID NO: 98523 - DNA, 21 bp, Artificial sequence
  SiRNA target sequence
ggaatagaattaaaatcacaa

SEQ ID NO: 98524 - DNA, 21 bp, Artificial sequence
  SiRNA target sequence
gaatagaattaaaatcacaat

SEQ ID NO: 98525 - DNA, 21 bp, Artificial sequence
  SiRNA target sequence
aatagaattaaaatcacaata

SEQ ID NO: 98526 - DNA, 21 bp, Artificial sequence
  SiRNA target sequence
atagaattaaaatcacaatat

SEQ ID NO: 98527 - DNA, 21 bp, Artificial sequence
  SiRNA target sequence
tagaattaaaatcacaatatt

SEQ ID NO: 98528 - DNA, 21 bp, Artificial sequence
  SiRNA target sequence
agaattaaaatcacaatattt

SEQ ID NO: 98529 - DNA, 21 bp, Artificial sequence
  SiRNA target sequence
gaattaaaatcacaatatttt

SEQ ID NO: 98530 - DNA, 21 bp, Artificial sequence
  SiRNA target sequence
aattaaaatcacaatattttt

SEQ ID NO: 98531 - DNA, 21 bp, Artificial sequence
  SiRNA target sequence
attaaaatcacaatatttttt

SEQ ID NO: 98532 - DNA, 21 bp, Artificial sequence
  SiRNA target sequence
ttaaaatcacaatatttttta

SEQ ID NO: 98533 - DNA, 21 bp, Artificial sequence
  SiRNA target sequence
taaaatcacaatattttttaa

SEQ ID NO: 98534 - DNA, 21 bp, Artificial sequence
  SiRNA target sequence
aaaatcacaatattttttaat

SEQ ID NO: 98535 - DNA, 21 bp, Artificial sequence
  SiRNA target sequence
aaatcacaatattttttaata

SEQ ID NO: 98536 - DNA, 21 bp, Artificial sequence
  SiRNA target sequence
aatcacaatattttttaatat

SEQ ID NO: 98537 - DNA, 21 bp, Artificial sequence
  SiRNA target sequence
atcacaatattttttaatata

SEQ ID NO: 98538 - DNA, 21 bp, Artificial sequence
  SiRNA target sequence
tcacaatattttttaatatat

SEQ ID NO: 98539 - DNA, 21 bp, Artificial sequence
  SiRNA target sequence
cacaatattttttaatatatt

SEQ ID NO: 98540 - DNA, 21 bp, Artificial sequence
  SiRNA target sequence
acaatattttttaatatattt

SEQ ID NO: 98541 - DNA, 21 bp, Artificial sequence
  SiRNA target sequence
caatattttttaatatattta

SEQ ID NO: 98542 - DNA, 21 bp, Artificial sequence
  SiRNA target sequence
aatattttttaatatatttaa

SEQ ID NO: 98543 - DNA, 21 bp, Artificial sequence
  SiRNA target sequence
atattttttaatatatttaac

SEQ ID NO: 98544 - DNA, 21 bp, Artificial sequence
  SiRNA target sequence
tattttttaatatatttaacc

SEQ ID NO: 98545 - DNA, 21 bp, Artificial sequence
  SiRNA target sequence
attttttaatatatttaacca

SEQ ID NO: 98546 - DNA, 21 bp, Artificial sequence
  SiRNA target sequence
ttttttaatatatttaaccaa

SEQ ID NO: 98547 - DNA, 21 bp, Artificial sequence
  SiRNA target sequence
tttttaatatatttaaccaag

SEQ ID NO: 98548 - DNA, 21 bp, Artificial sequence
  SiRNA target sequence
ttttaatatatttaaccaagg

SEQ ID NO: 98549 - DNA, 21 bp, Artificial sequence
  SiRNA target sequence
tttaatatatttaaccaaggt

SEQ ID NO: 98550 - DNA, 21 bp, Artificial sequence
  SiRNA target sequence
ttaatatatttaaccaaggta

SEQ ID NO: 98551 - DNA, 21 bp, Artificial sequence
  SiRNA target sequence
taatatatttaaccaaggtat

SEQ ID NO: 98552 - DNA, 21 bp, Artificial sequence
  SiRNA target sequence
aatatatttaaccaaggtatt

SEQ ID NO: 98553 - DNA, 21 bp, Artificial sequence
  SiRNA target sequence
atatatttaaccaaggtattg

SEQ ID NO: 98554 - DNA, 21 bp, Artificial sequence
  SiRNA target sequence
tatatttaaccaaggtattgt

SEQ ID NO: 98555 - DNA, 21 bp, Artificial sequence
  SiRNA target sequence
atatttaaccaaggtattgtc

SEQ ID NO: 98556 - DNA, 21 bp, Artificial sequence
  SiRNA target sequence
tatttaaccaaggtattgtcc

SEQ ID NO: 98557 - DNA, 21 bp, Artificial sequence
  SiRNA target sequence
atttaaccaaggtattgtcct

SEQ ID NO: 98558 - DNA, 21 bp, Artificial sequence
  SiRNA target sequence
tttaaccaaggtattgtcctt

SEQ ID NO: 98559 - DNA, 21 bp, Artificial sequence
  SiRNA target sequence
ttaaccaaggtattgtccttt

SEQ ID NO: 98560 - DNA, 21 bp, Artificial sequence
  SiRNA target sequence
taaccaaggtattgtccttta

SEQ ID NO: 98561 - DNA, 21 bp, Artificial sequence
  SiRNA target sequence
aaccaaggtattgtcctttat

SEQ ID NO: 98562 - DNA, 21 bp, Artificial sequence
  SiRNA target sequence
accaaggtattgtcctttatg

SEQ ID NO: 98563 - DNA, 21 bp, Artificial sequence
  SiRNA target sequence
ccaaggtattgtcctttatgt

SEQ ID NO: 98564 - DNA, 21 bp, Artificial sequence
  SiRNA target sequence
caaggtattgtcctttatgtt

SEQ ID NO: 98565 - DNA, 21 bp, Artificial sequence
  SiRNA target sequence
aaggtattgtcctttatgtta

SEQ ID NO: 98566 - DNA, 21 bp, Artificial sequence
  SiRNA target sequence
aggtattgtcctttatgttat

SEQ ID NO: 98567 - DNA, 21 bp, Artificial sequence
  SiRNA target sequence
ggtattgtcctttatgttatt

SEQ ID NO: 98568 - DNA, 21 bp, Artificial sequence
  SiRNA target sequence
gtattgtcctttatgttatta

SEQ ID NO: 98569 - DNA, 21 bp, Artificial sequence
  SiRNA target sequence
tattgtcctttatgttattat

SEQ ID NO: 98570 - DNA, 21 bp, Artificial sequence
  SiRNA target sequence
attgtcctttatgttattata

SEQ ID NO: 98571 - DNA, 21 bp, Artificial sequence
  SiRNA target sequence
ttgtcctttatgttattatat

SEQ ID NO: 98572 - DNA, 21 bp, Artificial sequence
  SiRNA target sequence
tgtcctttatgttattatatc

SEQ ID NO: 98573 - DNA, 21 bp, Artificial sequence
  SiRNA target sequence
gtcctttatgttattatatct

SEQ ID NO: 98574 - DNA, 21 bp, Artificial sequence
  SiRNA target sequence
tcctttatgttattatatctt

SEQ ID NO: 98575 - DNA, 21 bp, Artificial sequence
  SiRNA target sequence
cctttatgttattatatctta

SEQ ID NO: 98576 - DNA, 21 bp, Artificial sequence
  SiRNA target sequence
ctttatgttattatatcttac

SEQ ID NO: 98577 - DNA, 21 bp, Artificial sequence
  SiRNA target sequence
tttatgttattatatcttaca

SEQ ID NO: 98578 - DNA, 21 bp, Artificial sequence
  SiRNA target sequence
ttatgttattatatcttacaa

SEQ ID NO: 98579 - DNA, 21 bp, Artificial sequence
  SiRNA target sequence
tatgttattatatcttacaaa

SEQ ID NO: 98580 - DNA, 21 bp, Artificial sequence
  SiRNA target sequence
atgttattatatcttacaaac

SEQ ID NO: 98581 - DNA, 21 bp, Artificial sequence
  SiRNA target sequence
tgttattatatcttacaaact

SEQ ID NO: 98582 - DNA, 21 bp, Artificial sequence
  SiRNA target sequence
gttattatatcttacaaactc

SEQ ID NO: 98583 - DNA, 21 bp, Artificial sequence
  SiRNA target sequence
ttattatatcttacaaactcc

SEQ ID NO: 98584 - DNA, 21 bp, Artificial sequence
  SiRNA target sequence
tattatatcttacaaactcct

SEQ ID NO: 98585 - DNA, 21 bp, Artificial sequence
  SiRNA target sequence
attatatcttacaaactcctc

SEQ ID NO: 98586 - DNA, 21 bp, Artificial sequence
  SiRNA target sequence
ttatatcttacaaactcctcg

SEQ ID NO: 98587 - DNA, 21 bp, Artificial sequence
  SiRNA target sequence
tatatcttacaaactcctcgt

SEQ ID NO: 98588 - DNA, 21 bp, Artificial sequence
  SiRNA target sequence
atatcttacaaactcctcgta

SEQ ID NO: 98589 - DNA, 21 bp, Artificial sequence
  SiRNA target sequence
tatcttacaaactcctcgtaa

SEQ ID NO: 98590 - DNA, 21 bp, Artificial sequence
  SiRNA target sequence
atcttacaaactcctcgtaat

SEQ ID NO: 98591 - DNA, 21 bp, Artificial sequence
  SiRNA target sequence
tcttacaaactcctcgtaatt

SEQ ID NO: 98592 - DNA, 21 bp, Artificial sequence
  SiRNA target sequence
cttacaaactcctcgtaatta

SEQ ID NO: 98593 - DNA, 21 bp, Artificial sequence
  SiRNA target sequence
ttacaaactcctcgtaattat

SEQ ID NO: 98594 - DNA, 21 bp, Artificial sequence
  SiRNA target sequence
tacaaactcctcgtaattata

SEQ ID NO: 98595 - DNA, 21 bp, Artificial sequence
  SiRNA target sequence
acaaactcctcgtaattataa

SEQ ID NO: 98596 - DNA, 21 bp, Artificial sequence
  SiRNA target sequence
caaactcctcgtaattataat

SEQ ID NO: 98597 - DNA, 21 bp, Artificial sequence
  SiRNA target sequence
aaactcctcgtaattataatt

SEQ ID NO: 98598 - DNA, 21 bp, Artificial sequence
  SiRNA target sequence
aactcctcgtaattataattt

SEQ ID NO: 98599 - DNA, 21 bp, Artificial sequence
  SiRNA target sequence
actcctcgtaattataatttt

SEQ ID NO: 98600 - DNA, 21 bp, Artificial sequence
  SiRNA target sequence
ctcctcgtaattataattttc

SEQ ID NO: 98601 - DNA, 21 bp, Artificial sequence
  SiRNA target sequence
tcctcgtaattataattttca

SEQ ID NO: 98602 - DNA, 21 bp, Artificial sequence
  SiRNA target sequence
cctcgtaattataattttcag

SEQ ID NO: 98603 - DNA, 21 bp, Artificial sequence
  SiRNA target sequence
ctcgtaattataattttcagg

SEQ ID NO: 98604 - DNA, 21 bp, Artificial sequence
  SiRNA target sequence
tcgtaattataattttcagga

SEQ ID NO: 98605 - DNA, 21 bp, Artificial sequence
  SiRNA target sequence
cgtaattataattttcaggat

SEQ ID NO: 98606 - DNA, 21 bp, Artificial sequence
  SiRNA target sequence
gtaattataattttcaggata

SEQ ID NO: 98607 - DNA, 21 bp, Artificial sequence
  SiRNA target sequence
taattataattttcaggataa

SEQ ID NO: 98608 - DNA, 21 bp, Artificial sequence
  SiRNA target sequence
aattataattttcaggataaa

SEQ ID NO: 98609 - DNA, 21 bp, Artificial sequence
  SiRNA target sequence
attataattttcaggataaac

SEQ ID NO: 98610 - DNA, 21 bp, Artificial sequence
  SiRNA target sequence
ttataattttcaggataaacc

SEQ ID NO: 98611 - DNA, 21 bp, Artificial sequence
  SiRNA target sequence
tataattttcaggataaaccg

SEQ ID NO: 98612 - DNA, 21 bp, Artificial sequence
  SiRNA target sequence
ataattttcaggataaaccgc

SEQ ID NO: 98613 - DNA, 21 bp, Artificial sequence
  SiRNA target sequence
taattttcaggataaaccgct

SEQ ID NO: 98614 - DNA, 21 bp, Artificial sequence
  SiRNA target sequence
aattttcaggataaaccgcta

SEQ ID NO: 98615 - DNA, 21 bp, Artificial sequence
  SiRNA target sequence
attttcaggataaaccgctag

SEQ ID NO: 98616 - DNA, 21 bp, Artificial sequence
  SiRNA target sequence
ttttcaggataaaccgctaga

SEQ ID NO: 98617 - DNA, 21 bp, Artificial sequence
  SiRNA target sequence
tttcaggataaaccgctagac

SEQ ID NO: 98618 - DNA, 21 bp, Artificial sequence
  SiRNA target sequence
ttcaggataaaccgctagaca

SEQ ID NO: 98619 - DNA, 21 bp, Artificial sequence
  SiRNA target sequence
tcaggataaaccgctagacaa

SEQ ID NO: 98620 - DNA, 21 bp, Artificial sequence
  SiRNA target sequence
caggataaaccgctagacaat

SEQ ID NO: 98621 - DNA, 21 bp, Artificial sequence
  SiRNA target sequence
aggataaaccgctagacaatc

SEQ ID NO: 98622 - DNA, 21 bp, Artificial sequence
  SiRNA target sequence
ggataaaccgctagacaatca

SEQ ID NO: 98623 - DNA, 21 bp, Artificial sequence
  SiRNA target sequence
gataaaccgctagacaatcac

SEQ ID NO: 98624 - DNA, 21 bp, Artificial sequence
  SiRNA target sequence
ataaaccgctagacaatcacc

SEQ ID NO: 98625 - DNA, 21 bp, Artificial sequence
  SiRNA target sequence
taaaccgctagacaatcaccg

SEQ ID NO: 98626 - DNA, 21 bp, Artificial sequence
  SiRNA target sequence
aaaccgctagacaatcaccga

SEQ ID NO: 98627 - DNA, 21 bp, Artificial sequence
  SiRNA target sequence
aaccgctagacaatcaccgat

SEQ ID NO: 98628 - DNA, 21 bp, Artificial sequence
  SiRNA target sequence
accgctagacaatcaccgatt

SEQ ID NO: 98629 - DNA, 21 bp, Artificial sequence
  SiRNA target sequence
ccgctagacaatcaccgattt

SEQ ID NO: 98630 - DNA, 21 bp, Artificial sequence
  SiRNA target sequence
cgctagacaatcaccgatttc

SEQ ID NO: 98631 - DNA, 21 bp, Artificial sequence
  SiRNA target sequence
gctagacaatcaccgatttca

SEQ ID NO: 98632 - DNA, 21 bp, Artificial sequence
  SiRNA target sequence
ctagacaatcaccgatttcaa

SEQ ID NO: 98633 - DNA, 21 bp, Artificial sequence
  SiRNA target sequence
tagacaatcaccgatttcaaa

SEQ ID NO: 98634 - DNA, 21 bp, Artificial sequence
  SiRNA target sequence
agacaatcaccgatttcaaaa

SEQ ID NO: 98635 - DNA, 21 bp, Artificial sequence
  SiRNA target sequence
gacaatcaccgatttcaaaat

SEQ ID NO: 98636 - DNA, 21 bp, Artificial sequence
  SiRNA target sequence
acaatcaccgatttcaaaatt

SEQ ID NO: 98637 - DNA, 21 bp, Artificial sequence
  SiRNA target sequence
caatcaccgatttcaaaattt

SEQ ID NO: 98638 - DNA, 21 bp, Artificial sequence
  SiRNA target sequence
aatcaccgatttcaaaatttt

SEQ ID NO: 98639 - DNA, 21 bp, Artificial sequence
  SiRNA target sequence
atcaccgatttcaaaattttc

SEQ ID NO: 98640 - DNA, 21 bp, Artificial sequence
  SiRNA target sequence
tcaccgatttcaaaattttct

SEQ ID NO: 98641 - DNA, 21 bp, Artificial sequence
  SiRNA target sequence
caccgatttcaaaattttcta

SEQ ID NO: 98642 - DNA, 21 bp, Artificial sequence
  SiRNA target sequence
accgatttcaaaattttctat

SEQ ID NO: 98643 - DNA, 21 bp, Artificial sequence
  SiRNA target sequence
ccgatttcaaaattttctata

SEQ ID NO: 98644 - DNA, 21 bp, Artificial sequence
  SiRNA target sequence
cgatttcaaaattttctatat

SEQ ID NO: 98645 - DNA, 21 bp, Artificial sequence
  SiRNA target sequence
gatttcaaaattttctatatc

SEQ ID NO: 98646 - DNA, 21 bp, Artificial sequence
  SiRNA target sequence
atttcaaaattttctatatct

SEQ ID NO: 98647 - DNA, 21 bp, Artificial sequence
  SiRNA target sequence
tttcaaaattttctatatcta

SEQ ID NO: 98648 - DNA, 21 bp, Artificial sequence
  SiRNA target sequence
ttcaaaattttctatatctat

SEQ ID NO: 98649 - DNA, 21 bp, Artificial sequence
  SiRNA target sequence
tcaaaattttctatatctata

SEQ ID NO: 98650 - DNA, 21 bp, Artificial sequence
  SiRNA target sequence
caaaattttctatatctatat

SEQ ID NO: 98651 - DNA, 21 bp, Artificial sequence
  SiRNA target sequence
aaaattttctatatctatatc

SEQ ID NO: 98652 - DNA, 21 bp, Artificial sequence
  SiRNA target sequence
aaattttctatatctatatca

SEQ ID NO: 98653 - DNA, 21 bp, Artificial sequence
  SiRNA target sequence
aattttctatatctatatcaa

SEQ ID NO: 98654 - DNA, 21 bp, Artificial sequence
  SiRNA target sequence
attttctatatctatatcaaa

SEQ ID NO: 98655 - DNA, 21 bp, Artificial sequence
  SiRNA target sequence
ttttctatatctatatcaaat

SEQ ID NO: 98656 - DNA, 21 bp, Artificial sequence
  SiRNA target sequence
tttctatatctatatcaaatt

SEQ ID NO: 98657 - DNA, 21 bp, Artificial sequence
  SiRNA target sequence
ttctatatctatatcaaattt

SEQ ID NO: 98658 - DNA, 21 bp, Artificial sequence
  SiRNA target sequence
tctatatctatatcaaatttt

SEQ ID NO: 98659 - DNA, 21 bp, Artificial sequence
  SiRNA target sequence
ctatatctatatcaaatttta

SEQ ID NO: 98660 - DNA, 21 bp, Artificial sequence
  SiRNA target sequence
tatatctatatcaaattttat

SEQ ID NO: 98661 - DNA, 21 bp, Artificial sequence
  SiRNA target sequence
atatctatatcaaattttatt

SEQ ID NO: 98662 - DNA, 21 bp, Artificial sequence
  SiRNA target sequence
tatctatatcaaattttattt

SEQ ID NO: 98663 - DNA, 21 bp, Artificial sequence
  SiRNA target sequence
atctatatcaaattttatttc

SEQ ID NO: 98664 - DNA, 21 bp, Artificial sequence
  SiRNA target sequence
tctatatcaaattttatttct

SEQ ID NO: 98665 - DNA, 21 bp, Artificial sequence
  SiRNA target sequence
ctatatcaaattttatttcta

SEQ ID NO: 98666 - DNA, 21 bp, Artificial sequence
  SiRNA target sequence
tatatcaaattttatttctaa

SEQ ID NO: 98667 - DNA, 21 bp, Artificial sequence
  SiRNA target sequence
atatcaaattttatttctaaa

SEQ ID NO: 98668 - DNA, 21 bp, Artificial sequence
  SiRNA target sequence
tatcaaattttatttctaaaa

SEQ ID NO: 98669 - DNA, 21 bp, Artificial sequence
  SiRNA target sequence
atcaaattttatttctaaaat

SEQ ID NO: 98670 - DNA, 21 bp, Artificial sequence
  SiRNA target sequence
tcaaattttatttctaaaata

SEQ ID NO: 98671 - DNA, 21 bp, Artificial sequence
  SiRNA target sequence
caaattttatttctaaaatag

SEQ ID NO: 98672 - DNA, 21 bp, Artificial sequence
  SiRNA target sequence
aaattttatttctaaaatagg

SEQ ID NO: 98673 - DNA, 21 bp, Artificial sequence
  SiRNA target sequence
aattttatttctaaaatagga

SEQ ID NO: 98674 - DNA, 21 bp, Artificial sequence
  SiRNA target sequence
attttatttctaaaataggat

SEQ ID NO: 98675 - DNA, 21 bp, Artificial sequence
  SiRNA target sequence
ttttatttctaaaataggata

SEQ ID NO: 98676 - DNA, 21 bp, Artificial sequence
  SiRNA target sequence
tttatttctaaaataggataa

SEQ ID NO: 98677 - DNA, 21 bp, Artificial sequence
  SiRNA target sequence
ttatttctaaaataggataaa

SEQ ID NO: 98678 - DNA, 21 bp, Artificial sequence
  SiRNA target sequence
tatttctaaaataggataaat

SEQ ID NO: 98679 - DNA, 21 bp, Artificial sequence
  SiRNA target sequence
atttctaaaataggataaatg

SEQ ID NO: 98680 - DNA, 21 bp, Artificial sequence
  SiRNA target sequence
tttctaaaataggataaatgt

SEQ ID NO: 98681 - DNA, 21 bp, Artificial sequence
  SiRNA target sequence
ttctaaaataggataaatgta

SEQ ID NO: 98682 - DNA, 21 bp, Artificial sequence
  SiRNA target sequence
tctaaaataggataaatgtaa

SEQ ID NO: 98683 - DNA, 21 bp, Artificial sequence
  SiRNA target sequence
ctaaaataggataaatgtaat

SEQ ID NO: 98684 - DNA, 21 bp, Artificial sequence
  SiRNA target sequence
taaaataggataaatgtaatt

SEQ ID NO: 98685 - DNA, 21 bp, Artificial sequence
  SiRNA target sequence
aaaataggataaatgtaattg

SEQ ID NO: 98686 - DNA, 21 bp, Artificial sequence
  SiRNA target sequence
aaataggataaatgtaattgt

SEQ ID NO: 98687 - DNA, 21 bp, Artificial sequence
  SiRNA target sequence
aataggataaatgtaattgta

SEQ ID NO: 98688 - DNA, 21 bp, Artificial sequence
  SiRNA target sequence
ataggataaatgtaattgtaa

SEQ ID NO: 98689 - DNA, 21 bp, Artificial sequence
  SiRNA target sequence
taggataaatgtaattgtaag

SEQ ID NO: 98690 - DNA, 21 bp, Artificial sequence
  SiRNA target sequence
aggataaatgtaattgtaagg

SEQ ID NO: 98691 - DNA, 21 bp, Artificial sequence
  SiRNA target sequence
ggataaatgtaattgtaaggt

SEQ ID NO: 98692 - DNA, 21 bp, Artificial sequence
  SiRNA target sequence
gataaatgtaattgtaaggtg

SEQ ID NO: 98693 - DNA, 21 bp, Artificial sequence
  SiRNA target sequence
ataaatgtaattgtaaggtgt

SEQ ID NO: 98694 - DNA, 21 bp, Artificial sequence
  SiRNA target sequence
taaatgtaattgtaaggtgtt

SEQ ID NO: 98695 - DNA, 21 bp, Artificial sequence
  SiRNA target sequence
aaatgtaattgtaaggtgtta

SEQ ID NO: 98696 - DNA, 21 bp, Artificial sequence
  SiRNA target sequence
aatgtaattgtaaggtgttaa

SEQ ID NO: 98697 - DNA, 21 bp, Artificial sequence
  SiRNA target sequence
atgtaattgtaaggtgttaat

SEQ ID NO: 98698 - DNA, 21 bp, Artificial sequence
  SiRNA target sequence
tgtaattgtaaggtgttaata

SEQ ID NO: 98699 - DNA, 21 bp, Artificial sequence
  SiRNA target sequence
gtaattgtaaggtgttaatat

SEQ ID NO: 98700 - DNA, 21 bp, Artificial sequence
  SiRNA target sequence
taattgtaaggtgttaatatc

SEQ ID NO: 98701 - DNA, 21 bp, Artificial sequence
  SiRNA target sequence
aattgtaaggtgttaatatct

SEQ ID NO: 98702 - DNA, 21 bp, Artificial sequence
  SiRNA target sequence
attgtaaggtgttaatatctt

SEQ ID NO: 98703 - DNA, 21 bp, Artificial sequence
  SiRNA target sequence
ttgtaaggtgttaatatctta

SEQ ID NO: 98704 - DNA, 21 bp, Artificial sequence
  SiRNA target sequence
tgtaaggtgttaatatcttaa

SEQ ID NO: 98705 - DNA, 21 bp, Artificial sequence
  SiRNA target sequence
gtaaggtgttaatatcttaat

SEQ ID NO: 98706 - DNA, 21 bp, Artificial sequence
  SiRNA target sequence
taaggtgttaatatcttaata

SEQ ID NO: 98707 - DNA, 21 bp, Artificial sequence
  SiRNA target sequence
aaggtgttaatatcttaatat

SEQ ID NO: 98708 - DNA, 21 bp, Artificial sequence
  SiRNA target sequence
aggtgttaatatcttaatatc

SEQ ID NO: 98709 - DNA, 21 bp, Artificial sequence
  SiRNA target sequence
ggtgttaatatcttaatatca

SEQ ID NO: 98710 - DNA, 21 bp, Artificial sequence
  SiRNA target sequence
gtgttaatatcttaatatcat

SEQ ID NO: 98711 - DNA, 21 bp, Artificial sequence
  SiRNA target sequence
tgttaatatcttaatatcatt

SEQ ID NO: 98712 - DNA, 21 bp, Artificial sequence
  SiRNA target sequence
gttaatatcttaatatcattt

SEQ ID NO: 98713 - DNA, 21 bp, Artificial sequence
  SiRNA target sequence
ttaatatcttaatatcattta

SEQ ID NO: 98714 - DNA, 21 bp, Artificial sequence
  SiRNA target sequence
taatatcttaatatcatttat

SEQ ID NO: 98715 - DNA, 21 bp, Artificial sequence
  SiRNA target sequence
aatatcttaatatcatttatt

SEQ ID NO: 98716 - DNA, 21 bp, Artificial sequence
  SiRNA target sequence
atatcttaatatcatttattg

SEQ ID NO: 98717 - DNA, 21 bp, Artificial sequence
  SiRNA target sequence
tatcttaatatcatttattga

SEQ ID NO: 98718 - DNA, 21 bp, Artificial sequence
  SiRNA target sequence
atcttaatatcatttattgac

SEQ ID NO: 98719 - DNA, 21 bp, Artificial sequence
  SiRNA target sequence
tcttaatatcatttattgacg

SEQ ID NO: 98720 - DNA, 21 bp, Artificial sequence
  SiRNA target sequence
cttaatatcatttattgacgc

SEQ ID NO: 98721 - DNA, 21 bp, Artificial sequence
  SiRNA target sequence
ttaatatcatttattgacgca

SEQ ID NO: 98722 - DNA, 21 bp, Artificial sequence
  SiRNA target sequence
taatatcatttattgacgcac

SEQ ID NO: 98723 - DNA, 21 bp, Artificial sequence
  SiRNA target sequence
aatatcatttattgacgcact

SEQ ID NO: 98724 - DNA, 21 bp, Artificial sequence
  SiRNA target sequence
atatcatttattgacgcactg

SEQ ID NO: 98725 - DNA, 21 bp, Artificial sequence
  SiRNA target sequence
tatcatttattgacgcactgt

SEQ ID NO: 98726 - DNA, 21 bp, Artificial sequence
  SiRNA target sequence
atcatttattgacgcactgta

SEQ ID NO: 98727 - DNA, 21 bp, Artificial sequence
  SiRNA target sequence
tcatttattgacgcactgtat

SEQ ID NO: 98728 - DNA, 21 bp, Artificial sequence
  SiRNA target sequence
catttattgacgcactgtata

SEQ ID NO: 98729 - DNA, 21 bp, Artificial sequence
  SiRNA target sequence
atttattgacgcactgtataa

SEQ ID NO: 98730 - DNA, 21 bp, Artificial sequence
  SiRNA target sequence
tttattgacgcactgtataaa

SEQ ID NO: 98731 - DNA, 21 bp, Artificial sequence
  SiRNA target sequence
ttattgacgcactgtataaat

SEQ ID NO: 98732 - DNA, 21 bp, Artificial sequence
  SiRNA target sequence
tattgacgcactgtataaatc

SEQ ID NO: 98733 - DNA, 21 bp, Artificial sequence
  SiRNA target sequence
attgacgcactgtataaatca

SEQ ID NO: 98734 - DNA, 21 bp, Artificial sequence
  SiRNA target sequence
ttgacgcactgtataaatcat

SEQ ID NO: 98735 - DNA, 21 bp, Artificial sequence
  SiRNA target sequence
tgacgcactgtataaatcatt

SEQ ID NO: 98736 - DNA, 21 bp, Artificial sequence
  SiRNA target sequence
gacgcactgtataaatcattt

SEQ ID NO: 98737 - DNA, 21 bp, Artificial sequence
  SiRNA target sequence
acgcactgtataaatcatttt

SEQ ID NO: 98738 - DNA, 21 bp, Artificial sequence
  SiRNA target sequence
cgcactgtataaatcattttt

SEQ ID NO: 98739 - DNA, 21 bp, Artificial sequence
  SiRNA target sequence
gcactgtataaatcattttta

SEQ ID NO: 98740 - DNA, 21 bp, Artificial sequence
  SiRNA target sequence
cactgtataaatcatttttac

SEQ ID NO: 98741 - DNA, 21 bp, Artificial sequence
  SiRNA target sequence
actgtataaatcatttttaca

SEQ ID NO: 98742 - DNA, 21 bp, Artificial sequence
  SiRNA target sequence
ctgtataaatcatttttacaa

SEQ ID NO: 98743 - DNA, 21 bp, Artificial sequence
  SiRNA target sequence
tgtataaatcatttttacaac

SEQ ID NO: 98744 - DNA, 21 bp, Artificial sequence
  SiRNA target sequence
gtataaatcatttttacaact

SEQ ID NO: 98745 - DNA, 21 bp, Artificial sequence
  SiRNA target sequence
tataaatcatttttacaactt

SEQ ID NO: 98746 - DNA, 21 bp, Artificial sequence
  SiRNA target sequence
ataaatcatttttacaacttg

SEQ ID NO: 98747 - DNA, 21 bp, Artificial sequence
  SiRNA target sequence
taaatcatttttacaacttgc

SEQ ID NO: 98748 - DNA, 21 bp, Artificial sequence
  SiRNA target sequence
aaatcatttttacaacttgca

SEQ ID NO: 98749 - DNA, 21 bp, Artificial sequence
  SiRNA target sequence
aatcatttttacaacttgcaa

SEQ ID NO: 98750 - DNA, 21 bp, Artificial sequence
  SiRNA target sequence
atcatttttacaacttgcaaa

SEQ ID NO: 98751 - DNA, 21 bp, Artificial sequence
  SiRNA target sequence
tcatttttacaacttgcaaaa

SEQ ID NO: 98752 - DNA, 21 bp, Artificial sequence
  SiRNA target sequence
catttttacaacttgcaaaat

SEQ ID NO: 98753 - DNA, 21 bp, Artificial sequence
  SiRNA target sequence
atttttacaacttgcaaaatt

SEQ ID NO: 98754 - DNA, 21 bp, Artificial sequence
  SiRNA target sequence
tttttacaacttgcaaaattt

SEQ ID NO: 98755 - DNA, 21 bp, Artificial sequence
  SiRNA target sequence
ttttacaacttgcaaaatttt

SEQ ID NO: 98756 - DNA, 21 bp, Artificial sequence
  SiRNA target sequence
tttacaacttgcaaaattttt

SEQ ID NO: 98757 - DNA, 21 bp, Artificial sequence
  SiRNA target sequence
ttacaacttgcaaaattttta

SEQ ID NO: 98758 - DNA, 21 bp, Artificial sequence
  SiRNA target sequence
tacaacttgcaaaatttttag

SEQ ID NO: 98759 - DNA, 21 bp, Artificial sequence
  SiRNA target sequence
acaacttgcaaaatttttagc

SEQ ID NO: 98760 - DNA, 21 bp, Artificial sequence
  SiRNA target sequence
caacttgcaaaatttttagca

SEQ ID NO: 98761 - DNA, 21 bp, Artificial sequence
  SiRNA target sequence
aacttgcaaaatttttagcat

SEQ ID NO: 98762 - DNA, 21 bp, Artificial sequence
  SiRNA target sequence
acttgcaaaatttttagcatt

SEQ ID NO: 98763 - DNA, 21 bp, Artificial sequence
  SiRNA target sequence
cttgcaaaatttttagcattt

SEQ ID NO: 98764 - DNA, 21 bp, Artificial sequence
  SiRNA target sequence
ttgcaaaatttttagcatttt

SEQ ID NO: 98765 - DNA, 21 bp, Artificial sequence
  SiRNA target sequence
tgcaaaatttttagcattttg

SEQ ID NO: 98766 - DNA, 21 bp, Artificial sequence
  SiRNA target sequence
gcaaaatttttagcattttgt

SEQ ID NO: 98767 - DNA, 21 bp, Artificial sequence
  SiRNA target sequence
caaaatttttagcattttgta

SEQ ID NO: 98768 - DNA, 21 bp, Artificial sequence
  SiRNA target sequence
aaaatttttagcattttgtag

SEQ ID NO: 98769 - DNA, 21 bp, Artificial sequence
  SiRNA target sequence
aaatttttagcattttgtagt

SEQ ID NO: 98770 - DNA, 21 bp, Artificial sequence
  SiRNA target sequence
aatttttagcattttgtagtt

SEQ ID NO: 98771 - DNA, 21 bp, Artificial sequence
  SiRNA target sequence
atttttagcattttgtagttt

SEQ ID NO: 98772 - DNA, 21 bp, Artificial sequence
  SiRNA target sequence
tttttagcattttgtagtttg

SEQ ID NO: 98773 - DNA, 21 bp, Artificial sequence
  SiRNA target sequence
ttttagcattttgtagtttgt

SEQ ID NO: 98774 - DNA, 21 bp, Artificial sequence
  SiRNA target sequence
tttagcattttgtagtttgta

SEQ ID NO: 98775 - DNA, 21 bp, Artificial sequence
  SiRNA target sequence
ttagcattttgtagtttgtaa

SEQ ID NO: 98776 - DNA, 21 bp, Artificial sequence
  SiRNA target sequence
tagcattttgtagtttgtaat

SEQ ID NO: 98777 - DNA, 21 bp, Artificial sequence
  SiRNA target sequence
agcattttgtagtttgtaatg

SEQ ID NO: 98778 - DNA, 21 bp, Artificial sequence
  SiRNA target sequence
gcattttgtagtttgtaatgc

SEQ ID NO: 98779 - DNA, 21 bp, Artificial sequence
  SiRNA target sequence
cattttgtagtttgtaatgcg

SEQ ID NO: 98780 - DNA, 21 bp, Artificial sequence
  SiRNA target sequence
attttgtagtttgtaatgcgg

SEQ ID NO: 98781 - DNA, 21 bp, Artificial sequence
  SiRNA target sequence
ttttgtagtttgtaatgcggt

SEQ ID NO: 98782 - DNA, 21 bp, Artificial sequence
  SiRNA target sequence
tttgtagtttgtaatgcggta

SEQ ID NO: 98783 - DNA, 21 bp, Artificial sequence
  SiRNA target sequence
ttgtagtttgtaatgcggtaa

SEQ ID NO: 98784 - DNA, 21 bp, Artificial sequence
  SiRNA target sequence
tgtagtttgtaatgcggtaat

SEQ ID NO: 98785 - DNA, 21 bp, Artificial sequence
  SiRNA target sequence
gtagtttgtaatgcggtaata

SEQ ID NO: 98786 - DNA, 21 bp, Artificial sequence
  SiRNA target sequence
tagtttgtaatgcggtaatat

SEQ ID NO: 98787 - DNA, 21 bp, Artificial sequence
  SiRNA target sequence
agtttgtaatgcggtaatata

SEQ ID NO: 98788 - DNA, 21 bp, Artificial sequence
  SiRNA target sequence
gtttgtaatgcggtaatatat

SEQ ID NO: 98789 - DNA, 21 bp, Artificial sequence
  SiRNA target sequence
tttgtaatgcggtaatatata

SEQ ID NO: 98790 - DNA, 21 bp, Artificial sequence
  SiRNA target sequence
ttgtaatgcggtaatatataa

SEQ ID NO: 98791 - DNA, 21 bp, Artificial sequence
  SiRNA target sequence
tgtaatgcggtaatatataat

SEQ ID NO: 98792 - DNA, 21 bp, Artificial sequence
  SiRNA target sequence
gtaatgcggtaatatataata

SEQ ID NO: 98793 - DNA, 21 bp, Artificial sequence
  SiRNA target sequence
taatgcggtaatatataatat

SEQ ID NO: 98794 - DNA, 21 bp, Artificial sequence
  SiRNA target sequence
aatgcggtaatatataatata

SEQ ID NO: 98795 - DNA, 21 bp, Artificial sequence
  SiRNA target sequence
atgcggtaatatataatatag

SEQ ID NO: 98796 - DNA, 21 bp, Artificial sequence
  SiRNA target sequence
tgcggtaatatataatataga

SEQ ID NO: 98797 - DNA, 21 bp, Artificial sequence
  SiRNA target sequence
gcggtaatatataatatagat

SEQ ID NO: 98798 - DNA, 21 bp, Artificial sequence
  SiRNA target sequence
cggtaatatataatatagatc

SEQ ID NO: 98799 - DNA, 21 bp, Artificial sequence
  SiRNA target sequence
ggtaatatataatatagatct

SEQ ID NO: 98800 - DNA, 21 bp, Artificial sequence
  SiRNA target sequence
gtaatatataatatagatctt

SEQ ID NO: 98801 - DNA, 21 bp, Artificial sequence
  SiRNA target sequence
taatatataatatagatcttt

SEQ ID NO: 98802 - DNA, 21 bp, Artificial sequence
  SiRNA target sequence
aatatataatatagatctttt

SEQ ID NO: 98803 - DNA, 21 bp, Artificial sequence
  SiRNA target sequence
atatataatatagatctttta

SEQ ID NO: 98804 - DNA, 21 bp, Artificial sequence
  SiRNA target sequence
tatataatatagatcttttat

SEQ ID NO: 98805 - DNA, 21 bp, Artificial sequence
  SiRNA target sequence
atataatatagatcttttatc

SEQ ID NO: 98806 - DNA, 21 bp, Artificial sequence
  SiRNA target sequence
tataatatagatcttttatcc

SEQ ID NO: 98807 - DNA, 21 bp, Artificial sequence
  SiRNA target sequence
ataatatagatcttttatcca

SEQ ID NO: 98808 - DNA, 21 bp, Artificial sequence
  SiRNA target sequence
taatatagatcttttatccat

SEQ ID NO: 98809 - DNA, 21 bp, Artificial sequence
  SiRNA target sequence
aatatagatcttttatccatg

SEQ ID NO: 98810 - DNA, 21 bp, Artificial sequence
  SiRNA target sequence
atatagatcttttatccatgt

SEQ ID NO: 98811 - DNA, 21 bp, Artificial sequence
  SiRNA target sequence
tatagatcttttatccatgtc

SEQ ID NO: 98812 - DNA, 21 bp, Artificial sequence
  SiRNA target sequence
atagatcttttatccatgtct

SEQ ID NO: 98813 - DNA, 21 bp, Artificial sequence
  SiRNA target sequence
tagatcttttatccatgtctt

SEQ ID NO: 98814 - DNA, 21 bp, Artificial sequence
  SiRNA target sequence
agatcttttatccatgtctta

SEQ ID NO: 98815 - DNA, 21 bp, Artificial sequence
  SiRNA target sequence
gatcttttatccatgtcttaa

SEQ ID NO: 98816 - DNA, 21 bp, Artificial sequence
  SiRNA target sequence
atcttttatccatgtcttaaa

SEQ ID NO: 98817 - DNA, 21 bp, Artificial sequence
  SiRNA target sequence
tcttttatccatgtcttaaat

SEQ ID NO: 98818 - DNA, 21 bp, Artificial sequence
  SiRNA target sequence
cttttatccatgtcttaaatt

SEQ ID NO: 98819 - DNA, 21 bp, Artificial sequence
  SiRNA target sequence
ttttatccatgtcttaaattc

SEQ ID NO: 98820 - DNA, 21 bp, Artificial sequence
  SiRNA target sequence
tttatccatgtcttaaattcg

SEQ ID NO: 98821 - DNA, 21 bp, Artificial sequence
  SiRNA target sequence
ttatccatgtcttaaattcgc

SEQ ID NO: 98822 - DNA, 21 bp, Artificial sequence
  SiRNA target sequence
tatccatgtcttaaattcgcc

SEQ ID NO: 98823 - DNA, 21 bp, Artificial sequence
  SiRNA target sequence
atccatgtcttaaattcgccc

SEQ ID NO: 98824 - DNA, 21 bp, Artificial sequence
  SiRNA target sequence
tccatgtcttaaattcgccca

SEQ ID NO: 98825 - DNA, 21 bp, Artificial sequence
  SiRNA target sequence
ccatgtcttaaattcgcccat

SEQ ID NO: 98826 - DNA, 21 bp, Artificial sequence
  SiRNA target sequence
catgtcttaaattcgcccata

SEQ ID NO: 98827 - DNA, 21 bp, Artificial sequence
  SiRNA target sequence
atgtcttaaattcgcccataa

SEQ ID NO: 98828 - DNA, 21 bp, Artificial sequence
  SiRNA target sequence
tgtcttaaattcgcccataaa

SEQ ID NO: 98829 - DNA, 21 bp, Artificial sequence
  SiRNA target sequence
gtcttaaattcgcccataaat

SEQ ID NO: 98830 - DNA, 21 bp, Artificial sequence
  SiRNA target sequence
tcttaaattcgcccataaatc

SEQ ID NO: 98831 - DNA, 21 bp, Artificial sequence
  SiRNA target sequence
cttaaattcgcccataaatcc

SEQ ID NO: 98832 - DNA, 21 bp, Artificial sequence
  SiRNA target sequence
ttaaattcgcccataaatcct

SEQ ID NO: 98833 - DNA, 21 bp, Artificial sequence
  SiRNA target sequence
taaattcgcccataaatcctt

SEQ ID NO: 98834 - DNA, 21 bp, Artificial sequence
  SiRNA target sequence
aaattcgcccataaatccttc

SEQ ID NO: 98835 - DNA, 21 bp, Artificial sequence
  SiRNA target sequence
aattcgcccataaatccttct

SEQ ID NO: 98836 - DNA, 21 bp, Artificial sequence
  SiRNA target sequence
attcgcccataaatccttctt

SEQ ID NO: 98837 - DNA, 21 bp, Artificial sequence
  SiRNA target sequence
ttcgcccataaatccttcttt

SEQ ID NO: 98838 - DNA, 21 bp, Artificial sequence
  SiRNA target sequence
tcgcccataaatccttctttg

SEQ ID NO: 98839 - DNA, 21 bp, Artificial sequence
  SiRNA target sequence
cgcccataaatccttctttgt

SEQ ID NO: 98840 - DNA, 21 bp, Artificial sequence
  SiRNA target sequence
gcccataaatccttctttgtc

SEQ ID NO: 98841 - DNA, 21 bp, Artificial sequence
  SiRNA target sequence
cccataaatccttctttgtct

SEQ ID NO: 98842 - DNA, 21 bp, Artificial sequence
  SiRNA target sequence
ccataaatccttctttgtctt

SEQ ID NO: 98843 - DNA, 21 bp, Artificial sequence
  SiRNA target sequence
cataaatccttctttgtcttg

SEQ ID NO: 98844 - DNA, 21 bp, Artificial sequence
  SiRNA target sequence
ataaatccttctttgtcttgg

SEQ ID NO: 98845 - DNA, 21 bp, Artificial sequence
  SiRNA target sequence
taaatccttctttgtcttggc

SEQ ID NO: 98846 - DNA, 21 bp, Artificial sequence
  SiRNA target sequence
aaatccttctttgtcttggct

SEQ ID NO: 98847 - DNA, 21 bp, Artificial sequence
  SiRNA target sequence
aatccttctttgtcttggcta

SEQ ID NO: 98848 - DNA, 21 bp, Artificial sequence
  SiRNA target sequence
atccttctttgtcttggctat

SEQ ID NO: 98849 - DNA, 21 bp, Artificial sequence
  SiRNA target sequence
tccttctttgtcttggctatc

SEQ ID NO: 98850 - DNA, 21 bp, Artificial sequence
  SiRNA target sequence
ccttctttgtcttggctatct

SEQ ID NO: 98851 - DNA, 21 bp, Artificial sequence
  SiRNA target sequence
cttctttgtcttggctatctc

SEQ ID NO: 98852 - DNA, 21 bp, Artificial sequence
  SiRNA target sequence
ttctttgtcttggctatctcc

SEQ ID NO: 98853 - DNA, 21 bp, Artificial sequence
  SiRNA target sequence
tctttgtcttggctatctcca

SEQ ID NO: 98854 - DNA, 21 bp, Artificial sequence
  SiRNA target sequence
ctttgtcttggctatctccat

SEQ ID NO: 98855 - DNA, 21 bp, Artificial sequence
  SiRNA target sequence
tttgtcttggctatctccatt

SEQ ID NO: 98856 - DNA, 21 bp, Artificial sequence
  SiRNA target sequence
ttgtcttggctatctccatta

SEQ ID NO: 98857 - DNA, 21 bp, Artificial sequence
  SiRNA target sequence
tgtcttggctatctccattac

SEQ ID NO: 98858 - DNA, 21 bp, Artificial sequence
  SiRNA target sequence
gtcttggctatctccattacc

SEQ ID NO: 98859 - DNA, 21 bp, Artificial sequence
  SiRNA target sequence
tcttggctatctccattaccc

SEQ ID NO: 98860 - DNA, 21 bp, Artificial sequence
  SiRNA target sequence
cttggctatctccattaccct

SEQ ID NO: 98861 - DNA, 21 bp, Artificial sequence
  SiRNA target sequence
ttggctatctccattaccctt

SEQ ID NO: 98862 - DNA, 21 bp, Artificial sequence
  SiRNA target sequence
tggctatctccattacccttt

SEQ ID NO: 98863 - DNA, 21 bp, Artificial sequence
  SiRNA target sequence
ggctatctccattaccctttc

SEQ ID NO: 98864 - DNA, 21 bp, Artificial sequence
  SiRNA target sequence
gctatctccattaccctttct

SEQ ID NO: 98865 - DNA, 21 bp, Artificial sequence
  SiRNA target sequence
ctatctccattaccctttctt

SEQ ID NO: 98866 - DNA, 21 bp, Artificial sequence
  SiRNA target sequence
tatctccattaccctttctta

SEQ ID NO: 98867 - DNA, 21 bp, Artificial sequence
  SiRNA target sequence
atctccattaccctttcttat

SEQ ID NO: 98868 - DNA, 21 bp, Artificial sequence
  SiRNA target sequence
tctccattaccctttcttatc

SEQ ID NO: 98869 - DNA, 21 bp, Artificial sequence
  SiRNA target sequence
ctccattaccctttcttatca

SEQ ID NO: 98870 - DNA, 21 bp, Artificial sequence
  SiRNA target sequence
tccattaccctttcttatcag

SEQ ID NO: 98871 - DNA, 21 bp, Artificial sequence
  SiRNA target sequence
ccattaccctttcttatcaga

SEQ ID NO: 98872 - DNA, 21 bp, Artificial sequence
  SiRNA target sequence
cattaccctttcttatcagag

SEQ ID NO: 98873 - DNA, 21 bp, Artificial sequence
  SiRNA target sequence
attaccctttcttatcagagg

SEQ ID NO: 98874 - DNA, 21 bp, Artificial sequence
  SiRNA target sequence
ttaccctttcttatcagaggt

SEQ ID NO: 98875 - DNA, 21 bp, Artificial sequence
  SiRNA target sequence
taccctttcttatcagaggtt

SEQ ID NO: 98876 - DNA, 21 bp, Artificial sequence
  SiRNA target sequence
accctttcttatcagaggttt

SEQ ID NO: 98877 - DNA, 21 bp, Artificial sequence
  SiRNA target sequence
ccctttcttatcagaggttta

SEQ ID NO: 98878 - DNA, 21 bp, Artificial sequence
  SiRNA target sequence
cctttcttatcagaggtttag

SEQ ID NO: 98879 - DNA, 21 bp, Artificial sequence
  SiRNA target sequence
ctttcttatcagaggtttagc

SEQ ID NO: 98880 - DNA, 21 bp, Artificial sequence
  SiRNA target sequence
tttcttatcagaggtttagct

SEQ ID NO: 98881 - DNA, 21 bp, Artificial sequence
  SiRNA target sequence
ttcttatcagaggtttagctc

SEQ ID NO: 98882 - DNA, 21 bp, Artificial sequence
  SiRNA target sequence
tcttatcagaggtttagctcc

SEQ ID NO: 98883 - DNA, 21 bp, Artificial sequence
  SiRNA target sequence
cttatcagaggtttagctccg

SEQ ID NO: 98884 - DNA, 21 bp, Artificial sequence
  SiRNA target sequence
ttatcagaggtttagctccgt

SEQ ID NO: 98885 - DNA, 21 bp, Artificial sequence
  SiRNA target sequence
tatcagaggtttagctccgtg

SEQ ID NO: 98886 - DNA, 21 bp, Artificial sequence
  SiRNA target sequence
atcagaggtttagctccgtgt

SEQ ID NO: 98887 - DNA, 21 bp, Artificial sequence
  SiRNA target sequence
tcagaggtttagctccgtgtt

SEQ ID NO: 98888 - DNA, 21 bp, Artificial sequence
  SiRNA target sequence
cagaggtttagctccgtgttt

SEQ ID NO: 98889 - DNA, 21 bp, Artificial sequence
  SiRNA target sequence
agaggtttagctccgtgtttt

SEQ ID NO: 98890 - DNA, 21 bp, Artificial sequence
  SiRNA target sequence
gaggtttagctccgtgtttta

SEQ ID NO: 98891 - DNA, 21 bp, Artificial sequence
  SiRNA target sequence
aggtttagctccgtgttttaa

SEQ ID NO: 98892 - DNA, 21 bp, Artificial sequence
  SiRNA target sequence
ggtttagctccgtgttttaaa

SEQ ID NO: 98893 - DNA, 21 bp, Artificial sequence
  SiRNA target sequence
gtttagctccgtgttttaaaa

SEQ ID NO: 98894 - DNA, 21 bp, Artificial sequence
  SiRNA target sequence
tttagctccgtgttttaaaag

SEQ ID NO: 98895 - DNA, 21 bp, Artificial sequence
  SiRNA target sequence
ttagctccgtgttttaaaagg

SEQ ID NO: 98896 - DNA, 21 bp, Artificial sequence
  SiRNA target sequence
tagctccgtgttttaaaaggc

SEQ ID NO: 98897 - DNA, 21 bp, Artificial sequence
  SiRNA target sequence
agctccgtgttttaaaaggca

SEQ ID NO: 98898 - DNA, 21 bp, Artificial sequence
  SiRNA target sequence
gctccgtgttttaaaaggcaa

SEQ ID NO: 98899 - DNA, 21 bp, Artificial sequence
  SiRNA target sequence
ctccgtgttttaaaaggcaat

SEQ ID NO: 98900 - DNA, 21 bp, Artificial sequence
  SiRNA target sequence
tccgtgttttaaaaggcaatt

SEQ ID NO: 98901 - DNA, 21 bp, Artificial sequence
  SiRNA target sequence
ccgtgttttaaaaggcaatta

SEQ ID NO: 98902 - DNA, 21 bp, Artificial sequence
  SiRNA target sequence
cgtgttttaaaaggcaattat

SEQ ID NO: 98903 - DNA, 21 bp, Artificial sequence
  SiRNA target sequence
gtgttttaaaaggcaattata

SEQ ID NO: 98904 - DNA, 21 bp, Artificial sequence
  SiRNA target sequence
tgttttaaaaggcaattatac

SEQ ID NO: 98905 - DNA, 21 bp, Artificial sequence
  SiRNA target sequence
gttttaaaaggcaattataca

SEQ ID NO: 98906 - DNA, 21 bp, Artificial sequence
  SiRNA target sequence
ttttaaaaggcaattatacaa

SEQ ID NO: 98907 - DNA, 21 bp, Artificial sequence
  SiRNA target sequence
tttaaaaggcaattatacaac

SEQ ID NO: 98908 - DNA, 21 bp, Artificial sequence
  SiRNA target sequence
ttaaaaggcaattatacaact

SEQ ID NO: 98909 - DNA, 21 bp, Artificial sequence
  SiRNA target sequence
taaaaggcaattatacaactt

SEQ ID NO: 98910 - DNA, 21 bp, Artificial sequence
  SiRNA target sequence
aaaaggcaattatacaacttt

SEQ ID NO: 98911 - DNA, 21 bp, Artificial sequence
  SiRNA target sequence
aaaggcaattatacaactttt

SEQ ID NO: 98912 - DNA, 21 bp, Artificial sequence
  SiRNA target sequence
aaggcaattatacaacttttt

SEQ ID NO: 98913 - DNA, 21 bp, Artificial sequence
  SiRNA target sequence
aggcaattatacaacttttta

SEQ ID NO: 98914 - DNA, 21 bp, Artificial sequence
  SiRNA target sequence
ggcaattatacaactttttag

SEQ ID NO: 98915 - DNA, 21 bp, Artificial sequence
  SiRNA target sequence
gcaattatacaactttttaga

SEQ ID NO: 98916 - DNA, 21 bp, Artificial sequence
  SiRNA target sequence
caattatacaactttttagaa

SEQ ID NO: 98917 - DNA, 21 bp, Artificial sequence
  SiRNA target sequence
aattatacaactttttagaac

SEQ ID NO: 98918 - DNA, 21 bp, Artificial sequence
  SiRNA target sequence
attatacaactttttagaaca

SEQ ID NO: 98919 - DNA, 21 bp, Artificial sequence
  SiRNA target sequence
ttatacaactttttagaacaa

SEQ ID NO: 98920 - DNA, 21 bp, Artificial sequence
  SiRNA target sequence
tatacaactttttagaacaaa

SEQ ID NO: 98921 - DNA, 21 bp, Artificial sequence
  SiRNA target sequence
atacaactttttagaacaaaa

SEQ ID NO: 98922 - DNA, 21 bp, Artificial sequence
  SiRNA target sequence
tacaactttttagaacaaaaa

SEQ ID NO: 98923 - DNA, 21 bp, Artificial sequence
  SiRNA target sequence
acaactttttagaacaaaaat

SEQ ID NO: 98924 - DNA, 21 bp, Artificial sequence
  SiRNA target sequence
caactttttagaacaaaaatt

SEQ ID NO: 98925 - DNA, 21 bp, Artificial sequence
  SiRNA target sequence
aactttttagaacaaaaatta

SEQ ID NO: 98926 - DNA, 21 bp, Artificial sequence
  SiRNA target sequence
actttttagaacaaaaattaa

SEQ ID NO: 98927 - DNA, 21 bp, Artificial sequence
  SiRNA target sequence
ctttttagaacaaaaattaaa

SEQ ID NO: 98928 - DNA, 21 bp, Artificial sequence
  SiRNA target sequence
tttttagaacaaaaattaaaa

SEQ ID NO: 98929 - DNA, 21 bp, Artificial sequence
  SiRNA target sequence
ttttagaacaaaaattaaaag

SEQ ID NO: 98930 - DNA, 21 bp, Artificial sequence
  SiRNA target sequence
tttagaacaaaaattaaaaga

SEQ ID NO: 98931 - DNA, 21 bp, Artificial sequence
  SiRNA target sequence
ttagaacaaaaattaaaagat

SEQ ID NO: 98932 - DNA, 21 bp, Artificial sequence
  SiRNA target sequence
tagaacaaaaattaaaagatt

SEQ ID NO: 98933 - DNA, 21 bp, Artificial sequence
  SiRNA target sequence
agaacaaaaattaaaagattt

SEQ ID NO: 98934 - DNA, 21 bp, Artificial sequence
  SiRNA target sequence
gaacaaaaattaaaagattta

SEQ ID NO: 98935 - DNA, 21 bp, Artificial sequence
  SiRNA target sequence
aacaaaaattaaaagatttat

SEQ ID NO: 98936 - DNA, 21 bp, Artificial sequence
  SiRNA target sequence
acaaaaattaaaagatttata

SEQ ID NO: 98937 - DNA, 21 bp, Artificial sequence
  SiRNA target sequence
caaaaattaaaagatttataa

SEQ ID NO: 98938 - DNA, 21 bp, Artificial sequence
  SiRNA target sequence
aaaaattaaaagatttataag

SEQ ID NO: 98939 - DNA, 21 bp, Artificial sequence
  SiRNA target sequence
aaaattaaaagatttataaga

SEQ ID NO: 98940 - DNA, 21 bp, Artificial sequence
  SiRNA target sequence
aaattaaaagatttataagac

SEQ ID NO: 98941 - DNA, 21 bp, Artificial sequence
  SiRNA target sequence
aattaaaagatttataagacg

SEQ ID NO: 98942 - DNA, 21 bp, Artificial sequence
  SiRNA target sequence
attaaaagatttataagacga

SEQ ID NO: 98943 - DNA, 21 bp, Artificial sequence
  SiRNA target sequence
ttaaaagatttataagacgaa

SEQ ID NO: 98944 - DNA, 21 bp, Artificial sequence
  SiRNA target sequence
taaaagatttataagacgaat

SEQ ID NO: 98945 - DNA, 21 bp, Artificial sequence
  SiRNA target sequence
aaaagatttataagacgaatc

SEQ ID NO: 98946 - DNA, 21 bp, Artificial sequence
  SiRNA target sequence
aaagatttataagacgaatcc

SEQ ID NO: 98947 - DNA, 21 bp, Artificial sequence
  SiRNA target sequence
aagatttataagacgaatccc

SEQ ID NO: 98948 - DNA, 21 bp, Artificial sequence
  SiRNA target sequence
agatttataagacgaatcccc

SEQ ID NO: 98949 - DNA, 21 bp, Artificial sequence
  SiRNA target sequence
gatttataagacgaatcccca

SEQ ID NO: 98950 - DNA, 21 bp, Artificial sequence
  SiRNA target sequence
atttataagacgaatccccaa

SEQ ID NO: 98951 - DNA, 21 bp, Artificial sequence
  SiRNA target sequence
tttataagacgaatccccaag

SEQ ID NO: 98952 - DNA, 21 bp, Artificial sequence
  SiRNA target sequence
ttataagacgaatccccaagg

SEQ ID NO: 98953 - DNA, 21 bp, Artificial sequence
  SiRNA target sequence
tataagacgaatccccaaggc

SEQ ID NO: 98954 - DNA, 21 bp, Artificial sequence
  SiRNA target sequence
ataagacgaatccccaaggcc

SEQ ID NO: 98955 - DNA, 21 bp, Artificial sequence
  SiRNA target sequence
taagacgaatccccaaggcca

SEQ ID NO: 98956 - DNA, 21 bp, Artificial sequence
  SiRNA target sequence
aagacgaatccccaaggccaa

SEQ ID NO: 98957 - DNA, 21 bp, Artificial sequence
  SiRNA target sequence
agacgaatccccaaggccaaa

SEQ ID NO: 98958 - DNA, 21 bp, Artificial sequence
  SiRNA target sequence
gacgaatccccaaggccaaat

SEQ ID NO: 98959 - DNA, 21 bp, Artificial sequence
  SiRNA target sequence
acgaatccccaaggccaaata

SEQ ID NO: 98960 - DNA, 21 bp, Artificial sequence
  SiRNA target sequence
cgaatccccaaggccaaatac

SEQ ID NO: 98961 - DNA, 21 bp, Artificial sequence
  SiRNA target sequence
gaatccccaaggccaaataca

SEQ ID NO: 98962 - DNA, 21 bp, Artificial sequence
  SiRNA target sequence
aatccccaaggccaaatacag

SEQ ID NO: 98963 - DNA, 21 bp, Artificial sequence
  SiRNA target sequence
atccccaaggccaaatacagc

SEQ ID NO: 98964 - DNA, 21 bp, Artificial sequence
  SiRNA target sequence
tccccaaggccaaatacagca

SEQ ID NO: 98965 - DNA, 21 bp, Artificial sequence
  SiRNA target sequence
ccccaaggccaaatacagcaa

SEQ ID NO: 98966 - DNA, 21 bp, Artificial sequence
  SiRNA target sequence
cccaaggccaaatacagcaaa

SEQ ID NO: 98967 - DNA, 21 bp, Artificial sequence
  SiRNA target sequence
ccaaggccaaatacagcaaaa

SEQ ID NO: 98968 - DNA, 21 bp, Artificial sequence
  SiRNA target sequence
caaggccaaatacagcaaaat

SEQ ID NO: 98969 - DNA, 21 bp, Artificial sequence
  SiRNA target sequence
aaggccaaatacagcaaaatt

SEQ ID NO: 98970 - DNA, 21 bp, Artificial sequence
  SiRNA target sequence
aggccaaatacagcaaaattt

SEQ ID NO: 98971 - DNA, 21 bp, Artificial sequence
  SiRNA target sequence
ggccaaatacagcaaaattta

SEQ ID NO: 98972 - DNA, 21 bp, Artificial sequence
  SiRNA target sequence
gccaaatacagcaaaatttaa

SEQ ID NO: 98973 - DNA, 21 bp, Artificial sequence
  SiRNA target sequence
ccaaatacagcaaaatttaag

SEQ ID NO: 98974 - DNA, 21 bp, Artificial sequence
  SiRNA target sequence
caaatacagcaaaatttaagt

SEQ ID NO: 98975 - DNA, 21 bp, Artificial sequence
  SiRNA target sequence
aaatacagcaaaatttaagtg

SEQ ID NO: 98976 - DNA, 21 bp, Artificial sequence
  SiRNA target sequence
aatacagcaaaatttaagtgt

SEQ ID NO: 98977 - DNA, 21 bp, Artificial sequence
  SiRNA target sequence
atacagcaaaatttaagtgtt

SEQ ID NO: 98978 - DNA, 21 bp, Artificial sequence
  SiRNA target sequence
tacagcaaaatttaagtgttg

SEQ ID NO: 98979 - DNA, 21 bp, Artificial sequence
  SiRNA target sequence
acagcaaaatttaagtgttgt

SEQ ID NO: 98980 - DNA, 21 bp, Artificial sequence
  SiRNA target sequence
cagcaaaatttaagtgttgta

SEQ ID NO: 98981 - DNA, 21 bp, Artificial sequence
  SiRNA target sequence
agcaaaatttaagtgttgtaa

SEQ ID NO: 98982 - DNA, 21 bp, Artificial sequence
  SiRNA target sequence
gcaaaatttaagtgttgtaaa

SEQ ID NO: 98983 - DNA, 21 bp, Artificial sequence
  SiRNA target sequence
caaaatttaagtgttgtaaaa

SEQ ID NO: 98984 - DNA, 21 bp, Artificial sequence
  SiRNA target sequence
aaaatttaagtgttgtaaaaa

SEQ ID NO: 98985 - DNA, 21 bp, Artificial sequence
  SiRNA target sequence
aaatttaagtgttgtaaaaaa

SEQ ID NO: 98986 - DNA, 21 bp, Artificial sequence
  SiRNA target sequence
aatttaagtgttgtaaaaaat

SEQ ID NO: 98987 - DNA, 21 bp, Artificial sequence
  SiRNA target sequence
atttaagtgttgtaaaaaatt

SEQ ID NO: 98988 - DNA, 21 bp, Artificial sequence
  SiRNA target sequence
tttaagtgttgtaaaaaattt

SEQ ID NO: 98989 - DNA, 21 bp, Artificial sequence
  SiRNA target sequence
ttaagtgttgtaaaaaatttg

SEQ ID NO: 98990 - DNA, 21 bp, Artificial sequence
  SiRNA target sequence
taagtgttgtaaaaaatttgt

SEQ ID NO: 98991 - DNA, 21 bp, Artificial sequence
  SiRNA target sequence
aagtgttgtaaaaaatttgta

SEQ ID NO: 98992 - DNA, 21 bp, Artificial sequence
  SiRNA target sequence
agtgttgtaaaaaatttgtag

SEQ ID NO: 98993 - DNA, 21 bp, Artificial sequence
  SiRNA target sequence
gtgttgtaaaaaatttgtagg

SEQ ID NO: 98994 - DNA, 21 bp, Artificial sequence
  SiRNA target sequence
tgttgtaaaaaatttgtaggc

SEQ ID NO: 98995 - DNA, 21 bp, Artificial sequence
  SiRNA target sequence
gttgtaaaaaatttgtaggca

SEQ ID NO: 98996 - DNA, 21 bp, Artificial sequence
  SiRNA target sequence
ttgtaaaaaatttgtaggcag

SEQ ID NO: 98997 - DNA, 21 bp, Artificial sequence
  SiRNA target sequence
tgtaaaaaatttgtaggcaga

SEQ ID NO: 98998 - DNA, 21 bp, Artificial sequence
  SiRNA target sequence
gtaaaaaatttgtaggcagat

SEQ ID NO: 98999 - DNA, 21 bp, Artificial sequence
  SiRNA target sequence
taaaaaatttgtaggcagatt

SEQ ID NO: 99000 - DNA, 21 bp, Artificial sequence
  SiRNA target sequence
aaaaaatttgtaggcagattt

SEQ ID NO: 99001 - DNA, 21 bp, Artificial sequence
  SiRNA target sequence
aaaaatttgtaggcagatttt

SEQ ID NO: 99002 - DNA, 21 bp, Artificial sequence
  SiRNA target sequence
aaaatttgtaggcagattttt

SEQ ID NO: 99003 - DNA, 21 bp, Artificial sequence
  SiRNA target sequence
aaatttgtaggcagatttttt

SEQ ID NO: 99004 - DNA, 21 bp, Artificial sequence
  SiRNA target sequence
aatttgtaggcagattttttt

SEQ ID NO: 99005 - DNA, 21 bp, Artificial sequence
  SiRNA target sequence
atttgtaggcagatttttttt

SEQ ID NO: 99006 - DNA, 21 bp, Artificial sequence
  SiRNA target sequence
tttgtaggcagattttttttg

SEQ ID NO: 99007 - DNA, 21 bp, Artificial sequence
  SiRNA target sequence
ttgtaggcagattttttttgc

SEQ ID NO: 99008 - DNA, 21 bp, Artificial sequence
  SiRNA target sequence
tgtaggcagattttttttgcg

SEQ ID NO: 99009 - DNA, 21 bp, Artificial sequence
  SiRNA target sequence
gtaggcagattttttttgcgc

SEQ ID NO: 99010 - DNA, 21 bp, Artificial sequence
  SiRNA target sequence
taggcagattttttttgcgca

SEQ ID NO: 99011 - DNA, 21 bp, Artificial sequence
  SiRNA target sequence
aggcagattttttttgcgcaa

SEQ ID NO: 99012 - DNA, 21 bp, Artificial sequence
  SiRNA target sequence
ggcagattttttttgcgcaaa

SEQ ID NO: 99013 - DNA, 21 bp, Artificial sequence
  SiRNA target sequence
gcagattttttttgcgcaaaa

SEQ ID NO: 99014 - DNA, 21 bp, Artificial sequence
  SiRNA target sequence
cagattttttttgcgcaaaaa

SEQ ID NO: 99015 - DNA, 21 bp, Artificial sequence
  SiRNA target sequence
agattttttttgcgcaaaaat

SEQ ID NO: 99016 - DNA, 21 bp, Artificial sequence
  SiRNA target sequence
gattttttttgcgcaaaaatt

SEQ ID NO: 99017 - DNA, 21 bp, Artificial sequence
  SiRNA target sequence
attttttttgcgcaaaaattt

SEQ ID NO: 99018 - DNA, 21 bp, Artificial sequence
  SiRNA target sequence
ttttttttgcgcaaaaatttc

SEQ ID NO: 99019 - DNA, 21 bp, Artificial sequence
  SiRNA target sequence
tttttttgcgcaaaaatttcc

SEQ ID NO: 99020 - DNA, 21 bp, Artificial sequence
  SiRNA target sequence
ttttttgcgcaaaaatttcca

SEQ ID NO: 99021 - DNA, 21 bp, Artificial sequence
  SiRNA target sequence
tttttgcgcaaaaatttccaa

SEQ ID NO: 99022 - DNA, 21 bp, Artificial sequence
  SiRNA target sequence
ttttgcgcaaaaatttccaaa

SEQ ID NO: 99023 - DNA, 21 bp, Artificial sequence
  SiRNA target sequence
tttgcgcaaaaatttccaaaa

SEQ ID NO: 99024 - DNA, 21 bp, Artificial sequence
  SiRNA target sequence
ttgcgcaaaaatttccaaaat

SEQ ID NO: 99025 - DNA, 21 bp, Artificial sequence
  SiRNA target sequence
tgcgcaaaaatttccaaaatt

SEQ ID NO: 99026 - DNA, 21 bp, Artificial sequence
  SiRNA target sequence
gcgcaaaaatttccaaaattt

SEQ ID NO: 99027 - DNA, 21 bp, Artificial sequence
  SiRNA target sequence
cgcaaaaatttccaaaattta

SEQ ID NO: 99028 - DNA, 21 bp, Artificial sequence
  SiRNA target sequence
gcaaaaatttccaaaatttag

SEQ ID NO: 99029 - DNA, 21 bp, Artificial sequence
  SiRNA target sequence
caaaaatttccaaaatttagt

SEQ ID NO: 99030 - DNA, 21 bp, Artificial sequence
  SiRNA target sequence
aaaaatttccaaaatttagtc

SEQ ID NO: 99031 - DNA, 21 bp, Artificial sequence
  SiRNA target sequence
aaaatttccaaaatttagtca

SEQ ID NO: 99032 - DNA, 21 bp, Artificial sequence
  SiRNA target sequence
aaatttccaaaatttagtcat

SEQ ID NO: 99033 - DNA, 21 bp, Artificial sequence
  SiRNA target sequence
aatttccaaaatttagtcatg

SEQ ID NO: 99034 - DNA, 21 bp, Artificial sequence
  SiRNA target sequence
atttccaaaatttagtcatgt

SEQ ID NO: 99035 - DNA, 21 bp, Artificial sequence
  SiRNA target sequence
tttccaaaatttagtcatgtt

SEQ ID NO: 99036 - DNA, 21 bp, Artificial sequence
  SiRNA target sequence
ttccaaaatttagtcatgtta

SEQ ID NO: 99037 - DNA, 21 bp, Artificial sequence
  SiRNA target sequence
tccaaaatttagtcatgttaa

SEQ ID NO: 99038 - DNA, 21 bp, Artificial sequence
  SiRNA target sequence
ccaaaatttagtcatgttaaa

SEQ ID NO: 99039 - DNA, 21 bp, Artificial sequence
  SiRNA target sequence
caaaatttagtcatgttaaaa

SEQ ID NO: 99040 - DNA, 21 bp, Artificial sequence
  SiRNA target sequence
aaaatttagtcatgttaaaag

SEQ ID NO: 99041 - DNA, 21 bp, Artificial sequence
  SiRNA target sequence
aaatttagtcatgttaaaagg

SEQ ID NO: 99042 - DNA, 21 bp, Artificial sequence
  SiRNA target sequence
aatttagtcatgttaaaaggt

SEQ ID NO: 99043 - DNA, 21 bp, Artificial sequence
  SiRNA target sequence
atttagtcatgttaaaaggtt

SEQ ID NO: 99044 - DNA, 21 bp, Artificial sequence
  SiRNA target sequence
tttagtcatgttaaaaggttc

SEQ ID NO: 99045 - DNA, 21 bp, Artificial sequence
  SiRNA target sequence
ttagtcatgttaaaaggttca

SEQ ID NO: 99046 - DNA, 21 bp, Artificial sequence
  SiRNA target sequence
tagtcatgttaaaaggttcag

SEQ ID NO: 99047 - DNA, 21 bp, Artificial sequence
  SiRNA target sequence
agtcatgttaaaaggttcaga

SEQ ID NO: 99048 - DNA, 21 bp, Artificial sequence
  SiRNA target sequence
gtcatgttaaaaggttcagaa

SEQ ID NO: 99049 - DNA, 21 bp, Artificial sequence
  SiRNA target sequence
tcatgttaaaaggttcagaac

SEQ ID NO: 99050 - DNA, 21 bp, Artificial sequence
  SiRNA target sequence
catgttaaaaggttcagaacc

SEQ ID NO: 99051 - DNA, 21 bp, Artificial sequence
  SiRNA target sequence
atgttaaaaggttcagaacca

SEQ ID NO: 99052 - DNA, 21 bp, Artificial sequence
  SiRNA target sequence
tgttaaaaggttcagaaccat

SEQ ID NO: 99053 - DNA, 21 bp, Artificial sequence
  SiRNA target sequence
gttaaaaggttcagaaccatt

SEQ ID NO: 99054 - DNA, 21 bp, Artificial sequence
  SiRNA target sequence
ttaaaaggttcagaaccattc

SEQ ID NO: 99055 - DNA, 21 bp, Artificial sequence
  SiRNA target sequence
taaaaggttcagaaccattcc

SEQ ID NO: 99056 - DNA, 21 bp, Artificial sequence
  SiRNA target sequence
aaaaggttcagaaccattccc

SEQ ID NO: 99057 - DNA, 21 bp, Artificial sequence
  SiRNA target sequence
aaaggttcagaaccattccca

SEQ ID NO: 99058 - DNA, 21 bp, Artificial sequence
  SiRNA target sequence
aaggttcagaaccattcccat

SEQ ID NO: 99059 - DNA, 21 bp, Artificial sequence
  SiRNA target sequence
aggttcagaaccattcccatg

SEQ ID NO: 99060 - DNA, 21 bp, Artificial sequence
  SiRNA target sequence
ggttcagaaccattcccatga

SEQ ID NO: 99061 - DNA, 21 bp, Artificial sequence
  SiRNA target sequence
gttcagaaccattcccatgag

SEQ ID NO: 99062 - DNA, 21 bp, Artificial sequence
  SiRNA target sequence
ttcagaaccattcccatgagt

SEQ ID NO: 99063 - DNA, 21 bp, Artificial sequence
  SiRNA target sequence
tcagaaccattcccatgagtc

SEQ ID NO: 99064 - DNA, 21 bp, Artificial sequence
  SiRNA target sequence
cagaaccattcccatgagtcg

SEQ ID NO: 99065 - DNA, 21 bp, Artificial sequence
  SiRNA target sequence
agaaccattcccatgagtcga

SEQ ID NO: 99066 - DNA, 21 bp, Artificial sequence
  SiRNA target sequence
gaaccattcccatgagtcgaa

SEQ ID NO: 99067 - DNA, 21 bp, Artificial sequence
  SiRNA target sequence
aaccattcccatgagtcgaac

SEQ ID NO: 99068 - DNA, 21 bp, Artificial sequence
  SiRNA target sequence
accattcccatgagtcgaaca

SEQ ID NO: 99069 - DNA, 21 bp, Artificial sequence
  SiRNA target sequence
ccattcccatgagtcgaacat

SEQ ID NO: 99070 - DNA, 21 bp, Artificial sequence
  SiRNA target sequence
cattcccatgagtcgaacata

SEQ ID NO: 99071 - DNA, 21 bp, Artificial sequence
  SiRNA target sequence
attcccatgagtcgaacatac

SEQ ID NO: 99072 - DNA, 21 bp, Artificial sequence
  SiRNA target sequence
ttcccatgagtcgaacataca

SEQ ID NO: 99073 - DNA, 21 bp, Artificial sequence
  SiRNA target sequence
tcccatgagtcgaacatacaa

SEQ ID NO: 99074 - DNA, 21 bp, Artificial sequence
  SiRNA target sequence
cccatgagtcgaacatacaaa

SEQ ID NO: 99075 - DNA, 21 bp, Artificial sequence
  SiRNA target sequence
ccatgagtcgaacatacaaat

SEQ ID NO: 99076 - DNA, 21 bp, Artificial sequence
  SiRNA target sequence
catgagtcgaacatacaaata

SEQ ID NO: 99077 - DNA, 21 bp, Artificial sequence
  SiRNA target sequence
atgagtcgaacatacaaatat

SEQ ID NO: 99078 - DNA, 21 bp, Artificial sequence
  SiRNA target sequence
tgagtcgaacatacaaatata

SEQ ID NO: 99079 - DNA, 21 bp, Artificial sequence
  SiRNA target sequence
gagtcgaacatacaaatataa

SEQ ID NO: 99080 - DNA, 21 bp, Artificial sequence
  SiRNA target sequence
agtcgaacatacaaatataat

SEQ ID NO: 99081 - DNA, 21 bp, Artificial sequence
  SiRNA target sequence
gtcgaacatacaaatataatc

SEQ ID NO: 99082 - DNA, 21 bp, Artificial sequence
  SiRNA target sequence
tcgaacatacaaatataatca

SEQ ID NO: 99083 - DNA, 21 bp, Artificial sequence
  SiRNA target sequence
cgaacatacaaatataatcat

SEQ ID NO: 99084 - DNA, 21 bp, Artificial sequence
  SiRNA target sequence
gaacatacaaatataatcata

SEQ ID NO: 99085 - DNA, 21 bp, Artificial sequence
  SiRNA target sequence
aacatacaaatataatcatat

SEQ ID NO: 99086 - DNA, 21 bp, Artificial sequence
  SiRNA target sequence
acatacaaatataatcatatc

SEQ ID NO: 99087 - DNA, 21 bp, Artificial sequence
  SiRNA target sequence
catacaaatataatcatatca

SEQ ID NO: 99088 - DNA, 21 bp, Artificial sequence
  SiRNA target sequence
atacaaatataatcatatcaa

SEQ ID NO: 99089 - DNA, 21 bp, Artificial sequence
  SiRNA target sequence
tacaaatataatcatatcaat

SEQ ID NO: 99090 - DNA, 21 bp, Artificial sequence
  SiRNA target sequence
acaaatataatcatatcaata

SEQ ID NO: 99091 - DNA, 21 bp, Artificial sequence
  SiRNA target sequence
caaatataatcatatcaatat

SEQ ID NO: 99092 - DNA, 21 bp, Artificial sequence
  SiRNA target sequence
aaatataatcatatcaatatc

SEQ ID NO: 99093 - DNA, 21 bp, Artificial sequence
  SiRNA target sequence
aatataatcatatcaatatct

SEQ ID NO: 99094 - DNA, 21 bp, Artificial sequence
  SiRNA target sequence
atataatcatatcaatatcta

SEQ ID NO: 99095 - DNA, 21 bp, Artificial sequence
  SiRNA target sequence
tataatcatatcaatatctaa

SEQ ID NO: 99096 - DNA, 21 bp, Artificial sequence
  SiRNA target sequence
ataatcatatcaatatctaat

SEQ ID NO: 99097 - DNA, 21 bp, Artificial sequence
  SiRNA target sequence
taatcatatcaatatctaata

SEQ ID NO: 99098 - DNA, 21 bp, Artificial sequence
  SiRNA target sequence
aatcatatcaatatctaatat

SEQ ID NO: 99099 - DNA, 21 bp, Artificial sequence
  SiRNA target sequence
atcatatcaatatctaatatt

SEQ ID NO: 99100 - DNA, 21 bp, Artificial sequence
  SiRNA target sequence
tcatatcaatatctaatattt

SEQ ID NO: 99101 - DNA, 21 bp, Artificial sequence
  SiRNA target sequence
catatcaatatctaatatttt

SEQ ID NO: 99102 - DNA, 21 bp, Artificial sequence
  SiRNA target sequence
atatcaatatctaatattttt

SEQ ID NO: 99103 - DNA, 21 bp, Artificial sequence
  SiRNA target sequence
tatcaatatctaatatttttt

SEQ ID NO: 99104 - DNA, 21 bp, Artificial sequence
  SiRNA target sequence
atcaatatctaatattttttc

SEQ ID NO: 99105 - DNA, 21 bp, Artificial sequence
  SiRNA target sequence
tcaatatctaatattttttcg

SEQ ID NO: 99106 - DNA, 21 bp, Artificial sequence
  SiRNA target sequence
caatatctaatattttttcga

SEQ ID NO: 99107 - DNA, 21 bp, Artificial sequence
  SiRNA target sequence
aatatctaatattttttcgaa

SEQ ID NO: 99108 - DNA, 21 bp, Artificial sequence
  SiRNA target sequence
atatctaatattttttcgaaa

SEQ ID NO: 99109 - DNA, 21 bp, Artificial sequence
  SiRNA target sequence
tatctaatattttttcgaaat

SEQ ID NO: 99110 - DNA, 21 bp, Artificial sequence
  SiRNA target sequence
atctaatattttttcgaaatc

SEQ ID NO: 99111 - DNA, 21 bp, Artificial sequence
  SiRNA target sequence
tctaatattttttcgaaatca

SEQ ID NO: 99112 - DNA, 21 bp, Artificial sequence
  SiRNA target sequence
ctaatattttttcgaaatcaa

SEQ ID NO: 99113 - DNA, 21 bp, Artificial sequence
  SiRNA target sequence
taatattttttcgaaatcaaa

SEQ ID NO: 99114 - DNA, 21 bp, Artificial sequence
  SiRNA target sequence
aatattttttcgaaatcaaaa

SEQ ID NO: 99115 - DNA, 21 bp, Artificial sequence
  SiRNA target sequence
atattttttcgaaatcaaaac

SEQ ID NO: 99116 - DNA, 21 bp, Artificial sequence
  SiRNA target sequence
tattttttcgaaatcaaaact

SEQ ID NO: 99117 - DNA, 21 bp, Artificial sequence
  SiRNA target sequence
attttttcgaaatcaaaactg

SEQ ID NO: 99118 - DNA, 21 bp, Artificial sequence
  SiRNA target sequence
ttttttcgaaatcaaaactgt

SEQ ID NO: 99119 - DNA, 21 bp, Artificial sequence
  SiRNA target sequence
tttttcgaaatcaaaactgtc

SEQ ID NO: 99120 - DNA, 21 bp, Artificial sequence
  SiRNA target sequence
ttttcgaaatcaaaactgtcc

SEQ ID NO: 99121 - DNA, 21 bp, Artificial sequence
  SiRNA target sequence
tttcgaaatcaaaactgtcca

SEQ ID NO: 99122 - DNA, 21 bp, Artificial sequence
  SiRNA target sequence
ttcgaaatcaaaactgtccat

SEQ ID NO: 99123 - DNA, 21 bp, Artificial sequence
  SiRNA target sequence
tcgaaatcaaaactgtccata

SEQ ID NO: 99124 - DNA, 21 bp, Artificial sequence
  SiRNA target sequence
cgaaatcaaaactgtccatat

SEQ ID NO: 99125 - DNA, 21 bp, Artificial sequence
  SiRNA target sequence
gaaatcaaaactgtccatatc

SEQ ID NO: 99126 - DNA, 21 bp, Artificial sequence
  SiRNA target sequence
aaatcaaaactgtccatatct

SEQ ID NO: 99127 - DNA, 21 bp, Artificial sequence
  SiRNA target sequence
aatcaaaactgtccatatcta

SEQ ID NO: 99128 - DNA, 21 bp, Artificial sequence
  SiRNA target sequence
atcaaaactgtccatatctaa

SEQ ID NO: 99129 - DNA, 21 bp, Artificial sequence
  SiRNA target sequence
tcaaaactgtccatatctaaa

SEQ ID NO: 99130 - DNA, 21 bp, Artificial sequence
  SiRNA target sequence
caaaactgtccatatctaaag

SEQ ID NO: 99131 - DNA, 21 bp, Artificial sequence
  SiRNA target sequence
aaaactgtccatatctaaagt

SEQ ID NO: 99132 - DNA, 21 bp, Artificial sequence
  SiRNA target sequence
aaactgtccatatctaaagta

SEQ ID NO: 99133 - DNA, 21 bp, Artificial sequence
  SiRNA target sequence
aactgtccatatctaaagtaa

SEQ ID NO: 99134 - DNA, 21 bp, Artificial sequence
  SiRNA target sequence
actgtccatatctaaagtaaa

SEQ ID NO: 99135 - DNA, 21 bp, Artificial sequence
  SiRNA target sequence
ctgtccatatctaaagtaaaa

SEQ ID NO: 99136 - DNA, 21 bp, Artificial sequence
  SiRNA target sequence
tgtccatatctaaagtaaaat

SEQ ID NO: 99137 - DNA, 21 bp, Artificial sequence
  SiRNA target sequence
gtccatatctaaagtaaaatc

SEQ ID NO: 99138 - DNA, 21 bp, Artificial sequence
  SiRNA target sequence
tccatatctaaagtaaaatct

SEQ ID NO: 99139 - DNA, 21 bp, Artificial sequence
  SiRNA target sequence
ccatatctaaagtaaaatctg

SEQ ID NO: 99140 - DNA, 21 bp, Artificial sequence
  SiRNA target sequence
catatctaaagtaaaatctgt

SEQ ID NO: 99141 - DNA, 21 bp, Artificial sequence
  SiRNA target sequence
atatctaaagtaaaatctgtt

SEQ ID NO: 99142 - DNA, 21 bp, Artificial sequence
  SiRNA target sequence
tatctaaagtaaaatctgttg

SEQ ID NO: 99143 - DNA, 21 bp, Artificial sequence
  SiRNA target sequence
atctaaagtaaaatctgttgg

SEQ ID NO: 99144 - DNA, 21 bp, Artificial sequence
  SiRNA target sequence
tctaaagtaaaatctgttgga

SEQ ID NO: 99145 - DNA, 21 bp, Artificial sequence
  SiRNA target sequence
ctaaagtaaaatctgttggaa

SEQ ID NO: 99146 - DNA, 21 bp, Artificial sequence
  SiRNA target sequence
taaagtaaaatctgttggaag

SEQ ID NO: 99147 - DNA, 21 bp, Artificial sequence
  SiRNA target sequence
aaagtaaaatctgttggaagc

SEQ ID NO: 99148 - DNA, 21 bp, Artificial sequence
  SiRNA target sequence
aagtaaaatctgttggaagca

SEQ ID NO: 99149 - DNA, 21 bp, Artificial sequence
  SiRNA target sequence
agtaaaatctgttggaagcaa

SEQ ID NO: 99150 - DNA, 21 bp, Artificial sequence
  SiRNA target sequence
gtaaaatctgttggaagcaat

SEQ ID NO: 99151 - DNA, 21 bp, Artificial sequence
  SiRNA target sequence
taaaatctgttggaagcaatt

SEQ ID NO: 99152 - DNA, 21 bp, Artificial sequence
  SiRNA target sequence
aaaatctgttggaagcaattc

SEQ ID NO: 99153 - DNA, 21 bp, Artificial sequence
  SiRNA target sequence
aaatctgttggaagcaattct

SEQ ID NO: 99154 - DNA, 21 bp, Artificial sequence
  SiRNA target sequence
aatctgttggaagcaattctt

SEQ ID NO: 99155 - DNA, 21 bp, Artificial sequence
  SiRNA target sequence
atctgttggaagcaattcttt

SEQ ID NO: 99156 - DNA, 21 bp, Artificial sequence
  SiRNA target sequence
tctgttggaagcaattcttta

SEQ ID NO: 99157 - DNA, 21 bp, Artificial sequence
  SiRNA target sequence
ctgttggaagcaattctttat

SEQ ID NO: 99158 - DNA, 21 bp, Artificial sequence
  SiRNA target sequence
tgttggaagcaattctttatc

SEQ ID NO: 99159 - DNA, 21 bp, Artificial sequence
  SiRNA target sequence
gttggaagcaattctttatca

SEQ ID NO: 99160 - DNA, 21 bp, Artificial sequence
  SiRNA target sequence
ttggaagcaattctttatcaa

SEQ ID NO: 99161 - DNA, 21 bp, Artificial sequence
  SiRNA target sequence
tggaagcaattctttatcaac

SEQ ID NO: 99162 - DNA, 21 bp, Artificial sequence
  SiRNA target sequence
ggaagcaattctttatcaacg

SEQ ID NO: 99163 - DNA, 21 bp, Artificial sequence
  SiRNA target sequence
gaagcaattctttatcaacgt

SEQ ID NO: 99164 - DNA, 21 bp, Artificial sequence
  SiRNA target sequence
aagcaattctttatcaacgtt

SEQ ID NO: 99165 - DNA, 21 bp, Artificial sequence
  SiRNA target sequence
agcaattctttatcaacgtta

SEQ ID NO: 99166 - DNA, 21 bp, Artificial sequence
  SiRNA target sequence
gcaattctttatcaacgttat

SEQ ID NO: 99167 - DNA, 21 bp, Artificial sequence
  SiRNA target sequence
caattctttatcaacgttata

SEQ ID NO: 99168 - DNA, 21 bp, Artificial sequence
  SiRNA target sequence
aattctttatcaacgttataa

SEQ ID NO: 99169 - DNA, 21 bp, Artificial sequence
  SiRNA target sequence
attctttatcaacgttataaa

SEQ ID NO: 99170 - DNA, 21 bp, Artificial sequence
  SiRNA target sequence
ttctttatcaacgttataaat

SEQ ID NO: 99171 - DNA, 21 bp, Artificial sequence
  SiRNA target sequence
tctttatcaacgttataaatc

SEQ ID NO: 99172 - DNA, 21 bp, Artificial sequence
  SiRNA target sequence
ctttatcaacgttataaatca

SEQ ID NO: 99173 - DNA, 21 bp, Artificial sequence
  SiRNA target sequence
tttatcaacgttataaatcaa

SEQ ID NO: 99174 - DNA, 21 bp, Artificial sequence
  SiRNA target sequence
ttatcaacgttataaatcaaa

SEQ ID NO: 99175 - DNA, 21 bp, Artificial sequence
  SiRNA target sequence
tatcaacgttataaatcaaat

SEQ ID NO: 99176 - DNA, 21 bp, Artificial sequence
  SiRNA target sequence
atcaacgttataaatcaaatc

SEQ ID NO: 99177 - DNA, 21 bp, Artificial sequence
  SiRNA target sequence
tcaacgttataaatcaaatct

SEQ ID NO: 99178 - DNA, 21 bp, Artificial sequence
  SiRNA target sequence
caacgttataaatcaaatctt

SEQ ID NO: 99179 - DNA, 21 bp, Artificial sequence
  SiRNA target sequence
aacgttataaatcaaatcttt

SEQ ID NO: 99180 - DNA, 21 bp, Artificial sequence
  SiRNA target sequence
acgttataaatcaaatcttta

SEQ ID NO: 99181 - DNA, 21 bp, Artificial sequence
  SiRNA target sequence
cgttataaatcaaatctttat

SEQ ID NO: 99182 - DNA, 21 bp, Artificial sequence
  SiRNA target sequence
gttataaatcaaatctttatt

SEQ ID NO: 99183 - DNA, 21 bp, Artificial sequence
  SiRNA target sequence
ttataaatcaaatctttattg

SEQ ID NO: 99184 - DNA, 21 bp, Artificial sequence
  SiRNA target sequence
tataaatcaaatctttattgt

SEQ ID NO: 99185 - DNA, 21 bp, Artificial sequence
  SiRNA target sequence
ataaatcaaatctttattgta

SEQ ID NO: 99186 - DNA, 21 bp, Artificial sequence
  SiRNA target sequence
taaatcaaatctttattgtat

SEQ ID NO: 99187 - DNA, 21 bp, Artificial sequence
  SiRNA target sequence
aaatcaaatctttattgtatc

SEQ ID NO: 99188 - DNA, 21 bp, Artificial sequence
  SiRNA target sequence
aatcaaatctttattgtatcc

SEQ ID NO: 99189 - DNA, 21 bp, Artificial sequence
  SiRNA target sequence
atcaaatctttattgtatccg

SEQ ID NO: 99190 - DNA, 21 bp, Artificial sequence
  SiRNA target sequence
tcaaatctttattgtatccgt

SEQ ID NO: 99191 - DNA, 21 bp, Artificial sequence
  SiRNA target sequence
caaatctttattgtatccgta

SEQ ID NO: 99192 - DNA, 21 bp, Artificial sequence
  SiRNA target sequence
aaatctttattgtatccgtat

SEQ ID NO: 99193 - DNA, 21 bp, Artificial sequence
  SiRNA target sequence
aatctttattgtatccgtata

SEQ ID NO: 99194 - DNA, 21 bp, Artificial sequence
  SiRNA target sequence
atctttattgtatccgtatag

SEQ ID NO: 99195 - DNA, 21 bp, Artificial sequence
  SiRNA target sequence
tctttattgtatccgtatagt

SEQ ID NO: 99196 - DNA, 21 bp, Artificial sequence
  SiRNA target sequence
ctttattgtatccgtatagta

SEQ ID NO: 99197 - DNA, 21 bp, Artificial sequence
  SiRNA target sequence
tttattgtatccgtatagtat

SEQ ID NO: 99198 - DNA, 21 bp, Artificial sequence
  SiRNA target sequence
ttattgtatccgtatagtata

SEQ ID NO: 99199 - DNA, 21 bp, Artificial sequence
  SiRNA target sequence
tattgtatccgtatagtataa

SEQ ID NO: 99200 - DNA, 21 bp, Artificial sequence
  SiRNA target sequence
attgtatccgtatagtataac

SEQ ID NO: 99201 - DNA, 21 bp, Artificial sequence
  SiRNA target sequence
ttgtatccgtatagtataaca

SEQ ID NO: 99202 - DNA, 21 bp, Artificial sequence
  SiRNA target sequence
tgtatccgtatagtataacat

SEQ ID NO: 99203 - DNA, 21 bp, Artificial sequence
  SiRNA target sequence
gtatccgtatagtataacatt

SEQ ID NO: 99204 - DNA, 21 bp, Artificial sequence
  SiRNA target sequence
tatccgtatagtataacattt

SEQ ID NO: 99205 - DNA, 21 bp, Artificial sequence
  SiRNA target sequence
atccgtatagtataacatttt

SEQ ID NO: 99206 - DNA, 21 bp, Artificial sequence
  SiRNA target sequence
tccgtatagtataacattttg

SEQ ID NO: 99207 - DNA, 21 bp, Artificial sequence
  SiRNA target sequence
ccgtatagtataacattttga

SEQ ID NO: 99208 - DNA, 21 bp, Artificial sequence
  SiRNA target sequence
cgtatagtataacattttgaa

SEQ ID NO: 99209 - DNA, 21 bp, Artificial sequence
  SiRNA target sequence
gtatagtataacattttgaat

SEQ ID NO: 99210 - DNA, 21 bp, Artificial sequence
  SiRNA target sequence
tatagtataacattttgaata

SEQ ID NO: 99211 - DNA, 21 bp, Artificial sequence
  SiRNA target sequence
atagtataacattttgaataa

SEQ ID NO: 99212 - DNA, 21 bp, Artificial sequence
  SiRNA target sequence
tagtataacattttgaataag

SEQ ID NO: 99213 - DNA, 21 bp, Artificial sequence
  SiRNA target sequence
agtataacattttgaataagt

SEQ ID NO: 99214 - DNA, 21 bp, Artificial sequence
  SiRNA target sequence
gtataacattttgaataagtt

SEQ ID NO: 99215 - DNA, 21 bp, Artificial sequence
  SiRNA target sequence
tataacattttgaataagttt

SEQ ID NO: 99216 - DNA, 21 bp, Artificial sequence
  SiRNA target sequence
ataacattttgaataagttta

SEQ ID NO: 99217 - DNA, 21 bp, Artificial sequence
  SiRNA target sequence
taacattttgaataagtttag

SEQ ID NO: 99218 - DNA, 21 bp, Artificial sequence
  SiRNA target sequence
aacattttgaataagtttagc

SEQ ID NO: 99219 - DNA, 21 bp, Artificial sequence
  SiRNA target sequence
acattttgaataagtttagca

SEQ ID NO: 99220 - DNA, 21 bp, Artificial sequence
  SiRNA target sequence
cattttgaataagtttagcaa

SEQ ID NO: 99221 - DNA, 21 bp, Artificial sequence
  SiRNA target sequence
attttgaataagtttagcaat

SEQ ID NO: 99222 - DNA, 21 bp, Artificial sequence
  SiRNA target sequence
ttttgaataagtttagcaata

SEQ ID NO: 99223 - DNA, 21 bp, Artificial sequence
  SiRNA target sequence
tttgaataagtttagcaatat

SEQ ID NO: 99224 - DNA, 21 bp, Artificial sequence
  SiRNA target sequence
ttgaataagtttagcaatatg

SEQ ID NO: 99225 - DNA, 21 bp, Artificial sequence
  SiRNA target sequence
tgaataagtttagcaatatgt

SEQ ID NO: 99226 - DNA, 21 bp, Artificial sequence
  SiRNA target sequence
gaataagtttagcaatatgta

SEQ ID NO: 99227 - DNA, 21 bp, Artificial sequence
  SiRNA target sequence
aataagtttagcaatatgtat

SEQ ID NO: 99228 - DNA, 21 bp, Artificial sequence
  SiRNA target sequence
ataagtttagcaatatgtata

SEQ ID NO: 99229 - DNA, 21 bp, Artificial sequence
  SiRNA target sequence
taagtttagcaatatgtatag

SEQ ID NO: 99230 - DNA, 21 bp, Artificial sequence
  SiRNA target sequence
aagtttagcaatatgtataga

SEQ ID NO: 99231 - DNA, 21 bp, Artificial sequence
  SiRNA target sequence
agtttagcaatatgtatagaa

SEQ ID NO: 99232 - DNA, 21 bp, Artificial sequence
  SiRNA target sequence
gtttagcaatatgtatagaat

SEQ ID NO: 99233 - DNA, 21 bp, Artificial sequence
  SiRNA target sequence
tttagcaatatgtatagaatt

SEQ ID NO: 99234 - DNA, 21 bp, Artificial sequence
  SiRNA target sequence
ttagcaatatgtatagaattt

SEQ ID NO: 99235 - DNA, 21 bp, Artificial sequence
  SiRNA target sequence
tagcaatatgtatagaatttc

SEQ ID NO: 99236 - DNA, 21 bp, Artificial sequence
  SiRNA target sequence
agcaatatgtatagaatttcc

SEQ ID NO: 99237 - DNA, 21 bp, Artificial sequence
  SiRNA target sequence
gcaatatgtatagaatttcct

SEQ ID NO: 99238 - DNA, 21 bp, Artificial sequence
  SiRNA target sequence
caatatgtatagaatttcctg

SEQ ID NO: 99239 - DNA, 21 bp, Artificial sequence
  SiRNA target sequence
aatatgtatagaatttcctgt

SEQ ID NO: 99240 - DNA, 21 bp, Artificial sequence
  SiRNA target sequence
atatgtatagaatttcctgtt

SEQ ID NO: 99241 - DNA, 21 bp, Artificial sequence
  SiRNA target sequence
tatgtatagaatttcctgttt

SEQ ID NO: 99242 - DNA, 21 bp, Artificial sequence
  SiRNA target sequence
atgtatagaatttcctgtttg

SEQ ID NO: 99243 - DNA, 21 bp, Artificial sequence
  SiRNA target sequence
tgtatagaatttcctgtttgg

SEQ ID NO: 99244 - DNA, 21 bp, Artificial sequence
  SiRNA target sequence
gtatagaatttcctgtttggg

SEQ ID NO: 99245 - DNA, 21 bp, Artificial sequence
  SiRNA target sequence
tatagaatttcctgtttggga

SEQ ID NO: 99246 - DNA, 21 bp, Artificial sequence
  SiRNA target sequence
atagaatttcctgtttgggag

SEQ ID NO: 99247 - DNA, 21 bp, Artificial sequence
  SiRNA target sequence
tagaatttcctgtttgggagc

SEQ ID NO: 99248 - DNA, 21 bp, Artificial sequence
  SiRNA target sequence
agaatttcctgtttgggagcc

SEQ ID NO: 99249 - DNA, 21 bp, Artificial sequence
  SiRNA target sequence
gaatttcctgtttgggagcca

SEQ ID NO: 99250 - DNA, 21 bp, Artificial sequence
  SiRNA target sequence
aatttcctgtttgggagccat

SEQ ID NO: 99251 - DNA, 21 bp, Artificial sequence
  SiRNA target sequence
atttcctgtttgggagccata

SEQ ID NO: 99252 - DNA, 21 bp, Artificial sequence
  SiRNA target sequence
tttcctgtttgggagccatat

SEQ ID NO: 99253 - DNA, 21 bp, Artificial sequence
  SiRNA target sequence
ttcctgtttgggagccatata

SEQ ID NO: 99254 - DNA, 21 bp, Artificial sequence
  SiRNA target sequence
tcctgtttgggagccatataa

SEQ ID NO: 99255 - DNA, 21 bp, Artificial sequence
  SiRNA target sequence
cctgtttgggagccatataag

SEQ ID NO: 99256 - DNA, 21 bp, Artificial sequence
  SiRNA target sequence
ctgtttgggagccatataaga

SEQ ID NO: 99257 - DNA, 21 bp, Artificial sequence
  SiRNA target sequence
tgtttgggagccatataagat

SEQ ID NO: 99258 - DNA, 21 bp, Artificial sequence
  SiRNA target sequence
gtttgggagccatataagatt

SEQ ID NO: 99259 - DNA, 21 bp, Artificial sequence
  SiRNA target sequence
tttgggagccatataagatta

SEQ ID NO: 99260 - DNA, 21 bp, Artificial sequence
  SiRNA target sequence
ttgggagccatataagattat

SEQ ID NO: 99261 - DNA, 21 bp, Artificial sequence
  SiRNA target sequence
tgggagccatataagattatc

SEQ ID NO: 99262 - DNA, 21 bp, Artificial sequence
  SiRNA target sequence
gggagccatataagattatca

SEQ ID NO: 99263 - DNA, 21 bp, Artificial sequence
  SiRNA target sequence
ggagccatataagattatcat

SEQ ID NO: 99264 - DNA, 22 bp, Artificial sequence
  SiRNA target sequence
ttaccaagtttctgcctgaaaa

SEQ ID NO: 99265 - DNA, 22 bp, Artificial sequence
  SiRNA target sequence
taccaagtttctgcctgaaaat

SEQ ID NO: 99266 - DNA, 22 bp, Artificial sequence
  SiRNA target sequence
accaagtttctgcctgaaaata

SEQ ID NO: 99267 - DNA, 22 bp, Artificial sequence
  SiRNA target sequence
ccaagtttctgcctgaaaatat

SEQ ID NO: 99268 - DNA, 22 bp, Artificial sequence
  SiRNA target sequence
caagtttctgcctgaaaatata

SEQ ID NO: 99269 - DNA, 22 bp, Artificial sequence
  SiRNA target sequence
aagtttctgcctgaaaatatat

SEQ ID NO: 99270 - DNA, 22 bp, Artificial sequence
  SiRNA target sequence
agtttctgcctgaaaatatatt

SEQ ID NO: 99271 - DNA, 22 bp, Artificial sequence
  SiRNA target sequence
gtttctgcctgaaaatatattt

SEQ ID NO: 99272 - DNA, 22 bp, Artificial sequence
  SiRNA target sequence
tttctgcctgaaaatatatttt

SEQ ID NO: 99273 - DNA, 22 bp, Artificial sequence
  SiRNA target sequence
ttctgcctgaaaatatattttc

SEQ ID NO: 99274 - DNA, 22 bp, Artificial sequence
  SiRNA target sequence
tctgcctgaaaatatattttct

SEQ ID NO: 99275 - DNA, 22 bp, Artificial sequence
  SiRNA target sequence
ctgcctgaaaatatattttctt

SEQ ID NO: 99276 - DNA, 22 bp, Artificial sequence
  SiRNA target sequence
tgcctgaaaatatattttcttt

SEQ ID NO: 99277 - DNA, 22 bp, Artificial sequence
  SiRNA target sequence
gcctgaaaatatattttctttt

SEQ ID NO: 99278 - DNA, 22 bp, Artificial sequence
  SiRNA target sequence
cctgaaaatatattttcttttt

SEQ ID NO: 99279 - DNA, 22 bp, Artificial sequence
  SiRNA target sequence
ctgaaaatatattttcttttta

SEQ ID NO: 99280 - DNA, 22 bp, Artificial sequence
  SiRNA target sequence
tgaaaatatattttctttttat

SEQ ID NO: 99281 - DNA, 22 bp, Artificial sequence
  SiRNA target sequence
gaaaatatattttctttttata

SEQ ID NO: 99282 - DNA, 22 bp, Artificial sequence
  SiRNA target sequence
aaaatatattttctttttataa

SEQ ID NO: 99283 - DNA, 22 bp, Artificial sequence
  SiRNA target sequence
aaatatattttctttttataaa

SEQ ID NO: 99284 - DNA, 22 bp, Artificial sequence
  SiRNA target sequence
aatatattttctttttataaat

SEQ ID NO: 99285 - DNA, 22 bp, Artificial sequence
  SiRNA target sequence
atatattttctttttataaata

SEQ ID NO: 99286 - DNA, 22 bp, Artificial sequence
  SiRNA target sequence
tatattttctttttataaatat

SEQ ID NO: 99287 - DNA, 22 bp, Artificial sequence
  SiRNA target sequence
atattttctttttataaatatc

SEQ ID NO: 99288 - DNA, 22 bp, Artificial sequence
  SiRNA target sequence
tattttctttttataaatatct

SEQ ID NO: 99289 - DNA, 22 bp, Artificial sequence
  SiRNA target sequence
attttctttttataaatatcta

SEQ ID NO: 99290 - DNA, 22 bp, Artificial sequence
  SiRNA target sequence
ttttctttttataaatatctaa

SEQ ID NO: 99291 - DNA, 22 bp, Artificial sequence
  SiRNA target sequence
tttctttttataaatatctaat

SEQ ID NO: 99292 - DNA, 22 bp, Artificial sequence
  SiRNA target sequence
ttctttttataaatatctaata

SEQ ID NO: 99293 - DNA, 22 bp, Artificial sequence
  SiRNA target sequence
tctttttataaatatctaataa

SEQ ID NO: 99294 - DNA, 22 bp, Artificial sequence
  SiRNA target sequence
ctttttataaatatctaataac

SEQ ID NO: 99295 - DNA, 22 bp, Artificial sequence
  SiRNA target sequence
tttttataaatatctaataaca

SEQ ID NO: 99296 - DNA, 22 bp, Artificial sequence
  SiRNA target sequence
ttttataaatatctaataacat

SEQ ID NO: 99297 - DNA, 22 bp, Artificial sequence
  SiRNA target sequence
tttataaatatctaataacatt

SEQ ID NO: 99298 - DNA, 22 bp, Artificial sequence
  SiRNA target sequence
ttataaatatctaataacattt

SEQ ID NO: 99299 - DNA, 22 bp, Artificial sequence
  SiRNA target sequence
tataaatatctaataacatttt

SEQ ID NO: 99300 - DNA, 22 bp, Artificial sequence
  SiRNA target sequence
ataaatatctaataacattttt

SEQ ID NO: 99301 - DNA, 22 bp, Artificial sequence
  SiRNA target sequence
taaatatctaataacatttttt

SEQ ID NO: 99302 - DNA, 22 bp, Artificial sequence
  SiRNA target sequence
aaatatctaataacattttttc

SEQ ID NO: 99303 - DNA, 22 bp, Artificial sequence
  SiRNA target sequence
aatatctaataacattttttca

SEQ ID NO: 99304 - DNA, 22 bp, Artificial sequence
  SiRNA target sequence
atatctaataacattttttcaa

SEQ ID NO: 99305 - DNA, 22 bp, Artificial sequence
  SiRNA target sequence
tatctaataacattttttcaat

SEQ ID NO: 99306 - DNA, 22 bp, Artificial sequence
  SiRNA target sequence
atctaataacattttttcaata

SEQ ID NO: 99307 - DNA, 22 bp, Artificial sequence
  SiRNA target sequence
tctaataacattttttcaataa

SEQ ID NO: 99308 - DNA, 22 bp, Artificial sequence
  SiRNA target sequence
ctaataacattttttcaataat

SEQ ID NO: 99309 - DNA, 22 bp, Artificial sequence
  SiRNA target sequence
taataacattttttcaataata

SEQ ID NO: 99310 - DNA, 22 bp, Artificial sequence
  SiRNA target sequence
aataacattttttcaataatat

SEQ ID NO: 99311 - DNA, 22 bp, Artificial sequence
  SiRNA target sequence
ataacattttttcaataatatt

SEQ ID NO: 99312 - DNA, 22 bp, Artificial sequence
  SiRNA target sequence
taacattttttcaataatatta

SEQ ID NO: 99313 - DNA, 22 bp, Artificial sequence
  SiRNA target sequence
aacattttttcaataatattat

SEQ ID NO: 99314 - DNA, 22 bp, Artificial sequence
  SiRNA target sequence
acattttttcaataatattatt

SEQ ID NO: 99315 - DNA, 22 bp, Artificial sequence
  SiRNA target sequence
cattttttcaataatattatta

SEQ ID NO: 99316 - DNA, 22 bp, Artificial sequence
  SiRNA target sequence
attttttcaataatattattaa

SEQ ID NO: 99317 - DNA, 22 bp, Artificial sequence
  SiRNA target sequence
ttttttcaataatattattaag

SEQ ID NO: 99318 - DNA, 22 bp, Artificial sequence
  SiRNA target sequence
tttttcaataatattattaagt

SEQ ID NO: 99319 - DNA, 22 bp, Artificial sequence
  SiRNA target sequence
ttttcaataatattattaagtc

SEQ ID NO: 99320 - DNA, 22 bp, Artificial sequence
  SiRNA target sequence
tttcaataatattattaagtct

SEQ ID NO: 99321 - DNA, 22 bp, Artificial sequence
  SiRNA target sequence
ttcaataatattattaagtcta

SEQ ID NO: 99322 - DNA, 22 bp, Artificial sequence
  SiRNA target sequence
tcaataatattattaagtctag

SEQ ID NO: 99323 - DNA, 22 bp, Artificial sequence
  SiRNA target sequence
caataatattattaagtctaga

SEQ ID NO: 99324 - DNA, 22 bp, Artificial sequence
  SiRNA target sequence
aataatattattaagtctagaa

SEQ ID NO: 99325 - DNA, 22 bp, Artificial sequence
  SiRNA target sequence
ataatattattaagtctagaat

SEQ ID NO: 99326 - DNA, 22 bp, Artificial sequence
  SiRNA target sequence
taatattattaagtctagaatt

SEQ ID NO: 99327 - DNA, 22 bp, Artificial sequence
  SiRNA target sequence
aatattattaagtctagaattt

SEQ ID NO: 99328 - DNA, 22 bp, Artificial sequence
  SiRNA target sequence
atattattaagtctagaatttc

SEQ ID NO: 99329 - DNA, 22 bp, Artificial sequence
  SiRNA target sequence
tattattaagtctagaatttcc

SEQ ID NO: 99330 - DNA, 22 bp, Artificial sequence
  SiRNA target sequence
attattaagtctagaatttcca

SEQ ID NO: 99331 - DNA, 22 bp, Artificial sequence
  SiRNA target sequence
ttattaagtctagaatttccac

SEQ ID NO: 99332 - DNA, 22 bp, Artificial sequence
  SiRNA target sequence
tattaagtctagaatttccact

SEQ ID NO: 99333 - DNA, 22 bp, Artificial sequence
  SiRNA target sequence
attaagtctagaatttccactt

SEQ ID NO: 99334 - DNA, 22 bp, Artificial sequence
  SiRNA target sequence
ttaagtctagaatttccactta

SEQ ID NO: 99335 - DNA, 22 bp, Artificial sequence
  SiRNA target sequence
taagtctagaatttccacttac

SEQ ID NO: 99336 - DNA, 22 bp, Artificial sequence
  SiRNA target sequence
aagtctagaatttccacttaca

SEQ ID NO: 99337 - DNA, 22 bp, Artificial sequence
  SiRNA target sequence
agtctagaatttccacttacaa

SEQ ID NO: 99338 - DNA, 22 bp, Artificial sequence
  SiRNA target sequence
gtctagaatttccacttacaaa

SEQ ID NO: 99339 - DNA, 22 bp, Artificial sequence
  SiRNA target sequence
tctagaatttccacttacaaat

SEQ ID NO: 99340 - DNA, 22 bp, Artificial sequence
  SiRNA target sequence
ctagaatttccacttacaaata

SEQ ID NO: 99341 - DNA, 22 bp, Artificial sequence
  SiRNA target sequence
tagaatttccacttacaaatat

SEQ ID NO: 99342 - DNA, 22 bp, Artificial sequence
  SiRNA target sequence
agaatttccacttacaaatatt

SEQ ID NO: 99343 - DNA, 22 bp, Artificial sequence
  SiRNA target sequence
gaatttccacttacaaatatta

SEQ ID NO: 99344 - DNA, 22 bp, Artificial sequence
  SiRNA target sequence
aatttccacttacaaatattaa

SEQ ID NO: 99345 - DNA, 22 bp, Artificial sequence
  SiRNA target sequence
atttccacttacaaatattaac

SEQ ID NO: 99346 - DNA, 22 bp, Artificial sequence
  SiRNA target sequence
tttccacttacaaatattaacc

SEQ ID NO: 99347 - DNA, 22 bp, Artificial sequence
  SiRNA target sequence
ttccacttacaaatattaacca

SEQ ID NO: 99348 - DNA, 22 bp, Artificial sequence
  SiRNA target sequence
tccacttacaaatattaaccaa

SEQ ID NO: 99349 - DNA, 22 bp, Artificial sequence
  SiRNA target sequence
ccacttacaaatattaaccaat

SEQ ID NO: 99350 - DNA, 22 bp, Artificial sequence
  SiRNA target sequence
cacttacaaatattaaccaatc

SEQ ID NO: 99351 - DNA, 22 bp, Artificial sequence
  SiRNA target sequence
acttacaaatattaaccaatca

SEQ ID NO: 99352 - DNA, 22 bp, Artificial sequence
  SiRNA target sequence
cttacaaatattaaccaatcat

SEQ ID NO: 99353 - DNA, 22 bp, Artificial sequence
  SiRNA target sequence
ttacaaatattaaccaatcatc

SEQ ID NO: 99354 - DNA, 22 bp, Artificial sequence
  SiRNA target sequence
tacaaatattaaccaatcatca

SEQ ID NO: 99355 - DNA, 22 bp, Artificial sequence
  SiRNA target sequence
acaaatattaaccaatcatcaa

SEQ ID NO: 99356 - DNA, 22 bp, Artificial sequence
  SiRNA target sequence
caaatattaaccaatcatcaat

SEQ ID NO: 99357 - DNA, 22 bp, Artificial sequence
  SiRNA target sequence
aaatattaaccaatcatcaata

SEQ ID NO: 99358 - DNA, 22 bp, Artificial sequence
  SiRNA target sequence
aatattaaccaatcatcaatat

SEQ ID NO: 99359 - DNA, 22 bp, Artificial sequence
  SiRNA target sequence
atattaaccaatcatcaatatt

SEQ ID NO: 99360 - DNA, 22 bp, Artificial sequence
  SiRNA target sequence
tattaaccaatcatcaatattt

SEQ ID NO: 99361 - DNA, 22 bp, Artificial sequence
  SiRNA target sequence
attaaccaatcatcaatatttt

SEQ ID NO: 99362 - DNA, 22 bp, Artificial sequence
  SiRNA target sequence
ttaaccaatcatcaatattttc

SEQ ID NO: 99363 - DNA, 22 bp, Artificial sequence
  SiRNA target sequence
taaccaatcatcaatattttct

SEQ ID NO: 99364 - DNA, 22 bp, Artificial sequence
  SiRNA target sequence
aaccaatcatcaatattttcta

SEQ ID NO: 99365 - DNA, 22 bp, Artificial sequence
  SiRNA target sequence
accaatcatcaatattttctag

SEQ ID NO: 99366 - DNA, 22 bp, Artificial sequence
  SiRNA target sequence
ccaatcatcaatattttctagc

SEQ ID NO: 99367 - DNA, 22 bp, Artificial sequence
  SiRNA target sequence
caatcatcaatattttctagcc

SEQ ID NO: 99368 - DNA, 22 bp, Artificial sequence
  SiRNA target sequence
aatcatcaatattttctagccc

SEQ ID NO: 99369 - DNA, 22 bp, Artificial sequence
  SiRNA target sequence
atcatcaatattttctagccct

SEQ ID NO: 99370 - DNA, 22 bp, Artificial sequence
  SiRNA target sequence
tcatcaatattttctagccctt

SEQ ID NO: 99371 - DNA, 22 bp, Artificial sequence
  SiRNA target sequence
catcaatattttctagcccttt

SEQ ID NO: 99372 - DNA, 22 bp, Artificial sequence
  SiRNA target sequence
atcaatattttctagccctttt

SEQ ID NO: 99373 - DNA, 22 bp, Artificial sequence
  SiRNA target sequence
tcaatattttctagccctttta

SEQ ID NO: 99374 - DNA, 22 bp, Artificial sequence
  SiRNA target sequence
caatattttctagcccttttat

SEQ ID NO: 99375 - DNA, 22 bp, Artificial sequence
  SiRNA target sequence
aatattttctagcccttttata

SEQ ID NO: 99376 - DNA, 22 bp, Artificial sequence
  SiRNA target sequence
atattttctagcccttttatag

SEQ ID NO: 99377 - DNA, 22 bp, Artificial sequence
  SiRNA target sequence
tattttctagcccttttatagt

SEQ ID NO: 99378 - DNA, 22 bp, Artificial sequence
  SiRNA target sequence
attttctagcccttttatagtc

SEQ ID NO: 99379 - DNA, 22 bp, Artificial sequence
  SiRNA target sequence
ttttctagcccttttatagtct

SEQ ID NO: 99380 - DNA, 22 bp, Artificial sequence
  SiRNA target sequence
tttctagcccttttatagtctt

SEQ ID NO: 99381 - DNA, 22 bp, Artificial sequence
  SiRNA target sequence
ttctagcccttttatagtctta

SEQ ID NO: 99382 - DNA, 22 bp, Artificial sequence
  SiRNA target sequence
tctagcccttttatagtcttat

SEQ ID NO: 99383 - DNA, 22 bp, Artificial sequence
  SiRNA target sequence
ctagcccttttatagtcttata

SEQ ID NO: 99384 - DNA, 22 bp, Artificial sequence
  SiRNA target sequence
tagcccttttatagtcttataa

SEQ ID NO: 99385 - DNA, 22 bp, Artificial sequence
  SiRNA target sequence
agcccttttatagtcttataaa

SEQ ID NO: 99386 - DNA, 22 bp, Artificial sequence
  SiRNA target sequence
gcccttttatagtcttataaat

SEQ ID NO: 99387 - DNA, 22 bp, Artificial sequence
  SiRNA target sequence
cccttttatagtcttataaata

SEQ ID NO: 99388 - DNA, 22 bp, Artificial sequence
  SiRNA target sequence
ccttttatagtcttataaatat

SEQ ID NO: 99389 - DNA, 22 bp, Artificial sequence
  SiRNA target sequence
cttttatagtcttataaatatc

SEQ ID NO: 99390 - DNA, 22 bp, Artificial sequence
  SiRNA target sequence
ttttatagtcttataaatatct

SEQ ID NO: 99391 - DNA, 22 bp, Artificial sequence
  SiRNA target sequence
tttatagtcttataaatatctt

SEQ ID NO: 99392 - DNA, 22 bp, Artificial sequence
  SiRNA target sequence
ttatagtcttataaatatcttg

SEQ ID NO: 99393 - DNA, 22 bp, Artificial sequence
  SiRNA target sequence
tatagtcttataaatatcttgt

SEQ ID NO: 99394 - DNA, 22 bp, Artificial sequence
  SiRNA target sequence
atagtcttataaatatcttgta

SEQ ID NO: 99395 - DNA, 22 bp, Artificial sequence
  SiRNA target sequence
tagtcttataaatatcttgtat

SEQ ID NO: 99396 - DNA, 22 bp, Artificial sequence
  SiRNA target sequence
agtcttataaatatcttgtatg

SEQ ID NO: 99397 - DNA, 22 bp, Artificial sequence
  SiRNA target sequence
gtcttataaatatcttgtatgt

SEQ ID NO: 99398 - DNA, 22 bp, Artificial sequence
  SiRNA target sequence
tcttataaatatcttgtatgta

SEQ ID NO: 99399 - DNA, 22 bp, Artificial sequence
  SiRNA target sequence
cttataaatatcttgtatgtat

SEQ ID NO: 99400 - DNA, 22 bp, Artificial sequence
  SiRNA target sequence
ttataaatatcttgtatgtatt

SEQ ID NO: 99401 - DNA, 22 bp, Artificial sequence
  SiRNA target sequence
tataaatatcttgtatgtattt

SEQ ID NO: 99402 - DNA, 22 bp, Artificial sequence
  SiRNA target sequence
ataaatatcttgtatgtattta

SEQ ID NO: 99403 - DNA, 22 bp, Artificial sequence
  SiRNA target sequence
taaatatcttgtatgtatttat

SEQ ID NO: 99404 - DNA, 22 bp, Artificial sequence
  SiRNA target sequence
aaatatcttgtatgtatttatt

SEQ ID NO: 99405 - DNA, 22 bp, Artificial sequence
  SiRNA target sequence
aatatcttgtatgtatttatta

SEQ ID NO: 99406 - DNA, 22 bp, Artificial sequence
  SiRNA target sequence
atatcttgtatgtatttattat

SEQ ID NO: 99407 - DNA, 22 bp, Artificial sequence
  SiRNA target sequence
tatcttgtatgtatttattatc

SEQ ID NO: 99408 - DNA, 22 bp, Artificial sequence
  SiRNA target sequence
atcttgtatgtatttattatct

SEQ ID NO: 99409 - DNA, 22 bp, Artificial sequence
  SiRNA target sequence
tcttgtatgtatttattatctt

SEQ ID NO: 99410 - DNA, 22 bp, Artificial sequence
  SiRNA target sequence
cttgtatgtatttattatcttc

SEQ ID NO: 99411 - DNA, 22 bp, Artificial sequence
  SiRNA target sequence
ttgtatgtatttattatcttcc

SEQ ID NO: 99412 - DNA, 22 bp, Artificial sequence
  SiRNA target sequence
tgtatgtatttattatcttccc

SEQ ID NO: 99413 - DNA, 22 bp, Artificial sequence
  SiRNA target sequence
gtatgtatttattatcttccct

SEQ ID NO: 99414 - DNA, 22 bp, Artificial sequence
  SiRNA target sequence
tatgtatttattatcttccctt

SEQ ID NO: 99415 - DNA, 22 bp, Artificial sequence
  SiRNA target sequence
atgtatttattatcttcccttg

SEQ ID NO: 99416 - DNA, 22 bp, Artificial sequence
  SiRNA target sequence
tgtatttattatcttcccttga

SEQ ID NO: 99417 - DNA, 22 bp, Artificial sequence
  SiRNA target sequence
gtatttattatcttcccttgaa

SEQ ID NO: 99418 - DNA, 22 bp, Artificial sequence
  SiRNA target sequence
tatttattatcttcccttgaaa

SEQ ID NO: 99419 - DNA, 22 bp, Artificial sequence
  SiRNA target sequence
atttattatcttcccttgaaac

SEQ ID NO: 99420 - DNA, 22 bp, Artificial sequence
  SiRNA target sequence
tttattatcttcccttgaaaca

SEQ ID NO: 99421 - DNA, 22 bp, Artificial sequence
  SiRNA target sequence
ttattatcttcccttgaaacag

SEQ ID NO: 99422 - DNA, 22 bp, Artificial sequence
  SiRNA target sequence
tattatcttcccttgaaacagc

SEQ ID NO: 99423 - DNA, 22 bp, Artificial sequence
  SiRNA target sequence
attatcttcccttgaaacagcg

SEQ ID NO: 99424 - DNA, 22 bp, Artificial sequence
  SiRNA target sequence
ttatcttcccttgaaacagcgg

SEQ ID NO: 99425 - DNA, 22 bp, Artificial sequence
  SiRNA target sequence
tatcttcccttgaaacagcggg

SEQ ID NO: 99426 - DNA, 22 bp, Artificial sequence
  SiRNA target sequence
atcttcccttgaaacagcgggg

SEQ ID NO: 99427 - DNA, 22 bp, Artificial sequence
  SiRNA target sequence
tcttcccttgaaacagcggggt

SEQ ID NO: 99428 - DNA, 22 bp, Artificial sequence
  SiRNA target sequence
cttcccttgaaacagcggggta

SEQ ID NO: 99429 - DNA, 22 bp, Artificial sequence
  SiRNA target sequence
ttcccttgaaacagcggggtaa

SEQ ID NO: 99430 - DNA, 22 bp, Artificial sequence
  SiRNA target sequence
tcccttgaaacagcggggtaaa

SEQ ID NO: 99431 - DNA, 22 bp, Artificial sequence
  SiRNA target sequence
cccttgaaacagcggggtaaat

SEQ ID NO: 99432 - DNA, 22 bp, Artificial sequence
  SiRNA target sequence
ccttgaaacagcggggtaaatt

SEQ ID NO: 99433 - DNA, 22 bp, Artificial sequence
  SiRNA target sequence
cttgaaacagcggggtaaattt

SEQ ID NO: 99434 - DNA, 22 bp, Artificial sequence
  SiRNA target sequence
ttgaaacagcggggtaaatttc

SEQ ID NO: 99435 - DNA, 22 bp, Artificial sequence
  SiRNA target sequence
tgaaacagcggggtaaatttca

SEQ ID NO: 99436 - DNA, 22 bp, Artificial sequence
  SiRNA target sequence
gaaacagcggggtaaatttcaa

SEQ ID NO: 99437 - DNA, 22 bp, Artificial sequence
  SiRNA target sequence
aaacagcggggtaaatttcaat

SEQ ID NO: 99438 - DNA, 22 bp, Artificial sequence
  SiRNA target sequence
aacagcggggtaaatttcaatg

SEQ ID NO: 99439 - DNA, 22 bp, Artificial sequence
  SiRNA target sequence
acagcggggtaaatttcaatgc

SEQ ID NO: 99440 - DNA, 22 bp, Artificial sequence
  SiRNA target sequence
cagcggggtaaatttcaatgcc

SEQ ID NO: 99441 - DNA, 22 bp, Artificial sequence
  SiRNA target sequence
agcggggtaaatttcaatgcct

SEQ ID NO: 99442 - DNA, 22 bp, Artificial sequence
  SiRNA target sequence
gcggggtaaatttcaatgcctt

SEQ ID NO: 99443 - DNA, 22 bp, Artificial sequence
  SiRNA target sequence
cggggtaaatttcaatgccttt

SEQ ID NO: 99444 - DNA, 22 bp, Artificial sequence
  SiRNA target sequence
ggggtaaatttcaatgccttta

SEQ ID NO: 99445 - DNA, 22 bp, Artificial sequence
  SiRNA target sequence
gggtaaatttcaatgcctttat

SEQ ID NO: 99446 - DNA, 22 bp, Artificial sequence
  SiRNA target sequence
ggtaaatttcaatgcctttatt

SEQ ID NO: 99447 - DNA, 22 bp, Artificial sequence
  SiRNA target sequence
gtaaatttcaatgcctttattt

SEQ ID NO: 99448 - DNA, 22 bp, Artificial sequence
  SiRNA target sequence
taaatttcaatgcctttatttt

SEQ ID NO: 99449 - DNA, 22 bp, Artificial sequence
  SiRNA target sequence
aaatttcaatgcctttattttc

SEQ ID NO: 99450 - DNA, 22 bp, Artificial sequence
  SiRNA target sequence
aatttcaatgcctttattttca

SEQ ID NO: 99451 - DNA, 22 bp, Artificial sequence
  SiRNA target sequence
atttcaatgcctttattttcaa

SEQ ID NO: 99452 - DNA, 22 bp, Artificial sequence
  SiRNA target sequence
tttcaatgcctttattttcaaa

SEQ ID NO: 99453 - DNA, 22 bp, Artificial sequence
  SiRNA target sequence
ttcaatgcctttattttcaaac

SEQ ID NO: 99454 - DNA, 22 bp, Artificial sequence
  SiRNA target sequence
tcaatgcctttattttcaaact

SEQ ID NO: 99455 - DNA, 22 bp, Artificial sequence
  SiRNA target sequence
caatgcctttattttcaaactc

SEQ ID NO: 99456 - DNA, 22 bp, Artificial sequence
  SiRNA target sequence
aatgcctttattttcaaactct

SEQ ID NO: 99457 - DNA, 22 bp, Artificial sequence
  SiRNA target sequence
atgcctttattttcaaactctt

SEQ ID NO: 99458 - DNA, 22 bp, Artificial sequence
  SiRNA target sequence
tgcctttattttcaaactcttc

SEQ ID NO: 99459 - DNA, 22 bp, Artificial sequence
  SiRNA target sequence
gcctttattttcaaactcttct

SEQ ID NO: 99460 - DNA, 22 bp, Artificial sequence
  SiRNA target sequence
cctttattttcaaactcttctt

SEQ ID NO: 99461 - DNA, 22 bp, Artificial sequence
  SiRNA target sequence
ctttattttcaaactcttcttt

SEQ ID NO: 99462 - DNA, 22 bp, Artificial sequence
  SiRNA target sequence
tttattttcaaactcttcttta

SEQ ID NO: 99463 - DNA, 22 bp, Artificial sequence
  SiRNA target sequence
ttattttcaaactcttctttat

SEQ ID NO: 99464 - DNA, 22 bp, Artificial sequence
  SiRNA target sequence
tattttcaaactcttctttata

SEQ ID NO: 99465 - DNA, 22 bp, Artificial sequence
  SiRNA target sequence
attttcaaactcttctttatat

SEQ ID NO: 99466 - DNA, 22 bp, Artificial sequence
  SiRNA target sequence
ttttcaaactcttctttatata

SEQ ID NO: 99467 - DNA, 22 bp, Artificial sequence
  SiRNA target sequence
tttcaaactcttctttatataa

SEQ ID NO: 99468 - DNA, 22 bp, Artificial sequence
  SiRNA target sequence
ttcaaactcttctttatataaa

SEQ ID NO: 99469 - DNA, 22 bp, Artificial sequence
  SiRNA target sequence
tcaaactcttctttatataaaa

SEQ ID NO: 99470 - DNA, 22 bp, Artificial sequence
  SiRNA target sequence
caaactcttctttatataaaaa

SEQ ID NO: 99471 - DNA, 22 bp, Artificial sequence
  SiRNA target sequence
aaactcttctttatataaaaaa

SEQ ID NO: 99472 - DNA, 22 bp, Artificial sequence
  SiRNA target sequence
aactcttctttatataaaaaat

SEQ ID NO: 99473 - DNA, 22 bp, Artificial sequence
  SiRNA target sequence
actcttctttatataaaaaatc

SEQ ID NO: 99474 - DNA, 22 bp, Artificial sequence
  SiRNA target sequence
ctcttctttatataaaaaatct

SEQ ID NO: 99475 - DNA, 22 bp, Artificial sequence
  SiRNA target sequence
tcttctttatataaaaaatcta

SEQ ID NO: 99476 - DNA, 22 bp, Artificial sequence
  SiRNA target sequence
cttctttatataaaaaatctac

SEQ ID NO: 99477 - DNA, 22 bp, Artificial sequence
  SiRNA target sequence
ttctttatataaaaaatctaca

SEQ ID NO: 99478 - DNA, 22 bp, Artificial sequence
  SiRNA target sequence
tctttatataaaaaatctacat

SEQ ID NO: 99479 - DNA, 22 bp, Artificial sequence
  SiRNA target sequence
ctttatataaaaaatctacatc

SEQ ID NO: 99480 - DNA, 22 bp, Artificial sequence
  SiRNA target sequence
tttatataaaaaatctacatct

SEQ ID NO: 99481 - DNA, 22 bp, Artificial sequence
  SiRNA target sequence
ttatataaaaaatctacatctc

SEQ ID NO: 99482 - DNA, 22 bp, Artificial sequence
  SiRNA target sequence
tatataaaaaatctacatctct

SEQ ID NO: 99483 - DNA, 22 bp, Artificial sequence
  SiRNA target sequence
atataaaaaatctacatctcta

SEQ ID NO: 99484 - DNA, 22 bp, Artificial sequence
  SiRNA target sequence
tataaaaaatctacatctctaa

SEQ ID NO: 99485 - DNA, 22 bp, Artificial sequence
  SiRNA target sequence
ataaaaaatctacatctctaaa

SEQ ID NO: 99486 - DNA, 22 bp, Artificial sequence
  SiRNA target sequence
taaaaaatctacatctctaaat

SEQ ID NO: 99487 - DNA, 22 bp, Artificial sequence
  SiRNA target sequence
aaaaaatctacatctctaaatc

SEQ ID NO: 99488 - DNA, 22 bp, Artificial sequence
  SiRNA target sequence
aaaaatctacatctctaaatct

SEQ ID NO: 99489 - DNA, 22 bp, Artificial sequence
  SiRNA target sequence
aaaatctacatctctaaatcta

SEQ ID NO: 99490 - DNA, 22 bp, Artificial sequence
  SiRNA target sequence
aaatctacatctctaaatctaa

SEQ ID NO: 99491 - DNA, 22 bp, Artificial sequence
  SiRNA target sequence
aatctacatctctaaatctaaa

SEQ ID NO: 99492 - DNA, 22 bp, Artificial sequence
  SiRNA target sequence
atctacatctctaaatctaaaa

SEQ ID NO: 99493 - DNA, 22 bp, Artificial sequence
  SiRNA target sequence
tctacatctctaaatctaaaac

SEQ ID NO: 99494 - DNA, 22 bp, Artificial sequence
  SiRNA target sequence
ctacatctctaaatctaaaacc

SEQ ID NO: 99495 - DNA, 22 bp, Artificial sequence
  SiRNA target sequence
tacatctctaaatctaaaacca

SEQ ID NO: 99496 - DNA, 22 bp, Artificial sequence
  SiRNA target sequence
acatctctaaatctaaaaccat

SEQ ID NO: 99497 - DNA, 22 bp, Artificial sequence
  SiRNA target sequence
catctctaaatctaaaaccata

SEQ ID NO: 99498 - DNA, 22 bp, Artificial sequence
  SiRNA target sequence
atctctaaatctaaaaccatat

SEQ ID NO: 99499 - DNA, 22 bp, Artificial sequence
  SiRNA target sequence
tctctaaatctaaaaccatata

SEQ ID NO: 99500 - DNA, 22 bp, Artificial sequence
  SiRNA target sequence
ctctaaatctaaaaccatataa

SEQ ID NO: 99501 - DNA, 22 bp, Artificial sequence
  SiRNA target sequence
tctaaatctaaaaccatataat

SEQ ID NO: 99502 - DNA, 22 bp, Artificial sequence
  SiRNA target sequence
ctaaatctaaaaccatataata

SEQ ID NO: 99503 - DNA, 22 bp, Artificial sequence
  SiRNA target sequence
taaatctaaaaccatataataa

SEQ ID NO: 99504 - DNA, 22 bp, Artificial sequence
  SiRNA target sequence
aaatctaaaaccatataataaa

SEQ ID NO: 99505 - DNA, 22 bp, Artificial sequence
  SiRNA target sequence
aatctaaaaccatataataaaa

SEQ ID NO: 99506 - DNA, 22 bp, Artificial sequence
  SiRNA target sequence
atctaaaaccatataataaaat

SEQ ID NO: 99507 - DNA, 22 bp, Artificial sequence
  SiRNA target sequence
tctaaaaccatataataaaata

SEQ ID NO: 99508 - DNA, 22 bp, Artificial sequence
  SiRNA target sequence
ctaaaaccatataataaaataa

SEQ ID NO: 99509 - DNA, 22 bp, Artificial sequence
  SiRNA target sequence
taaaaccatataataaaataac

SEQ ID NO: 99510 - DNA, 22 bp, Artificial sequence
  SiRNA target sequence
aaaaccatataataaaataact

SEQ ID NO: 99511 - DNA, 22 bp, Artificial sequence
  SiRNA target sequence
aaaccatataataaaataactt

SEQ ID NO: 99512 - DNA, 22 bp, Artificial sequence
  SiRNA target sequence
aaccatataataaaataacttt

SEQ ID NO: 99513 - DNA, 22 bp, Artificial sequence
  SiRNA target sequence
accatataataaaataactttt

SEQ ID NO: 99514 - DNA, 22 bp, Artificial sequence
  SiRNA target sequence
ccatataataaaataacttttt

SEQ ID NO: 99515 - DNA, 22 bp, Artificial sequence
  SiRNA target sequence
catataataaaataactttttt

SEQ ID NO: 99516 - DNA, 22 bp, Artificial sequence
  SiRNA target sequence
atataataaaataactttttta

SEQ ID NO: 99517 - DNA, 22 bp, Artificial sequence
  SiRNA target sequence
tataataaaataacttttttaa

SEQ ID NO: 99518 - DNA, 22 bp, Artificial sequence
  SiRNA target sequence
ataataaaataacttttttaaa

SEQ ID NO: 99519 - DNA, 22 bp, Artificial sequence
  SiRNA target sequence
taataaaataacttttttaaaa

SEQ ID NO: 99520 - DNA, 22 bp, Artificial sequence
  SiRNA target sequence
aataaaataacttttttaaaaa

SEQ ID NO: 99521 - DNA, 22 bp, Artificial sequence
  SiRNA target sequence
ataaaataacttttttaaaaaa

SEQ ID NO: 99522 - DNA, 22 bp, Artificial sequence
  SiRNA target sequence
taaaataacttttttaaaaaaa

SEQ ID NO: 99523 - DNA, 22 bp, Artificial sequence
  SiRNA target sequence
aaaataacttttttaaaaaaat

SEQ ID NO: 99524 - DNA, 22 bp, Artificial sequence
  SiRNA target sequence
aaataacttttttaaaaaaatt

SEQ ID NO: 99525 - DNA, 22 bp, Artificial sequence
  SiRNA target sequence
aataacttttttaaaaaaattt

SEQ ID NO: 99526 - DNA, 22 bp, Artificial sequence
  SiRNA target sequence
ataacttttttaaaaaaattta

SEQ ID NO: 99527 - DNA, 22 bp, Artificial sequence
  SiRNA target sequence
taacttttttaaaaaaatttaa

SEQ ID NO: 99528 - DNA, 22 bp, Artificial sequence
  SiRNA target sequence
aacttttttaaaaaaatttaaa

SEQ ID NO: 99529 - DNA, 22 bp, Artificial sequence
  SiRNA target sequence
acttttttaaaaaaatttaaat

SEQ ID NO: 99530 - DNA, 22 bp, Artificial sequence
  SiRNA target sequence
cttttttaaaaaaatttaaatc

SEQ ID NO: 99531 - DNA, 22 bp, Artificial sequence
  SiRNA target sequence
ttttttaaaaaaatttaaatca

SEQ ID NO: 99532 - DNA, 22 bp, Artificial sequence
  SiRNA target sequence
tttttaaaaaaatttaaatcag

SEQ ID NO: 99533 - DNA, 22 bp, Artificial sequence
  SiRNA target sequence
ttttaaaaaaatttaaatcaga

SEQ ID NO: 99534 - DNA, 22 bp, Artificial sequence
  SiRNA target sequence
tttaaaaaaatttaaatcagaa

SEQ ID NO: 99535 - DNA, 22 bp, Artificial sequence
  SiRNA target sequence
ttaaaaaaatttaaatcagaat

SEQ ID NO: 99536 - DNA, 22 bp, Artificial sequence
  SiRNA target sequence
taaaaaaatttaaatcagaata

SEQ ID NO: 99537 - DNA, 22 bp, Artificial sequence
  SiRNA target sequence
aaaaaaatttaaatcagaatag

SEQ ID NO: 99538 - DNA, 22 bp, Artificial sequence
  SiRNA target sequence
aaaaaatttaaatcagaatagt

SEQ ID NO: 99539 - DNA, 22 bp, Artificial sequence
  SiRNA target sequence
aaaaatttaaatcagaatagta

SEQ ID NO: 99540 - DNA, 22 bp, Artificial sequence
  SiRNA target sequence
aaaatttaaatcagaatagtaa

SEQ ID NO: 99541 - DNA, 22 bp, Artificial sequence
  SiRNA target sequence
aaatttaaatcagaatagtaat

SEQ ID NO: 99542 - DNA, 22 bp, Artificial sequence
  SiRNA target sequence
aatttaaatcagaatagtaatt

SEQ ID NO: 99543 - DNA, 22 bp, Artificial sequence
  SiRNA target sequence
atttaaatcagaatagtaatta

SEQ ID NO: 99544 - DNA, 22 bp, Artificial sequence
  SiRNA target sequence
tttaaatcagaatagtaattaa

SEQ ID NO: 99545 - DNA, 22 bp, Artificial sequence
  SiRNA target sequence
ttaaatcagaatagtaattaac

SEQ ID NO: 99546 - DNA, 22 bp, Artificial sequence
  SiRNA target sequence
taaatcagaatagtaattaaca

SEQ ID NO: 99547 - DNA, 22 bp, Artificial sequence
  SiRNA target sequence
aaatcagaatagtaattaacaa

SEQ ID NO: 99548 - DNA, 22 bp, Artificial sequence
  SiRNA target sequence
aatcagaatagtaattaacaaa

SEQ ID NO: 99549 - DNA, 22 bp, Artificial sequence
  SiRNA target sequence
atcagaatagtaattaacaaat

SEQ ID NO: 99550 - DNA, 22 bp, Artificial sequence
  SiRNA target sequence
tcagaatagtaattaacaaatg

SEQ ID NO: 99551 - DNA, 22 bp, Artificial sequence
  SiRNA target sequence
cagaatagtaattaacaaatgc

SEQ ID NO: 99552 - DNA, 22 bp, Artificial sequence
  SiRNA target sequence
agaatagtaattaacaaatgcc

SEQ ID NO: 99553 - DNA, 22 bp, Artificial sequence
  SiRNA target sequence
gaatagtaattaacaaatgccc

SEQ ID NO: 99554 - DNA, 22 bp, Artificial sequence
  SiRNA target sequence
aatagtaattaacaaatgccct

SEQ ID NO: 99555 - DNA, 22 bp, Artificial sequence
  SiRNA target sequence
atagtaattaacaaatgccctg

SEQ ID NO: 99556 - DNA, 22 bp, Artificial sequence
  SiRNA target sequence
tagtaattaacaaatgccctgg

SEQ ID NO: 99557 - DNA, 22 bp, Artificial sequence
  SiRNA target sequence
agtaattaacaaatgccctggg

SEQ ID NO: 99558 - DNA, 22 bp, Artificial sequence
  SiRNA target sequence
gtaattaacaaatgccctggga

SEQ ID NO: 99559 - DNA, 22 bp, Artificial sequence
  SiRNA target sequence
taattaacaaatgccctgggaa

SEQ ID NO: 99560 - DNA, 22 bp, Artificial sequence
  SiRNA target sequence
aattaacaaatgccctgggaag

SEQ ID NO: 99561 - DNA, 22 bp, Artificial sequence
  SiRNA target sequence
attaacaaatgccctgggaagt

SEQ ID NO: 99562 - DNA, 22 bp, Artificial sequence
  SiRNA target sequence
ttaacaaatgccctgggaagtg

SEQ ID NO: 99563 - DNA, 22 bp, Artificial sequence
  SiRNA target sequence
taacaaatgccctgggaagtgt

SEQ ID NO: 99564 - DNA, 22 bp, Artificial sequence
  SiRNA target sequence
aacaaatgccctgggaagtgta

SEQ ID NO: 99565 - DNA, 22 bp, Artificial sequence
  SiRNA target sequence
acaaatgccctgggaagtgtaa

SEQ ID NO: 99566 - DNA, 22 bp, Artificial sequence
  SiRNA target sequence
caaatgccctgggaagtgtaat

SEQ ID NO: 99567 - DNA, 22 bp, Artificial sequence
  SiRNA target sequence
aaatgccctgggaagtgtaata

SEQ ID NO: 99568 - DNA, 22 bp, Artificial sequence
  SiRNA target sequence
aatgccctgggaagtgtaatac

SEQ ID NO: 99569 - DNA, 22 bp, Artificial sequence
  SiRNA target sequence
atgccctgggaagtgtaatacc

SEQ ID NO: 99570 - DNA, 22 bp, Artificial sequence
  SiRNA target sequence
tgccctgggaagtgtaatacca

SEQ ID NO: 99571 - DNA, 22 bp, Artificial sequence
  SiRNA target sequence
gccctgggaagtgtaataccag

SEQ ID NO: 99572 - DNA, 22 bp, Artificial sequence
  SiRNA target sequence
ccctgggaagtgtaataccagt

SEQ ID NO: 99573 - DNA, 22 bp, Artificial sequence
  SiRNA target sequence
cctgggaagtgtaataccagta

SEQ ID NO: 99574 - DNA, 22 bp, Artificial sequence
  SiRNA target sequence
ctgggaagtgtaataccagtac

SEQ ID NO: 99575 - DNA, 22 bp, Artificial sequence
  SiRNA target sequence
tgggaagtgtaataccagtacc

SEQ ID NO: 99576 - DNA, 22 bp, Artificial sequence
  SiRNA target sequence
gggaagtgtaataccagtacca

SEQ ID NO: 99577 - DNA, 22 bp, Artificial sequence
  SiRNA target sequence
ggaagtgtaataccagtaccag

SEQ ID NO: 99578 - DNA, 22 bp, Artificial sequence
  SiRNA target sequence
gaagtgtaataccagtaccagt

SEQ ID NO: 99579 - DNA, 22 bp, Artificial sequence
  SiRNA target sequence
aagtgtaataccagtaccagtg

SEQ ID NO: 99580 - DNA, 22 bp, Artificial sequence
  SiRNA target sequence
agtgtaataccagtaccagtgc

SEQ ID NO: 99581 - DNA, 22 bp, Artificial sequence
  SiRNA target sequence
gtgtaataccagtaccagtgca

SEQ ID NO: 99582 - DNA, 22 bp, Artificial sequence
  SiRNA target sequence
tgtaataccagtaccagtgcac

SEQ ID NO: 99583 - DNA, 22 bp, Artificial sequence
  SiRNA target sequence
gtaataccagtaccagtgcaca

SEQ ID NO: 99584 - DNA, 22 bp, Artificial sequence
  SiRNA target sequence
taataccagtaccagtgcacat

SEQ ID NO: 99585 - DNA, 22 bp, Artificial sequence
  SiRNA target sequence
aataccagtaccagtgcacata

SEQ ID NO: 99586 - DNA, 22 bp, Artificial sequence
  SiRNA target sequence
ataccagtaccagtgcacataa

SEQ ID NO: 99587 - DNA, 22 bp, Artificial sequence
  SiRNA target sequence
taccagtaccagtgcacataaa

SEQ ID NO: 99588 - DNA, 22 bp, Artificial sequence
  SiRNA target sequence
accagtaccagtgcacataaac

SEQ ID NO: 99589 - DNA, 22 bp, Artificial sequence
  SiRNA target sequence
ccagtaccagtgcacataaaca

SEQ ID NO: 99590 - DNA, 22 bp, Artificial sequence
  SiRNA target sequence
cagtaccagtgcacataaacaa

SEQ ID NO: 99591 - DNA, 22 bp, Artificial sequence
  SiRNA target sequence
agtaccagtgcacataaacaaa

SEQ ID NO: 99592 - DNA, 22 bp, Artificial sequence
  SiRNA target sequence
gtaccagtgcacataaacaaaa

SEQ ID NO: 99593 - DNA, 22 bp, Artificial sequence
  SiRNA target sequence
taccagtgcacataaacaaaat

SEQ ID NO: 99594 - DNA, 22 bp, Artificial sequence
  SiRNA target sequence
accagtgcacataaacaaaatc

SEQ ID NO: 99595 - DNA, 22 bp, Artificial sequence
  SiRNA target sequence
ccagtgcacataaacaaaatct

SEQ ID NO: 99596 - DNA, 22 bp, Artificial sequence
  SiRNA target sequence
cagtgcacataaacaaaatctt

SEQ ID NO: 99597 - DNA, 22 bp, Artificial sequence
  SiRNA target sequence
agtgcacataaacaaaatcttt

SEQ ID NO: 99598 - DNA, 22 bp, Artificial sequence
  SiRNA target sequence
gtgcacataaacaaaatctttt

SEQ ID NO: 99599 - DNA, 22 bp, Artificial sequence
  SiRNA target sequence
tgcacataaacaaaatcttttt

SEQ ID NO: 99600 - DNA, 22 bp, Artificial sequence
  SiRNA target sequence
gcacataaacaaaatcttttta

SEQ ID NO: 99601 - DNA, 22 bp, Artificial sequence
  SiRNA target sequence
cacataaacaaaatctttttac

SEQ ID NO: 99602 - DNA, 22 bp, Artificial sequence
  SiRNA target sequence
acataaacaaaatctttttacc

SEQ ID NO: 99603 - DNA, 22 bp, Artificial sequence
  SiRNA target sequence
cataaacaaaatctttttacca

SEQ ID NO: 99604 - DNA, 22 bp, Artificial sequence
  SiRNA target sequence
ataaacaaaatctttttaccac

SEQ ID NO: 99605 - DNA, 22 bp, Artificial sequence
  SiRNA target sequence
taaacaaaatctttttaccact

SEQ ID NO: 99606 - DNA, 22 bp, Artificial sequence
  SiRNA target sequence
aaacaaaatctttttaccacta

SEQ ID NO: 99607 - DNA, 22 bp, Artificial sequence
  SiRNA target sequence
aacaaaatctttttaccactaa

SEQ ID NO: 99608 - DNA, 22 bp, Artificial sequence
  SiRNA target sequence
acaaaatctttttaccactaaa

SEQ ID NO: 99609 - DNA, 22 bp, Artificial sequence
  SiRNA target sequence
caaaatctttttaccactaaaa

SEQ ID NO: 99610 - DNA, 22 bp, Artificial sequence
  SiRNA target sequence
aaaatctttttaccactaaaat

SEQ ID NO: 99611 - DNA, 22 bp, Artificial sequence
  SiRNA target sequence
aaatctttttaccactaaaatt

SEQ ID NO: 99612 - DNA, 22 bp, Artificial sequence
  SiRNA target sequence
aatctttttaccactaaaatta

SEQ ID NO: 99613 - DNA, 22 bp, Artificial sequence
  SiRNA target sequence
atctttttaccactaaaattaa

SEQ ID NO: 99614 - DNA, 22 bp, Artificial sequence
  SiRNA target sequence
tctttttaccactaaaattaag

SEQ ID NO: 99615 - DNA, 22 bp, Artificial sequence
  SiRNA target sequence
ctttttaccactaaaattaagt

SEQ ID NO: 99616 - DNA, 22 bp, Artificial sequence
  SiRNA target sequence
tttttaccactaaaattaagtc

SEQ ID NO: 99617 - DNA, 22 bp, Artificial sequence
  SiRNA target sequence
ttttaccactaaaattaagtct

SEQ ID NO: 99618 - DNA, 22 bp, Artificial sequence
  SiRNA target sequence
tttaccactaaaattaagtcta

SEQ ID NO: 99619 - DNA, 22 bp, Artificial sequence
  SiRNA target sequence
ttaccactaaaattaagtctat

SEQ ID NO: 99620 - DNA, 22 bp, Artificial sequence
  SiRNA target sequence
taccactaaaattaagtctatt

SEQ ID NO: 99621 - DNA, 22 bp, Artificial sequence
  SiRNA target sequence
accactaaaattaagtctattt

SEQ ID NO: 99622 - DNA, 22 bp, Artificial sequence
  SiRNA target sequence
ccactaaaattaagtctatttt

SEQ ID NO: 99623 - DNA, 22 bp, Artificial sequence
  SiRNA target sequence
cactaaaattaagtctattttg

SEQ ID NO: 99624 - DNA, 22 bp, Artificial sequence
  SiRNA target sequence
actaaaattaagtctattttgt

SEQ ID NO: 99625 - DNA, 22 bp, Artificial sequence
  SiRNA target sequence
ctaaaattaagtctattttgta

SEQ ID NO: 99626 - DNA, 22 bp, Artificial sequence
  SiRNA target sequence
taaaattaagtctattttgtac

SEQ ID NO: 99627 - DNA, 22 bp, Artificial sequence
  SiRNA target sequence
aaaattaagtctattttgtact

SEQ ID NO: 99628 - DNA, 22 bp, Artificial sequence
  SiRNA target sequence
aaattaagtctattttgtacta

SEQ ID NO: 99629 - DNA, 22 bp, Artificial sequence
  SiRNA target sequence
aattaagtctattttgtactat

SEQ ID NO: 99630 - DNA, 22 bp, Artificial sequence
  SiRNA target sequence
attaagtctattttgtactatg

SEQ ID NO: 99631 - DNA, 22 bp, Artificial sequence
  SiRNA target sequence
ttaagtctattttgtactatgt

SEQ ID NO: 99632 - DNA, 22 bp, Artificial sequence
  SiRNA target sequence
taagtctattttgtactatgtt

SEQ ID NO: 99633 - DNA, 22 bp, Artificial sequence
  SiRNA target sequence
aagtctattttgtactatgtta

SEQ ID NO: 99634 - DNA, 22 bp, Artificial sequence
  SiRNA target sequence
agtctattttgtactatgttaa

SEQ ID NO: 99635 - DNA, 22 bp, Artificial sequence
  SiRNA target sequence
gtctattttgtactatgttaac

SEQ ID NO: 99636 - DNA, 22 bp, Artificial sequence
  SiRNA target sequence
tctattttgtactatgttaaca

SEQ ID NO: 99637 - DNA, 22 bp, Artificial sequence
  SiRNA target sequence
ctattttgtactatgttaacat

SEQ ID NO: 99638 - DNA, 22 bp, Artificial sequence
  SiRNA target sequence
tattttgtactatgttaacatg

SEQ ID NO: 99639 - DNA, 22 bp, Artificial sequence
  SiRNA target sequence
attttgtactatgttaacatga

SEQ ID NO: 99640 - DNA, 22 bp, Artificial sequence
  SiRNA target sequence
ttttgtactatgttaacatgaa

SEQ ID NO: 99641 - DNA, 22 bp, Artificial sequence
  SiRNA target sequence
tttgtactatgttaacatgaat

SEQ ID NO: 99642 - DNA, 22 bp, Artificial sequence
  SiRNA target sequence
ttgtactatgttaacatgaata

SEQ ID NO: 99643 - DNA, 22 bp, Artificial sequence
  SiRNA target sequence
tgtactatgttaacatgaatag

SEQ ID NO: 99644 - DNA, 22 bp, Artificial sequence
  SiRNA target sequence
gtactatgttaacatgaatagt

SEQ ID NO: 99645 - DNA, 22 bp, Artificial sequence
  SiRNA target sequence
tactatgttaacatgaatagta

SEQ ID NO: 99646 - DNA, 22 bp, Artificial sequence
  SiRNA target sequence
actatgttaacatgaatagtag

SEQ ID NO: 99647 - DNA, 22 bp, Artificial sequence
  SiRNA target sequence
ctatgttaacatgaatagtaga

SEQ ID NO: 99648 - DNA, 22 bp, Artificial sequence
  SiRNA target sequence
tatgttaacatgaatagtagac

SEQ ID NO: 99649 - DNA, 22 bp, Artificial sequence
  SiRNA target sequence
atgttaacatgaatagtagacc

SEQ ID NO: 99650 - DNA, 22 bp, Artificial sequence
  SiRNA target sequence
tgttaacatgaatagtagaccc

SEQ ID NO: 99651 - DNA, 22 bp, Artificial sequence
  SiRNA target sequence
gttaacatgaatagtagaccct

SEQ ID NO: 99652 - DNA, 22 bp, Artificial sequence
  SiRNA target sequence
ttaacatgaatagtagaccctt

SEQ ID NO: 99653 - DNA, 22 bp, Artificial sequence
  SiRNA target sequence
taacatgaatagtagacccttt

SEQ ID NO: 99654 - DNA, 22 bp, Artificial sequence
  SiRNA target sequence
aacatgaatagtagacccttta

SEQ ID NO: 99655 - DNA, 22 bp, Artificial sequence
  SiRNA target sequence
acatgaatagtagaccctttag

SEQ ID NO: 99656 - DNA, 22 bp, Artificial sequence
  SiRNA target sequence
catgaatagtagaccctttagt

SEQ ID NO: 99657 - DNA, 22 bp, Artificial sequence
  SiRNA target sequence
atgaatagtagaccctttagta

SEQ ID NO: 99658 - DNA, 22 bp, Artificial sequence
  SiRNA target sequence
tgaatagtagaccctttagtaa

SEQ ID NO: 99659 - DNA, 22 bp, Artificial sequence
  SiRNA target sequence
gaatagtagaccctttagtaag

SEQ ID NO: 99660 - DNA, 22 bp, Artificial sequence
  SiRNA target sequence
aatagtagaccctttagtaagt

SEQ ID NO: 99661 - DNA, 22 bp, Artificial sequence
  SiRNA target sequence
atagtagaccctttagtaagta

SEQ ID NO: 99662 - DNA, 22 bp, Artificial sequence
  SiRNA target sequence
tagtagaccctttagtaagtaa

SEQ ID NO: 99663 - DNA, 22 bp, Artificial sequence
  SiRNA target sequence
agtagaccctttagtaagtaat

SEQ ID NO: 99664 - DNA, 22 bp, Artificial sequence
  SiRNA target sequence
gtagaccctttagtaagtaatt

SEQ ID NO: 99665 - DNA, 22 bp, Artificial sequence
  SiRNA target sequence
tagaccctttagtaagtaattt

SEQ ID NO: 99666 - DNA, 22 bp, Artificial sequence
  SiRNA target sequence
agaccctttagtaagtaatttt

SEQ ID NO: 99667 - DNA, 22 bp, Artificial sequence
  SiRNA target sequence
gaccctttagtaagtaatttta

SEQ ID NO: 99668 - DNA, 22 bp, Artificial sequence
  SiRNA target sequence
accctttagtaagtaattttaa

SEQ ID NO: 99669 - DNA, 22 bp, Artificial sequence
  SiRNA target sequence
ccctttagtaagtaattttaaa

SEQ ID NO: 99670 - DNA, 22 bp, Artificial sequence
  SiRNA target sequence
cctttagtaagtaattttaaat

SEQ ID NO: 99671 - DNA, 22 bp, Artificial sequence
  SiRNA target sequence
ctttagtaagtaattttaaata

SEQ ID NO: 99672 - DNA, 22 bp, Artificial sequence
  SiRNA target sequence
tttagtaagtaattttaaatac

SEQ ID NO: 99673 - DNA, 22 bp, Artificial sequence
  SiRNA target sequence
ttagtaagtaattttaaatact

SEQ ID NO: 99674 - DNA, 22 bp, Artificial sequence
  SiRNA target sequence
tagtaagtaattttaaatactc

SEQ ID NO: 99675 - DNA, 22 bp, Artificial sequence
  SiRNA target sequence
agtaagtaattttaaatactct

SEQ ID NO: 99676 - DNA, 22 bp, Artificial sequence
  SiRNA target sequence
gtaagtaattttaaatactctg

SEQ ID NO: 99677 - DNA, 22 bp, Artificial sequence
  SiRNA target sequence
taagtaattttaaatactctga

SEQ ID NO: 99678 - DNA, 22 bp, Artificial sequence
  SiRNA target sequence
aagtaattttaaatactctgaa

SEQ ID NO: 99679 - DNA, 22 bp, Artificial sequence
  SiRNA target sequence
agtaattttaaatactctgaac

SEQ ID NO: 99680 - DNA, 22 bp, Artificial sequence
  SiRNA target sequence
gtaattttaaatactctgaaca

SEQ ID NO: 99681 - DNA, 22 bp, Artificial sequence
  SiRNA target sequence
taattttaaatactctgaacaa

SEQ ID NO: 99682 - DNA, 22 bp, Artificial sequence
  SiRNA target sequence
aattttaaatactctgaacaaa

SEQ ID NO: 99683 - DNA, 22 bp, Artificial sequence
  SiRNA target sequence
attttaaatactctgaacaaag

SEQ ID NO: 99684 - DNA, 22 bp, Artificial sequence
  SiRNA target sequence
ttttaaatactctgaacaaaga

SEQ ID NO: 99685 - DNA, 22 bp, Artificial sequence
  SiRNA target sequence
tttaaatactctgaacaaagac

SEQ ID NO: 99686 - DNA, 22 bp, Artificial sequence
  SiRNA target sequence
ttaaatactctgaacaaagacc

SEQ ID NO: 99687 - DNA, 22 bp, Artificial sequence
  SiRNA target sequence
taaatactctgaacaaagacct

SEQ ID NO: 99688 - DNA, 22 bp, Artificial sequence
  SiRNA target sequence
aaatactctgaacaaagacctt

SEQ ID NO: 99689 - DNA, 22 bp, Artificial sequence
  SiRNA target sequence
aatactctgaacaaagaccttt

SEQ ID NO: 99690 - DNA, 22 bp, Artificial sequence
  SiRNA target sequence
atactctgaacaaagacctttt

SEQ ID NO: 99691 - DNA, 22 bp, Artificial sequence
  SiRNA target sequence
tactctgaacaaagaccttttc

SEQ ID NO: 99692 - DNA, 22 bp, Artificial sequence
  SiRNA target sequence
actctgaacaaagaccttttcg

SEQ ID NO: 99693 - DNA, 22 bp, Artificial sequence
  SiRNA target sequence
ctctgaacaaagaccttttcgt

SEQ ID NO: 99694 - DNA, 22 bp, Artificial sequence
  SiRNA target sequence
tctgaacaaagaccttttcgtt

SEQ ID NO: 99695 - DNA, 22 bp, Artificial sequence
  SiRNA target sequence
ctgaacaaagaccttttcgttc

SEQ ID NO: 99696 - DNA, 22 bp, Artificial sequence
  SiRNA target sequence
tgaacaaagaccttttcgttct

SEQ ID NO: 99697 - DNA, 22 bp, Artificial sequence
  SiRNA target sequence
gaacaaagaccttttcgttctt

SEQ ID NO: 99698 - DNA, 22 bp, Artificial sequence
  SiRNA target sequence
aacaaagaccttttcgttcttc

SEQ ID NO: 99699 - DNA, 22 bp, Artificial sequence
  SiRNA target sequence
acaaagaccttttcgttcttct

SEQ ID NO: 99700 - DNA, 22 bp, Artificial sequence
  SiRNA target sequence
caaagaccttttcgttcttctt

SEQ ID NO: 99701 - DNA, 22 bp, Artificial sequence
  SiRNA target sequence
aaagaccttttcgttcttcttt

SEQ ID NO: 99702 - DNA, 22 bp, Artificial sequence
  SiRNA target sequence
aagaccttttcgttcttctttt

SEQ ID NO: 99703 - DNA, 22 bp, Artificial sequence
  SiRNA target sequence
agaccttttcgttcttctttta

SEQ ID NO: 99704 - DNA, 22 bp, Artificial sequence
  SiRNA target sequence
gaccttttcgttcttcttttaa

SEQ ID NO: 99705 - DNA, 22 bp, Artificial sequence
  SiRNA target sequence
accttttcgttcttcttttaaa

SEQ ID NO: 99706 - DNA, 22 bp, Artificial sequence
  SiRNA target sequence
ccttttcgttcttcttttaaac

SEQ ID NO: 99707 - DNA, 22 bp, Artificial sequence
  SiRNA target sequence
cttttcgttcttcttttaaact

SEQ ID NO: 99708 - DNA, 22 bp, Artificial sequence
  SiRNA target sequence
ttttcgttcttcttttaaactt

SEQ ID NO: 99709 - DNA, 22 bp, Artificial sequence
  SiRNA target sequence
tttcgttcttcttttaaacttg

SEQ ID NO: 99710 - DNA, 22 bp, Artificial sequence
  SiRNA target sequence
ttcgttcttcttttaaacttgt

SEQ ID NO: 99711 - DNA, 22 bp, Artificial sequence
  SiRNA target sequence
tcgttcttcttttaaacttgtt

SEQ ID NO: 99712 - DNA, 22 bp, Artificial sequence
  SiRNA target sequence
cgttcttcttttaaacttgttt

SEQ ID NO: 99713 - DNA, 22 bp, Artificial sequence
  SiRNA target sequence
gttcttcttttaaacttgtttt

SEQ ID NO: 99714 - DNA, 22 bp, Artificial sequence
  SiRNA target sequence
ttcttcttttaaacttgtttta

SEQ ID NO: 99715 - DNA, 22 bp, Artificial sequence
  SiRNA target sequence
tcttcttttaaacttgttttaa

SEQ ID NO: 99716 - DNA, 22 bp, Artificial sequence
  SiRNA target sequence
cttcttttaaacttgttttaaa

SEQ ID NO: 99717 - DNA, 22 bp, Artificial sequence
  SiRNA target sequence
ttcttttaaacttgttttaaaa

SEQ ID NO: 99718 - DNA, 22 bp, Artificial sequence
  SiRNA target sequence
tcttttaaacttgttttaaaag

SEQ ID NO: 99719 - DNA, 22 bp, Artificial sequence
  SiRNA target sequence
cttttaaacttgttttaaaaga

SEQ ID NO: 99720 - DNA, 22 bp, Artificial sequence
  SiRNA target sequence
ttttaaacttgttttaaaagaa

SEQ ID NO: 99721 - DNA, 22 bp, Artificial sequence
  SiRNA target sequence
tttaaacttgttttaaaagaaa

SEQ ID NO: 99722 - DNA, 22 bp, Artificial sequence
  SiRNA target sequence
ttaaacttgttttaaaagaaac

SEQ ID NO: 99723 - DNA, 22 bp, Artificial sequence
  SiRNA target sequence
taaacttgttttaaaagaaaca

SEQ ID NO: 99724 - DNA, 22 bp, Artificial sequence
  SiRNA target sequence
aaacttgttttaaaagaaacaa

SEQ ID NO: 99725 - DNA, 22 bp, Artificial sequence
  SiRNA target sequence
aacttgttttaaaagaaacaag

SEQ ID NO: 99726 - DNA, 22 bp, Artificial sequence
  SiRNA target sequence
acttgttttaaaagaaacaaga

SEQ ID NO: 99727 - DNA, 22 bp, Artificial sequence
  SiRNA target sequence
cttgttttaaaagaaacaagag

SEQ ID NO: 99728 - DNA, 22 bp, Artificial sequence
  SiRNA target sequence
ttgttttaaaagaaacaagaga

SEQ ID NO: 99729 - DNA, 22 bp, Artificial sequence
  SiRNA target sequence
tgttttaaaagaaacaagagag

SEQ ID NO: 99730 - DNA, 22 bp, Artificial sequence
  SiRNA target sequence
gttttaaaagaaacaagagaga

SEQ ID NO: 99731 - DNA, 22 bp, Artificial sequence
  SiRNA target sequence
ttttaaaagaaacaagagagac

SEQ ID NO: 99732 - DNA, 22 bp, Artificial sequence
  SiRNA target sequence
tttaaaagaaacaagagagacg

SEQ ID NO: 99733 - DNA, 22 bp, Artificial sequence
  SiRNA target sequence
ttaaaagaaacaagagagacgg

SEQ ID NO: 99734 - DNA, 22 bp, Artificial sequence
  SiRNA target sequence
taaaagaaacaagagagacggt

SEQ ID NO: 99735 - DNA, 22 bp, Artificial sequence
  SiRNA target sequence
aaaagaaacaagagagacggtg

SEQ ID NO: 99736 - DNA, 22 bp, Artificial sequence
  SiRNA target sequence
aaagaaacaagagagacggtga

SEQ ID NO: 99737 - DNA, 22 bp, Artificial sequence
  SiRNA target sequence
aagaaacaagagagacggtgac

SEQ ID NO: 99738 - DNA, 22 bp, Artificial sequence
  SiRNA target sequence
agaaacaagagagacggtgaca

SEQ ID NO: 99739 - DNA, 22 bp, Artificial sequence
  SiRNA target sequence
gaaacaagagagacggtgacaa

SEQ ID NO: 99740 - DNA, 22 bp, Artificial sequence
  SiRNA target sequence
aaacaagagagacggtgacaaa

SEQ ID NO: 99741 - DNA, 22 bp, Artificial sequence
  SiRNA target sequence
aacaagagagacggtgacaaag

SEQ ID NO: 99742 - DNA, 22 bp, Artificial sequence
  SiRNA target sequence
acaagagagacggtgacaaagt

SEQ ID NO: 99743 - DNA, 22 bp, Artificial sequence
  SiRNA target sequence
caagagagacggtgacaaagta

SEQ ID NO: 99744 - DNA, 22 bp, Artificial sequence
  SiRNA target sequence
aagagagacggtgacaaagtaa

SEQ ID NO: 99745 - DNA, 22 bp, Artificial sequence
  SiRNA target sequence
agagagacggtgacaaagtaac

SEQ ID NO: 99746 - DNA, 22 bp, Artificial sequence
  SiRNA target sequence
gagagacggtgacaaagtaaca

SEQ ID NO: 99747 - DNA, 22 bp, Artificial sequence
  SiRNA target sequence
agagacggtgacaaagtaacaa

SEQ ID NO: 99748 - DNA, 22 bp, Artificial sequence
  SiRNA target sequence
gagacggtgacaaagtaacaaa

SEQ ID NO: 99749 - DNA, 22 bp, Artificial sequence
  SiRNA target sequence
agacggtgacaaagtaacaaaa

SEQ ID NO: 99750 - DNA, 22 bp, Artificial sequence
  SiRNA target sequence
gacggtgacaaagtaacaaaaa

SEQ ID NO: 99751 - DNA, 22 bp, Artificial sequence
  SiRNA target sequence
acggtgacaaagtaacaaaaat

SEQ ID NO: 99752 - DNA, 22 bp, Artificial sequence
  SiRNA target sequence
cggtgacaaagtaacaaaaatc

SEQ ID NO: 99753 - DNA, 22 bp, Artificial sequence
  SiRNA target sequence
ggtgacaaagtaacaaaaatct

SEQ ID NO: 99754 - DNA, 22 bp, Artificial sequence
  SiRNA target sequence
gtgacaaagtaacaaaaatctt

SEQ ID NO: 99755 - DNA, 22 bp, Artificial sequence
  SiRNA target sequence
tgacaaagtaacaaaaatcttt

SEQ ID NO: 99756 - DNA, 22 bp, Artificial sequence
  SiRNA target sequence
gacaaagtaacaaaaatctttt

SEQ ID NO: 99757 - DNA, 22 bp, Artificial sequence
  SiRNA target sequence
acaaagtaacaaaaatcttttt

SEQ ID NO: 99758 - DNA, 22 bp, Artificial sequence
  SiRNA target sequence
caaagtaacaaaaatctttttt

SEQ ID NO: 99759 - DNA, 22 bp, Artificial sequence
  SiRNA target sequence
aaagtaacaaaaatcttttttc

SEQ ID NO: 99760 - DNA, 22 bp, Artificial sequence
  SiRNA target sequence
aagtaacaaaaatcttttttcg

SEQ ID NO: 99761 - DNA, 22 bp, Artificial sequence
  SiRNA target sequence
agtaacaaaaatcttttttcgt

SEQ ID NO: 99762 - DNA, 22 bp, Artificial sequence
  SiRNA target sequence
gtaacaaaaatcttttttcgtt

SEQ ID NO: 99763 - DNA, 22 bp, Artificial sequence
  SiRNA target sequence
taacaaaaatcttttttcgtta

SEQ ID NO: 99764 - DNA, 22 bp, Artificial sequence
  SiRNA target sequence
aacaaaaatcttttttcgttaa

SEQ ID NO: 99765 - DNA, 22 bp, Artificial sequence
  SiRNA target sequence
acaaaaatcttttttcgttaat

SEQ ID NO: 99766 - DNA, 22 bp, Artificial sequence
  SiRNA target sequence
caaaaatcttttttcgttaatg

SEQ ID NO: 99767 - DNA, 22 bp, Artificial sequence
  SiRNA target sequence
aaaaatcttttttcgttaatgt

SEQ ID NO: 99768 - DNA, 22 bp, Artificial sequence
  SiRNA target sequence
aaaatcttttttcgttaatgta

SEQ ID NO: 99769 - DNA, 22 bp, Artificial sequence
  SiRNA target sequence
aaatcttttttcgttaatgtaa

SEQ ID NO: 99770 - DNA, 22 bp, Artificial sequence
  SiRNA target sequence
aatcttttttcgttaatgtaaa

SEQ ID NO: 99771 - DNA, 22 bp, Artificial sequence
  SiRNA target sequence
atcttttttcgttaatgtaaaa

SEQ ID NO: 99772 - DNA, 22 bp, Artificial sequence
  SiRNA target sequence
tcttttttcgttaatgtaaaat

SEQ ID NO: 99773 - DNA, 22 bp, Artificial sequence
  SiRNA target sequence
cttttttcgttaatgtaaaata

SEQ ID NO: 99774 - DNA, 22 bp, Artificial sequence
  SiRNA target sequence
ttttttcgttaatgtaaaatat

SEQ ID NO: 99775 - DNA, 22 bp, Artificial sequence
  SiRNA target sequence
tttttcgttaatgtaaaatatc

SEQ ID NO: 99776 - DNA, 22 bp, Artificial sequence
  SiRNA target sequence
ttttcgttaatgtaaaatatct

SEQ ID NO: 99777 - DNA, 22 bp, Artificial sequence
  SiRNA target sequence
tttcgttaatgtaaaatatctt

SEQ ID NO: 99778 - DNA, 22 bp, Artificial sequence
  SiRNA target sequence
ttcgttaatgtaaaatatcttg

SEQ ID NO: 99779 - DNA, 22 bp, Artificial sequence
  SiRNA target sequence
tcgttaatgtaaaatatcttgg

SEQ ID NO: 99780 - DNA, 22 bp, Artificial sequence
  SiRNA target sequence
cgttaatgtaaaatatcttgga

SEQ ID NO: 99781 - DNA, 22 bp, Artificial sequence
  SiRNA target sequence
gttaatgtaaaatatcttggat

SEQ ID NO: 99782 - DNA, 22 bp, Artificial sequence
  SiRNA target sequence
ttaatgtaaaatatcttggatt

SEQ ID NO: 99783 - DNA, 22 bp, Artificial sequence
  SiRNA target sequence
taatgtaaaatatcttggatta

SEQ ID NO: 99784 - DNA, 22 bp, Artificial sequence
  SiRNA target sequence
aatgtaaaatatcttggattaa

SEQ ID NO: 99785 - DNA, 22 bp, Artificial sequence
  SiRNA target sequence
atgtaaaatatcttggattaat

SEQ ID NO: 99786 - DNA, 22 bp, Artificial sequence
  SiRNA target sequence
tgtaaaatatcttggattaatt

SEQ ID NO: 99787 - DNA, 22 bp, Artificial sequence
  SiRNA target sequence
gtaaaatatcttggattaatta

SEQ ID NO: 99788 - DNA, 22 bp, Artificial sequence
  SiRNA target sequence
taaaatatcttggattaattac

SEQ ID NO: 99789 - DNA, 22 bp, Artificial sequence
  SiRNA target sequence
aaaatatcttggattaattaca

SEQ ID NO: 99790 - DNA, 22 bp, Artificial sequence
  SiRNA target sequence
aaatatcttggattaattacag

SEQ ID NO: 99791 - DNA, 22 bp, Artificial sequence
  SiRNA target sequence
aatatcttggattaattacagg

SEQ ID NO: 99792 - DNA, 22 bp, Artificial sequence
  SiRNA target sequence
atatcttggattaattacaggg

SEQ ID NO: 99793 - DNA, 22 bp, Artificial sequence
  SiRNA target sequence
tatcttggattaattacaggga

SEQ ID NO: 99794 - DNA, 22 bp, Artificial sequence
  SiRNA target sequence
atcttggattaattacagggat

SEQ ID NO: 99795 - DNA, 22 bp, Artificial sequence
  SiRNA target sequence
tcttggattaattacagggata

SEQ ID NO: 99796 - DNA, 22 bp, Artificial sequence
  SiRNA target sequence
cttggattaattacagggatat

SEQ ID NO: 99797 - DNA, 22 bp, Artificial sequence
  SiRNA target sequence
ttggattaattacagggatata

SEQ ID NO: 99798 - DNA, 22 bp, Artificial sequence
  SiRNA target sequence
tggattaattacagggatatac

SEQ ID NO: 99799 - DNA, 22 bp, Artificial sequence
  SiRNA target sequence
ggattaattacagggatatact

SEQ ID NO: 99800 - DNA, 22 bp, Artificial sequence
  SiRNA target sequence
gattaattacagggatatactt

SEQ ID NO: 99801 - DNA, 22 bp, Artificial sequence
  SiRNA target sequence
attaattacagggatatacttg

SEQ ID NO: 99802 - DNA, 22 bp, Artificial sequence
  SiRNA target sequence
ttaattacagggatatacttgt

SEQ ID NO: 99803 - DNA, 22 bp, Artificial sequence
  SiRNA target sequence
taattacagggatatacttgta

SEQ ID NO: 99804 - DNA, 22 bp, Artificial sequence
  SiRNA target sequence
aattacagggatatacttgtac

SEQ ID NO: 99805 - DNA, 22 bp, Artificial sequence
  SiRNA target sequence
attacagggatatacttgtaca

SEQ ID NO: 99806 - DNA, 22 bp, Artificial sequence
  SiRNA target sequence
ttacagggatatacttgtacat

SEQ ID NO: 99807 - DNA, 22 bp, Artificial sequence
  SiRNA target sequence
tacagggatatacttgtacata

SEQ ID NO: 99808 - DNA, 22 bp, Artificial sequence
  SiRNA target sequence
acagggatatacttgtacataa

SEQ ID NO: 99809 - DNA, 22 bp, Artificial sequence
  SiRNA target sequence
cagggatatacttgtacataaa

SEQ ID NO: 99810 - DNA, 22 bp, Artificial sequence
  SiRNA target sequence
agggatatacttgtacataaaa

SEQ ID NO: 99811 - DNA, 22 bp, Artificial sequence
  SiRNA target sequence
gggatatacttgtacataaaat

SEQ ID NO: 99812 - DNA, 22 bp, Artificial sequence
  SiRNA target sequence
ggatatacttgtacataaaatt

SEQ ID NO: 99813 - DNA, 22 bp, Artificial sequence
  SiRNA target sequence
gatatacttgtacataaaattt

SEQ ID NO: 99814 - DNA, 22 bp, Artificial sequence
  SiRNA target sequence
atatacttgtacataaaatttg

SEQ ID NO: 99815 - DNA, 22 bp, Artificial sequence
  SiRNA target sequence
tatacttgtacataaaatttga

SEQ ID NO: 99816 - DNA, 22 bp, Artificial sequence
  SiRNA target sequence
atacttgtacataaaatttgag

SEQ ID NO: 99817 - DNA, 22 bp, Artificial sequence
  SiRNA target sequence
tacttgtacataaaatttgagg

SEQ ID NO: 99818 - DNA, 22 bp, Artificial sequence
  SiRNA target sequence
acttgtacataaaatttgaggt

SEQ ID NO: 99819 - DNA, 22 bp, Artificial sequence
  SiRNA target sequence
cttgtacataaaatttgaggta

SEQ ID NO: 99820 - DNA, 22 bp, Artificial sequence
  SiRNA target sequence
ttgtacataaaatttgaggtaa

SEQ ID NO: 99821 - DNA, 22 bp, Artificial sequence
  SiRNA target sequence
tgtacataaaatttgaggtaag

SEQ ID NO: 99822 - DNA, 22 bp, Artificial sequence
  SiRNA target sequence
gtacataaaatttgaggtaagt

SEQ ID NO: 99823 - DNA, 22 bp, Artificial sequence
  SiRNA target sequence
tacataaaatttgaggtaagtt

SEQ ID NO: 99824 - DNA, 22 bp, Artificial sequence
  SiRNA target sequence
acataaaatttgaggtaagttt

SEQ ID NO: 99825 - DNA, 22 bp, Artificial sequence
  SiRNA target sequence
cataaaatttgaggtaagtttt

SEQ ID NO: 99826 - DNA, 22 bp, Artificial sequence
  SiRNA target sequence
ataaaatttgaggtaagtttta

SEQ ID NO: 99827 - DNA, 22 bp, Artificial sequence
  SiRNA target sequence
taaaatttgaggtaagttttat

SEQ ID NO: 99828 - DNA, 22 bp, Artificial sequence
  SiRNA target sequence
aaaatttgaggtaagttttatc

SEQ ID NO: 99829 - DNA, 22 bp, Artificial sequence
  SiRNA target sequence
aaatttgaggtaagttttatct

SEQ ID NO: 99830 - DNA, 22 bp, Artificial sequence
  SiRNA target sequence
aatttgaggtaagttttatctt

SEQ ID NO: 99831 - DNA, 22 bp, Artificial sequence
  SiRNA target sequence
atttgaggtaagttttatctta

SEQ ID NO: 99832 - DNA, 22 bp, Artificial sequence
  SiRNA target sequence
tttgaggtaagttttatcttaa

SEQ ID NO: 99833 - DNA, 22 bp, Artificial sequence
  SiRNA target sequence
ttgaggtaagttttatcttaaa

SEQ ID NO: 99834 - DNA, 22 bp, Artificial sequence
  SiRNA target sequence
tgaggtaagttttatcttaaaa

SEQ ID NO: 99835 - DNA, 22 bp, Artificial sequence
  SiRNA target sequence
gaggtaagttttatcttaaaat

SEQ ID NO: 99836 - DNA, 22 bp, Artificial sequence
  SiRNA target sequence
aggtaagttttatcttaaaatc

SEQ ID NO: 99837 - DNA, 22 bp, Artificial sequence
  SiRNA target sequence
ggtaagttttatcttaaaatct

SEQ ID NO: 99838 - DNA, 22 bp, Artificial sequence
  SiRNA target sequence
gtaagttttatcttaaaatctt

SEQ ID NO: 99839 - DNA, 22 bp, Artificial sequence
  SiRNA target sequence
taagttttatcttaaaatcttt

SEQ ID NO: 99840 - DNA, 22 bp, Artificial sequence
  SiRNA target sequence
aagttttatcttaaaatctttt

SEQ ID NO: 99841 - DNA, 22 bp, Artificial sequence
  SiRNA target sequence
agttttatcttaaaatctttta

SEQ ID NO: 99842 - DNA, 22 bp, Artificial sequence
  SiRNA target sequence
gttttatcttaaaatcttttag

SEQ ID NO: 99843 - DNA, 22 bp, Artificial sequence
  SiRNA target sequence
ttttatcttaaaatcttttaga

SEQ ID NO: 99844 - DNA, 22 bp, Artificial sequence
  SiRNA target sequence
tttatcttaaaatcttttagaa

SEQ ID NO: 99845 - DNA, 22 bp, Artificial sequence
  SiRNA target sequence
ttatcttaaaatcttttagaac

SEQ ID NO: 99846 - DNA, 22 bp, Artificial sequence
  SiRNA target sequence
tatcttaaaatcttttagaacc

SEQ ID NO: 99847 - DNA, 22 bp, Artificial sequence
  SiRNA target sequence
atcttaaaatcttttagaacct

SEQ ID NO: 99848 - DNA, 22 bp, Artificial sequence
  SiRNA target sequence
tcttaaaatcttttagaacctc

SEQ ID NO: 99849 - DNA, 22 bp, Artificial sequence
  SiRNA target sequence
cttaaaatcttttagaacctca

SEQ ID NO: 99850 - DNA, 22 bp, Artificial sequence
  SiRNA target sequence
ttaaaatcttttagaacctcaa

SEQ ID NO: 99851 - DNA, 22 bp, Artificial sequence
  SiRNA target sequence
taaaatcttttagaacctcaaa

SEQ ID NO: 99852 - DNA, 22 bp, Artificial sequence
  SiRNA target sequence
aaaatcttttagaacctcaaaa

SEQ ID NO: 99853 - DNA, 22 bp, Artificial sequence
  SiRNA target sequence
aaatcttttagaacctcaaaaa

SEQ ID NO: 99854 - DNA, 22 bp, Artificial sequence
  SiRNA target sequence
aatcttttagaacctcaaaaat

SEQ ID NO: 99855 - DNA, 22 bp, Artificial sequence
  SiRNA target sequence
atcttttagaacctcaaaaata

SEQ ID NO: 99856 - DNA, 22 bp, Artificial sequence
  SiRNA target sequence
tcttttagaacctcaaaaatag

SEQ ID NO: 99857 - DNA, 22 bp, Artificial sequence
  SiRNA target sequence
cttttagaacctcaaaaatagt

SEQ ID NO: 99858 - DNA, 22 bp, Artificial sequence
  SiRNA target sequence
ttttagaacctcaaaaatagtg

SEQ ID NO: 99859 - DNA, 22 bp, Artificial sequence
  SiRNA target sequence
tttagaacctcaaaaatagtgc

SEQ ID NO: 99860 - DNA, 22 bp, Artificial sequence
  SiRNA target sequence
ttagaacctcaaaaatagtgcg

SEQ ID NO: 99861 - DNA, 22 bp, Artificial sequence
  SiRNA target sequence
tagaacctcaaaaatagtgcgc

SEQ ID NO: 99862 - DNA, 22 bp, Artificial sequence
  SiRNA target sequence
agaacctcaaaaatagtgcgct

SEQ ID NO: 99863 - DNA, 22 bp, Artificial sequence
  SiRNA target sequence
gaacctcaaaaatagtgcgctt

SEQ ID NO: 99864 - DNA, 22 bp, Artificial sequence
  SiRNA target sequence
aacctcaaaaatagtgcgcttc

SEQ ID NO: 99865 - DNA, 22 bp, Artificial sequence
  SiRNA target sequence
acctcaaaaatagtgcgcttcg

SEQ ID NO: 99866 - DNA, 22 bp, Artificial sequence
  SiRNA target sequence
cctcaaaaatagtgcgcttcgg

SEQ ID NO: 99867 - DNA, 22 bp, Artificial sequence
  SiRNA target sequence
ctcaaaaatagtgcgcttcggt

SEQ ID NO: 99868 - DNA, 22 bp, Artificial sequence
  SiRNA target sequence
tcaaaaatagtgcgcttcggta

SEQ ID NO: 99869 - DNA, 22 bp, Artificial sequence
  SiRNA target sequence
caaaaatagtgcgcttcggtag

SEQ ID NO: 99870 - DNA, 22 bp, Artificial sequence
  SiRNA target sequence
aaaaatagtgcgcttcggtagt

SEQ ID NO: 99871 - DNA, 22 bp, Artificial sequence
  SiRNA target sequence
aaaatagtgcgcttcggtagta

SEQ ID NO: 99872 - DNA, 22 bp, Artificial sequence
  SiRNA target sequence
aaatagtgcgcttcggtagtaa

SEQ ID NO: 99873 - DNA, 22 bp, Artificial sequence
  SiRNA target sequence
aatagtgcgcttcggtagtaaa

SEQ ID NO: 99874 - DNA, 22 bp, Artificial sequence
  SiRNA target sequence
atagtgcgcttcggtagtaaaa

SEQ ID NO: 99875 - DNA, 22 bp, Artificial sequence
  SiRNA target sequence
tagtgcgcttcggtagtaaaat

SEQ ID NO: 99876 - DNA, 22 bp, Artificial sequence
  SiRNA target sequence
agtgcgcttcggtagtaaaatg

SEQ ID NO: 99877 - DNA, 22 bp, Artificial sequence
  SiRNA target sequence
gtgcgcttcggtagtaaaatgt

SEQ ID NO: 99878 - DNA, 22 bp, Artificial sequence
  SiRNA target sequence
tgcgcttcggtagtaaaatgta

SEQ ID NO: 99879 - DNA, 22 bp, Artificial sequence
  SiRNA target sequence
gcgcttcggtagtaaaatgtaa

SEQ ID NO: 99880 - DNA, 22 bp, Artificial sequence
  SiRNA target sequence
cgcttcggtagtaaaatgtaat

SEQ ID NO: 99881 - DNA, 22 bp, Artificial sequence
  SiRNA target sequence
gcttcggtagtaaaatgtaatc

SEQ ID NO: 99882 - DNA, 22 bp, Artificial sequence
  SiRNA target sequence
cttcggtagtaaaatgtaatca

SEQ ID NO: 99883 - DNA, 22 bp, Artificial sequence
  SiRNA target sequence
ttcggtagtaaaatgtaatcat

SEQ ID NO: 99884 - DNA, 22 bp, Artificial sequence
  SiRNA target sequence
tcggtagtaaaatgtaatcata

SEQ ID NO: 99885 - DNA, 22 bp, Artificial sequence
  SiRNA target sequence
cggtagtaaaatgtaatcatag

SEQ ID NO: 99886 - DNA, 22 bp, Artificial sequence
  SiRNA target sequence
ggtagtaaaatgtaatcatagt

SEQ ID NO: 99887 - DNA, 22 bp, Artificial sequence
  SiRNA target sequence
gtagtaaaatgtaatcatagta

SEQ ID NO: 99888 - DNA, 22 bp, Artificial sequence
  SiRNA target sequence
tagtaaaatgtaatcatagtac

SEQ ID NO: 99889 - DNA, 22 bp, Artificial sequence
  SiRNA target sequence
agtaaaatgtaatcatagtaca

SEQ ID NO: 99890 - DNA, 22 bp, Artificial sequence
  SiRNA target sequence
gtaaaatgtaatcatagtacag

SEQ ID NO: 99891 - DNA, 22 bp, Artificial sequence
  SiRNA target sequence
taaaatgtaatcatagtacaga

SEQ ID NO: 99892 - DNA, 22 bp, Artificial sequence
  SiRNA target sequence
aaaatgtaatcatagtacagat

SEQ ID NO: 99893 - DNA, 22 bp, Artificial sequence
  SiRNA target sequence
aaatgtaatcatagtacagatc

SEQ ID NO: 99894 - DNA, 22 bp, Artificial sequence
  SiRNA target sequence
aatgtaatcatagtacagatcg

SEQ ID NO: 99895 - DNA, 22 bp, Artificial sequence
  SiRNA target sequence
atgtaatcatagtacagatcgt

SEQ ID NO: 99896 - DNA, 22 bp, Artificial sequence
  SiRNA target sequence
tgtaatcatagtacagatcgta

SEQ ID NO: 99897 - DNA, 22 bp, Artificial sequence
  SiRNA target sequence
gtaatcatagtacagatcgtaa

SEQ ID NO: 99898 - DNA, 22 bp, Artificial sequence
  SiRNA target sequence
taatcatagtacagatcgtaat

SEQ ID NO: 99899 - DNA, 22 bp, Artificial sequence
  SiRNA target sequence
aatcatagtacagatcgtaatt

SEQ ID NO: 99900 - DNA, 22 bp, Artificial sequence
  SiRNA target sequence
atcatagtacagatcgtaattt

SEQ ID NO: 99901 - DNA, 22 bp, Artificial sequence
  SiRNA target sequence
tcatagtacagatcgtaattta

SEQ ID NO: 99902 - DNA, 22 bp, Artificial sequence
  SiRNA target sequence
catagtacagatcgtaatttag

SEQ ID NO: 99903 - DNA, 22 bp, Artificial sequence
  SiRNA target sequence
atagtacagatcgtaatttaga

SEQ ID NO: 99904 - DNA, 22 bp, Artificial sequence
  SiRNA target sequence
tagtacagatcgtaatttagat

SEQ ID NO: 99905 - DNA, 22 bp, Artificial sequence
  SiRNA target sequence
agtacagatcgtaatttagata

SEQ ID NO: 99906 - DNA, 22 bp, Artificial sequence
  SiRNA target sequence
gtacagatcgtaatttagataa

SEQ ID NO: 99907 - DNA, 22 bp, Artificial sequence
  SiRNA target sequence
tacagatcgtaatttagataaa

SEQ ID NO: 99908 - DNA, 22 bp, Artificial sequence
  SiRNA target sequence
acagatcgtaatttagataaat

SEQ ID NO: 99909 - DNA, 22 bp, Artificial sequence
  SiRNA target sequence
cagatcgtaatttagataaatt

SEQ ID NO: 99910 - DNA, 22 bp, Artificial sequence
  SiRNA target sequence
agatcgtaatttagataaattt

SEQ ID NO: 99911 - DNA, 22 bp, Artificial sequence
  SiRNA target sequence
gatcgtaatttagataaatttc

SEQ ID NO: 99912 - DNA, 22 bp, Artificial sequence
  SiRNA target sequence
atcgtaatttagataaatttct

SEQ ID NO: 99913 - DNA, 22 bp, Artificial sequence
  SiRNA target sequence
tcgtaatttagataaatttctt

SEQ ID NO: 99914 - DNA, 22 bp, Artificial sequence
  SiRNA target sequence
cgtaatttagataaatttcttt

SEQ ID NO: 99915 - DNA, 22 bp, Artificial sequence
  SiRNA target sequence
gtaatttagataaatttcttta

SEQ ID NO: 99916 - DNA, 22 bp, Artificial sequence
  SiRNA target sequence
taatttagataaatttctttac

SEQ ID NO: 99917 - DNA, 22 bp, Artificial sequence
  SiRNA target sequence
aatttagataaatttctttaca

SEQ ID NO: 99918 - DNA, 22 bp, Artificial sequence
  SiRNA target sequence
atttagataaatttctttacat

SEQ ID NO: 99919 - DNA, 22 bp, Artificial sequence
  SiRNA target sequence
tttagataaatttctttacatt

SEQ ID NO: 99920 - DNA, 22 bp, Artificial sequence
  SiRNA target sequence
ttagataaatttctttacattt

SEQ ID NO: 99921 - DNA, 22 bp, Artificial sequence
  SiRNA target sequence
tagataaatttctttacatttc

SEQ ID NO: 99922 - DNA, 22 bp, Artificial sequence
  SiRNA target sequence
agataaatttctttacatttct

SEQ ID NO: 99923 - DNA, 22 bp, Artificial sequence
  SiRNA target sequence
gataaatttctttacatttctc

SEQ ID NO: 99924 - DNA, 22 bp, Artificial sequence
  SiRNA target sequence
ataaatttctttacatttctca

SEQ ID NO: 99925 - DNA, 22 bp, Artificial sequence
  SiRNA target sequence
taaatttctttacatttctcac

SEQ ID NO: 99926 - DNA, 22 bp, Artificial sequence
  SiRNA target sequence
aaatttctttacatttctcacg

SEQ ID NO: 99927 - DNA, 22 bp, Artificial sequence
  SiRNA target sequence
aatttctttacatttctcacga

SEQ ID NO: 99928 - DNA, 22 bp, Artificial sequence
  SiRNA target sequence
atttctttacatttctcacgat

SEQ ID NO: 99929 - DNA, 22 bp, Artificial sequence
  SiRNA target sequence
tttctttacatttctcacgata

SEQ ID NO: 99930 - DNA, 22 bp, Artificial sequence
  SiRNA target sequence
ttctttacatttctcacgatat

SEQ ID NO: 99931 - DNA, 22 bp, Artificial sequence
  SiRNA target sequence
tctttacatttctcacgatatt

SEQ ID NO: 99932 - DNA, 22 bp, Artificial sequence
  SiRNA target sequence
ctttacatttctcacgatattc

SEQ ID NO: 99933 - DNA, 22 bp, Artificial sequence
  SiRNA target sequence
tttacatttctcacgatattcc

SEQ ID NO: 99934 - DNA, 22 bp, Artificial sequence
  SiRNA target sequence
ttacatttctcacgatattcct

SEQ ID NO: 99935 - DNA, 22 bp, Artificial sequence
  SiRNA target sequence
tacatttctcacgatattcctc

SEQ ID NO: 99936 - DNA, 22 bp, Artificial sequence
  SiRNA target sequence
acatttctcacgatattcctca

SEQ ID NO: 99937 - DNA, 22 bp, Artificial sequence
  SiRNA target sequence
catttctcacgatattcctcag

SEQ ID NO: 99938 - DNA, 22 bp, Artificial sequence
  SiRNA target sequence
atttctcacgatattcctcagc

SEQ ID NO: 99939 - DNA, 22 bp, Artificial sequence
  SiRNA target sequence
tttctcacgatattcctcagca

SEQ ID NO: 99940 - DNA, 22 bp, Artificial sequence
  SiRNA target sequence
ttctcacgatattcctcagcaa

SEQ ID NO: 99941 - DNA, 22 bp, Artificial sequence
  SiRNA target sequence
tctcacgatattcctcagcaat

SEQ ID NO: 99942 - DNA, 22 bp, Artificial sequence
  SiRNA target sequence
ctcacgatattcctcagcaatg

SEQ ID NO: 99943 - DNA, 22 bp, Artificial sequence
  SiRNA target sequence
tcacgatattcctcagcaatgg

SEQ ID NO: 99944 - DNA, 22 bp, Artificial sequence
  SiRNA target sequence
cacgatattcctcagcaatggt

SEQ ID NO: 99945 - DNA, 22 bp, Artificial sequence
  SiRNA target sequence
acgatattcctcagcaatggta

SEQ ID NO: 99946 - DNA, 22 bp, Artificial sequence
  SiRNA target sequence
cgatattcctcagcaatggtat

SEQ ID NO: 99947 - DNA, 22 bp, Artificial sequence
  SiRNA target sequence
gatattcctcagcaatggtatc

SEQ ID NO: 99948 - DNA, 22 bp, Artificial sequence
  SiRNA target sequence
atattcctcagcaatggtatct

SEQ ID NO: 99949 - DNA, 22 bp, Artificial sequence
  SiRNA target sequence
tattcctcagcaatggtatctg

SEQ ID NO: 99950 - DNA, 22 bp, Artificial sequence
  SiRNA target sequence
attcctcagcaatggtatctgt

SEQ ID NO: 99951 - DNA, 22 bp, Artificial sequence
  SiRNA target sequence
ttcctcagcaatggtatctgtg

SEQ ID NO: 99952 - DNA, 22 bp, Artificial sequence
  SiRNA target sequence
tcctcagcaatggtatctgtga

SEQ ID NO: 99953 - DNA, 22 bp, Artificial sequence
  SiRNA target sequence
cctcagcaatggtatctgtgat

SEQ ID NO: 99954 - DNA, 22 bp, Artificial sequence
  SiRNA target sequence
ctcagcaatggtatctgtgata

SEQ ID NO: 99955 - DNA, 22 bp, Artificial sequence
  SiRNA target sequence
tcagcaatggtatctgtgataa

SEQ ID NO: 99956 - DNA, 22 bp, Artificial sequence
  SiRNA target sequence
cagcaatggtatctgtgataag

SEQ ID NO: 99957 - DNA, 22 bp, Artificial sequence
  SiRNA target sequence
agcaatggtatctgtgataagc

SEQ ID NO: 99958 - DNA, 22 bp, Artificial sequence
  SiRNA target sequence
gcaatggtatctgtgataagcg

SEQ ID NO: 99959 - DNA, 22 bp, Artificial sequence
  SiRNA target sequence
caatggtatctgtgataagcga

SEQ ID NO: 99960 - DNA, 22 bp, Artificial sequence
  SiRNA target sequence
aatggtatctgtgataagcgaa

SEQ ID NO: 99961 - DNA, 22 bp, Artificial sequence
  SiRNA target sequence
atggtatctgtgataagcgaaa

SEQ ID NO: 99962 - DNA, 22 bp, Artificial sequence
  SiRNA target sequence
tggtatctgtgataagcgaaag

SEQ ID NO: 99963 - DNA, 22 bp, Artificial sequence
  SiRNA target sequence
ggtatctgtgataagcgaaagt

SEQ ID NO: 99964 - DNA, 22 bp, Artificial sequence
  SiRNA target sequence
gtatctgtgataagcgaaagtt

SEQ ID NO: 99965 - DNA, 22 bp, Artificial sequence
  SiRNA target sequence
tatctgtgataagcgaaagttg

SEQ ID NO: 99966 - DNA, 22 bp, Artificial sequence
  SiRNA target sequence
atctgtgataagcgaaagttgt

SEQ ID NO: 99967 - DNA, 22 bp, Artificial sequence
  SiRNA target sequence
tctgtgataagcgaaagttgta

SEQ ID NO: 99968 - DNA, 22 bp, Artificial sequence
  SiRNA target sequence
ctgtgataagcgaaagttgtag

SEQ ID NO: 99969 - DNA, 22 bp, Artificial sequence
  SiRNA target sequence
tgtgataagcgaaagttgtaga

SEQ ID NO: 99970 - DNA, 22 bp, Artificial sequence
  SiRNA target sequence
gtgataagcgaaagttgtagaa

SEQ ID NO: 99971 - DNA, 22 bp, Artificial sequence
  SiRNA target sequence
tgataagcgaaagttgtagaaa

SEQ ID NO: 99972 - DNA, 22 bp, Artificial sequence
  SiRNA target sequence
gataagcgaaagttgtagaaaa

SEQ ID NO: 99973 - DNA, 22 bp, Artificial sequence
  SiRNA target sequence
ataagcgaaagttgtagaaaaa

SEQ ID NO: 99974 - DNA, 22 bp, Artificial sequence
  SiRNA target sequence
taagcgaaagttgtagaaaaaa

SEQ ID NO: 99975 - DNA, 22 bp, Artificial sequence
  SiRNA target sequence
aagcgaaagttgtagaaaaaaa

SEQ ID NO: 99976 - DNA, 22 bp, Artificial sequence
  SiRNA target sequence
agcgaaagttgtagaaaaaaat

SEQ ID NO: 99977 - DNA, 22 bp, Artificial sequence
  SiRNA target sequence
gcgaaagttgtagaaaaaaata

SEQ ID NO: 99978 - DNA, 22 bp, Artificial sequence
  SiRNA target sequence
cgaaagttgtagaaaaaaatag

SEQ ID NO: 99979 - DNA, 22 bp, Artificial sequence
  SiRNA target sequence
gaaagttgtagaaaaaaataga

SEQ ID NO: 99980 - DNA, 22 bp, Artificial sequence
  SiRNA target sequence
aaagttgtagaaaaaaatagat

SEQ ID NO: 99981 - DNA, 22 bp, Artificial sequence
  SiRNA target sequence
aagttgtagaaaaaaatagatt

SEQ ID NO: 99982 - DNA, 22 bp, Artificial sequence
  SiRNA target sequence
agttgtagaaaaaaatagattt

SEQ ID NO: 99983 - DNA, 22 bp, Artificial sequence
  SiRNA target sequence
gttgtagaaaaaaatagatttg

SEQ ID NO: 99984 - DNA, 22 bp, Artificial sequence
  SiRNA target sequence
ttgtagaaaaaaatagatttga

SEQ ID NO: 99985 - DNA, 22 bp, Artificial sequence
  SiRNA target sequence
tgtagaaaaaaatagatttgag

SEQ ID NO: 99986 - DNA, 22 bp, Artificial sequence
  SiRNA target sequence
gtagaaaaaaatagatttgagg

SEQ ID NO: 99987 - DNA, 22 bp, Artificial sequence
  SiRNA target sequence
tagaaaaaaatagatttgagga

SEQ ID NO: 99988 - DNA, 22 bp, Artificial sequence
  SiRNA target sequence
agaaaaaaatagatttgaggaa

SEQ ID NO: 99989 - DNA, 22 bp, Artificial sequence
  SiRNA target sequence
gaaaaaaatagatttgaggaat

SEQ ID NO: 99990 - DNA, 22 bp, Artificial sequence
  SiRNA target sequence
aaaaaaatagatttgaggaata

SEQ ID NO: 99991 - DNA, 22 bp, Artificial sequence
  SiRNA target sequence
aaaaaatagatttgaggaatag

SEQ ID NO: 99992 - DNA, 22 bp, Artificial sequence
  SiRNA target sequence
aaaaatagatttgaggaataga

SEQ ID NO: 99993 - DNA, 22 bp, Artificial sequence
  SiRNA target sequence
aaaatagatttgaggaatagaa

SEQ ID NO: 99994 - DNA, 22 bp, Artificial sequence
  SiRNA target sequence
aaatagatttgaggaatagaat

SEQ ID NO: 99995 - DNA, 22 bp, Artificial sequence
  SiRNA target sequence
aatagatttgaggaatagaatt

SEQ ID NO: 99996 - DNA, 22 bp, Artificial sequence
  SiRNA target sequence
atagatttgaggaatagaatta

SEQ ID NO: 99997 - DNA, 22 bp, Artificial sequence
  SiRNA target sequence
tagatttgaggaatagaattaa

SEQ ID NO: 99998 - DNA, 22 bp, Artificial sequence
  SiRNA target sequence
agatttgaggaatagaattaaa

SEQ ID NO: 99999 - DNA, 22 bp, Artificial sequence
  SiRNA target sequence
gatttgaggaatagaattaaaa

SEQ ID NO: 100000 - DNA, 22 bp, Artificial sequence
  SiRNA target sequence
atttgaggaatagaattaaaat

SEQ ID NO: 100001 - DNA, 22 bp, Artificial sequence
  SiRNA target sequence
tttgaggaatagaattaaaatc

SEQ ID NO: 100002 - DNA, 22 bp, Artificial sequence
  SiRNA target sequence
ttgaggaatagaattaaaatca

SEQ ID NO: 100003 - DNA, 22 bp, Artificial sequence
  SiRNA target sequence
tgaggaatagaattaaaatcac

SEQ ID NO: 100004 - DNA, 22 bp, Artificial sequence
  SiRNA target sequence
gaggaatagaattaaaatcaca

SEQ ID NO: 100005 - DNA, 22 bp, Artificial sequence
  SiRNA target sequence
aggaatagaattaaaatcacaa

SEQ ID NO: 100006 - DNA, 22 bp, Artificial sequence
  SiRNA target sequence
ggaatagaattaaaatcacaat

SEQ ID NO: 100007 - DNA, 22 bp, Artificial sequence
  SiRNA target sequence
gaatagaattaaaatcacaata

SEQ ID NO: 100008 - DNA, 22 bp, Artificial sequence
  SiRNA target sequence
aatagaattaaaatcacaatat

SEQ ID NO: 100009 - DNA, 22 bp, Artificial sequence
  SiRNA target sequence
atagaattaaaatcacaatatt

SEQ ID NO: 100010 - DNA, 22 bp, Artificial sequence
  SiRNA target sequence
tagaattaaaatcacaatattt

SEQ ID NO: 100011 - DNA, 22 bp, Artificial sequence
  SiRNA target sequence
agaattaaaatcacaatatttt

SEQ ID NO: 100012 - DNA, 22 bp, Artificial sequence
  SiRNA target sequence
gaattaaaatcacaatattttt

SEQ ID NO: 100013 - DNA, 22 bp, Artificial sequence
  SiRNA target sequence
aattaaaatcacaatatttttt

SEQ ID NO: 100014 - DNA, 22 bp, Artificial sequence
  SiRNA target sequence
attaaaatcacaatatttttta

SEQ ID NO: 100015 - DNA, 22 bp, Artificial sequence
  SiRNA target sequence
ttaaaatcacaatattttttaa

SEQ ID NO: 100016 - DNA, 22 bp, Artificial sequence
  SiRNA target sequence
taaaatcacaatattttttaat

SEQ ID NO: 100017 - DNA, 22 bp, Artificial sequence
  SiRNA target sequence
aaaatcacaatattttttaata

SEQ ID NO: 100018 - DNA, 22 bp, Artificial sequence
  SiRNA target sequence
aaatcacaatattttttaatat

SEQ ID NO: 100019 - DNA, 22 bp, Artificial sequence
  SiRNA target sequence
aatcacaatattttttaatata

SEQ ID NO: 100020 - DNA, 22 bp, Artificial sequence
  SiRNA target sequence
atcacaatattttttaatatat

SEQ ID NO: 100021 - DNA, 22 bp, Artificial sequence
  SiRNA target sequence
tcacaatattttttaatatatt

SEQ ID NO: 100022 - DNA, 22 bp, Artificial sequence
  SiRNA target sequence
cacaatattttttaatatattt

SEQ ID NO: 100023 - DNA, 22 bp, Artificial sequence
  SiRNA target sequence
acaatattttttaatatattta

SEQ ID NO: 100024 - DNA, 22 bp, Artificial sequence
  SiRNA target sequence
caatattttttaatatatttaa

SEQ ID NO: 100025 - DNA, 22 bp, Artificial sequence
  SiRNA target sequence
aatattttttaatatatttaac

SEQ ID NO: 100026 - DNA, 22 bp, Artificial sequence
  SiRNA target sequence
atattttttaatatatttaacc

SEQ ID NO: 100027 - DNA, 22 bp, Artificial sequence
  SiRNA target sequence
tattttttaatatatttaacca

SEQ ID NO: 100028 - DNA, 22 bp, Artificial sequence
  SiRNA target sequence
attttttaatatatttaaccaa

SEQ ID NO: 100029 - DNA, 22 bp, Artificial sequence
  SiRNA target sequence
ttttttaatatatttaaccaag

SEQ ID NO: 100030 - DNA, 22 bp, Artificial sequence
  SiRNA target sequence
tttttaatatatttaaccaagg

SEQ ID NO: 100031 - DNA, 22 bp, Artificial sequence
  SiRNA target sequence
ttttaatatatttaaccaaggt

SEQ ID NO: 100032 - DNA, 22 bp, Artificial sequence
  SiRNA target sequence
tttaatatatttaaccaaggta

SEQ ID NO: 100033 - DNA, 22 bp, Artificial sequence
  SiRNA target sequence
ttaatatatttaaccaaggtat

SEQ ID NO: 100034 - DNA, 22 bp, Artificial sequence
  SiRNA target sequence
taatatatttaaccaaggtatt

SEQ ID NO: 100035 - DNA, 22 bp, Artificial sequence
  SiRNA target sequence
aatatatttaaccaaggtattg

SEQ ID NO: 100036 - DNA, 22 bp, Artificial sequence
  SiRNA target sequence
atatatttaaccaaggtattgt

SEQ ID NO: 100037 - DNA, 22 bp, Artificial sequence
  SiRNA target sequence
tatatttaaccaaggtattgtc

SEQ ID NO: 100038 - DNA, 22 bp, Artificial sequence
  SiRNA target sequence
atatttaaccaaggtattgtcc

SEQ ID NO: 100039 - DNA, 22 bp, Artificial sequence
  SiRNA target sequence
tatttaaccaaggtattgtcct

SEQ ID NO: 100040 - DNA, 22 bp, Artificial sequence
  SiRNA target sequence
atttaaccaaggtattgtcctt

SEQ ID NO: 100041 - DNA, 22 bp, Artificial sequence
  SiRNA target sequence
tttaaccaaggtattgtccttt

SEQ ID NO: 100042 - DNA, 22 bp, Artificial sequence
  SiRNA target sequence
ttaaccaaggtattgtccttta

SEQ ID NO: 100043 - DNA, 22 bp, Artificial sequence
  SiRNA target sequence
taaccaaggtattgtcctttat

SEQ ID NO: 100044 - DNA, 22 bp, Artificial sequence
  SiRNA target sequence
aaccaaggtattgtcctttatg

SEQ ID NO: 100045 - DNA, 22 bp, Artificial sequence
  SiRNA target sequence
accaaggtattgtcctttatgt

SEQ ID NO: 100046 - DNA, 22 bp, Artificial sequence
  SiRNA target sequence
ccaaggtattgtcctttatgtt

SEQ ID NO: 100047 - DNA, 22 bp, Artificial sequence
  SiRNA target sequence
caaggtattgtcctttatgtta

SEQ ID NO: 100048 - DNA, 22 bp, Artificial sequence
  SiRNA target sequence
aaggtattgtcctttatgttat

SEQ ID NO: 100049 - DNA, 22 bp, Artificial sequence
  SiRNA target sequence
aggtattgtcctttatgttatt

SEQ ID NO: 100050 - DNA, 22 bp, Artificial sequence
  SiRNA target sequence
ggtattgtcctttatgttatta

SEQ ID NO: 100051 - DNA, 22 bp, Artificial sequence
  SiRNA target sequence
gtattgtcctttatgttattat

SEQ ID NO: 100052 - DNA, 22 bp, Artificial sequence
  SiRNA target sequence
tattgtcctttatgttattata

SEQ ID NO: 100053 - DNA, 22 bp, Artificial sequence
  SiRNA target sequence
attgtcctttatgttattatat

SEQ ID NO: 100054 - DNA, 22 bp, Artificial sequence
  SiRNA target sequence
ttgtcctttatgttattatatc

SEQ ID NO: 100055 - DNA, 22 bp, Artificial sequence
  SiRNA target sequence
tgtcctttatgttattatatct

SEQ ID NO: 100056 - DNA, 22 bp, Artificial sequence
  SiRNA target sequence
gtcctttatgttattatatctt

SEQ ID NO: 100057 - DNA, 22 bp, Artificial sequence
  SiRNA target sequence
tcctttatgttattatatctta

SEQ ID NO: 100058 - DNA, 22 bp, Artificial sequence
  SiRNA target sequence
cctttatgttattatatcttac

SEQ ID NO: 100059 - DNA, 22 bp, Artificial sequence
  SiRNA target sequence
ctttatgttattatatcttaca

SEQ ID NO: 100060 - DNA, 22 bp, Artificial sequence
  SiRNA target sequence
tttatgttattatatcttacaa

SEQ ID NO: 100061 - DNA, 22 bp, Artificial sequence
  SiRNA target sequence
ttatgttattatatcttacaaa

SEQ ID NO: 100062 - DNA, 22 bp, Artificial sequence
  SiRNA target sequence
tatgttattatatcttacaaac

SEQ ID NO: 100063 - DNA, 22 bp, Artificial sequence
  SiRNA target sequence
atgttattatatcttacaaact

SEQ ID NO: 100064 - DNA, 22 bp, Artificial sequence
  SiRNA target sequence
tgttattatatcttacaaactc

SEQ ID NO: 100065 - DNA, 22 bp, Artificial sequence
  SiRNA target sequence
gttattatatcttacaaactcc

SEQ ID NO: 100066 - DNA, 22 bp, Artificial sequence
  SiRNA target sequence
ttattatatcttacaaactcct

SEQ ID NO: 100067 - DNA, 22 bp, Artificial sequence
  SiRNA target sequence
tattatatcttacaaactcctc

SEQ ID NO: 100068 - DNA, 22 bp, Artificial sequence
  SiRNA target sequence
attatatcttacaaactcctcg

SEQ ID NO: 100069 - DNA, 22 bp, Artificial sequence
  SiRNA target sequence
ttatatcttacaaactcctcgt

SEQ ID NO: 100070 - DNA, 22 bp, Artificial sequence
  SiRNA target sequence
tatatcttacaaactcctcgta

SEQ ID NO: 100071 - DNA, 22 bp, Artificial sequence
  SiRNA target sequence
atatcttacaaactcctcgtaa

SEQ ID NO: 100072 - DNA, 22 bp, Artificial sequence
  SiRNA target sequence
tatcttacaaactcctcgtaat

SEQ ID NO: 100073 - DNA, 22 bp, Artificial sequence
  SiRNA target sequence
atcttacaaactcctcgtaatt

SEQ ID NO: 100074 - DNA, 22 bp, Artificial sequence
  SiRNA target sequence
tcttacaaactcctcgtaatta

SEQ ID NO: 100075 - DNA, 22 bp, Artificial sequence
  SiRNA target sequence
cttacaaactcctcgtaattat

SEQ ID NO: 100076 - DNA, 22 bp, Artificial sequence
  SiRNA target sequence
ttacaaactcctcgtaattata

SEQ ID NO: 100077 - DNA, 22 bp, Artificial sequence
  SiRNA target sequence
tacaaactcctcgtaattataa

SEQ ID NO: 100078 - DNA, 22 bp, Artificial sequence
  SiRNA target sequence
acaaactcctcgtaattataat

SEQ ID NO: 100079 - DNA, 22 bp, Artificial sequence
  SiRNA target sequence
caaactcctcgtaattataatt

SEQ ID NO: 100080 - DNA, 22 bp, Artificial sequence
  SiRNA target sequence
aaactcctcgtaattataattt

SEQ ID NO: 100081 - DNA, 22 bp, Artificial sequence
  SiRNA target sequence
aactcctcgtaattataatttt

SEQ ID NO: 100082 - DNA, 22 bp, Artificial sequence
  SiRNA target sequence
actcctcgtaattataattttc

SEQ ID NO: 100083 - DNA, 22 bp, Artificial sequence
  SiRNA target sequence
ctcctcgtaattataattttca

SEQ ID NO: 100084 - DNA, 22 bp, Artificial sequence
  SiRNA target sequence
tcctcgtaattataattttcag

SEQ ID NO: 100085 - DNA, 22 bp, Artificial sequence
  SiRNA target sequence
cctcgtaattataattttcagg

SEQ ID NO: 100086 - DNA, 22 bp, Artificial sequence
  SiRNA target sequence
ctcgtaattataattttcagga

SEQ ID NO: 100087 - DNA, 22 bp, Artificial sequence
  SiRNA target sequence
tcgtaattataattttcaggat

SEQ ID NO: 100088 - DNA, 22 bp, Artificial sequence
  SiRNA target sequence
cgtaattataattttcaggata

SEQ ID NO: 100089 - DNA, 22 bp, Artificial sequence
  SiRNA target sequence
gtaattataattttcaggataa

SEQ ID NO: 100090 - DNA, 22 bp, Artificial sequence
  SiRNA target sequence
taattataattttcaggataaa

SEQ ID NO: 100091 - DNA, 22 bp, Artificial sequence
  SiRNA target sequence
aattataattttcaggataaac

SEQ ID NO: 100092 - DNA, 22 bp, Artificial sequence
  SiRNA target sequence
attataattttcaggataaacc

SEQ ID NO: 100093 - DNA, 22 bp, Artificial sequence
  SiRNA target sequence
ttataattttcaggataaaccg

SEQ ID NO: 100094 - DNA, 22 bp, Artificial sequence
  SiRNA target sequence
tataattttcaggataaaccgc

SEQ ID NO: 100095 - DNA, 22 bp, Artificial sequence
  SiRNA target sequence
ataattttcaggataaaccgct

SEQ ID NO: 100096 - DNA, 22 bp, Artificial sequence
  SiRNA target sequence
taattttcaggataaaccgcta

SEQ ID NO: 100097 - DNA, 22 bp, Artificial sequence
  SiRNA target sequence
aattttcaggataaaccgctag

SEQ ID NO: 100098 - DNA, 22 bp, Artificial sequence
  SiRNA target sequence
attttcaggataaaccgctaga

SEQ ID NO: 100099 - DNA, 22 bp, Artificial sequence
  SiRNA target sequence
ttttcaggataaaccgctagac

SEQ ID NO: 100100 - DNA, 22 bp, Artificial sequence
  SiRNA target sequence
tttcaggataaaccgctagaca

SEQ ID NO: 100101 - DNA, 22 bp, Artificial sequence
  SiRNA target sequence
ttcaggataaaccgctagacaa

SEQ ID NO: 100102 - DNA, 22 bp, Artificial sequence
  SiRNA target sequence
tcaggataaaccgctagacaat

SEQ ID NO: 100103 - DNA, 22 bp, Artificial sequence
  SiRNA target sequence
caggataaaccgctagacaatc

SEQ ID NO: 100104 - DNA, 22 bp, Artificial sequence
  SiRNA target sequence
aggataaaccgctagacaatca

SEQ ID NO: 100105 - DNA, 22 bp, Artificial sequence
  SiRNA target sequence
ggataaaccgctagacaatcac

SEQ ID NO: 100106 - DNA, 22 bp, Artificial sequence
  SiRNA target sequence
gataaaccgctagacaatcacc

SEQ ID NO: 100107 - DNA, 22 bp, Artificial sequence
  SiRNA target sequence
ataaaccgctagacaatcaccg

SEQ ID NO: 100108 - DNA, 22 bp, Artificial sequence
  SiRNA target sequence
taaaccgctagacaatcaccga

SEQ ID NO: 100109 - DNA, 22 bp, Artificial sequence
  SiRNA target sequence
aaaccgctagacaatcaccgat

SEQ ID NO: 100110 - DNA, 22 bp, Artificial sequence
  SiRNA target sequence
aaccgctagacaatcaccgatt

SEQ ID NO: 100111 - DNA, 22 bp, Artificial sequence
  SiRNA target sequence
accgctagacaatcaccgattt

SEQ ID NO: 100112 - DNA, 22 bp, Artificial sequence
  SiRNA target sequence
ccgctagacaatcaccgatttc

SEQ ID NO: 100113 - DNA, 22 bp, Artificial sequence
  SiRNA target sequence
cgctagacaatcaccgatttca

SEQ ID NO: 100114 - DNA, 22 bp, Artificial sequence
  SiRNA target sequence
gctagacaatcaccgatttcaa

SEQ ID NO: 100115 - DNA, 22 bp, Artificial sequence
  SiRNA target sequence
ctagacaatcaccgatttcaaa

SEQ ID NO: 100116 - DNA, 22 bp, Artificial sequence
  SiRNA target sequence
tagacaatcaccgatttcaaaa

SEQ ID NO: 100117 - DNA, 22 bp, Artificial sequence
  SiRNA target sequence
agacaatcaccgatttcaaaat

SEQ ID NO: 100118 - DNA, 22 bp, Artificial sequence
  SiRNA target sequence
gacaatcaccgatttcaaaatt

SEQ ID NO: 100119 - DNA, 22 bp, Artificial sequence
  SiRNA target sequence
acaatcaccgatttcaaaattt

SEQ ID NO: 100120 - DNA, 22 bp, Artificial sequence
  SiRNA target sequence
caatcaccgatttcaaaatttt

SEQ ID NO: 100121 - DNA, 22 bp, Artificial sequence
  SiRNA target sequence
aatcaccgatttcaaaattttc

SEQ ID NO: 100122 - DNA, 22 bp, Artificial sequence
  SiRNA target sequence
atcaccgatttcaaaattttct

SEQ ID NO: 100123 - DNA, 22 bp, Artificial sequence
  SiRNA target sequence
tcaccgatttcaaaattttcta

SEQ ID NO: 100124 - DNA, 22 bp, Artificial sequence
  SiRNA target sequence
caccgatttcaaaattttctat

SEQ ID NO: 100125 - DNA, 22 bp, Artificial sequence
  SiRNA target sequence
accgatttcaaaattttctata

SEQ ID NO: 100126 - DNA, 22 bp, Artificial sequence
  SiRNA target sequence
ccgatttcaaaattttctatat

SEQ ID NO: 100127 - DNA, 22 bp, Artificial sequence
  SiRNA target sequence
cgatttcaaaattttctatatc

SEQ ID NO: 100128 - DNA, 22 bp, Artificial sequence
  SiRNA target sequence
gatttcaaaattttctatatct

SEQ ID NO: 100129 - DNA, 22 bp, Artificial sequence
  SiRNA target sequence
atttcaaaattttctatatcta

SEQ ID NO: 100130 - DNA, 22 bp, Artificial sequence
  SiRNA target sequence
tttcaaaattttctatatctat

SEQ ID NO: 100131 - DNA, 22 bp, Artificial sequence
  SiRNA target sequence
ttcaaaattttctatatctata

SEQ ID NO: 100132 - DNA, 22 bp, Artificial sequence
  SiRNA target sequence
tcaaaattttctatatctatat

SEQ ID NO: 100133 - DNA, 22 bp, Artificial sequence
  SiRNA target sequence
caaaattttctatatctatatc

SEQ ID NO: 100134 - DNA, 22 bp, Artificial sequence
  SiRNA target sequence
aaaattttctatatctatatca

SEQ ID NO: 100135 - DNA, 22 bp, Artificial sequence
  SiRNA target sequence
aaattttctatatctatatcaa

SEQ ID NO: 100136 - DNA, 22 bp, Artificial sequence
  SiRNA target sequence
aattttctatatctatatcaaa

SEQ ID NO: 100137 - DNA, 22 bp, Artificial sequence
  SiRNA target sequence
attttctatatctatatcaaat

SEQ ID NO: 100138 - DNA, 22 bp, Artificial sequence
  SiRNA target sequence
ttttctatatctatatcaaatt

SEQ ID NO: 100139 - DNA, 22 bp, Artificial sequence
  SiRNA target sequence
tttctatatctatatcaaattt

SEQ ID NO: 100140 - DNA, 22 bp, Artificial sequence
  SiRNA target sequence
ttctatatctatatcaaatttt

SEQ ID NO: 100141 - DNA, 22 bp, Artificial sequence
  SiRNA target sequence
tctatatctatatcaaatttta

SEQ ID NO: 100142 - DNA, 22 bp, Artificial sequence
  SiRNA target sequence
ctatatctatatcaaattttat

SEQ ID NO: 100143 - DNA, 22 bp, Artificial sequence
  SiRNA target sequence
tatatctatatcaaattttatt

SEQ ID NO: 100144 - DNA, 22 bp, Artificial sequence
  SiRNA target sequence
atatctatatcaaattttattt

SEQ ID NO: 100145 - DNA, 22 bp, Artificial sequence
  SiRNA target sequence
tatctatatcaaattttatttc

SEQ ID NO: 100146 - DNA, 22 bp, Artificial sequence
  SiRNA target sequence
atctatatcaaattttatttct

SEQ ID NO: 100147 - DNA, 22 bp, Artificial sequence
  SiRNA target sequence
tctatatcaaattttatttcta

SEQ ID NO: 100148 - DNA, 22 bp, Artificial sequence
  SiRNA target sequence
ctatatcaaattttatttctaa

SEQ ID NO: 100149 - DNA, 22 bp, Artificial sequence
  SiRNA target sequence
tatatcaaattttatttctaaa

SEQ ID NO: 100150 - DNA, 22 bp, Artificial sequence
  SiRNA target sequence
atatcaaattttatttctaaaa

SEQ ID NO: 100151 - DNA, 22 bp, Artificial sequence
  SiRNA target sequence
tatcaaattttatttctaaaat

SEQ ID NO: 100152 - DNA, 22 bp, Artificial sequence
  SiRNA target sequence
atcaaattttatttctaaaata

SEQ ID NO: 100153 - DNA, 22 bp, Artificial sequence
  SiRNA target sequence
tcaaattttatttctaaaatag

SEQ ID NO: 100154 - DNA, 22 bp, Artificial sequence
  SiRNA target sequence
caaattttatttctaaaatagg

SEQ ID NO: 100155 - DNA, 22 bp, Artificial sequence
  SiRNA target sequence
aaattttatttctaaaatagga

SEQ ID NO: 100156 - DNA, 22 bp, Artificial sequence
  SiRNA target sequence
aattttatttctaaaataggat

SEQ ID NO: 100157 - DNA, 22 bp, Artificial sequence
  SiRNA target sequence
attttatttctaaaataggata

SEQ ID NO: 100158 - DNA, 22 bp, Artificial sequence
  SiRNA target sequence
ttttatttctaaaataggataa

SEQ ID NO: 100159 - DNA, 22 bp, Artificial sequence
  SiRNA target sequence
tttatttctaaaataggataaa

SEQ ID NO: 100160 - DNA, 22 bp, Artificial sequence
  SiRNA target sequence
ttatttctaaaataggataaat

SEQ ID NO: 100161 - DNA, 22 bp, Artificial sequence
  SiRNA target sequence
tatttctaaaataggataaatg

SEQ ID NO: 100162 - DNA, 22 bp, Artificial sequence
  SiRNA target sequence
atttctaaaataggataaatgt

SEQ ID NO: 100163 - DNA, 22 bp, Artificial sequence
  SiRNA target sequence
tttctaaaataggataaatgta

SEQ ID NO: 100164 - DNA, 22 bp, Artificial sequence
  SiRNA target sequence
ttctaaaataggataaatgtaa

SEQ ID NO: 100165 - DNA, 22 bp, Artificial sequence
  SiRNA target sequence
tctaaaataggataaatgtaat

SEQ ID NO: 100166 - DNA, 22 bp, Artificial sequence
  SiRNA target sequence
ctaaaataggataaatgtaatt

SEQ ID NO: 100167 - DNA, 22 bp, Artificial sequence
  SiRNA target sequence
taaaataggataaatgtaattg

SEQ ID NO: 100168 - DNA, 22 bp, Artificial sequence
  SiRNA target sequence
aaaataggataaatgtaattgt

SEQ ID NO: 100169 - DNA, 22 bp, Artificial sequence
  SiRNA target sequence
aaataggataaatgtaattgta

SEQ ID NO: 100170 - DNA, 22 bp, Artificial sequence
  SiRNA target sequence
aataggataaatgtaattgtaa

SEQ ID NO: 100171 - DNA, 22 bp, Artificial sequence
  SiRNA target sequence
ataggataaatgtaattgtaag

SEQ ID NO: 100172 - DNA, 22 bp, Artificial sequence
  SiRNA target sequence
taggataaatgtaattgtaagg

SEQ ID NO: 100173 - DNA, 22 bp, Artificial sequence
  SiRNA target sequence
aggataaatgtaattgtaaggt

SEQ ID NO: 100174 - DNA, 22 bp, Artificial sequence
  SiRNA target sequence
ggataaatgtaattgtaaggtg

SEQ ID NO: 100175 - DNA, 22 bp, Artificial sequence
  SiRNA target sequence
gataaatgtaattgtaaggtgt

SEQ ID NO: 100176 - DNA, 22 bp, Artificial sequence
  SiRNA target sequence
ataaatgtaattgtaaggtgtt

SEQ ID NO: 100177 - DNA, 22 bp, Artificial sequence
  SiRNA target sequence
taaatgtaattgtaaggtgtta

SEQ ID NO: 100178 - DNA, 22 bp, Artificial sequence
  SiRNA target sequence
aaatgtaattgtaaggtgttaa

SEQ ID NO: 100179 - DNA, 22 bp, Artificial sequence
  SiRNA target sequence
aatgtaattgtaaggtgttaat

SEQ ID NO: 100180 - DNA, 22 bp, Artificial sequence
  SiRNA target sequence
atgtaattgtaaggtgttaata

SEQ ID NO: 100181 - DNA, 22 bp, Artificial sequence
  SiRNA target sequence
tgtaattgtaaggtgttaatat

SEQ ID NO: 100182 - DNA, 22 bp, Artificial sequence
  SiRNA target sequence
gtaattgtaaggtgttaatatc

SEQ ID NO: 100183 - DNA, 22 bp, Artificial sequence
  SiRNA target sequence
taattgtaaggtgttaatatct

SEQ ID NO: 100184 - DNA, 22 bp, Artificial sequence
  SiRNA target sequence
aattgtaaggtgttaatatctt

SEQ ID NO: 100185 - DNA, 22 bp, Artificial sequence
  SiRNA target sequence
attgtaaggtgttaatatctta

SEQ ID NO: 100186 - DNA, 22 bp, Artificial sequence
  SiRNA target sequence
ttgtaaggtgttaatatcttaa

SEQ ID NO: 100187 - DNA, 22 bp, Artificial sequence
  SiRNA target sequence
tgtaaggtgttaatatcttaat

SEQ ID NO: 100188 - DNA, 22 bp, Artificial sequence
  SiRNA target sequence
gtaaggtgttaatatcttaata

SEQ ID NO: 100189 - DNA, 22 bp, Artificial sequence
  SiRNA target sequence
taaggtgttaatatcttaatat

SEQ ID NO: 100190 - DNA, 22 bp, Artificial sequence
  SiRNA target sequence
aaggtgttaatatcttaatatc

SEQ ID NO: 100191 - DNA, 22 bp, Artificial sequence
  SiRNA target sequence
aggtgttaatatcttaatatca

SEQ ID NO: 100192 - DNA, 22 bp, Artificial sequence
  SiRNA target sequence
ggtgttaatatcttaatatcat

SEQ ID NO: 100193 - DNA, 22 bp, Artificial sequence
  SiRNA target sequence
gtgttaatatcttaatatcatt

SEQ ID NO: 100194 - DNA, 22 bp, Artificial sequence
  SiRNA target sequence
tgttaatatcttaatatcattt

SEQ ID NO: 100195 - DNA, 22 bp, Artificial sequence
  SiRNA target sequence
gttaatatcttaatatcattta

SEQ ID NO: 100196 - DNA, 22 bp, Artificial sequence
  SiRNA target sequence
ttaatatcttaatatcatttat

SEQ ID NO: 100197 - DNA, 22 bp, Artificial sequence
  SiRNA target sequence
taatatcttaatatcatttatt

SEQ ID NO: 100198 - DNA, 22 bp, Artificial sequence
  SiRNA target sequence
aatatcttaatatcatttattg

SEQ ID NO: 100199 - DNA, 22 bp, Artificial sequence
  SiRNA target sequence
atatcttaatatcatttattga

SEQ ID NO: 100200 - DNA, 22 bp, Artificial sequence
  SiRNA target sequence
tatcttaatatcatttattgac

SEQ ID NO: 100201 - DNA, 22 bp, Artificial sequence
  SiRNA target sequence
atcttaatatcatttattgacg

SEQ ID NO: 100202 - DNA, 22 bp, Artificial sequence
  SiRNA target sequence
tcttaatatcatttattgacgc

SEQ ID NO: 100203 - DNA, 22 bp, Artificial sequence
  SiRNA target sequence
cttaatatcatttattgacgca

SEQ ID NO: 100204 - DNA, 22 bp, Artificial sequence
  SiRNA target sequence
ttaatatcatttattgacgcac

SEQ ID NO: 100205 - DNA, 22 bp, Artificial sequence
  SiRNA target sequence
taatatcatttattgacgcact

SEQ ID NO: 100206 - DNA, 22 bp, Artificial sequence
  SiRNA target sequence
aatatcatttattgacgcactg

SEQ ID NO: 100207 - DNA, 22 bp, Artificial sequence
  SiRNA target sequence
atatcatttattgacgcactgt

SEQ ID NO: 100208 - DNA, 22 bp, Artificial sequence
  SiRNA target sequence
tatcatttattgacgcactgta

SEQ ID NO: 100209 - DNA, 22 bp, Artificial sequence
  SiRNA target sequence
atcatttattgacgcactgtat

SEQ ID NO: 100210 - DNA, 22 bp, Artificial sequence
  SiRNA target sequence
tcatttattgacgcactgtata

SEQ ID NO: 100211 - DNA, 22 bp, Artificial sequence
  SiRNA target sequence
catttattgacgcactgtataa

SEQ ID NO: 100212 - DNA, 22 bp, Artificial sequence
  SiRNA target sequence
atttattgacgcactgtataaa

SEQ ID NO: 100213 - DNA, 22 bp, Artificial sequence
  SiRNA target sequence
tttattgacgcactgtataaat

SEQ ID NO: 100214 - DNA, 22 bp, Artificial sequence
  SiRNA target sequence
ttattgacgcactgtataaatc

SEQ ID NO: 100215 - DNA, 22 bp, Artificial sequence
  SiRNA target sequence
tattgacgcactgtataaatca

SEQ ID NO: 100216 - DNA, 22 bp, Artificial sequence
  SiRNA target sequence
attgacgcactgtataaatcat

SEQ ID NO: 100217 - DNA, 22 bp, Artificial sequence
  SiRNA target sequence
ttgacgcactgtataaatcatt

SEQ ID NO: 100218 - DNA, 22 bp, Artificial sequence
  SiRNA target sequence
tgacgcactgtataaatcattt

SEQ ID NO: 100219 - DNA, 22 bp, Artificial sequence
  SiRNA target sequence
gacgcactgtataaatcatttt

SEQ ID NO: 100220 - DNA, 22 bp, Artificial sequence
  SiRNA target sequence
acgcactgtataaatcattttt

SEQ ID NO: 100221 - DNA, 22 bp, Artificial sequence
  SiRNA target sequence
cgcactgtataaatcattttta

SEQ ID NO: 100222 - DNA, 22 bp, Artificial sequence
  SiRNA target sequence
gcactgtataaatcatttttac

SEQ ID NO: 100223 - DNA, 22 bp, Artificial sequence
  SiRNA target sequence
cactgtataaatcatttttaca

SEQ ID NO: 100224 - DNA, 22 bp, Artificial sequence
  SiRNA target sequence
actgtataaatcatttttacaa

SEQ ID NO: 100225 - DNA, 22 bp, Artificial sequence
  SiRNA target sequence
ctgtataaatcatttttacaac

SEQ ID NO: 100226 - DNA, 22 bp, Artificial sequence
  SiRNA target sequence
tgtataaatcatttttacaact

SEQ ID NO: 100227 - DNA, 22 bp, Artificial sequence
  SiRNA target sequence
gtataaatcatttttacaactt

SEQ ID NO: 100228 - DNA, 22 bp, Artificial sequence
  SiRNA target sequence
tataaatcatttttacaacttg

SEQ ID NO: 100229 - DNA, 22 bp, Artificial sequence
  SiRNA target sequence
ataaatcatttttacaacttgc

SEQ ID NO: 100230 - DNA, 22 bp, Artificial sequence
  SiRNA target sequence
taaatcatttttacaacttgca

SEQ ID NO: 100231 - DNA, 22 bp, Artificial sequence
  SiRNA target sequence
aaatcatttttacaacttgcaa

SEQ ID NO: 100232 - DNA, 22 bp, Artificial sequence
  SiRNA target sequence
aatcatttttacaacttgcaaa

SEQ ID NO: 100233 - DNA, 22 bp, Artificial sequence
  SiRNA target sequence
atcatttttacaacttgcaaaa

SEQ ID NO: 100234 - DNA, 22 bp, Artificial sequence
  SiRNA target sequence
tcatttttacaacttgcaaaat

SEQ ID NO: 100235 - DNA, 22 bp, Artificial sequence
  SiRNA target sequence
catttttacaacttgcaaaatt

SEQ ID NO: 100236 - DNA, 22 bp, Artificial sequence
  SiRNA target sequence
atttttacaacttgcaaaattt

SEQ ID NO: 100237 - DNA, 22 bp, Artificial sequence
  SiRNA target sequence
tttttacaacttgcaaaatttt

SEQ ID NO: 100238 - DNA, 22 bp, Artificial sequence
  SiRNA target sequence
ttttacaacttgcaaaattttt

SEQ ID NO: 100239 - DNA, 22 bp, Artificial sequence
  SiRNA target sequence
tttacaacttgcaaaattttta

SEQ ID NO: 100240 - DNA, 22 bp, Artificial sequence
  SiRNA target sequence
ttacaacttgcaaaatttttag

SEQ ID NO: 100241 - DNA, 22 bp, Artificial sequence
  SiRNA target sequence
tacaacttgcaaaatttttagc

SEQ ID NO: 100242 - DNA, 22 bp, Artificial sequence
  SiRNA target sequence
acaacttgcaaaatttttagca

SEQ ID NO: 100243 - DNA, 22 bp, Artificial sequence
  SiRNA target sequence
caacttgcaaaatttttagcat

SEQ ID NO: 100244 - DNA, 22 bp, Artificial sequence
  SiRNA target sequence
aacttgcaaaatttttagcatt

SEQ ID NO: 100245 - DNA, 22 bp, Artificial sequence
  SiRNA target sequence
acttgcaaaatttttagcattt

SEQ ID NO: 100246 - DNA, 22 bp, Artificial sequence
  SiRNA target sequence
cttgcaaaatttttagcatttt

SEQ ID NO: 100247 - DNA, 22 bp, Artificial sequence
  SiRNA target sequence
ttgcaaaatttttagcattttg

SEQ ID NO: 100248 - DNA, 22 bp, Artificial sequence
  SiRNA target sequence
tgcaaaatttttagcattttgt

SEQ ID NO: 100249 - DNA, 22 bp, Artificial sequence
  SiRNA target sequence
gcaaaatttttagcattttgta

SEQ ID NO: 100250 - DNA, 22 bp, Artificial sequence
  SiRNA target sequence
caaaatttttagcattttgtag

SEQ ID NO: 100251 - DNA, 22 bp, Artificial sequence
  SiRNA target sequence
aaaatttttagcattttgtagt

SEQ ID NO: 100252 - DNA, 22 bp, Artificial sequence
  SiRNA target sequence
aaatttttagcattttgtagtt

SEQ ID NO: 100253 - DNA, 22 bp, Artificial sequence
  SiRNA target sequence
aatttttagcattttgtagttt

SEQ ID NO: 100254 - DNA, 22 bp, Artificial sequence
  SiRNA target sequence
atttttagcattttgtagtttg

SEQ ID NO: 100255 - DNA, 22 bp, Artificial sequence
  SiRNA target sequence
tttttagcattttgtagtttgt

SEQ ID NO: 100256 - DNA, 22 bp, Artificial sequence
  SiRNA target sequence
ttttagcattttgtagtttgta

SEQ ID NO: 100257 - DNA, 22 bp, Artificial sequence
  SiRNA target sequence
tttagcattttgtagtttgtaa

SEQ ID NO: 100258 - DNA, 22 bp, Artificial sequence
  SiRNA target sequence
ttagcattttgtagtttgtaat

SEQ ID NO: 100259 - DNA, 22 bp, Artificial sequence
  SiRNA target sequence
tagcattttgtagtttgtaatg

SEQ ID NO: 100260 - DNA, 22 bp, Artificial sequence
  SiRNA target sequence
agcattttgtagtttgtaatgc

SEQ ID NO: 100261 - DNA, 22 bp, Artificial sequence
  SiRNA target sequence
gcattttgtagtttgtaatgcg

SEQ ID NO: 100262 - DNA, 22 bp, Artificial sequence
  SiRNA target sequence
cattttgtagtttgtaatgcgg

SEQ ID NO: 100263 - DNA, 22 bp, Artificial sequence
  SiRNA target sequence
attttgtagtttgtaatgcggt

SEQ ID NO: 100264 - DNA, 22 bp, Artificial sequence
  SiRNA target sequence
ttttgtagtttgtaatgcggta

SEQ ID NO: 100265 - DNA, 22 bp, Artificial sequence
  SiRNA target sequence
tttgtagtttgtaatgcggtaa

SEQ ID NO: 100266 - DNA, 22 bp, Artificial sequence
  SiRNA target sequence
ttgtagtttgtaatgcggtaat

SEQ ID NO: 100267 - DNA, 22 bp, Artificial sequence
  SiRNA target sequence
tgtagtttgtaatgcggtaata

SEQ ID NO: 100268 - DNA, 22 bp, Artificial sequence
  SiRNA target sequence
gtagtttgtaatgcggtaatat

SEQ ID NO: 100269 - DNA, 22 bp, Artificial sequence
  SiRNA target sequence
tagtttgtaatgcggtaatata

SEQ ID NO: 100270 - DNA, 22 bp, Artificial sequence
  SiRNA target sequence
agtttgtaatgcggtaatatat

SEQ ID NO: 100271 - DNA, 22 bp, Artificial sequence
  SiRNA target sequence
gtttgtaatgcggtaatatata

SEQ ID NO: 100272 - DNA, 22 bp, Artificial sequence
  SiRNA target sequence
tttgtaatgcggtaatatataa

SEQ ID NO: 100273 - DNA, 22 bp, Artificial sequence
  SiRNA target sequence
ttgtaatgcggtaatatataat

SEQ ID NO: 100274 - DNA, 22 bp, Artificial sequence
  SiRNA target sequence
tgtaatgcggtaatatataata

SEQ ID NO: 100275 - DNA, 22 bp, Artificial sequence
  SiRNA target sequence
gtaatgcggtaatatataatat

SEQ ID NO: 100276 - DNA, 22 bp, Artificial sequence
  SiRNA target sequence
taatgcggtaatatataatata

SEQ ID NO: 100277 - DNA, 22 bp, Artificial sequence
  SiRNA target sequence
aatgcggtaatatataatatag

SEQ ID NO: 100278 - DNA, 22 bp, Artificial sequence
  SiRNA target sequence
atgcggtaatatataatataga

SEQ ID NO: 100279 - DNA, 22 bp, Artificial sequence
  SiRNA target sequence
tgcggtaatatataatatagat

SEQ ID NO: 100280 - DNA, 22 bp, Artificial sequence
  SiRNA target sequence
gcggtaatatataatatagatc

SEQ ID NO: 100281 - DNA, 22 bp, Artificial sequence
  SiRNA target sequence
cggtaatatataatatagatct

SEQ ID NO: 100282 - DNA, 22 bp, Artificial sequence
  SiRNA target sequence
ggtaatatataatatagatctt

SEQ ID NO: 100283 - DNA, 22 bp, Artificial sequence
  SiRNA target sequence
gtaatatataatatagatcttt

SEQ ID NO: 100284 - DNA, 22 bp, Artificial sequence
  SiRNA target sequence
taatatataatatagatctttt

SEQ ID NO: 100285 - DNA, 22 bp, Artificial sequence
  SiRNA target sequence
aatatataatatagatctttta

SEQ ID NO: 100286 - DNA, 22 bp, Artificial sequence
  SiRNA target sequence
atatataatatagatcttttat

SEQ ID NO: 100287 - DNA, 22 bp, Artificial sequence
  SiRNA target sequence
tatataatatagatcttttatc

SEQ ID NO: 100288 - DNA, 22 bp, Artificial sequence
  SiRNA target sequence
atataatatagatcttttatcc

SEQ ID NO: 100289 - DNA, 22 bp, Artificial sequence
  SiRNA target sequence
tataatatagatcttttatcca

SEQ ID NO: 100290 - DNA, 22 bp, Artificial sequence
  SiRNA target sequence
ataatatagatcttttatccat

SEQ ID NO: 100291 - DNA, 22 bp, Artificial sequence
  SiRNA target sequence
taatatagatcttttatccatg

SEQ ID NO: 100292 - DNA, 22 bp, Artificial sequence
  SiRNA target sequence
aatatagatcttttatccatgt

SEQ ID NO: 100293 - DNA, 22 bp, Artificial sequence
  SiRNA target sequence
atatagatcttttatccatgtc

SEQ ID NO: 100294 - DNA, 22 bp, Artificial sequence
  SiRNA target sequence
tatagatcttttatccatgtct

SEQ ID NO: 100295 - DNA, 22 bp, Artificial sequence
  SiRNA target sequence
atagatcttttatccatgtctt

SEQ ID NO: 100296 - DNA, 22 bp, Artificial sequence
  SiRNA target sequence
tagatcttttatccatgtctta

SEQ ID NO: 100297 - DNA, 22 bp, Artificial sequence
  SiRNA target sequence
agatcttttatccatgtcttaa

SEQ ID NO: 100298 - DNA, 22 bp, Artificial sequence
  SiRNA target sequence
gatcttttatccatgtcttaaa

SEQ ID NO: 100299 - DNA, 22 bp, Artificial sequence
  SiRNA target sequence
atcttttatccatgtcttaaat

SEQ ID NO: 100300 - DNA, 22 bp, Artificial sequence
  SiRNA target sequence
tcttttatccatgtcttaaatt

SEQ ID NO: 100301 - DNA, 22 bp, Artificial sequence
  SiRNA target sequence
cttttatccatgtcttaaattc

SEQ ID NO: 100302 - DNA, 22 bp, Artificial sequence
  SiRNA target sequence
ttttatccatgtcttaaattcg

SEQ ID NO: 100303 - DNA, 22 bp, Artificial sequence
  SiRNA target sequence
tttatccatgtcttaaattcgc

SEQ ID NO: 100304 - DNA, 22 bp, Artificial sequence
  SiRNA target sequence
ttatccatgtcttaaattcgcc

SEQ ID NO: 100305 - DNA, 22 bp, Artificial sequence
  SiRNA target sequence
tatccatgtcttaaattcgccc

SEQ ID NO: 100306 - DNA, 22 bp, Artificial sequence
  SiRNA target sequence
atccatgtcttaaattcgccca

SEQ ID NO: 100307 - DNA, 22 bp, Artificial sequence
  SiRNA target sequence
tccatgtcttaaattcgcccat

SEQ ID NO: 100308 - DNA, 22 bp, Artificial sequence
  SiRNA target sequence
ccatgtcttaaattcgcccata

SEQ ID NO: 100309 - DNA, 22 bp, Artificial sequence
  SiRNA target sequence
catgtcttaaattcgcccataa

SEQ ID NO: 100310 - DNA, 22 bp, Artificial sequence
  SiRNA target sequence
atgtcttaaattcgcccataaa

SEQ ID NO: 100311 - DNA, 22 bp, Artificial sequence
  SiRNA target sequence
tgtcttaaattcgcccataaat

SEQ ID NO: 100312 - DNA, 22 bp, Artificial sequence
  SiRNA target sequence
gtcttaaattcgcccataaatc

SEQ ID NO: 100313 - DNA, 22 bp, Artificial sequence
  SiRNA target sequence
tcttaaattcgcccataaatcc

SEQ ID NO: 100314 - DNA, 22 bp, Artificial sequence
  SiRNA target sequence
cttaaattcgcccataaatcct

SEQ ID NO: 100315 - DNA, 22 bp, Artificial sequence
  SiRNA target sequence
ttaaattcgcccataaatcctt

SEQ ID NO: 100316 - DNA, 22 bp, Artificial sequence
  SiRNA target sequence
taaattcgcccataaatccttc

SEQ ID NO: 100317 - DNA, 22 bp, Artificial sequence
  SiRNA target sequence
aaattcgcccataaatccttct

SEQ ID NO: 100318 - DNA, 22 bp, Artificial sequence
  SiRNA target sequence
aattcgcccataaatccttctt

SEQ ID NO: 100319 - DNA, 22 bp, Artificial sequence
  SiRNA target sequence
attcgcccataaatccttcttt

SEQ ID NO: 100320 - DNA, 22 bp, Artificial sequence
  SiRNA target sequence
ttcgcccataaatccttctttg

SEQ ID NO: 100321 - DNA, 22 bp, Artificial sequence
  SiRNA target sequence
tcgcccataaatccttctttgt

SEQ ID NO: 100322 - DNA, 22 bp, Artificial sequence
  SiRNA target sequence
cgcccataaatccttctttgtc

SEQ ID NO: 100323 - DNA, 22 bp, Artificial sequence
  SiRNA target sequence
gcccataaatccttctttgtct

SEQ ID NO: 100324 - DNA, 22 bp, Artificial sequence
  SiRNA target sequence
cccataaatccttctttgtctt

SEQ ID NO: 100325 - DNA, 22 bp, Artificial sequence
  SiRNA target sequence
ccataaatccttctttgtcttg

SEQ ID NO: 100326 - DNA, 22 bp, Artificial sequence
  SiRNA target sequence
cataaatccttctttgtcttgg

SEQ ID NO: 100327 - DNA, 22 bp, Artificial sequence
  SiRNA target sequence
ataaatccttctttgtcttggc

SEQ ID NO: 100328 - DNA, 22 bp, Artificial sequence
  SiRNA target sequence
taaatccttctttgtcttggct

SEQ ID NO: 100329 - DNA, 22 bp, Artificial sequence
  SiRNA target sequence
aaatccttctttgtcttggcta

SEQ ID NO: 100330 - DNA, 22 bp, Artificial sequence
  SiRNA target sequence
aatccttctttgtcttggctat

SEQ ID NO: 100331 - DNA, 22 bp, Artificial sequence
  SiRNA target sequence
atccttctttgtcttggctatc

SEQ ID NO: 100332 - DNA, 22 bp, Artificial sequence
  SiRNA target sequence
tccttctttgtcttggctatct

SEQ ID NO: 100333 - DNA, 22 bp, Artificial sequence
  SiRNA target sequence
ccttctttgtcttggctatctc

SEQ ID NO: 100334 - DNA, 22 bp, Artificial sequence
  SiRNA target sequence
cttctttgtcttggctatctcc

SEQ ID NO: 100335 - DNA, 22 bp, Artificial sequence
  SiRNA target sequence
ttctttgtcttggctatctcca

SEQ ID NO: 100336 - DNA, 22 bp, Artificial sequence
  SiRNA target sequence
tctttgtcttggctatctccat

SEQ ID NO: 100337 - DNA, 22 bp, Artificial sequence
  SiRNA target sequence
ctttgtcttggctatctccatt

SEQ ID NO: 100338 - DNA, 22 bp, Artificial sequence
  SiRNA target sequence
tttgtcttggctatctccatta

SEQ ID NO: 100339 - DNA, 22 bp, Artificial sequence
  SiRNA target sequence
ttgtcttggctatctccattac

SEQ ID NO: 100340 - DNA, 22 bp, Artificial sequence
  SiRNA target sequence
tgtcttggctatctccattacc

SEQ ID NO: 100341 - DNA, 22 bp, Artificial sequence
  SiRNA target sequence
gtcttggctatctccattaccc

SEQ ID NO: 100342 - DNA, 22 bp, Artificial sequence
  SiRNA target sequence
tcttggctatctccattaccct

SEQ ID NO: 100343 - DNA, 22 bp, Artificial sequence
  SiRNA target sequence
cttggctatctccattaccctt

SEQ ID NO: 100344 - DNA, 22 bp, Artificial sequence
  SiRNA target sequence
ttggctatctccattacccttt

SEQ ID NO: 100345 - DNA, 22 bp, Artificial sequence
  SiRNA target sequence
tggctatctccattaccctttc

SEQ ID NO: 100346 - DNA, 22 bp, Artificial sequence
  SiRNA target sequence
ggctatctccattaccctttct

SEQ ID NO: 100347 - DNA, 22 bp, Artificial sequence
  SiRNA target sequence
gctatctccattaccctttctt

SEQ ID NO: 100348 - DNA, 22 bp, Artificial sequence
  SiRNA target sequence
ctatctccattaccctttctta

SEQ ID NO: 100349 - DNA, 22 bp, Artificial sequence
  SiRNA target sequence
tatctccattaccctttcttat

SEQ ID NO: 100350 - DNA, 22 bp, Artificial sequence
  SiRNA target sequence
atctccattaccctttcttatc

SEQ ID NO: 100351 - DNA, 22 bp, Artificial sequence
  SiRNA target sequence
tctccattaccctttcttatca

SEQ ID NO: 100352 - DNA, 22 bp, Artificial sequence
  SiRNA target sequence
ctccattaccctttcttatcag

SEQ ID NO: 100353 - DNA, 22 bp, Artificial sequence
  SiRNA target sequence
tccattaccctttcttatcaga

SEQ ID NO: 100354 - DNA, 22 bp, Artificial sequence
  SiRNA target sequence
ccattaccctttcttatcagag

SEQ ID NO: 100355 - DNA, 22 bp, Artificial sequence
  SiRNA target sequence
cattaccctttcttatcagagg

SEQ ID NO: 100356 - DNA, 22 bp, Artificial sequence
  SiRNA target sequence
attaccctttcttatcagaggt

SEQ ID NO: 100357 - DNA, 22 bp, Artificial sequence
  SiRNA target sequence
ttaccctttcttatcagaggtt

SEQ ID NO: 100358 - DNA, 22 bp, Artificial sequence
  SiRNA target sequence
taccctttcttatcagaggttt

SEQ ID NO: 100359 - DNA, 22 bp, Artificial sequence
  SiRNA target sequence
accctttcttatcagaggttta

SEQ ID NO: 100360 - DNA, 22 bp, Artificial sequence
  SiRNA target sequence
ccctttcttatcagaggtttag

SEQ ID NO: 100361 - DNA, 22 bp, Artificial sequence
  SiRNA target sequence
cctttcttatcagaggtttagc

SEQ ID NO: 100362 - DNA, 22 bp, Artificial sequence
  SiRNA target sequence
ctttcttatcagaggtttagct

SEQ ID NO: 100363 - DNA, 22 bp, Artificial sequence
  SiRNA target sequence
tttcttatcagaggtttagctc

SEQ ID NO: 100364 - DNA, 22 bp, Artificial sequence
  SiRNA target sequence
ttcttatcagaggtttagctcc

SEQ ID NO: 100365 - DNA, 22 bp, Artificial sequence
  SiRNA target sequence
tcttatcagaggtttagctccg

SEQ ID NO: 100366 - DNA, 22 bp, Artificial sequence
  SiRNA target sequence
cttatcagaggtttagctccgt

SEQ ID NO: 100367 - DNA, 22 bp, Artificial sequence
  SiRNA target sequence
ttatcagaggtttagctccgtg

SEQ ID NO: 100368 - DNA, 22 bp, Artificial sequence
  SiRNA target sequence
tatcagaggtttagctccgtgt

SEQ ID NO: 100369 - DNA, 22 bp, Artificial sequence
  SiRNA target sequence
atcagaggtttagctccgtgtt

SEQ ID NO: 100370 - DNA, 22 bp, Artificial sequence
  SiRNA target sequence
tcagaggtttagctccgtgttt

SEQ ID NO: 100371 - DNA, 22 bp, Artificial sequence
  SiRNA target sequence
cagaggtttagctccgtgtttt

SEQ ID NO: 100372 - DNA, 22 bp, Artificial sequence
  SiRNA target sequence
agaggtttagctccgtgtttta

SEQ ID NO: 100373 - DNA, 22 bp, Artificial sequence
  SiRNA target sequence
gaggtttagctccgtgttttaa

SEQ ID NO: 100374 - DNA, 22 bp, Artificial sequence
  SiRNA target sequence
aggtttagctccgtgttttaaa

SEQ ID NO: 100375 - DNA, 22 bp, Artificial sequence
  SiRNA target sequence
ggtttagctccgtgttttaaaa

SEQ ID NO: 100376 - DNA, 22 bp, Artificial sequence
  SiRNA target sequence
gtttagctccgtgttttaaaag

SEQ ID NO: 100377 - DNA, 22 bp, Artificial sequence
  SiRNA target sequence
tttagctccgtgttttaaaagg

SEQ ID NO: 100378 - DNA, 22 bp, Artificial sequence
  SiRNA target sequence
ttagctccgtgttttaaaaggc

SEQ ID NO: 100379 - DNA, 22 bp, Artificial sequence
  SiRNA target sequence
tagctccgtgttttaaaaggca

SEQ ID NO: 100380 - DNA, 22 bp, Artificial sequence
  SiRNA target sequence
agctccgtgttttaaaaggcaa

SEQ ID NO: 100381 - DNA, 22 bp, Artificial sequence
  SiRNA target sequence
gctccgtgttttaaaaggcaat

SEQ ID NO: 100382 - DNA, 22 bp, Artificial sequence
  SiRNA target sequence
ctccgtgttttaaaaggcaatt

SEQ ID NO: 100383 - DNA, 22 bp, Artificial sequence
  SiRNA target sequence
tccgtgttttaaaaggcaatta

SEQ ID NO: 100384 - DNA, 22 bp, Artificial sequence
  SiRNA target sequence
ccgtgttttaaaaggcaattat

SEQ ID NO: 100385 - DNA, 22 bp, Artificial sequence
  SiRNA target sequence
cgtgttttaaaaggcaattata

SEQ ID NO: 100386 - DNA, 22 bp, Artificial sequence
  SiRNA target sequence
gtgttttaaaaggcaattatac

SEQ ID NO: 100387 - DNA, 22 bp, Artificial sequence
  SiRNA target sequence
tgttttaaaaggcaattataca

SEQ ID NO: 100388 - DNA, 22 bp, Artificial sequence
  SiRNA target sequence
gttttaaaaggcaattatacaa

SEQ ID NO: 100389 - DNA, 22 bp, Artificial sequence
  SiRNA target sequence
ttttaaaaggcaattatacaac

SEQ ID NO: 100390 - DNA, 22 bp, Artificial sequence
  SiRNA target sequence
tttaaaaggcaattatacaact

SEQ ID NO: 100391 - DNA, 22 bp, Artificial sequence
  SiRNA target sequence
ttaaaaggcaattatacaactt

SEQ ID NO: 100392 - DNA, 22 bp, Artificial sequence
  SiRNA target sequence
taaaaggcaattatacaacttt

SEQ ID NO: 100393 - DNA, 22 bp, Artificial sequence
  SiRNA target sequence
aaaaggcaattatacaactttt

SEQ ID NO: 100394 - DNA, 22 bp, Artificial sequence
  SiRNA target sequence
aaaggcaattatacaacttttt

SEQ ID NO: 100395 - DNA, 22 bp, Artificial sequence
  SiRNA target sequence
aaggcaattatacaacttttta

SEQ ID NO: 100396 - DNA, 22 bp, Artificial sequence
  SiRNA target sequence
aggcaattatacaactttttag

SEQ ID NO: 100397 - DNA, 22 bp, Artificial sequence
  SiRNA target sequence
ggcaattatacaactttttaga

SEQ ID NO: 100398 - DNA, 22 bp, Artificial sequence
  SiRNA target sequence
gcaattatacaactttttagaa

SEQ ID NO: 100399 - DNA, 22 bp, Artificial sequence
  SiRNA target sequence
caattatacaactttttagaac

SEQ ID NO: 100400 - DNA, 22 bp, Artificial sequence
  SiRNA target sequence
aattatacaactttttagaaca

SEQ ID NO: 100401 - DNA, 22 bp, Artificial sequence
  SiRNA target sequence
attatacaactttttagaacaa

SEQ ID NO: 100402 - DNA, 22 bp, Artificial sequence
  SiRNA target sequence
ttatacaactttttagaacaaa

SEQ ID NO: 100403 - DNA, 22 bp, Artificial sequence
  SiRNA target sequence
tatacaactttttagaacaaaa

SEQ ID NO: 100404 - DNA, 22 bp, Artificial sequence
  SiRNA target sequence
atacaactttttagaacaaaaa

SEQ ID NO: 100405 - DNA, 22 bp, Artificial sequence
  SiRNA target sequence
tacaactttttagaacaaaaat

SEQ ID NO: 100406 - DNA, 22 bp, Artificial sequence
  SiRNA target sequence
acaactttttagaacaaaaatt

SEQ ID NO: 100407 - DNA, 22 bp, Artificial sequence
  SiRNA target sequence
caactttttagaacaaaaatta

SEQ ID NO: 100408 - DNA, 22 bp, Artificial sequence
  SiRNA target sequence
aactttttagaacaaaaattaa

SEQ ID NO: 100409 - DNA, 22 bp, Artificial sequence
  SiRNA target sequence
actttttagaacaaaaattaaa

SEQ ID NO: 100410 - DNA, 22 bp, Artificial sequence
  SiRNA target sequence
ctttttagaacaaaaattaaaa

SEQ ID NO: 100411 - DNA, 22 bp, Artificial sequence
  SiRNA target sequence
tttttagaacaaaaattaaaag

SEQ ID NO: 100412 - DNA, 22 bp, Artificial sequence
  SiRNA target sequence
ttttagaacaaaaattaaaaga

SEQ ID NO: 100413 - DNA, 22 bp, Artificial sequence
  SiRNA target sequence
tttagaacaaaaattaaaagat

SEQ ID NO: 100414 - DNA, 22 bp, Artificial sequence
  SiRNA target sequence
ttagaacaaaaattaaaagatt

SEQ ID NO: 100415 - DNA, 22 bp, Artificial sequence
  SiRNA target sequence
tagaacaaaaattaaaagattt

SEQ ID NO: 100416 - DNA, 22 bp, Artificial sequence
  SiRNA target sequence
agaacaaaaattaaaagattta

SEQ ID NO: 100417 - DNA, 22 bp, Artificial sequence
  SiRNA target sequence
gaacaaaaattaaaagatttat

SEQ ID NO: 100418 - DNA, 22 bp, Artificial sequence
  SiRNA target sequence
aacaaaaattaaaagatttata

SEQ ID NO: 100419 - DNA, 22 bp, Artificial sequence
  SiRNA target sequence
acaaaaattaaaagatttataa

SEQ ID NO: 100420 - DNA, 22 bp, Artificial sequence
  SiRNA target sequence
caaaaattaaaagatttataag

SEQ ID NO: 100421 - DNA, 22 bp, Artificial sequence
  SiRNA target sequence
aaaaattaaaagatttataaga

SEQ ID NO: 100422 - DNA, 22 bp, Artificial sequence
  SiRNA target sequence
aaaattaaaagatttataagac

SEQ ID NO: 100423 - DNA, 22 bp, Artificial sequence
  SiRNA target sequence
aaattaaaagatttataagacg

SEQ ID NO: 100424 - DNA, 22 bp, Artificial sequence
  SiRNA target sequence
aattaaaagatttataagacga

SEQ ID NO: 100425 - DNA, 22 bp, Artificial sequence
  SiRNA target sequence
attaaaagatttataagacgaa

SEQ ID NO: 100426 - DNA, 22 bp, Artificial sequence
  SiRNA target sequence
ttaaaagatttataagacgaat

SEQ ID NO: 100427 - DNA, 22 bp, Artificial sequence
  SiRNA target sequence
taaaagatttataagacgaatc

SEQ ID NO: 100428 - DNA, 22 bp, Artificial sequence
  SiRNA target sequence
aaaagatttataagacgaatcc

SEQ ID NO: 100429 - DNA, 22 bp, Artificial sequence
  SiRNA target sequence
aaagatttataagacgaatccc

SEQ ID NO: 100430 - DNA, 22 bp, Artificial sequence
  SiRNA target sequence
aagatttataagacgaatcccc

SEQ ID NO: 100431 - DNA, 22 bp, Artificial sequence
  SiRNA target sequence
agatttataagacgaatcccca

SEQ ID NO: 100432 - DNA, 22 bp, Artificial sequence
  SiRNA target sequence
gatttataagacgaatccccaa

SEQ ID NO: 100433 - DNA, 22 bp, Artificial sequence
  SiRNA target sequence
atttataagacgaatccccaag

SEQ ID NO: 100434 - DNA, 22 bp, Artificial sequence
  SiRNA target sequence
tttataagacgaatccccaagg

SEQ ID NO: 100435 - DNA, 22 bp, Artificial sequence
  SiRNA target sequence
ttataagacgaatccccaaggc

SEQ ID NO: 100436 - DNA, 22 bp, Artificial sequence
  SiRNA target sequence
tataagacgaatccccaaggcc

SEQ ID NO: 100437 - DNA, 22 bp, Artificial sequence
  SiRNA target sequence
ataagacgaatccccaaggcca

SEQ ID NO: 100438 - DNA, 22 bp, Artificial sequence
  SiRNA target sequence
taagacgaatccccaaggccaa

SEQ ID NO: 100439 - DNA, 22 bp, Artificial sequence
  SiRNA target sequence
aagacgaatccccaaggccaaa

SEQ ID NO: 100440 - DNA, 22 bp, Artificial sequence
  SiRNA target sequence
agacgaatccccaaggccaaat

SEQ ID NO: 100441 - DNA, 22 bp, Artificial sequence
  SiRNA target sequence
gacgaatccccaaggccaaata

SEQ ID NO: 100442 - DNA, 22 bp, Artificial sequence
  SiRNA target sequence
acgaatccccaaggccaaatac

SEQ ID NO: 100443 - DNA, 22 bp, Artificial sequence
  SiRNA target sequence
cgaatccccaaggccaaataca

SEQ ID NO: 100444 - DNA, 22 bp, Artificial sequence
  SiRNA target sequence
gaatccccaaggccaaatacag

SEQ ID NO: 100445 - DNA, 22 bp, Artificial sequence
  SiRNA target sequence
aatccccaaggccaaatacagc

SEQ ID NO: 100446 - DNA, 22 bp, Artificial sequence
  SiRNA target sequence
atccccaaggccaaatacagca

SEQ ID NO: 100447 - DNA, 22 bp, Artificial sequence
  SiRNA target sequence
tccccaaggccaaatacagcaa

SEQ ID NO: 100448 - DNA, 22 bp, Artificial sequence
  SiRNA target sequence
ccccaaggccaaatacagcaaa

SEQ ID NO: 100449 - DNA, 22 bp, Artificial sequence
  SiRNA target sequence
cccaaggccaaatacagcaaaa

SEQ ID NO: 100450 - DNA, 22 bp, Artificial sequence
  SiRNA target sequence
ccaaggccaaatacagcaaaat

SEQ ID NO: 100451 - DNA, 22 bp, Artificial sequence
  SiRNA target sequence
caaggccaaatacagcaaaatt

SEQ ID NO: 100452 - DNA, 22 bp, Artificial sequence
  SiRNA target sequence
aaggccaaatacagcaaaattt

SEQ ID NO: 100453 - DNA, 22 bp, Artificial sequence
  SiRNA target sequence
aggccaaatacagcaaaattta

SEQ ID NO: 100454 - DNA, 22 bp, Artificial sequence
  SiRNA target sequence
ggccaaatacagcaaaatttaa

SEQ ID NO: 100455 - DNA, 22 bp, Artificial sequence
  SiRNA target sequence
gccaaatacagcaaaatttaag

SEQ ID NO: 100456 - DNA, 22 bp, Artificial sequence
  SiRNA target sequence
ccaaatacagcaaaatttaagt

SEQ ID NO: 100457 - DNA, 22 bp, Artificial sequence
  SiRNA target sequence
caaatacagcaaaatttaagtg

SEQ ID NO: 100458 - DNA, 22 bp, Artificial sequence
  SiRNA target sequence
aaatacagcaaaatttaagtgt

SEQ ID NO: 100459 - DNA, 22 bp, Artificial sequence
  SiRNA target sequence
aatacagcaaaatttaagtgtt

SEQ ID NO: 100460 - DNA, 22 bp, Artificial sequence
  SiRNA target sequence
atacagcaaaatttaagtgttg

SEQ ID NO: 100461 - DNA, 22 bp, Artificial sequence
  SiRNA target sequence
tacagcaaaatttaagtgttgt

SEQ ID NO: 100462 - DNA, 22 bp, Artificial sequence
  SiRNA target sequence
acagcaaaatttaagtgttgta

SEQ ID NO: 100463 - DNA, 22 bp, Artificial sequence
  SiRNA target sequence
cagcaaaatttaagtgttgtaa

SEQ ID NO: 100464 - DNA, 22 bp, Artificial sequence
  SiRNA target sequence
agcaaaatttaagtgttgtaaa

SEQ ID NO: 100465 - DNA, 22 bp, Artificial sequence
  SiRNA target sequence
gcaaaatttaagtgttgtaaaa

SEQ ID NO: 100466 - DNA, 22 bp, Artificial sequence
  SiRNA target sequence
caaaatttaagtgttgtaaaaa

SEQ ID NO: 100467 - DNA, 22 bp, Artificial sequence
  SiRNA target sequence
aaaatttaagtgttgtaaaaaa

SEQ ID NO: 100468 - DNA, 22 bp, Artificial sequence
  SiRNA target sequence
aaatttaagtgttgtaaaaaat

SEQ ID NO: 100469 - DNA, 22 bp, Artificial sequence
  SiRNA target sequence
aatttaagtgttgtaaaaaatt

SEQ ID NO: 100470 - DNA, 22 bp, Artificial sequence
  SiRNA target sequence
atttaagtgttgtaaaaaattt

SEQ ID NO: 100471 - DNA, 22 bp, Artificial sequence
  SiRNA target sequence
tttaagtgttgtaaaaaatttg

SEQ ID NO: 100472 - DNA, 22 bp, Artificial sequence
  SiRNA target sequence
ttaagtgttgtaaaaaatttgt

SEQ ID NO: 100473 - DNA, 22 bp, Artificial sequence
  SiRNA target sequence
taagtgttgtaaaaaatttgta

SEQ ID NO: 100474 - DNA, 22 bp, Artificial sequence
  SiRNA target sequence
aagtgttgtaaaaaatttgtag

SEQ ID NO: 100475 - DNA, 22 bp, Artificial sequence
  SiRNA target sequence
agtgttgtaaaaaatttgtagg

SEQ ID NO: 100476 - DNA, 22 bp, Artificial sequence
  SiRNA target sequence
gtgttgtaaaaaatttgtaggc

SEQ ID NO: 100477 - DNA, 22 bp, Artificial sequence
  SiRNA target sequence
tgttgtaaaaaatttgtaggca

SEQ ID NO: 100478 - DNA, 22 bp, Artificial sequence
  SiRNA target sequence
gttgtaaaaaatttgtaggcag

SEQ ID NO: 100479 - DNA, 22 bp, Artificial sequence
  SiRNA target sequence
ttgtaaaaaatttgtaggcaga

SEQ ID NO: 100480 - DNA, 22 bp, Artificial sequence
  SiRNA target sequence
tgtaaaaaatttgtaggcagat

SEQ ID NO: 100481 - DNA, 22 bp, Artificial sequence
  SiRNA target sequence
gtaaaaaatttgtaggcagatt

SEQ ID NO: 100482 - DNA, 22 bp, Artificial sequence
  SiRNA target sequence
taaaaaatttgtaggcagattt

SEQ ID NO: 100483 - DNA, 22 bp, Artificial sequence
  SiRNA target sequence
aaaaaatttgtaggcagatttt

SEQ ID NO: 100484 - DNA, 22 bp, Artificial sequence
  SiRNA target sequence
aaaaatttgtaggcagattttt

SEQ ID NO: 100485 - DNA, 22 bp, Artificial sequence
  SiRNA target sequence
aaaatttgtaggcagatttttt

SEQ ID NO: 100486 - DNA, 22 bp, Artificial sequence
  SiRNA target sequence
aaatttgtaggcagattttttt

SEQ ID NO: 100487 - DNA, 22 bp, Artificial sequence
  SiRNA target sequence
aatttgtaggcagatttttttt

SEQ ID NO: 100488 - DNA, 22 bp, Artificial sequence
  SiRNA target sequence
atttgtaggcagattttttttg

SEQ ID NO: 100489 - DNA, 22 bp, Artificial sequence
  SiRNA target sequence
tttgtaggcagattttttttgc

SEQ ID NO: 100490 - DNA, 22 bp, Artificial sequence
  SiRNA target sequence
ttgtaggcagattttttttgcg

SEQ ID NO: 100491 - DNA, 22 bp, Artificial sequence
  SiRNA target sequence
tgtaggcagattttttttgcgc

SEQ ID NO: 100492 - DNA, 22 bp, Artificial sequence
  SiRNA target sequence
gtaggcagattttttttgcgca

SEQ ID NO: 100493 - DNA, 22 bp, Artificial sequence
  SiRNA target sequence
taggcagattttttttgcgcaa

SEQ ID NO: 100494 - DNA, 22 bp, Artificial sequence
  SiRNA target sequence
aggcagattttttttgcgcaaa

SEQ ID NO: 100495 - DNA, 22 bp, Artificial sequence
  SiRNA target sequence
ggcagattttttttgcgcaaaa

SEQ ID NO: 100496 - DNA, 22 bp, Artificial sequence
  SiRNA target sequence
gcagattttttttgcgcaaaaa

SEQ ID NO: 100497 - DNA, 22 bp, Artificial sequence
  SiRNA target sequence
cagattttttttgcgcaaaaat

SEQ ID NO: 100498 - DNA, 22 bp, Artificial sequence
  SiRNA target sequence
agattttttttgcgcaaaaatt

SEQ ID NO: 100499 - DNA, 22 bp, Artificial sequence
  SiRNA target sequence
gattttttttgcgcaaaaattt

SEQ ID NO: 100500 - DNA, 22 bp, Artificial sequence
  SiRNA target sequence
attttttttgcgcaaaaatttc

SEQ ID NO: 100501 - DNA, 22 bp, Artificial sequence
  SiRNA target sequence
ttttttttgcgcaaaaatttcc

SEQ ID NO: 100502 - DNA, 22 bp, Artificial sequence
  SiRNA target sequence
tttttttgcgcaaaaatttcca

SEQ ID NO: 100503 - DNA, 22 bp, Artificial sequence
  SiRNA target sequence
ttttttgcgcaaaaatttccaa

SEQ ID NO: 100504 - DNA, 22 bp, Artificial sequence
  SiRNA target sequence
tttttgcgcaaaaatttccaaa

SEQ ID NO: 100505 - DNA, 22 bp, Artificial sequence
  SiRNA target sequence
ttttgcgcaaaaatttccaaaa

SEQ ID NO: 100506 - DNA, 22 bp, Artificial sequence
  SiRNA target sequence
tttgcgcaaaaatttccaaaat

SEQ ID NO: 100507 - DNA, 22 bp, Artificial sequence
  SiRNA target sequence
ttgcgcaaaaatttccaaaatt

SEQ ID NO: 100508 - DNA, 22 bp, Artificial sequence
  SiRNA target sequence
tgcgcaaaaatttccaaaattt

SEQ ID NO: 100509 - DNA, 22 bp, Artificial sequence
  SiRNA target sequence
gcgcaaaaatttccaaaattta

SEQ ID NO: 100510 - DNA, 22 bp, Artificial sequence
  SiRNA target sequence
cgcaaaaatttccaaaatttag

SEQ ID NO: 100511 - DNA, 22 bp, Artificial sequence
  SiRNA target sequence
gcaaaaatttccaaaatttagt

SEQ ID NO: 100512 - DNA, 22 bp, Artificial sequence
  SiRNA target sequence
caaaaatttccaaaatttagtc

SEQ ID NO: 100513 - DNA, 22 bp, Artificial sequence
  SiRNA target sequence
aaaaatttccaaaatttagtca

SEQ ID NO: 100514 - DNA, 22 bp, Artificial sequence
  SiRNA target sequence
aaaatttccaaaatttagtcat

SEQ ID NO: 100515 - DNA, 22 bp, Artificial sequence
  SiRNA target sequence
aaatttccaaaatttagtcatg

SEQ ID NO: 100516 - DNA, 22 bp, Artificial sequence
  SiRNA target sequence
aatttccaaaatttagtcatgt

SEQ ID NO: 100517 - DNA, 22 bp, Artificial sequence
  SiRNA target sequence
atttccaaaatttagtcatgtt

SEQ ID NO: 100518 - DNA, 22 bp, Artificial sequence
  SiRNA target sequence
tttccaaaatttagtcatgtta

SEQ ID NO: 100519 - DNA, 22 bp, Artificial sequence
  SiRNA target sequence
ttccaaaatttagtcatgttaa

SEQ ID NO: 100520 - DNA, 22 bp, Artificial sequence
  SiRNA target sequence
tccaaaatttagtcatgttaaa

SEQ ID NO: 100521 - DNA, 22 bp, Artificial sequence
  SiRNA target sequence
ccaaaatttagtcatgttaaaa

SEQ ID NO: 100522 - DNA, 22 bp, Artificial sequence
  SiRNA target sequence
caaaatttagtcatgttaaaag

SEQ ID NO: 100523 - DNA, 22 bp, Artificial sequence
  SiRNA target sequence
aaaatttagtcatgttaaaagg

SEQ ID NO: 100524 - DNA, 22 bp, Artificial sequence
  SiRNA target sequence
aaatttagtcatgttaaaaggt

SEQ ID NO: 100525 - DNA, 22 bp, Artificial sequence
  SiRNA target sequence
aatttagtcatgttaaaaggtt

SEQ ID NO: 100526 - DNA, 22 bp, Artificial sequence
  SiRNA target sequence
atttagtcatgttaaaaggttc

SEQ ID NO: 100527 - DNA, 22 bp, Artificial sequence
  SiRNA target sequence
tttagtcatgttaaaaggttca

SEQ ID NO: 100528 - DNA, 22 bp, Artificial sequence
  SiRNA target sequence
ttagtcatgttaaaaggttcag

SEQ ID NO: 100529 - DNA, 22 bp, Artificial sequence
  SiRNA target sequence
tagtcatgttaaaaggttcaga

SEQ ID NO: 100530 - DNA, 22 bp, Artificial sequence
  SiRNA target sequence
agtcatgttaaaaggttcagaa

SEQ ID NO: 100531 - DNA, 22 bp, Artificial sequence
  SiRNA target sequence
gtcatgttaaaaggttcagaac

SEQ ID NO: 100532 - DNA, 22 bp, Artificial sequence
  SiRNA target sequence
tcatgttaaaaggttcagaacc

SEQ ID NO: 100533 - DNA, 22 bp, Artificial sequence
  SiRNA target sequence
catgttaaaaggttcagaacca

SEQ ID NO: 100534 - DNA, 22 bp, Artificial sequence
  SiRNA target sequence
atgttaaaaggttcagaaccat

SEQ ID NO: 100535 - DNA, 22 bp, Artificial sequence
  SiRNA target sequence
tgttaaaaggttcagaaccatt

SEQ ID NO: 100536 - DNA, 22 bp, Artificial sequence
  SiRNA target sequence
gttaaaaggttcagaaccattc

SEQ ID NO: 100537 - DNA, 22 bp, Artificial sequence
  SiRNA target sequence
ttaaaaggttcagaaccattcc

SEQ ID NO: 100538 - DNA, 22 bp, Artificial sequence
  SiRNA target sequence
taaaaggttcagaaccattccc

SEQ ID NO: 100539 - DNA, 22 bp, Artificial sequence
  SiRNA target sequence
aaaaggttcagaaccattccca

SEQ ID NO: 100540 - DNA, 22 bp, Artificial sequence
  SiRNA target sequence
aaaggttcagaaccattcccat

SEQ ID NO: 100541 - DNA, 22 bp, Artificial sequence
  SiRNA target sequence
aaggttcagaaccattcccatg

SEQ ID NO: 100542 - DNA, 22 bp, Artificial sequence
  SiRNA target sequence
aggttcagaaccattcccatga

SEQ ID NO: 100543 - DNA, 22 bp, Artificial sequence
  SiRNA target sequence
ggttcagaaccattcccatgag

SEQ ID NO: 100544 - DNA, 22 bp, Artificial sequence
  SiRNA target sequence
gttcagaaccattcccatgagt

SEQ ID NO: 100545 - DNA, 22 bp, Artificial sequence
  SiRNA target sequence
ttcagaaccattcccatgagtc

SEQ ID NO: 100546 - DNA, 22 bp, Artificial sequence
  SiRNA target sequence
tcagaaccattcccatgagtcg

SEQ ID NO: 100547 - DNA, 22 bp, Artificial sequence
  SiRNA target sequence
cagaaccattcccatgagtcga

SEQ ID NO: 100548 - DNA, 22 bp, Artificial sequence
  SiRNA target sequence
agaaccattcccatgagtcgaa

SEQ ID NO: 100549 - DNA, 22 bp, Artificial sequence
  SiRNA target sequence
gaaccattcccatgagtcgaac

SEQ ID NO: 100550 - DNA, 22 bp, Artificial sequence
  SiRNA target sequence
aaccattcccatgagtcgaaca

SEQ ID NO: 100551 - DNA, 22 bp, Artificial sequence
  SiRNA target sequence
accattcccatgagtcgaacat

SEQ ID NO: 100552 - DNA, 22 bp, Artificial sequence
  SiRNA target sequence
ccattcccatgagtcgaacata

SEQ ID NO: 100553 - DNA, 22 bp, Artificial sequence
  SiRNA target sequence
cattcccatgagtcgaacatac

SEQ ID NO: 100554 - DNA, 22 bp, Artificial sequence
  SiRNA target sequence
attcccatgagtcgaacataca

SEQ ID NO: 100555 - DNA, 22 bp, Artificial sequence
  SiRNA target sequence
ttcccatgagtcgaacatacaa

SEQ ID NO: 100556 - DNA, 22 bp, Artificial sequence
  SiRNA target sequence
tcccatgagtcgaacatacaaa

SEQ ID NO: 100557 - DNA, 22 bp, Artificial sequence
  SiRNA target sequence
cccatgagtcgaacatacaaat

SEQ ID NO: 100558 - DNA, 22 bp, Artificial sequence
  SiRNA target sequence
ccatgagtcgaacatacaaata

SEQ ID NO: 100559 - DNA, 22 bp, Artificial sequence
  SiRNA target sequence
catgagtcgaacatacaaatat

SEQ ID NO: 100560 - DNA, 22 bp, Artificial sequence
  SiRNA target sequence
atgagtcgaacatacaaatata

SEQ ID NO: 100561 - DNA, 22 bp, Artificial sequence
  SiRNA target sequence
tgagtcgaacatacaaatataa

SEQ ID NO: 100562 - DNA, 22 bp, Artificial sequence
  SiRNA target sequence
gagtcgaacatacaaatataat

SEQ ID NO: 100563 - DNA, 22 bp, Artificial sequence
  SiRNA target sequence
agtcgaacatacaaatataatc

SEQ ID NO: 100564 - DNA, 22 bp, Artificial sequence
  SiRNA target sequence
gtcgaacatacaaatataatca

SEQ ID NO: 100565 - DNA, 22 bp, Artificial sequence
  SiRNA target sequence
tcgaacatacaaatataatcat

SEQ ID NO: 100566 - DNA, 22 bp, Artificial sequence
  SiRNA target sequence
cgaacatacaaatataatcata

SEQ ID NO: 100567 - DNA, 22 bp, Artificial sequence
  SiRNA target sequence
gaacatacaaatataatcatat

SEQ ID NO: 100568 - DNA, 22 bp, Artificial sequence
  SiRNA target sequence
aacatacaaatataatcatatc

SEQ ID NO: 100569 - DNA, 22 bp, Artificial sequence
  SiRNA target sequence
acatacaaatataatcatatca

SEQ ID NO: 100570 - DNA, 22 bp, Artificial sequence
  SiRNA target sequence
catacaaatataatcatatcaa

SEQ ID NO: 100571 - DNA, 22 bp, Artificial sequence
  SiRNA target sequence
atacaaatataatcatatcaat

SEQ ID NO: 100572 - DNA, 22 bp, Artificial sequence
  SiRNA target sequence
tacaaatataatcatatcaata

SEQ ID NO: 100573 - DNA, 22 bp, Artificial sequence
  SiRNA target sequence
acaaatataatcatatcaatat

SEQ ID NO: 100574 - DNA, 22 bp, Artificial sequence
  SiRNA target sequence
caaatataatcatatcaatatc

SEQ ID NO: 100575 - DNA, 22 bp, Artificial sequence
  SiRNA target sequence
aaatataatcatatcaatatct

SEQ ID NO: 100576 - DNA, 22 bp, Artificial sequence
  SiRNA target sequence
aatataatcatatcaatatcta

SEQ ID NO: 100577 - DNA, 22 bp, Artificial sequence
  SiRNA target sequence
atataatcatatcaatatctaa

SEQ ID NO: 100578 - DNA, 22 bp, Artificial sequence
  SiRNA target sequence
tataatcatatcaatatctaat

SEQ ID NO: 100579 - DNA, 22 bp, Artificial sequence
  SiRNA target sequence
ataatcatatcaatatctaata

SEQ ID NO: 100580 - DNA, 22 bp, Artificial sequence
  SiRNA target sequence
taatcatatcaatatctaatat

SEQ ID NO: 100581 - DNA, 22 bp, Artificial sequence
  SiRNA target sequence
aatcatatcaatatctaatatt

SEQ ID NO: 100582 - DNA, 22 bp, Artificial sequence
  SiRNA target sequence
atcatatcaatatctaatattt

SEQ ID NO: 100583 - DNA, 22 bp, Artificial sequence
  SiRNA target sequence
tcatatcaatatctaatatttt

SEQ ID NO: 100584 - DNA, 22 bp, Artificial sequence
  SiRNA target sequence
catatcaatatctaatattttt

SEQ ID NO: 100585 - DNA, 22 bp, Artificial sequence
  SiRNA target sequence
atatcaatatctaatatttttt

SEQ ID NO: 100586 - DNA, 22 bp, Artificial sequence
  SiRNA target sequence
tatcaatatctaatattttttc

SEQ ID NO: 100587 - DNA, 22 bp, Artificial sequence
  SiRNA target sequence
atcaatatctaatattttttcg

SEQ ID NO: 100588 - DNA, 22 bp, Artificial sequence
  SiRNA target sequence
tcaatatctaatattttttcga

SEQ ID NO: 100589 - DNA, 22 bp, Artificial sequence
  SiRNA target sequence
caatatctaatattttttcgaa

SEQ ID NO: 100590 - DNA, 22 bp, Artificial sequence
  SiRNA target sequence
aatatctaatattttttcgaaa

SEQ ID NO: 100591 - DNA, 22 bp, Artificial sequence
  SiRNA target sequence
atatctaatattttttcgaaat

SEQ ID NO: 100592 - DNA, 22 bp, Artificial sequence
  SiRNA target sequence
tatctaatattttttcgaaatc

SEQ ID NO: 100593 - DNA, 22 bp, Artificial sequence
  SiRNA target sequence
atctaatattttttcgaaatca

SEQ ID NO: 100594 - DNA, 22 bp, Artificial sequence
  SiRNA target sequence
tctaatattttttcgaaatcaa

SEQ ID NO: 100595 - DNA, 22 bp, Artificial sequence
  SiRNA target sequence
ctaatattttttcgaaatcaaa

SEQ ID NO: 100596 - DNA, 22 bp, Artificial sequence
  SiRNA target sequence
taatattttttcgaaatcaaaa

SEQ ID NO: 100597 - DNA, 22 bp, Artificial sequence
  SiRNA target sequence
aatattttttcgaaatcaaaac

SEQ ID NO: 100598 - DNA, 22 bp, Artificial sequence
  SiRNA target sequence
atattttttcgaaatcaaaact

SEQ ID NO: 100599 - DNA, 22 bp, Artificial sequence
  SiRNA target sequence
tattttttcgaaatcaaaactg

SEQ ID NO: 100600 - DNA, 22 bp, Artificial sequence
  SiRNA target sequence
attttttcgaaatcaaaactgt

SEQ ID NO: 100601 - DNA, 22 bp, Artificial sequence
  SiRNA target sequence
ttttttcgaaatcaaaactgtc

SEQ ID NO: 100602 - DNA, 22 bp, Artificial sequence
  SiRNA target sequence
tttttcgaaatcaaaactgtcc

SEQ ID NO: 100603 - DNA, 22 bp, Artificial sequence
  SiRNA target sequence
ttttcgaaatcaaaactgtcca

SEQ ID NO: 100604 - DNA, 22 bp, Artificial sequence
  SiRNA target sequence
tttcgaaatcaaaactgtccat

SEQ ID NO: 100605 - DNA, 22 bp, Artificial sequence
  SiRNA target sequence
ttcgaaatcaaaactgtccata

SEQ ID NO: 100606 - DNA, 22 bp, Artificial sequence
  SiRNA target sequence
tcgaaatcaaaactgtccatat

SEQ ID NO: 100607 - DNA, 22 bp, Artificial sequence
  SiRNA target sequence
cgaaatcaaaactgtccatatc

SEQ ID NO: 100608 - DNA, 22 bp, Artificial sequence
  SiRNA target sequence
gaaatcaaaactgtccatatct

SEQ ID NO: 100609 - DNA, 22 bp, Artificial sequence
  SiRNA target sequence
aaatcaaaactgtccatatcta

SEQ ID NO: 100610 - DNA, 22 bp, Artificial sequence
  SiRNA target sequence
aatcaaaactgtccatatctaa

SEQ ID NO: 100611 - DNA, 22 bp, Artificial sequence
  SiRNA target sequence
atcaaaactgtccatatctaaa

SEQ ID NO: 100612 - DNA, 22 bp, Artificial sequence
  SiRNA target sequence
tcaaaactgtccatatctaaag

SEQ ID NO: 100613 - DNA, 22 bp, Artificial sequence
  SiRNA target sequence
caaaactgtccatatctaaagt

SEQ ID NO: 100614 - DNA, 22 bp, Artificial sequence
  SiRNA target sequence
aaaactgtccatatctaaagta

SEQ ID NO: 100615 - DNA, 22 bp, Artificial sequence
  SiRNA target sequence
aaactgtccatatctaaagtaa

SEQ ID NO: 100616 - DNA, 22 bp, Artificial sequence
  SiRNA target sequence
aactgtccatatctaaagtaaa

SEQ ID NO: 100617 - DNA, 22 bp, Artificial sequence
  SiRNA target sequence
actgtccatatctaaagtaaaa

SEQ ID NO: 100618 - DNA, 22 bp, Artificial sequence
  SiRNA target sequence
ctgtccatatctaaagtaaaat

SEQ ID NO: 100619 - DNA, 22 bp, Artificial sequence
  SiRNA target sequence
tgtccatatctaaagtaaaatc

SEQ ID NO: 100620 - DNA, 22 bp, Artificial sequence
  SiRNA target sequence
gtccatatctaaagtaaaatct

SEQ ID NO: 100621 - DNA, 22 bp, Artificial sequence
  SiRNA target sequence
tccatatctaaagtaaaatctg

SEQ ID NO: 100622 - DNA, 22 bp, Artificial sequence
  SiRNA target sequence
ccatatctaaagtaaaatctgt

SEQ ID NO: 100623 - DNA, 22 bp, Artificial sequence
  SiRNA target sequence
catatctaaagtaaaatctgtt

SEQ ID NO: 100624 - DNA, 22 bp, Artificial sequence
  SiRNA target sequence
atatctaaagtaaaatctgttg

SEQ ID NO: 100625 - DNA, 22 bp, Artificial sequence
  SiRNA target sequence
tatctaaagtaaaatctgttgg

SEQ ID NO: 100626 - DNA, 22 bp, Artificial sequence
  SiRNA target sequence
atctaaagtaaaatctgttgga

SEQ ID NO: 100627 - DNA, 22 bp, Artificial sequence
  SiRNA target sequence
tctaaagtaaaatctgttggaa

SEQ ID NO: 100628 - DNA, 22 bp, Artificial sequence
  SiRNA target sequence
ctaaagtaaaatctgttggaag

SEQ ID NO: 100629 - DNA, 22 bp, Artificial sequence
  SiRNA target sequence
taaagtaaaatctgttggaagc

SEQ ID NO: 100630 - DNA, 22 bp, Artificial sequence
  SiRNA target sequence
aaagtaaaatctgttggaagca

SEQ ID NO: 100631 - DNA, 22 bp, Artificial sequence
  SiRNA target sequence
aagtaaaatctgttggaagcaa

SEQ ID NO: 100632 - DNA, 22 bp, Artificial sequence
  SiRNA target sequence
agtaaaatctgttggaagcaat

SEQ ID NO: 100633 - DNA, 22 bp, Artificial sequence
  SiRNA target sequence
gtaaaatctgttggaagcaatt

SEQ ID NO: 100634 - DNA, 22 bp, Artificial sequence
  SiRNA target sequence
taaaatctgttggaagcaattc

SEQ ID NO: 100635 - DNA, 22 bp, Artificial sequence
  SiRNA target sequence
aaaatctgttggaagcaattct

SEQ ID NO: 100636 - DNA, 22 bp, Artificial sequence
  SiRNA target sequence
aaatctgttggaagcaattctt

SEQ ID NO: 100637 - DNA, 22 bp, Artificial sequence
  SiRNA target sequence
aatctgttggaagcaattcttt

SEQ ID NO: 100638 - DNA, 22 bp, Artificial sequence
  SiRNA target sequence
atctgttggaagcaattcttta

SEQ ID NO: 100639 - DNA, 22 bp, Artificial sequence
  SiRNA target sequence
tctgttggaagcaattctttat

SEQ ID NO: 100640 - DNA, 22 bp, Artificial sequence
  SiRNA target sequence
ctgttggaagcaattctttatc

SEQ ID NO: 100641 - DNA, 22 bp, Artificial sequence
  SiRNA target sequence
tgttggaagcaattctttatca

SEQ ID NO: 100642 - DNA, 22 bp, Artificial sequence
  SiRNA target sequence
gttggaagcaattctttatcaa

SEQ ID NO: 100643 - DNA, 22 bp, Artificial sequence
  SiRNA target sequence
ttggaagcaattctttatcaac

SEQ ID NO: 100644 - DNA, 22 bp, Artificial sequence
  SiRNA target sequence
tggaagcaattctttatcaacg

SEQ ID NO: 100645 - DNA, 22 bp, Artificial sequence
  SiRNA target sequence
ggaagcaattctttatcaacgt

SEQ ID NO: 100646 - DNA, 22 bp, Artificial sequence
  SiRNA target sequence
gaagcaattctttatcaacgtt

SEQ ID NO: 100647 - DNA, 22 bp, Artificial sequence
  SiRNA target sequence
aagcaattctttatcaacgtta

SEQ ID NO: 100648 - DNA, 22 bp, Artificial sequence
  SiRNA target sequence
agcaattctttatcaacgttat

SEQ ID NO: 100649 - DNA, 22 bp, Artificial sequence
  SiRNA target sequence
gcaattctttatcaacgttata

SEQ ID NO: 100650 - DNA, 22 bp, Artificial sequence
  SiRNA target sequence
caattctttatcaacgttataa

SEQ ID NO: 100651 - DNA, 22 bp, Artificial sequence
  SiRNA target sequence
aattctttatcaacgttataaa

SEQ ID NO: 100652 - DNA, 22 bp, Artificial sequence
  SiRNA target sequence
attctttatcaacgttataaat

SEQ ID NO: 100653 - DNA, 22 bp, Artificial sequence
  SiRNA target sequence
ttctttatcaacgttataaatc

SEQ ID NO: 100654 - DNA, 22 bp, Artificial sequence
  SiRNA target sequence
tctttatcaacgttataaatca

SEQ ID NO: 100655 - DNA, 22 bp, Artificial sequence
  SiRNA target sequence
ctttatcaacgttataaatcaa

SEQ ID NO: 100656 - DNA, 22 bp, Artificial sequence
  SiRNA target sequence
tttatcaacgttataaatcaaa

SEQ ID NO: 100657 - DNA, 22 bp, Artificial sequence
  SiRNA target sequence
ttatcaacgttataaatcaaat

SEQ ID NO: 100658 - DNA, 22 bp, Artificial sequence
  SiRNA target sequence
tatcaacgttataaatcaaatc

SEQ ID NO: 100659 - DNA, 22 bp, Artificial sequence
  SiRNA target sequence
atcaacgttataaatcaaatct

SEQ ID NO: 100660 - DNA, 22 bp, Artificial sequence
  SiRNA target sequence
tcaacgttataaatcaaatctt

SEQ ID NO: 100661 - DNA, 22 bp, Artificial sequence
  SiRNA target sequence
caacgttataaatcaaatcttt

SEQ ID NO: 100662 - DNA, 22 bp, Artificial sequence
  SiRNA target sequence
aacgttataaatcaaatcttta

SEQ ID NO: 100663 - DNA, 22 bp, Artificial sequence
  SiRNA target sequence
acgttataaatcaaatctttat

SEQ ID NO: 100664 - DNA, 22 bp, Artificial sequence
  SiRNA target sequence
cgttataaatcaaatctttatt

SEQ ID NO: 100665 - DNA, 22 bp, Artificial sequence
  SiRNA target sequence
gttataaatcaaatctttattg

SEQ ID NO: 100666 - DNA, 22 bp, Artificial sequence
  SiRNA target sequence
ttataaatcaaatctttattgt

SEQ ID NO: 100667 - DNA, 22 bp, Artificial sequence
  SiRNA target sequence
tataaatcaaatctttattgta

SEQ ID NO: 100668 - DNA, 22 bp, Artificial sequence
  SiRNA target sequence
ataaatcaaatctttattgtat

SEQ ID NO: 100669 - DNA, 22 bp, Artificial sequence
  SiRNA target sequence
taaatcaaatctttattgtatc

SEQ ID NO: 100670 - DNA, 22 bp, Artificial sequence
  SiRNA target sequence
aaatcaaatctttattgtatcc

SEQ ID NO: 100671 - DNA, 22 bp, Artificial sequence
  SiRNA target sequence
aatcaaatctttattgtatccg

SEQ ID NO: 100672 - DNA, 22 bp, Artificial sequence
  SiRNA target sequence
atcaaatctttattgtatccgt

SEQ ID NO: 100673 - DNA, 22 bp, Artificial sequence
  SiRNA target sequence
tcaaatctttattgtatccgta

SEQ ID NO: 100674 - DNA, 22 bp, Artificial sequence
  SiRNA target sequence
caaatctttattgtatccgtat

SEQ ID NO: 100675 - DNA, 22 bp, Artificial sequence
  SiRNA target sequence
aaatctttattgtatccgtata

SEQ ID NO: 100676 - DNA, 22 bp, Artificial sequence
  SiRNA target sequence
aatctttattgtatccgtatag

SEQ ID NO: 100677 - DNA, 22 bp, Artificial sequence
  SiRNA target sequence
atctttattgtatccgtatagt

SEQ ID NO: 100678 - DNA, 22 bp, Artificial sequence
  SiRNA target sequence
tctttattgtatccgtatagta

SEQ ID NO: 100679 - DNA, 22 bp, Artificial sequence
  SiRNA target sequence
ctttattgtatccgtatagtat

SEQ ID NO: 100680 - DNA, 22 bp, Artificial sequence
  SiRNA target sequence
tttattgtatccgtatagtata

SEQ ID NO: 100681 - DNA, 22 bp, Artificial sequence
  SiRNA target sequence
ttattgtatccgtatagtataa

SEQ ID NO: 100682 - DNA, 22 bp, Artificial sequence
  SiRNA target sequence
tattgtatccgtatagtataac

SEQ ID NO: 100683 - DNA, 22 bp, Artificial sequence
  SiRNA target sequence
attgtatccgtatagtataaca

SEQ ID NO: 100684 - DNA, 22 bp, Artificial sequence
  SiRNA target sequence
ttgtatccgtatagtataacat

SEQ ID NO: 100685 - DNA, 22 bp, Artificial sequence
  SiRNA target sequence
tgtatccgtatagtataacatt

SEQ ID NO: 100686 - DNA, 22 bp, Artificial sequence
  SiRNA target sequence
gtatccgtatagtataacattt

SEQ ID NO: 100687 - DNA, 22 bp, Artificial sequence
  SiRNA target sequence
tatccgtatagtataacatttt

SEQ ID NO: 100688 - DNA, 22 bp, Artificial sequence
  SiRNA target sequence
atccgtatagtataacattttg

SEQ ID NO: 100689 - DNA, 22 bp, Artificial sequence
  SiRNA target sequence
tccgtatagtataacattttga

SEQ ID NO: 100690 - DNA, 22 bp, Artificial sequence
  SiRNA target sequence
ccgtatagtataacattttgaa

SEQ ID NO: 100691 - DNA, 22 bp, Artificial sequence
  SiRNA target sequence
cgtatagtataacattttgaat

SEQ ID NO: 100692 - DNA, 22 bp, Artificial sequence
  SiRNA target sequence
gtatagtataacattttgaata

SEQ ID NO: 100693 - DNA, 22 bp, Artificial sequence
  SiRNA target sequence
tatagtataacattttgaataa

SEQ ID NO: 100694 - DNA, 22 bp, Artificial sequence
  SiRNA target sequence
atagtataacattttgaataag

SEQ ID NO: 100695 - DNA, 22 bp, Artificial sequence
  SiRNA target sequence
tagtataacattttgaataagt

SEQ ID NO: 100696 - DNA, 22 bp, Artificial sequence
  SiRNA target sequence
agtataacattttgaataagtt

SEQ ID NO: 100697 - DNA, 22 bp, Artificial sequence
  SiRNA target sequence
gtataacattttgaataagttt

SEQ ID NO: 100698 - DNA, 22 bp, Artificial sequence
  SiRNA target sequence
tataacattttgaataagttta

SEQ ID NO: 100699 - DNA, 22 bp, Artificial sequence
  SiRNA target sequence
ataacattttgaataagtttag

SEQ ID NO: 100700 - DNA, 22 bp, Artificial sequence
  SiRNA target sequence
taacattttgaataagtttagc

SEQ ID NO: 100701 - DNA, 22 bp, Artificial sequence
  SiRNA target sequence
aacattttgaataagtttagca

SEQ ID NO: 100702 - DNA, 22 bp, Artificial sequence
  SiRNA target sequence
acattttgaataagtttagcaa

SEQ ID NO: 100703 - DNA, 22 bp, Artificial sequence
  SiRNA target sequence
cattttgaataagtttagcaat

SEQ ID NO: 100704 - DNA, 22 bp, Artificial sequence
  SiRNA target sequence
attttgaataagtttagcaata

SEQ ID NO: 100705 - DNA, 22 bp, Artificial sequence
  SiRNA target sequence
ttttgaataagtttagcaatat

SEQ ID NO: 100706 - DNA, 22 bp, Artificial sequence
  SiRNA target sequence
tttgaataagtttagcaatatg

SEQ ID NO: 100707 - DNA, 22 bp, Artificial sequence
  SiRNA target sequence
ttgaataagtttagcaatatgt

SEQ ID NO: 100708 - DNA, 22 bp, Artificial sequence
  SiRNA target sequence
tgaataagtttagcaatatgta

SEQ ID NO: 100709 - DNA, 22 bp, Artificial sequence
  SiRNA target sequence
gaataagtttagcaatatgtat

SEQ ID NO: 100710 - DNA, 22 bp, Artificial sequence
  SiRNA target sequence
aataagtttagcaatatgtata

SEQ ID NO: 100711 - DNA, 22 bp, Artificial sequence
  SiRNA target sequence
ataagtttagcaatatgtatag

SEQ ID NO: 100712 - DNA, 22 bp, Artificial sequence
  SiRNA target sequence
taagtttagcaatatgtataga

SEQ ID NO: 100713 - DNA, 22 bp, Artificial sequence
  SiRNA target sequence
aagtttagcaatatgtatagaa

SEQ ID NO: 100714 - DNA, 22 bp, Artificial sequence
  SiRNA target sequence
agtttagcaatatgtatagaat

SEQ ID NO: 100715 - DNA, 22 bp, Artificial sequence
  SiRNA target sequence
gtttagcaatatgtatagaatt

SEQ ID NO: 100716 - DNA, 22 bp, Artificial sequence
  SiRNA target sequence
tttagcaatatgtatagaattt

SEQ ID NO: 100717 - DNA, 22 bp, Artificial sequence
  SiRNA target sequence
ttagcaatatgtatagaatttc

SEQ ID NO: 100718 - DNA, 22 bp, Artificial sequence
  SiRNA target sequence
tagcaatatgtatagaatttcc

SEQ ID NO: 100719 - DNA, 22 bp, Artificial sequence
  SiRNA target sequence
agcaatatgtatagaatttcct

SEQ ID NO: 100720 - DNA, 22 bp, Artificial sequence
  SiRNA target sequence
gcaatatgtatagaatttcctg

SEQ ID NO: 100721 - DNA, 22 bp, Artificial sequence
  SiRNA target sequence
caatatgtatagaatttcctgt

SEQ ID NO: 100722 - DNA, 22 bp, Artificial sequence
  SiRNA target sequence
aatatgtatagaatttcctgtt

SEQ ID NO: 100723 - DNA, 22 bp, Artificial sequence
  SiRNA target sequence
atatgtatagaatttcctgttt

SEQ ID NO: 100724 - DNA, 22 bp, Artificial sequence
  SiRNA target sequence
tatgtatagaatttcctgtttg

SEQ ID NO: 100725 - DNA, 22 bp, Artificial sequence
  SiRNA target sequence
atgtatagaatttcctgtttgg

SEQ ID NO: 100726 - DNA, 22 bp, Artificial sequence
  SiRNA target sequence
tgtatagaatttcctgtttggg

SEQ ID NO: 100727 - DNA, 22 bp, Artificial sequence
  SiRNA target sequence
gtatagaatttcctgtttggga

SEQ ID NO: 100728 - DNA, 22 bp, Artificial sequence
  SiRNA target sequence
tatagaatttcctgtttgggag

SEQ ID NO: 100729 - DNA, 22 bp, Artificial sequence
  SiRNA target sequence
atagaatttcctgtttgggagc

SEQ ID NO: 100730 - DNA, 22 bp, Artificial sequence
  SiRNA target sequence
tagaatttcctgtttgggagcc

SEQ ID NO: 100731 - DNA, 22 bp, Artificial sequence
  SiRNA target sequence
agaatttcctgtttgggagcca

SEQ ID NO: 100732 - DNA, 22 bp, Artificial sequence
  SiRNA target sequence
gaatttcctgtttgggagccat

SEQ ID NO: 100733 - DNA, 22 bp, Artificial sequence
  SiRNA target sequence
aatttcctgtttgggagccata

SEQ ID NO: 100734 - DNA, 22 bp, Artificial sequence
  SiRNA target sequence
atttcctgtttgggagccatat

SEQ ID NO: 100735 - DNA, 22 bp, Artificial sequence
  SiRNA target sequence
tttcctgtttgggagccatata

SEQ ID NO: 100736 - DNA, 22 bp, Artificial sequence
  SiRNA target sequence
ttcctgtttgggagccatataa

SEQ ID NO: 100737 - DNA, 22 bp, Artificial sequence
  SiRNA target sequence
tcctgtttgggagccatataag

SEQ ID NO: 100738 - DNA, 22 bp, Artificial sequence
  SiRNA target sequence
cctgtttgggagccatataaga

SEQ ID NO: 100739 - DNA, 22 bp, Artificial sequence
  SiRNA target sequence
ctgtttgggagccatataagat

SEQ ID NO: 100740 - DNA, 22 bp, Artificial sequence
  SiRNA target sequence
tgtttgggagccatataagatt

SEQ ID NO: 100741 - DNA, 22 bp, Artificial sequence
  SiRNA target sequence
gtttgggagccatataagatta

SEQ ID NO: 100742 - DNA, 22 bp, Artificial sequence
  SiRNA target sequence
tttgggagccatataagattat

SEQ ID NO: 100743 - DNA, 22 bp, Artificial sequence
  SiRNA target sequence
ttgggagccatataagattatc

SEQ ID NO: 100744 - DNA, 22 bp, Artificial sequence
  SiRNA target sequence
tgggagccatataagattatca

SEQ ID NO: 100745 - DNA, 22 bp, Artificial sequence
  SiRNA target sequence
gggagccatataagattatcat

SEQ ID NO: 100746 - DNA, 23 bp, Artificial sequence
  SiRNA target sequence
ttaccaagtttctgcctgaaaat

SEQ ID NO: 100747 - DNA, 23 bp, Artificial sequence
  SiRNA target sequence
taccaagtttctgcctgaaaata

SEQ ID NO: 100748 - DNA, 23 bp, Artificial sequence
  SiRNA target sequence
accaagtttctgcctgaaaatat

SEQ ID NO: 100749 - DNA, 23 bp, Artificial sequence
  SiRNA target sequence
ccaagtttctgcctgaaaatata

SEQ ID NO: 100750 - DNA, 23 bp, Artificial sequence
  SiRNA target sequence
caagtttctgcctgaaaatatat

SEQ ID NO: 100751 - DNA, 23 bp, Artificial sequence
  SiRNA target sequence
aagtttctgcctgaaaatatatt

SEQ ID NO: 100752 - DNA, 23 bp, Artificial sequence
  SiRNA target sequence
agtttctgcctgaaaatatattt

SEQ ID NO: 100753 - DNA, 23 bp, Artificial sequence
  SiRNA target sequence
gtttctgcctgaaaatatatttt

SEQ ID NO: 100754 - DNA, 23 bp, Artificial sequence
  SiRNA target sequence
tttctgcctgaaaatatattttc

SEQ ID NO: 100755 - DNA, 23 bp, Artificial sequence
  SiRNA target sequence
ttctgcctgaaaatatattttct

SEQ ID NO: 100756 - DNA, 23 bp, Artificial sequence
  SiRNA target sequence
tctgcctgaaaatatattttctt

SEQ ID NO: 100757 - DNA, 23 bp, Artificial sequence
  SiRNA target sequence
ctgcctgaaaatatattttcttt

SEQ ID NO: 100758 - DNA, 23 bp, Artificial sequence
  SiRNA target sequence
tgcctgaaaatatattttctttt

SEQ ID NO: 100759 - DNA, 23 bp, Artificial sequence
  SiRNA target sequence
gcctgaaaatatattttcttttt

SEQ ID NO: 100760 - DNA, 23 bp, Artificial sequence
  SiRNA target sequence
cctgaaaatatattttcttttta

SEQ ID NO: 100761 - DNA, 23 bp, Artificial sequence
  SiRNA target sequence
ctgaaaatatattttctttttat

SEQ ID NO: 100762 - DNA, 23 bp, Artificial sequence
  SiRNA target sequence
tgaaaatatattttctttttata

SEQ ID NO: 100763 - DNA, 23 bp, Artificial sequence
  SiRNA target sequence
gaaaatatattttctttttataa

SEQ ID NO: 100764 - DNA, 23 bp, Artificial sequence
  SiRNA target sequence
aaaatatattttctttttataaa

SEQ ID NO: 100765 - DNA, 23 bp, Artificial sequence
  SiRNA target sequence
aaatatattttctttttataaat

SEQ ID NO: 100766 - DNA, 23 bp, Artificial sequence
  SiRNA target sequence
aatatattttctttttataaata

SEQ ID NO: 100767 - DNA, 23 bp, Artificial sequence
  SiRNA target sequence
atatattttctttttataaatat

SEQ ID NO: 100768 - DNA, 23 bp, Artificial sequence
  SiRNA target sequence
tatattttctttttataaatatc

SEQ ID NO: 100769 - DNA, 23 bp, Artificial sequence
  SiRNA target sequence
atattttctttttataaatatct

SEQ ID NO: 100770 - DNA, 23 bp, Artificial sequence
  SiRNA target sequence
tattttctttttataaatatcta

SEQ ID NO: 100771 - DNA, 23 bp, Artificial sequence
  SiRNA target sequence
attttctttttataaatatctaa

SEQ ID NO: 100772 - DNA, 23 bp, Artificial sequence
  SiRNA target sequence
ttttctttttataaatatctaat

SEQ ID NO: 100773 - DNA, 23 bp, Artificial sequence
  SiRNA target sequence
tttctttttataaatatctaata

SEQ ID NO: 100774 - DNA, 23 bp, Artificial sequence
  SiRNA target sequence
ttctttttataaatatctaataa

SEQ ID NO: 100775 - DNA, 23 bp, Artificial sequence
  SiRNA target sequence
tctttttataaatatctaataac

SEQ ID NO: 100776 - DNA, 23 bp, Artificial sequence
  SiRNA target sequence
ctttttataaatatctaataaca

SEQ ID NO: 100777 - DNA, 23 bp, Artificial sequence
  SiRNA target sequence
tttttataaatatctaataacat

SEQ ID NO: 100778 - DNA, 23 bp, Artificial sequence
  SiRNA target sequence
ttttataaatatctaataacatt

SEQ ID NO: 100779 - DNA, 23 bp, Artificial sequence
  SiRNA target sequence
tttataaatatctaataacattt

SEQ ID NO: 100780 - DNA, 23 bp, Artificial sequence
  SiRNA target sequence
ttataaatatctaataacatttt

SEQ ID NO: 100781 - DNA, 23 bp, Artificial sequence
  SiRNA target sequence
tataaatatctaataacattttt

SEQ ID NO: 100782 - DNA, 23 bp, Artificial sequence
  SiRNA target sequence
ataaatatctaataacatttttt

SEQ ID NO: 100783 - DNA, 23 bp, Artificial sequence
  SiRNA target sequence
taaatatctaataacattttttc

SEQ ID NO: 100784 - DNA, 23 bp, Artificial sequence
  SiRNA target sequence
aaatatctaataacattttttca

SEQ ID NO: 100785 - DNA, 23 bp, Artificial sequence
  SiRNA target sequence
aatatctaataacattttttcaa

SEQ ID NO: 100786 - DNA, 23 bp, Artificial sequence
  SiRNA target sequence
atatctaataacattttttcaat

SEQ ID NO: 100787 - DNA, 23 bp, Artificial sequence
  SiRNA target sequence
tatctaataacattttttcaata

SEQ ID NO: 100788 - DNA, 23 bp, Artificial sequence
  SiRNA target sequence
atctaataacattttttcaataa

SEQ ID NO: 100789 - DNA, 23 bp, Artificial sequence
  SiRNA target sequence
tctaataacattttttcaataat

SEQ ID NO: 100790 - DNA, 23 bp, Artificial sequence
  SiRNA target sequence
ctaataacattttttcaataata

SEQ ID NO: 100791 - DNA, 23 bp, Artificial sequence
  SiRNA target sequence
taataacattttttcaataatat

SEQ ID NO: 100792 - DNA, 23 bp, Artificial sequence
  SiRNA target sequence
aataacattttttcaataatatt

SEQ ID NO: 100793 - DNA, 23 bp, Artificial sequence
  SiRNA target sequence
ataacattttttcaataatatta

SEQ ID NO: 100794 - DNA, 23 bp, Artificial sequence
  SiRNA target sequence
taacattttttcaataatattat

SEQ ID NO: 100795 - DNA, 23 bp, Artificial sequence
  SiRNA target sequence
aacattttttcaataatattatt

SEQ ID NO: 100796 - DNA, 23 bp, Artificial sequence
  SiRNA target sequence
acattttttcaataatattatta

SEQ ID NO: 100797 - DNA, 23 bp, Artificial sequence
  SiRNA target sequence
cattttttcaataatattattaa

SEQ ID NO: 100798 - DNA, 23 bp, Artificial sequence
  SiRNA target sequence
attttttcaataatattattaag

SEQ ID NO: 100799 - DNA, 23 bp, Artificial sequence
  SiRNA target sequence
ttttttcaataatattattaagt

SEQ ID NO: 100800 - DNA, 23 bp, Artificial sequence
  SiRNA target sequence
tttttcaataatattattaagtc

SEQ ID NO: 100801 - DNA, 23 bp, Artificial sequence
  SiRNA target sequence
ttttcaataatattattaagtct

SEQ ID NO: 100802 - DNA, 23 bp, Artificial sequence
  SiRNA target sequence
tttcaataatattattaagtcta

SEQ ID NO: 100803 - DNA, 23 bp, Artificial sequence
  SiRNA target sequence
ttcaataatattattaagtctag

SEQ ID NO: 100804 - DNA, 23 bp, Artificial sequence
  SiRNA target sequence
tcaataatattattaagtctaga

SEQ ID NO: 100805 - DNA, 23 bp, Artificial sequence
  SiRNA target sequence
caataatattattaagtctagaa

SEQ ID NO: 100806 - DNA, 23 bp, Artificial sequence
  SiRNA target sequence
aataatattattaagtctagaat

SEQ ID NO: 100807 - DNA, 23 bp, Artificial sequence
  SiRNA target sequence
ataatattattaagtctagaatt

SEQ ID NO: 100808 - DNA, 23 bp, Artificial sequence
  SiRNA target sequence
taatattattaagtctagaattt

SEQ ID NO: 100809 - DNA, 23 bp, Artificial sequence
  SiRNA target sequence
aatattattaagtctagaatttc

SEQ ID NO: 100810 - DNA, 23 bp, Artificial sequence
  SiRNA target sequence
atattattaagtctagaatttcc

SEQ ID NO: 100811 - DNA, 23 bp, Artificial sequence
  SiRNA target sequence
tattattaagtctagaatttcca

SEQ ID NO: 100812 - DNA, 23 bp, Artificial sequence
  SiRNA target sequence
attattaagtctagaatttccac

SEQ ID NO: 100813 - DNA, 23 bp, Artificial sequence
  SiRNA target sequence
ttattaagtctagaatttccact

SEQ ID NO: 100814 - DNA, 23 bp, Artificial sequence
  SiRNA target sequence
tattaagtctagaatttccactt

SEQ ID NO: 100815 - DNA, 23 bp, Artificial sequence
  SiRNA target sequence
attaagtctagaatttccactta

SEQ ID NO: 100816 - DNA, 23 bp, Artificial sequence
  SiRNA target sequence
ttaagtctagaatttccacttac

SEQ ID NO: 100817 - DNA, 23 bp, Artificial sequence
  SiRNA target sequence
taagtctagaatttccacttaca

SEQ ID NO: 100818 - DNA, 23 bp, Artificial sequence
  SiRNA target sequence
aagtctagaatttccacttacaa

SEQ ID NO: 100819 - DNA, 23 bp, Artificial sequence
  SiRNA target sequence
agtctagaatttccacttacaaa

SEQ ID NO: 100820 - DNA, 23 bp, Artificial sequence
  SiRNA target sequence
gtctagaatttccacttacaaat

SEQ ID NO: 100821 - DNA, 23 bp, Artificial sequence
  SiRNA target sequence
tctagaatttccacttacaaata

SEQ ID NO: 100822 - DNA, 23 bp, Artificial sequence
  SiRNA target sequence
ctagaatttccacttacaaatat

SEQ ID NO: 100823 - DNA, 23 bp, Artificial sequence
  SiRNA target sequence
tagaatttccacttacaaatatt

SEQ ID NO: 100824 - DNA, 23 bp, Artificial sequence
  SiRNA target sequence
agaatttccacttacaaatatta

SEQ ID NO: 100825 - DNA, 23 bp, Artificial sequence
  SiRNA target sequence
gaatttccacttacaaatattaa

SEQ ID NO: 100826 - DNA, 23 bp, Artificial sequence
  SiRNA target sequence
aatttccacttacaaatattaac

SEQ ID NO: 100827 - DNA, 23 bp, Artificial sequence
  SiRNA target sequence
atttccacttacaaatattaacc

SEQ ID NO: 100828 - DNA, 23 bp, Artificial sequence
  SiRNA target sequence
tttccacttacaaatattaacca

SEQ ID NO: 100829 - DNA, 23 bp, Artificial sequence
  SiRNA target sequence
ttccacttacaaatattaaccaa

SEQ ID NO: 100830 - DNA, 23 bp, Artificial sequence
  SiRNA target sequence
tccacttacaaatattaaccaat

SEQ ID NO: 100831 - DNA, 23 bp, Artificial sequence
  SiRNA target sequence
ccacttacaaatattaaccaatc

SEQ ID NO: 100832 - DNA, 23 bp, Artificial sequence
  SiRNA target sequence
cacttacaaatattaaccaatca

SEQ ID NO: 100833 - DNA, 23 bp, Artificial sequence
  SiRNA target sequence
acttacaaatattaaccaatcat

SEQ ID NO: 100834 - DNA, 23 bp, Artificial sequence
  SiRNA target sequence
cttacaaatattaaccaatcatc

SEQ ID NO: 100835 - DNA, 23 bp, Artificial sequence
  SiRNA target sequence
ttacaaatattaaccaatcatca

SEQ ID NO: 100836 - DNA, 23 bp, Artificial sequence
  SiRNA target sequence
tacaaatattaaccaatcatcaa

SEQ ID NO: 100837 - DNA, 23 bp, Artificial sequence
  SiRNA target sequence
acaaatattaaccaatcatcaat

SEQ ID NO: 100838 - DNA, 23 bp, Artificial sequence
  SiRNA target sequence
caaatattaaccaatcatcaata

SEQ ID NO: 100839 - DNA, 23 bp, Artificial sequence
  SiRNA target sequence
aaatattaaccaatcatcaatat

SEQ ID NO: 100840 - DNA, 23 bp, Artificial sequence
  SiRNA target sequence
aatattaaccaatcatcaatatt

SEQ ID NO: 100841 - DNA, 23 bp, Artificial sequence
  SiRNA target sequence
atattaaccaatcatcaatattt

SEQ ID NO: 100842 - DNA, 23 bp, Artificial sequence
  SiRNA target sequence
tattaaccaatcatcaatatttt

SEQ ID NO: 100843 - DNA, 23 bp, Artificial sequence
  SiRNA target sequence
attaaccaatcatcaatattttc

SEQ ID NO: 100844 - DNA, 23 bp, Artificial sequence
  SiRNA target sequence
ttaaccaatcatcaatattttct

SEQ ID NO: 100845 - DNA, 23 bp, Artificial sequence
  SiRNA target sequence
taaccaatcatcaatattttcta

SEQ ID NO: 100846 - DNA, 23 bp, Artificial sequence
  SiRNA target sequence
aaccaatcatcaatattttctag

SEQ ID NO: 100847 - DNA, 23 bp, Artificial sequence
  SiRNA target sequence
accaatcatcaatattttctagc

SEQ ID NO: 100848 - DNA, 23 bp, Artificial sequence
  SiRNA target sequence
ccaatcatcaatattttctagcc

SEQ ID NO: 100849 - DNA, 23 bp, Artificial sequence
  SiRNA target sequence
caatcatcaatattttctagccc

SEQ ID NO: 100850 - DNA, 23 bp, Artificial sequence
  SiRNA target sequence
aatcatcaatattttctagccct

SEQ ID NO: 100851 - DNA, 23 bp, Artificial sequence
  SiRNA target sequence
atcatcaatattttctagccctt

SEQ ID NO: 100852 - DNA, 23 bp, Artificial sequence
  SiRNA target sequence
tcatcaatattttctagcccttt

SEQ ID NO: 100853 - DNA, 23 bp, Artificial sequence
  SiRNA target sequence
catcaatattttctagccctttt

SEQ ID NO: 100854 - DNA, 23 bp, Artificial sequence
  SiRNA target sequence
atcaatattttctagccctttta

SEQ ID NO: 100855 - DNA, 23 bp, Artificial sequence
  SiRNA target sequence
tcaatattttctagcccttttat

SEQ ID NO: 100856 - DNA, 23 bp, Artificial sequence
  SiRNA target sequence
caatattttctagcccttttata

SEQ ID NO: 100857 - DNA, 23 bp, Artificial sequence
  SiRNA target sequence
aatattttctagcccttttatag

SEQ ID NO: 100858 - DNA, 23 bp, Artificial sequence
  SiRNA target sequence
atattttctagcccttttatagt

SEQ ID NO: 100859 - DNA, 23 bp, Artificial sequence
  SiRNA target sequence
tattttctagcccttttatagtc

SEQ ID NO: 100860 - DNA, 23 bp, Artificial sequence
  SiRNA target sequence
attttctagcccttttatagtct

SEQ ID NO: 100861 - DNA, 23 bp, Artificial sequence
  SiRNA target sequence
ttttctagcccttttatagtctt

SEQ ID NO: 100862 - DNA, 23 bp, Artificial sequence
  SiRNA target sequence
tttctagcccttttatagtctta

SEQ ID NO: 100863 - DNA, 23 bp, Artificial sequence
  SiRNA target sequence
ttctagcccttttatagtcttat

SEQ ID NO: 100864 - DNA, 23 bp, Artificial sequence
  SiRNA target sequence
tctagcccttttatagtcttata

SEQ ID NO: 100865 - DNA, 23 bp, Artificial sequence
  SiRNA target sequence
ctagcccttttatagtcttataa

SEQ ID NO: 100866 - DNA, 23 bp, Artificial sequence
  SiRNA target sequence
tagcccttttatagtcttataaa

SEQ ID NO: 100867 - DNA, 23 bp, Artificial sequence
  SiRNA target sequence
agcccttttatagtcttataaat

SEQ ID NO: 100868 - DNA, 23 bp, Artificial sequence
  SiRNA target sequence
gcccttttatagtcttataaata

SEQ ID NO: 100869 - DNA, 23 bp, Artificial sequence
  SiRNA target sequence
cccttttatagtcttataaatat

SEQ ID NO: 100870 - DNA, 23 bp, Artificial sequence
  SiRNA target sequence
ccttttatagtcttataaatatc

SEQ ID NO: 100871 - DNA, 23 bp, Artificial sequence
  SiRNA target sequence
cttttatagtcttataaatatct

SEQ ID NO: 100872 - DNA, 23 bp, Artificial sequence
  SiRNA target sequence
ttttatagtcttataaatatctt

SEQ ID NO: 100873 - DNA, 23 bp, Artificial sequence
  SiRNA target sequence
tttatagtcttataaatatcttg

SEQ ID NO: 100874 - DNA, 23 bp, Artificial sequence
  SiRNA target sequence
ttatagtcttataaatatcttgt

SEQ ID NO: 100875 - DNA, 23 bp, Artificial sequence
  SiRNA target sequence
tatagtcttataaatatcttgta

SEQ ID NO: 100876 - DNA, 23 bp, Artificial sequence
  SiRNA target sequence
atagtcttataaatatcttgtat

SEQ ID NO: 100877 - DNA, 23 bp, Artificial sequence
  SiRNA target sequence
tagtcttataaatatcttgtatg

SEQ ID NO: 100878 - DNA, 23 bp, Artificial sequence
  SiRNA target sequence
agtcttataaatatcttgtatgt

SEQ ID NO: 100879 - DNA, 23 bp, Artificial sequence
  SiRNA target sequence
gtcttataaatatcttgtatgta

SEQ ID NO: 100880 - DNA, 23 bp, Artificial sequence
  SiRNA target sequence
tcttataaatatcttgtatgtat

SEQ ID NO: 100881 - DNA, 23 bp, Artificial sequence
  SiRNA target sequence
cttataaatatcttgtatgtatt

SEQ ID NO: 100882 - DNA, 23 bp, Artificial sequence
  SiRNA target sequence
ttataaatatcttgtatgtattt

SEQ ID NO: 100883 - DNA, 23 bp, Artificial sequence
  SiRNA target sequence
tataaatatcttgtatgtattta

SEQ ID NO: 100884 - DNA, 23 bp, Artificial sequence
  SiRNA target sequence
ataaatatcttgtatgtatttat

SEQ ID NO: 100885 - DNA, 23 bp, Artificial sequence
  SiRNA target sequence
taaatatcttgtatgtatttatt

SEQ ID NO: 100886 - DNA, 23 bp, Artificial sequence
  SiRNA target sequence
aaatatcttgtatgtatttatta

SEQ ID NO: 100887 - DNA, 23 bp, Artificial sequence
  SiRNA target sequence
aatatcttgtatgtatttattat

SEQ ID NO: 100888 - DNA, 23 bp, Artificial sequence
  SiRNA target sequence
atatcttgtatgtatttattatc

SEQ ID NO: 100889 - DNA, 23 bp, Artificial sequence
  SiRNA target sequence
tatcttgtatgtatttattatct

SEQ ID NO: 100890 - DNA, 23 bp, Artificial sequence
  SiRNA target sequence
atcttgtatgtatttattatctt

SEQ ID NO: 100891 - DNA, 23 bp, Artificial sequence
  SiRNA target sequence
tcttgtatgtatttattatcttc

SEQ ID NO: 100892 - DNA, 23 bp, Artificial sequence
  SiRNA target sequence
cttgtatgtatttattatcttcc

SEQ ID NO: 100893 - DNA, 23 bp, Artificial sequence
  SiRNA target sequence
ttgtatgtatttattatcttccc

SEQ ID NO: 100894 - DNA, 23 bp, Artificial sequence
  SiRNA target sequence
tgtatgtatttattatcttccct

SEQ ID NO: 100895 - DNA, 23 bp, Artificial sequence
  SiRNA target sequence
gtatgtatttattatcttccctt

SEQ ID NO: 100896 - DNA, 23 bp, Artificial sequence
  SiRNA target sequence
tatgtatttattatcttcccttg

SEQ ID NO: 100897 - DNA, 23 bp, Artificial sequence
  SiRNA target sequence
atgtatttattatcttcccttga

SEQ ID NO: 100898 - DNA, 23 bp, Artificial sequence
  SiRNA target sequence
tgtatttattatcttcccttgaa

SEQ ID NO: 100899 - DNA, 23 bp, Artificial sequence
  SiRNA target sequence
gtatttattatcttcccttgaaa

SEQ ID NO: 100900 - DNA, 23 bp, Artificial sequence
  SiRNA target sequence
tatttattatcttcccttgaaac

SEQ ID NO: 100901 - DNA, 23 bp, Artificial sequence
  SiRNA target sequence
atttattatcttcccttgaaaca

SEQ ID NO: 100902 - DNA, 23 bp, Artificial sequence
  SiRNA target sequence
tttattatcttcccttgaaacag

SEQ ID NO: 100903 - DNA, 23 bp, Artificial sequence
  SiRNA target sequence
ttattatcttcccttgaaacagc

SEQ ID NO: 100904 - DNA, 23 bp, Artificial sequence
  SiRNA target sequence
tattatcttcccttgaaacagcg

SEQ ID NO: 100905 - DNA, 23 bp, Artificial sequence
  SiRNA target sequence
attatcttcccttgaaacagcgg

SEQ ID NO: 100906 - DNA, 23 bp, Artificial sequence
  SiRNA target sequence
ttatcttcccttgaaacagcggg

SEQ ID NO: 100907 - DNA, 23 bp, Artificial sequence
  SiRNA target sequence
tatcttcccttgaaacagcgggg

SEQ ID NO: 100908 - DNA, 23 bp, Artificial sequence
  SiRNA target sequence
atcttcccttgaaacagcggggt

SEQ ID NO: 100909 - DNA, 23 bp, Artificial sequence
  SiRNA target sequence
tcttcccttgaaacagcggggta

SEQ ID NO: 100910 - DNA, 23 bp, Artificial sequence
  SiRNA target sequence
cttcccttgaaacagcggggtaa

SEQ ID NO: 100911 - DNA, 23 bp, Artificial sequence
  SiRNA target sequence
ttcccttgaaacagcggggtaaa

SEQ ID NO: 100912 - DNA, 23 bp, Artificial sequence
  SiRNA target sequence
tcccttgaaacagcggggtaaat

SEQ ID NO: 100913 - DNA, 23 bp, Artificial sequence
  SiRNA target sequence
cccttgaaacagcggggtaaatt

SEQ ID NO: 100914 - DNA, 23 bp, Artificial sequence
  SiRNA target sequence
ccttgaaacagcggggtaaattt

SEQ ID NO: 100915 - DNA, 23 bp, Artificial sequence
  SiRNA target sequence
cttgaaacagcggggtaaatttc

SEQ ID NO: 100916 - DNA, 23 bp, Artificial sequence
  SiRNA target sequence
ttgaaacagcggggtaaatttca

SEQ ID NO: 100917 - DNA, 23 bp, Artificial sequence
  SiRNA target sequence
tgaaacagcggggtaaatttcaa

SEQ ID NO: 100918 - DNA, 23 bp, Artificial sequence
  SiRNA target sequence
gaaacagcggggtaaatttcaat

SEQ ID NO: 100919 - DNA, 23 bp, Artificial sequence
  SiRNA target sequence
aaacagcggggtaaatttcaatg

SEQ ID NO: 100920 - DNA, 23 bp, Artificial sequence
  SiRNA target sequence
aacagcggggtaaatttcaatgc

SEQ ID NO: 100921 - DNA, 23 bp, Artificial sequence
  SiRNA target sequence
acagcggggtaaatttcaatgcc

SEQ ID NO: 100922 - DNA, 23 bp, Artificial sequence
  SiRNA target sequence
cagcggggtaaatttcaatgcct

SEQ ID NO: 100923 - DNA, 23 bp, Artificial sequence
  SiRNA target sequence
agcggggtaaatttcaatgcctt

SEQ ID NO: 100924 - DNA, 23 bp, Artificial sequence
  SiRNA target sequence
gcggggtaaatttcaatgccttt

SEQ ID NO: 100925 - DNA, 23 bp, Artificial sequence
  SiRNA target sequence
cggggtaaatttcaatgccttta

SEQ ID NO: 100926 - DNA, 23 bp, Artificial sequence
  SiRNA target sequence
ggggtaaatttcaatgcctttat

SEQ ID NO: 100927 - DNA, 23 bp, Artificial sequence
  SiRNA target sequence
gggtaaatttcaatgcctttatt

SEQ ID NO: 100928 - DNA, 23 bp, Artificial sequence
  SiRNA target sequence
ggtaaatttcaatgcctttattt

SEQ ID NO: 100929 - DNA, 23 bp, Artificial sequence
  SiRNA target sequence
gtaaatttcaatgcctttatttt

SEQ ID NO: 100930 - DNA, 23 bp, Artificial sequence
  SiRNA target sequence
taaatttcaatgcctttattttc

SEQ ID NO: 100931 - DNA, 23 bp, Artificial sequence
  SiRNA target sequence
aaatttcaatgcctttattttca

SEQ ID NO: 100932 - DNA, 23 bp, Artificial sequence
  SiRNA target sequence
aatttcaatgcctttattttcaa

SEQ ID NO: 100933 - DNA, 23 bp, Artificial sequence
  SiRNA target sequence
atttcaatgcctttattttcaaa

SEQ ID NO: 100934 - DNA, 23 bp, Artificial sequence
  SiRNA target sequence
tttcaatgcctttattttcaaac

SEQ ID NO: 100935 - DNA, 23 bp, Artificial sequence
  SiRNA target sequence
ttcaatgcctttattttcaaact

SEQ ID NO: 100936 - DNA, 23 bp, Artificial sequence
  SiRNA target sequence
tcaatgcctttattttcaaactc

SEQ ID NO: 100937 - DNA, 23 bp, Artificial sequence
  SiRNA target sequence
caatgcctttattttcaaactct

SEQ ID NO: 100938 - DNA, 23 bp, Artificial sequence
  SiRNA target sequence
aatgcctttattttcaaactctt

SEQ ID NO: 100939 - DNA, 23 bp, Artificial sequence
  SiRNA target sequence
atgcctttattttcaaactcttc

SEQ ID NO: 100940 - DNA, 23 bp, Artificial sequence
  SiRNA target sequence
tgcctttattttcaaactcttct

SEQ ID NO: 100941 - DNA, 23 bp, Artificial sequence
  SiRNA target sequence
gcctttattttcaaactcttctt

SEQ ID NO: 100942 - DNA, 23 bp, Artificial sequence
  SiRNA target sequence
cctttattttcaaactcttcttt

SEQ ID NO: 100943 - DNA, 23 bp, Artificial sequence
  SiRNA target sequence
ctttattttcaaactcttcttta

SEQ ID NO: 100944 - DNA, 23 bp, Artificial sequence
  SiRNA target sequence
tttattttcaaactcttctttat

SEQ ID NO: 100945 - DNA, 23 bp, Artificial sequence
  SiRNA target sequence
ttattttcaaactcttctttata

SEQ ID NO: 100946 - DNA, 23 bp, Artificial sequence
  SiRNA target sequence
tattttcaaactcttctttatat

SEQ ID NO: 100947 - DNA, 23 bp, Artificial sequence
  SiRNA target sequence
attttcaaactcttctttatata

SEQ ID NO: 100948 - DNA, 23 bp, Artificial sequence
  SiRNA target sequence
ttttcaaactcttctttatataa

SEQ ID NO: 100949 - DNA, 23 bp, Artificial sequence
  SiRNA target sequence
tttcaaactcttctttatataaa

SEQ ID NO: 100950 - DNA, 23 bp, Artificial sequence
  SiRNA target sequence
ttcaaactcttctttatataaaa

SEQ ID NO: 100951 - DNA, 23 bp, Artificial sequence
  SiRNA target sequence
tcaaactcttctttatataaaaa

SEQ ID NO: 100952 - DNA, 23 bp, Artificial sequence
  SiRNA target sequence
caaactcttctttatataaaaaa

SEQ ID NO: 100953 - DNA, 23 bp, Artificial sequence
  SiRNA target sequence
aaactcttctttatataaaaaat

SEQ ID NO: 100954 - DNA, 23 bp, Artificial sequence
  SiRNA target sequence
aactcttctttatataaaaaatc

SEQ ID NO: 100955 - DNA, 23 bp, Artificial sequence
  SiRNA target sequence
actcttctttatataaaaaatct

SEQ ID NO: 100956 - DNA, 23 bp, Artificial sequence
  SiRNA target sequence
ctcttctttatataaaaaatcta

SEQ ID NO: 100957 - DNA, 23 bp, Artificial sequence
  SiRNA target sequence
tcttctttatataaaaaatctac

SEQ ID NO: 100958 - DNA, 23 bp, Artificial sequence
  SiRNA target sequence
cttctttatataaaaaatctaca

SEQ ID NO: 100959 - DNA, 23 bp, Artificial sequence
  SiRNA target sequence
ttctttatataaaaaatctacat

SEQ ID NO: 100960 - DNA, 23 bp, Artificial sequence
  SiRNA target sequence
tctttatataaaaaatctacatc

SEQ ID NO: 100961 - DNA, 23 bp, Artificial sequence
  SiRNA target sequence
ctttatataaaaaatctacatct

SEQ ID NO: 100962 - DNA, 23 bp, Artificial sequence
  SiRNA target sequence
tttatataaaaaatctacatctc

SEQ ID NO: 100963 - DNA, 23 bp, Artificial sequence
  SiRNA target sequence
ttatataaaaaatctacatctct

SEQ ID NO: 100964 - DNA, 23 bp, Artificial sequence
  SiRNA target sequence
tatataaaaaatctacatctcta

SEQ ID NO: 100965 - DNA, 23 bp, Artificial sequence
  SiRNA target sequence
atataaaaaatctacatctctaa

SEQ ID NO: 100966 - DNA, 23 bp, Artificial sequence
  SiRNA target sequence
tataaaaaatctacatctctaaa

SEQ ID NO: 100967 - DNA, 23 bp, Artificial sequence
  SiRNA target sequence
ataaaaaatctacatctctaaat

SEQ ID NO: 100968 - DNA, 23 bp, Artificial sequence
  SiRNA target sequence
taaaaaatctacatctctaaatc

SEQ ID NO: 100969 - DNA, 23 bp, Artificial sequence
  SiRNA target sequence
aaaaaatctacatctctaaatct

SEQ ID NO: 100970 - DNA, 23 bp, Artificial sequence
  SiRNA target sequence
aaaaatctacatctctaaatcta

SEQ ID NO: 100971 - DNA, 23 bp, Artificial sequence
  SiRNA target sequence
aaaatctacatctctaaatctaa

SEQ ID NO: 100972 - DNA, 23 bp, Artificial sequence
  SiRNA target sequence
aaatctacatctctaaatctaaa

SEQ ID NO: 100973 - DNA, 23 bp, Artificial sequence
  SiRNA target sequence
aatctacatctctaaatctaaaa

SEQ ID NO: 100974 - DNA, 23 bp, Artificial sequence
  SiRNA target sequence
atctacatctctaaatctaaaac

SEQ ID NO: 100975 - DNA, 23 bp, Artificial sequence
  SiRNA target sequence
tctacatctctaaatctaaaacc

SEQ ID NO: 100976 - DNA, 23 bp, Artificial sequence
  SiRNA target sequence
ctacatctctaaatctaaaacca

SEQ ID NO: 100977 - DNA, 23 bp, Artificial sequence
  SiRNA target sequence
tacatctctaaatctaaaaccat

SEQ ID NO: 100978 - DNA, 23 bp, Artificial sequence
  SiRNA target sequence
acatctctaaatctaaaaccata

SEQ ID NO: 100979 - DNA, 23 bp, Artificial sequence
  SiRNA target sequence
catctctaaatctaaaaccatat

SEQ ID NO: 100980 - DNA, 23 bp, Artificial sequence
  SiRNA target sequence
atctctaaatctaaaaccatata

SEQ ID NO: 100981 - DNA, 23 bp, Artificial sequence
  SiRNA target sequence
tctctaaatctaaaaccatataa

SEQ ID NO: 100982 - DNA, 23 bp, Artificial sequence
  SiRNA target sequence
ctctaaatctaaaaccatataat

SEQ ID NO: 100983 - DNA, 23 bp, Artificial sequence
  SiRNA target sequence
tctaaatctaaaaccatataata

SEQ ID NO: 100984 - DNA, 23 bp, Artificial sequence
  SiRNA target sequence
ctaaatctaaaaccatataataa

SEQ ID NO: 100985 - DNA, 23 bp, Artificial sequence
  SiRNA target sequence
taaatctaaaaccatataataaa

SEQ ID NO: 100986 - DNA, 23 bp, Artificial sequence
  SiRNA target sequence
aaatctaaaaccatataataaaa

SEQ ID NO: 100987 - DNA, 23 bp, Artificial sequence
  SiRNA target sequence
aatctaaaaccatataataaaat

SEQ ID NO: 100988 - DNA, 23 bp, Artificial sequence
  SiRNA target sequence
atctaaaaccatataataaaata

SEQ ID NO: 100989 - DNA, 23 bp, Artificial sequence
  SiRNA target sequence
tctaaaaccatataataaaataa

SEQ ID NO: 100990 - DNA, 23 bp, Artificial sequence
  SiRNA target sequence
ctaaaaccatataataaaataac

SEQ ID NO: 100991 - DNA, 23 bp, Artificial sequence
  SiRNA target sequence
taaaaccatataataaaataact

SEQ ID NO: 100992 - DNA, 23 bp, Artificial sequence
  SiRNA target sequence
aaaaccatataataaaataactt

SEQ ID NO: 100993 - DNA, 23 bp, Artificial sequence
  SiRNA target sequence
aaaccatataataaaataacttt

SEQ ID NO: 100994 - DNA, 23 bp, Artificial sequence
  SiRNA target sequence
aaccatataataaaataactttt

SEQ ID NO: 100995 - DNA, 23 bp, Artificial sequence
  SiRNA target sequence
accatataataaaataacttttt

SEQ ID NO: 100996 - DNA, 23 bp, Artificial sequence
  SiRNA target sequence
ccatataataaaataactttttt

SEQ ID NO: 100997 - DNA, 23 bp, Artificial sequence
  SiRNA target sequence
catataataaaataactttttta

SEQ ID NO: 100998 - DNA, 23 bp, Artificial sequence
  SiRNA target sequence
atataataaaataacttttttaa

SEQ ID NO: 100999 - DNA, 23 bp, Artificial sequence
  SiRNA target sequence
tataataaaataacttttttaaa

SEQ ID NO: 101000 - DNA, 23 bp, Artificial sequence
  SiRNA target sequence
ataataaaataacttttttaaaa

SEQ ID NO: 101001 - DNA, 23 bp, Artificial sequence
  SiRNA target sequence
taataaaataacttttttaaaaa

SEQ ID NO: 101002 - DNA, 23 bp, Artificial sequence
  SiRNA target sequence
aataaaataacttttttaaaaaa

SEQ ID NO: 101003 - DNA, 23 bp, Artificial sequence
  SiRNA target sequence
ataaaataacttttttaaaaaaa

SEQ ID NO: 101004 - DNA, 23 bp, Artificial sequence
  SiRNA target sequence
taaaataacttttttaaaaaaat

SEQ ID NO: 101005 - DNA, 23 bp, Artificial sequence
  SiRNA target sequence
aaaataacttttttaaaaaaatt

SEQ ID NO: 101006 - DNA, 23 bp, Artificial sequence
  SiRNA target sequence
aaataacttttttaaaaaaattt

SEQ ID NO: 101007 - DNA, 23 bp, Artificial sequence
  SiRNA target sequence
aataacttttttaaaaaaattta

SEQ ID NO: 101008 - DNA, 23 bp, Artificial sequence
  SiRNA target sequence
ataacttttttaaaaaaatttaa

SEQ ID NO: 101009 - DNA, 23 bp, Artificial sequence
  SiRNA target sequence
taacttttttaaaaaaatttaaa

SEQ ID NO: 101010 - DNA, 23 bp, Artificial sequence
  SiRNA target sequence
aacttttttaaaaaaatttaaat

SEQ ID NO: 101011 - DNA, 23 bp, Artificial sequence
  SiRNA target sequence
acttttttaaaaaaatttaaatc

SEQ ID NO: 101012 - DNA, 23 bp, Artificial sequence
  SiRNA target sequence
cttttttaaaaaaatttaaatca

SEQ ID NO: 101013 - DNA, 23 bp, Artificial sequence
  SiRNA target sequence
ttttttaaaaaaatttaaatcag

SEQ ID NO: 101014 - DNA, 23 bp, Artificial sequence
  SiRNA target sequence
tttttaaaaaaatttaaatcaga

SEQ ID NO: 101015 - DNA, 23 bp, Artificial sequence
  SiRNA target sequence
ttttaaaaaaatttaaatcagaa

SEQ ID NO: 101016 - DNA, 23 bp, Artificial sequence
  SiRNA target sequence
tttaaaaaaatttaaatcagaat

SEQ ID NO: 101017 - DNA, 23 bp, Artificial sequence
  SiRNA target sequence
ttaaaaaaatttaaatcagaata

SEQ ID NO: 101018 - DNA, 23 bp, Artificial sequence
  SiRNA target sequence
taaaaaaatttaaatcagaatag

SEQ ID NO: 101019 - DNA, 23 bp, Artificial sequence
  SiRNA target sequence
aaaaaaatttaaatcagaatagt

SEQ ID NO: 101020 - DNA, 23 bp, Artificial sequence
  SiRNA target sequence
aaaaaatttaaatcagaatagta

SEQ ID NO: 101021 - DNA, 23 bp, Artificial sequence
  SiRNA target sequence
aaaaatttaaatcagaatagtaa

SEQ ID NO: 101022 - DNA, 23 bp, Artificial sequence
  SiRNA target sequence
aaaatttaaatcagaatagtaat

SEQ ID NO: 101023 - DNA, 23 bp, Artificial sequence
  SiRNA target sequence
aaatttaaatcagaatagtaatt

SEQ ID NO: 101024 - DNA, 23 bp, Artificial sequence
  SiRNA target sequence
aatttaaatcagaatagtaatta

SEQ ID NO: 101025 - DNA, 23 bp, Artificial sequence
  SiRNA target sequence
atttaaatcagaatagtaattaa

SEQ ID NO: 101026 - DNA, 23 bp, Artificial sequence
  SiRNA target sequence
tttaaatcagaatagtaattaac

SEQ ID NO: 101027 - DNA, 23 bp, Artificial sequence
  SiRNA target sequence
ttaaatcagaatagtaattaaca

SEQ ID NO: 101028 - DNA, 23 bp, Artificial sequence
  SiRNA target sequence
taaatcagaatagtaattaacaa

SEQ ID NO: 101029 - DNA, 23 bp, Artificial sequence
  SiRNA target sequence
aaatcagaatagtaattaacaaa

SEQ ID NO: 101030 - DNA, 23 bp, Artificial sequence
  SiRNA target sequence
aatcagaatagtaattaacaaat

SEQ ID NO: 101031 - DNA, 23 bp, Artificial sequence
  SiRNA target sequence
atcagaatagtaattaacaaatg

SEQ ID NO: 101032 - DNA, 23 bp, Artificial sequence
  SiRNA target sequence
tcagaatagtaattaacaaatgc

SEQ ID NO: 101033 - DNA, 23 bp, Artificial sequence
  SiRNA target sequence
cagaatagtaattaacaaatgcc

SEQ ID NO: 101034 - DNA, 23 bp, Artificial sequence
  SiRNA target sequence
agaatagtaattaacaaatgccc

SEQ ID NO: 101035 - DNA, 23 bp, Artificial sequence
  SiRNA target sequence
gaatagtaattaacaaatgccct

SEQ ID NO: 101036 - DNA, 23 bp, Artificial sequence
  SiRNA target sequence
aatagtaattaacaaatgccctg

SEQ ID NO: 101037 - DNA, 23 bp, Artificial sequence
  SiRNA target sequence
atagtaattaacaaatgccctgg

SEQ ID NO: 101038 - DNA, 23 bp, Artificial sequence
  SiRNA target sequence
tagtaattaacaaatgccctggg

SEQ ID NO: 101039 - DNA, 23 bp, Artificial sequence
  SiRNA target sequence
agtaattaacaaatgccctggga

SEQ ID NO: 101040 - DNA, 23 bp, Artificial sequence
  SiRNA target sequence
gtaattaacaaatgccctgggaa

SEQ ID NO: 101041 - DNA, 23 bp, Artificial sequence
  SiRNA target sequence
taattaacaaatgccctgggaag

SEQ ID NO: 101042 - DNA, 23 bp, Artificial sequence
  SiRNA target sequence
aattaacaaatgccctgggaagt

SEQ ID NO: 101043 - DNA, 23 bp, Artificial sequence
  SiRNA target sequence
attaacaaatgccctgggaagtg

SEQ ID NO: 101044 - DNA, 23 bp, Artificial sequence
  SiRNA target sequence
ttaacaaatgccctgggaagtgt

SEQ ID NO: 101045 - DNA, 23 bp, Artificial sequence
  SiRNA target sequence
taacaaatgccctgggaagtgta

SEQ ID NO: 101046 - DNA, 23 bp, Artificial sequence
  SiRNA target sequence
aacaaatgccctgggaagtgtaa

SEQ ID NO: 101047 - DNA, 23 bp, Artificial sequence
  SiRNA target sequence
acaaatgccctgggaagtgtaat

SEQ ID NO: 101048 - DNA, 23 bp, Artificial sequence
  SiRNA target sequence
caaatgccctgggaagtgtaata

SEQ ID NO: 101049 - DNA, 23 bp, Artificial sequence
  SiRNA target sequence
aaatgccctgggaagtgtaatac

SEQ ID NO: 101050 - DNA, 23 bp, Artificial sequence
  SiRNA target sequence
aatgccctgggaagtgtaatacc

SEQ ID NO: 101051 - DNA, 23 bp, Artificial sequence
  SiRNA target sequence
atgccctgggaagtgtaatacca

SEQ ID NO: 101052 - DNA, 23 bp, Artificial sequence
  SiRNA target sequence
tgccctgggaagtgtaataccag

SEQ ID NO: 101053 - DNA, 23 bp, Artificial sequence
  SiRNA target sequence
gccctgggaagtgtaataccagt

SEQ ID NO: 101054 - DNA, 23 bp, Artificial sequence
  SiRNA target sequence
ccctgggaagtgtaataccagta

SEQ ID NO: 101055 - DNA, 23 bp, Artificial sequence
  SiRNA target sequence
cctgggaagtgtaataccagtac

SEQ ID NO: 101056 - DNA, 23 bp, Artificial sequence
  SiRNA target sequence
ctgggaagtgtaataccagtacc

SEQ ID NO: 101057 - DNA, 23 bp, Artificial sequence
  SiRNA target sequence
tgggaagtgtaataccagtacca

SEQ ID NO: 101058 - DNA, 23 bp, Artificial sequence
  SiRNA target sequence
gggaagtgtaataccagtaccag

SEQ ID NO: 101059 - DNA, 23 bp, Artificial sequence
  SiRNA target sequence
ggaagtgtaataccagtaccagt

SEQ ID NO: 101060 - DNA, 23 bp, Artificial sequence
  SiRNA target sequence
gaagtgtaataccagtaccagtg

SEQ ID NO: 101061 - DNA, 23 bp, Artificial sequence
  SiRNA target sequence
aagtgtaataccagtaccagtgc

SEQ ID NO: 101062 - DNA, 23 bp, Artificial sequence
  SiRNA target sequence
agtgtaataccagtaccagtgca

SEQ ID NO: 101063 - DNA, 23 bp, Artificial sequence
  SiRNA target sequence
gtgtaataccagtaccagtgcac

SEQ ID NO: 101064 - DNA, 23 bp, Artificial sequence
  SiRNA target sequence
tgtaataccagtaccagtgcaca

SEQ ID NO: 101065 - DNA, 23 bp, Artificial sequence
  SiRNA target sequence
gtaataccagtaccagtgcacat

SEQ ID NO: 101066 - DNA, 23 bp, Artificial sequence
  SiRNA target sequence
taataccagtaccagtgcacata

SEQ ID NO: 101067 - DNA, 23 bp, Artificial sequence
  SiRNA target sequence
aataccagtaccagtgcacataa

SEQ ID NO: 101068 - DNA, 23 bp, Artificial sequence
  SiRNA target sequence
ataccagtaccagtgcacataaa

SEQ ID NO: 101069 - DNA, 23 bp, Artificial sequence
  SiRNA target sequence
taccagtaccagtgcacataaac

SEQ ID NO: 101070 - DNA, 23 bp, Artificial sequence
  SiRNA target sequence
accagtaccagtgcacataaaca

SEQ ID NO: 101071 - DNA, 23 bp, Artificial sequence
  SiRNA target sequence
ccagtaccagtgcacataaacaa

SEQ ID NO: 101072 - DNA, 23 bp, Artificial sequence
  SiRNA target sequence
cagtaccagtgcacataaacaaa

SEQ ID NO: 101073 - DNA, 23 bp, Artificial sequence
  SiRNA target sequence
agtaccagtgcacataaacaaaa

SEQ ID NO: 101074 - DNA, 23 bp, Artificial sequence
  SiRNA target sequence
gtaccagtgcacataaacaaaat

SEQ ID NO: 101075 - DNA, 23 bp, Artificial sequence
  SiRNA target sequence
taccagtgcacataaacaaaatc

SEQ ID NO: 101076 - DNA, 23 bp, Artificial sequence
  SiRNA target sequence
accagtgcacataaacaaaatct

SEQ ID NO: 101077 - DNA, 23 bp, Artificial sequence
  SiRNA target sequence
ccagtgcacataaacaaaatctt

SEQ ID NO: 101078 - DNA, 23 bp, Artificial sequence
  SiRNA target sequence
cagtgcacataaacaaaatcttt

SEQ ID NO: 101079 - DNA, 23 bp, Artificial sequence
  SiRNA target sequence
agtgcacataaacaaaatctttt

SEQ ID NO: 101080 - DNA, 23 bp, Artificial sequence
  SiRNA target sequence
gtgcacataaacaaaatcttttt

SEQ ID NO: 101081 - DNA, 23 bp, Artificial sequence
  SiRNA target sequence
tgcacataaacaaaatcttttta

SEQ ID NO: 101082 - DNA, 23 bp, Artificial sequence
  SiRNA target sequence
gcacataaacaaaatctttttac

SEQ ID NO: 101083 - DNA, 23 bp, Artificial sequence
  SiRNA target sequence
cacataaacaaaatctttttacc

SEQ ID NO: 101084 - DNA, 23 bp, Artificial sequence
  SiRNA target sequence
acataaacaaaatctttttacca

SEQ ID NO: 101085 - DNA, 23 bp, Artificial sequence
  SiRNA target sequence
cataaacaaaatctttttaccac

SEQ ID NO: 101086 - DNA, 23 bp, Artificial sequence
  SiRNA target sequence
ataaacaaaatctttttaccact

SEQ ID NO: 101087 - DNA, 23 bp, Artificial sequence
  SiRNA target sequence
taaacaaaatctttttaccacta

SEQ ID NO: 101088 - DNA, 23 bp, Artificial sequence
  SiRNA target sequence
aaacaaaatctttttaccactaa

SEQ ID NO: 101089 - DNA, 23 bp, Artificial sequence
  SiRNA target sequence
aacaaaatctttttaccactaaa

SEQ ID NO: 101090 - DNA, 23 bp, Artificial sequence
  SiRNA target sequence
acaaaatctttttaccactaaaa

SEQ ID NO: 101091 - DNA, 23 bp, Artificial sequence
  SiRNA target sequence
caaaatctttttaccactaaaat

SEQ ID NO: 101092 - DNA, 23 bp, Artificial sequence
  SiRNA target sequence
aaaatctttttaccactaaaatt

SEQ ID NO: 101093 - DNA, 23 bp, Artificial sequence
  SiRNA target sequence
aaatctttttaccactaaaatta

SEQ ID NO: 101094 - DNA, 23 bp, Artificial sequence
  SiRNA target sequence
aatctttttaccactaaaattaa

SEQ ID NO: 101095 - DNA, 23 bp, Artificial sequence
  SiRNA target sequence
atctttttaccactaaaattaag

SEQ ID NO: 101096 - DNA, 23 bp, Artificial sequence
  SiRNA target sequence
tctttttaccactaaaattaagt

SEQ ID NO: 101097 - DNA, 23 bp, Artificial sequence
  SiRNA target sequence
ctttttaccactaaaattaagtc

SEQ ID NO: 101098 - DNA, 23 bp, Artificial sequence
  SiRNA target sequence
tttttaccactaaaattaagtct

SEQ ID NO: 101099 - DNA, 23 bp, Artificial sequence
  SiRNA target sequence
ttttaccactaaaattaagtcta

SEQ ID NO: 101100 - DNA, 23 bp, Artificial sequence
  SiRNA target sequence
tttaccactaaaattaagtctat

SEQ ID NO: 101101 - DNA, 23 bp, Artificial sequence
  SiRNA target sequence
ttaccactaaaattaagtctatt

SEQ ID NO: 101102 - DNA, 23 bp, Artificial sequence
  SiRNA target sequence
taccactaaaattaagtctattt

SEQ ID NO: 101103 - DNA, 23 bp, Artificial sequence
  SiRNA target sequence
accactaaaattaagtctatttt

SEQ ID NO: 101104 - DNA, 23 bp, Artificial sequence
  SiRNA target sequence
ccactaaaattaagtctattttg

SEQ ID NO: 101105 - DNA, 23 bp, Artificial sequence
  SiRNA target sequence
cactaaaattaagtctattttgt

SEQ ID NO: 101106 - DNA, 23 bp, Artificial sequence
  SiRNA target sequence
actaaaattaagtctattttgta

SEQ ID NO: 101107 - DNA, 23 bp, Artificial sequence
  SiRNA target sequence
ctaaaattaagtctattttgtac

SEQ ID NO: 101108 - DNA, 23 bp, Artificial sequence
  SiRNA target sequence
taaaattaagtctattttgtact

SEQ ID NO: 101109 - DNA, 23 bp, Artificial sequence
  SiRNA target sequence
aaaattaagtctattttgtacta

SEQ ID NO: 101110 - DNA, 23 bp, Artificial sequence
  SiRNA target sequence
aaattaagtctattttgtactat

SEQ ID NO: 101111 - DNA, 23 bp, Artificial sequence
  SiRNA target sequence
aattaagtctattttgtactatg

SEQ ID NO: 101112 - DNA, 23 bp, Artificial sequence
  SiRNA target sequence
attaagtctattttgtactatgt

SEQ ID NO: 101113 - DNA, 23 bp, Artificial sequence
  SiRNA target sequence
ttaagtctattttgtactatgtt

SEQ ID NO: 101114 - DNA, 23 bp, Artificial sequence
  SiRNA target sequence
taagtctattttgtactatgtta

SEQ ID NO: 101115 - DNA, 23 bp, Artificial sequence
  SiRNA target sequence
aagtctattttgtactatgttaa

SEQ ID NO: 101116 - DNA, 23 bp, Artificial sequence
  SiRNA target sequence
agtctattttgtactatgttaac

SEQ ID NO: 101117 - DNA, 23 bp, Artificial sequence
  SiRNA target sequence
gtctattttgtactatgttaaca

SEQ ID NO: 101118 - DNA, 23 bp, Artificial sequence
  SiRNA target sequence
tctattttgtactatgttaacat

SEQ ID NO: 101119 - DNA, 23 bp, Artificial sequence
  SiRNA target sequence
ctattttgtactatgttaacatg

SEQ ID NO: 101120 - DNA, 23 bp, Artificial sequence
  SiRNA target sequence
tattttgtactatgttaacatga

SEQ ID NO: 101121 - DNA, 23 bp, Artificial sequence
  SiRNA target sequence
attttgtactatgttaacatgaa

SEQ ID NO: 101122 - DNA, 23 bp, Artificial sequence
  SiRNA target sequence
ttttgtactatgttaacatgaat

SEQ ID NO: 101123 - DNA, 23 bp, Artificial sequence
  SiRNA target sequence
tttgtactatgttaacatgaata

SEQ ID NO: 101124 - DNA, 23 bp, Artificial sequence
  SiRNA target sequence
ttgtactatgttaacatgaatag

SEQ ID NO: 101125 - DNA, 23 bp, Artificial sequence
  SiRNA target sequence
tgtactatgttaacatgaatagt

SEQ ID NO: 101126 - DNA, 23 bp, Artificial sequence
  SiRNA target sequence
gtactatgttaacatgaatagta

SEQ ID NO: 101127 - DNA, 23 bp, Artificial sequence
  SiRNA target sequence
tactatgttaacatgaatagtag

SEQ ID NO: 101128 - DNA, 23 bp, Artificial sequence
  SiRNA target sequence
actatgttaacatgaatagtaga

SEQ ID NO: 101129 - DNA, 23 bp, Artificial sequence
  SiRNA target sequence
ctatgttaacatgaatagtagac

SEQ ID NO: 101130 - DNA, 23 bp, Artificial sequence
  SiRNA target sequence
tatgttaacatgaatagtagacc

SEQ ID NO: 101131 - DNA, 23 bp, Artificial sequence
  SiRNA target sequence
atgttaacatgaatagtagaccc

SEQ ID NO: 101132 - DNA, 23 bp, Artificial sequence
  SiRNA target sequence
tgttaacatgaatagtagaccct

SEQ ID NO: 101133 - DNA, 23 bp, Artificial sequence
  SiRNA target sequence
gttaacatgaatagtagaccctt

SEQ ID NO: 101134 - DNA, 23 bp, Artificial sequence
  SiRNA target sequence
ttaacatgaatagtagacccttt

SEQ ID NO: 101135 - DNA, 23 bp, Artificial sequence
  SiRNA target sequence
taacatgaatagtagacccttta

SEQ ID NO: 101136 - DNA, 23 bp, Artificial sequence
  SiRNA target sequence
aacatgaatagtagaccctttag

SEQ ID NO: 101137 - DNA, 23 bp, Artificial sequence
  SiRNA target sequence
acatgaatagtagaccctttagt

SEQ ID NO: 101138 - DNA, 23 bp, Artificial sequence
  SiRNA target sequence
catgaatagtagaccctttagta

SEQ ID NO: 101139 - DNA, 23 bp, Artificial sequence
  SiRNA target sequence
atgaatagtagaccctttagtaa

SEQ ID NO: 101140 - DNA, 23 bp, Artificial sequence
  SiRNA target sequence
tgaatagtagaccctttagtaag

SEQ ID NO: 101141 - DNA, 23 bp, Artificial sequence
  SiRNA target sequence
gaatagtagaccctttagtaagt

SEQ ID NO: 101142 - DNA, 23 bp, Artificial sequence
  SiRNA target sequence
aatagtagaccctttagtaagta

SEQ ID NO: 101143 - DNA, 23 bp, Artificial sequence
  SiRNA target sequence
atagtagaccctttagtaagtaa

SEQ ID NO: 101144 - DNA, 23 bp, Artificial sequence
  SiRNA target sequence
tagtagaccctttagtaagtaat

SEQ ID NO: 101145 - DNA, 23 bp, Artificial sequence
  SiRNA target sequence
agtagaccctttagtaagtaatt

SEQ ID NO: 101146 - DNA, 23 bp, Artificial sequence
  SiRNA target sequence
gtagaccctttagtaagtaattt

SEQ ID NO: 101147 - DNA, 23 bp, Artificial sequence
  SiRNA target sequence
tagaccctttagtaagtaatttt

SEQ ID NO: 101148 - DNA, 23 bp, Artificial sequence
  SiRNA target sequence
agaccctttagtaagtaatttta

SEQ ID NO: 101149 - DNA, 23 bp, Artificial sequence
  SiRNA target sequence
gaccctttagtaagtaattttaa

SEQ ID NO: 101150 - DNA, 23 bp, Artificial sequence
  SiRNA target sequence
accctttagtaagtaattttaaa

SEQ ID NO: 101151 - DNA, 23 bp, Artificial sequence
  SiRNA target sequence
ccctttagtaagtaattttaaat

SEQ ID NO: 101152 - DNA, 23 bp, Artificial sequence
  SiRNA target sequence
cctttagtaagtaattttaaata

SEQ ID NO: 101153 - DNA, 23 bp, Artificial sequence
  SiRNA target sequence
ctttagtaagtaattttaaatac

SEQ ID NO: 101154 - DNA, 23 bp, Artificial sequence
  SiRNA target sequence
tttagtaagtaattttaaatact

SEQ ID NO: 101155 - DNA, 23 bp, Artificial sequence
  SiRNA target sequence
ttagtaagtaattttaaatactc

SEQ ID NO: 101156 - DNA, 23 bp, Artificial sequence
  SiRNA target sequence
tagtaagtaattttaaatactct

SEQ ID NO: 101157 - DNA, 23 bp, Artificial sequence
  SiRNA target sequence
agtaagtaattttaaatactctg

SEQ ID NO: 101158 - DNA, 23 bp, Artificial sequence
  SiRNA target sequence
gtaagtaattttaaatactctga

SEQ ID NO: 101159 - DNA, 23 bp, Artificial sequence
  SiRNA target sequence
taagtaattttaaatactctgaa

SEQ ID NO: 101160 - DNA, 23 bp, Artificial sequence
  SiRNA target sequence
aagtaattttaaatactctgaac

SEQ ID NO: 101161 - DNA, 23 bp, Artificial sequence
  SiRNA target sequence
agtaattttaaatactctgaaca

SEQ ID NO: 101162 - DNA, 23 bp, Artificial sequence
  SiRNA target sequence
gtaattttaaatactctgaacaa

SEQ ID NO: 101163 - DNA, 23 bp, Artificial sequence
  SiRNA target sequence
taattttaaatactctgaacaaa

SEQ ID NO: 101164 - DNA, 23 bp, Artificial sequence
  SiRNA target sequence
aattttaaatactctgaacaaag

SEQ ID NO: 101165 - DNA, 23 bp, Artificial sequence
  SiRNA target sequence
attttaaatactctgaacaaaga

SEQ ID NO: 101166 - DNA, 23 bp, Artificial sequence
  SiRNA target sequence
ttttaaatactctgaacaaagac

SEQ ID NO: 101167 - DNA, 23 bp, Artificial sequence
  SiRNA target sequence
tttaaatactctgaacaaagacc

SEQ ID NO: 101168 - DNA, 23 bp, Artificial sequence
  SiRNA target sequence
ttaaatactctgaacaaagacct

SEQ ID NO: 101169 - DNA, 23 bp, Artificial sequence
  SiRNA target sequence
taaatactctgaacaaagacctt

SEQ ID NO: 101170 - DNA, 23 bp, Artificial sequence
  SiRNA target sequence
aaatactctgaacaaagaccttt

SEQ ID NO: 101171 - DNA, 23 bp, Artificial sequence
  SiRNA target sequence
aatactctgaacaaagacctttt

SEQ ID NO: 101172 - DNA, 23 bp, Artificial sequence
  SiRNA target sequence
atactctgaacaaagaccttttc

SEQ ID NO: 101173 - DNA, 23 bp, Artificial sequence
  SiRNA target sequence
tactctgaacaaagaccttttcg

SEQ ID NO: 101174 - DNA, 23 bp, Artificial sequence
  SiRNA target sequence
actctgaacaaagaccttttcgt

SEQ ID NO: 101175 - DNA, 23 bp, Artificial sequence
  SiRNA target sequence
ctctgaacaaagaccttttcgtt

SEQ ID NO: 101176 - DNA, 23 bp, Artificial sequence
  SiRNA target sequence
tctgaacaaagaccttttcgttc

SEQ ID NO: 101177 - DNA, 23 bp, Artificial sequence
  SiRNA target sequence
ctgaacaaagaccttttcgttct

SEQ ID NO: 101178 - DNA, 23 bp, Artificial sequence
  SiRNA target sequence
tgaacaaagaccttttcgttctt

SEQ ID NO: 101179 - DNA, 23 bp, Artificial sequence
  SiRNA target sequence
gaacaaagaccttttcgttcttc

SEQ ID NO: 101180 - DNA, 23 bp, Artificial sequence
  SiRNA target sequence
aacaaagaccttttcgttcttct

SEQ ID NO: 101181 - DNA, 23 bp, Artificial sequence
  SiRNA target sequence
acaaagaccttttcgttcttctt

SEQ ID NO: 101182 - DNA, 23 bp, Artificial sequence
  SiRNA target sequence
caaagaccttttcgttcttcttt

SEQ ID NO: 101183 - DNA, 23 bp, Artificial sequence
  SiRNA target sequence
aaagaccttttcgttcttctttt

SEQ ID NO: 101184 - DNA, 23 bp, Artificial sequence
  SiRNA target sequence
aagaccttttcgttcttctttta

SEQ ID NO: 101185 - DNA, 23 bp, Artificial sequence
  SiRNA target sequence
agaccttttcgttcttcttttaa

SEQ ID NO: 101186 - DNA, 23 bp, Artificial sequence
  SiRNA target sequence
gaccttttcgttcttcttttaaa

SEQ ID NO: 101187 - DNA, 23 bp, Artificial sequence
  SiRNA target sequence
accttttcgttcttcttttaaac

SEQ ID NO: 101188 - DNA, 23 bp, Artificial sequence
  SiRNA target sequence
ccttttcgttcttcttttaaact

SEQ ID NO: 101189 - DNA, 23 bp, Artificial sequence
  SiRNA target sequence
cttttcgttcttcttttaaactt

SEQ ID NO: 101190 - DNA, 23 bp, Artificial sequence
  SiRNA target sequence
ttttcgttcttcttttaaacttg

SEQ ID NO: 101191 - DNA, 23 bp, Artificial sequence
  SiRNA target sequence
tttcgttcttcttttaaacttgt

SEQ ID NO: 101192 - DNA, 23 bp, Artificial sequence
  SiRNA target sequence
ttcgttcttcttttaaacttgtt

SEQ ID NO: 101193 - DNA, 23 bp, Artificial sequence
  SiRNA target sequence
tcgttcttcttttaaacttgttt

SEQ ID NO: 101194 - DNA, 23 bp, Artificial sequence
  SiRNA target sequence
cgttcttcttttaaacttgtttt

SEQ ID NO: 101195 - DNA, 23 bp, Artificial sequence
  SiRNA target sequence
gttcttcttttaaacttgtttta

SEQ ID NO: 101196 - DNA, 23 bp, Artificial sequence
  SiRNA target sequence
ttcttcttttaaacttgttttaa

SEQ ID NO: 101197 - DNA, 23 bp, Artificial sequence
  SiRNA target sequence
tcttcttttaaacttgttttaaa

SEQ ID NO: 101198 - DNA, 23 bp, Artificial sequence
  SiRNA target sequence
cttcttttaaacttgttttaaaa

SEQ ID NO: 101199 - DNA, 23 bp, Artificial sequence
  SiRNA target sequence
ttcttttaaacttgttttaaaag

SEQ ID NO: 101200 - DNA, 23 bp, Artificial sequence
  SiRNA target sequence
tcttttaaacttgttttaaaaga

SEQ ID NO: 101201 - DNA, 23 bp, Artificial sequence
  SiRNA target sequence
cttttaaacttgttttaaaagaa

SEQ ID NO: 101202 - DNA, 23 bp, Artificial sequence
  SiRNA target sequence
ttttaaacttgttttaaaagaaa

SEQ ID NO: 101203 - DNA, 23 bp, Artificial sequence
  SiRNA target sequence
tttaaacttgttttaaaagaaac

SEQ ID NO: 101204 - DNA, 23 bp, Artificial sequence
  SiRNA target sequence
ttaaacttgttttaaaagaaaca

SEQ ID NO: 101205 - DNA, 23 bp, Artificial sequence
  SiRNA target sequence
taaacttgttttaaaagaaacaa

SEQ ID NO: 101206 - DNA, 23 bp, Artificial sequence
  SiRNA target sequence
aaacttgttttaaaagaaacaag

SEQ ID NO: 101207 - DNA, 23 bp, Artificial sequence
  SiRNA target sequence
aacttgttttaaaagaaacaaga

SEQ ID NO: 101208 - DNA, 23 bp, Artificial sequence
  SiRNA target sequence
acttgttttaaaagaaacaagag

SEQ ID NO: 101209 - DNA, 23 bp, Artificial sequence
  SiRNA target sequence
cttgttttaaaagaaacaagaga

SEQ ID NO: 101210 - DNA, 23 bp, Artificial sequence
  SiRNA target sequence
ttgttttaaaagaaacaagagag

SEQ ID NO: 101211 - DNA, 23 bp, Artificial sequence
  SiRNA target sequence
tgttttaaaagaaacaagagaga

SEQ ID NO: 101212 - DNA, 23 bp, Artificial sequence
  SiRNA target sequence
gttttaaaagaaacaagagagac

SEQ ID NO: 101213 - DNA, 23 bp, Artificial sequence
  SiRNA target sequence
ttttaaaagaaacaagagagacg

SEQ ID NO: 101214 - DNA, 23 bp, Artificial sequence
  SiRNA target sequence
tttaaaagaaacaagagagacgg

SEQ ID NO: 101215 - DNA, 23 bp, Artificial sequence
  SiRNA target sequence
ttaaaagaaacaagagagacggt

SEQ ID NO: 101216 - DNA, 23 bp, Artificial sequence
  SiRNA target sequence
taaaagaaacaagagagacggtg

SEQ ID NO: 101217 - DNA, 23 bp, Artificial sequence
  SiRNA target sequence
aaaagaaacaagagagacggtga

SEQ ID NO: 101218 - DNA, 23 bp, Artificial sequence
  SiRNA target sequence
aaagaaacaagagagacggtgac

SEQ ID NO: 101219 - DNA, 23 bp, Artificial sequence
  SiRNA target sequence
aagaaacaagagagacggtgaca

SEQ ID NO: 101220 - DNA, 23 bp, Artificial sequence
  SiRNA target sequence
agaaacaagagagacggtgacaa

SEQ ID NO: 101221 - DNA, 23 bp, Artificial sequence
  SiRNA target sequence
gaaacaagagagacggtgacaaa

SEQ ID NO: 101222 - DNA, 23 bp, Artificial sequence
  SiRNA target sequence
aaacaagagagacggtgacaaag

SEQ ID NO: 101223 - DNA, 23 bp, Artificial sequence
  SiRNA target sequence
aacaagagagacggtgacaaagt

SEQ ID NO: 101224 - DNA, 23 bp, Artificial sequence
  SiRNA target sequence
acaagagagacggtgacaaagta

SEQ ID NO: 101225 - DNA, 23 bp, Artificial sequence
  SiRNA target sequence
caagagagacggtgacaaagtaa

SEQ ID NO: 101226 - DNA, 23 bp, Artificial sequence
  SiRNA target sequence
aagagagacggtgacaaagtaac

SEQ ID NO: 101227 - DNA, 23 bp, Artificial sequence
  SiRNA target sequence
agagagacggtgacaaagtaaca

SEQ ID NO: 101228 - DNA, 23 bp, Artificial sequence
  SiRNA target sequence
gagagacggtgacaaagtaacaa

SEQ ID NO: 101229 - DNA, 23 bp, Artificial sequence
  SiRNA target sequence
agagacggtgacaaagtaacaaa

SEQ ID NO: 101230 - DNA, 23 bp, Artificial sequence
  SiRNA target sequence
gagacggtgacaaagtaacaaaa

SEQ ID NO: 101231 - DNA, 23 bp, Artificial sequence
  SiRNA target sequence
agacggtgacaaagtaacaaaaa

SEQ ID NO: 101232 - DNA, 23 bp, Artificial sequence
  SiRNA target sequence
gacggtgacaaagtaacaaaaat

SEQ ID NO: 101233 - DNA, 23 bp, Artificial sequence
  SiRNA target sequence
acggtgacaaagtaacaaaaatc

SEQ ID NO: 101234 - DNA, 23 bp, Artificial sequence
  SiRNA target sequence
cggtgacaaagtaacaaaaatct

SEQ ID NO: 101235 - DNA, 23 bp, Artificial sequence
  SiRNA target sequence
ggtgacaaagtaacaaaaatctt

SEQ ID NO: 101236 - DNA, 23 bp, Artificial sequence
  SiRNA target sequence
gtgacaaagtaacaaaaatcttt

SEQ ID NO: 101237 - DNA, 23 bp, Artificial sequence
  SiRNA target sequence
tgacaaagtaacaaaaatctttt

SEQ ID NO: 101238 - DNA, 23 bp, Artificial sequence
  SiRNA target sequence
gacaaagtaacaaaaatcttttt

SEQ ID NO: 101239 - DNA, 23 bp, Artificial sequence
  SiRNA target sequence
acaaagtaacaaaaatctttttt

SEQ ID NO: 101240 - DNA, 23 bp, Artificial sequence
  SiRNA target sequence
caaagtaacaaaaatcttttttc

SEQ ID NO: 101241 - DNA, 23 bp, Artificial sequence
  SiRNA target sequence
aaagtaacaaaaatcttttttcg

SEQ ID NO: 101242 - DNA, 23 bp, Artificial sequence
  SiRNA target sequence
aagtaacaaaaatcttttttcgt

SEQ ID NO: 101243 - DNA, 23 bp, Artificial sequence
  SiRNA target sequence
agtaacaaaaatcttttttcgtt

SEQ ID NO: 101244 - DNA, 23 bp, Artificial sequence
  SiRNA target sequence
gtaacaaaaatcttttttcgtta

SEQ ID NO: 101245 - DNA, 23 bp, Artificial sequence
  SiRNA target sequence
taacaaaaatcttttttcgttaa

SEQ ID NO: 101246 - DNA, 23 bp, Artificial sequence
  SiRNA target sequence
aacaaaaatcttttttcgttaat

SEQ ID NO: 101247 - DNA, 23 bp, Artificial sequence
  SiRNA target sequence
acaaaaatcttttttcgttaatg

SEQ ID NO: 101248 - DNA, 23 bp, Artificial sequence
  SiRNA target sequence
caaaaatcttttttcgttaatgt

SEQ ID NO: 101249 - DNA, 23 bp, Artificial sequence
  SiRNA target sequence
aaaaatcttttttcgttaatgta

SEQ ID NO: 101250 - DNA, 23 bp, Artificial sequence
  SiRNA target sequence
aaaatcttttttcgttaatgtaa

SEQ ID NO: 101251 - DNA, 23 bp, Artificial sequence
  SiRNA target sequence
aaatcttttttcgttaatgtaaa

SEQ ID NO: 101252 - DNA, 23 bp, Artificial sequence
  SiRNA target sequence
aatcttttttcgttaatgtaaaa

SEQ ID NO: 101253 - DNA, 23 bp, Artificial sequence
  SiRNA target sequence
atcttttttcgttaatgtaaaat

SEQ ID NO: 101254 - DNA, 23 bp, Artificial sequence
  SiRNA target sequence
tcttttttcgttaatgtaaaata

SEQ ID NO: 101255 - DNA, 23 bp, Artificial sequence
  SiRNA target sequence
cttttttcgttaatgtaaaatat

SEQ ID NO: 101256 - DNA, 23 bp, Artificial sequence
  SiRNA target sequence
ttttttcgttaatgtaaaatatc

SEQ ID NO: 101257 - DNA, 23 bp, Artificial sequence
  SiRNA target sequence
tttttcgttaatgtaaaatatct

SEQ ID NO: 101258 - DNA, 23 bp, Artificial sequence
  SiRNA target sequence
ttttcgttaatgtaaaatatctt

SEQ ID NO: 101259 - DNA, 23 bp, Artificial sequence
  SiRNA target sequence
tttcgttaatgtaaaatatcttg

SEQ ID NO: 101260 - DNA, 23 bp, Artificial sequence
  SiRNA target sequence
ttcgttaatgtaaaatatcttgg

SEQ ID NO: 101261 - DNA, 23 bp, Artificial sequence
  SiRNA target sequence
tcgttaatgtaaaatatcttgga

SEQ ID NO: 101262 - DNA, 23 bp, Artificial sequence
  SiRNA target sequence
cgttaatgtaaaatatcttggat

SEQ ID NO: 101263 - DNA, 23 bp, Artificial sequence
  SiRNA target sequence
gttaatgtaaaatatcttggatt

SEQ ID NO: 101264 - DNA, 23 bp, Artificial sequence
  SiRNA target sequence
ttaatgtaaaatatcttggatta

SEQ ID NO: 101265 - DNA, 23 bp, Artificial sequence
  SiRNA target sequence
taatgtaaaatatcttggattaa

SEQ ID NO: 101266 - DNA, 23 bp, Artificial sequence
  SiRNA target sequence
aatgtaaaatatcttggattaat

SEQ ID NO: 101267 - DNA, 23 bp, Artificial sequence
  SiRNA target sequence
atgtaaaatatcttggattaatt

SEQ ID NO: 101268 - DNA, 23 bp, Artificial sequence
  SiRNA target sequence
tgtaaaatatcttggattaatta

SEQ ID NO: 101269 - DNA, 23 bp, Artificial sequence
  SiRNA target sequence
gtaaaatatcttggattaattac

SEQ ID NO: 101270 - DNA, 23 bp, Artificial sequence
  SiRNA target sequence
taaaatatcttggattaattaca

SEQ ID NO: 101271 - DNA, 23 bp, Artificial sequence
  SiRNA target sequence
aaaatatcttggattaattacag

SEQ ID NO: 101272 - DNA, 23 bp, Artificial sequence
  SiRNA target sequence
aaatatcttggattaattacagg

SEQ ID NO: 101273 - DNA, 23 bp, Artificial sequence
  SiRNA target sequence
aatatcttggattaattacaggg

SEQ ID NO: 101274 - DNA, 23 bp, Artificial sequence
  SiRNA target sequence
atatcttggattaattacaggga

SEQ ID NO: 101275 - DNA, 23 bp, Artificial sequence
  SiRNA target sequence
tatcttggattaattacagggat

SEQ ID NO: 101276 - DNA, 23 bp, Artificial sequence
  SiRNA target sequence
atcttggattaattacagggata

SEQ ID NO: 101277 - DNA, 23 bp, Artificial sequence
  SiRNA target sequence
tcttggattaattacagggatat

SEQ ID NO: 101278 - DNA, 23 bp, Artificial sequence
  SiRNA target sequence
cttggattaattacagggatata

SEQ ID NO: 101279 - DNA, 23 bp, Artificial sequence
  SiRNA target sequence
ttggattaattacagggatatac

SEQ ID NO: 101280 - DNA, 23 bp, Artificial sequence
  SiRNA target sequence
tggattaattacagggatatact

SEQ ID NO: 101281 - DNA, 23 bp, Artificial sequence
  SiRNA target sequence
ggattaattacagggatatactt

SEQ ID NO: 101282 - DNA, 23 bp, Artificial sequence
  SiRNA target sequence
gattaattacagggatatacttg

SEQ ID NO: 101283 - DNA, 23 bp, Artificial sequence
  SiRNA target sequence
attaattacagggatatacttgt

SEQ ID NO: 101284 - DNA, 23 bp, Artificial sequence
  SiRNA target sequence
ttaattacagggatatacttgta

SEQ ID NO: 101285 - DNA, 23 bp, Artificial sequence
  SiRNA target sequence
taattacagggatatacttgtac

SEQ ID NO: 101286 - DNA, 23 bp, Artificial sequence
  SiRNA target sequence
aattacagggatatacttgtaca

SEQ ID NO: 101287 - DNA, 23 bp, Artificial sequence
  SiRNA target sequence
attacagggatatacttgtacat

SEQ ID NO: 101288 - DNA, 23 bp, Artificial sequence
  SiRNA target sequence
ttacagggatatacttgtacata

SEQ ID NO: 101289 - DNA, 23 bp, Artificial sequence
  SiRNA target sequence
tacagggatatacttgtacataa

SEQ ID NO: 101290 - DNA, 23 bp, Artificial sequence
  SiRNA target sequence
acagggatatacttgtacataaa

SEQ ID NO: 101291 - DNA, 23 bp, Artificial sequence
  SiRNA target sequence
cagggatatacttgtacataaaa

SEQ ID NO: 101292 - DNA, 23 bp, Artificial sequence
  SiRNA target sequence
agggatatacttgtacataaaat

SEQ ID NO: 101293 - DNA, 23 bp, Artificial sequence
  SiRNA target sequence
gggatatacttgtacataaaatt

SEQ ID NO: 101294 - DNA, 23 bp, Artificial sequence
  SiRNA target sequence
ggatatacttgtacataaaattt

SEQ ID NO: 101295 - DNA, 23 bp, Artificial sequence
  SiRNA target sequence
gatatacttgtacataaaatttg

SEQ ID NO: 101296 - DNA, 23 bp, Artificial sequence
  SiRNA target sequence
atatacttgtacataaaatttga

SEQ ID NO: 101297 - DNA, 23 bp, Artificial sequence
  SiRNA target sequence
tatacttgtacataaaatttgag

SEQ ID NO: 101298 - DNA, 23 bp, Artificial sequence
  SiRNA target sequence
atacttgtacataaaatttgagg

SEQ ID NO: 101299 - DNA, 23 bp, Artificial sequence
  SiRNA target sequence
tacttgtacataaaatttgaggt

SEQ ID NO: 101300 - DNA, 23 bp, Artificial sequence
  SiRNA target sequence
acttgtacataaaatttgaggta

SEQ ID NO: 101301 - DNA, 23 bp, Artificial sequence
  SiRNA target sequence
cttgtacataaaatttgaggtaa

SEQ ID NO: 101302 - DNA, 23 bp, Artificial sequence
  SiRNA target sequence
ttgtacataaaatttgaggtaag

SEQ ID NO: 101303 - DNA, 23 bp, Artificial sequence
  SiRNA target sequence
tgtacataaaatttgaggtaagt

SEQ ID NO: 101304 - DNA, 23 bp, Artificial sequence
  SiRNA target sequence
gtacataaaatttgaggtaagtt

SEQ ID NO: 101305 - DNA, 23 bp, Artificial sequence
  SiRNA target sequence
tacataaaatttgaggtaagttt

SEQ ID NO: 101306 - DNA, 23 bp, Artificial sequence
  SiRNA target sequence
acataaaatttgaggtaagtttt

SEQ ID NO: 101307 - DNA, 23 bp, Artificial sequence
  SiRNA target sequence
cataaaatttgaggtaagtttta

SEQ ID NO: 101308 - DNA, 23 bp, Artificial sequence
  SiRNA target sequence
ataaaatttgaggtaagttttat

SEQ ID NO: 101309 - DNA, 23 bp, Artificial sequence
  SiRNA target sequence
taaaatttgaggtaagttttatc

SEQ ID NO: 101310 - DNA, 23 bp, Artificial sequence
  SiRNA target sequence
aaaatttgaggtaagttttatct

SEQ ID NO: 101311 - DNA, 23 bp, Artificial sequence
  SiRNA target sequence
aaatttgaggtaagttttatctt

SEQ ID NO: 101312 - DNA, 23 bp, Artificial sequence
  SiRNA target sequence
aatttgaggtaagttttatctta

SEQ ID NO: 101313 - DNA, 23 bp, Artificial sequence
  SiRNA target sequence
atttgaggtaagttttatcttaa

SEQ ID NO: 101314 - DNA, 23 bp, Artificial sequence
  SiRNA target sequence
tttgaggtaagttttatcttaaa

SEQ ID NO: 101315 - DNA, 23 bp, Artificial sequence
  SiRNA target sequence
ttgaggtaagttttatcttaaaa

SEQ ID NO: 101316 - DNA, 23 bp, Artificial sequence
  SiRNA target sequence
tgaggtaagttttatcttaaaat

SEQ ID NO: 101317 - DNA, 23 bp, Artificial sequence
  SiRNA target sequence
gaggtaagttttatcttaaaatc

SEQ ID NO: 101318 - DNA, 23 bp, Artificial sequence
  SiRNA target sequence
aggtaagttttatcttaaaatct

SEQ ID NO: 101319 - DNA, 23 bp, Artificial sequence
  SiRNA target sequence
ggtaagttttatcttaaaatctt

SEQ ID NO: 101320 - DNA, 23 bp, Artificial sequence
  SiRNA target sequence
gtaagttttatcttaaaatcttt

SEQ ID NO: 101321 - DNA, 23 bp, Artificial sequence
  SiRNA target sequence
taagttttatcttaaaatctttt

SEQ ID NO: 101322 - DNA, 23 bp, Artificial sequence
  SiRNA target sequence
aagttttatcttaaaatctttta

SEQ ID NO: 101323 - DNA, 23 bp, Artificial sequence
  SiRNA target sequence
agttttatcttaaaatcttttag

SEQ ID NO: 101324 - DNA, 23 bp, Artificial sequence
  SiRNA target sequence
gttttatcttaaaatcttttaga

SEQ ID NO: 101325 - DNA, 23 bp, Artificial sequence
  SiRNA target sequence
ttttatcttaaaatcttttagaa

SEQ ID NO: 101326 - DNA, 23 bp, Artificial sequence
  SiRNA target sequence
tttatcttaaaatcttttagaac

SEQ ID NO: 101327 - DNA, 23 bp, Artificial sequence
  SiRNA target sequence
ttatcttaaaatcttttagaacc

SEQ ID NO: 101328 - DNA, 23 bp, Artificial sequence
  SiRNA target sequence
tatcttaaaatcttttagaacct

SEQ ID NO: 101329 - DNA, 23 bp, Artificial sequence
  SiRNA target sequence
atcttaaaatcttttagaacctc

SEQ ID NO: 101330 - DNA, 23 bp, Artificial sequence
  SiRNA target sequence
tcttaaaatcttttagaacctca

SEQ ID NO: 101331 - DNA, 23 bp, Artificial sequence
  SiRNA target sequence
cttaaaatcttttagaacctcaa

SEQ ID NO: 101332 - DNA, 23 bp, Artificial sequence
  SiRNA target sequence
ttaaaatcttttagaacctcaaa

SEQ ID NO: 101333 - DNA, 23 bp, Artificial sequence
  SiRNA target sequence
taaaatcttttagaacctcaaaa

SEQ ID NO: 101334 - DNA, 23 bp, Artificial sequence
  SiRNA target sequence
aaaatcttttagaacctcaaaaa

SEQ ID NO: 101335 - DNA, 23 bp, Artificial sequence
  SiRNA target sequence
aaatcttttagaacctcaaaaat

SEQ ID NO: 101336 - DNA, 23 bp, Artificial sequence
  SiRNA target sequence
aatcttttagaacctcaaaaata

SEQ ID NO: 101337 - DNA, 23 bp, Artificial sequence
  SiRNA target sequence
atcttttagaacctcaaaaatag

SEQ ID NO: 101338 - DNA, 23 bp, Artificial sequence
  SiRNA target sequence
tcttttagaacctcaaaaatagt

SEQ ID NO: 101339 - DNA, 23 bp, Artificial sequence
  SiRNA target sequence
cttttagaacctcaaaaatagtg

SEQ ID NO: 101340 - DNA, 23 bp, Artificial sequence
  SiRNA target sequence
ttttagaacctcaaaaatagtgc

SEQ ID NO: 101341 - DNA, 23 bp, Artificial sequence
  SiRNA target sequence
tttagaacctcaaaaatagtgcg

SEQ ID NO: 101342 - DNA, 23 bp, Artificial sequence
  SiRNA target sequence
ttagaacctcaaaaatagtgcgc

SEQ ID NO: 101343 - DNA, 23 bp, Artificial sequence
  SiRNA target sequence
tagaacctcaaaaatagtgcgct

SEQ ID NO: 101344 - DNA, 23 bp, Artificial sequence
  SiRNA target sequence
agaacctcaaaaatagtgcgctt

SEQ ID NO: 101345 - DNA, 23 bp, Artificial sequence
  SiRNA target sequence
gaacctcaaaaatagtgcgcttc

SEQ ID NO: 101346 - DNA, 23 bp, Artificial sequence
  SiRNA target sequence
aacctcaaaaatagtgcgcttcg

SEQ ID NO: 101347 - DNA, 23 bp, Artificial sequence
  SiRNA target sequence
acctcaaaaatagtgcgcttcgg

SEQ ID NO: 101348 - DNA, 23 bp, Artificial sequence
  SiRNA target sequence
cctcaaaaatagtgcgcttcggt

SEQ ID NO: 101349 - DNA, 23 bp, Artificial sequence
  SiRNA target sequence
ctcaaaaatagtgcgcttcggta

SEQ ID NO: 101350 - DNA, 23 bp, Artificial sequence
  SiRNA target sequence
tcaaaaatagtgcgcttcggtag

SEQ ID NO: 101351 - DNA, 23 bp, Artificial sequence
  SiRNA target sequence
caaaaatagtgcgcttcggtagt

SEQ ID NO: 101352 - DNA, 23 bp, Artificial sequence
  SiRNA target sequence
aaaaatagtgcgcttcggtagta

SEQ ID NO: 101353 - DNA, 23 bp, Artificial sequence
  SiRNA target sequence
aaaatagtgcgcttcggtagtaa

SEQ ID NO: 101354 - DNA, 23 bp, Artificial sequence
  SiRNA target sequence
aaatagtgcgcttcggtagtaaa

SEQ ID NO: 101355 - DNA, 23 bp, Artificial sequence
  SiRNA target sequence
aatagtgcgcttcggtagtaaaa

SEQ ID NO: 101356 - DNA, 23 bp, Artificial sequence
  SiRNA target sequence
atagtgcgcttcggtagtaaaat

SEQ ID NO: 101357 - DNA, 23 bp, Artificial sequence
  SiRNA target sequence
tagtgcgcttcggtagtaaaatg

SEQ ID NO: 101358 - DNA, 23 bp, Artificial sequence
  SiRNA target sequence
agtgcgcttcggtagtaaaatgt

SEQ ID NO: 101359 - DNA, 23 bp, Artificial sequence
  SiRNA target sequence
gtgcgcttcggtagtaaaatgta

SEQ ID NO: 101360 - DNA, 23 bp, Artificial sequence
  SiRNA target sequence
tgcgcttcggtagtaaaatgtaa

SEQ ID NO: 101361 - DNA, 23 bp, Artificial sequence
  SiRNA target sequence
gcgcttcggtagtaaaatgtaat

SEQ ID NO: 101362 - DNA, 23 bp, Artificial sequence
  SiRNA target sequence
cgcttcggtagtaaaatgtaatc

SEQ ID NO: 101363 - DNA, 23 bp, Artificial sequence
  SiRNA target sequence
gcttcggtagtaaaatgtaatca

SEQ ID NO: 101364 - DNA, 23 bp, Artificial sequence
  SiRNA target sequence
cttcggtagtaaaatgtaatcat

SEQ ID NO: 101365 - DNA, 23 bp, Artificial sequence
  SiRNA target sequence
ttcggtagtaaaatgtaatcata

SEQ ID NO: 101366 - DNA, 23 bp, Artificial sequence
  SiRNA target sequence
tcggtagtaaaatgtaatcatag

SEQ ID NO: 101367 - DNA, 23 bp, Artificial sequence
  SiRNA target sequence
cggtagtaaaatgtaatcatagt

SEQ ID NO: 101368 - DNA, 23 bp, Artificial sequence
  SiRNA target sequence
ggtagtaaaatgtaatcatagta

SEQ ID NO: 101369 - DNA, 23 bp, Artificial sequence
  SiRNA target sequence
gtagtaaaatgtaatcatagtac

SEQ ID NO: 101370 - DNA, 23 bp, Artificial sequence
  SiRNA target sequence
tagtaaaatgtaatcatagtaca

SEQ ID NO: 101371 - DNA, 23 bp, Artificial sequence
  SiRNA target sequence
agtaaaatgtaatcatagtacag

SEQ ID NO: 101372 - DNA, 23 bp, Artificial sequence
  SiRNA target sequence
gtaaaatgtaatcatagtacaga

SEQ ID NO: 101373 - DNA, 23 bp, Artificial sequence
  SiRNA target sequence
taaaatgtaatcatagtacagat

SEQ ID NO: 101374 - DNA, 23 bp, Artificial sequence
  SiRNA target sequence
aaaatgtaatcatagtacagatc

SEQ ID NO: 101375 - DNA, 23 bp, Artificial sequence
  SiRNA target sequence
aaatgtaatcatagtacagatcg

SEQ ID NO: 101376 - DNA, 23 bp, Artificial sequence
  SiRNA target sequence
aatgtaatcatagtacagatcgt

SEQ ID NO: 101377 - DNA, 23 bp, Artificial sequence
  SiRNA target sequence
atgtaatcatagtacagatcgta

SEQ ID NO: 101378 - DNA, 23 bp, Artificial sequence
  SiRNA target sequence
tgtaatcatagtacagatcgtaa

SEQ ID NO: 101379 - DNA, 23 bp, Artificial sequence
  SiRNA target sequence
gtaatcatagtacagatcgtaat

SEQ ID NO: 101380 - DNA, 23 bp, Artificial sequence
  SiRNA target sequence
taatcatagtacagatcgtaatt

SEQ ID NO: 101381 - DNA, 23 bp, Artificial sequence
  SiRNA target sequence
aatcatagtacagatcgtaattt

SEQ ID NO: 101382 - DNA, 23 bp, Artificial sequence
  SiRNA target sequence
atcatagtacagatcgtaattta

SEQ ID NO: 101383 - DNA, 23 bp, Artificial sequence
  SiRNA target sequence
tcatagtacagatcgtaatttag

SEQ ID NO: 101384 - DNA, 23 bp, Artificial sequence
  SiRNA target sequence
catagtacagatcgtaatttaga

SEQ ID NO: 101385 - DNA, 23 bp, Artificial sequence
  SiRNA target sequence
atagtacagatcgtaatttagat

SEQ ID NO: 101386 - DNA, 23 bp, Artificial sequence
  SiRNA target sequence
tagtacagatcgtaatttagata

SEQ ID NO: 101387 - DNA, 23 bp, Artificial sequence
  SiRNA target sequence
agtacagatcgtaatttagataa

SEQ ID NO: 101388 - DNA, 23 bp, Artificial sequence
  SiRNA target sequence
gtacagatcgtaatttagataaa

SEQ ID NO: 101389 - DNA, 23 bp, Artificial sequence
  SiRNA target sequence
tacagatcgtaatttagataaat

SEQ ID NO: 101390 - DNA, 23 bp, Artificial sequence
  SiRNA target sequence
acagatcgtaatttagataaatt

SEQ ID NO: 101391 - DNA, 23 bp, Artificial sequence
  SiRNA target sequence
cagatcgtaatttagataaattt

SEQ ID NO: 101392 - DNA, 23 bp, Artificial sequence
  SiRNA target sequence
agatcgtaatttagataaatttc

SEQ ID NO: 101393 - DNA, 23 bp, Artificial sequence
  SiRNA target sequence
gatcgtaatttagataaatttct

SEQ ID NO: 101394 - DNA, 23 bp, Artificial sequence
  SiRNA target sequence
atcgtaatttagataaatttctt

SEQ ID NO: 101395 - DNA, 23 bp, Artificial sequence
  SiRNA target sequence
tcgtaatttagataaatttcttt

SEQ ID NO: 101396 - DNA, 23 bp, Artificial sequence
  SiRNA target sequence
cgtaatttagataaatttcttta

SEQ ID NO: 101397 - DNA, 23 bp, Artificial sequence
  SiRNA target sequence
gtaatttagataaatttctttac

SEQ ID NO: 101398 - DNA, 23 bp, Artificial sequence
  SiRNA target sequence
taatttagataaatttctttaca

SEQ ID NO: 101399 - DNA, 23 bp, Artificial sequence
  SiRNA target sequence
aatttagataaatttctttacat

SEQ ID NO: 101400 - DNA, 23 bp, Artificial sequence
  SiRNA target sequence
atttagataaatttctttacatt

SEQ ID NO: 101401 - DNA, 23 bp, Artificial sequence
  SiRNA target sequence
tttagataaatttctttacattt

SEQ ID NO: 101402 - DNA, 23 bp, Artificial sequence
  SiRNA target sequence
ttagataaatttctttacatttc

SEQ ID NO: 101403 - DNA, 23 bp, Artificial sequence
  SiRNA target sequence
tagataaatttctttacatttct

SEQ ID NO: 101404 - DNA, 23 bp, Artificial sequence
  SiRNA target sequence
agataaatttctttacatttctc

SEQ ID NO: 101405 - DNA, 23 bp, Artificial sequence
  SiRNA target sequence
gataaatttctttacatttctca

SEQ ID NO: 101406 - DNA, 23 bp, Artificial sequence
  SiRNA target sequence
ataaatttctttacatttctcac

SEQ ID NO: 101407 - DNA, 23 bp, Artificial sequence
  SiRNA target sequence
taaatttctttacatttctcacg

SEQ ID NO: 101408 - DNA, 23 bp, Artificial sequence
  SiRNA target sequence
aaatttctttacatttctcacga

SEQ ID NO: 101409 - DNA, 23 bp, Artificial sequence
  SiRNA target sequence
aatttctttacatttctcacgat

SEQ ID NO: 101410 - DNA, 23 bp, Artificial sequence
  SiRNA target sequence
atttctttacatttctcacgata

SEQ ID NO: 101411 - DNA, 23 bp, Artificial sequence
  SiRNA target sequence
tttctttacatttctcacgatat

SEQ ID NO: 101412 - DNA, 23 bp, Artificial sequence
  SiRNA target sequence
ttctttacatttctcacgatatt

SEQ ID NO: 101413 - DNA, 23 bp, Artificial sequence
  SiRNA target sequence
tctttacatttctcacgatattc

SEQ ID NO: 101414 - DNA, 23 bp, Artificial sequence
  SiRNA target sequence
ctttacatttctcacgatattcc

SEQ ID NO: 101415 - DNA, 23 bp, Artificial sequence
  SiRNA target sequence
tttacatttctcacgatattcct

SEQ ID NO: 101416 - DNA, 23 bp, Artificial sequence
  SiRNA target sequence
ttacatttctcacgatattcctc

SEQ ID NO: 101417 - DNA, 23 bp, Artificial sequence
  SiRNA target sequence
tacatttctcacgatattcctca

SEQ ID NO: 101418 - DNA, 23 bp, Artificial sequence
  SiRNA target sequence
acatttctcacgatattcctcag

SEQ ID NO: 101419 - DNA, 23 bp, Artificial sequence
  SiRNA target sequence
catttctcacgatattcctcagc

SEQ ID NO: 101420 - DNA, 23 bp, Artificial sequence
  SiRNA target sequence
atttctcacgatattcctcagca

SEQ ID NO: 101421 - DNA, 23 bp, Artificial sequence
  SiRNA target sequence
tttctcacgatattcctcagcaa

SEQ ID NO: 101422 - DNA, 23 bp, Artificial sequence
  SiRNA target sequence
ttctcacgatattcctcagcaat

SEQ ID NO: 101423 - DNA, 23 bp, Artificial sequence
  SiRNA target sequence
tctcacgatattcctcagcaatg

SEQ ID NO: 101424 - DNA, 23 bp, Artificial sequence
  SiRNA target sequence
ctcacgatattcctcagcaatgg

SEQ ID NO: 101425 - DNA, 23 bp, Artificial sequence
  SiRNA target sequence
tcacgatattcctcagcaatggt

SEQ ID NO: 101426 - DNA, 23 bp, Artificial sequence
  SiRNA target sequence
cacgatattcctcagcaatggta

SEQ ID NO: 101427 - DNA, 23 bp, Artificial sequence
  SiRNA target sequence
acgatattcctcagcaatggtat

SEQ ID NO: 101428 - DNA, 23 bp, Artificial sequence
  SiRNA target sequence
cgatattcctcagcaatggtatc

SEQ ID NO: 101429 - DNA, 23 bp, Artificial sequence
  SiRNA target sequence
gatattcctcagcaatggtatct

SEQ ID NO: 101430 - DNA, 23 bp, Artificial sequence
  SiRNA target sequence
atattcctcagcaatggtatctg

SEQ ID NO: 101431 - DNA, 23 bp, Artificial sequence
  SiRNA target sequence
tattcctcagcaatggtatctgt

SEQ ID NO: 101432 - DNA, 23 bp, Artificial sequence
  SiRNA target sequence
attcctcagcaatggtatctgtg

SEQ ID NO: 101433 - DNA, 23 bp, Artificial sequence
  SiRNA target sequence
ttcctcagcaatggtatctgtga

SEQ ID NO: 101434 - DNA, 23 bp, Artificial sequence
  SiRNA target sequence
tcctcagcaatggtatctgtgat

SEQ ID NO: 101435 - DNA, 23 bp, Artificial sequence
  SiRNA target sequence
cctcagcaatggtatctgtgata

SEQ ID NO: 101436 - DNA, 23 bp, Artificial sequence
  SiRNA target sequence
ctcagcaatggtatctgtgataa

SEQ ID NO: 101437 - DNA, 23 bp, Artificial sequence
  SiRNA target sequence
tcagcaatggtatctgtgataag

SEQ ID NO: 101438 - DNA, 23 bp, Artificial sequence
  SiRNA target sequence
cagcaatggtatctgtgataagc

SEQ ID NO: 101439 - DNA, 23 bp, Artificial sequence
  SiRNA target sequence
agcaatggtatctgtgataagcg

SEQ ID NO: 101440 - DNA, 23 bp, Artificial sequence
  SiRNA target sequence
gcaatggtatctgtgataagcga

SEQ ID NO: 101441 - DNA, 23 bp, Artificial sequence
  SiRNA target sequence
caatggtatctgtgataagcgaa

SEQ ID NO: 101442 - DNA, 23 bp, Artificial sequence
  SiRNA target sequence
aatggtatctgtgataagcgaaa

SEQ ID NO: 101443 - DNA, 23 bp, Artificial sequence
  SiRNA target sequence
atggtatctgtgataagcgaaag

SEQ ID NO: 101444 - DNA, 23 bp, Artificial sequence
  SiRNA target sequence
tggtatctgtgataagcgaaagt

SEQ ID NO: 101445 - DNA, 23 bp, Artificial sequence
  SiRNA target sequence
ggtatctgtgataagcgaaagtt

SEQ ID NO: 101446 - DNA, 23 bp, Artificial sequence
  SiRNA target sequence
gtatctgtgataagcgaaagttg

SEQ ID NO: 101447 - DNA, 23 bp, Artificial sequence
  SiRNA target sequence
tatctgtgataagcgaaagttgt

SEQ ID NO: 101448 - DNA, 23 bp, Artificial sequence
  SiRNA target sequence
atctgtgataagcgaaagttgta

SEQ ID NO: 101449 - DNA, 23 bp, Artificial sequence
  SiRNA target sequence
tctgtgataagcgaaagttgtag

SEQ ID NO: 101450 - DNA, 23 bp, Artificial sequence
  SiRNA target sequence
ctgtgataagcgaaagttgtaga

SEQ ID NO: 101451 - DNA, 23 bp, Artificial sequence
  SiRNA target sequence
tgtgataagcgaaagttgtagaa

SEQ ID NO: 101452 - DNA, 23 bp, Artificial sequence
  SiRNA target sequence
gtgataagcgaaagttgtagaaa

SEQ ID NO: 101453 - DNA, 23 bp, Artificial sequence
  SiRNA target sequence
tgataagcgaaagttgtagaaaa

SEQ ID NO: 101454 - DNA, 23 bp, Artificial sequence
  SiRNA target sequence
gataagcgaaagttgtagaaaaa

SEQ ID NO: 101455 - DNA, 23 bp, Artificial sequence
  SiRNA target sequence
ataagcgaaagttgtagaaaaaa

SEQ ID NO: 101456 - DNA, 23 bp, Artificial sequence
  SiRNA target sequence
taagcgaaagttgtagaaaaaaa

SEQ ID NO: 101457 - DNA, 23 bp, Artificial sequence
  SiRNA target sequence
aagcgaaagttgtagaaaaaaat

SEQ ID NO: 101458 - DNA, 23 bp, Artificial sequence
  SiRNA target sequence
agcgaaagttgtagaaaaaaata

SEQ ID NO: 101459 - DNA, 23 bp, Artificial sequence
  SiRNA target sequence
gcgaaagttgtagaaaaaaatag

SEQ ID NO: 101460 - DNA, 23 bp, Artificial sequence
  SiRNA target sequence
cgaaagttgtagaaaaaaataga

SEQ ID NO: 101461 - DNA, 23 bp, Artificial sequence
  SiRNA target sequence
gaaagttgtagaaaaaaatagat

SEQ ID NO: 101462 - DNA, 23 bp, Artificial sequence
  SiRNA target sequence
aaagttgtagaaaaaaatagatt

SEQ ID NO: 101463 - DNA, 23 bp, Artificial sequence
  SiRNA target sequence
aagttgtagaaaaaaatagattt

SEQ ID NO: 101464 - DNA, 23 bp, Artificial sequence
  SiRNA target sequence
agttgtagaaaaaaatagatttg

SEQ ID NO: 101465 - DNA, 23 bp, Artificial sequence
  SiRNA target sequence
gttgtagaaaaaaatagatttga

SEQ ID NO: 101466 - DNA, 23 bp, Artificial sequence
  SiRNA target sequence
ttgtagaaaaaaatagatttgag

SEQ ID NO: 101467 - DNA, 23 bp, Artificial sequence
  SiRNA target sequence
tgtagaaaaaaatagatttgagg

SEQ ID NO: 101468 - DNA, 23 bp, Artificial sequence
  SiRNA target sequence
gtagaaaaaaatagatttgagga

SEQ ID NO: 101469 - DNA, 23 bp, Artificial sequence
  SiRNA target sequence
tagaaaaaaatagatttgaggaa

SEQ ID NO: 101470 - DNA, 23 bp, Artificial sequence
  SiRNA target sequence
agaaaaaaatagatttgaggaat

SEQ ID NO: 101471 - DNA, 23 bp, Artificial sequence
  SiRNA target sequence
gaaaaaaatagatttgaggaata

SEQ ID NO: 101472 - DNA, 23 bp, Artificial sequence
  SiRNA target sequence
aaaaaaatagatttgaggaatag

SEQ ID NO: 101473 - DNA, 23 bp, Artificial sequence
  SiRNA target sequence
aaaaaatagatttgaggaataga

SEQ ID NO: 101474 - DNA, 23 bp, Artificial sequence
  SiRNA target sequence
aaaaatagatttgaggaatagaa

SEQ ID NO: 101475 - DNA, 23 bp, Artificial sequence
  SiRNA target sequence
aaaatagatttgaggaatagaat

SEQ ID NO: 101476 - DNA, 23 bp, Artificial sequence
  SiRNA target sequence
aaatagatttgaggaatagaatt

SEQ ID NO: 101477 - DNA, 23 bp, Artificial sequence
  SiRNA target sequence
aatagatttgaggaatagaatta

SEQ ID NO: 101478 - DNA, 23 bp, Artificial sequence
  SiRNA target sequence
atagatttgaggaatagaattaa

SEQ ID NO: 101479 - DNA, 23 bp, Artificial sequence
  SiRNA target sequence
tagatttgaggaatagaattaaa

SEQ ID NO: 101480 - DNA, 23 bp, Artificial sequence
  SiRNA target sequence
agatttgaggaatagaattaaaa

SEQ ID NO: 101481 - DNA, 23 bp, Artificial sequence
  SiRNA target sequence
gatttgaggaatagaattaaaat

SEQ ID NO: 101482 - DNA, 23 bp, Artificial sequence
  SiRNA target sequence
atttgaggaatagaattaaaatc

SEQ ID NO: 101483 - DNA, 23 bp, Artificial sequence
  SiRNA target sequence
tttgaggaatagaattaaaatca

SEQ ID NO: 101484 - DNA, 23 bp, Artificial sequence
  SiRNA target sequence
ttgaggaatagaattaaaatcac

SEQ ID NO: 101485 - DNA, 23 bp, Artificial sequence
  SiRNA target sequence
tgaggaatagaattaaaatcaca

SEQ ID NO: 101486 - DNA, 23 bp, Artificial sequence
  SiRNA target sequence
gaggaatagaattaaaatcacaa

SEQ ID NO: 101487 - DNA, 23 bp, Artificial sequence
  SiRNA target sequence
aggaatagaattaaaatcacaat

SEQ ID NO: 101488 - DNA, 23 bp, Artificial sequence
  SiRNA target sequence
ggaatagaattaaaatcacaata

SEQ ID NO: 101489 - DNA, 23 bp, Artificial sequence
  SiRNA target sequence
gaatagaattaaaatcacaatat

SEQ ID NO: 101490 - DNA, 23 bp, Artificial sequence
  SiRNA target sequence
aatagaattaaaatcacaatatt

SEQ ID NO: 101491 - DNA, 23 bp, Artificial sequence
  SiRNA target sequence
atagaattaaaatcacaatattt

SEQ ID NO: 101492 - DNA, 23 bp, Artificial sequence
  SiRNA target sequence
tagaattaaaatcacaatatttt

SEQ ID NO: 101493 - DNA, 23 bp, Artificial sequence
  SiRNA target sequence
agaattaaaatcacaatattttt

SEQ ID NO: 101494 - DNA, 23 bp, Artificial sequence
  SiRNA target sequence
gaattaaaatcacaatatttttt

SEQ ID NO: 101495 - DNA, 23 bp, Artificial sequence
  SiRNA target sequence
aattaaaatcacaatatttttta

SEQ ID NO: 101496 - DNA, 23 bp, Artificial sequence
  SiRNA target sequence
attaaaatcacaatattttttaa

SEQ ID NO: 101497 - DNA, 23 bp, Artificial sequence
  SiRNA target sequence
ttaaaatcacaatattttttaat

SEQ ID NO: 101498 - DNA, 23 bp, Artificial sequence
  SiRNA target sequence
taaaatcacaatattttttaata

SEQ ID NO: 101499 - DNA, 23 bp, Artificial sequence
  SiRNA target sequence
aaaatcacaatattttttaatat

SEQ ID NO: 101500 - DNA, 23 bp, Artificial sequence
  SiRNA target sequence
aaatcacaatattttttaatata

SEQ ID NO: 101501 - DNA, 23 bp, Artificial sequence
  SiRNA target sequence
aatcacaatattttttaatatat

SEQ ID NO: 101502 - DNA, 23 bp, Artificial sequence
  SiRNA target sequence
atcacaatattttttaatatatt

SEQ ID NO: 101503 - DNA, 23 bp, Artificial sequence
  SiRNA target sequence
tcacaatattttttaatatattt

SEQ ID NO: 101504 - DNA, 23 bp, Artificial sequence
  SiRNA target sequence
cacaatattttttaatatattta

SEQ ID NO: 101505 - DNA, 23 bp, Artificial sequence
  SiRNA target sequence
acaatattttttaatatatttaa

SEQ ID NO: 101506 - DNA, 23 bp, Artificial sequence
  SiRNA target sequence
caatattttttaatatatttaac

SEQ ID NO: 101507 - DNA, 23 bp, Artificial sequence
  SiRNA target sequence
aatattttttaatatatttaacc

SEQ ID NO: 101508 - DNA, 23 bp, Artificial sequence
  SiRNA target sequence
atattttttaatatatttaacca

SEQ ID NO: 101509 - DNA, 23 bp, Artificial sequence
  SiRNA target sequence
tattttttaatatatttaaccaa

SEQ ID NO: 101510 - DNA, 23 bp, Artificial sequence
  SiRNA target sequence
attttttaatatatttaaccaag

SEQ ID NO: 101511 - DNA, 23 bp, Artificial sequence
  SiRNA target sequence
ttttttaatatatttaaccaagg

SEQ ID NO: 101512 - DNA, 23 bp, Artificial sequence
  SiRNA target sequence
tttttaatatatttaaccaaggt

SEQ ID NO: 101513 - DNA, 23 bp, Artificial sequence
  SiRNA target sequence
ttttaatatatttaaccaaggta

SEQ ID NO: 101514 - DNA, 23 bp, Artificial sequence
  SiRNA target sequence
tttaatatatttaaccaaggtat

SEQ ID NO: 101515 - DNA, 23 bp, Artificial sequence
  SiRNA target sequence
ttaatatatttaaccaaggtatt

SEQ ID NO: 101516 - DNA, 23 bp, Artificial sequence
  SiRNA target sequence
taatatatttaaccaaggtattg

SEQ ID NO: 101517 - DNA, 23 bp, Artificial sequence
  SiRNA target sequence
aatatatttaaccaaggtattgt

SEQ ID NO: 101518 - DNA, 23 bp, Artificial sequence
  SiRNA target sequence
atatatttaaccaaggtattgtc

SEQ ID NO: 101519 - DNA, 23 bp, Artificial sequence
  SiRNA target sequence
tatatttaaccaaggtattgtcc

SEQ ID NO: 101520 - DNA, 23 bp, Artificial sequence
  SiRNA target sequence
atatttaaccaaggtattgtcct

SEQ ID NO: 101521 - DNA, 23 bp, Artificial sequence
  SiRNA target sequence
tatttaaccaaggtattgtcctt

SEQ ID NO: 101522 - DNA, 23 bp, Artificial sequence
  SiRNA target sequence
atttaaccaaggtattgtccttt

SEQ ID NO: 101523 - DNA, 23 bp, Artificial sequence
  SiRNA target sequence
tttaaccaaggtattgtccttta

SEQ ID NO: 101524 - DNA, 23 bp, Artificial sequence
  SiRNA target sequence
ttaaccaaggtattgtcctttat

SEQ ID NO: 101525 - DNA, 23 bp, Artificial sequence
  SiRNA target sequence
taaccaaggtattgtcctttatg

SEQ ID NO: 101526 - DNA, 23 bp, Artificial sequence
  SiRNA target sequence
aaccaaggtattgtcctttatgt

SEQ ID NO: 101527 - DNA, 23 bp, Artificial sequence
  SiRNA target sequence
accaaggtattgtcctttatgtt

SEQ ID NO: 101528 - DNA, 23 bp, Artificial sequence
  SiRNA target sequence
ccaaggtattgtcctttatgtta

SEQ ID NO: 101529 - DNA, 23 bp, Artificial sequence
  SiRNA target sequence
caaggtattgtcctttatgttat

SEQ ID NO: 101530 - DNA, 23 bp, Artificial sequence
  SiRNA target sequence
aaggtattgtcctttatgttatt

SEQ ID NO: 101531 - DNA, 23 bp, Artificial sequence
  SiRNA target sequence
aggtattgtcctttatgttatta

SEQ ID NO: 101532 - DNA, 23 bp, Artificial sequence
  SiRNA target sequence
ggtattgtcctttatgttattat

SEQ ID NO: 101533 - DNA, 23 bp, Artificial sequence
  SiRNA target sequence
gtattgtcctttatgttattata

SEQ ID NO: 101534 - DNA, 23 bp, Artificial sequence
  SiRNA target sequence
tattgtcctttatgttattatat

SEQ ID NO: 101535 - DNA, 23 bp, Artificial sequence
  SiRNA target sequence
attgtcctttatgttattatatc

SEQ ID NO: 101536 - DNA, 23 bp, Artificial sequence
  SiRNA target sequence
ttgtcctttatgttattatatct

SEQ ID NO: 101537 - DNA, 23 bp, Artificial sequence
  SiRNA target sequence
tgtcctttatgttattatatctt

SEQ ID NO: 101538 - DNA, 23 bp, Artificial sequence
  SiRNA target sequence
gtcctttatgttattatatctta

SEQ ID NO: 101539 - DNA, 23 bp, Artificial sequence
  SiRNA target sequence
tcctttatgttattatatcttac

SEQ ID NO: 101540 - DNA, 23 bp, Artificial sequence
  SiRNA target sequence
cctttatgttattatatcttaca

SEQ ID NO: 101541 - DNA, 23 bp, Artificial sequence
  SiRNA target sequence
ctttatgttattatatcttacaa

SEQ ID NO: 101542 - DNA, 23 bp, Artificial sequence
  SiRNA target sequence
tttatgttattatatcttacaaa

SEQ ID NO: 101543 - DNA, 23 bp, Artificial sequence
  SiRNA target sequence
ttatgttattatatcttacaaac

SEQ ID NO: 101544 - DNA, 23 bp, Artificial sequence
  SiRNA target sequence
tatgttattatatcttacaaact

SEQ ID NO: 101545 - DNA, 23 bp, Artificial sequence
  SiRNA target sequence
atgttattatatcttacaaactc

SEQ ID NO: 101546 - DNA, 23 bp, Artificial sequence
  SiRNA target sequence
tgttattatatcttacaaactcc

SEQ ID NO: 101547 - DNA, 23 bp, Artificial sequence
  SiRNA target sequence
gttattatatcttacaaactcct

SEQ ID NO: 101548 - DNA, 23 bp, Artificial sequence
  SiRNA target sequence
ttattatatcttacaaactcctc

SEQ ID NO: 101549 - DNA, 23 bp, Artificial sequence
  SiRNA target sequence
tattatatcttacaaactcctcg

SEQ ID NO: 101550 - DNA, 23 bp, Artificial sequence
  SiRNA target sequence
attatatcttacaaactcctcgt

SEQ ID NO: 101551 - DNA, 23 bp, Artificial sequence
  SiRNA target sequence
ttatatcttacaaactcctcgta

SEQ ID NO: 101552 - DNA, 23 bp, Artificial sequence
  SiRNA target sequence
tatatcttacaaactcctcgtaa

SEQ ID NO: 101553 - DNA, 23 bp, Artificial sequence
  SiRNA target sequence
atatcttacaaactcctcgtaat

SEQ ID NO: 101554 - DNA, 23 bp, Artificial sequence
  SiRNA target sequence
tatcttacaaactcctcgtaatt

SEQ ID NO: 101555 - DNA, 23 bp, Artificial sequence
  SiRNA target sequence
atcttacaaactcctcgtaatta

SEQ ID NO: 101556 - DNA, 23 bp, Artificial sequence
  SiRNA target sequence
tcttacaaactcctcgtaattat

SEQ ID NO: 101557 - DNA, 23 bp, Artificial sequence
  SiRNA target sequence
cttacaaactcctcgtaattata

SEQ ID NO: 101558 - DNA, 23 bp, Artificial sequence
  SiRNA target sequence
ttacaaactcctcgtaattataa

SEQ ID NO: 101559 - DNA, 23 bp, Artificial sequence
  SiRNA target sequence
tacaaactcctcgtaattataat

SEQ ID NO: 101560 - DNA, 23 bp, Artificial sequence
  SiRNA target sequence
acaaactcctcgtaattataatt

SEQ ID NO: 101561 - DNA, 23 bp, Artificial sequence
  SiRNA target sequence
caaactcctcgtaattataattt

SEQ ID NO: 101562 - DNA, 23 bp, Artificial sequence
  SiRNA target sequence
aaactcctcgtaattataatttt

SEQ ID NO: 101563 - DNA, 23 bp, Artificial sequence
  SiRNA target sequence
aactcctcgtaattataattttc

SEQ ID NO: 101564 - DNA, 23 bp, Artificial sequence
  SiRNA target sequence
actcctcgtaattataattttca

SEQ ID NO: 101565 - DNA, 23 bp, Artificial sequence
  SiRNA target sequence
ctcctcgtaattataattttcag

SEQ ID NO: 101566 - DNA, 23 bp, Artificial sequence
  SiRNA target sequence
tcctcgtaattataattttcagg

SEQ ID NO: 101567 - DNA, 23 bp, Artificial sequence
  SiRNA target sequence
cctcgtaattataattttcagga

SEQ ID NO: 101568 - DNA, 23 bp, Artificial sequence
  SiRNA target sequence
ctcgtaattataattttcaggat

SEQ ID NO: 101569 - DNA, 23 bp, Artificial sequence
  SiRNA target sequence
tcgtaattataattttcaggata

SEQ ID NO: 101570 - DNA, 23 bp, Artificial sequence
  SiRNA target sequence
cgtaattataattttcaggataa

SEQ ID NO: 101571 - DNA, 23 bp, Artificial sequence
  SiRNA target sequence
gtaattataattttcaggataaa

SEQ ID NO: 101572 - DNA, 23 bp, Artificial sequence
  SiRNA target sequence
taattataattttcaggataaac

SEQ ID NO: 101573 - DNA, 23 bp, Artificial sequence
  SiRNA target sequence
aattataattttcaggataaacc

SEQ ID NO: 101574 - DNA, 23 bp, Artificial sequence
  SiRNA target sequence
attataattttcaggataaaccg

SEQ ID NO: 101575 - DNA, 23 bp, Artificial sequence
  SiRNA target sequence
ttataattttcaggataaaccgc

SEQ ID NO: 101576 - DNA, 23 bp, Artificial sequence
  SiRNA target sequence
tataattttcaggataaaccgct

SEQ ID NO: 101577 - DNA, 23 bp, Artificial sequence
  SiRNA target sequence
ataattttcaggataaaccgcta

SEQ ID NO: 101578 - DNA, 23 bp, Artificial sequence
  SiRNA target sequence
taattttcaggataaaccgctag

SEQ ID NO: 101579 - DNA, 23 bp, Artificial sequence
  SiRNA target sequence
aattttcaggataaaccgctaga

SEQ ID NO: 101580 - DNA, 23 bp, Artificial sequence
  SiRNA target sequence
attttcaggataaaccgctagac

SEQ ID NO: 101581 - DNA, 23 bp, Artificial sequence
  SiRNA target sequence
ttttcaggataaaccgctagaca

SEQ ID NO: 101582 - DNA, 23 bp, Artificial sequence
  SiRNA target sequence
tttcaggataaaccgctagacaa

SEQ ID NO: 101583 - DNA, 23 bp, Artificial sequence
  SiRNA target sequence
ttcaggataaaccgctagacaat

SEQ ID NO: 101584 - DNA, 23 bp, Artificial sequence
  SiRNA target sequence
tcaggataaaccgctagacaatc

SEQ ID NO: 101585 - DNA, 23 bp, Artificial sequence
  SiRNA target sequence
caggataaaccgctagacaatca

SEQ ID NO: 101586 - DNA, 23 bp, Artificial sequence
  SiRNA target sequence
aggataaaccgctagacaatcac

SEQ ID NO: 101587 - DNA, 23 bp, Artificial sequence
  SiRNA target sequence
ggataaaccgctagacaatcacc

SEQ ID NO: 101588 - DNA, 23 bp, Artificial sequence
  SiRNA target sequence
gataaaccgctagacaatcaccg

SEQ ID NO: 101589 - DNA, 23 bp, Artificial sequence
  SiRNA target sequence
ataaaccgctagacaatcaccga

SEQ ID NO: 101590 - DNA, 23 bp, Artificial sequence
  SiRNA target sequence
taaaccgctagacaatcaccgat

SEQ ID NO: 101591 - DNA, 23 bp, Artificial sequence
  SiRNA target sequence
aaaccgctagacaatcaccgatt

SEQ ID NO: 101592 - DNA, 23 bp, Artificial sequence
  SiRNA target sequence
aaccgctagacaatcaccgattt

SEQ ID NO: 101593 - DNA, 23 bp, Artificial sequence
  SiRNA target sequence
accgctagacaatcaccgatttc

SEQ ID NO: 101594 - DNA, 23 bp, Artificial sequence
  SiRNA target sequence
ccgctagacaatcaccgatttca

SEQ ID NO: 101595 - DNA, 23 bp, Artificial sequence
  SiRNA target sequence
cgctagacaatcaccgatttcaa

SEQ ID NO: 101596 - DNA, 23 bp, Artificial sequence
  SiRNA target sequence
gctagacaatcaccgatttcaaa

SEQ ID NO: 101597 - DNA, 23 bp, Artificial sequence
  SiRNA target sequence
ctagacaatcaccgatttcaaaa

SEQ ID NO: 101598 - DNA, 23 bp, Artificial sequence
  SiRNA target sequence
tagacaatcaccgatttcaaaat

SEQ ID NO: 101599 - DNA, 23 bp, Artificial sequence
  SiRNA target sequence
agacaatcaccgatttcaaaatt

SEQ ID NO: 101600 - DNA, 23 bp, Artificial sequence
  SiRNA target sequence
gacaatcaccgatttcaaaattt

SEQ ID NO: 101601 - DNA, 23 bp, Artificial sequence
  SiRNA target sequence
acaatcaccgatttcaaaatttt

SEQ ID NO: 101602 - DNA, 23 bp, Artificial sequence
  SiRNA target sequence
caatcaccgatttcaaaattttc

SEQ ID NO: 101603 - DNA, 23 bp, Artificial sequence
  SiRNA target sequence
aatcaccgatttcaaaattttct

SEQ ID NO: 101604 - DNA, 23 bp, Artificial sequence
  SiRNA target sequence
atcaccgatttcaaaattttcta

SEQ ID NO: 101605 - DNA, 23 bp, Artificial sequence
  SiRNA target sequence
tcaccgatttcaaaattttctat

SEQ ID NO: 101606 - DNA, 23 bp, Artificial sequence
  SiRNA target sequence
caccgatttcaaaattttctata

SEQ ID NO: 101607 - DNA, 23 bp, Artificial sequence
  SiRNA target sequence
accgatttcaaaattttctatat

SEQ ID NO: 101608 - DNA, 23 bp, Artificial sequence
  SiRNA target sequence
ccgatttcaaaattttctatatc

SEQ ID NO: 101609 - DNA, 23 bp, Artificial sequence
  SiRNA target sequence
cgatttcaaaattttctatatct

SEQ ID NO: 101610 - DNA, 23 bp, Artificial sequence
  SiRNA target sequence
gatttcaaaattttctatatcta

SEQ ID NO: 101611 - DNA, 23 bp, Artificial sequence
  SiRNA target sequence
atttcaaaattttctatatctat

SEQ ID NO: 101612 - DNA, 23 bp, Artificial sequence
  SiRNA target sequence
tttcaaaattttctatatctata

SEQ ID NO: 101613 - DNA, 23 bp, Artificial sequence
  SiRNA target sequence
ttcaaaattttctatatctatat

SEQ ID NO: 101614 - DNA, 23 bp, Artificial sequence
  SiRNA target sequence
tcaaaattttctatatctatatc

SEQ ID NO: 101615 - DNA, 23 bp, Artificial sequence
  SiRNA target sequence
caaaattttctatatctatatca

SEQ ID NO: 101616 - DNA, 23 bp, Artificial sequence
  SiRNA target sequence
aaaattttctatatctatatcaa

SEQ ID NO: 101617 - DNA, 23 bp, Artificial sequence
  SiRNA target sequence
aaattttctatatctatatcaaa

SEQ ID NO: 101618 - DNA, 23 bp, Artificial sequence
  SiRNA target sequence
aattttctatatctatatcaaat

SEQ ID NO: 101619 - DNA, 23 bp, Artificial sequence
  SiRNA target sequence
attttctatatctatatcaaatt

SEQ ID NO: 101620 - DNA, 23 bp, Artificial sequence
  SiRNA target sequence
ttttctatatctatatcaaattt

SEQ ID NO: 101621 - DNA, 23 bp, Artificial sequence
  SiRNA target sequence
tttctatatctatatcaaatttt

SEQ ID NO: 101622 - DNA, 23 bp, Artificial sequence
  SiRNA target sequence
ttctatatctatatcaaatttta

SEQ ID NO: 101623 - DNA, 23 bp, Artificial sequence
  SiRNA target sequence
tctatatctatatcaaattttat

SEQ ID NO: 101624 - DNA, 23 bp, Artificial sequence
  SiRNA target sequence
ctatatctatatcaaattttatt

SEQ ID NO: 101625 - DNA, 23 bp, Artificial sequence
  SiRNA target sequence
tatatctatatcaaattttattt

SEQ ID NO: 101626 - DNA, 23 bp, Artificial sequence
  SiRNA target sequence
atatctatatcaaattttatttc

SEQ ID NO: 101627 - DNA, 23 bp, Artificial sequence
  SiRNA target sequence
tatctatatcaaattttatttct

SEQ ID NO: 101628 - DNA, 23 bp, Artificial sequence
  SiRNA target sequence
atctatatcaaattttatttcta

SEQ ID NO: 101629 - DNA, 23 bp, Artificial sequence
  SiRNA target sequence
tctatatcaaattttatttctaa

SEQ ID NO: 101630 - DNA, 23 bp, Artificial sequence
  SiRNA target sequence
ctatatcaaattttatttctaaa

SEQ ID NO: 101631 - DNA, 23 bp, Artificial sequence
  SiRNA target sequence
tatatcaaattttatttctaaaa

SEQ ID NO: 101632 - DNA, 23 bp, Artificial sequence
  SiRNA target sequence
atatcaaattttatttctaaaat

SEQ ID NO: 101633 - DNA, 23 bp, Artificial sequence
  SiRNA target sequence
tatcaaattttatttctaaaata

SEQ ID NO: 101634 - DNA, 23 bp, Artificial sequence
  SiRNA target sequence
atcaaattttatttctaaaatag

SEQ ID NO: 101635 - DNA, 23 bp, Artificial sequence
  SiRNA target sequence
tcaaattttatttctaaaatagg

SEQ ID NO: 101636 - DNA, 23 bp, Artificial sequence
  SiRNA target sequence
caaattttatttctaaaatagga

SEQ ID NO: 101637 - DNA, 23 bp, Artificial sequence
  SiRNA target sequence
aaattttatttctaaaataggat

SEQ ID NO: 101638 - DNA, 23 bp, Artificial sequence
  SiRNA target sequence
aattttatttctaaaataggata

SEQ ID NO: 101639 - DNA, 23 bp, Artificial sequence
  SiRNA target sequence
attttatttctaaaataggataa

SEQ ID NO: 101640 - DNA, 23 bp, Artificial sequence
  SiRNA target sequence
ttttatttctaaaataggataaa

SEQ ID NO: 101641 - DNA, 23 bp, Artificial sequence
  SiRNA target sequence
tttatttctaaaataggataaat

SEQ ID NO: 101642 - DNA, 23 bp, Artificial sequence
  SiRNA target sequence
ttatttctaaaataggataaatg

SEQ ID NO: 101643 - DNA, 23 bp, Artificial sequence
  SiRNA target sequence
tatttctaaaataggataaatgt

SEQ ID NO: 101644 - DNA, 23 bp, Artificial sequence
  SiRNA target sequence
atttctaaaataggataaatgta

SEQ ID NO: 101645 - DNA, 23 bp, Artificial sequence
  SiRNA target sequence
tttctaaaataggataaatgtaa

SEQ ID NO: 101646 - DNA, 23 bp, Artificial sequence
  SiRNA target sequence
ttctaaaataggataaatgtaat

SEQ ID NO: 101647 - DNA, 23 bp, Artificial sequence
  SiRNA target sequence
tctaaaataggataaatgtaatt

SEQ ID NO: 101648 - DNA, 23 bp, Artificial sequence
  SiRNA target sequence
ctaaaataggataaatgtaattg

SEQ ID NO: 101649 - DNA, 23 bp, Artificial sequence
  SiRNA target sequence
taaaataggataaatgtaattgt

SEQ ID NO: 101650 - DNA, 23 bp, Artificial sequence
  SiRNA target sequence
aaaataggataaatgtaattgta

SEQ ID NO: 101651 - DNA, 23 bp, Artificial sequence
  SiRNA target sequence
aaataggataaatgtaattgtaa

SEQ ID NO: 101652 - DNA, 23 bp, Artificial sequence
  SiRNA target sequence
aataggataaatgtaattgtaag

SEQ ID NO: 101653 - DNA, 23 bp, Artificial sequence
  SiRNA target sequence
ataggataaatgtaattgtaagg

SEQ ID NO: 101654 - DNA, 23 bp, Artificial sequence
  SiRNA target sequence
taggataaatgtaattgtaaggt

SEQ ID NO: 101655 - DNA, 23 bp, Artificial sequence
  SiRNA target sequence
aggataaatgtaattgtaaggtg

SEQ ID NO: 101656 - DNA, 23 bp, Artificial sequence
  SiRNA target sequence
ggataaatgtaattgtaaggtgt

SEQ ID NO: 101657 - DNA, 23 bp, Artificial sequence
  SiRNA target sequence
gataaatgtaattgtaaggtgtt

SEQ ID NO: 101658 - DNA, 23 bp, Artificial sequence
  SiRNA target sequence
ataaatgtaattgtaaggtgtta

SEQ ID NO: 101659 - DNA, 23 bp, Artificial sequence
  SiRNA target sequence
taaatgtaattgtaaggtgttaa

SEQ ID NO: 101660 - DNA, 23 bp, Artificial sequence
  SiRNA target sequence
aaatgtaattgtaaggtgttaat

SEQ ID NO: 101661 - DNA, 23 bp, Artificial sequence
  SiRNA target sequence
aatgtaattgtaaggtgttaata

SEQ ID NO: 101662 - DNA, 23 bp, Artificial sequence
  SiRNA target sequence
atgtaattgtaaggtgttaatat

SEQ ID NO: 101663 - DNA, 23 bp, Artificial sequence
  SiRNA target sequence
tgtaattgtaaggtgttaatatc

SEQ ID NO: 101664 - DNA, 23 bp, Artificial sequence
  SiRNA target sequence
gtaattgtaaggtgttaatatct

SEQ ID NO: 101665 - DNA, 23 bp, Artificial sequence
  SiRNA target sequence
taattgtaaggtgttaatatctt

SEQ ID NO: 101666 - DNA, 23 bp, Artificial sequence
  SiRNA target sequence
aattgtaaggtgttaatatctta

SEQ ID NO: 101667 - DNA, 23 bp, Artificial sequence
  SiRNA target sequence
attgtaaggtgttaatatcttaa

SEQ ID NO: 101668 - DNA, 23 bp, Artificial sequence
  SiRNA target sequence
ttgtaaggtgttaatatcttaat

SEQ ID NO: 101669 - DNA, 23 bp, Artificial sequence
  SiRNA target sequence
tgtaaggtgttaatatcttaata

SEQ ID NO: 101670 - DNA, 23 bp, Artificial sequence
  SiRNA target sequence
gtaaggtgttaatatcttaatat

SEQ ID NO: 101671 - DNA, 23 bp, Artificial sequence
  SiRNA target sequence
taaggtgttaatatcttaatatc

SEQ ID NO: 101672 - DNA, 23 bp, Artificial sequence
  SiRNA target sequence
aaggtgttaatatcttaatatca

SEQ ID NO: 101673 - DNA, 23 bp, Artificial sequence
  SiRNA target sequence
aggtgttaatatcttaatatcat

SEQ ID NO: 101674 - DNA, 23 bp, Artificial sequence
  SiRNA target sequence
ggtgttaatatcttaatatcatt

SEQ ID NO: 101675 - DNA, 23 bp, Artificial sequence
  SiRNA target sequence
gtgttaatatcttaatatcattt

SEQ ID NO: 101676 - DNA, 23 bp, Artificial sequence
  SiRNA target sequence
tgttaatatcttaatatcattta

SEQ ID NO: 101677 - DNA, 23 bp, Artificial sequence
  SiRNA target sequence
gttaatatcttaatatcatttat

SEQ ID NO: 101678 - DNA, 23 bp, Artificial sequence
  SiRNA target sequence
ttaatatcttaatatcatttatt

SEQ ID NO: 101679 - DNA, 23 bp, Artificial sequence
  SiRNA target sequence
taatatcttaatatcatttattg

SEQ ID NO: 101680 - DNA, 23 bp, Artificial sequence
  SiRNA target sequence
aatatcttaatatcatttattga

SEQ ID NO: 101681 - DNA, 23 bp, Artificial sequence
  SiRNA target sequence
atatcttaatatcatttattgac

SEQ ID NO: 101682 - DNA, 23 bp, Artificial sequence
  SiRNA target sequence
tatcttaatatcatttattgacg

SEQ ID NO: 101683 - DNA, 23 bp, Artificial sequence
  SiRNA target sequence
atcttaatatcatttattgacgc

SEQ ID NO: 101684 - DNA, 23 bp, Artificial sequence
  SiRNA target sequence
tcttaatatcatttattgacgca

SEQ ID NO: 101685 - DNA, 23 bp, Artificial sequence
  SiRNA target sequence
cttaatatcatttattgacgcac

SEQ ID NO: 101686 - DNA, 23 bp, Artificial sequence
  SiRNA target sequence
ttaatatcatttattgacgcact

SEQ ID NO: 101687 - DNA, 23 bp, Artificial sequence
  SiRNA target sequence
taatatcatttattgacgcactg

SEQ ID NO: 101688 - DNA, 23 bp, Artificial sequence
  SiRNA target sequence
aatatcatttattgacgcactgt

SEQ ID NO: 101689 - DNA, 23 bp, Artificial sequence
  SiRNA target sequence
atatcatttattgacgcactgta

SEQ ID NO: 101690 - DNA, 23 bp, Artificial sequence
  SiRNA target sequence
tatcatttattgacgcactgtat

SEQ ID NO: 101691 - DNA, 23 bp, Artificial sequence
  SiRNA target sequence
atcatttattgacgcactgtata

SEQ ID NO: 101692 - DNA, 23 bp, Artificial sequence
  SiRNA target sequence
tcatttattgacgcactgtataa

SEQ ID NO: 101693 - DNA, 23 bp, Artificial sequence
  SiRNA target sequence
catttattgacgcactgtataaa

SEQ ID NO: 101694 - DNA, 23 bp, Artificial sequence
  SiRNA target sequence
atttattgacgcactgtataaat

SEQ ID NO: 101695 - DNA, 23 bp, Artificial sequence
  SiRNA target sequence
tttattgacgcactgtataaatc

SEQ ID NO: 101696 - DNA, 23 bp, Artificial sequence
  SiRNA target sequence
ttattgacgcactgtataaatca

SEQ ID NO: 101697 - DNA, 23 bp, Artificial sequence
  SiRNA target sequence
tattgacgcactgtataaatcat

SEQ ID NO: 101698 - DNA, 23 bp, Artificial sequence
  SiRNA target sequence
attgacgcactgtataaatcatt

SEQ ID NO: 101699 - DNA, 23 bp, Artificial sequence
  SiRNA target sequence
ttgacgcactgtataaatcattt

SEQ ID NO: 101700 - DNA, 23 bp, Artificial sequence
  SiRNA target sequence
tgacgcactgtataaatcatttt

SEQ ID NO: 101701 - DNA, 23 bp, Artificial sequence
  SiRNA target sequence
gacgcactgtataaatcattttt

SEQ ID NO: 101702 - DNA, 23 bp, Artificial sequence
  SiRNA target sequence
acgcactgtataaatcattttta

SEQ ID NO: 101703 - DNA, 23 bp, Artificial sequence
  SiRNA target sequence
cgcactgtataaatcatttttac

SEQ ID NO: 101704 - DNA, 23 bp, Artificial sequence
  SiRNA target sequence
gcactgtataaatcatttttaca

SEQ ID NO: 101705 - DNA, 23 bp, Artificial sequence
  SiRNA target sequence
cactgtataaatcatttttacaa

SEQ ID NO: 101706 - DNA, 23 bp, Artificial sequence
  SiRNA target sequence
actgtataaatcatttttacaac

SEQ ID NO: 101707 - DNA, 23 bp, Artificial sequence
  SiRNA target sequence
ctgtataaatcatttttacaact

SEQ ID NO: 101708 - DNA, 23 bp, Artificial sequence
  SiRNA target sequence
tgtataaatcatttttacaactt

SEQ ID NO: 101709 - DNA, 23 bp, Artificial sequence
  SiRNA target sequence
gtataaatcatttttacaacttg

SEQ ID NO: 101710 - DNA, 23 bp, Artificial sequence
  SiRNA target sequence
tataaatcatttttacaacttgc

SEQ ID NO: 101711 - DNA, 23 bp, Artificial sequence
  SiRNA target sequence
ataaatcatttttacaacttgca

SEQ ID NO: 101712 - DNA, 23 bp, Artificial sequence
  SiRNA target sequence
taaatcatttttacaacttgcaa

SEQ ID NO: 101713 - DNA, 23 bp, Artificial sequence
  SiRNA target sequence
aaatcatttttacaacttgcaaa

SEQ ID NO: 101714 - DNA, 23 bp, Artificial sequence
  SiRNA target sequence
aatcatttttacaacttgcaaaa

SEQ ID NO: 101715 - DNA, 23 bp, Artificial sequence
  SiRNA target sequence
atcatttttacaacttgcaaaat

SEQ ID NO: 101716 - DNA, 23 bp, Artificial sequence
  SiRNA target sequence
tcatttttacaacttgcaaaatt

SEQ ID NO: 101717 - DNA, 23 bp, Artificial sequence
  SiRNA target sequence
catttttacaacttgcaaaattt

SEQ ID NO: 101718 - DNA, 23 bp, Artificial sequence
  SiRNA target sequence
atttttacaacttgcaaaatttt

SEQ ID NO: 101719 - DNA, 23 bp, Artificial sequence
  SiRNA target sequence
tttttacaacttgcaaaattttt

SEQ ID NO: 101720 - DNA, 23 bp, Artificial sequence
  SiRNA target sequence
ttttacaacttgcaaaattttta

SEQ ID NO: 101721 - DNA, 23 bp, Artificial sequence
  SiRNA target sequence
tttacaacttgcaaaatttttag

SEQ ID NO: 101722 - DNA, 23 bp, Artificial sequence
  SiRNA target sequence
ttacaacttgcaaaatttttagc

SEQ ID NO: 101723 - DNA, 23 bp, Artificial sequence
  SiRNA target sequence
tacaacttgcaaaatttttagca

SEQ ID NO: 101724 - DNA, 23 bp, Artificial sequence
  SiRNA target sequence
acaacttgcaaaatttttagcat

SEQ ID NO: 101725 - DNA, 23 bp, Artificial sequence
  SiRNA target sequence
caacttgcaaaatttttagcatt

SEQ ID NO: 101726 - DNA, 23 bp, Artificial sequence
  SiRNA target sequence
aacttgcaaaatttttagcattt

SEQ ID NO: 101727 - DNA, 23 bp, Artificial sequence
  SiRNA target sequence
acttgcaaaatttttagcatttt

SEQ ID NO: 101728 - DNA, 23 bp, Artificial sequence
  SiRNA target sequence
cttgcaaaatttttagcattttg

SEQ ID NO: 101729 - DNA, 23 bp, Artificial sequence
  SiRNA target sequence
ttgcaaaatttttagcattttgt

SEQ ID NO: 101730 - DNA, 23 bp, Artificial sequence
  SiRNA target sequence
tgcaaaatttttagcattttgta

SEQ ID NO: 101731 - DNA, 23 bp, Artificial sequence
  SiRNA target sequence
gcaaaatttttagcattttgtag

SEQ ID NO: 101732 - DNA, 23 bp, Artificial sequence
  SiRNA target sequence
caaaatttttagcattttgtagt

SEQ ID NO: 101733 - DNA, 23 bp, Artificial sequence
  SiRNA target sequence
aaaatttttagcattttgtagtt

SEQ ID NO: 101734 - DNA, 23 bp, Artificial sequence
  SiRNA target sequence
aaatttttagcattttgtagttt

SEQ ID NO: 101735 - DNA, 23 bp, Artificial sequence
  SiRNA target sequence
aatttttagcattttgtagtttg

SEQ ID NO: 101736 - DNA, 23 bp, Artificial sequence
  SiRNA target sequence
atttttagcattttgtagtttgt

SEQ ID NO: 101737 - DNA, 23 bp, Artificial sequence
  SiRNA target sequence
tttttagcattttgtagtttgta

SEQ ID NO: 101738 - DNA, 23 bp, Artificial sequence
  SiRNA target sequence
ttttagcattttgtagtttgtaa

SEQ ID NO: 101739 - DNA, 23 bp, Artificial sequence
  SiRNA target sequence
tttagcattttgtagtttgtaat

SEQ ID NO: 101740 - DNA, 23 bp, Artificial sequence
  SiRNA target sequence
ttagcattttgtagtttgtaatg

SEQ ID NO: 101741 - DNA, 23 bp, Artificial sequence
  SiRNA target sequence
tagcattttgtagtttgtaatgc

SEQ ID NO: 101742 - DNA, 23 bp, Artificial sequence
  SiRNA target sequence
agcattttgtagtttgtaatgcg

SEQ ID NO: 101743 - DNA, 23 bp, Artificial sequence
  SiRNA target sequence
gcattttgtagtttgtaatgcgg

SEQ ID NO: 101744 - DNA, 23 bp, Artificial sequence
  SiRNA target sequence
cattttgtagtttgtaatgcggt

SEQ ID NO: 101745 - DNA, 23 bp, Artificial sequence
  SiRNA target sequence
attttgtagtttgtaatgcggta

SEQ ID NO: 101746 - DNA, 23 bp, Artificial sequence
  SiRNA target sequence
ttttgtagtttgtaatgcggtaa

SEQ ID NO: 101747 - DNA, 23 bp, Artificial sequence
  SiRNA target sequence
tttgtagtttgtaatgcggtaat

SEQ ID NO: 101748 - DNA, 23 bp, Artificial sequence
  SiRNA target sequence
ttgtagtttgtaatgcggtaata

SEQ ID NO: 101749 - DNA, 23 bp, Artificial sequence
  SiRNA target sequence
tgtagtttgtaatgcggtaatat

SEQ ID NO: 101750 - DNA, 23 bp, Artificial sequence
  SiRNA target sequence
gtagtttgtaatgcggtaatata

SEQ ID NO: 101751 - DNA, 23 bp, Artificial sequence
  SiRNA target sequence
tagtttgtaatgcggtaatatat

SEQ ID NO: 101752 - DNA, 23 bp, Artificial sequence
  SiRNA target sequence
agtttgtaatgcggtaatatata

SEQ ID NO: 101753 - DNA, 23 bp, Artificial sequence
  SiRNA target sequence
gtttgtaatgcggtaatatataa

SEQ ID NO: 101754 - DNA, 23 bp, Artificial sequence
  SiRNA target sequence
tttgtaatgcggtaatatataat

SEQ ID NO: 101755 - DNA, 23 bp, Artificial sequence
  SiRNA target sequence
ttgtaatgcggtaatatataata

SEQ ID NO: 101756 - DNA, 23 bp, Artificial sequence
  SiRNA target sequence
tgtaatgcggtaatatataatat

SEQ ID NO: 101757 - DNA, 23 bp, Artificial sequence
  SiRNA target sequence
gtaatgcggtaatatataatata

SEQ ID NO: 101758 - DNA, 23 bp, Artificial sequence
  SiRNA target sequence
taatgcggtaatatataatatag

SEQ ID NO: 101759 - DNA, 23 bp, Artificial sequence
  SiRNA target sequence
aatgcggtaatatataatataga

SEQ ID NO: 101760 - DNA, 23 bp, Artificial sequence
  SiRNA target sequence
atgcggtaatatataatatagat

SEQ ID NO: 101761 - DNA, 23 bp, Artificial sequence
  SiRNA target sequence
tgcggtaatatataatatagatc

SEQ ID NO: 101762 - DNA, 23 bp, Artificial sequence
  SiRNA target sequence
gcggtaatatataatatagatct

SEQ ID NO: 101763 - DNA, 23 bp, Artificial sequence
  SiRNA target sequence
cggtaatatataatatagatctt

SEQ ID NO: 101764 - DNA, 23 bp, Artificial sequence
  SiRNA target sequence
ggtaatatataatatagatcttt

SEQ ID NO: 101765 - DNA, 23 bp, Artificial sequence
  SiRNA target sequence
gtaatatataatatagatctttt

SEQ ID NO: 101766 - DNA, 23 bp, Artificial sequence
  SiRNA target sequence
taatatataatatagatctttta

SEQ ID NO: 101767 - DNA, 23 bp, Artificial sequence
  SiRNA target sequence
aatatataatatagatcttttat

SEQ ID NO: 101768 - DNA, 23 bp, Artificial sequence
  SiRNA target sequence
atatataatatagatcttttatc

SEQ ID NO: 101769 - DNA, 23 bp, Artificial sequence
  SiRNA target sequence
tatataatatagatcttttatcc

SEQ ID NO: 101770 - DNA, 23 bp, Artificial sequence
  SiRNA target sequence
atataatatagatcttttatcca

SEQ ID NO: 101771 - DNA, 23 bp, Artificial sequence
  SiRNA target sequence
tataatatagatcttttatccat

SEQ ID NO: 101772 - DNA, 23 bp, Artificial sequence
  SiRNA target sequence
ataatatagatcttttatccatg

SEQ ID NO: 101773 - DNA, 23 bp, Artificial sequence
  SiRNA target sequence
taatatagatcttttatccatgt

SEQ ID NO: 101774 - DNA, 23 bp, Artificial sequence
  SiRNA target sequence
aatatagatcttttatccatgtc

SEQ ID NO: 101775 - DNA, 23 bp, Artificial sequence
  SiRNA target sequence
atatagatcttttatccatgtct

SEQ ID NO: 101776 - DNA, 23 bp, Artificial sequence
  SiRNA target sequence
tatagatcttttatccatgtctt

SEQ ID NO: 101777 - DNA, 23 bp, Artificial sequence
  SiRNA target sequence
atagatcttttatccatgtctta

SEQ ID NO: 101778 - DNA, 23 bp, Artificial sequence
  SiRNA target sequence
tagatcttttatccatgtcttaa

SEQ ID NO: 101779 - DNA, 23 bp, Artificial sequence
  SiRNA target sequence
agatcttttatccatgtcttaaa

SEQ ID NO: 101780 - DNA, 23 bp, Artificial sequence
  SiRNA target sequence
gatcttttatccatgtcttaaat

SEQ ID NO: 101781 - DNA, 23 bp, Artificial sequence
  SiRNA target sequence
atcttttatccatgtcttaaatt

SEQ ID NO: 101782 - DNA, 23 bp, Artificial sequence
  SiRNA target sequence
tcttttatccatgtcttaaattc

SEQ ID NO: 101783 - DNA, 23 bp, Artificial sequence
  SiRNA target sequence
cttttatccatgtcttaaattcg

SEQ ID NO: 101784 - DNA, 23 bp, Artificial sequence
  SiRNA target sequence
ttttatccatgtcttaaattcgc

SEQ ID NO: 101785 - DNA, 23 bp, Artificial sequence
  SiRNA target sequence
tttatccatgtcttaaattcgcc

SEQ ID NO: 101786 - DNA, 23 bp, Artificial sequence
  SiRNA target sequence
ttatccatgtcttaaattcgccc

SEQ ID NO: 101787 - DNA, 23 bp, Artificial sequence
  SiRNA target sequence
tatccatgtcttaaattcgccca

SEQ ID NO: 101788 - DNA, 23 bp, Artificial sequence
  SiRNA target sequence
atccatgtcttaaattcgcccat

SEQ ID NO: 101789 - DNA, 23 bp, Artificial sequence
  SiRNA target sequence
tccatgtcttaaattcgcccata

SEQ ID NO: 101790 - DNA, 23 bp, Artificial sequence
  SiRNA target sequence
ccatgtcttaaattcgcccataa

SEQ ID NO: 101791 - DNA, 23 bp, Artificial sequence
  SiRNA target sequence
catgtcttaaattcgcccataaa

SEQ ID NO: 101792 - DNA, 23 bp, Artificial sequence
  SiRNA target sequence
atgtcttaaattcgcccataaat

SEQ ID NO: 101793 - DNA, 23 bp, Artificial sequence
  SiRNA target sequence
tgtcttaaattcgcccataaatc

SEQ ID NO: 101794 - DNA, 23 bp, Artificial sequence
  SiRNA target sequence
gtcttaaattcgcccataaatcc

SEQ ID NO: 101795 - DNA, 23 bp, Artificial sequence
  SiRNA target sequence
tcttaaattcgcccataaatcct

SEQ ID NO: 101796 - DNA, 23 bp, Artificial sequence
  SiRNA target sequence
cttaaattcgcccataaatcctt

SEQ ID NO: 101797 - DNA, 23 bp, Artificial sequence
  SiRNA target sequence
ttaaattcgcccataaatccttc

SEQ ID NO: 101798 - DNA, 23 bp, Artificial sequence
  SiRNA target sequence
taaattcgcccataaatccttct

SEQ ID NO: 101799 - DNA, 23 bp, Artificial sequence
  SiRNA target sequence
aaattcgcccataaatccttctt

SEQ ID NO: 101800 - DNA, 23 bp, Artificial sequence
  SiRNA target sequence
aattcgcccataaatccttcttt

SEQ ID NO: 101801 - DNA, 23 bp, Artificial sequence
  SiRNA target sequence
attcgcccataaatccttctttg

SEQ ID NO: 101802 - DNA, 23 bp, Artificial sequence
  SiRNA target sequence
ttcgcccataaatccttctttgt

SEQ ID NO: 101803 - DNA, 23 bp, Artificial sequence
  SiRNA target sequence
tcgcccataaatccttctttgtc

SEQ ID NO: 101804 - DNA, 23 bp, Artificial sequence
  SiRNA target sequence
cgcccataaatccttctttgtct

SEQ ID NO: 101805 - DNA, 23 bp, Artificial sequence
  SiRNA target sequence
gcccataaatccttctttgtctt

SEQ ID NO: 101806 - DNA, 23 bp, Artificial sequence
  SiRNA target sequence
cccataaatccttctttgtcttg

SEQ ID NO: 101807 - DNA, 23 bp, Artificial sequence
  SiRNA target sequence
ccataaatccttctttgtcttgg

SEQ ID NO: 101808 - DNA, 23 bp, Artificial sequence
  SiRNA target sequence
cataaatccttctttgtcttggc

SEQ ID NO: 101809 - DNA, 23 bp, Artificial sequence
  SiRNA target sequence
ataaatccttctttgtcttggct

SEQ ID NO: 101810 - DNA, 23 bp, Artificial sequence
  SiRNA target sequence
taaatccttctttgtcttggcta

SEQ ID NO: 101811 - DNA, 23 bp, Artificial sequence
  SiRNA target sequence
aaatccttctttgtcttggctat

SEQ ID NO: 101812 - DNA, 23 bp, Artificial sequence
  SiRNA target sequence
aatccttctttgtcttggctatc

SEQ ID NO: 101813 - DNA, 23 bp, Artificial sequence
  SiRNA target sequence
atccttctttgtcttggctatct

SEQ ID NO: 101814 - DNA, 23 bp, Artificial sequence
  SiRNA target sequence
tccttctttgtcttggctatctc

SEQ ID NO: 101815 - DNA, 23 bp, Artificial sequence
  SiRNA target sequence
ccttctttgtcttggctatctcc

SEQ ID NO: 101816 - DNA, 23 bp, Artificial sequence
  SiRNA target sequence
cttctttgtcttggctatctcca

SEQ ID NO: 101817 - DNA, 23 bp, Artificial sequence
  SiRNA target sequence
ttctttgtcttggctatctccat

SEQ ID NO: 101818 - DNA, 23 bp, Artificial sequence
  SiRNA target sequence
tctttgtcttggctatctccatt

SEQ ID NO: 101819 - DNA, 23 bp, Artificial sequence
  SiRNA target sequence
ctttgtcttggctatctccatta

SEQ ID NO: 101820 - DNA, 23 bp, Artificial sequence
  SiRNA target sequence
tttgtcttggctatctccattac

SEQ ID NO: 101821 - DNA, 23 bp, Artificial sequence
  SiRNA target sequence
ttgtcttggctatctccattacc

SEQ ID NO: 101822 - DNA, 23 bp, Artificial sequence
  SiRNA target sequence
tgtcttggctatctccattaccc

SEQ ID NO: 101823 - DNA, 23 bp, Artificial sequence
  SiRNA target sequence
gtcttggctatctccattaccct

SEQ ID NO: 101824 - DNA, 23 bp, Artificial sequence
  SiRNA target sequence
tcttggctatctccattaccctt

SEQ ID NO: 101825 - DNA, 23 bp, Artificial sequence
  SiRNA target sequence
cttggctatctccattacccttt

SEQ ID NO: 101826 - DNA, 23 bp, Artificial sequence
  SiRNA target sequence
ttggctatctccattaccctttc

SEQ ID NO: 101827 - DNA, 23 bp, Artificial sequence
  SiRNA target sequence
tggctatctccattaccctttct

SEQ ID NO: 101828 - DNA, 23 bp, Artificial sequence
  SiRNA target sequence
ggctatctccattaccctttctt

SEQ ID NO: 101829 - DNA, 23 bp, Artificial sequence
  SiRNA target sequence
gctatctccattaccctttctta

SEQ ID NO: 101830 - DNA, 23 bp, Artificial sequence
  SiRNA target sequence
ctatctccattaccctttcttat

SEQ ID NO: 101831 - DNA, 23 bp, Artificial sequence
  SiRNA target sequence
tatctccattaccctttcttatc

SEQ ID NO: 101832 - DNA, 23 bp, Artificial sequence
  SiRNA target sequence
atctccattaccctttcttatca

SEQ ID NO: 101833 - DNA, 23 bp, Artificial sequence
  SiRNA target sequence
tctccattaccctttcttatcag

SEQ ID NO: 101834 - DNA, 23 bp, Artificial sequence
  SiRNA target sequence
ctccattaccctttcttatcaga

SEQ ID NO: 101835 - DNA, 23 bp, Artificial sequence
  SiRNA target sequence
tccattaccctttcttatcagag

SEQ ID NO: 101836 - DNA, 23 bp, Artificial sequence
  SiRNA target sequence
ccattaccctttcttatcagagg

SEQ ID NO: 101837 - DNA, 23 bp, Artificial sequence
  SiRNA target sequence
cattaccctttcttatcagaggt

SEQ ID NO: 101838 - DNA, 23 bp, Artificial sequence
  SiRNA target sequence
attaccctttcttatcagaggtt

SEQ ID NO: 101839 - DNA, 23 bp, Artificial sequence
  SiRNA target sequence
ttaccctttcttatcagaggttt

SEQ ID NO: 101840 - DNA, 23 bp, Artificial sequence
  SiRNA target sequence
taccctttcttatcagaggttta

SEQ ID NO: 101841 - DNA, 23 bp, Artificial sequence
  SiRNA target sequence
accctttcttatcagaggtttag

SEQ ID NO: 101842 - DNA, 23 bp, Artificial sequence
  SiRNA target sequence
ccctttcttatcagaggtttagc

SEQ ID NO: 101843 - DNA, 23 bp, Artificial sequence
  SiRNA target sequence
cctttcttatcagaggtttagct

SEQ ID NO: 101844 - DNA, 23 bp, Artificial sequence
  SiRNA target sequence
ctttcttatcagaggtttagctc

SEQ ID NO: 101845 - DNA, 23 bp, Artificial sequence
  SiRNA target sequence
tttcttatcagaggtttagctcc

SEQ ID NO: 101846 - DNA, 23 bp, Artificial sequence
  SiRNA target sequence
ttcttatcagaggtttagctccg

SEQ ID NO: 101847 - DNA, 23 bp, Artificial sequence
  SiRNA target sequence
tcttatcagaggtttagctccgt

SEQ ID NO: 101848 - DNA, 23 bp, Artificial sequence
  SiRNA target sequence
cttatcagaggtttagctccgtg

SEQ ID NO: 101849 - DNA, 23 bp, Artificial sequence
  SiRNA target sequence
ttatcagaggtttagctccgtgt

SEQ ID NO: 101850 - DNA, 23 bp, Artificial sequence
  SiRNA target sequence
tatcagaggtttagctccgtgtt

SEQ ID NO: 101851 - DNA, 23 bp, Artificial sequence
  SiRNA target sequence
atcagaggtttagctccgtgttt

SEQ ID NO: 101852 - DNA, 23 bp, Artificial sequence
  SiRNA target sequence
tcagaggtttagctccgtgtttt

SEQ ID NO: 101853 - DNA, 23 bp, Artificial sequence
  SiRNA target sequence
cagaggtttagctccgtgtttta

SEQ ID NO: 101854 - DNA, 23 bp, Artificial sequence
  SiRNA target sequence
agaggtttagctccgtgttttaa

SEQ ID NO: 101855 - DNA, 23 bp, Artificial sequence
  SiRNA target sequence
gaggtttagctccgtgttttaaa

SEQ ID NO: 101856 - DNA, 23 bp, Artificial sequence
  SiRNA target sequence
aggtttagctccgtgttttaaaa

SEQ ID NO: 101857 - DNA, 23 bp, Artificial sequence
  SiRNA target sequence
ggtttagctccgtgttttaaaag

SEQ ID NO: 101858 - DNA, 23 bp, Artificial sequence
  SiRNA target sequence
gtttagctccgtgttttaaaagg

SEQ ID NO: 101859 - DNA, 23 bp, Artificial sequence
  SiRNA target sequence
tttagctccgtgttttaaaaggc

SEQ ID NO: 101860 - DNA, 23 bp, Artificial sequence
  SiRNA target sequence
ttagctccgtgttttaaaaggca

SEQ ID NO: 101861 - DNA, 23 bp, Artificial sequence
  SiRNA target sequence
tagctccgtgttttaaaaggcaa

SEQ ID NO: 101862 - DNA, 23 bp, Artificial sequence
  SiRNA target sequence
agctccgtgttttaaaaggcaat

SEQ ID NO: 101863 - DNA, 23 bp, Artificial sequence
  SiRNA target sequence
gctccgtgttttaaaaggcaatt

SEQ ID NO: 101864 - DNA, 23 bp, Artificial sequence
  SiRNA target sequence
ctccgtgttttaaaaggcaatta

SEQ ID NO: 101865 - DNA, 23 bp, Artificial sequence
  SiRNA target sequence
tccgtgttttaaaaggcaattat

SEQ ID NO: 101866 - DNA, 23 bp, Artificial sequence
  SiRNA target sequence
ccgtgttttaaaaggcaattata

SEQ ID NO: 101867 - DNA, 23 bp, Artificial sequence
  SiRNA target sequence
cgtgttttaaaaggcaattatac

SEQ ID NO: 101868 - DNA, 23 bp, Artificial sequence
  SiRNA target sequence
gtgttttaaaaggcaattataca

SEQ ID NO: 101869 - DNA, 23 bp, Artificial sequence
  SiRNA target sequence
tgttttaaaaggcaattatacaa

SEQ ID NO: 101870 - DNA, 23 bp, Artificial sequence
  SiRNA target sequence
gttttaaaaggcaattatacaac

SEQ ID NO: 101871 - DNA, 23 bp, Artificial sequence
  SiRNA target sequence
ttttaaaaggcaattatacaact

SEQ ID NO: 101872 - DNA, 23 bp, Artificial sequence
  SiRNA target sequence
tttaaaaggcaattatacaactt

SEQ ID NO: 101873 - DNA, 23 bp, Artificial sequence
  SiRNA target sequence
ttaaaaggcaattatacaacttt

SEQ ID NO: 101874 - DNA, 23 bp, Artificial sequence
  SiRNA target sequence
taaaaggcaattatacaactttt

SEQ ID NO: 101875 - DNA, 23 bp, Artificial sequence
  SiRNA target sequence
aaaaggcaattatacaacttttt

SEQ ID NO: 101876 - DNA, 23 bp, Artificial sequence
  SiRNA target sequence
aaaggcaattatacaacttttta

SEQ ID NO: 101877 - DNA, 23 bp, Artificial sequence
  SiRNA target sequence
aaggcaattatacaactttttag

SEQ ID NO: 101878 - DNA, 23 bp, Artificial sequence
  SiRNA target sequence
aggcaattatacaactttttaga

SEQ ID NO: 101879 - DNA, 23 bp, Artificial sequence
  SiRNA target sequence
ggcaattatacaactttttagaa

SEQ ID NO: 101880 - DNA, 23 bp, Artificial sequence
  SiRNA target sequence
gcaattatacaactttttagaac

SEQ ID NO: 101881 - DNA, 23 bp, Artificial sequence
  SiRNA target sequence
caattatacaactttttagaaca

SEQ ID NO: 101882 - DNA, 23 bp, Artificial sequence
  SiRNA target sequence
aattatacaactttttagaacaa

SEQ ID NO: 101883 - DNA, 23 bp, Artificial sequence
  SiRNA target sequence
attatacaactttttagaacaaa

SEQ ID NO: 101884 - DNA, 23 bp, Artificial sequence
  SiRNA target sequence
ttatacaactttttagaacaaaa

SEQ ID NO: 101885 - DNA, 23 bp, Artificial sequence
  SiRNA target sequence
tatacaactttttagaacaaaaa

SEQ ID NO: 101886 - DNA, 23 bp, Artificial sequence
  SiRNA target sequence
atacaactttttagaacaaaaat

SEQ ID NO: 101887 - DNA, 23 bp, Artificial sequence
  SiRNA target sequence
tacaactttttagaacaaaaatt

SEQ ID NO: 101888 - DNA, 23 bp, Artificial sequence
  SiRNA target sequence
acaactttttagaacaaaaatta

SEQ ID NO: 101889 - DNA, 23 bp, Artificial sequence
  SiRNA target sequence
caactttttagaacaaaaattaa

SEQ ID NO: 101890 - DNA, 23 bp, Artificial sequence
  SiRNA target sequence
aactttttagaacaaaaattaaa

SEQ ID NO: 101891 - DNA, 23 bp, Artificial sequence
  SiRNA target sequence
actttttagaacaaaaattaaaa

SEQ ID NO: 101892 - DNA, 23 bp, Artificial sequence
  SiRNA target sequence
ctttttagaacaaaaattaaaag

SEQ ID NO: 101893 - DNA, 23 bp, Artificial sequence
  SiRNA target sequence
tttttagaacaaaaattaaaaga

SEQ ID NO: 101894 - DNA, 23 bp, Artificial sequence
  SiRNA target sequence
ttttagaacaaaaattaaaagat

SEQ ID NO: 101895 - DNA, 23 bp, Artificial sequence
  SiRNA target sequence
tttagaacaaaaattaaaagatt

SEQ ID NO: 101896 - DNA, 23 bp, Artificial sequence
  SiRNA target sequence
ttagaacaaaaattaaaagattt

SEQ ID NO: 101897 - DNA, 23 bp, Artificial sequence
  SiRNA target sequence
tagaacaaaaattaaaagattta

SEQ ID NO: 101898 - DNA, 23 bp, Artificial sequence
  SiRNA target sequence
agaacaaaaattaaaagatttat

SEQ ID NO: 101899 - DNA, 23 bp, Artificial sequence
  SiRNA target sequence
gaacaaaaattaaaagatttata

SEQ ID NO: 101900 - DNA, 23 bp, Artificial sequence
  SiRNA target sequence
aacaaaaattaaaagatttataa

SEQ ID NO: 101901 - DNA, 23 bp, Artificial sequence
  SiRNA target sequence
acaaaaattaaaagatttataag

SEQ ID NO: 101902 - DNA, 23 bp, Artificial sequence
  SiRNA target sequence
caaaaattaaaagatttataaga

SEQ ID NO: 101903 - DNA, 23 bp, Artificial sequence
  SiRNA target sequence
aaaaattaaaagatttataagac

SEQ ID NO: 101904 - DNA, 23 bp, Artificial sequence
  SiRNA target sequence
aaaattaaaagatttataagacg

SEQ ID NO: 101905 - DNA, 23 bp, Artificial sequence
  SiRNA target sequence
aaattaaaagatttataagacga

SEQ ID NO: 101906 - DNA, 23 bp, Artificial sequence
  SiRNA target sequence
aattaaaagatttataagacgaa

SEQ ID NO: 101907 - DNA, 23 bp, Artificial sequence
  SiRNA target sequence
attaaaagatttataagacgaat

SEQ ID NO: 101908 - DNA, 23 bp, Artificial sequence
  SiRNA target sequence
ttaaaagatttataagacgaatc

SEQ ID NO: 101909 - DNA, 23 bp, Artificial sequence
  SiRNA target sequence
taaaagatttataagacgaatcc

SEQ ID NO: 101910 - DNA, 23 bp, Artificial sequence
  SiRNA target sequence
aaaagatttataagacgaatccc

SEQ ID NO: 101911 - DNA, 23 bp, Artificial sequence
  SiRNA target sequence
aaagatttataagacgaatcccc

SEQ ID NO: 101912 - DNA, 23 bp, Artificial sequence
  SiRNA target sequence
aagatttataagacgaatcccca

SEQ ID NO: 101913 - DNA, 23 bp, Artificial sequence
  SiRNA target sequence
agatttataagacgaatccccaa

SEQ ID NO: 101914 - DNA, 23 bp, Artificial sequence
  SiRNA target sequence
gatttataagacgaatccccaag

SEQ ID NO: 101915 - DNA, 23 bp, Artificial sequence
  SiRNA target sequence
atttataagacgaatccccaagg

SEQ ID NO: 101916 - DNA, 23 bp, Artificial sequence
  SiRNA target sequence
tttataagacgaatccccaaggc

SEQ ID NO: 101917 - DNA, 23 bp, Artificial sequence
  SiRNA target sequence
ttataagacgaatccccaaggcc

SEQ ID NO: 101918 - DNA, 23 bp, Artificial sequence
  SiRNA target sequence
tataagacgaatccccaaggcca

SEQ ID NO: 101919 - DNA, 23 bp, Artificial sequence
  SiRNA target sequence
ataagacgaatccccaaggccaa

SEQ ID NO: 101920 - DNA, 23 bp, Artificial sequence
  SiRNA target sequence
taagacgaatccccaaggccaaa

SEQ ID NO: 101921 - DNA, 23 bp, Artificial sequence
  SiRNA target sequence
aagacgaatccccaaggccaaat

SEQ ID NO: 101922 - DNA, 23 bp, Artificial sequence
  SiRNA target sequence
agacgaatccccaaggccaaata

SEQ ID NO: 101923 - DNA, 23 bp, Artificial sequence
  SiRNA target sequence
gacgaatccccaaggccaaatac

SEQ ID NO: 101924 - DNA, 23 bp, Artificial sequence
  SiRNA target sequence
acgaatccccaaggccaaataca

SEQ ID NO: 101925 - DNA, 23 bp, Artificial sequence
  SiRNA target sequence
cgaatccccaaggccaaatacag

SEQ ID NO: 101926 - DNA, 23 bp, Artificial sequence
  SiRNA target sequence
gaatccccaaggccaaatacagc

SEQ ID NO: 101927 - DNA, 23 bp, Artificial sequence
  SiRNA target sequence
aatccccaaggccaaatacagca

SEQ ID NO: 101928 - DNA, 23 bp, Artificial sequence
  SiRNA target sequence
atccccaaggccaaatacagcaa

SEQ ID NO: 101929 - DNA, 23 bp, Artificial sequence
  SiRNA target sequence
tccccaaggccaaatacagcaaa

SEQ ID NO: 101930 - DNA, 23 bp, Artificial sequence
  SiRNA target sequence
ccccaaggccaaatacagcaaaa

SEQ ID NO: 101931 - DNA, 23 bp, Artificial sequence
  SiRNA target sequence
cccaaggccaaatacagcaaaat

SEQ ID NO: 101932 - DNA, 23 bp, Artificial sequence
  SiRNA target sequence
ccaaggccaaatacagcaaaatt

SEQ ID NO: 101933 - DNA, 23 bp, Artificial sequence
  SiRNA target sequence
caaggccaaatacagcaaaattt

SEQ ID NO: 101934 - DNA, 23 bp, Artificial sequence
  SiRNA target sequence
aaggccaaatacagcaaaattta

SEQ ID NO: 101935 - DNA, 23 bp, Artificial sequence
  SiRNA target sequence
aggccaaatacagcaaaatttaa

SEQ ID NO: 101936 - DNA, 23 bp, Artificial sequence
  SiRNA target sequence
ggccaaatacagcaaaatttaag

SEQ ID NO: 101937 - DNA, 23 bp, Artificial sequence
  SiRNA target sequence
gccaaatacagcaaaatttaagt

SEQ ID NO: 101938 - DNA, 23 bp, Artificial sequence
  SiRNA target sequence
ccaaatacagcaaaatttaagtg

SEQ ID NO: 101939 - DNA, 23 bp, Artificial sequence
  SiRNA target sequence
caaatacagcaaaatttaagtgt

SEQ ID NO: 101940 - DNA, 23 bp, Artificial sequence
  SiRNA target sequence
aaatacagcaaaatttaagtgtt

SEQ ID NO: 101941 - DNA, 23 bp, Artificial sequence
  SiRNA target sequence
aatacagcaaaatttaagtgttg

SEQ ID NO: 101942 - DNA, 23 bp, Artificial sequence
  SiRNA target sequence
atacagcaaaatttaagtgttgt

SEQ ID NO: 101943 - DNA, 23 bp, Artificial sequence
  SiRNA target sequence
tacagcaaaatttaagtgttgta

SEQ ID NO: 101944 - DNA, 23 bp, Artificial sequence
  SiRNA target sequence
acagcaaaatttaagtgttgtaa

SEQ ID NO: 101945 - DNA, 23 bp, Artificial sequence
  SiRNA target sequence
cagcaaaatttaagtgttgtaaa

SEQ ID NO: 101946 - DNA, 23 bp, Artificial sequence
  SiRNA target sequence
agcaaaatttaagtgttgtaaaa

SEQ ID NO: 101947 - DNA, 23 bp, Artificial sequence
  SiRNA target sequence
gcaaaatttaagtgttgtaaaaa

SEQ ID NO: 101948 - DNA, 23 bp, Artificial sequence
  SiRNA target sequence
caaaatttaagtgttgtaaaaaa

SEQ ID NO: 101949 - DNA, 23 bp, Artificial sequence
  SiRNA target sequence
aaaatttaagtgttgtaaaaaat

SEQ ID NO: 101950 - DNA, 23 bp, Artificial sequence
  SiRNA target sequence
aaatttaagtgttgtaaaaaatt

SEQ ID NO: 101951 - DNA, 23 bp, Artificial sequence
  SiRNA target sequence
aatttaagtgttgtaaaaaattt

SEQ ID NO: 101952 - DNA, 23 bp, Artificial sequence
  SiRNA target sequence
atttaagtgttgtaaaaaatttg

SEQ ID NO: 101953 - DNA, 23 bp, Artificial sequence
  SiRNA target sequence
tttaagtgttgtaaaaaatttgt

SEQ ID NO: 101954 - DNA, 23 bp, Artificial sequence
  SiRNA target sequence
ttaagtgttgtaaaaaatttgta

SEQ ID NO: 101955 - DNA, 23 bp, Artificial sequence
  SiRNA target sequence
taagtgttgtaaaaaatttgtag

SEQ ID NO: 101956 - DNA, 23 bp, Artificial sequence
  SiRNA target sequence
aagtgttgtaaaaaatttgtagg

SEQ ID NO: 101957 - DNA, 23 bp, Artificial sequence
  SiRNA target sequence
agtgttgtaaaaaatttgtaggc

SEQ ID NO: 101958 - DNA, 23 bp, Artificial sequence
  SiRNA target sequence
gtgttgtaaaaaatttgtaggca

SEQ ID NO: 101959 - DNA, 23 bp, Artificial sequence
  SiRNA target sequence
tgttgtaaaaaatttgtaggcag

SEQ ID NO: 101960 - DNA, 23 bp, Artificial sequence
  SiRNA target sequence
gttgtaaaaaatttgtaggcaga

SEQ ID NO: 101961 - DNA, 23 bp, Artificial sequence
  SiRNA target sequence
ttgtaaaaaatttgtaggcagat

SEQ ID NO: 101962 - DNA, 23 bp, Artificial sequence
  SiRNA target sequence
tgtaaaaaatttgtaggcagatt

SEQ ID NO: 101963 - DNA, 23 bp, Artificial sequence
  SiRNA target sequence
gtaaaaaatttgtaggcagattt

SEQ ID NO: 101964 - DNA, 23 bp, Artificial sequence
  SiRNA target sequence
taaaaaatttgtaggcagatttt

SEQ ID NO: 101965 - DNA, 23 bp, Artificial sequence
  SiRNA target sequence
aaaaaatttgtaggcagattttt

SEQ ID NO: 101966 - DNA, 23 bp, Artificial sequence
  SiRNA target sequence
aaaaatttgtaggcagatttttt

SEQ ID NO: 101967 - DNA, 23 bp, Artificial sequence
  SiRNA target sequence
aaaatttgtaggcagattttttt

SEQ ID NO: 101968 - DNA, 23 bp, Artificial sequence
  SiRNA target sequence
aaatttgtaggcagatttttttt

SEQ ID NO: 101969 - DNA, 23 bp, Artificial sequence
  SiRNA target sequence
aatttgtaggcagattttttttg

SEQ ID NO: 101970 - DNA, 23 bp, Artificial sequence
  SiRNA target sequence
atttgtaggcagattttttttgc

SEQ ID NO: 101971 - DNA, 23 bp, Artificial sequence
  SiRNA target sequence
tttgtaggcagattttttttgcg

SEQ ID NO: 101972 - DNA, 23 bp, Artificial sequence
  SiRNA target sequence
ttgtaggcagattttttttgcgc

SEQ ID NO: 101973 - DNA, 23 bp, Artificial sequence
  SiRNA target sequence
tgtaggcagattttttttgcgca

SEQ ID NO: 101974 - DNA, 23 bp, Artificial sequence
  SiRNA target sequence
gtaggcagattttttttgcgcaa

SEQ ID NO: 101975 - DNA, 23 bp, Artificial sequence
  SiRNA target sequence
taggcagattttttttgcgcaaa

SEQ ID NO: 101976 - DNA, 23 bp, Artificial sequence
  SiRNA target sequence
aggcagattttttttgcgcaaaa

SEQ ID NO: 101977 - DNA, 23 bp, Artificial sequence
  SiRNA target sequence
ggcagattttttttgcgcaaaaa

SEQ ID NO: 101978 - DNA, 23 bp, Artificial sequence
  SiRNA target sequence
gcagattttttttgcgcaaaaat

SEQ ID NO: 101979 - DNA, 23 bp, Artificial sequence
  SiRNA target sequence
cagattttttttgcgcaaaaatt

SEQ ID NO: 101980 - DNA, 23 bp, Artificial sequence
  SiRNA target sequence
agattttttttgcgcaaaaattt

SEQ ID NO: 101981 - DNA, 23 bp, Artificial sequence
  SiRNA target sequence
gattttttttgcgcaaaaatttc

SEQ ID NO: 101982 - DNA, 23 bp, Artificial sequence
  SiRNA target sequence
attttttttgcgcaaaaatttcc

SEQ ID NO: 101983 - DNA, 23 bp, Artificial sequence
  SiRNA target sequence
ttttttttgcgcaaaaatttcca

SEQ ID NO: 101984 - DNA, 23 bp, Artificial sequence
  SiRNA target sequence
tttttttgcgcaaaaatttccaa

SEQ ID NO: 101985 - DNA, 23 bp, Artificial sequence
  SiRNA target sequence
ttttttgcgcaaaaatttccaaa

SEQ ID NO: 101986 - DNA, 23 bp, Artificial sequence
  SiRNA target sequence
tttttgcgcaaaaatttccaaaa

SEQ ID NO: 101987 - DNA, 23 bp, Artificial sequence
  SiRNA target sequence
ttttgcgcaaaaatttccaaaat

SEQ ID NO: 101988 - DNA, 23 bp, Artificial sequence
  SiRNA target sequence
tttgcgcaaaaatttccaaaatt

SEQ ID NO: 101989 - DNA, 23 bp, Artificial sequence
  SiRNA target sequence
ttgcgcaaaaatttccaaaattt

SEQ ID NO: 101990 - DNA, 23 bp, Artificial sequence
  SiRNA target sequence
tgcgcaaaaatttccaaaattta

SEQ ID NO: 101991 - DNA, 23 bp, Artificial sequence
  SiRNA target sequence
gcgcaaaaatttccaaaatttag

SEQ ID NO: 101992 - DNA, 23 bp, Artificial sequence
  SiRNA target sequence
cgcaaaaatttccaaaatttagt

SEQ ID NO: 101993 - DNA, 23 bp, Artificial sequence
  SiRNA target sequence
gcaaaaatttccaaaatttagtc

SEQ ID NO: 101994 - DNA, 23 bp, Artificial sequence
  SiRNA target sequence
caaaaatttccaaaatttagtca

SEQ ID NO: 101995 - DNA, 23 bp, Artificial sequence
  SiRNA target sequence
aaaaatttccaaaatttagtcat

SEQ ID NO: 101996 - DNA, 23 bp, Artificial sequence
  SiRNA target sequence
aaaatttccaaaatttagtcatg

SEQ ID NO: 101997 - DNA, 23 bp, Artificial sequence
  SiRNA target sequence
aaatttccaaaatttagtcatgt

SEQ ID NO: 101998 - DNA, 23 bp, Artificial sequence
  SiRNA target sequence
aatttccaaaatttagtcatgtt

SEQ ID NO: 101999 - DNA, 23 bp, Artificial sequence
  SiRNA target sequence
atttccaaaatttagtcatgtta

SEQ ID NO: 102000 - DNA, 23 bp, Artificial sequence
  SiRNA target sequence
tttccaaaatttagtcatgttaa

SEQ ID NO: 102001 - DNA, 23 bp, Artificial sequence
  SiRNA target sequence
ttccaaaatttagtcatgttaaa

SEQ ID NO: 102002 - DNA, 23 bp, Artificial sequence
  SiRNA target sequence
tccaaaatttagtcatgttaaaa

SEQ ID NO: 102003 - DNA, 23 bp, Artificial sequence
  SiRNA target sequence
ccaaaatttagtcatgttaaaag

SEQ ID NO: 102004 - DNA, 23 bp, Artificial sequence
  SiRNA target sequence
caaaatttagtcatgttaaaagg

SEQ ID NO: 102005 - DNA, 23 bp, Artificial sequence
  SiRNA target sequence
aaaatttagtcatgttaaaaggt

SEQ ID NO: 102006 - DNA, 23 bp, Artificial sequence
  SiRNA target sequence
aaatttagtcatgttaaaaggtt

SEQ ID NO: 102007 - DNA, 23 bp, Artificial sequence
  SiRNA target sequence
aatttagtcatgttaaaaggttc

SEQ ID NO: 102008 - DNA, 23 bp, Artificial sequence
  SiRNA target sequence
atttagtcatgttaaaaggttca

SEQ ID NO: 102009 - DNA, 23 bp, Artificial sequence
  SiRNA target sequence
tttagtcatgttaaaaggttcag

SEQ ID NO: 102010 - DNA, 23 bp, Artificial sequence
  SiRNA target sequence
ttagtcatgttaaaaggttcaga

SEQ ID NO: 102011 - DNA, 23 bp, Artificial sequence
  SiRNA target sequence
tagtcatgttaaaaggttcagaa

SEQ ID NO: 102012 - DNA, 23 bp, Artificial sequence
  SiRNA target sequence
agtcatgttaaaaggttcagaac

SEQ ID NO: 102013 - DNA, 23 bp, Artificial sequence
  SiRNA target sequence
gtcatgttaaaaggttcagaacc

SEQ ID NO: 102014 - DNA, 23 bp, Artificial sequence
  SiRNA target sequence
tcatgttaaaaggttcagaacca

SEQ ID NO: 102015 - DNA, 23 bp, Artificial sequence
  SiRNA target sequence
catgttaaaaggttcagaaccat

SEQ ID NO: 102016 - DNA, 23 bp, Artificial sequence
  SiRNA target sequence
atgttaaaaggttcagaaccatt

SEQ ID NO: 102017 - DNA, 23 bp, Artificial sequence
  SiRNA target sequence
tgttaaaaggttcagaaccattc

SEQ ID NO: 102018 - DNA, 23 bp, Artificial sequence
  SiRNA target sequence
gttaaaaggttcagaaccattcc

SEQ ID NO: 102019 - DNA, 23 bp, Artificial sequence
  SiRNA target sequence
ttaaaaggttcagaaccattccc

SEQ ID NO: 102020 - DNA, 23 bp, Artificial sequence
  SiRNA target sequence
taaaaggttcagaaccattccca

SEQ ID NO: 102021 - DNA, 23 bp, Artificial sequence
  SiRNA target sequence
aaaaggttcagaaccattcccat

SEQ ID NO: 102022 - DNA, 23 bp, Artificial sequence
  SiRNA target sequence
aaaggttcagaaccattcccatg

SEQ ID NO: 102023 - DNA, 23 bp, Artificial sequence
  SiRNA target sequence
aaggttcagaaccattcccatga

SEQ ID NO: 102024 - DNA, 23 bp, Artificial sequence
  SiRNA target sequence
aggttcagaaccattcccatgag

SEQ ID NO: 102025 - DNA, 23 bp, Artificial sequence
  SiRNA target sequence
ggttcagaaccattcccatgagt

SEQ ID NO: 102026 - DNA, 23 bp, Artificial sequence
  SiRNA target sequence
gttcagaaccattcccatgagtc

SEQ ID NO: 102027 - DNA, 23 bp, Artificial sequence
  SiRNA target sequence
ttcagaaccattcccatgagtcg

SEQ ID NO: 102028 - DNA, 23 bp, Artificial sequence
  SiRNA target sequence
tcagaaccattcccatgagtcga

SEQ ID NO: 102029 - DNA, 23 bp, Artificial sequence
  SiRNA target sequence
cagaaccattcccatgagtcgaa

SEQ ID NO: 102030 - DNA, 23 bp, Artificial sequence
  SiRNA target sequence
agaaccattcccatgagtcgaac

SEQ ID NO: 102031 - DNA, 23 bp, Artificial sequence
  SiRNA target sequence
gaaccattcccatgagtcgaaca

SEQ ID NO: 102032 - DNA, 23 bp, Artificial sequence
  SiRNA target sequence
aaccattcccatgagtcgaacat

SEQ ID NO: 102033 - DNA, 23 bp, Artificial sequence
  SiRNA target sequence
accattcccatgagtcgaacata

SEQ ID NO: 102034 - DNA, 23 bp, Artificial sequence
  SiRNA target sequence
ccattcccatgagtcgaacatac

SEQ ID NO: 102035 - DNA, 23 bp, Artificial sequence
  SiRNA target sequence
cattcccatgagtcgaacataca

SEQ ID NO: 102036 - DNA, 23 bp, Artificial sequence
  SiRNA target sequence
attcccatgagtcgaacatacaa

SEQ ID NO: 102037 - DNA, 23 bp, Artificial sequence
  SiRNA target sequence
ttcccatgagtcgaacatacaaa

SEQ ID NO: 102038 - DNA, 23 bp, Artificial sequence
  SiRNA target sequence
tcccatgagtcgaacatacaaat

SEQ ID NO: 102039 - DNA, 23 bp, Artificial sequence
  SiRNA target sequence
cccatgagtcgaacatacaaata

SEQ ID NO: 102040 - DNA, 23 bp, Artificial sequence
  SiRNA target sequence
ccatgagtcgaacatacaaatat

SEQ ID NO: 102041 - DNA, 23 bp, Artificial sequence
  SiRNA target sequence
catgagtcgaacatacaaatata

SEQ ID NO: 102042 - DNA, 23 bp, Artificial sequence
  SiRNA target sequence
atgagtcgaacatacaaatataa

SEQ ID NO: 102043 - DNA, 23 bp, Artificial sequence
  SiRNA target sequence
tgagtcgaacatacaaatataat

SEQ ID NO: 102044 - DNA, 23 bp, Artificial sequence
  SiRNA target sequence
gagtcgaacatacaaatataatc

SEQ ID NO: 102045 - DNA, 23 bp, Artificial sequence
  SiRNA target sequence
agtcgaacatacaaatataatca

SEQ ID NO: 102046 - DNA, 23 bp, Artificial sequence
  SiRNA target sequence
gtcgaacatacaaatataatcat

SEQ ID NO: 102047 - DNA, 23 bp, Artificial sequence
  SiRNA target sequence
tcgaacatacaaatataatcata

SEQ ID NO: 102048 - DNA, 23 bp, Artificial sequence
  SiRNA target sequence
cgaacatacaaatataatcatat

SEQ ID NO: 102049 - DNA, 23 bp, Artificial sequence
  SiRNA target sequence
gaacatacaaatataatcatatc

SEQ ID NO: 102050 - DNA, 23 bp, Artificial sequence
  SiRNA target sequence
aacatacaaatataatcatatca

SEQ ID NO: 102051 - DNA, 23 bp, Artificial sequence
  SiRNA target sequence
acatacaaatataatcatatcaa

SEQ ID NO: 102052 - DNA, 23 bp, Artificial sequence
  SiRNA target sequence
catacaaatataatcatatcaat

SEQ ID NO: 102053 - DNA, 23 bp, Artificial sequence
  SiRNA target sequence
atacaaatataatcatatcaata

SEQ ID NO: 102054 - DNA, 23 bp, Artificial sequence
  SiRNA target sequence
tacaaatataatcatatcaatat

SEQ ID NO: 102055 - DNA, 23 bp, Artificial sequence
  SiRNA target sequence
acaaatataatcatatcaatatc

SEQ ID NO: 102056 - DNA, 23 bp, Artificial sequence
  SiRNA target sequence
caaatataatcatatcaatatct

SEQ ID NO: 102057 - DNA, 23 bp, Artificial sequence
  SiRNA target sequence
aaatataatcatatcaatatcta

SEQ ID NO: 102058 - DNA, 23 bp, Artificial sequence
  SiRNA target sequence
aatataatcatatcaatatctaa

SEQ ID NO: 102059 - DNA, 23 bp, Artificial sequence
  SiRNA target sequence
atataatcatatcaatatctaat

SEQ ID NO: 102060 - DNA, 23 bp, Artificial sequence
  SiRNA target sequence
tataatcatatcaatatctaata

SEQ ID NO: 102061 - DNA, 23 bp, Artificial sequence
  SiRNA target sequence
ataatcatatcaatatctaatat

SEQ ID NO: 102062 - DNA, 23 bp, Artificial sequence
  SiRNA target sequence
taatcatatcaatatctaatatt

SEQ ID NO: 102063 - DNA, 23 bp, Artificial sequence
  SiRNA target sequence
aatcatatcaatatctaatattt

SEQ ID NO: 102064 - DNA, 23 bp, Artificial sequence
  SiRNA target sequence
atcatatcaatatctaatatttt

SEQ ID NO: 102065 - DNA, 23 bp, Artificial sequence
  SiRNA target sequence
tcatatcaatatctaatattttt

SEQ ID NO: 102066 - DNA, 23 bp, Artificial sequence
  SiRNA target sequence
catatcaatatctaatatttttt

SEQ ID NO: 102067 - DNA, 23 bp, Artificial sequence
  SiRNA target sequence
atatcaatatctaatattttttc

SEQ ID NO: 102068 - DNA, 23 bp, Artificial sequence
  SiRNA target sequence
tatcaatatctaatattttttcg

SEQ ID NO: 102069 - DNA, 23 bp, Artificial sequence
  SiRNA target sequence
atcaatatctaatattttttcga

SEQ ID NO: 102070 - DNA, 23 bp, Artificial sequence
  SiRNA target sequence
tcaatatctaatattttttcgaa

SEQ ID NO: 102071 - DNA, 23 bp, Artificial sequence
  SiRNA target sequence
caatatctaatattttttcgaaa

SEQ ID NO: 102072 - DNA, 23 bp, Artificial sequence
  SiRNA target sequence
aatatctaatattttttcgaaat

SEQ ID NO: 102073 - DNA, 23 bp, Artificial sequence
  SiRNA target sequence
atatctaatattttttcgaaatc

SEQ ID NO: 102074 - DNA, 23 bp, Artificial sequence
  SiRNA target sequence
tatctaatattttttcgaaatca

SEQ ID NO: 102075 - DNA, 23 bp, Artificial sequence
  SiRNA target sequence
atctaatattttttcgaaatcaa

SEQ ID NO: 102076 - DNA, 23 bp, Artificial sequence
  SiRNA target sequence
tctaatattttttcgaaatcaaa

SEQ ID NO: 102077 - DNA, 23 bp, Artificial sequence
  SiRNA target sequence
ctaatattttttcgaaatcaaaa

SEQ ID NO: 102078 - DNA, 23 bp, Artificial sequence
  SiRNA target sequence
taatattttttcgaaatcaaaac

SEQ ID NO: 102079 - DNA, 23 bp, Artificial sequence
  SiRNA target sequence
aatattttttcgaaatcaaaact

SEQ ID NO: 102080 - DNA, 23 bp, Artificial sequence
  SiRNA target sequence
atattttttcgaaatcaaaactg

SEQ ID NO: 102081 - DNA, 23 bp, Artificial sequence
  SiRNA target sequence
tattttttcgaaatcaaaactgt

SEQ ID NO: 102082 - DNA, 23 bp, Artificial sequence
  SiRNA target sequence
attttttcgaaatcaaaactgtc

SEQ ID NO: 102083 - DNA, 23 bp, Artificial sequence
  SiRNA target sequence
ttttttcgaaatcaaaactgtcc

SEQ ID NO: 102084 - DNA, 23 bp, Artificial sequence
  SiRNA target sequence
tttttcgaaatcaaaactgtcca

SEQ ID NO: 102085 - DNA, 23 bp, Artificial sequence
  SiRNA target sequence
ttttcgaaatcaaaactgtccat

SEQ ID NO: 102086 - DNA, 23 bp, Artificial sequence
  SiRNA target sequence
tttcgaaatcaaaactgtccata

SEQ ID NO: 102087 - DNA, 23 bp, Artificial sequence
  SiRNA target sequence
ttcgaaatcaaaactgtccatat

SEQ ID NO: 102088 - DNA, 23 bp, Artificial sequence
  SiRNA target sequence
tcgaaatcaaaactgtccatatc

SEQ ID NO: 102089 - DNA, 23 bp, Artificial sequence
  SiRNA target sequence
cgaaatcaaaactgtccatatct

SEQ ID NO: 102090 - DNA, 23 bp, Artificial sequence
  SiRNA target sequence
gaaatcaaaactgtccatatcta

SEQ ID NO: 102091 - DNA, 23 bp, Artificial sequence
  SiRNA target sequence
aaatcaaaactgtccatatctaa

SEQ ID NO: 102092 - DNA, 23 bp, Artificial sequence
  SiRNA target sequence
aatcaaaactgtccatatctaaa

SEQ ID NO: 102093 - DNA, 23 bp, Artificial sequence
  SiRNA target sequence
atcaaaactgtccatatctaaag

SEQ ID NO: 102094 - DNA, 23 bp, Artificial sequence
  SiRNA target sequence
tcaaaactgtccatatctaaagt

SEQ ID NO: 102095 - DNA, 23 bp, Artificial sequence
  SiRNA target sequence
caaaactgtccatatctaaagta

SEQ ID NO: 102096 - DNA, 23 bp, Artificial sequence
  SiRNA target sequence
aaaactgtccatatctaaagtaa

SEQ ID NO: 102097 - DNA, 23 bp, Artificial sequence
  SiRNA target sequence
aaactgtccatatctaaagtaaa

SEQ ID NO: 102098 - DNA, 23 bp, Artificial sequence
  SiRNA target sequence
aactgtccatatctaaagtaaaa

SEQ ID NO: 102099 - DNA, 23 bp, Artificial sequence
  SiRNA target sequence
actgtccatatctaaagtaaaat

SEQ ID NO: 102100 - DNA, 23 bp, Artificial sequence
  SiRNA target sequence
ctgtccatatctaaagtaaaatc

SEQ ID NO: 102101 - DNA, 23 bp, Artificial sequence
  SiRNA target sequence
tgtccatatctaaagtaaaatct

SEQ ID NO: 102102 - DNA, 23 bp, Artificial sequence
  SiRNA target sequence
gtccatatctaaagtaaaatctg

SEQ ID NO: 102103 - DNA, 23 bp, Artificial sequence
  SiRNA target sequence
tccatatctaaagtaaaatctgt

SEQ ID NO: 102104 - DNA, 23 bp, Artificial sequence
  SiRNA target sequence
ccatatctaaagtaaaatctgtt

SEQ ID NO: 102105 - DNA, 23 bp, Artificial sequence
  SiRNA target sequence
catatctaaagtaaaatctgttg

SEQ ID NO: 102106 - DNA, 23 bp, Artificial sequence
  SiRNA target sequence
atatctaaagtaaaatctgttgg

SEQ ID NO: 102107 - DNA, 23 bp, Artificial sequence
  SiRNA target sequence
tatctaaagtaaaatctgttgga

SEQ ID NO: 102108 - DNA, 23 bp, Artificial sequence
  SiRNA target sequence
atctaaagtaaaatctgttggaa

SEQ ID NO: 102109 - DNA, 23 bp, Artificial sequence
  SiRNA target sequence
tctaaagtaaaatctgttggaag

SEQ ID NO: 102110 - DNA, 23 bp, Artificial sequence
  SiRNA target sequence
ctaaagtaaaatctgttggaagc

SEQ ID NO: 102111 - DNA, 23 bp, Artificial sequence
  SiRNA target sequence
taaagtaaaatctgttggaagca

SEQ ID NO: 102112 - DNA, 23 bp, Artificial sequence
  SiRNA target sequence
aaagtaaaatctgttggaagcaa

SEQ ID NO: 102113 - DNA, 23 bp, Artificial sequence
  SiRNA target sequence
aagtaaaatctgttggaagcaat

SEQ ID NO: 102114 - DNA, 23 bp, Artificial sequence
  SiRNA target sequence
agtaaaatctgttggaagcaatt

SEQ ID NO: 102115 - DNA, 23 bp, Artificial sequence
  SiRNA target sequence
gtaaaatctgttggaagcaattc

SEQ ID NO: 102116 - DNA, 23 bp, Artificial sequence
  SiRNA target sequence
taaaatctgttggaagcaattct

SEQ ID NO: 102117 - DNA, 23 bp, Artificial sequence
  SiRNA target sequence
aaaatctgttggaagcaattctt

SEQ ID NO: 102118 - DNA, 23 bp, Artificial sequence
  SiRNA target sequence
aaatctgttggaagcaattcttt

SEQ ID NO: 102119 - DNA, 23 bp, Artificial sequence
  SiRNA target sequence
aatctgttggaagcaattcttta

SEQ ID NO: 102120 - DNA, 23 bp, Artificial sequence
  SiRNA target sequence
atctgttggaagcaattctttat

SEQ ID NO: 102121 - DNA, 23 bp, Artificial sequence
  SiRNA target sequence
tctgttggaagcaattctttatc

SEQ ID NO: 102122 - DNA, 23 bp, Artificial sequence
  SiRNA target sequence
ctgttggaagcaattctttatca

SEQ ID NO: 102123 - DNA, 23 bp, Artificial sequence
  SiRNA target sequence
tgttggaagcaattctttatcaa

SEQ ID NO: 102124 - DNA, 23 bp, Artificial sequence
  SiRNA target sequence
gttggaagcaattctttatcaac

SEQ ID NO: 102125 - DNA, 23 bp, Artificial sequence
  SiRNA target sequence
ttggaagcaattctttatcaacg

SEQ ID NO: 102126 - DNA, 23 bp, Artificial sequence
  SiRNA target sequence
tggaagcaattctttatcaacgt

SEQ ID NO: 102127 - DNA, 23 bp, Artificial sequence
  SiRNA target sequence
ggaagcaattctttatcaacgtt

SEQ ID NO: 102128 - DNA, 23 bp, Artificial sequence
  SiRNA target sequence
gaagcaattctttatcaacgtta

SEQ ID NO: 102129 - DNA, 23 bp, Artificial sequence
  SiRNA target sequence
aagcaattctttatcaacgttat

SEQ ID NO: 102130 - DNA, 23 bp, Artificial sequence
  SiRNA target sequence
agcaattctttatcaacgttata

SEQ ID NO: 102131 - DNA, 23 bp, Artificial sequence
  SiRNA target sequence
gcaattctttatcaacgttataa

SEQ ID NO: 102132 - DNA, 23 bp, Artificial sequence
  SiRNA target sequence
caattctttatcaacgttataaa

SEQ ID NO: 102133 - DNA, 23 bp, Artificial sequence
  SiRNA target sequence
aattctttatcaacgttataaat

SEQ ID NO: 102134 - DNA, 23 bp, Artificial sequence
  SiRNA target sequence
attctttatcaacgttataaatc

SEQ ID NO: 102135 - DNA, 23 bp, Artificial sequence
  SiRNA target sequence
ttctttatcaacgttataaatca

SEQ ID NO: 102136 - DNA, 23 bp, Artificial sequence
  SiRNA target sequence
tctttatcaacgttataaatcaa

SEQ ID NO: 102137 - DNA, 23 bp, Artificial sequence
  SiRNA target sequence
ctttatcaacgttataaatcaaa

SEQ ID NO: 102138 - DNA, 23 bp, Artificial sequence
  SiRNA target sequence
tttatcaacgttataaatcaaat

SEQ ID NO: 102139 - DNA, 23 bp, Artificial sequence
  SiRNA target sequence
ttatcaacgttataaatcaaatc

SEQ ID NO: 102140 - DNA, 23 bp, Artificial sequence
  SiRNA target sequence
tatcaacgttataaatcaaatct

SEQ ID NO: 102141 - DNA, 23 bp, Artificial sequence
  SiRNA target sequence
atcaacgttataaatcaaatctt

SEQ ID NO: 102142 - DNA, 23 bp, Artificial sequence
  SiRNA target sequence
tcaacgttataaatcaaatcttt

SEQ ID NO: 102143 - DNA, 23 bp, Artificial sequence
  SiRNA target sequence
caacgttataaatcaaatcttta

SEQ ID NO: 102144 - DNA, 23 bp, Artificial sequence
  SiRNA target sequence
aacgttataaatcaaatctttat

SEQ ID NO: 102145 - DNA, 23 bp, Artificial sequence
  SiRNA target sequence
acgttataaatcaaatctttatt

SEQ ID NO: 102146 - DNA, 23 bp, Artificial sequence
  SiRNA target sequence
cgttataaatcaaatctttattg

SEQ ID NO: 102147 - DNA, 23 bp, Artificial sequence
  SiRNA target sequence
gttataaatcaaatctttattgt

SEQ ID NO: 102148 - DNA, 23 bp, Artificial sequence
  SiRNA target sequence
ttataaatcaaatctttattgta

SEQ ID NO: 102149 - DNA, 23 bp, Artificial sequence
  SiRNA target sequence
tataaatcaaatctttattgtat

SEQ ID NO: 102150 - DNA, 23 bp, Artificial sequence
  SiRNA target sequence
ataaatcaaatctttattgtatc

SEQ ID NO: 102151 - DNA, 23 bp, Artificial sequence
  SiRNA target sequence
taaatcaaatctttattgtatcc

SEQ ID NO: 102152 - DNA, 23 bp, Artificial sequence
  SiRNA target sequence
aaatcaaatctttattgtatccg

SEQ ID NO: 102153 - DNA, 23 bp, Artificial sequence
  SiRNA target sequence
aatcaaatctttattgtatccgt

SEQ ID NO: 102154 - DNA, 23 bp, Artificial sequence
  SiRNA target sequence
atcaaatctttattgtatccgta

SEQ ID NO: 102155 - DNA, 23 bp, Artificial sequence
  SiRNA target sequence
tcaaatctttattgtatccgtat

SEQ ID NO: 102156 - DNA, 23 bp, Artificial sequence
  SiRNA target sequence
caaatctttattgtatccgtata

SEQ ID NO: 102157 - DNA, 23 bp, Artificial sequence
  SiRNA target sequence
aaatctttattgtatccgtatag

SEQ ID NO: 102158 - DNA, 23 bp, Artificial sequence
  SiRNA target sequence
aatctttattgtatccgtatagt

SEQ ID NO: 102159 - DNA, 23 bp, Artificial sequence
  SiRNA target sequence
atctttattgtatccgtatagta

SEQ ID NO: 102160 - DNA, 23 bp, Artificial sequence
  SiRNA target sequence
tctttattgtatccgtatagtat

SEQ ID NO: 102161 - DNA, 23 bp, Artificial sequence
  SiRNA target sequence
ctttattgtatccgtatagtata

SEQ ID NO: 102162 - DNA, 23 bp, Artificial sequence
  SiRNA target sequence
tttattgtatccgtatagtataa

SEQ ID NO: 102163 - DNA, 23 bp, Artificial sequence
  SiRNA target sequence
ttattgtatccgtatagtataac

SEQ ID NO: 102164 - DNA, 23 bp, Artificial sequence
  SiRNA target sequence
tattgtatccgtatagtataaca

SEQ ID NO: 102165 - DNA, 23 bp, Artificial sequence
  SiRNA target sequence
attgtatccgtatagtataacat

SEQ ID NO: 102166 - DNA, 23 bp, Artificial sequence
  SiRNA target sequence
ttgtatccgtatagtataacatt

SEQ ID NO: 102167 - DNA, 23 bp, Artificial sequence
  SiRNA target sequence
tgtatccgtatagtataacattt

SEQ ID NO: 102168 - DNA, 23 bp, Artificial sequence
  SiRNA target sequence
gtatccgtatagtataacatttt

SEQ ID NO: 102169 - DNA, 23 bp, Artificial sequence
  SiRNA target sequence
tatccgtatagtataacattttg

SEQ ID NO: 102170 - DNA, 23 bp, Artificial sequence
  SiRNA target sequence
atccgtatagtataacattttga

SEQ ID NO: 102171 - DNA, 23 bp, Artificial sequence
  SiRNA target sequence
tccgtatagtataacattttgaa

SEQ ID NO: 102172 - DNA, 23 bp, Artificial sequence
  SiRNA target sequence
ccgtatagtataacattttgaat

SEQ ID NO: 102173 - DNA, 23 bp, Artificial sequence
  SiRNA target sequence
cgtatagtataacattttgaata

SEQ ID NO: 102174 - DNA, 23 bp, Artificial sequence
  SiRNA target sequence
gtatagtataacattttgaataa

SEQ ID NO: 102175 - DNA, 23 bp, Artificial sequence
  SiRNA target sequence
tatagtataacattttgaataag

SEQ ID NO: 102176 - DNA, 23 bp, Artificial sequence
  SiRNA target sequence
atagtataacattttgaataagt

SEQ ID NO: 102177 - DNA, 23 bp, Artificial sequence
  SiRNA target sequence
tagtataacattttgaataagtt

SEQ ID NO: 102178 - DNA, 23 bp, Artificial sequence
  SiRNA target sequence
agtataacattttgaataagttt

SEQ ID NO: 102179 - DNA, 23 bp, Artificial sequence
  SiRNA target sequence
gtataacattttgaataagttta

SEQ ID NO: 102180 - DNA, 23 bp, Artificial sequence
  SiRNA target sequence
tataacattttgaataagtttag

SEQ ID NO: 102181 - DNA, 23 bp, Artificial sequence
  SiRNA target sequence
ataacattttgaataagtttagc

SEQ ID NO: 102182 - DNA, 23 bp, Artificial sequence
  SiRNA target sequence
taacattttgaataagtttagca

SEQ ID NO: 102183 - DNA, 23 bp, Artificial sequence
  SiRNA target sequence
aacattttgaataagtttagcaa

SEQ ID NO: 102184 - DNA, 23 bp, Artificial sequence
  SiRNA target sequence
acattttgaataagtttagcaat

SEQ ID NO: 102185 - DNA, 23 bp, Artificial sequence
  SiRNA target sequence
cattttgaataagtttagcaata

SEQ ID NO: 102186 - DNA, 23 bp, Artificial sequence
  SiRNA target sequence
attttgaataagtttagcaatat

SEQ ID NO: 102187 - DNA, 23 bp, Artificial sequence
  SiRNA target sequence
ttttgaataagtttagcaatatg

SEQ ID NO: 102188 - DNA, 23 bp, Artificial sequence
  SiRNA target sequence
tttgaataagtttagcaatatgt

SEQ ID NO: 102189 - DNA, 23 bp, Artificial sequence
  SiRNA target sequence
ttgaataagtttagcaatatgta

SEQ ID NO: 102190 - DNA, 23 bp, Artificial sequence
  SiRNA target sequence
tgaataagtttagcaatatgtat

SEQ ID NO: 102191 - DNA, 23 bp, Artificial sequence
  SiRNA target sequence
gaataagtttagcaatatgtata

SEQ ID NO: 102192 - DNA, 23 bp, Artificial sequence
  SiRNA target sequence
aataagtttagcaatatgtatag

SEQ ID NO: 102193 - DNA, 23 bp, Artificial sequence
  SiRNA target sequence
ataagtttagcaatatgtataga

SEQ ID NO: 102194 - DNA, 23 bp, Artificial sequence
  SiRNA target sequence
taagtttagcaatatgtatagaa

SEQ ID NO: 102195 - DNA, 23 bp, Artificial sequence
  SiRNA target sequence
aagtttagcaatatgtatagaat

SEQ ID NO: 102196 - DNA, 23 bp, Artificial sequence
  SiRNA target sequence
agtttagcaatatgtatagaatt

SEQ ID NO: 102197 - DNA, 23 bp, Artificial sequence
  SiRNA target sequence
gtttagcaatatgtatagaattt

SEQ ID NO: 102198 - DNA, 23 bp, Artificial sequence
  SiRNA target sequence
tttagcaatatgtatagaatttc

SEQ ID NO: 102199 - DNA, 23 bp, Artificial sequence
  SiRNA target sequence
ttagcaatatgtatagaatttcc

SEQ ID NO: 102200 - DNA, 23 bp, Artificial sequence
  SiRNA target sequence
tagcaatatgtatagaatttcct

SEQ ID NO: 102201 - DNA, 23 bp, Artificial sequence
  SiRNA target sequence
agcaatatgtatagaatttcctg

SEQ ID NO: 102202 - DNA, 23 bp, Artificial sequence
  SiRNA target sequence
gcaatatgtatagaatttcctgt

SEQ ID NO: 102203 - DNA, 23 bp, Artificial sequence
  SiRNA target sequence
caatatgtatagaatttcctgtt

SEQ ID NO: 102204 - DNA, 23 bp, Artificial sequence
  SiRNA target sequence
aatatgtatagaatttcctgttt

SEQ ID NO: 102205 - DNA, 23 bp, Artificial sequence
  SiRNA target sequence
atatgtatagaatttcctgtttg

SEQ ID NO: 102206 - DNA, 23 bp, Artificial sequence
  SiRNA target sequence
tatgtatagaatttcctgtttgg

SEQ ID NO: 102207 - DNA, 23 bp, Artificial sequence
  SiRNA target sequence
atgtatagaatttcctgtttggg

SEQ ID NO: 102208 - DNA, 23 bp, Artificial sequence
  SiRNA target sequence
tgtatagaatttcctgtttggga

SEQ ID NO: 102209 - DNA, 23 bp, Artificial sequence
  SiRNA target sequence
gtatagaatttcctgtttgggag

SEQ ID NO: 102210 - DNA, 23 bp, Artificial sequence
  SiRNA target sequence
tatagaatttcctgtttgggagc

SEQ ID NO: 102211 - DNA, 23 bp, Artificial sequence
  SiRNA target sequence
atagaatttcctgtttgggagcc

SEQ ID NO: 102212 - DNA, 23 bp, Artificial sequence
  SiRNA target sequence
tagaatttcctgtttgggagcca

SEQ ID NO: 102213 - DNA, 23 bp, Artificial sequence
  SiRNA target sequence
agaatttcctgtttgggagccat

SEQ ID NO: 102214 - DNA, 23 bp, Artificial sequence
  SiRNA target sequence
gaatttcctgtttgggagccata

SEQ ID NO: 102215 - DNA, 23 bp, Artificial sequence
  SiRNA target sequence
aatttcctgtttgggagccatat

SEQ ID NO: 102216 - DNA, 23 bp, Artificial sequence
  SiRNA target sequence
atttcctgtttgggagccatata

SEQ ID NO: 102217 - DNA, 23 bp, Artificial sequence
  SiRNA target sequence
tttcctgtttgggagccatataa

SEQ ID NO: 102218 - DNA, 23 bp, Artificial sequence
  SiRNA target sequence
ttcctgtttgggagccatataag

SEQ ID NO: 102219 - DNA, 23 bp, Artificial sequence
  SiRNA target sequence
tcctgtttgggagccatataaga

SEQ ID NO: 102220 - DNA, 23 bp, Artificial sequence
  SiRNA target sequence
cctgtttgggagccatataagat

SEQ ID NO: 102221 - DNA, 23 bp, Artificial sequence
  SiRNA target sequence
ctgtttgggagccatataagatt

SEQ ID NO: 102222 - DNA, 23 bp, Artificial sequence
  SiRNA target sequence
tgtttgggagccatataagatta

SEQ ID NO: 102223 - DNA, 23 bp, Artificial sequence
  SiRNA target sequence
gtttgggagccatataagattat

SEQ ID NO: 102224 - DNA, 23 bp, Artificial sequence
  SiRNA target sequence
tttgggagccatataagattatc

SEQ ID NO: 102225 - DNA, 23 bp, Artificial sequence
  SiRNA target sequence
ttgggagccatataagattatca

SEQ ID NO: 102226 - DNA, 23 bp, Artificial sequence
  SiRNA target sequence
tgggagccatataagattatcat

SEQ ID NO: 102227 - DNA, 24 bp, Artificial sequence
  SiRNA target sequence
ttaccaagtttctgcctgaaaata

SEQ ID NO: 102228 - DNA, 24 bp, Artificial sequence
  SiRNA target sequence
taccaagtttctgcctgaaaatat

SEQ ID NO: 102229 - DNA, 24 bp, Artificial sequence
  SiRNA target sequence
accaagtttctgcctgaaaatata

SEQ ID NO: 102230 - DNA, 24 bp, Artificial sequence
  SiRNA target sequence
ccaagtttctgcctgaaaatatat

SEQ ID NO: 102231 - DNA, 24 bp, Artificial sequence
  SiRNA target sequence
caagtttctgcctgaaaatatatt

SEQ ID NO: 102232 - DNA, 24 bp, Artificial sequence
  SiRNA target sequence
aagtttctgcctgaaaatatattt

SEQ ID NO: 102233 - DNA, 24 bp, Artificial sequence
  SiRNA target sequence
agtttctgcctgaaaatatatttt

SEQ ID NO: 102234 - DNA, 24 bp, Artificial sequence
  SiRNA target sequence
gtttctgcctgaaaatatattttc

SEQ ID NO: 102235 - DNA, 24 bp, Artificial sequence
  SiRNA target sequence
tttctgcctgaaaatatattttct

SEQ ID NO: 102236 - DNA, 24 bp, Artificial sequence
  SiRNA target sequence
ttctgcctgaaaatatattttctt

SEQ ID NO: 102237 - DNA, 24 bp, Artificial sequence
  SiRNA target sequence
tctgcctgaaaatatattttcttt

SEQ ID NO: 102238 - DNA, 24 bp, Artificial sequence
  SiRNA target sequence
ctgcctgaaaatatattttctttt

SEQ ID NO: 102239 - DNA, 24 bp, Artificial sequence
  SiRNA target sequence
tgcctgaaaatatattttcttttt

SEQ ID NO: 102240 - DNA, 24 bp, Artificial sequence
  SiRNA target sequence
gcctgaaaatatattttcttttta

SEQ ID NO: 102241 - DNA, 24 bp, Artificial sequence
  SiRNA target sequence
cctgaaaatatattttctttttat

SEQ ID NO: 102242 - DNA, 24 bp, Artificial sequence
  SiRNA target sequence
ctgaaaatatattttctttttata

SEQ ID NO: 102243 - DNA, 24 bp, Artificial sequence
  SiRNA target sequence
tgaaaatatattttctttttataa

SEQ ID NO: 102244 - DNA, 24 bp, Artificial sequence
  SiRNA target sequence
gaaaatatattttctttttataaa

SEQ ID NO: 102245 - DNA, 24 bp, Artificial sequence
  SiRNA target sequence
aaaatatattttctttttataaat

SEQ ID NO: 102246 - DNA, 24 bp, Artificial sequence
  SiRNA target sequence
aaatatattttctttttataaata

SEQ ID NO: 102247 - DNA, 24 bp, Artificial sequence
  SiRNA target sequence
aatatattttctttttataaatat

SEQ ID NO: 102248 - DNA, 24 bp, Artificial sequence
  SiRNA target sequence
atatattttctttttataaatatc

SEQ ID NO: 102249 - DNA, 24 bp, Artificial sequence
  SiRNA target sequence
tatattttctttttataaatatct

SEQ ID NO: 102250 - DNA, 24 bp, Artificial sequence
  SiRNA target sequence
atattttctttttataaatatcta

SEQ ID NO: 102251 - DNA, 24 bp, Artificial sequence
  SiRNA target sequence
tattttctttttataaatatctaa

SEQ ID NO: 102252 - DNA, 24 bp, Artificial sequence
  SiRNA target sequence
attttctttttataaatatctaat

SEQ ID NO: 102253 - DNA, 24 bp, Artificial sequence
  SiRNA target sequence
ttttctttttataaatatctaata

SEQ ID NO: 102254 - DNA, 24 bp, Artificial sequence
  SiRNA target sequence
tttctttttataaatatctaataa

SEQ ID NO: 102255 - DNA, 24 bp, Artificial sequence
  SiRNA target sequence
ttctttttataaatatctaataac

SEQ ID NO: 102256 - DNA, 24 bp, Artificial sequence
  SiRNA target sequence
tctttttataaatatctaataaca

SEQ ID NO: 102257 - DNA, 24 bp, Artificial sequence
  SiRNA target sequence
ctttttataaatatctaataacat

SEQ ID NO: 102258 - DNA, 24 bp, Artificial sequence
  SiRNA target sequence
tttttataaatatctaataacatt

SEQ ID NO: 102259 - DNA, 24 bp, Artificial sequence
  SiRNA target sequence
ttttataaatatctaataacattt

SEQ ID NO: 102260 - DNA, 24 bp, Artificial sequence
  SiRNA target sequence
tttataaatatctaataacatttt

SEQ ID NO: 102261 - DNA, 24 bp, Artificial sequence
  SiRNA target sequence
ttataaatatctaataacattttt

SEQ ID NO: 102262 - DNA, 24 bp, Artificial sequence
  SiRNA target sequence
tataaatatctaataacatttttt

SEQ ID NO: 102263 - DNA, 24 bp, Artificial sequence
  SiRNA target sequence
ataaatatctaataacattttttc

SEQ ID NO: 102264 - DNA, 24 bp, Artificial sequence
  SiRNA target sequence
taaatatctaataacattttttca

SEQ ID NO: 102265 - DNA, 24 bp, Artificial sequence
  SiRNA target sequence
aaatatctaataacattttttcaa

SEQ ID NO: 102266 - DNA, 24 bp, Artificial sequence
  SiRNA target sequence
aatatctaataacattttttcaat

SEQ ID NO: 102267 - DNA, 24 bp, Artificial sequence
  SiRNA target sequence
atatctaataacattttttcaata

SEQ ID NO: 102268 - DNA, 24 bp, Artificial sequence
  SiRNA target sequence
tatctaataacattttttcaataa

SEQ ID NO: 102269 - DNA, 24 bp, Artificial sequence
  SiRNA target sequence
atctaataacattttttcaataat

SEQ ID NO: 102270 - DNA, 24 bp, Artificial sequence
  SiRNA target sequence
tctaataacattttttcaataata

SEQ ID NO: 102271 - DNA, 24 bp, Artificial sequence
  SiRNA target sequence
ctaataacattttttcaataatat

SEQ ID NO: 102272 - DNA, 24 bp, Artificial sequence
  SiRNA target sequence
taataacattttttcaataatatt

SEQ ID NO: 102273 - DNA, 24 bp, Artificial sequence
  SiRNA target sequence
aataacattttttcaataatatta

SEQ ID NO: 102274 - DNA, 24 bp, Artificial sequence
  SiRNA target sequence
ataacattttttcaataatattat

SEQ ID NO: 102275 - DNA, 24 bp, Artificial sequence
  SiRNA target sequence
taacattttttcaataatattatt

SEQ ID NO: 102276 - DNA, 24 bp, Artificial sequence
  SiRNA target sequence
aacattttttcaataatattatta

SEQ ID NO: 102277 - DNA, 24 bp, Artificial sequence
  SiRNA target sequence
acattttttcaataatattattaa

SEQ ID NO: 102278 - DNA, 24 bp, Artificial sequence
  SiRNA target sequence
cattttttcaataatattattaag

SEQ ID NO: 102279 - DNA, 24 bp, Artificial sequence
  SiRNA target sequence
attttttcaataatattattaagt

SEQ ID NO: 102280 - DNA, 24 bp, Artificial sequence
  SiRNA target sequence
ttttttcaataatattattaagtc

SEQ ID NO: 102281 - DNA, 24 bp, Artificial sequence
  SiRNA target sequence
tttttcaataatattattaagtct

SEQ ID NO: 102282 - DNA, 24 bp, Artificial sequence
  SiRNA target sequence
ttttcaataatattattaagtcta

SEQ ID NO: 102283 - DNA, 24 bp, Artificial sequence
  SiRNA target sequence
tttcaataatattattaagtctag

SEQ ID NO: 102284 - DNA, 24 bp, Artificial sequence
  SiRNA target sequence
ttcaataatattattaagtctaga

SEQ ID NO: 102285 - DNA, 24 bp, Artificial sequence
  SiRNA target sequence
tcaataatattattaagtctagaa

SEQ ID NO: 102286 - DNA, 24 bp, Artificial sequence
  SiRNA target sequence
caataatattattaagtctagaat

SEQ ID NO: 102287 - DNA, 24 bp, Artificial sequence
  SiRNA target sequence
aataatattattaagtctagaatt

SEQ ID NO: 102288 - DNA, 24 bp, Artificial sequence
  SiRNA target sequence
ataatattattaagtctagaattt

SEQ ID NO: 102289 - DNA, 24 bp, Artificial sequence
  SiRNA target sequence
taatattattaagtctagaatttc

SEQ ID NO: 102290 - DNA, 24 bp, Artificial sequence
  SiRNA target sequence
aatattattaagtctagaatttcc

SEQ ID NO: 102291 - DNA, 24 bp, Artificial sequence
  SiRNA target sequence
atattattaagtctagaatttcca

SEQ ID NO: 102292 - DNA, 24 bp, Artificial sequence
  SiRNA target sequence
tattattaagtctagaatttccac

SEQ ID NO: 102293 - DNA, 24 bp, Artificial sequence
  SiRNA target sequence
attattaagtctagaatttccact

SEQ ID NO: 102294 - DNA, 24 bp, Artificial sequence
  SiRNA target sequence
ttattaagtctagaatttccactt

SEQ ID NO: 102295 - DNA, 24 bp, Artificial sequence
  SiRNA target sequence
tattaagtctagaatttccactta

SEQ ID NO: 102296 - DNA, 24 bp, Artificial sequence
  SiRNA target sequence
attaagtctagaatttccacttac

SEQ ID NO: 102297 - DNA, 24 bp, Artificial sequence
  SiRNA target sequence
ttaagtctagaatttccacttaca

SEQ ID NO: 102298 - DNA, 24 bp, Artificial sequence
  SiRNA target sequence
taagtctagaatttccacttacaa

SEQ ID NO: 102299 - DNA, 24 bp, Artificial sequence
  SiRNA target sequence
aagtctagaatttccacttacaaa

SEQ ID NO: 102300 - DNA, 24 bp, Artificial sequence
  SiRNA target sequence
agtctagaatttccacttacaaat

SEQ ID NO: 102301 - DNA, 24 bp, Artificial sequence
  SiRNA target sequence
gtctagaatttccacttacaaata

SEQ ID NO: 102302 - DNA, 24 bp, Artificial sequence
  SiRNA target sequence
tctagaatttccacttacaaatat

SEQ ID NO: 102303 - DNA, 24 bp, Artificial sequence
  SiRNA target sequence
ctagaatttccacttacaaatatt

SEQ ID NO: 102304 - DNA, 24 bp, Artificial sequence
  SiRNA target sequence
tagaatttccacttacaaatatta

SEQ ID NO: 102305 - DNA, 24 bp, Artificial sequence
  SiRNA target sequence
agaatttccacttacaaatattaa

SEQ ID NO: 102306 - DNA, 24 bp, Artificial sequence
  SiRNA target sequence
gaatttccacttacaaatattaac

SEQ ID NO: 102307 - DNA, 24 bp, Artificial sequence
  SiRNA target sequence
aatttccacttacaaatattaacc

SEQ ID NO: 102308 - DNA, 24 bp, Artificial sequence
  SiRNA target sequence
atttccacttacaaatattaacca

SEQ ID NO: 102309 - DNA, 24 bp, Artificial sequence
  SiRNA target sequence
tttccacttacaaatattaaccaa

SEQ ID NO: 102310 - DNA, 24 bp, Artificial sequence
  SiRNA target sequence
ttccacttacaaatattaaccaat

SEQ ID NO: 102311 - DNA, 24 bp, Artificial sequence
  SiRNA target sequence
tccacttacaaatattaaccaatc

SEQ ID NO: 102312 - DNA, 24 bp, Artificial sequence
  SiRNA target sequence
ccacttacaaatattaaccaatca

SEQ ID NO: 102313 - DNA, 24 bp, Artificial sequence
  SiRNA target sequence
cacttacaaatattaaccaatcat

SEQ ID NO: 102314 - DNA, 24 bp, Artificial sequence
  SiRNA target sequence
acttacaaatattaaccaatcatc

SEQ ID NO: 102315 - DNA, 24 bp, Artificial sequence
  SiRNA target sequence
cttacaaatattaaccaatcatca

SEQ ID NO: 102316 - DNA, 24 bp, Artificial sequence
  SiRNA target sequence
ttacaaatattaaccaatcatcaa

SEQ ID NO: 102317 - DNA, 24 bp, Artificial sequence
  SiRNA target sequence
tacaaatattaaccaatcatcaat

SEQ ID NO: 102318 - DNA, 24 bp, Artificial sequence
  SiRNA target sequence
acaaatattaaccaatcatcaata

SEQ ID NO: 102319 - DNA, 24 bp, Artificial sequence
  SiRNA target sequence
caaatattaaccaatcatcaatat

SEQ ID NO: 102320 - DNA, 24 bp, Artificial sequence
  SiRNA target sequence
aaatattaaccaatcatcaatatt

SEQ ID NO: 102321 - DNA, 24 bp, Artificial sequence
  SiRNA target sequence
aatattaaccaatcatcaatattt

SEQ ID NO: 102322 - DNA, 24 bp, Artificial sequence
  SiRNA target sequence
atattaaccaatcatcaatatttt

SEQ ID NO: 102323 - DNA, 24 bp, Artificial sequence
  SiRNA target sequence
tattaaccaatcatcaatattttc

SEQ ID NO: 102324 - DNA, 24 bp, Artificial sequence
  SiRNA target sequence
attaaccaatcatcaatattttct

SEQ ID NO: 102325 - DNA, 24 bp, Artificial sequence
  SiRNA target sequence
ttaaccaatcatcaatattttcta

SEQ ID NO: 102326 - DNA, 24 bp, Artificial sequence
  SiRNA target sequence
taaccaatcatcaatattttctag

SEQ ID NO: 102327 - DNA, 24 bp, Artificial sequence
  SiRNA target sequence
aaccaatcatcaatattttctagc

SEQ ID NO: 102328 - DNA, 24 bp, Artificial sequence
  SiRNA target sequence
accaatcatcaatattttctagcc

SEQ ID NO: 102329 - DNA, 24 bp, Artificial sequence
  SiRNA target sequence
ccaatcatcaatattttctagccc

SEQ ID NO: 102330 - DNA, 24 bp, Artificial sequence
  SiRNA target sequence
caatcatcaatattttctagccct

SEQ ID NO: 102331 - DNA, 24 bp, Artificial sequence
  SiRNA target sequence
aatcatcaatattttctagccctt

SEQ ID NO: 102332 - DNA, 24 bp, Artificial sequence
  SiRNA target sequence
atcatcaatattttctagcccttt

SEQ ID NO: 102333 - DNA, 24 bp, Artificial sequence
  SiRNA target sequence
tcatcaatattttctagccctttt

SEQ ID NO: 102334 - DNA, 24 bp, Artificial sequence
  SiRNA target sequence
catcaatattttctagccctttta

SEQ ID NO: 102335 - DNA, 24 bp, Artificial sequence
  SiRNA target sequence
atcaatattttctagcccttttat

SEQ ID NO: 102336 - DNA, 24 bp, Artificial sequence
  SiRNA target sequence
tcaatattttctagcccttttata

SEQ ID NO: 102337 - DNA, 24 bp, Artificial sequence
  SiRNA target sequence
caatattttctagcccttttatag

SEQ ID NO: 102338 - DNA, 24 bp, Artificial sequence
  SiRNA target sequence
aatattttctagcccttttatagt

SEQ ID NO: 102339 - DNA, 24 bp, Artificial sequence
  SiRNA target sequence
atattttctagcccttttatagtc

SEQ ID NO: 102340 - DNA, 24 bp, Artificial sequence
  SiRNA target sequence
tattttctagcccttttatagtct

SEQ ID NO: 102341 - DNA, 24 bp, Artificial sequence
  SiRNA target sequence
attttctagcccttttatagtctt

SEQ ID NO: 102342 - DNA, 24 bp, Artificial sequence
  SiRNA target sequence
ttttctagcccttttatagtctta

SEQ ID NO: 102343 - DNA, 24 bp, Artificial sequence
  SiRNA target sequence
tttctagcccttttatagtcttat

SEQ ID NO: 102344 - DNA, 24 bp, Artificial sequence
  SiRNA target sequence
ttctagcccttttatagtcttata

SEQ ID NO: 102345 - DNA, 24 bp, Artificial sequence
  SiRNA target sequence
tctagcccttttatagtcttataa

SEQ ID NO: 102346 - DNA, 24 bp, Artificial sequence
  SiRNA target sequence
ctagcccttttatagtcttataaa

SEQ ID NO: 102347 - DNA, 24 bp, Artificial sequence
  SiRNA target sequence
tagcccttttatagtcttataaat

SEQ ID NO: 102348 - DNA, 24 bp, Artificial sequence
  SiRNA target sequence
agcccttttatagtcttataaata

SEQ ID NO: 102349 - DNA, 24 bp, Artificial sequence
  SiRNA target sequence
gcccttttatagtcttataaatat

SEQ ID NO: 102350 - DNA, 24 bp, Artificial sequence
  SiRNA target sequence
cccttttatagtcttataaatatc

SEQ ID NO: 102351 - DNA, 24 bp, Artificial sequence
  SiRNA target sequence
ccttttatagtcttataaatatct

SEQ ID NO: 102352 - DNA, 24 bp, Artificial sequence
  SiRNA target sequence
cttttatagtcttataaatatctt

SEQ ID NO: 102353 - DNA, 24 bp, Artificial sequence
  SiRNA target sequence
ttttatagtcttataaatatcttg

SEQ ID NO: 102354 - DNA, 24 bp, Artificial sequence
  SiRNA target sequence
tttatagtcttataaatatcttgt

SEQ ID NO: 102355 - DNA, 24 bp, Artificial sequence
  SiRNA target sequence
ttatagtcttataaatatcttgta

SEQ ID NO: 102356 - DNA, 24 bp, Artificial sequence
  SiRNA target sequence
tatagtcttataaatatcttgtat

SEQ ID NO: 102357 - DNA, 24 bp, Artificial sequence
  SiRNA target sequence
atagtcttataaatatcttgtatg

SEQ ID NO: 102358 - DNA, 24 bp, Artificial sequence
  SiRNA target sequence
tagtcttataaatatcttgtatgt

SEQ ID NO: 102359 - DNA, 24 bp, Artificial sequence
  SiRNA target sequence
agtcttataaatatcttgtatgta

SEQ ID NO: 102360 - DNA, 24 bp, Artificial sequence
  SiRNA target sequence
gtcttataaatatcttgtatgtat

SEQ ID NO: 102361 - DNA, 24 bp, Artificial sequence
  SiRNA target sequence
tcttataaatatcttgtatgtatt

SEQ ID NO: 102362 - DNA, 24 bp, Artificial sequence
  SiRNA target sequence
cttataaatatcttgtatgtattt

SEQ ID NO: 102363 - DNA, 24 bp, Artificial sequence
  SiRNA target sequence
ttataaatatcttgtatgtattta

SEQ ID NO: 102364 - DNA, 24 bp, Artificial sequence
  SiRNA target sequence
tataaatatcttgtatgtatttat

SEQ ID NO: 102365 - DNA, 24 bp, Artificial sequence
  SiRNA target sequence
ataaatatcttgtatgtatttatt

SEQ ID NO: 102366 - DNA, 24 bp, Artificial sequence
  SiRNA target sequence
taaatatcttgtatgtatttatta

SEQ ID NO: 102367 - DNA, 24 bp, Artificial sequence
  SiRNA target sequence
aaatatcttgtatgtatttattat

SEQ ID NO: 102368 - DNA, 24 bp, Artificial sequence
  SiRNA target sequence
aatatcttgtatgtatttattatc

SEQ ID NO: 102369 - DNA, 24 bp, Artificial sequence
  SiRNA target sequence
atatcttgtatgtatttattatct

SEQ ID NO: 102370 - DNA, 24 bp, Artificial sequence
  SiRNA target sequence
tatcttgtatgtatttattatctt

SEQ ID NO: 102371 - DNA, 24 bp, Artificial sequence
  SiRNA target sequence
atcttgtatgtatttattatcttc

SEQ ID NO: 102372 - DNA, 24 bp, Artificial sequence
  SiRNA target sequence
tcttgtatgtatttattatcttcc

SEQ ID NO: 102373 - DNA, 24 bp, Artificial sequence
  SiRNA target sequence
cttgtatgtatttattatcttccc

SEQ ID NO: 102374 - DNA, 24 bp, Artificial sequence
  SiRNA target sequence
ttgtatgtatttattatcttccct

SEQ ID NO: 102375 - DNA, 24 bp, Artificial sequence
  SiRNA target sequence
tgtatgtatttattatcttccctt

SEQ ID NO: 102376 - DNA, 24 bp, Artificial sequence
  SiRNA target sequence
gtatgtatttattatcttcccttg

SEQ ID NO: 102377 - DNA, 24 bp, Artificial sequence
  SiRNA target sequence
tatgtatttattatcttcccttga

SEQ ID NO: 102378 - DNA, 24 bp, Artificial sequence
  SiRNA target sequence
atgtatttattatcttcccttgaa

SEQ ID NO: 102379 - DNA, 24 bp, Artificial sequence
  SiRNA target sequence
tgtatttattatcttcccttgaaa

SEQ ID NO: 102380 - DNA, 24 bp, Artificial sequence
  SiRNA target sequence
gtatttattatcttcccttgaaac

SEQ ID NO: 102381 - DNA, 24 bp, Artificial sequence
  SiRNA target sequence
tatttattatcttcccttgaaaca

SEQ ID NO: 102382 - DNA, 24 bp, Artificial sequence
  SiRNA target sequence
atttattatcttcccttgaaacag

SEQ ID NO: 102383 - DNA, 24 bp, Artificial sequence
  SiRNA target sequence
tttattatcttcccttgaaacagc

SEQ ID NO: 102384 - DNA, 24 bp, Artificial sequence
  SiRNA target sequence
ttattatcttcccttgaaacagcg

SEQ ID NO: 102385 - DNA, 24 bp, Artificial sequence
  SiRNA target sequence
tattatcttcccttgaaacagcgg

SEQ ID NO: 102386 - DNA, 24 bp, Artificial sequence
  SiRNA target sequence
attatcttcccttgaaacagcggg

SEQ ID NO: 102387 - DNA, 24 bp, Artificial sequence
  SiRNA target sequence
ttatcttcccttgaaacagcgggg

SEQ ID NO: 102388 - DNA, 24 bp, Artificial sequence
  SiRNA target sequence
tatcttcccttgaaacagcggggt

SEQ ID NO: 102389 - DNA, 24 bp, Artificial sequence
  SiRNA target sequence
atcttcccttgaaacagcggggta

SEQ ID NO: 102390 - DNA, 24 bp, Artificial sequence
  SiRNA target sequence
tcttcccttgaaacagcggggtaa

SEQ ID NO: 102391 - DNA, 24 bp, Artificial sequence
  SiRNA target sequence
cttcccttgaaacagcggggtaaa

SEQ ID NO: 102392 - DNA, 24 bp, Artificial sequence
  SiRNA target sequence
ttcccttgaaacagcggggtaaat

SEQ ID NO: 102393 - DNA, 24 bp, Artificial sequence
  SiRNA target sequence
tcccttgaaacagcggggtaaatt

SEQ ID NO: 102394 - DNA, 24 bp, Artificial sequence
  SiRNA target sequence
cccttgaaacagcggggtaaattt

SEQ ID NO: 102395 - DNA, 24 bp, Artificial sequence
  SiRNA target sequence
ccttgaaacagcggggtaaatttc

SEQ ID NO: 102396 - DNA, 24 bp, Artificial sequence
  SiRNA target sequence
cttgaaacagcggggtaaatttca

SEQ ID NO: 102397 - DNA, 24 bp, Artificial sequence
  SiRNA target sequence
ttgaaacagcggggtaaatttcaa

SEQ ID NO: 102398 - DNA, 24 bp, Artificial sequence
  SiRNA target sequence
tgaaacagcggggtaaatttcaat

SEQ ID NO: 102399 - DNA, 24 bp, Artificial sequence
  SiRNA target sequence
gaaacagcggggtaaatttcaatg

SEQ ID NO: 102400 - DNA, 24 bp, Artificial sequence
  SiRNA target sequence
aaacagcggggtaaatttcaatgc

SEQ ID NO: 102401 - DNA, 24 bp, Artificial sequence
  SiRNA target sequence
aacagcggggtaaatttcaatgcc

SEQ ID NO: 102402 - DNA, 24 bp, Artificial sequence
  SiRNA target sequence
acagcggggtaaatttcaatgcct

SEQ ID NO: 102403 - DNA, 24 bp, Artificial sequence
  SiRNA target sequence
cagcggggtaaatttcaatgcctt

SEQ ID NO: 102404 - DNA, 24 bp, Artificial sequence
  SiRNA target sequence
agcggggtaaatttcaatgccttt

SEQ ID NO: 102405 - DNA, 24 bp, Artificial sequence
  SiRNA target sequence
gcggggtaaatttcaatgccttta

SEQ ID NO: 102406 - DNA, 24 bp, Artificial sequence
  SiRNA target sequence
cggggtaaatttcaatgcctttat

SEQ ID NO: 102407 - DNA, 24 bp, Artificial sequence
  SiRNA target sequence
ggggtaaatttcaatgcctttatt

SEQ ID NO: 102408 - DNA, 24 bp, Artificial sequence
  SiRNA target sequence
gggtaaatttcaatgcctttattt

SEQ ID NO: 102409 - DNA, 24 bp, Artificial sequence
  SiRNA target sequence
ggtaaatttcaatgcctttatttt

SEQ ID NO: 102410 - DNA, 24 bp, Artificial sequence
  SiRNA target sequence
gtaaatttcaatgcctttattttc

SEQ ID NO: 102411 - DNA, 24 bp, Artificial sequence
  SiRNA target sequence
taaatttcaatgcctttattttca

SEQ ID NO: 102412 - DNA, 24 bp, Artificial sequence
  SiRNA target sequence
aaatttcaatgcctttattttcaa

SEQ ID NO: 102413 - DNA, 24 bp, Artificial sequence
  SiRNA target sequence
aatttcaatgcctttattttcaaa

SEQ ID NO: 102414 - DNA, 24 bp, Artificial sequence
  SiRNA target sequence
atttcaatgcctttattttcaaac

SEQ ID NO: 102415 - DNA, 24 bp, Artificial sequence
  SiRNA target sequence
tttcaatgcctttattttcaaact

SEQ ID NO: 102416 - DNA, 24 bp, Artificial sequence
  SiRNA target sequence
ttcaatgcctttattttcaaactc

SEQ ID NO: 102417 - DNA, 24 bp, Artificial sequence
  SiRNA target sequence
tcaatgcctttattttcaaactct

SEQ ID NO: 102418 - DNA, 24 bp, Artificial sequence
  SiRNA target sequence
caatgcctttattttcaaactctt

SEQ ID NO: 102419 - DNA, 24 bp, Artificial sequence
  SiRNA target sequence
aatgcctttattttcaaactcttc

SEQ ID NO: 102420 - DNA, 24 bp, Artificial sequence
  SiRNA target sequence
atgcctttattttcaaactcttct

SEQ ID NO: 102421 - DNA, 24 bp, Artificial sequence
  SiRNA target sequence
tgcctttattttcaaactcttctt

SEQ ID NO: 102422 - DNA, 24 bp, Artificial sequence
  SiRNA target sequence
gcctttattttcaaactcttcttt

SEQ ID NO: 102423 - DNA, 24 bp, Artificial sequence
  SiRNA target sequence
cctttattttcaaactcttcttta

SEQ ID NO: 102424 - DNA, 24 bp, Artificial sequence
  SiRNA target sequence
ctttattttcaaactcttctttat

SEQ ID NO: 102425 - DNA, 24 bp, Artificial sequence
  SiRNA target sequence
tttattttcaaactcttctttata

SEQ ID NO: 102426 - DNA, 24 bp, Artificial sequence
  SiRNA target sequence
ttattttcaaactcttctttatat

SEQ ID NO: 102427 - DNA, 24 bp, Artificial sequence
  SiRNA target sequence
tattttcaaactcttctttatata

SEQ ID NO: 102428 - DNA, 24 bp, Artificial sequence
  SiRNA target sequence
attttcaaactcttctttatataa

SEQ ID NO: 102429 - DNA, 24 bp, Artificial sequence
  SiRNA target sequence
ttttcaaactcttctttatataaa

SEQ ID NO: 102430 - DNA, 24 bp, Artificial sequence
  SiRNA target sequence
tttcaaactcttctttatataaaa

SEQ ID NO: 102431 - DNA, 24 bp, Artificial sequence
  SiRNA target sequence
ttcaaactcttctttatataaaaa

SEQ ID NO: 102432 - DNA, 24 bp, Artificial sequence
  SiRNA target sequence
tcaaactcttctttatataaaaaa

SEQ ID NO: 102433 - DNA, 24 bp, Artificial sequence
  SiRNA target sequence
caaactcttctttatataaaaaat

SEQ ID NO: 102434 - DNA, 24 bp, Artificial sequence
  SiRNA target sequence
aaactcttctttatataaaaaatc

SEQ ID NO: 102435 - DNA, 24 bp, Artificial sequence
  SiRNA target sequence
aactcttctttatataaaaaatct

SEQ ID NO: 102436 - DNA, 24 bp, Artificial sequence
  SiRNA target sequence
actcttctttatataaaaaatcta

SEQ ID NO: 102437 - DNA, 24 bp, Artificial sequence
  SiRNA target sequence
ctcttctttatataaaaaatctac

SEQ ID NO: 102438 - DNA, 24 bp, Artificial sequence
  SiRNA target sequence
tcttctttatataaaaaatctaca

SEQ ID NO: 102439 - DNA, 24 bp, Artificial sequence
  SiRNA target sequence
cttctttatataaaaaatctacat

SEQ ID NO: 102440 - DNA, 24 bp, Artificial sequence
  SiRNA target sequence
ttctttatataaaaaatctacatc

SEQ ID NO: 102441 - DNA, 24 bp, Artificial sequence
  SiRNA target sequence
tctttatataaaaaatctacatct

SEQ ID NO: 102442 - DNA, 24 bp, Artificial sequence
  SiRNA target sequence
ctttatataaaaaatctacatctc

SEQ ID NO: 102443 - DNA, 24 bp, Artificial sequence
  SiRNA target sequence
tttatataaaaaatctacatctct

SEQ ID NO: 102444 - DNA, 24 bp, Artificial sequence
  SiRNA target sequence
ttatataaaaaatctacatctcta

SEQ ID NO: 102445 - DNA, 24 bp, Artificial sequence
  SiRNA target sequence
tatataaaaaatctacatctctaa

SEQ ID NO: 102446 - DNA, 24 bp, Artificial sequence
  SiRNA target sequence
atataaaaaatctacatctctaaa

SEQ ID NO: 102447 - DNA, 24 bp, Artificial sequence
  SiRNA target sequence
tataaaaaatctacatctctaaat

SEQ ID NO: 102448 - DNA, 24 bp, Artificial sequence
  SiRNA target sequence
ataaaaaatctacatctctaaatc

SEQ ID NO: 102449 - DNA, 24 bp, Artificial sequence
  SiRNA target sequence
taaaaaatctacatctctaaatct

SEQ ID NO: 102450 - DNA, 24 bp, Artificial sequence
  SiRNA target sequence
aaaaaatctacatctctaaatcta

SEQ ID NO: 102451 - DNA, 24 bp, Artificial sequence
  SiRNA target sequence
aaaaatctacatctctaaatctaa

SEQ ID NO: 102452 - DNA, 24 bp, Artificial sequence
  SiRNA target sequence
aaaatctacatctctaaatctaaa

SEQ ID NO: 102453 - DNA, 24 bp, Artificial sequence
  SiRNA target sequence
aaatctacatctctaaatctaaaa

SEQ ID NO: 102454 - DNA, 24 bp, Artificial sequence
  SiRNA target sequence
aatctacatctctaaatctaaaac

SEQ ID NO: 102455 - DNA, 24 bp, Artificial sequence
  SiRNA target sequence
atctacatctctaaatctaaaacc

SEQ ID NO: 102456 - DNA, 24 bp, Artificial sequence
  SiRNA target sequence
tctacatctctaaatctaaaacca

SEQ ID NO: 102457 - DNA, 24 bp, Artificial sequence
  SiRNA target sequence
ctacatctctaaatctaaaaccat

SEQ ID NO: 102458 - DNA, 24 bp, Artificial sequence
  SiRNA target sequence
tacatctctaaatctaaaaccata

SEQ ID NO: 102459 - DNA, 24 bp, Artificial sequence
  SiRNA target sequence
acatctctaaatctaaaaccatat

SEQ ID NO: 102460 - DNA, 24 bp, Artificial sequence
  SiRNA target sequence
catctctaaatctaaaaccatata

SEQ ID NO: 102461 - DNA, 24 bp, Artificial sequence
  SiRNA target sequence
atctctaaatctaaaaccatataa

SEQ ID NO: 102462 - DNA, 24 bp, Artificial sequence
  SiRNA target sequence
tctctaaatctaaaaccatataat

SEQ ID NO: 102463 - DNA, 24 bp, Artificial sequence
  SiRNA target sequence
ctctaaatctaaaaccatataata

SEQ ID NO: 102464 - DNA, 24 bp, Artificial sequence
  SiRNA target sequence
tctaaatctaaaaccatataataa

SEQ ID NO: 102465 - DNA, 24 bp, Artificial sequence
  SiRNA target sequence
ctaaatctaaaaccatataataaa

SEQ ID NO: 102466 - DNA, 24 bp, Artificial sequence
  SiRNA target sequence
taaatctaaaaccatataataaaa

SEQ ID NO: 102467 - DNA, 24 bp, Artificial sequence
  SiRNA target sequence
aaatctaaaaccatataataaaat

SEQ ID NO: 102468 - DNA, 24 bp, Artificial sequence
  SiRNA target sequence
aatctaaaaccatataataaaata

SEQ ID NO: 102469 - DNA, 24 bp, Artificial sequence
  SiRNA target sequence
atctaaaaccatataataaaataa

SEQ ID NO: 102470 - DNA, 24 bp, Artificial sequence
  SiRNA target sequence
tctaaaaccatataataaaataac

SEQ ID NO: 102471 - DNA, 24 bp, Artificial sequence
  SiRNA target sequence
ctaaaaccatataataaaataact

SEQ ID NO: 102472 - DNA, 24 bp, Artificial sequence
  SiRNA target sequence
taaaaccatataataaaataactt

SEQ ID NO: 102473 - DNA, 24 bp, Artificial sequence
  SiRNA target sequence
aaaaccatataataaaataacttt

SEQ ID NO: 102474 - DNA, 24 bp, Artificial sequence
  SiRNA target sequence
aaaccatataataaaataactttt

SEQ ID NO: 102475 - DNA, 24 bp, Artificial sequence
  SiRNA target sequence
aaccatataataaaataacttttt

SEQ ID NO: 102476 - DNA, 24 bp, Artificial sequence
  SiRNA target sequence
accatataataaaataactttttt

SEQ ID NO: 102477 - DNA, 24 bp, Artificial sequence
  SiRNA target sequence
ccatataataaaataactttttta

SEQ ID NO: 102478 - DNA, 24 bp, Artificial sequence
  SiRNA target sequence
catataataaaataacttttttaa

SEQ ID NO: 102479 - DNA, 24 bp, Artificial sequence
  SiRNA target sequence
atataataaaataacttttttaaa

SEQ ID NO: 102480 - DNA, 24 bp, Artificial sequence
  SiRNA target sequence
tataataaaataacttttttaaaa

SEQ ID NO: 102481 - DNA, 24 bp, Artificial sequence
  SiRNA target sequence
ataataaaataacttttttaaaaa

SEQ ID NO: 102482 - DNA, 24 bp, Artificial sequence
  SiRNA target sequence
taataaaataacttttttaaaaaa

SEQ ID NO: 102483 - DNA, 24 bp, Artificial sequence
  SiRNA target sequence
aataaaataacttttttaaaaaaa

SEQ ID NO: 102484 - DNA, 24 bp, Artificial sequence
  SiRNA target sequence
ataaaataacttttttaaaaaaat

SEQ ID NO: 102485 - DNA, 24 bp, Artificial sequence
  SiRNA target sequence
taaaataacttttttaaaaaaatt

SEQ ID NO: 102486 - DNA, 24 bp, Artificial sequence
  SiRNA target sequence
aaaataacttttttaaaaaaattt

SEQ ID NO: 102487 - DNA, 24 bp, Artificial sequence
  SiRNA target sequence
aaataacttttttaaaaaaattta

SEQ ID NO: 102488 - DNA, 24 bp, Artificial sequence
  SiRNA target sequence
aataacttttttaaaaaaatttaa

SEQ ID NO: 102489 - DNA, 24 bp, Artificial sequence
  SiRNA target sequence
ataacttttttaaaaaaatttaaa

SEQ ID NO: 102490 - DNA, 24 bp, Artificial sequence
  SiRNA target sequence
taacttttttaaaaaaatttaaat

SEQ ID NO: 102491 - DNA, 24 bp, Artificial sequence
  SiRNA target sequence
aacttttttaaaaaaatttaaatc

SEQ ID NO: 102492 - DNA, 24 bp, Artificial sequence
  SiRNA target sequence
acttttttaaaaaaatttaaatca

SEQ ID NO: 102493 - DNA, 24 bp, Artificial sequence
  SiRNA target sequence
cttttttaaaaaaatttaaatcag

SEQ ID NO: 102494 - DNA, 24 bp, Artificial sequence
  SiRNA target sequence
ttttttaaaaaaatttaaatcaga

SEQ ID NO: 102495 - DNA, 24 bp, Artificial sequence
  SiRNA target sequence
tttttaaaaaaatttaaatcagaa

SEQ ID NO: 102496 - DNA, 24 bp, Artificial sequence
  SiRNA target sequence
ttttaaaaaaatttaaatcagaat

SEQ ID NO: 102497 - DNA, 24 bp, Artificial sequence
  SiRNA target sequence
tttaaaaaaatttaaatcagaata

SEQ ID NO: 102498 - DNA, 24 bp, Artificial sequence
  SiRNA target sequence
ttaaaaaaatttaaatcagaatag

SEQ ID NO: 102499 - DNA, 24 bp, Artificial sequence
  SiRNA target sequence
taaaaaaatttaaatcagaatagt

SEQ ID NO: 102500 - DNA, 24 bp, Artificial sequence
  SiRNA target sequence
aaaaaaatttaaatcagaatagta

SEQ ID NO: 102501 - DNA, 24 bp, Artificial sequence
  SiRNA target sequence
aaaaaatttaaatcagaatagtaa

SEQ ID NO: 102502 - DNA, 24 bp, Artificial sequence
  SiRNA target sequence
aaaaatttaaatcagaatagtaat

SEQ ID NO: 102503 - DNA, 24 bp, Artificial sequence
  SiRNA target sequence
aaaatttaaatcagaatagtaatt

SEQ ID NO: 102504 - DNA, 24 bp, Artificial sequence
  SiRNA target sequence
aaatttaaatcagaatagtaatta

SEQ ID NO: 102505 - DNA, 24 bp, Artificial sequence
  SiRNA target sequence
aatttaaatcagaatagtaattaa

SEQ ID NO: 102506 - DNA, 24 bp, Artificial sequence
  SiRNA target sequence
atttaaatcagaatagtaattaac

SEQ ID NO: 102507 - DNA, 24 bp, Artificial sequence
  SiRNA target sequence
tttaaatcagaatagtaattaaca

SEQ ID NO: 102508 - DNA, 24 bp, Artificial sequence
  SiRNA target sequence
ttaaatcagaatagtaattaacaa

SEQ ID NO: 102509 - DNA, 24 bp, Artificial sequence
  SiRNA target sequence
taaatcagaatagtaattaacaaa

SEQ ID NO: 102510 - DNA, 24 bp, Artificial sequence
  SiRNA target sequence
aaatcagaatagtaattaacaaat

SEQ ID NO: 102511 - DNA, 24 bp, Artificial sequence
  SiRNA target sequence
aatcagaatagtaattaacaaatg

SEQ ID NO: 102512 - DNA, 24 bp, Artificial sequence
  SiRNA target sequence
atcagaatagtaattaacaaatgc

SEQ ID NO: 102513 - DNA, 24 bp, Artificial sequence
  SiRNA target sequence
tcagaatagtaattaacaaatgcc

SEQ ID NO: 102514 - DNA, 24 bp, Artificial sequence
  SiRNA target sequence
cagaatagtaattaacaaatgccc

SEQ ID NO: 102515 - DNA, 24 bp, Artificial sequence
  SiRNA target sequence
agaatagtaattaacaaatgccct

SEQ ID NO: 102516 - DNA, 24 bp, Artificial sequence
  SiRNA target sequence
gaatagtaattaacaaatgccctg

SEQ ID NO: 102517 - DNA, 24 bp, Artificial sequence
  SiRNA target sequence
aatagtaattaacaaatgccctgg

SEQ ID NO: 102518 - DNA, 24 bp, Artificial sequence
  SiRNA target sequence
atagtaattaacaaatgccctggg

SEQ ID NO: 102519 - DNA, 24 bp, Artificial sequence
  SiRNA target sequence
tagtaattaacaaatgccctggga

SEQ ID NO: 102520 - DNA, 24 bp, Artificial sequence
  SiRNA target sequence
agtaattaacaaatgccctgggaa

SEQ ID NO: 102521 - DNA, 24 bp, Artificial sequence
  SiRNA target sequence
gtaattaacaaatgccctgggaag

SEQ ID NO: 102522 - DNA, 24 bp, Artificial sequence
  SiRNA target sequence
taattaacaaatgccctgggaagt

SEQ ID NO: 102523 - DNA, 24 bp, Artificial sequence
  SiRNA target sequence
aattaacaaatgccctgggaagtg

SEQ ID NO: 102524 - DNA, 24 bp, Artificial sequence
  SiRNA target sequence
attaacaaatgccctgggaagtgt

SEQ ID NO: 102525 - DNA, 24 bp, Artificial sequence
  SiRNA target sequence
ttaacaaatgccctgggaagtgta

SEQ ID NO: 102526 - DNA, 24 bp, Artificial sequence
  SiRNA target sequence
taacaaatgccctgggaagtgtaa

SEQ ID NO: 102527 - DNA, 24 bp, Artificial sequence
  SiRNA target sequence
aacaaatgccctgggaagtgtaat

SEQ ID NO: 102528 - DNA, 24 bp, Artificial sequence
  SiRNA target sequence
acaaatgccctgggaagtgtaata

SEQ ID NO: 102529 - DNA, 24 bp, Artificial sequence
  SiRNA target sequence
caaatgccctgggaagtgtaatac

SEQ ID NO: 102530 - DNA, 24 bp, Artificial sequence
  SiRNA target sequence
aaatgccctgggaagtgtaatacc

SEQ ID NO: 102531 - DNA, 24 bp, Artificial sequence
  SiRNA target sequence
aatgccctgggaagtgtaatacca

SEQ ID NO: 102532 - DNA, 24 bp, Artificial sequence
  SiRNA target sequence
atgccctgggaagtgtaataccag

SEQ ID NO: 102533 - DNA, 24 bp, Artificial sequence
  SiRNA target sequence
tgccctgggaagtgtaataccagt

SEQ ID NO: 102534 - DNA, 24 bp, Artificial sequence
  SiRNA target sequence
gccctgggaagtgtaataccagta

SEQ ID NO: 102535 - DNA, 24 bp, Artificial sequence
  SiRNA target sequence
ccctgggaagtgtaataccagtac

SEQ ID NO: 102536 - DNA, 24 bp, Artificial sequence
  SiRNA target sequence
cctgggaagtgtaataccagtacc

SEQ ID NO: 102537 - DNA, 24 bp, Artificial sequence
  SiRNA target sequence
ctgggaagtgtaataccagtacca

SEQ ID NO: 102538 - DNA, 24 bp, Artificial sequence
  SiRNA target sequence
tgggaagtgtaataccagtaccag

SEQ ID NO: 102539 - DNA, 24 bp, Artificial sequence
  SiRNA target sequence
gggaagtgtaataccagtaccagt

SEQ ID NO: 102540 - DNA, 24 bp, Artificial sequence
  SiRNA target sequence
ggaagtgtaataccagtaccagtg

SEQ ID NO: 102541 - DNA, 24 bp, Artificial sequence
  SiRNA target sequence
gaagtgtaataccagtaccagtgc

SEQ ID NO: 102542 - DNA, 24 bp, Artificial sequence
  SiRNA target sequence
aagtgtaataccagtaccagtgca

SEQ ID NO: 102543 - DNA, 24 bp, Artificial sequence
  SiRNA target sequence
agtgtaataccagtaccagtgcac

SEQ ID NO: 102544 - DNA, 24 bp, Artificial sequence
  SiRNA target sequence
gtgtaataccagtaccagtgcaca

SEQ ID NO: 102545 - DNA, 24 bp, Artificial sequence
  SiRNA target sequence
tgtaataccagtaccagtgcacat

SEQ ID NO: 102546 - DNA, 24 bp, Artificial sequence
  SiRNA target sequence
gtaataccagtaccagtgcacata

SEQ ID NO: 102547 - DNA, 24 bp, Artificial sequence
  SiRNA target sequence
taataccagtaccagtgcacataa

SEQ ID NO: 102548 - DNA, 24 bp, Artificial sequence
  SiRNA target sequence
aataccagtaccagtgcacataaa

SEQ ID NO: 102549 - DNA, 24 bp, Artificial sequence
  SiRNA target sequence
ataccagtaccagtgcacataaac

SEQ ID NO: 102550 - DNA, 24 bp, Artificial sequence
  SiRNA target sequence
taccagtaccagtgcacataaaca

SEQ ID NO: 102551 - DNA, 24 bp, Artificial sequence
  SiRNA target sequence
accagtaccagtgcacataaacaa

SEQ ID NO: 102552 - DNA, 24 bp, Artificial sequence
  SiRNA target sequence
ccagtaccagtgcacataaacaaa

SEQ ID NO: 102553 - DNA, 24 bp, Artificial sequence
  SiRNA target sequence
cagtaccagtgcacataaacaaaa

SEQ ID NO: 102554 - DNA, 24 bp, Artificial sequence
  SiRNA target sequence
agtaccagtgcacataaacaaaat

SEQ ID NO: 102555 - DNA, 24 bp, Artificial sequence
  SiRNA target sequence
gtaccagtgcacataaacaaaatc

SEQ ID NO: 102556 - DNA, 24 bp, Artificial sequence
  SiRNA target sequence
taccagtgcacataaacaaaatct

SEQ ID NO: 102557 - DNA, 24 bp, Artificial sequence
  SiRNA target sequence
accagtgcacataaacaaaatctt

SEQ ID NO: 102558 - DNA, 24 bp, Artificial sequence
  SiRNA target sequence
ccagtgcacataaacaaaatcttt

SEQ ID NO: 102559 - DNA, 24 bp, Artificial sequence
  SiRNA target sequence
cagtgcacataaacaaaatctttt

SEQ ID NO: 102560 - DNA, 24 bp, Artificial sequence
  SiRNA target sequence
agtgcacataaacaaaatcttttt

SEQ ID NO: 102561 - DNA, 24 bp, Artificial sequence
  SiRNA target sequence
gtgcacataaacaaaatcttttta

SEQ ID NO: 102562 - DNA, 24 bp, Artificial sequence
  SiRNA target sequence
tgcacataaacaaaatctttttac

SEQ ID NO: 102563 - DNA, 24 bp, Artificial sequence
  SiRNA target sequence
gcacataaacaaaatctttttacc

SEQ ID NO: 102564 - DNA, 24 bp, Artificial sequence
  SiRNA target sequence
cacataaacaaaatctttttacca

SEQ ID NO: 102565 - DNA, 24 bp, Artificial sequence
  SiRNA target sequence
acataaacaaaatctttttaccac

SEQ ID NO: 102566 - DNA, 24 bp, Artificial sequence
  SiRNA target sequence
cataaacaaaatctttttaccact

SEQ ID NO: 102567 - DNA, 24 bp, Artificial sequence
  SiRNA target sequence
ataaacaaaatctttttaccacta

SEQ ID NO: 102568 - DNA, 24 bp, Artificial sequence
  SiRNA target sequence
taaacaaaatctttttaccactaa

SEQ ID NO: 102569 - DNA, 24 bp, Artificial sequence
  SiRNA target sequence
aaacaaaatctttttaccactaaa

SEQ ID NO: 102570 - DNA, 24 bp, Artificial sequence
  SiRNA target sequence
aacaaaatctttttaccactaaaa

SEQ ID NO: 102571 - DNA, 24 bp, Artificial sequence
  SiRNA target sequence
acaaaatctttttaccactaaaat

SEQ ID NO: 102572 - DNA, 24 bp, Artificial sequence
  SiRNA target sequence
caaaatctttttaccactaaaatt

SEQ ID NO: 102573 - DNA, 24 bp, Artificial sequence
  SiRNA target sequence
aaaatctttttaccactaaaatta

SEQ ID NO: 102574 - DNA, 24 bp, Artificial sequence
  SiRNA target sequence
aaatctttttaccactaaaattaa

SEQ ID NO: 102575 - DNA, 24 bp, Artificial sequence
  SiRNA target sequence
aatctttttaccactaaaattaag

SEQ ID NO: 102576 - DNA, 24 bp, Artificial sequence
  SiRNA target sequence
atctttttaccactaaaattaagt

SEQ ID NO: 102577 - DNA, 24 bp, Artificial sequence
  SiRNA target sequence
tctttttaccactaaaattaagtc

SEQ ID NO: 102578 - DNA, 24 bp, Artificial sequence
  SiRNA target sequence
ctttttaccactaaaattaagtct

SEQ ID NO: 102579 - DNA, 24 bp, Artificial sequence
  SiRNA target sequence
tttttaccactaaaattaagtcta

SEQ ID NO: 102580 - DNA, 24 bp, Artificial sequence
  SiRNA target sequence
ttttaccactaaaattaagtctat

SEQ ID NO: 102581 - DNA, 24 bp, Artificial sequence
  SiRNA target sequence
tttaccactaaaattaagtctatt

SEQ ID NO: 102582 - DNA, 24 bp, Artificial sequence
  SiRNA target sequence
ttaccactaaaattaagtctattt

SEQ ID NO: 102583 - DNA, 24 bp, Artificial sequence
  SiRNA target sequence
taccactaaaattaagtctatttt

SEQ ID NO: 102584 - DNA, 24 bp, Artificial sequence
  SiRNA target sequence
accactaaaattaagtctattttg

SEQ ID NO: 102585 - DNA, 24 bp, Artificial sequence
  SiRNA target sequence
ccactaaaattaagtctattttgt

SEQ ID NO: 102586 - DNA, 24 bp, Artificial sequence
  SiRNA target sequence
cactaaaattaagtctattttgta

SEQ ID NO: 102587 - DNA, 24 bp, Artificial sequence
  SiRNA target sequence
actaaaattaagtctattttgtac

SEQ ID NO: 102588 - DNA, 24 bp, Artificial sequence
  SiRNA target sequence
ctaaaattaagtctattttgtact

SEQ ID NO: 102589 - DNA, 24 bp, Artificial sequence
  SiRNA target sequence
taaaattaagtctattttgtacta

SEQ ID NO: 102590 - DNA, 24 bp, Artificial sequence
  SiRNA target sequence
aaaattaagtctattttgtactat

SEQ ID NO: 102591 - DNA, 24 bp, Artificial sequence
  SiRNA target sequence
aaattaagtctattttgtactatg

SEQ ID NO: 102592 - DNA, 24 bp, Artificial sequence
  SiRNA target sequence
aattaagtctattttgtactatgt

SEQ ID NO: 102593 - DNA, 24 bp, Artificial sequence
  SiRNA target sequence
attaagtctattttgtactatgtt

SEQ ID NO: 102594 - DNA, 24 bp, Artificial sequence
  SiRNA target sequence
ttaagtctattttgtactatgtta

SEQ ID NO: 102595 - DNA, 24 bp, Artificial sequence
  SiRNA target sequence
taagtctattttgtactatgttaa

SEQ ID NO: 102596 - DNA, 24 bp, Artificial sequence
  SiRNA target sequence
aagtctattttgtactatgttaac

SEQ ID NO: 102597 - DNA, 24 bp, Artificial sequence
  SiRNA target sequence
agtctattttgtactatgttaaca

SEQ ID NO: 102598 - DNA, 24 bp, Artificial sequence
  SiRNA target sequence
gtctattttgtactatgttaacat

SEQ ID NO: 102599 - DNA, 24 bp, Artificial sequence
  SiRNA target sequence
tctattttgtactatgttaacatg

SEQ ID NO: 102600 - DNA, 24 bp, Artificial sequence
  SiRNA target sequence
ctattttgtactatgttaacatga

SEQ ID NO: 102601 - DNA, 24 bp, Artificial sequence
  SiRNA target sequence
tattttgtactatgttaacatgaa

SEQ ID NO: 102602 - DNA, 24 bp, Artificial sequence
  SiRNA target sequence
attttgtactatgttaacatgaat

SEQ ID NO: 102603 - DNA, 24 bp, Artificial sequence
  SiRNA target sequence
ttttgtactatgttaacatgaata

SEQ ID NO: 102604 - DNA, 24 bp, Artificial sequence
  SiRNA target sequence
tttgtactatgttaacatgaatag

SEQ ID NO: 102605 - DNA, 24 bp, Artificial sequence
  SiRNA target sequence
ttgtactatgttaacatgaatagt

SEQ ID NO: 102606 - DNA, 24 bp, Artificial sequence
  SiRNA target sequence
tgtactatgttaacatgaatagta

SEQ ID NO: 102607 - DNA, 24 bp, Artificial sequence
  SiRNA target sequence
gtactatgttaacatgaatagtag

SEQ ID NO: 102608 - DNA, 24 bp, Artificial sequence
  SiRNA target sequence
tactatgttaacatgaatagtaga

SEQ ID NO: 102609 - DNA, 24 bp, Artificial sequence
  SiRNA target sequence
actatgttaacatgaatagtagac

SEQ ID NO: 102610 - DNA, 24 bp, Artificial sequence
  SiRNA target sequence
ctatgttaacatgaatagtagacc

SEQ ID NO: 102611 - DNA, 24 bp, Artificial sequence
  SiRNA target sequence
tatgttaacatgaatagtagaccc

SEQ ID NO: 102612 - DNA, 24 bp, Artificial sequence
  SiRNA target sequence
atgttaacatgaatagtagaccct

SEQ ID NO: 102613 - DNA, 24 bp, Artificial sequence
  SiRNA target sequence
tgttaacatgaatagtagaccctt

SEQ ID NO: 102614 - DNA, 24 bp, Artificial sequence
  SiRNA target sequence
gttaacatgaatagtagacccttt

SEQ ID NO: 102615 - DNA, 24 bp, Artificial sequence
  SiRNA target sequence
ttaacatgaatagtagacccttta

SEQ ID NO: 102616 - DNA, 24 bp, Artificial sequence
  SiRNA target sequence
taacatgaatagtagaccctttag

SEQ ID NO: 102617 - DNA, 24 bp, Artificial sequence
  SiRNA target sequence
aacatgaatagtagaccctttagt

SEQ ID NO: 102618 - DNA, 24 bp, Artificial sequence
  SiRNA target sequence
acatgaatagtagaccctttagta

SEQ ID NO: 102619 - DNA, 24 bp, Artificial sequence
  SiRNA target sequence
catgaatagtagaccctttagtaa

SEQ ID NO: 102620 - DNA, 24 bp, Artificial sequence
  SiRNA target sequence
atgaatagtagaccctttagtaag

SEQ ID NO: 102621 - DNA, 24 bp, Artificial sequence
  SiRNA target sequence
tgaatagtagaccctttagtaagt

SEQ ID NO: 102622 - DNA, 24 bp, Artificial sequence
  SiRNA target sequence
gaatagtagaccctttagtaagta

SEQ ID NO: 102623 - DNA, 24 bp, Artificial sequence
  SiRNA target sequence
aatagtagaccctttagtaagtaa

SEQ ID NO: 102624 - DNA, 24 bp, Artificial sequence
  SiRNA target sequence
atagtagaccctttagtaagtaat

SEQ ID NO: 102625 - DNA, 24 bp, Artificial sequence
  SiRNA target sequence
tagtagaccctttagtaagtaatt

SEQ ID NO: 102626 - DNA, 24 bp, Artificial sequence
  SiRNA target sequence
agtagaccctttagtaagtaattt

SEQ ID NO: 102627 - DNA, 24 bp, Artificial sequence
  SiRNA target sequence
gtagaccctttagtaagtaatttt

SEQ ID NO: 102628 - DNA, 24 bp, Artificial sequence
  SiRNA target sequence
tagaccctttagtaagtaatttta

SEQ ID NO: 102629 - DNA, 24 bp, Artificial sequence
  SiRNA target sequence
agaccctttagtaagtaattttaa

SEQ ID NO: 102630 - DNA, 24 bp, Artificial sequence
  SiRNA target sequence
gaccctttagtaagtaattttaaa

SEQ ID NO: 102631 - DNA, 24 bp, Artificial sequence
  SiRNA target sequence
accctttagtaagtaattttaaat

SEQ ID NO: 102632 - DNA, 24 bp, Artificial sequence
  SiRNA target sequence
ccctttagtaagtaattttaaata

SEQ ID NO: 102633 - DNA, 24 bp, Artificial sequence
  SiRNA target sequence
cctttagtaagtaattttaaatac

SEQ ID NO: 102634 - DNA, 24 bp, Artificial sequence
  SiRNA target sequence
ctttagtaagtaattttaaatact

SEQ ID NO: 102635 - DNA, 24 bp, Artificial sequence
  SiRNA target sequence
tttagtaagtaattttaaatactc

SEQ ID NO: 102636 - DNA, 24 bp, Artificial sequence
  SiRNA target sequence
ttagtaagtaattttaaatactct

SEQ ID NO: 102637 - DNA, 24 bp, Artificial sequence
  SiRNA target sequence
tagtaagtaattttaaatactctg

SEQ ID NO: 102638 - DNA, 24 bp, Artificial sequence
  SiRNA target sequence
agtaagtaattttaaatactctga

SEQ ID NO: 102639 - DNA, 24 bp, Artificial sequence
  SiRNA target sequence
gtaagtaattttaaatactctgaa

SEQ ID NO: 102640 - DNA, 24 bp, Artificial sequence
  SiRNA target sequence
taagtaattttaaatactctgaac

SEQ ID NO: 102641 - DNA, 24 bp, Artificial sequence
  SiRNA target sequence
aagtaattttaaatactctgaaca

SEQ ID NO: 102642 - DNA, 24 bp, Artificial sequence
  SiRNA target sequence
agtaattttaaatactctgaacaa

SEQ ID NO: 102643 - DNA, 24 bp, Artificial sequence
  SiRNA target sequence
gtaattttaaatactctgaacaaa

SEQ ID NO: 102644 - DNA, 24 bp, Artificial sequence
  SiRNA target sequence
taattttaaatactctgaacaaag

SEQ ID NO: 102645 - DNA, 24 bp, Artificial sequence
  SiRNA target sequence
aattttaaatactctgaacaaaga

SEQ ID NO: 102646 - DNA, 24 bp, Artificial sequence
  SiRNA target sequence
attttaaatactctgaacaaagac

SEQ ID NO: 102647 - DNA, 24 bp, Artificial sequence
  SiRNA target sequence
ttttaaatactctgaacaaagacc

SEQ ID NO: 102648 - DNA, 24 bp, Artificial sequence
  SiRNA target sequence
tttaaatactctgaacaaagacct

SEQ ID NO: 102649 - DNA, 24 bp, Artificial sequence
  SiRNA target sequence
ttaaatactctgaacaaagacctt

SEQ ID NO: 102650 - DNA, 24 bp, Artificial sequence
  SiRNA target sequence
taaatactctgaacaaagaccttt

SEQ ID NO: 102651 - DNA, 24 bp, Artificial sequence
  SiRNA target sequence
aaatactctgaacaaagacctttt

SEQ ID NO: 102652 - DNA, 24 bp, Artificial sequence
  SiRNA target sequence
aatactctgaacaaagaccttttc

SEQ ID NO: 102653 - DNA, 24 bp, Artificial sequence
  SiRNA target sequence
atactctgaacaaagaccttttcg

SEQ ID NO: 102654 - DNA, 24 bp, Artificial sequence
  SiRNA target sequence
tactctgaacaaagaccttttcgt

SEQ ID NO: 102655 - DNA, 24 bp, Artificial sequence
  SiRNA target sequence
actctgaacaaagaccttttcgtt

SEQ ID NO: 102656 - DNA, 24 bp, Artificial sequence
  SiRNA target sequence
ctctgaacaaagaccttttcgttc

SEQ ID NO: 102657 - DNA, 24 bp, Artificial sequence
  SiRNA target sequence
tctgaacaaagaccttttcgttct

SEQ ID NO: 102658 - DNA, 24 bp, Artificial sequence
  SiRNA target sequence
ctgaacaaagaccttttcgttctt

SEQ ID NO: 102659 - DNA, 24 bp, Artificial sequence
  SiRNA target sequence
tgaacaaagaccttttcgttcttc

SEQ ID NO: 102660 - DNA, 24 bp, Artificial sequence
  SiRNA target sequence
gaacaaagaccttttcgttcttct

SEQ ID NO: 102661 - DNA, 24 bp, Artificial sequence
  SiRNA target sequence
aacaaagaccttttcgttcttctt

SEQ ID NO: 102662 - DNA, 24 bp, Artificial sequence
  SiRNA target sequence
acaaagaccttttcgttcttcttt

SEQ ID NO: 102663 - DNA, 24 bp, Artificial sequence
  SiRNA target sequence
caaagaccttttcgttcttctttt

SEQ ID NO: 102664 - DNA, 24 bp, Artificial sequence
  SiRNA target sequence
aaagaccttttcgttcttctttta

SEQ ID NO: 102665 - DNA, 24 bp, Artificial sequence
  SiRNA target sequence
aagaccttttcgttcttcttttaa

SEQ ID NO: 102666 - DNA, 24 bp, Artificial sequence
  SiRNA target sequence
agaccttttcgttcttcttttaaa

SEQ ID NO: 102667 - DNA, 24 bp, Artificial sequence
  SiRNA target sequence
gaccttttcgttcttcttttaaac

SEQ ID NO: 102668 - DNA, 24 bp, Artificial sequence
  SiRNA target sequence
accttttcgttcttcttttaaact

SEQ ID NO: 102669 - DNA, 24 bp, Artificial sequence
  SiRNA target sequence
ccttttcgttcttcttttaaactt

SEQ ID NO: 102670 - DNA, 24 bp, Artificial sequence
  SiRNA target sequence
cttttcgttcttcttttaaacttg

SEQ ID NO: 102671 - DNA, 24 bp, Artificial sequence
  SiRNA target sequence
ttttcgttcttcttttaaacttgt

SEQ ID NO: 102672 - DNA, 24 bp, Artificial sequence
  SiRNA target sequence
tttcgttcttcttttaaacttgtt

SEQ ID NO: 102673 - DNA, 24 bp, Artificial sequence
  SiRNA target sequence
ttcgttcttcttttaaacttgttt

SEQ ID NO: 102674 - DNA, 24 bp, Artificial sequence
  SiRNA target sequence
tcgttcttcttttaaacttgtttt

SEQ ID NO: 102675 - DNA, 24 bp, Artificial sequence
  SiRNA target sequence
cgttcttcttttaaacttgtttta

SEQ ID NO: 102676 - DNA, 24 bp, Artificial sequence
  SiRNA target sequence
gttcttcttttaaacttgttttaa

SEQ ID NO: 102677 - DNA, 24 bp, Artificial sequence
  SiRNA target sequence
ttcttcttttaaacttgttttaaa

SEQ ID NO: 102678 - DNA, 24 bp, Artificial sequence
  SiRNA target sequence
tcttcttttaaacttgttttaaaa

SEQ ID NO: 102679 - DNA, 24 bp, Artificial sequence
  SiRNA target sequence
cttcttttaaacttgttttaaaag

SEQ ID NO: 102680 - DNA, 24 bp, Artificial sequence
  SiRNA target sequence
ttcttttaaacttgttttaaaaga

SEQ ID NO: 102681 - DNA, 24 bp, Artificial sequence
  SiRNA target sequence
tcttttaaacttgttttaaaagaa

SEQ ID NO: 102682 - DNA, 24 bp, Artificial sequence
  SiRNA target sequence
cttttaaacttgttttaaaagaaa

SEQ ID NO: 102683 - DNA, 24 bp, Artificial sequence
  SiRNA target sequence
ttttaaacttgttttaaaagaaac

SEQ ID NO: 102684 - DNA, 24 bp, Artificial sequence
  SiRNA target sequence
tttaaacttgttttaaaagaaaca

SEQ ID NO: 102685 - DNA, 24 bp, Artificial sequence
  SiRNA target sequence
ttaaacttgttttaaaagaaacaa

SEQ ID NO: 102686 - DNA, 24 bp, Artificial sequence
  SiRNA target sequence
taaacttgttttaaaagaaacaag

SEQ ID NO: 102687 - DNA, 24 bp, Artificial sequence
  SiRNA target sequence
aaacttgttttaaaagaaacaaga

SEQ ID NO: 102688 - DNA, 24 bp, Artificial sequence
  SiRNA target sequence
aacttgttttaaaagaaacaagag

SEQ ID NO: 102689 - DNA, 24 bp, Artificial sequence
  SiRNA target sequence
acttgttttaaaagaaacaagaga

SEQ ID NO: 102690 - DNA, 24 bp, Artificial sequence
  SiRNA target sequence
cttgttttaaaagaaacaagagag

SEQ ID NO: 102691 - DNA, 24 bp, Artificial sequence
  SiRNA target sequence
ttgttttaaaagaaacaagagaga

SEQ ID NO: 102692 - DNA, 24 bp, Artificial sequence
  SiRNA target sequence
tgttttaaaagaaacaagagagac

SEQ ID NO: 102693 - DNA, 24 bp, Artificial sequence
  SiRNA target sequence
gttttaaaagaaacaagagagacg

SEQ ID NO: 102694 - DNA, 24 bp, Artificial sequence
  SiRNA target sequence
ttttaaaagaaacaagagagacgg

SEQ ID NO: 102695 - DNA, 24 bp, Artificial sequence
  SiRNA target sequence
tttaaaagaaacaagagagacggt

SEQ ID NO: 102696 - DNA, 24 bp, Artificial sequence
  SiRNA target sequence
ttaaaagaaacaagagagacggtg

SEQ ID NO: 102697 - DNA, 24 bp, Artificial sequence
  SiRNA target sequence
taaaagaaacaagagagacggtga

SEQ ID NO: 102698 - DNA, 24 bp, Artificial sequence
  SiRNA target sequence
aaaagaaacaagagagacggtgac

SEQ ID NO: 102699 - DNA, 24 bp, Artificial sequence
  SiRNA target sequence
aaagaaacaagagagacggtgaca

SEQ ID NO: 102700 - DNA, 24 bp, Artificial sequence
  SiRNA target sequence
aagaaacaagagagacggtgacaa

SEQ ID NO: 102701 - DNA, 24 bp, Artificial sequence
  SiRNA target sequence
agaaacaagagagacggtgacaaa

SEQ ID NO: 102702 - DNA, 24 bp, Artificial sequence
  SiRNA target sequence
gaaacaagagagacggtgacaaag

SEQ ID NO: 102703 - DNA, 24 bp, Artificial sequence
  SiRNA target sequence
aaacaagagagacggtgacaaagt

SEQ ID NO: 102704 - DNA, 24 bp, Artificial sequence
  SiRNA target sequence
aacaagagagacggtgacaaagta

SEQ ID NO: 102705 - DNA, 24 bp, Artificial sequence
  SiRNA target sequence
acaagagagacggtgacaaagtaa

SEQ ID NO: 102706 - DNA, 24 bp, Artificial sequence
  SiRNA target sequence
caagagagacggtgacaaagtaac

SEQ ID NO: 102707 - DNA, 24 bp, Artificial sequence
  SiRNA target sequence
aagagagacggtgacaaagtaaca

SEQ ID NO: 102708 - DNA, 24 bp, Artificial sequence
  SiRNA target sequence
agagagacggtgacaaagtaacaa

SEQ ID NO: 102709 - DNA, 24 bp, Artificial sequence
  SiRNA target sequence
gagagacggtgacaaagtaacaaa

SEQ ID NO: 102710 - DNA, 24 bp, Artificial sequence
  SiRNA target sequence
agagacggtgacaaagtaacaaaa

SEQ ID NO: 102711 - DNA, 24 bp, Artificial sequence
  SiRNA target sequence
gagacggtgacaaagtaacaaaaa

SEQ ID NO: 102712 - DNA, 24 bp, Artificial sequence
  SiRNA target sequence
agacggtgacaaagtaacaaaaat

SEQ ID NO: 102713 - DNA, 24 bp, Artificial sequence
  SiRNA target sequence
gacggtgacaaagtaacaaaaatc

SEQ ID NO: 102714 - DNA, 24 bp, Artificial sequence
  SiRNA target sequence
acggtgacaaagtaacaaaaatct

SEQ ID NO: 102715 - DNA, 24 bp, Artificial sequence
  SiRNA target sequence
cggtgacaaagtaacaaaaatctt

SEQ ID NO: 102716 - DNA, 24 bp, Artificial sequence
  SiRNA target sequence
ggtgacaaagtaacaaaaatcttt

SEQ ID NO: 102717 - DNA, 24 bp, Artificial sequence
  SiRNA target sequence
gtgacaaagtaacaaaaatctttt

SEQ ID NO: 102718 - DNA, 24 bp, Artificial sequence
  SiRNA target sequence
tgacaaagtaacaaaaatcttttt

SEQ ID NO: 102719 - DNA, 24 bp, Artificial sequence
  SiRNA target sequence
gacaaagtaacaaaaatctttttt

SEQ ID NO: 102720 - DNA, 24 bp, Artificial sequence
  SiRNA target sequence
acaaagtaacaaaaatcttttttc

SEQ ID NO: 102721 - DNA, 24 bp, Artificial sequence
  SiRNA target sequence
caaagtaacaaaaatcttttttcg

SEQ ID NO: 102722 - DNA, 24 bp, Artificial sequence
  SiRNA target sequence
aaagtaacaaaaatcttttttcgt

SEQ ID NO: 102723 - DNA, 24 bp, Artificial sequence
  SiRNA target sequence
aagtaacaaaaatcttttttcgtt

SEQ ID NO: 102724 - DNA, 24 bp, Artificial sequence
  SiRNA target sequence
agtaacaaaaatcttttttcgtta

SEQ ID NO: 102725 - DNA, 24 bp, Artificial sequence
  SiRNA target sequence
gtaacaaaaatcttttttcgttaa

SEQ ID NO: 102726 - DNA, 24 bp, Artificial sequence
  SiRNA target sequence
taacaaaaatcttttttcgttaat

SEQ ID NO: 102727 - DNA, 24 bp, Artificial sequence
  SiRNA target sequence
aacaaaaatcttttttcgttaatg

SEQ ID NO: 102728 - DNA, 24 bp, Artificial sequence
  SiRNA target sequence
acaaaaatcttttttcgttaatgt

SEQ ID NO: 102729 - DNA, 24 bp, Artificial sequence
  SiRNA target sequence
caaaaatcttttttcgttaatgta

SEQ ID NO: 102730 - DNA, 24 bp, Artificial sequence
  SiRNA target sequence
aaaaatcttttttcgttaatgtaa

SEQ ID NO: 102731 - DNA, 24 bp, Artificial sequence
  SiRNA target sequence
aaaatcttttttcgttaatgtaaa

SEQ ID NO: 102732 - DNA, 24 bp, Artificial sequence
  SiRNA target sequence
aaatcttttttcgttaatgtaaaa

SEQ ID NO: 102733 - DNA, 24 bp, Artificial sequence
  SiRNA target sequence
aatcttttttcgttaatgtaaaat

SEQ ID NO: 102734 - DNA, 24 bp, Artificial sequence
  SiRNA target sequence
atcttttttcgttaatgtaaaata

SEQ ID NO: 102735 - DNA, 24 bp, Artificial sequence
  SiRNA target sequence
tcttttttcgttaatgtaaaatat

SEQ ID NO: 102736 - DNA, 24 bp, Artificial sequence
  SiRNA target sequence
cttttttcgttaatgtaaaatatc

SEQ ID NO: 102737 - DNA, 24 bp, Artificial sequence
  SiRNA target sequence
ttttttcgttaatgtaaaatatct

SEQ ID NO: 102738 - DNA, 24 bp, Artificial sequence
  SiRNA target sequence
tttttcgttaatgtaaaatatctt

SEQ ID NO: 102739 - DNA, 24 bp, Artificial sequence
  SiRNA target sequence
ttttcgttaatgtaaaatatcttg

SEQ ID NO: 102740 - DNA, 24 bp, Artificial sequence
  SiRNA target sequence
tttcgttaatgtaaaatatcttgg

SEQ ID NO: 102741 - DNA, 24 bp, Artificial sequence
  SiRNA target sequence
ttcgttaatgtaaaatatcttgga

SEQ ID NO: 102742 - DNA, 24 bp, Artificial sequence
  SiRNA target sequence
tcgttaatgtaaaatatcttggat

SEQ ID NO: 102743 - DNA, 24 bp, Artificial sequence
  SiRNA target sequence
cgttaatgtaaaatatcttggatt

SEQ ID NO: 102744 - DNA, 24 bp, Artificial sequence
  SiRNA target sequence
gttaatgtaaaatatcttggatta

SEQ ID NO: 102745 - DNA, 24 bp, Artificial sequence
  SiRNA target sequence
ttaatgtaaaatatcttggattaa

SEQ ID NO: 102746 - DNA, 24 bp, Artificial sequence
  SiRNA target sequence
taatgtaaaatatcttggattaat

SEQ ID NO: 102747 - DNA, 24 bp, Artificial sequence
  SiRNA target sequence
aatgtaaaatatcttggattaatt

SEQ ID NO: 102748 - DNA, 24 bp, Artificial sequence
  SiRNA target sequence
atgtaaaatatcttggattaatta

SEQ ID NO: 102749 - DNA, 24 bp, Artificial sequence
  SiRNA target sequence
tgtaaaatatcttggattaattac

SEQ ID NO: 102750 - DNA, 24 bp, Artificial sequence
  SiRNA target sequence
gtaaaatatcttggattaattaca

SEQ ID NO: 102751 - DNA, 24 bp, Artificial sequence
  SiRNA target sequence
taaaatatcttggattaattacag

SEQ ID NO: 102752 - DNA, 24 bp, Artificial sequence
  SiRNA target sequence
aaaatatcttggattaattacagg

SEQ ID NO: 102753 - DNA, 24 bp, Artificial sequence
  SiRNA target sequence
aaatatcttggattaattacaggg

SEQ ID NO: 102754 - DNA, 24 bp, Artificial sequence
  SiRNA target sequence
aatatcttggattaattacaggga

SEQ ID NO: 102755 - DNA, 24 bp, Artificial sequence
  SiRNA target sequence
atatcttggattaattacagggat

SEQ ID NO: 102756 - DNA, 24 bp, Artificial sequence
  SiRNA target sequence
tatcttggattaattacagggata

SEQ ID NO: 102757 - DNA, 24 bp, Artificial sequence
  SiRNA target sequence
atcttggattaattacagggatat

SEQ ID NO: 102758 - DNA, 24 bp, Artificial sequence
  SiRNA target sequence
tcttggattaattacagggatata

SEQ ID NO: 102759 - DNA, 24 bp, Artificial sequence
  SiRNA target sequence
cttggattaattacagggatatac

SEQ ID NO: 102760 - DNA, 24 bp, Artificial sequence
  SiRNA target sequence
ttggattaattacagggatatact

SEQ ID NO: 102761 - DNA, 24 bp, Artificial sequence
  SiRNA target sequence
tggattaattacagggatatactt

SEQ ID NO: 102762 - DNA, 24 bp, Artificial sequence
  SiRNA target sequence
ggattaattacagggatatacttg

SEQ ID NO: 102763 - DNA, 24 bp, Artificial sequence
  SiRNA target sequence
gattaattacagggatatacttgt

SEQ ID NO: 102764 - DNA, 24 bp, Artificial sequence
  SiRNA target sequence
attaattacagggatatacttgta

SEQ ID NO: 102765 - DNA, 24 bp, Artificial sequence
  SiRNA target sequence
ttaattacagggatatacttgtac

SEQ ID NO: 102766 - DNA, 24 bp, Artificial sequence
  SiRNA target sequence
taattacagggatatacttgtaca

SEQ ID NO: 102767 - DNA, 24 bp, Artificial sequence
  SiRNA target sequence
aattacagggatatacttgtacat

SEQ ID NO: 102768 - DNA, 24 bp, Artificial sequence
  SiRNA target sequence
attacagggatatacttgtacata

SEQ ID NO: 102769 - DNA, 24 bp, Artificial sequence
  SiRNA target sequence
ttacagggatatacttgtacataa

SEQ ID NO: 102770 - DNA, 24 bp, Artificial sequence
  SiRNA target sequence
tacagggatatacttgtacataaa

SEQ ID NO: 102771 - DNA, 24 bp, Artificial sequence
  SiRNA target sequence
acagggatatacttgtacataaaa

SEQ ID NO: 102772 - DNA, 24 bp, Artificial sequence
  SiRNA target sequence
cagggatatacttgtacataaaat

SEQ ID NO: 102773 - DNA, 24 bp, Artificial sequence
  SiRNA target sequence
agggatatacttgtacataaaatt

SEQ ID NO: 102774 - DNA, 24 bp, Artificial sequence
  SiRNA target sequence
gggatatacttgtacataaaattt

SEQ ID NO: 102775 - DNA, 24 bp, Artificial sequence
  SiRNA target sequence
ggatatacttgtacataaaatttg

SEQ ID NO: 102776 - DNA, 24 bp, Artificial sequence
  SiRNA target sequence
gatatacttgtacataaaatttga

SEQ ID NO: 102777 - DNA, 24 bp, Artificial sequence
  SiRNA target sequence
atatacttgtacataaaatttgag

SEQ ID NO: 102778 - DNA, 24 bp, Artificial sequence
  SiRNA target sequence
tatacttgtacataaaatttgagg

SEQ ID NO: 102779 - DNA, 24 bp, Artificial sequence
  SiRNA target sequence
atacttgtacataaaatttgaggt

SEQ ID NO: 102780 - DNA, 24 bp, Artificial sequence
  SiRNA target sequence
tacttgtacataaaatttgaggta

SEQ ID NO: 102781 - DNA, 24 bp, Artificial sequence
  SiRNA target sequence
acttgtacataaaatttgaggtaa

SEQ ID NO: 102782 - DNA, 24 bp, Artificial sequence
  SiRNA target sequence
cttgtacataaaatttgaggtaag

SEQ ID NO: 102783 - DNA, 24 bp, Artificial sequence
  SiRNA target sequence
ttgtacataaaatttgaggtaagt

SEQ ID NO: 102784 - DNA, 24 bp, Artificial sequence
  SiRNA target sequence
tgtacataaaatttgaggtaagtt

SEQ ID NO: 102785 - DNA, 24 bp, Artificial sequence
  SiRNA target sequence
gtacataaaatttgaggtaagttt

SEQ ID NO: 102786 - DNA, 24 bp, Artificial sequence
  SiRNA target sequence
tacataaaatttgaggtaagtttt

SEQ ID NO: 102787 - DNA, 24 bp, Artificial sequence
  SiRNA target sequence
acataaaatttgaggtaagtttta

SEQ ID NO: 102788 - DNA, 24 bp, Artificial sequence
  SiRNA target sequence
cataaaatttgaggtaagttttat

SEQ ID NO: 102789 - DNA, 24 bp, Artificial sequence
  SiRNA target sequence
ataaaatttgaggtaagttttatc

SEQ ID NO: 102790 - DNA, 24 bp, Artificial sequence
  SiRNA target sequence
taaaatttgaggtaagttttatct

SEQ ID NO: 102791 - DNA, 24 bp, Artificial sequence
  SiRNA target sequence
aaaatttgaggtaagttttatctt

SEQ ID NO: 102792 - DNA, 24 bp, Artificial sequence
  SiRNA target sequence
aaatttgaggtaagttttatctta

SEQ ID NO: 102793 - DNA, 24 bp, Artificial sequence
  SiRNA target sequence
aatttgaggtaagttttatcttaa

SEQ ID NO: 102794 - DNA, 24 bp, Artificial sequence
  SiRNA target sequence
atttgaggtaagttttatcttaaa

SEQ ID NO: 102795 - DNA, 24 bp, Artificial sequence
  SiRNA target sequence
tttgaggtaagttttatcttaaaa

SEQ ID NO: 102796 - DNA, 24 bp, Artificial sequence
  SiRNA target sequence
ttgaggtaagttttatcttaaaat

SEQ ID NO: 102797 - DNA, 24 bp, Artificial sequence
  SiRNA target sequence
tgaggtaagttttatcttaaaatc

SEQ ID NO: 102798 - DNA, 24 bp, Artificial sequence
  SiRNA target sequence
gaggtaagttttatcttaaaatct

SEQ ID NO: 102799 - DNA, 24 bp, Artificial sequence
  SiRNA target sequence
aggtaagttttatcttaaaatctt

SEQ ID NO: 102800 - DNA, 24 bp, Artificial sequence
  SiRNA target sequence
ggtaagttttatcttaaaatcttt

SEQ ID NO: 102801 - DNA, 24 bp, Artificial sequence
  SiRNA target sequence
gtaagttttatcttaaaatctttt

SEQ ID NO: 102802 - DNA, 24 bp, Artificial sequence
  SiRNA target sequence
taagttttatcttaaaatctttta

SEQ ID NO: 102803 - DNA, 24 bp, Artificial sequence
  SiRNA target sequence
aagttttatcttaaaatcttttag

SEQ ID NO: 102804 - DNA, 24 bp, Artificial sequence
  SiRNA target sequence
agttttatcttaaaatcttttaga

SEQ ID NO: 102805 - DNA, 24 bp, Artificial sequence
  SiRNA target sequence
gttttatcttaaaatcttttagaa

SEQ ID NO: 102806 - DNA, 24 bp, Artificial sequence
  SiRNA target sequence
ttttatcttaaaatcttttagaac

SEQ ID NO: 102807 - DNA, 24 bp, Artificial sequence
  SiRNA target sequence
tttatcttaaaatcttttagaacc

SEQ ID NO: 102808 - DNA, 24 bp, Artificial sequence
  SiRNA target sequence
ttatcttaaaatcttttagaacct

SEQ ID NO: 102809 - DNA, 24 bp, Artificial sequence
  SiRNA target sequence
tatcttaaaatcttttagaacctc

SEQ ID NO: 102810 - DNA, 24 bp, Artificial sequence
  SiRNA target sequence
atcttaaaatcttttagaacctca

SEQ ID NO: 102811 - DNA, 24 bp, Artificial sequence
  SiRNA target sequence
tcttaaaatcttttagaacctcaa

SEQ ID NO: 102812 - DNA, 24 bp, Artificial sequence
  SiRNA target sequence
cttaaaatcttttagaacctcaaa

SEQ ID NO: 102813 - DNA, 24 bp, Artificial sequence
  SiRNA target sequence
ttaaaatcttttagaacctcaaaa

SEQ ID NO: 102814 - DNA, 24 bp, Artificial sequence
  SiRNA target sequence
taaaatcttttagaacctcaaaaa

SEQ ID NO: 102815 - DNA, 24 bp, Artificial sequence
  SiRNA target sequence
aaaatcttttagaacctcaaaaat

SEQ ID NO: 102816 - DNA, 24 bp, Artificial sequence
  SiRNA target sequence
aaatcttttagaacctcaaaaata

SEQ ID NO: 102817 - DNA, 24 bp, Artificial sequence
  SiRNA target sequence
aatcttttagaacctcaaaaatag

SEQ ID NO: 102818 - DNA, 24 bp, Artificial sequence
  SiRNA target sequence
atcttttagaacctcaaaaatagt

SEQ ID NO: 102819 - DNA, 24 bp, Artificial sequence
  SiRNA target sequence
tcttttagaacctcaaaaatagtg

SEQ ID NO: 102820 - DNA, 24 bp, Artificial sequence
  SiRNA target sequence
cttttagaacctcaaaaatagtgc

SEQ ID NO: 102821 - DNA, 24 bp, Artificial sequence
  SiRNA target sequence
ttttagaacctcaaaaatagtgcg

SEQ ID NO: 102822 - DNA, 24 bp, Artificial sequence
  SiRNA target sequence
tttagaacctcaaaaatagtgcgc

SEQ ID NO: 102823 - DNA, 24 bp, Artificial sequence
  SiRNA target sequence
ttagaacctcaaaaatagtgcgct

SEQ ID NO: 102824 - DNA, 24 bp, Artificial sequence
  SiRNA target sequence
tagaacctcaaaaatagtgcgctt

SEQ ID NO: 102825 - DNA, 24 bp, Artificial sequence
  SiRNA target sequence
agaacctcaaaaatagtgcgcttc

SEQ ID NO: 102826 - DNA, 24 bp, Artificial sequence
  SiRNA target sequence
gaacctcaaaaatagtgcgcttcg

SEQ ID NO: 102827 - DNA, 24 bp, Artificial sequence
  SiRNA target sequence
aacctcaaaaatagtgcgcttcgg

SEQ ID NO: 102828 - DNA, 24 bp, Artificial sequence
  SiRNA target sequence
acctcaaaaatagtgcgcttcggt

SEQ ID NO: 102829 - DNA, 24 bp, Artificial sequence
  SiRNA target sequence
cctcaaaaatagtgcgcttcggta

SEQ ID NO: 102830 - DNA, 24 bp, Artificial sequence
  SiRNA target sequence
ctcaaaaatagtgcgcttcggtag

SEQ ID NO: 102831 - DNA, 24 bp, Artificial sequence
  SiRNA target sequence
tcaaaaatagtgcgcttcggtagt

SEQ ID NO: 102832 - DNA, 24 bp, Artificial sequence
  SiRNA target sequence
caaaaatagtgcgcttcggtagta

SEQ ID NO: 102833 - DNA, 24 bp, Artificial sequence
  SiRNA target sequence
aaaaatagtgcgcttcggtagtaa

SEQ ID NO: 102834 - DNA, 24 bp, Artificial sequence
  SiRNA target sequence
aaaatagtgcgcttcggtagtaaa

SEQ ID NO: 102835 - DNA, 24 bp, Artificial sequence
  SiRNA target sequence
aaatagtgcgcttcggtagtaaaa

SEQ ID NO: 102836 - DNA, 24 bp, Artificial sequence
  SiRNA target sequence
aatagtgcgcttcggtagtaaaat

SEQ ID NO: 102837 - DNA, 24 bp, Artificial sequence
  SiRNA target sequence
atagtgcgcttcggtagtaaaatg

SEQ ID NO: 102838 - DNA, 24 bp, Artificial sequence
  SiRNA target sequence
tagtgcgcttcggtagtaaaatgt

SEQ ID NO: 102839 - DNA, 24 bp, Artificial sequence
  SiRNA target sequence
agtgcgcttcggtagtaaaatgta

SEQ ID NO: 102840 - DNA, 24 bp, Artificial sequence
  SiRNA target sequence
gtgcgcttcggtagtaaaatgtaa

SEQ ID NO: 102841 - DNA, 24 bp, Artificial sequence
  SiRNA target sequence
tgcgcttcggtagtaaaatgtaat

SEQ ID NO: 102842 - DNA, 24 bp, Artificial sequence
  SiRNA target sequence
gcgcttcggtagtaaaatgtaatc

SEQ ID NO: 102843 - DNA, 24 bp, Artificial sequence
  SiRNA target sequence
cgcttcggtagtaaaatgtaatca

SEQ ID NO: 102844 - DNA, 24 bp, Artificial sequence
  SiRNA target sequence
gcttcggtagtaaaatgtaatcat

SEQ ID NO: 102845 - DNA, 24 bp, Artificial sequence
  SiRNA target sequence
cttcggtagtaaaatgtaatcata

SEQ ID NO: 102846 - DNA, 24 bp, Artificial sequence
  SiRNA target sequence
ttcggtagtaaaatgtaatcatag

SEQ ID NO: 102847 - DNA, 24 bp, Artificial sequence
  SiRNA target sequence
tcggtagtaaaatgtaatcatagt

SEQ ID NO: 102848 - DNA, 24 bp, Artificial sequence
  SiRNA target sequence
cggtagtaaaatgtaatcatagta

SEQ ID NO: 102849 - DNA, 24 bp, Artificial sequence
  SiRNA target sequence
ggtagtaaaatgtaatcatagtac

SEQ ID NO: 102850 - DNA, 24 bp, Artificial sequence
  SiRNA target sequence
gtagtaaaatgtaatcatagtaca

SEQ ID NO: 102851 - DNA, 24 bp, Artificial sequence
  SiRNA target sequence
tagtaaaatgtaatcatagtacag

SEQ ID NO: 102852 - DNA, 24 bp, Artificial sequence
  SiRNA target sequence
agtaaaatgtaatcatagtacaga

SEQ ID NO: 102853 - DNA, 24 bp, Artificial sequence
  SiRNA target sequence
gtaaaatgtaatcatagtacagat

SEQ ID NO: 102854 - DNA, 24 bp, Artificial sequence
  SiRNA target sequence
taaaatgtaatcatagtacagatc

SEQ ID NO: 102855 - DNA, 24 bp, Artificial sequence
  SiRNA target sequence
aaaatgtaatcatagtacagatcg

SEQ ID NO: 102856 - DNA, 24 bp, Artificial sequence
  SiRNA target sequence
aaatgtaatcatagtacagatcgt

SEQ ID NO: 102857 - DNA, 24 bp, Artificial sequence
  SiRNA target sequence
aatgtaatcatagtacagatcgta

SEQ ID NO: 102858 - DNA, 24 bp, Artificial sequence
  SiRNA target sequence
atgtaatcatagtacagatcgtaa

SEQ ID NO: 102859 - DNA, 24 bp, Artificial sequence
  SiRNA target sequence
tgtaatcatagtacagatcgtaat

SEQ ID NO: 102860 - DNA, 24 bp, Artificial sequence
  SiRNA target sequence
gtaatcatagtacagatcgtaatt

SEQ ID NO: 102861 - DNA, 24 bp, Artificial sequence
  SiRNA target sequence
taatcatagtacagatcgtaattt

SEQ ID NO: 102862 - DNA, 24 bp, Artificial sequence
  SiRNA target sequence
aatcatagtacagatcgtaattta

SEQ ID NO: 102863 - DNA, 24 bp, Artificial sequence
  SiRNA target sequence
atcatagtacagatcgtaatttag

SEQ ID NO: 102864 - DNA, 24 bp, Artificial sequence
  SiRNA target sequence
tcatagtacagatcgtaatttaga

SEQ ID NO: 102865 - DNA, 24 bp, Artificial sequence
  SiRNA target sequence
catagtacagatcgtaatttagat

SEQ ID NO: 102866 - DNA, 24 bp, Artificial sequence
  SiRNA target sequence
atagtacagatcgtaatttagata

SEQ ID NO: 102867 - DNA, 24 bp, Artificial sequence
  SiRNA target sequence
tagtacagatcgtaatttagataa

SEQ ID NO: 102868 - DNA, 24 bp, Artificial sequence
  SiRNA target sequence
agtacagatcgtaatttagataaa

SEQ ID NO: 102869 - DNA, 24 bp, Artificial sequence
  SiRNA target sequence
gtacagatcgtaatttagataaat

SEQ ID NO: 102870 - DNA, 24 bp, Artificial sequence
  SiRNA target sequence
tacagatcgtaatttagataaatt

SEQ ID NO: 102871 - DNA, 24 bp, Artificial sequence
  SiRNA target sequence
acagatcgtaatttagataaattt

SEQ ID NO: 102872 - DNA, 24 bp, Artificial sequence
  SiRNA target sequence
cagatcgtaatttagataaatttc

SEQ ID NO: 102873 - DNA, 24 bp, Artificial sequence
  SiRNA target sequence
agatcgtaatttagataaatttct

SEQ ID NO: 102874 - DNA, 24 bp, Artificial sequence
  SiRNA target sequence
gatcgtaatttagataaatttctt

SEQ ID NO: 102875 - DNA, 24 bp, Artificial sequence
  SiRNA target sequence
atcgtaatttagataaatttcttt

SEQ ID NO: 102876 - DNA, 24 bp, Artificial sequence
  SiRNA target sequence
tcgtaatttagataaatttcttta

SEQ ID NO: 102877 - DNA, 24 bp, Artificial sequence
  SiRNA target sequence
cgtaatttagataaatttctttac

SEQ ID NO: 102878 - DNA, 24 bp, Artificial sequence
  SiRNA target sequence
gtaatttagataaatttctttaca

SEQ ID NO: 102879 - DNA, 24 bp, Artificial sequence
  SiRNA target sequence
taatttagataaatttctttacat

SEQ ID NO: 102880 - DNA, 24 bp, Artificial sequence
  SiRNA target sequence
aatttagataaatttctttacatt

SEQ ID NO: 102881 - DNA, 24 bp, Artificial sequence
  SiRNA target sequence
atttagataaatttctttacattt

SEQ ID NO: 102882 - DNA, 24 bp, Artificial sequence
  SiRNA target sequence
tttagataaatttctttacatttc

SEQ ID NO: 102883 - DNA, 24 bp, Artificial sequence
  SiRNA target sequence
ttagataaatttctttacatttct

SEQ ID NO: 102884 - DNA, 24 bp, Artificial sequence
  SiRNA target sequence
tagataaatttctttacatttctc

SEQ ID NO: 102885 - DNA, 24 bp, Artificial sequence
  SiRNA target sequence
agataaatttctttacatttctca

SEQ ID NO: 102886 - DNA, 24 bp, Artificial sequence
  SiRNA target sequence
gataaatttctttacatttctcac

SEQ ID NO: 102887 - DNA, 24 bp, Artificial sequence
  SiRNA target sequence
ataaatttctttacatttctcacg

SEQ ID NO: 102888 - DNA, 24 bp, Artificial sequence
  SiRNA target sequence
taaatttctttacatttctcacga

SEQ ID NO: 102889 - DNA, 24 bp, Artificial sequence
  SiRNA target sequence
aaatttctttacatttctcacgat

SEQ ID NO: 102890 - DNA, 24 bp, Artificial sequence
  SiRNA target sequence
aatttctttacatttctcacgata

SEQ ID NO: 102891 - DNA, 24 bp, Artificial sequence
  SiRNA target sequence
atttctttacatttctcacgatat

SEQ ID NO: 102892 - DNA, 24 bp, Artificial sequence
  SiRNA target sequence
tttctttacatttctcacgatatt

SEQ ID NO: 102893 - DNA, 24 bp, Artificial sequence
  SiRNA target sequence
ttctttacatttctcacgatattc

SEQ ID NO: 102894 - DNA, 24 bp, Artificial sequence
  SiRNA target sequence
tctttacatttctcacgatattcc

SEQ ID NO: 102895 - DNA, 24 bp, Artificial sequence
  SiRNA target sequence
ctttacatttctcacgatattcct

SEQ ID NO: 102896 - DNA, 24 bp, Artificial sequence
  SiRNA target sequence
tttacatttctcacgatattcctc

SEQ ID NO: 102897 - DNA, 24 bp, Artificial sequence
  SiRNA target sequence
ttacatttctcacgatattcctca

SEQ ID NO: 102898 - DNA, 24 bp, Artificial sequence
  SiRNA target sequence
tacatttctcacgatattcctcag

SEQ ID NO: 102899 - DNA, 24 bp, Artificial sequence
  SiRNA target sequence
acatttctcacgatattcctcagc

SEQ ID NO: 102900 - DNA, 24 bp, Artificial sequence
  SiRNA target sequence
catttctcacgatattcctcagca

SEQ ID NO: 102901 - DNA, 24 bp, Artificial sequence
  SiRNA target sequence
atttctcacgatattcctcagcaa

SEQ ID NO: 102902 - DNA, 24 bp, Artificial sequence
  SiRNA target sequence
tttctcacgatattcctcagcaat

SEQ ID NO: 102903 - DNA, 24 bp, Artificial sequence
  SiRNA target sequence
ttctcacgatattcctcagcaatg

SEQ ID NO: 102904 - DNA, 24 bp, Artificial sequence
  SiRNA target sequence
tctcacgatattcctcagcaatgg

SEQ ID NO: 102905 - DNA, 24 bp, Artificial sequence
  SiRNA target sequence
ctcacgatattcctcagcaatggt

SEQ ID NO: 102906 - DNA, 24 bp, Artificial sequence
  SiRNA target sequence
tcacgatattcctcagcaatggta

SEQ ID NO: 102907 - DNA, 24 bp, Artificial sequence
  SiRNA target sequence
cacgatattcctcagcaatggtat

SEQ ID NO: 102908 - DNA, 24 bp, Artificial sequence
  SiRNA target sequence
acgatattcctcagcaatggtatc

SEQ ID NO: 102909 - DNA, 24 bp, Artificial sequence
  SiRNA target sequence
cgatattcctcagcaatggtatct

SEQ ID NO: 102910 - DNA, 24 bp, Artificial sequence
  SiRNA target sequence
gatattcctcagcaatggtatctg

SEQ ID NO: 102911 - DNA, 24 bp, Artificial sequence
  SiRNA target sequence
atattcctcagcaatggtatctgt

SEQ ID NO: 102912 - DNA, 24 bp, Artificial sequence
  SiRNA target sequence
tattcctcagcaatggtatctgtg

SEQ ID NO: 102913 - DNA, 24 bp, Artificial sequence
  SiRNA target sequence
attcctcagcaatggtatctgtga

SEQ ID NO: 102914 - DNA, 24 bp, Artificial sequence
  SiRNA target sequence
ttcctcagcaatggtatctgtgat

SEQ ID NO: 102915 - DNA, 24 bp, Artificial sequence
  SiRNA target sequence
tcctcagcaatggtatctgtgata

SEQ ID NO: 102916 - DNA, 24 bp, Artificial sequence
  SiRNA target sequence
cctcagcaatggtatctgtgataa

SEQ ID NO: 102917 - DNA, 24 bp, Artificial sequence
  SiRNA target sequence
ctcagcaatggtatctgtgataag

SEQ ID NO: 102918 - DNA, 24 bp, Artificial sequence
  SiRNA target sequence
tcagcaatggtatctgtgataagc

SEQ ID NO: 102919 - DNA, 24 bp, Artificial sequence
  SiRNA target sequence
cagcaatggtatctgtgataagcg

SEQ ID NO: 102920 - DNA, 24 bp, Artificial sequence
  SiRNA target sequence
agcaatggtatctgtgataagcga

SEQ ID NO: 102921 - DNA, 24 bp, Artificial sequence
  SiRNA target sequence
gcaatggtatctgtgataagcgaa

SEQ ID NO: 102922 - DNA, 24 bp, Artificial sequence
  SiRNA target sequence
caatggtatctgtgataagcgaaa

SEQ ID NO: 102923 - DNA, 24 bp, Artificial sequence
  SiRNA target sequence
aatggtatctgtgataagcgaaag

SEQ ID NO: 102924 - DNA, 24 bp, Artificial sequence
  SiRNA target sequence
atggtatctgtgataagcgaaagt

SEQ ID NO: 102925 - DNA, 24 bp, Artificial sequence
  SiRNA target sequence
tggtatctgtgataagcgaaagtt

SEQ ID NO: 102926 - DNA, 24 bp, Artificial sequence
  SiRNA target sequence
ggtatctgtgataagcgaaagttg

SEQ ID NO: 102927 - DNA, 24 bp, Artificial sequence
  SiRNA target sequence
gtatctgtgataagcgaaagttgt

SEQ ID NO: 102928 - DNA, 24 bp, Artificial sequence
  SiRNA target sequence
tatctgtgataagcgaaagttgta

SEQ ID NO: 102929 - DNA, 24 bp, Artificial sequence
  SiRNA target sequence
atctgtgataagcgaaagttgtag

SEQ ID NO: 102930 - DNA, 24 bp, Artificial sequence
  SiRNA target sequence
tctgtgataagcgaaagttgtaga

SEQ ID NO: 102931 - DNA, 24 bp, Artificial sequence
  SiRNA target sequence
ctgtgataagcgaaagttgtagaa

SEQ ID NO: 102932 - DNA, 24 bp, Artificial sequence
  SiRNA target sequence
tgtgataagcgaaagttgtagaaa

SEQ ID NO: 102933 - DNA, 24 bp, Artificial sequence
  SiRNA target sequence
gtgataagcgaaagttgtagaaaa

SEQ ID NO: 102934 - DNA, 24 bp, Artificial sequence
  SiRNA target sequence
tgataagcgaaagttgtagaaaaa

SEQ ID NO: 102935 - DNA, 24 bp, Artificial sequence
  SiRNA target sequence
gataagcgaaagttgtagaaaaaa

SEQ ID NO: 102936 - DNA, 24 bp, Artificial sequence
  SiRNA target sequence
ataagcgaaagttgtagaaaaaaa

SEQ ID NO: 102937 - DNA, 24 bp, Artificial sequence
  SiRNA target sequence
taagcgaaagttgtagaaaaaaat

SEQ ID NO: 102938 - DNA, 24 bp, Artificial sequence
  SiRNA target sequence
aagcgaaagttgtagaaaaaaata

SEQ ID NO: 102939 - DNA, 24 bp, Artificial sequence
  SiRNA target sequence
agcgaaagttgtagaaaaaaatag

SEQ ID NO: 102940 - DNA, 24 bp, Artificial sequence
  SiRNA target sequence
gcgaaagttgtagaaaaaaataga

SEQ ID NO: 102941 - DNA, 24 bp, Artificial sequence
  SiRNA target sequence
cgaaagttgtagaaaaaaatagat

SEQ ID NO: 102942 - DNA, 24 bp, Artificial sequence
  SiRNA target sequence
gaaagttgtagaaaaaaatagatt

SEQ ID NO: 102943 - DNA, 24 bp, Artificial sequence
  SiRNA target sequence
aaagttgtagaaaaaaatagattt

SEQ ID NO: 102944 - DNA, 24 bp, Artificial sequence
  SiRNA target sequence
aagttgtagaaaaaaatagatttg

SEQ ID NO: 102945 - DNA, 24 bp, Artificial sequence
  SiRNA target sequence
agttgtagaaaaaaatagatttga

SEQ ID NO: 102946 - DNA, 24 bp, Artificial sequence
  SiRNA target sequence
gttgtagaaaaaaatagatttgag

SEQ ID NO: 102947 - DNA, 24 bp, Artificial sequence
  SiRNA target sequence
ttgtagaaaaaaatagatttgagg

SEQ ID NO: 102948 - DNA, 24 bp, Artificial sequence
  SiRNA target sequence
tgtagaaaaaaatagatttgagga

SEQ ID NO: 102949 - DNA, 24 bp, Artificial sequence
  SiRNA target sequence
gtagaaaaaaatagatttgaggaa

SEQ ID NO: 102950 - DNA, 24 bp, Artificial sequence
  SiRNA target sequence
tagaaaaaaatagatttgaggaat

SEQ ID NO: 102951 - DNA, 24 bp, Artificial sequence
  SiRNA target sequence
agaaaaaaatagatttgaggaata

SEQ ID NO: 102952 - DNA, 24 bp, Artificial sequence
  SiRNA target sequence
gaaaaaaatagatttgaggaatag

SEQ ID NO: 102953 - DNA, 24 bp, Artificial sequence
  SiRNA target sequence
aaaaaaatagatttgaggaataga

SEQ ID NO: 102954 - DNA, 24 bp, Artificial sequence
  SiRNA target sequence
aaaaaatagatttgaggaatagaa

SEQ ID NO: 102955 - DNA, 24 bp, Artificial sequence
  SiRNA target sequence
aaaaatagatttgaggaatagaat

SEQ ID NO: 102956 - DNA, 24 bp, Artificial sequence
  SiRNA target sequence
aaaatagatttgaggaatagaatt

SEQ ID NO: 102957 - DNA, 24 bp, Artificial sequence
  SiRNA target sequence
aaatagatttgaggaatagaatta

SEQ ID NO: 102958 - DNA, 24 bp, Artificial sequence
  SiRNA target sequence
aatagatttgaggaatagaattaa

SEQ ID NO: 102959 - DNA, 24 bp, Artificial sequence
  SiRNA target sequence
atagatttgaggaatagaattaaa

SEQ ID NO: 102960 - DNA, 24 bp, Artificial sequence
  SiRNA target sequence
tagatttgaggaatagaattaaaa

SEQ ID NO: 102961 - DNA, 24 bp, Artificial sequence
  SiRNA target sequence
agatttgaggaatagaattaaaat

SEQ ID NO: 102962 - DNA, 24 bp, Artificial sequence
  SiRNA target sequence
gatttgaggaatagaattaaaatc

SEQ ID NO: 102963 - DNA, 24 bp, Artificial sequence
  SiRNA target sequence
atttgaggaatagaattaaaatca

SEQ ID NO: 102964 - DNA, 24 bp, Artificial sequence
  SiRNA target sequence
tttgaggaatagaattaaaatcac

SEQ ID NO: 102965 - DNA, 24 bp, Artificial sequence
  SiRNA target sequence
ttgaggaatagaattaaaatcaca

SEQ ID NO: 102966 - DNA, 24 bp, Artificial sequence
  SiRNA target sequence
tgaggaatagaattaaaatcacaa

SEQ ID NO: 102967 - DNA, 24 bp, Artificial sequence
  SiRNA target sequence
gaggaatagaattaaaatcacaat

SEQ ID NO: 102968 - DNA, 24 bp, Artificial sequence
  SiRNA target sequence
aggaatagaattaaaatcacaata

SEQ ID NO: 102969 - DNA, 24 bp, Artificial sequence
  SiRNA target sequence
ggaatagaattaaaatcacaatat

SEQ ID NO: 102970 - DNA, 24 bp, Artificial sequence
  SiRNA target sequence
gaatagaattaaaatcacaatatt

SEQ ID NO: 102971 - DNA, 24 bp, Artificial sequence
  SiRNA target sequence
aatagaattaaaatcacaatattt

SEQ ID NO: 102972 - DNA, 24 bp, Artificial sequence
  SiRNA target sequence
atagaattaaaatcacaatatttt

SEQ ID NO: 102973 - DNA, 24 bp, Artificial sequence
  SiRNA target sequence
tagaattaaaatcacaatattttt

SEQ ID NO: 102974 - DNA, 24 bp, Artificial sequence
  SiRNA target sequence
agaattaaaatcacaatatttttt

SEQ ID NO: 102975 - DNA, 24 bp, Artificial sequence
  SiRNA target sequence
gaattaaaatcacaatatttttta

SEQ ID NO: 102976 - DNA, 24 bp, Artificial sequence
  SiRNA target sequence
aattaaaatcacaatattttttaa

SEQ ID NO: 102977 - DNA, 24 bp, Artificial sequence
  SiRNA target sequence
attaaaatcacaatattttttaat

SEQ ID NO: 102978 - DNA, 24 bp, Artificial sequence
  SiRNA target sequence
ttaaaatcacaatattttttaata

SEQ ID NO: 102979 - DNA, 24 bp, Artificial sequence
  SiRNA target sequence
taaaatcacaatattttttaatat

SEQ ID NO: 102980 - DNA, 24 bp, Artificial sequence
  SiRNA target sequence
aaaatcacaatattttttaatata

SEQ ID NO: 102981 - DNA, 24 bp, Artificial sequence
  SiRNA target sequence
aaatcacaatattttttaatatat

SEQ ID NO: 102982 - DNA, 24 bp, Artificial sequence
  SiRNA target sequence
aatcacaatattttttaatatatt

SEQ ID NO: 102983 - DNA, 24 bp, Artificial sequence
  SiRNA target sequence
atcacaatattttttaatatattt

SEQ ID NO: 102984 - DNA, 24 bp, Artificial sequence
  SiRNA target sequence
tcacaatattttttaatatattta

SEQ ID NO: 102985 - DNA, 24 bp, Artificial sequence
  SiRNA target sequence
cacaatattttttaatatatttaa

SEQ ID NO: 102986 - DNA, 24 bp, Artificial sequence
  SiRNA target sequence
acaatattttttaatatatttaac

SEQ ID NO: 102987 - DNA, 24 bp, Artificial sequence
  SiRNA target sequence
caatattttttaatatatttaacc

SEQ ID NO: 102988 - DNA, 24 bp, Artificial sequence
  SiRNA target sequence
aatattttttaatatatttaacca

SEQ ID NO: 102989 - DNA, 24 bp, Artificial sequence
  SiRNA target sequence
atattttttaatatatttaaccaa

SEQ ID NO: 102990 - DNA, 24 bp, Artificial sequence
  SiRNA target sequence
tattttttaatatatttaaccaag

SEQ ID NO: 102991 - DNA, 24 bp, Artificial sequence
  SiRNA target sequence
attttttaatatatttaaccaagg

SEQ ID NO: 102992 - DNA, 24 bp, Artificial sequence
  SiRNA target sequence
ttttttaatatatttaaccaaggt

SEQ ID NO: 102993 - DNA, 24 bp, Artificial sequence
  SiRNA target sequence
tttttaatatatttaaccaaggta

SEQ ID NO: 102994 - DNA, 24 bp, Artificial sequence
  SiRNA target sequence
ttttaatatatttaaccaaggtat

SEQ ID NO: 102995 - DNA, 24 bp, Artificial sequence
  SiRNA target sequence
tttaatatatttaaccaaggtatt

SEQ ID NO: 102996 - DNA, 24 bp, Artificial sequence
  SiRNA target sequence
ttaatatatttaaccaaggtattg

SEQ ID NO: 102997 - DNA, 24 bp, Artificial sequence
  SiRNA target sequence
taatatatttaaccaaggtattgt

SEQ ID NO: 102998 - DNA, 24 bp, Artificial sequence
  SiRNA target sequence
aatatatttaaccaaggtattgtc

SEQ ID NO: 102999 - DNA, 24 bp, Artificial sequence
  SiRNA target sequence
atatatttaaccaaggtattgtcc

SEQ ID NO: 103000 - DNA, 24 bp, Artificial sequence
  SiRNA target sequence
tatatttaaccaaggtattgtcct

SEQ ID NO: 103001 - DNA, 24 bp, Artificial sequence
  SiRNA target sequence
atatttaaccaaggtattgtcctt

SEQ ID NO: 103002 - DNA, 24 bp, Artificial sequence
  SiRNA target sequence
tatttaaccaaggtattgtccttt

SEQ ID NO: 103003 - DNA, 24 bp, Artificial sequence
  SiRNA target sequence
atttaaccaaggtattgtccttta

SEQ ID NO: 103004 - DNA, 24 bp, Artificial sequence
  SiRNA target sequence
tttaaccaaggtattgtcctttat

SEQ ID NO: 103005 - DNA, 24 bp, Artificial sequence
  SiRNA target sequence
ttaaccaaggtattgtcctttatg

SEQ ID NO: 103006 - DNA, 24 bp, Artificial sequence
  SiRNA target sequence
taaccaaggtattgtcctttatgt

SEQ ID NO: 103007 - DNA, 24 bp, Artificial sequence
  SiRNA target sequence
aaccaaggtattgtcctttatgtt

SEQ ID NO: 103008 - DNA, 24 bp, Artificial sequence
  SiRNA target sequence
accaaggtattgtcctttatgtta

SEQ ID NO: 103009 - DNA, 24 bp, Artificial sequence
  SiRNA target sequence
ccaaggtattgtcctttatgttat

SEQ ID NO: 103010 - DNA, 24 bp, Artificial sequence
  SiRNA target sequence
caaggtattgtcctttatgttatt

SEQ ID NO: 103011 - DNA, 24 bp, Artificial sequence
  SiRNA target sequence
aaggtattgtcctttatgttatta

SEQ ID NO: 103012 - DNA, 24 bp, Artificial sequence
  SiRNA target sequence
aggtattgtcctttatgttattat

SEQ ID NO: 103013 - DNA, 24 bp, Artificial sequence
  SiRNA target sequence
ggtattgtcctttatgttattata

SEQ ID NO: 103014 - DNA, 24 bp, Artificial sequence
  SiRNA target sequence
gtattgtcctttatgttattatat

SEQ ID NO: 103015 - DNA, 24 bp, Artificial sequence
  SiRNA target sequence
tattgtcctttatgttattatatc

SEQ ID NO: 103016 - DNA, 24 bp, Artificial sequence
  SiRNA target sequence
attgtcctttatgttattatatct

SEQ ID NO: 103017 - DNA, 24 bp, Artificial sequence
  SiRNA target sequence
ttgtcctttatgttattatatctt

SEQ ID NO: 103018 - DNA, 24 bp, Artificial sequence
  SiRNA target sequence
tgtcctttatgttattatatctta

SEQ ID NO: 103019 - DNA, 24 bp, Artificial sequence
  SiRNA target sequence
gtcctttatgttattatatcttac

SEQ ID NO: 103020 - DNA, 24 bp, Artificial sequence
  SiRNA target sequence
tcctttatgttattatatcttaca

SEQ ID NO: 103021 - DNA, 24 bp, Artificial sequence
  SiRNA target sequence
cctttatgttattatatcttacaa

SEQ ID NO: 103022 - DNA, 24 bp, Artificial sequence
  SiRNA target sequence
ctttatgttattatatcttacaaa

SEQ ID NO: 103023 - DNA, 24 bp, Artificial sequence
  SiRNA target sequence
tttatgttattatatcttacaaac

SEQ ID NO: 103024 - DNA, 24 bp, Artificial sequence
  SiRNA target sequence
ttatgttattatatcttacaaact

SEQ ID NO: 103025 - DNA, 24 bp, Artificial sequence
  SiRNA target sequence
tatgttattatatcttacaaactc

SEQ ID NO: 103026 - DNA, 24 bp, Artificial sequence
  SiRNA target sequence
atgttattatatcttacaaactcc

SEQ ID NO: 103027 - DNA, 24 bp, Artificial sequence
  SiRNA target sequence
tgttattatatcttacaaactcct

SEQ ID NO: 103028 - DNA, 24 bp, Artificial sequence
  SiRNA target sequence
gttattatatcttacaaactcctc

SEQ ID NO: 103029 - DNA, 24 bp, Artificial sequence
  SiRNA target sequence
ttattatatcttacaaactcctcg

SEQ ID NO: 103030 - DNA, 24 bp, Artificial sequence
  SiRNA target sequence
tattatatcttacaaactcctcgt

SEQ ID NO: 103031 - DNA, 24 bp, Artificial sequence
  SiRNA target sequence
attatatcttacaaactcctcgta

SEQ ID NO: 103032 - DNA, 24 bp, Artificial sequence
  SiRNA target sequence
ttatatcttacaaactcctcgtaa

SEQ ID NO: 103033 - DNA, 24 bp, Artificial sequence
  SiRNA target sequence
tatatcttacaaactcctcgtaat

SEQ ID NO: 103034 - DNA, 24 bp, Artificial sequence
  SiRNA target sequence
atatcttacaaactcctcgtaatt

SEQ ID NO: 103035 - DNA, 24 bp, Artificial sequence
  SiRNA target sequence
tatcttacaaactcctcgtaatta

SEQ ID NO: 103036 - DNA, 24 bp, Artificial sequence
  SiRNA target sequence
atcttacaaactcctcgtaattat

SEQ ID NO: 103037 - DNA, 24 bp, Artificial sequence
  SiRNA target sequence
tcttacaaactcctcgtaattata

SEQ ID NO: 103038 - DNA, 24 bp, Artificial sequence
  SiRNA target sequence
cttacaaactcctcgtaattataa

SEQ ID NO: 103039 - DNA, 24 bp, Artificial sequence
  SiRNA target sequence
ttacaaactcctcgtaattataat

SEQ ID NO: 103040 - DNA, 24 bp, Artificial sequence
  SiRNA target sequence
tacaaactcctcgtaattataatt

SEQ ID NO: 103041 - DNA, 24 bp, Artificial sequence
  SiRNA target sequence
acaaactcctcgtaattataattt

SEQ ID NO: 103042 - DNA, 24 bp, Artificial sequence
  SiRNA target sequence
caaactcctcgtaattataatttt

SEQ ID NO: 103043 - DNA, 24 bp, Artificial sequence
  SiRNA target sequence
aaactcctcgtaattataattttc

SEQ ID NO: 103044 - DNA, 24 bp, Artificial sequence
  SiRNA target sequence
aactcctcgtaattataattttca

SEQ ID NO: 103045 - DNA, 24 bp, Artificial sequence
  SiRNA target sequence
actcctcgtaattataattttcag

SEQ ID NO: 103046 - DNA, 24 bp, Artificial sequence
  SiRNA target sequence
ctcctcgtaattataattttcagg

SEQ ID NO: 103047 - DNA, 24 bp, Artificial sequence
  SiRNA target sequence
tcctcgtaattataattttcagga

SEQ ID NO: 103048 - DNA, 24 bp, Artificial sequence
  SiRNA target sequence
cctcgtaattataattttcaggat

SEQ ID NO: 103049 - DNA, 24 bp, Artificial sequence
  SiRNA target sequence
ctcgtaattataattttcaggata

SEQ ID NO: 103050 - DNA, 24 bp, Artificial sequence
  SiRNA target sequence
tcgtaattataattttcaggataa

SEQ ID NO: 103051 - DNA, 24 bp, Artificial sequence
  SiRNA target sequence
cgtaattataattttcaggataaa

SEQ ID NO: 103052 - DNA, 24 bp, Artificial sequence
  SiRNA target sequence
gtaattataattttcaggataaac

SEQ ID NO: 103053 - DNA, 24 bp, Artificial sequence
  SiRNA target sequence
taattataattttcaggataaacc

SEQ ID NO: 103054 - DNA, 24 bp, Artificial sequence
  SiRNA target sequence
aattataattttcaggataaaccg

SEQ ID NO: 103055 - DNA, 24 bp, Artificial sequence
  SiRNA target sequence
attataattttcaggataaaccgc

SEQ ID NO: 103056 - DNA, 24 bp, Artificial sequence
  SiRNA target sequence
ttataattttcaggataaaccgct

SEQ ID NO: 103057 - DNA, 24 bp, Artificial sequence
  SiRNA target sequence
tataattttcaggataaaccgcta

SEQ ID NO: 103058 - DNA, 24 bp, Artificial sequence
  SiRNA target sequence
ataattttcaggataaaccgctag

SEQ ID NO: 103059 - DNA, 24 bp, Artificial sequence
  SiRNA target sequence
taattttcaggataaaccgctaga

SEQ ID NO: 103060 - DNA, 24 bp, Artificial sequence
  SiRNA target sequence
aattttcaggataaaccgctagac

SEQ ID NO: 103061 - DNA, 24 bp, Artificial sequence
  SiRNA target sequence
attttcaggataaaccgctagaca

SEQ ID NO: 103062 - DNA, 24 bp, Artificial sequence
  SiRNA target sequence
ttttcaggataaaccgctagacaa

SEQ ID NO: 103063 - DNA, 24 bp, Artificial sequence
  SiRNA target sequence
tttcaggataaaccgctagacaat

SEQ ID NO: 103064 - DNA, 24 bp, Artificial sequence
  SiRNA target sequence
ttcaggataaaccgctagacaatc

SEQ ID NO: 103065 - DNA, 24 bp, Artificial sequence
  SiRNA target sequence
tcaggataaaccgctagacaatca

SEQ ID NO: 103066 - DNA, 24 bp, Artificial sequence
  SiRNA target sequence
caggataaaccgctagacaatcac

SEQ ID NO: 103067 - DNA, 24 bp, Artificial sequence
  SiRNA target sequence
aggataaaccgctagacaatcacc

SEQ ID NO: 103068 - DNA, 24 bp, Artificial sequence
  SiRNA target sequence
ggataaaccgctagacaatcaccg

SEQ ID NO: 103069 - DNA, 24 bp, Artificial sequence
  SiRNA target sequence
gataaaccgctagacaatcaccga

SEQ ID NO: 103070 - DNA, 24 bp, Artificial sequence
  SiRNA target sequence
ataaaccgctagacaatcaccgat

SEQ ID NO: 103071 - DNA, 24 bp, Artificial sequence
  SiRNA target sequence
taaaccgctagacaatcaccgatt

SEQ ID NO: 103072 - DNA, 24 bp, Artificial sequence
  SiRNA target sequence
aaaccgctagacaatcaccgattt

SEQ ID NO: 103073 - DNA, 24 bp, Artificial sequence
  SiRNA target sequence
aaccgctagacaatcaccgatttc

SEQ ID NO: 103074 - DNA, 24 bp, Artificial sequence
  SiRNA target sequence
accgctagacaatcaccgatttca

SEQ ID NO: 103075 - DNA, 24 bp, Artificial sequence
  SiRNA target sequence
ccgctagacaatcaccgatttcaa

SEQ ID NO: 103076 - DNA, 24 bp, Artificial sequence
  SiRNA target sequence
cgctagacaatcaccgatttcaaa

SEQ ID NO: 103077 - DNA, 24 bp, Artificial sequence
  SiRNA target sequence
gctagacaatcaccgatttcaaaa

SEQ ID NO: 103078 - DNA, 24 bp, Artificial sequence
  SiRNA target sequence
ctagacaatcaccgatttcaaaat

SEQ ID NO: 103079 - DNA, 24 bp, Artificial sequence
  SiRNA target sequence
tagacaatcaccgatttcaaaatt

SEQ ID NO: 103080 - DNA, 24 bp, Artificial sequence
  SiRNA target sequence
agacaatcaccgatttcaaaattt

SEQ ID NO: 103081 - DNA, 24 bp, Artificial sequence
  SiRNA target sequence
gacaatcaccgatttcaaaatttt

SEQ ID NO: 103082 - DNA, 24 bp, Artificial sequence
  SiRNA target sequence
acaatcaccgatttcaaaattttc

SEQ ID NO: 103083 - DNA, 24 bp, Artificial sequence
  SiRNA target sequence
caatcaccgatttcaaaattttct

SEQ ID NO: 103084 - DNA, 24 bp, Artificial sequence
  SiRNA target sequence
aatcaccgatttcaaaattttcta

SEQ ID NO: 103085 - DNA, 24 bp, Artificial sequence
  SiRNA target sequence
atcaccgatttcaaaattttctat

SEQ ID NO: 103086 - DNA, 24 bp, Artificial sequence
  SiRNA target sequence
tcaccgatttcaaaattttctata

SEQ ID NO: 103087 - DNA, 24 bp, Artificial sequence
  SiRNA target sequence
caccgatttcaaaattttctatat

SEQ ID NO: 103088 - DNA, 24 bp, Artificial sequence
  SiRNA target sequence
accgatttcaaaattttctatatc

SEQ ID NO: 103089 - DNA, 24 bp, Artificial sequence
  SiRNA target sequence
ccgatttcaaaattttctatatct

SEQ ID NO: 103090 - DNA, 24 bp, Artificial sequence
  SiRNA target sequence
cgatttcaaaattttctatatcta

SEQ ID NO: 103091 - DNA, 24 bp, Artificial sequence
  SiRNA target sequence
gatttcaaaattttctatatctat

SEQ ID NO: 103092 - DNA, 24 bp, Artificial sequence
  SiRNA target sequence
atttcaaaattttctatatctata

SEQ ID NO: 103093 - DNA, 24 bp, Artificial sequence
  SiRNA target sequence
tttcaaaattttctatatctatat

SEQ ID NO: 103094 - DNA, 24 bp, Artificial sequence
  SiRNA target sequence
ttcaaaattttctatatctatatc

SEQ ID NO: 103095 - DNA, 24 bp, Artificial sequence
  SiRNA target sequence
tcaaaattttctatatctatatca

SEQ ID NO: 103096 - DNA, 24 bp, Artificial sequence
  SiRNA target sequence
caaaattttctatatctatatcaa

SEQ ID NO: 103097 - DNA, 24 bp, Artificial sequence
  SiRNA target sequence
aaaattttctatatctatatcaaa

SEQ ID NO: 103098 - DNA, 24 bp, Artificial sequence
  SiRNA target sequence
aaattttctatatctatatcaaat

SEQ ID NO: 103099 - DNA, 24 bp, Artificial sequence
  SiRNA target sequence
aattttctatatctatatcaaatt

SEQ ID NO: 103100 - DNA, 24 bp, Artificial sequence
  SiRNA target sequence
attttctatatctatatcaaattt

SEQ ID NO: 103101 - DNA, 24 bp, Artificial sequence
  SiRNA target sequence
ttttctatatctatatcaaatttt

SEQ ID NO: 103102 - DNA, 24 bp, Artificial sequence
  SiRNA target sequence
tttctatatctatatcaaatttta

SEQ ID NO: 103103 - DNA, 24 bp, Artificial sequence
  SiRNA target sequence
ttctatatctatatcaaattttat

SEQ ID NO: 103104 - DNA, 24 bp, Artificial sequence
  SiRNA target sequence
tctatatctatatcaaattttatt

SEQ ID NO: 103105 - DNA, 24 bp, Artificial sequence
  SiRNA target sequence
ctatatctatatcaaattttattt

SEQ ID NO: 103106 - DNA, 24 bp, Artificial sequence
  SiRNA target sequence
tatatctatatcaaattttatttc

SEQ ID NO: 103107 - DNA, 24 bp, Artificial sequence
  SiRNA target sequence
atatctatatcaaattttatttct

SEQ ID NO: 103108 - DNA, 24 bp, Artificial sequence
  SiRNA target sequence
tatctatatcaaattttatttcta

SEQ ID NO: 103109 - DNA, 24 bp, Artificial sequence
  SiRNA target sequence
atctatatcaaattttatttctaa

SEQ ID NO: 103110 - DNA, 24 bp, Artificial sequence
  SiRNA target sequence
tctatatcaaattttatttctaaa

SEQ ID NO: 103111 - DNA, 24 bp, Artificial sequence
  SiRNA target sequence
ctatatcaaattttatttctaaaa

SEQ ID NO: 103112 - DNA, 24 bp, Artificial sequence
  SiRNA target sequence
tatatcaaattttatttctaaaat

SEQ ID NO: 103113 - DNA, 24 bp, Artificial sequence
  SiRNA target sequence
atatcaaattttatttctaaaata

SEQ ID NO: 103114 - DNA, 24 bp, Artificial sequence
  SiRNA target sequence
tatcaaattttatttctaaaatag

SEQ ID NO: 103115 - DNA, 24 bp, Artificial sequence
  SiRNA target sequence
atcaaattttatttctaaaatagg

SEQ ID NO: 103116 - DNA, 24 bp, Artificial sequence
  SiRNA target sequence
tcaaattttatttctaaaatagga

SEQ ID NO: 103117 - DNA, 24 bp, Artificial sequence
  SiRNA target sequence
caaattttatttctaaaataggat

SEQ ID NO: 103118 - DNA, 24 bp, Artificial sequence
  SiRNA target sequence
aaattttatttctaaaataggata

SEQ ID NO: 103119 - DNA, 24 bp, Artificial sequence
  SiRNA target sequence
aattttatttctaaaataggataa

SEQ ID NO: 103120 - DNA, 24 bp, Artificial sequence
  SiRNA target sequence
attttatttctaaaataggataaa

SEQ ID NO: 103121 - DNA, 24 bp, Artificial sequence
  SiRNA target sequence
ttttatttctaaaataggataaat

SEQ ID NO: 103122 - DNA, 24 bp, Artificial sequence
  SiRNA target sequence
tttatttctaaaataggataaatg

SEQ ID NO: 103123 - DNA, 24 bp, Artificial sequence
  SiRNA target sequence
ttatttctaaaataggataaatgt

SEQ ID NO: 103124 - DNA, 24 bp, Artificial sequence
  SiRNA target sequence
tatttctaaaataggataaatgta

SEQ ID NO: 103125 - DNA, 24 bp, Artificial sequence
  SiRNA target sequence
atttctaaaataggataaatgtaa

SEQ ID NO: 103126 - DNA, 24 bp, Artificial sequence
  SiRNA target sequence
tttctaaaataggataaatgtaat

SEQ ID NO: 103127 - DNA, 24 bp, Artificial sequence
  SiRNA target sequence
ttctaaaataggataaatgtaatt

SEQ ID NO: 103128 - DNA, 24 bp, Artificial sequence
  SiRNA target sequence
tctaaaataggataaatgtaattg

SEQ ID NO: 103129 - DNA, 24 bp, Artificial sequence
  SiRNA target sequence
ctaaaataggataaatgtaattgt

SEQ ID NO: 103130 - DNA, 24 bp, Artificial sequence
  SiRNA target sequence
taaaataggataaatgtaattgta

SEQ ID NO: 103131 - DNA, 24 bp, Artificial sequence
  SiRNA target sequence
aaaataggataaatgtaattgtaa

SEQ ID NO: 103132 - DNA, 24 bp, Artificial sequence
  SiRNA target sequence
aaataggataaatgtaattgtaag

SEQ ID NO: 103133 - DNA, 24 bp, Artificial sequence
  SiRNA target sequence
aataggataaatgtaattgtaagg

SEQ ID NO: 103134 - DNA, 24 bp, Artificial sequence
  SiRNA target sequence
ataggataaatgtaattgtaaggt

SEQ ID NO: 103135 - DNA, 24 bp, Artificial sequence
  SiRNA target sequence
taggataaatgtaattgtaaggtg

SEQ ID NO: 103136 - DNA, 24 bp, Artificial sequence
  SiRNA target sequence
aggataaatgtaattgtaaggtgt

SEQ ID NO: 103137 - DNA, 24 bp, Artificial sequence
  SiRNA target sequence
ggataaatgtaattgtaaggtgtt

SEQ ID NO: 103138 - DNA, 24 bp, Artificial sequence
  SiRNA target sequence
gataaatgtaattgtaaggtgtta

SEQ ID NO: 103139 - DNA, 24 bp, Artificial sequence
  SiRNA target sequence
ataaatgtaattgtaaggtgttaa

SEQ ID NO: 103140 - DNA, 24 bp, Artificial sequence
  SiRNA target sequence
taaatgtaattgtaaggtgttaat

SEQ ID NO: 103141 - DNA, 24 bp, Artificial sequence
  SiRNA target sequence
aaatgtaattgtaaggtgttaata

SEQ ID NO: 103142 - DNA, 24 bp, Artificial sequence
  SiRNA target sequence
aatgtaattgtaaggtgttaatat

SEQ ID NO: 103143 - DNA, 24 bp, Artificial sequence
  SiRNA target sequence
atgtaattgtaaggtgttaatatc

SEQ ID NO: 103144 - DNA, 24 bp, Artificial sequence
  SiRNA target sequence
tgtaattgtaaggtgttaatatct

SEQ ID NO: 103145 - DNA, 24 bp, Artificial sequence
  SiRNA target sequence
gtaattgtaaggtgttaatatctt

SEQ ID NO: 103146 - DNA, 24 bp, Artificial sequence
  SiRNA target sequence
taattgtaaggtgttaatatctta

SEQ ID NO: 103147 - DNA, 24 bp, Artificial sequence
  SiRNA target sequence
aattgtaaggtgttaatatcttaa

SEQ ID NO: 103148 - DNA, 24 bp, Artificial sequence
  SiRNA target sequence
attgtaaggtgttaatatcttaat

SEQ ID NO: 103149 - DNA, 24 bp, Artificial sequence
  SiRNA target sequence
ttgtaaggtgttaatatcttaata

SEQ ID NO: 103150 - DNA, 24 bp, Artificial sequence
  SiRNA target sequence
tgtaaggtgttaatatcttaatat

SEQ ID NO: 103151 - DNA, 24 bp, Artificial sequence
  SiRNA target sequence
gtaaggtgttaatatcttaatatc

SEQ ID NO: 103152 - DNA, 24 bp, Artificial sequence
  SiRNA target sequence
taaggtgttaatatcttaatatca

SEQ ID NO: 103153 - DNA, 24 bp, Artificial sequence
  SiRNA target sequence
aaggtgttaatatcttaatatcat

SEQ ID NO: 103154 - DNA, 24 bp, Artificial sequence
  SiRNA target sequence
aggtgttaatatcttaatatcatt

SEQ ID NO: 103155 - DNA, 24 bp, Artificial sequence
  SiRNA target sequence
ggtgttaatatcttaatatcattt

SEQ ID NO: 103156 - DNA, 24 bp, Artificial sequence
  SiRNA target sequence
gtgttaatatcttaatatcattta

SEQ ID NO: 103157 - DNA, 24 bp, Artificial sequence
  SiRNA target sequence
tgttaatatcttaatatcatttat

SEQ ID NO: 103158 - DNA, 24 bp, Artificial sequence
  SiRNA target sequence
gttaatatcttaatatcatttatt

SEQ ID NO: 103159 - DNA, 24 bp, Artificial sequence
  SiRNA target sequence
ttaatatcttaatatcatttattg

SEQ ID NO: 103160 - DNA, 24 bp, Artificial sequence
  SiRNA target sequence
taatatcttaatatcatttattga

SEQ ID NO: 103161 - DNA, 24 bp, Artificial sequence
  SiRNA target sequence
aatatcttaatatcatttattgac

SEQ ID NO: 103162 - DNA, 24 bp, Artificial sequence
  SiRNA target sequence
atatcttaatatcatttattgacg

SEQ ID NO: 103163 - DNA, 24 bp, Artificial sequence
  SiRNA target sequence
tatcttaatatcatttattgacgc

SEQ ID NO: 103164 - DNA, 24 bp, Artificial sequence
  SiRNA target sequence
atcttaatatcatttattgacgca

SEQ ID NO: 103165 - DNA, 24 bp, Artificial sequence
  SiRNA target sequence
tcttaatatcatttattgacgcac

SEQ ID NO: 103166 - DNA, 24 bp, Artificial sequence
  SiRNA target sequence
cttaatatcatttattgacgcact

SEQ ID NO: 103167 - DNA, 24 bp, Artificial sequence
  SiRNA target sequence
ttaatatcatttattgacgcactg

SEQ ID NO: 103168 - DNA, 24 bp, Artificial sequence
  SiRNA target sequence
taatatcatttattgacgcactgt

SEQ ID NO: 103169 - DNA, 24 bp, Artificial sequence
  SiRNA target sequence
aatatcatttattgacgcactgta

SEQ ID NO: 103170 - DNA, 24 bp, Artificial sequence
  SiRNA target sequence
atatcatttattgacgcactgtat

SEQ ID NO: 103171 - DNA, 24 bp, Artificial sequence
  SiRNA target sequence
tatcatttattgacgcactgtata

SEQ ID NO: 103172 - DNA, 24 bp, Artificial sequence
  SiRNA target sequence
atcatttattgacgcactgtataa

SEQ ID NO: 103173 - DNA, 24 bp, Artificial sequence
  SiRNA target sequence
tcatttattgacgcactgtataaa

SEQ ID NO: 103174 - DNA, 24 bp, Artificial sequence
  SiRNA target sequence
catttattgacgcactgtataaat

SEQ ID NO: 103175 - DNA, 24 bp, Artificial sequence
  SiRNA target sequence
atttattgacgcactgtataaatc

SEQ ID NO: 103176 - DNA, 24 bp, Artificial sequence
  SiRNA target sequence
tttattgacgcactgtataaatca

SEQ ID NO: 103177 - DNA, 24 bp, Artificial sequence
  SiRNA target sequence
ttattgacgcactgtataaatcat

SEQ ID NO: 103178 - DNA, 24 bp, Artificial sequence
  SiRNA target sequence
tattgacgcactgtataaatcatt

SEQ ID NO: 103179 - DNA, 24 bp, Artificial sequence
  SiRNA target sequence
attgacgcactgtataaatcattt

SEQ ID NO: 103180 - DNA, 24 bp, Artificial sequence
  SiRNA target sequence
ttgacgcactgtataaatcatttt

SEQ ID NO: 103181 - DNA, 24 bp, Artificial sequence
  SiRNA target sequence
tgacgcactgtataaatcattttt

SEQ ID NO: 103182 - DNA, 24 bp, Artificial sequence
  SiRNA target sequence
gacgcactgtataaatcattttta

SEQ ID NO: 103183 - DNA, 24 bp, Artificial sequence
  SiRNA target sequence
acgcactgtataaatcatttttac

SEQ ID NO: 103184 - DNA, 24 bp, Artificial sequence
  SiRNA target sequence
cgcactgtataaatcatttttaca

SEQ ID NO: 103185 - DNA, 24 bp, Artificial sequence
  SiRNA target sequence
gcactgtataaatcatttttacaa

SEQ ID NO: 103186 - DNA, 24 bp, Artificial sequence
  SiRNA target sequence
cactgtataaatcatttttacaac

SEQ ID NO: 103187 - DNA, 24 bp, Artificial sequence
  SiRNA target sequence
actgtataaatcatttttacaact

SEQ ID NO: 103188 - DNA, 24 bp, Artificial sequence
  SiRNA target sequence
ctgtataaatcatttttacaactt

SEQ ID NO: 103189 - DNA, 24 bp, Artificial sequence
  SiRNA target sequence
tgtataaatcatttttacaacttg

SEQ ID NO: 103190 - DNA, 24 bp, Artificial sequence
  SiRNA target sequence
gtataaatcatttttacaacttgc

SEQ ID NO: 103191 - DNA, 24 bp, Artificial sequence
  SiRNA target sequence
tataaatcatttttacaacttgca

SEQ ID NO: 103192 - DNA, 24 bp, Artificial sequence
  SiRNA target sequence
ataaatcatttttacaacttgcaa

SEQ ID NO: 103193 - DNA, 24 bp, Artificial sequence
  SiRNA target sequence
taaatcatttttacaacttgcaaa

SEQ ID NO: 103194 - DNA, 24 bp, Artificial sequence
  SiRNA target sequence
aaatcatttttacaacttgcaaaa

SEQ ID NO: 103195 - DNA, 24 bp, Artificial sequence
  SiRNA target sequence
aatcatttttacaacttgcaaaat

SEQ ID NO: 103196 - DNA, 24 bp, Artificial sequence
  SiRNA target sequence
atcatttttacaacttgcaaaatt

SEQ ID NO: 103197 - DNA, 24 bp, Artificial sequence
  SiRNA target sequence
tcatttttacaacttgcaaaattt

SEQ ID NO: 103198 - DNA, 24 bp, Artificial sequence
  SiRNA target sequence
catttttacaacttgcaaaatttt

SEQ ID NO: 103199 - DNA, 24 bp, Artificial sequence
  SiRNA target sequence
atttttacaacttgcaaaattttt

SEQ ID NO: 103200 - DNA, 24 bp, Artificial sequence
  SiRNA target sequence
tttttacaacttgcaaaattttta

SEQ ID NO: 103201 - DNA, 24 bp, Artificial sequence
  SiRNA target sequence
ttttacaacttgcaaaatttttag

SEQ ID NO: 103202 - DNA, 24 bp, Artificial sequence
  SiRNA target sequence
tttacaacttgcaaaatttttagc

SEQ ID NO: 103203 - DNA, 24 bp, Artificial sequence
  SiRNA target sequence
ttacaacttgcaaaatttttagca

SEQ ID NO: 103204 - DNA, 24 bp, Artificial sequence
  SiRNA target sequence
tacaacttgcaaaatttttagcat

SEQ ID NO: 103205 - DNA, 24 bp, Artificial sequence
  SiRNA target sequence
acaacttgcaaaatttttagcatt

SEQ ID NO: 103206 - DNA, 24 bp, Artificial sequence
  SiRNA target sequence
caacttgcaaaatttttagcattt

SEQ ID NO: 103207 - DNA, 24 bp, Artificial sequence
  SiRNA target sequence
aacttgcaaaatttttagcatttt

SEQ ID NO: 103208 - DNA, 24 bp, Artificial sequence
  SiRNA target sequence
acttgcaaaatttttagcattttg

SEQ ID NO: 103209 - DNA, 24 bp, Artificial sequence
  SiRNA target sequence
cttgcaaaatttttagcattttgt

SEQ ID NO: 103210 - DNA, 24 bp, Artificial sequence
  SiRNA target sequence
ttgcaaaatttttagcattttgta

SEQ ID NO: 103211 - DNA, 24 bp, Artificial sequence
  SiRNA target sequence
tgcaaaatttttagcattttgtag

SEQ ID NO: 103212 - DNA, 24 bp, Artificial sequence
  SiRNA target sequence
gcaaaatttttagcattttgtagt

SEQ ID NO: 103213 - DNA, 24 bp, Artificial sequence
  SiRNA target sequence
caaaatttttagcattttgtagtt

SEQ ID NO: 103214 - DNA, 24 bp, Artificial sequence
  SiRNA target sequence
aaaatttttagcattttgtagttt

SEQ ID NO: 103215 - DNA, 24 bp, Artificial sequence
  SiRNA target sequence
aaatttttagcattttgtagtttg

SEQ ID NO: 103216 - DNA, 24 bp, Artificial sequence
  SiRNA target sequence
aatttttagcattttgtagtttgt

SEQ ID NO: 103217 - DNA, 24 bp, Artificial sequence
  SiRNA target sequence
atttttagcattttgtagtttgta

SEQ ID NO: 103218 - DNA, 24 bp, Artificial sequence
  SiRNA target sequence
tttttagcattttgtagtttgtaa

SEQ ID NO: 103219 - DNA, 24 bp, Artificial sequence
  SiRNA target sequence
ttttagcattttgtagtttgtaat

SEQ ID NO: 103220 - DNA, 24 bp, Artificial sequence
  SiRNA target sequence
tttagcattttgtagtttgtaatg

SEQ ID NO: 103221 - DNA, 24 bp, Artificial sequence
  SiRNA target sequence
ttagcattttgtagtttgtaatgc

SEQ ID NO: 103222 - DNA, 24 bp, Artificial sequence
  SiRNA target sequence
tagcattttgtagtttgtaatgcg

SEQ ID NO: 103223 - DNA, 24 bp, Artificial sequence
  SiRNA target sequence
agcattttgtagtttgtaatgcgg

SEQ ID NO: 103224 - DNA, 24 bp, Artificial sequence
  SiRNA target sequence
gcattttgtagtttgtaatgcggt

SEQ ID NO: 103225 - DNA, 24 bp, Artificial sequence
  SiRNA target sequence
cattttgtagtttgtaatgcggta

SEQ ID NO: 103226 - DNA, 24 bp, Artificial sequence
  SiRNA target sequence
attttgtagtttgtaatgcggtaa

SEQ ID NO: 103227 - DNA, 24 bp, Artificial sequence
  SiRNA target sequence
ttttgtagtttgtaatgcggtaat

SEQ ID NO: 103228 - DNA, 24 bp, Artificial sequence
  SiRNA target sequence
tttgtagtttgtaatgcggtaata

SEQ ID NO: 103229 - DNA, 24 bp, Artificial sequence
  SiRNA target sequence
ttgtagtttgtaatgcggtaatat

SEQ ID NO: 103230 - DNA, 24 bp, Artificial sequence
  SiRNA target sequence
tgtagtttgtaatgcggtaatata

SEQ ID NO: 103231 - DNA, 24 bp, Artificial sequence
  SiRNA target sequence
gtagtttgtaatgcggtaatatat

SEQ ID NO: 103232 - DNA, 24 bp, Artificial sequence
  SiRNA target sequence
tagtttgtaatgcggtaatatata

SEQ ID NO: 103233 - DNA, 24 bp, Artificial sequence
  SiRNA target sequence
agtttgtaatgcggtaatatataa

SEQ ID NO: 103234 - DNA, 24 bp, Artificial sequence
  SiRNA target sequence
gtttgtaatgcggtaatatataat

SEQ ID NO: 103235 - DNA, 24 bp, Artificial sequence
  SiRNA target sequence
tttgtaatgcggtaatatataata

SEQ ID NO: 103236 - DNA, 24 bp, Artificial sequence
  SiRNA target sequence
ttgtaatgcggtaatatataatat

SEQ ID NO: 103237 - DNA, 24 bp, Artificial sequence
  SiRNA target sequence
tgtaatgcggtaatatataatata

SEQ ID NO: 103238 - DNA, 24 bp, Artificial sequence
  SiRNA target sequence
gtaatgcggtaatatataatatag

SEQ ID NO: 103239 - DNA, 24 bp, Artificial sequence
  SiRNA target sequence
taatgcggtaatatataatataga

SEQ ID NO: 103240 - DNA, 24 bp, Artificial sequence
  SiRNA target sequence
aatgcggtaatatataatatagat

SEQ ID NO: 103241 - DNA, 24 bp, Artificial sequence
  SiRNA target sequence
atgcggtaatatataatatagatc

SEQ ID NO: 103242 - DNA, 24 bp, Artificial sequence
  SiRNA target sequence
tgcggtaatatataatatagatct

SEQ ID NO: 103243 - DNA, 24 bp, Artificial sequence
  SiRNA target sequence
gcggtaatatataatatagatctt

SEQ ID NO: 103244 - DNA, 24 bp, Artificial sequence
  SiRNA target sequence
cggtaatatataatatagatcttt

SEQ ID NO: 103245 - DNA, 24 bp, Artificial sequence
  SiRNA target sequence
ggtaatatataatatagatctttt

SEQ ID NO: 103246 - DNA, 24 bp, Artificial sequence
  SiRNA target sequence
gtaatatataatatagatctttta

SEQ ID NO: 103247 - DNA, 24 bp, Artificial sequence
  SiRNA target sequence
taatatataatatagatcttttat

SEQ ID NO: 103248 - DNA, 24 bp, Artificial sequence
  SiRNA target sequence
aatatataatatagatcttttatc

SEQ ID NO: 103249 - DNA, 24 bp, Artificial sequence
  SiRNA target sequence
atatataatatagatcttttatcc

SEQ ID NO: 103250 - DNA, 24 bp, Artificial sequence
  SiRNA target sequence
tatataatatagatcttttatcca

SEQ ID NO: 103251 - DNA, 24 bp, Artificial sequence
  SiRNA target sequence
atataatatagatcttttatccat

SEQ ID NO: 103252 - DNA, 24 bp, Artificial sequence
  SiRNA target sequence
tataatatagatcttttatccatg

SEQ ID NO: 103253 - DNA, 24 bp, Artificial sequence
  SiRNA target sequence
ataatatagatcttttatccatgt

SEQ ID NO: 103254 - DNA, 24 bp, Artificial sequence
  SiRNA target sequence
taatatagatcttttatccatgtc

SEQ ID NO: 103255 - DNA, 24 bp, Artificial sequence
  SiRNA target sequence
aatatagatcttttatccatgtct

SEQ ID NO: 103256 - DNA, 24 bp, Artificial sequence
  SiRNA target sequence
atatagatcttttatccatgtctt

SEQ ID NO: 103257 - DNA, 24 bp, Artificial sequence
  SiRNA target sequence
tatagatcttttatccatgtctta

SEQ ID NO: 103258 - DNA, 24 bp, Artificial sequence
  SiRNA target sequence
atagatcttttatccatgtcttaa

SEQ ID NO: 103259 - DNA, 24 bp, Artificial sequence
  SiRNA target sequence
tagatcttttatccatgtcttaaa

SEQ ID NO: 103260 - DNA, 24 bp, Artificial sequence
  SiRNA target sequence
agatcttttatccatgtcttaaat

SEQ ID NO: 103261 - DNA, 24 bp, Artificial sequence
  SiRNA target sequence
gatcttttatccatgtcttaaatt

SEQ ID NO: 103262 - DNA, 24 bp, Artificial sequence
  SiRNA target sequence
atcttttatccatgtcttaaattc

SEQ ID NO: 103263 - DNA, 24 bp, Artificial sequence
  SiRNA target sequence
tcttttatccatgtcttaaattcg

SEQ ID NO: 103264 - DNA, 24 bp, Artificial sequence
  SiRNA target sequence
cttttatccatgtcttaaattcgc

SEQ ID NO: 103265 - DNA, 24 bp, Artificial sequence
  SiRNA target sequence
ttttatccatgtcttaaattcgcc

SEQ ID NO: 103266 - DNA, 24 bp, Artificial sequence
  SiRNA target sequence
tttatccatgtcttaaattcgccc

SEQ ID NO: 103267 - DNA, 24 bp, Artificial sequence
  SiRNA target sequence
ttatccatgtcttaaattcgccca

SEQ ID NO: 103268 - DNA, 24 bp, Artificial sequence
  SiRNA target sequence
tatccatgtcttaaattcgcccat

SEQ ID NO: 103269 - DNA, 24 bp, Artificial sequence
  SiRNA target sequence
atccatgtcttaaattcgcccata

SEQ ID NO: 103270 - DNA, 24 bp, Artificial sequence
  SiRNA target sequence
tccatgtcttaaattcgcccataa

SEQ ID NO: 103271 - DNA, 24 bp, Artificial sequence
  SiRNA target sequence
ccatgtcttaaattcgcccataaa

SEQ ID NO: 103272 - DNA, 24 bp, Artificial sequence
  SiRNA target sequence
catgtcttaaattcgcccataaat

SEQ ID NO: 103273 - DNA, 24 bp, Artificial sequence
  SiRNA target sequence
atgtcttaaattcgcccataaatc

SEQ ID NO: 103274 - DNA, 24 bp, Artificial sequence
  SiRNA target sequence
tgtcttaaattcgcccataaatcc

SEQ ID NO: 103275 - DNA, 24 bp, Artificial sequence
  SiRNA target sequence
gtcttaaattcgcccataaatcct

SEQ ID NO: 103276 - DNA, 24 bp, Artificial sequence
  SiRNA target sequence
tcttaaattcgcccataaatcctt

SEQ ID NO: 103277 - DNA, 24 bp, Artificial sequence
  SiRNA target sequence
cttaaattcgcccataaatccttc

SEQ ID NO: 103278 - DNA, 24 bp, Artificial sequence
  SiRNA target sequence
ttaaattcgcccataaatccttct

SEQ ID NO: 103279 - DNA, 24 bp, Artificial sequence
  SiRNA target sequence
taaattcgcccataaatccttctt

SEQ ID NO: 103280 - DNA, 24 bp, Artificial sequence
  SiRNA target sequence
aaattcgcccataaatccttcttt

SEQ ID NO: 103281 - DNA, 24 bp, Artificial sequence
  SiRNA target sequence
aattcgcccataaatccttctttg

SEQ ID NO: 103282 - DNA, 24 bp, Artificial sequence
  SiRNA target sequence
attcgcccataaatccttctttgt

SEQ ID NO: 103283 - DNA, 24 bp, Artificial sequence
  SiRNA target sequence
ttcgcccataaatccttctttgtc

SEQ ID NO: 103284 - DNA, 24 bp, Artificial sequence
  SiRNA target sequence
tcgcccataaatccttctttgtct

SEQ ID NO: 103285 - DNA, 24 bp, Artificial sequence
  SiRNA target sequence
cgcccataaatccttctttgtctt

SEQ ID NO: 103286 - DNA, 24 bp, Artificial sequence
  SiRNA target sequence
gcccataaatccttctttgtcttg

SEQ ID NO: 103287 - DNA, 24 bp, Artificial sequence
  SiRNA target sequence
cccataaatccttctttgtcttgg

SEQ ID NO: 103288 - DNA, 24 bp, Artificial sequence
  SiRNA target sequence
ccataaatccttctttgtcttggc

SEQ ID NO: 103289 - DNA, 24 bp, Artificial sequence
  SiRNA target sequence
cataaatccttctttgtcttggct

SEQ ID NO: 103290 - DNA, 24 bp, Artificial sequence
  SiRNA target sequence
ataaatccttctttgtcttggcta

SEQ ID NO: 103291 - DNA, 24 bp, Artificial sequence
  SiRNA target sequence
taaatccttctttgtcttggctat

SEQ ID NO: 103292 - DNA, 24 bp, Artificial sequence
  SiRNA target sequence
aaatccttctttgtcttggctatc

SEQ ID NO: 103293 - DNA, 24 bp, Artificial sequence
  SiRNA target sequence
aatccttctttgtcttggctatct

SEQ ID NO: 103294 - DNA, 24 bp, Artificial sequence
  SiRNA target sequence
atccttctttgtcttggctatctc

SEQ ID NO: 103295 - DNA, 24 bp, Artificial sequence
  SiRNA target sequence
tccttctttgtcttggctatctcc

SEQ ID NO: 103296 - DNA, 24 bp, Artificial sequence
  SiRNA target sequence
ccttctttgtcttggctatctcca

SEQ ID NO: 103297 - DNA, 24 bp, Artificial sequence
  SiRNA target sequence
cttctttgtcttggctatctccat

SEQ ID NO: 103298 - DNA, 24 bp, Artificial sequence
  SiRNA target sequence
ttctttgtcttggctatctccatt

SEQ ID NO: 103299 - DNA, 24 bp, Artificial sequence
  SiRNA target sequence
tctttgtcttggctatctccatta

SEQ ID NO: 103300 - DNA, 24 bp, Artificial sequence
  SiRNA target sequence
ctttgtcttggctatctccattac

SEQ ID NO: 103301 - DNA, 24 bp, Artificial sequence
  SiRNA target sequence
tttgtcttggctatctccattacc

SEQ ID NO: 103302 - DNA, 24 bp, Artificial sequence
  SiRNA target sequence
ttgtcttggctatctccattaccc

SEQ ID NO: 103303 - DNA, 24 bp, Artificial sequence
  SiRNA target sequence
tgtcttggctatctccattaccct

SEQ ID NO: 103304 - DNA, 24 bp, Artificial sequence
  SiRNA target sequence
gtcttggctatctccattaccctt

SEQ ID NO: 103305 - DNA, 24 bp, Artificial sequence
  SiRNA target sequence
tcttggctatctccattacccttt

SEQ ID NO: 103306 - DNA, 24 bp, Artificial sequence
  SiRNA target sequence
cttggctatctccattaccctttc

SEQ ID NO: 103307 - DNA, 24 bp, Artificial sequence
  SiRNA target sequence
ttggctatctccattaccctttct

SEQ ID NO: 103308 - DNA, 24 bp, Artificial sequence
  SiRNA target sequence
tggctatctccattaccctttctt

SEQ ID NO: 103309 - DNA, 24 bp, Artificial sequence
  SiRNA target sequence
ggctatctccattaccctttctta

SEQ ID NO: 103310 - DNA, 24 bp, Artificial sequence
  SiRNA target sequence
gctatctccattaccctttcttat

SEQ ID NO: 103311 - DNA, 24 bp, Artificial sequence
  SiRNA target sequence
ctatctccattaccctttcttatc

SEQ ID NO: 103312 - DNA, 24 bp, Artificial sequence
  SiRNA target sequence
tatctccattaccctttcttatca

SEQ ID NO: 103313 - DNA, 24 bp, Artificial sequence
  SiRNA target sequence
atctccattaccctttcttatcag

SEQ ID NO: 103314 - DNA, 24 bp, Artificial sequence
  SiRNA target sequence
tctccattaccctttcttatcaga

SEQ ID NO: 103315 - DNA, 24 bp, Artificial sequence
  SiRNA target sequence
ctccattaccctttcttatcagag

SEQ ID NO: 103316 - DNA, 24 bp, Artificial sequence
  SiRNA target sequence
tccattaccctttcttatcagagg

SEQ ID NO: 103317 - DNA, 24 bp, Artificial sequence
  SiRNA target sequence
ccattaccctttcttatcagaggt

SEQ ID NO: 103318 - DNA, 24 bp, Artificial sequence
  SiRNA target sequence
cattaccctttcttatcagaggtt

SEQ ID NO: 103319 - DNA, 24 bp, Artificial sequence
  SiRNA target sequence
attaccctttcttatcagaggttt

SEQ ID NO: 103320 - DNA, 24 bp, Artificial sequence
  SiRNA target sequence
ttaccctttcttatcagaggttta

SEQ ID NO: 103321 - DNA, 24 bp, Artificial sequence
  SiRNA target sequence
taccctttcttatcagaggtttag

SEQ ID NO: 103322 - DNA, 24 bp, Artificial sequence
  SiRNA target sequence
accctttcttatcagaggtttagc

SEQ ID NO: 103323 - DNA, 24 bp, Artificial sequence
  SiRNA target sequence
ccctttcttatcagaggtttagct

SEQ ID NO: 103324 - DNA, 24 bp, Artificial sequence
  SiRNA target sequence
cctttcttatcagaggtttagctc

SEQ ID NO: 103325 - DNA, 24 bp, Artificial sequence
  SiRNA target sequence
ctttcttatcagaggtttagctcc

SEQ ID NO: 103326 - DNA, 24 bp, Artificial sequence
  SiRNA target sequence
tttcttatcagaggtttagctccg

SEQ ID NO: 103327 - DNA, 24 bp, Artificial sequence
  SiRNA target sequence
ttcttatcagaggtttagctccgt

SEQ ID NO: 103328 - DNA, 24 bp, Artificial sequence
  SiRNA target sequence
tcttatcagaggtttagctccgtg

SEQ ID NO: 103329 - DNA, 24 bp, Artificial sequence
  SiRNA target sequence
cttatcagaggtttagctccgtgt

SEQ ID NO: 103330 - DNA, 24 bp, Artificial sequence
  SiRNA target sequence
ttatcagaggtttagctccgtgtt

SEQ ID NO: 103331 - DNA, 24 bp, Artificial sequence
  SiRNA target sequence
tatcagaggtttagctccgtgttt

SEQ ID NO: 103332 - DNA, 24 bp, Artificial sequence
  SiRNA target sequence
atcagaggtttagctccgtgtttt

SEQ ID NO: 103333 - DNA, 24 bp, Artificial sequence
  SiRNA target sequence
tcagaggtttagctccgtgtttta

SEQ ID NO: 103334 - DNA, 24 bp, Artificial sequence
  SiRNA target sequence
cagaggtttagctccgtgttttaa

SEQ ID NO: 103335 - DNA, 24 bp, Artificial sequence
  SiRNA target sequence
agaggtttagctccgtgttttaaa

SEQ ID NO: 103336 - DNA, 24 bp, Artificial sequence
  SiRNA target sequence
gaggtttagctccgtgttttaaaa

SEQ ID NO: 103337 - DNA, 24 bp, Artificial sequence
  SiRNA target sequence
aggtttagctccgtgttttaaaag

SEQ ID NO: 103338 - DNA, 24 bp, Artificial sequence
  SiRNA target sequence
ggtttagctccgtgttttaaaagg

SEQ ID NO: 103339 - DNA, 24 bp, Artificial sequence
  SiRNA target sequence
gtttagctccgtgttttaaaaggc

SEQ ID NO: 103340 - DNA, 24 bp, Artificial sequence
  SiRNA target sequence
tttagctccgtgttttaaaaggca

SEQ ID NO: 103341 - DNA, 24 bp, Artificial sequence
  SiRNA target sequence
ttagctccgtgttttaaaaggcaa

SEQ ID NO: 103342 - DNA, 24 bp, Artificial sequence
  SiRNA target sequence
tagctccgtgttttaaaaggcaat

SEQ ID NO: 103343 - DNA, 24 bp, Artificial sequence
  SiRNA target sequence
agctccgtgttttaaaaggcaatt

SEQ ID NO: 103344 - DNA, 24 bp, Artificial sequence
  SiRNA target sequence
gctccgtgttttaaaaggcaatta

SEQ ID NO: 103345 - DNA, 24 bp, Artificial sequence
  SiRNA target sequence
ctccgtgttttaaaaggcaattat

SEQ ID NO: 103346 - DNA, 24 bp, Artificial sequence
  SiRNA target sequence
tccgtgttttaaaaggcaattata

SEQ ID NO: 103347 - DNA, 24 bp, Artificial sequence
  SiRNA target sequence
ccgtgttttaaaaggcaattatac

SEQ ID NO: 103348 - DNA, 24 bp, Artificial sequence
  SiRNA target sequence
cgtgttttaaaaggcaattataca

SEQ ID NO: 103349 - DNA, 24 bp, Artificial sequence
  SiRNA target sequence
gtgttttaaaaggcaattatacaa

SEQ ID NO: 103350 - DNA, 24 bp, Artificial sequence
  SiRNA target sequence
tgttttaaaaggcaattatacaac

SEQ ID NO: 103351 - DNA, 24 bp, Artificial sequence
  SiRNA target sequence
gttttaaaaggcaattatacaact

SEQ ID NO: 103352 - DNA, 24 bp, Artificial sequence
  SiRNA target sequence
ttttaaaaggcaattatacaactt

SEQ ID NO: 103353 - DNA, 24 bp, Artificial sequence
  SiRNA target sequence
tttaaaaggcaattatacaacttt

SEQ ID NO: 103354 - DNA, 24 bp, Artificial sequence
  SiRNA target sequence
ttaaaaggcaattatacaactttt

SEQ ID NO: 103355 - DNA, 24 bp, Artificial sequence
  SiRNA target sequence
taaaaggcaattatacaacttttt

SEQ ID NO: 103356 - DNA, 24 bp, Artificial sequence
  SiRNA target sequence
aaaaggcaattatacaacttttta

SEQ ID NO: 103357 - DNA, 24 bp, Artificial sequence
  SiRNA target sequence
aaaggcaattatacaactttttag

SEQ ID NO: 103358 - DNA, 24 bp, Artificial sequence
  SiRNA target sequence
aaggcaattatacaactttttaga

SEQ ID NO: 103359 - DNA, 24 bp, Artificial sequence
  SiRNA target sequence
aggcaattatacaactttttagaa

SEQ ID NO: 103360 - DNA, 24 bp, Artificial sequence
  SiRNA target sequence
ggcaattatacaactttttagaac

SEQ ID NO: 103361 - DNA, 24 bp, Artificial sequence
  SiRNA target sequence
gcaattatacaactttttagaaca

SEQ ID NO: 103362 - DNA, 24 bp, Artificial sequence
  SiRNA target sequence
caattatacaactttttagaacaa

SEQ ID NO: 103363 - DNA, 24 bp, Artificial sequence
  SiRNA target sequence
aattatacaactttttagaacaaa

SEQ ID NO: 103364 - DNA, 24 bp, Artificial sequence
  SiRNA target sequence
attatacaactttttagaacaaaa

SEQ ID NO: 103365 - DNA, 24 bp, Artificial sequence
  SiRNA target sequence
ttatacaactttttagaacaaaaa

SEQ ID NO: 103366 - DNA, 24 bp, Artificial sequence
  SiRNA target sequence
tatacaactttttagaacaaaaat

SEQ ID NO: 103367 - DNA, 24 bp, Artificial sequence
  SiRNA target sequence
atacaactttttagaacaaaaatt

SEQ ID NO: 103368 - DNA, 24 bp, Artificial sequence
  SiRNA target sequence
tacaactttttagaacaaaaatta

SEQ ID NO: 103369 - DNA, 24 bp, Artificial sequence
  SiRNA target sequence
acaactttttagaacaaaaattaa

SEQ ID NO: 103370 - DNA, 24 bp, Artificial sequence
  SiRNA target sequence
caactttttagaacaaaaattaaa

SEQ ID NO: 103371 - DNA, 24 bp, Artificial sequence
  SiRNA target sequence
aactttttagaacaaaaattaaaa

SEQ ID NO: 103372 - DNA, 24 bp, Artificial sequence
  SiRNA target sequence
actttttagaacaaaaattaaaag

SEQ ID NO: 103373 - DNA, 24 bp, Artificial sequence
  SiRNA target sequence
ctttttagaacaaaaattaaaaga

SEQ ID NO: 103374 - DNA, 24 bp, Artificial sequence
  SiRNA target sequence
tttttagaacaaaaattaaaagat

SEQ ID NO: 103375 - DNA, 24 bp, Artificial sequence
  SiRNA target sequence
ttttagaacaaaaattaaaagatt

SEQ ID NO: 103376 - DNA, 24 bp, Artificial sequence
  SiRNA target sequence
tttagaacaaaaattaaaagattt

SEQ ID NO: 103377 - DNA, 24 bp, Artificial sequence
  SiRNA target sequence
ttagaacaaaaattaaaagattta

SEQ ID NO: 103378 - DNA, 24 bp, Artificial sequence
  SiRNA target sequence
tagaacaaaaattaaaagatttat

SEQ ID NO: 103379 - DNA, 24 bp, Artificial sequence
  SiRNA target sequence
agaacaaaaattaaaagatttata

SEQ ID NO: 103380 - DNA, 24 bp, Artificial sequence
  SiRNA target sequence
gaacaaaaattaaaagatttataa

SEQ ID NO: 103381 - DNA, 24 bp, Artificial sequence
  SiRNA target sequence
aacaaaaattaaaagatttataag

SEQ ID NO: 103382 - DNA, 24 bp, Artificial sequence
  SiRNA target sequence
acaaaaattaaaagatttataaga

SEQ ID NO: 103383 - DNA, 24 bp, Artificial sequence
  SiRNA target sequence
caaaaattaaaagatttataagac

SEQ ID NO: 103384 - DNA, 24 bp, Artificial sequence
  SiRNA target sequence
aaaaattaaaagatttataagacg

SEQ ID NO: 103385 - DNA, 24 bp, Artificial sequence
  SiRNA target sequence
aaaattaaaagatttataagacga

SEQ ID NO: 103386 - DNA, 24 bp, Artificial sequence
  SiRNA target sequence
aaattaaaagatttataagacgaa

SEQ ID NO: 103387 - DNA, 24 bp, Artificial sequence
  SiRNA target sequence
aattaaaagatttataagacgaat

SEQ ID NO: 103388 - DNA, 24 bp, Artificial sequence
  SiRNA target sequence
attaaaagatttataagacgaatc

SEQ ID NO: 103389 - DNA, 24 bp, Artificial sequence
  SiRNA target sequence
ttaaaagatttataagacgaatcc

SEQ ID NO: 103390 - DNA, 24 bp, Artificial sequence
  SiRNA target sequence
taaaagatttataagacgaatccc

SEQ ID NO: 103391 - DNA, 24 bp, Artificial sequence
  SiRNA target sequence
aaaagatttataagacgaatcccc

SEQ ID NO: 103392 - DNA, 24 bp, Artificial sequence
  SiRNA target sequence
aaagatttataagacgaatcccca

SEQ ID NO: 103393 - DNA, 24 bp, Artificial sequence
  SiRNA target sequence
aagatttataagacgaatccccaa

SEQ ID NO: 103394 - DNA, 24 bp, Artificial sequence
  SiRNA target sequence
agatttataagacgaatccccaag

SEQ ID NO: 103395 - DNA, 24 bp, Artificial sequence
  SiRNA target sequence
gatttataagacgaatccccaagg

SEQ ID NO: 103396 - DNA, 24 bp, Artificial sequence
  SiRNA target sequence
atttataagacgaatccccaaggc

SEQ ID NO: 103397 - DNA, 24 bp, Artificial sequence
  SiRNA target sequence
tttataagacgaatccccaaggcc

SEQ ID NO: 103398 - DNA, 24 bp, Artificial sequence
  SiRNA target sequence
ttataagacgaatccccaaggcca

SEQ ID NO: 103399 - DNA, 24 bp, Artificial sequence
  SiRNA target sequence
tataagacgaatccccaaggccaa

SEQ ID NO: 103400 - DNA, 24 bp, Artificial sequence
  SiRNA target sequence
ataagacgaatccccaaggccaaa

SEQ ID NO: 103401 - DNA, 24 bp, Artificial sequence
  SiRNA target sequence
taagacgaatccccaaggccaaat

SEQ ID NO: 103402 - DNA, 24 bp, Artificial sequence
  SiRNA target sequence
aagacgaatccccaaggccaaata

SEQ ID NO: 103403 - DNA, 24 bp, Artificial sequence
  SiRNA target sequence
agacgaatccccaaggccaaatac

SEQ ID NO: 103404 - DNA, 24 bp, Artificial sequence
  SiRNA target sequence
gacgaatccccaaggccaaataca

SEQ ID NO: 103405 - DNA, 24 bp, Artificial sequence
  SiRNA target sequence
acgaatccccaaggccaaatacag

SEQ ID NO: 103406 - DNA, 24 bp, Artificial sequence
  SiRNA target sequence
cgaatccccaaggccaaatacagc

SEQ ID NO: 103407 - DNA, 24 bp, Artificial sequence
  SiRNA target sequence
gaatccccaaggccaaatacagca

SEQ ID NO: 103408 - DNA, 24 bp, Artificial sequence
  SiRNA target sequence
aatccccaaggccaaatacagcaa

SEQ ID NO: 103409 - DNA, 24 bp, Artificial sequence
  SiRNA target sequence
atccccaaggccaaatacagcaaa

SEQ ID NO: 103410 - DNA, 24 bp, Artificial sequence
  SiRNA target sequence
tccccaaggccaaatacagcaaaa

SEQ ID NO: 103411 - DNA, 24 bp, Artificial sequence
  SiRNA target sequence
ccccaaggccaaatacagcaaaat

SEQ ID NO: 103412 - DNA, 24 bp, Artificial sequence
  SiRNA target sequence
cccaaggccaaatacagcaaaatt

SEQ ID NO: 103413 - DNA, 24 bp, Artificial sequence
  SiRNA target sequence
ccaaggccaaatacagcaaaattt

SEQ ID NO: 103414 - DNA, 24 bp, Artificial sequence
  SiRNA target sequence
caaggccaaatacagcaaaattta

SEQ ID NO: 103415 - DNA, 24 bp, Artificial sequence
  SiRNA target sequence
aaggccaaatacagcaaaatttaa

SEQ ID NO: 103416 - DNA, 24 bp, Artificial sequence
  SiRNA target sequence
aggccaaatacagcaaaatttaag

SEQ ID NO: 103417 - DNA, 24 bp, Artificial sequence
  SiRNA target sequence
ggccaaatacagcaaaatttaagt

SEQ ID NO: 103418 - DNA, 24 bp, Artificial sequence
  SiRNA target sequence
gccaaatacagcaaaatttaagtg

SEQ ID NO: 103419 - DNA, 24 bp, Artificial sequence
  SiRNA target sequence
ccaaatacagcaaaatttaagtgt

SEQ ID NO: 103420 - DNA, 24 bp, Artificial sequence
  SiRNA target sequence
caaatacagcaaaatttaagtgtt

SEQ ID NO: 103421 - DNA, 24 bp, Artificial sequence
  SiRNA target sequence
aaatacagcaaaatttaagtgttg

SEQ ID NO: 103422 - DNA, 24 bp, Artificial sequence
  SiRNA target sequence
aatacagcaaaatttaagtgttgt

SEQ ID NO: 103423 - DNA, 24 bp, Artificial sequence
  SiRNA target sequence
atacagcaaaatttaagtgttgta

SEQ ID NO: 103424 - DNA, 24 bp, Artificial sequence
  SiRNA target sequence
tacagcaaaatttaagtgttgtaa

SEQ ID NO: 103425 - DNA, 24 bp, Artificial sequence
  SiRNA target sequence
acagcaaaatttaagtgttgtaaa

SEQ ID NO: 103426 - DNA, 24 bp, Artificial sequence
  SiRNA target sequence
cagcaaaatttaagtgttgtaaaa

SEQ ID NO: 103427 - DNA, 24 bp, Artificial sequence
  SiRNA target sequence
agcaaaatttaagtgttgtaaaaa

SEQ ID NO: 103428 - DNA, 24 bp, Artificial sequence
  SiRNA target sequence
gcaaaatttaagtgttgtaaaaaa

SEQ ID NO: 103429 - DNA, 24 bp, Artificial sequence
  SiRNA target sequence
caaaatttaagtgttgtaaaaaat

SEQ ID NO: 103430 - DNA, 24 bp, Artificial sequence
  SiRNA target sequence
aaaatttaagtgttgtaaaaaatt

SEQ ID NO: 103431 - DNA, 24 bp, Artificial sequence
  SiRNA target sequence
aaatttaagtgttgtaaaaaattt

SEQ ID NO: 103432 - DNA, 24 bp, Artificial sequence
  SiRNA target sequence
aatttaagtgttgtaaaaaatttg

SEQ ID NO: 103433 - DNA, 24 bp, Artificial sequence
  SiRNA target sequence
atttaagtgttgtaaaaaatttgt

SEQ ID NO: 103434 - DNA, 24 bp, Artificial sequence
  SiRNA target sequence
tttaagtgttgtaaaaaatttgta

SEQ ID NO: 103435 - DNA, 24 bp, Artificial sequence
  SiRNA target sequence
ttaagtgttgtaaaaaatttgtag

SEQ ID NO: 103436 - DNA, 24 bp, Artificial sequence
  SiRNA target sequence
taagtgttgtaaaaaatttgtagg

SEQ ID NO: 103437 - DNA, 24 bp, Artificial sequence
  SiRNA target sequence
aagtgttgtaaaaaatttgtaggc

SEQ ID NO: 103438 - DNA, 24 bp, Artificial sequence
  SiRNA target sequence
agtgttgtaaaaaatttgtaggca

SEQ ID NO: 103439 - DNA, 24 bp, Artificial sequence
  SiRNA target sequence
gtgttgtaaaaaatttgtaggcag

SEQ ID NO: 103440 - DNA, 24 bp, Artificial sequence
  SiRNA target sequence
tgttgtaaaaaatttgtaggcaga

SEQ ID NO: 103441 - DNA, 24 bp, Artificial sequence
  SiRNA target sequence
gttgtaaaaaatttgtaggcagat

SEQ ID NO: 103442 - DNA, 24 bp, Artificial sequence
  SiRNA target sequence
ttgtaaaaaatttgtaggcagatt

SEQ ID NO: 103443 - DNA, 24 bp, Artificial sequence
  SiRNA target sequence
tgtaaaaaatttgtaggcagattt

SEQ ID NO: 103444 - DNA, 24 bp, Artificial sequence
  SiRNA target sequence
gtaaaaaatttgtaggcagatttt

SEQ ID NO: 103445 - DNA, 24 bp, Artificial sequence
  SiRNA target sequence
taaaaaatttgtaggcagattttt

SEQ ID NO: 103446 - DNA, 24 bp, Artificial sequence
  SiRNA target sequence
aaaaaatttgtaggcagatttttt

SEQ ID NO: 103447 - DNA, 24 bp, Artificial sequence
  SiRNA target sequence
aaaaatttgtaggcagattttttt

SEQ ID NO: 103448 - DNA, 24 bp, Artificial sequence
  SiRNA target sequence
aaaatttgtaggcagatttttttt

SEQ ID NO: 103449 - DNA, 24 bp, Artificial sequence
  SiRNA target sequence
aaatttgtaggcagattttttttg

SEQ ID NO: 103450 - DNA, 24 bp, Artificial sequence
  SiRNA target sequence
aatttgtaggcagattttttttgc

SEQ ID NO: 103451 - DNA, 24 bp, Artificial sequence
  SiRNA target sequence
atttgtaggcagattttttttgcg

SEQ ID NO: 103452 - DNA, 24 bp, Artificial sequence
  SiRNA target sequence
tttgtaggcagattttttttgcgc

SEQ ID NO: 103453 - DNA, 24 bp, Artificial sequence
  SiRNA target sequence
ttgtaggcagattttttttgcgca

SEQ ID NO: 103454 - DNA, 24 bp, Artificial sequence
  SiRNA target sequence
tgtaggcagattttttttgcgcaa

SEQ ID NO: 103455 - DNA, 24 bp, Artificial sequence
  SiRNA target sequence
gtaggcagattttttttgcgcaaa

SEQ ID NO: 103456 - DNA, 24 bp, Artificial sequence
  SiRNA target sequence
taggcagattttttttgcgcaaaa

SEQ ID NO: 103457 - DNA, 24 bp, Artificial sequence
  SiRNA target sequence
aggcagattttttttgcgcaaaaa

SEQ ID NO: 103458 - DNA, 24 bp, Artificial sequence
  SiRNA target sequence
ggcagattttttttgcgcaaaaat

SEQ ID NO: 103459 - DNA, 24 bp, Artificial sequence
  SiRNA target sequence
gcagattttttttgcgcaaaaatt

SEQ ID NO: 103460 - DNA, 24 bp, Artificial sequence
  SiRNA target sequence
cagattttttttgcgcaaaaattt

SEQ ID NO: 103461 - DNA, 24 bp, Artificial sequence
  SiRNA target sequence
agattttttttgcgcaaaaatttc

SEQ ID NO: 103462 - DNA, 24 bp, Artificial sequence
  SiRNA target sequence
gattttttttgcgcaaaaatttcc

SEQ ID NO: 103463 - DNA, 24 bp, Artificial sequence
  SiRNA target sequence
attttttttgcgcaaaaatttcca

SEQ ID NO: 103464 - DNA, 24 bp, Artificial sequence
  SiRNA target sequence
ttttttttgcgcaaaaatttccaa

SEQ ID NO: 103465 - DNA, 24 bp, Artificial sequence
  SiRNA target sequence
tttttttgcgcaaaaatttccaaa

SEQ ID NO: 103466 - DNA, 24 bp, Artificial sequence
  SiRNA target sequence
ttttttgcgcaaaaatttccaaaa

SEQ ID NO: 103467 - DNA, 24 bp, Artificial sequence
  SiRNA target sequence
tttttgcgcaaaaatttccaaaat

SEQ ID NO: 103468 - DNA, 24 bp, Artificial sequence
  SiRNA target sequence
ttttgcgcaaaaatttccaaaatt

SEQ ID NO: 103469 - DNA, 24 bp, Artificial sequence
  SiRNA target sequence
tttgcgcaaaaatttccaaaattt

SEQ ID NO: 103470 - DNA, 24 bp, Artificial sequence
  SiRNA target sequence
ttgcgcaaaaatttccaaaattta

SEQ ID NO: 103471 - DNA, 24 bp, Artificial sequence
  SiRNA target sequence
tgcgcaaaaatttccaaaatttag

SEQ ID NO: 103472 - DNA, 24 bp, Artificial sequence
  SiRNA target sequence
gcgcaaaaatttccaaaatttagt

SEQ ID NO: 103473 - DNA, 24 bp, Artificial sequence
  SiRNA target sequence
cgcaaaaatttccaaaatttagtc

SEQ ID NO: 103474 - DNA, 24 bp, Artificial sequence
  SiRNA target sequence
gcaaaaatttccaaaatttagtca

SEQ ID NO: 103475 - DNA, 24 bp, Artificial sequence
  SiRNA target sequence
caaaaatttccaaaatttagtcat

SEQ ID NO: 103476 - DNA, 24 bp, Artificial sequence
  SiRNA target sequence
aaaaatttccaaaatttagtcatg

SEQ ID NO: 103477 - DNA, 24 bp, Artificial sequence
  SiRNA target sequence
aaaatttccaaaatttagtcatgt

SEQ ID NO: 103478 - DNA, 24 bp, Artificial sequence
  SiRNA target sequence
aaatttccaaaatttagtcatgtt

SEQ ID NO: 103479 - DNA, 24 bp, Artificial sequence
  SiRNA target sequence
aatttccaaaatttagtcatgtta

SEQ ID NO: 103480 - DNA, 24 bp, Artificial sequence
  SiRNA target sequence
atttccaaaatttagtcatgttaa

SEQ ID NO: 103481 - DNA, 24 bp, Artificial sequence
  SiRNA target sequence
tttccaaaatttagtcatgttaaa

SEQ ID NO: 103482 - DNA, 24 bp, Artificial sequence
  SiRNA target sequence
ttccaaaatttagtcatgttaaaa

SEQ ID NO: 103483 - DNA, 24 bp, Artificial sequence
  SiRNA target sequence
tccaaaatttagtcatgttaaaag

SEQ ID NO: 103484 - DNA, 24 bp, Artificial sequence
  SiRNA target sequence
ccaaaatttagtcatgttaaaagg

SEQ ID NO: 103485 - DNA, 24 bp, Artificial sequence
  SiRNA target sequence
caaaatttagtcatgttaaaaggt

SEQ ID NO: 103486 - DNA, 24 bp, Artificial sequence
  SiRNA target sequence
aaaatttagtcatgttaaaaggtt

SEQ ID NO: 103487 - DNA, 24 bp, Artificial sequence
  SiRNA target sequence
aaatttagtcatgttaaaaggttc

SEQ ID NO: 103488 - DNA, 24 bp, Artificial sequence
  SiRNA target sequence
aatttagtcatgttaaaaggttca

SEQ ID NO: 103489 - DNA, 24 bp, Artificial sequence
  SiRNA target sequence
atttagtcatgttaaaaggttcag

SEQ ID NO: 103490 - DNA, 24 bp, Artificial sequence
  SiRNA target sequence
tttagtcatgttaaaaggttcaga

SEQ ID NO: 103491 - DNA, 24 bp, Artificial sequence
  SiRNA target sequence
ttagtcatgttaaaaggttcagaa

SEQ ID NO: 103492 - DNA, 24 bp, Artificial sequence
  SiRNA target sequence
tagtcatgttaaaaggttcagaac

SEQ ID NO: 103493 - DNA, 24 bp, Artificial sequence
  SiRNA target sequence
agtcatgttaaaaggttcagaacc

SEQ ID NO: 103494 - DNA, 24 bp, Artificial sequence
  SiRNA target sequence
gtcatgttaaaaggttcagaacca

SEQ ID NO: 103495 - DNA, 24 bp, Artificial sequence
  SiRNA target sequence
tcatgttaaaaggttcagaaccat

SEQ ID NO: 103496 - DNA, 24 bp, Artificial sequence
  SiRNA target sequence
catgttaaaaggttcagaaccatt

SEQ ID NO: 103497 - DNA, 24 bp, Artificial sequence
  SiRNA target sequence
atgttaaaaggttcagaaccattc

SEQ ID NO: 103498 - DNA, 24 bp, Artificial sequence
  SiRNA target sequence
tgttaaaaggttcagaaccattcc

SEQ ID NO: 103499 - DNA, 24 bp, Artificial sequence
  SiRNA target sequence
gttaaaaggttcagaaccattccc

SEQ ID NO: 103500 - DNA, 24 bp, Artificial sequence
  SiRNA target sequence
ttaaaaggttcagaaccattccca

SEQ ID NO: 103501 - DNA, 24 bp, Artificial sequence
  SiRNA target sequence
taaaaggttcagaaccattcccat

SEQ ID NO: 103502 - DNA, 24 bp, Artificial sequence
  SiRNA target sequence
aaaaggttcagaaccattcccatg

SEQ ID NO: 103503 - DNA, 24 bp, Artificial sequence
  SiRNA target sequence
aaaggttcagaaccattcccatga

SEQ ID NO: 103504 - DNA, 24 bp, Artificial sequence
  SiRNA target sequence
aaggttcagaaccattcccatgag

SEQ ID NO: 103505 - DNA, 24 bp, Artificial sequence
  SiRNA target sequence
aggttcagaaccattcccatgagt

SEQ ID NO: 103506 - DNA, 24 bp, Artificial sequence
  SiRNA target sequence
ggttcagaaccattcccatgagtc

SEQ ID NO: 103507 - DNA, 24 bp, Artificial sequence
  SiRNA target sequence
gttcagaaccattcccatgagtcg

SEQ ID NO: 103508 - DNA, 24 bp, Artificial sequence
  SiRNA target sequence
ttcagaaccattcccatgagtcga

SEQ ID NO: 103509 - DNA, 24 bp, Artificial sequence
  SiRNA target sequence
tcagaaccattcccatgagtcgaa

SEQ ID NO: 103510 - DNA, 24 bp, Artificial sequence
  SiRNA target sequence
cagaaccattcccatgagtcgaac

SEQ ID NO: 103511 - DNA, 24 bp, Artificial sequence
  SiRNA target sequence
agaaccattcccatgagtcgaaca

SEQ ID NO: 103512 - DNA, 24 bp, Artificial sequence
  SiRNA target sequence
gaaccattcccatgagtcgaacat

SEQ ID NO: 103513 - DNA, 24 bp, Artificial sequence
  SiRNA target sequence
aaccattcccatgagtcgaacata

SEQ ID NO: 103514 - DNA, 24 bp, Artificial sequence
  SiRNA target sequence
accattcccatgagtcgaacatac

SEQ ID NO: 103515 - DNA, 24 bp, Artificial sequence
  SiRNA target sequence
ccattcccatgagtcgaacataca

SEQ ID NO: 103516 - DNA, 24 bp, Artificial sequence
  SiRNA target sequence
cattcccatgagtcgaacatacaa

SEQ ID NO: 103517 - DNA, 24 bp, Artificial sequence
  SiRNA target sequence
attcccatgagtcgaacatacaaa

SEQ ID NO: 103518 - DNA, 24 bp, Artificial sequence
  SiRNA target sequence
ttcccatgagtcgaacatacaaat

SEQ ID NO: 103519 - DNA, 24 bp, Artificial sequence
  SiRNA target sequence
tcccatgagtcgaacatacaaata

SEQ ID NO: 103520 - DNA, 24 bp, Artificial sequence
  SiRNA target sequence
cccatgagtcgaacatacaaatat

SEQ ID NO: 103521 - DNA, 24 bp, Artificial sequence
  SiRNA target sequence
ccatgagtcgaacatacaaatata

SEQ ID NO: 103522 - DNA, 24 bp, Artificial sequence
  SiRNA target sequence
catgagtcgaacatacaaatataa

SEQ ID NO: 103523 - DNA, 24 bp, Artificial sequence
  SiRNA target sequence
atgagtcgaacatacaaatataat

SEQ ID NO: 103524 - DNA, 24 bp, Artificial sequence
  SiRNA target sequence
tgagtcgaacatacaaatataatc

SEQ ID NO: 103525 - DNA, 24 bp, Artificial sequence
  SiRNA target sequence
gagtcgaacatacaaatataatca

SEQ ID NO: 103526 - DNA, 24 bp, Artificial sequence
  SiRNA target sequence
agtcgaacatacaaatataatcat

SEQ ID NO: 103527 - DNA, 24 bp, Artificial sequence
  SiRNA target sequence
gtcgaacatacaaatataatcata

SEQ ID NO: 103528 - DNA, 24 bp, Artificial sequence
  SiRNA target sequence
tcgaacatacaaatataatcatat

SEQ ID NO: 103529 - DNA, 24 bp, Artificial sequence
  SiRNA target sequence
cgaacatacaaatataatcatatc

SEQ ID NO: 103530 - DNA, 24 bp, Artificial sequence
  SiRNA target sequence
gaacatacaaatataatcatatca

SEQ ID NO: 103531 - DNA, 24 bp, Artificial sequence
  SiRNA target sequence
aacatacaaatataatcatatcaa

SEQ ID NO: 103532 - DNA, 24 bp, Artificial sequence
  SiRNA target sequence
acatacaaatataatcatatcaat

SEQ ID NO: 103533 - DNA, 24 bp, Artificial sequence
  SiRNA target sequence
catacaaatataatcatatcaata

SEQ ID NO: 103534 - DNA, 24 bp, Artificial sequence
  SiRNA target sequence
atacaaatataatcatatcaatat

SEQ ID NO: 103535 - DNA, 24 bp, Artificial sequence
  SiRNA target sequence
tacaaatataatcatatcaatatc

SEQ ID NO: 103536 - DNA, 24 bp, Artificial sequence
  SiRNA target sequence
acaaatataatcatatcaatatct

SEQ ID NO: 103537 - DNA, 24 bp, Artificial sequence
  SiRNA target sequence
caaatataatcatatcaatatcta

SEQ ID NO: 103538 - DNA, 24 bp, Artificial sequence
  SiRNA target sequence
aaatataatcatatcaatatctaa

SEQ ID NO: 103539 - DNA, 24 bp, Artificial sequence
  SiRNA target sequence
aatataatcatatcaatatctaat

SEQ ID NO: 103540 - DNA, 24 bp, Artificial sequence
  SiRNA target sequence
atataatcatatcaatatctaata

SEQ ID NO: 103541 - DNA, 24 bp, Artificial sequence
  SiRNA target sequence
tataatcatatcaatatctaatat

SEQ ID NO: 103542 - DNA, 24 bp, Artificial sequence
  SiRNA target sequence
ataatcatatcaatatctaatatt

SEQ ID NO: 103543 - DNA, 24 bp, Artificial sequence
  SiRNA target sequence
taatcatatcaatatctaatattt

SEQ ID NO: 103544 - DNA, 24 bp, Artificial sequence
  SiRNA target sequence
aatcatatcaatatctaatatttt

SEQ ID NO: 103545 - DNA, 24 bp, Artificial sequence
  SiRNA target sequence
atcatatcaatatctaatattttt

SEQ ID NO: 103546 - DNA, 24 bp, Artificial sequence
  SiRNA target sequence
tcatatcaatatctaatatttttt

SEQ ID NO: 103547 - DNA, 24 bp, Artificial sequence
  SiRNA target sequence
catatcaatatctaatattttttc

SEQ ID NO: 103548 - DNA, 24 bp, Artificial sequence
  SiRNA target sequence
atatcaatatctaatattttttcg

SEQ ID NO: 103549 - DNA, 24 bp, Artificial sequence
  SiRNA target sequence
tatcaatatctaatattttttcga

SEQ ID NO: 103550 - DNA, 24 bp, Artificial sequence
  SiRNA target sequence
atcaatatctaatattttttcgaa

SEQ ID NO: 103551 - DNA, 24 bp, Artificial sequence
  SiRNA target sequence
tcaatatctaatattttttcgaaa

SEQ ID NO: 103552 - DNA, 24 bp, Artificial sequence
  SiRNA target sequence
caatatctaatattttttcgaaat

SEQ ID NO: 103553 - DNA, 24 bp, Artificial sequence
  SiRNA target sequence
aatatctaatattttttcgaaatc

SEQ ID NO: 103554 - DNA, 24 bp, Artificial sequence
  SiRNA target sequence
atatctaatattttttcgaaatca

SEQ ID NO: 103555 - DNA, 24 bp, Artificial sequence
  SiRNA target sequence
tatctaatattttttcgaaatcaa

SEQ ID NO: 103556 - DNA, 24 bp, Artificial sequence
  SiRNA target sequence
atctaatattttttcgaaatcaaa

SEQ ID NO: 103557 - DNA, 24 bp, Artificial sequence
  SiRNA target sequence
tctaatattttttcgaaatcaaaa

SEQ ID NO: 103558 - DNA, 24 bp, Artificial sequence
  SiRNA target sequence
ctaatattttttcgaaatcaaaac

SEQ ID NO: 103559 - DNA, 24 bp, Artificial sequence
  SiRNA target sequence
taatattttttcgaaatcaaaact

SEQ ID NO: 103560 - DNA, 24 bp, Artificial sequence
  SiRNA target sequence
aatattttttcgaaatcaaaactg

SEQ ID NO: 103561 - DNA, 24 bp, Artificial sequence
  SiRNA target sequence
atattttttcgaaatcaaaactgt

SEQ ID NO: 103562 - DNA, 24 bp, Artificial sequence
  SiRNA target sequence
tattttttcgaaatcaaaactgtc

SEQ ID NO: 103563 - DNA, 24 bp, Artificial sequence
  SiRNA target sequence
attttttcgaaatcaaaactgtcc

SEQ ID NO: 103564 - DNA, 24 bp, Artificial sequence
  SiRNA target sequence
ttttttcgaaatcaaaactgtcca

SEQ ID NO: 103565 - DNA, 24 bp, Artificial sequence
  SiRNA target sequence
tttttcgaaatcaaaactgtccat

SEQ ID NO: 103566 - DNA, 24 bp, Artificial sequence
  SiRNA target sequence
ttttcgaaatcaaaactgtccata

SEQ ID NO: 103567 - DNA, 24 bp, Artificial sequence
  SiRNA target sequence
tttcgaaatcaaaactgtccatat

SEQ ID NO: 103568 - DNA, 24 bp, Artificial sequence
  SiRNA target sequence
ttcgaaatcaaaactgtccatatc

SEQ ID NO: 103569 - DNA, 24 bp, Artificial sequence
  SiRNA target sequence
tcgaaatcaaaactgtccatatct

SEQ ID NO: 103570 - DNA, 24 bp, Artificial sequence
  SiRNA target sequence
cgaaatcaaaactgtccatatcta

SEQ ID NO: 103571 - DNA, 24 bp, Artificial sequence
  SiRNA target sequence
gaaatcaaaactgtccatatctaa

SEQ ID NO: 103572 - DNA, 24 bp, Artificial sequence
  SiRNA target sequence
aaatcaaaactgtccatatctaaa

SEQ ID NO: 103573 - DNA, 24 bp, Artificial sequence
  SiRNA target sequence
aatcaaaactgtccatatctaaag

SEQ ID NO: 103574 - DNA, 24 bp, Artificial sequence
  SiRNA target sequence
atcaaaactgtccatatctaaagt

SEQ ID NO: 103575 - DNA, 24 bp, Artificial sequence
  SiRNA target sequence
tcaaaactgtccatatctaaagta

SEQ ID NO: 103576 - DNA, 24 bp, Artificial sequence
  SiRNA target sequence
caaaactgtccatatctaaagtaa

SEQ ID NO: 103577 - DNA, 24 bp, Artificial sequence
  SiRNA target sequence
aaaactgtccatatctaaagtaaa

SEQ ID NO: 103578 - DNA, 24 bp, Artificial sequence
  SiRNA target sequence
aaactgtccatatctaaagtaaaa

SEQ ID NO: 103579 - DNA, 24 bp, Artificial sequence
  SiRNA target sequence
aactgtccatatctaaagtaaaat

SEQ ID NO: 103580 - DNA, 24 bp, Artificial sequence
  SiRNA target sequence
actgtccatatctaaagtaaaatc

SEQ ID NO: 103581 - DNA, 24 bp, Artificial sequence
  SiRNA target sequence
ctgtccatatctaaagtaaaatct

SEQ ID NO: 103582 - DNA, 24 bp, Artificial sequence
  SiRNA target sequence
tgtccatatctaaagtaaaatctg

SEQ ID NO: 103583 - DNA, 24 bp, Artificial sequence
  SiRNA target sequence
gtccatatctaaagtaaaatctgt

SEQ ID NO: 103584 - DNA, 24 bp, Artificial sequence
  SiRNA target sequence
tccatatctaaagtaaaatctgtt

SEQ ID NO: 103585 - DNA, 24 bp, Artificial sequence
  SiRNA target sequence
ccatatctaaagtaaaatctgttg

SEQ ID NO: 103586 - DNA, 24 bp, Artificial sequence
  SiRNA target sequence
catatctaaagtaaaatctgttgg

SEQ ID NO: 103587 - DNA, 24 bp, Artificial sequence
  SiRNA target sequence
atatctaaagtaaaatctgttgga

SEQ ID NO: 103588 - DNA, 24 bp, Artificial sequence
  SiRNA target sequence
tatctaaagtaaaatctgttggaa

SEQ ID NO: 103589 - DNA, 24 bp, Artificial sequence
  SiRNA target sequence
atctaaagtaaaatctgttggaag

SEQ ID NO: 103590 - DNA, 24 bp, Artificial sequence
  SiRNA target sequence
tctaaagtaaaatctgttggaagc

SEQ ID NO: 103591 - DNA, 24 bp, Artificial sequence
  SiRNA target sequence
ctaaagtaaaatctgttggaagca

SEQ ID NO: 103592 - DNA, 24 bp, Artificial sequence
  SiRNA target sequence
taaagtaaaatctgttggaagcaa

SEQ ID NO: 103593 - DNA, 24 bp, Artificial sequence
  SiRNA target sequence
aaagtaaaatctgttggaagcaat

SEQ ID NO: 103594 - DNA, 24 bp, Artificial sequence
  SiRNA target sequence
aagtaaaatctgttggaagcaatt

SEQ ID NO: 103595 - DNA, 24 bp, Artificial sequence
  SiRNA target sequence
agtaaaatctgttggaagcaattc

SEQ ID NO: 103596 - DNA, 24 bp, Artificial sequence
  SiRNA target sequence
gtaaaatctgttggaagcaattct

SEQ ID NO: 103597 - DNA, 24 bp, Artificial sequence
  SiRNA target sequence
taaaatctgttggaagcaattctt

SEQ ID NO: 103598 - DNA, 24 bp, Artificial sequence
  SiRNA target sequence
aaaatctgttggaagcaattcttt

SEQ ID NO: 103599 - DNA, 24 bp, Artificial sequence
  SiRNA target sequence
aaatctgttggaagcaattcttta

SEQ ID NO: 103600 - DNA, 24 bp, Artificial sequence
  SiRNA target sequence
aatctgttggaagcaattctttat

SEQ ID NO: 103601 - DNA, 24 bp, Artificial sequence
  SiRNA target sequence
atctgttggaagcaattctttatc

SEQ ID NO: 103602 - DNA, 24 bp, Artificial sequence
  SiRNA target sequence
tctgttggaagcaattctttatca

SEQ ID NO: 103603 - DNA, 24 bp, Artificial sequence
  SiRNA target sequence
ctgttggaagcaattctttatcaa

SEQ ID NO: 103604 - DNA, 24 bp, Artificial sequence
  SiRNA target sequence
tgttggaagcaattctttatcaac

SEQ ID NO: 103605 - DNA, 24 bp, Artificial sequence
  SiRNA target sequence
gttggaagcaattctttatcaacg

SEQ ID NO: 103606 - DNA, 24 bp, Artificial sequence
  SiRNA target sequence
ttggaagcaattctttatcaacgt

SEQ ID NO: 103607 - DNA, 24 bp, Artificial sequence
  SiRNA target sequence
tggaagcaattctttatcaacgtt

SEQ ID NO: 103608 - DNA, 24 bp, Artificial sequence
  SiRNA target sequence
ggaagcaattctttatcaacgtta

SEQ ID NO: 103609 - DNA, 24 bp, Artificial sequence
  SiRNA target sequence
gaagcaattctttatcaacgttat

SEQ ID NO: 103610 - DNA, 24 bp, Artificial sequence
  SiRNA target sequence
aagcaattctttatcaacgttata

SEQ ID NO: 103611 - DNA, 24 bp, Artificial sequence
  SiRNA target sequence
agcaattctttatcaacgttataa

SEQ ID NO: 103612 - DNA, 24 bp, Artificial sequence
  SiRNA target sequence
gcaattctttatcaacgttataaa

SEQ ID NO: 103613 - DNA, 24 bp, Artificial sequence
  SiRNA target sequence
caattctttatcaacgttataaat

SEQ ID NO: 103614 - DNA, 24 bp, Artificial sequence
  SiRNA target sequence
aattctttatcaacgttataaatc

SEQ ID NO: 103615 - DNA, 24 bp, Artificial sequence
  SiRNA target sequence
attctttatcaacgttataaatca

SEQ ID NO: 103616 - DNA, 24 bp, Artificial sequence
  SiRNA target sequence
ttctttatcaacgttataaatcaa

SEQ ID NO: 103617 - DNA, 24 bp, Artificial sequence
  SiRNA target sequence
tctttatcaacgttataaatcaaa

SEQ ID NO: 103618 - DNA, 24 bp, Artificial sequence
  SiRNA target sequence
ctttatcaacgttataaatcaaat

SEQ ID NO: 103619 - DNA, 24 bp, Artificial sequence
  SiRNA target sequence
tttatcaacgttataaatcaaatc

SEQ ID NO: 103620 - DNA, 24 bp, Artificial sequence
  SiRNA target sequence
ttatcaacgttataaatcaaatct

SEQ ID NO: 103621 - DNA, 24 bp, Artificial sequence
  SiRNA target sequence
tatcaacgttataaatcaaatctt

SEQ ID NO: 103622 - DNA, 24 bp, Artificial sequence
  SiRNA target sequence
atcaacgttataaatcaaatcttt

SEQ ID NO: 103623 - DNA, 24 bp, Artificial sequence
  SiRNA target sequence
tcaacgttataaatcaaatcttta

SEQ ID NO: 103624 - DNA, 24 bp, Artificial sequence
  SiRNA target sequence
caacgttataaatcaaatctttat

SEQ ID NO: 103625 - DNA, 24 bp, Artificial sequence
  SiRNA target sequence
aacgttataaatcaaatctttatt

SEQ ID NO: 103626 - DNA, 24 bp, Artificial sequence
  SiRNA target sequence
acgttataaatcaaatctttattg

SEQ ID NO: 103627 - DNA, 24 bp, Artificial sequence
  SiRNA target sequence
cgttataaatcaaatctttattgt

SEQ ID NO: 103628 - DNA, 24 bp, Artificial sequence
  SiRNA target sequence
gttataaatcaaatctttattgta

SEQ ID NO: 103629 - DNA, 24 bp, Artificial sequence
  SiRNA target sequence
ttataaatcaaatctttattgtat

SEQ ID NO: 103630 - DNA, 24 bp, Artificial sequence
  SiRNA target sequence
tataaatcaaatctttattgtatc

SEQ ID NO: 103631 - DNA, 24 bp, Artificial sequence
  SiRNA target sequence
ataaatcaaatctttattgtatcc

SEQ ID NO: 103632 - DNA, 24 bp, Artificial sequence
  SiRNA target sequence
taaatcaaatctttattgtatccg

SEQ ID NO: 103633 - DNA, 24 bp, Artificial sequence
  SiRNA target sequence
aaatcaaatctttattgtatccgt

SEQ ID NO: 103634 - DNA, 24 bp, Artificial sequence
  SiRNA target sequence
aatcaaatctttattgtatccgta

SEQ ID NO: 103635 - DNA, 24 bp, Artificial sequence
  SiRNA target sequence
atcaaatctttattgtatccgtat

SEQ ID NO: 103636 - DNA, 24 bp, Artificial sequence
  SiRNA target sequence
tcaaatctttattgtatccgtata

SEQ ID NO: 103637 - DNA, 24 bp, Artificial sequence
  SiRNA target sequence
caaatctttattgtatccgtatag

SEQ ID NO: 103638 - DNA, 24 bp, Artificial sequence
  SiRNA target sequence
aaatctttattgtatccgtatagt

SEQ ID NO: 103639 - DNA, 24 bp, Artificial sequence
  SiRNA target sequence
aatctttattgtatccgtatagta

SEQ ID NO: 103640 - DNA, 24 bp, Artificial sequence
  SiRNA target sequence
atctttattgtatccgtatagtat

SEQ ID NO: 103641 - DNA, 24 bp, Artificial sequence
  SiRNA target sequence
tctttattgtatccgtatagtata

SEQ ID NO: 103642 - DNA, 24 bp, Artificial sequence
  SiRNA target sequence
ctttattgtatccgtatagtataa

SEQ ID NO: 103643 - DNA, 24 bp, Artificial sequence
  SiRNA target sequence
tttattgtatccgtatagtataac

SEQ ID NO: 103644 - DNA, 24 bp, Artificial sequence
  SiRNA target sequence
ttattgtatccgtatagtataaca

SEQ ID NO: 103645 - DNA, 24 bp, Artificial sequence
  SiRNA target sequence
tattgtatccgtatagtataacat

SEQ ID NO: 103646 - DNA, 24 bp, Artificial sequence
  SiRNA target sequence
attgtatccgtatagtataacatt

SEQ ID NO: 103647 - DNA, 24 bp, Artificial sequence
  SiRNA target sequence
ttgtatccgtatagtataacattt

SEQ ID NO: 103648 - DNA, 24 bp, Artificial sequence
  SiRNA target sequence
tgtatccgtatagtataacatttt

SEQ ID NO: 103649 - DNA, 24 bp, Artificial sequence
  SiRNA target sequence
gtatccgtatagtataacattttg

SEQ ID NO: 103650 - DNA, 24 bp, Artificial sequence
  SiRNA target sequence
tatccgtatagtataacattttga

SEQ ID NO: 103651 - DNA, 24 bp, Artificial sequence
  SiRNA target sequence
atccgtatagtataacattttgaa

SEQ ID NO: 103652 - DNA, 24 bp, Artificial sequence
  SiRNA target sequence
tccgtatagtataacattttgaat

SEQ ID NO: 103653 - DNA, 24 bp, Artificial sequence
  SiRNA target sequence
ccgtatagtataacattttgaata

SEQ ID NO: 103654 - DNA, 24 bp, Artificial sequence
  SiRNA target sequence
cgtatagtataacattttgaataa

SEQ ID NO: 103655 - DNA, 24 bp, Artificial sequence
  SiRNA target sequence
gtatagtataacattttgaataag

SEQ ID NO: 103656 - DNA, 24 bp, Artificial sequence
  SiRNA target sequence
tatagtataacattttgaataagt

SEQ ID NO: 103657 - DNA, 24 bp, Artificial sequence
  SiRNA target sequence
atagtataacattttgaataagtt

SEQ ID NO: 103658 - DNA, 24 bp, Artificial sequence
  SiRNA target sequence
tagtataacattttgaataagttt

SEQ ID NO: 103659 - DNA, 24 bp, Artificial sequence
  SiRNA target sequence
agtataacattttgaataagttta

SEQ ID NO: 103660 - DNA, 24 bp, Artificial sequence
  SiRNA target sequence
gtataacattttgaataagtttag

SEQ ID NO: 103661 - DNA, 24 bp, Artificial sequence
  SiRNA target sequence
tataacattttgaataagtttagc

SEQ ID NO: 103662 - DNA, 24 bp, Artificial sequence
  SiRNA target sequence
ataacattttgaataagtttagca

SEQ ID NO: 103663 - DNA, 24 bp, Artificial sequence
  SiRNA target sequence
taacattttgaataagtttagcaa

SEQ ID NO: 103664 - DNA, 24 bp, Artificial sequence
  SiRNA target sequence
aacattttgaataagtttagcaat

SEQ ID NO: 103665 - DNA, 24 bp, Artificial sequence
  SiRNA target sequence
acattttgaataagtttagcaata

SEQ ID NO: 103666 - DNA, 24 bp, Artificial sequence
  SiRNA target sequence
cattttgaataagtttagcaatat

SEQ ID NO: 103667 - DNA, 24 bp, Artificial sequence
  SiRNA target sequence
attttgaataagtttagcaatatg

SEQ ID NO: 103668 - DNA, 24 bp, Artificial sequence
  SiRNA target sequence
ttttgaataagtttagcaatatgt

SEQ ID NO: 103669 - DNA, 24 bp, Artificial sequence
  SiRNA target sequence
tttgaataagtttagcaatatgta

SEQ ID NO: 103670 - DNA, 24 bp, Artificial sequence
  SiRNA target sequence
ttgaataagtttagcaatatgtat

SEQ ID NO: 103671 - DNA, 24 bp, Artificial sequence
  SiRNA target sequence
tgaataagtttagcaatatgtata

SEQ ID NO: 103672 - DNA, 24 bp, Artificial sequence
  SiRNA target sequence
gaataagtttagcaatatgtatag

SEQ ID NO: 103673 - DNA, 24 bp, Artificial sequence
  SiRNA target sequence
aataagtttagcaatatgtataga

SEQ ID NO: 103674 - DNA, 24 bp, Artificial sequence
  SiRNA target sequence
ataagtttagcaatatgtatagaa

SEQ ID NO: 103675 - DNA, 24 bp, Artificial sequence
  SiRNA target sequence
taagtttagcaatatgtatagaat

SEQ ID NO: 103676 - DNA, 24 bp, Artificial sequence
  SiRNA target sequence
aagtttagcaatatgtatagaatt

SEQ ID NO: 103677 - DNA, 24 bp, Artificial sequence
  SiRNA target sequence
agtttagcaatatgtatagaattt

SEQ ID NO: 103678 - DNA, 24 bp, Artificial sequence
  SiRNA target sequence
gtttagcaatatgtatagaatttc

SEQ ID NO: 103679 - DNA, 24 bp, Artificial sequence
  SiRNA target sequence
tttagcaatatgtatagaatttcc

SEQ ID NO: 103680 - DNA, 24 bp, Artificial sequence
  SiRNA target sequence
ttagcaatatgtatagaatttcct

SEQ ID NO: 103681 - DNA, 24 bp, Artificial sequence
  SiRNA target sequence
tagcaatatgtatagaatttcctg

SEQ ID NO: 103682 - DNA, 24 bp, Artificial sequence
  SiRNA target sequence
agcaatatgtatagaatttcctgt

SEQ ID NO: 103683 - DNA, 24 bp, Artificial sequence
  SiRNA target sequence
gcaatatgtatagaatttcctgtt

SEQ ID NO: 103684 - DNA, 24 bp, Artificial sequence
  SiRNA target sequence
caatatgtatagaatttcctgttt

SEQ ID NO: 103685 - DNA, 24 bp, Artificial sequence
  SiRNA target sequence
aatatgtatagaatttcctgtttg

SEQ ID NO: 103686 - DNA, 24 bp, Artificial sequence
  SiRNA target sequence
atatgtatagaatttcctgtttgg

SEQ ID NO: 103687 - DNA, 24 bp, Artificial sequence
  SiRNA target sequence
tatgtatagaatttcctgtttggg

SEQ ID NO: 103688 - DNA, 24 bp, Artificial sequence
  SiRNA target sequence
atgtatagaatttcctgtttggga

SEQ ID NO: 103689 - DNA, 24 bp, Artificial sequence
  SiRNA target sequence
tgtatagaatttcctgtttgggag

SEQ ID NO: 103690 - DNA, 24 bp, Artificial sequence
  SiRNA target sequence
gtatagaatttcctgtttgggagc

SEQ ID NO: 103691 - DNA, 24 bp, Artificial sequence
  SiRNA target sequence
tatagaatttcctgtttgggagcc

SEQ ID NO: 103692 - DNA, 24 bp, Artificial sequence
  SiRNA target sequence
atagaatttcctgtttgggagcca

SEQ ID NO: 103693 - DNA, 24 bp, Artificial sequence
  SiRNA target sequence
tagaatttcctgtttgggagccat

SEQ ID NO: 103694 - DNA, 24 bp, Artificial sequence
  SiRNA target sequence
agaatttcctgtttgggagccata

SEQ ID NO: 103695 - DNA, 24 bp, Artificial sequence
  SiRNA target sequence
gaatttcctgtttgggagccatat

SEQ ID NO: 103696 - DNA, 24 bp, Artificial sequence
  SiRNA target sequence
aatttcctgtttgggagccatata

SEQ ID NO: 103697 - DNA, 24 bp, Artificial sequence
  SiRNA target sequence
atttcctgtttgggagccatataa

SEQ ID NO: 103698 - DNA, 24 bp, Artificial sequence
  SiRNA target sequence
tttcctgtttgggagccatataag

SEQ ID NO: 103699 - DNA, 24 bp, Artificial sequence
  SiRNA target sequence
ttcctgtttgggagccatataaga

SEQ ID NO: 103700 - DNA, 24 bp, Artificial sequence
  SiRNA target sequence
tcctgtttgggagccatataagat

SEQ ID NO: 103701 - DNA, 24 bp, Artificial sequence
  SiRNA target sequence
cctgtttgggagccatataagatt

SEQ ID NO: 103702 - DNA, 24 bp, Artificial sequence
  SiRNA target sequence
ctgtttgggagccatataagatta

SEQ ID NO: 103703 - DNA, 24 bp, Artificial sequence
  SiRNA target sequence
tgtttgggagccatataagattat

SEQ ID NO: 103704 - DNA, 24 bp, Artificial sequence
  SiRNA target sequence
gtttgggagccatataagattatc

SEQ ID NO: 103705 - DNA, 24 bp, Artificial sequence
  SiRNA target sequence
tttgggagccatataagattatca

SEQ ID NO: 103706 - DNA, 24 bp, Artificial sequence
  SiRNA target sequence
ttgggagccatataagattatcat

SEQ ID NO: 103707 - DNA, 25 bp, Artificial sequence
  SiRNA target sequence
ttaccaagtttctgcctgaaaatat

SEQ ID NO: 103708 - DNA, 25 bp, Artificial sequence
  SiRNA target sequence
taccaagtttctgcctgaaaatata

SEQ ID NO: 103709 - DNA, 25 bp, Artificial sequence
  SiRNA target sequence
accaagtttctgcctgaaaatatat

SEQ ID NO: 103710 - DNA, 25 bp, Artificial sequence
  SiRNA target sequence
ccaagtttctgcctgaaaatatatt

SEQ ID NO: 103711 - DNA, 25 bp, Artificial sequence
  SiRNA target sequence
caagtttctgcctgaaaatatattt

SEQ ID NO: 103712 - DNA, 25 bp, Artificial sequence
  SiRNA target sequence
aagtttctgcctgaaaatatatttt

SEQ ID NO: 103713 - DNA, 25 bp, Artificial sequence
  SiRNA target sequence
agtttctgcctgaaaatatattttc

SEQ ID NO: 103714 - DNA, 25 bp, Artificial sequence
  SiRNA target sequence
gtttctgcctgaaaatatattttct

SEQ ID NO: 103715 - DNA, 25 bp, Artificial sequence
  SiRNA target sequence
tttctgcctgaaaatatattttctt

SEQ ID NO: 103716 - DNA, 25 bp, Artificial sequence
  SiRNA target sequence
ttctgcctgaaaatatattttcttt

SEQ ID NO: 103717 - DNA, 25 bp, Artificial sequence
  SiRNA target sequence
tctgcctgaaaatatattttctttt

SEQ ID NO: 103718 - DNA, 25 bp, Artificial sequence
  SiRNA target sequence
ctgcctgaaaatatattttcttttt

SEQ ID NO: 103719 - DNA, 25 bp, Artificial sequence
  SiRNA target sequence
tgcctgaaaatatattttcttttta

SEQ ID NO: 103720 - DNA, 25 bp, Artificial sequence
  SiRNA target sequence
gcctgaaaatatattttctttttat

SEQ ID NO: 103721 - DNA, 25 bp, Artificial sequence
  SiRNA target sequence
cctgaaaatatattttctttttata

SEQ ID NO: 103722 - DNA, 25 bp, Artificial sequence
  SiRNA target sequence
ctgaaaatatattttctttttataa

SEQ ID NO: 103723 - DNA, 25 bp, Artificial sequence
  SiRNA target sequence
tgaaaatatattttctttttataaa

SEQ ID NO: 103724 - DNA, 25 bp, Artificial sequence
  SiRNA target sequence
gaaaatatattttctttttataaat

SEQ ID NO: 103725 - DNA, 25 bp, Artificial sequence
  SiRNA target sequence
aaaatatattttctttttataaata

SEQ ID NO: 103726 - DNA, 25 bp, Artificial sequence
  SiRNA target sequence
aaatatattttctttttataaatat

SEQ ID NO: 103727 - DNA, 25 bp, Artificial sequence
  SiRNA target sequence
aatatattttctttttataaatatc

SEQ ID NO: 103728 - DNA, 25 bp, Artificial sequence
  SiRNA target sequence
atatattttctttttataaatatct

SEQ ID NO: 103729 - DNA, 25 bp, Artificial sequence
  SiRNA target sequence
tatattttctttttataaatatcta

SEQ ID NO: 103730 - DNA, 25 bp, Artificial sequence
  SiRNA target sequence
atattttctttttataaatatctaa

SEQ ID NO: 103731 - DNA, 25 bp, Artificial sequence
  SiRNA target sequence
tattttctttttataaatatctaat

SEQ ID NO: 103732 - DNA, 25 bp, Artificial sequence
  SiRNA target sequence
attttctttttataaatatctaata

SEQ ID NO: 103733 - DNA, 25 bp, Artificial sequence
  SiRNA target sequence
ttttctttttataaatatctaataa

SEQ ID NO: 103734 - DNA, 25 bp, Artificial sequence
  SiRNA target sequence
tttctttttataaatatctaataac

SEQ ID NO: 103735 - DNA, 25 bp, Artificial sequence
  SiRNA target sequence
ttctttttataaatatctaataaca

SEQ ID NO: 103736 - DNA, 25 bp, Artificial sequence
  SiRNA target sequence
tctttttataaatatctaataacat

SEQ ID NO: 103737 - DNA, 25 bp, Artificial sequence
  SiRNA target sequence
ctttttataaatatctaataacatt

SEQ ID NO: 103738 - DNA, 25 bp, Artificial sequence
  SiRNA target sequence
tttttataaatatctaataacattt

SEQ ID NO: 103739 - DNA, 25 bp, Artificial sequence
  SiRNA target sequence
ttttataaatatctaataacatttt

SEQ ID NO: 103740 - DNA, 25 bp, Artificial sequence
  SiRNA target sequence
tttataaatatctaataacattttt

SEQ ID NO: 103741 - DNA, 25 bp, Artificial sequence
  SiRNA target sequence
ttataaatatctaataacatttttt

SEQ ID NO: 103742 - DNA, 25 bp, Artificial sequence
  SiRNA target sequence
tataaatatctaataacattttttc

SEQ ID NO: 103743 - DNA, 25 bp, Artificial sequence
  SiRNA target sequence
ataaatatctaataacattttttca

SEQ ID NO: 103744 - DNA, 25 bp, Artificial sequence
  SiRNA target sequence
taaatatctaataacattttttcaa

SEQ ID NO: 103745 - DNA, 25 bp, Artificial sequence
  SiRNA target sequence
aaatatctaataacattttttcaat

SEQ ID NO: 103746 - DNA, 25 bp, Artificial sequence
  SiRNA target sequence
aatatctaataacattttttcaata

SEQ ID NO: 103747 - DNA, 25 bp, Artificial sequence
  SiRNA target sequence
atatctaataacattttttcaataa

SEQ ID NO: 103748 - DNA, 25 bp, Artificial sequence
  SiRNA target sequence
tatctaataacattttttcaataat

SEQ ID NO: 103749 - DNA, 25 bp, Artificial sequence
  SiRNA target sequence
atctaataacattttttcaataata

SEQ ID NO: 103750 - DNA, 25 bp, Artificial sequence
  SiRNA target sequence
tctaataacattttttcaataatat

SEQ ID NO: 103751 - DNA, 25 bp, Artificial sequence
  SiRNA target sequence
ctaataacattttttcaataatatt

SEQ ID NO: 103752 - DNA, 25 bp, Artificial sequence
  SiRNA target sequence
taataacattttttcaataatatta

SEQ ID NO: 103753 - DNA, 25 bp, Artificial sequence
  SiRNA target sequence
aataacattttttcaataatattat

SEQ ID NO: 103754 - DNA, 25 bp, Artificial sequence
  SiRNA target sequence
ataacattttttcaataatattatt

SEQ ID NO: 103755 - DNA, 25 bp, Artificial sequence
  SiRNA target sequence
taacattttttcaataatattatta

SEQ ID NO: 103756 - DNA, 25 bp, Artificial sequence
  SiRNA target sequence
aacattttttcaataatattattaa

SEQ ID NO: 103757 - DNA, 25 bp, Artificial sequence
  SiRNA target sequence
acattttttcaataatattattaag

SEQ ID NO: 103758 - DNA, 25 bp, Artificial sequence
  SiRNA target sequence
cattttttcaataatattattaagt

SEQ ID NO: 103759 - DNA, 25 bp, Artificial sequence
  SiRNA target sequence
attttttcaataatattattaagtc

SEQ ID NO: 103760 - DNA, 25 bp, Artificial sequence
  SiRNA target sequence
ttttttcaataatattattaagtct

SEQ ID NO: 103761 - DNA, 25 bp, Artificial sequence
  SiRNA target sequence
tttttcaataatattattaagtcta

SEQ ID NO: 103762 - DNA, 25 bp, Artificial sequence
  SiRNA target sequence
ttttcaataatattattaagtctag

SEQ ID NO: 103763 - DNA, 25 bp, Artificial sequence
  SiRNA target sequence
tttcaataatattattaagtctaga

SEQ ID NO: 103764 - DNA, 25 bp, Artificial sequence
  SiRNA target sequence
ttcaataatattattaagtctagaa

SEQ ID NO: 103765 - DNA, 25 bp, Artificial sequence
  SiRNA target sequence
tcaataatattattaagtctagaat

SEQ ID NO: 103766 - DNA, 25 bp, Artificial sequence
  SiRNA target sequence
caataatattattaagtctagaatt

SEQ ID NO: 103767 - DNA, 25 bp, Artificial sequence
  SiRNA target sequence
aataatattattaagtctagaattt

SEQ ID NO: 103768 - DNA, 25 bp, Artificial sequence
  SiRNA target sequence
ataatattattaagtctagaatttc

SEQ ID NO: 103769 - DNA, 25 bp, Artificial sequence
  SiRNA target sequence
taatattattaagtctagaatttcc

SEQ ID NO: 103770 - DNA, 25 bp, Artificial sequence
  SiRNA target sequence
aatattattaagtctagaatttcca

SEQ ID NO: 103771 - DNA, 25 bp, Artificial sequence
  SiRNA target sequence
atattattaagtctagaatttccac

SEQ ID NO: 103772 - DNA, 25 bp, Artificial sequence
  SiRNA target sequence
tattattaagtctagaatttccact

SEQ ID NO: 103773 - DNA, 25 bp, Artificial sequence
  SiRNA target sequence
attattaagtctagaatttccactt

SEQ ID NO: 103774 - DNA, 25 bp, Artificial sequence
  SiRNA target sequence
ttattaagtctagaatttccactta

SEQ ID NO: 103775 - DNA, 25 bp, Artificial sequence
  SiRNA target sequence
tattaagtctagaatttccacttac

SEQ ID NO: 103776 - DNA, 25 bp, Artificial sequence
  SiRNA target sequence
attaagtctagaatttccacttaca

SEQ ID NO: 103777 - DNA, 25 bp, Artificial sequence
  SiRNA target sequence
ttaagtctagaatttccacttacaa

SEQ ID NO: 103778 - DNA, 25 bp, Artificial sequence
  SiRNA target sequence
taagtctagaatttccacttacaaa

SEQ ID NO: 103779 - DNA, 25 bp, Artificial sequence
  SiRNA target sequence
aagtctagaatttccacttacaaat

SEQ ID NO: 103780 - DNA, 25 bp, Artificial sequence
  SiRNA target sequence
agtctagaatttccacttacaaata

SEQ ID NO: 103781 - DNA, 25 bp, Artificial sequence
  SiRNA target sequence
gtctagaatttccacttacaaatat

SEQ ID NO: 103782 - DNA, 25 bp, Artificial sequence
  SiRNA target sequence
tctagaatttccacttacaaatatt

SEQ ID NO: 103783 - DNA, 25 bp, Artificial sequence
  SiRNA target sequence
ctagaatttccacttacaaatatta

SEQ ID NO: 103784 - DNA, 25 bp, Artificial sequence
  SiRNA target sequence
tagaatttccacttacaaatattaa

SEQ ID NO: 103785 - DNA, 25 bp, Artificial sequence
  SiRNA target sequence
agaatttccacttacaaatattaac

SEQ ID NO: 103786 - DNA, 25 bp, Artificial sequence
  SiRNA target sequence
gaatttccacttacaaatattaacc

SEQ ID NO: 103787 - DNA, 25 bp, Artificial sequence
  SiRNA target sequence
aatttccacttacaaatattaacca

SEQ ID NO: 103788 - DNA, 25 bp, Artificial sequence
  SiRNA target sequence
atttccacttacaaatattaaccaa

SEQ ID NO: 103789 - DNA, 25 bp, Artificial sequence
  SiRNA target sequence
tttccacttacaaatattaaccaat

SEQ ID NO: 103790 - DNA, 25 bp, Artificial sequence
  SiRNA target sequence
ttccacttacaaatattaaccaatc

SEQ ID NO: 103791 - DNA, 25 bp, Artificial sequence
  SiRNA target sequence
tccacttacaaatattaaccaatca

SEQ ID NO: 103792 - DNA, 25 bp, Artificial sequence
  SiRNA target sequence
ccacttacaaatattaaccaatcat

SEQ ID NO: 103793 - DNA, 25 bp, Artificial sequence
  SiRNA target sequence
cacttacaaatattaaccaatcatc

SEQ ID NO: 103794 - DNA, 25 bp, Artificial sequence
  SiRNA target sequence
acttacaaatattaaccaatcatca

SEQ ID NO: 103795 - DNA, 25 bp, Artificial sequence
  SiRNA target sequence
cttacaaatattaaccaatcatcaa

SEQ ID NO: 103796 - DNA, 25 bp, Artificial sequence
  SiRNA target sequence
ttacaaatattaaccaatcatcaat

SEQ ID NO: 103797 - DNA, 25 bp, Artificial sequence
  SiRNA target sequence
tacaaatattaaccaatcatcaata

SEQ ID NO: 103798 - DNA, 25 bp, Artificial sequence
  SiRNA target sequence
acaaatattaaccaatcatcaatat

SEQ ID NO: 103799 - DNA, 25 bp, Artificial sequence
  SiRNA target sequence
caaatattaaccaatcatcaatatt

SEQ ID NO: 103800 - DNA, 25 bp, Artificial sequence
  SiRNA target sequence
aaatattaaccaatcatcaatattt

SEQ ID NO: 103801 - DNA, 25 bp, Artificial sequence
  SiRNA target sequence
aatattaaccaatcatcaatatttt

SEQ ID NO: 103802 - DNA, 25 bp, Artificial sequence
  SiRNA target sequence
atattaaccaatcatcaatattttc

SEQ ID NO: 103803 - DNA, 25 bp, Artificial sequence
  SiRNA target sequence
tattaaccaatcatcaatattttct

SEQ ID NO: 103804 - DNA, 25 bp, Artificial sequence
  SiRNA target sequence
attaaccaatcatcaatattttcta

SEQ ID NO: 103805 - DNA, 25 bp, Artificial sequence
  SiRNA target sequence
ttaaccaatcatcaatattttctag

SEQ ID NO: 103806 - DNA, 25 bp, Artificial sequence
  SiRNA target sequence
taaccaatcatcaatattttctagc

SEQ ID NO: 103807 - DNA, 25 bp, Artificial sequence
  SiRNA target sequence
aaccaatcatcaatattttctagcc

SEQ ID NO: 103808 - DNA, 25 bp, Artificial sequence
  SiRNA target sequence
accaatcatcaatattttctagccc

SEQ ID NO: 103809 - DNA, 25 bp, Artificial sequence
  SiRNA target sequence
ccaatcatcaatattttctagccct

SEQ ID NO: 103810 - DNA, 25 bp, Artificial sequence
  SiRNA target sequence
caatcatcaatattttctagccctt

SEQ ID NO: 103811 - DNA, 25 bp, Artificial sequence
  SiRNA target sequence
aatcatcaatattttctagcccttt

SEQ ID NO: 103812 - DNA, 25 bp, Artificial sequence
  SiRNA target sequence
atcatcaatattttctagccctttt

SEQ ID NO: 103813 - DNA, 25 bp, Artificial sequence
  SiRNA target sequence
tcatcaatattttctagccctttta

SEQ ID NO: 103814 - DNA, 25 bp, Artificial sequence
  SiRNA target sequence
catcaatattttctagcccttttat

SEQ ID NO: 103815 - DNA, 25 bp, Artificial sequence
  SiRNA target sequence
atcaatattttctagcccttttata

SEQ ID NO: 103816 - DNA, 25 bp, Artificial sequence
  SiRNA target sequence
tcaatattttctagcccttttatag

SEQ ID NO: 103817 - DNA, 25 bp, Artificial sequence
  SiRNA target sequence
caatattttctagcccttttatagt

SEQ ID NO: 103818 - DNA, 25 bp, Artificial sequence
  SiRNA target sequence
aatattttctagcccttttatagtc

SEQ ID NO: 103819 - DNA, 25 bp, Artificial sequence
  SiRNA target sequence
atattttctagcccttttatagtct

SEQ ID NO: 103820 - DNA, 25 bp, Artificial sequence
  SiRNA target sequence
tattttctagcccttttatagtctt

SEQ ID NO: 103821 - DNA, 25 bp, Artificial sequence
  SiRNA target sequence
attttctagcccttttatagtctta

SEQ ID NO: 103822 - DNA, 25 bp, Artificial sequence
  SiRNA target sequence
ttttctagcccttttatagtcttat

SEQ ID NO: 103823 - DNA, 25 bp, Artificial sequence
  SiRNA target sequence
tttctagcccttttatagtcttata

SEQ ID NO: 103824 - DNA, 25 bp, Artificial sequence
  SiRNA target sequence
ttctagcccttttatagtcttataa

SEQ ID NO: 103825 - DNA, 25 bp, Artificial sequence
  SiRNA target sequence
tctagcccttttatagtcttataaa

SEQ ID NO: 103826 - DNA, 25 bp, Artificial sequence
  SiRNA target sequence
ctagcccttttatagtcttataaat

SEQ ID NO: 103827 - DNA, 25 bp, Artificial sequence
  SiRNA target sequence
tagcccttttatagtcttataaata

SEQ ID NO: 103828 - DNA, 25 bp, Artificial sequence
  SiRNA target sequence
agcccttttatagtcttataaatat

SEQ ID NO: 103829 - DNA, 25 bp, Artificial sequence
  SiRNA target sequence
gcccttttatagtcttataaatatc

SEQ ID NO: 103830 - DNA, 25 bp, Artificial sequence
  SiRNA target sequence
cccttttatagtcttataaatatct

SEQ ID NO: 103831 - DNA, 25 bp, Artificial sequence
  SiRNA target sequence
ccttttatagtcttataaatatctt

SEQ ID NO: 103832 - DNA, 25 bp, Artificial sequence
  SiRNA target sequence
cttttatagtcttataaatatcttg

SEQ ID NO: 103833 - DNA, 25 bp, Artificial sequence
  SiRNA target sequence
ttttatagtcttataaatatcttgt

SEQ ID NO: 103834 - DNA, 25 bp, Artificial sequence
  SiRNA target sequence
tttatagtcttataaatatcttgta

SEQ ID NO: 103835 - DNA, 25 bp, Artificial sequence
  SiRNA target sequence
ttatagtcttataaatatcttgtat

SEQ ID NO: 103836 - DNA, 25 bp, Artificial sequence
  SiRNA target sequence
tatagtcttataaatatcttgtatg

SEQ ID NO: 103837 - DNA, 25 bp, Artificial sequence
  SiRNA target sequence
atagtcttataaatatcttgtatgt

SEQ ID NO: 103838 - DNA, 25 bp, Artificial sequence
  SiRNA target sequence
tagtcttataaatatcttgtatgta

SEQ ID NO: 103839 - DNA, 25 bp, Artificial sequence
  SiRNA target sequence
agtcttataaatatcttgtatgtat

SEQ ID NO: 103840 - DNA, 25 bp, Artificial sequence
  SiRNA target sequence
gtcttataaatatcttgtatgtatt

SEQ ID NO: 103841 - DNA, 25 bp, Artificial sequence
  SiRNA target sequence
tcttataaatatcttgtatgtattt

SEQ ID NO: 103842 - DNA, 25 bp, Artificial sequence
  SiRNA target sequence
cttataaatatcttgtatgtattta

SEQ ID NO: 103843 - DNA, 25 bp, Artificial sequence
  SiRNA target sequence
ttataaatatcttgtatgtatttat

SEQ ID NO: 103844 - DNA, 25 bp, Artificial sequence
  SiRNA target sequence
tataaatatcttgtatgtatttatt

SEQ ID NO: 103845 - DNA, 25 bp, Artificial sequence
  SiRNA target sequence
ataaatatcttgtatgtatttatta

SEQ ID NO: 103846 - DNA, 25 bp, Artificial sequence
  SiRNA target sequence
taaatatcttgtatgtatttattat

SEQ ID NO: 103847 - DNA, 25 bp, Artificial sequence
  SiRNA target sequence
aaatatcttgtatgtatttattatc

SEQ ID NO: 103848 - DNA, 25 bp, Artificial sequence
  SiRNA target sequence
aatatcttgtatgtatttattatct

SEQ ID NO: 103849 - DNA, 25 bp, Artificial sequence
  SiRNA target sequence
atatcttgtatgtatttattatctt

SEQ ID NO: 103850 - DNA, 25 bp, Artificial sequence
  SiRNA target sequence
tatcttgtatgtatttattatcttc

SEQ ID NO: 103851 - DNA, 25 bp, Artificial sequence
  SiRNA target sequence
atcttgtatgtatttattatcttcc

SEQ ID NO: 103852 - DNA, 25 bp, Artificial sequence
  SiRNA target sequence
tcttgtatgtatttattatcttccc

SEQ ID NO: 103853 - DNA, 25 bp, Artificial sequence
  SiRNA target sequence
cttgtatgtatttattatcttccct

SEQ ID NO: 103854 - DNA, 25 bp, Artificial sequence
  SiRNA target sequence
ttgtatgtatttattatcttccctt

SEQ ID NO: 103855 - DNA, 25 bp, Artificial sequence
  SiRNA target sequence
tgtatgtatttattatcttcccttg

SEQ ID NO: 103856 - DNA, 25 bp, Artificial sequence
  SiRNA target sequence
gtatgtatttattatcttcccttga

SEQ ID NO: 103857 - DNA, 25 bp, Artificial sequence
  SiRNA target sequence
tatgtatttattatcttcccttgaa

SEQ ID NO: 103858 - DNA, 25 bp, Artificial sequence
  SiRNA target sequence
atgtatttattatcttcccttgaaa

SEQ ID NO: 103859 - DNA, 25 bp, Artificial sequence
  SiRNA target sequence
tgtatttattatcttcccttgaaac

SEQ ID NO: 103860 - DNA, 25 bp, Artificial sequence
  SiRNA target sequence
gtatttattatcttcccttgaaaca

SEQ ID NO: 103861 - DNA, 25 bp, Artificial sequence
  SiRNA target sequence
tatttattatcttcccttgaaacag

SEQ ID NO: 103862 - DNA, 25 bp, Artificial sequence
  SiRNA target sequence
atttattatcttcccttgaaacagc

SEQ ID NO: 103863 - DNA, 25 bp, Artificial sequence
  SiRNA target sequence
tttattatcttcccttgaaacagcg

SEQ ID NO: 103864 - DNA, 25 bp, Artificial sequence
  SiRNA target sequence
ttattatcttcccttgaaacagcgg

SEQ ID NO: 103865 - DNA, 25 bp, Artificial sequence
  SiRNA target sequence
tattatcttcccttgaaacagcggg

SEQ ID NO: 103866 - DNA, 25 bp, Artificial sequence
  SiRNA target sequence
attatcttcccttgaaacagcgggg

SEQ ID NO: 103867 - DNA, 25 bp, Artificial sequence
  SiRNA target sequence
ttatcttcccttgaaacagcggggt

SEQ ID NO: 103868 - DNA, 25 bp, Artificial sequence
  SiRNA target sequence
tatcttcccttgaaacagcggggta

SEQ ID NO: 103869 - DNA, 25 bp, Artificial sequence
  SiRNA target sequence
atcttcccttgaaacagcggggtaa

SEQ ID NO: 103870 - DNA, 25 bp, Artificial sequence
  SiRNA target sequence
tcttcccttgaaacagcggggtaaa

SEQ ID NO: 103871 - DNA, 25 bp, Artificial sequence
  SiRNA target sequence
cttcccttgaaacagcggggtaaat

SEQ ID NO: 103872 - DNA, 25 bp, Artificial sequence
  SiRNA target sequence
ttcccttgaaacagcggggtaaatt

SEQ ID NO: 103873 - DNA, 25 bp, Artificial sequence
  SiRNA target sequence
tcccttgaaacagcggggtaaattt

SEQ ID NO: 103874 - DNA, 25 bp, Artificial sequence
  SiRNA target sequence
cccttgaaacagcggggtaaatttc

SEQ ID NO: 103875 - DNA, 25 bp, Artificial sequence
  SiRNA target sequence
ccttgaaacagcggggtaaatttca

SEQ ID NO: 103876 - DNA, 25 bp, Artificial sequence
  SiRNA target sequence
cttgaaacagcggggtaaatttcaa

SEQ ID NO: 103877 - DNA, 25 bp, Artificial sequence
  SiRNA target sequence
ttgaaacagcggggtaaatttcaat

SEQ ID NO: 103878 - DNA, 25 bp, Artificial sequence
  SiRNA target sequence
tgaaacagcggggtaaatttcaatg

SEQ ID NO: 103879 - DNA, 25 bp, Artificial sequence
  SiRNA target sequence
gaaacagcggggtaaatttcaatgc

SEQ ID NO: 103880 - DNA, 25 bp, Artificial sequence
  SiRNA target sequence
aaacagcggggtaaatttcaatgcc

SEQ ID NO: 103881 - DNA, 25 bp, Artificial sequence
  SiRNA target sequence
aacagcggggtaaatttcaatgcct

SEQ ID NO: 103882 - DNA, 25 bp, Artificial sequence
  SiRNA target sequence
acagcggggtaaatttcaatgcctt

SEQ ID NO: 103883 - DNA, 25 bp, Artificial sequence
  SiRNA target sequence
cagcggggtaaatttcaatgccttt

SEQ ID NO: 103884 - DNA, 25 bp, Artificial sequence
  SiRNA target sequence
agcggggtaaatttcaatgccttta

SEQ ID NO: 103885 - DNA, 25 bp, Artificial sequence
  SiRNA target sequence
gcggggtaaatttcaatgcctttat

SEQ ID NO: 103886 - DNA, 25 bp, Artificial sequence
  SiRNA target sequence
cggggtaaatttcaatgcctttatt

SEQ ID NO: 103887 - DNA, 25 bp, Artificial sequence
  SiRNA target sequence
ggggtaaatttcaatgcctttattt

SEQ ID NO: 103888 - DNA, 25 bp, Artificial sequence
  SiRNA target sequence
gggtaaatttcaatgcctttatttt

SEQ ID NO: 103889 - DNA, 25 bp, Artificial sequence
  SiRNA target sequence
ggtaaatttcaatgcctttattttc

SEQ ID NO: 103890 - DNA, 25 bp, Artificial sequence
  SiRNA target sequence
gtaaatttcaatgcctttattttca

SEQ ID NO: 103891 - DNA, 25 bp, Artificial sequence
  SiRNA target sequence
taaatttcaatgcctttattttcaa

SEQ ID NO: 103892 - DNA, 25 bp, Artificial sequence
  SiRNA target sequence
aaatttcaatgcctttattttcaaa

SEQ ID NO: 103893 - DNA, 25 bp, Artificial sequence
  SiRNA target sequence
aatttcaatgcctttattttcaaac

SEQ ID NO: 103894 - DNA, 25 bp, Artificial sequence
  SiRNA target sequence
atttcaatgcctttattttcaaact

SEQ ID NO: 103895 - DNA, 25 bp, Artificial sequence
  SiRNA target sequence
tttcaatgcctttattttcaaactc

SEQ ID NO: 103896 - DNA, 25 bp, Artificial sequence
  SiRNA target sequence
ttcaatgcctttattttcaaactct

SEQ ID NO: 103897 - DNA, 25 bp, Artificial sequence
  SiRNA target sequence
tcaatgcctttattttcaaactctt

SEQ ID NO: 103898 - DNA, 25 bp, Artificial sequence
  SiRNA target sequence
caatgcctttattttcaaactcttc

SEQ ID NO: 103899 - DNA, 25 bp, Artificial sequence
  SiRNA target sequence
aatgcctttattttcaaactcttct

SEQ ID NO: 103900 - DNA, 25 bp, Artificial sequence
  SiRNA target sequence
atgcctttattttcaaactcttctt

SEQ ID NO: 103901 - DNA, 25 bp, Artificial sequence
  SiRNA target sequence
tgcctttattttcaaactcttcttt

SEQ ID NO: 103902 - DNA, 25 bp, Artificial sequence
  SiRNA target sequence
gcctttattttcaaactcttcttta

SEQ ID NO: 103903 - DNA, 25 bp, Artificial sequence
  SiRNA target sequence
cctttattttcaaactcttctttat

SEQ ID NO: 103904 - DNA, 25 bp, Artificial sequence
  SiRNA target sequence
ctttattttcaaactcttctttata

SEQ ID NO: 103905 - DNA, 25 bp, Artificial sequence
  SiRNA target sequence
tttattttcaaactcttctttatat

SEQ ID NO: 103906 - DNA, 25 bp, Artificial sequence
  SiRNA target sequence
ttattttcaaactcttctttatata

SEQ ID NO: 103907 - DNA, 25 bp, Artificial sequence
  SiRNA target sequence
tattttcaaactcttctttatataa

SEQ ID NO: 103908 - DNA, 25 bp, Artificial sequence
  SiRNA target sequence
attttcaaactcttctttatataaa

SEQ ID NO: 103909 - DNA, 25 bp, Artificial sequence
  SiRNA target sequence
ttttcaaactcttctttatataaaa

SEQ ID NO: 103910 - DNA, 25 bp, Artificial sequence
  SiRNA target sequence
tttcaaactcttctttatataaaaa

SEQ ID NO: 103911 - DNA, 25 bp, Artificial sequence
  SiRNA target sequence
ttcaaactcttctttatataaaaaa

SEQ ID NO: 103912 - DNA, 25 bp, Artificial sequence
  SiRNA target sequence
tcaaactcttctttatataaaaaat

SEQ ID NO: 103913 - DNA, 25 bp, Artificial sequence
  SiRNA target sequence
caaactcttctttatataaaaaatc

SEQ ID NO: 103914 - DNA, 25 bp, Artificial sequence
  SiRNA target sequence
aaactcttctttatataaaaaatct

SEQ ID NO: 103915 - DNA, 25 bp, Artificial sequence
  SiRNA target sequence
aactcttctttatataaaaaatcta

SEQ ID NO: 103916 - DNA, 25 bp, Artificial sequence
  SiRNA target sequence
actcttctttatataaaaaatctac

SEQ ID NO: 103917 - DNA, 25 bp, Artificial sequence
  SiRNA target sequence
ctcttctttatataaaaaatctaca

SEQ ID NO: 103918 - DNA, 25 bp, Artificial sequence
  SiRNA target sequence
tcttctttatataaaaaatctacat

SEQ ID NO: 103919 - DNA, 25 bp, Artificial sequence
  SiRNA target sequence
cttctttatataaaaaatctacatc

SEQ ID NO: 103920 - DNA, 25 bp, Artificial sequence
  SiRNA target sequence
ttctttatataaaaaatctacatct

SEQ ID NO: 103921 - DNA, 25 bp, Artificial sequence
  SiRNA target sequence
tctttatataaaaaatctacatctc

SEQ ID NO: 103922 - DNA, 25 bp, Artificial sequence
  SiRNA target sequence
ctttatataaaaaatctacatctct

SEQ ID NO: 103923 - DNA, 25 bp, Artificial sequence
  SiRNA target sequence
tttatataaaaaatctacatctcta

SEQ ID NO: 103924 - DNA, 25 bp, Artificial sequence
  SiRNA target sequence
ttatataaaaaatctacatctctaa

SEQ ID NO: 103925 - DNA, 25 bp, Artificial sequence
  SiRNA target sequence
tatataaaaaatctacatctctaaa

SEQ ID NO: 103926 - DNA, 25 bp, Artificial sequence
  SiRNA target sequence
atataaaaaatctacatctctaaat

SEQ ID NO: 103927 - DNA, 25 bp, Artificial sequence
  SiRNA target sequence
tataaaaaatctacatctctaaatc

SEQ ID NO: 103928 - DNA, 25 bp, Artificial sequence
  SiRNA target sequence
ataaaaaatctacatctctaaatct

SEQ ID NO: 103929 - DNA, 25 bp, Artificial sequence
  SiRNA target sequence
taaaaaatctacatctctaaatcta

SEQ ID NO: 103930 - DNA, 25 bp, Artificial sequence
  SiRNA target sequence
aaaaaatctacatctctaaatctaa

SEQ ID NO: 103931 - DNA, 25 bp, Artificial sequence
  SiRNA target sequence
aaaaatctacatctctaaatctaaa

SEQ ID NO: 103932 - DNA, 25 bp, Artificial sequence
  SiRNA target sequence
aaaatctacatctctaaatctaaaa

SEQ ID NO: 103933 - DNA, 25 bp, Artificial sequence
  SiRNA target sequence
aaatctacatctctaaatctaaaac

SEQ ID NO: 103934 - DNA, 25 bp, Artificial sequence
  SiRNA target sequence
aatctacatctctaaatctaaaacc

SEQ ID NO: 103935 - DNA, 25 bp, Artificial sequence
  SiRNA target sequence
atctacatctctaaatctaaaacca

SEQ ID NO: 103936 - DNA, 25 bp, Artificial sequence
  SiRNA target sequence
tctacatctctaaatctaaaaccat

SEQ ID NO: 103937 - DNA, 25 bp, Artificial sequence
  SiRNA target sequence
ctacatctctaaatctaaaaccata

SEQ ID NO: 103938 - DNA, 25 bp, Artificial sequence
  SiRNA target sequence
tacatctctaaatctaaaaccatat

SEQ ID NO: 103939 - DNA, 25 bp, Artificial sequence
  SiRNA target sequence
acatctctaaatctaaaaccatata

SEQ ID NO: 103940 - DNA, 25 bp, Artificial sequence
  SiRNA target sequence
catctctaaatctaaaaccatataa

SEQ ID NO: 103941 - DNA, 25 bp, Artificial sequence
  SiRNA target sequence
atctctaaatctaaaaccatataat

SEQ ID NO: 103942 - DNA, 25 bp, Artificial sequence
  SiRNA target sequence
tctctaaatctaaaaccatataata

SEQ ID NO: 103943 - DNA, 25 bp, Artificial sequence
  SiRNA target sequence
ctctaaatctaaaaccatataataa

SEQ ID NO: 103944 - DNA, 25 bp, Artificial sequence
  SiRNA target sequence
tctaaatctaaaaccatataataaa

SEQ ID NO: 103945 - DNA, 25 bp, Artificial sequence
  SiRNA target sequence
ctaaatctaaaaccatataataaaa

SEQ ID NO: 103946 - DNA, 25 bp, Artificial sequence
  SiRNA target sequence
taaatctaaaaccatataataaaat

SEQ ID NO: 103947 - DNA, 25 bp, Artificial sequence
  SiRNA target sequence
aaatctaaaaccatataataaaata

SEQ ID NO: 103948 - DNA, 25 bp, Artificial sequence
  SiRNA target sequence
aatctaaaaccatataataaaataa

SEQ ID NO: 103949 - DNA, 25 bp, Artificial sequence
  SiRNA target sequence
atctaaaaccatataataaaataac

SEQ ID NO: 103950 - DNA, 25 bp, Artificial sequence
  SiRNA target sequence
tctaaaaccatataataaaataact

SEQ ID NO: 103951 - DNA, 25 bp, Artificial sequence
  SiRNA target sequence
ctaaaaccatataataaaataactt

SEQ ID NO: 103952 - DNA, 25 bp, Artificial sequence
  SiRNA target sequence
taaaaccatataataaaataacttt

SEQ ID NO: 103953 - DNA, 25 bp, Artificial sequence
  SiRNA target sequence
aaaaccatataataaaataactttt

SEQ ID NO: 103954 - DNA, 25 bp, Artificial sequence
  SiRNA target sequence
aaaccatataataaaataacttttt

SEQ ID NO: 103955 - DNA, 25 bp, Artificial sequence
  SiRNA target sequence
aaccatataataaaataactttttt

SEQ ID NO: 103956 - DNA, 25 bp, Artificial sequence
  SiRNA target sequence
accatataataaaataactttttta

SEQ ID NO: 103957 - DNA, 25 bp, Artificial sequence
  SiRNA target sequence
ccatataataaaataacttttttaa

SEQ ID NO: 103958 - DNA, 25 bp, Artificial sequence
  SiRNA target sequence
catataataaaataacttttttaaa

SEQ ID NO: 103959 - DNA, 25 bp, Artificial sequence
  SiRNA target sequence
atataataaaataacttttttaaaa

SEQ ID NO: 103960 - DNA, 25 bp, Artificial sequence
  SiRNA target sequence
tataataaaataacttttttaaaaa

SEQ ID NO: 103961 - DNA, 25 bp, Artificial sequence
  SiRNA target sequence
ataataaaataacttttttaaaaaa

SEQ ID NO: 103962 - DNA, 25 bp, Artificial sequence
  SiRNA target sequence
taataaaataacttttttaaaaaaa

SEQ ID NO: 103963 - DNA, 25 bp, Artificial sequence
  SiRNA target sequence
aataaaataacttttttaaaaaaat

SEQ ID NO: 103964 - DNA, 25 bp, Artificial sequence
  SiRNA target sequence
ataaaataacttttttaaaaaaatt

SEQ ID NO: 103965 - DNA, 25 bp, Artificial sequence
  SiRNA target sequence
taaaataacttttttaaaaaaattt

SEQ ID NO: 103966 - DNA, 25 bp, Artificial sequence
  SiRNA target sequence
aaaataacttttttaaaaaaattta

SEQ ID NO: 103967 - DNA, 25 bp, Artificial sequence
  SiRNA target sequence
aaataacttttttaaaaaaatttaa

SEQ ID NO: 103968 - DNA, 25 bp, Artificial sequence
  SiRNA target sequence
aataacttttttaaaaaaatttaaa

SEQ ID NO: 103969 - DNA, 25 bp, Artificial sequence
  SiRNA target sequence
ataacttttttaaaaaaatttaaat

SEQ ID NO: 103970 - DNA, 25 bp, Artificial sequence
  SiRNA target sequence
taacttttttaaaaaaatttaaatc

SEQ ID NO: 103971 - DNA, 25 bp, Artificial sequence
  SiRNA target sequence
aacttttttaaaaaaatttaaatca

SEQ ID NO: 103972 - DNA, 25 bp, Artificial sequence
  SiRNA target sequence
acttttttaaaaaaatttaaatcag

SEQ ID NO: 103973 - DNA, 25 bp, Artificial sequence
  SiRNA target sequence
cttttttaaaaaaatttaaatcaga

SEQ ID NO: 103974 - DNA, 25 bp, Artificial sequence
  SiRNA target sequence
ttttttaaaaaaatttaaatcagaa

SEQ ID NO: 103975 - DNA, 25 bp, Artificial sequence
  SiRNA target sequence
tttttaaaaaaatttaaatcagaat

SEQ ID NO: 103976 - DNA, 25 bp, Artificial sequence
  SiRNA target sequence
ttttaaaaaaatttaaatcagaata

SEQ ID NO: 103977 - DNA, 25 bp, Artificial sequence
  SiRNA target sequence
tttaaaaaaatttaaatcagaatag

SEQ ID NO: 103978 - DNA, 25 bp, Artificial sequence
  SiRNA target sequence
ttaaaaaaatttaaatcagaatagt

SEQ ID NO: 103979 - DNA, 25 bp, Artificial sequence
  SiRNA target sequence
taaaaaaatttaaatcagaatagta

SEQ ID NO: 103980 - DNA, 25 bp, Artificial sequence
  SiRNA target sequence
aaaaaaatttaaatcagaatagtaa

SEQ ID NO: 103981 - DNA, 25 bp, Artificial sequence
  SiRNA target sequence
aaaaaatttaaatcagaatagtaat

SEQ ID NO: 103982 - DNA, 25 bp, Artificial sequence
  SiRNA target sequence
aaaaatttaaatcagaatagtaatt

SEQ ID NO: 103983 - DNA, 25 bp, Artificial sequence
  SiRNA target sequence
aaaatttaaatcagaatagtaatta

SEQ ID NO: 103984 - DNA, 25 bp, Artificial sequence
  SiRNA target sequence
aaatttaaatcagaatagtaattaa

SEQ ID NO: 103985 - DNA, 25 bp, Artificial sequence
  SiRNA target sequence
aatttaaatcagaatagtaattaac

SEQ ID NO: 103986 - DNA, 25 bp, Artificial sequence
  SiRNA target sequence
atttaaatcagaatagtaattaaca

SEQ ID NO: 103987 - DNA, 25 bp, Artificial sequence
  SiRNA target sequence
tttaaatcagaatagtaattaacaa

SEQ ID NO: 103988 - DNA, 25 bp, Artificial sequence
  SiRNA target sequence
ttaaatcagaatagtaattaacaaa

SEQ ID NO: 103989 - DNA, 25 bp, Artificial sequence
  SiRNA target sequence
taaatcagaatagtaattaacaaat

SEQ ID NO: 103990 - DNA, 25 bp, Artificial sequence
  SiRNA target sequence
aaatcagaatagtaattaacaaatg

SEQ ID NO: 103991 - DNA, 25 bp, Artificial sequence
  SiRNA target sequence
aatcagaatagtaattaacaaatgc

SEQ ID NO: 103992 - DNA, 25 bp, Artificial sequence
  SiRNA target sequence
atcagaatagtaattaacaaatgcc

SEQ ID NO: 103993 - DNA, 25 bp, Artificial sequence
  SiRNA target sequence
tcagaatagtaattaacaaatgccc

SEQ ID NO: 103994 - DNA, 25 bp, Artificial sequence
  SiRNA target sequence
cagaatagtaattaacaaatgccct

SEQ ID NO: 103995 - DNA, 25 bp, Artificial sequence
  SiRNA target sequence
agaatagtaattaacaaatgccctg

SEQ ID NO: 103996 - DNA, 25 bp, Artificial sequence
  SiRNA target sequence
gaatagtaattaacaaatgccctgg

SEQ ID NO: 103997 - DNA, 25 bp, Artificial sequence
  SiRNA target sequence
aatagtaattaacaaatgccctggg

SEQ ID NO: 103998 - DNA, 25 bp, Artificial sequence
  SiRNA target sequence
atagtaattaacaaatgccctggga

SEQ ID NO: 103999 - DNA, 25 bp, Artificial sequence
  SiRNA target sequence
tagtaattaacaaatgccctgggaa

SEQ ID NO: 104000 - DNA, 25 bp, Artificial sequence
  SiRNA target sequence
agtaattaacaaatgccctgggaag

SEQ ID NO: 104001 - DNA, 25 bp, Artificial sequence
  SiRNA target sequence
gtaattaacaaatgccctgggaagt

SEQ ID NO: 104002 - DNA, 25 bp, Artificial sequence
  SiRNA target sequence
taattaacaaatgccctgggaagtg

SEQ ID NO: 104003 - DNA, 25 bp, Artificial sequence
  SiRNA target sequence
aattaacaaatgccctgggaagtgt

SEQ ID NO: 104004 - DNA, 25 bp, Artificial sequence
  SiRNA target sequence
attaacaaatgccctgggaagtgta

SEQ ID NO: 104005 - DNA, 25 bp, Artificial sequence
  SiRNA target sequence
ttaacaaatgccctgggaagtgtaa

SEQ ID NO: 104006 - DNA, 25 bp, Artificial sequence
  SiRNA target sequence
taacaaatgccctgggaagtgtaat

SEQ ID NO: 104007 - DNA, 25 bp, Artificial sequence
  SiRNA target sequence
aacaaatgccctgggaagtgtaata

SEQ ID NO: 104008 - DNA, 25 bp, Artificial sequence
  SiRNA target sequence
acaaatgccctgggaagtgtaatac

SEQ ID NO: 104009 - DNA, 25 bp, Artificial sequence
  SiRNA target sequence
caaatgccctgggaagtgtaatacc

SEQ ID NO: 104010 - DNA, 25 bp, Artificial sequence
  SiRNA target sequence
aaatgccctgggaagtgtaatacca

SEQ ID NO: 104011 - DNA, 25 bp, Artificial sequence
  SiRNA target sequence
aatgccctgggaagtgtaataccag

SEQ ID NO: 104012 - DNA, 25 bp, Artificial sequence
  SiRNA target sequence
atgccctgggaagtgtaataccagt

SEQ ID NO: 104013 - DNA, 25 bp, Artificial sequence
  SiRNA target sequence
tgccctgggaagtgtaataccagta

SEQ ID NO: 104014 - DNA, 25 bp, Artificial sequence
  SiRNA target sequence
gccctgggaagtgtaataccagtac

SEQ ID NO: 104015 - DNA, 25 bp, Artificial sequence
  SiRNA target sequence
ccctgggaagtgtaataccagtacc

SEQ ID NO: 104016 - DNA, 25 bp, Artificial sequence
  SiRNA target sequence
cctgggaagtgtaataccagtacca

SEQ ID NO: 104017 - DNA, 25 bp, Artificial sequence
  SiRNA target sequence
ctgggaagtgtaataccagtaccag

SEQ ID NO: 104018 - DNA, 25 bp, Artificial sequence
  SiRNA target sequence
tgggaagtgtaataccagtaccagt

SEQ ID NO: 104019 - DNA, 25 bp, Artificial sequence
  SiRNA target sequence
gggaagtgtaataccagtaccagtg

SEQ ID NO: 104020 - DNA, 25 bp, Artificial sequence
  SiRNA target sequence
ggaagtgtaataccagtaccagtgc

SEQ ID NO: 104021 - DNA, 25 bp, Artificial sequence
  SiRNA target sequence
gaagtgtaataccagtaccagtgca

SEQ ID NO: 104022 - DNA, 25 bp, Artificial sequence
  SiRNA target sequence
aagtgtaataccagtaccagtgcac

SEQ ID NO: 104023 - DNA, 25 bp, Artificial sequence
  SiRNA target sequence
agtgtaataccagtaccagtgcaca

SEQ ID NO: 104024 - DNA, 25 bp, Artificial sequence
  SiRNA target sequence
gtgtaataccagtaccagtgcacat

SEQ ID NO: 104025 - DNA, 25 bp, Artificial sequence
  SiRNA target sequence
tgtaataccagtaccagtgcacata

SEQ ID NO: 104026 - DNA, 25 bp, Artificial sequence
  SiRNA target sequence
gtaataccagtaccagtgcacataa

SEQ ID NO: 104027 - DNA, 25 bp, Artificial sequence
  SiRNA target sequence
taataccagtaccagtgcacataaa

SEQ ID NO: 104028 - DNA, 25 bp, Artificial sequence
  SiRNA target sequence
aataccagtaccagtgcacataaac

SEQ ID NO: 104029 - DNA, 25 bp, Artificial sequence
  SiRNA target sequence
ataccagtaccagtgcacataaaca

SEQ ID NO: 104030 - DNA, 25 bp, Artificial sequence
  SiRNA target sequence
taccagtaccagtgcacataaacaa

SEQ ID NO: 104031 - DNA, 25 bp, Artificial sequence
  SiRNA target sequence
accagtaccagtgcacataaacaaa

SEQ ID NO: 104032 - DNA, 25 bp, Artificial sequence
  SiRNA target sequence
ccagtaccagtgcacataaacaaaa

SEQ ID NO: 104033 - DNA, 25 bp, Artificial sequence
  SiRNA target sequence
cagtaccagtgcacataaacaaaat

SEQ ID NO: 104034 - DNA, 25 bp, Artificial sequence
  SiRNA target sequence
agtaccagtgcacataaacaaaatc

SEQ ID NO: 104035 - DNA, 25 bp, Artificial sequence
  SiRNA target sequence
gtaccagtgcacataaacaaaatct

SEQ ID NO: 104036 - DNA, 25 bp, Artificial sequence
  SiRNA target sequence
taccagtgcacataaacaaaatctt

SEQ ID NO: 104037 - DNA, 25 bp, Artificial sequence
  SiRNA target sequence
accagtgcacataaacaaaatcttt

SEQ ID NO: 104038 - DNA, 25 bp, Artificial sequence
  SiRNA target sequence
ccagtgcacataaacaaaatctttt

SEQ ID NO: 104039 - DNA, 25 bp, Artificial sequence
  SiRNA target sequence
cagtgcacataaacaaaatcttttt

SEQ ID NO: 104040 - DNA, 25 bp, Artificial sequence
  SiRNA target sequence
agtgcacataaacaaaatcttttta

SEQ ID NO: 104041 - DNA, 25 bp, Artificial sequence
  SiRNA target sequence
gtgcacataaacaaaatctttttac

SEQ ID NO: 104042 - DNA, 25 bp, Artificial sequence
  SiRNA target sequence
tgcacataaacaaaatctttttacc

SEQ ID NO: 104043 - DNA, 25 bp, Artificial sequence
  SiRNA target sequence
gcacataaacaaaatctttttacca

SEQ ID NO: 104044 - DNA, 25 bp, Artificial sequence
  SiRNA target sequence
cacataaacaaaatctttttaccac

SEQ ID NO: 104045 - DNA, 25 bp, Artificial sequence
  SiRNA target sequence
acataaacaaaatctttttaccact

SEQ ID NO: 104046 - DNA, 25 bp, Artificial sequence
  SiRNA target sequence
cataaacaaaatctttttaccacta

SEQ ID NO: 104047 - DNA, 25 bp, Artificial sequence
  SiRNA target sequence
ataaacaaaatctttttaccactaa

SEQ ID NO: 104048 - DNA, 25 bp, Artificial sequence
  SiRNA target sequence
taaacaaaatctttttaccactaaa

SEQ ID NO: 104049 - DNA, 25 bp, Artificial sequence
  SiRNA target sequence
aaacaaaatctttttaccactaaaa

SEQ ID NO: 104050 - DNA, 25 bp, Artificial sequence
  SiRNA target sequence
aacaaaatctttttaccactaaaat

SEQ ID NO: 104051 - DNA, 25 bp, Artificial sequence
  SiRNA target sequence
acaaaatctttttaccactaaaatt

SEQ ID NO: 104052 - DNA, 25 bp, Artificial sequence
  SiRNA target sequence
caaaatctttttaccactaaaatta

SEQ ID NO: 104053 - DNA, 25 bp, Artificial sequence
  SiRNA target sequence
aaaatctttttaccactaaaattaa

SEQ ID NO: 104054 - DNA, 25 bp, Artificial sequence
  SiRNA target sequence
aaatctttttaccactaaaattaag

SEQ ID NO: 104055 - DNA, 25 bp, Artificial sequence
  SiRNA target sequence
aatctttttaccactaaaattaagt

SEQ ID NO: 104056 - DNA, 25 bp, Artificial sequence
  SiRNA target sequence
atctttttaccactaaaattaagtc

SEQ ID NO: 104057 - DNA, 25 bp, Artificial sequence
  SiRNA target sequence
tctttttaccactaaaattaagtct

SEQ ID NO: 104058 - DNA, 25 bp, Artificial sequence
  SiRNA target sequence
ctttttaccactaaaattaagtcta

SEQ ID NO: 104059 - DNA, 25 bp, Artificial sequence
  SiRNA target sequence
tttttaccactaaaattaagtctat

SEQ ID NO: 104060 - DNA, 25 bp, Artificial sequence
  SiRNA target sequence
ttttaccactaaaattaagtctatt

SEQ ID NO: 104061 - DNA, 25 bp, Artificial sequence
  SiRNA target sequence
tttaccactaaaattaagtctattt

SEQ ID NO: 104062 - DNA, 25 bp, Artificial sequence
  SiRNA target sequence
ttaccactaaaattaagtctatttt

SEQ ID NO: 104063 - DNA, 25 bp, Artificial sequence
  SiRNA target sequence
taccactaaaattaagtctattttg

SEQ ID NO: 104064 - DNA, 25 bp, Artificial sequence
  SiRNA target sequence
accactaaaattaagtctattttgt

SEQ ID NO: 104065 - DNA, 25 bp, Artificial sequence
  SiRNA target sequence
ccactaaaattaagtctattttgta

SEQ ID NO: 104066 - DNA, 25 bp, Artificial sequence
  SiRNA target sequence
cactaaaattaagtctattttgtac

SEQ ID NO: 104067 - DNA, 25 bp, Artificial sequence
  SiRNA target sequence
actaaaattaagtctattttgtact

SEQ ID NO: 104068 - DNA, 25 bp, Artificial sequence
  SiRNA target sequence
ctaaaattaagtctattttgtacta

SEQ ID NO: 104069 - DNA, 25 bp, Artificial sequence
  SiRNA target sequence
taaaattaagtctattttgtactat

SEQ ID NO: 104070 - DNA, 25 bp, Artificial sequence
  SiRNA target sequence
aaaattaagtctattttgtactatg

SEQ ID NO: 104071 - DNA, 25 bp, Artificial sequence
  SiRNA target sequence
aaattaagtctattttgtactatgt

SEQ ID NO: 104072 - DNA, 25 bp, Artificial sequence
  SiRNA target sequence
aattaagtctattttgtactatgtt

SEQ ID NO: 104073 - DNA, 25 bp, Artificial sequence
  SiRNA target sequence
attaagtctattttgtactatgtta

SEQ ID NO: 104074 - DNA, 25 bp, Artificial sequence
  SiRNA target sequence
ttaagtctattttgtactatgttaa

SEQ ID NO: 104075 - DNA, 25 bp, Artificial sequence
  SiRNA target sequence
taagtctattttgtactatgttaac

SEQ ID NO: 104076 - DNA, 25 bp, Artificial sequence
  SiRNA target sequence
aagtctattttgtactatgttaaca

SEQ ID NO: 104077 - DNA, 25 bp, Artificial sequence
  SiRNA target sequence
agtctattttgtactatgttaacat

SEQ ID NO: 104078 - DNA, 25 bp, Artificial sequence
  SiRNA target sequence
gtctattttgtactatgttaacatg

SEQ ID NO: 104079 - DNA, 25 bp, Artificial sequence
  SiRNA target sequence
tctattttgtactatgttaacatga

SEQ ID NO: 104080 - DNA, 25 bp, Artificial sequence
  SiRNA target sequence
ctattttgtactatgttaacatgaa

SEQ ID NO: 104081 - DNA, 25 bp, Artificial sequence
  SiRNA target sequence
tattttgtactatgttaacatgaat

SEQ ID NO: 104082 - DNA, 25 bp, Artificial sequence
  SiRNA target sequence
attttgtactatgttaacatgaata

SEQ ID NO: 104083 - DNA, 25 bp, Artificial sequence
  SiRNA target sequence
ttttgtactatgttaacatgaatag

SEQ ID NO: 104084 - DNA, 25 bp, Artificial sequence
  SiRNA target sequence
tttgtactatgttaacatgaatagt

SEQ ID NO: 104085 - DNA, 25 bp, Artificial sequence
  SiRNA target sequence
ttgtactatgttaacatgaatagta

SEQ ID NO: 104086 - DNA, 25 bp, Artificial sequence
  SiRNA target sequence
tgtactatgttaacatgaatagtag

SEQ ID NO: 104087 - DNA, 25 bp, Artificial sequence
  SiRNA target sequence
gtactatgttaacatgaatagtaga

SEQ ID NO: 104088 - DNA, 25 bp, Artificial sequence
  SiRNA target sequence
tactatgttaacatgaatagtagac

SEQ ID NO: 104089 - DNA, 25 bp, Artificial sequence
  SiRNA target sequence
actatgttaacatgaatagtagacc

SEQ ID NO: 104090 - DNA, 25 bp, Artificial sequence
  SiRNA target sequence
ctatgttaacatgaatagtagaccc

SEQ ID NO: 104091 - DNA, 25 bp, Artificial sequence
  SiRNA target sequence
tatgttaacatgaatagtagaccct

SEQ ID NO: 104092 - DNA, 25 bp, Artificial sequence
  SiRNA target sequence
atgttaacatgaatagtagaccctt

SEQ ID NO: 104093 - DNA, 25 bp, Artificial sequence
  SiRNA target sequence
tgttaacatgaatagtagacccttt

SEQ ID NO: 104094 - DNA, 25 bp, Artificial sequence
  SiRNA target sequence
gttaacatgaatagtagacccttta

SEQ ID NO: 104095 - DNA, 25 bp, Artificial sequence
  SiRNA target sequence
ttaacatgaatagtagaccctttag

SEQ ID NO: 104096 - DNA, 25 bp, Artificial sequence
  SiRNA target sequence
taacatgaatagtagaccctttagt

SEQ ID NO: 104097 - DNA, 25 bp, Artificial sequence
  SiRNA target sequence
aacatgaatagtagaccctttagta

SEQ ID NO: 104098 - DNA, 25 bp, Artificial sequence
  SiRNA target sequence
acatgaatagtagaccctttagtaa

SEQ ID NO: 104099 - DNA, 25 bp, Artificial sequence
  SiRNA target sequence
catgaatagtagaccctttagtaag

SEQ ID NO: 104100 - DNA, 25 bp, Artificial sequence
  SiRNA target sequence
atgaatagtagaccctttagtaagt

SEQ ID NO: 104101 - DNA, 25 bp, Artificial sequence
  SiRNA target sequence
tgaatagtagaccctttagtaagta

SEQ ID NO: 104102 - DNA, 25 bp, Artificial sequence
  SiRNA target sequence
gaatagtagaccctttagtaagtaa

SEQ ID NO: 104103 - DNA, 25 bp, Artificial sequence
  SiRNA target sequence
aatagtagaccctttagtaagtaat

SEQ ID NO: 104104 - DNA, 25 bp, Artificial sequence
  SiRNA target sequence
atagtagaccctttagtaagtaatt

SEQ ID NO: 104105 - DNA, 25 bp, Artificial sequence
  SiRNA target sequence
tagtagaccctttagtaagtaattt

SEQ ID NO: 104106 - DNA, 25 bp, Artificial sequence
  SiRNA target sequence
agtagaccctttagtaagtaatttt

SEQ ID NO: 104107 - DNA, 25 bp, Artificial sequence
  SiRNA target sequence
gtagaccctttagtaagtaatttta

SEQ ID NO: 104108 - DNA, 25 bp, Artificial sequence
  SiRNA target sequence
tagaccctttagtaagtaattttaa

SEQ ID NO: 104109 - DNA, 25 bp, Artificial sequence
  SiRNA target sequence
agaccctttagtaagtaattttaaa

SEQ ID NO: 104110 - DNA, 25 bp, Artificial sequence
  SiRNA target sequence
gaccctttagtaagtaattttaaat

SEQ ID NO: 104111 - DNA, 25 bp, Artificial sequence
  SiRNA target sequence
accctttagtaagtaattttaaata

SEQ ID NO: 104112 - DNA, 25 bp, Artificial sequence
  SiRNA target sequence
ccctttagtaagtaattttaaatac

SEQ ID NO: 104113 - DNA, 25 bp, Artificial sequence
  SiRNA target sequence
cctttagtaagtaattttaaatact

SEQ ID NO: 104114 - DNA, 25 bp, Artificial sequence
  SiRNA target sequence
ctttagtaagtaattttaaatactc

SEQ ID NO: 104115 - DNA, 25 bp, Artificial sequence
  SiRNA target sequence
tttagtaagtaattttaaatactct

SEQ ID NO: 104116 - DNA, 25 bp, Artificial sequence
  SiRNA target sequence
ttagtaagtaattttaaatactctg

SEQ ID NO: 104117 - DNA, 25 bp, Artificial sequence
  SiRNA target sequence
tagtaagtaattttaaatactctga

SEQ ID NO: 104118 - DNA, 25 bp, Artificial sequence
  SiRNA target sequence
agtaagtaattttaaatactctgaa

SEQ ID NO: 104119 - DNA, 25 bp, Artificial sequence
  SiRNA target sequence
gtaagtaattttaaatactctgaac

SEQ ID NO: 104120 - DNA, 25 bp, Artificial sequence
  SiRNA target sequence
taagtaattttaaatactctgaaca

SEQ ID NO: 104121 - DNA, 25 bp, Artificial sequence
  SiRNA target sequence
aagtaattttaaatactctgaacaa

SEQ ID NO: 104122 - DNA, 25 bp, Artificial sequence
  SiRNA target sequence
agtaattttaaatactctgaacaaa

SEQ ID NO: 104123 - DNA, 25 bp, Artificial sequence
  SiRNA target sequence
gtaattttaaatactctgaacaaag

SEQ ID NO: 104124 - DNA, 25 bp, Artificial sequence
  SiRNA target sequence
taattttaaatactctgaacaaaga

SEQ ID NO: 104125 - DNA, 25 bp, Artificial sequence
  SiRNA target sequence
aattttaaatactctgaacaaagac

SEQ ID NO: 104126 - DNA, 25 bp, Artificial sequence
  SiRNA target sequence
attttaaatactctgaacaaagacc

SEQ ID NO: 104127 - DNA, 25 bp, Artificial sequence
  SiRNA target sequence
ttttaaatactctgaacaaagacct

SEQ ID NO: 104128 - DNA, 25 bp, Artificial sequence
  SiRNA target sequence
tttaaatactctgaacaaagacctt

SEQ ID NO: 104129 - DNA, 25 bp, Artificial sequence
  SiRNA target sequence
ttaaatactctgaacaaagaccttt

SEQ ID NO: 104130 - DNA, 25 bp, Artificial sequence
  SiRNA target sequence
taaatactctgaacaaagacctttt

SEQ ID NO: 104131 - DNA, 25 bp, Artificial sequence
  SiRNA target sequence
aaatactctgaacaaagaccttttc

SEQ ID NO: 104132 - DNA, 25 bp, Artificial sequence
  SiRNA target sequence
aatactctgaacaaagaccttttcg

SEQ ID NO: 104133 - DNA, 25 bp, Artificial sequence
  SiRNA target sequence
atactctgaacaaagaccttttcgt

SEQ ID NO: 104134 - DNA, 25 bp, Artificial sequence
  SiRNA target sequence
tactctgaacaaagaccttttcgtt

SEQ ID NO: 104135 - DNA, 25 bp, Artificial sequence
  SiRNA target sequence
actctgaacaaagaccttttcgttc

SEQ ID NO: 104136 - DNA, 25 bp, Artificial sequence
  SiRNA target sequence
ctctgaacaaagaccttttcgttct

SEQ ID NO: 104137 - DNA, 25 bp, Artificial sequence
  SiRNA target sequence
tctgaacaaagaccttttcgttctt

SEQ ID NO: 104138 - DNA, 25 bp, Artificial sequence
  SiRNA target sequence
ctgaacaaagaccttttcgttcttc

SEQ ID NO: 104139 - DNA, 25 bp, Artificial sequence
  SiRNA target sequence
tgaacaaagaccttttcgttcttct

SEQ ID NO: 104140 - DNA, 25 bp, Artificial sequence
  SiRNA target sequence
gaacaaagaccttttcgttcttctt

SEQ ID NO: 104141 - DNA, 25 bp, Artificial sequence
  SiRNA target sequence
aacaaagaccttttcgttcttcttt

SEQ ID NO: 104142 - DNA, 25 bp, Artificial sequence
  SiRNA target sequence
acaaagaccttttcgttcttctttt

SEQ ID NO: 104143 - DNA, 25 bp, Artificial sequence
  SiRNA target sequence
caaagaccttttcgttcttctttta

SEQ ID NO: 104144 - DNA, 25 bp, Artificial sequence
  SiRNA target sequence
aaagaccttttcgttcttcttttaa

SEQ ID NO: 104145 - DNA, 25 bp, Artificial sequence
  SiRNA target sequence
aagaccttttcgttcttcttttaaa

SEQ ID NO: 104146 - DNA, 25 bp, Artificial sequence
  SiRNA target sequence
agaccttttcgttcttcttttaaac

SEQ ID NO: 104147 - DNA, 25 bp, Artificial sequence
  SiRNA target sequence
gaccttttcgttcttcttttaaact

SEQ ID NO: 104148 - DNA, 25 bp, Artificial sequence
  SiRNA target sequence
accttttcgttcttcttttaaactt

SEQ ID NO: 104149 - DNA, 25 bp, Artificial sequence
  SiRNA target sequence
ccttttcgttcttcttttaaacttg

SEQ ID NO: 104150 - DNA, 25 bp, Artificial sequence
  SiRNA target sequence
cttttcgttcttcttttaaacttgt

SEQ ID NO: 104151 - DNA, 25 bp, Artificial sequence
  SiRNA target sequence
ttttcgttcttcttttaaacttgtt

SEQ ID NO: 104152 - DNA, 25 bp, Artificial sequence
  SiRNA target sequence
tttcgttcttcttttaaacttgttt

SEQ ID NO: 104153 - DNA, 25 bp, Artificial sequence
  SiRNA target sequence
ttcgttcttcttttaaacttgtttt

SEQ ID NO: 104154 - DNA, 25 bp, Artificial sequence
  SiRNA target sequence
tcgttcttcttttaaacttgtttta

SEQ ID NO: 104155 - DNA, 25 bp, Artificial sequence
  SiRNA target sequence
cgttcttcttttaaacttgttttaa

SEQ ID NO: 104156 - DNA, 25 bp, Artificial sequence
  SiRNA target sequence
gttcttcttttaaacttgttttaaa

SEQ ID NO: 104157 - DNA, 25 bp, Artificial sequence
  SiRNA target sequence
ttcttcttttaaacttgttttaaaa

SEQ ID NO: 104158 - DNA, 25 bp, Artificial sequence
  SiRNA target sequence
tcttcttttaaacttgttttaaaag

SEQ ID NO: 104159 - DNA, 25 bp, Artificial sequence
  SiRNA target sequence
cttcttttaaacttgttttaaaaga

SEQ ID NO: 104160 - DNA, 25 bp, Artificial sequence
  SiRNA target sequence
ttcttttaaacttgttttaaaagaa

SEQ ID NO: 104161 - DNA, 25 bp, Artificial sequence
  SiRNA target sequence
tcttttaaacttgttttaaaagaaa

SEQ ID NO: 104162 - DNA, 25 bp, Artificial sequence
  SiRNA target sequence
cttttaaacttgttttaaaagaaac

SEQ ID NO: 104163 - DNA, 25 bp, Artificial sequence
  SiRNA target sequence
ttttaaacttgttttaaaagaaaca

SEQ ID NO: 104164 - DNA, 25 bp, Artificial sequence
  SiRNA target sequence
tttaaacttgttttaaaagaaacaa

SEQ ID NO: 104165 - DNA, 25 bp, Artificial sequence
  SiRNA target sequence
ttaaacttgttttaaaagaaacaag

SEQ ID NO: 104166 - DNA, 25 bp, Artificial sequence
  SiRNA target sequence
taaacttgttttaaaagaaacaaga

SEQ ID NO: 104167 - DNA, 25 bp, Artificial sequence
  SiRNA target sequence
aaacttgttttaaaagaaacaagag

SEQ ID NO: 104168 - DNA, 25 bp, Artificial sequence
  SiRNA target sequence
aacttgttttaaaagaaacaagaga

SEQ ID NO: 104169 - DNA, 25 bp, Artificial sequence
  SiRNA target sequence
acttgttttaaaagaaacaagagag

SEQ ID NO: 104170 - DNA, 25 bp, Artificial sequence
  SiRNA target sequence
cttgttttaaaagaaacaagagaga

SEQ ID NO: 104171 - DNA, 25 bp, Artificial sequence
  SiRNA target sequence
ttgttttaaaagaaacaagagagac

SEQ ID NO: 104172 - DNA, 25 bp, Artificial sequence
  SiRNA target sequence
tgttttaaaagaaacaagagagacg

SEQ ID NO: 104173 - DNA, 25 bp, Artificial sequence
  SiRNA target sequence
gttttaaaagaaacaagagagacgg

SEQ ID NO: 104174 - DNA, 25 bp, Artificial sequence
  SiRNA target sequence
ttttaaaagaaacaagagagacggt

SEQ ID NO: 104175 - DNA, 25 bp, Artificial sequence
  SiRNA target sequence
tttaaaagaaacaagagagacggtg

SEQ ID NO: 104176 - DNA, 25 bp, Artificial sequence
  SiRNA target sequence
ttaaaagaaacaagagagacggtga

SEQ ID NO: 104177 - DNA, 25 bp, Artificial sequence
  SiRNA target sequence
taaaagaaacaagagagacggtgac

SEQ ID NO: 104178 - DNA, 25 bp, Artificial sequence
  SiRNA target sequence
aaaagaaacaagagagacggtgaca

SEQ ID NO: 104179 - DNA, 25 bp, Artificial sequence
  SiRNA target sequence
aaagaaacaagagagacggtgacaa

SEQ ID NO: 104180 - DNA, 25 bp, Artificial sequence
  SiRNA target sequence
aagaaacaagagagacggtgacaaa

SEQ ID NO: 104181 - DNA, 25 bp, Artificial sequence
  SiRNA target sequence
agaaacaagagagacggtgacaaag

SEQ ID NO: 104182 - DNA, 25 bp, Artificial sequence
  SiRNA target sequence
gaaacaagagagacggtgacaaagt

SEQ ID NO: 104183 - DNA, 25 bp, Artificial sequence
  SiRNA target sequence
aaacaagagagacggtgacaaagta

SEQ ID NO: 104184 - DNA, 25 bp, Artificial sequence
  SiRNA target sequence
aacaagagagacggtgacaaagtaa

SEQ ID NO: 104185 - DNA, 25 bp, Artificial sequence
  SiRNA target sequence
acaagagagacggtgacaaagtaac

SEQ ID NO: 104186 - DNA, 25 bp, Artificial sequence
  SiRNA target sequence
caagagagacggtgacaaagtaaca

SEQ ID NO: 104187 - DNA, 25 bp, Artificial sequence
  SiRNA target sequence
aagagagacggtgacaaagtaacaa

SEQ ID NO: 104188 - DNA, 25 bp, Artificial sequence
  SiRNA target sequence
agagagacggtgacaaagtaacaaa

SEQ ID NO: 104189 - DNA, 25 bp, Artificial sequence
  SiRNA target sequence
gagagacggtgacaaagtaacaaaa

SEQ ID NO: 104190 - DNA, 25 bp, Artificial sequence
  SiRNA target sequence
agagacggtgacaaagtaacaaaaa

SEQ ID NO: 104191 - DNA, 25 bp, Artificial sequence
  SiRNA target sequence
gagacggtgacaaagtaacaaaaat

SEQ ID NO: 104192 - DNA, 25 bp, Artificial sequence
  SiRNA target sequence
agacggtgacaaagtaacaaaaatc

SEQ ID NO: 104193 - DNA, 25 bp, Artificial sequence
  SiRNA target sequence
gacggtgacaaagtaacaaaaatct

SEQ ID NO: 104194 - DNA, 25 bp, Artificial sequence
  SiRNA target sequence
acggtgacaaagtaacaaaaatctt

SEQ ID NO: 104195 - DNA, 25 bp, Artificial sequence
  SiRNA target sequence
cggtgacaaagtaacaaaaatcttt

SEQ ID NO: 104196 - DNA, 25 bp, Artificial sequence
  SiRNA target sequence
ggtgacaaagtaacaaaaatctttt

SEQ ID NO: 104197 - DNA, 25 bp, Artificial sequence
  SiRNA target sequence
gtgacaaagtaacaaaaatcttttt

SEQ ID NO: 104198 - DNA, 25 bp, Artificial sequence
  SiRNA target sequence
tgacaaagtaacaaaaatctttttt

SEQ ID NO: 104199 - DNA, 25 bp, Artificial sequence
  SiRNA target sequence
gacaaagtaacaaaaatcttttttc

SEQ ID NO: 104200 - DNA, 25 bp, Artificial sequence
  SiRNA target sequence
acaaagtaacaaaaatcttttttcg

SEQ ID NO: 104201 - DNA, 25 bp, Artificial sequence
  SiRNA target sequence
caaagtaacaaaaatcttttttcgt

SEQ ID NO: 104202 - DNA, 25 bp, Artificial sequence
  SiRNA target sequence
aaagtaacaaaaatcttttttcgtt

SEQ ID NO: 104203 - DNA, 25 bp, Artificial sequence
  SiRNA target sequence
aagtaacaaaaatcttttttcgtta

SEQ ID NO: 104204 - DNA, 25 bp, Artificial sequence
  SiRNA target sequence
agtaacaaaaatcttttttcgttaa

SEQ ID NO: 104205 - DNA, 25 bp, Artificial sequence
  SiRNA target sequence
gtaacaaaaatcttttttcgttaat

SEQ ID NO: 104206 - DNA, 25 bp, Artificial sequence
  SiRNA target sequence
taacaaaaatcttttttcgttaatg

SEQ ID NO: 104207 - DNA, 25 bp, Artificial sequence
  SiRNA target sequence
aacaaaaatcttttttcgttaatgt

SEQ ID NO: 104208 - DNA, 25 bp, Artificial sequence
  SiRNA target sequence
acaaaaatcttttttcgttaatgta

SEQ ID NO: 104209 - DNA, 25 bp, Artificial sequence
  SiRNA target sequence
caaaaatcttttttcgttaatgtaa

SEQ ID NO: 104210 - DNA, 25 bp, Artificial sequence
  SiRNA target sequence
aaaaatcttttttcgttaatgtaaa

SEQ ID NO: 104211 - DNA, 25 bp, Artificial sequence
  SiRNA target sequence
aaaatcttttttcgttaatgtaaaa

SEQ ID NO: 104212 - DNA, 25 bp, Artificial sequence
  SiRNA target sequence
aaatcttttttcgttaatgtaaaat

SEQ ID NO: 104213 - DNA, 25 bp, Artificial sequence
  SiRNA target sequence
aatcttttttcgttaatgtaaaata

SEQ ID NO: 104214 - DNA, 25 bp, Artificial sequence
  SiRNA target sequence
atcttttttcgttaatgtaaaatat

SEQ ID NO: 104215 - DNA, 25 bp, Artificial sequence
  SiRNA target sequence
tcttttttcgttaatgtaaaatatc

SEQ ID NO: 104216 - DNA, 25 bp, Artificial sequence
  SiRNA target sequence
cttttttcgttaatgtaaaatatct

SEQ ID NO: 104217 - DNA, 25 bp, Artificial sequence
  SiRNA target sequence
ttttttcgttaatgtaaaatatctt

SEQ ID NO: 104218 - DNA, 25 bp, Artificial sequence
  SiRNA target sequence
tttttcgttaatgtaaaatatcttg

SEQ ID NO: 104219 - DNA, 25 bp, Artificial sequence
  SiRNA target sequence
ttttcgttaatgtaaaatatcttgg

SEQ ID NO: 104220 - DNA, 25 bp, Artificial sequence
  SiRNA target sequence
tttcgttaatgtaaaatatcttgga

SEQ ID NO: 104221 - DNA, 25 bp, Artificial sequence
  SiRNA target sequence
ttcgttaatgtaaaatatcttggat

SEQ ID NO: 104222 - DNA, 25 bp, Artificial sequence
  SiRNA target sequence
tcgttaatgtaaaatatcttggatt

SEQ ID NO: 104223 - DNA, 25 bp, Artificial sequence
  SiRNA target sequence
cgttaatgtaaaatatcttggatta

SEQ ID NO: 104224 - DNA, 25 bp, Artificial sequence
  SiRNA target sequence
gttaatgtaaaatatcttggattaa

SEQ ID NO: 104225 - DNA, 25 bp, Artificial sequence
  SiRNA target sequence
ttaatgtaaaatatcttggattaat

SEQ ID NO: 104226 - DNA, 25 bp, Artificial sequence
  SiRNA target sequence
taatgtaaaatatcttggattaatt

SEQ ID NO: 104227 - DNA, 25 bp, Artificial sequence
  SiRNA target sequence
aatgtaaaatatcttggattaatta

SEQ ID NO: 104228 - DNA, 25 bp, Artificial sequence
  SiRNA target sequence
atgtaaaatatcttggattaattac

SEQ ID NO: 104229 - DNA, 25 bp, Artificial sequence
  SiRNA target sequence
tgtaaaatatcttggattaattaca

SEQ ID NO: 104230 - DNA, 25 bp, Artificial sequence
  SiRNA target sequence
gtaaaatatcttggattaattacag

SEQ ID NO: 104231 - DNA, 25 bp, Artificial sequence
  SiRNA target sequence
taaaatatcttggattaattacagg

SEQ ID NO: 104232 - DNA, 25 bp, Artificial sequence
  SiRNA target sequence
aaaatatcttggattaattacaggg

SEQ ID NO: 104233 - DNA, 25 bp, Artificial sequence
  SiRNA target sequence
aaatatcttggattaattacaggga

SEQ ID NO: 104234 - DNA, 25 bp, Artificial sequence
  SiRNA target sequence
aatatcttggattaattacagggat

SEQ ID NO: 104235 - DNA, 25 bp, Artificial sequence
  SiRNA target sequence
atatcttggattaattacagggata

SEQ ID NO: 104236 - DNA, 25 bp, Artificial sequence
  SiRNA target sequence
tatcttggattaattacagggatat

SEQ ID NO: 104237 - DNA, 25 bp, Artificial sequence
  SiRNA target sequence
atcttggattaattacagggatata

SEQ ID NO: 104238 - DNA, 25 bp, Artificial sequence
  SiRNA target sequence
tcttggattaattacagggatatac

SEQ ID NO: 104239 - DNA, 25 bp, Artificial sequence
  SiRNA target sequence
cttggattaattacagggatatact

SEQ ID NO: 104240 - DNA, 25 bp, Artificial sequence
  SiRNA target sequence
ttggattaattacagggatatactt

SEQ ID NO: 104241 - DNA, 25 bp, Artificial sequence
  SiRNA target sequence
tggattaattacagggatatacttg

SEQ ID NO: 104242 - DNA, 25 bp, Artificial sequence
  SiRNA target sequence
ggattaattacagggatatacttgt

SEQ ID NO: 104243 - DNA, 25 bp, Artificial sequence
  SiRNA target sequence
gattaattacagggatatacttgta

SEQ ID NO: 104244 - DNA, 25 bp, Artificial sequence
  SiRNA target sequence
attaattacagggatatacttgtac

SEQ ID NO: 104245 - DNA, 25 bp, Artificial sequence
  SiRNA target sequence
ttaattacagggatatacttgtaca

SEQ ID NO: 104246 - DNA, 25 bp, Artificial sequence
  SiRNA target sequence
taattacagggatatacttgtacat

SEQ ID NO: 104247 - DNA, 25 bp, Artificial sequence
  SiRNA target sequence
aattacagggatatacttgtacata

SEQ ID NO: 104248 - DNA, 25 bp, Artificial sequence
  SiRNA target sequence
attacagggatatacttgtacataa

SEQ ID NO: 104249 - DNA, 25 bp, Artificial sequence
  SiRNA target sequence
ttacagggatatacttgtacataaa

SEQ ID NO: 104250 - DNA, 25 bp, Artificial sequence
  SiRNA target sequence
tacagggatatacttgtacataaaa

SEQ ID NO: 104251 - DNA, 25 bp, Artificial sequence
  SiRNA target sequence
acagggatatacttgtacataaaat

SEQ ID NO: 104252 - DNA, 25 bp, Artificial sequence
  SiRNA target sequence
cagggatatacttgtacataaaatt

SEQ ID NO: 104253 - DNA, 25 bp, Artificial sequence
  SiRNA target sequence
agggatatacttgtacataaaattt

SEQ ID NO: 104254 - DNA, 25 bp, Artificial sequence
  SiRNA target sequence
gggatatacttgtacataaaatttg

SEQ ID NO: 104255 - DNA, 25 bp, Artificial sequence
  SiRNA target sequence
ggatatacttgtacataaaatttga

SEQ ID NO: 104256 - DNA, 25 bp, Artificial sequence
  SiRNA target sequence
gatatacttgtacataaaatttgag

SEQ ID NO: 104257 - DNA, 25 bp, Artificial sequence
  SiRNA target sequence
atatacttgtacataaaatttgagg

SEQ ID NO: 104258 - DNA, 25 bp, Artificial sequence
  SiRNA target sequence
tatacttgtacataaaatttgaggt

SEQ ID NO: 104259 - DNA, 25 bp, Artificial sequence
  SiRNA target sequence
atacttgtacataaaatttgaggta

SEQ ID NO: 104260 - DNA, 25 bp, Artificial sequence
  SiRNA target sequence
tacttgtacataaaatttgaggtaa

SEQ ID NO: 104261 - DNA, 25 bp, Artificial sequence
  SiRNA target sequence
acttgtacataaaatttgaggtaag

SEQ ID NO: 104262 - DNA, 25 bp, Artificial sequence
  SiRNA target sequence
cttgtacataaaatttgaggtaagt

SEQ ID NO: 104263 - DNA, 25 bp, Artificial sequence
  SiRNA target sequence
ttgtacataaaatttgaggtaagtt

SEQ ID NO: 104264 - DNA, 25 bp, Artificial sequence
  SiRNA target sequence
tgtacataaaatttgaggtaagttt

SEQ ID NO: 104265 - DNA, 25 bp, Artificial sequence
  SiRNA target sequence
gtacataaaatttgaggtaagtttt

SEQ ID NO: 104266 - DNA, 25 bp, Artificial sequence
  SiRNA target sequence
tacataaaatttgaggtaagtttta

SEQ ID NO: 104267 - DNA, 25 bp, Artificial sequence
  SiRNA target sequence
acataaaatttgaggtaagttttat

SEQ ID NO: 104268 - DNA, 25 bp, Artificial sequence
  SiRNA target sequence
cataaaatttgaggtaagttttatc

SEQ ID NO: 104269 - DNA, 25 bp, Artificial sequence
  SiRNA target sequence
ataaaatttgaggtaagttttatct

SEQ ID NO: 104270 - DNA, 25 bp, Artificial sequence
  SiRNA target sequence
taaaatttgaggtaagttttatctt

SEQ ID NO: 104271 - DNA, 25 bp, Artificial sequence
  SiRNA target sequence
aaaatttgaggtaagttttatctta

SEQ ID NO: 104272 - DNA, 25 bp, Artificial sequence
  SiRNA target sequence
aaatttgaggtaagttttatcttaa

SEQ ID NO: 104273 - DNA, 25 bp, Artificial sequence
  SiRNA target sequence
aatttgaggtaagttttatcttaaa

SEQ ID NO: 104274 - DNA, 25 bp, Artificial sequence
  SiRNA target sequence
atttgaggtaagttttatcttaaaa

SEQ ID NO: 104275 - DNA, 25 bp, Artificial sequence
  SiRNA target sequence
tttgaggtaagttttatcttaaaat

SEQ ID NO: 104276 - DNA, 25 bp, Artificial sequence
  SiRNA target sequence
ttgaggtaagttttatcttaaaatc

SEQ ID NO: 104277 - DNA, 25 bp, Artificial sequence
  SiRNA target sequence
tgaggtaagttttatcttaaaatct

SEQ ID NO: 104278 - DNA, 25 bp, Artificial sequence
  SiRNA target sequence
gaggtaagttttatcttaaaatctt

SEQ ID NO: 104279 - DNA, 25 bp, Artificial sequence
  SiRNA target sequence
aggtaagttttatcttaaaatcttt

SEQ ID NO: 104280 - DNA, 25 bp, Artificial sequence
  SiRNA target sequence
ggtaagttttatcttaaaatctttt

SEQ ID NO: 104281 - DNA, 25 bp, Artificial sequence
  SiRNA target sequence
gtaagttttatcttaaaatctttta

SEQ ID NO: 104282 - DNA, 25 bp, Artificial sequence
  SiRNA target sequence
taagttttatcttaaaatcttttag

SEQ ID NO: 104283 - DNA, 25 bp, Artificial sequence
  SiRNA target sequence
aagttttatcttaaaatcttttaga

SEQ ID NO: 104284 - DNA, 25 bp, Artificial sequence
  SiRNA target sequence
agttttatcttaaaatcttttagaa

SEQ ID NO: 104285 - DNA, 25 bp, Artificial sequence
  SiRNA target sequence
gttttatcttaaaatcttttagaac

SEQ ID NO: 104286 - DNA, 25 bp, Artificial sequence
  SiRNA target sequence
ttttatcttaaaatcttttagaacc

SEQ ID NO: 104287 - DNA, 25 bp, Artificial sequence
  SiRNA target sequence
tttatcttaaaatcttttagaacct

SEQ ID NO: 104288 - DNA, 25 bp, Artificial sequence
  SiRNA target sequence
ttatcttaaaatcttttagaacctc

SEQ ID NO: 104289 - DNA, 25 bp, Artificial sequence
  SiRNA target sequence
tatcttaaaatcttttagaacctca

SEQ ID NO: 104290 - DNA, 25 bp, Artificial sequence
  SiRNA target sequence
atcttaaaatcttttagaacctcaa

SEQ ID NO: 104291 - DNA, 25 bp, Artificial sequence
  SiRNA target sequence
tcttaaaatcttttagaacctcaaa

SEQ ID NO: 104292 - DNA, 25 bp, Artificial sequence
  SiRNA target sequence
cttaaaatcttttagaacctcaaaa

SEQ ID NO: 104293 - DNA, 25 bp, Artificial sequence
  SiRNA target sequence
ttaaaatcttttagaacctcaaaaa

SEQ ID NO: 104294 - DNA, 25 bp, Artificial sequence
  SiRNA target sequence
taaaatcttttagaacctcaaaaat

SEQ ID NO: 104295 - DNA, 25 bp, Artificial sequence
  SiRNA target sequence
aaaatcttttagaacctcaaaaata

SEQ ID NO: 104296 - DNA, 25 bp, Artificial sequence
  SiRNA target sequence
aaatcttttagaacctcaaaaatag

SEQ ID NO: 104297 - DNA, 25 bp, Artificial sequence
  SiRNA target sequence
aatcttttagaacctcaaaaatagt

SEQ ID NO: 104298 - DNA, 25 bp, Artificial sequence
  SiRNA target sequence
atcttttagaacctcaaaaatagtg

SEQ ID NO: 104299 - DNA, 25 bp, Artificial sequence
  SiRNA target sequence
tcttttagaacctcaaaaatagtgc

SEQ ID NO: 104300 - DNA, 25 bp, Artificial sequence
  SiRNA target sequence
cttttagaacctcaaaaatagtgcg

SEQ ID NO: 104301 - DNA, 25 bp, Artificial sequence
  SiRNA target sequence
ttttagaacctcaaaaatagtgcgc

SEQ ID NO: 104302 - DNA, 25 bp, Artificial sequence
  SiRNA target sequence
tttagaacctcaaaaatagtgcgct

SEQ ID NO: 104303 - DNA, 25 bp, Artificial sequence
  SiRNA target sequence
ttagaacctcaaaaatagtgcgctt

SEQ ID NO: 104304 - DNA, 25 bp, Artificial sequence
  SiRNA target sequence
tagaacctcaaaaatagtgcgcttc

SEQ ID NO: 104305 - DNA, 25 bp, Artificial sequence
  SiRNA target sequence
agaacctcaaaaatagtgcgcttcg

SEQ ID NO: 104306 - DNA, 25 bp, Artificial sequence
  SiRNA target sequence
gaacctcaaaaatagtgcgcttcgg

SEQ ID NO: 104307 - DNA, 25 bp, Artificial sequence
  SiRNA target sequence
aacctcaaaaatagtgcgcttcggt

SEQ ID NO: 104308 - DNA, 25 bp, Artificial sequence
  SiRNA target sequence
acctcaaaaatagtgcgcttcggta

SEQ ID NO: 104309 - DNA, 25 bp, Artificial sequence
  SiRNA target sequence
cctcaaaaatagtgcgcttcggtag

SEQ ID NO: 104310 - DNA, 25 bp, Artificial sequence
  SiRNA target sequence
ctcaaaaatagtgcgcttcggtagt

SEQ ID NO: 104311 - DNA, 25 bp, Artificial sequence
  SiRNA target sequence
tcaaaaatagtgcgcttcggtagta

SEQ ID NO: 104312 - DNA, 25 bp, Artificial sequence
  SiRNA target sequence
caaaaatagtgcgcttcggtagtaa

SEQ ID NO: 104313 - DNA, 25 bp, Artificial sequence
  SiRNA target sequence
aaaaatagtgcgcttcggtagtaaa

SEQ ID NO: 104314 - DNA, 25 bp, Artificial sequence
  SiRNA target sequence
aaaatagtgcgcttcggtagtaaaa

SEQ ID NO: 104315 - DNA, 25 bp, Artificial sequence
  SiRNA target sequence
aaatagtgcgcttcggtagtaaaat

SEQ ID NO: 104316 - DNA, 25 bp, Artificial sequence
  SiRNA target sequence
aatagtgcgcttcggtagtaaaatg

SEQ ID NO: 104317 - DNA, 25 bp, Artificial sequence
  SiRNA target sequence
atagtgcgcttcggtagtaaaatgt

SEQ ID NO: 104318 - DNA, 25 bp, Artificial sequence
  SiRNA target sequence
tagtgcgcttcggtagtaaaatgta

SEQ ID NO: 104319 - DNA, 25 bp, Artificial sequence
  SiRNA target sequence
agtgcgcttcggtagtaaaatgtaa

SEQ ID NO: 104320 - DNA, 25 bp, Artificial sequence
  SiRNA target sequence
gtgcgcttcggtagtaaaatgtaat

SEQ ID NO: 104321 - DNA, 25 bp, Artificial sequence
  SiRNA target sequence
tgcgcttcggtagtaaaatgtaatc

SEQ ID NO: 104322 - DNA, 25 bp, Artificial sequence
  SiRNA target sequence
gcgcttcggtagtaaaatgtaatca

SEQ ID NO: 104323 - DNA, 25 bp, Artificial sequence
  SiRNA target sequence
cgcttcggtagtaaaatgtaatcat

SEQ ID NO: 104324 - DNA, 25 bp, Artificial sequence
  SiRNA target sequence
gcttcggtagtaaaatgtaatcata

SEQ ID NO: 104325 - DNA, 25 bp, Artificial sequence
  SiRNA target sequence
cttcggtagtaaaatgtaatcatag

SEQ ID NO: 104326 - DNA, 25 bp, Artificial sequence
  SiRNA target sequence
ttcggtagtaaaatgtaatcatagt

SEQ ID NO: 104327 - DNA, 25 bp, Artificial sequence
  SiRNA target sequence
tcggtagtaaaatgtaatcatagta

SEQ ID NO: 104328 - DNA, 25 bp, Artificial sequence
  SiRNA target sequence
cggtagtaaaatgtaatcatagtac

SEQ ID NO: 104329 - DNA, 25 bp, Artificial sequence
  SiRNA target sequence
ggtagtaaaatgtaatcatagtaca

SEQ ID NO: 104330 - DNA, 25 bp, Artificial sequence
  SiRNA target sequence
gtagtaaaatgtaatcatagtacag

SEQ ID NO: 104331 - DNA, 25 bp, Artificial sequence
  SiRNA target sequence
tagtaaaatgtaatcatagtacaga

SEQ ID NO: 104332 - DNA, 25 bp, Artificial sequence
  SiRNA target sequence
agtaaaatgtaatcatagtacagat

SEQ ID NO: 104333 - DNA, 25 bp, Artificial sequence
  SiRNA target sequence
gtaaaatgtaatcatagtacagatc

SEQ ID NO: 104334 - DNA, 25 bp, Artificial sequence
  SiRNA target sequence
taaaatgtaatcatagtacagatcg

SEQ ID NO: 104335 - DNA, 25 bp, Artificial sequence
  SiRNA target sequence
aaaatgtaatcatagtacagatcgt

SEQ ID NO: 104336 - DNA, 25 bp, Artificial sequence
  SiRNA target sequence
aaatgtaatcatagtacagatcgta

SEQ ID NO: 104337 - DNA, 25 bp, Artificial sequence
  SiRNA target sequence
aatgtaatcatagtacagatcgtaa

SEQ ID NO: 104338 - DNA, 25 bp, Artificial sequence
  SiRNA target sequence
atgtaatcatagtacagatcgtaat

SEQ ID NO: 104339 - DNA, 25 bp, Artificial sequence
  SiRNA target sequence
tgtaatcatagtacagatcgtaatt

SEQ ID NO: 104340 - DNA, 25 bp, Artificial sequence
  SiRNA target sequence
gtaatcatagtacagatcgtaattt

SEQ ID NO: 104341 - DNA, 25 bp, Artificial sequence
  SiRNA target sequence
taatcatagtacagatcgtaattta

SEQ ID NO: 104342 - DNA, 25 bp, Artificial sequence
  SiRNA target sequence
aatcatagtacagatcgtaatttag

SEQ ID NO: 104343 - DNA, 25 bp, Artificial sequence
  SiRNA target sequence
atcatagtacagatcgtaatttaga

SEQ ID NO: 104344 - DNA, 25 bp, Artificial sequence
  SiRNA target sequence
tcatagtacagatcgtaatttagat

SEQ ID NO: 104345 - DNA, 25 bp, Artificial sequence
  SiRNA target sequence
catagtacagatcgtaatttagata

SEQ ID NO: 104346 - DNA, 25 bp, Artificial sequence
  SiRNA target sequence
atagtacagatcgtaatttagataa

SEQ ID NO: 104347 - DNA, 25 bp, Artificial sequence
  SiRNA target sequence
tagtacagatcgtaatttagataaa

SEQ ID NO: 104348 - DNA, 25 bp, Artificial sequence
  SiRNA target sequence
agtacagatcgtaatttagataaat

SEQ ID NO: 104349 - DNA, 25 bp, Artificial sequence
  SiRNA target sequence
gtacagatcgtaatttagataaatt

SEQ ID NO: 104350 - DNA, 25 bp, Artificial sequence
  SiRNA target sequence
tacagatcgtaatttagataaattt

SEQ ID NO: 104351 - DNA, 25 bp, Artificial sequence
  SiRNA target sequence
acagatcgtaatttagataaatttc

SEQ ID NO: 104352 - DNA, 25 bp, Artificial sequence
  SiRNA target sequence
cagatcgtaatttagataaatttct

SEQ ID NO: 104353 - DNA, 25 bp, Artificial sequence
  SiRNA target sequence
agatcgtaatttagataaatttctt

SEQ ID NO: 104354 - DNA, 25 bp, Artificial sequence
  SiRNA target sequence
gatcgtaatttagataaatttcttt

SEQ ID NO: 104355 - DNA, 25 bp, Artificial sequence
  SiRNA target sequence
atcgtaatttagataaatttcttta

SEQ ID NO: 104356 - DNA, 25 bp, Artificial sequence
  SiRNA target sequence
tcgtaatttagataaatttctttac

SEQ ID NO: 104357 - DNA, 25 bp, Artificial sequence
  SiRNA target sequence
cgtaatttagataaatttctttaca

SEQ ID NO: 104358 - DNA, 25 bp, Artificial sequence
  SiRNA target sequence
gtaatttagataaatttctttacat

SEQ ID NO: 104359 - DNA, 25 bp, Artificial sequence
  SiRNA target sequence
taatttagataaatttctttacatt

SEQ ID NO: 104360 - DNA, 25 bp, Artificial sequence
  SiRNA target sequence
aatttagataaatttctttacattt

SEQ ID NO: 104361 - DNA, 25 bp, Artificial sequence
  SiRNA target sequence
atttagataaatttctttacatttc

SEQ ID NO: 104362 - DNA, 25 bp, Artificial sequence
  SiRNA target sequence
tttagataaatttctttacatttct

SEQ ID NO: 104363 - DNA, 25 bp, Artificial sequence
  SiRNA target sequence
ttagataaatttctttacatttctc

SEQ ID NO: 104364 - DNA, 25 bp, Artificial sequence
  SiRNA target sequence
tagataaatttctttacatttctca

SEQ ID NO: 104365 - DNA, 25 bp, Artificial sequence
  SiRNA target sequence
agataaatttctttacatttctcac

SEQ ID NO: 104366 - DNA, 25 bp, Artificial sequence
  SiRNA target sequence
gataaatttctttacatttctcacg

SEQ ID NO: 104367 - DNA, 25 bp, Artificial sequence
  SiRNA target sequence
ataaatttctttacatttctcacga

SEQ ID NO: 104368 - DNA, 25 bp, Artificial sequence
  SiRNA target sequence
taaatttctttacatttctcacgat

SEQ ID NO: 104369 - DNA, 25 bp, Artificial sequence
  SiRNA target sequence
aaatttctttacatttctcacgata

SEQ ID NO: 104370 - DNA, 25 bp, Artificial sequence
  SiRNA target sequence
aatttctttacatttctcacgatat

SEQ ID NO: 104371 - DNA, 25 bp, Artificial sequence
  SiRNA target sequence
atttctttacatttctcacgatatt

SEQ ID NO: 104372 - DNA, 25 bp, Artificial sequence
  SiRNA target sequence
tttctttacatttctcacgatattc

SEQ ID NO: 104373 - DNA, 25 bp, Artificial sequence
  SiRNA target sequence
ttctttacatttctcacgatattcc

SEQ ID NO: 104374 - DNA, 25 bp, Artificial sequence
  SiRNA target sequence
tctttacatttctcacgatattcct

SEQ ID NO: 104375 - DNA, 25 bp, Artificial sequence
  SiRNA target sequence
ctttacatttctcacgatattcctc

SEQ ID NO: 104376 - DNA, 25 bp, Artificial sequence
  SiRNA target sequence
tttacatttctcacgatattcctca

SEQ ID NO: 104377 - DNA, 25 bp, Artificial sequence
  SiRNA target sequence
ttacatttctcacgatattcctcag

SEQ ID NO: 104378 - DNA, 25 bp, Artificial sequence
  SiRNA target sequence
tacatttctcacgatattcctcagc

SEQ ID NO: 104379 - DNA, 25 bp, Artificial sequence
  SiRNA target sequence
acatttctcacgatattcctcagca

SEQ ID NO: 104380 - DNA, 25 bp, Artificial sequence
  SiRNA target sequence
catttctcacgatattcctcagcaa

SEQ ID NO: 104381 - DNA, 25 bp, Artificial sequence
  SiRNA target sequence
atttctcacgatattcctcagcaat

SEQ ID NO: 104382 - DNA, 25 bp, Artificial sequence
  SiRNA target sequence
tttctcacgatattcctcagcaatg

SEQ ID NO: 104383 - DNA, 25 bp, Artificial sequence
  SiRNA target sequence
ttctcacgatattcctcagcaatgg

SEQ ID NO: 104384 - DNA, 25 bp, Artificial sequence
  SiRNA target sequence
tctcacgatattcctcagcaatggt

SEQ ID NO: 104385 - DNA, 25 bp, Artificial sequence
  SiRNA target sequence
ctcacgatattcctcagcaatggta

SEQ ID NO: 104386 - DNA, 25 bp, Artificial sequence
  SiRNA target sequence
tcacgatattcctcagcaatggtat

SEQ ID NO: 104387 - DNA, 25 bp, Artificial sequence
  SiRNA target sequence
cacgatattcctcagcaatggtatc

SEQ ID NO: 104388 - DNA, 25 bp, Artificial sequence
  SiRNA target sequence
acgatattcctcagcaatggtatct

SEQ ID NO: 104389 - DNA, 25 bp, Artificial sequence
  SiRNA target sequence
cgatattcctcagcaatggtatctg

SEQ ID NO: 104390 - DNA, 25 bp, Artificial sequence
  SiRNA target sequence
gatattcctcagcaatggtatctgt

SEQ ID NO: 104391 - DNA, 25 bp, Artificial sequence
  SiRNA target sequence
atattcctcagcaatggtatctgtg

SEQ ID NO: 104392 - DNA, 25 bp, Artificial sequence
  SiRNA target sequence
tattcctcagcaatggtatctgtga

SEQ ID NO: 104393 - DNA, 25 bp, Artificial sequence
  SiRNA target sequence
attcctcagcaatggtatctgtgat

SEQ ID NO: 104394 - DNA, 25 bp, Artificial sequence
  SiRNA target sequence
ttcctcagcaatggtatctgtgata

SEQ ID NO: 104395 - DNA, 25 bp, Artificial sequence
  SiRNA target sequence
tcctcagcaatggtatctgtgataa

SEQ ID NO: 104396 - DNA, 25 bp, Artificial sequence
  SiRNA target sequence
cctcagcaatggtatctgtgataag

SEQ ID NO: 104397 - DNA, 25 bp, Artificial sequence
  SiRNA target sequence
ctcagcaatggtatctgtgataagc

SEQ ID NO: 104398 - DNA, 25 bp, Artificial sequence
  SiRNA target sequence
tcagcaatggtatctgtgataagcg

SEQ ID NO: 104399 - DNA, 25 bp, Artificial sequence
  SiRNA target sequence
cagcaatggtatctgtgataagcga

SEQ ID NO: 104400 - DNA, 25 bp, Artificial sequence
  SiRNA target sequence
agcaatggtatctgtgataagcgaa

SEQ ID NO: 104401 - DNA, 25 bp, Artificial sequence
  SiRNA target sequence
gcaatggtatctgtgataagcgaaa

SEQ ID NO: 104402 - DNA, 25 bp, Artificial sequence
  SiRNA target sequence
caatggtatctgtgataagcgaaag

SEQ ID NO: 104403 - DNA, 25 bp, Artificial sequence
  SiRNA target sequence
aatggtatctgtgataagcgaaagt

SEQ ID NO: 104404 - DNA, 25 bp, Artificial sequence
  SiRNA target sequence
atggtatctgtgataagcgaaagtt

SEQ ID NO: 104405 - DNA, 25 bp, Artificial sequence
  SiRNA target sequence
tggtatctgtgataagcgaaagttg

SEQ ID NO: 104406 - DNA, 25 bp, Artificial sequence
  SiRNA target sequence
ggtatctgtgataagcgaaagttgt

SEQ ID NO: 104407 - DNA, 25 bp, Artificial sequence
  SiRNA target sequence
gtatctgtgataagcgaaagttgta

SEQ ID NO: 104408 - DNA, 25 bp, Artificial sequence
  SiRNA target sequence
tatctgtgataagcgaaagttgtag

SEQ ID NO: 104409 - DNA, 25 bp, Artificial sequence
  SiRNA target sequence
atctgtgataagcgaaagttgtaga

SEQ ID NO: 104410 - DNA, 25 bp, Artificial sequence
  SiRNA target sequence
tctgtgataagcgaaagttgtagaa

SEQ ID NO: 104411 - DNA, 25 bp, Artificial sequence
  SiRNA target sequence
ctgtgataagcgaaagttgtagaaa

SEQ ID NO: 104412 - DNA, 25 bp, Artificial sequence
  SiRNA target sequence
tgtgataagcgaaagttgtagaaaa

SEQ ID NO: 104413 - DNA, 25 bp, Artificial sequence
  SiRNA target sequence
gtgataagcgaaagttgtagaaaaa

SEQ ID NO: 104414 - DNA, 25 bp, Artificial sequence
  SiRNA target sequence
tgataagcgaaagttgtagaaaaaa

SEQ ID NO: 104415 - DNA, 25 bp, Artificial sequence
  SiRNA target sequence
gataagcgaaagttgtagaaaaaaa

SEQ ID NO: 104416 - DNA, 25 bp, Artificial sequence
  SiRNA target sequence
ataagcgaaagttgtagaaaaaaat

SEQ ID NO: 104417 - DNA, 25 bp, Artificial sequence
  SiRNA target sequence
taagcgaaagttgtagaaaaaaata

SEQ ID NO: 104418 - DNA, 25 bp, Artificial sequence
  SiRNA target sequence
aagcgaaagttgtagaaaaaaatag

SEQ ID NO: 104419 - DNA, 25 bp, Artificial sequence
  SiRNA target sequence
agcgaaagttgtagaaaaaaataga

SEQ ID NO: 104420 - DNA, 25 bp, Artificial sequence
  SiRNA target sequence
gcgaaagttgtagaaaaaaatagat

SEQ ID NO: 104421 - DNA, 25 bp, Artificial sequence
  SiRNA target sequence
cgaaagttgtagaaaaaaatagatt

SEQ ID NO: 104422 - DNA, 25 bp, Artificial sequence
  SiRNA target sequence
gaaagttgtagaaaaaaatagattt

SEQ ID NO: 104423 - DNA, 25 bp, Artificial sequence
  SiRNA target sequence
aaagttgtagaaaaaaatagatttg

SEQ ID NO: 104424 - DNA, 25 bp, Artificial sequence
  SiRNA target sequence
aagttgtagaaaaaaatagatttga

SEQ ID NO: 104425 - DNA, 25 bp, Artificial sequence
  SiRNA target sequence
agttgtagaaaaaaatagatttgag

SEQ ID NO: 104426 - DNA, 25 bp, Artificial sequence
  SiRNA target sequence
gttgtagaaaaaaatagatttgagg

SEQ ID NO: 104427 - DNA, 25 bp, Artificial sequence
  SiRNA target sequence
ttgtagaaaaaaatagatttgagga

SEQ ID NO: 104428 - DNA, 25 bp, Artificial sequence
  SiRNA target sequence
tgtagaaaaaaatagatttgaggaa

SEQ ID NO: 104429 - DNA, 25 bp, Artificial sequence
  SiRNA target sequence
gtagaaaaaaatagatttgaggaat

SEQ ID NO: 104430 - DNA, 25 bp, Artificial sequence
  SiRNA target sequence
tagaaaaaaatagatttgaggaata

SEQ ID NO: 104431 - DNA, 25 bp, Artificial sequence
  SiRNA target sequence
agaaaaaaatagatttgaggaatag

SEQ ID NO: 104432 - DNA, 25 bp, Artificial sequence
  SiRNA target sequence
gaaaaaaatagatttgaggaataga

SEQ ID NO: 104433 - DNA, 25 bp, Artificial sequence
  SiRNA target sequence
aaaaaaatagatttgaggaatagaa

SEQ ID NO: 104434 - DNA, 25 bp, Artificial sequence
  SiRNA target sequence
aaaaaatagatttgaggaatagaat

SEQ ID NO: 104435 - DNA, 25 bp, Artificial sequence
  SiRNA target sequence
aaaaatagatttgaggaatagaatt

SEQ ID NO: 104436 - DNA, 25 bp, Artificial sequence
  SiRNA target sequence
aaaatagatttgaggaatagaatta

SEQ ID NO: 104437 - DNA, 25 bp, Artificial sequence
  SiRNA target sequence
aaatagatttgaggaatagaattaa

SEQ ID NO: 104438 - DNA, 25 bp, Artificial sequence
  SiRNA target sequence
aatagatttgaggaatagaattaaa

SEQ ID NO: 104439 - DNA, 25 bp, Artificial sequence
  SiRNA target sequence
atagatttgaggaatagaattaaaa

SEQ ID NO: 104440 - DNA, 25 bp, Artificial sequence
  SiRNA target sequence
tagatttgaggaatagaattaaaat

SEQ ID NO: 104441 - DNA, 25 bp, Artificial sequence
  SiRNA target sequence
agatttgaggaatagaattaaaatc

SEQ ID NO: 104442 - DNA, 25 bp, Artificial sequence
  SiRNA target sequence
gatttgaggaatagaattaaaatca

SEQ ID NO: 104443 - DNA, 25 bp, Artificial sequence
  SiRNA target sequence
atttgaggaatagaattaaaatcac

SEQ ID NO: 104444 - DNA, 25 bp, Artificial sequence
  SiRNA target sequence
tttgaggaatagaattaaaatcaca

SEQ ID NO: 104445 - DNA, 25 bp, Artificial sequence
  SiRNA target sequence
ttgaggaatagaattaaaatcacaa

SEQ ID NO: 104446 - DNA, 25 bp, Artificial sequence
  SiRNA target sequence
tgaggaatagaattaaaatcacaat

SEQ ID NO: 104447 - DNA, 25 bp, Artificial sequence
  SiRNA target sequence
gaggaatagaattaaaatcacaata

SEQ ID NO: 104448 - DNA, 25 bp, Artificial sequence
  SiRNA target sequence
aggaatagaattaaaatcacaatat

SEQ ID NO: 104449 - DNA, 25 bp, Artificial sequence
  SiRNA target sequence
ggaatagaattaaaatcacaatatt

SEQ ID NO: 104450 - DNA, 25 bp, Artificial sequence
  SiRNA target sequence
gaatagaattaaaatcacaatattt

SEQ ID NO: 104451 - DNA, 25 bp, Artificial sequence
  SiRNA target sequence
aatagaattaaaatcacaatatttt

SEQ ID NO: 104452 - DNA, 25 bp, Artificial sequence
  SiRNA target sequence
atagaattaaaatcacaatattttt

SEQ ID NO: 104453 - DNA, 25 bp, Artificial sequence
  SiRNA target sequence
tagaattaaaatcacaatatttttt

SEQ ID NO: 104454 - DNA, 25 bp, Artificial sequence
  SiRNA target sequence
agaattaaaatcacaatatttttta

SEQ ID NO: 104455 - DNA, 25 bp, Artificial sequence
  SiRNA target sequence
gaattaaaatcacaatattttttaa

SEQ ID NO: 104456 - DNA, 25 bp, Artificial sequence
  SiRNA target sequence
aattaaaatcacaatattttttaat

SEQ ID NO: 104457 - DNA, 25 bp, Artificial sequence
  SiRNA target sequence
attaaaatcacaatattttttaata

SEQ ID NO: 104458 - DNA, 25 bp, Artificial sequence
  SiRNA target sequence
ttaaaatcacaatattttttaatat

SEQ ID NO: 104459 - DNA, 25 bp, Artificial sequence
  SiRNA target sequence
taaaatcacaatattttttaatata

SEQ ID NO: 104460 - DNA, 25 bp, Artificial sequence
  SiRNA target sequence
aaaatcacaatattttttaatatat

SEQ ID NO: 104461 - DNA, 25 bp, Artificial sequence
  SiRNA target sequence
aaatcacaatattttttaatatatt

SEQ ID NO: 104462 - DNA, 25 bp, Artificial sequence
  SiRNA target sequence
aatcacaatattttttaatatattt

SEQ ID NO: 104463 - DNA, 25 bp, Artificial sequence
  SiRNA target sequence
atcacaatattttttaatatattta

SEQ ID NO: 104464 - DNA, 25 bp, Artificial sequence
  SiRNA target sequence
tcacaatattttttaatatatttaa

SEQ ID NO: 104465 - DNA, 25 bp, Artificial sequence
  SiRNA target sequence
cacaatattttttaatatatttaac

SEQ ID NO: 104466 - DNA, 25 bp, Artificial sequence
  SiRNA target sequence
acaatattttttaatatatttaacc

SEQ ID NO: 104467 - DNA, 25 bp, Artificial sequence
  SiRNA target sequence
caatattttttaatatatttaacca

SEQ ID NO: 104468 - DNA, 25 bp, Artificial sequence
  SiRNA target sequence
aatattttttaatatatttaaccaa

SEQ ID NO: 104469 - DNA, 25 bp, Artificial sequence
  SiRNA target sequence
atattttttaatatatttaaccaag

SEQ ID NO: 104470 - DNA, 25 bp, Artificial sequence
  SiRNA target sequence
tattttttaatatatttaaccaagg

SEQ ID NO: 104471 - DNA, 25 bp, Artificial sequence
  SiRNA target sequence
attttttaatatatttaaccaaggt

SEQ ID NO: 104472 - DNA, 25 bp, Artificial sequence
  SiRNA target sequence
ttttttaatatatttaaccaaggta

SEQ ID NO: 104473 - DNA, 25 bp, Artificial sequence
  SiRNA target sequence
tttttaatatatttaaccaaggtat

SEQ ID NO: 104474 - DNA, 25 bp, Artificial sequence
  SiRNA target sequence
ttttaatatatttaaccaaggtatt

SEQ ID NO: 104475 - DNA, 25 bp, Artificial sequence
  SiRNA target sequence
tttaatatatttaaccaaggtattg

SEQ ID NO: 104476 - DNA, 25 bp, Artificial sequence
  SiRNA target sequence
ttaatatatttaaccaaggtattgt

SEQ ID NO: 104477 - DNA, 25 bp, Artificial sequence
  SiRNA target sequence
taatatatttaaccaaggtattgtc

SEQ ID NO: 104478 - DNA, 25 bp, Artificial sequence
  SiRNA target sequence
aatatatttaaccaaggtattgtcc

SEQ ID NO: 104479 - DNA, 25 bp, Artificial sequence
  SiRNA target sequence
atatatttaaccaaggtattgtcct

SEQ ID NO: 104480 - DNA, 25 bp, Artificial sequence
  SiRNA target sequence
tatatttaaccaaggtattgtcctt

SEQ ID NO: 104481 - DNA, 25 bp, Artificial sequence
  SiRNA target sequence
atatttaaccaaggtattgtccttt

SEQ ID NO: 104482 - DNA, 25 bp, Artificial sequence
  SiRNA target sequence
tatttaaccaaggtattgtccttta

SEQ ID NO: 104483 - DNA, 25 bp, Artificial sequence
  SiRNA target sequence
atttaaccaaggtattgtcctttat

SEQ ID NO: 104484 - DNA, 25 bp, Artificial sequence
  SiRNA target sequence
tttaaccaaggtattgtcctttatg

SEQ ID NO: 104485 - DNA, 25 bp, Artificial sequence
  SiRNA target sequence
ttaaccaaggtattgtcctttatgt

SEQ ID NO: 104486 - DNA, 25 bp, Artificial sequence
  SiRNA target sequence
taaccaaggtattgtcctttatgtt

SEQ ID NO: 104487 - DNA, 25 bp, Artificial sequence
  SiRNA target sequence
aaccaaggtattgtcctttatgtta

SEQ ID NO: 104488 - DNA, 25 bp, Artificial sequence
  SiRNA target sequence
accaaggtattgtcctttatgttat

SEQ ID NO: 104489 - DNA, 25 bp, Artificial sequence
  SiRNA target sequence
ccaaggtattgtcctttatgttatt

SEQ ID NO: 104490 - DNA, 25 bp, Artificial sequence
  SiRNA target sequence
caaggtattgtcctttatgttatta

SEQ ID NO: 104491 - DNA, 25 bp, Artificial sequence
  SiRNA target sequence
aaggtattgtcctttatgttattat

SEQ ID NO: 104492 - DNA, 25 bp, Artificial sequence
  SiRNA target sequence
aggtattgtcctttatgttattata

SEQ ID NO: 104493 - DNA, 25 bp, Artificial sequence
  SiRNA target sequence
ggtattgtcctttatgttattatat

SEQ ID NO: 104494 - DNA, 25 bp, Artificial sequence
  SiRNA target sequence
gtattgtcctttatgttattatatc

SEQ ID NO: 104495 - DNA, 25 bp, Artificial sequence
  SiRNA target sequence
tattgtcctttatgttattatatct

SEQ ID NO: 104496 - DNA, 25 bp, Artificial sequence
  SiRNA target sequence
attgtcctttatgttattatatctt

SEQ ID NO: 104497 - DNA, 25 bp, Artificial sequence
  SiRNA target sequence
ttgtcctttatgttattatatctta

SEQ ID NO: 104498 - DNA, 25 bp, Artificial sequence
  SiRNA target sequence
tgtcctttatgttattatatcttac

SEQ ID NO: 104499 - DNA, 25 bp, Artificial sequence
  SiRNA target sequence
gtcctttatgttattatatcttaca

SEQ ID NO: 104500 - DNA, 25 bp, Artificial sequence
  SiRNA target sequence
tcctttatgttattatatcttacaa

SEQ ID NO: 104501 - DNA, 25 bp, Artificial sequence
  SiRNA target sequence
cctttatgttattatatcttacaaa

SEQ ID NO: 104502 - DNA, 25 bp, Artificial sequence
  SiRNA target sequence
ctttatgttattatatcttacaaac

SEQ ID NO: 104503 - DNA, 25 bp, Artificial sequence
  SiRNA target sequence
tttatgttattatatcttacaaact

SEQ ID NO: 104504 - DNA, 25 bp, Artificial sequence
  SiRNA target sequence
ttatgttattatatcttacaaactc

SEQ ID NO: 104505 - DNA, 25 bp, Artificial sequence
  SiRNA target sequence
tatgttattatatcttacaaactcc

SEQ ID NO: 104506 - DNA, 25 bp, Artificial sequence
  SiRNA target sequence
atgttattatatcttacaaactcct

SEQ ID NO: 104507 - DNA, 25 bp, Artificial sequence
  SiRNA target sequence
tgttattatatcttacaaactcctc

SEQ ID NO: 104508 - DNA, 25 bp, Artificial sequence
  SiRNA target sequence
gttattatatcttacaaactcctcg

SEQ ID NO: 104509 - DNA, 25 bp, Artificial sequence
  SiRNA target sequence
ttattatatcttacaaactcctcgt

SEQ ID NO: 104510 - DNA, 25 bp, Artificial sequence
  SiRNA target sequence
tattatatcttacaaactcctcgta

SEQ ID NO: 104511 - DNA, 25 bp, Artificial sequence
  SiRNA target sequence
attatatcttacaaactcctcgtaa

SEQ ID NO: 104512 - DNA, 25 bp, Artificial sequence
  SiRNA target sequence
ttatatcttacaaactcctcgtaat

SEQ ID NO: 104513 - DNA, 25 bp, Artificial sequence
  SiRNA target sequence
tatatcttacaaactcctcgtaatt

SEQ ID NO: 104514 - DNA, 25 bp, Artificial sequence
  SiRNA target sequence
atatcttacaaactcctcgtaatta

SEQ ID NO: 104515 - DNA, 25 bp, Artificial sequence
  SiRNA target sequence
tatcttacaaactcctcgtaattat

SEQ ID NO: 104516 - DNA, 25 bp, Artificial sequence
  SiRNA target sequence
atcttacaaactcctcgtaattata

SEQ ID NO: 104517 - DNA, 25 bp, Artificial sequence
  SiRNA target sequence
tcttacaaactcctcgtaattataa

SEQ ID NO: 104518 - DNA, 25 bp, Artificial sequence
  SiRNA target sequence
cttacaaactcctcgtaattataat

SEQ ID NO: 104519 - DNA, 25 bp, Artificial sequence
  SiRNA target sequence
ttacaaactcctcgtaattataatt

SEQ ID NO: 104520 - DNA, 25 bp, Artificial sequence
  SiRNA target sequence
tacaaactcctcgtaattataattt

SEQ ID NO: 104521 - DNA, 25 bp, Artificial sequence
  SiRNA target sequence
acaaactcctcgtaattataatttt

SEQ ID NO: 104522 - DNA, 25 bp, Artificial sequence
  SiRNA target sequence
caaactcctcgtaattataattttc

SEQ ID NO: 104523 - DNA, 25 bp, Artificial sequence
  SiRNA target sequence
aaactcctcgtaattataattttca

SEQ ID NO: 104524 - DNA, 25 bp, Artificial sequence
  SiRNA target sequence
aactcctcgtaattataattttcag

SEQ ID NO: 104525 - DNA, 25 bp, Artificial sequence
  SiRNA target sequence
actcctcgtaattataattttcagg

SEQ ID NO: 104526 - DNA, 25 bp, Artificial sequence
  SiRNA target sequence
ctcctcgtaattataattttcagga

SEQ ID NO: 104527 - DNA, 25 bp, Artificial sequence
  SiRNA target sequence
tcctcgtaattataattttcaggat

SEQ ID NO: 104528 - DNA, 25 bp, Artificial sequence
  SiRNA target sequence
cctcgtaattataattttcaggata

SEQ ID NO: 104529 - DNA, 25 bp, Artificial sequence
  SiRNA target sequence
ctcgtaattataattttcaggataa

SEQ ID NO: 104530 - DNA, 25 bp, Artificial sequence
  SiRNA target sequence
tcgtaattataattttcaggataaa

SEQ ID NO: 104531 - DNA, 25 bp, Artificial sequence
  SiRNA target sequence
cgtaattataattttcaggataaac

SEQ ID NO: 104532 - DNA, 25 bp, Artificial sequence
  SiRNA target sequence
gtaattataattttcaggataaacc

SEQ ID NO: 104533 - DNA, 25 bp, Artificial sequence
  SiRNA target sequence
taattataattttcaggataaaccg

SEQ ID NO: 104534 - DNA, 25 bp, Artificial sequence
  SiRNA target sequence
aattataattttcaggataaaccgc

SEQ ID NO: 104535 - DNA, 25 bp, Artificial sequence
  SiRNA target sequence
attataattttcaggataaaccgct

SEQ ID NO: 104536 - DNA, 25 bp, Artificial sequence
  SiRNA target sequence
ttataattttcaggataaaccgcta

SEQ ID NO: 104537 - DNA, 25 bp, Artificial sequence
  SiRNA target sequence
tataattttcaggataaaccgctag

SEQ ID NO: 104538 - DNA, 25 bp, Artificial sequence
  SiRNA target sequence
ataattttcaggataaaccgctaga

SEQ ID NO: 104539 - DNA, 25 bp, Artificial sequence
  SiRNA target sequence
taattttcaggataaaccgctagac

SEQ ID NO: 104540 - DNA, 25 bp, Artificial sequence
  SiRNA target sequence
aattttcaggataaaccgctagaca

SEQ ID NO: 104541 - DNA, 25 bp, Artificial sequence
  SiRNA target sequence
attttcaggataaaccgctagacaa

SEQ ID NO: 104542 - DNA, 25 bp, Artificial sequence
  SiRNA target sequence
ttttcaggataaaccgctagacaat

SEQ ID NO: 104543 - DNA, 25 bp, Artificial sequence
  SiRNA target sequence
tttcaggataaaccgctagacaatc

SEQ ID NO: 104544 - DNA, 25 bp, Artificial sequence
  SiRNA target sequence
ttcaggataaaccgctagacaatca

SEQ ID NO: 104545 - DNA, 25 bp, Artificial sequence
  SiRNA target sequence
tcaggataaaccgctagacaatcac

SEQ ID NO: 104546 - DNA, 25 bp, Artificial sequence
  SiRNA target sequence
caggataaaccgctagacaatcacc

SEQ ID NO: 104547 - DNA, 25 bp, Artificial sequence
  SiRNA target sequence
aggataaaccgctagacaatcaccg

SEQ ID NO: 104548 - DNA, 25 bp, Artificial sequence
  SiRNA target sequence
ggataaaccgctagacaatcaccga

SEQ ID NO: 104549 - DNA, 25 bp, Artificial sequence
  SiRNA target sequence
gataaaccgctagacaatcaccgat

SEQ ID NO: 104550 - DNA, 25 bp, Artificial sequence
  SiRNA target sequence
ataaaccgctagacaatcaccgatt

SEQ ID NO: 104551 - DNA, 25 bp, Artificial sequence
  SiRNA target sequence
taaaccgctagacaatcaccgattt

SEQ ID NO: 104552 - DNA, 25 bp, Artificial sequence
  SiRNA target sequence
aaaccgctagacaatcaccgatttc

SEQ ID NO: 104553 - DNA, 25 bp, Artificial sequence
  SiRNA target sequence
aaccgctagacaatcaccgatttca

SEQ ID NO: 104554 - DNA, 25 bp, Artificial sequence
  SiRNA target sequence
accgctagacaatcaccgatttcaa

SEQ ID NO: 104555 - DNA, 25 bp, Artificial sequence
  SiRNA target sequence
ccgctagacaatcaccgatttcaaa

SEQ ID NO: 104556 - DNA, 25 bp, Artificial sequence
  SiRNA target sequence
cgctagacaatcaccgatttcaaaa

SEQ ID NO: 104557 - DNA, 25 bp, Artificial sequence
  SiRNA target sequence
gctagacaatcaccgatttcaaaat

SEQ ID NO: 104558 - DNA, 25 bp, Artificial sequence
  SiRNA target sequence
ctagacaatcaccgatttcaaaatt

SEQ ID NO: 104559 - DNA, 25 bp, Artificial sequence
  SiRNA target sequence
tagacaatcaccgatttcaaaattt

SEQ ID NO: 104560 - DNA, 25 bp, Artificial sequence
  SiRNA target sequence
agacaatcaccgatttcaaaatttt

SEQ ID NO: 104561 - DNA, 25 bp, Artificial sequence
  SiRNA target sequence
gacaatcaccgatttcaaaattttc

SEQ ID NO: 104562 - DNA, 25 bp, Artificial sequence
  SiRNA target sequence
acaatcaccgatttcaaaattttct

SEQ ID NO: 104563 - DNA, 25 bp, Artificial sequence
  SiRNA target sequence
caatcaccgatttcaaaattttcta

SEQ ID NO: 104564 - DNA, 25 bp, Artificial sequence
  SiRNA target sequence
aatcaccgatttcaaaattttctat

SEQ ID NO: 104565 - DNA, 25 bp, Artificial sequence
  SiRNA target sequence
atcaccgatttcaaaattttctata

SEQ ID NO: 104566 - DNA, 25 bp, Artificial sequence
  SiRNA target sequence
tcaccgatttcaaaattttctatat

SEQ ID NO: 104567 - DNA, 25 bp, Artificial sequence
  SiRNA target sequence
caccgatttcaaaattttctatatc

SEQ ID NO: 104568 - DNA, 25 bp, Artificial sequence
  SiRNA target sequence
accgatttcaaaattttctatatct

SEQ ID NO: 104569 - DNA, 25 bp, Artificial sequence
  SiRNA target sequence
ccgatttcaaaattttctatatcta

SEQ ID NO: 104570 - DNA, 25 bp, Artificial sequence
  SiRNA target sequence
cgatttcaaaattttctatatctat

SEQ ID NO: 104571 - DNA, 25 bp, Artificial sequence
  SiRNA target sequence
gatttcaaaattttctatatctata

SEQ ID NO: 104572 - DNA, 25 bp, Artificial sequence
  SiRNA target sequence
atttcaaaattttctatatctatat

SEQ ID NO: 104573 - DNA, 25 bp, Artificial sequence
  SiRNA target sequence
tttcaaaattttctatatctatatc

SEQ ID NO: 104574 - DNA, 25 bp, Artificial sequence
  SiRNA target sequence
ttcaaaattttctatatctatatca

SEQ ID NO: 104575 - DNA, 25 bp, Artificial sequence
  SiRNA target sequence
tcaaaattttctatatctatatcaa

SEQ ID NO: 104576 - DNA, 25 bp, Artificial sequence
  SiRNA target sequence
caaaattttctatatctatatcaaa

SEQ ID NO: 104577 - DNA, 25 bp, Artificial sequence
  SiRNA target sequence
aaaattttctatatctatatcaaat

SEQ ID NO: 104578 - DNA, 25 bp, Artificial sequence
  SiRNA target sequence
aaattttctatatctatatcaaatt

SEQ ID NO: 104579 - DNA, 25 bp, Artificial sequence
  SiRNA target sequence
aattttctatatctatatcaaattt

SEQ ID NO: 104580 - DNA, 25 bp, Artificial sequence
  SiRNA target sequence
attttctatatctatatcaaatttt

SEQ ID NO: 104581 - DNA, 25 bp, Artificial sequence
  SiRNA target sequence
ttttctatatctatatcaaatttta

SEQ ID NO: 104582 - DNA, 25 bp, Artificial sequence
  SiRNA target sequence
tttctatatctatatcaaattttat

SEQ ID NO: 104583 - DNA, 25 bp, Artificial sequence
  SiRNA target sequence
ttctatatctatatcaaattttatt

SEQ ID NO: 104584 - DNA, 25 bp, Artificial sequence
  SiRNA target sequence
tctatatctatatcaaattttattt

SEQ ID NO: 104585 - DNA, 25 bp, Artificial sequence
  SiRNA target sequence
ctatatctatatcaaattttatttc

SEQ ID NO: 104586 - DNA, 25 bp, Artificial sequence
  SiRNA target sequence
tatatctatatcaaattttatttct

SEQ ID NO: 104587 - DNA, 25 bp, Artificial sequence
  SiRNA target sequence
atatctatatcaaattttatttcta

SEQ ID NO: 104588 - DNA, 25 bp, Artificial sequence
  SiRNA target sequence
tatctatatcaaattttatttctaa

SEQ ID NO: 104589 - DNA, 25 bp, Artificial sequence
  SiRNA target sequence
atctatatcaaattttatttctaaa

SEQ ID NO: 104590 - DNA, 25 bp, Artificial sequence
  SiRNA target sequence
tctatatcaaattttatttctaaaa

SEQ ID NO: 104591 - DNA, 25 bp, Artificial sequence
  SiRNA target sequence
ctatatcaaattttatttctaaaat

SEQ ID NO: 104592 - DNA, 25 bp, Artificial sequence
  SiRNA target sequence
tatatcaaattttatttctaaaata

SEQ ID NO: 104593 - DNA, 25 bp, Artificial sequence
  SiRNA target sequence
atatcaaattttatttctaaaatag

SEQ ID NO: 104594 - DNA, 25 bp, Artificial sequence
  SiRNA target sequence
tatcaaattttatttctaaaatagg

SEQ ID NO: 104595 - DNA, 25 bp, Artificial sequence
  SiRNA target sequence
atcaaattttatttctaaaatagga

SEQ ID NO: 104596 - DNA, 25 bp, Artificial sequence
  SiRNA target sequence
tcaaattttatttctaaaataggat

SEQ ID NO: 104597 - DNA, 25 bp, Artificial sequence
  SiRNA target sequence
caaattttatttctaaaataggata

SEQ ID NO: 104598 - DNA, 25 bp, Artificial sequence
  SiRNA target sequence
aaattttatttctaaaataggataa

SEQ ID NO: 104599 - DNA, 25 bp, Artificial sequence
  SiRNA target sequence
aattttatttctaaaataggataaa

SEQ ID NO: 104600 - DNA, 25 bp, Artificial sequence
  SiRNA target sequence
attttatttctaaaataggataaat

SEQ ID NO: 104601 - DNA, 25 bp, Artificial sequence
  SiRNA target sequence
ttttatttctaaaataggataaatg

SEQ ID NO: 104602 - DNA, 25 bp, Artificial sequence
  SiRNA target sequence
tttatttctaaaataggataaatgt

SEQ ID NO: 104603 - DNA, 25 bp, Artificial sequence
  SiRNA target sequence
ttatttctaaaataggataaatgta

SEQ ID NO: 104604 - DNA, 25 bp, Artificial sequence
  SiRNA target sequence
tatttctaaaataggataaatgtaa

SEQ ID NO: 104605 - DNA, 25 bp, Artificial sequence
  SiRNA target sequence
atttctaaaataggataaatgtaat

SEQ ID NO: 104606 - DNA, 25 bp, Artificial sequence
  SiRNA target sequence
tttctaaaataggataaatgtaatt

SEQ ID NO: 104607 - DNA, 25 bp, Artificial sequence
  SiRNA target sequence
ttctaaaataggataaatgtaattg

SEQ ID NO: 104608 - DNA, 25 bp, Artificial sequence
  SiRNA target sequence
tctaaaataggataaatgtaattgt

SEQ ID NO: 104609 - DNA, 25 bp, Artificial sequence
  SiRNA target sequence
ctaaaataggataaatgtaattgta

SEQ ID NO: 104610 - DNA, 25 bp, Artificial sequence
  SiRNA target sequence
taaaataggataaatgtaattgtaa

SEQ ID NO: 104611 - DNA, 25 bp, Artificial sequence
  SiRNA target sequence
aaaataggataaatgtaattgtaag

SEQ ID NO: 104612 - DNA, 25 bp, Artificial sequence
  SiRNA target sequence
aaataggataaatgtaattgtaagg

SEQ ID NO: 104613 - DNA, 25 bp, Artificial sequence
  SiRNA target sequence
aataggataaatgtaattgtaaggt

SEQ ID NO: 104614 - DNA, 25 bp, Artificial sequence
  SiRNA target sequence
ataggataaatgtaattgtaaggtg

SEQ ID NO: 104615 - DNA, 25 bp, Artificial sequence
  SiRNA target sequence
taggataaatgtaattgtaaggtgt

SEQ ID NO: 104616 - DNA, 25 bp, Artificial sequence
  SiRNA target sequence
aggataaatgtaattgtaaggtgtt

SEQ ID NO: 104617 - DNA, 25 bp, Artificial sequence
  SiRNA target sequence
ggataaatgtaattgtaaggtgtta

SEQ ID NO: 104618 - DNA, 25 bp, Artificial sequence
  SiRNA target sequence
gataaatgtaattgtaaggtgttaa

SEQ ID NO: 104619 - DNA, 25 bp, Artificial sequence
  SiRNA target sequence
ataaatgtaattgtaaggtgttaat

SEQ ID NO: 104620 - DNA, 25 bp, Artificial sequence
  SiRNA target sequence
taaatgtaattgtaaggtgttaata

SEQ ID NO: 104621 - DNA, 25 bp, Artificial sequence
  SiRNA target sequence
aaatgtaattgtaaggtgttaatat

SEQ ID NO: 104622 - DNA, 25 bp, Artificial sequence
  SiRNA target sequence
aatgtaattgtaaggtgttaatatc

SEQ ID NO: 104623 - DNA, 25 bp, Artificial sequence
  SiRNA target sequence
atgtaattgtaaggtgttaatatct

SEQ ID NO: 104624 - DNA, 25 bp, Artificial sequence
  SiRNA target sequence
tgtaattgtaaggtgttaatatctt

SEQ ID NO: 104625 - DNA, 25 bp, Artificial sequence
  SiRNA target sequence
gtaattgtaaggtgttaatatctta

SEQ ID NO: 104626 - DNA, 25 bp, Artificial sequence
  SiRNA target sequence
taattgtaaggtgttaatatcttaa

SEQ ID NO: 104627 - DNA, 25 bp, Artificial sequence
  SiRNA target sequence
aattgtaaggtgttaatatcttaat

SEQ ID NO: 104628 - DNA, 25 bp, Artificial sequence
  SiRNA target sequence
attgtaaggtgttaatatcttaata

SEQ ID NO: 104629 - DNA, 25 bp, Artificial sequence
  SiRNA target sequence
ttgtaaggtgttaatatcttaatat

SEQ ID NO: 104630 - DNA, 25 bp, Artificial sequence
  SiRNA target sequence
tgtaaggtgttaatatcttaatatc

SEQ ID NO: 104631 - DNA, 25 bp, Artificial sequence
  SiRNA target sequence
gtaaggtgttaatatcttaatatca

SEQ ID NO: 104632 - DNA, 25 bp, Artificial sequence
  SiRNA target sequence
taaggtgttaatatcttaatatcat

SEQ ID NO: 104633 - DNA, 25 bp, Artificial sequence
  SiRNA target sequence
aaggtgttaatatcttaatatcatt

SEQ ID NO: 104634 - DNA, 25 bp, Artificial sequence
  SiRNA target sequence
aggtgttaatatcttaatatcattt

SEQ ID NO: 104635 - DNA, 25 bp, Artificial sequence
  SiRNA target sequence
ggtgttaatatcttaatatcattta

SEQ ID NO: 104636 - DNA, 25 bp, Artificial sequence
  SiRNA target sequence
gtgttaatatcttaatatcatttat

SEQ ID NO: 104637 - DNA, 25 bp, Artificial sequence
  SiRNA target sequence
tgttaatatcttaatatcatttatt

SEQ ID NO: 104638 - DNA, 25 bp, Artificial sequence
  SiRNA target sequence
gttaatatcttaatatcatttattg

SEQ ID NO: 104639 - DNA, 25 bp, Artificial sequence
  SiRNA target sequence
ttaatatcttaatatcatttattga

SEQ ID NO: 104640 - DNA, 25 bp, Artificial sequence
  SiRNA target sequence
taatatcttaatatcatttattgac

SEQ ID NO: 104641 - DNA, 25 bp, Artificial sequence
  SiRNA target sequence
aatatcttaatatcatttattgacg

SEQ ID NO: 104642 - DNA, 25 bp, Artificial sequence
  SiRNA target sequence
atatcttaatatcatttattgacgc

SEQ ID NO: 104643 - DNA, 25 bp, Artificial sequence
  SiRNA target sequence
tatcttaatatcatttattgacgca

SEQ ID NO: 104644 - DNA, 25 bp, Artificial sequence
  SiRNA target sequence
atcttaatatcatttattgacgcac

SEQ ID NO: 104645 - DNA, 25 bp, Artificial sequence
  SiRNA target sequence
tcttaatatcatttattgacgcact

SEQ ID NO: 104646 - DNA, 25 bp, Artificial sequence
  SiRNA target sequence
cttaatatcatttattgacgcactg

SEQ ID NO: 104647 - DNA, 25 bp, Artificial sequence
  SiRNA target sequence
ttaatatcatttattgacgcactgt

SEQ ID NO: 104648 - DNA, 25 bp, Artificial sequence
  SiRNA target sequence
taatatcatttattgacgcactgta

SEQ ID NO: 104649 - DNA, 25 bp, Artificial sequence
  SiRNA target sequence
aatatcatttattgacgcactgtat

SEQ ID NO: 104650 - DNA, 25 bp, Artificial sequence
  SiRNA target sequence
atatcatttattgacgcactgtata

SEQ ID NO: 104651 - DNA, 25 bp, Artificial sequence
  SiRNA target sequence
tatcatttattgacgcactgtataa

SEQ ID NO: 104652 - DNA, 25 bp, Artificial sequence
  SiRNA target sequence
atcatttattgacgcactgtataaa

SEQ ID NO: 104653 - DNA, 25 bp, Artificial sequence
  SiRNA target sequence
tcatttattgacgcactgtataaat

SEQ ID NO: 104654 - DNA, 25 bp, Artificial sequence
  SiRNA target sequence
catttattgacgcactgtataaatc

SEQ ID NO: 104655 - DNA, 25 bp, Artificial sequence
  SiRNA target sequence
atttattgacgcactgtataaatca

SEQ ID NO: 104656 - DNA, 25 bp, Artificial sequence
  SiRNA target sequence
tttattgacgcactgtataaatcat

SEQ ID NO: 104657 - DNA, 25 bp, Artificial sequence
  SiRNA target sequence
ttattgacgcactgtataaatcatt

SEQ ID NO: 104658 - DNA, 25 bp, Artificial sequence
  SiRNA target sequence
tattgacgcactgtataaatcattt

SEQ ID NO: 104659 - DNA, 25 bp, Artificial sequence
  SiRNA target sequence
attgacgcactgtataaatcatttt

SEQ ID NO: 104660 - DNA, 25 bp, Artificial sequence
  SiRNA target sequence
ttgacgcactgtataaatcattttt

SEQ ID NO: 104661 - DNA, 25 bp, Artificial sequence
  SiRNA target sequence
tgacgcactgtataaatcattttta

SEQ ID NO: 104662 - DNA, 25 bp, Artificial sequence
  SiRNA target sequence
gacgcactgtataaatcatttttac

SEQ ID NO: 104663 - DNA, 25 bp, Artificial sequence
  SiRNA target sequence
acgcactgtataaatcatttttaca

SEQ ID NO: 104664 - DNA, 25 bp, Artificial sequence
  SiRNA target sequence
cgcactgtataaatcatttttacaa

SEQ ID NO: 104665 - DNA, 25 bp, Artificial sequence
  SiRNA target sequence
gcactgtataaatcatttttacaac

SEQ ID NO: 104666 - DNA, 25 bp, Artificial sequence
  SiRNA target sequence
cactgtataaatcatttttacaact

SEQ ID NO: 104667 - DNA, 25 bp, Artificial sequence
  SiRNA target sequence
actgtataaatcatttttacaactt

SEQ ID NO: 104668 - DNA, 25 bp, Artificial sequence
  SiRNA target sequence
ctgtataaatcatttttacaacttg

SEQ ID NO: 104669 - DNA, 25 bp, Artificial sequence
  SiRNA target sequence
tgtataaatcatttttacaacttgc

SEQ ID NO: 104670 - DNA, 25 bp, Artificial sequence
  SiRNA target sequence
gtataaatcatttttacaacttgca

SEQ ID NO: 104671 - DNA, 25 bp, Artificial sequence
  SiRNA target sequence
tataaatcatttttacaacttgcaa

SEQ ID NO: 104672 - DNA, 25 bp, Artificial sequence
  SiRNA target sequence
ataaatcatttttacaacttgcaaa

SEQ ID NO: 104673 - DNA, 25 bp, Artificial sequence
  SiRNA target sequence
taaatcatttttacaacttgcaaaa

SEQ ID NO: 104674 - DNA, 25 bp, Artificial sequence
  SiRNA target sequence
aaatcatttttacaacttgcaaaat

SEQ ID NO: 104675 - DNA, 25 bp, Artificial sequence
  SiRNA target sequence
aatcatttttacaacttgcaaaatt

SEQ ID NO: 104676 - DNA, 25 bp, Artificial sequence
  SiRNA target sequence
atcatttttacaacttgcaaaattt

SEQ ID NO: 104677 - DNA, 25 bp, Artificial sequence
  SiRNA target sequence
tcatttttacaacttgcaaaatttt

SEQ ID NO: 104678 - DNA, 25 bp, Artificial sequence
  SiRNA target sequence
catttttacaacttgcaaaattttt

SEQ ID NO: 104679 - DNA, 25 bp, Artificial sequence
  SiRNA target sequence
atttttacaacttgcaaaattttta

SEQ ID NO: 104680 - DNA, 25 bp, Artificial sequence
  SiRNA target sequence
tttttacaacttgcaaaatttttag

SEQ ID NO: 104681 - DNA, 25 bp, Artificial sequence
  SiRNA target sequence
ttttacaacttgcaaaatttttagc

SEQ ID NO: 104682 - DNA, 25 bp, Artificial sequence
  SiRNA target sequence
tttacaacttgcaaaatttttagca

SEQ ID NO: 104683 - DNA, 25 bp, Artificial sequence
  SiRNA target sequence
ttacaacttgcaaaatttttagcat

SEQ ID NO: 104684 - DNA, 25 bp, Artificial sequence
  SiRNA target sequence
tacaacttgcaaaatttttagcatt

SEQ ID NO: 104685 - DNA, 25 bp, Artificial sequence
  SiRNA target sequence
acaacttgcaaaatttttagcattt

SEQ ID NO: 104686 - DNA, 25 bp, Artificial sequence
  SiRNA target sequence
caacttgcaaaatttttagcatttt

SEQ ID NO: 104687 - DNA, 25 bp, Artificial sequence
  SiRNA target sequence
aacttgcaaaatttttagcattttg

SEQ ID NO: 104688 - DNA, 25 bp, Artificial sequence
  SiRNA target sequence
acttgcaaaatttttagcattttgt

SEQ ID NO: 104689 - DNA, 25 bp, Artificial sequence
  SiRNA target sequence
cttgcaaaatttttagcattttgta

SEQ ID NO: 104690 - DNA, 25 bp, Artificial sequence
  SiRNA target sequence
ttgcaaaatttttagcattttgtag

SEQ ID NO: 104691 - DNA, 25 bp, Artificial sequence
  SiRNA target sequence
tgcaaaatttttagcattttgtagt

SEQ ID NO: 104692 - DNA, 25 bp, Artificial sequence
  SiRNA target sequence
gcaaaatttttagcattttgtagtt

SEQ ID NO: 104693 - DNA, 25 bp, Artificial sequence
  SiRNA target sequence
caaaatttttagcattttgtagttt

SEQ ID NO: 104694 - DNA, 25 bp, Artificial sequence
  SiRNA target sequence
aaaatttttagcattttgtagtttg

SEQ ID NO: 104695 - DNA, 25 bp, Artificial sequence
  SiRNA target sequence
aaatttttagcattttgtagtttgt

SEQ ID NO: 104696 - DNA, 25 bp, Artificial sequence
  SiRNA target sequence
aatttttagcattttgtagtttgta

SEQ ID NO: 104697 - DNA, 25 bp, Artificial sequence
  SiRNA target sequence
atttttagcattttgtagtttgtaa

SEQ ID NO: 104698 - DNA, 25 bp, Artificial sequence
  SiRNA target sequence
tttttagcattttgtagtttgtaat

SEQ ID NO: 104699 - DNA, 25 bp, Artificial sequence
  SiRNA target sequence
ttttagcattttgtagtttgtaatg

SEQ ID NO: 104700 - DNA, 25 bp, Artificial sequence
  SiRNA target sequence
tttagcattttgtagtttgtaatgc

SEQ ID NO: 104701 - DNA, 25 bp, Artificial sequence
  SiRNA target sequence
ttagcattttgtagtttgtaatgcg

SEQ ID NO: 104702 - DNA, 25 bp, Artificial sequence
  SiRNA target sequence
tagcattttgtagtttgtaatgcgg

SEQ ID NO: 104703 - DNA, 25 bp, Artificial sequence
  SiRNA target sequence
agcattttgtagtttgtaatgcggt

SEQ ID NO: 104704 - DNA, 25 bp, Artificial sequence
  SiRNA target sequence
gcattttgtagtttgtaatgcggta

SEQ ID NO: 104705 - DNA, 25 bp, Artificial sequence
  SiRNA target sequence
cattttgtagtttgtaatgcggtaa

SEQ ID NO: 104706 - DNA, 25 bp, Artificial sequence
  SiRNA target sequence
attttgtagtttgtaatgcggtaat

SEQ ID NO: 104707 - DNA, 25 bp, Artificial sequence
  SiRNA target sequence
ttttgtagtttgtaatgcggtaata

SEQ ID NO: 104708 - DNA, 25 bp, Artificial sequence
  SiRNA target sequence
tttgtagtttgtaatgcggtaatat

SEQ ID NO: 104709 - DNA, 25 bp, Artificial sequence
  SiRNA target sequence
ttgtagtttgtaatgcggtaatata

SEQ ID NO: 104710 - DNA, 25 bp, Artificial sequence
  SiRNA target sequence
tgtagtttgtaatgcggtaatatat

SEQ ID NO: 104711 - DNA, 25 bp, Artificial sequence
  SiRNA target sequence
gtagtttgtaatgcggtaatatata

SEQ ID NO: 104712 - DNA, 25 bp, Artificial sequence
  SiRNA target sequence
tagtttgtaatgcggtaatatataa

SEQ ID NO: 104713 - DNA, 25 bp, Artificial sequence
  SiRNA target sequence
agtttgtaatgcggtaatatataat

SEQ ID NO: 104714 - DNA, 25 bp, Artificial sequence
  SiRNA target sequence
gtttgtaatgcggtaatatataata

SEQ ID NO: 104715 - DNA, 25 bp, Artificial sequence
  SiRNA target sequence
tttgtaatgcggtaatatataatat

SEQ ID NO: 104716 - DNA, 25 bp, Artificial sequence
  SiRNA target sequence
ttgtaatgcggtaatatataatata

SEQ ID NO: 104717 - DNA, 25 bp, Artificial sequence
  SiRNA target sequence
tgtaatgcggtaatatataatatag

SEQ ID NO: 104718 - DNA, 25 bp, Artificial sequence
  SiRNA target sequence
gtaatgcggtaatatataatataga

SEQ ID NO: 104719 - DNA, 25 bp, Artificial sequence
  SiRNA target sequence
taatgcggtaatatataatatagat

SEQ ID NO: 104720 - DNA, 25 bp, Artificial sequence
  SiRNA target sequence
aatgcggtaatatataatatagatc

SEQ ID NO: 104721 - DNA, 25 bp, Artificial sequence
  SiRNA target sequence
atgcggtaatatataatatagatct

SEQ ID NO: 104722 - DNA, 25 bp, Artificial sequence
  SiRNA target sequence
tgcggtaatatataatatagatctt

SEQ ID NO: 104723 - DNA, 25 bp, Artificial sequence
  SiRNA target sequence
gcggtaatatataatatagatcttt

SEQ ID NO: 104724 - DNA, 25 bp, Artificial sequence
  SiRNA target sequence
cggtaatatataatatagatctttt

SEQ ID NO: 104725 - DNA, 25 bp, Artificial sequence
  SiRNA target sequence
ggtaatatataatatagatctttta

SEQ ID NO: 104726 - DNA, 25 bp, Artificial sequence
  SiRNA target sequence
gtaatatataatatagatcttttat

SEQ ID NO: 104727 - DNA, 25 bp, Artificial sequence
  SiRNA target sequence
taatatataatatagatcttttatc

SEQ ID NO: 104728 - DNA, 25 bp, Artificial sequence
  SiRNA target sequence
aatatataatatagatcttttatcc

SEQ ID NO: 104729 - DNA, 25 bp, Artificial sequence
  SiRNA target sequence
atatataatatagatcttttatcca

SEQ ID NO: 104730 - DNA, 25 bp, Artificial sequence
  SiRNA target sequence
tatataatatagatcttttatccat

SEQ ID NO: 104731 - DNA, 25 bp, Artificial sequence
  SiRNA target sequence
atataatatagatcttttatccatg

SEQ ID NO: 104732 - DNA, 25 bp, Artificial sequence
  SiRNA target sequence
tataatatagatcttttatccatgt

SEQ ID NO: 104733 - DNA, 25 bp, Artificial sequence
  SiRNA target sequence
ataatatagatcttttatccatgtc

SEQ ID NO: 104734 - DNA, 25 bp, Artificial sequence
  SiRNA target sequence
taatatagatcttttatccatgtct

SEQ ID NO: 104735 - DNA, 25 bp, Artificial sequence
  SiRNA target sequence
aatatagatcttttatccatgtctt

SEQ ID NO: 104736 - DNA, 25 bp, Artificial sequence
  SiRNA target sequence
atatagatcttttatccatgtctta

SEQ ID NO: 104737 - DNA, 25 bp, Artificial sequence
  SiRNA target sequence
tatagatcttttatccatgtcttaa

SEQ ID NO: 104738 - DNA, 25 bp, Artificial sequence
  SiRNA target sequence
atagatcttttatccatgtcttaaa

SEQ ID NO: 104739 - DNA, 25 bp, Artificial sequence
  SiRNA target sequence
tagatcttttatccatgtcttaaat

SEQ ID NO: 104740 - DNA, 25 bp, Artificial sequence
  SiRNA target sequence
agatcttttatccatgtcttaaatt

SEQ ID NO: 104741 - DNA, 25 bp, Artificial sequence
  SiRNA target sequence
gatcttttatccatgtcttaaattc

SEQ ID NO: 104742 - DNA, 25 bp, Artificial sequence
  SiRNA target sequence
atcttttatccatgtcttaaattcg

SEQ ID NO: 104743 - DNA, 25 bp, Artificial sequence
  SiRNA target sequence
tcttttatccatgtcttaaattcgc

SEQ ID NO: 104744 - DNA, 25 bp, Artificial sequence
  SiRNA target sequence
cttttatccatgtcttaaattcgcc

SEQ ID NO: 104745 - DNA, 25 bp, Artificial sequence
  SiRNA target sequence
ttttatccatgtcttaaattcgccc

SEQ ID NO: 104746 - DNA, 25 bp, Artificial sequence
  SiRNA target sequence
tttatccatgtcttaaattcgccca

SEQ ID NO: 104747 - DNA, 25 bp, Artificial sequence
  SiRNA target sequence
ttatccatgtcttaaattcgcccat

SEQ ID NO: 104748 - DNA, 25 bp, Artificial sequence
  SiRNA target sequence
tatccatgtcttaaattcgcccata

SEQ ID NO: 104749 - DNA, 25 bp, Artificial sequence
  SiRNA target sequence
atccatgtcttaaattcgcccataa

SEQ ID NO: 104750 - DNA, 25 bp, Artificial sequence
  SiRNA target sequence
tccatgtcttaaattcgcccataaa

SEQ ID NO: 104751 - DNA, 25 bp, Artificial sequence
  SiRNA target sequence
ccatgtcttaaattcgcccataaat

SEQ ID NO: 104752 - DNA, 25 bp, Artificial sequence
  SiRNA target sequence
catgtcttaaattcgcccataaatc

SEQ ID NO: 104753 - DNA, 25 bp, Artificial sequence
  SiRNA target sequence
atgtcttaaattcgcccataaatcc

SEQ ID NO: 104754 - DNA, 25 bp, Artificial sequence
  SiRNA target sequence
tgtcttaaattcgcccataaatcct

SEQ ID NO: 104755 - DNA, 25 bp, Artificial sequence
  SiRNA target sequence
gtcttaaattcgcccataaatcctt

SEQ ID NO: 104756 - DNA, 25 bp, Artificial sequence
  SiRNA target sequence
tcttaaattcgcccataaatccttc

SEQ ID NO: 104757 - DNA, 25 bp, Artificial sequence
  SiRNA target sequence
cttaaattcgcccataaatccttct

SEQ ID NO: 104758 - DNA, 25 bp, Artificial sequence
  SiRNA target sequence
ttaaattcgcccataaatccttctt

SEQ ID NO: 104759 - DNA, 25 bp, Artificial sequence
  SiRNA target sequence
taaattcgcccataaatccttcttt

SEQ ID NO: 104760 - DNA, 25 bp, Artificial sequence
  SiRNA target sequence
aaattcgcccataaatccttctttg

SEQ ID NO: 104761 - DNA, 25 bp, Artificial sequence
  SiRNA target sequence
aattcgcccataaatccttctttgt

SEQ ID NO: 104762 - DNA, 25 bp, Artificial sequence
  SiRNA target sequence
attcgcccataaatccttctttgtc

SEQ ID NO: 104763 - DNA, 25 bp, Artificial sequence
  SiRNA target sequence
ttcgcccataaatccttctttgtct

SEQ ID NO: 104764 - DNA, 25 bp, Artificial sequence
  SiRNA target sequence
tcgcccataaatccttctttgtctt

SEQ ID NO: 104765 - DNA, 25 bp, Artificial sequence
  SiRNA target sequence
cgcccataaatccttctttgtcttg

SEQ ID NO: 104766 - DNA, 25 bp, Artificial sequence
  SiRNA target sequence
gcccataaatccttctttgtcttgg

SEQ ID NO: 104767 - DNA, 25 bp, Artificial sequence
  SiRNA target sequence
cccataaatccttctttgtcttggc

SEQ ID NO: 104768 - DNA, 25 bp, Artificial sequence
  SiRNA target sequence
ccataaatccttctttgtcttggct

SEQ ID NO: 104769 - DNA, 25 bp, Artificial sequence
  SiRNA target sequence
cataaatccttctttgtcttggcta

SEQ ID NO: 104770 - DNA, 25 bp, Artificial sequence
  SiRNA target sequence
ataaatccttctttgtcttggctat

SEQ ID NO: 104771 - DNA, 25 bp, Artificial sequence
  SiRNA target sequence
taaatccttctttgtcttggctatc

SEQ ID NO: 104772 - DNA, 25 bp, Artificial sequence
  SiRNA target sequence
aaatccttctttgtcttggctatct

SEQ ID NO: 104773 - DNA, 25 bp, Artificial sequence
  SiRNA target sequence
aatccttctttgtcttggctatctc

SEQ ID NO: 104774 - DNA, 25 bp, Artificial sequence
  SiRNA target sequence
atccttctttgtcttggctatctcc

SEQ ID NO: 104775 - DNA, 25 bp, Artificial sequence
  SiRNA target sequence
tccttctttgtcttggctatctcca

SEQ ID NO: 104776 - DNA, 25 bp, Artificial sequence
  SiRNA target sequence
ccttctttgtcttggctatctccat

SEQ ID NO: 104777 - DNA, 25 bp, Artificial sequence
  SiRNA target sequence
cttctttgtcttggctatctccatt

SEQ ID NO: 104778 - DNA, 25 bp, Artificial sequence
  SiRNA target sequence
ttctttgtcttggctatctccatta

SEQ ID NO: 104779 - DNA, 25 bp, Artificial sequence
  SiRNA target sequence
tctttgtcttggctatctccattac

SEQ ID NO: 104780 - DNA, 25 bp, Artificial sequence
  SiRNA target sequence
ctttgtcttggctatctccattacc

SEQ ID NO: 104781 - DNA, 25 bp, Artificial sequence
  SiRNA target sequence
tttgtcttggctatctccattaccc

SEQ ID NO: 104782 - DNA, 25 bp, Artificial sequence
  SiRNA target sequence
ttgtcttggctatctccattaccct

SEQ ID NO: 104783 - DNA, 25 bp, Artificial sequence
  SiRNA target sequence
tgtcttggctatctccattaccctt

SEQ ID NO: 104784 - DNA, 25 bp, Artificial sequence
  SiRNA target sequence
gtcttggctatctccattacccttt

SEQ ID NO: 104785 - DNA, 25 bp, Artificial sequence
  SiRNA target sequence
tcttggctatctccattaccctttc

SEQ ID NO: 104786 - DNA, 25 bp, Artificial sequence
  SiRNA target sequence
cttggctatctccattaccctttct

SEQ ID NO: 104787 - DNA, 25 bp, Artificial sequence
  SiRNA target sequence
ttggctatctccattaccctttctt

SEQ ID NO: 104788 - DNA, 25 bp, Artificial sequence
  SiRNA target sequence
tggctatctccattaccctttctta

SEQ ID NO: 104789 - DNA, 25 bp, Artificial sequence
  SiRNA target sequence
ggctatctccattaccctttcttat

SEQ ID NO: 104790 - DNA, 25 bp, Artificial sequence
  SiRNA target sequence
gctatctccattaccctttcttatc

SEQ ID NO: 104791 - DNA, 25 bp, Artificial sequence
  SiRNA target sequence
ctatctccattaccctttcttatca

SEQ ID NO: 104792 - DNA, 25 bp, Artificial sequence
  SiRNA target sequence
tatctccattaccctttcttatcag

SEQ ID NO: 104793 - DNA, 25 bp, Artificial sequence
  SiRNA target sequence
atctccattaccctttcttatcaga

SEQ ID NO: 104794 - DNA, 25 bp, Artificial sequence
  SiRNA target sequence
tctccattaccctttcttatcagag

SEQ ID NO: 104795 - DNA, 25 bp, Artificial sequence
  SiRNA target sequence
ctccattaccctttcttatcagagg

SEQ ID NO: 104796 - DNA, 25 bp, Artificial sequence
  SiRNA target sequence
tccattaccctttcttatcagaggt

SEQ ID NO: 104797 - DNA, 25 bp, Artificial sequence
  SiRNA target sequence
ccattaccctttcttatcagaggtt

SEQ ID NO: 104798 - DNA, 25 bp, Artificial sequence
  SiRNA target sequence
cattaccctttcttatcagaggttt

SEQ ID NO: 104799 - DNA, 25 bp, Artificial sequence
  SiRNA target sequence
attaccctttcttatcagaggttta

SEQ ID NO: 104800 - DNA, 25 bp, Artificial sequence
  SiRNA target sequence
ttaccctttcttatcagaggtttag

SEQ ID NO: 104801 - DNA, 25 bp, Artificial sequence
  SiRNA target sequence
taccctttcttatcagaggtttagc

SEQ ID NO: 104802 - DNA, 25 bp, Artificial sequence
  SiRNA target sequence
accctttcttatcagaggtttagct

SEQ ID NO: 104803 - DNA, 25 bp, Artificial sequence
  SiRNA target sequence
ccctttcttatcagaggtttagctc

SEQ ID NO: 104804 - DNA, 25 bp, Artificial sequence
  SiRNA target sequence
cctttcttatcagaggtttagctcc

SEQ ID NO: 104805 - DNA, 25 bp, Artificial sequence
  SiRNA target sequence
ctttcttatcagaggtttagctccg

SEQ ID NO: 104806 - DNA, 25 bp, Artificial sequence
  SiRNA target sequence
tttcttatcagaggtttagctccgt

SEQ ID NO: 104807 - DNA, 25 bp, Artificial sequence
  SiRNA target sequence
ttcttatcagaggtttagctccgtg

SEQ ID NO: 104808 - DNA, 25 bp, Artificial sequence
  SiRNA target sequence
tcttatcagaggtttagctccgtgt

SEQ ID NO: 104809 - DNA, 25 bp, Artificial sequence
  SiRNA target sequence
cttatcagaggtttagctccgtgtt

SEQ ID NO: 104810 - DNA, 25 bp, Artificial sequence
  SiRNA target sequence
ttatcagaggtttagctccgtgttt

SEQ ID NO: 104811 - DNA, 25 bp, Artificial sequence
  SiRNA target sequence
tatcagaggtttagctccgtgtttt

SEQ ID NO: 104812 - DNA, 25 bp, Artificial sequence
  SiRNA target sequence
atcagaggtttagctccgtgtttta

SEQ ID NO: 104813 - DNA, 25 bp, Artificial sequence
  SiRNA target sequence
tcagaggtttagctccgtgttttaa

SEQ ID NO: 104814 - DNA, 25 bp, Artificial sequence
  SiRNA target sequence
cagaggtttagctccgtgttttaaa

SEQ ID NO: 104815 - DNA, 25 bp, Artificial sequence
  SiRNA target sequence
agaggtttagctccgtgttttaaaa

SEQ ID NO: 104816 - DNA, 25 bp, Artificial sequence
  SiRNA target sequence
gaggtttagctccgtgttttaaaag

SEQ ID NO: 104817 - DNA, 25 bp, Artificial sequence
  SiRNA target sequence
aggtttagctccgtgttttaaaagg

SEQ ID NO: 104818 - DNA, 25 bp, Artificial sequence
  SiRNA target sequence
ggtttagctccgtgttttaaaaggc

SEQ ID NO: 104819 - DNA, 25 bp, Artificial sequence
  SiRNA target sequence
gtttagctccgtgttttaaaaggca

SEQ ID NO: 104820 - DNA, 25 bp, Artificial sequence
  SiRNA target sequence
tttagctccgtgttttaaaaggcaa

SEQ ID NO: 104821 - DNA, 25 bp, Artificial sequence
  SiRNA target sequence
ttagctccgtgttttaaaaggcaat

SEQ ID NO: 104822 - DNA, 25 bp, Artificial sequence
  SiRNA target sequence
tagctccgtgttttaaaaggcaatt

SEQ ID NO: 104823 - DNA, 25 bp, Artificial sequence
  SiRNA target sequence
agctccgtgttttaaaaggcaatta

SEQ ID NO: 104824 - DNA, 25 bp, Artificial sequence
  SiRNA target sequence
gctccgtgttttaaaaggcaattat

SEQ ID NO: 104825 - DNA, 25 bp, Artificial sequence
  SiRNA target sequence
ctccgtgttttaaaaggcaattata

SEQ ID NO: 104826 - DNA, 25 bp, Artificial sequence
  SiRNA target sequence
tccgtgttttaaaaggcaattatac

SEQ ID NO: 104827 - DNA, 25 bp, Artificial sequence
  SiRNA target sequence
ccgtgttttaaaaggcaattataca

SEQ ID NO: 104828 - DNA, 25 bp, Artificial sequence
  SiRNA target sequence
cgtgttttaaaaggcaattatacaa

SEQ ID NO: 104829 - DNA, 25 bp, Artificial sequence
  SiRNA target sequence
gtgttttaaaaggcaattatacaac

SEQ ID NO: 104830 - DNA, 25 bp, Artificial sequence
  SiRNA target sequence
tgttttaaaaggcaattatacaact

SEQ ID NO: 104831 - DNA, 25 bp, Artificial sequence
  SiRNA target sequence
gttttaaaaggcaattatacaactt

SEQ ID NO: 104832 - DNA, 25 bp, Artificial sequence
  SiRNA target sequence
ttttaaaaggcaattatacaacttt

SEQ ID NO: 104833 - DNA, 25 bp, Artificial sequence
  SiRNA target sequence
tttaaaaggcaattatacaactttt

SEQ ID NO: 104834 - DNA, 25 bp, Artificial sequence
  SiRNA target sequence
ttaaaaggcaattatacaacttttt

SEQ ID NO: 104835 - DNA, 25 bp, Artificial sequence
  SiRNA target sequence
taaaaggcaattatacaacttttta

SEQ ID NO: 104836 - DNA, 25 bp, Artificial sequence
  SiRNA target sequence
aaaaggcaattatacaactttttag

SEQ ID NO: 104837 - DNA, 25 bp, Artificial sequence
  SiRNA target sequence
aaaggcaattatacaactttttaga

SEQ ID NO: 104838 - DNA, 25 bp, Artificial sequence
  SiRNA target sequence
aaggcaattatacaactttttagaa

SEQ ID NO: 104839 - DNA, 25 bp, Artificial sequence
  SiRNA target sequence
aggcaattatacaactttttagaac

SEQ ID NO: 104840 - DNA, 25 bp, Artificial sequence
  SiRNA target sequence
ggcaattatacaactttttagaaca

SEQ ID NO: 104841 - DNA, 25 bp, Artificial sequence
  SiRNA target sequence
gcaattatacaactttttagaacaa

SEQ ID NO: 104842 - DNA, 25 bp, Artificial sequence
  SiRNA target sequence
caattatacaactttttagaacaaa

SEQ ID NO: 104843 - DNA, 25 bp, Artificial sequence
  SiRNA target sequence
aattatacaactttttagaacaaaa

SEQ ID NO: 104844 - DNA, 25 bp, Artificial sequence
  SiRNA target sequence
attatacaactttttagaacaaaaa

SEQ ID NO: 104845 - DNA, 25 bp, Artificial sequence
  SiRNA target sequence
ttatacaactttttagaacaaaaat

SEQ ID NO: 104846 - DNA, 25 bp, Artificial sequence
  SiRNA target sequence
tatacaactttttagaacaaaaatt

SEQ ID NO: 104847 - DNA, 25 bp, Artificial sequence
  SiRNA target sequence
atacaactttttagaacaaaaatta

SEQ ID NO: 104848 - DNA, 25 bp, Artificial sequence
  SiRNA target sequence
tacaactttttagaacaaaaattaa

SEQ ID NO: 104849 - DNA, 25 bp, Artificial sequence
  SiRNA target sequence
acaactttttagaacaaaaattaaa

SEQ ID NO: 104850 - DNA, 25 bp, Artificial sequence
  SiRNA target sequence
caactttttagaacaaaaattaaaa

SEQ ID NO: 104851 - DNA, 25 bp, Artificial sequence
  SiRNA target sequence
aactttttagaacaaaaattaaaag

SEQ ID NO: 104852 - DNA, 25 bp, Artificial sequence
  SiRNA target sequence
actttttagaacaaaaattaaaaga

SEQ ID NO: 104853 - DNA, 25 bp, Artificial sequence
  SiRNA target sequence
ctttttagaacaaaaattaaaagat

SEQ ID NO: 104854 - DNA, 25 bp, Artificial sequence
  SiRNA target sequence
tttttagaacaaaaattaaaagatt

SEQ ID NO: 104855 - DNA, 25 bp, Artificial sequence
  SiRNA target sequence
ttttagaacaaaaattaaaagattt

SEQ ID NO: 104856 - DNA, 25 bp, Artificial sequence
  SiRNA target sequence
tttagaacaaaaattaaaagattta

SEQ ID NO: 104857 - DNA, 25 bp, Artificial sequence
  SiRNA target sequence
ttagaacaaaaattaaaagatttat

SEQ ID NO: 104858 - DNA, 25 bp, Artificial sequence
  SiRNA target sequence
tagaacaaaaattaaaagatttata

SEQ ID NO: 104859 - DNA, 25 bp, Artificial sequence
  SiRNA target sequence
agaacaaaaattaaaagatttataa

SEQ ID NO: 104860 - DNA, 25 bp, Artificial sequence
  SiRNA target sequence
gaacaaaaattaaaagatttataag

SEQ ID NO: 104861 - DNA, 25 bp, Artificial sequence
  SiRNA target sequence
aacaaaaattaaaagatttataaga

SEQ ID NO: 104862 - DNA, 25 bp, Artificial sequence
  SiRNA target sequence
acaaaaattaaaagatttataagac

SEQ ID NO: 104863 - DNA, 25 bp, Artificial sequence
  SiRNA target sequence
caaaaattaaaagatttataagacg

SEQ ID NO: 104864 - DNA, 25 bp, Artificial sequence
  SiRNA target sequence
aaaaattaaaagatttataagacga

SEQ ID NO: 104865 - DNA, 25 bp, Artificial sequence
  SiRNA target sequence
aaaattaaaagatttataagacgaa

SEQ ID NO: 104866 - DNA, 25 bp, Artificial sequence
  SiRNA target sequence
aaattaaaagatttataagacgaat

SEQ ID NO: 104867 - DNA, 25 bp, Artificial sequence
  SiRNA target sequence
aattaaaagatttataagacgaatc

SEQ ID NO: 104868 - DNA, 25 bp, Artificial sequence
  SiRNA target sequence
attaaaagatttataagacgaatcc

SEQ ID NO: 104869 - DNA, 25 bp, Artificial sequence
  SiRNA target sequence
ttaaaagatttataagacgaatccc

SEQ ID NO: 104870 - DNA, 25 bp, Artificial sequence
  SiRNA target sequence
taaaagatttataagacgaatcccc

SEQ ID NO: 104871 - DNA, 25 bp, Artificial sequence
  SiRNA target sequence
aaaagatttataagacgaatcccca

SEQ ID NO: 104872 - DNA, 25 bp, Artificial sequence
  SiRNA target sequence
aaagatttataagacgaatccccaa

SEQ ID NO: 104873 - DNA, 25 bp, Artificial sequence
  SiRNA target sequence
aagatttataagacgaatccccaag

SEQ ID NO: 104874 - DNA, 25 bp, Artificial sequence
  SiRNA target sequence
agatttataagacgaatccccaagg

SEQ ID NO: 104875 - DNA, 25 bp, Artificial sequence
  SiRNA target sequence
gatttataagacgaatccccaaggc

SEQ ID NO: 104876 - DNA, 25 bp, Artificial sequence
  SiRNA target sequence
atttataagacgaatccccaaggcc

SEQ ID NO: 104877 - DNA, 25 bp, Artificial sequence
  SiRNA target sequence
tttataagacgaatccccaaggcca

SEQ ID NO: 104878 - DNA, 25 bp, Artificial sequence
  SiRNA target sequence
ttataagacgaatccccaaggccaa

SEQ ID NO: 104879 - DNA, 25 bp, Artificial sequence
  SiRNA target sequence
tataagacgaatccccaaggccaaa

SEQ ID NO: 104880 - DNA, 25 bp, Artificial sequence
  SiRNA target sequence
ataagacgaatccccaaggccaaat

SEQ ID NO: 104881 - DNA, 25 bp, Artificial sequence
  SiRNA target sequence
taagacgaatccccaaggccaaata

SEQ ID NO: 104882 - DNA, 25 bp, Artificial sequence
  SiRNA target sequence
aagacgaatccccaaggccaaatac

SEQ ID NO: 104883 - DNA, 25 bp, Artificial sequence
  SiRNA target sequence
agacgaatccccaaggccaaataca

SEQ ID NO: 104884 - DNA, 25 bp, Artificial sequence
  SiRNA target sequence
gacgaatccccaaggccaaatacag

SEQ ID NO: 104885 - DNA, 25 bp, Artificial sequence
  SiRNA target sequence
acgaatccccaaggccaaatacagc

SEQ ID NO: 104886 - DNA, 25 bp, Artificial sequence
  SiRNA target sequence
cgaatccccaaggccaaatacagca

SEQ ID NO: 104887 - DNA, 25 bp, Artificial sequence
  SiRNA target sequence
gaatccccaaggccaaatacagcaa

SEQ ID NO: 104888 - DNA, 25 bp, Artificial sequence
  SiRNA target sequence
aatccccaaggccaaatacagcaaa

SEQ ID NO: 104889 - DNA, 25 bp, Artificial sequence
  SiRNA target sequence
atccccaaggccaaatacagcaaaa

SEQ ID NO: 104890 - DNA, 25 bp, Artificial sequence
  SiRNA target sequence
tccccaaggccaaatacagcaaaat

SEQ ID NO: 104891 - DNA, 25 bp, Artificial sequence
  SiRNA target sequence
ccccaaggccaaatacagcaaaatt

SEQ ID NO: 104892 - DNA, 25 bp, Artificial sequence
  SiRNA target sequence
cccaaggccaaatacagcaaaattt

SEQ ID NO: 104893 - DNA, 25 bp, Artificial sequence
  SiRNA target sequence
ccaaggccaaatacagcaaaattta

SEQ ID NO: 104894 - DNA, 25 bp, Artificial sequence
  SiRNA target sequence
caaggccaaatacagcaaaatttaa

SEQ ID NO: 104895 - DNA, 25 bp, Artificial sequence
  SiRNA target sequence
aaggccaaatacagcaaaatttaag

SEQ ID NO: 104896 - DNA, 25 bp, Artificial sequence
  SiRNA target sequence
aggccaaatacagcaaaatttaagt

SEQ ID NO: 104897 - DNA, 25 bp, Artificial sequence
  SiRNA target sequence
ggccaaatacagcaaaatttaagtg

SEQ ID NO: 104898 - DNA, 25 bp, Artificial sequence
  SiRNA target sequence
gccaaatacagcaaaatttaagtgt

SEQ ID NO: 104899 - DNA, 25 bp, Artificial sequence
  SiRNA target sequence
ccaaatacagcaaaatttaagtgtt

SEQ ID NO: 104900 - DNA, 25 bp, Artificial sequence
  SiRNA target sequence
caaatacagcaaaatttaagtgttg

SEQ ID NO: 104901 - DNA, 25 bp, Artificial sequence
  SiRNA target sequence
aaatacagcaaaatttaagtgttgt

SEQ ID NO: 104902 - DNA, 25 bp, Artificial sequence
  SiRNA target sequence
aatacagcaaaatttaagtgttgta

SEQ ID NO: 104903 - DNA, 25 bp, Artificial sequence
  SiRNA target sequence
atacagcaaaatttaagtgttgtaa

SEQ ID NO: 104904 - DNA, 25 bp, Artificial sequence
  SiRNA target sequence
tacagcaaaatttaagtgttgtaaa

SEQ ID NO: 104905 - DNA, 25 bp, Artificial sequence
  SiRNA target sequence
acagcaaaatttaagtgttgtaaaa

SEQ ID NO: 104906 - DNA, 25 bp, Artificial sequence
  SiRNA target sequence
cagcaaaatttaagtgttgtaaaaa

SEQ ID NO: 104907 - DNA, 25 bp, Artificial sequence
  SiRNA target sequence
agcaaaatttaagtgttgtaaaaaa

SEQ ID NO: 104908 - DNA, 25 bp, Artificial sequence
  SiRNA target sequence
gcaaaatttaagtgttgtaaaaaat

SEQ ID NO: 104909 - DNA, 25 bp, Artificial sequence
  SiRNA target sequence
caaaatttaagtgttgtaaaaaatt

SEQ ID NO: 104910 - DNA, 25 bp, Artificial sequence
  SiRNA target sequence
aaaatttaagtgttgtaaaaaattt

SEQ ID NO: 104911 - DNA, 25 bp, Artificial sequence
  SiRNA target sequence
aaatttaagtgttgtaaaaaatttg

SEQ ID NO: 104912 - DNA, 25 bp, Artificial sequence
  SiRNA target sequence
aatttaagtgttgtaaaaaatttgt

SEQ ID NO: 104913 - DNA, 25 bp, Artificial sequence
  SiRNA target sequence
atttaagtgttgtaaaaaatttgta

SEQ ID NO: 104914 - DNA, 25 bp, Artificial sequence
  SiRNA target sequence
tttaagtgttgtaaaaaatttgtag

SEQ ID NO: 104915 - DNA, 25 bp, Artificial sequence
  SiRNA target sequence
ttaagtgttgtaaaaaatttgtagg

SEQ ID NO: 104916 - DNA, 25 bp, Artificial sequence
  SiRNA target sequence
taagtgttgtaaaaaatttgtaggc

SEQ ID NO: 104917 - DNA, 25 bp, Artificial sequence
  SiRNA target sequence
aagtgttgtaaaaaatttgtaggca

SEQ ID NO: 104918 - DNA, 25 bp, Artificial sequence
  SiRNA target sequence
agtgttgtaaaaaatttgtaggcag

SEQ ID NO: 104919 - DNA, 25 bp, Artificial sequence
  SiRNA target sequence
gtgttgtaaaaaatttgtaggcaga

SEQ ID NO: 104920 - DNA, 25 bp, Artificial sequence
  SiRNA target sequence
tgttgtaaaaaatttgtaggcagat

SEQ ID NO: 104921 - DNA, 25 bp, Artificial sequence
  SiRNA target sequence
gttgtaaaaaatttgtaggcagatt

SEQ ID NO: 104922 - DNA, 25 bp, Artificial sequence
  SiRNA target sequence
ttgtaaaaaatttgtaggcagattt

SEQ ID NO: 104923 - DNA, 25 bp, Artificial sequence
  SiRNA target sequence
tgtaaaaaatttgtaggcagatttt

SEQ ID NO: 104924 - DNA, 25 bp, Artificial sequence
  SiRNA target sequence
gtaaaaaatttgtaggcagattttt

SEQ ID NO: 104925 - DNA, 25 bp, Artificial sequence
  SiRNA target sequence
taaaaaatttgtaggcagatttttt

SEQ ID NO: 104926 - DNA, 25 bp, Artificial sequence
  SiRNA target sequence
aaaaaatttgtaggcagattttttt

SEQ ID NO: 104927 - DNA, 25 bp, Artificial sequence
  SiRNA target sequence
aaaaatttgtaggcagatttttttt

SEQ ID NO: 104928 - DNA, 25 bp, Artificial sequence
  SiRNA target sequence
aaaatttgtaggcagattttttttg

SEQ ID NO: 104929 - DNA, 25 bp, Artificial sequence
  SiRNA target sequence
aaatttgtaggcagattttttttgc

SEQ ID NO: 104930 - DNA, 25 bp, Artificial sequence
  SiRNA target sequence
aatttgtaggcagattttttttgcg

SEQ ID NO: 104931 - DNA, 25 bp, Artificial sequence
  SiRNA target sequence
atttgtaggcagattttttttgcgc

SEQ ID NO: 104932 - DNA, 25 bp, Artificial sequence
  SiRNA target sequence
tttgtaggcagattttttttgcgca

SEQ ID NO: 104933 - DNA, 25 bp, Artificial sequence
  SiRNA target sequence
ttgtaggcagattttttttgcgcaa

SEQ ID NO: 104934 - DNA, 25 bp, Artificial sequence
  SiRNA target sequence
tgtaggcagattttttttgcgcaaa

SEQ ID NO: 104935 - DNA, 25 bp, Artificial sequence
  SiRNA target sequence
gtaggcagattttttttgcgcaaaa

SEQ ID NO: 104936 - DNA, 25 bp, Artificial sequence
  SiRNA target sequence
taggcagattttttttgcgcaaaaa

SEQ ID NO: 104937 - DNA, 25 bp, Artificial sequence
  SiRNA target sequence
aggcagattttttttgcgcaaaaat

SEQ ID NO: 104938 - DNA, 25 bp, Artificial sequence
  SiRNA target sequence
ggcagattttttttgcgcaaaaatt

SEQ ID NO: 104939 - DNA, 25 bp, Artificial sequence
  SiRNA target sequence
gcagattttttttgcgcaaaaattt

SEQ ID NO: 104940 - DNA, 25 bp, Artificial sequence
  SiRNA target sequence
cagattttttttgcgcaaaaatttc

SEQ ID NO: 104941 - DNA, 25 bp, Artificial sequence
  SiRNA target sequence
agattttttttgcgcaaaaatttcc

SEQ ID NO: 104942 - DNA, 25 bp, Artificial sequence
  SiRNA target sequence
gattttttttgcgcaaaaatttcca

SEQ ID NO: 104943 - DNA, 25 bp, Artificial sequence
  SiRNA target sequence
attttttttgcgcaaaaatttccaa

SEQ ID NO: 104944 - DNA, 25 bp, Artificial sequence
  SiRNA target sequence
ttttttttgcgcaaaaatttccaaa

SEQ ID NO: 104945 - DNA, 25 bp, Artificial sequence
  SiRNA target sequence
tttttttgcgcaaaaatttccaaaa

SEQ ID NO: 104946 - DNA, 25 bp, Artificial sequence
  SiRNA target sequence
ttttttgcgcaaaaatttccaaaat

SEQ ID NO: 104947 - DNA, 25 bp, Artificial sequence
  SiRNA target sequence
tttttgcgcaaaaatttccaaaatt

SEQ ID NO: 104948 - DNA, 25 bp, Artificial sequence
  SiRNA target sequence
ttttgcgcaaaaatttccaaaattt

SEQ ID NO: 104949 - DNA, 25 bp, Artificial sequence
  SiRNA target sequence
tttgcgcaaaaatttccaaaattta

SEQ ID NO: 104950 - DNA, 25 bp, Artificial sequence
  SiRNA target sequence
ttgcgcaaaaatttccaaaatttag

SEQ ID NO: 104951 - DNA, 25 bp, Artificial sequence
  SiRNA target sequence
tgcgcaaaaatttccaaaatttagt

SEQ ID NO: 104952 - DNA, 25 bp, Artificial sequence
  SiRNA target sequence
gcgcaaaaatttccaaaatttagtc

SEQ ID NO: 104953 - DNA, 25 bp, Artificial sequence
  SiRNA target sequence
cgcaaaaatttccaaaatttagtca

SEQ ID NO: 104954 - DNA, 25 bp, Artificial sequence
  SiRNA target sequence
gcaaaaatttccaaaatttagtcat

SEQ ID NO: 104955 - DNA, 25 bp, Artificial sequence
  SiRNA target sequence
caaaaatttccaaaatttagtcatg

SEQ ID NO: 104956 - DNA, 25 bp, Artificial sequence
  SiRNA target sequence
aaaaatttccaaaatttagtcatgt

SEQ ID NO: 104957 - DNA, 25 bp, Artificial sequence
  SiRNA target sequence
aaaatttccaaaatttagtcatgtt

SEQ ID NO: 104958 - DNA, 25 bp, Artificial sequence
  SiRNA target sequence
aaatttccaaaatttagtcatgtta

SEQ ID NO: 104959 - DNA, 25 bp, Artificial sequence
  SiRNA target sequence
aatttccaaaatttagtcatgttaa

SEQ ID NO: 104960 - DNA, 25 bp, Artificial sequence
  SiRNA target sequence
atttccaaaatttagtcatgttaaa

SEQ ID NO: 104961 - DNA, 25 bp, Artificial sequence
  SiRNA target sequence
tttccaaaatttagtcatgttaaaa

SEQ ID NO: 104962 - DNA, 25 bp, Artificial sequence
  SiRNA target sequence
ttccaaaatttagtcatgttaaaag

SEQ ID NO: 104963 - DNA, 25 bp, Artificial sequence
  SiRNA target sequence
tccaaaatttagtcatgttaaaagg

SEQ ID NO: 104964 - DNA, 25 bp, Artificial sequence
  SiRNA target sequence
ccaaaatttagtcatgttaaaaggt

SEQ ID NO: 104965 - DNA, 25 bp, Artificial sequence
  SiRNA target sequence
caaaatttagtcatgttaaaaggtt

SEQ ID NO: 104966 - DNA, 25 bp, Artificial sequence
  SiRNA target sequence
aaaatttagtcatgttaaaaggttc

SEQ ID NO: 104967 - DNA, 25 bp, Artificial sequence
  SiRNA target sequence
aaatttagtcatgttaaaaggttca

SEQ ID NO: 104968 - DNA, 25 bp, Artificial sequence
  SiRNA target sequence
aatttagtcatgttaaaaggttcag

SEQ ID NO: 104969 - DNA, 25 bp, Artificial sequence
  SiRNA target sequence
atttagtcatgttaaaaggttcaga

SEQ ID NO: 104970 - DNA, 25 bp, Artificial sequence
  SiRNA target sequence
tttagtcatgttaaaaggttcagaa

SEQ ID NO: 104971 - DNA, 25 bp, Artificial sequence
  SiRNA target sequence
ttagtcatgttaaaaggttcagaac

SEQ ID NO: 104972 - DNA, 25 bp, Artificial sequence
  SiRNA target sequence
tagtcatgttaaaaggttcagaacc

SEQ ID NO: 104973 - DNA, 25 bp, Artificial sequence
  SiRNA target sequence
agtcatgttaaaaggttcagaacca

SEQ ID NO: 104974 - DNA, 25 bp, Artificial sequence
  SiRNA target sequence
gtcatgttaaaaggttcagaaccat

SEQ ID NO: 104975 - DNA, 25 bp, Artificial sequence
  SiRNA target sequence
tcatgttaaaaggttcagaaccatt

SEQ ID NO: 104976 - DNA, 25 bp, Artificial sequence
  SiRNA target sequence
catgttaaaaggttcagaaccattc

SEQ ID NO: 104977 - DNA, 25 bp, Artificial sequence
  SiRNA target sequence
atgttaaaaggttcagaaccattcc

SEQ ID NO: 104978 - DNA, 25 bp, Artificial sequence
  SiRNA target sequence
tgttaaaaggttcagaaccattccc

SEQ ID NO: 104979 - DNA, 25 bp, Artificial sequence
  SiRNA target sequence
gttaaaaggttcagaaccattccca

SEQ ID NO: 104980 - DNA, 25 bp, Artificial sequence
  SiRNA target sequence
ttaaaaggttcagaaccattcccat

SEQ ID NO: 104981 - DNA, 25 bp, Artificial sequence
  SiRNA target sequence
taaaaggttcagaaccattcccatg

SEQ ID NO: 104982 - DNA, 25 bp, Artificial sequence
  SiRNA target sequence
aaaaggttcagaaccattcccatga

SEQ ID NO: 104983 - DNA, 25 bp, Artificial sequence
  SiRNA target sequence
aaaggttcagaaccattcccatgag

SEQ ID NO: 104984 - DNA, 25 bp, Artificial sequence
  SiRNA target sequence
aaggttcagaaccattcccatgagt

SEQ ID NO: 104985 - DNA, 25 bp, Artificial sequence
  SiRNA target sequence
aggttcagaaccattcccatgagtc

SEQ ID NO: 104986 - DNA, 25 bp, Artificial sequence
  SiRNA target sequence
ggttcagaaccattcccatgagtcg

SEQ ID NO: 104987 - DNA, 25 bp, Artificial sequence
  SiRNA target sequence
gttcagaaccattcccatgagtcga

SEQ ID NO: 104988 - DNA, 25 bp, Artificial sequence
  SiRNA target sequence
ttcagaaccattcccatgagtcgaa

SEQ ID NO: 104989 - DNA, 25 bp, Artificial sequence
  SiRNA target sequence
tcagaaccattcccatgagtcgaac

SEQ ID NO: 104990 - DNA, 25 bp, Artificial sequence
  SiRNA target sequence
cagaaccattcccatgagtcgaaca

SEQ ID NO: 104991 - DNA, 25 bp, Artificial sequence
  SiRNA target sequence
agaaccattcccatgagtcgaacat

SEQ ID NO: 104992 - DNA, 25 bp, Artificial sequence
  SiRNA target sequence
gaaccattcccatgagtcgaacata

SEQ ID NO: 104993 - DNA, 25 bp, Artificial sequence
  SiRNA target sequence
aaccattcccatgagtcgaacatac

SEQ ID NO: 104994 - DNA, 25 bp, Artificial sequence
  SiRNA target sequence
accattcccatgagtcgaacataca

SEQ ID NO: 104995 - DNA, 25 bp, Artificial sequence
  SiRNA target sequence
ccattcccatgagtcgaacatacaa

SEQ ID NO: 104996 - DNA, 25 bp, Artificial sequence
  SiRNA target sequence
cattcccatgagtcgaacatacaaa

SEQ ID NO: 104997 - DNA, 25 bp, Artificial sequence
  SiRNA target sequence
attcccatgagtcgaacatacaaat

SEQ ID NO: 104998 - DNA, 25 bp, Artificial sequence
  SiRNA target sequence
ttcccatgagtcgaacatacaaata

SEQ ID NO: 104999 - DNA, 25 bp, Artificial sequence
  SiRNA target sequence
tcccatgagtcgaacatacaaatat

SEQ ID NO: 105000 - DNA, 25 bp, Artificial sequence
  SiRNA target sequence
cccatgagtcgaacatacaaatata

SEQ ID NO: 105001 - DNA, 25 bp, Artificial sequence
  SiRNA target sequence
ccatgagtcgaacatacaaatataa

SEQ ID NO: 105002 - DNA, 25 bp, Artificial sequence
  SiRNA target sequence
catgagtcgaacatacaaatataat

SEQ ID NO: 105003 - DNA, 25 bp, Artificial sequence
  SiRNA target sequence
atgagtcgaacatacaaatataatc

SEQ ID NO: 105004 - DNA, 25 bp, Artificial sequence
  SiRNA target sequence
tgagtcgaacatacaaatataatca

SEQ ID NO: 105005 - DNA, 25 bp, Artificial sequence
  SiRNA target sequence
gagtcgaacatacaaatataatcat

SEQ ID NO: 105006 - DNA, 25 bp, Artificial sequence
  SiRNA target sequence
agtcgaacatacaaatataatcata

SEQ ID NO: 105007 - DNA, 25 bp, Artificial sequence
  SiRNA target sequence
gtcgaacatacaaatataatcatat

SEQ ID NO: 105008 - DNA, 25 bp, Artificial sequence
  SiRNA target sequence
tcgaacatacaaatataatcatatc

SEQ ID NO: 105009 - DNA, 25 bp, Artificial sequence
  SiRNA target sequence
cgaacatacaaatataatcatatca

SEQ ID NO: 105010 - DNA, 25 bp, Artificial sequence
  SiRNA target sequence
gaacatacaaatataatcatatcaa

SEQ ID NO: 105011 - DNA, 25 bp, Artificial sequence
  SiRNA target sequence
aacatacaaatataatcatatcaat

SEQ ID NO: 105012 - DNA, 25 bp, Artificial sequence
  SiRNA target sequence
acatacaaatataatcatatcaata

SEQ ID NO: 105013 - DNA, 25 bp, Artificial sequence
  SiRNA target sequence
catacaaatataatcatatcaatat

SEQ ID NO: 105014 - DNA, 25 bp, Artificial sequence
  SiRNA target sequence
atacaaatataatcatatcaatatc

SEQ ID NO: 105015 - DNA, 25 bp, Artificial sequence
  SiRNA target sequence
tacaaatataatcatatcaatatct

SEQ ID NO: 105016 - DNA, 25 bp, Artificial sequence
  SiRNA target sequence
acaaatataatcatatcaatatcta

SEQ ID NO: 105017 - DNA, 25 bp, Artificial sequence
  SiRNA target sequence
caaatataatcatatcaatatctaa

SEQ ID NO: 105018 - DNA, 25 bp, Artificial sequence
  SiRNA target sequence
aaatataatcatatcaatatctaat

SEQ ID NO: 105019 - DNA, 25 bp, Artificial sequence
  SiRNA target sequence
aatataatcatatcaatatctaata

SEQ ID NO: 105020 - DNA, 25 bp, Artificial sequence
  SiRNA target sequence
atataatcatatcaatatctaatat

SEQ ID NO: 105021 - DNA, 25 bp, Artificial sequence
  SiRNA target sequence
tataatcatatcaatatctaatatt

SEQ ID NO: 105022 - DNA, 25 bp, Artificial sequence
  SiRNA target sequence
ataatcatatcaatatctaatattt

SEQ ID NO: 105023 - DNA, 25 bp, Artificial sequence
  SiRNA target sequence
taatcatatcaatatctaatatttt

SEQ ID NO: 105024 - DNA, 25 bp, Artificial sequence
  SiRNA target sequence
aatcatatcaatatctaatattttt

SEQ ID NO: 105025 - DNA, 25 bp, Artificial sequence
  SiRNA target sequence
atcatatcaatatctaatatttttt

SEQ ID NO: 105026 - DNA, 25 bp, Artificial sequence
  SiRNA target sequence
tcatatcaatatctaatattttttc

SEQ ID NO: 105027 - DNA, 25 bp, Artificial sequence
  SiRNA target sequence
catatcaatatctaatattttttcg

SEQ ID NO: 105028 - DNA, 25 bp, Artificial sequence
  SiRNA target sequence
atatcaatatctaatattttttcga

SEQ ID NO: 105029 - DNA, 25 bp, Artificial sequence
  SiRNA target sequence
tatcaatatctaatattttttcgaa

SEQ ID NO: 105030 - DNA, 25 bp, Artificial sequence
  SiRNA target sequence
atcaatatctaatattttttcgaaa

SEQ ID NO: 105031 - DNA, 25 bp, Artificial sequence
  SiRNA target sequence
tcaatatctaatattttttcgaaat

SEQ ID NO: 105032 - DNA, 25 bp, Artificial sequence
  SiRNA target sequence
caatatctaatattttttcgaaatc

SEQ ID NO: 105033 - DNA, 25 bp, Artificial sequence
  SiRNA target sequence
aatatctaatattttttcgaaatca

SEQ ID NO: 105034 - DNA, 25 bp, Artificial sequence
  SiRNA target sequence
atatctaatattttttcgaaatcaa

SEQ ID NO: 105035 - DNA, 25 bp, Artificial sequence
  SiRNA target sequence
tatctaatattttttcgaaatcaaa

SEQ ID NO: 105036 - DNA, 25 bp, Artificial sequence
  SiRNA target sequence
atctaatattttttcgaaatcaaaa

SEQ ID NO: 105037 - DNA, 25 bp, Artificial sequence
  SiRNA target sequence
tctaatattttttcgaaatcaaaac

SEQ ID NO: 105038 - DNA, 25 bp, Artificial sequence
  SiRNA target sequence
ctaatattttttcgaaatcaaaact

SEQ ID NO: 105039 - DNA, 25 bp, Artificial sequence
  SiRNA target sequence
taatattttttcgaaatcaaaactg

SEQ ID NO: 105040 - DNA, 25 bp, Artificial sequence
  SiRNA target sequence
aatattttttcgaaatcaaaactgt

SEQ ID NO: 105041 - DNA, 25 bp, Artificial sequence
  SiRNA target sequence
atattttttcgaaatcaaaactgtc

SEQ ID NO: 105042 - DNA, 25 bp, Artificial sequence
  SiRNA target sequence
tattttttcgaaatcaaaactgtcc

SEQ ID NO: 105043 - DNA, 25 bp, Artificial sequence
  SiRNA target sequence
attttttcgaaatcaaaactgtcca

SEQ ID NO: 105044 - DNA, 25 bp, Artificial sequence
  SiRNA target sequence
ttttttcgaaatcaaaactgtccat

SEQ ID NO: 105045 - DNA, 25 bp, Artificial sequence
  SiRNA target sequence
tttttcgaaatcaaaactgtccata

SEQ ID NO: 105046 - DNA, 25 bp, Artificial sequence
  SiRNA target sequence
ttttcgaaatcaaaactgtccatat

SEQ ID NO: 105047 - DNA, 25 bp, Artificial sequence
  SiRNA target sequence
tttcgaaatcaaaactgtccatatc

SEQ ID NO: 105048 - DNA, 25 bp, Artificial sequence
  SiRNA target sequence
ttcgaaatcaaaactgtccatatct

SEQ ID NO: 105049 - DNA, 25 bp, Artificial sequence
  SiRNA target sequence
tcgaaatcaaaactgtccatatcta

SEQ ID NO: 105050 - DNA, 25 bp, Artificial sequence
  SiRNA target sequence
cgaaatcaaaactgtccatatctaa

SEQ ID NO: 105051 - DNA, 25 bp, Artificial sequence
  SiRNA target sequence
gaaatcaaaactgtccatatctaaa

SEQ ID NO: 105052 - DNA, 25 bp, Artificial sequence
  SiRNA target sequence
aaatcaaaactgtccatatctaaag

SEQ ID NO: 105053 - DNA, 25 bp, Artificial sequence
  SiRNA target sequence
aatcaaaactgtccatatctaaagt

SEQ ID NO: 105054 - DNA, 25 bp, Artificial sequence
  SiRNA target sequence
atcaaaactgtccatatctaaagta

SEQ ID NO: 105055 - DNA, 25 bp, Artificial sequence
  SiRNA target sequence
tcaaaactgtccatatctaaagtaa

SEQ ID NO: 105056 - DNA, 25 bp, Artificial sequence
  SiRNA target sequence
caaaactgtccatatctaaagtaaa

SEQ ID NO: 105057 - DNA, 25 bp, Artificial sequence
  SiRNA target sequence
aaaactgtccatatctaaagtaaaa

SEQ ID NO: 105058 - DNA, 25 bp, Artificial sequence
  SiRNA target sequence
aaactgtccatatctaaagtaaaat

SEQ ID NO: 105059 - DNA, 25 bp, Artificial sequence
  SiRNA target sequence
aactgtccatatctaaagtaaaatc

SEQ ID NO: 105060 - DNA, 25 bp, Artificial sequence
  SiRNA target sequence
actgtccatatctaaagtaaaatct

SEQ ID NO: 105061 - DNA, 25 bp, Artificial sequence
  SiRNA target sequence
ctgtccatatctaaagtaaaatctg

SEQ ID NO: 105062 - DNA, 25 bp, Artificial sequence
  SiRNA target sequence
tgtccatatctaaagtaaaatctgt

SEQ ID NO: 105063 - DNA, 25 bp, Artificial sequence
  SiRNA target sequence
gtccatatctaaagtaaaatctgtt

SEQ ID NO: 105064 - DNA, 25 bp, Artificial sequence
  SiRNA target sequence
tccatatctaaagtaaaatctgttg

SEQ ID NO: 105065 - DNA, 25 bp, Artificial sequence
  SiRNA target sequence
ccatatctaaagtaaaatctgttgg

SEQ ID NO: 105066 - DNA, 25 bp, Artificial sequence
  SiRNA target sequence
catatctaaagtaaaatctgttgga

SEQ ID NO: 105067 - DNA, 25 bp, Artificial sequence
  SiRNA target sequence
atatctaaagtaaaatctgttggaa

SEQ ID NO: 105068 - DNA, 25 bp, Artificial sequence
  SiRNA target sequence
tatctaaagtaaaatctgttggaag

SEQ ID NO: 105069 - DNA, 25 bp, Artificial sequence
  SiRNA target sequence
atctaaagtaaaatctgttggaagc

SEQ ID NO: 105070 - DNA, 25 bp, Artificial sequence
  SiRNA target sequence
tctaaagtaaaatctgttggaagca

SEQ ID NO: 105071 - DNA, 25 bp, Artificial sequence
  SiRNA target sequence
ctaaagtaaaatctgttggaagcaa

SEQ ID NO: 105072 - DNA, 25 bp, Artificial sequence
  SiRNA target sequence
taaagtaaaatctgttggaagcaat

SEQ ID NO: 105073 - DNA, 25 bp, Artificial sequence
  SiRNA target sequence
aaagtaaaatctgttggaagcaatt

SEQ ID NO: 105074 - DNA, 25 bp, Artificial sequence
  SiRNA target sequence
aagtaaaatctgttggaagcaattc

SEQ ID NO: 105075 - DNA, 25 bp, Artificial sequence
  SiRNA target sequence
agtaaaatctgttggaagcaattct

SEQ ID NO: 105076 - DNA, 25 bp, Artificial sequence
  SiRNA target sequence
gtaaaatctgttggaagcaattctt

SEQ ID NO: 105077 - DNA, 25 bp, Artificial sequence
  SiRNA target sequence
taaaatctgttggaagcaattcttt

SEQ ID NO: 105078 - DNA, 25 bp, Artificial sequence
  SiRNA target sequence
aaaatctgttggaagcaattcttta

SEQ ID NO: 105079 - DNA, 25 bp, Artificial sequence
  SiRNA target sequence
aaatctgttggaagcaattctttat

SEQ ID NO: 105080 - DNA, 25 bp, Artificial sequence
  SiRNA target sequence
aatctgttggaagcaattctttatc

SEQ ID NO: 105081 - DNA, 25 bp, Artificial sequence
  SiRNA target sequence
atctgttggaagcaattctttatca

SEQ ID NO: 105082 - DNA, 25 bp, Artificial sequence
  SiRNA target sequence
tctgttggaagcaattctttatcaa

SEQ ID NO: 105083 - DNA, 25 bp, Artificial sequence
  SiRNA target sequence
ctgttggaagcaattctttatcaac

SEQ ID NO: 105084 - DNA, 25 bp, Artificial sequence
  SiRNA target sequence
tgttggaagcaattctttatcaacg

SEQ ID NO: 105085 - DNA, 25 bp, Artificial sequence
  SiRNA target sequence
gttggaagcaattctttatcaacgt

SEQ ID NO: 105086 - DNA, 25 bp, Artificial sequence
  SiRNA target sequence
ttggaagcaattctttatcaacgtt

SEQ ID NO: 105087 - DNA, 25 bp, Artificial sequence
  SiRNA target sequence
tggaagcaattctttatcaacgtta

SEQ ID NO: 105088 - DNA, 25 bp, Artificial sequence
  SiRNA target sequence
ggaagcaattctttatcaacgttat

SEQ ID NO: 105089 - DNA, 25 bp, Artificial sequence
  SiRNA target sequence
gaagcaattctttatcaacgttata

SEQ ID NO: 105090 - DNA, 25 bp, Artificial sequence
  SiRNA target sequence
aagcaattctttatcaacgttataa

SEQ ID NO: 105091 - DNA, 25 bp, Artificial sequence
  SiRNA target sequence
agcaattctttatcaacgttataaa

SEQ ID NO: 105092 - DNA, 25 bp, Artificial sequence
  SiRNA target sequence
gcaattctttatcaacgttataaat

SEQ ID NO: 105093 - DNA, 25 bp, Artificial sequence
  SiRNA target sequence
caattctttatcaacgttataaatc

SEQ ID NO: 105094 - DNA, 25 bp, Artificial sequence
  SiRNA target sequence
aattctttatcaacgttataaatca

SEQ ID NO: 105095 - DNA, 25 bp, Artificial sequence
  SiRNA target sequence
attctttatcaacgttataaatcaa

SEQ ID NO: 105096 - DNA, 25 bp, Artificial sequence
  SiRNA target sequence
ttctttatcaacgttataaatcaaa

SEQ ID NO: 105097 - DNA, 25 bp, Artificial sequence
  SiRNA target sequence
tctttatcaacgttataaatcaaat

SEQ ID NO: 105098 - DNA, 25 bp, Artificial sequence
  SiRNA target sequence
ctttatcaacgttataaatcaaatc

SEQ ID NO: 105099 - DNA, 25 bp, Artificial sequence
  SiRNA target sequence
tttatcaacgttataaatcaaatct

SEQ ID NO: 105100 - DNA, 25 bp, Artificial sequence
  SiRNA target sequence
ttatcaacgttataaatcaaatctt

SEQ ID NO: 105101 - DNA, 25 bp, Artificial sequence
  SiRNA target sequence
tatcaacgttataaatcaaatcttt

SEQ ID NO: 105102 - DNA, 25 bp, Artificial sequence
  SiRNA target sequence
atcaacgttataaatcaaatcttta

SEQ ID NO: 105103 - DNA, 25 bp, Artificial sequence
  SiRNA target sequence
tcaacgttataaatcaaatctttat

SEQ ID NO: 105104 - DNA, 25 bp, Artificial sequence
  SiRNA target sequence
caacgttataaatcaaatctttatt

SEQ ID NO: 105105 - DNA, 25 bp, Artificial sequence
  SiRNA target sequence
aacgttataaatcaaatctttattg

SEQ ID NO: 105106 - DNA, 25 bp, Artificial sequence
  SiRNA target sequence
acgttataaatcaaatctttattgt

SEQ ID NO: 105107 - DNA, 25 bp, Artificial sequence
  SiRNA target sequence
cgttataaatcaaatctttattgta

SEQ ID NO: 105108 - DNA, 25 bp, Artificial sequence
  SiRNA target sequence
gttataaatcaaatctttattgtat

SEQ ID NO: 105109 - DNA, 25 bp, Artificial sequence
  SiRNA target sequence
ttataaatcaaatctttattgtatc

SEQ ID NO: 105110 - DNA, 25 bp, Artificial sequence
  SiRNA target sequence
tataaatcaaatctttattgtatcc

SEQ ID NO: 105111 - DNA, 25 bp, Artificial sequence
  SiRNA target sequence
ataaatcaaatctttattgtatccg

SEQ ID NO: 105112 - DNA, 25 bp, Artificial sequence
  SiRNA target sequence
taaatcaaatctttattgtatccgt

SEQ ID NO: 105113 - DNA, 25 bp, Artificial sequence
  SiRNA target sequence
aaatcaaatctttattgtatccgta

SEQ ID NO: 105114 - DNA, 25 bp, Artificial sequence
  SiRNA target sequence
aatcaaatctttattgtatccgtat

SEQ ID NO: 105115 - DNA, 25 bp, Artificial sequence
  SiRNA target sequence
atcaaatctttattgtatccgtata

SEQ ID NO: 105116 - DNA, 25 bp, Artificial sequence
  SiRNA target sequence
tcaaatctttattgtatccgtatag

SEQ ID NO: 105117 - DNA, 25 bp, Artificial sequence
  SiRNA target sequence
caaatctttattgtatccgtatagt

SEQ ID NO: 105118 - DNA, 25 bp, Artificial sequence
  SiRNA target sequence
aaatctttattgtatccgtatagta

SEQ ID NO: 105119 - DNA, 25 bp, Artificial sequence
  SiRNA target sequence
aatctttattgtatccgtatagtat

SEQ ID NO: 105120 - DNA, 25 bp, Artificial sequence
  SiRNA target sequence
atctttattgtatccgtatagtata

SEQ ID NO: 105121 - DNA, 25 bp, Artificial sequence
  SiRNA target sequence
tctttattgtatccgtatagtataa

SEQ ID NO: 105122 - DNA, 25 bp, Artificial sequence
  SiRNA target sequence
ctttattgtatccgtatagtataac

SEQ ID NO: 105123 - DNA, 25 bp, Artificial sequence
  SiRNA target sequence
tttattgtatccgtatagtataaca

SEQ ID NO: 105124 - DNA, 25 bp, Artificial sequence
  SiRNA target sequence
ttattgtatccgtatagtataacat

SEQ ID NO: 105125 - DNA, 25 bp, Artificial sequence
  SiRNA target sequence
tattgtatccgtatagtataacatt

SEQ ID NO: 105126 - DNA, 25 bp, Artificial sequence
  SiRNA target sequence
attgtatccgtatagtataacattt

SEQ ID NO: 105127 - DNA, 25 bp, Artificial sequence
  SiRNA target sequence
ttgtatccgtatagtataacatttt

SEQ ID NO: 105128 - DNA, 25 bp, Artificial sequence
  SiRNA target sequence
tgtatccgtatagtataacattttg

SEQ ID NO: 105129 - DNA, 25 bp, Artificial sequence
  SiRNA target sequence
gtatccgtatagtataacattttga

SEQ ID NO: 105130 - DNA, 25 bp, Artificial sequence
  SiRNA target sequence
tatccgtatagtataacattttgaa

SEQ ID NO: 105131 - DNA, 25 bp, Artificial sequence
  SiRNA target sequence
atccgtatagtataacattttgaat

SEQ ID NO: 105132 - DNA, 25 bp, Artificial sequence
  SiRNA target sequence
tccgtatagtataacattttgaata

SEQ ID NO: 105133 - DNA, 25 bp, Artificial sequence
  SiRNA target sequence
ccgtatagtataacattttgaataa

SEQ ID NO: 105134 - DNA, 25 bp, Artificial sequence
  SiRNA target sequence
cgtatagtataacattttgaataag

SEQ ID NO: 105135 - DNA, 25 bp, Artificial sequence
  SiRNA target sequence
gtatagtataacattttgaataagt

SEQ ID NO: 105136 - DNA, 25 bp, Artificial sequence
  SiRNA target sequence
tatagtataacattttgaataagtt

SEQ ID NO: 105137 - DNA, 25 bp, Artificial sequence
  SiRNA target sequence
atagtataacattttgaataagttt

SEQ ID NO: 105138 - DNA, 25 bp, Artificial sequence
  SiRNA target sequence
tagtataacattttgaataagttta

SEQ ID NO: 105139 - DNA, 25 bp, Artificial sequence
  SiRNA target sequence
agtataacattttgaataagtttag

SEQ ID NO: 105140 - DNA, 25 bp, Artificial sequence
  SiRNA target sequence
gtataacattttgaataagtttagc

SEQ ID NO: 105141 - DNA, 25 bp, Artificial sequence
  SiRNA target sequence
tataacattttgaataagtttagca

SEQ ID NO: 105142 - DNA, 25 bp, Artificial sequence
  SiRNA target sequence
ataacattttgaataagtttagcaa

SEQ ID NO: 105143 - DNA, 25 bp, Artificial sequence
  SiRNA target sequence
taacattttgaataagtttagcaat

SEQ ID NO: 105144 - DNA, 25 bp, Artificial sequence
  SiRNA target sequence
aacattttgaataagtttagcaata

SEQ ID NO: 105145 - DNA, 25 bp, Artificial sequence
  SiRNA target sequence
acattttgaataagtttagcaatat

SEQ ID NO: 105146 - DNA, 25 bp, Artificial sequence
  SiRNA target sequence
cattttgaataagtttagcaatatg

SEQ ID NO: 105147 - DNA, 25 bp, Artificial sequence
  SiRNA target sequence
attttgaataagtttagcaatatgt

SEQ ID NO: 105148 - DNA, 25 bp, Artificial sequence
  SiRNA target sequence
ttttgaataagtttagcaatatgta

SEQ ID NO: 105149 - DNA, 25 bp, Artificial sequence
  SiRNA target sequence
tttgaataagtttagcaatatgtat

SEQ ID NO: 105150 - DNA, 25 bp, Artificial sequence
  SiRNA target sequence
ttgaataagtttagcaatatgtata

SEQ ID NO: 105151 - DNA, 25 bp, Artificial sequence
  SiRNA target sequence
tgaataagtttagcaatatgtatag

SEQ ID NO: 105152 - DNA, 25 bp, Artificial sequence
  SiRNA target sequence
gaataagtttagcaatatgtataga

SEQ ID NO: 105153 - DNA, 25 bp, Artificial sequence
  SiRNA target sequence
aataagtttagcaatatgtatagaa

SEQ ID NO: 105154 - DNA, 25 bp, Artificial sequence
  SiRNA target sequence
ataagtttagcaatatgtatagaat

SEQ ID NO: 105155 - DNA, 25 bp, Artificial sequence
  SiRNA target sequence
taagtttagcaatatgtatagaatt

SEQ ID NO: 105156 - DNA, 25 bp, Artificial sequence
  SiRNA target sequence
aagtttagcaatatgtatagaattt

SEQ ID NO: 105157 - DNA, 25 bp, Artificial sequence
  SiRNA target sequence
agtttagcaatatgtatagaatttc

SEQ ID NO: 105158 - DNA, 25 bp, Artificial sequence
  SiRNA target sequence
gtttagcaatatgtatagaatttcc

SEQ ID NO: 105159 - DNA, 25 bp, Artificial sequence
  SiRNA target sequence
tttagcaatatgtatagaatttcct

SEQ ID NO: 105160 - DNA, 25 bp, Artificial sequence
  SiRNA target sequence
ttagcaatatgtatagaatttcctg

SEQ ID NO: 105161 - DNA, 25 bp, Artificial sequence
  SiRNA target sequence
tagcaatatgtatagaatttcctgt

SEQ ID NO: 105162 - DNA, 25 bp, Artificial sequence
  SiRNA target sequence
agcaatatgtatagaatttcctgtt

SEQ ID NO: 105163 - DNA, 25 bp, Artificial sequence
  SiRNA target sequence
gcaatatgtatagaatttcctgttt

SEQ ID NO: 105164 - DNA, 25 bp, Artificial sequence
  SiRNA target sequence
caatatgtatagaatttcctgtttg

SEQ ID NO: 105165 - DNA, 25 bp, Artificial sequence
  SiRNA target sequence
aatatgtatagaatttcctgtttgg

SEQ ID NO: 105166 - DNA, 25 bp, Artificial sequence
  SiRNA target sequence
atatgtatagaatttcctgtttggg

SEQ ID NO: 105167 - DNA, 25 bp, Artificial sequence
  SiRNA target sequence
tatgtatagaatttcctgtttggga

SEQ ID NO: 105168 - DNA, 25 bp, Artificial sequence
  SiRNA target sequence
atgtatagaatttcctgtttgggag

SEQ ID NO: 105169 - DNA, 25 bp, Artificial sequence
  SiRNA target sequence
tgtatagaatttcctgtttgggagc

SEQ ID NO: 105170 - DNA, 25 bp, Artificial sequence
  SiRNA target sequence
gtatagaatttcctgtttgggagcc

SEQ ID NO: 105171 - DNA, 25 bp, Artificial sequence
  SiRNA target sequence
tatagaatttcctgtttgggagcca

SEQ ID NO: 105172 - DNA, 25 bp, Artificial sequence
  SiRNA target sequence
atagaatttcctgtttgggagccat

SEQ ID NO: 105173 - DNA, 25 bp, Artificial sequence
  SiRNA target sequence
tagaatttcctgtttgggagccata

SEQ ID NO: 105174 - DNA, 25 bp, Artificial sequence
  SiRNA target sequence
agaatttcctgtttgggagccatat

SEQ ID NO: 105175 - DNA, 25 bp, Artificial sequence
  SiRNA target sequence
gaatttcctgtttgggagccatata

SEQ ID NO: 105176 - DNA, 25 bp, Artificial sequence
  SiRNA target sequence
aatttcctgtttgggagccatataa

SEQ ID NO: 105177 - DNA, 25 bp, Artificial sequence
  SiRNA target sequence
atttcctgtttgggagccatataag

SEQ ID NO: 105178 - DNA, 25 bp, Artificial sequence
  SiRNA target sequence
tttcctgtttgggagccatataaga

SEQ ID NO: 105179 - DNA, 25 bp, Artificial sequence
  SiRNA target sequence
ttcctgtttgggagccatataagat

SEQ ID NO: 105180 - DNA, 25 bp, Artificial sequence
  SiRNA target sequence
tcctgtttgggagccatataagatt

SEQ ID NO: 105181 - DNA, 25 bp, Artificial sequence
  SiRNA target sequence
cctgtttgggagccatataagatta

SEQ ID NO: 105182 - DNA, 25 bp, Artificial sequence
  SiRNA target sequence
ctgtttgggagccatataagattat

SEQ ID NO: 105183 - DNA, 25 bp, Artificial sequence
  SiRNA target sequence
tgtttgggagccatataagattatc

SEQ ID NO: 105184 - DNA, 25 bp, Artificial sequence
  SiRNA target sequence
gtttgggagccatataagattatca

SEQ ID NO: 105185 - DNA, 25 bp, Artificial sequence
  SiRNA target sequence
tttgggagccatataagattatcat

SEQ ID NO: 105186 - DNA, 26 bp, Artificial sequence
  SiRNA target sequence
ttaccaagtttctgcctgaaaatata

SEQ ID NO: 105187 - DNA, 26 bp, Artificial sequence
  SiRNA target sequence
taccaagtttctgcctgaaaatatat

SEQ ID NO: 105188 - DNA, 26 bp, Artificial sequence
  SiRNA target sequence
accaagtttctgcctgaaaatatatt

SEQ ID NO: 105189 - DNA, 26 bp, Artificial sequence
  SiRNA target sequence
ccaagtttctgcctgaaaatatattt

SEQ ID NO: 105190 - DNA, 26 bp, Artificial sequence
  SiRNA target sequence
caagtttctgcctgaaaatatatttt

SEQ ID NO: 105191 - DNA, 26 bp, Artificial sequence
  SiRNA target sequence
aagtttctgcctgaaaatatattttc

SEQ ID NO: 105192 - DNA, 26 bp, Artificial sequence
  SiRNA target sequence
agtttctgcctgaaaatatattttct

SEQ ID NO: 105193 - DNA, 26 bp, Artificial sequence
  SiRNA target sequence
gtttctgcctgaaaatatattttctt

SEQ ID NO: 105194 - DNA, 26 bp, Artificial sequence
  SiRNA target sequence
tttctgcctgaaaatatattttcttt

SEQ ID NO: 105195 - DNA, 26 bp, Artificial sequence
  SiRNA target sequence
ttctgcctgaaaatatattttctttt

SEQ ID NO: 105196 - DNA, 26 bp, Artificial sequence
  SiRNA target sequence
tctgcctgaaaatatattttcttttt

SEQ ID NO: 105197 - DNA, 26 bp, Artificial sequence
  SiRNA target sequence
ctgcctgaaaatatattttcttttta

SEQ ID NO: 105198 - DNA, 26 bp, Artificial sequence
  SiRNA target sequence
tgcctgaaaatatattttctttttat

SEQ ID NO: 105199 - DNA, 26 bp, Artificial sequence
  SiRNA target sequence
gcctgaaaatatattttctttttata

SEQ ID NO: 105200 - DNA, 26 bp, Artificial sequence
  SiRNA target sequence
cctgaaaatatattttctttttataa

SEQ ID NO: 105201 - DNA, 26 bp, Artificial sequence
  SiRNA target sequence
ctgaaaatatattttctttttataaa

SEQ ID NO: 105202 - DNA, 26 bp, Artificial sequence
  SiRNA target sequence
tgaaaatatattttctttttataaat

SEQ ID NO: 105203 - DNA, 26 bp, Artificial sequence
  SiRNA target sequence
gaaaatatattttctttttataaata

SEQ ID NO: 105204 - DNA, 26 bp, Artificial sequence
  SiRNA target sequence
aaaatatattttctttttataaatat

SEQ ID NO: 105205 - DNA, 26 bp, Artificial sequence
  SiRNA target sequence
aaatatattttctttttataaatatc

SEQ ID NO: 105206 - DNA, 26 bp, Artificial sequence
  SiRNA target sequence
aatatattttctttttataaatatct

SEQ ID NO: 105207 - DNA, 26 bp, Artificial sequence
  SiRNA target sequence
atatattttctttttataaatatcta

SEQ ID NO: 105208 - DNA, 26 bp, Artificial sequence
  SiRNA target sequence
tatattttctttttataaatatctaa

SEQ ID NO: 105209 - DNA, 26 bp, Artificial sequence
  SiRNA target sequence
atattttctttttataaatatctaat

SEQ ID NO: 105210 - DNA, 26 bp, Artificial sequence
  SiRNA target sequence
tattttctttttataaatatctaata

SEQ ID NO: 105211 - DNA, 26 bp, Artificial sequence
  SiRNA target sequence
attttctttttataaatatctaataa

SEQ ID NO: 105212 - DNA, 26 bp, Artificial sequence
  SiRNA target sequence
ttttctttttataaatatctaataac

SEQ ID NO: 105213 - DNA, 26 bp, Artificial sequence
  SiRNA target sequence
tttctttttataaatatctaataaca

SEQ ID NO: 105214 - DNA, 26 bp, Artificial sequence
  SiRNA target sequence
ttctttttataaatatctaataacat

SEQ ID NO: 105215 - DNA, 26 bp, Artificial sequence
  SiRNA target sequence
tctttttataaatatctaataacatt

SEQ ID NO: 105216 - DNA, 26 bp, Artificial sequence
  SiRNA target sequence
ctttttataaatatctaataacattt

SEQ ID NO: 105217 - DNA, 26 bp, Artificial sequence
  SiRNA target sequence
tttttataaatatctaataacatttt

SEQ ID NO: 105218 - DNA, 26 bp, Artificial sequence
  SiRNA target sequence
ttttataaatatctaataacattttt

SEQ ID NO: 105219 - DNA, 26 bp, Artificial sequence
  SiRNA target sequence
tttataaatatctaataacatttttt

SEQ ID NO: 105220 - DNA, 26 bp, Artificial sequence
  SiRNA target sequence
ttataaatatctaataacattttttc

SEQ ID NO: 105221 - DNA, 26 bp, Artificial sequence
  SiRNA target sequence
tataaatatctaataacattttttca

SEQ ID NO: 105222 - DNA, 26 bp, Artificial sequence
  SiRNA target sequence
ataaatatctaataacattttttcaa

SEQ ID NO: 105223 - DNA, 26 bp, Artificial sequence
  SiRNA target sequence
taaatatctaataacattttttcaat

SEQ ID NO: 105224 - DNA, 26 bp, Artificial sequence
  SiRNA target sequence
aaatatctaataacattttttcaata

SEQ ID NO: 105225 - DNA, 26 bp, Artificial sequence
  SiRNA target sequence
aatatctaataacattttttcaataa

SEQ ID NO: 105226 - DNA, 26 bp, Artificial sequence
  SiRNA target sequence
atatctaataacattttttcaataat

SEQ ID NO: 105227 - DNA, 26 bp, Artificial sequence
  SiRNA target sequence
tatctaataacattttttcaataata

SEQ ID NO: 105228 - DNA, 26 bp, Artificial sequence
  SiRNA target sequence
atctaataacattttttcaataatat

SEQ ID NO: 105229 - DNA, 26 bp, Artificial sequence
  SiRNA target sequence
tctaataacattttttcaataatatt

SEQ ID NO: 105230 - DNA, 26 bp, Artificial sequence
  SiRNA target sequence
ctaataacattttttcaataatatta

SEQ ID NO: 105231 - DNA, 26 bp, Artificial sequence
  SiRNA target sequence
taataacattttttcaataatattat

SEQ ID NO: 105232 - DNA, 26 bp, Artificial sequence
  SiRNA target sequence
aataacattttttcaataatattatt

SEQ ID NO: 105233 - DNA, 26 bp, Artificial sequence
  SiRNA target sequence
ataacattttttcaataatattatta

SEQ ID NO: 105234 - DNA, 26 bp, Artificial sequence
  SiRNA target sequence
taacattttttcaataatattattaa

SEQ ID NO: 105235 - DNA, 26 bp, Artificial sequence
  SiRNA target sequence
aacattttttcaataatattattaag

SEQ ID NO: 105236 - DNA, 26 bp, Artificial sequence
  SiRNA target sequence
acattttttcaataatattattaagt

SEQ ID NO: 105237 - DNA, 26 bp, Artificial sequence
  SiRNA target sequence
cattttttcaataatattattaagtc

SEQ ID NO: 105238 - DNA, 26 bp, Artificial sequence
  SiRNA target sequence
attttttcaataatattattaagtct

SEQ ID NO: 105239 - DNA, 26 bp, Artificial sequence
  SiRNA target sequence
ttttttcaataatattattaagtcta

SEQ ID NO: 105240 - DNA, 26 bp, Artificial sequence
  SiRNA target sequence
tttttcaataatattattaagtctag

SEQ ID NO: 105241 - DNA, 26 bp, Artificial sequence
  SiRNA target sequence
ttttcaataatattattaagtctaga

SEQ ID NO: 105242 - DNA, 26 bp, Artificial sequence
  SiRNA target sequence
tttcaataatattattaagtctagaa

SEQ ID NO: 105243 - DNA, 26 bp, Artificial sequence
  SiRNA target sequence
ttcaataatattattaagtctagaat

SEQ ID NO: 105244 - DNA, 26 bp, Artificial sequence
  SiRNA target sequence
tcaataatattattaagtctagaatt

SEQ ID NO: 105245 - DNA, 26 bp, Artificial sequence
  SiRNA target sequence
caataatattattaagtctagaattt

SEQ ID NO: 105246 - DNA, 26 bp, Artificial sequence
  SiRNA target sequence
aataatattattaagtctagaatttc

SEQ ID NO: 105247 - DNA, 26 bp, Artificial sequence
  SiRNA target sequence
ataatattattaagtctagaatttcc

SEQ ID NO: 105248 - DNA, 26 bp, Artificial sequence
  SiRNA target sequence
taatattattaagtctagaatttcca

SEQ ID NO: 105249 - DNA, 26 bp, Artificial sequence
  SiRNA target sequence
aatattattaagtctagaatttccac

SEQ ID NO: 105250 - DNA, 26 bp, Artificial sequence
  SiRNA target sequence
atattattaagtctagaatttccact

SEQ ID NO: 105251 - DNA, 26 bp, Artificial sequence
  SiRNA target sequence
tattattaagtctagaatttccactt

SEQ ID NO: 105252 - DNA, 26 bp, Artificial sequence
  SiRNA target sequence
attattaagtctagaatttccactta

SEQ ID NO: 105253 - DNA, 26 bp, Artificial sequence
  SiRNA target sequence
ttattaagtctagaatttccacttac

SEQ ID NO: 105254 - DNA, 26 bp, Artificial sequence
  SiRNA target sequence
tattaagtctagaatttccacttaca

SEQ ID NO: 105255 - DNA, 26 bp, Artificial sequence
  SiRNA target sequence
attaagtctagaatttccacttacaa

SEQ ID NO: 105256 - DNA, 26 bp, Artificial sequence
  SiRNA target sequence
ttaagtctagaatttccacttacaaa

SEQ ID NO: 105257 - DNA, 26 bp, Artificial sequence
  SiRNA target sequence
taagtctagaatttccacttacaaat

SEQ ID NO: 105258 - DNA, 26 bp, Artificial sequence
  SiRNA target sequence
aagtctagaatttccacttacaaata

SEQ ID NO: 105259 - DNA, 26 bp, Artificial sequence
  SiRNA target sequence
agtctagaatttccacttacaaatat

SEQ ID NO: 105260 - DNA, 26 bp, Artificial sequence
  SiRNA target sequence
gtctagaatttccacttacaaatatt

SEQ ID NO: 105261 - DNA, 26 bp, Artificial sequence
  SiRNA target sequence
tctagaatttccacttacaaatatta

SEQ ID NO: 105262 - DNA, 26 bp, Artificial sequence
  SiRNA target sequence
ctagaatttccacttacaaatattaa

SEQ ID NO: 105263 - DNA, 26 bp, Artificial sequence
  SiRNA target sequence
tagaatttccacttacaaatattaac

SEQ ID NO: 105264 - DNA, 26 bp, Artificial sequence
  SiRNA target sequence
agaatttccacttacaaatattaacc

SEQ ID NO: 105265 - DNA, 26 bp, Artificial sequence
  SiRNA target sequence
gaatttccacttacaaatattaacca

SEQ ID NO: 105266 - DNA, 26 bp, Artificial sequence
  SiRNA target sequence
aatttccacttacaaatattaaccaa

SEQ ID NO: 105267 - DNA, 26 bp, Artificial sequence
  SiRNA target sequence
atttccacttacaaatattaaccaat

SEQ ID NO: 105268 - DNA, 26 bp, Artificial sequence
  SiRNA target sequence
tttccacttacaaatattaaccaatc

SEQ ID NO: 105269 - DNA, 26 bp, Artificial sequence
  SiRNA target sequence
ttccacttacaaatattaaccaatca

SEQ ID NO: 105270 - DNA, 26 bp, Artificial sequence
  SiRNA target sequence
tccacttacaaatattaaccaatcat

SEQ ID NO: 105271 - DNA, 26 bp, Artificial sequence
  SiRNA target sequence
ccacttacaaatattaaccaatcatc

SEQ ID NO: 105272 - DNA, 26 bp, Artificial sequence
  SiRNA target sequence
cacttacaaatattaaccaatcatca

SEQ ID NO: 105273 - DNA, 26 bp, Artificial sequence
  SiRNA target sequence
acttacaaatattaaccaatcatcaa

SEQ ID NO: 105274 - DNA, 26 bp, Artificial sequence
  SiRNA target sequence
cttacaaatattaaccaatcatcaat

SEQ ID NO: 105275 - DNA, 26 bp, Artificial sequence
  SiRNA target sequence
ttacaaatattaaccaatcatcaata

SEQ ID NO: 105276 - DNA, 26 bp, Artificial sequence
  SiRNA target sequence
tacaaatattaaccaatcatcaatat

SEQ ID NO: 105277 - DNA, 26 bp, Artificial sequence
  SiRNA target sequence
acaaatattaaccaatcatcaatatt

SEQ ID NO: 105278 - DNA, 26 bp, Artificial sequence
  SiRNA target sequence
caaatattaaccaatcatcaatattt

SEQ ID NO: 105279 - DNA, 26 bp, Artificial sequence
  SiRNA target sequence
aaatattaaccaatcatcaatatttt

SEQ ID NO: 105280 - DNA, 26 bp, Artificial sequence
  SiRNA target sequence
aatattaaccaatcatcaatattttc

SEQ ID NO: 105281 - DNA, 26 bp, Artificial sequence
  SiRNA target sequence
atattaaccaatcatcaatattttct

SEQ ID NO: 105282 - DNA, 26 bp, Artificial sequence
  SiRNA target sequence
tattaaccaatcatcaatattttcta

SEQ ID NO: 105283 - DNA, 26 bp, Artificial sequence
  SiRNA target sequence
attaaccaatcatcaatattttctag

SEQ ID NO: 105284 - DNA, 26 bp, Artificial sequence
  SiRNA target sequence
ttaaccaatcatcaatattttctagc

SEQ ID NO: 105285 - DNA, 26 bp, Artificial sequence
  SiRNA target sequence
taaccaatcatcaatattttctagcc

SEQ ID NO: 105286 - DNA, 26 bp, Artificial sequence
  SiRNA target sequence
aaccaatcatcaatattttctagccc

SEQ ID NO: 105287 - DNA, 26 bp, Artificial sequence
  SiRNA target sequence
accaatcatcaatattttctagccct

SEQ ID NO: 105288 - DNA, 26 bp, Artificial sequence
  SiRNA target sequence
ccaatcatcaatattttctagccctt

SEQ ID NO: 105289 - DNA, 26 bp, Artificial sequence
  SiRNA target sequence
caatcatcaatattttctagcccttt

SEQ ID NO: 105290 - DNA, 26 bp, Artificial sequence
  SiRNA target sequence
aatcatcaatattttctagccctttt

SEQ ID NO: 105291 - DNA, 26 bp, Artificial sequence
  SiRNA target sequence
atcatcaatattttctagccctttta

SEQ ID NO: 105292 - DNA, 26 bp, Artificial sequence
  SiRNA target sequence
tcatcaatattttctagcccttttat

SEQ ID NO: 105293 - DNA, 26 bp, Artificial sequence
  SiRNA target sequence
catcaatattttctagcccttttata

SEQ ID NO: 105294 - DNA, 26 bp, Artificial sequence
  SiRNA target sequence
atcaatattttctagcccttttatag

SEQ ID NO: 105295 - DNA, 26 bp, Artificial sequence
  SiRNA target sequence
tcaatattttctagcccttttatagt

SEQ ID NO: 105296 - DNA, 26 bp, Artificial sequence
  SiRNA target sequence
caatattttctagcccttttatagtc

SEQ ID NO: 105297 - DNA, 26 bp, Artificial sequence
  SiRNA target sequence
aatattttctagcccttttatagtct

SEQ ID NO: 105298 - DNA, 26 bp, Artificial sequence
  SiRNA target sequence
atattttctagcccttttatagtctt

SEQ ID NO: 105299 - DNA, 26 bp, Artificial sequence
  SiRNA target sequence
tattttctagcccttttatagtctta

SEQ ID NO: 105300 - DNA, 26 bp, Artificial sequence
  SiRNA target sequence
attttctagcccttttatagtcttat

SEQ ID NO: 105301 - DNA, 26 bp, Artificial sequence
  SiRNA target sequence
ttttctagcccttttatagtcttata

SEQ ID NO: 105302 - DNA, 26 bp, Artificial sequence
  SiRNA target sequence
tttctagcccttttatagtcttataa

SEQ ID NO: 105303 - DNA, 26 bp, Artificial sequence
  SiRNA target sequence
ttctagcccttttatagtcttataaa

SEQ ID NO: 105304 - DNA, 26 bp, Artificial sequence
  SiRNA target sequence
tctagcccttttatagtcttataaat

SEQ ID NO: 105305 - DNA, 26 bp, Artificial sequence
  SiRNA target sequence
ctagcccttttatagtcttataaata

SEQ ID NO: 105306 - DNA, 26 bp, Artificial sequence
  SiRNA target sequence
tagcccttttatagtcttataaatat

SEQ ID NO: 105307 - DNA, 26 bp, Artificial sequence
  SiRNA target sequence
agcccttttatagtcttataaatatc

SEQ ID NO: 105308 - DNA, 26 bp, Artificial sequence
  SiRNA target sequence
gcccttttatagtcttataaatatct

SEQ ID NO: 105309 - DNA, 26 bp, Artificial sequence
  SiRNA target sequence
cccttttatagtcttataaatatctt

SEQ ID NO: 105310 - DNA, 26 bp, Artificial sequence
  SiRNA target sequence
ccttttatagtcttataaatatcttg

SEQ ID NO: 105311 - DNA, 26 bp, Artificial sequence
  SiRNA target sequence
cttttatagtcttataaatatcttgt

SEQ ID NO: 105312 - DNA, 26 bp, Artificial sequence
  SiRNA target sequence
ttttatagtcttataaatatcttgta

SEQ ID NO: 105313 - DNA, 26 bp, Artificial sequence
  SiRNA target sequence
tttatagtcttataaatatcttgtat

SEQ ID NO: 105314 - DNA, 26 bp, Artificial sequence
  SiRNA target sequence
ttatagtcttataaatatcttgtatg

SEQ ID NO: 105315 - DNA, 26 bp, Artificial sequence
  SiRNA target sequence
tatagtcttataaatatcttgtatgt

SEQ ID NO: 105316 - DNA, 26 bp, Artificial sequence
  SiRNA target sequence
atagtcttataaatatcttgtatgta

SEQ ID NO: 105317 - DNA, 26 bp, Artificial sequence
  SiRNA target sequence
tagtcttataaatatcttgtatgtat

SEQ ID NO: 105318 - DNA, 26 bp, Artificial sequence
  SiRNA target sequence
agtcttataaatatcttgtatgtatt

SEQ ID NO: 105319 - DNA, 26 bp, Artificial sequence
  SiRNA target sequence
gtcttataaatatcttgtatgtattt

SEQ ID NO: 105320 - DNA, 26 bp, Artificial sequence
  SiRNA target sequence
tcttataaatatcttgtatgtattta

SEQ ID NO: 105321 - DNA, 26 bp, Artificial sequence
  SiRNA target sequence
cttataaatatcttgtatgtatttat

SEQ ID NO: 105322 - DNA, 26 bp, Artificial sequence
  SiRNA target sequence
ttataaatatcttgtatgtatttatt

SEQ ID NO: 105323 - DNA, 26 bp, Artificial sequence
  SiRNA target sequence
tataaatatcttgtatgtatttatta

SEQ ID NO: 105324 - DNA, 26 bp, Artificial sequence
  SiRNA target sequence
ataaatatcttgtatgtatttattat

SEQ ID NO: 105325 - DNA, 26 bp, Artificial sequence
  SiRNA target sequence
taaatatcttgtatgtatttattatc

SEQ ID NO: 105326 - DNA, 26 bp, Artificial sequence
  SiRNA target sequence
aaatatcttgtatgtatttattatct

SEQ ID NO: 105327 - DNA, 26 bp, Artificial sequence
  SiRNA target sequence
aatatcttgtatgtatttattatctt

SEQ ID NO: 105328 - DNA, 26 bp, Artificial sequence
  SiRNA target sequence
atatcttgtatgtatttattatcttc

SEQ ID NO: 105329 - DNA, 26 bp, Artificial sequence
  SiRNA target sequence
tatcttgtatgtatttattatcttcc

SEQ ID NO: 105330 - DNA, 26 bp, Artificial sequence
  SiRNA target sequence
atcttgtatgtatttattatcttccc

SEQ ID NO: 105331 - DNA, 26 bp, Artificial sequence
  SiRNA target sequence
tcttgtatgtatttattatcttccct

SEQ ID NO: 105332 - DNA, 26 bp, Artificial sequence
  SiRNA target sequence
cttgtatgtatttattatcttccctt

SEQ ID NO: 105333 - DNA, 26 bp, Artificial sequence
  SiRNA target sequence
ttgtatgtatttattatcttcccttg

SEQ ID NO: 105334 - DNA, 26 bp, Artificial sequence
  SiRNA target sequence
tgtatgtatttattatcttcccttga

SEQ ID NO: 105335 - DNA, 26 bp, Artificial sequence
  SiRNA target sequence
gtatgtatttattatcttcccttgaa

SEQ ID NO: 105336 - DNA, 26 bp, Artificial sequence
  SiRNA target sequence
tatgtatttattatcttcccttgaaa

SEQ ID NO: 105337 - DNA, 26 bp, Artificial sequence
  SiRNA target sequence
atgtatttattatcttcccttgaaac

SEQ ID NO: 105338 - DNA, 26 bp, Artificial sequence
  SiRNA target sequence
tgtatttattatcttcccttgaaaca

SEQ ID NO: 105339 - DNA, 26 bp, Artificial sequence
  SiRNA target sequence
gtatttattatcttcccttgaaacag

SEQ ID NO: 105340 - DNA, 26 bp, Artificial sequence
  SiRNA target sequence
tatttattatcttcccttgaaacagc

SEQ ID NO: 105341 - DNA, 26 bp, Artificial sequence
  SiRNA target sequence
atttattatcttcccttgaaacagcg

SEQ ID NO: 105342 - DNA, 26 bp, Artificial sequence
  SiRNA target sequence
tttattatcttcccttgaaacagcgg

SEQ ID NO: 105343 - DNA, 26 bp, Artificial sequence
  SiRNA target sequence
ttattatcttcccttgaaacagcggg

SEQ ID NO: 105344 - DNA, 26 bp, Artificial sequence
  SiRNA target sequence
tattatcttcccttgaaacagcgggg

SEQ ID NO: 105345 - DNA, 26 bp, Artificial sequence
  SiRNA target sequence
attatcttcccttgaaacagcggggt

SEQ ID NO: 105346 - DNA, 26 bp, Artificial sequence
  SiRNA target sequence
ttatcttcccttgaaacagcggggta

SEQ ID NO: 105347 - DNA, 26 bp, Artificial sequence
  SiRNA target sequence
tatcttcccttgaaacagcggggtaa

SEQ ID NO: 105348 - DNA, 26 bp, Artificial sequence
  SiRNA target sequence
atcttcccttgaaacagcggggtaaa

SEQ ID NO: 105349 - DNA, 26 bp, Artificial sequence
  SiRNA target sequence
tcttcccttgaaacagcggggtaaat

SEQ ID NO: 105350 - DNA, 26 bp, Artificial sequence
  SiRNA target sequence
cttcccttgaaacagcggggtaaatt

SEQ ID NO: 105351 - DNA, 26 bp, Artificial sequence
  SiRNA target sequence
ttcccttgaaacagcggggtaaattt

SEQ ID NO: 105352 - DNA, 26 bp, Artificial sequence
  SiRNA target sequence
tcccttgaaacagcggggtaaatttc

SEQ ID NO: 105353 - DNA, 26 bp, Artificial sequence
  SiRNA target sequence
cccttgaaacagcggggtaaatttca

SEQ ID NO: 105354 - DNA, 26 bp, Artificial sequence
  SiRNA target sequence
ccttgaaacagcggggtaaatttcaa

SEQ ID NO: 105355 - DNA, 26 bp, Artificial sequence
  SiRNA target sequence
cttgaaacagcggggtaaatttcaat

SEQ ID NO: 105356 - DNA, 26 bp, Artificial sequence
  SiRNA target sequence
ttgaaacagcggggtaaatttcaatg

SEQ ID NO: 105357 - DNA, 26 bp, Artificial sequence
  SiRNA target sequence
tgaaacagcggggtaaatttcaatgc

SEQ ID NO: 105358 - DNA, 26 bp, Artificial sequence
  SiRNA target sequence
gaaacagcggggtaaatttcaatgcc

SEQ ID NO: 105359 - DNA, 26 bp, Artificial sequence
  SiRNA target sequence
aaacagcggggtaaatttcaatgcct

SEQ ID NO: 105360 - DNA, 26 bp, Artificial sequence
  SiRNA target sequence
aacagcggggtaaatttcaatgcctt

SEQ ID NO: 105361 - DNA, 26 bp, Artificial sequence
  SiRNA target sequence
acagcggggtaaatttcaatgccttt

SEQ ID NO: 105362 - DNA, 26 bp, Artificial sequence
  SiRNA target sequence
cagcggggtaaatttcaatgccttta

SEQ ID NO: 105363 - DNA, 26 bp, Artificial sequence
  SiRNA target sequence
agcggggtaaatttcaatgcctttat

SEQ ID NO: 105364 - DNA, 26 bp, Artificial sequence
  SiRNA target sequence
gcggggtaaatttcaatgcctttatt

SEQ ID NO: 105365 - DNA, 26 bp, Artificial sequence
  SiRNA target sequence
cggggtaaatttcaatgcctttattt

SEQ ID NO: 105366 - DNA, 26 bp, Artificial sequence
  SiRNA target sequence
ggggtaaatttcaatgcctttatttt

SEQ ID NO: 105367 - DNA, 26 bp, Artificial sequence
  SiRNA target sequence
gggtaaatttcaatgcctttattttc

SEQ ID NO: 105368 - DNA, 26 bp, Artificial sequence
  SiRNA target sequence
ggtaaatttcaatgcctttattttca

SEQ ID NO: 105369 - DNA, 26 bp, Artificial sequence
  SiRNA target sequence
gtaaatttcaatgcctttattttcaa

SEQ ID NO: 105370 - DNA, 26 bp, Artificial sequence
  SiRNA target sequence
taaatttcaatgcctttattttcaaa

SEQ ID NO: 105371 - DNA, 26 bp, Artificial sequence
  SiRNA target sequence
aaatttcaatgcctttattttcaaac

SEQ ID NO: 105372 - DNA, 26 bp, Artificial sequence
  SiRNA target sequence
aatttcaatgcctttattttcaaact

SEQ ID NO: 105373 - DNA, 26 bp, Artificial sequence
  SiRNA target sequence
atttcaatgcctttattttcaaactc

SEQ ID NO: 105374 - DNA, 26 bp, Artificial sequence
  SiRNA target sequence
tttcaatgcctttattttcaaactct

SEQ ID NO: 105375 - DNA, 26 bp, Artificial sequence
  SiRNA target sequence
ttcaatgcctttattttcaaactctt

SEQ ID NO: 105376 - DNA, 26 bp, Artificial sequence
  SiRNA target sequence
tcaatgcctttattttcaaactcttc

SEQ ID NO: 105377 - DNA, 26 bp, Artificial sequence
  SiRNA target sequence
caatgcctttattttcaaactcttct

SEQ ID NO: 105378 - DNA, 26 bp, Artificial sequence
  SiRNA target sequence
aatgcctttattttcaaactcttctt

SEQ ID NO: 105379 - DNA, 26 bp, Artificial sequence
  SiRNA target sequence
atgcctttattttcaaactcttcttt

SEQ ID NO: 105380 - DNA, 26 bp, Artificial sequence
  SiRNA target sequence
tgcctttattttcaaactcttcttta

SEQ ID NO: 105381 - DNA, 26 bp, Artificial sequence
  SiRNA target sequence
gcctttattttcaaactcttctttat

SEQ ID NO: 105382 - DNA, 26 bp, Artificial sequence
  SiRNA target sequence
cctttattttcaaactcttctttata

SEQ ID NO: 105383 - DNA, 26 bp, Artificial sequence
  SiRNA target sequence
ctttattttcaaactcttctttatat

SEQ ID NO: 105384 - DNA, 26 bp, Artificial sequence
  SiRNA target sequence
tttattttcaaactcttctttatata

SEQ ID NO: 105385 - DNA, 26 bp, Artificial sequence
  SiRNA target sequence
ttattttcaaactcttctttatataa

SEQ ID NO: 105386 - DNA, 26 bp, Artificial sequence
  SiRNA target sequence
tattttcaaactcttctttatataaa

SEQ ID NO: 105387 - DNA, 26 bp, Artificial sequence
  SiRNA target sequence
attttcaaactcttctttatataaaa

SEQ ID NO: 105388 - DNA, 26 bp, Artificial sequence
  SiRNA target sequence
ttttcaaactcttctttatataaaaa

SEQ ID NO: 105389 - DNA, 26 bp, Artificial sequence
  SiRNA target sequence
tttcaaactcttctttatataaaaaa

SEQ ID NO: 105390 - DNA, 26 bp, Artificial sequence
  SiRNA target sequence
ttcaaactcttctttatataaaaaat

SEQ ID NO: 105391 - DNA, 26 bp, Artificial sequence
  SiRNA target sequence
tcaaactcttctttatataaaaaatc

SEQ ID NO: 105392 - DNA, 26 bp, Artificial sequence
  SiRNA target sequence
caaactcttctttatataaaaaatct

SEQ ID NO: 105393 - DNA, 26 bp, Artificial sequence
  SiRNA target sequence
aaactcttctttatataaaaaatcta

SEQ ID NO: 105394 - DNA, 26 bp, Artificial sequence
  SiRNA target sequence
aactcttctttatataaaaaatctac

SEQ ID NO: 105395 - DNA, 26 bp, Artificial sequence
  SiRNA target sequence
actcttctttatataaaaaatctaca

SEQ ID NO: 105396 - DNA, 26 bp, Artificial sequence
  SiRNA target sequence
ctcttctttatataaaaaatctacat

SEQ ID NO: 105397 - DNA, 26 bp, Artificial sequence
  SiRNA target sequence
tcttctttatataaaaaatctacatc

SEQ ID NO: 105398 - DNA, 26 bp, Artificial sequence
  SiRNA target sequence
cttctttatataaaaaatctacatct

SEQ ID NO: 105399 - DNA, 26 bp, Artificial sequence
  SiRNA target sequence
ttctttatataaaaaatctacatctc

SEQ ID NO: 105400 - DNA, 26 bp, Artificial sequence
  SiRNA target sequence
tctttatataaaaaatctacatctct

SEQ ID NO: 105401 - DNA, 26 bp, Artificial sequence
  SiRNA target sequence
ctttatataaaaaatctacatctcta

SEQ ID NO: 105402 - DNA, 26 bp, Artificial sequence
  SiRNA target sequence
tttatataaaaaatctacatctctaa

SEQ ID NO: 105403 - DNA, 26 bp, Artificial sequence
  SiRNA target sequence
ttatataaaaaatctacatctctaaa

SEQ ID NO: 105404 - DNA, 26 bp, Artificial sequence
  SiRNA target sequence
tatataaaaaatctacatctctaaat

SEQ ID NO: 105405 - DNA, 26 bp, Artificial sequence
  SiRNA target sequence
atataaaaaatctacatctctaaatc

SEQ ID NO: 105406 - DNA, 26 bp, Artificial sequence
  SiRNA target sequence
tataaaaaatctacatctctaaatct

SEQ ID NO: 105407 - DNA, 26 bp, Artificial sequence
  SiRNA target sequence
ataaaaaatctacatctctaaatcta

SEQ ID NO: 105408 - DNA, 26 bp, Artificial sequence
  SiRNA target sequence
taaaaaatctacatctctaaatctaa

SEQ ID NO: 105409 - DNA, 26 bp, Artificial sequence
  SiRNA target sequence
aaaaaatctacatctctaaatctaaa

SEQ ID NO: 105410 - DNA, 26 bp, Artificial sequence
  SiRNA target sequence
aaaaatctacatctctaaatctaaaa

SEQ ID NO: 105411 - DNA, 26 bp, Artificial sequence
  SiRNA target sequence
aaaatctacatctctaaatctaaaac

SEQ ID NO: 105412 - DNA, 26 bp, Artificial sequence
  SiRNA target sequence
aaatctacatctctaaatctaaaacc

SEQ ID NO: 105413 - DNA, 26 bp, Artificial sequence
  SiRNA target sequence
aatctacatctctaaatctaaaacca

SEQ ID NO: 105414 - DNA, 26 bp, Artificial sequence
  SiRNA target sequence
atctacatctctaaatctaaaaccat

SEQ ID NO: 105415 - DNA, 26 bp, Artificial sequence
  SiRNA target sequence
tctacatctctaaatctaaaaccata

SEQ ID NO: 105416 - DNA, 26 bp, Artificial sequence
  SiRNA target sequence
ctacatctctaaatctaaaaccatat

SEQ ID NO: 105417 - DNA, 26 bp, Artificial sequence
  SiRNA target sequence
tacatctctaaatctaaaaccatata

SEQ ID NO: 105418 - DNA, 26 bp, Artificial sequence
  SiRNA target sequence
acatctctaaatctaaaaccatataa

SEQ ID NO: 105419 - DNA, 26 bp, Artificial sequence
  SiRNA target sequence
catctctaaatctaaaaccatataat

SEQ ID NO: 105420 - DNA, 26 bp, Artificial sequence
  SiRNA target sequence
atctctaaatctaaaaccatataata

SEQ ID NO: 105421 - DNA, 26 bp, Artificial sequence
  SiRNA target sequence
tctctaaatctaaaaccatataataa

SEQ ID NO: 105422 - DNA, 26 bp, Artificial sequence
  SiRNA target sequence
ctctaaatctaaaaccatataataaa

SEQ ID NO: 105423 - DNA, 26 bp, Artificial sequence
  SiRNA target sequence
tctaaatctaaaaccatataataaaa

SEQ ID NO: 105424 - DNA, 26 bp, Artificial sequence
  SiRNA target sequence
ctaaatctaaaaccatataataaaat

SEQ ID NO: 105425 - DNA, 26 bp, Artificial sequence
  SiRNA target sequence
taaatctaaaaccatataataaaata

SEQ ID NO: 105426 - DNA, 26 bp, Artificial sequence
  SiRNA target sequence
aaatctaaaaccatataataaaataa

SEQ ID NO: 105427 - DNA, 26 bp, Artificial sequence
  SiRNA target sequence
aatctaaaaccatataataaaataac

SEQ ID NO: 105428 - DNA, 26 bp, Artificial sequence
  SiRNA target sequence
atctaaaaccatataataaaataact

SEQ ID NO: 105429 - DNA, 26 bp, Artificial sequence
  SiRNA target sequence
tctaaaaccatataataaaataactt

SEQ ID NO: 105430 - DNA, 26 bp, Artificial sequence
  SiRNA target sequence
ctaaaaccatataataaaataacttt

SEQ ID NO: 105431 - DNA, 26 bp, Artificial sequence
  SiRNA target sequence
taaaaccatataataaaataactttt

SEQ ID NO: 105432 - DNA, 26 bp, Artificial sequence
  SiRNA target sequence
aaaaccatataataaaataacttttt

SEQ ID NO: 105433 - DNA, 26 bp, Artificial sequence
  SiRNA target sequence
aaaccatataataaaataactttttt

SEQ ID NO: 105434 - DNA, 26 bp, Artificial sequence
  SiRNA target sequence
aaccatataataaaataactttttta

SEQ ID NO: 105435 - DNA, 26 bp, Artificial sequence
  SiRNA target sequence
accatataataaaataacttttttaa

SEQ ID NO: 105436 - DNA, 26 bp, Artificial sequence
  SiRNA target sequence
ccatataataaaataacttttttaaa

SEQ ID NO: 105437 - DNA, 26 bp, Artificial sequence
  SiRNA target sequence
catataataaaataacttttttaaaa

SEQ ID NO: 105438 - DNA, 26 bp, Artificial sequence
  SiRNA target sequence
atataataaaataacttttttaaaaa

SEQ ID NO: 105439 - DNA, 26 bp, Artificial sequence
  SiRNA target sequence
tataataaaataacttttttaaaaaa

SEQ ID NO: 105440 - DNA, 26 bp, Artificial sequence
  SiRNA target sequence
ataataaaataacttttttaaaaaaa

SEQ ID NO: 105441 - DNA, 26 bp, Artificial sequence
  SiRNA target sequence
taataaaataacttttttaaaaaaat

SEQ ID NO: 105442 - DNA, 26 bp, Artificial sequence
  SiRNA target sequence
aataaaataacttttttaaaaaaatt

SEQ ID NO: 105443 - DNA, 26 bp, Artificial sequence
  SiRNA target sequence
ataaaataacttttttaaaaaaattt

SEQ ID NO: 105444 - DNA, 26 bp, Artificial sequence
  SiRNA target sequence
taaaataacttttttaaaaaaattta

SEQ ID NO: 105445 - DNA, 26 bp, Artificial sequence
  SiRNA target sequence
aaaataacttttttaaaaaaatttaa

SEQ ID NO: 105446 - DNA, 26 bp, Artificial sequence
  SiRNA target sequence
aaataacttttttaaaaaaatttaaa

SEQ ID NO: 105447 - DNA, 26 bp, Artificial sequence
  SiRNA target sequence
aataacttttttaaaaaaatttaaat

SEQ ID NO: 105448 - DNA, 26 bp, Artificial sequence
  SiRNA target sequence
ataacttttttaaaaaaatttaaatc

SEQ ID NO: 105449 - DNA, 26 bp, Artificial sequence
  SiRNA target sequence
taacttttttaaaaaaatttaaatca

SEQ ID NO: 105450 - DNA, 26 bp, Artificial sequence
  SiRNA target sequence
aacttttttaaaaaaatttaaatcag

SEQ ID NO: 105451 - DNA, 26 bp, Artificial sequence
  SiRNA target sequence
acttttttaaaaaaatttaaatcaga

SEQ ID NO: 105452 - DNA, 26 bp, Artificial sequence
  SiRNA target sequence
cttttttaaaaaaatttaaatcagaa

SEQ ID NO: 105453 - DNA, 26 bp, Artificial sequence
  SiRNA target sequence
ttttttaaaaaaatttaaatcagaat

SEQ ID NO: 105454 - DNA, 26 bp, Artificial sequence
  SiRNA target sequence
tttttaaaaaaatttaaatcagaata

SEQ ID NO: 105455 - DNA, 26 bp, Artificial sequence
  SiRNA target sequence
ttttaaaaaaatttaaatcagaatag

SEQ ID NO: 105456 - DNA, 26 bp, Artificial sequence
  SiRNA target sequence
tttaaaaaaatttaaatcagaatagt

SEQ ID NO: 105457 - DNA, 26 bp, Artificial sequence
  SiRNA target sequence
ttaaaaaaatttaaatcagaatagta

SEQ ID NO: 105458 - DNA, 26 bp, Artificial sequence
  SiRNA target sequence
taaaaaaatttaaatcagaatagtaa

SEQ ID NO: 105459 - DNA, 26 bp, Artificial sequence
  SiRNA target sequence
aaaaaaatttaaatcagaatagtaat

SEQ ID NO: 105460 - DNA, 26 bp, Artificial sequence
  SiRNA target sequence
aaaaaatttaaatcagaatagtaatt

SEQ ID NO: 105461 - DNA, 26 bp, Artificial sequence
  SiRNA target sequence
aaaaatttaaatcagaatagtaatta

SEQ ID NO: 105462 - DNA, 26 bp, Artificial sequence
  SiRNA target sequence
aaaatttaaatcagaatagtaattaa

SEQ ID NO: 105463 - DNA, 26 bp, Artificial sequence
  SiRNA target sequence
aaatttaaatcagaatagtaattaac

SEQ ID NO: 105464 - DNA, 26 bp, Artificial sequence
  SiRNA target sequence
aatttaaatcagaatagtaattaaca

SEQ ID NO: 105465 - DNA, 26 bp, Artificial sequence
  SiRNA target sequence
atttaaatcagaatagtaattaacaa

SEQ ID NO: 105466 - DNA, 26 bp, Artificial sequence
  SiRNA target sequence
tttaaatcagaatagtaattaacaaa

SEQ ID NO: 105467 - DNA, 26 bp, Artificial sequence
  SiRNA target sequence
ttaaatcagaatagtaattaacaaat

SEQ ID NO: 105468 - DNA, 26 bp, Artificial sequence
  SiRNA target sequence
taaatcagaatagtaattaacaaatg

SEQ ID NO: 105469 - DNA, 26 bp, Artificial sequence
  SiRNA target sequence
aaatcagaatagtaattaacaaatgc

SEQ ID NO: 105470 - DNA, 26 bp, Artificial sequence
  SiRNA target sequence
aatcagaatagtaattaacaaatgcc

SEQ ID NO: 105471 - DNA, 26 bp, Artificial sequence
  SiRNA target sequence
atcagaatagtaattaacaaatgccc

SEQ ID NO: 105472 - DNA, 26 bp, Artificial sequence
  SiRNA target sequence
tcagaatagtaattaacaaatgccct

SEQ ID NO: 105473 - DNA, 26 bp, Artificial sequence
  SiRNA target sequence
cagaatagtaattaacaaatgccctg

SEQ ID NO: 105474 - DNA, 26 bp, Artificial sequence
  SiRNA target sequence
agaatagtaattaacaaatgccctgg

SEQ ID NO: 105475 - DNA, 26 bp, Artificial sequence
  SiRNA target sequence
gaatagtaattaacaaatgccctggg

SEQ ID NO: 105476 - DNA, 26 bp, Artificial sequence
  SiRNA target sequence
aatagtaattaacaaatgccctggga

SEQ ID NO: 105477 - DNA, 26 bp, Artificial sequence
  SiRNA target sequence
atagtaattaacaaatgccctgggaa

SEQ ID NO: 105478 - DNA, 26 bp, Artificial sequence
  SiRNA target sequence
tagtaattaacaaatgccctgggaag

SEQ ID NO: 105479 - DNA, 26 bp, Artificial sequence
  SiRNA target sequence
agtaattaacaaatgccctgggaagt

SEQ ID NO: 105480 - DNA, 26 bp, Artificial sequence
  SiRNA target sequence
gtaattaacaaatgccctgggaagtg

SEQ ID NO: 105481 - DNA, 26 bp, Artificial sequence
  SiRNA target sequence
taattaacaaatgccctgggaagtgt

SEQ ID NO: 105482 - DNA, 26 bp, Artificial sequence
  SiRNA target sequence
aattaacaaatgccctgggaagtgta

SEQ ID NO: 105483 - DNA, 26 bp, Artificial sequence
  SiRNA target sequence
attaacaaatgccctgggaagtgtaa

SEQ ID NO: 105484 - DNA, 26 bp, Artificial sequence
  SiRNA target sequence
ttaacaaatgccctgggaagtgtaat

SEQ ID NO: 105485 - DNA, 26 bp, Artificial sequence
  SiRNA target sequence
taacaaatgccctgggaagtgtaata

SEQ ID NO: 105486 - DNA, 26 bp, Artificial sequence
  SiRNA target sequence
aacaaatgccctgggaagtgtaatac

SEQ ID NO: 105487 - DNA, 26 bp, Artificial sequence
  SiRNA target sequence
acaaatgccctgggaagtgtaatacc

SEQ ID NO: 105488 - DNA, 26 bp, Artificial sequence
  SiRNA target sequence
caaatgccctgggaagtgtaatacca

SEQ ID NO: 105489 - DNA, 26 bp, Artificial sequence
  SiRNA target sequence
aaatgccctgggaagtgtaataccag

SEQ ID NO: 105490 - DNA, 26 bp, Artificial sequence
  SiRNA target sequence
aatgccctgggaagtgtaataccagt

SEQ ID NO: 105491 - DNA, 26 bp, Artificial sequence
  SiRNA target sequence
atgccctgggaagtgtaataccagta

SEQ ID NO: 105492 - DNA, 26 bp, Artificial sequence
  SiRNA target sequence
tgccctgggaagtgtaataccagtac

SEQ ID NO: 105493 - DNA, 26 bp, Artificial sequence
  SiRNA target sequence
gccctgggaagtgtaataccagtacc

SEQ ID NO: 105494 - DNA, 26 bp, Artificial sequence
  SiRNA target sequence
ccctgggaagtgtaataccagtacca

SEQ ID NO: 105495 - DNA, 26 bp, Artificial sequence
  SiRNA target sequence
cctgggaagtgtaataccagtaccag

SEQ ID NO: 105496 - DNA, 26 bp, Artificial sequence
  SiRNA target sequence
ctgggaagtgtaataccagtaccagt

SEQ ID NO: 105497 - DNA, 26 bp, Artificial sequence
  SiRNA target sequence
tgggaagtgtaataccagtaccagtg

SEQ ID NO: 105498 - DNA, 26 bp, Artificial sequence
  SiRNA target sequence
gggaagtgtaataccagtaccagtgc

SEQ ID NO: 105499 - DNA, 26 bp, Artificial sequence
  SiRNA target sequence
ggaagtgtaataccagtaccagtgca

SEQ ID NO: 105500 - DNA, 26 bp, Artificial sequence
  SiRNA target sequence
gaagtgtaataccagtaccagtgcac

SEQ ID NO: 105501 - DNA, 26 bp, Artificial sequence
  SiRNA target sequence
aagtgtaataccagtaccagtgcaca

SEQ ID NO: 105502 - DNA, 26 bp, Artificial sequence
  SiRNA target sequence
agtgtaataccagtaccagtgcacat

SEQ ID NO: 105503 - DNA, 26 bp, Artificial sequence
  SiRNA target sequence
gtgtaataccagtaccagtgcacata

SEQ ID NO: 105504 - DNA, 26 bp, Artificial sequence
  SiRNA target sequence
tgtaataccagtaccagtgcacataa

SEQ ID NO: 105505 - DNA, 26 bp, Artificial sequence
  SiRNA target sequence
gtaataccagtaccagtgcacataaa

SEQ ID NO: 105506 - DNA, 26 bp, Artificial sequence
  SiRNA target sequence
taataccagtaccagtgcacataaac

SEQ ID NO: 105507 - DNA, 26 bp, Artificial sequence
  SiRNA target sequence
aataccagtaccagtgcacataaaca

SEQ ID NO: 105508 - DNA, 26 bp, Artificial sequence
  SiRNA target sequence
ataccagtaccagtgcacataaacaa

SEQ ID NO: 105509 - DNA, 26 bp, Artificial sequence
  SiRNA target sequence
taccagtaccagtgcacataaacaaa

SEQ ID NO: 105510 - DNA, 26 bp, Artificial sequence
  SiRNA target sequence
accagtaccagtgcacataaacaaaa

SEQ ID NO: 105511 - DNA, 26 bp, Artificial sequence
  SiRNA target sequence
ccagtaccagtgcacataaacaaaat

SEQ ID NO: 105512 - DNA, 26 bp, Artificial sequence
  SiRNA target sequence
cagtaccagtgcacataaacaaaatc

SEQ ID NO: 105513 - DNA, 26 bp, Artificial sequence
  SiRNA target sequence
agtaccagtgcacataaacaaaatct

SEQ ID NO: 105514 - DNA, 26 bp, Artificial sequence
  SiRNA target sequence
gtaccagtgcacataaacaaaatctt

SEQ ID NO: 105515 - DNA, 26 bp, Artificial sequence
  SiRNA target sequence
taccagtgcacataaacaaaatcttt

SEQ ID NO: 105516 - DNA, 26 bp, Artificial sequence
  SiRNA target sequence
accagtgcacataaacaaaatctttt

SEQ ID NO: 105517 - DNA, 26 bp, Artificial sequence
  SiRNA target sequence
ccagtgcacataaacaaaatcttttt

SEQ ID NO: 105518 - DNA, 26 bp, Artificial sequence
  SiRNA target sequence
cagtgcacataaacaaaatcttttta

SEQ ID NO: 105519 - DNA, 26 bp, Artificial sequence
  SiRNA target sequence
agtgcacataaacaaaatctttttac

SEQ ID NO: 105520 - DNA, 26 bp, Artificial sequence
  SiRNA target sequence
gtgcacataaacaaaatctttttacc

SEQ ID NO: 105521 - DNA, 26 bp, Artificial sequence
  SiRNA target sequence
tgcacataaacaaaatctttttacca

SEQ ID NO: 105522 - DNA, 26 bp, Artificial sequence
  SiRNA target sequence
gcacataaacaaaatctttttaccac

SEQ ID NO: 105523 - DNA, 26 bp, Artificial sequence
  SiRNA target sequence
cacataaacaaaatctttttaccact

SEQ ID NO: 105524 - DNA, 26 bp, Artificial sequence
  SiRNA target sequence
acataaacaaaatctttttaccacta

SEQ ID NO: 105525 - DNA, 26 bp, Artificial sequence
  SiRNA target sequence
cataaacaaaatctttttaccactaa

SEQ ID NO: 105526 - DNA, 26 bp, Artificial sequence
  SiRNA target sequence
ataaacaaaatctttttaccactaaa

SEQ ID NO: 105527 - DNA, 26 bp, Artificial sequence
  SiRNA target sequence
taaacaaaatctttttaccactaaaa

SEQ ID NO: 105528 - DNA, 26 bp, Artificial sequence
  SiRNA target sequence
aaacaaaatctttttaccactaaaat

SEQ ID NO: 105529 - DNA, 26 bp, Artificial sequence
  SiRNA target sequence
aacaaaatctttttaccactaaaatt

SEQ ID NO: 105530 - DNA, 26 bp, Artificial sequence
  SiRNA target sequence
acaaaatctttttaccactaaaatta

SEQ ID NO: 105531 - DNA, 26 bp, Artificial sequence
  SiRNA target sequence
caaaatctttttaccactaaaattaa

SEQ ID NO: 105532 - DNA, 26 bp, Artificial sequence
  SiRNA target sequence
aaaatctttttaccactaaaattaag

SEQ ID NO: 105533 - DNA, 26 bp, Artificial sequence
  SiRNA target sequence
aaatctttttaccactaaaattaagt

SEQ ID NO: 105534 - DNA, 26 bp, Artificial sequence
  SiRNA target sequence
aatctttttaccactaaaattaagtc

SEQ ID NO: 105535 - DNA, 26 bp, Artificial sequence
  SiRNA target sequence
atctttttaccactaaaattaagtct

SEQ ID NO: 105536 - DNA, 26 bp, Artificial sequence
  SiRNA target sequence
tctttttaccactaaaattaagtcta

SEQ ID NO: 105537 - DNA, 26 bp, Artificial sequence
  SiRNA target sequence
ctttttaccactaaaattaagtctat

SEQ ID NO: 105538 - DNA, 26 bp, Artificial sequence
  SiRNA target sequence
tttttaccactaaaattaagtctatt

SEQ ID NO: 105539 - DNA, 26 bp, Artificial sequence
  SiRNA target sequence
ttttaccactaaaattaagtctattt

SEQ ID NO: 105540 - DNA, 26 bp, Artificial sequence
  SiRNA target sequence
tttaccactaaaattaagtctatttt

SEQ ID NO: 105541 - DNA, 26 bp, Artificial sequence
  SiRNA target sequence
ttaccactaaaattaagtctattttg

SEQ ID NO: 105542 - DNA, 26 bp, Artificial sequence
  SiRNA target sequence
taccactaaaattaagtctattttgt

SEQ ID NO: 105543 - DNA, 26 bp, Artificial sequence
  SiRNA target sequence
accactaaaattaagtctattttgta

SEQ ID NO: 105544 - DNA, 26 bp, Artificial sequence
  SiRNA target sequence
ccactaaaattaagtctattttgtac

SEQ ID NO: 105545 - DNA, 26 bp, Artificial sequence
  SiRNA target sequence
cactaaaattaagtctattttgtact

SEQ ID NO: 105546 - DNA, 26 bp, Artificial sequence
  SiRNA target sequence
actaaaattaagtctattttgtacta

SEQ ID NO: 105547 - DNA, 26 bp, Artificial sequence
  SiRNA target sequence
ctaaaattaagtctattttgtactat

SEQ ID NO: 105548 - DNA, 26 bp, Artificial sequence
  SiRNA target sequence
taaaattaagtctattttgtactatg

SEQ ID NO: 105549 - DNA, 26 bp, Artificial sequence
  SiRNA target sequence
aaaattaagtctattttgtactatgt

SEQ ID NO: 105550 - DNA, 26 bp, Artificial sequence
  SiRNA target sequence
aaattaagtctattttgtactatgtt

SEQ ID NO: 105551 - DNA, 26 bp, Artificial sequence
  SiRNA target sequence
aattaagtctattttgtactatgtta

SEQ ID NO: 105552 - DNA, 26 bp, Artificial sequence
  SiRNA target sequence
attaagtctattttgtactatgttaa

SEQ ID NO: 105553 - DNA, 26 bp, Artificial sequence
  SiRNA target sequence
ttaagtctattttgtactatgttaac

SEQ ID NO: 105554 - DNA, 26 bp, Artificial sequence
  SiRNA target sequence
taagtctattttgtactatgttaaca

SEQ ID NO: 105555 - DNA, 26 bp, Artificial sequence
  SiRNA target sequence
aagtctattttgtactatgttaacat

SEQ ID NO: 105556 - DNA, 26 bp, Artificial sequence
  SiRNA target sequence
agtctattttgtactatgttaacatg

SEQ ID NO: 105557 - DNA, 26 bp, Artificial sequence
  SiRNA target sequence
gtctattttgtactatgttaacatga

SEQ ID NO: 105558 - DNA, 26 bp, Artificial sequence
  SiRNA target sequence
tctattttgtactatgttaacatgaa

SEQ ID NO: 105559 - DNA, 26 bp, Artificial sequence
  SiRNA target sequence
ctattttgtactatgttaacatgaat

SEQ ID NO: 105560 - DNA, 26 bp, Artificial sequence
  SiRNA target sequence
tattttgtactatgttaacatgaata

SEQ ID NO: 105561 - DNA, 26 bp, Artificial sequence
  SiRNA target sequence
attttgtactatgttaacatgaatag

SEQ ID NO: 105562 - DNA, 26 bp, Artificial sequence
  SiRNA target sequence
ttttgtactatgttaacatgaatagt

SEQ ID NO: 105563 - DNA, 26 bp, Artificial sequence
  SiRNA target sequence
tttgtactatgttaacatgaatagta

SEQ ID NO: 105564 - DNA, 26 bp, Artificial sequence
  SiRNA target sequence
ttgtactatgttaacatgaatagtag

SEQ ID NO: 105565 - DNA, 26 bp, Artificial sequence
  SiRNA target sequence
tgtactatgttaacatgaatagtaga

SEQ ID NO: 105566 - DNA, 26 bp, Artificial sequence
  SiRNA target sequence
gtactatgttaacatgaatagtagac

SEQ ID NO: 105567 - DNA, 26 bp, Artificial sequence
  SiRNA target sequence
tactatgttaacatgaatagtagacc

SEQ ID NO: 105568 - DNA, 26 bp, Artificial sequence
  SiRNA target sequence
actatgttaacatgaatagtagaccc

SEQ ID NO: 105569 - DNA, 26 bp, Artificial sequence
  SiRNA target sequence
ctatgttaacatgaatagtagaccct

SEQ ID NO: 105570 - DNA, 26 bp, Artificial sequence
  SiRNA target sequence
tatgttaacatgaatagtagaccctt

SEQ ID NO: 105571 - DNA, 26 bp, Artificial sequence
  SiRNA target sequence
atgttaacatgaatagtagacccttt

SEQ ID NO: 105572 - DNA, 26 bp, Artificial sequence
  SiRNA target sequence
tgttaacatgaatagtagacccttta

SEQ ID NO: 105573 - DNA, 26 bp, Artificial sequence
  SiRNA target sequence
gttaacatgaatagtagaccctttag

SEQ ID NO: 105574 - DNA, 26 bp, Artificial sequence
  SiRNA target sequence
ttaacatgaatagtagaccctttagt

SEQ ID NO: 105575 - DNA, 26 bp, Artificial sequence
  SiRNA target sequence
taacatgaatagtagaccctttagta

SEQ ID NO: 105576 - DNA, 26 bp, Artificial sequence
  SiRNA target sequence
aacatgaatagtagaccctttagtaa

SEQ ID NO: 105577 - DNA, 26 bp, Artificial sequence
  SiRNA target sequence
acatgaatagtagaccctttagtaag

SEQ ID NO: 105578 - DNA, 26 bp, Artificial sequence
  SiRNA target sequence
catgaatagtagaccctttagtaagt

SEQ ID NO: 105579 - DNA, 26 bp, Artificial sequence
  SiRNA target sequence
atgaatagtagaccctttagtaagta

SEQ ID NO: 105580 - DNA, 26 bp, Artificial sequence
  SiRNA target sequence
tgaatagtagaccctttagtaagtaa

SEQ ID NO: 105581 - DNA, 26 bp, Artificial sequence
  SiRNA target sequence
gaatagtagaccctttagtaagtaat

SEQ ID NO: 105582 - DNA, 26 bp, Artificial sequence
  SiRNA target sequence
aatagtagaccctttagtaagtaatt

SEQ ID NO: 105583 - DNA, 26 bp, Artificial sequence
  SiRNA target sequence
atagtagaccctttagtaagtaattt

SEQ ID NO: 105584 - DNA, 26 bp, Artificial sequence
  SiRNA target sequence
tagtagaccctttagtaagtaatttt

SEQ ID NO: 105585 - DNA, 26 bp, Artificial sequence
  SiRNA target sequence
agtagaccctttagtaagtaatttta

SEQ ID NO: 105586 - DNA, 26 bp, Artificial sequence
  SiRNA target sequence
gtagaccctttagtaagtaattttaa

SEQ ID NO: 105587 - DNA, 26 bp, Artificial sequence
  SiRNA target sequence
tagaccctttagtaagtaattttaaa

SEQ ID NO: 105588 - DNA, 26 bp, Artificial sequence
  SiRNA target sequence
agaccctttagtaagtaattttaaat

SEQ ID NO: 105589 - DNA, 26 bp, Artificial sequence
  SiRNA target sequence
gaccctttagtaagtaattttaaata

SEQ ID NO: 105590 - DNA, 26 bp, Artificial sequence
  SiRNA target sequence
accctttagtaagtaattttaaatac

SEQ ID NO: 105591 - DNA, 26 bp, Artificial sequence
  SiRNA target sequence
ccctttagtaagtaattttaaatact

SEQ ID NO: 105592 - DNA, 26 bp, Artificial sequence
  SiRNA target sequence
cctttagtaagtaattttaaatactc

SEQ ID NO: 105593 - DNA, 26 bp, Artificial sequence
  SiRNA target sequence
ctttagtaagtaattttaaatactct

SEQ ID NO: 105594 - DNA, 26 bp, Artificial sequence
  SiRNA target sequence
tttagtaagtaattttaaatactctg

SEQ ID NO: 105595 - DNA, 26 bp, Artificial sequence
  SiRNA target sequence
ttagtaagtaattttaaatactctga

SEQ ID NO: 105596 - DNA, 26 bp, Artificial sequence
  SiRNA target sequence
tagtaagtaattttaaatactctgaa

SEQ ID NO: 105597 - DNA, 26 bp, Artificial sequence
  SiRNA target sequence
agtaagtaattttaaatactctgaac

SEQ ID NO: 105598 - DNA, 26 bp, Artificial sequence
  SiRNA target sequence
gtaagtaattttaaatactctgaaca

SEQ ID NO: 105599 - DNA, 26 bp, Artificial sequence
  SiRNA target sequence
taagtaattttaaatactctgaacaa

SEQ ID NO: 105600 - DNA, 26 bp, Artificial sequence
  SiRNA target sequence
aagtaattttaaatactctgaacaaa

SEQ ID NO: 105601 - DNA, 26 bp, Artificial sequence
  SiRNA target sequence
agtaattttaaatactctgaacaaag

SEQ ID NO: 105602 - DNA, 26 bp, Artificial sequence
  SiRNA target sequence
gtaattttaaatactctgaacaaaga

SEQ ID NO: 105603 - DNA, 26 bp, Artificial sequence
  SiRNA target sequence
taattttaaatactctgaacaaagac

SEQ ID NO: 105604 - DNA, 26 bp, Artificial sequence
  SiRNA target sequence
aattttaaatactctgaacaaagacc

SEQ ID NO: 105605 - DNA, 26 bp, Artificial sequence
  SiRNA target sequence
attttaaatactctgaacaaagacct

SEQ ID NO: 105606 - DNA, 26 bp, Artificial sequence
  SiRNA target sequence
ttttaaatactctgaacaaagacctt

SEQ ID NO: 105607 - DNA, 26 bp, Artificial sequence
  SiRNA target sequence
tttaaatactctgaacaaagaccttt

SEQ ID NO: 105608 - DNA, 26 bp, Artificial sequence
  SiRNA target sequence
ttaaatactctgaacaaagacctttt

SEQ ID NO: 105609 - DNA, 26 bp, Artificial sequence
  SiRNA target sequence
taaatactctgaacaaagaccttttc

SEQ ID NO: 105610 - DNA, 26 bp, Artificial sequence
  SiRNA target sequence
aaatactctgaacaaagaccttttcg

SEQ ID NO: 105611 - DNA, 26 bp, Artificial sequence
  SiRNA target sequence
aatactctgaacaaagaccttttcgt

SEQ ID NO: 105612 - DNA, 26 bp, Artificial sequence
  SiRNA target sequence
atactctgaacaaagaccttttcgtt

SEQ ID NO: 105613 - DNA, 26 bp, Artificial sequence
  SiRNA target sequence
tactctgaacaaagaccttttcgttc

SEQ ID NO: 105614 - DNA, 26 bp, Artificial sequence
  SiRNA target sequence
actctgaacaaagaccttttcgttct

SEQ ID NO: 105615 - DNA, 26 bp, Artificial sequence
  SiRNA target sequence
ctctgaacaaagaccttttcgttctt

SEQ ID NO: 105616 - DNA, 26 bp, Artificial sequence
  SiRNA target sequence
tctgaacaaagaccttttcgttcttc

SEQ ID NO: 105617 - DNA, 26 bp, Artificial sequence
  SiRNA target sequence
ctgaacaaagaccttttcgttcttct

SEQ ID NO: 105618 - DNA, 26 bp, Artificial sequence
  SiRNA target sequence
tgaacaaagaccttttcgttcttctt

SEQ ID NO: 105619 - DNA, 26 bp, Artificial sequence
  SiRNA target sequence
gaacaaagaccttttcgttcttcttt

SEQ ID NO: 105620 - DNA, 26 bp, Artificial sequence
  SiRNA target sequence
aacaaagaccttttcgttcttctttt

SEQ ID NO: 105621 - DNA, 26 bp, Artificial sequence
  SiRNA target sequence
acaaagaccttttcgttcttctttta

SEQ ID NO: 105622 - DNA, 26 bp, Artificial sequence
  SiRNA target sequence
caaagaccttttcgttcttcttttaa

SEQ ID NO: 105623 - DNA, 26 bp, Artificial sequence
  SiRNA target sequence
aaagaccttttcgttcttcttttaaa

SEQ ID NO: 105624 - DNA, 26 bp, Artificial sequence
  SiRNA target sequence
aagaccttttcgttcttcttttaaac

SEQ ID NO: 105625 - DNA, 26 bp, Artificial sequence
  SiRNA target sequence
agaccttttcgttcttcttttaaact

SEQ ID NO: 105626 - DNA, 26 bp, Artificial sequence
  SiRNA target sequence
gaccttttcgttcttcttttaaactt

SEQ ID NO: 105627 - DNA, 26 bp, Artificial sequence
  SiRNA target sequence
accttttcgttcttcttttaaacttg

SEQ ID NO: 105628 - DNA, 26 bp, Artificial sequence
  SiRNA target sequence
ccttttcgttcttcttttaaacttgt

SEQ ID NO: 105629 - DNA, 26 bp, Artificial sequence
  SiRNA target sequence
cttttcgttcttcttttaaacttgtt

SEQ ID NO: 105630 - DNA, 26 bp, Artificial sequence
  SiRNA target sequence
ttttcgttcttcttttaaacttgttt

SEQ ID NO: 105631 - DNA, 26 bp, Artificial sequence
  SiRNA target sequence
tttcgttcttcttttaaacttgtttt

SEQ ID NO: 105632 - DNA, 26 bp, Artificial sequence
  SiRNA target sequence
ttcgttcttcttttaaacttgtttta

SEQ ID NO: 105633 - DNA, 26 bp, Artificial sequence
  SiRNA target sequence
tcgttcttcttttaaacttgttttaa

SEQ ID NO: 105634 - DNA, 26 bp, Artificial sequence
  SiRNA target sequence
cgttcttcttttaaacttgttttaaa

SEQ ID NO: 105635 - DNA, 26 bp, Artificial sequence
  SiRNA target sequence
gttcttcttttaaacttgttttaaaa

SEQ ID NO: 105636 - DNA, 26 bp, Artificial sequence
  SiRNA target sequence
ttcttcttttaaacttgttttaaaag

SEQ ID NO: 105637 - DNA, 26 bp, Artificial sequence
  SiRNA target sequence
tcttcttttaaacttgttttaaaaga

SEQ ID NO: 105638 - DNA, 26 bp, Artificial sequence
  SiRNA target sequence
cttcttttaaacttgttttaaaagaa

SEQ ID NO: 105639 - DNA, 26 bp, Artificial sequence
  SiRNA target sequence
ttcttttaaacttgttttaaaagaaa

SEQ ID NO: 105640 - DNA, 26 bp, Artificial sequence
  SiRNA target sequence
tcttttaaacttgttttaaaagaaac

SEQ ID NO: 105641 - DNA, 26 bp, Artificial sequence
  SiRNA target sequence
cttttaaacttgttttaaaagaaaca

SEQ ID NO: 105642 - DNA, 26 bp, Artificial sequence
  SiRNA target sequence
ttttaaacttgttttaaaagaaacaa

SEQ ID NO: 105643 - DNA, 26 bp, Artificial sequence
  SiRNA target sequence
tttaaacttgttttaaaagaaacaag

SEQ ID NO: 105644 - DNA, 26 bp, Artificial sequence
  SiRNA target sequence
ttaaacttgttttaaaagaaacaaga

SEQ ID NO: 105645 - DNA, 26 bp, Artificial sequence
  SiRNA target sequence
taaacttgttttaaaagaaacaagag

SEQ ID NO: 105646 - DNA, 26 bp, Artificial sequence
  SiRNA target sequence
aaacttgttttaaaagaaacaagaga

SEQ ID NO: 105647 - DNA, 26 bp, Artificial sequence
  SiRNA target sequence
aacttgttttaaaagaaacaagagag

SEQ ID NO: 105648 - DNA, 26 bp, Artificial sequence
  SiRNA target sequence
acttgttttaaaagaaacaagagaga

SEQ ID NO: 105649 - DNA, 26 bp, Artificial sequence
  SiRNA target sequence
cttgttttaaaagaaacaagagagac

SEQ ID NO: 105650 - DNA, 26 bp, Artificial sequence
  SiRNA target sequence
ttgttttaaaagaaacaagagagacg

SEQ ID NO: 105651 - DNA, 26 bp, Artificial sequence
  SiRNA target sequence
tgttttaaaagaaacaagagagacgg

SEQ ID NO: 105652 - DNA, 26 bp, Artificial sequence
  SiRNA target sequence
gttttaaaagaaacaagagagacggt

SEQ ID NO: 105653 - DNA, 26 bp, Artificial sequence
  SiRNA target sequence
ttttaaaagaaacaagagagacggtg

SEQ ID NO: 105654 - DNA, 26 bp, Artificial sequence
  SiRNA target sequence
tttaaaagaaacaagagagacggtga

SEQ ID NO: 105655 - DNA, 26 bp, Artificial sequence
  SiRNA target sequence
ttaaaagaaacaagagagacggtgac

SEQ ID NO: 105656 - DNA, 26 bp, Artificial sequence
  SiRNA target sequence
taaaagaaacaagagagacggtgaca

SEQ ID NO: 105657 - DNA, 26 bp, Artificial sequence
  SiRNA target sequence
aaaagaaacaagagagacggtgacaa

SEQ ID NO: 105658 - DNA, 26 bp, Artificial sequence
  SiRNA target sequence
aaagaaacaagagagacggtgacaaa

SEQ ID NO: 105659 - DNA, 26 bp, Artificial sequence
  SiRNA target sequence
aagaaacaagagagacggtgacaaag

SEQ ID NO: 105660 - DNA, 26 bp, Artificial sequence
  SiRNA target sequence
agaaacaagagagacggtgacaaagt

SEQ ID NO: 105661 - DNA, 26 bp, Artificial sequence
  SiRNA target sequence
gaaacaagagagacggtgacaaagta

SEQ ID NO: 105662 - DNA, 26 bp, Artificial sequence
  SiRNA target sequence
aaacaagagagacggtgacaaagtaa

SEQ ID NO: 105663 - DNA, 26 bp, Artificial sequence
  SiRNA target sequence
aacaagagagacggtgacaaagtaac

SEQ ID NO: 105664 - DNA, 26 bp, Artificial sequence
  SiRNA target sequence
acaagagagacggtgacaaagtaaca

SEQ ID NO: 105665 - DNA, 26 bp, Artificial sequence
  SiRNA target sequence
caagagagacggtgacaaagtaacaa

SEQ ID NO: 105666 - DNA, 26 bp, Artificial sequence
  SiRNA target sequence
aagagagacggtgacaaagtaacaaa

SEQ ID NO: 105667 - DNA, 26 bp, Artificial sequence
  SiRNA target sequence
agagagacggtgacaaagtaacaaaa

SEQ ID NO: 105668 - DNA, 26 bp, Artificial sequence
  SiRNA target sequence
gagagacggtgacaaagtaacaaaaa

SEQ ID NO: 105669 - DNA, 26 bp, Artificial sequence
  SiRNA target sequence
agagacggtgacaaagtaacaaaaat

SEQ ID NO: 105670 - DNA, 26 bp, Artificial sequence
  SiRNA target sequence
gagacggtgacaaagtaacaaaaatc

SEQ ID NO: 105671 - DNA, 26 bp, Artificial sequence
  SiRNA target sequence
agacggtgacaaagtaacaaaaatct

SEQ ID NO: 105672 - DNA, 26 bp, Artificial sequence
  SiRNA target sequence
gacggtgacaaagtaacaaaaatctt

SEQ ID NO: 105673 - DNA, 26 bp, Artificial sequence
  SiRNA target sequence
acggtgacaaagtaacaaaaatcttt

SEQ ID NO: 105674 - DNA, 26 bp, Artificial sequence
  SiRNA target sequence
cggtgacaaagtaacaaaaatctttt

SEQ ID NO: 105675 - DNA, 26 bp, Artificial sequence
  SiRNA target sequence
ggtgacaaagtaacaaaaatcttttt

SEQ ID NO: 105676 - DNA, 26 bp, Artificial sequence
  SiRNA target sequence
gtgacaaagtaacaaaaatctttttt

SEQ ID NO: 105677 - DNA, 26 bp, Artificial sequence
  SiRNA target sequence
tgacaaagtaacaaaaatcttttttc

SEQ ID NO: 105678 - DNA, 26 bp, Artificial sequence
  SiRNA target sequence
gacaaagtaacaaaaatcttttttcg

SEQ ID NO: 105679 - DNA, 26 bp, Artificial sequence
  SiRNA target sequence
acaaagtaacaaaaatcttttttcgt

SEQ ID NO: 105680 - DNA, 26 bp, Artificial sequence
  SiRNA target sequence
caaagtaacaaaaatcttttttcgtt

SEQ ID NO: 105681 - DNA, 26 bp, Artificial sequence
  SiRNA target sequence
aaagtaacaaaaatcttttttcgtta

SEQ ID NO: 105682 - DNA, 26 bp, Artificial sequence
  SiRNA target sequence
aagtaacaaaaatcttttttcgttaa

SEQ ID NO: 105683 - DNA, 26 bp, Artificial sequence
  SiRNA target sequence
agtaacaaaaatcttttttcgttaat

SEQ ID NO: 105684 - DNA, 26 bp, Artificial sequence
  SiRNA target sequence
gtaacaaaaatcttttttcgttaatg

SEQ ID NO: 105685 - DNA, 26 bp, Artificial sequence
  SiRNA target sequence
taacaaaaatcttttttcgttaatgt

SEQ ID NO: 105686 - DNA, 26 bp, Artificial sequence
  SiRNA target sequence
aacaaaaatcttttttcgttaatgta

SEQ ID NO: 105687 - DNA, 26 bp, Artificial sequence
  SiRNA target sequence
acaaaaatcttttttcgttaatgtaa

SEQ ID NO: 105688 - DNA, 26 bp, Artificial sequence
  SiRNA target sequence
caaaaatcttttttcgttaatgtaaa

SEQ ID NO: 105689 - DNA, 26 bp, Artificial sequence
  SiRNA target sequence
aaaaatcttttttcgttaatgtaaaa

SEQ ID NO: 105690 - DNA, 26 bp, Artificial sequence
  SiRNA target sequence
aaaatcttttttcgttaatgtaaaat

SEQ ID NO: 105691 - DNA, 26 bp, Artificial sequence
  SiRNA target sequence
aaatcttttttcgttaatgtaaaata

SEQ ID NO: 105692 - DNA, 26 bp, Artificial sequence
  SiRNA target sequence
aatcttttttcgttaatgtaaaatat

SEQ ID NO: 105693 - DNA, 26 bp, Artificial sequence
  SiRNA target sequence
atcttttttcgttaatgtaaaatatc

SEQ ID NO: 105694 - DNA, 26 bp, Artificial sequence
  SiRNA target sequence
tcttttttcgttaatgtaaaatatct

SEQ ID NO: 105695 - DNA, 26 bp, Artificial sequence
  SiRNA target sequence
cttttttcgttaatgtaaaatatctt

SEQ ID NO: 105696 - DNA, 26 bp, Artificial sequence
  SiRNA target sequence
ttttttcgttaatgtaaaatatcttg

SEQ ID NO: 105697 - DNA, 26 bp, Artificial sequence
  SiRNA target sequence
tttttcgttaatgtaaaatatcttgg

SEQ ID NO: 105698 - DNA, 26 bp, Artificial sequence
  SiRNA target sequence
ttttcgttaatgtaaaatatcttgga

SEQ ID NO: 105699 - DNA, 26 bp, Artificial sequence
  SiRNA target sequence
tttcgttaatgtaaaatatcttggat

SEQ ID NO: 105700 - DNA, 26 bp, Artificial sequence
  SiRNA target sequence
ttcgttaatgtaaaatatcttggatt

SEQ ID NO: 105701 - DNA, 26 bp, Artificial sequence
  SiRNA target sequence
tcgttaatgtaaaatatcttggatta

SEQ ID NO: 105702 - DNA, 26 bp, Artificial sequence
  SiRNA target sequence
cgttaatgtaaaatatcttggattaa

SEQ ID NO: 105703 - DNA, 26 bp, Artificial sequence
  SiRNA target sequence
gttaatgtaaaatatcttggattaat

SEQ ID NO: 105704 - DNA, 26 bp, Artificial sequence
  SiRNA target sequence
ttaatgtaaaatatcttggattaatt

SEQ ID NO: 105705 - DNA, 26 bp, Artificial sequence
  SiRNA target sequence
taatgtaaaatatcttggattaatta

SEQ ID NO: 105706 - DNA, 26 bp, Artificial sequence
  SiRNA target sequence
aatgtaaaatatcttggattaattac

SEQ ID NO: 105707 - DNA, 26 bp, Artificial sequence
  SiRNA target sequence
atgtaaaatatcttggattaattaca

SEQ ID NO: 105708 - DNA, 26 bp, Artificial sequence
  SiRNA target sequence
tgtaaaatatcttggattaattacag

SEQ ID NO: 105709 - DNA, 26 bp, Artificial sequence
  SiRNA target sequence
gtaaaatatcttggattaattacagg

SEQ ID NO: 105710 - DNA, 26 bp, Artificial sequence
  SiRNA target sequence
taaaatatcttggattaattacaggg

SEQ ID NO: 105711 - DNA, 26 bp, Artificial sequence
  SiRNA target sequence
aaaatatcttggattaattacaggga

SEQ ID NO: 105712 - DNA, 26 bp, Artificial sequence
  SiRNA target sequence
aaatatcttggattaattacagggat

SEQ ID NO: 105713 - DNA, 26 bp, Artificial sequence
  SiRNA target sequence
aatatcttggattaattacagggata

SEQ ID NO: 105714 - DNA, 26 bp, Artificial sequence
  SiRNA target sequence
atatcttggattaattacagggatat

SEQ ID NO: 105715 - DNA, 26 bp, Artificial sequence
  SiRNA target sequence
tatcttggattaattacagggatata

SEQ ID NO: 105716 - DNA, 26 bp, Artificial sequence
  SiRNA target sequence
atcttggattaattacagggatatac

SEQ ID NO: 105717 - DNA, 26 bp, Artificial sequence
  SiRNA target sequence
tcttggattaattacagggatatact

SEQ ID NO: 105718 - DNA, 26 bp, Artificial sequence
  SiRNA target sequence
cttggattaattacagggatatactt

SEQ ID NO: 105719 - DNA, 26 bp, Artificial sequence
  SiRNA target sequence
ttggattaattacagggatatacttg

SEQ ID NO: 105720 - DNA, 26 bp, Artificial sequence
  SiRNA target sequence
tggattaattacagggatatacttgt

SEQ ID NO: 105721 - DNA, 26 bp, Artificial sequence
  SiRNA target sequence
ggattaattacagggatatacttgta

SEQ ID NO: 105722 - DNA, 26 bp, Artificial sequence
  SiRNA target sequence
gattaattacagggatatacttgtac

SEQ ID NO: 105723 - DNA, 26 bp, Artificial sequence
  SiRNA target sequence
attaattacagggatatacttgtaca

SEQ ID NO: 105724 - DNA, 26 bp, Artificial sequence
  SiRNA target sequence
ttaattacagggatatacttgtacat

SEQ ID NO: 105725 - DNA, 26 bp, Artificial sequence
  SiRNA target sequence
taattacagggatatacttgtacata

SEQ ID NO: 105726 - DNA, 26 bp, Artificial sequence
  SiRNA target sequence
aattacagggatatacttgtacataa

SEQ ID NO: 105727 - DNA, 26 bp, Artificial sequence
  SiRNA target sequence
attacagggatatacttgtacataaa

SEQ ID NO: 105728 - DNA, 26 bp, Artificial sequence
  SiRNA target sequence
ttacagggatatacttgtacataaaa

SEQ ID NO: 105729 - DNA, 26 bp, Artificial sequence
  SiRNA target sequence
tacagggatatacttgtacataaaat

SEQ ID NO: 105730 - DNA, 26 bp, Artificial sequence
  SiRNA target sequence
acagggatatacttgtacataaaatt

SEQ ID NO: 105731 - DNA, 26 bp, Artificial sequence
  SiRNA target sequence
cagggatatacttgtacataaaattt

SEQ ID NO: 105732 - DNA, 26 bp, Artificial sequence
  SiRNA target sequence
agggatatacttgtacataaaatttg

SEQ ID NO: 105733 - DNA, 26 bp, Artificial sequence
  SiRNA target sequence
gggatatacttgtacataaaatttga

SEQ ID NO: 105734 - DNA, 26 bp, Artificial sequence
  SiRNA target sequence
ggatatacttgtacataaaatttgag

SEQ ID NO: 105735 - DNA, 26 bp, Artificial sequence
  SiRNA target sequence
gatatacttgtacataaaatttgagg

SEQ ID NO: 105736 - DNA, 26 bp, Artificial sequence
  SiRNA target sequence
atatacttgtacataaaatttgaggt

SEQ ID NO: 105737 - DNA, 26 bp, Artificial sequence
  SiRNA target sequence
tatacttgtacataaaatttgaggta

SEQ ID NO: 105738 - DNA, 26 bp, Artificial sequence
  SiRNA target sequence
atacttgtacataaaatttgaggtaa

SEQ ID NO: 105739 - DNA, 26 bp, Artificial sequence
  SiRNA target sequence
tacttgtacataaaatttgaggtaag

SEQ ID NO: 105740 - DNA, 26 bp, Artificial sequence
  SiRNA target sequence
acttgtacataaaatttgaggtaagt

SEQ ID NO: 105741 - DNA, 26 bp, Artificial sequence
  SiRNA target sequence
cttgtacataaaatttgaggtaagtt

SEQ ID NO: 105742 - DNA, 26 bp, Artificial sequence
  SiRNA target sequence
ttgtacataaaatttgaggtaagttt

SEQ ID NO: 105743 - DNA, 26 bp, Artificial sequence
  SiRNA target sequence
tgtacataaaatttgaggtaagtttt

SEQ ID NO: 105744 - DNA, 26 bp, Artificial sequence
  SiRNA target sequence
gtacataaaatttgaggtaagtttta

SEQ ID NO: 105745 - DNA, 26 bp, Artificial sequence
  SiRNA target sequence
tacataaaatttgaggtaagttttat

SEQ ID NO: 105746 - DNA, 26 bp, Artificial sequence
  SiRNA target sequence
acataaaatttgaggtaagttttatc

SEQ ID NO: 105747 - DNA, 26 bp, Artificial sequence
  SiRNA target sequence
cataaaatttgaggtaagttttatct

SEQ ID NO: 105748 - DNA, 26 bp, Artificial sequence
  SiRNA target sequence
ataaaatttgaggtaagttttatctt

SEQ ID NO: 105749 - DNA, 26 bp, Artificial sequence
  SiRNA target sequence
taaaatttgaggtaagttttatctta

SEQ ID NO: 105750 - DNA, 26 bp, Artificial sequence
  SiRNA target sequence
aaaatttgaggtaagttttatcttaa

SEQ ID NO: 105751 - DNA, 26 bp, Artificial sequence
  SiRNA target sequence
aaatttgaggtaagttttatcttaaa

SEQ ID NO: 105752 - DNA, 26 bp, Artificial sequence
  SiRNA target sequence
aatttgaggtaagttttatcttaaaa

SEQ ID NO: 105753 - DNA, 26 bp, Artificial sequence
  SiRNA target sequence
atttgaggtaagttttatcttaaaat

SEQ ID NO: 105754 - DNA, 26 bp, Artificial sequence
  SiRNA target sequence
tttgaggtaagttttatcttaaaatc

SEQ ID NO: 105755 - DNA, 26 bp, Artificial sequence
  SiRNA target sequence
ttgaggtaagttttatcttaaaatct

SEQ ID NO: 105756 - DNA, 26 bp, Artificial sequence
  SiRNA target sequence
tgaggtaagttttatcttaaaatctt

SEQ ID NO: 105757 - DNA, 26 bp, Artificial sequence
  SiRNA target sequence
gaggtaagttttatcttaaaatcttt

SEQ ID NO: 105758 - DNA, 26 bp, Artificial sequence
  SiRNA target sequence
aggtaagttttatcttaaaatctttt

SEQ ID NO: 105759 - DNA, 26 bp, Artificial sequence
  SiRNA target sequence
ggtaagttttatcttaaaatctttta

SEQ ID NO: 105760 - DNA, 26 bp, Artificial sequence
  SiRNA target sequence
gtaagttttatcttaaaatcttttag

SEQ ID NO: 105761 - DNA, 26 bp, Artificial sequence
  SiRNA target sequence
taagttttatcttaaaatcttttaga

SEQ ID NO: 105762 - DNA, 26 bp, Artificial sequence
  SiRNA target sequence
aagttttatcttaaaatcttttagaa

SEQ ID NO: 105763 - DNA, 26 bp, Artificial sequence
  SiRNA target sequence
agttttatcttaaaatcttttagaac

SEQ ID NO: 105764 - DNA, 26 bp, Artificial sequence
  SiRNA target sequence
gttttatcttaaaatcttttagaacc

SEQ ID NO: 105765 - DNA, 26 bp, Artificial sequence
  SiRNA target sequence
ttttatcttaaaatcttttagaacct

SEQ ID NO: 105766 - DNA, 26 bp, Artificial sequence
  SiRNA target sequence
tttatcttaaaatcttttagaacctc

SEQ ID NO: 105767 - DNA, 26 bp, Artificial sequence
  SiRNA target sequence
ttatcttaaaatcttttagaacctca

SEQ ID NO: 105768 - DNA, 26 bp, Artificial sequence
  SiRNA target sequence
tatcttaaaatcttttagaacctcaa

SEQ ID NO: 105769 - DNA, 26 bp, Artificial sequence
  SiRNA target sequence
atcttaaaatcttttagaacctcaaa

SEQ ID NO: 105770 - DNA, 26 bp, Artificial sequence
  SiRNA target sequence
tcttaaaatcttttagaacctcaaaa

SEQ ID NO: 105771 - DNA, 26 bp, Artificial sequence
  SiRNA target sequence
cttaaaatcttttagaacctcaaaaa

SEQ ID NO: 105772 - DNA, 26 bp, Artificial sequence
  SiRNA target sequence
ttaaaatcttttagaacctcaaaaat

SEQ ID NO: 105773 - DNA, 26 bp, Artificial sequence
  SiRNA target sequence
taaaatcttttagaacctcaaaaata

SEQ ID NO: 105774 - DNA, 26 bp, Artificial sequence
  SiRNA target sequence
aaaatcttttagaacctcaaaaatag

SEQ ID NO: 105775 - DNA, 26 bp, Artificial sequence
  SiRNA target sequence
aaatcttttagaacctcaaaaatagt

SEQ ID NO: 105776 - DNA, 26 bp, Artificial sequence
  SiRNA target sequence
aatcttttagaacctcaaaaatagtg

SEQ ID NO: 105777 - DNA, 26 bp, Artificial sequence
  SiRNA target sequence
atcttttagaacctcaaaaatagtgc

SEQ ID NO: 105778 - DNA, 26 bp, Artificial sequence
  SiRNA target sequence
tcttttagaacctcaaaaatagtgcg

SEQ ID NO: 105779 - DNA, 26 bp, Artificial sequence
  SiRNA target sequence
cttttagaacctcaaaaatagtgcgc

SEQ ID NO: 105780 - DNA, 26 bp, Artificial sequence
  SiRNA target sequence
ttttagaacctcaaaaatagtgcgct

SEQ ID NO: 105781 - DNA, 26 bp, Artificial sequence
  SiRNA target sequence
tttagaacctcaaaaatagtgcgctt

SEQ ID NO: 105782 - DNA, 26 bp, Artificial sequence
  SiRNA target sequence
ttagaacctcaaaaatagtgcgcttc

SEQ ID NO: 105783 - DNA, 26 bp, Artificial sequence
  SiRNA target sequence
tagaacctcaaaaatagtgcgcttcg

SEQ ID NO: 105784 - DNA, 26 bp, Artificial sequence
  SiRNA target sequence
agaacctcaaaaatagtgcgcttcgg

SEQ ID NO: 105785 - DNA, 26 bp, Artificial sequence
  SiRNA target sequence
gaacctcaaaaatagtgcgcttcggt

SEQ ID NO: 105786 - DNA, 26 bp, Artificial sequence
  SiRNA target sequence
aacctcaaaaatagtgcgcttcggta

SEQ ID NO: 105787 - DNA, 26 bp, Artificial sequence
  SiRNA target sequence
acctcaaaaatagtgcgcttcggtag

SEQ ID NO: 105788 - DNA, 26 bp, Artificial sequence
  SiRNA target sequence
cctcaaaaatagtgcgcttcggtagt

SEQ ID NO: 105789 - DNA, 26 bp, Artificial sequence
  SiRNA target sequence
ctcaaaaatagtgcgcttcggtagta

SEQ ID NO: 105790 - DNA, 26 bp, Artificial sequence
  SiRNA target sequence
tcaaaaatagtgcgcttcggtagtaa

SEQ ID NO: 105791 - DNA, 26 bp, Artificial sequence
  SiRNA target sequence
caaaaatagtgcgcttcggtagtaaa

SEQ ID NO: 105792 - DNA, 26 bp, Artificial sequence
  SiRNA target sequence
aaaaatagtgcgcttcggtagtaaaa

SEQ ID NO: 105793 - DNA, 26 bp, Artificial sequence
  SiRNA target sequence
aaaatagtgcgcttcggtagtaaaat

SEQ ID NO: 105794 - DNA, 26 bp, Artificial sequence
  SiRNA target sequence
aaatagtgcgcttcggtagtaaaatg

SEQ ID NO: 105795 - DNA, 26 bp, Artificial sequence
  SiRNA target sequence
aatagtgcgcttcggtagtaaaatgt

SEQ ID NO: 105796 - DNA, 26 bp, Artificial sequence
  SiRNA target sequence
atagtgcgcttcggtagtaaaatgta

SEQ ID NO: 105797 - DNA, 26 bp, Artificial sequence
  SiRNA target sequence
tagtgcgcttcggtagtaaaatgtaa

SEQ ID NO: 105798 - DNA, 26 bp, Artificial sequence
  SiRNA target sequence
agtgcgcttcggtagtaaaatgtaat

SEQ ID NO: 105799 - DNA, 26 bp, Artificial sequence
  SiRNA target sequence
gtgcgcttcggtagtaaaatgtaatc

SEQ ID NO: 105800 - DNA, 26 bp, Artificial sequence
  SiRNA target sequence
tgcgcttcggtagtaaaatgtaatca

SEQ ID NO: 105801 - DNA, 26 bp, Artificial sequence
  SiRNA target sequence
gcgcttcggtagtaaaatgtaatcat

SEQ ID NO: 105802 - DNA, 26 bp, Artificial sequence
  SiRNA target sequence
cgcttcggtagtaaaatgtaatcata

SEQ ID NO: 105803 - DNA, 26 bp, Artificial sequence
  SiRNA target sequence
gcttcggtagtaaaatgtaatcatag

SEQ ID NO: 105804 - DNA, 26 bp, Artificial sequence
  SiRNA target sequence
cttcggtagtaaaatgtaatcatagt

SEQ ID NO: 105805 - DNA, 26 bp, Artificial sequence
  SiRNA target sequence
ttcggtagtaaaatgtaatcatagta

SEQ ID NO: 105806 - DNA, 26 bp, Artificial sequence
  SiRNA target sequence
tcggtagtaaaatgtaatcatagtac

SEQ ID NO: 105807 - DNA, 26 bp, Artificial sequence
  SiRNA target sequence
cggtagtaaaatgtaatcatagtaca

SEQ ID NO: 105808 - DNA, 26 bp, Artificial sequence
  SiRNA target sequence
ggtagtaaaatgtaatcatagtacag

SEQ ID NO: 105809 - DNA, 26 bp, Artificial sequence
  SiRNA target sequence
gtagtaaaatgtaatcatagtacaga

SEQ ID NO: 105810 - DNA, 26 bp, Artificial sequence
  SiRNA target sequence
tagtaaaatgtaatcatagtacagat

SEQ ID NO: 105811 - DNA, 26 bp, Artificial sequence
  SiRNA target sequence
agtaaaatgtaatcatagtacagatc

SEQ ID NO: 105812 - DNA, 26 bp, Artificial sequence
  SiRNA target sequence
gtaaaatgtaatcatagtacagatcg

SEQ ID NO: 105813 - DNA, 26 bp, Artificial sequence
  SiRNA target sequence
taaaatgtaatcatagtacagatcgt

SEQ ID NO: 105814 - DNA, 26 bp, Artificial sequence
  SiRNA target sequence
aaaatgtaatcatagtacagatcgta

SEQ ID NO: 105815 - DNA, 26 bp, Artificial sequence
  SiRNA target sequence
aaatgtaatcatagtacagatcgtaa

SEQ ID NO: 105816 - DNA, 26 bp, Artificial sequence
  SiRNA target sequence
aatgtaatcatagtacagatcgtaat

SEQ ID NO: 105817 - DNA, 26 bp, Artificial sequence
  SiRNA target sequence
atgtaatcatagtacagatcgtaatt

SEQ ID NO: 105818 - DNA, 26 bp, Artificial sequence
  SiRNA target sequence
tgtaatcatagtacagatcgtaattt

SEQ ID NO: 105819 - DNA, 26 bp, Artificial sequence
  SiRNA target sequence
gtaatcatagtacagatcgtaattta

SEQ ID NO: 105820 - DNA, 26 bp, Artificial sequence
  SiRNA target sequence
taatcatagtacagatcgtaatttag

SEQ ID NO: 105821 - DNA, 26 bp, Artificial sequence
  SiRNA target sequence
aatcatagtacagatcgtaatttaga

SEQ ID NO: 105822 - DNA, 26 bp, Artificial sequence
  SiRNA target sequence
atcatagtacagatcgtaatttagat

SEQ ID NO: 105823 - DNA, 26 bp, Artificial sequence
  SiRNA target sequence
tcatagtacagatcgtaatttagata

SEQ ID NO: 105824 - DNA, 26 bp, Artificial sequence
  SiRNA target sequence
catagtacagatcgtaatttagataa

SEQ ID NO: 105825 - DNA, 26 bp, Artificial sequence
  SiRNA target sequence
atagtacagatcgtaatttagataaa

SEQ ID NO: 105826 - DNA, 26 bp, Artificial sequence
  SiRNA target sequence
tagtacagatcgtaatttagataaat

SEQ ID NO: 105827 - DNA, 26 bp, Artificial sequence
  SiRNA target sequence
agtacagatcgtaatttagataaatt

SEQ ID NO: 105828 - DNA, 26 bp, Artificial sequence
  SiRNA target sequence
gtacagatcgtaatttagataaattt

SEQ ID NO: 105829 - DNA, 26 bp, Artificial sequence
  SiRNA target sequence
tacagatcgtaatttagataaatttc

SEQ ID NO: 105830 - DNA, 26 bp, Artificial sequence
  SiRNA target sequence
acagatcgtaatttagataaatttct

SEQ ID NO: 105831 - DNA, 26 bp, Artificial sequence
  SiRNA target sequence
cagatcgtaatttagataaatttctt

SEQ ID NO: 105832 - DNA, 26 bp, Artificial sequence
  SiRNA target sequence
agatcgtaatttagataaatttcttt

SEQ ID NO: 105833 - DNA, 26 bp, Artificial sequence
  SiRNA target sequence
gatcgtaatttagataaatttcttta

SEQ ID NO: 105834 - DNA, 26 bp, Artificial sequence
  SiRNA target sequence
atcgtaatttagataaatttctttac

SEQ ID NO: 105835 - DNA, 26 bp, Artificial sequence
  SiRNA target sequence
tcgtaatttagataaatttctttaca

SEQ ID NO: 105836 - DNA, 26 bp, Artificial sequence
  SiRNA target sequence
cgtaatttagataaatttctttacat

SEQ ID NO: 105837 - DNA, 26 bp, Artificial sequence
  SiRNA target sequence
gtaatttagataaatttctttacatt

SEQ ID NO: 105838 - DNA, 26 bp, Artificial sequence
  SiRNA target sequence
taatttagataaatttctttacattt

SEQ ID NO: 105839 - DNA, 26 bp, Artificial sequence
  SiRNA target sequence
aatttagataaatttctttacatttc

SEQ ID NO: 105840 - DNA, 26 bp, Artificial sequence
  SiRNA target sequence
atttagataaatttctttacatttct

SEQ ID NO: 105841 - DNA, 26 bp, Artificial sequence
  SiRNA target sequence
tttagataaatttctttacatttctc

SEQ ID NO: 105842 - DNA, 26 bp, Artificial sequence
  SiRNA target sequence
ttagataaatttctttacatttctca

SEQ ID NO: 105843 - DNA, 26 bp, Artificial sequence
  SiRNA target sequence
tagataaatttctttacatttctcac

SEQ ID NO: 105844 - DNA, 26 bp, Artificial sequence
  SiRNA target sequence
agataaatttctttacatttctcacg

SEQ ID NO: 105845 - DNA, 26 bp, Artificial sequence
  SiRNA target sequence
gataaatttctttacatttctcacga

SEQ ID NO: 105846 - DNA, 26 bp, Artificial sequence
  SiRNA target sequence
ataaatttctttacatttctcacgat

SEQ ID NO: 105847 - DNA, 26 bp, Artificial sequence
  SiRNA target sequence
taaatttctttacatttctcacgata

SEQ ID NO: 105848 - DNA, 26 bp, Artificial sequence
  SiRNA target sequence
aaatttctttacatttctcacgatat

SEQ ID NO: 105849 - DNA, 26 bp, Artificial sequence
  SiRNA target sequence
aatttctttacatttctcacgatatt

SEQ ID NO: 105850 - DNA, 26 bp, Artificial sequence
  SiRNA target sequence
atttctttacatttctcacgatattc

SEQ ID NO: 105851 - DNA, 26 bp, Artificial sequence
  SiRNA target sequence
tttctttacatttctcacgatattcc

SEQ ID NO: 105852 - DNA, 26 bp, Artificial sequence
  SiRNA target sequence
ttctttacatttctcacgatattcct

SEQ ID NO: 105853 - DNA, 26 bp, Artificial sequence
  SiRNA target sequence
tctttacatttctcacgatattcctc

SEQ ID NO: 105854 - DNA, 26 bp, Artificial sequence
  SiRNA target sequence
ctttacatttctcacgatattcctca

SEQ ID NO: 105855 - DNA, 26 bp, Artificial sequence
  SiRNA target sequence
tttacatttctcacgatattcctcag

SEQ ID NO: 105856 - DNA, 26 bp, Artificial sequence
  SiRNA target sequence
ttacatttctcacgatattcctcagc

SEQ ID NO: 105857 - DNA, 26 bp, Artificial sequence
  SiRNA target sequence
tacatttctcacgatattcctcagca

SEQ ID NO: 105858 - DNA, 26 bp, Artificial sequence
  SiRNA target sequence
acatttctcacgatattcctcagcaa

SEQ ID NO: 105859 - DNA, 26 bp, Artificial sequence
  SiRNA target sequence
catttctcacgatattcctcagcaat

SEQ ID NO: 105860 - DNA, 26 bp, Artificial sequence
  SiRNA target sequence
atttctcacgatattcctcagcaatg

SEQ ID NO: 105861 - DNA, 26 bp, Artificial sequence
  SiRNA target sequence
tttctcacgatattcctcagcaatgg

SEQ ID NO: 105862 - DNA, 26 bp, Artificial sequence
  SiRNA target sequence
ttctcacgatattcctcagcaatggt

SEQ ID NO: 105863 - DNA, 26 bp, Artificial sequence
  SiRNA target sequence
tctcacgatattcctcagcaatggta

SEQ ID NO: 105864 - DNA, 26 bp, Artificial sequence
  SiRNA target sequence
ctcacgatattcctcagcaatggtat

SEQ ID NO: 105865 - DNA, 26 bp, Artificial sequence
  SiRNA target sequence
tcacgatattcctcagcaatggtatc

SEQ ID NO: 105866 - DNA, 26 bp, Artificial sequence
  SiRNA target sequence
cacgatattcctcagcaatggtatct

SEQ ID NO: 105867 - DNA, 26 bp, Artificial sequence
  SiRNA target sequence
acgatattcctcagcaatggtatctg

SEQ ID NO: 105868 - DNA, 26 bp, Artificial sequence
  SiRNA target sequence
cgatattcctcagcaatggtatctgt

SEQ ID NO: 105869 - DNA, 26 bp, Artificial sequence
  SiRNA target sequence
gatattcctcagcaatggtatctgtg

SEQ ID NO: 105870 - DNA, 26 bp, Artificial sequence
  SiRNA target sequence
atattcctcagcaatggtatctgtga

SEQ ID NO: 105871 - DNA, 26 bp, Artificial sequence
  SiRNA target sequence
tattcctcagcaatggtatctgtgat

SEQ ID NO: 105872 - DNA, 26 bp, Artificial sequence
  SiRNA target sequence
attcctcagcaatggtatctgtgata

SEQ ID NO: 105873 - DNA, 26 bp, Artificial sequence
  SiRNA target sequence
ttcctcagcaatggtatctgtgataa

SEQ ID NO: 105874 - DNA, 26 bp, Artificial sequence
  SiRNA target sequence
tcctcagcaatggtatctgtgataag

SEQ ID NO: 105875 - DNA, 26 bp, Artificial sequence
  SiRNA target sequence
cctcagcaatggtatctgtgataagc

SEQ ID NO: 105876 - DNA, 26 bp, Artificial sequence
  SiRNA target sequence
ctcagcaatggtatctgtgataagcg

SEQ ID NO: 105877 - DNA, 26 bp, Artificial sequence
  SiRNA target sequence
tcagcaatggtatctgtgataagcga

SEQ ID NO: 105878 - DNA, 26 bp, Artificial sequence
  SiRNA target sequence
cagcaatggtatctgtgataagcgaa

SEQ ID NO: 105879 - DNA, 26 bp, Artificial sequence
  SiRNA target sequence
agcaatggtatctgtgataagcgaaa

SEQ ID NO: 105880 - DNA, 26 bp, Artificial sequence
  SiRNA target sequence
gcaatggtatctgtgataagcgaaag

SEQ ID NO: 105881 - DNA, 26 bp, Artificial sequence
  SiRNA target sequence
caatggtatctgtgataagcgaaagt

SEQ ID NO: 105882 - DNA, 26 bp, Artificial sequence
  SiRNA target sequence
aatggtatctgtgataagcgaaagtt

SEQ ID NO: 105883 - DNA, 26 bp, Artificial sequence
  SiRNA target sequence
atggtatctgtgataagcgaaagttg

SEQ ID NO: 105884 - DNA, 26 bp, Artificial sequence
  SiRNA target sequence
tggtatctgtgataagcgaaagttgt

SEQ ID NO: 105885 - DNA, 26 bp, Artificial sequence
  SiRNA target sequence
ggtatctgtgataagcgaaagttgta

SEQ ID NO: 105886 - DNA, 26 bp, Artificial sequence
  SiRNA target sequence
gtatctgtgataagcgaaagttgtag

SEQ ID NO: 105887 - DNA, 26 bp, Artificial sequence
  SiRNA target sequence
tatctgtgataagcgaaagttgtaga

SEQ ID NO: 105888 - DNA, 26 bp, Artificial sequence
  SiRNA target sequence
atctgtgataagcgaaagttgtagaa

SEQ ID NO: 105889 - DNA, 26 bp, Artificial sequence
  SiRNA target sequence
tctgtgataagcgaaagttgtagaaa

SEQ ID NO: 105890 - DNA, 26 bp, Artificial sequence
  SiRNA target sequence
ctgtgataagcgaaagttgtagaaaa

SEQ ID NO: 105891 - DNA, 26 bp, Artificial sequence
  SiRNA target sequence
tgtgataagcgaaagttgtagaaaaa

SEQ ID NO: 105892 - DNA, 26 bp, Artificial sequence
  SiRNA target sequence
gtgataagcgaaagttgtagaaaaaa

SEQ ID NO: 105893 - DNA, 26 bp, Artificial sequence
  SiRNA target sequence
tgataagcgaaagttgtagaaaaaaa

SEQ ID NO: 105894 - DNA, 26 bp, Artificial sequence
  SiRNA target sequence
gataagcgaaagttgtagaaaaaaat

SEQ ID NO: 105895 - DNA, 26 bp, Artificial sequence
  SiRNA target sequence
ataagcgaaagttgtagaaaaaaata

SEQ ID NO: 105896 - DNA, 26 bp, Artificial sequence
  SiRNA target sequence
taagcgaaagttgtagaaaaaaatag

SEQ ID NO: 105897 - DNA, 26 bp, Artificial sequence
  SiRNA target sequence
aagcgaaagttgtagaaaaaaataga

SEQ ID NO: 105898 - DNA, 26 bp, Artificial sequence
  SiRNA target sequence
agcgaaagttgtagaaaaaaatagat

SEQ ID NO: 105899 - DNA, 26 bp, Artificial sequence
  SiRNA target sequence
gcgaaagttgtagaaaaaaatagatt

SEQ ID NO: 105900 - DNA, 26 bp, Artificial sequence
  SiRNA target sequence
cgaaagttgtagaaaaaaatagattt

SEQ ID NO: 105901 - DNA, 26 bp, Artificial sequence
  SiRNA target sequence
gaaagttgtagaaaaaaatagatttg

SEQ ID NO: 105902 - DNA, 26 bp, Artificial sequence
  SiRNA target sequence
aaagttgtagaaaaaaatagatttga

SEQ ID NO: 105903 - DNA, 26 bp, Artificial sequence
  SiRNA target sequence
aagttgtagaaaaaaatagatttgag

SEQ ID NO: 105904 - DNA, 26 bp, Artificial sequence
  SiRNA target sequence
agttgtagaaaaaaatagatttgagg

SEQ ID NO: 105905 - DNA, 26 bp, Artificial sequence
  SiRNA target sequence
gttgtagaaaaaaatagatttgagga

SEQ ID NO: 105906 - DNA, 26 bp, Artificial sequence
  SiRNA target sequence
ttgtagaaaaaaatagatttgaggaa

SEQ ID NO: 105907 - DNA, 26 bp, Artificial sequence
  SiRNA target sequence
tgtagaaaaaaatagatttgaggaat

SEQ ID NO: 105908 - DNA, 26 bp, Artificial sequence
  SiRNA target sequence
gtagaaaaaaatagatttgaggaata

SEQ ID NO: 105909 - DNA, 26 bp, Artificial sequence
  SiRNA target sequence
tagaaaaaaatagatttgaggaatag

SEQ ID NO: 105910 - DNA, 26 bp, Artificial sequence
  SiRNA target sequence
agaaaaaaatagatttgaggaataga

SEQ ID NO: 105911 - DNA, 26 bp, Artificial sequence
  SiRNA target sequence
gaaaaaaatagatttgaggaatagaa

SEQ ID NO: 105912 - DNA, 26 bp, Artificial sequence
  SiRNA target sequence
aaaaaaatagatttgaggaatagaat

SEQ ID NO: 105913 - DNA, 26 bp, Artificial sequence
  SiRNA target sequence
aaaaaatagatttgaggaatagaatt

SEQ ID NO: 105914 - DNA, 26 bp, Artificial sequence
  SiRNA target sequence
aaaaatagatttgaggaatagaatta

SEQ ID NO: 105915 - DNA, 26 bp, Artificial sequence
  SiRNA target sequence
aaaatagatttgaggaatagaattaa

SEQ ID NO: 105916 - DNA, 26 bp, Artificial sequence
  SiRNA target sequence
aaatagatttgaggaatagaattaaa

SEQ ID NO: 105917 - DNA, 26 bp, Artificial sequence
  SiRNA target sequence
aatagatttgaggaatagaattaaaa

SEQ ID NO: 105918 - DNA, 26 bp, Artificial sequence
  SiRNA target sequence
atagatttgaggaatagaattaaaat

SEQ ID NO: 105919 - DNA, 26 bp, Artificial sequence
  SiRNA target sequence
tagatttgaggaatagaattaaaatc

SEQ ID NO: 105920 - DNA, 26 bp, Artificial sequence
  SiRNA target sequence
agatttgaggaatagaattaaaatca

SEQ ID NO: 105921 - DNA, 26 bp, Artificial sequence
  SiRNA target sequence
gatttgaggaatagaattaaaatcac

SEQ ID NO: 105922 - DNA, 26 bp, Artificial sequence
  SiRNA target sequence
atttgaggaatagaattaaaatcaca

SEQ ID NO: 105923 - DNA, 26 bp, Artificial sequence
  SiRNA target sequence
tttgaggaatagaattaaaatcacaa

SEQ ID NO: 105924 - DNA, 26 bp, Artificial sequence
  SiRNA target sequence
ttgaggaatagaattaaaatcacaat

SEQ ID NO: 105925 - DNA, 26 bp, Artificial sequence
  SiRNA target sequence
tgaggaatagaattaaaatcacaata

SEQ ID NO: 105926 - DNA, 26 bp, Artificial sequence
  SiRNA target sequence
gaggaatagaattaaaatcacaatat

SEQ ID NO: 105927 - DNA, 26 bp, Artificial sequence
  SiRNA target sequence
aggaatagaattaaaatcacaatatt

SEQ ID NO: 105928 - DNA, 26 bp, Artificial sequence
  SiRNA target sequence
ggaatagaattaaaatcacaatattt

SEQ ID NO: 105929 - DNA, 26 bp, Artificial sequence
  SiRNA target sequence
gaatagaattaaaatcacaatatttt

SEQ ID NO: 105930 - DNA, 26 bp, Artificial sequence
  SiRNA target sequence
aatagaattaaaatcacaatattttt

SEQ ID NO: 105931 - DNA, 26 bp, Artificial sequence
  SiRNA target sequence
atagaattaaaatcacaatatttttt

SEQ ID NO: 105932 - DNA, 26 bp, Artificial sequence
  SiRNA target sequence
tagaattaaaatcacaatatttttta

SEQ ID NO: 105933 - DNA, 26 bp, Artificial sequence
  SiRNA target sequence
agaattaaaatcacaatattttttaa

SEQ ID NO: 105934 - DNA, 26 bp, Artificial sequence
  SiRNA target sequence
gaattaaaatcacaatattttttaat

SEQ ID NO: 105935 - DNA, 26 bp, Artificial sequence
  SiRNA target sequence
aattaaaatcacaatattttttaata

SEQ ID NO: 105936 - DNA, 26 bp, Artificial sequence
  SiRNA target sequence
attaaaatcacaatattttttaatat

SEQ ID NO: 105937 - DNA, 26 bp, Artificial sequence
  SiRNA target sequence
ttaaaatcacaatattttttaatata

SEQ ID NO: 105938 - DNA, 26 bp, Artificial sequence
  SiRNA target sequence
taaaatcacaatattttttaatatat

SEQ ID NO: 105939 - DNA, 26 bp, Artificial sequence
  SiRNA target sequence
aaaatcacaatattttttaatatatt

SEQ ID NO: 105940 - DNA, 26 bp, Artificial sequence
  SiRNA target sequence
aaatcacaatattttttaatatattt

SEQ ID NO: 105941 - DNA, 26 bp, Artificial sequence
  SiRNA target sequence
aatcacaatattttttaatatattta

SEQ ID NO: 105942 - DNA, 26 bp, Artificial sequence
  SiRNA target sequence
atcacaatattttttaatatatttaa

SEQ ID NO: 105943 - DNA, 26 bp, Artificial sequence
  SiRNA target sequence
tcacaatattttttaatatatttaac

SEQ ID NO: 105944 - DNA, 26 bp, Artificial sequence
  SiRNA target sequence
cacaatattttttaatatatttaacc

SEQ ID NO: 105945 - DNA, 26 bp, Artificial sequence
  SiRNA target sequence
acaatattttttaatatatttaacca

SEQ ID NO: 105946 - DNA, 26 bp, Artificial sequence
  SiRNA target sequence
caatattttttaatatatttaaccaa

SEQ ID NO: 105947 - DNA, 26 bp, Artificial sequence
  SiRNA target sequence
aatattttttaatatatttaaccaag

SEQ ID NO: 105948 - DNA, 26 bp, Artificial sequence
  SiRNA target sequence
atattttttaatatatttaaccaagg

SEQ ID NO: 105949 - DNA, 26 bp, Artificial sequence
  SiRNA target sequence
tattttttaatatatttaaccaaggt

SEQ ID NO: 105950 - DNA, 26 bp, Artificial sequence
  SiRNA target sequence
attttttaatatatttaaccaaggta

SEQ ID NO: 105951 - DNA, 26 bp, Artificial sequence
  SiRNA target sequence
ttttttaatatatttaaccaaggtat

SEQ ID NO: 105952 - DNA, 26 bp, Artificial sequence
  SiRNA target sequence
tttttaatatatttaaccaaggtatt

SEQ ID NO: 105953 - DNA, 26 bp, Artificial sequence
  SiRNA target sequence
ttttaatatatttaaccaaggtattg

SEQ ID NO: 105954 - DNA, 26 bp, Artificial sequence
  SiRNA target sequence
tttaatatatttaaccaaggtattgt

SEQ ID NO: 105955 - DNA, 26 bp, Artificial sequence
  SiRNA target sequence
ttaatatatttaaccaaggtattgtc

SEQ ID NO: 105956 - DNA, 26 bp, Artificial sequence
  SiRNA target sequence
taatatatttaaccaaggtattgtcc

SEQ ID NO: 105957 - DNA, 26 bp, Artificial sequence
  SiRNA target sequence
aatatatttaaccaaggtattgtcct

SEQ ID NO: 105958 - DNA, 26 bp, Artificial sequence
  SiRNA target sequence
atatatttaaccaaggtattgtcctt

SEQ ID NO: 105959 - DNA, 26 bp, Artificial sequence
  SiRNA target sequence
tatatttaaccaaggtattgtccttt

SEQ ID NO: 105960 - DNA, 26 bp, Artificial sequence
  SiRNA target sequence
atatttaaccaaggtattgtccttta

SEQ ID NO: 105961 - DNA, 26 bp, Artificial sequence
  SiRNA target sequence
tatttaaccaaggtattgtcctttat

SEQ ID NO: 105962 - DNA, 26 bp, Artificial sequence
  SiRNA target sequence
atttaaccaaggtattgtcctttatg

SEQ ID NO: 105963 - DNA, 26 bp, Artificial sequence
  SiRNA target sequence
tttaaccaaggtattgtcctttatgt

SEQ ID NO: 105964 - DNA, 26 bp, Artificial sequence
  SiRNA target sequence
ttaaccaaggtattgtcctttatgtt

SEQ ID NO: 105965 - DNA, 26 bp, Artificial sequence
  SiRNA target sequence
taaccaaggtattgtcctttatgtta

SEQ ID NO: 105966 - DNA, 26 bp, Artificial sequence
  SiRNA target sequence
aaccaaggtattgtcctttatgttat

SEQ ID NO: 105967 - DNA, 26 bp, Artificial sequence
  SiRNA target sequence
accaaggtattgtcctttatgttatt

SEQ ID NO: 105968 - DNA, 26 bp, Artificial sequence
  SiRNA target sequence
ccaaggtattgtcctttatgttatta

SEQ ID NO: 105969 - DNA, 26 bp, Artificial sequence
  SiRNA target sequence
caaggtattgtcctttatgttattat

SEQ ID NO: 105970 - DNA, 26 bp, Artificial sequence
  SiRNA target sequence
aaggtattgtcctttatgttattata

SEQ ID NO: 105971 - DNA, 26 bp, Artificial sequence
  SiRNA target sequence
aggtattgtcctttatgttattatat

SEQ ID NO: 105972 - DNA, 26 bp, Artificial sequence
  SiRNA target sequence
ggtattgtcctttatgttattatatc

SEQ ID NO: 105973 - DNA, 26 bp, Artificial sequence
  SiRNA target sequence
gtattgtcctttatgttattatatct

SEQ ID NO: 105974 - DNA, 26 bp, Artificial sequence
  SiRNA target sequence
tattgtcctttatgttattatatctt

SEQ ID NO: 105975 - DNA, 26 bp, Artificial sequence
  SiRNA target sequence
attgtcctttatgttattatatctta

SEQ ID NO: 105976 - DNA, 26 bp, Artificial sequence
  SiRNA target sequence
ttgtcctttatgttattatatcttac

SEQ ID NO: 105977 - DNA, 26 bp, Artificial sequence
  SiRNA target sequence
tgtcctttatgttattatatcttaca

SEQ ID NO: 105978 - DNA, 26 bp, Artificial sequence
  SiRNA target sequence
gtcctttatgttattatatcttacaa

SEQ ID NO: 105979 - DNA, 26 bp, Artificial sequence
  SiRNA target sequence
tcctttatgttattatatcttacaaa

SEQ ID NO: 105980 - DNA, 26 bp, Artificial sequence
  SiRNA target sequence
cctttatgttattatatcttacaaac

SEQ ID NO: 105981 - DNA, 26 bp, Artificial sequence
  SiRNA target sequence
ctttatgttattatatcttacaaact

SEQ ID NO: 105982 - DNA, 26 bp, Artificial sequence
  SiRNA target sequence
tttatgttattatatcttacaaactc

SEQ ID NO: 105983 - DNA, 26 bp, Artificial sequence
  SiRNA target sequence
ttatgttattatatcttacaaactcc

SEQ ID NO: 105984 - DNA, 26 bp, Artificial sequence
  SiRNA target sequence
tatgttattatatcttacaaactcct

SEQ ID NO: 105985 - DNA, 26 bp, Artificial sequence
  SiRNA target sequence
atgttattatatcttacaaactcctc

SEQ ID NO: 105986 - DNA, 26 bp, Artificial sequence
  SiRNA target sequence
tgttattatatcttacaaactcctcg

SEQ ID NO: 105987 - DNA, 26 bp, Artificial sequence
  SiRNA target sequence
gttattatatcttacaaactcctcgt

SEQ ID NO: 105988 - DNA, 26 bp, Artificial sequence
  SiRNA target sequence
ttattatatcttacaaactcctcgta

SEQ ID NO: 105989 - DNA, 26 bp, Artificial sequence
  SiRNA target sequence
tattatatcttacaaactcctcgtaa

SEQ ID NO: 105990 - DNA, 26 bp, Artificial sequence
  SiRNA target sequence
attatatcttacaaactcctcgtaat

SEQ ID NO: 105991 - DNA, 26 bp, Artificial sequence
  SiRNA target sequence
ttatatcttacaaactcctcgtaatt

SEQ ID NO: 105992 - DNA, 26 bp, Artificial sequence
  SiRNA target sequence
tatatcttacaaactcctcgtaatta

SEQ ID NO: 105993 - DNA, 26 bp, Artificial sequence
  SiRNA target sequence
atatcttacaaactcctcgtaattat

SEQ ID NO: 105994 - DNA, 26 bp, Artificial sequence
  SiRNA target sequence
tatcttacaaactcctcgtaattata

SEQ ID NO: 105995 - DNA, 26 bp, Artificial sequence
  SiRNA target sequence
atcttacaaactcctcgtaattataa

SEQ ID NO: 105996 - DNA, 26 bp, Artificial sequence
  SiRNA target sequence
tcttacaaactcctcgtaattataat

SEQ ID NO: 105997 - DNA, 26 bp, Artificial sequence
  SiRNA target sequence
cttacaaactcctcgtaattataatt

SEQ ID NO: 105998 - DNA, 26 bp, Artificial sequence
  SiRNA target sequence
ttacaaactcctcgtaattataattt

SEQ ID NO: 105999 - DNA, 26 bp, Artificial sequence
  SiRNA target sequence
tacaaactcctcgtaattataatttt

SEQ ID NO: 106000 - DNA, 26 bp, Artificial sequence
  SiRNA target sequence
acaaactcctcgtaattataattttc

SEQ ID NO: 106001 - DNA, 26 bp, Artificial sequence
  SiRNA target sequence
caaactcctcgtaattataattttca

SEQ ID NO: 106002 - DNA, 26 bp, Artificial sequence
  SiRNA target sequence
aaactcctcgtaattataattttcag

SEQ ID NO: 106003 - DNA, 26 bp, Artificial sequence
  SiRNA target sequence
aactcctcgtaattataattttcagg

SEQ ID NO: 106004 - DNA, 26 bp, Artificial sequence
  SiRNA target sequence
actcctcgtaattataattttcagga

SEQ ID NO: 106005 - DNA, 26 bp, Artificial sequence
  SiRNA target sequence
ctcctcgtaattataattttcaggat

SEQ ID NO: 106006 - DNA, 26 bp, Artificial sequence
  SiRNA target sequence
tcctcgtaattataattttcaggata

SEQ ID NO: 106007 - DNA, 26 bp, Artificial sequence
  SiRNA target sequence
cctcgtaattataattttcaggataa

SEQ ID NO: 106008 - DNA, 26 bp, Artificial sequence
  SiRNA target sequence
ctcgtaattataattttcaggataaa

SEQ ID NO: 106009 - DNA, 26 bp, Artificial sequence
  SiRNA target sequence
tcgtaattataattttcaggataaac

SEQ ID NO: 106010 - DNA, 26 bp, Artificial sequence
  SiRNA target sequence
cgtaattataattttcaggataaacc

SEQ ID NO: 106011 - DNA, 26 bp, Artificial sequence
  SiRNA target sequence
gtaattataattttcaggataaaccg

SEQ ID NO: 106012 - DNA, 26 bp, Artificial sequence
  SiRNA target sequence
taattataattttcaggataaaccgc

SEQ ID NO: 106013 - DNA, 26 bp, Artificial sequence
  SiRNA target sequence
aattataattttcaggataaaccgct

SEQ ID NO: 106014 - DNA, 26 bp, Artificial sequence
  SiRNA target sequence
attataattttcaggataaaccgcta

SEQ ID NO: 106015 - DNA, 26 bp, Artificial sequence
  SiRNA target sequence
ttataattttcaggataaaccgctag

SEQ ID NO: 106016 - DNA, 26 bp, Artificial sequence
  SiRNA target sequence
tataattttcaggataaaccgctaga

SEQ ID NO: 106017 - DNA, 26 bp, Artificial sequence
  SiRNA target sequence
ataattttcaggataaaccgctagac

SEQ ID NO: 106018 - DNA, 26 bp, Artificial sequence
  SiRNA target sequence
taattttcaggataaaccgctagaca

SEQ ID NO: 106019 - DNA, 26 bp, Artificial sequence
  SiRNA target sequence
aattttcaggataaaccgctagacaa

SEQ ID NO: 106020 - DNA, 26 bp, Artificial sequence
  SiRNA target sequence
attttcaggataaaccgctagacaat

SEQ ID NO: 106021 - DNA, 26 bp, Artificial sequence
  SiRNA target sequence
ttttcaggataaaccgctagacaatc

SEQ ID NO: 106022 - DNA, 26 bp, Artificial sequence
  SiRNA target sequence
tttcaggataaaccgctagacaatca

SEQ ID NO: 106023 - DNA, 26 bp, Artificial sequence
  SiRNA target sequence
ttcaggataaaccgctagacaatcac

SEQ ID NO: 106024 - DNA, 26 bp, Artificial sequence
  SiRNA target sequence
tcaggataaaccgctagacaatcacc

SEQ ID NO: 106025 - DNA, 26 bp, Artificial sequence
  SiRNA target sequence
caggataaaccgctagacaatcaccg

SEQ ID NO: 106026 - DNA, 26 bp, Artificial sequence
  SiRNA target sequence
aggataaaccgctagacaatcaccga

SEQ ID NO: 106027 - DNA, 26 bp, Artificial sequence
  SiRNA target sequence
ggataaaccgctagacaatcaccgat

SEQ ID NO: 106028 - DNA, 26 bp, Artificial sequence
  SiRNA target sequence
gataaaccgctagacaatcaccgatt

SEQ ID NO: 106029 - DNA, 26 bp, Artificial sequence
  SiRNA target sequence
ataaaccgctagacaatcaccgattt

SEQ ID NO: 106030 - DNA, 26 bp, Artificial sequence
  SiRNA target sequence
taaaccgctagacaatcaccgatttc

SEQ ID NO: 106031 - DNA, 26 bp, Artificial sequence
  SiRNA target sequence
aaaccgctagacaatcaccgatttca

SEQ ID NO: 106032 - DNA, 26 bp, Artificial sequence
  SiRNA target sequence
aaccgctagacaatcaccgatttcaa

SEQ ID NO: 106033 - DNA, 26 bp, Artificial sequence
  SiRNA target sequence
accgctagacaatcaccgatttcaaa

SEQ ID NO: 106034 - DNA, 26 bp, Artificial sequence
  SiRNA target sequence
ccgctagacaatcaccgatttcaaaa

SEQ ID NO: 106035 - DNA, 26 bp, Artificial sequence
  SiRNA target sequence
cgctagacaatcaccgatttcaaaat

SEQ ID NO: 106036 - DNA, 26 bp, Artificial sequence
  SiRNA target sequence
gctagacaatcaccgatttcaaaatt

SEQ ID NO: 106037 - DNA, 26 bp, Artificial sequence
  SiRNA target sequence
ctagacaatcaccgatttcaaaattt

SEQ ID NO: 106038 - DNA, 26 bp, Artificial sequence
  SiRNA target sequence
tagacaatcaccgatttcaaaatttt

SEQ ID NO: 106039 - DNA, 26 bp, Artificial sequence
  SiRNA target sequence
agacaatcaccgatttcaaaattttc

SEQ ID NO: 106040 - DNA, 26 bp, Artificial sequence
  SiRNA target sequence
gacaatcaccgatttcaaaattttct

SEQ ID NO: 106041 - DNA, 26 bp, Artificial sequence
  SiRNA target sequence
acaatcaccgatttcaaaattttcta

SEQ ID NO: 106042 - DNA, 26 bp, Artificial sequence
  SiRNA target sequence
caatcaccgatttcaaaattttctat

SEQ ID NO: 106043 - DNA, 26 bp, Artificial sequence
  SiRNA target sequence
aatcaccgatttcaaaattttctata

SEQ ID NO: 106044 - DNA, 26 bp, Artificial sequence
  SiRNA target sequence
atcaccgatttcaaaattttctatat

SEQ ID NO: 106045 - DNA, 26 bp, Artificial sequence
  SiRNA target sequence
tcaccgatttcaaaattttctatatc

SEQ ID NO: 106046 - DNA, 26 bp, Artificial sequence
  SiRNA target sequence
caccgatttcaaaattttctatatct

SEQ ID NO: 106047 - DNA, 26 bp, Artificial sequence
  SiRNA target sequence
accgatttcaaaattttctatatcta

SEQ ID NO: 106048 - DNA, 26 bp, Artificial sequence
  SiRNA target sequence
ccgatttcaaaattttctatatctat

SEQ ID NO: 106049 - DNA, 26 bp, Artificial sequence
  SiRNA target sequence
cgatttcaaaattttctatatctata

SEQ ID NO: 106050 - DNA, 26 bp, Artificial sequence
  SiRNA target sequence
gatttcaaaattttctatatctatat

SEQ ID NO: 106051 - DNA, 26 bp, Artificial sequence
  SiRNA target sequence
atttcaaaattttctatatctatatc

SEQ ID NO: 106052 - DNA, 26 bp, Artificial sequence
  SiRNA target sequence
tttcaaaattttctatatctatatca

SEQ ID NO: 106053 - DNA, 26 bp, Artificial sequence
  SiRNA target sequence
ttcaaaattttctatatctatatcaa

SEQ ID NO: 106054 - DNA, 26 bp, Artificial sequence
  SiRNA target sequence
tcaaaattttctatatctatatcaaa

SEQ ID NO: 106055 - DNA, 26 bp, Artificial sequence
  SiRNA target sequence
caaaattttctatatctatatcaaat

SEQ ID NO: 106056 - DNA, 26 bp, Artificial sequence
  SiRNA target sequence
aaaattttctatatctatatcaaatt

SEQ ID NO: 106057 - DNA, 26 bp, Artificial sequence
  SiRNA target sequence
aaattttctatatctatatcaaattt

SEQ ID NO: 106058 - DNA, 26 bp, Artificial sequence
  SiRNA target sequence
aattttctatatctatatcaaatttt

SEQ ID NO: 106059 - DNA, 26 bp, Artificial sequence
  SiRNA target sequence
attttctatatctatatcaaatttta

SEQ ID NO: 106060 - DNA, 26 bp, Artificial sequence
  SiRNA target sequence
ttttctatatctatatcaaattttat

SEQ ID NO: 106061 - DNA, 26 bp, Artificial sequence
  SiRNA target sequence
tttctatatctatatcaaattttatt

SEQ ID NO: 106062 - DNA, 26 bp, Artificial sequence
  SiRNA target sequence
ttctatatctatatcaaattttattt

SEQ ID NO: 106063 - DNA, 26 bp, Artificial sequence
  SiRNA target sequence
tctatatctatatcaaattttatttc

SEQ ID NO: 106064 - DNA, 26 bp, Artificial sequence
  SiRNA target sequence
ctatatctatatcaaattttatttct

SEQ ID NO: 106065 - DNA, 26 bp, Artificial sequence
  SiRNA target sequence
tatatctatatcaaattttatttcta

SEQ ID NO: 106066 - DNA, 26 bp, Artificial sequence
  SiRNA target sequence
atatctatatcaaattttatttctaa

SEQ ID NO: 106067 - DNA, 26 bp, Artificial sequence
  SiRNA target sequence
tatctatatcaaattttatttctaaa

SEQ ID NO: 106068 - DNA, 26 bp, Artificial sequence
  SiRNA target sequence
atctatatcaaattttatttctaaaa

SEQ ID NO: 106069 - DNA, 26 bp, Artificial sequence
  SiRNA target sequence
tctatatcaaattttatttctaaaat

SEQ ID NO: 106070 - DNA, 26 bp, Artificial sequence
  SiRNA target sequence
ctatatcaaattttatttctaaaata

SEQ ID NO: 106071 - DNA, 26 bp, Artificial sequence
  SiRNA target sequence
tatatcaaattttatttctaaaatag

SEQ ID NO: 106072 - DNA, 26 bp, Artificial sequence
  SiRNA target sequence
atatcaaattttatttctaaaatagg

SEQ ID NO: 106073 - DNA, 26 bp, Artificial sequence
  SiRNA target sequence
tatcaaattttatttctaaaatagga

SEQ ID NO: 106074 - DNA, 26 bp, Artificial sequence
  SiRNA target sequence
atcaaattttatttctaaaataggat

SEQ ID NO: 106075 - DNA, 26 bp, Artificial sequence
  SiRNA target sequence
tcaaattttatttctaaaataggata

SEQ ID NO: 106076 - DNA, 26 bp, Artificial sequence
  SiRNA target sequence
caaattttatttctaaaataggataa

SEQ ID NO: 106077 - DNA, 26 bp, Artificial sequence
  SiRNA target sequence
aaattttatttctaaaataggataaa

SEQ ID NO: 106078 - DNA, 26 bp, Artificial sequence
  SiRNA target sequence
aattttatttctaaaataggataaat

SEQ ID NO: 106079 - DNA, 26 bp, Artificial sequence
  SiRNA target sequence
attttatttctaaaataggataaatg

SEQ ID NO: 106080 - DNA, 26 bp, Artificial sequence
  SiRNA target sequence
ttttatttctaaaataggataaatgt

SEQ ID NO: 106081 - DNA, 26 bp, Artificial sequence
  SiRNA target sequence
tttatttctaaaataggataaatgta

SEQ ID NO: 106082 - DNA, 26 bp, Artificial sequence
  SiRNA target sequence
ttatttctaaaataggataaatgtaa

SEQ ID NO: 106083 - DNA, 26 bp, Artificial sequence
  SiRNA target sequence
tatttctaaaataggataaatgtaat

SEQ ID NO: 106084 - DNA, 26 bp, Artificial sequence
  SiRNA target sequence
atttctaaaataggataaatgtaatt

SEQ ID NO: 106085 - DNA, 26 bp, Artificial sequence
  SiRNA target sequence
tttctaaaataggataaatgtaattg

SEQ ID NO: 106086 - DNA, 26 bp, Artificial sequence
  SiRNA target sequence
ttctaaaataggataaatgtaattgt

SEQ ID NO: 106087 - DNA, 26 bp, Artificial sequence
  SiRNA target sequence
tctaaaataggataaatgtaattgta

SEQ ID NO: 106088 - DNA, 26 bp, Artificial sequence
  SiRNA target sequence
ctaaaataggataaatgtaattgtaa

SEQ ID NO: 106089 - DNA, 26 bp, Artificial sequence
  SiRNA target sequence
taaaataggataaatgtaattgtaag

SEQ ID NO: 106090 - DNA, 26 bp, Artificial sequence
  SiRNA target sequence
aaaataggataaatgtaattgtaagg

SEQ ID NO: 106091 - DNA, 26 bp, Artificial sequence
  SiRNA target sequence
aaataggataaatgtaattgtaaggt

SEQ ID NO: 106092 - DNA, 26 bp, Artificial sequence
  SiRNA target sequence
aataggataaatgtaattgtaaggtg

SEQ ID NO: 106093 - DNA, 26 bp, Artificial sequence
  SiRNA target sequence
ataggataaatgtaattgtaaggtgt

SEQ ID NO: 106094 - DNA, 26 bp, Artificial sequence
  SiRNA target sequence
taggataaatgtaattgtaaggtgtt

SEQ ID NO: 106095 - DNA, 26 bp, Artificial sequence
  SiRNA target sequence
aggataaatgtaattgtaaggtgtta

SEQ ID NO: 106096 - DNA, 26 bp, Artificial sequence
  SiRNA target sequence
ggataaatgtaattgtaaggtgttaa

SEQ ID NO: 106097 - DNA, 26 bp, Artificial sequence
  SiRNA target sequence
gataaatgtaattgtaaggtgttaat

SEQ ID NO: 106098 - DNA, 26 bp, Artificial sequence
  SiRNA target sequence
ataaatgtaattgtaaggtgttaata

SEQ ID NO: 106099 - DNA, 26 bp, Artificial sequence
  SiRNA target sequence
taaatgtaattgtaaggtgttaatat

SEQ ID NO: 106100 - DNA, 26 bp, Artificial sequence
  SiRNA target sequence
aaatgtaattgtaaggtgttaatatc

SEQ ID NO: 106101 - DNA, 26 bp, Artificial sequence
  SiRNA target sequence
aatgtaattgtaaggtgttaatatct

SEQ ID NO: 106102 - DNA, 26 bp, Artificial sequence
  SiRNA target sequence
atgtaattgtaaggtgttaatatctt

SEQ ID NO: 106103 - DNA, 26 bp, Artificial sequence
  SiRNA target sequence
tgtaattgtaaggtgttaatatctta

SEQ ID NO: 106104 - DNA, 26 bp, Artificial sequence
  SiRNA target sequence
gtaattgtaaggtgttaatatcttaa

SEQ ID NO: 106105 - DNA, 26 bp, Artificial sequence
  SiRNA target sequence
taattgtaaggtgttaatatcttaat

SEQ ID NO: 106106 - DNA, 26 bp, Artificial sequence
  SiRNA target sequence
aattgtaaggtgttaatatcttaata

SEQ ID NO: 106107 - DNA, 26 bp, Artificial sequence
  SiRNA target sequence
attgtaaggtgttaatatcttaatat

SEQ ID NO: 106108 - DNA, 26 bp, Artificial sequence
  SiRNA target sequence
ttgtaaggtgttaatatcttaatatc

SEQ ID NO: 106109 - DNA, 26 bp, Artificial sequence
  SiRNA target sequence
tgtaaggtgttaatatcttaatatca

SEQ ID NO: 106110 - DNA, 26 bp, Artificial sequence
  SiRNA target sequence
gtaaggtgttaatatcttaatatcat

SEQ ID NO: 106111 - DNA, 26 bp, Artificial sequence
  SiRNA target sequence
taaggtgttaatatcttaatatcatt

SEQ ID NO: 106112 - DNA, 26 bp, Artificial sequence
  SiRNA target sequence
aaggtgttaatatcttaatatcattt

SEQ ID NO: 106113 - DNA, 26 bp, Artificial sequence
  SiRNA target sequence
aggtgttaatatcttaatatcattta

SEQ ID NO: 106114 - DNA, 26 bp, Artificial sequence
  SiRNA target sequence
ggtgttaatatcttaatatcatttat

SEQ ID NO: 106115 - DNA, 26 bp, Artificial sequence
  SiRNA target sequence
gtgttaatatcttaatatcatttatt

SEQ ID NO: 106116 - DNA, 26 bp, Artificial sequence
  SiRNA target sequence
tgttaatatcttaatatcatttattg

SEQ ID NO: 106117 - DNA, 26 bp, Artificial sequence
  SiRNA target sequence
gttaatatcttaatatcatttattga

SEQ ID NO: 106118 - DNA, 26 bp, Artificial sequence
  SiRNA target sequence
ttaatatcttaatatcatttattgac

SEQ ID NO: 106119 - DNA, 26 bp, Artificial sequence
  SiRNA target sequence
taatatcttaatatcatttattgacg

SEQ ID NO: 106120 - DNA, 26 bp, Artificial sequence
  SiRNA target sequence
aatatcttaatatcatttattgacgc

SEQ ID NO: 106121 - DNA, 26 bp, Artificial sequence
  SiRNA target sequence
atatcttaatatcatttattgacgca

SEQ ID NO: 106122 - DNA, 26 bp, Artificial sequence
  SiRNA target sequence
tatcttaatatcatttattgacgcac

SEQ ID NO: 106123 - DNA, 26 bp, Artificial sequence
  SiRNA target sequence
atcttaatatcatttattgacgcact

SEQ ID NO: 106124 - DNA, 26 bp, Artificial sequence
  SiRNA target sequence
tcttaatatcatttattgacgcactg

SEQ ID NO: 106125 - DNA, 26 bp, Artificial sequence
  SiRNA target sequence
cttaatatcatttattgacgcactgt

SEQ ID NO: 106126 - DNA, 26 bp, Artificial sequence
  SiRNA target sequence
ttaatatcatttattgacgcactgta

SEQ ID NO: 106127 - DNA, 26 bp, Artificial sequence
  SiRNA target sequence
taatatcatttattgacgcactgtat

SEQ ID NO: 106128 - DNA, 26 bp, Artificial sequence
  SiRNA target sequence
aatatcatttattgacgcactgtata

SEQ ID NO: 106129 - DNA, 26 bp, Artificial sequence
  SiRNA target sequence
atatcatttattgacgcactgtataa

SEQ ID NO: 106130 - DNA, 26 bp, Artificial sequence
  SiRNA target sequence
tatcatttattgacgcactgtataaa

SEQ ID NO: 106131 - DNA, 26 bp, Artificial sequence
  SiRNA target sequence
atcatttattgacgcactgtataaat

SEQ ID NO: 106132 - DNA, 26 bp, Artificial sequence
  SiRNA target sequence
tcatttattgacgcactgtataaatc

SEQ ID NO: 106133 - DNA, 26 bp, Artificial sequence
  SiRNA target sequence
catttattgacgcactgtataaatca

SEQ ID NO: 106134 - DNA, 26 bp, Artificial sequence
  SiRNA target sequence
atttattgacgcactgtataaatcat

SEQ ID NO: 106135 - DNA, 26 bp, Artificial sequence
  SiRNA target sequence
tttattgacgcactgtataaatcatt

SEQ ID NO: 106136 - DNA, 26 bp, Artificial sequence
  SiRNA target sequence
ttattgacgcactgtataaatcattt

SEQ ID NO: 106137 - DNA, 26 bp, Artificial sequence
  SiRNA target sequence
tattgacgcactgtataaatcatttt

SEQ ID NO: 106138 - DNA, 26 bp, Artificial sequence
  SiRNA target sequence
attgacgcactgtataaatcattttt

SEQ ID NO: 106139 - DNA, 26 bp, Artificial sequence
  SiRNA target sequence
ttgacgcactgtataaatcattttta

SEQ ID NO: 106140 - DNA, 26 bp, Artificial sequence
  SiRNA target sequence
tgacgcactgtataaatcatttttac

SEQ ID NO: 106141 - DNA, 26 bp, Artificial sequence
  SiRNA target sequence
gacgcactgtataaatcatttttaca

SEQ ID NO: 106142 - DNA, 26 bp, Artificial sequence
  SiRNA target sequence
acgcactgtataaatcatttttacaa

SEQ ID NO: 106143 - DNA, 26 bp, Artificial sequence
  SiRNA target sequence
cgcactgtataaatcatttttacaac

SEQ ID NO: 106144 - DNA, 26 bp, Artificial sequence
  SiRNA target sequence
gcactgtataaatcatttttacaact

SEQ ID NO: 106145 - DNA, 26 bp, Artificial sequence
  SiRNA target sequence
cactgtataaatcatttttacaactt

SEQ ID NO: 106146 - DNA, 26 bp, Artificial sequence
  SiRNA target sequence
actgtataaatcatttttacaacttg

SEQ ID NO: 106147 - DNA, 26 bp, Artificial sequence
  SiRNA target sequence
ctgtataaatcatttttacaacttgc

SEQ ID NO: 106148 - DNA, 26 bp, Artificial sequence
  SiRNA target sequence
tgtataaatcatttttacaacttgca

SEQ ID NO: 106149 - DNA, 26 bp, Artificial sequence
  SiRNA target sequence
gtataaatcatttttacaacttgcaa

SEQ ID NO: 106150 - DNA, 26 bp, Artificial sequence
  SiRNA target sequence
tataaatcatttttacaacttgcaaa

SEQ ID NO: 106151 - DNA, 26 bp, Artificial sequence
  SiRNA target sequence
ataaatcatttttacaacttgcaaaa

SEQ ID NO: 106152 - DNA, 26 bp, Artificial sequence
  SiRNA target sequence
taaatcatttttacaacttgcaaaat

SEQ ID NO: 106153 - DNA, 26 bp, Artificial sequence
  SiRNA target sequence
aaatcatttttacaacttgcaaaatt

SEQ ID NO: 106154 - DNA, 26 bp, Artificial sequence
  SiRNA target sequence
aatcatttttacaacttgcaaaattt

SEQ ID NO: 106155 - DNA, 26 bp, Artificial sequence
  SiRNA target sequence
atcatttttacaacttgcaaaatttt

SEQ ID NO: 106156 - DNA, 26 bp, Artificial sequence
  SiRNA target sequence
tcatttttacaacttgcaaaattttt

SEQ ID NO: 106157 - DNA, 26 bp, Artificial sequence
  SiRNA target sequence
catttttacaacttgcaaaattttta

SEQ ID NO: 106158 - DNA, 26 bp, Artificial sequence
  SiRNA target sequence
atttttacaacttgcaaaatttttag

SEQ ID NO: 106159 - DNA, 26 bp, Artificial sequence
  SiRNA target sequence
tttttacaacttgcaaaatttttagc

SEQ ID NO: 106160 - DNA, 26 bp, Artificial sequence
  SiRNA target sequence
ttttacaacttgcaaaatttttagca

SEQ ID NO: 106161 - DNA, 26 bp, Artificial sequence
  SiRNA target sequence
tttacaacttgcaaaatttttagcat

SEQ ID NO: 106162 - DNA, 26 bp, Artificial sequence
  SiRNA target sequence
ttacaacttgcaaaatttttagcatt

SEQ ID NO: 106163 - DNA, 26 bp, Artificial sequence
  SiRNA target sequence
tacaacttgcaaaatttttagcattt

SEQ ID NO: 106164 - DNA, 26 bp, Artificial sequence
  SiRNA target sequence
acaacttgcaaaatttttagcatttt

SEQ ID NO: 106165 - DNA, 26 bp, Artificial sequence
  SiRNA target sequence
caacttgcaaaatttttagcattttg

SEQ ID NO: 106166 - DNA, 26 bp, Artificial sequence
  SiRNA target sequence
aacttgcaaaatttttagcattttgt

SEQ ID NO: 106167 - DNA, 26 bp, Artificial sequence
  SiRNA target sequence
acttgcaaaatttttagcattttgta

SEQ ID NO: 106168 - DNA, 26 bp, Artificial sequence
  SiRNA target sequence
cttgcaaaatttttagcattttgtag

SEQ ID NO: 106169 - DNA, 26 bp, Artificial sequence
  SiRNA target sequence
ttgcaaaatttttagcattttgtagt

SEQ ID NO: 106170 - DNA, 26 bp, Artificial sequence
  SiRNA target sequence
tgcaaaatttttagcattttgtagtt

SEQ ID NO: 106171 - DNA, 26 bp, Artificial sequence
  SiRNA target sequence
gcaaaatttttagcattttgtagttt

SEQ ID NO: 106172 - DNA, 26 bp, Artificial sequence
  SiRNA target sequence
caaaatttttagcattttgtagtttg

SEQ ID NO: 106173 - DNA, 26 bp, Artificial sequence
  SiRNA target sequence
aaaatttttagcattttgtagtttgt

SEQ ID NO: 106174 - DNA, 26 bp, Artificial sequence
  SiRNA target sequence
aaatttttagcattttgtagtttgta

SEQ ID NO: 106175 - DNA, 26 bp, Artificial sequence
  SiRNA target sequence
aatttttagcattttgtagtttgtaa

SEQ ID NO: 106176 - DNA, 26 bp, Artificial sequence
  SiRNA target sequence
atttttagcattttgtagtttgtaat

SEQ ID NO: 106177 - DNA, 26 bp, Artificial sequence
  SiRNA target sequence
tttttagcattttgtagtttgtaatg

SEQ ID NO: 106178 - DNA, 26 bp, Artificial sequence
  SiRNA target sequence
ttttagcattttgtagtttgtaatgc

SEQ ID NO: 106179 - DNA, 26 bp, Artificial sequence
  SiRNA target sequence
tttagcattttgtagtttgtaatgcg

SEQ ID NO: 106180 - DNA, 26 bp, Artificial sequence
  SiRNA target sequence
ttagcattttgtagtttgtaatgcgg

SEQ ID NO: 106181 - DNA, 26 bp, Artificial sequence
  SiRNA target sequence
tagcattttgtagtttgtaatgcggt

SEQ ID NO: 106182 - DNA, 26 bp, Artificial sequence
  SiRNA target sequence
agcattttgtagtttgtaatgcggta

SEQ ID NO: 106183 - DNA, 26 bp, Artificial sequence
  SiRNA target sequence
gcattttgtagtttgtaatgcggtaa

SEQ ID NO: 106184 - DNA, 26 bp, Artificial sequence
  SiRNA target sequence
cattttgtagtttgtaatgcggtaat

SEQ ID NO: 106185 - DNA, 26 bp, Artificial sequence
  SiRNA target sequence
attttgtagtttgtaatgcggtaata

SEQ ID NO: 106186 - DNA, 26 bp, Artificial sequence
  SiRNA target sequence
ttttgtagtttgtaatgcggtaatat

SEQ ID NO: 106187 - DNA, 26 bp, Artificial sequence
  SiRNA target sequence
tttgtagtttgtaatgcggtaatata

SEQ ID NO: 106188 - DNA, 26 bp, Artificial sequence
  SiRNA target sequence
ttgtagtttgtaatgcggtaatatat

SEQ ID NO: 106189 - DNA, 26 bp, Artificial sequence
  SiRNA target sequence
tgtagtttgtaatgcggtaatatata

SEQ ID NO: 106190 - DNA, 26 bp, Artificial sequence
  SiRNA target sequence
gtagtttgtaatgcggtaatatataa

SEQ ID NO: 106191 - DNA, 26 bp, Artificial sequence
  SiRNA target sequence
tagtttgtaatgcggtaatatataat

SEQ ID NO: 106192 - DNA, 26 bp, Artificial sequence
  SiRNA target sequence
agtttgtaatgcggtaatatataata

SEQ ID NO: 106193 - DNA, 26 bp, Artificial sequence
  SiRNA target sequence
gtttgtaatgcggtaatatataatat

SEQ ID NO: 106194 - DNA, 26 bp, Artificial sequence
  SiRNA target sequence
tttgtaatgcggtaatatataatata

SEQ ID NO: 106195 - DNA, 26 bp, Artificial sequence
  SiRNA target sequence
ttgtaatgcggtaatatataatatag

SEQ ID NO: 106196 - DNA, 26 bp, Artificial sequence
  SiRNA target sequence
tgtaatgcggtaatatataatataga

SEQ ID NO: 106197 - DNA, 26 bp, Artificial sequence
  SiRNA target sequence
gtaatgcggtaatatataatatagat

SEQ ID NO: 106198 - DNA, 26 bp, Artificial sequence
  SiRNA target sequence
taatgcggtaatatataatatagatc

SEQ ID NO: 106199 - DNA, 26 bp, Artificial sequence
  SiRNA target sequence
aatgcggtaatatataatatagatct

SEQ ID NO: 106200 - DNA, 26 bp, Artificial sequence
  SiRNA target sequence
atgcggtaatatataatatagatctt

SEQ ID NO: 106201 - DNA, 26 bp, Artificial sequence
  SiRNA target sequence
tgcggtaatatataatatagatcttt

SEQ ID NO: 106202 - DNA, 26 bp, Artificial sequence
  SiRNA target sequence
gcggtaatatataatatagatctttt

SEQ ID NO: 106203 - DNA, 26 bp, Artificial sequence
  SiRNA target sequence
cggtaatatataatatagatctttta

SEQ ID NO: 106204 - DNA, 26 bp, Artificial sequence
  SiRNA target sequence
ggtaatatataatatagatcttttat

SEQ ID NO: 106205 - DNA, 26 bp, Artificial sequence
  SiRNA target sequence
gtaatatataatatagatcttttatc

SEQ ID NO: 106206 - DNA, 26 bp, Artificial sequence
  SiRNA target sequence
taatatataatatagatcttttatcc

SEQ ID NO: 106207 - DNA, 26 bp, Artificial sequence
  SiRNA target sequence
aatatataatatagatcttttatcca

SEQ ID NO: 106208 - DNA, 26 bp, Artificial sequence
  SiRNA target sequence
atatataatatagatcttttatccat

SEQ ID NO: 106209 - DNA, 26 bp, Artificial sequence
  SiRNA target sequence
tatataatatagatcttttatccatg

SEQ ID NO: 106210 - DNA, 26 bp, Artificial sequence
  SiRNA target sequence
atataatatagatcttttatccatgt

SEQ ID NO: 106211 - DNA, 26 bp, Artificial sequence
  SiRNA target sequence
tataatatagatcttttatccatgtc

SEQ ID NO: 106212 - DNA, 26 bp, Artificial sequence
  SiRNA target sequence
ataatatagatcttttatccatgtct

SEQ ID NO: 106213 - DNA, 26 bp, Artificial sequence
  SiRNA target sequence
taatatagatcttttatccatgtctt

SEQ ID NO: 106214 - DNA, 26 bp, Artificial sequence
  SiRNA target sequence
aatatagatcttttatccatgtctta

SEQ ID NO: 106215 - DNA, 26 bp, Artificial sequence
  SiRNA target sequence
atatagatcttttatccatgtcttaa

SEQ ID NO: 106216 - DNA, 26 bp, Artificial sequence
  SiRNA target sequence
tatagatcttttatccatgtcttaaa

SEQ ID NO: 106217 - DNA, 26 bp, Artificial sequence
  SiRNA target sequence
atagatcttttatccatgtcttaaat

SEQ ID NO: 106218 - DNA, 26 bp, Artificial sequence
  SiRNA target sequence
tagatcttttatccatgtcttaaatt

SEQ ID NO: 106219 - DNA, 26 bp, Artificial sequence
  SiRNA target sequence
agatcttttatccatgtcttaaattc

SEQ ID NO: 106220 - DNA, 26 bp, Artificial sequence
  SiRNA target sequence
gatcttttatccatgtcttaaattcg

SEQ ID NO: 106221 - DNA, 26 bp, Artificial sequence
  SiRNA target sequence
atcttttatccatgtcttaaattcgc

SEQ ID NO: 106222 - DNA, 26 bp, Artificial sequence
  SiRNA target sequence
tcttttatccatgtcttaaattcgcc

SEQ ID NO: 106223 - DNA, 26 bp, Artificial sequence
  SiRNA target sequence
cttttatccatgtcttaaattcgccc

SEQ ID NO: 106224 - DNA, 26 bp, Artificial sequence
  SiRNA target sequence
ttttatccatgtcttaaattcgccca

SEQ ID NO: 106225 - DNA, 26 bp, Artificial sequence
  SiRNA target sequence
tttatccatgtcttaaattcgcccat

SEQ ID NO: 106226 - DNA, 26 bp, Artificial sequence
  SiRNA target sequence
ttatccatgtcttaaattcgcccata

SEQ ID NO: 106227 - DNA, 26 bp, Artificial sequence
  SiRNA target sequence
tatccatgtcttaaattcgcccataa

SEQ ID NO: 106228 - DNA, 26 bp, Artificial sequence
  SiRNA target sequence
atccatgtcttaaattcgcccataaa

SEQ ID NO: 106229 - DNA, 26 bp, Artificial sequence
  SiRNA target sequence
tccatgtcttaaattcgcccataaat

SEQ ID NO: 106230 - DNA, 26 bp, Artificial sequence
  SiRNA target sequence
ccatgtcttaaattcgcccataaatc

SEQ ID NO: 106231 - DNA, 26 bp, Artificial sequence
  SiRNA target sequence
catgtcttaaattcgcccataaatcc

SEQ ID NO: 106232 - DNA, 26 bp, Artificial sequence
  SiRNA target sequence
atgtcttaaattcgcccataaatcct

SEQ ID NO: 106233 - DNA, 26 bp, Artificial sequence
  SiRNA target sequence
tgtcttaaattcgcccataaatcctt

SEQ ID NO: 106234 - DNA, 26 bp, Artificial sequence
  SiRNA target sequence
gtcttaaattcgcccataaatccttc

SEQ ID NO: 106235 - DNA, 26 bp, Artificial sequence
  SiRNA target sequence
tcttaaattcgcccataaatccttct

SEQ ID NO: 106236 - DNA, 26 bp, Artificial sequence
  SiRNA target sequence
cttaaattcgcccataaatccttctt

SEQ ID NO: 106237 - DNA, 26 bp, Artificial sequence
  SiRNA target sequence
ttaaattcgcccataaatccttcttt

SEQ ID NO: 106238 - DNA, 26 bp, Artificial sequence
  SiRNA target sequence
taaattcgcccataaatccttctttg

SEQ ID NO: 106239 - DNA, 26 bp, Artificial sequence
  SiRNA target sequence
aaattcgcccataaatccttctttgt

SEQ ID NO: 106240 - DNA, 26 bp, Artificial sequence
  SiRNA target sequence
aattcgcccataaatccttctttgtc

SEQ ID NO: 106241 - DNA, 26 bp, Artificial sequence
  SiRNA target sequence
attcgcccataaatccttctttgtct

SEQ ID NO: 106242 - DNA, 26 bp, Artificial sequence
  SiRNA target sequence
ttcgcccataaatccttctttgtctt

SEQ ID NO: 106243 - DNA, 26 bp, Artificial sequence
  SiRNA target sequence
tcgcccataaatccttctttgtcttg

SEQ ID NO: 106244 - DNA, 26 bp, Artificial sequence
  SiRNA target sequence
cgcccataaatccttctttgtcttgg

SEQ ID NO: 106245 - DNA, 26 bp, Artificial sequence
  SiRNA target sequence
gcccataaatccttctttgtcttggc

SEQ ID NO: 106246 - DNA, 26 bp, Artificial sequence
  SiRNA target sequence
cccataaatccttctttgtcttggct

SEQ ID NO: 106247 - DNA, 26 bp, Artificial sequence
  SiRNA target sequence
ccataaatccttctttgtcttggcta

SEQ ID NO: 106248 - DNA, 26 bp, Artificial sequence
  SiRNA target sequence
cataaatccttctttgtcttggctat

SEQ ID NO: 106249 - DNA, 26 bp, Artificial sequence
  SiRNA target sequence
ataaatccttctttgtcttggctatc

SEQ ID NO: 106250 - DNA, 26 bp, Artificial sequence
  SiRNA target sequence
taaatccttctttgtcttggctatct

SEQ ID NO: 106251 - DNA, 26 bp, Artificial sequence
  SiRNA target sequence
aaatccttctttgtcttggctatctc

SEQ ID NO: 106252 - DNA, 26 bp, Artificial sequence
  SiRNA target sequence
aatccttctttgtcttggctatctcc

SEQ ID NO: 106253 - DNA, 26 bp, Artificial sequence
  SiRNA target sequence
atccttctttgtcttggctatctcca

SEQ ID NO: 106254 - DNA, 26 bp, Artificial sequence
  SiRNA target sequence
tccttctttgtcttggctatctccat

SEQ ID NO: 106255 - DNA, 26 bp, Artificial sequence
  SiRNA target sequence
ccttctttgtcttggctatctccatt

SEQ ID NO: 106256 - DNA, 26 bp, Artificial sequence
  SiRNA target sequence
cttctttgtcttggctatctccatta

SEQ ID NO: 106257 - DNA, 26 bp, Artificial sequence
  SiRNA target sequence
ttctttgtcttggctatctccattac

SEQ ID NO: 106258 - DNA, 26 bp, Artificial sequence
  SiRNA target sequence
tctttgtcttggctatctccattacc

SEQ ID NO: 106259 - DNA, 26 bp, Artificial sequence
  SiRNA target sequence
ctttgtcttggctatctccattaccc

SEQ ID NO: 106260 - DNA, 26 bp, Artificial sequence
  SiRNA target sequence
tttgtcttggctatctccattaccct

SEQ ID NO: 106261 - DNA, 26 bp, Artificial sequence
  SiRNA target sequence
ttgtcttggctatctccattaccctt

SEQ ID NO: 106262 - DNA, 26 bp, Artificial sequence
  SiRNA target sequence
tgtcttggctatctccattacccttt

SEQ ID NO: 106263 - DNA, 26 bp, Artificial sequence
  SiRNA target sequence
gtcttggctatctccattaccctttc

SEQ ID NO: 106264 - DNA, 26 bp, Artificial sequence
  SiRNA target sequence
tcttggctatctccattaccctttct

SEQ ID NO: 106265 - DNA, 26 bp, Artificial sequence
  SiRNA target sequence
cttggctatctccattaccctttctt

SEQ ID NO: 106266 - DNA, 26 bp, Artificial sequence
  SiRNA target sequence
ttggctatctccattaccctttctta

SEQ ID NO: 106267 - DNA, 26 bp, Artificial sequence
  SiRNA target sequence
tggctatctccattaccctttcttat

SEQ ID NO: 106268 - DNA, 26 bp, Artificial sequence
  SiRNA target sequence
ggctatctccattaccctttcttatc

SEQ ID NO: 106269 - DNA, 26 bp, Artificial sequence
  SiRNA target sequence
gctatctccattaccctttcttatca

SEQ ID NO: 106270 - DNA, 26 bp, Artificial sequence
  SiRNA target sequence
ctatctccattaccctttcttatcag

SEQ ID NO: 106271 - DNA, 26 bp, Artificial sequence
  SiRNA target sequence
tatctccattaccctttcttatcaga

SEQ ID NO: 106272 - DNA, 26 bp, Artificial sequence
  SiRNA target sequence
atctccattaccctttcttatcagag

SEQ ID NO: 106273 - DNA, 26 bp, Artificial sequence
  SiRNA target sequence
tctccattaccctttcttatcagagg

SEQ ID NO: 106274 - DNA, 26 bp, Artificial sequence
  SiRNA target sequence
ctccattaccctttcttatcagaggt

SEQ ID NO: 106275 - DNA, 26 bp, Artificial sequence
  SiRNA target sequence
tccattaccctttcttatcagaggtt

SEQ ID NO: 106276 - DNA, 26 bp, Artificial sequence
  SiRNA target sequence
ccattaccctttcttatcagaggttt

SEQ ID NO: 106277 - DNA, 26 bp, Artificial sequence
  SiRNA target sequence
cattaccctttcttatcagaggttta

SEQ ID NO: 106278 - DNA, 26 bp, Artificial sequence
  SiRNA target sequence
attaccctttcttatcagaggtttag

SEQ ID NO: 106279 - DNA, 26 bp, Artificial sequence
  SiRNA target sequence
ttaccctttcttatcagaggtttagc

SEQ ID NO: 106280 - DNA, 26 bp, Artificial sequence
  SiRNA target sequence
taccctttcttatcagaggtttagct

SEQ ID NO: 106281 - DNA, 26 bp, Artificial sequence
  SiRNA target sequence
accctttcttatcagaggtttagctc

SEQ ID NO: 106282 - DNA, 26 bp, Artificial sequence
  SiRNA target sequence
ccctttcttatcagaggtttagctcc

SEQ ID NO: 106283 - DNA, 26 bp, Artificial sequence
  SiRNA target sequence
cctttcttatcagaggtttagctccg

SEQ ID NO: 106284 - DNA, 26 bp, Artificial sequence
  SiRNA target sequence
ctttcttatcagaggtttagctccgt

SEQ ID NO: 106285 - DNA, 26 bp, Artificial sequence
  SiRNA target sequence
tttcttatcagaggtttagctccgtg

SEQ ID NO: 106286 - DNA, 26 bp, Artificial sequence
  SiRNA target sequence
ttcttatcagaggtttagctccgtgt

SEQ ID NO: 106287 - DNA, 26 bp, Artificial sequence
  SiRNA target sequence
tcttatcagaggtttagctccgtgtt

SEQ ID NO: 106288 - DNA, 26 bp, Artificial sequence
  SiRNA target sequence
cttatcagaggtttagctccgtgttt

SEQ ID NO: 106289 - DNA, 26 bp, Artificial sequence
  SiRNA target sequence
ttatcagaggtttagctccgtgtttt

SEQ ID NO: 106290 - DNA, 26 bp, Artificial sequence
  SiRNA target sequence
tatcagaggtttagctccgtgtttta

SEQ ID NO: 106291 - DNA, 26 bp, Artificial sequence
  SiRNA target sequence
atcagaggtttagctccgtgttttaa

SEQ ID NO: 106292 - DNA, 26 bp, Artificial sequence
  SiRNA target sequence
tcagaggtttagctccgtgttttaaa

SEQ ID NO: 106293 - DNA, 26 bp, Artificial sequence
  SiRNA target sequence
cagaggtttagctccgtgttttaaaa

SEQ ID NO: 106294 - DNA, 26 bp, Artificial sequence
  SiRNA target sequence
agaggtttagctccgtgttttaaaag

SEQ ID NO: 106295 - DNA, 26 bp, Artificial sequence
  SiRNA target sequence
gaggtttagctccgtgttttaaaagg

SEQ ID NO: 106296 - DNA, 26 bp, Artificial sequence
  SiRNA target sequence
aggtttagctccgtgttttaaaaggc

SEQ ID NO: 106297 - DNA, 26 bp, Artificial sequence
  SiRNA target sequence
ggtttagctccgtgttttaaaaggca

SEQ ID NO: 106298 - DNA, 26 bp, Artificial sequence
  SiRNA target sequence
gtttagctccgtgttttaaaaggcaa

SEQ ID NO: 106299 - DNA, 26 bp, Artificial sequence
  SiRNA target sequence
tttagctccgtgttttaaaaggcaat

SEQ ID NO: 106300 - DNA, 26 bp, Artificial sequence
  SiRNA target sequence
ttagctccgtgttttaaaaggcaatt

SEQ ID NO: 106301 - DNA, 26 bp, Artificial sequence
  SiRNA target sequence
tagctccgtgttttaaaaggcaatta

SEQ ID NO: 106302 - DNA, 26 bp, Artificial sequence
  SiRNA target sequence
agctccgtgttttaaaaggcaattat

SEQ ID NO: 106303 - DNA, 26 bp, Artificial sequence
  SiRNA target sequence
gctccgtgttttaaaaggcaattata

SEQ ID NO: 106304 - DNA, 26 bp, Artificial sequence
  SiRNA target sequence
ctccgtgttttaaaaggcaattatac

SEQ ID NO: 106305 - DNA, 26 bp, Artificial sequence
  SiRNA target sequence
tccgtgttttaaaaggcaattataca

SEQ ID NO: 106306 - DNA, 26 bp, Artificial sequence
  SiRNA target sequence
ccgtgttttaaaaggcaattatacaa

SEQ ID NO: 106307 - DNA, 26 bp, Artificial sequence
  SiRNA target sequence
cgtgttttaaaaggcaattatacaac

SEQ ID NO: 106308 - DNA, 26 bp, Artificial sequence
  SiRNA target sequence
gtgttttaaaaggcaattatacaact

SEQ ID NO: 106309 - DNA, 26 bp, Artificial sequence
  SiRNA target sequence
tgttttaaaaggcaattatacaactt

SEQ ID NO: 106310 - DNA, 26 bp, Artificial sequence
  SiRNA target sequence
gttttaaaaggcaattatacaacttt

SEQ ID NO: 106311 - DNA, 26 bp, Artificial sequence
  SiRNA target sequence
ttttaaaaggcaattatacaactttt

SEQ ID NO: 106312 - DNA, 26 bp, Artificial sequence
  SiRNA target sequence
tttaaaaggcaattatacaacttttt

SEQ ID NO: 106313 - DNA, 26 bp, Artificial sequence
  SiRNA target sequence
ttaaaaggcaattatacaacttttta

SEQ ID NO: 106314 - DNA, 26 bp, Artificial sequence
  SiRNA target sequence
taaaaggcaattatacaactttttag

SEQ ID NO: 106315 - DNA, 26 bp, Artificial sequence
  SiRNA target sequence
aaaaggcaattatacaactttttaga

SEQ ID NO: 106316 - DNA, 26 bp, Artificial sequence
  SiRNA target sequence
aaaggcaattatacaactttttagaa

SEQ ID NO: 106317 - DNA, 26 bp, Artificial sequence
  SiRNA target sequence
aaggcaattatacaactttttagaac

SEQ ID NO: 106318 - DNA, 26 bp, Artificial sequence
  SiRNA target sequence
aggcaattatacaactttttagaaca

SEQ ID NO: 106319 - DNA, 26 bp, Artificial sequence
  SiRNA target sequence
ggcaattatacaactttttagaacaa

SEQ ID NO: 106320 - DNA, 26 bp, Artificial sequence
  SiRNA target sequence
gcaattatacaactttttagaacaaa

SEQ ID NO: 106321 - DNA, 26 bp, Artificial sequence
  SiRNA target sequence
caattatacaactttttagaacaaaa

SEQ ID NO: 106322 - DNA, 26 bp, Artificial sequence
  SiRNA target sequence
aattatacaactttttagaacaaaaa

SEQ ID NO: 106323 - DNA, 26 bp, Artificial sequence
  SiRNA target sequence
attatacaactttttagaacaaaaat

SEQ ID NO: 106324 - DNA, 26 bp, Artificial sequence
  SiRNA target sequence
ttatacaactttttagaacaaaaatt

SEQ ID NO: 106325 - DNA, 26 bp, Artificial sequence
  SiRNA target sequence
tatacaactttttagaacaaaaatta

SEQ ID NO: 106326 - DNA, 26 bp, Artificial sequence
  SiRNA target sequence
atacaactttttagaacaaaaattaa

SEQ ID NO: 106327 - DNA, 26 bp, Artificial sequence
  SiRNA target sequence
tacaactttttagaacaaaaattaaa

SEQ ID NO: 106328 - DNA, 26 bp, Artificial sequence
  SiRNA target sequence
acaactttttagaacaaaaattaaaa

SEQ ID NO: 106329 - DNA, 26 bp, Artificial sequence
  SiRNA target sequence
caactttttagaacaaaaattaaaag

SEQ ID NO: 106330 - DNA, 26 bp, Artificial sequence
  SiRNA target sequence
aactttttagaacaaaaattaaaaga

SEQ ID NO: 106331 - DNA, 26 bp, Artificial sequence
  SiRNA target sequence
actttttagaacaaaaattaaaagat

SEQ ID NO: 106332 - DNA, 26 bp, Artificial sequence
  SiRNA target sequence
ctttttagaacaaaaattaaaagatt

SEQ ID NO: 106333 - DNA, 26 bp, Artificial sequence
  SiRNA target sequence
tttttagaacaaaaattaaaagattt

SEQ ID NO: 106334 - DNA, 26 bp, Artificial sequence
  SiRNA target sequence
ttttagaacaaaaattaaaagattta

SEQ ID NO: 106335 - DNA, 26 bp, Artificial sequence
  SiRNA target sequence
tttagaacaaaaattaaaagatttat

SEQ ID NO: 106336 - DNA, 26 bp, Artificial sequence
  SiRNA target sequence
ttagaacaaaaattaaaagatttata

SEQ ID NO: 106337 - DNA, 26 bp, Artificial sequence
  SiRNA target sequence
tagaacaaaaattaaaagatttataa

SEQ ID NO: 106338 - DNA, 26 bp, Artificial sequence
  SiRNA target sequence
agaacaaaaattaaaagatttataag

SEQ ID NO: 106339 - DNA, 26 bp, Artificial sequence
  SiRNA target sequence
gaacaaaaattaaaagatttataaga

SEQ ID NO: 106340 - DNA, 26 bp, Artificial sequence
  SiRNA target sequence
aacaaaaattaaaagatttataagac

SEQ ID NO: 106341 - DNA, 26 bp, Artificial sequence
  SiRNA target sequence
acaaaaattaaaagatttataagacg

SEQ ID NO: 106342 - DNA, 26 bp, Artificial sequence
  SiRNA target sequence
caaaaattaaaagatttataagacga

SEQ ID NO: 106343 - DNA, 26 bp, Artificial sequence
  SiRNA target sequence
aaaaattaaaagatttataagacgaa

SEQ ID NO: 106344 - DNA, 26 bp, Artificial sequence
  SiRNA target sequence
aaaattaaaagatttataagacgaat

SEQ ID NO: 106345 - DNA, 26 bp, Artificial sequence
  SiRNA target sequence
aaattaaaagatttataagacgaatc

SEQ ID NO: 106346 - DNA, 26 bp, Artificial sequence
  SiRNA target sequence
aattaaaagatttataagacgaatcc

SEQ ID NO: 106347 - DNA, 26 bp, Artificial sequence
  SiRNA target sequence
attaaaagatttataagacgaatccc

SEQ ID NO: 106348 - DNA, 26 bp, Artificial sequence
  SiRNA target sequence
ttaaaagatttataagacgaatcccc

SEQ ID NO: 106349 - DNA, 26 bp, Artificial sequence
  SiRNA target sequence
taaaagatttataagacgaatcccca

SEQ ID NO: 106350 - DNA, 26 bp, Artificial sequence
  SiRNA target sequence
aaaagatttataagacgaatccccaa

SEQ ID NO: 106351 - DNA, 26 bp, Artificial sequence
  SiRNA target sequence
aaagatttataagacgaatccccaag

SEQ ID NO: 106352 - DNA, 26 bp, Artificial sequence
  SiRNA target sequence
aagatttataagacgaatccccaagg

SEQ ID NO: 106353 - DNA, 26 bp, Artificial sequence
  SiRNA target sequence
agatttataagacgaatccccaaggc

SEQ ID NO: 106354 - DNA, 26 bp, Artificial sequence
  SiRNA target sequence
gatttataagacgaatccccaaggcc

SEQ ID NO: 106355 - DNA, 26 bp, Artificial sequence
  SiRNA target sequence
atttataagacgaatccccaaggcca

SEQ ID NO: 106356 - DNA, 26 bp, Artificial sequence
  SiRNA target sequence
tttataagacgaatccccaaggccaa

SEQ ID NO: 106357 - DNA, 26 bp, Artificial sequence
  SiRNA target sequence
ttataagacgaatccccaaggccaaa

SEQ ID NO: 106358 - DNA, 26 bp, Artificial sequence
  SiRNA target sequence
tataagacgaatccccaaggccaaat

SEQ ID NO: 106359 - DNA, 26 bp, Artificial sequence
  SiRNA target sequence
ataagacgaatccccaaggccaaata

SEQ ID NO: 106360 - DNA, 26 bp, Artificial sequence
  SiRNA target sequence
taagacgaatccccaaggccaaatac

SEQ ID NO: 106361 - DNA, 26 bp, Artificial sequence
  SiRNA target sequence
aagacgaatccccaaggccaaataca

SEQ ID NO: 106362 - DNA, 26 bp, Artificial sequence
  SiRNA target sequence
agacgaatccccaaggccaaatacag

SEQ ID NO: 106363 - DNA, 26 bp, Artificial sequence
  SiRNA target sequence
gacgaatccccaaggccaaatacagc

SEQ ID NO: 106364 - DNA, 26 bp, Artificial sequence
  SiRNA target sequence
acgaatccccaaggccaaatacagca

SEQ ID NO: 106365 - DNA, 26 bp, Artificial sequence
  SiRNA target sequence
cgaatccccaaggccaaatacagcaa

SEQ ID NO: 106366 - DNA, 26 bp, Artificial sequence
  SiRNA target sequence
gaatccccaaggccaaatacagcaaa

SEQ ID NO: 106367 - DNA, 26 bp, Artificial sequence
  SiRNA target sequence
aatccccaaggccaaatacagcaaaa

SEQ ID NO: 106368 - DNA, 26 bp, Artificial sequence
  SiRNA target sequence
atccccaaggccaaatacagcaaaat

SEQ ID NO: 106369 - DNA, 26 bp, Artificial sequence
  SiRNA target sequence
tccccaaggccaaatacagcaaaatt

SEQ ID NO: 106370 - DNA, 26 bp, Artificial sequence
  SiRNA target sequence
ccccaaggccaaatacagcaaaattt

SEQ ID NO: 106371 - DNA, 26 bp, Artificial sequence
  SiRNA target sequence
cccaaggccaaatacagcaaaattta

SEQ ID NO: 106372 - DNA, 26 bp, Artificial sequence
  SiRNA target sequence
ccaaggccaaatacagcaaaatttaa

SEQ ID NO: 106373 - DNA, 26 bp, Artificial sequence
  SiRNA target sequence
caaggccaaatacagcaaaatttaag

SEQ ID NO: 106374 - DNA, 26 bp, Artificial sequence
  SiRNA target sequence
aaggccaaatacagcaaaatttaagt

SEQ ID NO: 106375 - DNA, 26 bp, Artificial sequence
  SiRNA target sequence
aggccaaatacagcaaaatttaagtg

SEQ ID NO: 106376 - DNA, 26 bp, Artificial sequence
  SiRNA target sequence
ggccaaatacagcaaaatttaagtgt

SEQ ID NO: 106377 - DNA, 26 bp, Artificial sequence
  SiRNA target sequence
gccaaatacagcaaaatttaagtgtt

SEQ ID NO: 106378 - DNA, 26 bp, Artificial sequence
  SiRNA target sequence
ccaaatacagcaaaatttaagtgttg

SEQ ID NO: 106379 - DNA, 26 bp, Artificial sequence
  SiRNA target sequence
caaatacagcaaaatttaagtgttgt

SEQ ID NO: 106380 - DNA, 26 bp, Artificial sequence
  SiRNA target sequence
aaatacagcaaaatttaagtgttgta

SEQ ID NO: 106381 - DNA, 26 bp, Artificial sequence
  SiRNA target sequence
aatacagcaaaatttaagtgttgtaa

SEQ ID NO: 106382 - DNA, 26 bp, Artificial sequence
  SiRNA target sequence
atacagcaaaatttaagtgttgtaaa

SEQ ID NO: 106383 - DNA, 26 bp, Artificial sequence
  SiRNA target sequence
tacagcaaaatttaagtgttgtaaaa

SEQ ID NO: 106384 - DNA, 26 bp, Artificial sequence
  SiRNA target sequence
acagcaaaatttaagtgttgtaaaaa

SEQ ID NO: 106385 - DNA, 26 bp, Artificial sequence
  SiRNA target sequence
cagcaaaatttaagtgttgtaaaaaa

SEQ ID NO: 106386 - DNA, 26 bp, Artificial sequence
  SiRNA target sequence
agcaaaatttaagtgttgtaaaaaat

SEQ ID NO: 106387 - DNA, 26 bp, Artificial sequence
  SiRNA target sequence
gcaaaatttaagtgttgtaaaaaatt

SEQ ID NO: 106388 - DNA, 26 bp, Artificial sequence
  SiRNA target sequence
caaaatttaagtgttgtaaaaaattt

SEQ ID NO: 106389 - DNA, 26 bp, Artificial sequence
  SiRNA target sequence
aaaatttaagtgttgtaaaaaatttg

SEQ ID NO: 106390 - DNA, 26 bp, Artificial sequence
  SiRNA target sequence
aaatttaagtgttgtaaaaaatttgt

SEQ ID NO: 106391 - DNA, 26 bp, Artificial sequence
  SiRNA target sequence
aatttaagtgttgtaaaaaatttgta

SEQ ID NO: 106392 - DNA, 26 bp, Artificial sequence
  SiRNA target sequence
atttaagtgttgtaaaaaatttgtag

SEQ ID NO: 106393 - DNA, 26 bp, Artificial sequence
  SiRNA target sequence
tttaagtgttgtaaaaaatttgtagg

SEQ ID NO: 106394 - DNA, 26 bp, Artificial sequence
  SiRNA target sequence
ttaagtgttgtaaaaaatttgtaggc

SEQ ID NO: 106395 - DNA, 26 bp, Artificial sequence
  SiRNA target sequence
taagtgttgtaaaaaatttgtaggca

SEQ ID NO: 106396 - DNA, 26 bp, Artificial sequence
  SiRNA target sequence
aagtgttgtaaaaaatttgtaggcag

SEQ ID NO: 106397 - DNA, 26 bp, Artificial sequence
  SiRNA target sequence
agtgttgtaaaaaatttgtaggcaga

SEQ ID NO: 106398 - DNA, 26 bp, Artificial sequence
  SiRNA target sequence
gtgttgtaaaaaatttgtaggcagat

SEQ ID NO: 106399 - DNA, 26 bp, Artificial sequence
  SiRNA target sequence
tgttgtaaaaaatttgtaggcagatt

SEQ ID NO: 106400 - DNA, 26 bp, Artificial sequence
  SiRNA target sequence
gttgtaaaaaatttgtaggcagattt

SEQ ID NO: 106401 - DNA, 26 bp, Artificial sequence
  SiRNA target sequence
ttgtaaaaaatttgtaggcagatttt

SEQ ID NO: 106402 - DNA, 26 bp, Artificial sequence
  SiRNA target sequence
tgtaaaaaatttgtaggcagattttt

SEQ ID NO: 106403 - DNA, 26 bp, Artificial sequence
  SiRNA target sequence
gtaaaaaatttgtaggcagatttttt

SEQ ID NO: 106404 - DNA, 26 bp, Artificial sequence
  SiRNA target sequence
taaaaaatttgtaggcagattttttt

SEQ ID NO: 106405 - DNA, 26 bp, Artificial sequence
  SiRNA target sequence
aaaaaatttgtaggcagatttttttt

SEQ ID NO: 106406 - DNA, 26 bp, Artificial sequence
  SiRNA target sequence
aaaaatttgtaggcagattttttttg

SEQ ID NO: 106407 - DNA, 26 bp, Artificial sequence
  SiRNA target sequence
aaaatttgtaggcagattttttttgc

SEQ ID NO: 106408 - DNA, 26 bp, Artificial sequence
  SiRNA target sequence
aaatttgtaggcagattttttttgcg

SEQ ID NO: 106409 - DNA, 26 bp, Artificial sequence
  SiRNA target sequence
aatttgtaggcagattttttttgcgc

SEQ ID NO: 106410 - DNA, 26 bp, Artificial sequence
  SiRNA target sequence
atttgtaggcagattttttttgcgca

SEQ ID NO: 106411 - DNA, 26 bp, Artificial sequence
  SiRNA target sequence
tttgtaggcagattttttttgcgcaa

SEQ ID NO: 106412 - DNA, 26 bp, Artificial sequence
  SiRNA target sequence
ttgtaggcagattttttttgcgcaaa

SEQ ID NO: 106413 - DNA, 26 bp, Artificial sequence
  SiRNA target sequence
tgtaggcagattttttttgcgcaaaa

SEQ ID NO: 106414 - DNA, 26 bp, Artificial sequence
  SiRNA target sequence
gtaggcagattttttttgcgcaaaaa

SEQ ID NO: 106415 - DNA, 26 bp, Artificial sequence
  SiRNA target sequence
taggcagattttttttgcgcaaaaat

SEQ ID NO: 106416 - DNA, 26 bp, Artificial sequence
  SiRNA target sequence
aggcagattttttttgcgcaaaaatt

SEQ ID NO: 106417 - DNA, 26 bp, Artificial sequence
  SiRNA target sequence
ggcagattttttttgcgcaaaaattt

SEQ ID NO: 106418 - DNA, 26 bp, Artificial sequence
  SiRNA target sequence
gcagattttttttgcgcaaaaatttc

SEQ ID NO: 106419 - DNA, 26 bp, Artificial sequence
  SiRNA target sequence
cagattttttttgcgcaaaaatttcc

SEQ ID NO: 106420 - DNA, 26 bp, Artificial sequence
  SiRNA target sequence
agattttttttgcgcaaaaatttcca

SEQ ID NO: 106421 - DNA, 26 bp, Artificial sequence
  SiRNA target sequence
gattttttttgcgcaaaaatttccaa

SEQ ID NO: 106422 - DNA, 26 bp, Artificial sequence
  SiRNA target sequence
attttttttgcgcaaaaatttccaaa

SEQ ID NO: 106423 - DNA, 26 bp, Artificial sequence
  SiRNA target sequence
ttttttttgcgcaaaaatttccaaaa

SEQ ID NO: 106424 - DNA, 26 bp, Artificial sequence
  SiRNA target sequence
tttttttgcgcaaaaatttccaaaat

SEQ ID NO: 106425 - DNA, 26 bp, Artificial sequence
  SiRNA target sequence
ttttttgcgcaaaaatttccaaaatt

SEQ ID NO: 106426 - DNA, 26 bp, Artificial sequence
  SiRNA target sequence
tttttgcgcaaaaatttccaaaattt

SEQ ID NO: 106427 - DNA, 26 bp, Artificial sequence
  SiRNA target sequence
ttttgcgcaaaaatttccaaaattta

SEQ ID NO: 106428 - DNA, 26 bp, Artificial sequence
  SiRNA target sequence
tttgcgcaaaaatttccaaaatttag

SEQ ID NO: 106429 - DNA, 26 bp, Artificial sequence
  SiRNA target sequence
ttgcgcaaaaatttccaaaatttagt

SEQ ID NO: 106430 - DNA, 26 bp, Artificial sequence
  SiRNA target sequence
tgcgcaaaaatttccaaaatttagtc

SEQ ID NO: 106431 - DNA, 26 bp, Artificial sequence
  SiRNA target sequence
gcgcaaaaatttccaaaatttagtca

SEQ ID NO: 106432 - DNA, 26 bp, Artificial sequence
  SiRNA target sequence
cgcaaaaatttccaaaatttagtcat

SEQ ID NO: 106433 - DNA, 26 bp, Artificial sequence
  SiRNA target sequence
gcaaaaatttccaaaatttagtcatg

SEQ ID NO: 106434 - DNA, 26 bp, Artificial sequence
  SiRNA target sequence
caaaaatttccaaaatttagtcatgt

SEQ ID NO: 106435 - DNA, 26 bp, Artificial sequence
  SiRNA target sequence
aaaaatttccaaaatttagtcatgtt

SEQ ID NO: 106436 - DNA, 26 bp, Artificial sequence
  SiRNA target sequence
aaaatttccaaaatttagtcatgtta

SEQ ID NO: 106437 - DNA, 26 bp, Artificial sequence
  SiRNA target sequence
aaatttccaaaatttagtcatgttaa

SEQ ID NO: 106438 - DNA, 26 bp, Artificial sequence
  SiRNA target sequence
aatttccaaaatttagtcatgttaaa

SEQ ID NO: 106439 - DNA, 26 bp, Artificial sequence
  SiRNA target sequence
atttccaaaatttagtcatgttaaaa

SEQ ID NO: 106440 - DNA, 26 bp, Artificial sequence
  SiRNA target sequence
tttccaaaatttagtcatgttaaaag

SEQ ID NO: 106441 - DNA, 26 bp, Artificial sequence
  SiRNA target sequence
ttccaaaatttagtcatgttaaaagg

SEQ ID NO: 106442 - DNA, 26 bp, Artificial sequence
  SiRNA target sequence
tccaaaatttagtcatgttaaaaggt

SEQ ID NO: 106443 - DNA, 26 bp, Artificial sequence
  SiRNA target sequence
ccaaaatttagtcatgttaaaaggtt

SEQ ID NO: 106444 - DNA, 26 bp, Artificial sequence
  SiRNA target sequence
caaaatttagtcatgttaaaaggttc

SEQ ID NO: 106445 - DNA, 26 bp, Artificial sequence
  SiRNA target sequence
aaaatttagtcatgttaaaaggttca

SEQ ID NO: 106446 - DNA, 26 bp, Artificial sequence
  SiRNA target sequence
aaatttagtcatgttaaaaggttcag

SEQ ID NO: 106447 - DNA, 26 bp, Artificial sequence
  SiRNA target sequence
aatttagtcatgttaaaaggttcaga

SEQ ID NO: 106448 - DNA, 26 bp, Artificial sequence
  SiRNA target sequence
atttagtcatgttaaaaggttcagaa

SEQ ID NO: 106449 - DNA, 26 bp, Artificial sequence
  SiRNA target sequence
tttagtcatgttaaaaggttcagaac

SEQ ID NO: 106450 - DNA, 26 bp, Artificial sequence
  SiRNA target sequence
ttagtcatgttaaaaggttcagaacc

SEQ ID NO: 106451 - DNA, 26 bp, Artificial sequence
  SiRNA target sequence
tagtcatgttaaaaggttcagaacca

SEQ ID NO: 106452 - DNA, 26 bp, Artificial sequence
  SiRNA target sequence
agtcatgttaaaaggttcagaaccat

SEQ ID NO: 106453 - DNA, 26 bp, Artificial sequence
  SiRNA target sequence
gtcatgttaaaaggttcagaaccatt

SEQ ID NO: 106454 - DNA, 26 bp, Artificial sequence
  SiRNA target sequence
tcatgttaaaaggttcagaaccattc

SEQ ID NO: 106455 - DNA, 26 bp, Artificial sequence
  SiRNA target sequence
catgttaaaaggttcagaaccattcc

SEQ ID NO: 106456 - DNA, 26 bp, Artificial sequence
  SiRNA target sequence
atgttaaaaggttcagaaccattccc

SEQ ID NO: 106457 - DNA, 26 bp, Artificial sequence
  SiRNA target sequence
tgttaaaaggttcagaaccattccca

SEQ ID NO: 106458 - DNA, 26 bp, Artificial sequence
  SiRNA target sequence
gttaaaaggttcagaaccattcccat

SEQ ID NO: 106459 - DNA, 26 bp, Artificial sequence
  SiRNA target sequence
ttaaaaggttcagaaccattcccatg

SEQ ID NO: 106460 - DNA, 26 bp, Artificial sequence
  SiRNA target sequence
taaaaggttcagaaccattcccatga

SEQ ID NO: 106461 - DNA, 26 bp, Artificial sequence
  SiRNA target sequence
aaaaggttcagaaccattcccatgag

SEQ ID NO: 106462 - DNA, 26 bp, Artificial sequence
  SiRNA target sequence
aaaggttcagaaccattcccatgagt

SEQ ID NO: 106463 - DNA, 26 bp, Artificial sequence
  SiRNA target sequence
aaggttcagaaccattcccatgagtc

SEQ ID NO: 106464 - DNA, 26 bp, Artificial sequence
  SiRNA target sequence
aggttcagaaccattcccatgagtcg

SEQ ID NO: 106465 - DNA, 26 bp, Artificial sequence
  SiRNA target sequence
ggttcagaaccattcccatgagtcga

SEQ ID NO: 106466 - DNA, 26 bp, Artificial sequence
  SiRNA target sequence
gttcagaaccattcccatgagtcgaa

SEQ ID NO: 106467 - DNA, 26 bp, Artificial sequence
  SiRNA target sequence
ttcagaaccattcccatgagtcgaac

SEQ ID NO: 106468 - DNA, 26 bp, Artificial sequence
  SiRNA target sequence
tcagaaccattcccatgagtcgaaca

SEQ ID NO: 106469 - DNA, 26 bp, Artificial sequence
  SiRNA target sequence
cagaaccattcccatgagtcgaacat

SEQ ID NO: 106470 - DNA, 26 bp, Artificial sequence
  SiRNA target sequence
agaaccattcccatgagtcgaacata

SEQ ID NO: 106471 - DNA, 26 bp, Artificial sequence
  SiRNA target sequence
gaaccattcccatgagtcgaacatac

SEQ ID NO: 106472 - DNA, 26 bp, Artificial sequence
  SiRNA target sequence
aaccattcccatgagtcgaacataca

SEQ ID NO: 106473 - DNA, 26 bp, Artificial sequence
  SiRNA target sequence
accattcccatgagtcgaacatacaa

SEQ ID NO: 106474 - DNA, 26 bp, Artificial sequence
  SiRNA target sequence
ccattcccatgagtcgaacatacaaa

SEQ ID NO: 106475 - DNA, 26 bp, Artificial sequence
  SiRNA target sequence
cattcccatgagtcgaacatacaaat

SEQ ID NO: 106476 - DNA, 26 bp, Artificial sequence
  SiRNA target sequence
attcccatgagtcgaacatacaaata

SEQ ID NO: 106477 - DNA, 26 bp, Artificial sequence
  SiRNA target sequence
ttcccatgagtcgaacatacaaatat

SEQ ID NO: 106478 - DNA, 26 bp, Artificial sequence
  SiRNA target sequence
tcccatgagtcgaacatacaaatata

SEQ ID NO: 106479 - DNA, 26 bp, Artificial sequence
  SiRNA target sequence
cccatgagtcgaacatacaaatataa

SEQ ID NO: 106480 - DNA, 26 bp, Artificial sequence
  SiRNA target sequence
ccatgagtcgaacatacaaatataat

SEQ ID NO: 106481 - DNA, 26 bp, Artificial sequence
  SiRNA target sequence
catgagtcgaacatacaaatataatc

SEQ ID NO: 106482 - DNA, 26 bp, Artificial sequence
  SiRNA target sequence
atgagtcgaacatacaaatataatca

SEQ ID NO: 106483 - DNA, 26 bp, Artificial sequence
  SiRNA target sequence
tgagtcgaacatacaaatataatcat

SEQ ID NO: 106484 - DNA, 26 bp, Artificial sequence
  SiRNA target sequence
gagtcgaacatacaaatataatcata

SEQ ID NO: 106485 - DNA, 26 bp, Artificial sequence
  SiRNA target sequence
agtcgaacatacaaatataatcatat

SEQ ID NO: 106486 - DNA, 26 bp, Artificial sequence
  SiRNA target sequence
gtcgaacatacaaatataatcatatc

SEQ ID NO: 106487 - DNA, 26 bp, Artificial sequence
  SiRNA target sequence
tcgaacatacaaatataatcatatca

SEQ ID NO: 106488 - DNA, 26 bp, Artificial sequence
  SiRNA target sequence
cgaacatacaaatataatcatatcaa

SEQ ID NO: 106489 - DNA, 26 bp, Artificial sequence
  SiRNA target sequence
gaacatacaaatataatcatatcaat

SEQ ID NO: 106490 - DNA, 26 bp, Artificial sequence
  SiRNA target sequence
aacatacaaatataatcatatcaata

SEQ ID NO: 106491 - DNA, 26 bp, Artificial sequence
  SiRNA target sequence
acatacaaatataatcatatcaatat

SEQ ID NO: 106492 - DNA, 26 bp, Artificial sequence
  SiRNA target sequence
catacaaatataatcatatcaatatc

SEQ ID NO: 106493 - DNA, 26 bp, Artificial sequence
  SiRNA target sequence
atacaaatataatcatatcaatatct

SEQ ID NO: 106494 - DNA, 26 bp, Artificial sequence
  SiRNA target sequence
tacaaatataatcatatcaatatcta

SEQ ID NO: 106495 - DNA, 26 bp, Artificial sequence
  SiRNA target sequence
acaaatataatcatatcaatatctaa

SEQ ID NO: 106496 - DNA, 26 bp, Artificial sequence
  SiRNA target sequence
caaatataatcatatcaatatctaat

SEQ ID NO: 106497 - DNA, 26 bp, Artificial sequence
  SiRNA target sequence
aaatataatcatatcaatatctaata

SEQ ID NO: 106498 - DNA, 26 bp, Artificial sequence
  SiRNA target sequence
aatataatcatatcaatatctaatat

SEQ ID NO: 106499 - DNA, 26 bp, Artificial sequence
  SiRNA target sequence
atataatcatatcaatatctaatatt

SEQ ID NO: 106500 - DNA, 26 bp, Artificial sequence
  SiRNA target sequence
tataatcatatcaatatctaatattt

SEQ ID NO: 106501 - DNA, 26 bp, Artificial sequence
  SiRNA target sequence
ataatcatatcaatatctaatatttt

SEQ ID NO: 106502 - DNA, 26 bp, Artificial sequence
  SiRNA target sequence
taatcatatcaatatctaatattttt

SEQ ID NO: 106503 - DNA, 26 bp, Artificial sequence
  SiRNA target sequence
aatcatatcaatatctaatatttttt

SEQ ID NO: 106504 - DNA, 26 bp, Artificial sequence
  SiRNA target sequence
atcatatcaatatctaatattttttc

SEQ ID NO: 106505 - DNA, 26 bp, Artificial sequence
  SiRNA target sequence
tcatatcaatatctaatattttttcg

SEQ ID NO: 106506 - DNA, 26 bp, Artificial sequence
  SiRNA target sequence
catatcaatatctaatattttttcga

SEQ ID NO: 106507 - DNA, 26 bp, Artificial sequence
  SiRNA target sequence
atatcaatatctaatattttttcgaa

SEQ ID NO: 106508 - DNA, 26 bp, Artificial sequence
  SiRNA target sequence
tatcaatatctaatattttttcgaaa

SEQ ID NO: 106509 - DNA, 26 bp, Artificial sequence
  SiRNA target sequence
atcaatatctaatattttttcgaaat

SEQ ID NO: 106510 - DNA, 26 bp, Artificial sequence
  SiRNA target sequence
tcaatatctaatattttttcgaaatc

SEQ ID NO: 106511 - DNA, 26 bp, Artificial sequence
  SiRNA target sequence
caatatctaatattttttcgaaatca

SEQ ID NO: 106512 - DNA, 26 bp, Artificial sequence
  SiRNA target sequence
aatatctaatattttttcgaaatcaa

SEQ ID NO: 106513 - DNA, 26 bp, Artificial sequence
  SiRNA target sequence
atatctaatattttttcgaaatcaaa

SEQ ID NO: 106514 - DNA, 26 bp, Artificial sequence
  SiRNA target sequence
tatctaatattttttcgaaatcaaaa

SEQ ID NO: 106515 - DNA, 26 bp, Artificial sequence
  SiRNA target sequence
atctaatattttttcgaaatcaaaac

SEQ ID NO: 106516 - DNA, 26 bp, Artificial sequence
  SiRNA target sequence
tctaatattttttcgaaatcaaaact

SEQ ID NO: 106517 - DNA, 26 bp, Artificial sequence
  SiRNA target sequence
ctaatattttttcgaaatcaaaactg

SEQ ID NO: 106518 - DNA, 26 bp, Artificial sequence
  SiRNA target sequence
taatattttttcgaaatcaaaactgt

SEQ ID NO: 106519 - DNA, 26 bp, Artificial sequence
  SiRNA target sequence
aatattttttcgaaatcaaaactgtc

SEQ ID NO: 106520 - DNA, 26 bp, Artificial sequence
  SiRNA target sequence
atattttttcgaaatcaaaactgtcc

SEQ ID NO: 106521 - DNA, 26 bp, Artificial sequence
  SiRNA target sequence
tattttttcgaaatcaaaactgtcca

SEQ ID NO: 106522 - DNA, 26 bp, Artificial sequence
  SiRNA target sequence
attttttcgaaatcaaaactgtccat

SEQ ID NO: 106523 - DNA, 26 bp, Artificial sequence
  SiRNA target sequence
ttttttcgaaatcaaaactgtccata

SEQ ID NO: 106524 - DNA, 26 bp, Artificial sequence
  SiRNA target sequence
tttttcgaaatcaaaactgtccatat

SEQ ID NO: 106525 - DNA, 26 bp, Artificial sequence
  SiRNA target sequence
ttttcgaaatcaaaactgtccatatc

SEQ ID NO: 106526 - DNA, 26 bp, Artificial sequence
  SiRNA target sequence
tttcgaaatcaaaactgtccatatct

SEQ ID NO: 106527 - DNA, 26 bp, Artificial sequence
  SiRNA target sequence
ttcgaaatcaaaactgtccatatcta

SEQ ID NO: 106528 - DNA, 26 bp, Artificial sequence
  SiRNA target sequence
tcgaaatcaaaactgtccatatctaa

SEQ ID NO: 106529 - DNA, 26 bp, Artificial sequence
  SiRNA target sequence
cgaaatcaaaactgtccatatctaaa

SEQ ID NO: 106530 - DNA, 26 bp, Artificial sequence
  SiRNA target sequence
gaaatcaaaactgtccatatctaaag

SEQ ID NO: 106531 - DNA, 26 bp, Artificial sequence
  SiRNA target sequence
aaatcaaaactgtccatatctaaagt

SEQ ID NO: 106532 - DNA, 26 bp, Artificial sequence
  SiRNA target sequence
aatcaaaactgtccatatctaaagta

SEQ ID NO: 106533 - DNA, 26 bp, Artificial sequence
  SiRNA target sequence
atcaaaactgtccatatctaaagtaa

SEQ ID NO: 106534 - DNA, 26 bp, Artificial sequence
  SiRNA target sequence
tcaaaactgtccatatctaaagtaaa

SEQ ID NO: 106535 - DNA, 26 bp, Artificial sequence
  SiRNA target sequence
caaaactgtccatatctaaagtaaaa

SEQ ID NO: 106536 - DNA, 26 bp, Artificial sequence
  SiRNA target sequence
aaaactgtccatatctaaagtaaaat

SEQ ID NO: 106537 - DNA, 26 bp, Artificial sequence
  SiRNA target sequence
aaactgtccatatctaaagtaaaatc

SEQ ID NO: 106538 - DNA, 26 bp, Artificial sequence
  SiRNA target sequence
aactgtccatatctaaagtaaaatct

SEQ ID NO: 106539 - DNA, 26 bp, Artificial sequence
  SiRNA target sequence
actgtccatatctaaagtaaaatctg

SEQ ID NO: 106540 - DNA, 26 bp, Artificial sequence
  SiRNA target sequence
ctgtccatatctaaagtaaaatctgt

SEQ ID NO: 106541 - DNA, 26 bp, Artificial sequence
  SiRNA target sequence
tgtccatatctaaagtaaaatctgtt

SEQ ID NO: 106542 - DNA, 26 bp, Artificial sequence
  SiRNA target sequence
gtccatatctaaagtaaaatctgttg

SEQ ID NO: 106543 - DNA, 26 bp, Artificial sequence
  SiRNA target sequence
tccatatctaaagtaaaatctgttgg

SEQ ID NO: 106544 - DNA, 26 bp, Artificial sequence
  SiRNA target sequence
ccatatctaaagtaaaatctgttgga

SEQ ID NO: 106545 - DNA, 26 bp, Artificial sequence
  SiRNA target sequence
catatctaaagtaaaatctgttggaa

SEQ ID NO: 106546 - DNA, 26 bp, Artificial sequence
  SiRNA target sequence
atatctaaagtaaaatctgttggaag

SEQ ID NO: 106547 - DNA, 26 bp, Artificial sequence
  SiRNA target sequence
tatctaaagtaaaatctgttggaagc

SEQ ID NO: 106548 - DNA, 26 bp, Artificial sequence
  SiRNA target sequence
atctaaagtaaaatctgttggaagca

SEQ ID NO: 106549 - DNA, 26 bp, Artificial sequence
  SiRNA target sequence
tctaaagtaaaatctgttggaagcaa

SEQ ID NO: 106550 - DNA, 26 bp, Artificial sequence
  SiRNA target sequence
ctaaagtaaaatctgttggaagcaat

SEQ ID NO: 106551 - DNA, 26 bp, Artificial sequence
  SiRNA target sequence
taaagtaaaatctgttggaagcaatt

SEQ ID NO: 106552 - DNA, 26 bp, Artificial sequence
  SiRNA target sequence
aaagtaaaatctgttggaagcaattc

SEQ ID NO: 106553 - DNA, 26 bp, Artificial sequence
  SiRNA target sequence
aagtaaaatctgttggaagcaattct

SEQ ID NO: 106554 - DNA, 26 bp, Artificial sequence
  SiRNA target sequence
agtaaaatctgttggaagcaattctt

SEQ ID NO: 106555 - DNA, 26 bp, Artificial sequence
  SiRNA target sequence
gtaaaatctgttggaagcaattcttt

SEQ ID NO: 106556 - DNA, 26 bp, Artificial sequence
  SiRNA target sequence
taaaatctgttggaagcaattcttta

SEQ ID NO: 106557 - DNA, 26 bp, Artificial sequence
  SiRNA target sequence
aaaatctgttggaagcaattctttat

SEQ ID NO: 106558 - DNA, 26 bp, Artificial sequence
  SiRNA target sequence
aaatctgttggaagcaattctttatc

SEQ ID NO: 106559 - DNA, 26 bp, Artificial sequence
  SiRNA target sequence
aatctgttggaagcaattctttatca

SEQ ID NO: 106560 - DNA, 26 bp, Artificial sequence
  SiRNA target sequence
atctgttggaagcaattctttatcaa

SEQ ID NO: 106561 - DNA, 26 bp, Artificial sequence
  SiRNA target sequence
tctgttggaagcaattctttatcaac

SEQ ID NO: 106562 - DNA, 26 bp, Artificial sequence
  SiRNA target sequence
ctgttggaagcaattctttatcaacg

SEQ ID NO: 106563 - DNA, 26 bp, Artificial sequence
  SiRNA target sequence
tgttggaagcaattctttatcaacgt

SEQ ID NO: 106564 - DNA, 26 bp, Artificial sequence
  SiRNA target sequence
gttggaagcaattctttatcaacgtt

SEQ ID NO: 106565 - DNA, 26 bp, Artificial sequence
  SiRNA target sequence
ttggaagcaattctttatcaacgtta

SEQ ID NO: 106566 - DNA, 26 bp, Artificial sequence
  SiRNA target sequence
tggaagcaattctttatcaacgttat

SEQ ID NO: 106567 - DNA, 26 bp, Artificial sequence
  SiRNA target sequence
ggaagcaattctttatcaacgttata

SEQ ID NO: 106568 - DNA, 26 bp, Artificial sequence
  SiRNA target sequence
gaagcaattctttatcaacgttataa

SEQ ID NO: 106569 - DNA, 26 bp, Artificial sequence
  SiRNA target sequence
aagcaattctttatcaacgttataaa

SEQ ID NO: 106570 - DNA, 26 bp, Artificial sequence
  SiRNA target sequence
agcaattctttatcaacgttataaat

SEQ ID NO: 106571 - DNA, 26 bp, Artificial sequence
  SiRNA target sequence
gcaattctttatcaacgttataaatc

SEQ ID NO: 106572 - DNA, 26 bp, Artificial sequence
  SiRNA target sequence
caattctttatcaacgttataaatca

SEQ ID NO: 106573 - DNA, 26 bp, Artificial sequence
  SiRNA target sequence
aattctttatcaacgttataaatcaa

SEQ ID NO: 106574 - DNA, 26 bp, Artificial sequence
  SiRNA target sequence
attctttatcaacgttataaatcaaa

SEQ ID NO: 106575 - DNA, 26 bp, Artificial sequence
  SiRNA target sequence
ttctttatcaacgttataaatcaaat

SEQ ID NO: 106576 - DNA, 26 bp, Artificial sequence
  SiRNA target sequence
tctttatcaacgttataaatcaaatc

SEQ ID NO: 106577 - DNA, 26 bp, Artificial sequence
  SiRNA target sequence
ctttatcaacgttataaatcaaatct

SEQ ID NO: 106578 - DNA, 26 bp, Artificial sequence
  SiRNA target sequence
tttatcaacgttataaatcaaatctt

SEQ ID NO: 106579 - DNA, 26 bp, Artificial sequence
  SiRNA target sequence
ttatcaacgttataaatcaaatcttt

SEQ ID NO: 106580 - DNA, 26 bp, Artificial sequence
  SiRNA target sequence
tatcaacgttataaatcaaatcttta

SEQ ID NO: 106581 - DNA, 26 bp, Artificial sequence
  SiRNA target sequence
atcaacgttataaatcaaatctttat

SEQ ID NO: 106582 - DNA, 26 bp, Artificial sequence
  SiRNA target sequence
tcaacgttataaatcaaatctttatt

SEQ ID NO: 106583 - DNA, 26 bp, Artificial sequence
  SiRNA target sequence
caacgttataaatcaaatctttattg

SEQ ID NO: 106584 - DNA, 26 bp, Artificial sequence
  SiRNA target sequence
aacgttataaatcaaatctttattgt

SEQ ID NO: 106585 - DNA, 26 bp, Artificial sequence
  SiRNA target sequence
acgttataaatcaaatctttattgta

SEQ ID NO: 106586 - DNA, 26 bp, Artificial sequence
  SiRNA target sequence
cgttataaatcaaatctttattgtat

SEQ ID NO: 106587 - DNA, 26 bp, Artificial sequence
  SiRNA target sequence
gttataaatcaaatctttattgtatc

SEQ ID NO: 106588 - DNA, 26 bp, Artificial sequence
  SiRNA target sequence
ttataaatcaaatctttattgtatcc

SEQ ID NO: 106589 - DNA, 26 bp, Artificial sequence
  SiRNA target sequence
tataaatcaaatctttattgtatccg

SEQ ID NO: 106590 - DNA, 26 bp, Artificial sequence
  SiRNA target sequence
ataaatcaaatctttattgtatccgt

SEQ ID NO: 106591 - DNA, 26 bp, Artificial sequence
  SiRNA target sequence
taaatcaaatctttattgtatccgta

SEQ ID NO: 106592 - DNA, 26 bp, Artificial sequence
  SiRNA target sequence
aaatcaaatctttattgtatccgtat

SEQ ID NO: 106593 - DNA, 26 bp, Artificial sequence
  SiRNA target sequence
aatcaaatctttattgtatccgtata

SEQ ID NO: 106594 - DNA, 26 bp, Artificial sequence
  SiRNA target sequence
atcaaatctttattgtatccgtatag

SEQ ID NO: 106595 - DNA, 26 bp, Artificial sequence
  SiRNA target sequence
tcaaatctttattgtatccgtatagt

SEQ ID NO: 106596 - DNA, 26 bp, Artificial sequence
  SiRNA target sequence
caaatctttattgtatccgtatagta

SEQ ID NO: 106597 - DNA, 26 bp, Artificial sequence
  SiRNA target sequence
aaatctttattgtatccgtatagtat

SEQ ID NO: 106598 - DNA, 26 bp, Artificial sequence
  SiRNA target sequence
aatctttattgtatccgtatagtata

SEQ ID NO: 106599 - DNA, 26 bp, Artificial sequence
  SiRNA target sequence
atctttattgtatccgtatagtataa

SEQ ID NO: 106600 - DNA, 26 bp, Artificial sequence
  SiRNA target sequence
tctttattgtatccgtatagtataac

SEQ ID NO: 106601 - DNA, 26 bp, Artificial sequence
  SiRNA target sequence
ctttattgtatccgtatagtataaca

SEQ ID NO: 106602 - DNA, 26 bp, Artificial sequence
  SiRNA target sequence
tttattgtatccgtatagtataacat

SEQ ID NO: 106603 - DNA, 26 bp, Artificial sequence
  SiRNA target sequence
ttattgtatccgtatagtataacatt

SEQ ID NO: 106604 - DNA, 26 bp, Artificial sequence
  SiRNA target sequence
tattgtatccgtatagtataacattt

SEQ ID NO: 106605 - DNA, 26 bp, Artificial sequence
  SiRNA target sequence
attgtatccgtatagtataacatttt

SEQ ID NO: 106606 - DNA, 26 bp, Artificial sequence
  SiRNA target sequence
ttgtatccgtatagtataacattttg

SEQ ID NO: 106607 - DNA, 26 bp, Artificial sequence
  SiRNA target sequence
tgtatccgtatagtataacattttga

SEQ ID NO: 106608 - DNA, 26 bp, Artificial sequence
  SiRNA target sequence
gtatccgtatagtataacattttgaa

SEQ ID NO: 106609 - DNA, 26 bp, Artificial sequence
  SiRNA target sequence
tatccgtatagtataacattttgaat

SEQ ID NO: 106610 - DNA, 26 bp, Artificial sequence
  SiRNA target sequence
atccgtatagtataacattttgaata

SEQ ID NO: 106611 - DNA, 26 bp, Artificial sequence
  SiRNA target sequence
tccgtatagtataacattttgaataa

SEQ ID NO: 106612 - DNA, 26 bp, Artificial sequence
  SiRNA target sequence
ccgtatagtataacattttgaataag

SEQ ID NO: 106613 - DNA, 26 bp, Artificial sequence
  SiRNA target sequence
cgtatagtataacattttgaataagt

SEQ ID NO: 106614 - DNA, 26 bp, Artificial sequence
  SiRNA target sequence
gtatagtataacattttgaataagtt

SEQ ID NO: 106615 - DNA, 26 bp, Artificial sequence
  SiRNA target sequence
tatagtataacattttgaataagttt

SEQ ID NO: 106616 - DNA, 26 bp, Artificial sequence
  SiRNA target sequence
atagtataacattttgaataagttta

SEQ ID NO: 106617 - DNA, 26 bp, Artificial sequence
  SiRNA target sequence
tagtataacattttgaataagtttag

SEQ ID NO: 106618 - DNA, 26 bp, Artificial sequence
  SiRNA target sequence
agtataacattttgaataagtttagc

SEQ ID NO: 106619 - DNA, 26 bp, Artificial sequence
  SiRNA target sequence
gtataacattttgaataagtttagca

SEQ ID NO: 106620 - DNA, 26 bp, Artificial sequence
  SiRNA target sequence
tataacattttgaataagtttagcaa

SEQ ID NO: 106621 - DNA, 26 bp, Artificial sequence
  SiRNA target sequence
ataacattttgaataagtttagcaat

SEQ ID NO: 106622 - DNA, 26 bp, Artificial sequence
  SiRNA target sequence
taacattttgaataagtttagcaata

SEQ ID NO: 106623 - DNA, 26 bp, Artificial sequence
  SiRNA target sequence
aacattttgaataagtttagcaatat

SEQ ID NO: 106624 - DNA, 26 bp, Artificial sequence
  SiRNA target sequence
acattttgaataagtttagcaatatg

SEQ ID NO: 106625 - DNA, 26 bp, Artificial sequence
  SiRNA target sequence
cattttgaataagtttagcaatatgt

SEQ ID NO: 106626 - DNA, 26 bp, Artificial sequence
  SiRNA target sequence
attttgaataagtttagcaatatgta

SEQ ID NO: 106627 - DNA, 26 bp, Artificial sequence
  SiRNA target sequence
ttttgaataagtttagcaatatgtat

SEQ ID NO: 106628 - DNA, 26 bp, Artificial sequence
  SiRNA target sequence
tttgaataagtttagcaatatgtata

SEQ ID NO: 106629 - DNA, 26 bp, Artificial sequence
  SiRNA target sequence
ttgaataagtttagcaatatgtatag

SEQ ID NO: 106630 - DNA, 26 bp, Artificial sequence
  SiRNA target sequence
tgaataagtttagcaatatgtataga

SEQ ID NO: 106631 - DNA, 26 bp, Artificial sequence
  SiRNA target sequence
gaataagtttagcaatatgtatagaa

SEQ ID NO: 106632 - DNA, 26 bp, Artificial sequence
  SiRNA target sequence
aataagtttagcaatatgtatagaat

SEQ ID NO: 106633 - DNA, 26 bp, Artificial sequence
  SiRNA target sequence
ataagtttagcaatatgtatagaatt

SEQ ID NO: 106634 - DNA, 26 bp, Artificial sequence
  SiRNA target sequence
taagtttagcaatatgtatagaattt

SEQ ID NO: 106635 - DNA, 26 bp, Artificial sequence
  SiRNA target sequence
aagtttagcaatatgtatagaatttc

SEQ ID NO: 106636 - DNA, 26 bp, Artificial sequence
  SiRNA target sequence
agtttagcaatatgtatagaatttcc

SEQ ID NO: 106637 - DNA, 26 bp, Artificial sequence
  SiRNA target sequence
gtttagcaatatgtatagaatttcct

SEQ ID NO: 106638 - DNA, 26 bp, Artificial sequence
  SiRNA target sequence
tttagcaatatgtatagaatttcctg

SEQ ID NO: 106639 - DNA, 26 bp, Artificial sequence
  SiRNA target sequence
ttagcaatatgtatagaatttcctgt

SEQ ID NO: 106640 - DNA, 26 bp, Artificial sequence
  SiRNA target sequence
tagcaatatgtatagaatttcctgtt

SEQ ID NO: 106641 - DNA, 26 bp, Artificial sequence
  SiRNA target sequence
agcaatatgtatagaatttcctgttt

SEQ ID NO: 106642 - DNA, 26 bp, Artificial sequence
  SiRNA target sequence
gcaatatgtatagaatttcctgtttg

SEQ ID NO: 106643 - DNA, 26 bp, Artificial sequence
  SiRNA target sequence
caatatgtatagaatttcctgtttgg

SEQ ID NO: 106644 - DNA, 26 bp, Artificial sequence
  SiRNA target sequence
aatatgtatagaatttcctgtttggg

SEQ ID NO: 106645 - DNA, 26 bp, Artificial sequence
  SiRNA target sequence
atatgtatagaatttcctgtttggga

SEQ ID NO: 106646 - DNA, 26 bp, Artificial sequence
  SiRNA target sequence
tatgtatagaatttcctgtttgggag

SEQ ID NO: 106647 - DNA, 26 bp, Artificial sequence
  SiRNA target sequence
atgtatagaatttcctgtttgggagc

SEQ ID NO: 106648 - DNA, 26 bp, Artificial sequence
  SiRNA target sequence
tgtatagaatttcctgtttgggagcc

SEQ ID NO: 106649 - DNA, 26 bp, Artificial sequence
  SiRNA target sequence
gtatagaatttcctgtttgggagcca

SEQ ID NO: 106650 - DNA, 26 bp, Artificial sequence
  SiRNA target sequence
tatagaatttcctgtttgggagccat

SEQ ID NO: 106651 - DNA, 26 bp, Artificial sequence
  SiRNA target sequence
atagaatttcctgtttgggagccata

SEQ ID NO: 106652 - DNA, 26 bp, Artificial sequence
  SiRNA target sequence
tagaatttcctgtttgggagccatat

SEQ ID NO: 106653 - DNA, 26 bp, Artificial sequence
  SiRNA target sequence
agaatttcctgtttgggagccatata

SEQ ID NO: 106654 - DNA, 26 bp, Artificial sequence
  SiRNA target sequence
gaatttcctgtttgggagccatataa

SEQ ID NO: 106655 - DNA, 26 bp, Artificial sequence
  SiRNA target sequence
aatttcctgtttgggagccatataag

SEQ ID NO: 106656 - DNA, 26 bp, Artificial sequence
  SiRNA target sequence
atttcctgtttgggagccatataaga

SEQ ID NO: 106657 - DNA, 26 bp, Artificial sequence
  SiRNA target sequence
tttcctgtttgggagccatataagat

SEQ ID NO: 106658 - DNA, 26 bp, Artificial sequence
  SiRNA target sequence
ttcctgtttgggagccatataagatt

SEQ ID NO: 106659 - DNA, 26 bp, Artificial sequence
  SiRNA target sequence
tcctgtttgggagccatataagatta

SEQ ID NO: 106660 - DNA, 26 bp, Artificial sequence
  SiRNA target sequence
cctgtttgggagccatataagattat

SEQ ID NO: 106661 - DNA, 26 bp, Artificial sequence
  SiRNA target sequence
ctgtttgggagccatataagattatc

SEQ ID NO: 106662 - DNA, 26 bp, Artificial sequence
  SiRNA target sequence
tgtttgggagccatataagattatca

SEQ ID NO: 106663 - DNA, 26 bp, Artificial sequence
  SiRNA target sequence
gtttgggagccatataagattatcat

SEQ ID NO: 106664 - DNA, 27 bp, Artificial sequence
  SiRNA target sequence
ttaccaagtttctgcctgaaaatatat

SEQ ID NO: 106665 - DNA, 27 bp, Artificial sequence
  SiRNA target sequence
taccaagtttctgcctgaaaatatatt

SEQ ID NO: 106666 - DNA, 27 bp, Artificial sequence
  SiRNA target sequence
accaagtttctgcctgaaaatatattt

SEQ ID NO: 106667 - DNA, 27 bp, Artificial sequence
  SiRNA target sequence
ccaagtttctgcctgaaaatatatttt

SEQ ID NO: 106668 - DNA, 27 bp, Artificial sequence
  SiRNA target sequence
caagtttctgcctgaaaatatattttc

SEQ ID NO: 106669 - DNA, 27 bp, Artificial sequence
  SiRNA target sequence
aagtttctgcctgaaaatatattttct

SEQ ID NO: 106670 - DNA, 27 bp, Artificial sequence
  SiRNA target sequence
agtttctgcctgaaaatatattttctt

SEQ ID NO: 106671 - DNA, 27 bp, Artificial sequence
  SiRNA target sequence
gtttctgcctgaaaatatattttcttt

SEQ ID NO: 106672 - DNA, 27 bp, Artificial sequence
  SiRNA target sequence
tttctgcctgaaaatatattttctttt

SEQ ID NO: 106673 - DNA, 27 bp, Artificial sequence
  SiRNA target sequence
ttctgcctgaaaatatattttcttttt

SEQ ID NO: 106674 - DNA, 27 bp, Artificial sequence
  SiRNA target sequence
tctgcctgaaaatatattttcttttta

SEQ ID NO: 106675 - DNA, 27 bp, Artificial sequence
  SiRNA target sequence
ctgcctgaaaatatattttctttttat

SEQ ID NO: 106676 - DNA, 27 bp, Artificial sequence
  SiRNA target sequence
tgcctgaaaatatattttctttttata

SEQ ID NO: 106677 - DNA, 27 bp, Artificial sequence
  SiRNA target sequence
gcctgaaaatatattttctttttataa

SEQ ID NO: 106678 - DNA, 27 bp, Artificial sequence
  SiRNA target sequence
cctgaaaatatattttctttttataaa

SEQ ID NO: 106679 - DNA, 27 bp, Artificial sequence
  SiRNA target sequence
ctgaaaatatattttctttttataaat

SEQ ID NO: 106680 - DNA, 27 bp, Artificial sequence
  SiRNA target sequence
tgaaaatatattttctttttataaata

SEQ ID NO: 106681 - DNA, 27 bp, Artificial sequence
  SiRNA target sequence
gaaaatatattttctttttataaatat

SEQ ID NO: 106682 - DNA, 27 bp, Artificial sequence
  SiRNA target sequence
aaaatatattttctttttataaatatc

SEQ ID NO: 106683 - DNA, 27 bp, Artificial sequence
  SiRNA target sequence
aaatatattttctttttataaatatct

SEQ ID NO: 106684 - DNA, 27 bp, Artificial sequence
  SiRNA target sequence
aatatattttctttttataaatatcta

SEQ ID NO: 106685 - DNA, 27 bp, Artificial sequence
  SiRNA target sequence
atatattttctttttataaatatctaa

SEQ ID NO: 106686 - DNA, 27 bp, Artificial sequence
  SiRNA target sequence
tatattttctttttataaatatctaat

SEQ ID NO: 106687 - DNA, 27 bp, Artificial sequence
  SiRNA target sequence
atattttctttttataaatatctaata

SEQ ID NO: 106688 - DNA, 27 bp, Artificial sequence
  SiRNA target sequence
tattttctttttataaatatctaataa

SEQ ID NO: 106689 - DNA, 27 bp, Artificial sequence
  SiRNA target sequence
attttctttttataaatatctaataac

SEQ ID NO: 106690 - DNA, 27 bp, Artificial sequence
  SiRNA target sequence
ttttctttttataaatatctaataaca

SEQ ID NO: 106691 - DNA, 27 bp, Artificial sequence
  SiRNA target sequence
tttctttttataaatatctaataacat

SEQ ID NO: 106692 - DNA, 27 bp, Artificial sequence
  SiRNA target sequence
ttctttttataaatatctaataacatt

SEQ ID NO: 106693 - DNA, 27 bp, Artificial sequence
  SiRNA target sequence
tctttttataaatatctaataacattt

SEQ ID NO: 106694 - DNA, 27 bp, Artificial sequence
  SiRNA target sequence
ctttttataaatatctaataacatttt

SEQ ID NO: 106695 - DNA, 27 bp, Artificial sequence
  SiRNA target sequence
tttttataaatatctaataacattttt

SEQ ID NO: 106696 - DNA, 27 bp, Artificial sequence
  SiRNA target sequence
ttttataaatatctaataacatttttt

SEQ ID NO: 106697 - DNA, 27 bp, Artificial sequence
  SiRNA target sequence
tttataaatatctaataacattttttc

SEQ ID NO: 106698 - DNA, 27 bp, Artificial sequence
  SiRNA target sequence
ttataaatatctaataacattttttca

SEQ ID NO: 106699 - DNA, 27 bp, Artificial sequence
  SiRNA target sequence
tataaatatctaataacattttttcaa

SEQ ID NO: 106700 - DNA, 27 bp, Artificial sequence
  SiRNA target sequence
ataaatatctaataacattttttcaat

SEQ ID NO: 106701 - DNA, 27 bp, Artificial sequence
  SiRNA target sequence
taaatatctaataacattttttcaata

SEQ ID NO: 106702 - DNA, 27 bp, Artificial sequence
  SiRNA target sequence
aaatatctaataacattttttcaataa

SEQ ID NO: 106703 - DNA, 27 bp, Artificial sequence
  SiRNA target sequence
aatatctaataacattttttcaataat

SEQ ID NO: 106704 - DNA, 27 bp, Artificial sequence
  SiRNA target sequence
atatctaataacattttttcaataata

SEQ ID NO: 106705 - DNA, 27 bp, Artificial sequence
  SiRNA target sequence
tatctaataacattttttcaataatat

SEQ ID NO: 106706 - DNA, 27 bp, Artificial sequence
  SiRNA target sequence
atctaataacattttttcaataatatt

SEQ ID NO: 106707 - DNA, 27 bp, Artificial sequence
  SiRNA target sequence
tctaataacattttttcaataatatta

SEQ ID NO: 106708 - DNA, 27 bp, Artificial sequence
  SiRNA target sequence
ctaataacattttttcaataatattat

SEQ ID NO: 106709 - DNA, 27 bp, Artificial sequence
  SiRNA target sequence
taataacattttttcaataatattatt

SEQ ID NO: 106710 - DNA, 27 bp, Artificial sequence
  SiRNA target sequence
aataacattttttcaataatattatta

SEQ ID NO: 106711 - DNA, 27 bp, Artificial sequence
  SiRNA target sequence
ataacattttttcaataatattattaa

SEQ ID NO: 106712 - DNA, 27 bp, Artificial sequence
  SiRNA target sequence
taacattttttcaataatattattaag

SEQ ID NO: 106713 - DNA, 27 bp, Artificial sequence
  SiRNA target sequence
aacattttttcaataatattattaagt

SEQ ID NO: 106714 - DNA, 27 bp, Artificial sequence
  SiRNA target sequence
acattttttcaataatattattaagtc

SEQ ID NO: 106715 - DNA, 27 bp, Artificial sequence
  SiRNA target sequence
cattttttcaataatattattaagtct

SEQ ID NO: 106716 - DNA, 27 bp, Artificial sequence
  SiRNA target sequence
attttttcaataatattattaagtcta

SEQ ID NO: 106717 - DNA, 27 bp, Artificial sequence
  SiRNA target sequence
ttttttcaataatattattaagtctag

SEQ ID NO: 106718 - DNA, 27 bp, Artificial sequence
  SiRNA target sequence
tttttcaataatattattaagtctaga

SEQ ID NO: 106719 - DNA, 27 bp, Artificial sequence
  SiRNA target sequence
ttttcaataatattattaagtctagaa

SEQ ID NO: 106720 - DNA, 27 bp, Artificial sequence
  SiRNA target sequence
tttcaataatattattaagtctagaat

SEQ ID NO: 106721 - DNA, 27 bp, Artificial sequence
  SiRNA target sequence
ttcaataatattattaagtctagaatt

SEQ ID NO: 106722 - DNA, 27 bp, Artificial sequence
  SiRNA target sequence
tcaataatattattaagtctagaattt

SEQ ID NO: 106723 - DNA, 27 bp, Artificial sequence
  SiRNA target sequence
caataatattattaagtctagaatttc

SEQ ID NO: 106724 - DNA, 27 bp, Artificial sequence
  SiRNA target sequence
aataatattattaagtctagaatttcc

SEQ ID NO: 106725 - DNA, 27 bp, Artificial sequence
  SiRNA target sequence
ataatattattaagtctagaatttcca

SEQ ID NO: 106726 - DNA, 27 bp, Artificial sequence
  SiRNA target sequence
taatattattaagtctagaatttccac

SEQ ID NO: 106727 - DNA, 27 bp, Artificial sequence
  SiRNA target sequence
aatattattaagtctagaatttccact

SEQ ID NO: 106728 - DNA, 27 bp, Artificial sequence
  SiRNA target sequence
atattattaagtctagaatttccactt

SEQ ID NO: 106729 - DNA, 27 bp, Artificial sequence
  SiRNA target sequence
tattattaagtctagaatttccactta

SEQ ID NO: 106730 - DNA, 27 bp, Artificial sequence
  SiRNA target sequence
attattaagtctagaatttccacttac

SEQ ID NO: 106731 - DNA, 27 bp, Artificial sequence
  SiRNA target sequence
ttattaagtctagaatttccacttaca

SEQ ID NO: 106732 - DNA, 27 bp, Artificial sequence
  SiRNA target sequence
tattaagtctagaatttccacttacaa

SEQ ID NO: 106733 - DNA, 27 bp, Artificial sequence
  SiRNA target sequence
attaagtctagaatttccacttacaaa

SEQ ID NO: 106734 - DNA, 27 bp, Artificial sequence
  SiRNA target sequence
ttaagtctagaatttccacttacaaat

SEQ ID NO: 106735 - DNA, 27 bp, Artificial sequence
  SiRNA target sequence
taagtctagaatttccacttacaaata

SEQ ID NO: 106736 - DNA, 27 bp, Artificial sequence
  SiRNA target sequence
aagtctagaatttccacttacaaatat

SEQ ID NO: 106737 - DNA, 27 bp, Artificial sequence
  SiRNA target sequence
agtctagaatttccacttacaaatatt

SEQ ID NO: 106738 - DNA, 27 bp, Artificial sequence
  SiRNA target sequence
gtctagaatttccacttacaaatatta

SEQ ID NO: 106739 - DNA, 27 bp, Artificial sequence
  SiRNA target sequence
tctagaatttccacttacaaatattaa

SEQ ID NO: 106740 - DNA, 27 bp, Artificial sequence
  SiRNA target sequence
ctagaatttccacttacaaatattaac

SEQ ID NO: 106741 - DNA, 27 bp, Artificial sequence
  SiRNA target sequence
tagaatttccacttacaaatattaacc

SEQ ID NO: 106742 - DNA, 27 bp, Artificial sequence
  SiRNA target sequence
agaatttccacttacaaatattaacca

SEQ ID NO: 106743 - DNA, 27 bp, Artificial sequence
  SiRNA target sequence
gaatttccacttacaaatattaaccaa

SEQ ID NO: 106744 - DNA, 27 bp, Artificial sequence
  SiRNA target sequence
aatttccacttacaaatattaaccaat

SEQ ID NO: 106745 - DNA, 27 bp, Artificial sequence
  SiRNA target sequence
atttccacttacaaatattaaccaatc

SEQ ID NO: 106746 - DNA, 27 bp, Artificial sequence
  SiRNA target sequence
tttccacttacaaatattaaccaatca

SEQ ID NO: 106747 - DNA, 27 bp, Artificial sequence
  SiRNA target sequence
ttccacttacaaatattaaccaatcat

SEQ ID NO: 106748 - DNA, 27 bp, Artificial sequence
  SiRNA target sequence
tccacttacaaatattaaccaatcatc

SEQ ID NO: 106749 - DNA, 27 bp, Artificial sequence
  SiRNA target sequence
ccacttacaaatattaaccaatcatca

SEQ ID NO: 106750 - DNA, 27 bp, Artificial sequence
  SiRNA target sequence
cacttacaaatattaaccaatcatcaa

SEQ ID NO: 106751 - DNA, 27 bp, Artificial sequence
  SiRNA target sequence
acttacaaatattaaccaatcatcaat

SEQ ID NO: 106752 - DNA, 27 bp, Artificial sequence
  SiRNA target sequence
cttacaaatattaaccaatcatcaata

SEQ ID NO: 106753 - DNA, 27 bp, Artificial sequence
  SiRNA target sequence
ttacaaatattaaccaatcatcaatat

SEQ ID NO: 106754 - DNA, 27 bp, Artificial sequence
  SiRNA target sequence
tacaaatattaaccaatcatcaatatt

SEQ ID NO: 106755 - DNA, 27 bp, Artificial sequence
  SiRNA target sequence
acaaatattaaccaatcatcaatattt

SEQ ID NO: 106756 - DNA, 27 bp, Artificial sequence
  SiRNA target sequence
caaatattaaccaatcatcaatatttt

SEQ ID NO: 106757 - DNA, 27 bp, Artificial sequence
  SiRNA target sequence
aaatattaaccaatcatcaatattttc

SEQ ID NO: 106758 - DNA, 27 bp, Artificial sequence
  SiRNA target sequence
aatattaaccaatcatcaatattttct

SEQ ID NO: 106759 - DNA, 27 bp, Artificial sequence
  SiRNA target sequence
atattaaccaatcatcaatattttcta

SEQ ID NO: 106760 - DNA, 27 bp, Artificial sequence
  SiRNA target sequence
tattaaccaatcatcaatattttctag

SEQ ID NO: 106761 - DNA, 27 bp, Artificial sequence
  SiRNA target sequence
attaaccaatcatcaatattttctagc

SEQ ID NO: 106762 - DNA, 27 bp, Artificial sequence
  SiRNA target sequence
ttaaccaatcatcaatattttctagcc

SEQ ID NO: 106763 - DNA, 27 bp, Artificial sequence
  SiRNA target sequence
taaccaatcatcaatattttctagccc

SEQ ID NO: 106764 - DNA, 27 bp, Artificial sequence
  SiRNA target sequence
aaccaatcatcaatattttctagccct

SEQ ID NO: 106765 - DNA, 27 bp, Artificial sequence
  SiRNA target sequence
accaatcatcaatattttctagccctt

SEQ ID NO: 106766 - DNA, 27 bp, Artificial sequence
  SiRNA target sequence
ccaatcatcaatattttctagcccttt

SEQ ID NO: 106767 - DNA, 27 bp, Artificial sequence
  SiRNA target sequence
caatcatcaatattttctagccctttt

SEQ ID NO: 106768 - DNA, 27 bp, Artificial sequence
  SiRNA target sequence
aatcatcaatattttctagccctttta

SEQ ID NO: 106769 - DNA, 27 bp, Artificial sequence
  SiRNA target sequence
atcatcaatattttctagcccttttat

SEQ ID NO: 106770 - DNA, 27 bp, Artificial sequence
  SiRNA target sequence
tcatcaatattttctagcccttttata

SEQ ID NO: 106771 - DNA, 27 bp, Artificial sequence
  SiRNA target sequence
catcaatattttctagcccttttatag

SEQ ID NO: 106772 - DNA, 27 bp, Artificial sequence
  SiRNA target sequence
atcaatattttctagcccttttatagt

SEQ ID NO: 106773 - DNA, 27 bp, Artificial sequence
  SiRNA target sequence
tcaatattttctagcccttttatagtc

SEQ ID NO: 106774 - DNA, 27 bp, Artificial sequence
  SiRNA target sequence
caatattttctagcccttttatagtct

SEQ ID NO: 106775 - DNA, 27 bp, Artificial sequence
  SiRNA target sequence
aatattttctagcccttttatagtctt

SEQ ID NO: 106776 - DNA, 27 bp, Artificial sequence
  SiRNA target sequence
atattttctagcccttttatagtctta

SEQ ID NO: 106777 - DNA, 27 bp, Artificial sequence
  SiRNA target sequence
tattttctagcccttttatagtcttat

SEQ ID NO: 106778 - DNA, 27 bp, Artificial sequence
  SiRNA target sequence
attttctagcccttttatagtcttata

SEQ ID NO: 106779 - DNA, 27 bp, Artificial sequence
  SiRNA target sequence
ttttctagcccttttatagtcttataa

SEQ ID NO: 106780 - DNA, 27 bp, Artificial sequence
  SiRNA target sequence
tttctagcccttttatagtcttataaa

SEQ ID NO: 106781 - DNA, 27 bp, Artificial sequence
  SiRNA target sequence
ttctagcccttttatagtcttataaat

SEQ ID NO: 106782 - DNA, 27 bp, Artificial sequence
  SiRNA target sequence
tctagcccttttatagtcttataaata

SEQ ID NO: 106783 - DNA, 27 bp, Artificial sequence
  SiRNA target sequence
ctagcccttttatagtcttataaatat

SEQ ID NO: 106784 - DNA, 27 bp, Artificial sequence
  SiRNA target sequence
tagcccttttatagtcttataaatatc

SEQ ID NO: 106785 - DNA, 27 bp, Artificial sequence
  SiRNA target sequence
agcccttttatagtcttataaatatct

SEQ ID NO: 106786 - DNA, 27 bp, Artificial sequence
  SiRNA target sequence
gcccttttatagtcttataaatatctt

SEQ ID NO: 106787 - DNA, 27 bp, Artificial sequence
  SiRNA target sequence
cccttttatagtcttataaatatcttg

SEQ ID NO: 106788 - DNA, 27 bp, Artificial sequence
  SiRNA target sequence
ccttttatagtcttataaatatcttgt

SEQ ID NO: 106789 - DNA, 27 bp, Artificial sequence
  SiRNA target sequence
cttttatagtcttataaatatcttgta

SEQ ID NO: 106790 - DNA, 27 bp, Artificial sequence
  SiRNA target sequence
ttttatagtcttataaatatcttgtat

SEQ ID NO: 106791 - DNA, 27 bp, Artificial sequence
  SiRNA target sequence
tttatagtcttataaatatcttgtatg

SEQ ID NO: 106792 - DNA, 27 bp, Artificial sequence
  SiRNA target sequence
ttatagtcttataaatatcttgtatgt

SEQ ID NO: 106793 - DNA, 27 bp, Artificial sequence
  SiRNA target sequence
tatagtcttataaatatcttgtatgta

SEQ ID NO: 106794 - DNA, 27 bp, Artificial sequence
  SiRNA target sequence
atagtcttataaatatcttgtatgtat

SEQ ID NO: 106795 - DNA, 27 bp, Artificial sequence
  SiRNA target sequence
tagtcttataaatatcttgtatgtatt

SEQ ID NO: 106796 - DNA, 27 bp, Artificial sequence
  SiRNA target sequence
agtcttataaatatcttgtatgtattt

SEQ ID NO: 106797 - DNA, 27 bp, Artificial sequence
  SiRNA target sequence
gtcttataaatatcttgtatgtattta

SEQ ID NO: 106798 - DNA, 27 bp, Artificial sequence
  SiRNA target sequence
tcttataaatatcttgtatgtatttat

SEQ ID NO: 106799 - DNA, 27 bp, Artificial sequence
  SiRNA target sequence
cttataaatatcttgtatgtatttatt

SEQ ID NO: 106800 - DNA, 27 bp, Artificial sequence
  SiRNA target sequence
ttataaatatcttgtatgtatttatta

SEQ ID NO: 106801 - DNA, 27 bp, Artificial sequence
  SiRNA target sequence
tataaatatcttgtatgtatttattat

SEQ ID NO: 106802 - DNA, 27 bp, Artificial sequence
  SiRNA target sequence
ataaatatcttgtatgtatttattatc

SEQ ID NO: 106803 - DNA, 27 bp, Artificial sequence
  SiRNA target sequence
taaatatcttgtatgtatttattatct

SEQ ID NO: 106804 - DNA, 27 bp, Artificial sequence
  SiRNA target sequence
aaatatcttgtatgtatttattatctt

SEQ ID NO: 106805 - DNA, 27 bp, Artificial sequence
  SiRNA target sequence
aatatcttgtatgtatttattatcttc

SEQ ID NO: 106806 - DNA, 27 bp, Artificial sequence
  SiRNA target sequence
atatcttgtatgtatttattatcttcc

SEQ ID NO: 106807 - DNA, 27 bp, Artificial sequence
  SiRNA target sequence
tatcttgtatgtatttattatcttccc

SEQ ID NO: 106808 - DNA, 27 bp, Artificial sequence
  SiRNA target sequence
atcttgtatgtatttattatcttccct

SEQ ID NO: 106809 - DNA, 27 bp, Artificial sequence
  SiRNA target sequence
tcttgtatgtatttattatcttccctt

SEQ ID NO: 106810 - DNA, 27 bp, Artificial sequence
  SiRNA target sequence
cttgtatgtatttattatcttcccttg

SEQ ID NO: 106811 - DNA, 27 bp, Artificial sequence
  SiRNA target sequence
ttgtatgtatttattatcttcccttga

SEQ ID NO: 106812 - DNA, 27 bp, Artificial sequence
  SiRNA target sequence
tgtatgtatttattatcttcccttgaa

SEQ ID NO: 106813 - DNA, 27 bp, Artificial sequence
  SiRNA target sequence
gtatgtatttattatcttcccttgaaa

SEQ ID NO: 106814 - DNA, 27 bp, Artificial sequence
  SiRNA target sequence
tatgtatttattatcttcccttgaaac

SEQ ID NO: 106815 - DNA, 27 bp, Artificial sequence
  SiRNA target sequence
atgtatttattatcttcccttgaaaca

SEQ ID NO: 106816 - DNA, 27 bp, Artificial sequence
  SiRNA target sequence
tgtatttattatcttcccttgaaacag

SEQ ID NO: 106817 - DNA, 27 bp, Artificial sequence
  SiRNA target sequence
gtatttattatcttcccttgaaacagc

SEQ ID NO: 106818 - DNA, 27 bp, Artificial sequence
  SiRNA target sequence
tatttattatcttcccttgaaacagcg

SEQ ID NO: 106819 - DNA, 27 bp, Artificial sequence
  SiRNA target sequence
atttattatcttcccttgaaacagcgg

SEQ ID NO: 106820 - DNA, 27 bp, Artificial sequence
  SiRNA target sequence
tttattatcttcccttgaaacagcggg

SEQ ID NO: 106821 - DNA, 27 bp, Artificial sequence
  SiRNA target sequence
ttattatcttcccttgaaacagcgggg

SEQ ID NO: 106822 - DNA, 27 bp, Artificial sequence
  SiRNA target sequence
tattatcttcccttgaaacagcggggt

SEQ ID NO: 106823 - DNA, 27 bp, Artificial sequence
  SiRNA target sequence
attatcttcccttgaaacagcggggta

SEQ ID NO: 106824 - DNA, 27 bp, Artificial sequence
  SiRNA target sequence
ttatcttcccttgaaacagcggggtaa

SEQ ID NO: 106825 - DNA, 27 bp, Artificial sequence
  SiRNA target sequence
tatcttcccttgaaacagcggggtaaa

SEQ ID NO: 106826 - DNA, 27 bp, Artificial sequence
  SiRNA target sequence
atcttcccttgaaacagcggggtaaat

SEQ ID NO: 106827 - DNA, 27 bp, Artificial sequence
  SiRNA target sequence
tcttcccttgaaacagcggggtaaatt

SEQ ID NO: 106828 - DNA, 27 bp, Artificial sequence
  SiRNA target sequence
cttcccttgaaacagcggggtaaattt

SEQ ID NO: 106829 - DNA, 27 bp, Artificial sequence
  SiRNA target sequence
ttcccttgaaacagcggggtaaatttc

SEQ ID NO: 106830 - DNA, 27 bp, Artificial sequence
  SiRNA target sequence
tcccttgaaacagcggggtaaatttca

SEQ ID NO: 106831 - DNA, 27 bp, Artificial sequence
  SiRNA target sequence
cccttgaaacagcggggtaaatttcaa

SEQ ID NO: 106832 - DNA, 27 bp, Artificial sequence
  SiRNA target sequence
ccttgaaacagcggggtaaatttcaat

SEQ ID NO: 106833 - DNA, 27 bp, Artificial sequence
  SiRNA target sequence
cttgaaacagcggggtaaatttcaatg

SEQ ID NO: 106834 - DNA, 27 bp, Artificial sequence
  SiRNA target sequence
ttgaaacagcggggtaaatttcaatgc

SEQ ID NO: 106835 - DNA, 27 bp, Artificial sequence
  SiRNA target sequence
tgaaacagcggggtaaatttcaatgcc

SEQ ID NO: 106836 - DNA, 27 bp, Artificial sequence
  SiRNA target sequence
gaaacagcggggtaaatttcaatgcct

SEQ ID NO: 106837 - DNA, 27 bp, Artificial sequence
  SiRNA target sequence
aaacagcggggtaaatttcaatgcctt

SEQ ID NO: 106838 - DNA, 27 bp, Artificial sequence
  SiRNA target sequence
aacagcggggtaaatttcaatgccttt

SEQ ID NO: 106839 - DNA, 27 bp, Artificial sequence
  SiRNA target sequence
acagcggggtaaatttcaatgccttta

SEQ ID NO: 106840 - DNA, 27 bp, Artificial sequence
  SiRNA target sequence
cagcggggtaaatttcaatgcctttat

SEQ ID NO: 106841 - DNA, 27 bp, Artificial sequence
  SiRNA target sequence
agcggggtaaatttcaatgcctttatt

SEQ ID NO: 106842 - DNA, 27 bp, Artificial sequence
  SiRNA target sequence
gcggggtaaatttcaatgcctttattt

SEQ ID NO: 106843 - DNA, 27 bp, Artificial sequence
  SiRNA target sequence
cggggtaaatttcaatgcctttatttt

SEQ ID NO: 106844 - DNA, 27 bp, Artificial sequence
  SiRNA target sequence
ggggtaaatttcaatgcctttattttc

SEQ ID NO: 106845 - DNA, 27 bp, Artificial sequence
  SiRNA target sequence
gggtaaatttcaatgcctttattttca

SEQ ID NO: 106846 - DNA, 27 bp, Artificial sequence
  SiRNA target sequence
ggtaaatttcaatgcctttattttcaa

SEQ ID NO: 106847 - DNA, 27 bp, Artificial sequence
  SiRNA target sequence
gtaaatttcaatgcctttattttcaaa

SEQ ID NO: 106848 - DNA, 27 bp, Artificial sequence
  SiRNA target sequence
taaatttcaatgcctttattttcaaac

SEQ ID NO: 106849 - DNA, 27 bp, Artificial sequence
  SiRNA target sequence
aaatttcaatgcctttattttcaaact

SEQ ID NO: 106850 - DNA, 27 bp, Artificial sequence
  SiRNA target sequence
aatttcaatgcctttattttcaaactc

SEQ ID NO: 106851 - DNA, 27 bp, Artificial sequence
  SiRNA target sequence
atttcaatgcctttattttcaaactct

SEQ ID NO: 106852 - DNA, 27 bp, Artificial sequence
  SiRNA target sequence
tttcaatgcctttattttcaaactctt

SEQ ID NO: 106853 - DNA, 27 bp, Artificial sequence
  SiRNA target sequence
ttcaatgcctttattttcaaactcttc

SEQ ID NO: 106854 - DNA, 27 bp, Artificial sequence
  SiRNA target sequence
tcaatgcctttattttcaaactcttct

SEQ ID NO: 106855 - DNA, 27 bp, Artificial sequence
  SiRNA target sequence
caatgcctttattttcaaactcttctt

SEQ ID NO: 106856 - DNA, 27 bp, Artificial sequence
  SiRNA target sequence
aatgcctttattttcaaactcttcttt

SEQ ID NO: 106857 - DNA, 27 bp, Artificial sequence
  SiRNA target sequence
atgcctttattttcaaactcttcttta

SEQ ID NO: 106858 - DNA, 27 bp, Artificial sequence
  SiRNA target sequence
tgcctttattttcaaactcttctttat

SEQ ID NO: 106859 - DNA, 27 bp, Artificial sequence
  SiRNA target sequence
gcctttattttcaaactcttctttata

SEQ ID NO: 106860 - DNA, 27 bp, Artificial sequence
  SiRNA target sequence
cctttattttcaaactcttctttatat

SEQ ID NO: 106861 - DNA, 27 bp, Artificial sequence
  SiRNA target sequence
ctttattttcaaactcttctttatata

SEQ ID NO: 106862 - DNA, 27 bp, Artificial sequence
  SiRNA target sequence
tttattttcaaactcttctttatataa

SEQ ID NO: 106863 - DNA, 27 bp, Artificial sequence
  SiRNA target sequence
ttattttcaaactcttctttatataaa

SEQ ID NO: 106864 - DNA, 27 bp, Artificial sequence
  SiRNA target sequence
tattttcaaactcttctttatataaaa

SEQ ID NO: 106865 - DNA, 27 bp, Artificial sequence
  SiRNA target sequence
attttcaaactcttctttatataaaaa

SEQ ID NO: 106866 - DNA, 27 bp, Artificial sequence
  SiRNA target sequence
ttttcaaactcttctttatataaaaaa

SEQ ID NO: 106867 - DNA, 27 bp, Artificial sequence
  SiRNA target sequence
tttcaaactcttctttatataaaaaat

SEQ ID NO: 106868 - DNA, 27 bp, Artificial sequence
  SiRNA target sequence
ttcaaactcttctttatataaaaaatc

SEQ ID NO: 106869 - DNA, 27 bp, Artificial sequence
  SiRNA target sequence
tcaaactcttctttatataaaaaatct

SEQ ID NO: 106870 - DNA, 27 bp, Artificial sequence
  SiRNA target sequence
caaactcttctttatataaaaaatcta

SEQ ID NO: 106871 - DNA, 27 bp, Artificial sequence
  SiRNA target sequence
aaactcttctttatataaaaaatctac

SEQ ID NO: 106872 - DNA, 27 bp, Artificial sequence
  SiRNA target sequence
aactcttctttatataaaaaatctaca

SEQ ID NO: 106873 - DNA, 27 bp, Artificial sequence
  SiRNA target sequence
actcttctttatataaaaaatctacat

SEQ ID NO: 106874 - DNA, 27 bp, Artificial sequence
  SiRNA target sequence
ctcttctttatataaaaaatctacatc

SEQ ID NO: 106875 - DNA, 27 bp, Artificial sequence
  SiRNA target sequence
tcttctttatataaaaaatctacatct

SEQ ID NO: 106876 - DNA, 27 bp, Artificial sequence
  SiRNA target sequence
cttctttatataaaaaatctacatctc

SEQ ID NO: 106877 - DNA, 27 bp, Artificial sequence
  SiRNA target sequence
ttctttatataaaaaatctacatctct

SEQ ID NO: 106878 - DNA, 27 bp, Artificial sequence
  SiRNA target sequence
tctttatataaaaaatctacatctcta

SEQ ID NO: 106879 - DNA, 27 bp, Artificial sequence
  SiRNA target sequence
ctttatataaaaaatctacatctctaa

SEQ ID NO: 106880 - DNA, 27 bp, Artificial sequence
  SiRNA target sequence
tttatataaaaaatctacatctctaaa

SEQ ID NO: 106881 - DNA, 27 bp, Artificial sequence
  SiRNA target sequence
ttatataaaaaatctacatctctaaat

SEQ ID NO: 106882 - DNA, 27 bp, Artificial sequence
  SiRNA target sequence
tatataaaaaatctacatctctaaatc

SEQ ID NO: 106883 - DNA, 27 bp, Artificial sequence
  SiRNA target sequence
atataaaaaatctacatctctaaatct

SEQ ID NO: 106884 - DNA, 27 bp, Artificial sequence
  SiRNA target sequence
tataaaaaatctacatctctaaatcta

SEQ ID NO: 106885 - DNA, 27 bp, Artificial sequence
  SiRNA target sequence
ataaaaaatctacatctctaaatctaa

SEQ ID NO: 106886 - DNA, 27 bp, Artificial sequence
  SiRNA target sequence
taaaaaatctacatctctaaatctaaa

SEQ ID NO: 106887 - DNA, 27 bp, Artificial sequence
  SiRNA target sequence
aaaaaatctacatctctaaatctaaaa

SEQ ID NO: 106888 - DNA, 27 bp, Artificial sequence
  SiRNA target sequence
aaaaatctacatctctaaatctaaaac

SEQ ID NO: 106889 - DNA, 27 bp, Artificial sequence
  SiRNA target sequence
aaaatctacatctctaaatctaaaacc

SEQ ID NO: 106890 - DNA, 27 bp, Artificial sequence
  SiRNA target sequence
aaatctacatctctaaatctaaaacca

SEQ ID NO: 106891 - DNA, 27 bp, Artificial sequence
  SiRNA target sequence
aatctacatctctaaatctaaaaccat

SEQ ID NO: 106892 - DNA, 27 bp, Artificial sequence
  SiRNA target sequence
atctacatctctaaatctaaaaccata

SEQ ID NO: 106893 - DNA, 27 bp, Artificial sequence
  SiRNA target sequence
tctacatctctaaatctaaaaccatat

SEQ ID NO: 106894 - DNA, 27 bp, Artificial sequence
  SiRNA target sequence
ctacatctctaaatctaaaaccatata

SEQ ID NO: 106895 - DNA, 27 bp, Artificial sequence
  SiRNA target sequence
tacatctctaaatctaaaaccatataa

SEQ ID NO: 106896 - DNA, 27 bp, Artificial sequence
  SiRNA target sequence
acatctctaaatctaaaaccatataat

SEQ ID NO: 106897 - DNA, 27 bp, Artificial sequence
  SiRNA target sequence
catctctaaatctaaaaccatataata

SEQ ID NO: 106898 - DNA, 27 bp, Artificial sequence
  SiRNA target sequence
atctctaaatctaaaaccatataataa

SEQ ID NO: 106899 - DNA, 27 bp, Artificial sequence
  SiRNA target sequence
tctctaaatctaaaaccatataataaa

SEQ ID NO: 106900 - DNA, 27 bp, Artificial sequence
  SiRNA target sequence
ctctaaatctaaaaccatataataaaa

SEQ ID NO: 106901 - DNA, 27 bp, Artificial sequence
  SiRNA target sequence
tctaaatctaaaaccatataataaaat

SEQ ID NO: 106902 - DNA, 27 bp, Artificial sequence
  SiRNA target sequence
ctaaatctaaaaccatataataaaata

SEQ ID NO: 106903 - DNA, 27 bp, Artificial sequence
  SiRNA target sequence
taaatctaaaaccatataataaaataa

SEQ ID NO: 106904 - DNA, 27 bp, Artificial sequence
  SiRNA target sequence
aaatctaaaaccatataataaaataac

SEQ ID NO: 106905 - DNA, 27 bp, Artificial sequence
  SiRNA target sequence
aatctaaaaccatataataaaataact

SEQ ID NO: 106906 - DNA, 27 bp, Artificial sequence
  SiRNA target sequence
atctaaaaccatataataaaataactt

SEQ ID NO: 106907 - DNA, 27 bp, Artificial sequence
  SiRNA target sequence
tctaaaaccatataataaaataacttt

SEQ ID NO: 106908 - DNA, 27 bp, Artificial sequence
  SiRNA target sequence
ctaaaaccatataataaaataactttt

SEQ ID NO: 106909 - DNA, 27 bp, Artificial sequence
  SiRNA target sequence
taaaaccatataataaaataacttttt

SEQ ID NO: 106910 - DNA, 27 bp, Artificial sequence
  SiRNA target sequence
aaaaccatataataaaataactttttt

SEQ ID NO: 106911 - DNA, 27 bp, Artificial sequence
  SiRNA target sequence
aaaccatataataaaataactttttta

SEQ ID NO: 106912 - DNA, 27 bp, Artificial sequence
  SiRNA target sequence
aaccatataataaaataacttttttaa

SEQ ID NO: 106913 - DNA, 27 bp, Artificial sequence
  SiRNA target sequence
accatataataaaataacttttttaaa

SEQ ID NO: 106914 - DNA, 27 bp, Artificial sequence
  SiRNA target sequence
ccatataataaaataacttttttaaaa

SEQ ID NO: 106915 - DNA, 27 bp, Artificial sequence
  SiRNA target sequence
catataataaaataacttttttaaaaa

SEQ ID NO: 106916 - DNA, 27 bp, Artificial sequence
  SiRNA target sequence
atataataaaataacttttttaaaaaa

SEQ ID NO: 106917 - DNA, 27 bp, Artificial sequence
  SiRNA target sequence
tataataaaataacttttttaaaaaaa

SEQ ID NO: 106918 - DNA, 27 bp, Artificial sequence
  SiRNA target sequence
ataataaaataacttttttaaaaaaat

SEQ ID NO: 106919 - DNA, 27 bp, Artificial sequence
  SiRNA target sequence
taataaaataacttttttaaaaaaatt

SEQ ID NO: 106920 - DNA, 27 bp, Artificial sequence
  SiRNA target sequence
aataaaataacttttttaaaaaaattt

SEQ ID NO: 106921 - DNA, 27 bp, Artificial sequence
  SiRNA target sequence
ataaaataacttttttaaaaaaattta

SEQ ID NO: 106922 - DNA, 27 bp, Artificial sequence
  SiRNA target sequence
taaaataacttttttaaaaaaatttaa

SEQ ID NO: 106923 - DNA, 27 bp, Artificial sequence
  SiRNA target sequence
aaaataacttttttaaaaaaatttaaa

SEQ ID NO: 106924 - DNA, 27 bp, Artificial sequence
  SiRNA target sequence
aaataacttttttaaaaaaatttaaat

SEQ ID NO: 106925 - DNA, 27 bp, Artificial sequence
  SiRNA target sequence
aataacttttttaaaaaaatttaaatc

SEQ ID NO: 106926 - DNA, 27 bp, Artificial sequence
  SiRNA target sequence
ataacttttttaaaaaaatttaaatca

SEQ ID NO: 106927 - DNA, 27 bp, Artificial sequence
  SiRNA target sequence
taacttttttaaaaaaatttaaatcag

SEQ ID NO: 106928 - DNA, 27 bp, Artificial sequence
  SiRNA target sequence
aacttttttaaaaaaatttaaatcaga

SEQ ID NO: 106929 - DNA, 27 bp, Artificial sequence
  SiRNA target sequence
acttttttaaaaaaatttaaatcagaa

SEQ ID NO: 106930 - DNA, 27 bp, Artificial sequence
  SiRNA target sequence
cttttttaaaaaaatttaaatcagaat

SEQ ID NO: 106931 - DNA, 27 bp, Artificial sequence
  SiRNA target sequence
ttttttaaaaaaatttaaatcagaata

SEQ ID NO: 106932 - DNA, 27 bp, Artificial sequence
  SiRNA target sequence
tttttaaaaaaatttaaatcagaatag

SEQ ID NO: 106933 - DNA, 27 bp, Artificial sequence
  SiRNA target sequence
ttttaaaaaaatttaaatcagaatagt

SEQ ID NO: 106934 - DNA, 27 bp, Artificial sequence
  SiRNA target sequence
tttaaaaaaatttaaatcagaatagta

SEQ ID NO: 106935 - DNA, 27 bp, Artificial sequence
  SiRNA target sequence
ttaaaaaaatttaaatcagaatagtaa

SEQ ID NO: 106936 - DNA, 27 bp, Artificial sequence
  SiRNA target sequence
taaaaaaatttaaatcagaatagtaat

SEQ ID NO: 106937 - DNA, 27 bp, Artificial sequence
  SiRNA target sequence
aaaaaaatttaaatcagaatagtaatt

SEQ ID NO: 106938 - DNA, 27 bp, Artificial sequence
  SiRNA target sequence
aaaaaatttaaatcagaatagtaatta

SEQ ID NO: 106939 - DNA, 27 bp, Artificial sequence
  SiRNA target sequence
aaaaatttaaatcagaatagtaattaa

SEQ ID NO: 106940 - DNA, 27 bp, Artificial sequence
  SiRNA target sequence
aaaatttaaatcagaatagtaattaac

SEQ ID NO: 106941 - DNA, 27 bp, Artificial sequence
  SiRNA target sequence
aaatttaaatcagaatagtaattaaca

SEQ ID NO: 106942 - DNA, 27 bp, Artificial sequence
  SiRNA target sequence
aatttaaatcagaatagtaattaacaa

SEQ ID NO: 106943 - DNA, 27 bp, Artificial sequence
  SiRNA target sequence
atttaaatcagaatagtaattaacaaa

SEQ ID NO: 106944 - DNA, 27 bp, Artificial sequence
  SiRNA target sequence
tttaaatcagaatagtaattaacaaat

SEQ ID NO: 106945 - DNA, 27 bp, Artificial sequence
  SiRNA target sequence
ttaaatcagaatagtaattaacaaatg

SEQ ID NO: 106946 - DNA, 27 bp, Artificial sequence
  SiRNA target sequence
taaatcagaatagtaattaacaaatgc

SEQ ID NO: 106947 - DNA, 27 bp, Artificial sequence
  SiRNA target sequence
aaatcagaatagtaattaacaaatgcc

SEQ ID NO: 106948 - DNA, 27 bp, Artificial sequence
  SiRNA target sequence
aatcagaatagtaattaacaaatgccc

SEQ ID NO: 106949 - DNA, 27 bp, Artificial sequence
  SiRNA target sequence
atcagaatagtaattaacaaatgccct

SEQ ID NO: 106950 - DNA, 27 bp, Artificial sequence
  SiRNA target sequence
tcagaatagtaattaacaaatgccctg

SEQ ID NO: 106951 - DNA, 27 bp, Artificial sequence
  SiRNA target sequence
cagaatagtaattaacaaatgccctgg

SEQ ID NO: 106952 - DNA, 27 bp, Artificial sequence
  SiRNA target sequence
agaatagtaattaacaaatgccctggg

SEQ ID NO: 106953 - DNA, 27 bp, Artificial sequence
  SiRNA target sequence
gaatagtaattaacaaatgccctggga

SEQ ID NO: 106954 - DNA, 27 bp, Artificial sequence
  SiRNA target sequence
aatagtaattaacaaatgccctgggaa

SEQ ID NO: 106955 - DNA, 27 bp, Artificial sequence
  SiRNA target sequence
atagtaattaacaaatgccctgggaag

SEQ ID NO: 106956 - DNA, 27 bp, Artificial sequence
  SiRNA target sequence
tagtaattaacaaatgccctgggaagt

SEQ ID NO: 106957 - DNA, 27 bp, Artificial sequence
  SiRNA target sequence
agtaattaacaaatgccctgggaagtg

SEQ ID NO: 106958 - DNA, 27 bp, Artificial sequence
  SiRNA target sequence
gtaattaacaaatgccctgggaagtgt

SEQ ID NO: 106959 - DNA, 27 bp, Artificial sequence
  SiRNA target sequence
taattaacaaatgccctgggaagtgta

SEQ ID NO: 106960 - DNA, 27 bp, Artificial sequence
  SiRNA target sequence
aattaacaaatgccctgggaagtgtaa

SEQ ID NO: 106961 - DNA, 27 bp, Artificial sequence
  SiRNA target sequence
attaacaaatgccctgggaagtgtaat

SEQ ID NO: 106962 - DNA, 27 bp, Artificial sequence
  SiRNA target sequence
ttaacaaatgccctgggaagtgtaata

SEQ ID NO: 106963 - DNA, 27 bp, Artificial sequence
  SiRNA target sequence
taacaaatgccctgggaagtgtaatac

SEQ ID NO: 106964 - DNA, 27 bp, Artificial sequence
  SiRNA target sequence
aacaaatgccctgggaagtgtaatacc

SEQ ID NO: 106965 - DNA, 27 bp, Artificial sequence
  SiRNA target sequence
acaaatgccctgggaagtgtaatacca

SEQ ID NO: 106966 - DNA, 27 bp, Artificial sequence
  SiRNA target sequence
caaatgccctgggaagtgtaataccag

SEQ ID NO: 106967 - DNA, 27 bp, Artificial sequence
  SiRNA target sequence
aaatgccctgggaagtgtaataccagt

SEQ ID NO: 106968 - DNA, 27 bp, Artificial sequence
  SiRNA target sequence
aatgccctgggaagtgtaataccagta

SEQ ID NO: 106969 - DNA, 27 bp, Artificial sequence
  SiRNA target sequence
atgccctgggaagtgtaataccagtac

SEQ ID NO: 106970 - DNA, 27 bp, Artificial sequence
  SiRNA target sequence
tgccctgggaagtgtaataccagtacc

SEQ ID NO: 106971 - DNA, 27 bp, Artificial sequence
  SiRNA target sequence
gccctgggaagtgtaataccagtacca

SEQ ID NO: 106972 - DNA, 27 bp, Artificial sequence
  SiRNA target sequence
ccctgggaagtgtaataccagtaccag

SEQ ID NO: 106973 - DNA, 27 bp, Artificial sequence
  SiRNA target sequence
cctgggaagtgtaataccagtaccagt

SEQ ID NO: 106974 - DNA, 27 bp, Artificial sequence
  SiRNA target sequence
ctgggaagtgtaataccagtaccagtg

SEQ ID NO: 106975 - DNA, 27 bp, Artificial sequence
  SiRNA target sequence
tgggaagtgtaataccagtaccagtgc

SEQ ID NO: 106976 - DNA, 27 bp, Artificial sequence
  SiRNA target sequence
gggaagtgtaataccagtaccagtgca

SEQ ID NO: 106977 - DNA, 27 bp, Artificial sequence
  SiRNA target sequence
ggaagtgtaataccagtaccagtgcac

SEQ ID NO: 106978 - DNA, 27 bp, Artificial sequence
  SiRNA target sequence
gaagtgtaataccagtaccagtgcaca

SEQ ID NO: 106979 - DNA, 27 bp, Artificial sequence
  SiRNA target sequence
aagtgtaataccagtaccagtgcacat

SEQ ID NO: 106980 - DNA, 27 bp, Artificial sequence
  SiRNA target sequence
agtgtaataccagtaccagtgcacata

SEQ ID NO: 106981 - DNA, 27 bp, Artificial sequence
  SiRNA target sequence
gtgtaataccagtaccagtgcacataa

SEQ ID NO: 106982 - DNA, 27 bp, Artificial sequence
  SiRNA target sequence
tgtaataccagtaccagtgcacataaa

SEQ ID NO: 106983 - DNA, 27 bp, Artificial sequence
  SiRNA target sequence
gtaataccagtaccagtgcacataaac

SEQ ID NO: 106984 - DNA, 27 bp, Artificial sequence
  SiRNA target sequence
taataccagtaccagtgcacataaaca

SEQ ID NO: 106985 - DNA, 27 bp, Artificial sequence
  SiRNA target sequence
aataccagtaccagtgcacataaacaa

SEQ ID NO: 106986 - DNA, 27 bp, Artificial sequence
  SiRNA target sequence
ataccagtaccagtgcacataaacaaa

SEQ ID NO: 106987 - DNA, 27 bp, Artificial sequence
  SiRNA target sequence
taccagtaccagtgcacataaacaaaa

SEQ ID NO: 106988 - DNA, 27 bp, Artificial sequence
  SiRNA target sequence
accagtaccagtgcacataaacaaaat

SEQ ID NO: 106989 - DNA, 27 bp, Artificial sequence
  SiRNA target sequence
ccagtaccagtgcacataaacaaaatc

SEQ ID NO: 106990 - DNA, 27 bp, Artificial sequence
  SiRNA target sequence
cagtaccagtgcacataaacaaaatct

SEQ ID NO: 106991 - DNA, 27 bp, Artificial sequence
  SiRNA target sequence
agtaccagtgcacataaacaaaatctt

SEQ ID NO: 106992 - DNA, 27 bp, Artificial sequence
  SiRNA target sequence
gtaccagtgcacataaacaaaatcttt

SEQ ID NO: 106993 - DNA, 27 bp, Artificial sequence
  SiRNA target sequence
taccagtgcacataaacaaaatctttt

SEQ ID NO: 106994 - DNA, 27 bp, Artificial sequence
  SiRNA target sequence
accagtgcacataaacaaaatcttttt

SEQ ID NO: 106995 - DNA, 27 bp, Artificial sequence
  SiRNA target sequence
ccagtgcacataaacaaaatcttttta

SEQ ID NO: 106996 - DNA, 27 bp, Artificial sequence
  SiRNA target sequence
cagtgcacataaacaaaatctttttac

SEQ ID NO: 106997 - DNA, 27 bp, Artificial sequence
  SiRNA target sequence
agtgcacataaacaaaatctttttacc

SEQ ID NO: 106998 - DNA, 27 bp, Artificial sequence
  SiRNA target sequence
gtgcacataaacaaaatctttttacca

SEQ ID NO: 106999 - DNA, 27 bp, Artificial sequence
  SiRNA target sequence
tgcacataaacaaaatctttttaccac

SEQ ID NO: 107000 - DNA, 27 bp, Artificial sequence
  SiRNA target sequence
gcacataaacaaaatctttttaccact

SEQ ID NO: 107001 - DNA, 27 bp, Artificial sequence
  SiRNA target sequence
cacataaacaaaatctttttaccacta

SEQ ID NO: 107002 - DNA, 27 bp, Artificial sequence
  SiRNA target sequence
acataaacaaaatctttttaccactaa

SEQ ID NO: 107003 - DNA, 27 bp, Artificial sequence
  SiRNA target sequence
cataaacaaaatctttttaccactaaa

SEQ ID NO: 107004 - DNA, 27 bp, Artificial sequence
  SiRNA target sequence
ataaacaaaatctttttaccactaaaa

SEQ ID NO: 107005 - DNA, 27 bp, Artificial sequence
  SiRNA target sequence
taaacaaaatctttttaccactaaaat

SEQ ID NO: 107006 - DNA, 27 bp, Artificial sequence
  SiRNA target sequence
aaacaaaatctttttaccactaaaatt

SEQ ID NO: 107007 - DNA, 27 bp, Artificial sequence
  SiRNA target sequence
aacaaaatctttttaccactaaaatta

SEQ ID NO: 107008 - DNA, 27 bp, Artificial sequence
  SiRNA target sequence
acaaaatctttttaccactaaaattaa

SEQ ID NO: 107009 - DNA, 27 bp, Artificial sequence
  SiRNA target sequence
caaaatctttttaccactaaaattaag

SEQ ID NO: 107010 - DNA, 27 bp, Artificial sequence
  SiRNA target sequence
aaaatctttttaccactaaaattaagt

SEQ ID NO: 107011 - DNA, 27 bp, Artificial sequence
  SiRNA target sequence
aaatctttttaccactaaaattaagtc

SEQ ID NO: 107012 - DNA, 27 bp, Artificial sequence
  SiRNA target sequence
aatctttttaccactaaaattaagtct

SEQ ID NO: 107013 - DNA, 27 bp, Artificial sequence
  SiRNA target sequence
atctttttaccactaaaattaagtcta

SEQ ID NO: 107014 - DNA, 27 bp, Artificial sequence
  SiRNA target sequence
tctttttaccactaaaattaagtctat

SEQ ID NO: 107015 - DNA, 27 bp, Artificial sequence
  SiRNA target sequence
ctttttaccactaaaattaagtctatt

SEQ ID NO: 107016 - DNA, 27 bp, Artificial sequence
  SiRNA target sequence
tttttaccactaaaattaagtctattt

SEQ ID NO: 107017 - DNA, 27 bp, Artificial sequence
  SiRNA target sequence
ttttaccactaaaattaagtctatttt

SEQ ID NO: 107018 - DNA, 27 bp, Artificial sequence
  SiRNA target sequence
tttaccactaaaattaagtctattttg

SEQ ID NO: 107019 - DNA, 27 bp, Artificial sequence
  SiRNA target sequence
ttaccactaaaattaagtctattttgt

SEQ ID NO: 107020 - DNA, 27 bp, Artificial sequence
  SiRNA target sequence
taccactaaaattaagtctattttgta

SEQ ID NO: 107021 - DNA, 27 bp, Artificial sequence
  SiRNA target sequence
accactaaaattaagtctattttgtac

SEQ ID NO: 107022 - DNA, 27 bp, Artificial sequence
  SiRNA target sequence
ccactaaaattaagtctattttgtact

SEQ ID NO: 107023 - DNA, 27 bp, Artificial sequence
  SiRNA target sequence
cactaaaattaagtctattttgtacta

SEQ ID NO: 107024 - DNA, 27 bp, Artificial sequence
  SiRNA target sequence
actaaaattaagtctattttgtactat

SEQ ID NO: 107025 - DNA, 27 bp, Artificial sequence
  SiRNA target sequence
ctaaaattaagtctattttgtactatg

SEQ ID NO: 107026 - DNA, 27 bp, Artificial sequence
  SiRNA target sequence
taaaattaagtctattttgtactatgt

SEQ ID NO: 107027 - DNA, 27 bp, Artificial sequence
  SiRNA target sequence
aaaattaagtctattttgtactatgtt

SEQ ID NO: 107028 - DNA, 27 bp, Artificial sequence
  SiRNA target sequence
aaattaagtctattttgtactatgtta

SEQ ID NO: 107029 - DNA, 27 bp, Artificial sequence
  SiRNA target sequence
aattaagtctattttgtactatgttaa

SEQ ID NO: 107030 - DNA, 27 bp, Artificial sequence
  SiRNA target sequence
attaagtctattttgtactatgttaac

SEQ ID NO: 107031 - DNA, 27 bp, Artificial sequence
  SiRNA target sequence
ttaagtctattttgtactatgttaaca

SEQ ID NO: 107032 - DNA, 27 bp, Artificial sequence
  SiRNA target sequence
taagtctattttgtactatgttaacat

SEQ ID NO: 107033 - DNA, 27 bp, Artificial sequence
  SiRNA target sequence
aagtctattttgtactatgttaacatg

SEQ ID NO: 107034 - DNA, 27 bp, Artificial sequence
  SiRNA target sequence
agtctattttgtactatgttaacatga

SEQ ID NO: 107035 - DNA, 27 bp, Artificial sequence
  SiRNA target sequence
gtctattttgtactatgttaacatgaa

SEQ ID NO: 107036 - DNA, 27 bp, Artificial sequence
  SiRNA target sequence
tctattttgtactatgttaacatgaat

SEQ ID NO: 107037 - DNA, 27 bp, Artificial sequence
  SiRNA target sequence
ctattttgtactatgttaacatgaata

SEQ ID NO: 107038 - DNA, 27 bp, Artificial sequence
  SiRNA target sequence
tattttgtactatgttaacatgaatag

SEQ ID NO: 107039 - DNA, 27 bp, Artificial sequence
  SiRNA target sequence
attttgtactatgttaacatgaatagt

SEQ ID NO: 107040 - DNA, 27 bp, Artificial sequence
  SiRNA target sequence
ttttgtactatgttaacatgaatagta

SEQ ID NO: 107041 - DNA, 27 bp, Artificial sequence
  SiRNA target sequence
tttgtactatgttaacatgaatagtag

SEQ ID NO: 107042 - DNA, 27 bp, Artificial sequence
  SiRNA target sequence
ttgtactatgttaacatgaatagtaga

SEQ ID NO: 107043 - DNA, 27 bp, Artificial sequence
  SiRNA target sequence
tgtactatgttaacatgaatagtagac

SEQ ID NO: 107044 - DNA, 27 bp, Artificial sequence
  SiRNA target sequence
gtactatgttaacatgaatagtagacc

SEQ ID NO: 107045 - DNA, 27 bp, Artificial sequence
  SiRNA target sequence
tactatgttaacatgaatagtagaccc

SEQ ID NO: 107046 - DNA, 27 bp, Artificial sequence
  SiRNA target sequence
actatgttaacatgaatagtagaccct

SEQ ID NO: 107047 - DNA, 27 bp, Artificial sequence
  SiRNA target sequence
ctatgttaacatgaatagtagaccctt

SEQ ID NO: 107048 - DNA, 27 bp, Artificial sequence
  SiRNA target sequence
tatgttaacatgaatagtagacccttt

SEQ ID NO: 107049 - DNA, 27 bp, Artificial sequence
  SiRNA target sequence
atgttaacatgaatagtagacccttta

SEQ ID NO: 107050 - DNA, 27 bp, Artificial sequence
  SiRNA target sequence
tgttaacatgaatagtagaccctttag

SEQ ID NO: 107051 - DNA, 27 bp, Artificial sequence
  SiRNA target sequence
gttaacatgaatagtagaccctttagt

SEQ ID NO: 107052 - DNA, 27 bp, Artificial sequence
  SiRNA target sequence
ttaacatgaatagtagaccctttagta

SEQ ID NO: 107053 - DNA, 27 bp, Artificial sequence
  SiRNA target sequence
taacatgaatagtagaccctttagtaa

SEQ ID NO: 107054 - DNA, 27 bp, Artificial sequence
  SiRNA target sequence
aacatgaatagtagaccctttagtaag

SEQ ID NO: 107055 - DNA, 27 bp, Artificial sequence
  SiRNA target sequence
acatgaatagtagaccctttagtaagt

SEQ ID NO: 107056 - DNA, 27 bp, Artificial sequence
  SiRNA target sequence
catgaatagtagaccctttagtaagta

SEQ ID NO: 107057 - DNA, 27 bp, Artificial sequence
  SiRNA target sequence
atgaatagtagaccctttagtaagtaa

SEQ ID NO: 107058 - DNA, 27 bp, Artificial sequence
  SiRNA target sequence
tgaatagtagaccctttagtaagtaat

SEQ ID NO: 107059 - DNA, 27 bp, Artificial sequence
  SiRNA target sequence
gaatagtagaccctttagtaagtaatt

SEQ ID NO: 107060 - DNA, 27 bp, Artificial sequence
  SiRNA target sequence
aatagtagaccctttagtaagtaattt

SEQ ID NO: 107061 - DNA, 27 bp, Artificial sequence
  SiRNA target sequence
atagtagaccctttagtaagtaatttt

SEQ ID NO: 107062 - DNA, 27 bp, Artificial sequence
  SiRNA target sequence
tagtagaccctttagtaagtaatttta

SEQ ID NO: 107063 - DNA, 27 bp, Artificial sequence
  SiRNA target sequence
agtagaccctttagtaagtaattttaa

SEQ ID NO: 107064 - DNA, 27 bp, Artificial sequence
  SiRNA target sequence
gtagaccctttagtaagtaattttaaa

SEQ ID NO: 107065 - DNA, 27 bp, Artificial sequence
  SiRNA target sequence
tagaccctttagtaagtaattttaaat

SEQ ID NO: 107066 - DNA, 27 bp, Artificial sequence
  SiRNA target sequence
agaccctttagtaagtaattttaaata

SEQ ID NO: 107067 - DNA, 27 bp, Artificial sequence
  SiRNA target sequence
gaccctttagtaagtaattttaaatac

SEQ ID NO: 107068 - DNA, 27 bp, Artificial sequence
  SiRNA target sequence
accctttagtaagtaattttaaatact

SEQ ID NO: 107069 - DNA, 27 bp, Artificial sequence
  SiRNA target sequence
ccctttagtaagtaattttaaatactc

SEQ ID NO: 107070 - DNA, 27 bp, Artificial sequence
  SiRNA target sequence
cctttagtaagtaattttaaatactct

SEQ ID NO: 107071 - DNA, 27 bp, Artificial sequence
  SiRNA target sequence
ctttagtaagtaattttaaatactctg

SEQ ID NO: 107072 - DNA, 27 bp, Artificial sequence
  SiRNA target sequence
tttagtaagtaattttaaatactctga

SEQ ID NO: 107073 - DNA, 27 bp, Artificial sequence
  SiRNA target sequence
ttagtaagtaattttaaatactctgaa

SEQ ID NO: 107074 - DNA, 27 bp, Artificial sequence
  SiRNA target sequence
tagtaagtaattttaaatactctgaac

SEQ ID NO: 107075 - DNA, 27 bp, Artificial sequence
  SiRNA target sequence
agtaagtaattttaaatactctgaaca

SEQ ID NO: 107076 - DNA, 27 bp, Artificial sequence
  SiRNA target sequence
gtaagtaattttaaatactctgaacaa

SEQ ID NO: 107077 - DNA, 27 bp, Artificial sequence
  SiRNA target sequence
taagtaattttaaatactctgaacaaa

SEQ ID NO: 107078 - DNA, 27 bp, Artificial sequence
  SiRNA target sequence
aagtaattttaaatactctgaacaaag

SEQ ID NO: 107079 - DNA, 27 bp, Artificial sequence
  SiRNA target sequence
agtaattttaaatactctgaacaaaga

SEQ ID NO: 107080 - DNA, 27 bp, Artificial sequence
  SiRNA target sequence
gtaattttaaatactctgaacaaagac

SEQ ID NO: 107081 - DNA, 27 bp, Artificial sequence
  SiRNA target sequence
taattttaaatactctgaacaaagacc

SEQ ID NO: 107082 - DNA, 27 bp, Artificial sequence
  SiRNA target sequence
aattttaaatactctgaacaaagacct

SEQ ID NO: 107083 - DNA, 27 bp, Artificial sequence
  SiRNA target sequence
attttaaatactctgaacaaagacctt

SEQ ID NO: 107084 - DNA, 27 bp, Artificial sequence
  SiRNA target sequence
ttttaaatactctgaacaaagaccttt

SEQ ID NO: 107085 - DNA, 27 bp, Artificial sequence
  SiRNA target sequence
tttaaatactctgaacaaagacctttt

SEQ ID NO: 107086 - DNA, 27 bp, Artificial sequence
  SiRNA target sequence
ttaaatactctgaacaaagaccttttc

SEQ ID NO: 107087 - DNA, 27 bp, Artificial sequence
  SiRNA target sequence
taaatactctgaacaaagaccttttcg

SEQ ID NO: 107088 - DNA, 27 bp, Artificial sequence
  SiRNA target sequence
aaatactctgaacaaagaccttttcgt

SEQ ID NO: 107089 - DNA, 27 bp, Artificial sequence
  SiRNA target sequence
aatactctgaacaaagaccttttcgtt

SEQ ID NO: 107090 - DNA, 27 bp, Artificial sequence
  SiRNA target sequence
atactctgaacaaagaccttttcgttc

SEQ ID NO: 107091 - DNA, 27 bp, Artificial sequence
  SiRNA target sequence
tactctgaacaaagaccttttcgttct

SEQ ID NO: 107092 - DNA, 27 bp, Artificial sequence
  SiRNA target sequence
actctgaacaaagaccttttcgttctt

SEQ ID NO: 107093 - DNA, 27 bp, Artificial sequence
  SiRNA target sequence
ctctgaacaaagaccttttcgttcttc

SEQ ID NO: 107094 - DNA, 27 bp, Artificial sequence
  SiRNA target sequence
tctgaacaaagaccttttcgttcttct

SEQ ID NO: 107095 - DNA, 27 bp, Artificial sequence
  SiRNA target sequence
ctgaacaaagaccttttcgttcttctt

SEQ ID NO: 107096 - DNA, 27 bp, Artificial sequence
  SiRNA target sequence
tgaacaaagaccttttcgttcttcttt

SEQ ID NO: 107097 - DNA, 27 bp, Artificial sequence
  SiRNA target sequence
gaacaaagaccttttcgttcttctttt

SEQ ID NO: 107098 - DNA, 27 bp, Artificial sequence
  SiRNA target sequence
aacaaagaccttttcgttcttctttta

SEQ ID NO: 107099 - DNA, 27 bp, Artificial sequence
  SiRNA target sequence
acaaagaccttttcgttcttcttttaa

SEQ ID NO: 107100 - DNA, 27 bp, Artificial sequence
  SiRNA target sequence
caaagaccttttcgttcttcttttaaa

SEQ ID NO: 107101 - DNA, 27 bp, Artificial sequence
  SiRNA target sequence
aaagaccttttcgttcttcttttaaac

SEQ ID NO: 107102 - DNA, 27 bp, Artificial sequence
  SiRNA target sequence
aagaccttttcgttcttcttttaaact

SEQ ID NO: 107103 - DNA, 27 bp, Artificial sequence
  SiRNA target sequence
agaccttttcgttcttcttttaaactt

SEQ ID NO: 107104 - DNA, 27 bp, Artificial sequence
  SiRNA target sequence
gaccttttcgttcttcttttaaacttg

SEQ ID NO: 107105 - DNA, 27 bp, Artificial sequence
  SiRNA target sequence
accttttcgttcttcttttaaacttgt

SEQ ID NO: 107106 - DNA, 27 bp, Artificial sequence
  SiRNA target sequence
ccttttcgttcttcttttaaacttgtt

SEQ ID NO: 107107 - DNA, 27 bp, Artificial sequence
  SiRNA target sequence
cttttcgttcttcttttaaacttgttt

SEQ ID NO: 107108 - DNA, 27 bp, Artificial sequence
  SiRNA target sequence
ttttcgttcttcttttaaacttgtttt

SEQ ID NO: 107109 - DNA, 27 bp, Artificial sequence
  SiRNA target sequence
tttcgttcttcttttaaacttgtttta

SEQ ID NO: 107110 - DNA, 27 bp, Artificial sequence
  SiRNA target sequence
ttcgttcttcttttaaacttgttttaa

SEQ ID NO: 107111 - DNA, 27 bp, Artificial sequence
  SiRNA target sequence
tcgttcttcttttaaacttgttttaaa

SEQ ID NO: 107112 - DNA, 27 bp, Artificial sequence
  SiRNA target sequence
cgttcttcttttaaacttgttttaaaa

SEQ ID NO: 107113 - DNA, 27 bp, Artificial sequence
  SiRNA target sequence
gttcttcttttaaacttgttttaaaag

SEQ ID NO: 107114 - DNA, 27 bp, Artificial sequence
  SiRNA target sequence
ttcttcttttaaacttgttttaaaaga

SEQ ID NO: 107115 - DNA, 27 bp, Artificial sequence
  SiRNA target sequence
tcttcttttaaacttgttttaaaagaa

SEQ ID NO: 107116 - DNA, 27 bp, Artificial sequence
  SiRNA target sequence
cttcttttaaacttgttttaaaagaaa

SEQ ID NO: 107117 - DNA, 27 bp, Artificial sequence
  SiRNA target sequence
ttcttttaaacttgttttaaaagaaac

SEQ ID NO: 107118 - DNA, 27 bp, Artificial sequence
  SiRNA target sequence
tcttttaaacttgttttaaaagaaaca

SEQ ID NO: 107119 - DNA, 27 bp, Artificial sequence
  SiRNA target sequence
cttttaaacttgttttaaaagaaacaa

SEQ ID NO: 107120 - DNA, 27 bp, Artificial sequence
  SiRNA target sequence
ttttaaacttgttttaaaagaaacaag

SEQ ID NO: 107121 - DNA, 27 bp, Artificial sequence
  SiRNA target sequence
tttaaacttgttttaaaagaaacaaga

SEQ ID NO: 107122 - DNA, 27 bp, Artificial sequence
  SiRNA target sequence
ttaaacttgttttaaaagaaacaagag

SEQ ID NO: 107123 - DNA, 27 bp, Artificial sequence
  SiRNA target sequence
taaacttgttttaaaagaaacaagaga

SEQ ID NO: 107124 - DNA, 27 bp, Artificial sequence
  SiRNA target sequence
aaacttgttttaaaagaaacaagagag

SEQ ID NO: 107125 - DNA, 27 bp, Artificial sequence
  SiRNA target sequence
aacttgttttaaaagaaacaagagaga

SEQ ID NO: 107126 - DNA, 27 bp, Artificial sequence
  SiRNA target sequence
acttgttttaaaagaaacaagagagac

SEQ ID NO: 107127 - DNA, 27 bp, Artificial sequence
  SiRNA target sequence
cttgttttaaaagaaacaagagagacg

SEQ ID NO: 107128 - DNA, 27 bp, Artificial sequence
  SiRNA target sequence
ttgttttaaaagaaacaagagagacgg

SEQ ID NO: 107129 - DNA, 27 bp, Artificial sequence
  SiRNA target sequence
tgttttaaaagaaacaagagagacggt

SEQ ID NO: 107130 - DNA, 27 bp, Artificial sequence
  SiRNA target sequence
gttttaaaagaaacaagagagacggtg

SEQ ID NO: 107131 - DNA, 27 bp, Artificial sequence
  SiRNA target sequence
ttttaaaagaaacaagagagacggtga

SEQ ID NO: 107132 - DNA, 27 bp, Artificial sequence
  SiRNA target sequence
tttaaaagaaacaagagagacggtgac

SEQ ID NO: 107133 - DNA, 27 bp, Artificial sequence
  SiRNA target sequence
ttaaaagaaacaagagagacggtgaca

SEQ ID NO: 107134 - DNA, 27 bp, Artificial sequence
  SiRNA target sequence
taaaagaaacaagagagacggtgacaa

SEQ ID NO: 107135 - DNA, 27 bp, Artificial sequence
  SiRNA target sequence
aaaagaaacaagagagacggtgacaaa

SEQ ID NO: 107136 - DNA, 27 bp, Artificial sequence
  SiRNA target sequence
aaagaaacaagagagacggtgacaaag

SEQ ID NO: 107137 - DNA, 27 bp, Artificial sequence
  SiRNA target sequence
aagaaacaagagagacggtgacaaagt

SEQ ID NO: 107138 - DNA, 27 bp, Artificial sequence
  SiRNA target sequence
agaaacaagagagacggtgacaaagta

SEQ ID NO: 107139 - DNA, 27 bp, Artificial sequence
  SiRNA target sequence
gaaacaagagagacggtgacaaagtaa

SEQ ID NO: 107140 - DNA, 27 bp, Artificial sequence
  SiRNA target sequence
aaacaagagagacggtgacaaagtaac

SEQ ID NO: 107141 - DNA, 27 bp, Artificial sequence
  SiRNA target sequence
aacaagagagacggtgacaaagtaaca

SEQ ID NO: 107142 - DNA, 27 bp, Artificial sequence
  SiRNA target sequence
acaagagagacggtgacaaagtaacaa

SEQ ID NO: 107143 - DNA, 27 bp, Artificial sequence
  SiRNA target sequence
caagagagacggtgacaaagtaacaaa

SEQ ID NO: 107144 - DNA, 27 bp, Artificial sequence
  SiRNA target sequence
aagagagacggtgacaaagtaacaaaa

SEQ ID NO: 107145 - DNA, 27 bp, Artificial sequence
  SiRNA target sequence
agagagacggtgacaaagtaacaaaaa

SEQ ID NO: 107146 - DNA, 27 bp, Artificial sequence
  SiRNA target sequence
gagagacggtgacaaagtaacaaaaat

SEQ ID NO: 107147 - DNA, 27 bp, Artificial sequence
  SiRNA target sequence
agagacggtgacaaagtaacaaaaatc

SEQ ID NO: 107148 - DNA, 27 bp, Artificial sequence
  SiRNA target sequence
gagacggtgacaaagtaacaaaaatct

SEQ ID NO: 107149 - DNA, 27 bp, Artificial sequence
  SiRNA target sequence
agacggtgacaaagtaacaaaaatctt

SEQ ID NO: 107150 - DNA, 27 bp, Artificial sequence
  SiRNA target sequence
gacggtgacaaagtaacaaaaatcttt

SEQ ID NO: 107151 - DNA, 27 bp, Artificial sequence
  SiRNA target sequence
acggtgacaaagtaacaaaaatctttt

SEQ ID NO: 107152 - DNA, 27 bp, Artificial sequence
  SiRNA target sequence
cggtgacaaagtaacaaaaatcttttt

SEQ ID NO: 107153 - DNA, 27 bp, Artificial sequence
  SiRNA target sequence
ggtgacaaagtaacaaaaatctttttt

SEQ ID NO: 107154 - DNA, 27 bp, Artificial sequence
  SiRNA target sequence
gtgacaaagtaacaaaaatcttttttc

SEQ ID NO: 107155 - DNA, 27 bp, Artificial sequence
  SiRNA target sequence
tgacaaagtaacaaaaatcttttttcg

SEQ ID NO: 107156 - DNA, 27 bp, Artificial sequence
  SiRNA target sequence
gacaaagtaacaaaaatcttttttcgt

SEQ ID NO: 107157 - DNA, 27 bp, Artificial sequence
  SiRNA target sequence
acaaagtaacaaaaatcttttttcgtt

SEQ ID NO: 107158 - DNA, 27 bp, Artificial sequence
  SiRNA target sequence
caaagtaacaaaaatcttttttcgtta

SEQ ID NO: 107159 - DNA, 27 bp, Artificial sequence
  SiRNA target sequence
aaagtaacaaaaatcttttttcgttaa

SEQ ID NO: 107160 - DNA, 27 bp, Artificial sequence
  SiRNA target sequence
aagtaacaaaaatcttttttcgttaat

SEQ ID NO: 107161 - DNA, 27 bp, Artificial sequence
  SiRNA target sequence
agtaacaaaaatcttttttcgttaatg

SEQ ID NO: 107162 - DNA, 27 bp, Artificial sequence
  SiRNA target sequence
gtaacaaaaatcttttttcgttaatgt

SEQ ID NO: 107163 - DNA, 27 bp, Artificial sequence
  SiRNA target sequence
taacaaaaatcttttttcgttaatgta

SEQ ID NO: 107164 - DNA, 27 bp, Artificial sequence
  SiRNA target sequence
aacaaaaatcttttttcgttaatgtaa

SEQ ID NO: 107165 - DNA, 27 bp, Artificial sequence
  SiRNA target sequence
acaaaaatcttttttcgttaatgtaaa

SEQ ID NO: 107166 - DNA, 27 bp, Artificial sequence
  SiRNA target sequence
caaaaatcttttttcgttaatgtaaaa

SEQ ID NO: 107167 - DNA, 27 bp, Artificial sequence
  SiRNA target sequence
aaaaatcttttttcgttaatgtaaaat

SEQ ID NO: 107168 - DNA, 27 bp, Artificial sequence
  SiRNA target sequence
aaaatcttttttcgttaatgtaaaata

SEQ ID NO: 107169 - DNA, 27 bp, Artificial sequence
  SiRNA target sequence
aaatcttttttcgttaatgtaaaatat

SEQ ID NO: 107170 - DNA, 27 bp, Artificial sequence
  SiRNA target sequence
aatcttttttcgttaatgtaaaatatc

SEQ ID NO: 107171 - DNA, 27 bp, Artificial sequence
  SiRNA target sequence
atcttttttcgttaatgtaaaatatct

SEQ ID NO: 107172 - DNA, 27 bp, Artificial sequence
  SiRNA target sequence
tcttttttcgttaatgtaaaatatctt

SEQ ID NO: 107173 - DNA, 27 bp, Artificial sequence
  SiRNA target sequence
cttttttcgttaatgtaaaatatcttg

SEQ ID NO: 107174 - DNA, 27 bp, Artificial sequence
  SiRNA target sequence
ttttttcgttaatgtaaaatatcttgg

SEQ ID NO: 107175 - DNA, 27 bp, Artificial sequence
  SiRNA target sequence
tttttcgttaatgtaaaatatcttgga

SEQ ID NO: 107176 - DNA, 27 bp, Artificial sequence
  SiRNA target sequence
ttttcgttaatgtaaaatatcttggat

SEQ ID NO: 107177 - DNA, 27 bp, Artificial sequence
  SiRNA target sequence
tttcgttaatgtaaaatatcttggatt

SEQ ID NO: 107178 - DNA, 27 bp, Artificial sequence
  SiRNA target sequence
ttcgttaatgtaaaatatcttggatta

SEQ ID NO: 107179 - DNA, 27 bp, Artificial sequence
  SiRNA target sequence
tcgttaatgtaaaatatcttggattaa

SEQ ID NO: 107180 - DNA, 27 bp, Artificial sequence
  SiRNA target sequence
cgttaatgtaaaatatcttggattaat

SEQ ID NO: 107181 - DNA, 27 bp, Artificial sequence
  SiRNA target sequence
gttaatgtaaaatatcttggattaatt

SEQ ID NO: 107182 - DNA, 27 bp, Artificial sequence
  SiRNA target sequence
ttaatgtaaaatatcttggattaatta

SEQ ID NO: 107183 - DNA, 27 bp, Artificial sequence
  SiRNA target sequence
taatgtaaaatatcttggattaattac

SEQ ID NO: 107184 - DNA, 27 bp, Artificial sequence
  SiRNA target sequence
aatgtaaaatatcttggattaattaca

SEQ ID NO: 107185 - DNA, 27 bp, Artificial sequence
  SiRNA target sequence
atgtaaaatatcttggattaattacag

SEQ ID NO: 107186 - DNA, 27 bp, Artificial sequence
  SiRNA target sequence
tgtaaaatatcttggattaattacagg

SEQ ID NO: 107187 - DNA, 27 bp, Artificial sequence
  SiRNA target sequence
gtaaaatatcttggattaattacaggg

SEQ ID NO: 107188 - DNA, 27 bp, Artificial sequence
  SiRNA target sequence
taaaatatcttggattaattacaggga

SEQ ID NO: 107189 - DNA, 27 bp, Artificial sequence
  SiRNA target sequence
aaaatatcttggattaattacagggat

SEQ ID NO: 107190 - DNA, 27 bp, Artificial sequence
  SiRNA target sequence
aaatatcttggattaattacagggata

SEQ ID NO: 107191 - DNA, 27 bp, Artificial sequence
  SiRNA target sequence
aatatcttggattaattacagggatat

SEQ ID NO: 107192 - DNA, 27 bp, Artificial sequence
  SiRNA target sequence
atatcttggattaattacagggatata

SEQ ID NO: 107193 - DNA, 27 bp, Artificial sequence
  SiRNA target sequence
tatcttggattaattacagggatatac

SEQ ID NO: 107194 - DNA, 27 bp, Artificial sequence
  SiRNA target sequence
atcttggattaattacagggatatact

SEQ ID NO: 107195 - DNA, 27 bp, Artificial sequence
  SiRNA target sequence
tcttggattaattacagggatatactt

SEQ ID NO: 107196 - DNA, 27 bp, Artificial sequence
  SiRNA target sequence
cttggattaattacagggatatacttg

SEQ ID NO: 107197 - DNA, 27 bp, Artificial sequence
  SiRNA target sequence
ttggattaattacagggatatacttgt

SEQ ID NO: 107198 - DNA, 27 bp, Artificial sequence
  SiRNA target sequence
tggattaattacagggatatacttgta

SEQ ID NO: 107199 - DNA, 27 bp, Artificial sequence
  SiRNA target sequence
ggattaattacagggatatacttgtac

SEQ ID NO: 107200 - DNA, 27 bp, Artificial sequence
  SiRNA target sequence
gattaattacagggatatacttgtaca

SEQ ID NO: 107201 - DNA, 27 bp, Artificial sequence
  SiRNA target sequence
attaattacagggatatacttgtacat

SEQ ID NO: 107202 - DNA, 27 bp, Artificial sequence
  SiRNA target sequence
ttaattacagggatatacttgtacata

SEQ ID NO: 107203 - DNA, 27 bp, Artificial sequence
  SiRNA target sequence
taattacagggatatacttgtacataa

SEQ ID NO: 107204 - DNA, 27 bp, Artificial sequence
  SiRNA target sequence
aattacagggatatacttgtacataaa

SEQ ID NO: 107205 - DNA, 27 bp, Artificial sequence
  SiRNA target sequence
attacagggatatacttgtacataaaa

SEQ ID NO: 107206 - DNA, 27 bp, Artificial sequence
  SiRNA target sequence
ttacagggatatacttgtacataaaat

SEQ ID NO: 107207 - DNA, 27 bp, Artificial sequence
  SiRNA target sequence
tacagggatatacttgtacataaaatt

SEQ ID NO: 107208 - DNA, 27 bp, Artificial sequence
  SiRNA target sequence
acagggatatacttgtacataaaattt

SEQ ID NO: 107209 - DNA, 27 bp, Artificial sequence
  SiRNA target sequence
cagggatatacttgtacataaaatttg

SEQ ID NO: 107210 - DNA, 27 bp, Artificial sequence
  SiRNA target sequence
agggatatacttgtacataaaatttga

SEQ ID NO: 107211 - DNA, 27 bp, Artificial sequence
  SiRNA target sequence
gggatatacttgtacataaaatttgag

SEQ ID NO: 107212 - DNA, 27 bp, Artificial sequence
  SiRNA target sequence
ggatatacttgtacataaaatttgagg

SEQ ID NO: 107213 - DNA, 27 bp, Artificial sequence
  SiRNA target sequence
gatatacttgtacataaaatttgaggt

SEQ ID NO: 107214 - DNA, 27 bp, Artificial sequence
  SiRNA target sequence
atatacttgtacataaaatttgaggta

SEQ ID NO: 107215 - DNA, 27 bp, Artificial sequence
  SiRNA target sequence
tatacttgtacataaaatttgaggtaa

SEQ ID NO: 107216 - DNA, 27 bp, Artificial sequence
  SiRNA target sequence
atacttgtacataaaatttgaggtaag

SEQ ID NO: 107217 - DNA, 27 bp, Artificial sequence
  SiRNA target sequence
tacttgtacataaaatttgaggtaagt

SEQ ID NO: 107218 - DNA, 27 bp, Artificial sequence
  SiRNA target sequence
acttgtacataaaatttgaggtaagtt

SEQ ID NO: 107219 - DNA, 27 bp, Artificial sequence
  SiRNA target sequence
cttgtacataaaatttgaggtaagttt

SEQ ID NO: 107220 - DNA, 27 bp, Artificial sequence
  SiRNA target sequence
ttgtacataaaatttgaggtaagtttt

SEQ ID NO: 107221 - DNA, 27 bp, Artificial sequence
  SiRNA target sequence
tgtacataaaatttgaggtaagtttta

SEQ ID NO: 107222 - DNA, 27 bp, Artificial sequence
  SiRNA target sequence
gtacataaaatttgaggtaagttttat

SEQ ID NO: 107223 - DNA, 27 bp, Artificial sequence
  SiRNA target sequence
tacataaaatttgaggtaagttttatc

SEQ ID NO: 107224 - DNA, 27 bp, Artificial sequence
  SiRNA target sequence
acataaaatttgaggtaagttttatct

SEQ ID NO: 107225 - DNA, 27 bp, Artificial sequence
  SiRNA target sequence
cataaaatttgaggtaagttttatctt

SEQ ID NO: 107226 - DNA, 27 bp, Artificial sequence
  SiRNA target sequence
ataaaatttgaggtaagttttatctta

SEQ ID NO: 107227 - DNA, 27 bp, Artificial sequence
  SiRNA target sequence
taaaatttgaggtaagttttatcttaa

SEQ ID NO: 107228 - DNA, 27 bp, Artificial sequence
  SiRNA target sequence
aaaatttgaggtaagttttatcttaaa

SEQ ID NO: 107229 - DNA, 27 bp, Artificial sequence
  SiRNA target sequence
aaatttgaggtaagttttatcttaaaa

SEQ ID NO: 107230 - DNA, 27 bp, Artificial sequence
  SiRNA target sequence
aatttgaggtaagttttatcttaaaat

SEQ ID NO: 107231 - DNA, 27 bp, Artificial sequence
  SiRNA target sequence
atttgaggtaagttttatcttaaaatc

SEQ ID NO: 107232 - DNA, 27 bp, Artificial sequence
  SiRNA target sequence
tttgaggtaagttttatcttaaaatct

SEQ ID NO: 107233 - DNA, 27 bp, Artificial sequence
  SiRNA target sequence
ttgaggtaagttttatcttaaaatctt

SEQ ID NO: 107234 - DNA, 27 bp, Artificial sequence
  SiRNA target sequence
tgaggtaagttttatcttaaaatcttt

SEQ ID NO: 107235 - DNA, 27 bp, Artificial sequence
  SiRNA target sequence
gaggtaagttttatcttaaaatctttt

SEQ ID NO: 107236 - DNA, 27 bp, Artificial sequence
  SiRNA target sequence
aggtaagttttatcttaaaatctttta

SEQ ID NO: 107237 - DNA, 27 bp, Artificial sequence
  SiRNA target sequence
ggtaagttttatcttaaaatcttttag

SEQ ID NO: 107238 - DNA, 27 bp, Artificial sequence
  SiRNA target sequence
gtaagttttatcttaaaatcttttaga

SEQ ID NO: 107239 - DNA, 27 bp, Artificial sequence
  SiRNA target sequence
taagttttatcttaaaatcttttagaa

SEQ ID NO: 107240 - DNA, 27 bp, Artificial sequence
  SiRNA target sequence
aagttttatcttaaaatcttttagaac

SEQ ID NO: 107241 - DNA, 27 bp, Artificial sequence
  SiRNA target sequence
agttttatcttaaaatcttttagaacc

SEQ ID NO: 107242 - DNA, 27 bp, Artificial sequence
  SiRNA target sequence
gttttatcttaaaatcttttagaacct

SEQ ID NO: 107243 - DNA, 27 bp, Artificial sequence
  SiRNA target sequence
ttttatcttaaaatcttttagaacctc

SEQ ID NO: 107244 - DNA, 27 bp, Artificial sequence
  SiRNA target sequence
tttatcttaaaatcttttagaacctca

SEQ ID NO: 107245 - DNA, 27 bp, Artificial sequence
  SiRNA target sequence
ttatcttaaaatcttttagaacctcaa

SEQ ID NO: 107246 - DNA, 27 bp, Artificial sequence
  SiRNA target sequence
tatcttaaaatcttttagaacctcaaa

SEQ ID NO: 107247 - DNA, 27 bp, Artificial sequence
  SiRNA target sequence
atcttaaaatcttttagaacctcaaaa

SEQ ID NO: 107248 - DNA, 27 bp, Artificial sequence
  SiRNA target sequence
tcttaaaatcttttagaacctcaaaaa

SEQ ID NO: 107249 - DNA, 27 bp, Artificial sequence
  SiRNA target sequence
cttaaaatcttttagaacctcaaaaat

SEQ ID NO: 107250 - DNA, 27 bp, Artificial sequence
  SiRNA target sequence
ttaaaatcttttagaacctcaaaaata

SEQ ID NO: 107251 - DNA, 27 bp, Artificial sequence
  SiRNA target sequence
taaaatcttttagaacctcaaaaatag

SEQ ID NO: 107252 - DNA, 27 bp, Artificial sequence
  SiRNA target sequence
aaaatcttttagaacctcaaaaatagt

SEQ ID NO: 107253 - DNA, 27 bp, Artificial sequence
  SiRNA target sequence
aaatcttttagaacctcaaaaatagtg

SEQ ID NO: 107254 - DNA, 27 bp, Artificial sequence
  SiRNA target sequence
aatcttttagaacctcaaaaatagtgc

SEQ ID NO: 107255 - DNA, 27 bp, Artificial sequence
  SiRNA target sequence
atcttttagaacctcaaaaatagtgcg

SEQ ID NO: 107256 - DNA, 27 bp, Artificial sequence
  SiRNA target sequence
tcttttagaacctcaaaaatagtgcgc

SEQ ID NO: 107257 - DNA, 27 bp, Artificial sequence
  SiRNA target sequence
cttttagaacctcaaaaatagtgcgct

SEQ ID NO: 107258 - DNA, 27 bp, Artificial sequence
  SiRNA target sequence
ttttagaacctcaaaaatagtgcgctt

SEQ ID NO: 107259 - DNA, 27 bp, Artificial sequence
  SiRNA target sequence
tttagaacctcaaaaatagtgcgcttc

SEQ ID NO: 107260 - DNA, 27 bp, Artificial sequence
  SiRNA target sequence
ttagaacctcaaaaatagtgcgcttcg

SEQ ID NO: 107261 - DNA, 27 bp, Artificial sequence
  SiRNA target sequence
tagaacctcaaaaatagtgcgcttcgg

SEQ ID NO: 107262 - DNA, 27 bp, Artificial sequence
  SiRNA target sequence
agaacctcaaaaatagtgcgcttcggt

SEQ ID NO: 107263 - DNA, 27 bp, Artificial sequence
  SiRNA target sequence
gaacctcaaaaatagtgcgcttcggta

SEQ ID NO: 107264 - DNA, 27 bp, Artificial sequence
  SiRNA target sequence
aacctcaaaaatagtgcgcttcggtag

SEQ ID NO: 107265 - DNA, 27 bp, Artificial sequence
  SiRNA target sequence
acctcaaaaatagtgcgcttcggtagt

SEQ ID NO: 107266 - DNA, 27 bp, Artificial sequence
  SiRNA target sequence
cctcaaaaatagtgcgcttcggtagta

SEQ ID NO: 107267 - DNA, 27 bp, Artificial sequence
  SiRNA target sequence
ctcaaaaatagtgcgcttcggtagtaa

SEQ ID NO: 107268 - DNA, 27 bp, Artificial sequence
  SiRNA target sequence
tcaaaaatagtgcgcttcggtagtaaa

SEQ ID NO: 107269 - DNA, 27 bp, Artificial sequence
  SiRNA target sequence
caaaaatagtgcgcttcggtagtaaaa

SEQ ID NO: 107270 - DNA, 27 bp, Artificial sequence
  SiRNA target sequence
aaaaatagtgcgcttcggtagtaaaat

SEQ ID NO: 107271 - DNA, 27 bp, Artificial sequence
  SiRNA target sequence
aaaatagtgcgcttcggtagtaaaatg

SEQ ID NO: 107272 - DNA, 27 bp, Artificial sequence
  SiRNA target sequence
aaatagtgcgcttcggtagtaaaatgt

SEQ ID NO: 107273 - DNA, 27 bp, Artificial sequence
  SiRNA target sequence
aatagtgcgcttcggtagtaaaatgta

SEQ ID NO: 107274 - DNA, 27 bp, Artificial sequence
  SiRNA target sequence
atagtgcgcttcggtagtaaaatgtaa

SEQ ID NO: 107275 - DNA, 27 bp, Artificial sequence
  SiRNA target sequence
tagtgcgcttcggtagtaaaatgtaat

SEQ ID NO: 107276 - DNA, 27 bp, Artificial sequence
  SiRNA target sequence
agtgcgcttcggtagtaaaatgtaatc

SEQ ID NO: 107277 - DNA, 27 bp, Artificial sequence
  SiRNA target sequence
gtgcgcttcggtagtaaaatgtaatca

SEQ ID NO: 107278 - DNA, 27 bp, Artificial sequence
  SiRNA target sequence
tgcgcttcggtagtaaaatgtaatcat

SEQ ID NO: 107279 - DNA, 27 bp, Artificial sequence
  SiRNA target sequence
gcgcttcggtagtaaaatgtaatcata

SEQ ID NO: 107280 - DNA, 27 bp, Artificial sequence
  SiRNA target sequence
cgcttcggtagtaaaatgtaatcatag

SEQ ID NO: 107281 - DNA, 27 bp, Artificial sequence
  SiRNA target sequence
gcttcggtagtaaaatgtaatcatagt

SEQ ID NO: 107282 - DNA, 27 bp, Artificial sequence
  SiRNA target sequence
cttcggtagtaaaatgtaatcatagta

SEQ ID NO: 107283 - DNA, 27 bp, Artificial sequence
  SiRNA target sequence
ttcggtagtaaaatgtaatcatagtac

SEQ ID NO: 107284 - DNA, 27 bp, Artificial sequence
  SiRNA target sequence
tcggtagtaaaatgtaatcatagtaca

SEQ ID NO: 107285 - DNA, 27 bp, Artificial sequence
  SiRNA target sequence
cggtagtaaaatgtaatcatagtacag

SEQ ID NO: 107286 - DNA, 27 bp, Artificial sequence
  SiRNA target sequence
ggtagtaaaatgtaatcatagtacaga

SEQ ID NO: 107287 - DNA, 27 bp, Artificial sequence
  SiRNA target sequence
gtagtaaaatgtaatcatagtacagat

SEQ ID NO: 107288 - DNA, 27 bp, Artificial sequence
  SiRNA target sequence
tagtaaaatgtaatcatagtacagatc

SEQ ID NO: 107289 - DNA, 27 bp, Artificial sequence
  SiRNA target sequence
agtaaaatgtaatcatagtacagatcg

SEQ ID NO: 107290 - DNA, 27 bp, Artificial sequence
  SiRNA target sequence
gtaaaatgtaatcatagtacagatcgt

SEQ ID NO: 107291 - DNA, 27 bp, Artificial sequence
  SiRNA target sequence
taaaatgtaatcatagtacagatcgta

SEQ ID NO: 107292 - DNA, 27 bp, Artificial sequence
  SiRNA target sequence
aaaatgtaatcatagtacagatcgtaa

SEQ ID NO: 107293 - DNA, 27 bp, Artificial sequence
  SiRNA target sequence
aaatgtaatcatagtacagatcgtaat

SEQ ID NO: 107294 - DNA, 27 bp, Artificial sequence
  SiRNA target sequence
aatgtaatcatagtacagatcgtaatt

SEQ ID NO: 107295 - DNA, 27 bp, Artificial sequence
  SiRNA target sequence
atgtaatcatagtacagatcgtaattt

SEQ ID NO: 107296 - DNA, 27 bp, Artificial sequence
  SiRNA target sequence
tgtaatcatagtacagatcgtaattta

SEQ ID NO: 107297 - DNA, 27 bp, Artificial sequence
  SiRNA target sequence
gtaatcatagtacagatcgtaatttag

SEQ ID NO: 107298 - DNA, 27 bp, Artificial sequence
  SiRNA target sequence
taatcatagtacagatcgtaatttaga

SEQ ID NO: 107299 - DNA, 27 bp, Artificial sequence
  SiRNA target sequence
aatcatagtacagatcgtaatttagat

SEQ ID NO: 107300 - DNA, 27 bp, Artificial sequence
  SiRNA target sequence
atcatagtacagatcgtaatttagata

SEQ ID NO: 107301 - DNA, 27 bp, Artificial sequence
  SiRNA target sequence
tcatagtacagatcgtaatttagataa

SEQ ID NO: 107302 - DNA, 27 bp, Artificial sequence
  SiRNA target sequence
catagtacagatcgtaatttagataaa

SEQ ID NO: 107303 - DNA, 27 bp, Artificial sequence
  SiRNA target sequence
atagtacagatcgtaatttagataaat

SEQ ID NO: 107304 - DNA, 27 bp, Artificial sequence
  SiRNA target sequence
tagtacagatcgtaatttagataaatt

SEQ ID NO: 107305 - DNA, 27 bp, Artificial sequence
  SiRNA target sequence
agtacagatcgtaatttagataaattt

SEQ ID NO: 107306 - DNA, 27 bp, Artificial sequence
  SiRNA target sequence
gtacagatcgtaatttagataaatttc

SEQ ID NO: 107307 - DNA, 27 bp, Artificial sequence
  SiRNA target sequence
tacagatcgtaatttagataaatttct

SEQ ID NO: 107308 - DNA, 27 bp, Artificial sequence
  SiRNA target sequence
acagatcgtaatttagataaatttctt

SEQ ID NO: 107309 - DNA, 27 bp, Artificial sequence
  SiRNA target sequence
cagatcgtaatttagataaatttcttt

SEQ ID NO: 107310 - DNA, 27 bp, Artificial sequence
  SiRNA target sequence
agatcgtaatttagataaatttcttta

SEQ ID NO: 107311 - DNA, 27 bp, Artificial sequence
  SiRNA target sequence
gatcgtaatttagataaatttctttac

SEQ ID NO: 107312 - DNA, 27 bp, Artificial sequence
  SiRNA target sequence
atcgtaatttagataaatttctttaca

SEQ ID NO: 107313 - DNA, 27 bp, Artificial sequence
  SiRNA target sequence
tcgtaatttagataaatttctttacat

SEQ ID NO: 107314 - DNA, 27 bp, Artificial sequence
  SiRNA target sequence
cgtaatttagataaatttctttacatt

SEQ ID NO: 107315 - DNA, 27 bp, Artificial sequence
  SiRNA target sequence
gtaatttagataaatttctttacattt

SEQ ID NO: 107316 - DNA, 27 bp, Artificial sequence
  SiRNA target sequence
taatttagataaatttctttacatttc

SEQ ID NO: 107317 - DNA, 27 bp, Artificial sequence
  SiRNA target sequence
aatttagataaatttctttacatttct

SEQ ID NO: 107318 - DNA, 27 bp, Artificial sequence
  SiRNA target sequence
atttagataaatttctttacatttctc

SEQ ID NO: 107319 - DNA, 27 bp, Artificial sequence
  SiRNA target sequence
tttagataaatttctttacatttctca

SEQ ID NO: 107320 - DNA, 27 bp, Artificial sequence
  SiRNA target sequence
ttagataaatttctttacatttctcac

SEQ ID NO: 107321 - DNA, 27 bp, Artificial sequence
  SiRNA target sequence
tagataaatttctttacatttctcacg

SEQ ID NO: 107322 - DNA, 27 bp, Artificial sequence
  SiRNA target sequence
agataaatttctttacatttctcacga

SEQ ID NO: 107323 - DNA, 27 bp, Artificial sequence
  SiRNA target sequence
gataaatttctttacatttctcacgat

SEQ ID NO: 107324 - DNA, 27 bp, Artificial sequence
  SiRNA target sequence
ataaatttctttacatttctcacgata

SEQ ID NO: 107325 - DNA, 27 bp, Artificial sequence
  SiRNA target sequence
taaatttctttacatttctcacgatat

SEQ ID NO: 107326 - DNA, 27 bp, Artificial sequence
  SiRNA target sequence
aaatttctttacatttctcacgatatt

SEQ ID NO: 107327 - DNA, 27 bp, Artificial sequence
  SiRNA target sequence
aatttctttacatttctcacgatattc

SEQ ID NO: 107328 - DNA, 27 bp, Artificial sequence
  SiRNA target sequence
atttctttacatttctcacgatattcc

SEQ ID NO: 107329 - DNA, 27 bp, Artificial sequence
  SiRNA target sequence
tttctttacatttctcacgatattcct

SEQ ID NO: 107330 - DNA, 27 bp, Artificial sequence
  SiRNA target sequence
ttctttacatttctcacgatattcctc

SEQ ID NO: 107331 - DNA, 27 bp, Artificial sequence
  SiRNA target sequence
tctttacatttctcacgatattcctca

SEQ ID NO: 107332 - DNA, 27 bp, Artificial sequence
  SiRNA target sequence
ctttacatttctcacgatattcctcag

SEQ ID NO: 107333 - DNA, 27 bp, Artificial sequence
  SiRNA target sequence
tttacatttctcacgatattcctcagc

SEQ ID NO: 107334 - DNA, 27 bp, Artificial sequence
  SiRNA target sequence
ttacatttctcacgatattcctcagca

SEQ ID NO: 107335 - DNA, 27 bp, Artificial sequence
  SiRNA target sequence
tacatttctcacgatattcctcagcaa

SEQ ID NO: 107336 - DNA, 27 bp, Artificial sequence
  SiRNA target sequence
acatttctcacgatattcctcagcaat

SEQ ID NO: 107337 - DNA, 27 bp, Artificial sequence
  SiRNA target sequence
catttctcacgatattcctcagcaatg

SEQ ID NO: 107338 - DNA, 27 bp, Artificial sequence
  SiRNA target sequence
atttctcacgatattcctcagcaatgg

SEQ ID NO: 107339 - DNA, 27 bp, Artificial sequence
  SiRNA target sequence
tttctcacgatattcctcagcaatggt

SEQ ID NO: 107340 - DNA, 27 bp, Artificial sequence
  SiRNA target sequence
ttctcacgatattcctcagcaatggta

SEQ ID NO: 107341 - DNA, 27 bp, Artificial sequence
  SiRNA target sequence
tctcacgatattcctcagcaatggtat

SEQ ID NO: 107342 - DNA, 27 bp, Artificial sequence
  SiRNA target sequence
ctcacgatattcctcagcaatggtatc

SEQ ID NO: 107343 - DNA, 27 bp, Artificial sequence
  SiRNA target sequence
tcacgatattcctcagcaatggtatct

SEQ ID NO: 107344 - DNA, 27 bp, Artificial sequence
  SiRNA target sequence
cacgatattcctcagcaatggtatctg

SEQ ID NO: 107345 - DNA, 27 bp, Artificial sequence
  SiRNA target sequence
acgatattcctcagcaatggtatctgt

SEQ ID NO: 107346 - DNA, 27 bp, Artificial sequence
  SiRNA target sequence
cgatattcctcagcaatggtatctgtg

SEQ ID NO: 107347 - DNA, 27 bp, Artificial sequence
  SiRNA target sequence
gatattcctcagcaatggtatctgtga

SEQ ID NO: 107348 - DNA, 27 bp, Artificial sequence
  SiRNA target sequence
atattcctcagcaatggtatctgtgat

SEQ ID NO: 107349 - DNA, 27 bp, Artificial sequence
  SiRNA target sequence
tattcctcagcaatggtatctgtgata

SEQ ID NO: 107350 - DNA, 27 bp, Artificial sequence
  SiRNA target sequence
attcctcagcaatggtatctgtgataa

SEQ ID NO: 107351 - DNA, 27 bp, Artificial sequence
  SiRNA target sequence
ttcctcagcaatggtatctgtgataag

SEQ ID NO: 107352 - DNA, 27 bp, Artificial sequence
  SiRNA target sequence
tcctcagcaatggtatctgtgataagc

SEQ ID NO: 107353 - DNA, 27 bp, Artificial sequence
  SiRNA target sequence
cctcagcaatggtatctgtgataagcg

SEQ ID NO: 107354 - DNA, 27 bp, Artificial sequence
  SiRNA target sequence
ctcagcaatggtatctgtgataagcga

SEQ ID NO: 107355 - DNA, 27 bp, Artificial sequence
  SiRNA target sequence
tcagcaatggtatctgtgataagcgaa

SEQ ID NO: 107356 - DNA, 27 bp, Artificial sequence
  SiRNA target sequence
cagcaatggtatctgtgataagcgaaa

SEQ ID NO: 107357 - DNA, 27 bp, Artificial sequence
  SiRNA target sequence
agcaatggtatctgtgataagcgaaag

SEQ ID NO: 107358 - DNA, 27 bp, Artificial sequence
  SiRNA target sequence
gcaatggtatctgtgataagcgaaagt

SEQ ID NO: 107359 - DNA, 27 bp, Artificial sequence
  SiRNA target sequence
caatggtatctgtgataagcgaaagtt

SEQ ID NO: 107360 - DNA, 27 bp, Artificial sequence
  SiRNA target sequence
aatggtatctgtgataagcgaaagttg

SEQ ID NO: 107361 - DNA, 27 bp, Artificial sequence
  SiRNA target sequence
atggtatctgtgataagcgaaagttgt

SEQ ID NO: 107362 - DNA, 27 bp, Artificial sequence
  SiRNA target sequence
tggtatctgtgataagcgaaagttgta

SEQ ID NO: 107363 - DNA, 27 bp, Artificial sequence
  SiRNA target sequence
ggtatctgtgataagcgaaagttgtag

SEQ ID NO: 107364 - DNA, 27 bp, Artificial sequence
  SiRNA target sequence
gtatctgtgataagcgaaagttgtaga

SEQ ID NO: 107365 - DNA, 27 bp, Artificial sequence
  SiRNA target sequence
tatctgtgataagcgaaagttgtagaa

SEQ ID NO: 107366 - DNA, 27 bp, Artificial sequence
  SiRNA target sequence
atctgtgataagcgaaagttgtagaaa

SEQ ID NO: 107367 - DNA, 27 bp, Artificial sequence
  SiRNA target sequence
tctgtgataagcgaaagttgtagaaaa

SEQ ID NO: 107368 - DNA, 27 bp, Artificial sequence
  SiRNA target sequence
ctgtgataagcgaaagttgtagaaaaa

SEQ ID NO: 107369 - DNA, 27 bp, Artificial sequence
  SiRNA target sequence
tgtgataagcgaaagttgtagaaaaaa

SEQ ID NO: 107370 - DNA, 27 bp, Artificial sequence
  SiRNA target sequence
gtgataagcgaaagttgtagaaaaaaa

SEQ ID NO: 107371 - DNA, 27 bp, Artificial sequence
  SiRNA target sequence
tgataagcgaaagttgtagaaaaaaat

SEQ ID NO: 107372 - DNA, 27 bp, Artificial sequence
  SiRNA target sequence
gataagcgaaagttgtagaaaaaaata

SEQ ID NO: 107373 - DNA, 27 bp, Artificial sequence
  SiRNA target sequence
ataagcgaaagttgtagaaaaaaatag

SEQ ID NO: 107374 - DNA, 27 bp, Artificial sequence
  SiRNA target sequence
taagcgaaagttgtagaaaaaaataga

SEQ ID NO: 107375 - DNA, 27 bp, Artificial sequence
  SiRNA target sequence
aagcgaaagttgtagaaaaaaatagat

SEQ ID NO: 107376 - DNA, 27 bp, Artificial sequence
  SiRNA target sequence
agcgaaagttgtagaaaaaaatagatt

SEQ ID NO: 107377 - DNA, 27 bp, Artificial sequence
  SiRNA target sequence
gcgaaagttgtagaaaaaaatagattt

SEQ ID NO: 107378 - DNA, 27 bp, Artificial sequence
  SiRNA target sequence
cgaaagttgtagaaaaaaatagatttg

SEQ ID NO: 107379 - DNA, 27 bp, Artificial sequence
  SiRNA target sequence
gaaagttgtagaaaaaaatagatttga

SEQ ID NO: 107380 - DNA, 27 bp, Artificial sequence
  SiRNA target sequence
aaagttgtagaaaaaaatagatttgag

SEQ ID NO: 107381 - DNA, 27 bp, Artificial sequence
  SiRNA target sequence
aagttgtagaaaaaaatagatttgagg

SEQ ID NO: 107382 - DNA, 27 bp, Artificial sequence
  SiRNA target sequence
agttgtagaaaaaaatagatttgagga

SEQ ID NO: 107383 - DNA, 27 bp, Artificial sequence
  SiRNA target sequence
gttgtagaaaaaaatagatttgaggaa

SEQ ID NO: 107384 - DNA, 27 bp, Artificial sequence
  SiRNA target sequence
ttgtagaaaaaaatagatttgaggaat

SEQ ID NO: 107385 - DNA, 27 bp, Artificial sequence
  SiRNA target sequence
tgtagaaaaaaatagatttgaggaata

SEQ ID NO: 107386 - DNA, 27 bp, Artificial sequence
  SiRNA target sequence
gtagaaaaaaatagatttgaggaatag

SEQ ID NO: 107387 - DNA, 27 bp, Artificial sequence
  SiRNA target sequence
tagaaaaaaatagatttgaggaataga

SEQ ID NO: 107388 - DNA, 27 bp, Artificial sequence
  SiRNA target sequence
agaaaaaaatagatttgaggaatagaa

SEQ ID NO: 107389 - DNA, 27 bp, Artificial sequence
  SiRNA target sequence
gaaaaaaatagatttgaggaatagaat

SEQ ID NO: 107390 - DNA, 27 bp, Artificial sequence
  SiRNA target sequence
aaaaaaatagatttgaggaatagaatt

SEQ ID NO: 107391 - DNA, 27 bp, Artificial sequence
  SiRNA target sequence
aaaaaatagatttgaggaatagaatta

SEQ ID NO: 107392 - DNA, 27 bp, Artificial sequence
  SiRNA target sequence
aaaaatagatttgaggaatagaattaa

SEQ ID NO: 107393 - DNA, 27 bp, Artificial sequence
  SiRNA target sequence
aaaatagatttgaggaatagaattaaa

SEQ ID NO: 107394 - DNA, 27 bp, Artificial sequence
  SiRNA target sequence
aaatagatttgaggaatagaattaaaa

SEQ ID NO: 107395 - DNA, 27 bp, Artificial sequence
  SiRNA target sequence
aatagatttgaggaatagaattaaaat

SEQ ID NO: 107396 - DNA, 27 bp, Artificial sequence
  SiRNA target sequence
atagatttgaggaatagaattaaaatc

SEQ ID NO: 107397 - DNA, 27 bp, Artificial sequence
  SiRNA target sequence
tagatttgaggaatagaattaaaatca

SEQ ID NO: 107398 - DNA, 27 bp, Artificial sequence
  SiRNA target sequence
agatttgaggaatagaattaaaatcac

SEQ ID NO: 107399 - DNA, 27 bp, Artificial sequence
  SiRNA target sequence
gatttgaggaatagaattaaaatcaca

SEQ ID NO: 107400 - DNA, 27 bp, Artificial sequence
  SiRNA target sequence
atttgaggaatagaattaaaatcacaa

SEQ ID NO: 107401 - DNA, 27 bp, Artificial sequence
  SiRNA target sequence
tttgaggaatagaattaaaatcacaat

SEQ ID NO: 107402 - DNA, 27 bp, Artificial sequence
  SiRNA target sequence
ttgaggaatagaattaaaatcacaata

SEQ ID NO: 107403 - DNA, 27 bp, Artificial sequence
  SiRNA target sequence
tgaggaatagaattaaaatcacaatat

SEQ ID NO: 107404 - DNA, 27 bp, Artificial sequence
  SiRNA target sequence
gaggaatagaattaaaatcacaatatt

SEQ ID NO: 107405 - DNA, 27 bp, Artificial sequence
  SiRNA target sequence
aggaatagaattaaaatcacaatattt

SEQ ID NO: 107406 - DNA, 27 bp, Artificial sequence
  SiRNA target sequence
ggaatagaattaaaatcacaatatttt

SEQ ID NO: 107407 - DNA, 27 bp, Artificial sequence
  SiRNA target sequence
gaatagaattaaaatcacaatattttt

SEQ ID NO: 107408 - DNA, 27 bp, Artificial sequence
  SiRNA target sequence
aatagaattaaaatcacaatatttttt

SEQ ID NO: 107409 - DNA, 27 bp, Artificial sequence
  SiRNA target sequence
atagaattaaaatcacaatatttttta

SEQ ID NO: 107410 - DNA, 27 bp, Artificial sequence
  SiRNA target sequence
tagaattaaaatcacaatattttttaa

SEQ ID NO: 107411 - DNA, 27 bp, Artificial sequence
  SiRNA target sequence
agaattaaaatcacaatattttttaat

SEQ ID NO: 107412 - DNA, 27 bp, Artificial sequence
  SiRNA target sequence
gaattaaaatcacaatattttttaata

SEQ ID NO: 107413 - DNA, 27 bp, Artificial sequence
  SiRNA target sequence
aattaaaatcacaatattttttaatat

SEQ ID NO: 107414 - DNA, 27 bp, Artificial sequence
  SiRNA target sequence
attaaaatcacaatattttttaatata

SEQ ID NO: 107415 - DNA, 27 bp, Artificial sequence
  SiRNA target sequence
ttaaaatcacaatattttttaatatat

SEQ ID NO: 107416 - DNA, 27 bp, Artificial sequence
  SiRNA target sequence
taaaatcacaatattttttaatatatt

SEQ ID NO: 107417 - DNA, 27 bp, Artificial sequence
  SiRNA target sequence
aaaatcacaatattttttaatatattt

SEQ ID NO: 107418 - DNA, 27 bp, Artificial sequence
  SiRNA target sequence
aaatcacaatattttttaatatattta

SEQ ID NO: 107419 - DNA, 27 bp, Artificial sequence
  SiRNA target sequence
aatcacaatattttttaatatatttaa

SEQ ID NO: 107420 - DNA, 27 bp, Artificial sequence
  SiRNA target sequence
atcacaatattttttaatatatttaac

SEQ ID NO: 107421 - DNA, 27 bp, Artificial sequence
  SiRNA target sequence
tcacaatattttttaatatatttaacc

SEQ ID NO: 107422 - DNA, 27 bp, Artificial sequence
  SiRNA target sequence
cacaatattttttaatatatttaacca

SEQ ID NO: 107423 - DNA, 27 bp, Artificial sequence
  SiRNA target sequence
acaatattttttaatatatttaaccaa

SEQ ID NO: 107424 - DNA, 27 bp, Artificial sequence
  SiRNA target sequence
caatattttttaatatatttaaccaag

SEQ ID NO: 107425 - DNA, 27 bp, Artificial sequence
  SiRNA target sequence
aatattttttaatatatttaaccaagg

SEQ ID NO: 107426 - DNA, 27 bp, Artificial sequence
  SiRNA target sequence
atattttttaatatatttaaccaaggt

SEQ ID NO: 107427 - DNA, 27 bp, Artificial sequence
  SiRNA target sequence
tattttttaatatatttaaccaaggta

SEQ ID NO: 107428 - DNA, 27 bp, Artificial sequence
  SiRNA target sequence
attttttaatatatttaaccaaggtat

SEQ ID NO: 107429 - DNA, 27 bp, Artificial sequence
  SiRNA target sequence
ttttttaatatatttaaccaaggtatt

SEQ ID NO: 107430 - DNA, 27 bp, Artificial sequence
  SiRNA target sequence
tttttaatatatttaaccaaggtattg

SEQ ID NO: 107431 - DNA, 27 bp, Artificial sequence
  SiRNA target sequence
ttttaatatatttaaccaaggtattgt

SEQ ID NO: 107432 - DNA, 27 bp, Artificial sequence
  SiRNA target sequence
tttaatatatttaaccaaggtattgtc

SEQ ID NO: 107433 - DNA, 27 bp, Artificial sequence
  SiRNA target sequence
ttaatatatttaaccaaggtattgtcc

SEQ ID NO: 107434 - DNA, 27 bp, Artificial sequence
  SiRNA target sequence
taatatatttaaccaaggtattgtcct

SEQ ID NO: 107435 - DNA, 27 bp, Artificial sequence
  SiRNA target sequence
aatatatttaaccaaggtattgtcctt

SEQ ID NO: 107436 - DNA, 27 bp, Artificial sequence
  SiRNA target sequence
atatatttaaccaaggtattgtccttt

SEQ ID NO: 107437 - DNA, 27 bp, Artificial sequence
  SiRNA target sequence
tatatttaaccaaggtattgtccttta

SEQ ID NO: 107438 - DNA, 27 bp, Artificial sequence
  SiRNA target sequence
atatttaaccaaggtattgtcctttat

SEQ ID NO: 107439 - DNA, 27 bp, Artificial sequence
  SiRNA target sequence
tatttaaccaaggtattgtcctttatg

SEQ ID NO: 107440 - DNA, 27 bp, Artificial sequence
  SiRNA target sequence
atttaaccaaggtattgtcctttatgt

SEQ ID NO: 107441 - DNA, 27 bp, Artificial sequence
  SiRNA target sequence
tttaaccaaggtattgtcctttatgtt

SEQ ID NO: 107442 - DNA, 27 bp, Artificial sequence
  SiRNA target sequence
ttaaccaaggtattgtcctttatgtta

SEQ ID NO: 107443 - DNA, 27 bp, Artificial sequence
  SiRNA target sequence
taaccaaggtattgtcctttatgttat

SEQ ID NO: 107444 - DNA, 27 bp, Artificial sequence
  SiRNA target sequence
aaccaaggtattgtcctttatgttatt

SEQ ID NO: 107445 - DNA, 27 bp, Artificial sequence
  SiRNA target sequence
accaaggtattgtcctttatgttatta

SEQ ID NO: 107446 - DNA, 27 bp, Artificial sequence
  SiRNA target sequence
ccaaggtattgtcctttatgttattat

SEQ ID NO: 107447 - DNA, 27 bp, Artificial sequence
  SiRNA target sequence
caaggtattgtcctttatgttattata

SEQ ID NO: 107448 - DNA, 27 bp, Artificial sequence
  SiRNA target sequence
aaggtattgtcctttatgttattatat

SEQ ID NO: 107449 - DNA, 27 bp, Artificial sequence
  SiRNA target sequence
aggtattgtcctttatgttattatatc

SEQ ID NO: 107450 - DNA, 27 bp, Artificial sequence
  SiRNA target sequence
ggtattgtcctttatgttattatatct

SEQ ID NO: 107451 - DNA, 27 bp, Artificial sequence
  SiRNA target sequence
gtattgtcctttatgttattatatctt

SEQ ID NO: 107452 - DNA, 27 bp, Artificial sequence
  SiRNA target sequence
tattgtcctttatgttattatatctta

SEQ ID NO: 107453 - DNA, 27 bp, Artificial sequence
  SiRNA target sequence
attgtcctttatgttattatatcttac

SEQ ID NO: 107454 - DNA, 27 bp, Artificial sequence
  SiRNA target sequence
ttgtcctttatgttattatatcttaca

SEQ ID NO: 107455 - DNA, 27 bp, Artificial sequence
  SiRNA target sequence
tgtcctttatgttattatatcttacaa

SEQ ID NO: 107456 - DNA, 27 bp, Artificial sequence
  SiRNA target sequence
gtcctttatgttattatatcttacaaa

SEQ ID NO: 107457 - DNA, 27 bp, Artificial sequence
  SiRNA target sequence
tcctttatgttattatatcttacaaac

SEQ ID NO: 107458 - DNA, 27 bp, Artificial sequence
  SiRNA target sequence
cctttatgttattatatcttacaaact

SEQ ID NO: 107459 - DNA, 27 bp, Artificial sequence
  SiRNA target sequence
ctttatgttattatatcttacaaactc

SEQ ID NO: 107460 - DNA, 27 bp, Artificial sequence
  SiRNA target sequence
tttatgttattatatcttacaaactcc

SEQ ID NO: 107461 - DNA, 27 bp, Artificial sequence
  SiRNA target sequence
ttatgttattatatcttacaaactcct

SEQ ID NO: 107462 - DNA, 27 bp, Artificial sequence
  SiRNA target sequence
tatgttattatatcttacaaactcctc

SEQ ID NO: 107463 - DNA, 27 bp, Artificial sequence
  SiRNA target sequence
atgttattatatcttacaaactcctcg

SEQ ID NO: 107464 - DNA, 27 bp, Artificial sequence
  SiRNA target sequence
tgttattatatcttacaaactcctcgt

SEQ ID NO: 107465 - DNA, 27 bp, Artificial sequence
  SiRNA target sequence
gttattatatcttacaaactcctcgta

SEQ ID NO: 107466 - DNA, 27 bp, Artificial sequence
  SiRNA target sequence
ttattatatcttacaaactcctcgtaa

SEQ ID NO: 107467 - DNA, 27 bp, Artificial sequence
  SiRNA target sequence
tattatatcttacaaactcctcgtaat

SEQ ID NO: 107468 - DNA, 27 bp, Artificial sequence
  SiRNA target sequence
attatatcttacaaactcctcgtaatt

SEQ ID NO: 107469 - DNA, 27 bp, Artificial sequence
  SiRNA target sequence
ttatatcttacaaactcctcgtaatta

SEQ ID NO: 107470 - DNA, 27 bp, Artificial sequence
  SiRNA target sequence
tatatcttacaaactcctcgtaattat

SEQ ID NO: 107471 - DNA, 27 bp, Artificial sequence
  SiRNA target sequence
atatcttacaaactcctcgtaattata

SEQ ID NO: 107472 - DNA, 27 bp, Artificial sequence
  SiRNA target sequence
tatcttacaaactcctcgtaattataa

SEQ ID NO: 107473 - DNA, 27 bp, Artificial sequence
  SiRNA target sequence
atcttacaaactcctcgtaattataat

SEQ ID NO: 107474 - DNA, 27 bp, Artificial sequence
  SiRNA target sequence
tcttacaaactcctcgtaattataatt

SEQ ID NO: 107475 - DNA, 27 bp, Artificial sequence
  SiRNA target sequence
cttacaaactcctcgtaattataattt

SEQ ID NO: 107476 - DNA, 27 bp, Artificial sequence
  SiRNA target sequence
ttacaaactcctcgtaattataatttt

SEQ ID NO: 107477 - DNA, 27 bp, Artificial sequence
  SiRNA target sequence
tacaaactcctcgtaattataattttc

SEQ ID NO: 107478 - DNA, 27 bp, Artificial sequence
  SiRNA target sequence
acaaactcctcgtaattataattttca

SEQ ID NO: 107479 - DNA, 27 bp, Artificial sequence
  SiRNA target sequence
caaactcctcgtaattataattttcag

SEQ ID NO: 107480 - DNA, 27 bp, Artificial sequence
  SiRNA target sequence
aaactcctcgtaattataattttcagg

SEQ ID NO: 107481 - DNA, 27 bp, Artificial sequence
  SiRNA target sequence
aactcctcgtaattataattttcagga

SEQ ID NO: 107482 - DNA, 27 bp, Artificial sequence
  SiRNA target sequence
actcctcgtaattataattttcaggat

SEQ ID NO: 107483 - DNA, 27 bp, Artificial sequence
  SiRNA target sequence
ctcctcgtaattataattttcaggata

SEQ ID NO: 107484 - DNA, 27 bp, Artificial sequence
  SiRNA target sequence
tcctcgtaattataattttcaggataa

SEQ ID NO: 107485 - DNA, 27 bp, Artificial sequence
  SiRNA target sequence
cctcgtaattataattttcaggataaa

SEQ ID NO: 107486 - DNA, 27 bp, Artificial sequence
  SiRNA target sequence
ctcgtaattataattttcaggataaac

SEQ ID NO: 107487 - DNA, 27 bp, Artificial sequence
  SiRNA target sequence
tcgtaattataattttcaggataaacc

SEQ ID NO: 107488 - DNA, 27 bp, Artificial sequence
  SiRNA target sequence
cgtaattataattttcaggataaaccg

SEQ ID NO: 107489 - DNA, 27 bp, Artificial sequence
  SiRNA target sequence
gtaattataattttcaggataaaccgc

SEQ ID NO: 107490 - DNA, 27 bp, Artificial sequence
  SiRNA target sequence
taattataattttcaggataaaccgct

SEQ ID NO: 107491 - DNA, 27 bp, Artificial sequence
  SiRNA target sequence
aattataattttcaggataaaccgcta

SEQ ID NO: 107492 - DNA, 27 bp, Artificial sequence
  SiRNA target sequence
attataattttcaggataaaccgctag

SEQ ID NO: 107493 - DNA, 27 bp, Artificial sequence
  SiRNA target sequence
ttataattttcaggataaaccgctaga

SEQ ID NO: 107494 - DNA, 27 bp, Artificial sequence
  SiRNA target sequence
tataattttcaggataaaccgctagac

SEQ ID NO: 107495 - DNA, 27 bp, Artificial sequence
  SiRNA target sequence
ataattttcaggataaaccgctagaca

SEQ ID NO: 107496 - DNA, 27 bp, Artificial sequence
  SiRNA target sequence
taattttcaggataaaccgctagacaa

SEQ ID NO: 107497 - DNA, 27 bp, Artificial sequence
  SiRNA target sequence
aattttcaggataaaccgctagacaat

SEQ ID NO: 107498 - DNA, 27 bp, Artificial sequence
  SiRNA target sequence
attttcaggataaaccgctagacaatc

SEQ ID NO: 107499 - DNA, 27 bp, Artificial sequence
  SiRNA target sequence
ttttcaggataaaccgctagacaatca

SEQ ID NO: 107500 - DNA, 27 bp, Artificial sequence
  SiRNA target sequence
tttcaggataaaccgctagacaatcac

SEQ ID NO: 107501 - DNA, 27 bp, Artificial sequence
  SiRNA target sequence
ttcaggataaaccgctagacaatcacc

SEQ ID NO: 107502 - DNA, 27 bp, Artificial sequence
  SiRNA target sequence
tcaggataaaccgctagacaatcaccg

SEQ ID NO: 107503 - DNA, 27 bp, Artificial sequence
  SiRNA target sequence
caggataaaccgctagacaatcaccga

SEQ ID NO: 107504 - DNA, 27 bp, Artificial sequence
  SiRNA target sequence
aggataaaccgctagacaatcaccgat

SEQ ID NO: 107505 - DNA, 27 bp, Artificial sequence
  SiRNA target sequence
ggataaaccgctagacaatcaccgatt

SEQ ID NO: 107506 - DNA, 27 bp, Artificial sequence
  SiRNA target sequence
gataaaccgctagacaatcaccgattt

SEQ ID NO: 107507 - DNA, 27 bp, Artificial sequence
  SiRNA target sequence
ataaaccgctagacaatcaccgatttc

SEQ ID NO: 107508 - DNA, 27 bp, Artificial sequence
  SiRNA target sequence
taaaccgctagacaatcaccgatttca

SEQ ID NO: 107509 - DNA, 27 bp, Artificial sequence
  SiRNA target sequence
aaaccgctagacaatcaccgatttcaa

SEQ ID NO: 107510 - DNA, 27 bp, Artificial sequence
  SiRNA target sequence
aaccgctagacaatcaccgatttcaaa

SEQ ID NO: 107511 - DNA, 27 bp, Artificial sequence
  SiRNA target sequence
accgctagacaatcaccgatttcaaaa

SEQ ID NO: 107512 - DNA, 27 bp, Artificial sequence
  SiRNA target sequence
ccgctagacaatcaccgatttcaaaat

SEQ ID NO: 107513 - DNA, 27 bp, Artificial sequence
  SiRNA target sequence
cgctagacaatcaccgatttcaaaatt

SEQ ID NO: 107514 - DNA, 27 bp, Artificial sequence
  SiRNA target sequence
gctagacaatcaccgatttcaaaattt

SEQ ID NO: 107515 - DNA, 27 bp, Artificial sequence
  SiRNA target sequence
ctagacaatcaccgatttcaaaatttt

SEQ ID NO: 107516 - DNA, 27 bp, Artificial sequence
  SiRNA target sequence
tagacaatcaccgatttcaaaattttc

SEQ ID NO: 107517 - DNA, 27 bp, Artificial sequence
  SiRNA target sequence
agacaatcaccgatttcaaaattttct

SEQ ID NO: 107518 - DNA, 27 bp, Artificial sequence
  SiRNA target sequence
gacaatcaccgatttcaaaattttcta

SEQ ID NO: 107519 - DNA, 27 bp, Artificial sequence
  SiRNA target sequence
acaatcaccgatttcaaaattttctat

SEQ ID NO: 107520 - DNA, 27 bp, Artificial sequence
  SiRNA target sequence
caatcaccgatttcaaaattttctata

SEQ ID NO: 107521 - DNA, 27 bp, Artificial sequence
  SiRNA target sequence
aatcaccgatttcaaaattttctatat

SEQ ID NO: 107522 - DNA, 27 bp, Artificial sequence
  SiRNA target sequence
atcaccgatttcaaaattttctatatc

SEQ ID NO: 107523 - DNA, 27 bp, Artificial sequence
  SiRNA target sequence
tcaccgatttcaaaattttctatatct

SEQ ID NO: 107524 - DNA, 27 bp, Artificial sequence
  SiRNA target sequence
caccgatttcaaaattttctatatcta

SEQ ID NO: 107525 - DNA, 27 bp, Artificial sequence
  SiRNA target sequence
accgatttcaaaattttctatatctat

SEQ ID NO: 107526 - DNA, 27 bp, Artificial sequence
  SiRNA target sequence
ccgatttcaaaattttctatatctata

SEQ ID NO: 107527 - DNA, 27 bp, Artificial sequence
  SiRNA target sequence
cgatttcaaaattttctatatctatat

SEQ ID NO: 107528 - DNA, 27 bp, Artificial sequence
  SiRNA target sequence
gatttcaaaattttctatatctatatc

SEQ ID NO: 107529 - DNA, 27 bp, Artificial sequence
  SiRNA target sequence
atttcaaaattttctatatctatatca

SEQ ID NO: 107530 - DNA, 27 bp, Artificial sequence
  SiRNA target sequence
tttcaaaattttctatatctatatcaa

SEQ ID NO: 107531 - DNA, 27 bp, Artificial sequence
  SiRNA target sequence
ttcaaaattttctatatctatatcaaa

SEQ ID NO: 107532 - DNA, 27 bp, Artificial sequence
  SiRNA target sequence
tcaaaattttctatatctatatcaaat

SEQ ID NO: 107533 - DNA, 27 bp, Artificial sequence
  SiRNA target sequence
caaaattttctatatctatatcaaatt

SEQ ID NO: 107534 - DNA, 27 bp, Artificial sequence
  SiRNA target sequence
aaaattttctatatctatatcaaattt

SEQ ID NO: 107535 - DNA, 27 bp, Artificial sequence
  SiRNA target sequence
aaattttctatatctatatcaaatttt

SEQ ID NO: 107536 - DNA, 27 bp, Artificial sequence
  SiRNA target sequence
aattttctatatctatatcaaatttta

SEQ ID NO: 107537 - DNA, 27 bp, Artificial sequence
  SiRNA target sequence
attttctatatctatatcaaattttat

SEQ ID NO: 107538 - DNA, 27 bp, Artificial sequence
  SiRNA target sequence
ttttctatatctatatcaaattttatt

SEQ ID NO: 107539 - DNA, 27 bp, Artificial sequence
  SiRNA target sequence
tttctatatctatatcaaattttattt

SEQ ID NO: 107540 - DNA, 27 bp, Artificial sequence
  SiRNA target sequence
ttctatatctatatcaaattttatttc

SEQ ID NO: 107541 - DNA, 27 bp, Artificial sequence
  SiRNA target sequence
tctatatctatatcaaattttatttct

SEQ ID NO: 107542 - DNA, 27 bp, Artificial sequence
  SiRNA target sequence
ctatatctatatcaaattttatttcta

SEQ ID NO: 107543 - DNA, 27 bp, Artificial sequence
  SiRNA target sequence
tatatctatatcaaattttatttctaa

SEQ ID NO: 107544 - DNA, 27 bp, Artificial sequence
  SiRNA target sequence
atatctatatcaaattttatttctaaa

SEQ ID NO: 107545 - DNA, 27 bp, Artificial sequence
  SiRNA target sequence
tatctatatcaaattttatttctaaaa

SEQ ID NO: 107546 - DNA, 27 bp, Artificial sequence
  SiRNA target sequence
atctatatcaaattttatttctaaaat

SEQ ID NO: 107547 - DNA, 27 bp, Artificial sequence
  SiRNA target sequence
tctatatcaaattttatttctaaaata

SEQ ID NO: 107548 - DNA, 27 bp, Artificial sequence
  SiRNA target sequence
ctatatcaaattttatttctaaaatag

SEQ ID NO: 107549 - DNA, 27 bp, Artificial sequence
  SiRNA target sequence
tatatcaaattttatttctaaaatagg

SEQ ID NO: 107550 - DNA, 27 bp, Artificial sequence
  SiRNA target sequence
atatcaaattttatttctaaaatagga

SEQ ID NO: 107551 - DNA, 27 bp, Artificial sequence
  SiRNA target sequence
tatcaaattttatttctaaaataggat

SEQ ID NO: 107552 - DNA, 27 bp, Artificial sequence
  SiRNA target sequence
atcaaattttatttctaaaataggata

SEQ ID NO: 107553 - DNA, 27 bp, Artificial sequence
  SiRNA target sequence
tcaaattttatttctaaaataggataa

SEQ ID NO: 107554 - DNA, 27 bp, Artificial sequence
  SiRNA target sequence
caaattttatttctaaaataggataaa

SEQ ID NO: 107555 - DNA, 27 bp, Artificial sequence
  SiRNA target sequence
aaattttatttctaaaataggataaat

SEQ ID NO: 107556 - DNA, 27 bp, Artificial sequence
  SiRNA target sequence
aattttatttctaaaataggataaatg

SEQ ID NO: 107557 - DNA, 27 bp, Artificial sequence
  SiRNA target sequence
attttatttctaaaataggataaatgt

SEQ ID NO: 107558 - DNA, 27 bp, Artificial sequence
  SiRNA target sequence
ttttatttctaaaataggataaatgta

SEQ ID NO: 107559 - DNA, 27 bp, Artificial sequence
  SiRNA target sequence
tttatttctaaaataggataaatgtaa

SEQ ID NO: 107560 - DNA, 27 bp, Artificial sequence
  SiRNA target sequence
ttatttctaaaataggataaatgtaat

SEQ ID NO: 107561 - DNA, 27 bp, Artificial sequence
  SiRNA target sequence
tatttctaaaataggataaatgtaatt

SEQ ID NO: 107562 - DNA, 27 bp, Artificial sequence
  SiRNA target sequence
atttctaaaataggataaatgtaattg

SEQ ID NO: 107563 - DNA, 27 bp, Artificial sequence
  SiRNA target sequence
tttctaaaataggataaatgtaattgt

SEQ ID NO: 107564 - DNA, 27 bp, Artificial sequence
  SiRNA target sequence
ttctaaaataggataaatgtaattgta

SEQ ID NO: 107565 - DNA, 27 bp, Artificial sequence
  SiRNA target sequence
tctaaaataggataaatgtaattgtaa

SEQ ID NO: 107566 - DNA, 27 bp, Artificial sequence
  SiRNA target sequence
ctaaaataggataaatgtaattgtaag

SEQ ID NO: 107567 - DNA, 27 bp, Artificial sequence
  SiRNA target sequence
taaaataggataaatgtaattgtaagg

SEQ ID NO: 107568 - DNA, 27 bp, Artificial sequence
  SiRNA target sequence
aaaataggataaatgtaattgtaaggt

SEQ ID NO: 107569 - DNA, 27 bp, Artificial sequence
  SiRNA target sequence
aaataggataaatgtaattgtaaggtg

SEQ ID NO: 107570 - DNA, 27 bp, Artificial sequence
  SiRNA target sequence
aataggataaatgtaattgtaaggtgt

SEQ ID NO: 107571 - DNA, 27 bp, Artificial sequence
  SiRNA target sequence
ataggataaatgtaattgtaaggtgtt

SEQ ID NO: 107572 - DNA, 27 bp, Artificial sequence
  SiRNA target sequence
taggataaatgtaattgtaaggtgtta

SEQ ID NO: 107573 - DNA, 27 bp, Artificial sequence
  SiRNA target sequence
aggataaatgtaattgtaaggtgttaa

SEQ ID NO: 107574 - DNA, 27 bp, Artificial sequence
  SiRNA target sequence
ggataaatgtaattgtaaggtgttaat

SEQ ID NO: 107575 - DNA, 27 bp, Artificial sequence
  SiRNA target sequence
gataaatgtaattgtaaggtgttaata

SEQ ID NO: 107576 - DNA, 27 bp, Artificial sequence
  SiRNA target sequence
ataaatgtaattgtaaggtgttaatat

SEQ ID NO: 107577 - DNA, 27 bp, Artificial sequence
  SiRNA target sequence
taaatgtaattgtaaggtgttaatatc

SEQ ID NO: 107578 - DNA, 27 bp, Artificial sequence
  SiRNA target sequence
aaatgtaattgtaaggtgttaatatct

SEQ ID NO: 107579 - DNA, 27 bp, Artificial sequence
  SiRNA target sequence
aatgtaattgtaaggtgttaatatctt

SEQ ID NO: 107580 - DNA, 27 bp, Artificial sequence
  SiRNA target sequence
atgtaattgtaaggtgttaatatctta

SEQ ID NO: 107581 - DNA, 27 bp, Artificial sequence
  SiRNA target sequence
tgtaattgtaaggtgttaatatcttaa

SEQ ID NO: 107582 - DNA, 27 bp, Artificial sequence
  SiRNA target sequence
gtaattgtaaggtgttaatatcttaat

SEQ ID NO: 107583 - DNA, 27 bp, Artificial sequence
  SiRNA target sequence
taattgtaaggtgttaatatcttaata

SEQ ID NO: 107584 - DNA, 27 bp, Artificial sequence
  SiRNA target sequence
aattgtaaggtgttaatatcttaatat

SEQ ID NO: 107585 - DNA, 27 bp, Artificial sequence
  SiRNA target sequence
attgtaaggtgttaatatcttaatatc

SEQ ID NO: 107586 - DNA, 27 bp, Artificial sequence
  SiRNA target sequence
ttgtaaggtgttaatatcttaatatca

SEQ ID NO: 107587 - DNA, 27 bp, Artificial sequence
  SiRNA target sequence
tgtaaggtgttaatatcttaatatcat

SEQ ID NO: 107588 - DNA, 27 bp, Artificial sequence
  SiRNA target sequence
gtaaggtgttaatatcttaatatcatt

SEQ ID NO: 107589 - DNA, 27 bp, Artificial sequence
  SiRNA target sequence
taaggtgttaatatcttaatatcattt

SEQ ID NO: 107590 - DNA, 27 bp, Artificial sequence
  SiRNA target sequence
aaggtgttaatatcttaatatcattta

SEQ ID NO: 107591 - DNA, 27 bp, Artificial sequence
  SiRNA target sequence
aggtgttaatatcttaatatcatttat

SEQ ID NO: 107592 - DNA, 27 bp, Artificial sequence
  SiRNA target sequence
ggtgttaatatcttaatatcatttatt

SEQ ID NO: 107593 - DNA, 27 bp, Artificial sequence
  SiRNA target sequence
gtgttaatatcttaatatcatttattg

SEQ ID NO: 107594 - DNA, 27 bp, Artificial sequence
  SiRNA target sequence
tgttaatatcttaatatcatttattga

SEQ ID NO: 107595 - DNA, 27 bp, Artificial sequence
  SiRNA target sequence
gttaatatcttaatatcatttattgac

SEQ ID NO: 107596 - DNA, 27 bp, Artificial sequence
  SiRNA target sequence
ttaatatcttaatatcatttattgacg

SEQ ID NO: 107597 - DNA, 27 bp, Artificial sequence
  SiRNA target sequence
taatatcttaatatcatttattgacgc

SEQ ID NO: 107598 - DNA, 27 bp, Artificial sequence
  SiRNA target sequence
aatatcttaatatcatttattgacgca

SEQ ID NO: 107599 - DNA, 27 bp, Artificial sequence
  SiRNA target sequence
atatcttaatatcatttattgacgcac

SEQ ID NO: 107600 - DNA, 27 bp, Artificial sequence
  SiRNA target sequence
tatcttaatatcatttattgacgcact

SEQ ID NO: 107601 - DNA, 27 bp, Artificial sequence
  SiRNA target sequence
atcttaatatcatttattgacgcactg

SEQ ID NO: 107602 - DNA, 27 bp, Artificial sequence
  SiRNA target sequence
tcttaatatcatttattgacgcactgt

SEQ ID NO: 107603 - DNA, 27 bp, Artificial sequence
  SiRNA target sequence
cttaatatcatttattgacgcactgta

SEQ ID NO: 107604 - DNA, 27 bp, Artificial sequence
  SiRNA target sequence
ttaatatcatttattgacgcactgtat

SEQ ID NO: 107605 - DNA, 27 bp, Artificial sequence
  SiRNA target sequence
taatatcatttattgacgcactgtata

SEQ ID NO: 107606 - DNA, 27 bp, Artificial sequence
  SiRNA target sequence
aatatcatttattgacgcactgtataa

SEQ ID NO: 107607 - DNA, 27 bp, Artificial sequence
  SiRNA target sequence
atatcatttattgacgcactgtataaa

SEQ ID NO: 107608 - DNA, 27 bp, Artificial sequence
  SiRNA target sequence
tatcatttattgacgcactgtataaat

SEQ ID NO: 107609 - DNA, 27 bp, Artificial sequence
  SiRNA target sequence
atcatttattgacgcactgtataaatc

SEQ ID NO: 107610 - DNA, 27 bp, Artificial sequence
  SiRNA target sequence
tcatttattgacgcactgtataaatca

SEQ ID NO: 107611 - DNA, 27 bp, Artificial sequence
  SiRNA target sequence
catttattgacgcactgtataaatcat

SEQ ID NO: 107612 - DNA, 27 bp, Artificial sequence
  SiRNA target sequence
atttattgacgcactgtataaatcatt

SEQ ID NO: 107613 - DNA, 27 bp, Artificial sequence
  SiRNA target sequence
tttattgacgcactgtataaatcattt

SEQ ID NO: 107614 - DNA, 27 bp, Artificial sequence
  SiRNA target sequence
ttattgacgcactgtataaatcatttt

SEQ ID NO: 107615 - DNA, 27 bp, Artificial sequence
  SiRNA target sequence
tattgacgcactgtataaatcattttt

SEQ ID NO: 107616 - DNA, 27 bp, Artificial sequence
  SiRNA target sequence
attgacgcactgtataaatcattttta

SEQ ID NO: 107617 - DNA, 27 bp, Artificial sequence
  SiRNA target sequence
ttgacgcactgtataaatcatttttac

SEQ ID NO: 107618 - DNA, 27 bp, Artificial sequence
  SiRNA target sequence
tgacgcactgtataaatcatttttaca

SEQ ID NO: 107619 - DNA, 27 bp, Artificial sequence
  SiRNA target sequence
gacgcactgtataaatcatttttacaa

SEQ ID NO: 107620 - DNA, 27 bp, Artificial sequence
  SiRNA target sequence
acgcactgtataaatcatttttacaac

SEQ ID NO: 107621 - DNA, 27 bp, Artificial sequence
  SiRNA target sequence
cgcactgtataaatcatttttacaact

SEQ ID NO: 107622 - DNA, 27 bp, Artificial sequence
  SiRNA target sequence
gcactgtataaatcatttttacaactt

SEQ ID NO: 107623 - DNA, 27 bp, Artificial sequence
  SiRNA target sequence
cactgtataaatcatttttacaacttg

SEQ ID NO: 107624 - DNA, 27 bp, Artificial sequence
  SiRNA target sequence
actgtataaatcatttttacaacttgc

SEQ ID NO: 107625 - DNA, 27 bp, Artificial sequence
  SiRNA target sequence
ctgtataaatcatttttacaacttgca

SEQ ID NO: 107626 - DNA, 27 bp, Artificial sequence
  SiRNA target sequence
tgtataaatcatttttacaacttgcaa

SEQ ID NO: 107627 - DNA, 27 bp, Artificial sequence
  SiRNA target sequence
gtataaatcatttttacaacttgcaaa

SEQ ID NO: 107628 - DNA, 27 bp, Artificial sequence
  SiRNA target sequence
tataaatcatttttacaacttgcaaaa

SEQ ID NO: 107629 - DNA, 27 bp, Artificial sequence
  SiRNA target sequence
ataaatcatttttacaacttgcaaaat

SEQ ID NO: 107630 - DNA, 27 bp, Artificial sequence
  SiRNA target sequence
taaatcatttttacaacttgcaaaatt

SEQ ID NO: 107631 - DNA, 27 bp, Artificial sequence
  SiRNA target sequence
aaatcatttttacaacttgcaaaattt

SEQ ID NO: 107632 - DNA, 27 bp, Artificial sequence
  SiRNA target sequence
aatcatttttacaacttgcaaaatttt

SEQ ID NO: 107633 - DNA, 27 bp, Artificial sequence
  SiRNA target sequence
atcatttttacaacttgcaaaattttt

SEQ ID NO: 107634 - DNA, 27 bp, Artificial sequence
  SiRNA target sequence
tcatttttacaacttgcaaaattttta

SEQ ID NO: 107635 - DNA, 27 bp, Artificial sequence
  SiRNA target sequence
catttttacaacttgcaaaatttttag

SEQ ID NO: 107636 - DNA, 27 bp, Artificial sequence
  SiRNA target sequence
atttttacaacttgcaaaatttttagc

SEQ ID NO: 107637 - DNA, 27 bp, Artificial sequence
  SiRNA target sequence
tttttacaacttgcaaaatttttagca

SEQ ID NO: 107638 - DNA, 27 bp, Artificial sequence
  SiRNA target sequence
ttttacaacttgcaaaatttttagcat

SEQ ID NO: 107639 - DNA, 27 bp, Artificial sequence
  SiRNA target sequence
tttacaacttgcaaaatttttagcatt

SEQ ID NO: 107640 - DNA, 27 bp, Artificial sequence
  SiRNA target sequence
ttacaacttgcaaaatttttagcattt

SEQ ID NO: 107641 - DNA, 27 bp, Artificial sequence
  SiRNA target sequence
tacaacttgcaaaatttttagcatttt

SEQ ID NO: 107642 - DNA, 27 bp, Artificial sequence
  SiRNA target sequence
acaacttgcaaaatttttagcattttg

SEQ ID NO: 107643 - DNA, 27 bp, Artificial sequence
  SiRNA target sequence
caacttgcaaaatttttagcattttgt

SEQ ID NO: 107644 - DNA, 27 bp, Artificial sequence
  SiRNA target sequence
aacttgcaaaatttttagcattttgta

SEQ ID NO: 107645 - DNA, 27 bp, Artificial sequence
  SiRNA target sequence
acttgcaaaatttttagcattttgtag

SEQ ID NO: 107646 - DNA, 27 bp, Artificial sequence
  SiRNA target sequence
cttgcaaaatttttagcattttgtagt

SEQ ID NO: 107647 - DNA, 27 bp, Artificial sequence
  SiRNA target sequence
ttgcaaaatttttagcattttgtagtt

SEQ ID NO: 107648 - DNA, 27 bp, Artificial sequence
  SiRNA target sequence
tgcaaaatttttagcattttgtagttt

SEQ ID NO: 107649 - DNA, 27 bp, Artificial sequence
  SiRNA target sequence
gcaaaatttttagcattttgtagtttg

SEQ ID NO: 107650 - DNA, 27 bp, Artificial sequence
  SiRNA target sequence
caaaatttttagcattttgtagtttgt

SEQ ID NO: 107651 - DNA, 27 bp, Artificial sequence
  SiRNA target sequence
aaaatttttagcattttgtagtttgta

SEQ ID NO: 107652 - DNA, 27 bp, Artificial sequence
  SiRNA target sequence
aaatttttagcattttgtagtttgtaa

SEQ ID NO: 107653 - DNA, 27 bp, Artificial sequence
  SiRNA target sequence
aatttttagcattttgtagtttgtaat

SEQ ID NO: 107654 - DNA, 27 bp, Artificial sequence
  SiRNA target sequence
atttttagcattttgtagtttgtaatg

SEQ ID NO: 107655 - DNA, 27 bp, Artificial sequence
  SiRNA target sequence
tttttagcattttgtagtttgtaatgc

SEQ ID NO: 107656 - DNA, 27 bp, Artificial sequence
  SiRNA target sequence
ttttagcattttgtagtttgtaatgcg

SEQ ID NO: 107657 - DNA, 27 bp, Artificial sequence
  SiRNA target sequence
tttagcattttgtagtttgtaatgcgg

SEQ ID NO: 107658 - DNA, 27 bp, Artificial sequence
  SiRNA target sequence
ttagcattttgtagtttgtaatgcggt

SEQ ID NO: 107659 - DNA, 27 bp, Artificial sequence
  SiRNA target sequence
tagcattttgtagtttgtaatgcggta

SEQ ID NO: 107660 - DNA, 27 bp, Artificial sequence
  SiRNA target sequence
agcattttgtagtttgtaatgcggtaa

SEQ ID NO: 107661 - DNA, 27 bp, Artificial sequence
  SiRNA target sequence
gcattttgtagtttgtaatgcggtaat

SEQ ID NO: 107662 - DNA, 27 bp, Artificial sequence
  SiRNA target sequence
cattttgtagtttgtaatgcggtaata

SEQ ID NO: 107663 - DNA, 27 bp, Artificial sequence
  SiRNA target sequence
attttgtagtttgtaatgcggtaatat

SEQ ID NO: 107664 - DNA, 27 bp, Artificial sequence
  SiRNA target sequence
ttttgtagtttgtaatgcggtaatata

SEQ ID NO: 107665 - DNA, 27 bp, Artificial sequence
  SiRNA target sequence
tttgtagtttgtaatgcggtaatatat

SEQ ID NO: 107666 - DNA, 27 bp, Artificial sequence
  SiRNA target sequence
ttgtagtttgtaatgcggtaatatata

SEQ ID NO: 107667 - DNA, 27 bp, Artificial sequence
  SiRNA target sequence
tgtagtttgtaatgcggtaatatataa

SEQ ID NO: 107668 - DNA, 27 bp, Artificial sequence
  SiRNA target sequence
gtagtttgtaatgcggtaatatataat

SEQ ID NO: 107669 - DNA, 27 bp, Artificial sequence
  SiRNA target sequence
tagtttgtaatgcggtaatatataata

SEQ ID NO: 107670 - DNA, 27 bp, Artificial sequence
  SiRNA target sequence
agtttgtaatgcggtaatatataatat

SEQ ID NO: 107671 - DNA, 27 bp, Artificial sequence
  SiRNA target sequence
gtttgtaatgcggtaatatataatata

SEQ ID NO: 107672 - DNA, 27 bp, Artificial sequence
  SiRNA target sequence
tttgtaatgcggtaatatataatatag

SEQ ID NO: 107673 - DNA, 27 bp, Artificial sequence
  SiRNA target sequence
ttgtaatgcggtaatatataatataga

SEQ ID NO: 107674 - DNA, 27 bp, Artificial sequence
  SiRNA target sequence
tgtaatgcggtaatatataatatagat

SEQ ID NO: 107675 - DNA, 27 bp, Artificial sequence
  SiRNA target sequence
gtaatgcggtaatatataatatagatc

SEQ ID NO: 107676 - DNA, 27 bp, Artificial sequence
  SiRNA target sequence
taatgcggtaatatataatatagatct

SEQ ID NO: 107677 - DNA, 27 bp, Artificial sequence
  SiRNA target sequence
aatgcggtaatatataatatagatctt

SEQ ID NO: 107678 - DNA, 27 bp, Artificial sequence
  SiRNA target sequence
atgcggtaatatataatatagatcttt

SEQ ID NO: 107679 - DNA, 27 bp, Artificial sequence
  SiRNA target sequence
tgcggtaatatataatatagatctttt

SEQ ID NO: 107680 - DNA, 27 bp, Artificial sequence
  SiRNA target sequence
gcggtaatatataatatagatctttta

SEQ ID NO: 107681 - DNA, 27 bp, Artificial sequence
  SiRNA target sequence
cggtaatatataatatagatcttttat

SEQ ID NO: 107682 - DNA, 27 bp, Artificial sequence
  SiRNA target sequence
ggtaatatataatatagatcttttatc

SEQ ID NO: 107683 - DNA, 27 bp, Artificial sequence
  SiRNA target sequence
gtaatatataatatagatcttttatcc

SEQ ID NO: 107684 - DNA, 27 bp, Artificial sequence
  SiRNA target sequence
taatatataatatagatcttttatcca

SEQ ID NO: 107685 - DNA, 27 bp, Artificial sequence
  SiRNA target sequence
aatatataatatagatcttttatccat

SEQ ID NO: 107686 - DNA, 27 bp, Artificial sequence
  SiRNA target sequence
atatataatatagatcttttatccatg

SEQ ID NO: 107687 - DNA, 27 bp, Artificial sequence
  SiRNA target sequence
tatataatatagatcttttatccatgt

SEQ ID NO: 107688 - DNA, 27 bp, Artificial sequence
  SiRNA target sequence
atataatatagatcttttatccatgtc

SEQ ID NO: 107689 - DNA, 27 bp, Artificial sequence
  SiRNA target sequence
tataatatagatcttttatccatgtct

SEQ ID NO: 107690 - DNA, 27 bp, Artificial sequence
  SiRNA target sequence
ataatatagatcttttatccatgtctt

SEQ ID NO: 107691 - DNA, 27 bp, Artificial sequence
  SiRNA target sequence
taatatagatcttttatccatgtctta

SEQ ID NO: 107692 - DNA, 27 bp, Artificial sequence
  SiRNA target sequence
aatatagatcttttatccatgtcttaa

SEQ ID NO: 107693 - DNA, 27 bp, Artificial sequence
  SiRNA target sequence
atatagatcttttatccatgtcttaaa

SEQ ID NO: 107694 - DNA, 27 bp, Artificial sequence
  SiRNA target sequence
tatagatcttttatccatgtcttaaat

SEQ ID NO: 107695 - DNA, 27 bp, Artificial sequence
  SiRNA target sequence
atagatcttttatccatgtcttaaatt

SEQ ID NO: 107696 - DNA, 27 bp, Artificial sequence
  SiRNA target sequence
tagatcttttatccatgtcttaaattc

SEQ ID NO: 107697 - DNA, 27 bp, Artificial sequence
  SiRNA target sequence
agatcttttatccatgtcttaaattcg

SEQ ID NO: 107698 - DNA, 27 bp, Artificial sequence
  SiRNA target sequence
gatcttttatccatgtcttaaattcgc

SEQ ID NO: 107699 - DNA, 27 bp, Artificial sequence
  SiRNA target sequence
atcttttatccatgtcttaaattcgcc

SEQ ID NO: 107700 - DNA, 27 bp, Artificial sequence
  SiRNA target sequence
tcttttatccatgtcttaaattcgccc

SEQ ID NO: 107701 - DNA, 27 bp, Artificial sequence
  SiRNA target sequence
cttttatccatgtcttaaattcgccca

SEQ ID NO: 107702 - DNA, 27 bp, Artificial sequence
  SiRNA target sequence
ttttatccatgtcttaaattcgcccat

SEQ ID NO: 107703 - DNA, 27 bp, Artificial sequence
  SiRNA target sequence
tttatccatgtcttaaattcgcccata

SEQ ID NO: 107704 - DNA, 27 bp, Artificial sequence
  SiRNA target sequence
ttatccatgtcttaaattcgcccataa

SEQ ID NO: 107705 - DNA, 27 bp, Artificial sequence
  SiRNA target sequence
tatccatgtcttaaattcgcccataaa

SEQ ID NO: 107706 - DNA, 27 bp, Artificial sequence
  SiRNA target sequence
atccatgtcttaaattcgcccataaat

SEQ ID NO: 107707 - DNA, 27 bp, Artificial sequence
  SiRNA target sequence
tccatgtcttaaattcgcccataaatc

SEQ ID NO: 107708 - DNA, 27 bp, Artificial sequence
  SiRNA target sequence
ccatgtcttaaattcgcccataaatcc

SEQ ID NO: 107709 - DNA, 27 bp, Artificial sequence
  SiRNA target sequence
catgtcttaaattcgcccataaatcct

SEQ ID NO: 107710 - DNA, 27 bp, Artificial sequence
  SiRNA target sequence
atgtcttaaattcgcccataaatcctt

SEQ ID NO: 107711 - DNA, 27 bp, Artificial sequence
  SiRNA target sequence
tgtcttaaattcgcccataaatccttc

SEQ ID NO: 107712 - DNA, 27 bp, Artificial sequence
  SiRNA target sequence
gtcttaaattcgcccataaatccttct

SEQ ID NO: 107713 - DNA, 27 bp, Artificial sequence
  SiRNA target sequence
tcttaaattcgcccataaatccttctt

SEQ ID NO: 107714 - DNA, 27 bp, Artificial sequence
  SiRNA target sequence
cttaaattcgcccataaatccttcttt

SEQ ID NO: 107715 - DNA, 27 bp, Artificial sequence
  SiRNA target sequence
ttaaattcgcccataaatccttctttg

SEQ ID NO: 107716 - DNA, 27 bp, Artificial sequence
  SiRNA target sequence
taaattcgcccataaatccttctttgt

SEQ ID NO: 107717 - DNA, 27 bp, Artificial sequence
  SiRNA target sequence
aaattcgcccataaatccttctttgtc

SEQ ID NO: 107718 - DNA, 27 bp, Artificial sequence
  SiRNA target sequence
aattcgcccataaatccttctttgtct

SEQ ID NO: 107719 - DNA, 27 bp, Artificial sequence
  SiRNA target sequence
attcgcccataaatccttctttgtctt

SEQ ID NO: 107720 - DNA, 27 bp, Artificial sequence
  SiRNA target sequence
ttcgcccataaatccttctttgtcttg

SEQ ID NO: 107721 - DNA, 27 bp, Artificial sequence
  SiRNA target sequence
tcgcccataaatccttctttgtcttgg

SEQ ID NO: 107722 - DNA, 27 bp, Artificial sequence
  SiRNA target sequence
cgcccataaatccttctttgtcttggc

SEQ ID NO: 107723 - DNA, 27 bp, Artificial sequence
  SiRNA target sequence
gcccataaatccttctttgtcttggct

SEQ ID NO: 107724 - DNA, 27 bp, Artificial sequence
  SiRNA target sequence
cccataaatccttctttgtcttggcta

SEQ ID NO: 107725 - DNA, 27 bp, Artificial sequence
  SiRNA target sequence
ccataaatccttctttgtcttggctat

SEQ ID NO: 107726 - DNA, 27 bp, Artificial sequence
  SiRNA target sequence
cataaatccttctttgtcttggctatc

SEQ ID NO: 107727 - DNA, 27 bp, Artificial sequence
  SiRNA target sequence
ataaatccttctttgtcttggctatct

SEQ ID NO: 107728 - DNA, 27 bp, Artificial sequence
  SiRNA target sequence
taaatccttctttgtcttggctatctc

SEQ ID NO: 107729 - DNA, 27 bp, Artificial sequence
  SiRNA target sequence
aaatccttctttgtcttggctatctcc

SEQ ID NO: 107730 - DNA, 27 bp, Artificial sequence
  SiRNA target sequence
aatccttctttgtcttggctatctcca

SEQ ID NO: 107731 - DNA, 27 bp, Artificial sequence
  SiRNA target sequence
atccttctttgtcttggctatctccat

SEQ ID NO: 107732 - DNA, 27 bp, Artificial sequence
  SiRNA target sequence
tccttctttgtcttggctatctccatt

SEQ ID NO: 107733 - DNA, 27 bp, Artificial sequence
  SiRNA target sequence
ccttctttgtcttggctatctccatta

SEQ ID NO: 107734 - DNA, 27 bp, Artificial sequence
  SiRNA target sequence
cttctttgtcttggctatctccattac

SEQ ID NO: 107735 - DNA, 27 bp, Artificial sequence
  SiRNA target sequence
ttctttgtcttggctatctccattacc

SEQ ID NO: 107736 - DNA, 27 bp, Artificial sequence
  SiRNA target sequence
tctttgtcttggctatctccattaccc

SEQ ID NO: 107737 - DNA, 27 bp, Artificial sequence
  SiRNA target sequence
ctttgtcttggctatctccattaccct

SEQ ID NO: 107738 - DNA, 27 bp, Artificial sequence
  SiRNA target sequence
tttgtcttggctatctccattaccctt

SEQ ID NO: 107739 - DNA, 27 bp, Artificial sequence
  SiRNA target sequence
ttgtcttggctatctccattacccttt

SEQ ID NO: 107740 - DNA, 27 bp, Artificial sequence
  SiRNA target sequence
tgtcttggctatctccattaccctttc

SEQ ID NO: 107741 - DNA, 27 bp, Artificial sequence
  SiRNA target sequence
gtcttggctatctccattaccctttct

SEQ ID NO: 107742 - DNA, 27 bp, Artificial sequence
  SiRNA target sequence
tcttggctatctccattaccctttctt

SEQ ID NO: 107743 - DNA, 27 bp, Artificial sequence
  SiRNA target sequence
cttggctatctccattaccctttctta

SEQ ID NO: 107744 - DNA, 27 bp, Artificial sequence
  SiRNA target sequence
ttggctatctccattaccctttcttat

SEQ ID NO: 107745 - DNA, 27 bp, Artificial sequence
  SiRNA target sequence
tggctatctccattaccctttcttatc

SEQ ID NO: 107746 - DNA, 27 bp, Artificial sequence
  SiRNA target sequence
ggctatctccattaccctttcttatca

SEQ ID NO: 107747 - DNA, 27 bp, Artificial sequence
  SiRNA target sequence
gctatctccattaccctttcttatcag

SEQ ID NO: 107748 - DNA, 27 bp, Artificial sequence
  SiRNA target sequence
ctatctccattaccctttcttatcaga

SEQ ID NO: 107749 - DNA, 27 bp, Artificial sequence
  SiRNA target sequence
tatctccattaccctttcttatcagag

SEQ ID NO: 107750 - DNA, 27 bp, Artificial sequence
  SiRNA target sequence
atctccattaccctttcttatcagagg

SEQ ID NO: 107751 - DNA, 27 bp, Artificial sequence
  SiRNA target sequence
tctccattaccctttcttatcagaggt

SEQ ID NO: 107752 - DNA, 27 bp, Artificial sequence
  SiRNA target sequence
ctccattaccctttcttatcagaggtt

SEQ ID NO: 107753 - DNA, 27 bp, Artificial sequence
  SiRNA target sequence
tccattaccctttcttatcagaggttt

SEQ ID NO: 107754 - DNA, 27 bp, Artificial sequence
  SiRNA target sequence
ccattaccctttcttatcagaggttta

SEQ ID NO: 107755 - DNA, 27 bp, Artificial sequence
  SiRNA target sequence
cattaccctttcttatcagaggtttag

SEQ ID NO: 107756 - DNA, 27 bp, Artificial sequence
  SiRNA target sequence
attaccctttcttatcagaggtttagc

SEQ ID NO: 107757 - DNA, 27 bp, Artificial sequence
  SiRNA target sequence
ttaccctttcttatcagaggtttagct

SEQ ID NO: 107758 - DNA, 27 bp, Artificial sequence
  SiRNA target sequence
taccctttcttatcagaggtttagctc

SEQ ID NO: 107759 - DNA, 27 bp, Artificial sequence
  SiRNA target sequence
accctttcttatcagaggtttagctcc

SEQ ID NO: 107760 - DNA, 27 bp, Artificial sequence
  SiRNA target sequence
ccctttcttatcagaggtttagctccg

SEQ ID NO: 107761 - DNA, 27 bp, Artificial sequence
  SiRNA target sequence
cctttcttatcagaggtttagctccgt

SEQ ID NO: 107762 - DNA, 27 bp, Artificial sequence
  SiRNA target sequence
ctttcttatcagaggtttagctccgtg

SEQ ID NO: 107763 - DNA, 27 bp, Artificial sequence
  SiRNA target sequence
tttcttatcagaggtttagctccgtgt

SEQ ID NO: 107764 - DNA, 27 bp, Artificial sequence
  SiRNA target sequence
ttcttatcagaggtttagctccgtgtt

SEQ ID NO: 107765 - DNA, 27 bp, Artificial sequence
  SiRNA target sequence
tcttatcagaggtttagctccgtgttt

SEQ ID NO: 107766 - DNA, 27 bp, Artificial sequence
  SiRNA target sequence
cttatcagaggtttagctccgtgtttt

SEQ ID NO: 107767 - DNA, 27 bp, Artificial sequence
  SiRNA target sequence
ttatcagaggtttagctccgtgtttta

SEQ ID NO: 107768 - DNA, 27 bp, Artificial sequence
  SiRNA target sequence
tatcagaggtttagctccgtgttttaa

SEQ ID NO: 107769 - DNA, 27 bp, Artificial sequence
  SiRNA target sequence
atcagaggtttagctccgtgttttaaa

SEQ ID NO: 107770 - DNA, 27 bp, Artificial sequence
  SiRNA target sequence
tcagaggtttagctccgtgttttaaaa

SEQ ID NO: 107771 - DNA, 27 bp, Artificial sequence
  SiRNA target sequence
cagaggtttagctccgtgttttaaaag

SEQ ID NO: 107772 - DNA, 27 bp, Artificial sequence
  SiRNA target sequence
agaggtttagctccgtgttttaaaagg

SEQ ID NO: 107773 - DNA, 27 bp, Artificial sequence
  SiRNA target sequence
gaggtttagctccgtgttttaaaaggc

SEQ ID NO: 107774 - DNA, 27 bp, Artificial sequence
  SiRNA target sequence
aggtttagctccgtgttttaaaaggca

SEQ ID NO: 107775 - DNA, 27 bp, Artificial sequence
  SiRNA target sequence
ggtttagctccgtgttttaaaaggcaa

SEQ ID NO: 107776 - DNA, 27 bp, Artificial sequence
  SiRNA target sequence
gtttagctccgtgttttaaaaggcaat

SEQ ID NO: 107777 - DNA, 27 bp, Artificial sequence
  SiRNA target sequence
tttagctccgtgttttaaaaggcaatt

SEQ ID NO: 107778 - DNA, 27 bp, Artificial sequence
  SiRNA target sequence
ttagctccgtgttttaaaaggcaatta

SEQ ID NO: 107779 - DNA, 27 bp, Artificial sequence
  SiRNA target sequence
tagctccgtgttttaaaaggcaattat

SEQ ID NO: 107780 - DNA, 27 bp, Artificial sequence
  SiRNA target sequence
agctccgtgttttaaaaggcaattata

SEQ ID NO: 107781 - DNA, 27 bp, Artificial sequence
  SiRNA target sequence
gctccgtgttttaaaaggcaattatac

SEQ ID NO: 107782 - DNA, 27 bp, Artificial sequence
  SiRNA target sequence
ctccgtgttttaaaaggcaattataca

SEQ ID NO: 107783 - DNA, 27 bp, Artificial sequence
  SiRNA target sequence
tccgtgttttaaaaggcaattatacaa

SEQ ID NO: 107784 - DNA, 27 bp, Artificial sequence
  SiRNA target sequence
ccgtgttttaaaaggcaattatacaac

SEQ ID NO: 107785 - DNA, 27 bp, Artificial sequence
  SiRNA target sequence
cgtgttttaaaaggcaattatacaact

SEQ ID NO: 107786 - DNA, 27 bp, Artificial sequence
  SiRNA target sequence
gtgttttaaaaggcaattatacaactt

SEQ ID NO: 107787 - DNA, 27 bp, Artificial sequence
  SiRNA target sequence
tgttttaaaaggcaattatacaacttt

SEQ ID NO: 107788 - DNA, 27 bp, Artificial sequence
  SiRNA target sequence
gttttaaaaggcaattatacaactttt

SEQ ID NO: 107789 - DNA, 27 bp, Artificial sequence
  SiRNA target sequence
ttttaaaaggcaattatacaacttttt

SEQ ID NO: 107790 - DNA, 27 bp, Artificial sequence
  SiRNA target sequence
tttaaaaggcaattatacaacttttta

SEQ ID NO: 107791 - DNA, 27 bp, Artificial sequence
  SiRNA target sequence
ttaaaaggcaattatacaactttttag

SEQ ID NO: 107792 - DNA, 27 bp, Artificial sequence
  SiRNA target sequence
taaaaggcaattatacaactttttaga

SEQ ID NO: 107793 - DNA, 27 bp, Artificial sequence
  SiRNA target sequence
aaaaggcaattatacaactttttagaa

SEQ ID NO: 107794 - DNA, 27 bp, Artificial sequence
  SiRNA target sequence
aaaggcaattatacaactttttagaac

SEQ ID NO: 107795 - DNA, 27 bp, Artificial sequence
  SiRNA target sequence
aaggcaattatacaactttttagaaca

SEQ ID NO: 107796 - DNA, 27 bp, Artificial sequence
  SiRNA target sequence
aggcaattatacaactttttagaacaa

SEQ ID NO: 107797 - DNA, 27 bp, Artificial sequence
  SiRNA target sequence
ggcaattatacaactttttagaacaaa

SEQ ID NO: 107798 - DNA, 27 bp, Artificial sequence
  SiRNA target sequence
gcaattatacaactttttagaacaaaa

SEQ ID NO: 107799 - DNA, 27 bp, Artificial sequence
  SiRNA target sequence
caattatacaactttttagaacaaaaa

SEQ ID NO: 107800 - DNA, 27 bp, Artificial sequence
  SiRNA target sequence
aattatacaactttttagaacaaaaat

SEQ ID NO: 107801 - DNA, 27 bp, Artificial sequence
  SiRNA target sequence
attatacaactttttagaacaaaaatt

SEQ ID NO: 107802 - DNA, 27 bp, Artificial sequence
  SiRNA target sequence
ttatacaactttttagaacaaaaatta

SEQ ID NO: 107803 - DNA, 27 bp, Artificial sequence
  SiRNA target sequence
tatacaactttttagaacaaaaattaa

SEQ ID NO: 107804 - DNA, 27 bp, Artificial sequence
  SiRNA target sequence
atacaactttttagaacaaaaattaaa

SEQ ID NO: 107805 - DNA, 27 bp, Artificial sequence
  SiRNA target sequence
tacaactttttagaacaaaaattaaaa

SEQ ID NO: 107806 - DNA, 27 bp, Artificial sequence
  SiRNA target sequence
acaactttttagaacaaaaattaaaag

SEQ ID NO: 107807 - DNA, 27 bp, Artificial sequence
  SiRNA target sequence
caactttttagaacaaaaattaaaaga

SEQ ID NO: 107808 - DNA, 27 bp, Artificial sequence
  SiRNA target sequence
aactttttagaacaaaaattaaaagat

SEQ ID NO: 107809 - DNA, 27 bp, Artificial sequence
  SiRNA target sequence
actttttagaacaaaaattaaaagatt

SEQ ID NO: 107810 - DNA, 27 bp, Artificial sequence
  SiRNA target sequence
ctttttagaacaaaaattaaaagattt

SEQ ID NO: 107811 - DNA, 27 bp, Artificial sequence
  SiRNA target sequence
tttttagaacaaaaattaaaagattta

SEQ ID NO: 107812 - DNA, 27 bp, Artificial sequence
  SiRNA target sequence
ttttagaacaaaaattaaaagatttat

SEQ ID NO: 107813 - DNA, 27 bp, Artificial sequence
  SiRNA target sequence
tttagaacaaaaattaaaagatttata

SEQ ID NO: 107814 - DNA, 27 bp, Artificial sequence
  SiRNA target sequence
ttagaacaaaaattaaaagatttataa

SEQ ID NO: 107815 - DNA, 27 bp, Artificial sequence
  SiRNA target sequence
tagaacaaaaattaaaagatttataag

SEQ ID NO: 107816 - DNA, 27 bp, Artificial sequence
  SiRNA target sequence
agaacaaaaattaaaagatttataaga

SEQ ID NO: 107817 - DNA, 27 bp, Artificial sequence
  SiRNA target sequence
gaacaaaaattaaaagatttataagac

SEQ ID NO: 107818 - DNA, 27 bp, Artificial sequence
  SiRNA target sequence
aacaaaaattaaaagatttataagacg

SEQ ID NO: 107819 - DNA, 27 bp, Artificial sequence
  SiRNA target sequence
acaaaaattaaaagatttataagacga

SEQ ID NO: 107820 - DNA, 27 bp, Artificial sequence
  SiRNA target sequence
caaaaattaaaagatttataagacgaa

SEQ ID NO: 107821 - DNA, 27 bp, Artificial sequence
  SiRNA target sequence
aaaaattaaaagatttataagacgaat

SEQ ID NO: 107822 - DNA, 27 bp, Artificial sequence
  SiRNA target sequence
aaaattaaaagatttataagacgaatc

SEQ ID NO: 107823 - DNA, 27 bp, Artificial sequence
  SiRNA target sequence
aaattaaaagatttataagacgaatcc

SEQ ID NO: 107824 - DNA, 27 bp, Artificial sequence
  SiRNA target sequence
aattaaaagatttataagacgaatccc

SEQ ID NO: 107825 - DNA, 27 bp, Artificial sequence
  SiRNA target sequence
attaaaagatttataagacgaatcccc

SEQ ID NO: 107826 - DNA, 27 bp, Artificial sequence
  SiRNA target sequence
ttaaaagatttataagacgaatcccca

SEQ ID NO: 107827 - DNA, 27 bp, Artificial sequence
  SiRNA target sequence
taaaagatttataagacgaatccccaa

SEQ ID NO: 107828 - DNA, 27 bp, Artificial sequence
  SiRNA target sequence
aaaagatttataagacgaatccccaag

SEQ ID NO: 107829 - DNA, 27 bp, Artificial sequence
  SiRNA target sequence
aaagatttataagacgaatccccaagg

SEQ ID NO: 107830 - DNA, 27 bp, Artificial sequence
  SiRNA target sequence
aagatttataagacgaatccccaaggc

SEQ ID NO: 107831 - DNA, 27 bp, Artificial sequence
  SiRNA target sequence
agatttataagacgaatccccaaggcc

SEQ ID NO: 107832 - DNA, 27 bp, Artificial sequence
  SiRNA target sequence
gatttataagacgaatccccaaggcca

SEQ ID NO: 107833 - DNA, 27 bp, Artificial sequence
  SiRNA target sequence
atttataagacgaatccccaaggccaa

SEQ ID NO: 107834 - DNA, 27 bp, Artificial sequence
  SiRNA target sequence
tttataagacgaatccccaaggccaaa

SEQ ID NO: 107835 - DNA, 27 bp, Artificial sequence
  SiRNA target sequence
ttataagacgaatccccaaggccaaat

SEQ ID NO: 107836 - DNA, 27 bp, Artificial sequence
  SiRNA target sequence
tataagacgaatccccaaggccaaata

SEQ ID NO: 107837 - DNA, 27 bp, Artificial sequence
  SiRNA target sequence
ataagacgaatccccaaggccaaatac

SEQ ID NO: 107838 - DNA, 27 bp, Artificial sequence
  SiRNA target sequence
taagacgaatccccaaggccaaataca

SEQ ID NO: 107839 - DNA, 27 bp, Artificial sequence
  SiRNA target sequence
aagacgaatccccaaggccaaatacag

SEQ ID NO: 107840 - DNA, 27 bp, Artificial sequence
  SiRNA target sequence
agacgaatccccaaggccaaatacagc

SEQ ID NO: 107841 - DNA, 27 bp, Artificial sequence
  SiRNA target sequence
gacgaatccccaaggccaaatacagca

SEQ ID NO: 107842 - DNA, 27 bp, Artificial sequence
  SiRNA target sequence
acgaatccccaaggccaaatacagcaa

SEQ ID NO: 107843 - DNA, 27 bp, Artificial sequence
  SiRNA target sequence
cgaatccccaaggccaaatacagcaaa

SEQ ID NO: 107844 - DNA, 27 bp, Artificial sequence
  SiRNA target sequence
gaatccccaaggccaaatacagcaaaa

SEQ ID NO: 107845 - DNA, 27 bp, Artificial sequence
  SiRNA target sequence
aatccccaaggccaaatacagcaaaat

SEQ ID NO: 107846 - DNA, 27 bp, Artificial sequence
  SiRNA target sequence
atccccaaggccaaatacagcaaaatt

SEQ ID NO: 107847 - DNA, 27 bp, Artificial sequence
  SiRNA target sequence
tccccaaggccaaatacagcaaaattt

SEQ ID NO: 107848 - DNA, 27 bp, Artificial sequence
  SiRNA target sequence
ccccaaggccaaatacagcaaaattta

SEQ ID NO: 107849 - DNA, 27 bp, Artificial sequence
  SiRNA target sequence
cccaaggccaaatacagcaaaatttaa

SEQ ID NO: 107850 - DNA, 27 bp, Artificial sequence
  SiRNA target sequence
ccaaggccaaatacagcaaaatttaag

SEQ ID NO: 107851 - DNA, 27 bp, Artificial sequence
  SiRNA target sequence
caaggccaaatacagcaaaatttaagt

SEQ ID NO: 107852 - DNA, 27 bp, Artificial sequence
  SiRNA target sequence
aaggccaaatacagcaaaatttaagtg

SEQ ID NO: 107853 - DNA, 27 bp, Artificial sequence
  SiRNA target sequence
aggccaaatacagcaaaatttaagtgt

SEQ ID NO: 107854 - DNA, 27 bp, Artificial sequence
  SiRNA target sequence
ggccaaatacagcaaaatttaagtgtt

SEQ ID NO: 107855 - DNA, 27 bp, Artificial sequence
  SiRNA target sequence
gccaaatacagcaaaatttaagtgttg

SEQ ID NO: 107856 - DNA, 27 bp, Artificial sequence
  SiRNA target sequence
ccaaatacagcaaaatttaagtgttgt

SEQ ID NO: 107857 - DNA, 27 bp, Artificial sequence
  SiRNA target sequence
caaatacagcaaaatttaagtgttgta

SEQ ID NO: 107858 - DNA, 27 bp, Artificial sequence
  SiRNA target sequence
aaatacagcaaaatttaagtgttgtaa

SEQ ID NO: 107859 - DNA, 27 bp, Artificial sequence
  SiRNA target sequence
aatacagcaaaatttaagtgttgtaaa

SEQ ID NO: 107860 - DNA, 27 bp, Artificial sequence
  SiRNA target sequence
atacagcaaaatttaagtgttgtaaaa

SEQ ID NO: 107861 - DNA, 27 bp, Artificial sequence
  SiRNA target sequence
tacagcaaaatttaagtgttgtaaaaa

SEQ ID NO: 107862 - DNA, 27 bp, Artificial sequence
  SiRNA target sequence
acagcaaaatttaagtgttgtaaaaaa

SEQ ID NO: 107863 - DNA, 27 bp, Artificial sequence
  SiRNA target sequence
cagcaaaatttaagtgttgtaaaaaat

SEQ ID NO: 107864 - DNA, 27 bp, Artificial sequence
  SiRNA target sequence
agcaaaatttaagtgttgtaaaaaatt

SEQ ID NO: 107865 - DNA, 27 bp, Artificial sequence
  SiRNA target sequence
gcaaaatttaagtgttgtaaaaaattt

SEQ ID NO: 107866 - DNA, 27 bp, Artificial sequence
  SiRNA target sequence
caaaatttaagtgttgtaaaaaatttg

SEQ ID NO: 107867 - DNA, 27 bp, Artificial sequence
  SiRNA target sequence
aaaatttaagtgttgtaaaaaatttgt

SEQ ID NO: 107868 - DNA, 27 bp, Artificial sequence
  SiRNA target sequence
aaatttaagtgttgtaaaaaatttgta

SEQ ID NO: 107869 - DNA, 27 bp, Artificial sequence
  SiRNA target sequence
aatttaagtgttgtaaaaaatttgtag

SEQ ID NO: 107870 - DNA, 27 bp, Artificial sequence
  SiRNA target sequence
atttaagtgttgtaaaaaatttgtagg

SEQ ID NO: 107871 - DNA, 27 bp, Artificial sequence
  SiRNA target sequence
tttaagtgttgtaaaaaatttgtaggc

SEQ ID NO: 107872 - DNA, 27 bp, Artificial sequence
  SiRNA target sequence
ttaagtgttgtaaaaaatttgtaggca

SEQ ID NO: 107873 - DNA, 27 bp, Artificial sequence
  SiRNA target sequence
taagtgttgtaaaaaatttgtaggcag

SEQ ID NO: 107874 - DNA, 27 bp, Artificial sequence
  SiRNA target sequence
aagtgttgtaaaaaatttgtaggcaga

SEQ ID NO: 107875 - DNA, 27 bp, Artificial sequence
  SiRNA target sequence
agtgttgtaaaaaatttgtaggcagat

SEQ ID NO: 107876 - DNA, 27 bp, Artificial sequence
  SiRNA target sequence
gtgttgtaaaaaatttgtaggcagatt

SEQ ID NO: 107877 - DNA, 27 bp, Artificial sequence
  SiRNA target sequence
tgttgtaaaaaatttgtaggcagattt

SEQ ID NO: 107878 - DNA, 27 bp, Artificial sequence
  SiRNA target sequence
gttgtaaaaaatttgtaggcagatttt

SEQ ID NO: 107879 - DNA, 27 bp, Artificial sequence
  SiRNA target sequence
ttgtaaaaaatttgtaggcagattttt

SEQ ID NO: 107880 - DNA, 27 bp, Artificial sequence
  SiRNA target sequence
tgtaaaaaatttgtaggcagatttttt

SEQ ID NO: 107881 - DNA, 27 bp, Artificial sequence
  SiRNA target sequence
gtaaaaaatttgtaggcagattttttt

SEQ ID NO: 107882 - DNA, 27 bp, Artificial sequence
  SiRNA target sequence
taaaaaatttgtaggcagatttttttt

SEQ ID NO: 107883 - DNA, 27 bp, Artificial sequence
  SiRNA target sequence
aaaaaatttgtaggcagattttttttg

SEQ ID NO: 107884 - DNA, 27 bp, Artificial sequence
  SiRNA target sequence
aaaaatttgtaggcagattttttttgc

SEQ ID NO: 107885 - DNA, 27 bp, Artificial sequence
  SiRNA target sequence
aaaatttgtaggcagattttttttgcg

SEQ ID NO: 107886 - DNA, 27 bp, Artificial sequence
  SiRNA target sequence
aaatttgtaggcagattttttttgcgc

SEQ ID NO: 107887 - DNA, 27 bp, Artificial sequence
  SiRNA target sequence
aatttgtaggcagattttttttgcgca

SEQ ID NO: 107888 - DNA, 27 bp, Artificial sequence
  SiRNA target sequence
atttgtaggcagattttttttgcgcaa

SEQ ID NO: 107889 - DNA, 27 bp, Artificial sequence
  SiRNA target sequence
tttgtaggcagattttttttgcgcaaa

SEQ ID NO: 107890 - DNA, 27 bp, Artificial sequence
  SiRNA target sequence
ttgtaggcagattttttttgcgcaaaa

SEQ ID NO: 107891 - DNA, 27 bp, Artificial sequence
  SiRNA target sequence
tgtaggcagattttttttgcgcaaaaa

SEQ ID NO: 107892 - DNA, 27 bp, Artificial sequence
  SiRNA target sequence
gtaggcagattttttttgcgcaaaaat

SEQ ID NO: 107893 - DNA, 27 bp, Artificial sequence
  SiRNA target sequence
taggcagattttttttgcgcaaaaatt

SEQ ID NO: 107894 - DNA, 27 bp, Artificial sequence
  SiRNA target sequence
aggcagattttttttgcgcaaaaattt

SEQ ID NO: 107895 - DNA, 27 bp, Artificial sequence
  SiRNA target sequence
ggcagattttttttgcgcaaaaatttc

SEQ ID NO: 107896 - DNA, 27 bp, Artificial sequence
  SiRNA target sequence
gcagattttttttgcgcaaaaatttcc

SEQ ID NO: 107897 - DNA, 27 bp, Artificial sequence
  SiRNA target sequence
cagattttttttgcgcaaaaatttcca

SEQ ID NO: 107898 - DNA, 27 bp, Artificial sequence
  SiRNA target sequence
agattttttttgcgcaaaaatttccaa

SEQ ID NO: 107899 - DNA, 27 bp, Artificial sequence
  SiRNA target sequence
gattttttttgcgcaaaaatttccaaa

SEQ ID NO: 107900 - DNA, 27 bp, Artificial sequence
  SiRNA target sequence
attttttttgcgcaaaaatttccaaaa

SEQ ID NO: 107901 - DNA, 27 bp, Artificial sequence
  SiRNA target sequence
ttttttttgcgcaaaaatttccaaaat

SEQ ID NO: 107902 - DNA, 27 bp, Artificial sequence
  SiRNA target sequence
tttttttgcgcaaaaatttccaaaatt

SEQ ID NO: 107903 - DNA, 27 bp, Artificial sequence
  SiRNA target sequence
ttttttgcgcaaaaatttccaaaattt

SEQ ID NO: 107904 - DNA, 27 bp, Artificial sequence
  SiRNA target sequence
tttttgcgcaaaaatttccaaaattta

SEQ ID NO: 107905 - DNA, 27 bp, Artificial sequence
  SiRNA target sequence
ttttgcgcaaaaatttccaaaatttag

SEQ ID NO: 107906 - DNA, 27 bp, Artificial sequence
  SiRNA target sequence
tttgcgcaaaaatttccaaaatttagt

SEQ ID NO: 107907 - DNA, 27 bp, Artificial sequence
  SiRNA target sequence
ttgcgcaaaaatttccaaaatttagtc

SEQ ID NO: 107908 - DNA, 27 bp, Artificial sequence
  SiRNA target sequence
tgcgcaaaaatttccaaaatttagtca

SEQ ID NO: 107909 - DNA, 27 bp, Artificial sequence
  SiRNA target sequence
gcgcaaaaatttccaaaatttagtcat

SEQ ID NO: 107910 - DNA, 27 bp, Artificial sequence
  SiRNA target sequence
cgcaaaaatttccaaaatttagtcatg

SEQ ID NO: 107911 - DNA, 27 bp, Artificial sequence
  SiRNA target sequence
gcaaaaatttccaaaatttagtcatgt

SEQ ID NO: 107912 - DNA, 27 bp, Artificial sequence
  SiRNA target sequence
caaaaatttccaaaatttagtcatgtt

SEQ ID NO: 107913 - DNA, 27 bp, Artificial sequence
  SiRNA target sequence
aaaaatttccaaaatttagtcatgtta

SEQ ID NO: 107914 - DNA, 27 bp, Artificial sequence
  SiRNA target sequence
aaaatttccaaaatttagtcatgttaa

SEQ ID NO: 107915 - DNA, 27 bp, Artificial sequence
  SiRNA target sequence
aaatttccaaaatttagtcatgttaaa

SEQ ID NO: 107916 - DNA, 27 bp, Artificial sequence
  SiRNA target sequence
aatttccaaaatttagtcatgttaaaa

SEQ ID NO: 107917 - DNA, 27 bp, Artificial sequence
  SiRNA target sequence
atttccaaaatttagtcatgttaaaag

SEQ ID NO: 107918 - DNA, 27 bp, Artificial sequence
  SiRNA target sequence
tttccaaaatttagtcatgttaaaagg

SEQ ID NO: 107919 - DNA, 27 bp, Artificial sequence
  SiRNA target sequence
ttccaaaatttagtcatgttaaaaggt

SEQ ID NO: 107920 - DNA, 27 bp, Artificial sequence
  SiRNA target sequence
tccaaaatttagtcatgttaaaaggtt

SEQ ID NO: 107921 - DNA, 27 bp, Artificial sequence
  SiRNA target sequence
ccaaaatttagtcatgttaaaaggttc

SEQ ID NO: 107922 - DNA, 27 bp, Artificial sequence
  SiRNA target sequence
caaaatttagtcatgttaaaaggttca

SEQ ID NO: 107923 - DNA, 27 bp, Artificial sequence
  SiRNA target sequence
aaaatttagtcatgttaaaaggttcag

SEQ ID NO: 107924 - DNA, 27 bp, Artificial sequence
  SiRNA target sequence
aaatttagtcatgttaaaaggttcaga

SEQ ID NO: 107925 - DNA, 27 bp, Artificial sequence
  SiRNA target sequence
aatttagtcatgttaaaaggttcagaa

SEQ ID NO: 107926 - DNA, 27 bp, Artificial sequence
  SiRNA target sequence
atttagtcatgttaaaaggttcagaac

SEQ ID NO: 107927 - DNA, 27 bp, Artificial sequence
  SiRNA target sequence
tttagtcatgttaaaaggttcagaacc

SEQ ID NO: 107928 - DNA, 27 bp, Artificial sequence
  SiRNA target sequence
ttagtcatgttaaaaggttcagaacca

SEQ ID NO: 107929 - DNA, 27 bp, Artificial sequence
  SiRNA target sequence
tagtcatgttaaaaggttcagaaccat

SEQ ID NO: 107930 - DNA, 27 bp, Artificial sequence
  SiRNA target sequence
agtcatgttaaaaggttcagaaccatt

SEQ ID NO: 107931 - DNA, 27 bp, Artificial sequence
  SiRNA target sequence
gtcatgttaaaaggttcagaaccattc

SEQ ID NO: 107932 - DNA, 27 bp, Artificial sequence
  SiRNA target sequence
tcatgttaaaaggttcagaaccattcc

SEQ ID NO: 107933 - DNA, 27 bp, Artificial sequence
  SiRNA target sequence
catgttaaaaggttcagaaccattccc

SEQ ID NO: 107934 - DNA, 27 bp, Artificial sequence
  SiRNA target sequence
atgttaaaaggttcagaaccattccca

SEQ ID NO: 107935 - DNA, 27 bp, Artificial sequence
  SiRNA target sequence
tgttaaaaggttcagaaccattcccat

SEQ ID NO: 107936 - DNA, 27 bp, Artificial sequence
  SiRNA target sequence
gttaaaaggttcagaaccattcccatg

SEQ ID NO: 107937 - DNA, 27 bp, Artificial sequence
  SiRNA target sequence
ttaaaaggttcagaaccattcccatga

SEQ ID NO: 107938 - DNA, 27 bp, Artificial sequence
  SiRNA target sequence
taaaaggttcagaaccattcccatgag

SEQ ID NO: 107939 - DNA, 27 bp, Artificial sequence
  SiRNA target sequence
aaaaggttcagaaccattcccatgagt

SEQ ID NO: 107940 - DNA, 27 bp, Artificial sequence
  SiRNA target sequence
aaaggttcagaaccattcccatgagtc

SEQ ID NO: 107941 - DNA, 27 bp, Artificial sequence
  SiRNA target sequence
aaggttcagaaccattcccatgagtcg

SEQ ID NO: 107942 - DNA, 27 bp, Artificial sequence
  SiRNA target sequence
aggttcagaaccattcccatgagtcga

SEQ ID NO: 107943 - DNA, 27 bp, Artificial sequence
  SiRNA target sequence
ggttcagaaccattcccatgagtcgaa

SEQ ID NO: 107944 - DNA, 27 bp, Artificial sequence
  SiRNA target sequence
gttcagaaccattcccatgagtcgaac

SEQ ID NO: 107945 - DNA, 27 bp, Artificial sequence
  SiRNA target sequence
ttcagaaccattcccatgagtcgaaca

SEQ ID NO: 107946 - DNA, 27 bp, Artificial sequence
  SiRNA target sequence
tcagaaccattcccatgagtcgaacat

SEQ ID NO: 107947 - DNA, 27 bp, Artificial sequence
  SiRNA target sequence
cagaaccattcccatgagtcgaacata

SEQ ID NO: 107948 - DNA, 27 bp, Artificial sequence
  SiRNA target sequence
agaaccattcccatgagtcgaacatac

SEQ ID NO: 107949 - DNA, 27 bp, Artificial sequence
  SiRNA target sequence
gaaccattcccatgagtcgaacataca

SEQ ID NO: 107950 - DNA, 27 bp, Artificial sequence
  SiRNA target sequence
aaccattcccatgagtcgaacatacaa

SEQ ID NO: 107951 - DNA, 27 bp, Artificial sequence
  SiRNA target sequence
accattcccatgagtcgaacatacaaa

SEQ ID NO: 107952 - DNA, 27 bp, Artificial sequence
  SiRNA target sequence
ccattcccatgagtcgaacatacaaat

SEQ ID NO: 107953 - DNA, 27 bp, Artificial sequence
  SiRNA target sequence
cattcccatgagtcgaacatacaaata

SEQ ID NO: 107954 - DNA, 27 bp, Artificial sequence
  SiRNA target sequence
attcccatgagtcgaacatacaaatat

SEQ ID NO: 107955 - DNA, 27 bp, Artificial sequence
  SiRNA target sequence
ttcccatgagtcgaacatacaaatata

SEQ ID NO: 107956 - DNA, 27 bp, Artificial sequence
  SiRNA target sequence
tcccatgagtcgaacatacaaatataa

SEQ ID NO: 107957 - DNA, 27 bp, Artificial sequence
  SiRNA target sequence
cccatgagtcgaacatacaaatataat

SEQ ID NO: 107958 - DNA, 27 bp, Artificial sequence
  SiRNA target sequence
ccatgagtcgaacatacaaatataatc

SEQ ID NO: 107959 - DNA, 27 bp, Artificial sequence
  SiRNA target sequence
catgagtcgaacatacaaatataatca

SEQ ID NO: 107960 - DNA, 27 bp, Artificial sequence
  SiRNA target sequence
atgagtcgaacatacaaatataatcat

SEQ ID NO: 107961 - DNA, 27 bp, Artificial sequence
  SiRNA target sequence
tgagtcgaacatacaaatataatcata

SEQ ID NO: 107962 - DNA, 27 bp, Artificial sequence
  SiRNA target sequence
gagtcgaacatacaaatataatcatat

SEQ ID NO: 107963 - DNA, 27 bp, Artificial sequence
  SiRNA target sequence
agtcgaacatacaaatataatcatatc

SEQ ID NO: 107964 - DNA, 27 bp, Artificial sequence
  SiRNA target sequence
gtcgaacatacaaatataatcatatca

SEQ ID NO: 107965 - DNA, 27 bp, Artificial sequence
  SiRNA target sequence
tcgaacatacaaatataatcatatcaa

SEQ ID NO: 107966 - DNA, 27 bp, Artificial sequence
  SiRNA target sequence
cgaacatacaaatataatcatatcaat

SEQ ID NO: 107967 - DNA, 27 bp, Artificial sequence
  SiRNA target sequence
gaacatacaaatataatcatatcaata

SEQ ID NO: 107968 - DNA, 27 bp, Artificial sequence
  SiRNA target sequence
aacatacaaatataatcatatcaatat

SEQ ID NO: 107969 - DNA, 27 bp, Artificial sequence
  SiRNA target sequence
acatacaaatataatcatatcaatatc

SEQ ID NO: 107970 - DNA, 27 bp, Artificial sequence
  SiRNA target sequence
catacaaatataatcatatcaatatct

SEQ ID NO: 107971 - DNA, 27 bp, Artificial sequence
  SiRNA target sequence
atacaaatataatcatatcaatatcta

SEQ ID NO: 107972 - DNA, 27 bp, Artificial sequence
  SiRNA target sequence
tacaaatataatcatatcaatatctaa

SEQ ID NO: 107973 - DNA, 27 bp, Artificial sequence
  SiRNA target sequence
acaaatataatcatatcaatatctaat

SEQ ID NO: 107974 - DNA, 27 bp, Artificial sequence
  SiRNA target sequence
caaatataatcatatcaatatctaata

SEQ ID NO: 107975 - DNA, 27 bp, Artificial sequence
  SiRNA target sequence
aaatataatcatatcaatatctaatat

SEQ ID NO: 107976 - DNA, 27 bp, Artificial sequence
  SiRNA target sequence
aatataatcatatcaatatctaatatt

SEQ ID NO: 107977 - DNA, 27 bp, Artificial sequence
  SiRNA target sequence
atataatcatatcaatatctaatattt

SEQ ID NO: 107978 - DNA, 27 bp, Artificial sequence
  SiRNA target sequence
tataatcatatcaatatctaatatttt

SEQ ID NO: 107979 - DNA, 27 bp, Artificial sequence
  SiRNA target sequence
ataatcatatcaatatctaatattttt

SEQ ID NO: 107980 - DNA, 27 bp, Artificial sequence
  SiRNA target sequence
taatcatatcaatatctaatatttttt

SEQ ID NO: 107981 - DNA, 27 bp, Artificial sequence
  SiRNA target sequence
aatcatatcaatatctaatattttttc

SEQ ID NO: 107982 - DNA, 27 bp, Artificial sequence
  SiRNA target sequence
atcatatcaatatctaatattttttcg

SEQ ID NO: 107983 - DNA, 27 bp, Artificial sequence
  SiRNA target sequence
tcatatcaatatctaatattttttcga

SEQ ID NO: 107984 - DNA, 27 bp, Artificial sequence
  SiRNA target sequence
catatcaatatctaatattttttcgaa

SEQ ID NO: 107985 - DNA, 27 bp, Artificial sequence
  SiRNA target sequence
atatcaatatctaatattttttcgaaa

SEQ ID NO: 107986 - DNA, 27 bp, Artificial sequence
  SiRNA target sequence
tatcaatatctaatattttttcgaaat

SEQ ID NO: 107987 - DNA, 27 bp, Artificial sequence
  SiRNA target sequence
atcaatatctaatattttttcgaaatc

SEQ ID NO: 107988 - DNA, 27 bp, Artificial sequence
  SiRNA target sequence
tcaatatctaatattttttcgaaatca

SEQ ID NO: 107989 - DNA, 27 bp, Artificial sequence
  SiRNA target sequence
caatatctaatattttttcgaaatcaa

SEQ ID NO: 107990 - DNA, 27 bp, Artificial sequence
  SiRNA target sequence
aatatctaatattttttcgaaatcaaa

SEQ ID NO: 107991 - DNA, 27 bp, Artificial sequence
  SiRNA target sequence
atatctaatattttttcgaaatcaaaa

SEQ ID NO: 107992 - DNA, 27 bp, Artificial sequence
  SiRNA target sequence
tatctaatattttttcgaaatcaaaac

SEQ ID NO: 107993 - DNA, 27 bp, Artificial sequence
  SiRNA target sequence
atctaatattttttcgaaatcaaaact

SEQ ID NO: 107994 - DNA, 27 bp, Artificial sequence
  SiRNA target sequence
tctaatattttttcgaaatcaaaactg

SEQ ID NO: 107995 - DNA, 27 bp, Artificial sequence
  SiRNA target sequence
ctaatattttttcgaaatcaaaactgt

SEQ ID NO: 107996 - DNA, 27 bp, Artificial sequence
  SiRNA target sequence
taatattttttcgaaatcaaaactgtc

SEQ ID NO: 107997 - DNA, 27 bp, Artificial sequence
  SiRNA target sequence
aatattttttcgaaatcaaaactgtcc

SEQ ID NO: 107998 - DNA, 27 bp, Artificial sequence
  SiRNA target sequence
atattttttcgaaatcaaaactgtcca

SEQ ID NO: 107999 - DNA, 27 bp, Artificial sequence
  SiRNA target sequence
tattttttcgaaatcaaaactgtccat

SEQ ID NO: 108000 - DNA, 27 bp, Artificial sequence
  SiRNA target sequence
attttttcgaaatcaaaactgtccata

SEQ ID NO: 108001 - DNA, 27 bp, Artificial sequence
  SiRNA target sequence
ttttttcgaaatcaaaactgtccatat

SEQ ID NO: 108002 - DNA, 27 bp, Artificial sequence
  SiRNA target sequence
tttttcgaaatcaaaactgtccatatc

SEQ ID NO: 108003 - DNA, 27 bp, Artificial sequence
  SiRNA target sequence
ttttcgaaatcaaaactgtccatatct

SEQ ID NO: 108004 - DNA, 27 bp, Artificial sequence
  SiRNA target sequence
tttcgaaatcaaaactgtccatatcta

SEQ ID NO: 108005 - DNA, 27 bp, Artificial sequence
  SiRNA target sequence
ttcgaaatcaaaactgtccatatctaa

SEQ ID NO: 108006 - DNA, 27 bp, Artificial sequence
  SiRNA target sequence
tcgaaatcaaaactgtccatatctaaa

SEQ ID NO: 108007 - DNA, 27 bp, Artificial sequence
  SiRNA target sequence
cgaaatcaaaactgtccatatctaaag

SEQ ID NO: 108008 - DNA, 27 bp, Artificial sequence
  SiRNA target sequence
gaaatcaaaactgtccatatctaaagt

SEQ ID NO: 108009 - DNA, 27 bp, Artificial sequence
  SiRNA target sequence
aaatcaaaactgtccatatctaaagta

SEQ ID NO: 108010 - DNA, 27 bp, Artificial sequence
  SiRNA target sequence
aatcaaaactgtccatatctaaagtaa

SEQ ID NO: 108011 - DNA, 27 bp, Artificial sequence
  SiRNA target sequence
atcaaaactgtccatatctaaagtaaa

SEQ ID NO: 108012 - DNA, 27 bp, Artificial sequence
  SiRNA target sequence
tcaaaactgtccatatctaaagtaaaa

SEQ ID NO: 108013 - DNA, 27 bp, Artificial sequence
  SiRNA target sequence
caaaactgtccatatctaaagtaaaat

SEQ ID NO: 108014 - DNA, 27 bp, Artificial sequence
  SiRNA target sequence
aaaactgtccatatctaaagtaaaatc

SEQ ID NO: 108015 - DNA, 27 bp, Artificial sequence
  SiRNA target sequence
aaactgtccatatctaaagtaaaatct

SEQ ID NO: 108016 - DNA, 27 bp, Artificial sequence
  SiRNA target sequence
aactgtccatatctaaagtaaaatctg

SEQ ID NO: 108017 - DNA, 27 bp, Artificial sequence
  SiRNA target sequence
actgtccatatctaaagtaaaatctgt

SEQ ID NO: 108018 - DNA, 27 bp, Artificial sequence
  SiRNA target sequence
ctgtccatatctaaagtaaaatctgtt

SEQ ID NO: 108019 - DNA, 27 bp, Artificial sequence
  SiRNA target sequence
tgtccatatctaaagtaaaatctgttg

SEQ ID NO: 108020 - DNA, 27 bp, Artificial sequence
  SiRNA target sequence
gtccatatctaaagtaaaatctgttgg

SEQ ID NO: 108021 - DNA, 27 bp, Artificial sequence
  SiRNA target sequence
tccatatctaaagtaaaatctgttgga

SEQ ID NO: 108022 - DNA, 27 bp, Artificial sequence
  SiRNA target sequence
ccatatctaaagtaaaatctgttggaa

SEQ ID NO: 108023 - DNA, 27 bp, Artificial sequence
  SiRNA target sequence
catatctaaagtaaaatctgttggaag

SEQ ID NO: 108024 - DNA, 27 bp, Artificial sequence
  SiRNA target sequence
atatctaaagtaaaatctgttggaagc

SEQ ID NO: 108025 - DNA, 27 bp, Artificial sequence
  SiRNA target sequence
tatctaaagtaaaatctgttggaagca

SEQ ID NO: 108026 - DNA, 27 bp, Artificial sequence
  SiRNA target sequence
atctaaagtaaaatctgttggaagcaa

SEQ ID NO: 108027 - DNA, 27 bp, Artificial sequence
  SiRNA target sequence
tctaaagtaaaatctgttggaagcaat

SEQ ID NO: 108028 - DNA, 27 bp, Artificial sequence
  SiRNA target sequence
ctaaagtaaaatctgttggaagcaatt

SEQ ID NO: 108029 - DNA, 27 bp, Artificial sequence
  SiRNA target sequence
taaagtaaaatctgttggaagcaattc

SEQ ID NO: 108030 - DNA, 27 bp, Artificial sequence
  SiRNA target sequence
aaagtaaaatctgttggaagcaattct

SEQ ID NO: 108031 - DNA, 27 bp, Artificial sequence
  SiRNA target sequence
aagtaaaatctgttggaagcaattctt

SEQ ID NO: 108032 - DNA, 27 bp, Artificial sequence
  SiRNA target sequence
agtaaaatctgttggaagcaattcttt

SEQ ID NO: 108033 - DNA, 27 bp, Artificial sequence
  SiRNA target sequence
gtaaaatctgttggaagcaattcttta

SEQ ID NO: 108034 - DNA, 27 bp, Artificial sequence
  SiRNA target sequence
taaaatctgttggaagcaattctttat

SEQ ID NO: 108035 - DNA, 27 bp, Artificial sequence
  SiRNA target sequence
aaaatctgttggaagcaattctttatc

SEQ ID NO: 108036 - DNA, 27 bp, Artificial sequence
  SiRNA target sequence
aaatctgttggaagcaattctttatca

SEQ ID NO: 108037 - DNA, 27 bp, Artificial sequence
  SiRNA target sequence
aatctgttggaagcaattctttatcaa

SEQ ID NO: 108038 - DNA, 27 bp, Artificial sequence
  SiRNA target sequence
atctgttggaagcaattctttatcaac

SEQ ID NO: 108039 - DNA, 27 bp, Artificial sequence
  SiRNA target sequence
tctgttggaagcaattctttatcaacg

SEQ ID NO: 108040 - DNA, 27 bp, Artificial sequence
  SiRNA target sequence
ctgttggaagcaattctttatcaacgt

SEQ ID NO: 108041 - DNA, 27 bp, Artificial sequence
  SiRNA target sequence
tgttggaagcaattctttatcaacgtt

SEQ ID NO: 108042 - DNA, 27 bp, Artificial sequence
  SiRNA target sequence
gttggaagcaattctttatcaacgtta

SEQ ID NO: 108043 - DNA, 27 bp, Artificial sequence
  SiRNA target sequence
ttggaagcaattctttatcaacgttat

SEQ ID NO: 108044 - DNA, 27 bp, Artificial sequence
  SiRNA target sequence
tggaagcaattctttatcaacgttata

SEQ ID NO: 108045 - DNA, 27 bp, Artificial sequence
  SiRNA target sequence
ggaagcaattctttatcaacgttataa

SEQ ID NO: 108046 - DNA, 27 bp, Artificial sequence
  SiRNA target sequence
gaagcaattctttatcaacgttataaa

SEQ ID NO: 108047 - DNA, 27 bp, Artificial sequence
  SiRNA target sequence
aagcaattctttatcaacgttataaat

SEQ ID NO: 108048 - DNA, 27 bp, Artificial sequence
  SiRNA target sequence
agcaattctttatcaacgttataaatc

SEQ ID NO: 108049 - DNA, 27 bp, Artificial sequence
  SiRNA target sequence
gcaattctttatcaacgttataaatca

SEQ ID NO: 108050 - DNA, 27 bp, Artificial sequence
  SiRNA target sequence
caattctttatcaacgttataaatcaa

SEQ ID NO: 108051 - DNA, 27 bp, Artificial sequence
  SiRNA target sequence
aattctttatcaacgttataaatcaaa

SEQ ID NO: 108052 - DNA, 27 bp, Artificial sequence
  SiRNA target sequence
attctttatcaacgttataaatcaaat

SEQ ID NO: 108053 - DNA, 27 bp, Artificial sequence
  SiRNA target sequence
ttctttatcaacgttataaatcaaatc

SEQ ID NO: 108054 - DNA, 27 bp, Artificial sequence
  SiRNA target sequence
tctttatcaacgttataaatcaaatct

SEQ ID NO: 108055 - DNA, 27 bp, Artificial sequence
  SiRNA target sequence
ctttatcaacgttataaatcaaatctt

SEQ ID NO: 108056 - DNA, 27 bp, Artificial sequence
  SiRNA target sequence
tttatcaacgttataaatcaaatcttt

SEQ ID NO: 108057 - DNA, 27 bp, Artificial sequence
  SiRNA target sequence
ttatcaacgttataaatcaaatcttta

SEQ ID NO: 108058 - DNA, 27 bp, Artificial sequence
  SiRNA target sequence
tatcaacgttataaatcaaatctttat

SEQ ID NO: 108059 - DNA, 27 bp, Artificial sequence
  SiRNA target sequence
atcaacgttataaatcaaatctttatt

SEQ ID NO: 108060 - DNA, 27 bp, Artificial sequence
  SiRNA target sequence
tcaacgttataaatcaaatctttattg

SEQ ID NO: 108061 - DNA, 27 bp, Artificial sequence
  SiRNA target sequence
caacgttataaatcaaatctttattgt

SEQ ID NO: 108062 - DNA, 27 bp, Artificial sequence
  SiRNA target sequence
aacgttataaatcaaatctttattgta

SEQ ID NO: 108063 - DNA, 27 bp, Artificial sequence
  SiRNA target sequence
acgttataaatcaaatctttattgtat

SEQ ID NO: 108064 - DNA, 27 bp, Artificial sequence
  SiRNA target sequence
cgttataaatcaaatctttattgtatc

SEQ ID NO: 108065 - DNA, 27 bp, Artificial sequence
  SiRNA target sequence
gttataaatcaaatctttattgtatcc

SEQ ID NO: 108066 - DNA, 27 bp, Artificial sequence
  SiRNA target sequence
ttataaatcaaatctttattgtatccg

SEQ ID NO: 108067 - DNA, 27 bp, Artificial sequence
  SiRNA target sequence
tataaatcaaatctttattgtatccgt

SEQ ID NO: 108068 - DNA, 27 bp, Artificial sequence
  SiRNA target sequence
ataaatcaaatctttattgtatccgta

SEQ ID NO: 108069 - DNA, 27 bp, Artificial sequence
  SiRNA target sequence
taaatcaaatctttattgtatccgtat

SEQ ID NO: 108070 - DNA, 27 bp, Artificial sequence
  SiRNA target sequence
aaatcaaatctttattgtatccgtata

SEQ ID NO: 108071 - DNA, 27 bp, Artificial sequence
  SiRNA target sequence
aatcaaatctttattgtatccgtatag

SEQ ID NO: 108072 - DNA, 27 bp, Artificial sequence
  SiRNA target sequence
atcaaatctttattgtatccgtatagt

SEQ ID NO: 108073 - DNA, 27 bp, Artificial sequence
  SiRNA target sequence
tcaaatctttattgtatccgtatagta

SEQ ID NO: 108074 - DNA, 27 bp, Artificial sequence
  SiRNA target sequence
caaatctttattgtatccgtatagtat

SEQ ID NO: 108075 - DNA, 27 bp, Artificial sequence
  SiRNA target sequence
aaatctttattgtatccgtatagtata

SEQ ID NO: 108076 - DNA, 27 bp, Artificial sequence
  SiRNA target sequence
aatctttattgtatccgtatagtataa

SEQ ID NO: 108077 - DNA, 27 bp, Artificial sequence
  SiRNA target sequence
atctttattgtatccgtatagtataac

SEQ ID NO: 108078 - DNA, 27 bp, Artificial sequence
  SiRNA target sequence
tctttattgtatccgtatagtataaca

SEQ ID NO: 108079 - DNA, 27 bp, Artificial sequence
  SiRNA target sequence
ctttattgtatccgtatagtataacat

SEQ ID NO: 108080 - DNA, 27 bp, Artificial sequence
  SiRNA target sequence
tttattgtatccgtatagtataacatt

SEQ ID NO: 108081 - DNA, 27 bp, Artificial sequence
  SiRNA target sequence
ttattgtatccgtatagtataacattt

SEQ ID NO: 108082 - DNA, 27 bp, Artificial sequence
  SiRNA target sequence
tattgtatccgtatagtataacatttt

SEQ ID NO: 108083 - DNA, 27 bp, Artificial sequence
  SiRNA target sequence
attgtatccgtatagtataacattttg

SEQ ID NO: 108084 - DNA, 27 bp, Artificial sequence
  SiRNA target sequence
ttgtatccgtatagtataacattttga

SEQ ID NO: 108085 - DNA, 27 bp, Artificial sequence
  SiRNA target sequence
tgtatccgtatagtataacattttgaa

SEQ ID NO: 108086 - DNA, 27 bp, Artificial sequence
  SiRNA target sequence
gtatccgtatagtataacattttgaat

SEQ ID NO: 108087 - DNA, 27 bp, Artificial sequence
  SiRNA target sequence
tatccgtatagtataacattttgaata

SEQ ID NO: 108088 - DNA, 27 bp, Artificial sequence
  SiRNA target sequence
atccgtatagtataacattttgaataa

SEQ ID NO: 108089 - DNA, 27 bp, Artificial sequence
  SiRNA target sequence
tccgtatagtataacattttgaataag

SEQ ID NO: 108090 - DNA, 27 bp, Artificial sequence
  SiRNA target sequence
ccgtatagtataacattttgaataagt

SEQ ID NO: 108091 - DNA, 27 bp, Artificial sequence
  SiRNA target sequence
cgtatagtataacattttgaataagtt

SEQ ID NO: 108092 - DNA, 27 bp, Artificial sequence
  SiRNA target sequence
gtatagtataacattttgaataagttt

SEQ ID NO: 108093 - DNA, 27 bp, Artificial sequence
  SiRNA target sequence
tatagtataacattttgaataagttta

SEQ ID NO: 108094 - DNA, 27 bp, Artificial sequence
  SiRNA target sequence
atagtataacattttgaataagtttag

SEQ ID NO: 108095 - DNA, 27 bp, Artificial sequence
  SiRNA target sequence
tagtataacattttgaataagtttagc

SEQ ID NO: 108096 - DNA, 27 bp, Artificial sequence
  SiRNA target sequence
agtataacattttgaataagtttagca

SEQ ID NO: 108097 - DNA, 27 bp, Artificial sequence
  SiRNA target sequence
gtataacattttgaataagtttagcaa

SEQ ID NO: 108098 - DNA, 27 bp, Artificial sequence
  SiRNA target sequence
tataacattttgaataagtttagcaat

SEQ ID NO: 108099 - DNA, 27 bp, Artificial sequence
  SiRNA target sequence
ataacattttgaataagtttagcaata

SEQ ID NO: 108100 - DNA, 27 bp, Artificial sequence
  SiRNA target sequence
taacattttgaataagtttagcaatat

SEQ ID NO: 108101 - DNA, 27 bp, Artificial sequence
  SiRNA target sequence
aacattttgaataagtttagcaatatg

SEQ ID NO: 108102 - DNA, 27 bp, Artificial sequence
  SiRNA target sequence
acattttgaataagtttagcaatatgt

SEQ ID NO: 108103 - DNA, 27 bp, Artificial sequence
  SiRNA target sequence
cattttgaataagtttagcaatatgta

SEQ ID NO: 108104 - DNA, 27 bp, Artificial sequence
  SiRNA target sequence
attttgaataagtttagcaatatgtat

SEQ ID NO: 108105 - DNA, 27 bp, Artificial sequence
  SiRNA target sequence
ttttgaataagtttagcaatatgtata

SEQ ID NO: 108106 - DNA, 27 bp, Artificial sequence
  SiRNA target sequence
tttgaataagtttagcaatatgtatag

SEQ ID NO: 108107 - DNA, 27 bp, Artificial sequence
  SiRNA target sequence
ttgaataagtttagcaatatgtataga

SEQ ID NO: 108108 - DNA, 27 bp, Artificial sequence
  SiRNA target sequence
tgaataagtttagcaatatgtatagaa

SEQ ID NO: 108109 - DNA, 27 bp, Artificial sequence
  SiRNA target sequence
gaataagtttagcaatatgtatagaat

SEQ ID NO: 108110 - DNA, 27 bp, Artificial sequence
  SiRNA target sequence
aataagtttagcaatatgtatagaatt

SEQ ID NO: 108111 - DNA, 27 bp, Artificial sequence
  SiRNA target sequence
ataagtttagcaatatgtatagaattt

SEQ ID NO: 108112 - DNA, 27 bp, Artificial sequence
  SiRNA target sequence
taagtttagcaatatgtatagaatttc

SEQ ID NO: 108113 - DNA, 27 bp, Artificial sequence
  SiRNA target sequence
aagtttagcaatatgtatagaatttcc

SEQ ID NO: 108114 - DNA, 27 bp, Artificial sequence
  SiRNA target sequence
agtttagcaatatgtatagaatttcct

SEQ ID NO: 108115 - DNA, 27 bp, Artificial sequence
  SiRNA target sequence
gtttagcaatatgtatagaatttcctg

SEQ ID NO: 108116 - DNA, 27 bp, Artificial sequence
  SiRNA target sequence
tttagcaatatgtatagaatttcctgt

SEQ ID NO: 108117 - DNA, 27 bp, Artificial sequence
  SiRNA target sequence
ttagcaatatgtatagaatttcctgtt

SEQ ID NO: 108118 - DNA, 27 bp, Artificial sequence
  SiRNA target sequence
tagcaatatgtatagaatttcctgttt

SEQ ID NO: 108119 - DNA, 27 bp, Artificial sequence
  SiRNA target sequence
agcaatatgtatagaatttcctgtttg

SEQ ID NO: 108120 - DNA, 27 bp, Artificial sequence
  SiRNA target sequence
gcaatatgtatagaatttcctgtttgg

SEQ ID NO: 108121 - DNA, 27 bp, Artificial sequence
  SiRNA target sequence
caatatgtatagaatttcctgtttggg

SEQ ID NO: 108122 - DNA, 27 bp, Artificial sequence
  SiRNA target sequence
aatatgtatagaatttcctgtttggga

SEQ ID NO: 108123 - DNA, 27 bp, Artificial sequence
  SiRNA target sequence
atatgtatagaatttcctgtttgggag

SEQ ID NO: 108124 - DNA, 27 bp, Artificial sequence
  SiRNA target sequence
tatgtatagaatttcctgtttgggagc

SEQ ID NO: 108125 - DNA, 27 bp, Artificial sequence
  SiRNA target sequence
atgtatagaatttcctgtttgggagcc

SEQ ID NO: 108126 - DNA, 27 bp, Artificial sequence
  SiRNA target sequence
tgtatagaatttcctgtttgggagcca

SEQ ID NO: 108127 - DNA, 27 bp, Artificial sequence
  SiRNA target sequence
gtatagaatttcctgtttgggagccat

SEQ ID NO: 108128 - DNA, 27 bp, Artificial sequence
  SiRNA target sequence
tatagaatttcctgtttgggagccata

SEQ ID NO: 108129 - DNA, 27 bp, Artificial sequence
  SiRNA target sequence
atagaatttcctgtttgggagccatat

SEQ ID NO: 108130 - DNA, 27 bp, Artificial sequence
  SiRNA target sequence
tagaatttcctgtttgggagccatata

SEQ ID NO: 108131 - DNA, 27 bp, Artificial sequence
  SiRNA target sequence
agaatttcctgtttgggagccatataa

SEQ ID NO: 108132 - DNA, 27 bp, Artificial sequence
  SiRNA target sequence
gaatttcctgtttgggagccatataag

SEQ ID NO: 108133 - DNA, 27 bp, Artificial sequence
  SiRNA target sequence
aatttcctgtttgggagccatataaga

SEQ ID NO: 108134 - DNA, 27 bp, Artificial sequence
  SiRNA target sequence
atttcctgtttgggagccatataagat

SEQ ID NO: 108135 - DNA, 27 bp, Artificial sequence
  SiRNA target sequence
tttcctgtttgggagccatataagatt

SEQ ID NO: 108136 - DNA, 27 bp, Artificial sequence
  SiRNA target sequence
ttcctgtttgggagccatataagatta

SEQ ID NO: 108137 - DNA, 27 bp, Artificial sequence
  SiRNA target sequence
tcctgtttgggagccatataagattat

SEQ ID NO: 108138 - DNA, 27 bp, Artificial sequence
  SiRNA target sequence
cctgtttgggagccatataagattatc

SEQ ID NO: 108139 - DNA, 27 bp, Artificial sequence
  SiRNA target sequence
ctgtttgggagccatataagattatca

SEQ ID NO: 108140 - DNA, 27 bp, Artificial sequence
  SiRNA target sequence
tgtttgggagccatataagattatcat

SEQ ID NO: 108141 - DNA, 19 bp, Artificial sequence
  SiRNA target sequence
ttattcagaataaacatct

SEQ ID NO: 108142 - DNA, 19 bp, Artificial sequence
  SiRNA target sequence
tattcagaataaacatctt

SEQ ID NO: 108143 - DNA, 19 bp, Artificial sequence
  SiRNA target sequence
attcagaataaacatcttt

SEQ ID NO: 108144 - DNA, 19 bp, Artificial sequence
  SiRNA target sequence
ttcagaataaacatctttt

SEQ ID NO: 108145 - DNA, 19 bp, Artificial sequence
  SiRNA target sequence
tcagaataaacatctttta

SEQ ID NO: 108146 - DNA, 19 bp, Artificial sequence
  SiRNA target sequence
cagaataaacatcttttaa

SEQ ID NO: 108147 - DNA, 19 bp, Artificial sequence
  SiRNA target sequence
agaataaacatcttttaaa

SEQ ID NO: 108148 - DNA, 19 bp, Artificial sequence
  SiRNA target sequence
gaataaacatcttttaaaa

SEQ ID NO: 108149 - DNA, 19 bp, Artificial sequence
  SiRNA target sequence
aataaacatcttttaaaag

SEQ ID NO: 108150 - DNA, 19 bp, Artificial sequence
  SiRNA target sequence
ataaacatcttttaaaagt

SEQ ID NO: 108151 - DNA, 19 bp, Artificial sequence
  SiRNA target sequence
taaacatcttttaaaagtt

SEQ ID NO: 108152 - DNA, 19 bp, Artificial sequence
  SiRNA target sequence
aaacatcttttaaaagttc

SEQ ID NO: 108153 - DNA, 19 bp, Artificial sequence
  SiRNA target sequence
aacatcttttaaaagttca

SEQ ID NO: 108154 - DNA, 19 bp, Artificial sequence
  SiRNA target sequence
acatcttttaaaagttcat

SEQ ID NO: 108155 - DNA, 19 bp, Artificial sequence
  SiRNA target sequence
catcttttaaaagttcatc

SEQ ID NO: 108156 - DNA, 19 bp, Artificial sequence
  SiRNA target sequence
atcttttaaaagttcatcg

SEQ ID NO: 108157 - DNA, 19 bp, Artificial sequence
  SiRNA target sequence
tcttttaaaagttcatcga

SEQ ID NO: 108158 - DNA, 19 bp, Artificial sequence
  SiRNA target sequence
cttttaaaagttcatcgat

SEQ ID NO: 108159 - DNA, 19 bp, Artificial sequence
  SiRNA target sequence
ttttaaaagttcatcgata

SEQ ID NO: 108160 - DNA, 19 bp, Artificial sequence
  SiRNA target sequence
tttaaaagttcatcgatat

SEQ ID NO: 108161 - DNA, 19 bp, Artificial sequence
  SiRNA target sequence
ttaaaagttcatcgatatc

SEQ ID NO: 108162 - DNA, 19 bp, Artificial sequence
  SiRNA target sequence
taaaagttcatcgatatcg

SEQ ID NO: 108163 - DNA, 19 bp, Artificial sequence
  SiRNA target sequence
aaaagttcatcgatatcgg

SEQ ID NO: 108164 - DNA, 19 bp, Artificial sequence
  SiRNA target sequence
aaagttcatcgatatcggg

SEQ ID NO: 108165 - DNA, 19 bp, Artificial sequence
  SiRNA target sequence
aagttcatcgatatcgggt

SEQ ID NO: 108166 - DNA, 19 bp, Artificial sequence
  SiRNA target sequence
agttcatcgatatcgggtt

SEQ ID NO: 108167 - DNA, 19 bp, Artificial sequence
  SiRNA target sequence
gttcatcgatatcgggttc

SEQ ID NO: 108168 - DNA, 19 bp, Artificial sequence
  SiRNA target sequence
ttcatcgatatcgggttct

SEQ ID NO: 108169 - DNA, 19 bp, Artificial sequence
  SiRNA target sequence
tcatcgatatcgggttctt

SEQ ID NO: 108170 - DNA, 19 bp, Artificial sequence
  SiRNA target sequence
catcgatatcgggttcttt

SEQ ID NO: 108171 - DNA, 19 bp, Artificial sequence
  SiRNA target sequence
atcgatatcgggttcttta

SEQ ID NO: 108172 - DNA, 19 bp, Artificial sequence
  SiRNA target sequence
tcgatatcgggttctttag

SEQ ID NO: 108173 - DNA, 19 bp, Artificial sequence
  SiRNA target sequence
cgatatcgggttctttaga

SEQ ID NO: 108174 - DNA, 19 bp, Artificial sequence
  SiRNA target sequence
gatatcgggttctttagaa

SEQ ID NO: 108175 - DNA, 19 bp, Artificial sequence
  SiRNA target sequence
atatcgggttctttagaaa

SEQ ID NO: 108176 - DNA, 19 bp, Artificial sequence
  SiRNA target sequence
tatcgggttctttagaaaa

SEQ ID NO: 108177 - DNA, 19 bp, Artificial sequence
  SiRNA target sequence
atcgggttctttagaaaaa

SEQ ID NO: 108178 - DNA, 19 bp, Artificial sequence
  SiRNA target sequence
tcgggttctttagaaaaaa

SEQ ID NO: 108179 - DNA, 19 bp, Artificial sequence
  SiRNA target sequence
cgggttctttagaaaaaat

SEQ ID NO: 108180 - DNA, 19 bp, Artificial sequence
  SiRNA target sequence
gggttctttagaaaaaata

SEQ ID NO: 108181 - DNA, 19 bp, Artificial sequence
  SiRNA target sequence
ggttctttagaaaaaataa

SEQ ID NO: 108182 - DNA, 19 bp, Artificial sequence
  SiRNA target sequence
gttctttagaaaaaataac

SEQ ID NO: 108183 - DNA, 19 bp, Artificial sequence
  SiRNA target sequence
ttctttagaaaaaataact

SEQ ID NO: 108184 - DNA, 19 bp, Artificial sequence
  SiRNA target sequence
tctttagaaaaaataactt

SEQ ID NO: 108185 - DNA, 19 bp, Artificial sequence
  SiRNA target sequence
ctttagaaaaaataacttt

SEQ ID NO: 108186 - DNA, 19 bp, Artificial sequence
  SiRNA target sequence
tttagaaaaaataactttt

SEQ ID NO: 108187 - DNA, 19 bp, Artificial sequence
  SiRNA target sequence
ttagaaaaaataacttttt

SEQ ID NO: 108188 - DNA, 19 bp, Artificial sequence
  SiRNA target sequence
tagaaaaaataactttttt

SEQ ID NO: 108189 - DNA, 19 bp, Artificial sequence
  SiRNA target sequence
agaaaaaataactttttta

SEQ ID NO: 108190 - DNA, 19 bp, Artificial sequence
  SiRNA target sequence
gaaaaaataacttttttaa

SEQ ID NO: 108191 - DNA, 19 bp, Artificial sequence
  SiRNA target sequence
aaaaaataacttttttaac

SEQ ID NO: 108192 - DNA, 19 bp, Artificial sequence
  SiRNA target sequence
aaaaataacttttttaaca

SEQ ID NO: 108193 - DNA, 19 bp, Artificial sequence
  SiRNA target sequence
aaaataacttttttaacac

SEQ ID NO: 108194 - DNA, 19 bp, Artificial sequence
  SiRNA target sequence
aaataacttttttaacacc

SEQ ID NO: 108195 - DNA, 19 bp, Artificial sequence
  SiRNA target sequence
aataacttttttaacacct

SEQ ID NO: 108196 - DNA, 19 bp, Artificial sequence
  SiRNA target sequence
ataacttttttaacacctt

SEQ ID NO: 108197 - DNA, 19 bp, Artificial sequence
  SiRNA target sequence
taacttttttaacaccttc

SEQ ID NO: 108198 - DNA, 19 bp, Artificial sequence
  SiRNA target sequence
aacttttttaacaccttct

SEQ ID NO: 108199 - DNA, 19 bp, Artificial sequence
  SiRNA target sequence
acttttttaacaccttctt

SEQ ID NO: 108200 - DNA, 19 bp, Artificial sequence
  SiRNA target sequence
cttttttaacaccttcttc

SEQ ID NO: 108201 - DNA, 19 bp, Artificial sequence
  SiRNA target sequence
ttttttaacaccttcttca

SEQ ID NO: 108202 - DNA, 19 bp, Artificial sequence
  SiRNA target sequence
tttttaacaccttcttcaa

SEQ ID NO: 108203 - DNA, 19 bp, Artificial sequence
  SiRNA target sequence
ttttaacaccttcttcaaa

SEQ ID NO: 108204 - DNA, 19 bp, Artificial sequence
  SiRNA target sequence
tttaacaccttcttcaaag

SEQ ID NO: 108205 - DNA, 19 bp, Artificial sequence
  SiRNA target sequence
ttaacaccttcttcaaagc

SEQ ID NO: 108206 - DNA, 19 bp, Artificial sequence
  SiRNA target sequence
taacaccttcttcaaagca

SEQ ID NO: 108207 - DNA, 19 bp, Artificial sequence
  SiRNA target sequence
aacaccttcttcaaagcag

SEQ ID NO: 108208 - DNA, 19 bp, Artificial sequence
  SiRNA target sequence
acaccttcttcaaagcagg

SEQ ID NO: 108209 - DNA, 19 bp, Artificial sequence
  SiRNA target sequence
caccttcttcaaagcagga

SEQ ID NO: 108210 - DNA, 19 bp, Artificial sequence
  SiRNA target sequence
accttcttcaaagcaggaa

SEQ ID NO: 108211 - DNA, 19 bp, Artificial sequence
  SiRNA target sequence
ccttcttcaaagcaggaaa

SEQ ID NO: 108212 - DNA, 19 bp, Artificial sequence
  SiRNA target sequence
cttcttcaaagcaggaaat

SEQ ID NO: 108213 - DNA, 19 bp, Artificial sequence
  SiRNA target sequence
ttcttcaaagcaggaaatt

SEQ ID NO: 108214 - DNA, 19 bp, Artificial sequence
  SiRNA target sequence
tcttcaaagcaggaaatta

SEQ ID NO: 108215 - DNA, 19 bp, Artificial sequence
  SiRNA target sequence
cttcaaagcaggaaattac

SEQ ID NO: 108216 - DNA, 19 bp, Artificial sequence
  SiRNA target sequence
ttcaaagcaggaaattacc

SEQ ID NO: 108217 - DNA, 19 bp, Artificial sequence
  SiRNA target sequence
tcaaagcaggaaattacct

SEQ ID NO: 108218 - DNA, 19 bp, Artificial sequence
  SiRNA target sequence
caaagcaggaaattacctc

SEQ ID NO: 108219 - DNA, 19 bp, Artificial sequence
  SiRNA target sequence
aaagcaggaaattacctca

SEQ ID NO: 108220 - DNA, 19 bp, Artificial sequence
  SiRNA target sequence
aagcaggaaattacctcat

SEQ ID NO: 108221 - DNA, 19 bp, Artificial sequence
  SiRNA target sequence
agcaggaaattacctcatc

SEQ ID NO: 108222 - DNA, 19 bp, Artificial sequence
  SiRNA target sequence
gcaggaaattacctcatct

SEQ ID NO: 108223 - DNA, 19 bp, Artificial sequence
  SiRNA target sequence
caggaaattacctcatctt

SEQ ID NO: 108224 - DNA, 19 bp, Artificial sequence
  SiRNA target sequence
aggaaattacctcatcttc

SEQ ID NO: 108225 - DNA, 19 bp, Artificial sequence
  SiRNA target sequence
ggaaattacctcatcttcg

SEQ ID NO: 108226 - DNA, 19 bp, Artificial sequence
  SiRNA target sequence
gaaattacctcatcttcga

SEQ ID NO: 108227 - DNA, 19 bp, Artificial sequence
  SiRNA target sequence
aaattacctcatcttcgat

SEQ ID NO: 108228 - DNA, 19 bp, Artificial sequence
  SiRNA target sequence
aattacctcatcttcgata

SEQ ID NO: 108229 - DNA, 19 bp, Artificial sequence
  SiRNA target sequence
attacctcatcttcgataa

SEQ ID NO: 108230 - DNA, 19 bp, Artificial sequence
  SiRNA target sequence
ttacctcatcttcgataat

SEQ ID NO: 108231 - DNA, 19 bp, Artificial sequence
  SiRNA target sequence
tacctcatcttcgataatt

SEQ ID NO: 108232 - DNA, 19 bp, Artificial sequence
  SiRNA target sequence
acctcatcttcgataattt

SEQ ID NO: 108233 - DNA, 19 bp, Artificial sequence
  SiRNA target sequence
cctcatcttcgataatttt

SEQ ID NO: 108234 - DNA, 19 bp, Artificial sequence
  SiRNA target sequence
ctcatcttcgataattttt

SEQ ID NO: 108235 - DNA, 19 bp, Artificial sequence
  SiRNA target sequence
tcatcttcgataattttta

SEQ ID NO: 108236 - DNA, 19 bp, Artificial sequence
  SiRNA target sequence
catcttcgataatttttac

SEQ ID NO: 108237 - DNA, 19 bp, Artificial sequence
  SiRNA target sequence
atcttcgataatttttact

SEQ ID NO: 108238 - DNA, 19 bp, Artificial sequence
  SiRNA target sequence
tcttcgataatttttactt

SEQ ID NO: 108239 - DNA, 19 bp, Artificial sequence
  SiRNA target sequence
cttcgataatttttacttc

SEQ ID NO: 108240 - DNA, 19 bp, Artificial sequence
  SiRNA target sequence
ttcgataatttttacttct

SEQ ID NO: 108241 - DNA, 19 bp, Artificial sequence
  SiRNA target sequence
tcgataatttttacttctt

SEQ ID NO: 108242 - DNA, 19 bp, Artificial sequence
  SiRNA target sequence
cgataatttttacttcttc

SEQ ID NO: 108243 - DNA, 19 bp, Artificial sequence
  SiRNA target sequence
gataatttttacttcttca

SEQ ID NO: 108244 - DNA, 19 bp, Artificial sequence
  SiRNA target sequence
ataatttttacttcttcac

SEQ ID NO: 108245 - DNA, 19 bp, Artificial sequence
  SiRNA target sequence
taatttttacttcttcaca

SEQ ID NO: 108246 - DNA, 19 bp, Artificial sequence
  SiRNA target sequence
aatttttacttcttcacaa

SEQ ID NO: 108247 - DNA, 19 bp, Artificial sequence
  SiRNA target sequence
atttttacttcttcacaag

SEQ ID NO: 108248 - DNA, 19 bp, Artificial sequence
  SiRNA target sequence
tttttacttcttcacaagt

SEQ ID NO: 108249 - DNA, 19 bp, Artificial sequence
  SiRNA target sequence
ttttacttcttcacaagtc

SEQ ID NO: 108250 - DNA, 19 bp, Artificial sequence
  SiRNA target sequence
tttacttcttcacaagtcg

SEQ ID NO: 108251 - DNA, 19 bp, Artificial sequence
  SiRNA target sequence
ttacttcttcacaagtcgc

SEQ ID NO: 108252 - DNA, 19 bp, Artificial sequence
  SiRNA target sequence
tacttcttcacaagtcgca

SEQ ID NO: 108253 - DNA, 19 bp, Artificial sequence
  SiRNA target sequence
acttcttcacaagtcgcaa

SEQ ID NO: 108254 - DNA, 19 bp, Artificial sequence
  SiRNA target sequence
cttcttcacaagtcgcaaa

SEQ ID NO: 108255 - DNA, 19 bp, Artificial sequence
  SiRNA target sequence
ttcttcacaagtcgcaaat

SEQ ID NO: 108256 - DNA, 19 bp, Artificial sequence
  SiRNA target sequence
tcttcacaagtcgcaaatt

SEQ ID NO: 108257 - DNA, 19 bp, Artificial sequence
  SiRNA target sequence
cttcacaagtcgcaaattt

SEQ ID NO: 108258 - DNA, 19 bp, Artificial sequence
  SiRNA target sequence
ttcacaagtcgcaaatttt

SEQ ID NO: 108259 - DNA, 19 bp, Artificial sequence
  SiRNA target sequence
tcacaagtcgcaaattttt

SEQ ID NO: 108260 - DNA, 19 bp, Artificial sequence
  SiRNA target sequence
cacaagtcgcaaatttttg

SEQ ID NO: 108261 - DNA, 19 bp, Artificial sequence
  SiRNA target sequence
acaagtcgcaaatttttgt

SEQ ID NO: 108262 - DNA, 19 bp, Artificial sequence
  SiRNA target sequence
caagtcgcaaatttttgta

SEQ ID NO: 108263 - DNA, 19 bp, Artificial sequence
  SiRNA target sequence
aagtcgcaaatttttgtaa

SEQ ID NO: 108264 - DNA, 19 bp, Artificial sequence
  SiRNA target sequence
agtcgcaaatttttgtaag

SEQ ID NO: 108265 - DNA, 19 bp, Artificial sequence
  SiRNA target sequence
gtcgcaaatttttgtaagt

SEQ ID NO: 108266 - DNA, 19 bp, Artificial sequence
  SiRNA target sequence
tcgcaaatttttgtaagtt

SEQ ID NO: 108267 - DNA, 19 bp, Artificial sequence
  SiRNA target sequence
cgcaaatttttgtaagtta

SEQ ID NO: 108268 - DNA, 19 bp, Artificial sequence
  SiRNA target sequence
gcaaatttttgtaagttat

SEQ ID NO: 108269 - DNA, 19 bp, Artificial sequence
  SiRNA target sequence
caaatttttgtaagttatt

SEQ ID NO: 108270 - DNA, 19 bp, Artificial sequence
  SiRNA target sequence
aaatttttgtaagttattt

SEQ ID NO: 108271 - DNA, 19 bp, Artificial sequence
  SiRNA target sequence
aatttttgtaagttatttt

SEQ ID NO: 108272 - DNA, 19 bp, Artificial sequence
  SiRNA target sequence
atttttgtaagttattttt

SEQ ID NO: 108273 - DNA, 19 bp, Artificial sequence
  SiRNA target sequence
tttttgtaagttatttttt

SEQ ID NO: 108274 - DNA, 19 bp, Artificial sequence
  SiRNA target sequence
ttttgtaagttattttttg

SEQ ID NO: 108275 - DNA, 19 bp, Artificial sequence
  SiRNA target sequence
tttgtaagttattttttgc

SEQ ID NO: 108276 - DNA, 19 bp, Artificial sequence
  SiRNA target sequence
ttgtaagttattttttgct

SEQ ID NO: 108277 - DNA, 19 bp, Artificial sequence
  SiRNA target sequence
tgtaagttattttttgctt

SEQ ID NO: 108278 - DNA, 19 bp, Artificial sequence
  SiRNA target sequence
gtaagttattttttgcttc

SEQ ID NO: 108279 - DNA, 19 bp, Artificial sequence
  SiRNA target sequence
taagttattttttgcttct

SEQ ID NO: 108280 - DNA, 19 bp, Artificial sequence
  SiRNA target sequence
aagttattttttgcttctt

SEQ ID NO: 108281 - DNA, 19 bp, Artificial sequence
  SiRNA target sequence
agttattttttgcttcttt

SEQ ID NO: 108282 - DNA, 19 bp, Artificial sequence
  SiRNA target sequence
gttattttttgcttcttta

SEQ ID NO: 108283 - DNA, 19 bp, Artificial sequence
  SiRNA target sequence
ttattttttgcttctttaa

SEQ ID NO: 108284 - DNA, 19 bp, Artificial sequence
  SiRNA target sequence
tattttttgcttctttaag

SEQ ID NO: 108285 - DNA, 19 bp, Artificial sequence
  SiRNA target sequence
attttttgcttctttaagg

SEQ ID NO: 108286 - DNA, 19 bp, Artificial sequence
  SiRNA target sequence
ttttttgcttctttaaggc

SEQ ID NO: 108287 - DNA, 19 bp, Artificial sequence
  SiRNA target sequence
tttttgcttctttaaggca

SEQ ID NO: 108288 - DNA, 19 bp, Artificial sequence
  SiRNA target sequence
ttttgcttctttaaggcaa

SEQ ID NO: 108289 - DNA, 19 bp, Artificial sequence
  SiRNA target sequence
tttgcttctttaaggcaat

SEQ ID NO: 108290 - DNA, 19 bp, Artificial sequence
  SiRNA target sequence
ttgcttctttaaggcaatc

SEQ ID NO: 108291 - DNA, 19 bp, Artificial sequence
  SiRNA target sequence
tgcttctttaaggcaatca

SEQ ID NO: 108292 - DNA, 19 bp, Artificial sequence
  SiRNA target sequence
gcttctttaaggcaatcat

SEQ ID NO: 108293 - DNA, 19 bp, Artificial sequence
  SiRNA target sequence
cttctttaaggcaatcatt

SEQ ID NO: 108294 - DNA, 19 bp, Artificial sequence
  SiRNA target sequence
ttctttaaggcaatcatta

SEQ ID NO: 108295 - DNA, 19 bp, Artificial sequence
  SiRNA target sequence
tctttaaggcaatcattat

SEQ ID NO: 108296 - DNA, 19 bp, Artificial sequence
  SiRNA target sequence
ctttaaggcaatcattatt

SEQ ID NO: 108297 - DNA, 19 bp, Artificial sequence
  SiRNA target sequence
tttaaggcaatcattattt

SEQ ID NO: 108298 - DNA, 19 bp, Artificial sequence
  SiRNA target sequence
ttaaggcaatcattatttt

SEQ ID NO: 108299 - DNA, 19 bp, Artificial sequence
  SiRNA target sequence
taaggcaatcattattttt

SEQ ID NO: 108300 - DNA, 19 bp, Artificial sequence
  SiRNA target sequence
aaggcaatcattatttttt

SEQ ID NO: 108301 - DNA, 19 bp, Artificial sequence
  SiRNA target sequence
aggcaatcattattttttt

SEQ ID NO: 108302 - DNA, 19 bp, Artificial sequence
  SiRNA target sequence
ggcaatcattatttttttt

SEQ ID NO: 108303 - DNA, 19 bp, Artificial sequence
  SiRNA target sequence
gcaatcattattttttttt

SEQ ID NO: 108304 - DNA, 19 bp, Artificial sequence
  SiRNA target sequence
caatcattatttttttttt

SEQ ID NO: 108305 - DNA, 19 bp, Artificial sequence
  SiRNA target sequence
aatcattattttttttttc

SEQ ID NO: 108306 - DNA, 19 bp, Artificial sequence
  SiRNA target sequence
atcattattttttttttca

SEQ ID NO: 108307 - DNA, 19 bp, Artificial sequence
  SiRNA target sequence
tcattattttttttttcat

SEQ ID NO: 108308 - DNA, 19 bp, Artificial sequence
  SiRNA target sequence
cattattttttttttcatt

SEQ ID NO: 108309 - DNA, 19 bp, Artificial sequence
  SiRNA target sequence
attattttttttttcatta

SEQ ID NO: 108310 - DNA, 19 bp, Artificial sequence
  SiRNA target sequence
ttattttttttttcattaa

SEQ ID NO: 108311 - DNA, 19 bp, Artificial sequence
  SiRNA target sequence
tattttttttttcattaat

SEQ ID NO: 108312 - DNA, 19 bp, Artificial sequence
  SiRNA target sequence
attttttttttcattaatt

SEQ ID NO: 108313 - DNA, 19 bp, Artificial sequence
  SiRNA target sequence
ttttttttttcattaattt

SEQ ID NO: 108314 - DNA, 19 bp, Artificial sequence
  SiRNA target sequence
tttttttttcattaatttc

SEQ ID NO: 108315 - DNA, 19 bp, Artificial sequence
  SiRNA target sequence
ttttttttcattaatttcc

SEQ ID NO: 108316 - DNA, 19 bp, Artificial sequence
  SiRNA target sequence
tttttttcattaatttcct

SEQ ID NO: 108317 - DNA, 19 bp, Artificial sequence
  SiRNA target sequence
ttttttcattaatttcctc

SEQ ID NO: 108318 - DNA, 19 bp, Artificial sequence
  SiRNA target sequence
tttttcattaatttcctcc

SEQ ID NO: 108319 - DNA, 19 bp, Artificial sequence
  SiRNA target sequence
ttttcattaatttcctccg

SEQ ID NO: 108320 - DNA, 19 bp, Artificial sequence
  SiRNA target sequence
tttcattaatttcctccgt

SEQ ID NO: 108321 - DNA, 19 bp, Artificial sequence
  SiRNA target sequence
ttcattaatttcctccgtg

SEQ ID NO: 108322 - DNA, 19 bp, Artificial sequence
  SiRNA target sequence
tcattaatttcctccgtgg

SEQ ID NO: 108323 - DNA, 19 bp, Artificial sequence
  SiRNA target sequence
cattaatttcctccgtgga

SEQ ID NO: 108324 - DNA, 19 bp, Artificial sequence
  SiRNA target sequence
attaatttcctccgtggat

SEQ ID NO: 108325 - DNA, 19 bp, Artificial sequence
  SiRNA target sequence
ttaatttcctccgtggatc

SEQ ID NO: 108326 - DNA, 19 bp, Artificial sequence
  SiRNA target sequence
taatttcctccgtggatct

SEQ ID NO: 108327 - DNA, 19 bp, Artificial sequence
  SiRNA target sequence
aatttcctccgtggatctg

SEQ ID NO: 108328 - DNA, 19 bp, Artificial sequence
  SiRNA target sequence
atttcctccgtggatctgt

SEQ ID NO: 108329 - DNA, 19 bp, Artificial sequence
  SiRNA target sequence
tttcctccgtggatctgta

SEQ ID NO: 108330 - DNA, 19 bp, Artificial sequence
  SiRNA target sequence
ttcctccgtggatctgtaa

SEQ ID NO: 108331 - DNA, 19 bp, Artificial sequence
  SiRNA target sequence
tcctccgtggatctgtaaa

SEQ ID NO: 108332 - DNA, 19 bp, Artificial sequence
  SiRNA target sequence
cctccgtggatctgtaaaa

SEQ ID NO: 108333 - DNA, 19 bp, Artificial sequence
  SiRNA target sequence
ctccgtggatctgtaaaaa

SEQ ID NO: 108334 - DNA, 19 bp, Artificial sequence
  SiRNA target sequence
tccgtggatctgtaaaaat

SEQ ID NO: 108335 - DNA, 19 bp, Artificial sequence
  SiRNA target sequence
ccgtggatctgtaaaaatc

SEQ ID NO: 108336 - DNA, 19 bp, Artificial sequence
  SiRNA target sequence
cgtggatctgtaaaaatcg

SEQ ID NO: 108337 - DNA, 19 bp, Artificial sequence
  SiRNA target sequence
gtggatctgtaaaaatcgt

SEQ ID NO: 108338 - DNA, 19 bp, Artificial sequence
  SiRNA target sequence
tggatctgtaaaaatcgtt

SEQ ID NO: 108339 - DNA, 19 bp, Artificial sequence
  SiRNA target sequence
ggatctgtaaaaatcgtta

SEQ ID NO: 108340 - DNA, 19 bp, Artificial sequence
  SiRNA target sequence
gatctgtaaaaatcgttaa

SEQ ID NO: 108341 - DNA, 19 bp, Artificial sequence
  SiRNA target sequence
atctgtaaaaatcgttaac

SEQ ID NO: 108342 - DNA, 19 bp, Artificial sequence
  SiRNA target sequence
tctgtaaaaatcgttaaca

SEQ ID NO: 108343 - DNA, 19 bp, Artificial sequence
  SiRNA target sequence
ctgtaaaaatcgttaacat

SEQ ID NO: 108344 - DNA, 19 bp, Artificial sequence
  SiRNA target sequence
tgtaaaaatcgttaacatc

SEQ ID NO: 108345 - DNA, 19 bp, Artificial sequence
  SiRNA target sequence
gtaaaaatcgttaacatct

SEQ ID NO: 108346 - DNA, 19 bp, Artificial sequence
  SiRNA target sequence
taaaaatcgttaacatcta

SEQ ID NO: 108347 - DNA, 19 bp, Artificial sequence
  SiRNA target sequence
aaaaatcgttaacatctaa

SEQ ID NO: 108348 - DNA, 19 bp, Artificial sequence
  SiRNA target sequence
aaaatcgttaacatctaaa

SEQ ID NO: 108349 - DNA, 19 bp, Artificial sequence
  SiRNA target sequence
aaatcgttaacatctaaac

SEQ ID NO: 108350 - DNA, 19 bp, Artificial sequence
  SiRNA target sequence
aatcgttaacatctaaaca

SEQ ID NO: 108351 - DNA, 19 bp, Artificial sequence
  SiRNA target sequence
atcgttaacatctaaacag

SEQ ID NO: 108352 - DNA, 19 bp, Artificial sequence
  SiRNA target sequence
tcgttaacatctaaacagg

SEQ ID NO: 108353 - DNA, 19 bp, Artificial sequence
  SiRNA target sequence
cgttaacatctaaacagga

SEQ ID NO: 108354 - DNA, 19 bp, Artificial sequence
  SiRNA target sequence
gttaacatctaaacaggag

SEQ ID NO: 108355 - DNA, 19 bp, Artificial sequence
  SiRNA target sequence
ttaacatctaaacaggagt

SEQ ID NO: 108356 - DNA, 19 bp, Artificial sequence
  SiRNA target sequence
taacatctaaacaggagtg

SEQ ID NO: 108357 - DNA, 19 bp, Artificial sequence
  SiRNA target sequence
aacatctaaacaggagtgc

SEQ ID NO: 108358 - DNA, 19 bp, Artificial sequence
  SiRNA target sequence
acatctaaacaggagtgcc

SEQ ID NO: 108359 - DNA, 19 bp, Artificial sequence
  SiRNA target sequence
catctaaacaggagtgccc

SEQ ID NO: 108360 - DNA, 19 bp, Artificial sequence
  SiRNA target sequence
atctaaacaggagtgccca

SEQ ID NO: 108361 - DNA, 19 bp, Artificial sequence
  SiRNA target sequence
tctaaacaggagtgcccac

SEQ ID NO: 108362 - DNA, 19 bp, Artificial sequence
  SiRNA target sequence
ctaaacaggagtgcccaca

SEQ ID NO: 108363 - DNA, 19 bp, Artificial sequence
  SiRNA target sequence
taaacaggagtgcccacat

SEQ ID NO: 108364 - DNA, 19 bp, Artificial sequence
  SiRNA target sequence
aaacaggagtgcccacatg

SEQ ID NO: 108365 - DNA, 19 bp, Artificial sequence
  SiRNA target sequence
aacaggagtgcccacatgt

SEQ ID NO: 108366 - DNA, 19 bp, Artificial sequence
  SiRNA target sequence
acaggagtgcccacatgtc

SEQ ID NO: 108367 - DNA, 19 bp, Artificial sequence
  SiRNA target sequence
caggagtgcccacatgtcc

SEQ ID NO: 108368 - DNA, 19 bp, Artificial sequence
  SiRNA target sequence
aggagtgcccacatgtcct

SEQ ID NO: 108369 - DNA, 19 bp, Artificial sequence
  SiRNA target sequence
ggagtgcccacatgtcctg

SEQ ID NO: 108370 - DNA, 19 bp, Artificial sequence
  SiRNA target sequence
gagtgcccacatgtcctgt

SEQ ID NO: 108371 - DNA, 19 bp, Artificial sequence
  SiRNA target sequence
agtgcccacatgtcctgta

SEQ ID NO: 108372 - DNA, 19 bp, Artificial sequence
  SiRNA target sequence
gtgcccacatgtcctgtac

SEQ ID NO: 108373 - DNA, 19 bp, Artificial sequence
  SiRNA target sequence
tgcccacatgtcctgtacg

SEQ ID NO: 108374 - DNA, 19 bp, Artificial sequence
  SiRNA target sequence
gcccacatgtcctgtacgt

SEQ ID NO: 108375 - DNA, 19 bp, Artificial sequence
  SiRNA target sequence
cccacatgtcctgtacgta

SEQ ID NO: 108376 - DNA, 19 bp, Artificial sequence
  SiRNA target sequence
ccacatgtcctgtacgtat

SEQ ID NO: 108377 - DNA, 19 bp, Artificial sequence
  SiRNA target sequence
cacatgtcctgtacgtatc

SEQ ID NO: 108378 - DNA, 19 bp, Artificial sequence
  SiRNA target sequence
acatgtcctgtacgtatca

SEQ ID NO: 108379 - DNA, 19 bp, Artificial sequence
  SiRNA target sequence
catgtcctgtacgtatcaa

SEQ ID NO: 108380 - DNA, 19 bp, Artificial sequence
  SiRNA target sequence
atgtcctgtacgtatcaat

SEQ ID NO: 108381 - DNA, 19 bp, Artificial sequence
  SiRNA target sequence
tgtcctgtacgtatcaatt

SEQ ID NO: 108382 - DNA, 19 bp, Artificial sequence
  SiRNA target sequence
gtcctgtacgtatcaattt

SEQ ID NO: 108383 - DNA, 19 bp, Artificial sequence
  SiRNA target sequence
tcctgtacgtatcaatttg

SEQ ID NO: 108384 - DNA, 19 bp, Artificial sequence
  SiRNA target sequence
cctgtacgtatcaatttgc

SEQ ID NO: 108385 - DNA, 19 bp, Artificial sequence
  SiRNA target sequence
ctgtacgtatcaatttgca

SEQ ID NO: 108386 - DNA, 19 bp, Artificial sequence
  SiRNA target sequence
tgtacgtatcaatttgcaa

SEQ ID NO: 108387 - DNA, 19 bp, Artificial sequence
  SiRNA target sequence
gtacgtatcaatttgcaag

SEQ ID NO: 108388 - DNA, 19 bp, Artificial sequence
  SiRNA target sequence
tacgtatcaatttgcaaga

SEQ ID NO: 108389 - DNA, 19 bp, Artificial sequence
  SiRNA target sequence
acgtatcaatttgcaagat

SEQ ID NO: 108390 - DNA, 19 bp, Artificial sequence
  SiRNA target sequence
cgtatcaatttgcaagatg

SEQ ID NO: 108391 - DNA, 19 bp, Artificial sequence
  SiRNA target sequence
gtatcaatttgcaagatga

SEQ ID NO: 108392 - DNA, 19 bp, Artificial sequence
  SiRNA target sequence
tatcaatttgcaagatgat

SEQ ID NO: 108393 - DNA, 19 bp, Artificial sequence
  SiRNA target sequence
atcaatttgcaagatgata

SEQ ID NO: 108394 - DNA, 19 bp, Artificial sequence
  SiRNA target sequence
tcaatttgcaagatgatag

SEQ ID NO: 108395 - DNA, 19 bp, Artificial sequence
  SiRNA target sequence
caatttgcaagatgatagg

SEQ ID NO: 108396 - DNA, 19 bp, Artificial sequence
  SiRNA target sequence
aatttgcaagatgataggt

SEQ ID NO: 108397 - DNA, 19 bp, Artificial sequence
  SiRNA target sequence
atttgcaagatgataggtc

SEQ ID NO: 108398 - DNA, 19 bp, Artificial sequence
  SiRNA target sequence
tttgcaagatgataggtcc

SEQ ID NO: 108399 - DNA, 19 bp, Artificial sequence
  SiRNA target sequence
ttgcaagatgataggtcct

SEQ ID NO: 108400 - DNA, 19 bp, Artificial sequence
  SiRNA target sequence
tgcaagatgataggtcctt

SEQ ID NO: 108401 - DNA, 19 bp, Artificial sequence
  SiRNA target sequence
gcaagatgataggtccttt

SEQ ID NO: 108402 - DNA, 19 bp, Artificial sequence
  SiRNA target sequence
caagatgataggtcctttt

SEQ ID NO: 108403 - DNA, 19 bp, Artificial sequence
  SiRNA target sequence
aagatgataggtccttttt

SEQ ID NO: 108404 - DNA, 19 bp, Artificial sequence
  SiRNA target sequence
agatgataggtcctttttc

SEQ ID NO: 108405 - DNA, 19 bp, Artificial sequence
  SiRNA target sequence
gatgataggtcctttttct

SEQ ID NO: 108406 - DNA, 19 bp, Artificial sequence
  SiRNA target sequence
atgataggtcctttttcta

SEQ ID NO: 108407 - DNA, 19 bp, Artificial sequence
  SiRNA target sequence
tgataggtcctttttctat

SEQ ID NO: 108408 - DNA, 19 bp, Artificial sequence
  SiRNA target sequence
gataggtcctttttctatt

SEQ ID NO: 108409 - DNA, 19 bp, Artificial sequence
  SiRNA target sequence
ataggtcctttttctattg

SEQ ID NO: 108410 - DNA, 19 bp, Artificial sequence
  SiRNA target sequence
taggtcctttttctattgc

SEQ ID NO: 108411 - DNA, 19 bp, Artificial sequence
  SiRNA target sequence
aggtcctttttctattgca

SEQ ID NO: 108412 - DNA, 19 bp, Artificial sequence
  SiRNA target sequence
ggtcctttttctattgcat

SEQ ID NO: 108413 - DNA, 19 bp, Artificial sequence
  SiRNA target sequence
gtcctttttctattgcatg

SEQ ID NO: 108414 - DNA, 19 bp, Artificial sequence
  SiRNA target sequence
tcctttttctattgcatgt

SEQ ID NO: 108415 - DNA, 19 bp, Artificial sequence
  SiRNA target sequence
cctttttctattgcatgtt

SEQ ID NO: 108416 - DNA, 19 bp, Artificial sequence
  SiRNA target sequence
ctttttctattgcatgttg

SEQ ID NO: 108417 - DNA, 19 bp, Artificial sequence
  SiRNA target sequence
tttttctattgcatgttgt

SEQ ID NO: 108418 - DNA, 19 bp, Artificial sequence
  SiRNA target sequence
ttttctattgcatgttgtc

SEQ ID NO: 108419 - DNA, 19 bp, Artificial sequence
  SiRNA target sequence
tttctattgcatgttgtct

SEQ ID NO: 108420 - DNA, 19 bp, Artificial sequence
  SiRNA target sequence
ttctattgcatgttgtcta

SEQ ID NO: 108421 - DNA, 19 bp, Artificial sequence
  SiRNA target sequence
tctattgcatgttgtctag

SEQ ID NO: 108422 - DNA, 19 bp, Artificial sequence
  SiRNA target sequence
ctattgcatgttgtctagc

SEQ ID NO: 108423 - DNA, 19 bp, Artificial sequence
  SiRNA target sequence
tattgcatgttgtctagca

SEQ ID NO: 108424 - DNA, 19 bp, Artificial sequence
  SiRNA target sequence
attgcatgttgtctagcaa

SEQ ID NO: 108425 - DNA, 19 bp, Artificial sequence
  SiRNA target sequence
ttgcatgttgtctagcaaa

SEQ ID NO: 108426 - DNA, 19 bp, Artificial sequence
  SiRNA target sequence
tgcatgttgtctagcaaat

SEQ ID NO: 108427 - DNA, 19 bp, Artificial sequence
  SiRNA target sequence
gcatgttgtctagcaaatg

SEQ ID NO: 108428 - DNA, 19 bp, Artificial sequence
  SiRNA target sequence
catgttgtctagcaaatgt

SEQ ID NO: 108429 - DNA, 19 bp, Artificial sequence
  SiRNA target sequence
atgttgtctagcaaatgta

SEQ ID NO: 108430 - DNA, 19 bp, Artificial sequence
  SiRNA target sequence
tgttgtctagcaaatgtaa

SEQ ID NO: 108431 - DNA, 19 bp, Artificial sequence
  SiRNA target sequence
gttgtctagcaaatgtaaa

SEQ ID NO: 108432 - DNA, 19 bp, Artificial sequence
  SiRNA target sequence
ttgtctagcaaatgtaaat

SEQ ID NO: 108433 - DNA, 19 bp, Artificial sequence
  SiRNA target sequence
tgtctagcaaatgtaaata

SEQ ID NO: 108434 - DNA, 19 bp, Artificial sequence
  SiRNA target sequence
gtctagcaaatgtaaatac

SEQ ID NO: 108435 - DNA, 19 bp, Artificial sequence
  SiRNA target sequence
tctagcaaatgtaaataca

SEQ ID NO: 108436 - DNA, 19 bp, Artificial sequence
  SiRNA target sequence
ctagcaaatgtaaatacat

SEQ ID NO: 108437 - DNA, 19 bp, Artificial sequence
  SiRNA target sequence
tagcaaatgtaaatacatc

SEQ ID NO: 108438 - DNA, 19 bp, Artificial sequence
  SiRNA target sequence
agcaaatgtaaatacatca

SEQ ID NO: 108439 - DNA, 19 bp, Artificial sequence
  SiRNA target sequence
gcaaatgtaaatacatcaa

SEQ ID NO: 108440 - DNA, 19 bp, Artificial sequence
  SiRNA target sequence
caaatgtaaatacatcaat

SEQ ID NO: 108441 - DNA, 19 bp, Artificial sequence
  SiRNA target sequence
aaatgtaaatacatcaatc

SEQ ID NO: 108442 - DNA, 19 bp, Artificial sequence
  SiRNA target sequence
aatgtaaatacatcaatca

SEQ ID NO: 108443 - DNA, 19 bp, Artificial sequence
  SiRNA target sequence
atgtaaatacatcaatcag

SEQ ID NO: 108444 - DNA, 19 bp, Artificial sequence
  SiRNA target sequence
tgtaaatacatcaatcagt

SEQ ID NO: 108445 - DNA, 19 bp, Artificial sequence
  SiRNA target sequence
gtaaatacatcaatcagtt

SEQ ID NO: 108446 - DNA, 19 bp, Artificial sequence
  SiRNA target sequence
taaatacatcaatcagttg

SEQ ID NO: 108447 - DNA, 19 bp, Artificial sequence
  SiRNA target sequence
aaatacatcaatcagttga

SEQ ID NO: 108448 - DNA, 19 bp, Artificial sequence
  SiRNA target sequence
aatacatcaatcagttgag

SEQ ID NO: 108449 - DNA, 19 bp, Artificial sequence
  SiRNA target sequence
atacatcaatcagttgagt

SEQ ID NO: 108450 - DNA, 19 bp, Artificial sequence
  SiRNA target sequence
tacatcaatcagttgagtt

SEQ ID NO: 108451 - DNA, 19 bp, Artificial sequence
  SiRNA target sequence
acatcaatcagttgagtta

SEQ ID NO: 108452 - DNA, 19 bp, Artificial sequence
  SiRNA target sequence
catcaatcagttgagttat

SEQ ID NO: 108453 - DNA, 19 bp, Artificial sequence
  SiRNA target sequence
atcaatcagttgagttatg

SEQ ID NO: 108454 - DNA, 19 bp, Artificial sequence
  SiRNA target sequence
tcaatcagttgagttatgt

SEQ ID NO: 108455 - DNA, 19 bp, Artificial sequence
  SiRNA target sequence
caatcagttgagttatgtt

SEQ ID NO: 108456 - DNA, 19 bp, Artificial sequence
  SiRNA target sequence
aatcagttgagttatgttt

SEQ ID NO: 108457 - DNA, 19 bp, Artificial sequence
  SiRNA target sequence
atcagttgagttatgtttt

SEQ ID NO: 108458 - DNA, 19 bp, Artificial sequence
  SiRNA target sequence
tcagttgagttatgttttt

SEQ ID NO: 108459 - DNA, 19 bp, Artificial sequence
  SiRNA target sequence
cagttgagttatgttttta

SEQ ID NO: 108460 - DNA, 19 bp, Artificial sequence
  SiRNA target sequence
agttgagttatgtttttat

SEQ ID NO: 108461 - DNA, 19 bp, Artificial sequence
  SiRNA target sequence
gttgagttatgtttttatc

SEQ ID NO: 108462 - DNA, 19 bp, Artificial sequence
  SiRNA target sequence
ttgagttatgtttttatct

SEQ ID NO: 108463 - DNA, 19 bp, Artificial sequence
  SiRNA target sequence
tgagttatgtttttatctg

SEQ ID NO: 108464 - DNA, 19 bp, Artificial sequence
  SiRNA target sequence
gagttatgtttttatctgt

SEQ ID NO: 108465 - DNA, 19 bp, Artificial sequence
  SiRNA target sequence
agttatgtttttatctgta

SEQ ID NO: 108466 - DNA, 19 bp, Artificial sequence
  SiRNA target sequence
gttatgtttttatctgtaa

SEQ ID NO: 108467 - DNA, 19 bp, Artificial sequence
  SiRNA target sequence
ttatgtttttatctgtaag

SEQ ID NO: 108468 - DNA, 19 bp, Artificial sequence
  SiRNA target sequence
tatgtttttatctgtaaga

SEQ ID NO: 108469 - DNA, 19 bp, Artificial sequence
  SiRNA target sequence
atgtttttatctgtaagac

SEQ ID NO: 108470 - DNA, 19 bp, Artificial sequence
  SiRNA target sequence
tgtttttatctgtaagacg

SEQ ID NO: 108471 - DNA, 19 bp, Artificial sequence
  SiRNA target sequence
gtttttatctgtaagacgt

SEQ ID NO: 108472 - DNA, 19 bp, Artificial sequence
  SiRNA target sequence
tttttatctgtaagacgta

SEQ ID NO: 108473 - DNA, 19 bp, Artificial sequence
  SiRNA target sequence
ttttatctgtaagacgtat

SEQ ID NO: 108474 - DNA, 19 bp, Artificial sequence
  SiRNA target sequence
tttatctgtaagacgtata

SEQ ID NO: 108475 - DNA, 19 bp, Artificial sequence
  SiRNA target sequence
ttatctgtaagacgtatac

SEQ ID NO: 108476 - DNA, 19 bp, Artificial sequence
  SiRNA target sequence
tatctgtaagacgtatacc

SEQ ID NO: 108477 - DNA, 19 bp, Artificial sequence
  SiRNA target sequence
atctgtaagacgtatacct

SEQ ID NO: 108478 - DNA, 19 bp, Artificial sequence
  SiRNA target sequence
tctgtaagacgtatacctg

SEQ ID NO: 108479 - DNA, 19 bp, Artificial sequence
  SiRNA target sequence
ctgtaagacgtatacctgg

SEQ ID NO: 108480 - DNA, 19 bp, Artificial sequence
  SiRNA target sequence
tgtaagacgtatacctgga

SEQ ID NO: 108481 - DNA, 19 bp, Artificial sequence
  SiRNA target sequence
gtaagacgtatacctggaa

SEQ ID NO: 108482 - DNA, 19 bp, Artificial sequence
  SiRNA target sequence
taagacgtatacctggaat

SEQ ID NO: 108483 - DNA, 19 bp, Artificial sequence
  SiRNA target sequence
aagacgtatacctggaata

SEQ ID NO: 108484 - DNA, 19 bp, Artificial sequence
  SiRNA target sequence
agacgtatacctggaatat

SEQ ID NO: 108485 - DNA, 19 bp, Artificial sequence
  SiRNA target sequence
gacgtatacctggaatatt

SEQ ID NO: 108486 - DNA, 19 bp, Artificial sequence
  SiRNA target sequence
acgtatacctggaatatta

SEQ ID NO: 108487 - DNA, 19 bp, Artificial sequence
  SiRNA target sequence
cgtatacctggaatattat

SEQ ID NO: 108488 - DNA, 19 bp, Artificial sequence
  SiRNA target sequence
gtatacctggaatattata

SEQ ID NO: 108489 - DNA, 19 bp, Artificial sequence
  SiRNA target sequence
tatacctggaatattatat

SEQ ID NO: 108490 - DNA, 19 bp, Artificial sequence
  SiRNA target sequence
atacctggaatattatatc

SEQ ID NO: 108491 - DNA, 19 bp, Artificial sequence
  SiRNA target sequence
tacctggaatattatatcc

SEQ ID NO: 108492 - DNA, 19 bp, Artificial sequence
  SiRNA target sequence
acctggaatattatatccc

SEQ ID NO: 108493 - DNA, 19 bp, Artificial sequence
  SiRNA target sequence
cctggaatattatatcccc

SEQ ID NO: 108494 - DNA, 19 bp, Artificial sequence
  SiRNA target sequence
ctggaatattatatcccct

SEQ ID NO: 108495 - DNA, 19 bp, Artificial sequence
  SiRNA target sequence
tggaatattatatcccctt

SEQ ID NO: 108496 - DNA, 19 bp, Artificial sequence
  SiRNA target sequence
ggaatattatatccccttt

SEQ ID NO: 108497 - DNA, 19 bp, Artificial sequence
  SiRNA target sequence
gaatattatatcccctttt

SEQ ID NO: 108498 - DNA, 19 bp, Artificial sequence
  SiRNA target sequence
aatattatatcccctttta

SEQ ID NO: 108499 - DNA, 19 bp, Artificial sequence
  SiRNA target sequence
atattatatccccttttaa

SEQ ID NO: 108500 - DNA, 19 bp, Artificial sequence
  SiRNA target sequence
tattatatccccttttaaa

SEQ ID NO: 108501 - DNA, 19 bp, Artificial sequence
  SiRNA target sequence
attatatccccttttaaaa

SEQ ID NO: 108502 - DNA, 19 bp, Artificial sequence
  SiRNA target sequence
ttatatccccttttaaaat

SEQ ID NO: 108503 - DNA, 19 bp, Artificial sequence
  SiRNA target sequence
tatatccccttttaaaata

SEQ ID NO: 108504 - DNA, 19 bp, Artificial sequence
  SiRNA target sequence
atatccccttttaaaatat

SEQ ID NO: 108505 - DNA, 19 bp, Artificial sequence
  SiRNA target sequence
tatccccttttaaaatatt

SEQ ID NO: 108506 - DNA, 19 bp, Artificial sequence
  SiRNA target sequence
atccccttttaaaatattc

SEQ ID NO: 108507 - DNA, 19 bp, Artificial sequence
  SiRNA target sequence
tccccttttaaaatattca

SEQ ID NO: 108508 - DNA, 19 bp, Artificial sequence
  SiRNA target sequence
ccccttttaaaatattcag

SEQ ID NO: 108509 - DNA, 19 bp, Artificial sequence
  SiRNA target sequence
cccttttaaaatattcagg

SEQ ID NO: 108510 - DNA, 19 bp, Artificial sequence
  SiRNA target sequence
ccttttaaaatattcagga

SEQ ID NO: 108511 - DNA, 19 bp, Artificial sequence
  SiRNA target sequence
cttttaaaatattcaggat

SEQ ID NO: 108512 - DNA, 19 bp, Artificial sequence
  SiRNA target sequence
ttttaaaatattcaggata

SEQ ID NO: 108513 - DNA, 19 bp, Artificial sequence
  SiRNA target sequence
tttaaaatattcaggatat

SEQ ID NO: 108514 - DNA, 19 bp, Artificial sequence
  SiRNA target sequence
ttaaaatattcaggatatg

SEQ ID NO: 108515 - DNA, 19 bp, Artificial sequence
  SiRNA target sequence
taaaatattcaggatatgt

SEQ ID NO: 108516 - DNA, 19 bp, Artificial sequence
  SiRNA target sequence
aaaatattcaggatatgta

SEQ ID NO: 108517 - DNA, 19 bp, Artificial sequence
  SiRNA target sequence
aaatattcaggatatgtag

SEQ ID NO: 108518 - DNA, 19 bp, Artificial sequence
  SiRNA target sequence
aatattcaggatatgtagt

SEQ ID NO: 108519 - DNA, 19 bp, Artificial sequence
  SiRNA target sequence
atattcaggatatgtagtg

SEQ ID NO: 108520 - DNA, 19 bp, Artificial sequence
  SiRNA target sequence
tattcaggatatgtagtgg

SEQ ID NO: 108521 - DNA, 19 bp, Artificial sequence
  SiRNA target sequence
attcaggatatgtagtgga

SEQ ID NO: 108522 - DNA, 19 bp, Artificial sequence
  SiRNA target sequence
ttcaggatatgtagtggaa

SEQ ID NO: 108523 - DNA, 19 bp, Artificial sequence
  SiRNA target sequence
tcaggatatgtagtggaat

SEQ ID NO: 108524 - DNA, 19 bp, Artificial sequence
  SiRNA target sequence
caggatatgtagtggaatt

SEQ ID NO: 108525 - DNA, 19 bp, Artificial sequence
  SiRNA target sequence
aggatatgtagtggaatta

SEQ ID NO: 108526 - DNA, 19 bp, Artificial sequence
  SiRNA target sequence
ggatatgtagtggaattac

SEQ ID NO: 108527 - DNA, 19 bp, Artificial sequence
  SiRNA target sequence
gatatgtagtggaattact

SEQ ID NO: 108528 - DNA, 19 bp, Artificial sequence
  SiRNA target sequence
atatgtagtggaattactt

SEQ ID NO: 108529 - DNA, 19 bp, Artificial sequence
  SiRNA target sequence
tatgtagtggaattacttt

SEQ ID NO: 108530 - DNA, 19 bp, Artificial sequence
  SiRNA target sequence
atgtagtggaattactttc

SEQ ID NO: 108531 - DNA, 19 bp, Artificial sequence
  SiRNA target sequence
tgtagtggaattactttca

SEQ ID NO: 108532 - DNA, 19 bp, Artificial sequence
  SiRNA target sequence
gtagtggaattactttcag

SEQ ID NO: 108533 - DNA, 19 bp, Artificial sequence
  SiRNA target sequence
tagtggaattactttcagg

SEQ ID NO: 108534 - DNA, 19 bp, Artificial sequence
  SiRNA target sequence
agtggaattactttcaggt

SEQ ID NO: 108535 - DNA, 19 bp, Artificial sequence
  SiRNA target sequence
gtggaattactttcaggtg

SEQ ID NO: 108536 - DNA, 19 bp, Artificial sequence
  SiRNA target sequence
tggaattactttcaggtgt

SEQ ID NO: 108537 - DNA, 19 bp, Artificial sequence
  SiRNA target sequence
ggaattactttcaggtgtc

SEQ ID NO: 108538 - DNA, 19 bp, Artificial sequence
  SiRNA target sequence
gaattactttcaggtgtcc

SEQ ID NO: 108539 - DNA, 19 bp, Artificial sequence
  SiRNA target sequence
aattactttcaggtgtcca

SEQ ID NO: 108540 - DNA, 19 bp, Artificial sequence
  SiRNA target sequence
attactttcaggtgtccac

SEQ ID NO: 108541 - DNA, 19 bp, Artificial sequence
  SiRNA target sequence
ttactttcaggtgtccaca

SEQ ID NO: 108542 - DNA, 19 bp, Artificial sequence
  SiRNA target sequence
tactttcaggtgtccacat

SEQ ID NO: 108543 - DNA, 19 bp, Artificial sequence
  SiRNA target sequence
actttcaggtgtccacata

SEQ ID NO: 108544 - DNA, 19 bp, Artificial sequence
  SiRNA target sequence
ctttcaggtgtccacatac

SEQ ID NO: 108545 - DNA, 19 bp, Artificial sequence
  SiRNA target sequence
tttcaggtgtccacatact

SEQ ID NO: 108546 - DNA, 19 bp, Artificial sequence
  SiRNA target sequence
ttcaggtgtccacatacta

SEQ ID NO: 108547 - DNA, 19 bp, Artificial sequence
  SiRNA target sequence
tcaggtgtccacatactat

SEQ ID NO: 108548 - DNA, 19 bp, Artificial sequence
  SiRNA target sequence
caggtgtccacatactata

SEQ ID NO: 108549 - DNA, 19 bp, Artificial sequence
  SiRNA target sequence
aggtgtccacatactataa

SEQ ID NO: 108550 - DNA, 19 bp, Artificial sequence
  SiRNA target sequence
ggtgtccacatactataat

SEQ ID NO: 108551 - DNA, 19 bp, Artificial sequence
  SiRNA target sequence
gtgtccacatactataatg

SEQ ID NO: 108552 - DNA, 19 bp, Artificial sequence
  SiRNA target sequence
tgtccacatactataatga

SEQ ID NO: 108553 - DNA, 19 bp, Artificial sequence
  SiRNA target sequence
gtccacatactataatgat

SEQ ID NO: 108554 - DNA, 19 bp, Artificial sequence
  SiRNA target sequence
tccacatactataatgatt

SEQ ID NO: 108555 - DNA, 19 bp, Artificial sequence
  SiRNA target sequence
ccacatactataatgatta

SEQ ID NO: 108556 - DNA, 19 bp, Artificial sequence
  SiRNA target sequence
cacatactataatgattat

SEQ ID NO: 108557 - DNA, 19 bp, Artificial sequence
  SiRNA target sequence
acatactataatgattatt

SEQ ID NO: 108558 - DNA, 19 bp, Artificial sequence
  SiRNA target sequence
catactataatgattattt

SEQ ID NO: 108559 - DNA, 19 bp, Artificial sequence
  SiRNA target sequence
atactataatgattatttt

SEQ ID NO: 108560 - DNA, 19 bp, Artificial sequence
  SiRNA target sequence
tactataatgattattttc

SEQ ID NO: 108561 - DNA, 19 bp, Artificial sequence
  SiRNA target sequence
actataatgattattttca

SEQ ID NO: 108562 - DNA, 19 bp, Artificial sequence
  SiRNA target sequence
ctataatgattattttcac

SEQ ID NO: 108563 - DNA, 19 bp, Artificial sequence
  SiRNA target sequence
tataatgattattttcaca

SEQ ID NO: 108564 - DNA, 19 bp, Artificial sequence
  SiRNA target sequence
ataatgattattttcacat

SEQ ID NO: 108565 - DNA, 19 bp, Artificial sequence
  SiRNA target sequence
taatgattattttcacata

SEQ ID NO: 108566 - DNA, 19 bp, Artificial sequence
  SiRNA target sequence
aatgattattttcacatac

SEQ ID NO: 108567 - DNA, 19 bp, Artificial sequence
  SiRNA target sequence
atgattattttcacataca

SEQ ID NO: 108568 - DNA, 19 bp, Artificial sequence
  SiRNA target sequence
tgattattttcacatacat

SEQ ID NO: 108569 - DNA, 19 bp, Artificial sequence
  SiRNA target sequence
gattattttcacatacata

SEQ ID NO: 108570 - DNA, 19 bp, Artificial sequence
  SiRNA target sequence
attattttcacatacataa

SEQ ID NO: 108571 - DNA, 19 bp, Artificial sequence
  SiRNA target sequence
ttattttcacatacataaa

SEQ ID NO: 108572 - DNA, 19 bp, Artificial sequence
  SiRNA target sequence
tattttcacatacataaac

SEQ ID NO: 108573 - DNA, 19 bp, Artificial sequence
  SiRNA target sequence
attttcacatacataaacc

SEQ ID NO: 108574 - DNA, 19 bp, Artificial sequence
  SiRNA target sequence
ttttcacatacataaacca

SEQ ID NO: 108575 - DNA, 19 bp, Artificial sequence
  SiRNA target sequence
tttcacatacataaaccac

SEQ ID NO: 108576 - DNA, 19 bp, Artificial sequence
  SiRNA target sequence
ttcacatacataaaccaca

SEQ ID NO: 108577 - DNA, 19 bp, Artificial sequence
  SiRNA target sequence
tcacatacataaaccacag

SEQ ID NO: 108578 - DNA, 19 bp, Artificial sequence
  SiRNA target sequence
cacatacataaaccacagg

SEQ ID NO: 108579 - DNA, 19 bp, Artificial sequence
  SiRNA target sequence
acatacataaaccacagga

SEQ ID NO: 108580 - DNA, 19 bp, Artificial sequence
  SiRNA target sequence
catacataaaccacaggaa

SEQ ID NO: 108581 - DNA, 19 bp, Artificial sequence
  SiRNA target sequence
atacataaaccacaggaag

SEQ ID NO: 108582 - DNA, 19 bp, Artificial sequence
  SiRNA target sequence
tacataaaccacaggaagt

SEQ ID NO: 108583 - DNA, 19 bp, Artificial sequence
  SiRNA target sequence
acataaaccacaggaagtt

SEQ ID NO: 108584 - DNA, 19 bp, Artificial sequence
  SiRNA target sequence
cataaaccacaggaagttt

SEQ ID NO: 108585 - DNA, 19 bp, Artificial sequence
  SiRNA target sequence
ataaaccacaggaagtttc

SEQ ID NO: 108586 - DNA, 19 bp, Artificial sequence
  SiRNA target sequence
taaaccacaggaagtttcc

SEQ ID NO: 108587 - DNA, 19 bp, Artificial sequence
  SiRNA target sequence
aaaccacaggaagtttcca

SEQ ID NO: 108588 - DNA, 19 bp, Artificial sequence
  SiRNA target sequence
aaccacaggaagtttccat

SEQ ID NO: 108589 - DNA, 19 bp, Artificial sequence
  SiRNA target sequence
accacaggaagtttccata

SEQ ID NO: 108590 - DNA, 19 bp, Artificial sequence
  SiRNA target sequence
ccacaggaagtttccataa

SEQ ID NO: 108591 - DNA, 19 bp, Artificial sequence
  SiRNA target sequence
cacaggaagtttccataat

SEQ ID NO: 108592 - DNA, 19 bp, Artificial sequence
  SiRNA target sequence
acaggaagtttccataatg

SEQ ID NO: 108593 - DNA, 19 bp, Artificial sequence
  SiRNA target sequence
caggaagtttccataatgc

SEQ ID NO: 108594 - DNA, 19 bp, Artificial sequence
  SiRNA target sequence
aggaagtttccataatgca

SEQ ID NO: 108595 - DNA, 19 bp, Artificial sequence
  SiRNA target sequence
ggaagtttccataatgcag

SEQ ID NO: 108596 - DNA, 19 bp, Artificial sequence
  SiRNA target sequence
gaagtttccataatgcagc

SEQ ID NO: 108597 - DNA, 19 bp, Artificial sequence
  SiRNA target sequence
aagtttccataatgcagcc

SEQ ID NO: 108598 - DNA, 19 bp, Artificial sequence
  SiRNA target sequence
agtttccataatgcagcca

SEQ ID NO: 108599 - DNA, 19 bp, Artificial sequence
  SiRNA target sequence
gtttccataatgcagccat

SEQ ID NO: 108600 - DNA, 19 bp, Artificial sequence
  SiRNA target sequence
tttccataatgcagccata

SEQ ID NO: 108601 - DNA, 19 bp, Artificial sequence
  SiRNA target sequence
ttccataatgcagccatat

SEQ ID NO: 108602 - DNA, 19 bp, Artificial sequence
  SiRNA target sequence
tccataatgcagccatatt

SEQ ID NO: 108603 - DNA, 19 bp, Artificial sequence
  SiRNA target sequence
ccataatgcagccatattg

SEQ ID NO: 108604 - DNA, 19 bp, Artificial sequence
  SiRNA target sequence
cataatgcagccatattga

SEQ ID NO: 108605 - DNA, 19 bp, Artificial sequence
  SiRNA target sequence
ataatgcagccatattgaa

SEQ ID NO: 108606 - DNA, 19 bp, Artificial sequence
  SiRNA target sequence
taatgcagccatattgaac

SEQ ID NO: 108607 - DNA, 19 bp, Artificial sequence
  SiRNA target sequence
aatgcagccatattgaacg

SEQ ID NO: 108608 - DNA, 19 bp, Artificial sequence
  SiRNA target sequence
atgcagccatattgaacga

SEQ ID NO: 108609 - DNA, 19 bp, Artificial sequence
  SiRNA target sequence
tgcagccatattgaacgac

SEQ ID NO: 108610 - DNA, 19 bp, Artificial sequence
  SiRNA target sequence
gcagccatattgaacgact

SEQ ID NO: 108611 - DNA, 19 bp, Artificial sequence
  SiRNA target sequence
cagccatattgaacgactc

SEQ ID NO: 108612 - DNA, 19 bp, Artificial sequence
  SiRNA target sequence
agccatattgaacgactcc

SEQ ID NO: 108613 - DNA, 19 bp, Artificial sequence
  SiRNA target sequence
gccatattgaacgactccc

SEQ ID NO: 108614 - DNA, 19 bp, Artificial sequence
  SiRNA target sequence
ccatattgaacgactccca

SEQ ID NO: 108615 - DNA, 19 bp, Artificial sequence
  SiRNA target sequence
catattgaacgactcccag

SEQ ID NO: 108616 - DNA, 19 bp, Artificial sequence
  SiRNA target sequence
atattgaacgactcccaga

SEQ ID NO: 108617 - DNA, 19 bp, Artificial sequence
  SiRNA target sequence
tattgaacgactcccagac

SEQ ID NO: 108618 - DNA, 19 bp, Artificial sequence
  SiRNA target sequence
attgaacgactcccagacc

SEQ ID NO: 108619 - DNA, 19 bp, Artificial sequence
  SiRNA target sequence
ttgaacgactcccagacct

SEQ ID NO: 108620 - DNA, 19 bp, Artificial sequence
  SiRNA target sequence
tgaacgactcccagacctg

SEQ ID NO: 108621 - DNA, 19 bp, Artificial sequence
  SiRNA target sequence
gaacgactcccagacctgt

SEQ ID NO: 108622 - DNA, 19 bp, Artificial sequence
  SiRNA target sequence
aacgactcccagacctgtc

SEQ ID NO: 108623 - DNA, 19 bp, Artificial sequence
  SiRNA target sequence
acgactcccagacctgtcc

SEQ ID NO: 108624 - DNA, 19 bp, Artificial sequence
  SiRNA target sequence
cgactcccagacctgtccc

SEQ ID NO: 108625 - DNA, 19 bp, Artificial sequence
  SiRNA target sequence
gactcccagacctgtccct

SEQ ID NO: 108626 - DNA, 19 bp, Artificial sequence
  SiRNA target sequence
actcccagacctgtccctg

SEQ ID NO: 108627 - DNA, 19 bp, Artificial sequence
  SiRNA target sequence
ctcccagacctgtccctga

SEQ ID NO: 108628 - DNA, 19 bp, Artificial sequence
  SiRNA target sequence
tcccagacctgtccctgat

SEQ ID NO: 108629 - DNA, 19 bp, Artificial sequence
  SiRNA target sequence
cccagacctgtccctgatt

SEQ ID NO: 108630 - DNA, 19 bp, Artificial sequence
  SiRNA target sequence
ccagacctgtccctgattt

SEQ ID NO: 108631 - DNA, 19 bp, Artificial sequence
  SiRNA target sequence
cagacctgtccctgatttg

SEQ ID NO: 108632 - DNA, 19 bp, Artificial sequence
  SiRNA target sequence
agacctgtccctgatttgc

SEQ ID NO: 108633 - DNA, 19 bp, Artificial sequence
  SiRNA target sequence
gacctgtccctgatttgca

SEQ ID NO: 108634 - DNA, 19 bp, Artificial sequence
  SiRNA target sequence
acctgtccctgatttgcag

SEQ ID NO: 108635 - DNA, 19 bp, Artificial sequence
  SiRNA target sequence
cctgtccctgatttgcagc

SEQ ID NO: 108636 - DNA, 19 bp, Artificial sequence
  SiRNA target sequence
ctgtccctgatttgcagca

SEQ ID NO: 108637 - DNA, 19 bp, Artificial sequence
  SiRNA target sequence
tgtccctgatttgcagcac

SEQ ID NO: 108638 - DNA, 19 bp, Artificial sequence
  SiRNA target sequence
gtccctgatttgcagcacc

SEQ ID NO: 108639 - DNA, 19 bp, Artificial sequence
  SiRNA target sequence
tccctgatttgcagcacca

SEQ ID NO: 108640 - DNA, 19 bp, Artificial sequence
  SiRNA target sequence
ccctgatttgcagcaccat

SEQ ID NO: 108641 - DNA, 19 bp, Artificial sequence
  SiRNA target sequence
cctgatttgcagcaccatc

SEQ ID NO: 108642 - DNA, 19 bp, Artificial sequence
  SiRNA target sequence
ctgatttgcagcaccatcc

SEQ ID NO: 108643 - DNA, 19 bp, Artificial sequence
  SiRNA target sequence
tgatttgcagcaccatccc

SEQ ID NO: 108644 - DNA, 19 bp, Artificial sequence
  SiRNA target sequence
gatttgcagcaccatcccc

SEQ ID NO: 108645 - DNA, 19 bp, Artificial sequence
  SiRNA target sequence
atttgcagcaccatccccg

SEQ ID NO: 108646 - DNA, 19 bp, Artificial sequence
  SiRNA target sequence
tttgcagcaccatccccga

SEQ ID NO: 108647 - DNA, 19 bp, Artificial sequence
  SiRNA target sequence
ttgcagcaccatccccgaa

SEQ ID NO: 108648 - DNA, 19 bp, Artificial sequence
  SiRNA target sequence
tgcagcaccatccccgaaa

SEQ ID NO: 108649 - DNA, 19 bp, Artificial sequence
  SiRNA target sequence
gcagcaccatccccgaaaa

SEQ ID NO: 108650 - DNA, 19 bp, Artificial sequence
  SiRNA target sequence
cagcaccatccccgaaaaa

SEQ ID NO: 108651 - DNA, 19 bp, Artificial sequence
  SiRNA target sequence
agcaccatccccgaaaaat

SEQ ID NO: 108652 - DNA, 19 bp, Artificial sequence
  SiRNA target sequence
gcaccatccccgaaaaata

SEQ ID NO: 108653 - DNA, 19 bp, Artificial sequence
  SiRNA target sequence
caccatccccgaaaaatac

SEQ ID NO: 108654 - DNA, 19 bp, Artificial sequence
  SiRNA target sequence
accatccccgaaaaataca

SEQ ID NO: 108655 - DNA, 19 bp, Artificial sequence
  SiRNA target sequence
ccatccccgaaaaatacaa

SEQ ID NO: 108656 - DNA, 19 bp, Artificial sequence
  SiRNA target sequence
catccccgaaaaatacaaa

SEQ ID NO: 108657 - DNA, 19 bp, Artificial sequence
  SiRNA target sequence
atccccgaaaaatacaaat

SEQ ID NO: 108658 - DNA, 19 bp, Artificial sequence
  SiRNA target sequence
tccccgaaaaatacaaatg

SEQ ID NO: 108659 - DNA, 19 bp, Artificial sequence
  SiRNA target sequence
ccccgaaaaatacaaatgc

SEQ ID NO: 108660 - DNA, 19 bp, Artificial sequence
  SiRNA target sequence
cccgaaaaatacaaatgct

SEQ ID NO: 108661 - DNA, 19 bp, Artificial sequence
  SiRNA target sequence
ccgaaaaatacaaatgcta

SEQ ID NO: 108662 - DNA, 19 bp, Artificial sequence
  SiRNA target sequence
cgaaaaatacaaatgctac

SEQ ID NO: 108663 - DNA, 19 bp, Artificial sequence
  SiRNA target sequence
gaaaaatacaaatgctaca

SEQ ID NO: 108664 - DNA, 19 bp, Artificial sequence
  SiRNA target sequence
aaaaatacaaatgctacat

SEQ ID NO: 108665 - DNA, 19 bp, Artificial sequence
  SiRNA target sequence
aaaatacaaatgctacatt

SEQ ID NO: 108666 - DNA, 19 bp, Artificial sequence
  SiRNA target sequence
aaatacaaatgctacattt

SEQ ID NO: 108667 - DNA, 19 bp, Artificial sequence
  SiRNA target sequence
aatacaaatgctacatttt

SEQ ID NO: 108668 - DNA, 19 bp, Artificial sequence
  SiRNA target sequence
atacaaatgctacattttt

SEQ ID NO: 108669 - DNA, 19 bp, Artificial sequence
  SiRNA target sequence
tacaaatgctacatttttt

SEQ ID NO: 108670 - DNA, 19 bp, Artificial sequence
  SiRNA target sequence
acaaatgctacatttttta

SEQ ID NO: 108671 - DNA, 19 bp, Artificial sequence
  SiRNA target sequence
caaatgctacattttttac

SEQ ID NO: 108672 - DNA, 19 bp, Artificial sequence
  SiRNA target sequence
aaatgctacattttttact

SEQ ID NO: 108673 - DNA, 19 bp, Artificial sequence
  SiRNA target sequence
aatgctacattttttactt

SEQ ID NO: 108674 - DNA, 19 bp, Artificial sequence
  SiRNA target sequence
atgctacattttttacttt

SEQ ID NO: 108675 - DNA, 19 bp, Artificial sequence
  SiRNA target sequence
tgctacattttttactttt

SEQ ID NO: 108676 - DNA, 19 bp, Artificial sequence
  SiRNA target sequence
gctacattttttacttttt

SEQ ID NO: 108677 - DNA, 19 bp, Artificial sequence
  SiRNA target sequence
ctacattttttactttttt

SEQ ID NO: 108678 - DNA, 19 bp, Artificial sequence
  SiRNA target sequence
tacattttttactttttta

SEQ ID NO: 108679 - DNA, 19 bp, Artificial sequence
  SiRNA target sequence
acattttttacttttttat

SEQ ID NO: 108680 - DNA, 19 bp, Artificial sequence
  SiRNA target sequence
cattttttacttttttata

SEQ ID NO: 108681 - DNA, 19 bp, Artificial sequence
  SiRNA target sequence
attttttacttttttatat

SEQ ID NO: 108682 - DNA, 19 bp, Artificial sequence
  SiRNA target sequence
ttttttacttttttatatt

SEQ ID NO: 108683 - DNA, 19 bp, Artificial sequence
  SiRNA target sequence
tttttacttttttatattg

SEQ ID NO: 108684 - DNA, 19 bp, Artificial sequence
  SiRNA target sequence
ttttacttttttatattgt

SEQ ID NO: 108685 - DNA, 19 bp, Artificial sequence
  SiRNA target sequence
tttacttttttatattgta

SEQ ID NO: 108686 - DNA, 19 bp, Artificial sequence
  SiRNA target sequence
ttacttttttatattgtaa

SEQ ID NO: 108687 - DNA, 19 bp, Artificial sequence
  SiRNA target sequence
tacttttttatattgtaaa

SEQ ID NO: 108688 - DNA, 19 bp, Artificial sequence
  SiRNA target sequence
acttttttatattgtaaag

SEQ ID NO: 108689 - DNA, 19 bp, Artificial sequence
  SiRNA target sequence
cttttttatattgtaaagc

SEQ ID NO: 108690 - DNA, 19 bp, Artificial sequence
  SiRNA target sequence
ttttttatattgtaaagca

SEQ ID NO: 108691 - DNA, 19 bp, Artificial sequence
  SiRNA target sequence
tttttatattgtaaagcaa

SEQ ID NO: 108692 - DNA, 19 bp, Artificial sequence
  SiRNA target sequence
ttttatattgtaaagcaaa

SEQ ID NO: 108693 - DNA, 19 bp, Artificial sequence
  SiRNA target sequence
tttatattgtaaagcaaat

SEQ ID NO: 108694 - DNA, 19 bp, Artificial sequence
  SiRNA target sequence
ttatattgtaaagcaaatc

SEQ ID NO: 108695 - DNA, 19 bp, Artificial sequence
  SiRNA target sequence
tatattgtaaagcaaatcc

SEQ ID NO: 108696 - DNA, 19 bp, Artificial sequence
  SiRNA target sequence
atattgtaaagcaaatccc

SEQ ID NO: 108697 - DNA, 19 bp, Artificial sequence
  SiRNA target sequence
tattgtaaagcaaatccca

SEQ ID NO: 108698 - DNA, 19 bp, Artificial sequence
  SiRNA target sequence
attgtaaagcaaatcccaa

SEQ ID NO: 108699 - DNA, 19 bp, Artificial sequence
  SiRNA target sequence
ttgtaaagcaaatcccaat

SEQ ID NO: 108700 - DNA, 19 bp, Artificial sequence
  SiRNA target sequence
tgtaaagcaaatcccaatc

SEQ ID NO: 108701 - DNA, 19 bp, Artificial sequence
  SiRNA target sequence
gtaaagcaaatcccaatcc

SEQ ID NO: 108702 - DNA, 19 bp, Artificial sequence
  SiRNA target sequence
taaagcaaatcccaatcct

SEQ ID NO: 108703 - DNA, 19 bp, Artificial sequence
  SiRNA target sequence
aaagcaaatcccaatcctg

SEQ ID NO: 108704 - DNA, 19 bp, Artificial sequence
  SiRNA target sequence
aagcaaatcccaatcctgt

SEQ ID NO: 108705 - DNA, 19 bp, Artificial sequence
  SiRNA target sequence
agcaaatcccaatcctgta

SEQ ID NO: 108706 - DNA, 19 bp, Artificial sequence
  SiRNA target sequence
gcaaatcccaatcctgtac

SEQ ID NO: 108707 - DNA, 19 bp, Artificial sequence
  SiRNA target sequence
caaatcccaatcctgtacc

SEQ ID NO: 108708 - DNA, 19 bp, Artificial sequence
  SiRNA target sequence
aaatcccaatcctgtacca

SEQ ID NO: 108709 - DNA, 19 bp, Artificial sequence
  SiRNA target sequence
aatcccaatcctgtaccaa

SEQ ID NO: 108710 - DNA, 19 bp, Artificial sequence
  SiRNA target sequence
atcccaatcctgtaccaag

SEQ ID NO: 108711 - DNA, 19 bp, Artificial sequence
  SiRNA target sequence
tcccaatcctgtaccaagc

SEQ ID NO: 108712 - DNA, 19 bp, Artificial sequence
  SiRNA target sequence
cccaatcctgtaccaagcg

SEQ ID NO: 108713 - DNA, 19 bp, Artificial sequence
  SiRNA target sequence
ccaatcctgtaccaagcga

SEQ ID NO: 108714 - DNA, 19 bp, Artificial sequence
  SiRNA target sequence
caatcctgtaccaagcgat

SEQ ID NO: 108715 - DNA, 19 bp, Artificial sequence
  SiRNA target sequence
aatcctgtaccaagcgata

SEQ ID NO: 108716 - DNA, 19 bp, Artificial sequence
  SiRNA target sequence
atcctgtaccaagcgatac

SEQ ID NO: 108717 - DNA, 19 bp, Artificial sequence
  SiRNA target sequence
tcctgtaccaagcgatacc

SEQ ID NO: 108718 - DNA, 19 bp, Artificial sequence
  SiRNA target sequence
cctgtaccaagcgatacct

SEQ ID NO: 108719 - DNA, 19 bp, Artificial sequence
  SiRNA target sequence
ctgtaccaagcgatacctg

SEQ ID NO: 108720 - DNA, 19 bp, Artificial sequence
  SiRNA target sequence
tgtaccaagcgatacctgc

SEQ ID NO: 108721 - DNA, 19 bp, Artificial sequence
  SiRNA target sequence
gtaccaagcgatacctgcg

SEQ ID NO: 108722 - DNA, 19 bp, Artificial sequence
  SiRNA target sequence
taccaagcgatacctgcgc

SEQ ID NO: 108723 - DNA, 19 bp, Artificial sequence
  SiRNA target sequence
accaagcgatacctgcgca

SEQ ID NO: 108724 - DNA, 19 bp, Artificial sequence
  SiRNA target sequence
ccaagcgatacctgcgcac

SEQ ID NO: 108725 - DNA, 19 bp, Artificial sequence
  SiRNA target sequence
caagcgatacctgcgcacc

SEQ ID NO: 108726 - DNA, 19 bp, Artificial sequence
  SiRNA target sequence
aagcgatacctgcgcacct

SEQ ID NO: 108727 - DNA, 19 bp, Artificial sequence
  SiRNA target sequence
agcgatacctgcgcaccta

SEQ ID NO: 108728 - DNA, 19 bp, Artificial sequence
  SiRNA target sequence
gcgatacctgcgcacctac

SEQ ID NO: 108729 - DNA, 19 bp, Artificial sequence
  SiRNA target sequence
cgatacctgcgcacctact

SEQ ID NO: 108730 - DNA, 19 bp, Artificial sequence
  SiRNA target sequence
gatacctgcgcacctacta

SEQ ID NO: 108731 - DNA, 19 bp, Artificial sequence
  SiRNA target sequence
atacctgcgcacctactat

SEQ ID NO: 108732 - DNA, 19 bp, Artificial sequence
  SiRNA target sequence
tacctgcgcacctactata

SEQ ID NO: 108733 - DNA, 19 bp, Artificial sequence
  SiRNA target sequence
acctgcgcacctactatac

SEQ ID NO: 108734 - DNA, 19 bp, Artificial sequence
  SiRNA target sequence
cctgcgcacctactatacc

SEQ ID NO: 108735 - DNA, 19 bp, Artificial sequence
  SiRNA target sequence
ctgcgcacctactataccg

SEQ ID NO: 108736 - DNA, 19 bp, Artificial sequence
  SiRNA target sequence
tgcgcacctactataccgt

SEQ ID NO: 108737 - DNA, 19 bp, Artificial sequence
  SiRNA target sequence
gcgcacctactataccgtg

SEQ ID NO: 108738 - DNA, 19 bp, Artificial sequence
  SiRNA target sequence
cgcacctactataccgtgt

SEQ ID NO: 108739 - DNA, 19 bp, Artificial sequence
  SiRNA target sequence
gcacctactataccgtgtc

SEQ ID NO: 108740 - DNA, 19 bp, Artificial sequence
  SiRNA target sequence
cacctactataccgtgtcc

SEQ ID NO: 108741 - DNA, 19 bp, Artificial sequence
  SiRNA target sequence
acctactataccgtgtccc

SEQ ID NO: 108742 - DNA, 19 bp, Artificial sequence
  SiRNA target sequence
cctactataccgtgtcccc

SEQ ID NO: 108743 - DNA, 19 bp, Artificial sequence
  SiRNA target sequence
ctactataccgtgtccccc

SEQ ID NO: 108744 - DNA, 19 bp, Artificial sequence
  SiRNA target sequence
tactataccgtgtccccca

SEQ ID NO: 108745 - DNA, 19 bp, Artificial sequence
  SiRNA target sequence
actataccgtgtcccccat

SEQ ID NO: 108746 - DNA, 19 bp, Artificial sequence
  SiRNA target sequence
ctataccgtgtcccccata

SEQ ID NO: 108747 - DNA, 19 bp, Artificial sequence
  SiRNA target sequence
tataccgtgtcccccataa

SEQ ID NO: 108748 - DNA, 19 bp, Artificial sequence
  SiRNA target sequence
ataccgtgtcccccataaa

SEQ ID NO: 108749 - DNA, 19 bp, Artificial sequence
  SiRNA target sequence
taccgtgtcccccataaaa

SEQ ID NO: 108750 - DNA, 19 bp, Artificial sequence
  SiRNA target sequence
accgtgtcccccataaaat

SEQ ID NO: 108751 - DNA, 19 bp, Artificial sequence
  SiRNA target sequence
ccgtgtcccccataaaatt

SEQ ID NO: 108752 - DNA, 19 bp, Artificial sequence
  SiRNA target sequence
cgtgtcccccataaaattg

SEQ ID NO: 108753 - DNA, 19 bp, Artificial sequence
  SiRNA target sequence
gtgtcccccataaaattgg

SEQ ID NO: 108754 - DNA, 19 bp, Artificial sequence
  SiRNA target sequence
tgtcccccataaaattggt

SEQ ID NO: 108755 - DNA, 19 bp, Artificial sequence
  SiRNA target sequence
gtcccccataaaattggtc

SEQ ID NO: 108756 - DNA, 19 bp, Artificial sequence
  SiRNA target sequence
tcccccataaaattggtca

SEQ ID NO: 108757 - DNA, 19 bp, Artificial sequence
  SiRNA target sequence
cccccataaaattggtcat

SEQ ID NO: 108758 - DNA, 19 bp, Artificial sequence
  SiRNA target sequence
ccccataaaattggtcatt

SEQ ID NO: 108759 - DNA, 19 bp, Artificial sequence
  SiRNA target sequence
cccataaaattggtcatta

SEQ ID NO: 108760 - DNA, 19 bp, Artificial sequence
  SiRNA target sequence
ccataaaattggtcattat

SEQ ID NO: 108761 - DNA, 19 bp, Artificial sequence
  SiRNA target sequence
cataaaattggtcattata

SEQ ID NO: 108762 - DNA, 19 bp, Artificial sequence
  SiRNA target sequence
ataaaattggtcattatac

SEQ ID NO: 108763 - DNA, 19 bp, Artificial sequence
  SiRNA target sequence
taaaattggtcattataca

SEQ ID NO: 108764 - DNA, 19 bp, Artificial sequence
  SiRNA target sequence
aaaattggtcattatacaa

SEQ ID NO: 108765 - DNA, 19 bp, Artificial sequence
  SiRNA target sequence
aaattggtcattatacaaa

SEQ ID NO: 108766 - DNA, 19 bp, Artificial sequence
  SiRNA target sequence
aattggtcattatacaaat

SEQ ID NO: 108767 - DNA, 19 bp, Artificial sequence
  SiRNA target sequence
attggtcattatacaaatg

SEQ ID NO: 108768 - DNA, 19 bp, Artificial sequence
  SiRNA target sequence
ttggtcattatacaaatgc

SEQ ID NO: 108769 - DNA, 19 bp, Artificial sequence
  SiRNA target sequence
tggtcattatacaaatgca

SEQ ID NO: 108770 - DNA, 19 bp, Artificial sequence
  SiRNA target sequence
ggtcattatacaaatgcat

SEQ ID NO: 108771 - DNA, 19 bp, Artificial sequence
  SiRNA target sequence
gtcattatacaaatgcatc

SEQ ID NO: 108772 - DNA, 19 bp, Artificial sequence
  SiRNA target sequence
tcattatacaaatgcatcg

SEQ ID NO: 108773 - DNA, 19 bp, Artificial sequence
  SiRNA target sequence
cattatacaaatgcatcga

SEQ ID NO: 108774 - DNA, 19 bp, Artificial sequence
  SiRNA target sequence
attatacaaatgcatcgat

SEQ ID NO: 108775 - DNA, 19 bp, Artificial sequence
  SiRNA target sequence
ttatacaaatgcatcgatc

SEQ ID NO: 108776 - DNA, 19 bp, Artificial sequence
  SiRNA target sequence
tatacaaatgcatcgatcc

SEQ ID NO: 108777 - DNA, 19 bp, Artificial sequence
  SiRNA target sequence
atacaaatgcatcgatcct

SEQ ID NO: 108778 - DNA, 19 bp, Artificial sequence
  SiRNA target sequence
tacaaatgcatcgatcctc

SEQ ID NO: 108779 - DNA, 19 bp, Artificial sequence
  SiRNA target sequence
acaaatgcatcgatcctcc

SEQ ID NO: 108780 - DNA, 19 bp, Artificial sequence
  SiRNA target sequence
caaatgcatcgatcctcct

SEQ ID NO: 108781 - DNA, 19 bp, Artificial sequence
  SiRNA target sequence
aaatgcatcgatcctcctt

SEQ ID NO: 108782 - DNA, 19 bp, Artificial sequence
  SiRNA target sequence
aatgcatcgatcctccttt

SEQ ID NO: 108783 - DNA, 19 bp, Artificial sequence
  SiRNA target sequence
atgcatcgatcctcctttt

SEQ ID NO: 108784 - DNA, 19 bp, Artificial sequence
  SiRNA target sequence
tgcatcgatcctccttttc

SEQ ID NO: 108785 - DNA, 19 bp, Artificial sequence
  SiRNA target sequence
gcatcgatcctccttttcc

SEQ ID NO: 108786 - DNA, 19 bp, Artificial sequence
  SiRNA target sequence
catcgatcctccttttcct

SEQ ID NO: 108787 - DNA, 19 bp, Artificial sequence
  SiRNA target sequence
atcgatcctccttttcctt

SEQ ID NO: 108788 - DNA, 19 bp, Artificial sequence
  SiRNA target sequence
tcgatcctccttttccttt

SEQ ID NO: 108789 - DNA, 19 bp, Artificial sequence
  SiRNA target sequence
cgatcctccttttcctttg

SEQ ID NO: 108790 - DNA, 19 bp, Artificial sequence
  SiRNA target sequence
gatcctccttttcctttgc

SEQ ID NO: 108791 - DNA, 19 bp, Artificial sequence
  SiRNA target sequence
atcctccttttcctttgca

SEQ ID NO: 108792 - DNA, 19 bp, Artificial sequence
  SiRNA target sequence
tcctccttttcctttgcaa

SEQ ID NO: 108793 - DNA, 19 bp, Artificial sequence
  SiRNA target sequence
cctccttttcctttgcaat

SEQ ID NO: 108794 - DNA, 19 bp, Artificial sequence
  SiRNA target sequence
ctccttttcctttgcaatt

SEQ ID NO: 108795 - DNA, 19 bp, Artificial sequence
  SiRNA target sequence
tccttttcctttgcaatta

SEQ ID NO: 108796 - DNA, 19 bp, Artificial sequence
  SiRNA target sequence
ccttttcctttgcaattac

SEQ ID NO: 108797 - DNA, 19 bp, Artificial sequence
  SiRNA target sequence
cttttcctttgcaattacc

SEQ ID NO: 108798 - DNA, 19 bp, Artificial sequence
  SiRNA target sequence
ttttcctttgcaattacca

SEQ ID NO: 108799 - DNA, 19 bp, Artificial sequence
  SiRNA target sequence
tttcctttgcaattaccaa

SEQ ID NO: 108800 - DNA, 19 bp, Artificial sequence
  SiRNA target sequence
ttcctttgcaattaccaat

SEQ ID NO: 108801 - DNA, 19 bp, Artificial sequence
  SiRNA target sequence
tcctttgcaattaccaata

SEQ ID NO: 108802 - DNA, 19 bp, Artificial sequence
  SiRNA target sequence
cctttgcaattaccaatag

SEQ ID NO: 108803 - DNA, 19 bp, Artificial sequence
  SiRNA target sequence
ctttgcaattaccaatagc

SEQ ID NO: 108804 - DNA, 19 bp, Artificial sequence
  SiRNA target sequence
tttgcaattaccaatagcc

SEQ ID NO: 108805 - DNA, 19 bp, Artificial sequence
  SiRNA target sequence
ttgcaattaccaatagcct

SEQ ID NO: 108806 - DNA, 19 bp, Artificial sequence
  SiRNA target sequence
tgcaattaccaatagcctt

SEQ ID NO: 108807 - DNA, 19 bp, Artificial sequence
  SiRNA target sequence
gcaattaccaatagccttt

SEQ ID NO: 108808 - DNA, 19 bp, Artificial sequence
  SiRNA target sequence
caattaccaatagcctttc

SEQ ID NO: 108809 - DNA, 19 bp, Artificial sequence
  SiRNA target sequence
aattaccaatagcctttcc

SEQ ID NO: 108810 - DNA, 19 bp, Artificial sequence
  SiRNA target sequence
attaccaatagcctttcct

SEQ ID NO: 108811 - DNA, 19 bp, Artificial sequence
  SiRNA target sequence
ttaccaatagcctttccta

SEQ ID NO: 108812 - DNA, 19 bp, Artificial sequence
  SiRNA target sequence
taccaatagcctttcctaa

SEQ ID NO: 108813 - DNA, 19 bp, Artificial sequence
  SiRNA target sequence
accaatagcctttcctaat

SEQ ID NO: 108814 - DNA, 19 bp, Artificial sequence
  SiRNA target sequence
ccaatagcctttcctaata

SEQ ID NO: 108815 - DNA, 19 bp, Artificial sequence
  SiRNA target sequence
caatagcctttcctaataa

SEQ ID NO: 108816 - DNA, 19 bp, Artificial sequence
  SiRNA target sequence
aatagcctttcctaataat

SEQ ID NO: 108817 - DNA, 19 bp, Artificial sequence
  SiRNA target sequence
atagcctttcctaataatt

SEQ ID NO: 108818 - DNA, 19 bp, Artificial sequence
  SiRNA target sequence
tagcctttcctaataattc

SEQ ID NO: 108819 - DNA, 19 bp, Artificial sequence
  SiRNA target sequence
agcctttcctaataattcc

SEQ ID NO: 108820 - DNA, 19 bp, Artificial sequence
  SiRNA target sequence
gcctttcctaataattccc

SEQ ID NO: 108821 - DNA, 19 bp, Artificial sequence
  SiRNA target sequence
cctttcctaataattcccc

SEQ ID NO: 108822 - DNA, 19 bp, Artificial sequence
  SiRNA target sequence
ctttcctaataattcccct

SEQ ID NO: 108823 - DNA, 19 bp, Artificial sequence
  SiRNA target sequence
tttcctaataattccccta

SEQ ID NO: 108824 - DNA, 19 bp, Artificial sequence
  SiRNA target sequence
ttcctaataattcccctat

SEQ ID NO: 108825 - DNA, 19 bp, Artificial sequence
  SiRNA target sequence
tcctaataattcccctata

SEQ ID NO: 108826 - DNA, 19 bp, Artificial sequence
  SiRNA target sequence
cctaataattcccctataa

SEQ ID NO: 108827 - DNA, 19 bp, Artificial sequence
  SiRNA target sequence
ctaataattcccctataat

SEQ ID NO: 108828 - DNA, 19 bp, Artificial sequence
  SiRNA target sequence
taataattcccctataata

SEQ ID NO: 108829 - DNA, 19 bp, Artificial sequence
  SiRNA target sequence
aataattcccctataatac

SEQ ID NO: 108830 - DNA, 19 bp, Artificial sequence
  SiRNA target sequence
ataattcccctataatact

SEQ ID NO: 108831 - DNA, 19 bp, Artificial sequence
  SiRNA target sequence
taattcccctataatactt

SEQ ID NO: 108832 - DNA, 19 bp, Artificial sequence
  SiRNA target sequence
aattcccctataatacttt

SEQ ID NO: 108833 - DNA, 19 bp, Artificial sequence
  SiRNA target sequence
attcccctataatactttc

SEQ ID NO: 108834 - DNA, 19 bp, Artificial sequence
  SiRNA target sequence
ttcccctataatactttct

SEQ ID NO: 108835 - DNA, 19 bp, Artificial sequence
  SiRNA target sequence
tcccctataatactttcta

SEQ ID NO: 108836 - DNA, 19 bp, Artificial sequence
  SiRNA target sequence
cccctataatactttctat

SEQ ID NO: 108837 - DNA, 19 bp, Artificial sequence
  SiRNA target sequence
ccctataatactttctata

SEQ ID NO: 108838 - DNA, 19 bp, Artificial sequence
  SiRNA target sequence
cctataatactttctatac

SEQ ID NO: 108839 - DNA, 19 bp, Artificial sequence
  SiRNA target sequence
ctataatactttctatact

SEQ ID NO: 108840 - DNA, 19 bp, Artificial sequence
  SiRNA target sequence
tataatactttctatactg

SEQ ID NO: 108841 - DNA, 19 bp, Artificial sequence
  SiRNA target sequence
ataatactttctatactga

SEQ ID NO: 108842 - DNA, 19 bp, Artificial sequence
  SiRNA target sequence
taatactttctatactgat

SEQ ID NO: 108843 - DNA, 19 bp, Artificial sequence
  SiRNA target sequence
aatactttctatactgatt

SEQ ID NO: 108844 - DNA, 19 bp, Artificial sequence
  SiRNA target sequence
atactttctatactgattc

SEQ ID NO: 108845 - DNA, 19 bp, Artificial sequence
  SiRNA target sequence
tactttctatactgattcc

SEQ ID NO: 108846 - DNA, 19 bp, Artificial sequence
  SiRNA target sequence
actttctatactgattcca

SEQ ID NO: 108847 - DNA, 19 bp, Artificial sequence
  SiRNA target sequence
ctttctatactgattccac

SEQ ID NO: 108848 - DNA, 19 bp, Artificial sequence
  SiRNA target sequence
tttctatactgattccaca

SEQ ID NO: 108849 - DNA, 19 bp, Artificial sequence
  SiRNA target sequence
ttctatactgattccacaa

SEQ ID NO: 108850 - DNA, 19 bp, Artificial sequence
  SiRNA target sequence
tctatactgattccacaaa

SEQ ID NO: 108851 - DNA, 19 bp, Artificial sequence
  SiRNA target sequence
ctatactgattccacaaat

SEQ ID NO: 108852 - DNA, 19 bp, Artificial sequence
  SiRNA target sequence
tatactgattccacaaata

SEQ ID NO: 108853 - DNA, 19 bp, Artificial sequence
  SiRNA target sequence
atactgattccacaaataa

SEQ ID NO: 108854 - DNA, 19 bp, Artificial sequence
  SiRNA target sequence
tactgattccacaaataaa

SEQ ID NO: 108855 - DNA, 19 bp, Artificial sequence
  SiRNA target sequence
actgattccacaaataaat

SEQ ID NO: 108856 - DNA, 19 bp, Artificial sequence
  SiRNA target sequence
ctgattccacaaataaatg

SEQ ID NO: 108857 - DNA, 19 bp, Artificial sequence
  SiRNA target sequence
tgattccacaaataaatgc

SEQ ID NO: 108858 - DNA, 19 bp, Artificial sequence
  SiRNA target sequence
gattccacaaataaatgct

SEQ ID NO: 108859 - DNA, 19 bp, Artificial sequence
  SiRNA target sequence
attccacaaataaatgcta

SEQ ID NO: 108860 - DNA, 19 bp, Artificial sequence
  SiRNA target sequence
ttccacaaataaatgctaa

SEQ ID NO: 108861 - DNA, 19 bp, Artificial sequence
  SiRNA target sequence
tccacaaataaatgctaat

SEQ ID NO: 108862 - DNA, 19 bp, Artificial sequence
  SiRNA target sequence
ccacaaataaatgctaatc

SEQ ID NO: 108863 - DNA, 19 bp, Artificial sequence
  SiRNA target sequence
cacaaataaatgctaatcc

SEQ ID NO: 108864 - DNA, 19 bp, Artificial sequence
  SiRNA target sequence
acaaataaatgctaatcca

SEQ ID NO: 108865 - DNA, 19 bp, Artificial sequence
  SiRNA target sequence
caaataaatgctaatccat

SEQ ID NO: 108866 - DNA, 19 bp, Artificial sequence
  SiRNA target sequence
aaataaatgctaatccatg

SEQ ID NO: 108867 - DNA, 19 bp, Artificial sequence
  SiRNA target sequence
aataaatgctaatccatgg

SEQ ID NO: 108868 - DNA, 19 bp, Artificial sequence
  SiRNA target sequence
ataaatgctaatccatggc

SEQ ID NO: 108869 - DNA, 19 bp, Artificial sequence
  SiRNA target sequence
taaatgctaatccatggca

SEQ ID NO: 108870 - DNA, 19 bp, Artificial sequence
  SiRNA target sequence
aaatgctaatccatggcat

SEQ ID NO: 108871 - DNA, 19 bp, Artificial sequence
  SiRNA target sequence
aatgctaatccatggcatc

SEQ ID NO: 108872 - DNA, 19 bp, Artificial sequence
  SiRNA target sequence
atgctaatccatggcatct

SEQ ID NO: 108873 - DNA, 19 bp, Artificial sequence
  SiRNA target sequence
tgctaatccatggcatcta

SEQ ID NO: 108874 - DNA, 19 bp, Artificial sequence
  SiRNA target sequence
gctaatccatggcatctat

SEQ ID NO: 108875 - DNA, 19 bp, Artificial sequence
  SiRNA target sequence
ctaatccatggcatctata

SEQ ID NO: 108876 - DNA, 19 bp, Artificial sequence
  SiRNA target sequence
taatccatggcatctataa

SEQ ID NO: 108877 - DNA, 19 bp, Artificial sequence
  SiRNA target sequence
aatccatggcatctataag

SEQ ID NO: 108878 - DNA, 19 bp, Artificial sequence
  SiRNA target sequence
atccatggcatctataaga

SEQ ID NO: 108879 - DNA, 19 bp, Artificial sequence
  SiRNA target sequence
tccatggcatctataagat

SEQ ID NO: 108880 - DNA, 19 bp, Artificial sequence
  SiRNA target sequence
ccatggcatctataagatc

SEQ ID NO: 108881 - DNA, 19 bp, Artificial sequence
  SiRNA target sequence
catggcatctataagatcc

SEQ ID NO: 108882 - DNA, 19 bp, Artificial sequence
  SiRNA target sequence
atggcatctataagatcct

SEQ ID NO: 108883 - DNA, 19 bp, Artificial sequence
  SiRNA target sequence
tggcatctataagatccta

SEQ ID NO: 108884 - DNA, 19 bp, Artificial sequence
  SiRNA target sequence
ggcatctataagatcctat

SEQ ID NO: 108885 - DNA, 19 bp, Artificial sequence
  SiRNA target sequence
gcatctataagatcctatg

SEQ ID NO: 108886 - DNA, 19 bp, Artificial sequence
  SiRNA target sequence
catctataagatcctatga

SEQ ID NO: 108887 - DNA, 19 bp, Artificial sequence
  SiRNA target sequence
atctataagatcctatgac

SEQ ID NO: 108888 - DNA, 19 bp, Artificial sequence
  SiRNA target sequence
tctataagatcctatgact

SEQ ID NO: 108889 - DNA, 19 bp, Artificial sequence
  SiRNA target sequence
ctataagatcctatgactt

SEQ ID NO: 108890 - DNA, 19 bp, Artificial sequence
  SiRNA target sequence
tataagatcctatgacttt

SEQ ID NO: 108891 - DNA, 19 bp, Artificial sequence
  SiRNA target sequence
ataagatcctatgacttta

SEQ ID NO: 108892 - DNA, 19 bp, Artificial sequence
  SiRNA target sequence
taagatcctatgactttat

SEQ ID NO: 108893 - DNA, 19 bp, Artificial sequence
  SiRNA target sequence
aagatcctatgactttatc

SEQ ID NO: 108894 - DNA, 19 bp, Artificial sequence
  SiRNA target sequence
agatcctatgactttatca

SEQ ID NO: 108895 - DNA, 19 bp, Artificial sequence
  SiRNA target sequence
gatcctatgactttatcat

SEQ ID NO: 108896 - DNA, 19 bp, Artificial sequence
  SiRNA target sequence
atcctatgactttatcatt

SEQ ID NO: 108897 - DNA, 19 bp, Artificial sequence
  SiRNA target sequence
tcctatgactttatcattt

SEQ ID NO: 108898 - DNA, 19 bp, Artificial sequence
  SiRNA target sequence
cctatgactttatcatttt

SEQ ID NO: 108899 - DNA, 19 bp, Artificial sequence
  SiRNA target sequence
ctatgactttatcattttt

SEQ ID NO: 108900 - DNA, 19 bp, Artificial sequence
  SiRNA target sequence
tatgactttatcattttta

SEQ ID NO: 108901 - DNA, 19 bp, Artificial sequence
  SiRNA target sequence
atgactttatcatttttat

SEQ ID NO: 108902 - DNA, 19 bp, Artificial sequence
  SiRNA target sequence
tgactttatcatttttatc

SEQ ID NO: 108903 - DNA, 19 bp, Artificial sequence
  SiRNA target sequence
gactttatcatttttatct

SEQ ID NO: 108904 - DNA, 19 bp, Artificial sequence
  SiRNA target sequence
actttatcatttttatcta

SEQ ID NO: 108905 - DNA, 19 bp, Artificial sequence
  SiRNA target sequence
ctttatcatttttatctag

SEQ ID NO: 108906 - DNA, 19 bp, Artificial sequence
  SiRNA target sequence
tttatcatttttatctagt

SEQ ID NO: 108907 - DNA, 19 bp, Artificial sequence
  SiRNA target sequence
ttatcatttttatctagta

SEQ ID NO: 108908 - DNA, 19 bp, Artificial sequence
  SiRNA target sequence
tatcatttttatctagtac

SEQ ID NO: 108909 - DNA, 19 bp, Artificial sequence
  SiRNA target sequence
atcatttttatctagtacc

SEQ ID NO: 108910 - DNA, 19 bp, Artificial sequence
  SiRNA target sequence
tcatttttatctagtacct

SEQ ID NO: 108911 - DNA, 19 bp, Artificial sequence
  SiRNA target sequence
catttttatctagtacctt

SEQ ID NO: 108912 - DNA, 19 bp, Artificial sequence
  SiRNA target sequence
atttttatctagtaccttt

SEQ ID NO: 108913 - DNA, 19 bp, Artificial sequence
  SiRNA target sequence
tttttatctagtacctttt

SEQ ID NO: 108914 - DNA, 19 bp, Artificial sequence
  SiRNA target sequence
ttttatctagtaccttttg

SEQ ID NO: 108915 - DNA, 19 bp, Artificial sequence
  SiRNA target sequence
tttatctagtaccttttgt

SEQ ID NO: 108916 - DNA, 19 bp, Artificial sequence
  SiRNA target sequence
ttatctagtaccttttgta

SEQ ID NO: 108917 - DNA, 19 bp, Artificial sequence
  SiRNA target sequence
tatctagtaccttttgtaa

SEQ ID NO: 108918 - DNA, 19 bp, Artificial sequence
  SiRNA target sequence
atctagtaccttttgtaaa

SEQ ID NO: 108919 - DNA, 19 bp, Artificial sequence
  SiRNA target sequence
tctagtaccttttgtaaac

SEQ ID NO: 108920 - DNA, 19 bp, Artificial sequence
  SiRNA target sequence
ctagtaccttttgtaaact

SEQ ID NO: 108921 - DNA, 19 bp, Artificial sequence
  SiRNA target sequence
tagtaccttttgtaaactc

SEQ ID NO: 108922 - DNA, 19 bp, Artificial sequence
  SiRNA target sequence
agtaccttttgtaaactca

SEQ ID NO: 108923 - DNA, 19 bp, Artificial sequence
  SiRNA target sequence
gtaccttttgtaaactcat

SEQ ID NO: 108924 - DNA, 19 bp, Artificial sequence
  SiRNA target sequence
taccttttgtaaactcata

SEQ ID NO: 108925 - DNA, 19 bp, Artificial sequence
  SiRNA target sequence
accttttgtaaactcatat

SEQ ID NO: 108926 - DNA, 19 bp, Artificial sequence
  SiRNA target sequence
ccttttgtaaactcatata

SEQ ID NO: 108927 - DNA, 19 bp, Artificial sequence
  SiRNA target sequence
cttttgtaaactcatataa

SEQ ID NO: 108928 - DNA, 19 bp, Artificial sequence
  SiRNA target sequence
ttttgtaaactcatataaa

SEQ ID NO: 108929 - DNA, 19 bp, Artificial sequence
  SiRNA target sequence
tttgtaaactcatataaat

SEQ ID NO: 108930 - DNA, 19 bp, Artificial sequence
  SiRNA target sequence
ttgtaaactcatataaatg

SEQ ID NO: 108931 - DNA, 19 bp, Artificial sequence
  SiRNA target sequence
tgtaaactcatataaatgt

SEQ ID NO: 108932 - DNA, 19 bp, Artificial sequence
  SiRNA target sequence
gtaaactcatataaatgtt

SEQ ID NO: 108933 - DNA, 19 bp, Artificial sequence
  SiRNA target sequence
taaactcatataaatgttt

SEQ ID NO: 108934 - DNA, 19 bp, Artificial sequence
  SiRNA target sequence
aaactcatataaatgtttt

SEQ ID NO: 108935 - DNA, 19 bp, Artificial sequence
  SiRNA target sequence
aactcatataaatgttttc

SEQ ID NO: 108936 - DNA, 19 bp, Artificial sequence
  SiRNA target sequence
actcatataaatgttttcc

SEQ ID NO: 108937 - DNA, 19 bp, Artificial sequence
  SiRNA target sequence
ctcatataaatgttttcct

SEQ ID NO: 108938 - DNA, 19 bp, Artificial sequence
  SiRNA target sequence
tcatataaatgttttcctg

SEQ ID NO: 108939 - DNA, 19 bp, Artificial sequence
  SiRNA target sequence
catataaatgttttcctgt

SEQ ID NO: 108940 - DNA, 19 bp, Artificial sequence
  SiRNA target sequence
atataaatgttttcctgtc

SEQ ID NO: 108941 - DNA, 19 bp, Artificial sequence
  SiRNA target sequence
tataaatgttttcctgtcc

SEQ ID NO: 108942 - DNA, 19 bp, Artificial sequence
  SiRNA target sequence
ataaatgttttcctgtcct

SEQ ID NO: 108943 - DNA, 19 bp, Artificial sequence
  SiRNA target sequence
taaatgttttcctgtccta

SEQ ID NO: 108944 - DNA, 19 bp, Artificial sequence
  SiRNA target sequence
aaatgttttcctgtcctat

SEQ ID NO: 108945 - DNA, 19 bp, Artificial sequence
  SiRNA target sequence
aatgttttcctgtcctatt

SEQ ID NO: 108946 - DNA, 19 bp, Artificial sequence
  SiRNA target sequence
atgttttcctgtcctatta

SEQ ID NO: 108947 - DNA, 19 bp, Artificial sequence
  SiRNA target sequence
tgttttcctgtcctattac

SEQ ID NO: 108948 - DNA, 19 bp, Artificial sequence
  SiRNA target sequence
gttttcctgtcctattact

SEQ ID NO: 108949 - DNA, 19 bp, Artificial sequence
  SiRNA target sequence
ttttcctgtcctattacta

SEQ ID NO: 108950 - DNA, 19 bp, Artificial sequence
  SiRNA target sequence
tttcctgtcctattactaa

SEQ ID NO: 108951 - DNA, 19 bp, Artificial sequence
  SiRNA target sequence
ttcctgtcctattactaaa

SEQ ID NO: 108952 - DNA, 19 bp, Artificial sequence
  SiRNA target sequence
tcctgtcctattactaaat

SEQ ID NO: 108953 - DNA, 19 bp, Artificial sequence
  SiRNA target sequence
cctgtcctattactaaatg

SEQ ID NO: 108954 - DNA, 19 bp, Artificial sequence
  SiRNA target sequence
ctgtcctattactaaatga

SEQ ID NO: 108955 - DNA, 19 bp, Artificial sequence
  SiRNA target sequence
tgtcctattactaaatgac

SEQ ID NO: 108956 - DNA, 19 bp, Artificial sequence
  SiRNA target sequence
gtcctattactaaatgaca

SEQ ID NO: 108957 - DNA, 19 bp, Artificial sequence
  SiRNA target sequence
tcctattactaaatgacag

SEQ ID NO: 108958 - DNA, 19 bp, Artificial sequence
  SiRNA target sequence
cctattactaaatgacaga

SEQ ID NO: 108959 - DNA, 19 bp, Artificial sequence
  SiRNA target sequence
ctattactaaatgacagaa

SEQ ID NO: 108960 - DNA, 19 bp, Artificial sequence
  SiRNA target sequence
tattactaaatgacagaag

SEQ ID NO: 108961 - DNA, 19 bp, Artificial sequence
  SiRNA target sequence
attactaaatgacagaagc

SEQ ID NO: 108962 - DNA, 19 bp, Artificial sequence
  SiRNA target sequence
ttactaaatgacagaagcc

SEQ ID NO: 108963 - DNA, 19 bp, Artificial sequence
  SiRNA target sequence
tactaaatgacagaagcct

SEQ ID NO: 108964 - DNA, 19 bp, Artificial sequence
  SiRNA target sequence
actaaatgacagaagcctc

SEQ ID NO: 108965 - DNA, 19 bp, Artificial sequence
  SiRNA target sequence
ctaaatgacagaagcctct

SEQ ID NO: 108966 - DNA, 19 bp, Artificial sequence
  SiRNA target sequence
taaatgacagaagcctctt

SEQ ID NO: 108967 - DNA, 19 bp, Artificial sequence
  SiRNA target sequence
aaatgacagaagcctctta

SEQ ID NO: 108968 - DNA, 19 bp, Artificial sequence
  SiRNA target sequence
aatgacagaagcctcttat

SEQ ID NO: 108969 - DNA, 19 bp, Artificial sequence
  SiRNA target sequence
atgacagaagcctcttata

SEQ ID NO: 108970 - DNA, 19 bp, Artificial sequence
  SiRNA target sequence
tgacagaagcctcttatat

SEQ ID NO: 108971 - DNA, 19 bp, Artificial sequence
  SiRNA target sequence
gacagaagcctcttatatt

SEQ ID NO: 108972 - DNA, 19 bp, Artificial sequence
  SiRNA target sequence
acagaagcctcttatattt

SEQ ID NO: 108973 - DNA, 19 bp, Artificial sequence
  SiRNA target sequence
cagaagcctcttatatttc

SEQ ID NO: 108974 - DNA, 19 bp, Artificial sequence
  SiRNA target sequence
agaagcctcttatatttcc

SEQ ID NO: 108975 - DNA, 19 bp, Artificial sequence
  SiRNA target sequence
gaagcctcttatatttcct

SEQ ID NO: 108976 - DNA, 19 bp, Artificial sequence
  SiRNA target sequence
aagcctcttatatttcctt

SEQ ID NO: 108977 - DNA, 19 bp, Artificial sequence
  SiRNA target sequence
agcctcttatatttccttt

SEQ ID NO: 108978 - DNA, 19 bp, Artificial sequence
  SiRNA target sequence
gcctcttatatttcctttt

SEQ ID NO: 108979 - DNA, 19 bp, Artificial sequence
  SiRNA target sequence
cctcttatatttccttttt

SEQ ID NO: 108980 - DNA, 19 bp, Artificial sequence
  SiRNA target sequence
ctcttatatttcctttttt

SEQ ID NO: 108981 - DNA, 19 bp, Artificial sequence
  SiRNA target sequence
tcttatatttcctttttta

SEQ ID NO: 108982 - DNA, 19 bp, Artificial sequence
  SiRNA target sequence
cttatatttccttttttat

SEQ ID NO: 108983 - DNA, 19 bp, Artificial sequence
  SiRNA target sequence
ttatatttccttttttata

SEQ ID NO: 108984 - DNA, 19 bp, Artificial sequence
  SiRNA target sequence
tatatttccttttttatac

SEQ ID NO: 108985 - DNA, 19 bp, Artificial sequence
  SiRNA target sequence
atatttccttttttatact

SEQ ID NO: 108986 - DNA, 19 bp, Artificial sequence
  SiRNA target sequence
tatttccttttttatactt

SEQ ID NO: 108987 - DNA, 19 bp, Artificial sequence
  SiRNA target sequence
atttccttttttatactta

SEQ ID NO: 108988 - DNA, 19 bp, Artificial sequence
  SiRNA target sequence
tttccttttttatacttag

SEQ ID NO: 108989 - DNA, 19 bp, Artificial sequence
  SiRNA target sequence
ttccttttttatacttaga

SEQ ID NO: 108990 - DNA, 19 bp, Artificial sequence
  SiRNA target sequence
tccttttttatacttagag

SEQ ID NO: 108991 - DNA, 19 bp, Artificial sequence
  SiRNA target sequence
ccttttttatacttagagt

SEQ ID NO: 108992 - DNA, 19 bp, Artificial sequence
  SiRNA target sequence
cttttttatacttagagtt

SEQ ID NO: 108993 - DNA, 19 bp, Artificial sequence
  SiRNA target sequence
ttttttatacttagagtta

SEQ ID NO: 108994 - DNA, 19 bp, Artificial sequence
  SiRNA target sequence
tttttatacttagagttag

SEQ ID NO: 108995 - DNA, 19 bp, Artificial sequence
  SiRNA target sequence
ttttatacttagagttagc

SEQ ID NO: 108996 - DNA, 19 bp, Artificial sequence
  SiRNA target sequence
tttatacttagagttagca

SEQ ID NO: 108997 - DNA, 19 bp, Artificial sequence
  SiRNA target sequence
ttatacttagagttagcat

SEQ ID NO: 108998 - DNA, 19 bp, Artificial sequence
  SiRNA target sequence
tatacttagagttagcata

SEQ ID NO: 108999 - DNA, 19 bp, Artificial sequence
  SiRNA target sequence
atacttagagttagcatat

SEQ ID NO: 109000 - DNA, 19 bp, Artificial sequence
  SiRNA target sequence
tacttagagttagcatatt

SEQ ID NO: 109001 - DNA, 19 bp, Artificial sequence
  SiRNA target sequence
acttagagttagcatattc

SEQ ID NO: 109002 - DNA, 19 bp, Artificial sequence
  SiRNA target sequence
cttagagttagcatattct

SEQ ID NO: 109003 - DNA, 19 bp, Artificial sequence
  SiRNA target sequence
ttagagttagcatattctt

SEQ ID NO: 109004 - DNA, 19 bp, Artificial sequence
  SiRNA target sequence
tagagttagcatattcttc

SEQ ID NO: 109005 - DNA, 19 bp, Artificial sequence
  SiRNA target sequence
agagttagcatattcttcg

SEQ ID NO: 109006 - DNA, 19 bp, Artificial sequence
  SiRNA target sequence
gagttagcatattcttcga

SEQ ID NO: 109007 - DNA, 19 bp, Artificial sequence
  SiRNA target sequence
agttagcatattcttcgat

SEQ ID NO: 109008 - DNA, 19 bp, Artificial sequence
  SiRNA target sequence
gttagcatattcttcgata

SEQ ID NO: 109009 - DNA, 19 bp, Artificial sequence
  SiRNA target sequence
ttagcatattcttcgataa

SEQ ID NO: 109010 - DNA, 19 bp, Artificial sequence
  SiRNA target sequence
tagcatattcttcgataag

SEQ ID NO: 109011 - DNA, 19 bp, Artificial sequence
  SiRNA target sequence
agcatattcttcgataaga

SEQ ID NO: 109012 - DNA, 19 bp, Artificial sequence
  SiRNA target sequence
gcatattcttcgataagac

SEQ ID NO: 109013 - DNA, 19 bp, Artificial sequence
  SiRNA target sequence
catattcttcgataagacg

SEQ ID NO: 109014 - DNA, 19 bp, Artificial sequence
  SiRNA target sequence
atattcttcgataagacgt

SEQ ID NO: 109015 - DNA, 19 bp, Artificial sequence
  SiRNA target sequence
tattcttcgataagacgta

SEQ ID NO: 109016 - DNA, 19 bp, Artificial sequence
  SiRNA target sequence
attcttcgataagacgtag

SEQ ID NO: 109017 - DNA, 19 bp, Artificial sequence
  SiRNA target sequence
ttcttcgataagacgtaga

SEQ ID NO: 109018 - DNA, 19 bp, Artificial sequence
  SiRNA target sequence
tcttcgataagacgtagaa

SEQ ID NO: 109019 - DNA, 19 bp, Artificial sequence
  SiRNA target sequence
cttcgataagacgtagaat

SEQ ID NO: 109020 - DNA, 19 bp, Artificial sequence
  SiRNA target sequence
ttcgataagacgtagaatt

SEQ ID NO: 109021 - DNA, 19 bp, Artificial sequence
  SiRNA target sequence
tcgataagacgtagaatta

SEQ ID NO: 109022 - DNA, 19 bp, Artificial sequence
  SiRNA target sequence
cgataagacgtagaattaa

SEQ ID NO: 109023 - DNA, 19 bp, Artificial sequence
  SiRNA target sequence
gataagacgtagaattaac

SEQ ID NO: 109024 - DNA, 19 bp, Artificial sequence
  SiRNA target sequence
ataagacgtagaattaaca

SEQ ID NO: 109025 - DNA, 19 bp, Artificial sequence
  SiRNA target sequence
taagacgtagaattaacat

SEQ ID NO: 109026 - DNA, 19 bp, Artificial sequence
  SiRNA target sequence
aagacgtagaattaacata

SEQ ID NO: 109027 - DNA, 19 bp, Artificial sequence
  SiRNA target sequence
agacgtagaattaacatat

SEQ ID NO: 109028 - DNA, 19 bp, Artificial sequence
  SiRNA target sequence
gacgtagaattaacatatt

SEQ ID NO: 109029 - DNA, 19 bp, Artificial sequence
  SiRNA target sequence
acgtagaattaacatattt

SEQ ID NO: 109030 - DNA, 19 bp, Artificial sequence
  SiRNA target sequence
cgtagaattaacatatttc

SEQ ID NO: 109031 - DNA, 19 bp, Artificial sequence
  SiRNA target sequence
gtagaattaacatatttct

SEQ ID NO: 109032 - DNA, 19 bp, Artificial sequence
  SiRNA target sequence
tagaattaacatatttcta

SEQ ID NO: 109033 - DNA, 19 bp, Artificial sequence
  SiRNA target sequence
agaattaacatatttctat

SEQ ID NO: 109034 - DNA, 19 bp, Artificial sequence
  SiRNA target sequence
gaattaacatatttctata

SEQ ID NO: 109035 - DNA, 19 bp, Artificial sequence
  SiRNA target sequence
aattaacatatttctataa

SEQ ID NO: 109036 - DNA, 19 bp, Artificial sequence
  SiRNA target sequence
attaacatatttctataaa

SEQ ID NO: 109037 - DNA, 19 bp, Artificial sequence
  SiRNA target sequence
ttaacatatttctataaac

SEQ ID NO: 109038 - DNA, 19 bp, Artificial sequence
  SiRNA target sequence
taacatatttctataaaca

SEQ ID NO: 109039 - DNA, 19 bp, Artificial sequence
  SiRNA target sequence
aacatatttctataaacat

SEQ ID NO: 109040 - DNA, 19 bp, Artificial sequence
  SiRNA target sequence
acatatttctataaacatc

SEQ ID NO: 109041 - DNA, 19 bp, Artificial sequence
  SiRNA target sequence
catatttctataaacatct

SEQ ID NO: 109042 - DNA, 19 bp, Artificial sequence
  SiRNA target sequence
atatttctataaacatctt

SEQ ID NO: 109043 - DNA, 19 bp, Artificial sequence
  SiRNA target sequence
tatttctataaacatcttg

SEQ ID NO: 109044 - DNA, 19 bp, Artificial sequence
  SiRNA target sequence
atttctataaacatcttgt

SEQ ID NO: 109045 - DNA, 19 bp, Artificial sequence
  SiRNA target sequence
tttctataaacatcttgta

SEQ ID NO: 109046 - DNA, 19 bp, Artificial sequence
  SiRNA target sequence
ttctataaacatcttgtac

SEQ ID NO: 109047 - DNA, 19 bp, Artificial sequence
  SiRNA target sequence
tctataaacatcttgtaca

SEQ ID NO: 109048 - DNA, 19 bp, Artificial sequence
  SiRNA target sequence
ctataaacatcttgtacaa

SEQ ID NO: 109049 - DNA, 19 bp, Artificial sequence
  SiRNA target sequence
tataaacatcttgtacaag

SEQ ID NO: 109050 - DNA, 19 bp, Artificial sequence
  SiRNA target sequence
ataaacatcttgtacaagt

SEQ ID NO: 109051 - DNA, 19 bp, Artificial sequence
  SiRNA target sequence
taaacatcttgtacaagtt

SEQ ID NO: 109052 - DNA, 19 bp, Artificial sequence
  SiRNA target sequence
aaacatcttgtacaagttc

SEQ ID NO: 109053 - DNA, 19 bp, Artificial sequence
  SiRNA target sequence
aacatcttgtacaagttct

SEQ ID NO: 109054 - DNA, 19 bp, Artificial sequence
  SiRNA target sequence
acatcttgtacaagttctt

SEQ ID NO: 109055 - DNA, 19 bp, Artificial sequence
  SiRNA target sequence
catcttgtacaagttcttt

SEQ ID NO: 109056 - DNA, 19 bp, Artificial sequence
  SiRNA target sequence
atcttgtacaagttctttg

SEQ ID NO: 109057 - DNA, 19 bp, Artificial sequence
  SiRNA target sequence
tcttgtacaagttctttgt

SEQ ID NO: 109058 - DNA, 19 bp, Artificial sequence
  SiRNA target sequence
cttgtacaagttctttgtt

SEQ ID NO: 109059 - DNA, 19 bp, Artificial sequence
  SiRNA target sequence
ttgtacaagttctttgttt

SEQ ID NO: 109060 - DNA, 19 bp, Artificial sequence
  SiRNA target sequence
tgtacaagttctttgttta

SEQ ID NO: 109061 - DNA, 19 bp, Artificial sequence
  SiRNA target sequence
gtacaagttctttgtttaa

SEQ ID NO: 109062 - DNA, 19 bp, Artificial sequence
  SiRNA target sequence
tacaagttctttgtttaaa

SEQ ID NO: 109063 - DNA, 19 bp, Artificial sequence
  SiRNA target sequence
acaagttctttgtttaaag

SEQ ID NO: 109064 - DNA, 19 bp, Artificial sequence
  SiRNA target sequence
caagttctttgtttaaagt

SEQ ID NO: 109065 - DNA, 19 bp, Artificial sequence
  SiRNA target sequence
aagttctttgtttaaagta

SEQ ID NO: 109066 - DNA, 19 bp, Artificial sequence
  SiRNA target sequence
agttctttgtttaaagtag

SEQ ID NO: 109067 - DNA, 19 bp, Artificial sequence
  SiRNA target sequence
gttctttgtttaaagtagt

SEQ ID NO: 109068 - DNA, 19 bp, Artificial sequence
  SiRNA target sequence
ttctttgtttaaagtagtt

SEQ ID NO: 109069 - DNA, 19 bp, Artificial sequence
  SiRNA target sequence
tctttgtttaaagtagttt

SEQ ID NO: 109070 - DNA, 19 bp, Artificial sequence
  SiRNA target sequence
ctttgtttaaagtagtttt

SEQ ID NO: 109071 - DNA, 19 bp, Artificial sequence
  SiRNA target sequence
tttgtttaaagtagttttc

SEQ ID NO: 109072 - DNA, 19 bp, Artificial sequence
  SiRNA target sequence
ttgtttaaagtagttttca

SEQ ID NO: 109073 - DNA, 19 bp, Artificial sequence
  SiRNA target sequence
tgtttaaagtagttttcag

SEQ ID NO: 109074 - DNA, 19 bp, Artificial sequence
  SiRNA target sequence
gtttaaagtagttttcagt

SEQ ID NO: 109075 - DNA, 19 bp, Artificial sequence
  SiRNA target sequence
tttaaagtagttttcagtt

SEQ ID NO: 109076 - DNA, 19 bp, Artificial sequence
  SiRNA target sequence
ttaaagtagttttcagttt

SEQ ID NO: 109077 - DNA, 19 bp, Artificial sequence
  SiRNA target sequence
taaagtagttttcagttta

SEQ ID NO: 109078 - DNA, 19 bp, Artificial sequence
  SiRNA target sequence
aaagtagttttcagtttaa

SEQ ID NO: 109079 - DNA, 19 bp, Artificial sequence
  SiRNA target sequence
aagtagttttcagtttaac

SEQ ID NO: 109080 - DNA, 19 bp, Artificial sequence
  SiRNA target sequence
agtagttttcagtttaact

SEQ ID NO: 109081 - DNA, 19 bp, Artificial sequence
  SiRNA target sequence
gtagttttcagtttaactg

SEQ ID NO: 109082 - DNA, 19 bp, Artificial sequence
  SiRNA target sequence
tagttttcagtttaactgt

SEQ ID NO: 109083 - DNA, 19 bp, Artificial sequence
  SiRNA target sequence
agttttcagtttaactgta

SEQ ID NO: 109084 - DNA, 19 bp, Artificial sequence
  SiRNA target sequence
gttttcagtttaactgtat

SEQ ID NO: 109085 - DNA, 19 bp, Artificial sequence
  SiRNA target sequence
ttttcagtttaactgtatt

SEQ ID NO: 109086 - DNA, 19 bp, Artificial sequence
  SiRNA target sequence
tttcagtttaactgtattt

SEQ ID NO: 109087 - DNA, 19 bp, Artificial sequence
  SiRNA target sequence
ttcagtttaactgtatttt

SEQ ID NO: 109088 - DNA, 19 bp, Artificial sequence
  SiRNA target sequence
tcagtttaactgtattttt

SEQ ID NO: 109089 - DNA, 19 bp, Artificial sequence
  SiRNA target sequence
cagtttaactgtattttta

SEQ ID NO: 109090 - DNA, 19 bp, Artificial sequence
  SiRNA target sequence
agtttaactgtatttttat

SEQ ID NO: 109091 - DNA, 19 bp, Artificial sequence
  SiRNA target sequence
gtttaactgtatttttatc

SEQ ID NO: 109092 - DNA, 19 bp, Artificial sequence
  SiRNA target sequence
tttaactgtatttttatct

SEQ ID NO: 109093 - DNA, 19 bp, Artificial sequence
  SiRNA target sequence
ttaactgtatttttatcta

SEQ ID NO: 109094 - DNA, 19 bp, Artificial sequence
  SiRNA target sequence
taactgtatttttatctac

SEQ ID NO: 109095 - DNA, 19 bp, Artificial sequence
  SiRNA target sequence
aactgtatttttatctacc

SEQ ID NO: 109096 - DNA, 19 bp, Artificial sequence
  SiRNA target sequence
actgtatttttatctacca

SEQ ID NO: 109097 - DNA, 19 bp, Artificial sequence
  SiRNA target sequence
ctgtatttttatctaccaa

SEQ ID NO: 109098 - DNA, 19 bp, Artificial sequence
  SiRNA target sequence
tgtatttttatctaccaaa

SEQ ID NO: 109099 - DNA, 19 bp, Artificial sequence
  SiRNA target sequence
gtatttttatctaccaaat

SEQ ID NO: 109100 - DNA, 19 bp, Artificial sequence
  SiRNA target sequence
tatttttatctaccaaata

SEQ ID NO: 109101 - DNA, 19 bp, Artificial sequence
  SiRNA target sequence
atttttatctaccaaataa

SEQ ID NO: 109102 - DNA, 19 bp, Artificial sequence
  SiRNA target sequence
tttttatctaccaaataat

SEQ ID NO: 109103 - DNA, 19 bp, Artificial sequence
  SiRNA target sequence
ttttatctaccaaataata

SEQ ID NO: 109104 - DNA, 19 bp, Artificial sequence
  SiRNA target sequence
tttatctaccaaataataa

SEQ ID NO: 109105 - DNA, 19 bp, Artificial sequence
  SiRNA target sequence
ttatctaccaaataataat

SEQ ID NO: 109106 - DNA, 19 bp, Artificial sequence
  SiRNA target sequence
tatctaccaaataataatc

SEQ ID NO: 109107 - DNA, 19 bp, Artificial sequence
  SiRNA target sequence
atctaccaaataataatct

SEQ ID NO: 109108 - DNA, 19 bp, Artificial sequence
  SiRNA target sequence
tctaccaaataataatcta

SEQ ID NO: 109109 - DNA, 19 bp, Artificial sequence
  SiRNA target sequence
ctaccaaataataatctat

SEQ ID NO: 109110 - DNA, 19 bp, Artificial sequence
  SiRNA target sequence
taccaaataataatctatc

SEQ ID NO: 109111 - DNA, 19 bp, Artificial sequence
  SiRNA target sequence
accaaataataatctatca

SEQ ID NO: 109112 - DNA, 19 bp, Artificial sequence
  SiRNA target sequence
ccaaataataatctatcat

SEQ ID NO: 109113 - DNA, 20 bp, Artificial sequence
  SiRNA target sequence
ttattcagaataaacatctt

SEQ ID NO: 109114 - DNA, 20 bp, Artificial sequence
  SiRNA target sequence
tattcagaataaacatcttt

SEQ ID NO: 109115 - DNA, 20 bp, Artificial sequence
  SiRNA target sequence
attcagaataaacatctttt

SEQ ID NO: 109116 - DNA, 20 bp, Artificial sequence
  SiRNA target sequence
ttcagaataaacatctttta

SEQ ID NO: 109117 - DNA, 20 bp, Artificial sequence
  SiRNA target sequence
tcagaataaacatcttttaa

SEQ ID NO: 109118 - DNA, 20 bp, Artificial sequence
  SiRNA target sequence
cagaataaacatcttttaaa

SEQ ID NO: 109119 - DNA, 20 bp, Artificial sequence
  SiRNA target sequence
agaataaacatcttttaaaa

SEQ ID NO: 109120 - DNA, 20 bp, Artificial sequence
  SiRNA target sequence
gaataaacatcttttaaaag

SEQ ID NO: 109121 - DNA, 20 bp, Artificial sequence
  SiRNA target sequence
aataaacatcttttaaaagt

SEQ ID NO: 109122 - DNA, 20 bp, Artificial sequence
  SiRNA target sequence
ataaacatcttttaaaagtt

SEQ ID NO: 109123 - DNA, 20 bp, Artificial sequence
  SiRNA target sequence
taaacatcttttaaaagttc

SEQ ID NO: 109124 - DNA, 20 bp, Artificial sequence
  SiRNA target sequence
aaacatcttttaaaagttca

SEQ ID NO: 109125 - DNA, 20 bp, Artificial sequence
  SiRNA target sequence
aacatcttttaaaagttcat

SEQ ID NO: 109126 - DNA, 20 bp, Artificial sequence
  SiRNA target sequence
acatcttttaaaagttcatc

SEQ ID NO: 109127 - DNA, 20 bp, Artificial sequence
  SiRNA target sequence
catcttttaaaagttcatcg

SEQ ID NO: 109128 - DNA, 20 bp, Artificial sequence
  SiRNA target sequence
atcttttaaaagttcatcga

SEQ ID NO: 109129 - DNA, 20 bp, Artificial sequence
  SiRNA target sequence
tcttttaaaagttcatcgat

SEQ ID NO: 109130 - DNA, 20 bp, Artificial sequence
  SiRNA target sequence
cttttaaaagttcatcgata

SEQ ID NO: 109131 - DNA, 20 bp, Artificial sequence
  SiRNA target sequence
ttttaaaagttcatcgatat

SEQ ID NO: 109132 - DNA, 20 bp, Artificial sequence
  SiRNA target sequence
tttaaaagttcatcgatatc

SEQ ID NO: 109133 - DNA, 20 bp, Artificial sequence
  SiRNA target sequence
ttaaaagttcatcgatatcg

SEQ ID NO: 109134 - DNA, 20 bp, Artificial sequence
  SiRNA target sequence
taaaagttcatcgatatcgg

SEQ ID NO: 109135 - DNA, 20 bp, Artificial sequence
  SiRNA target sequence
aaaagttcatcgatatcggg

SEQ ID NO: 109136 - DNA, 20 bp, Artificial sequence
  SiRNA target sequence
aaagttcatcgatatcgggt

SEQ ID NO: 109137 - DNA, 20 bp, Artificial sequence
  SiRNA target sequence
aagttcatcgatatcgggtt

SEQ ID NO: 109138 - DNA, 20 bp, Artificial sequence
  SiRNA target sequence
agttcatcgatatcgggttc

SEQ ID NO: 109139 - DNA, 20 bp, Artificial sequence
  SiRNA target sequence
gttcatcgatatcgggttct

SEQ ID NO: 109140 - DNA, 20 bp, Artificial sequence
  SiRNA target sequence
ttcatcgatatcgggttctt

SEQ ID NO: 109141 - DNA, 20 bp, Artificial sequence
  SiRNA target sequence
tcatcgatatcgggttcttt

SEQ ID NO: 109142 - DNA, 20 bp, Artificial sequence
  SiRNA target sequence
catcgatatcgggttcttta

SEQ ID NO: 109143 - DNA, 20 bp, Artificial sequence
  SiRNA target sequence
atcgatatcgggttctttag

SEQ ID NO: 109144 - DNA, 20 bp, Artificial sequence
  SiRNA target sequence
tcgatatcgggttctttaga

SEQ ID NO: 109145 - DNA, 20 bp, Artificial sequence
  SiRNA target sequence
cgatatcgggttctttagaa

SEQ ID NO: 109146 - DNA, 20 bp, Artificial sequence
  SiRNA target sequence
gatatcgggttctttagaaa

SEQ ID NO: 109147 - DNA, 20 bp, Artificial sequence
  SiRNA target sequence
atatcgggttctttagaaaa

SEQ ID NO: 109148 - DNA, 20 bp, Artificial sequence
  SiRNA target sequence
tatcgggttctttagaaaaa

SEQ ID NO: 109149 - DNA, 20 bp, Artificial sequence
  SiRNA target sequence
atcgggttctttagaaaaaa

SEQ ID NO: 109150 - DNA, 20 bp, Artificial sequence
  SiRNA target sequence
tcgggttctttagaaaaaat

SEQ ID NO: 109151 - DNA, 20 bp, Artificial sequence
  SiRNA target sequence
cgggttctttagaaaaaata

SEQ ID NO: 109152 - DNA, 20 bp, Artificial sequence
  SiRNA target sequence
gggttctttagaaaaaataa

SEQ ID NO: 109153 - DNA, 20 bp, Artificial sequence
  SiRNA target sequence
ggttctttagaaaaaataac

SEQ ID NO: 109154 - DNA, 20 bp, Artificial sequence
  SiRNA target sequence
gttctttagaaaaaataact

SEQ ID NO: 109155 - DNA, 20 bp, Artificial sequence
  SiRNA target sequence
ttctttagaaaaaataactt

SEQ ID NO: 109156 - DNA, 20 bp, Artificial sequence
  SiRNA target sequence
tctttagaaaaaataacttt

SEQ ID NO: 109157 - DNA, 20 bp, Artificial sequence
  SiRNA target sequence
ctttagaaaaaataactttt

SEQ ID NO: 109158 - DNA, 20 bp, Artificial sequence
  SiRNA target sequence
tttagaaaaaataacttttt

SEQ ID NO: 109159 - DNA, 20 bp, Artificial sequence
  SiRNA target sequence
ttagaaaaaataactttttt

SEQ ID NO: 109160 - DNA, 20 bp, Artificial sequence
  SiRNA target sequence
tagaaaaaataactttttta

SEQ ID NO: 109161 - DNA, 20 bp, Artificial sequence
  SiRNA target sequence
agaaaaaataacttttttaa

SEQ ID NO: 109162 - DNA, 20 bp, Artificial sequence
  SiRNA target sequence
gaaaaaataacttttttaac

SEQ ID NO: 109163 - DNA, 20 bp, Artificial sequence
  SiRNA target sequence
aaaaaataacttttttaaca

SEQ ID NO: 109164 - DNA, 20 bp, Artificial sequence
  SiRNA target sequence
aaaaataacttttttaacac

SEQ ID NO: 109165 - DNA, 20 bp, Artificial sequence
  SiRNA target sequence
aaaataacttttttaacacc

SEQ ID NO: 109166 - DNA, 20 bp, Artificial sequence
  SiRNA target sequence
aaataacttttttaacacct

SEQ ID NO: 109167 - DNA, 20 bp, Artificial sequence
  SiRNA target sequence
aataacttttttaacacctt

SEQ ID NO: 109168 - DNA, 20 bp, Artificial sequence
  SiRNA target sequence
ataacttttttaacaccttc

SEQ ID NO: 109169 - DNA, 20 bp, Artificial sequence
  SiRNA target sequence
taacttttttaacaccttct

SEQ ID NO: 109170 - DNA, 20 bp, Artificial sequence
  SiRNA target sequence
aacttttttaacaccttctt

SEQ ID NO: 109171 - DNA, 20 bp, Artificial sequence
  SiRNA target sequence
acttttttaacaccttcttc

SEQ ID NO: 109172 - DNA, 20 bp, Artificial sequence
  SiRNA target sequence
cttttttaacaccttcttca

SEQ ID NO: 109173 - DNA, 20 bp, Artificial sequence
  SiRNA target sequence
ttttttaacaccttcttcaa

SEQ ID NO: 109174 - DNA, 20 bp, Artificial sequence
  SiRNA target sequence
tttttaacaccttcttcaaa

SEQ ID NO: 109175 - DNA, 20 bp, Artificial sequence
  SiRNA target sequence
ttttaacaccttcttcaaag

SEQ ID NO: 109176 - DNA, 20 bp, Artificial sequence
  SiRNA target sequence
tttaacaccttcttcaaagc

SEQ ID NO: 109177 - DNA, 20 bp, Artificial sequence
  SiRNA target sequence
ttaacaccttcttcaaagca

SEQ ID NO: 109178 - DNA, 20 bp, Artificial sequence
  SiRNA target sequence
taacaccttcttcaaagcag

SEQ ID NO: 109179 - DNA, 20 bp, Artificial sequence
  SiRNA target sequence
aacaccttcttcaaagcagg

SEQ ID NO: 109180 - DNA, 20 bp, Artificial sequence
  SiRNA target sequence
acaccttcttcaaagcagga

SEQ ID NO: 109181 - DNA, 20 bp, Artificial sequence
  SiRNA target sequence
caccttcttcaaagcaggaa

SEQ ID NO: 109182 - DNA, 20 bp, Artificial sequence
  SiRNA target sequence
accttcttcaaagcaggaaa

SEQ ID NO: 109183 - DNA, 20 bp, Artificial sequence
  SiRNA target sequence
ccttcttcaaagcaggaaat

SEQ ID NO: 109184 - DNA, 20 bp, Artificial sequence
  SiRNA target sequence
cttcttcaaagcaggaaatt

SEQ ID NO: 109185 - DNA, 20 bp, Artificial sequence
  SiRNA target sequence
ttcttcaaagcaggaaatta

SEQ ID NO: 109186 - DNA, 20 bp, Artificial sequence
  SiRNA target sequence
tcttcaaagcaggaaattac

SEQ ID NO: 109187 - DNA, 20 bp, Artificial sequence
  SiRNA target sequence
cttcaaagcaggaaattacc

SEQ ID NO: 109188 - DNA, 20 bp, Artificial sequence
  SiRNA target sequence
ttcaaagcaggaaattacct

SEQ ID NO: 109189 - DNA, 20 bp, Artificial sequence
  SiRNA target sequence
tcaaagcaggaaattacctc

SEQ ID NO: 109190 - DNA, 20 bp, Artificial sequence
  SiRNA target sequence
caaagcaggaaattacctca

SEQ ID NO: 109191 - DNA, 20 bp, Artificial sequence
  SiRNA target sequence
aaagcaggaaattacctcat

SEQ ID NO: 109192 - DNA, 20 bp, Artificial sequence
  SiRNA target sequence
aagcaggaaattacctcatc

SEQ ID NO: 109193 - DNA, 20 bp, Artificial sequence
  SiRNA target sequence
agcaggaaattacctcatct

SEQ ID NO: 109194 - DNA, 20 bp, Artificial sequence
  SiRNA target sequence
gcaggaaattacctcatctt

SEQ ID NO: 109195 - DNA, 20 bp, Artificial sequence
  SiRNA target sequence
caggaaattacctcatcttc

SEQ ID NO: 109196 - DNA, 20 bp, Artificial sequence
  SiRNA target sequence
aggaaattacctcatcttcg

SEQ ID NO: 109197 - DNA, 20 bp, Artificial sequence
  SiRNA target sequence
ggaaattacctcatcttcga

SEQ ID NO: 109198 - DNA, 20 bp, Artificial sequence
  SiRNA target sequence
gaaattacctcatcttcgat

SEQ ID NO: 109199 - DNA, 20 bp, Artificial sequence
  SiRNA target sequence
aaattacctcatcttcgata

SEQ ID NO: 109200 - DNA, 20 bp, Artificial sequence
  SiRNA target sequence
aattacctcatcttcgataa

SEQ ID NO: 109201 - DNA, 20 bp, Artificial sequence
  SiRNA target sequence
attacctcatcttcgataat

SEQ ID NO: 109202 - DNA, 20 bp, Artificial sequence
  SiRNA target sequence
ttacctcatcttcgataatt

SEQ ID NO: 109203 - DNA, 20 bp, Artificial sequence
  SiRNA target sequence
tacctcatcttcgataattt

SEQ ID NO: 109204 - DNA, 20 bp, Artificial sequence
  SiRNA target sequence
acctcatcttcgataatttt

SEQ ID NO: 109205 - DNA, 20 bp, Artificial sequence
  SiRNA target sequence
cctcatcttcgataattttt

SEQ ID NO: 109206 - DNA, 20 bp, Artificial sequence
  SiRNA target sequence
ctcatcttcgataattttta

SEQ ID NO: 109207 - DNA, 20 bp, Artificial sequence
  SiRNA target sequence
tcatcttcgataatttttac

SEQ ID NO: 109208 - DNA, 20 bp, Artificial sequence
  SiRNA target sequence
catcttcgataatttttact

SEQ ID NO: 109209 - DNA, 20 bp, Artificial sequence
  SiRNA target sequence
atcttcgataatttttactt

SEQ ID NO: 109210 - DNA, 20 bp, Artificial sequence
  SiRNA target sequence
tcttcgataatttttacttc

SEQ ID NO: 109211 - DNA, 20 bp, Artificial sequence
  SiRNA target sequence
cttcgataatttttacttct

SEQ ID NO: 109212 - DNA, 20 bp, Artificial sequence
  SiRNA target sequence
ttcgataatttttacttctt

SEQ ID NO: 109213 - DNA, 20 bp, Artificial sequence
  SiRNA target sequence
tcgataatttttacttcttc

SEQ ID NO: 109214 - DNA, 20 bp, Artificial sequence
  SiRNA target sequence
cgataatttttacttcttca

SEQ ID NO: 109215 - DNA, 20 bp, Artificial sequence
  SiRNA target sequence
gataatttttacttcttcac

SEQ ID NO: 109216 - DNA, 20 bp, Artificial sequence
  SiRNA target sequence
ataatttttacttcttcaca

SEQ ID NO: 109217 - DNA, 20 bp, Artificial sequence
  SiRNA target sequence
taatttttacttcttcacaa

SEQ ID NO: 109218 - DNA, 20 bp, Artificial sequence
  SiRNA target sequence
aatttttacttcttcacaag

SEQ ID NO: 109219 - DNA, 20 bp, Artificial sequence
  SiRNA target sequence
atttttacttcttcacaagt

SEQ ID NO: 109220 - DNA, 20 bp, Artificial sequence
  SiRNA target sequence
tttttacttcttcacaagtc

SEQ ID NO: 109221 - DNA, 20 bp, Artificial sequence
  SiRNA target sequence
ttttacttcttcacaagtcg

SEQ ID NO: 109222 - DNA, 20 bp, Artificial sequence
  SiRNA target sequence
tttacttcttcacaagtcgc

SEQ ID NO: 109223 - DNA, 20 bp, Artificial sequence
  SiRNA target sequence
ttacttcttcacaagtcgca

SEQ ID NO: 109224 - DNA, 20 bp, Artificial sequence
  SiRNA target sequence
tacttcttcacaagtcgcaa

SEQ ID NO: 109225 - DNA, 20 bp, Artificial sequence
  SiRNA target sequence
acttcttcacaagtcgcaaa

SEQ ID NO: 109226 - DNA, 20 bp, Artificial sequence
  SiRNA target sequence
cttcttcacaagtcgcaaat

SEQ ID NO: 109227 - DNA, 20 bp, Artificial sequence
  SiRNA target sequence
ttcttcacaagtcgcaaatt

SEQ ID NO: 109228 - DNA, 20 bp, Artificial sequence
  SiRNA target sequence
tcttcacaagtcgcaaattt

SEQ ID NO: 109229 - DNA, 20 bp, Artificial sequence
  SiRNA target sequence
cttcacaagtcgcaaatttt

SEQ ID NO: 109230 - DNA, 20 bp, Artificial sequence
  SiRNA target sequence
ttcacaagtcgcaaattttt

SEQ ID NO: 109231 - DNA, 20 bp, Artificial sequence
  SiRNA target sequence
tcacaagtcgcaaatttttg

SEQ ID NO: 109232 - DNA, 20 bp, Artificial sequence
  SiRNA target sequence
cacaagtcgcaaatttttgt

SEQ ID NO: 109233 - DNA, 20 bp, Artificial sequence
  SiRNA target sequence
acaagtcgcaaatttttgta

SEQ ID NO: 109234 - DNA, 20 bp, Artificial sequence
  SiRNA target sequence
caagtcgcaaatttttgtaa

SEQ ID NO: 109235 - DNA, 20 bp, Artificial sequence
  SiRNA target sequence
aagtcgcaaatttttgtaag

SEQ ID NO: 109236 - DNA, 20 bp, Artificial sequence
  SiRNA target sequence
agtcgcaaatttttgtaagt

SEQ ID NO: 109237 - DNA, 20 bp, Artificial sequence
  SiRNA target sequence
gtcgcaaatttttgtaagtt

SEQ ID NO: 109238 - DNA, 20 bp, Artificial sequence
  SiRNA target sequence
tcgcaaatttttgtaagtta

SEQ ID NO: 109239 - DNA, 20 bp, Artificial sequence
  SiRNA target sequence
cgcaaatttttgtaagttat

SEQ ID NO: 109240 - DNA, 20 bp, Artificial sequence
  SiRNA target sequence
gcaaatttttgtaagttatt

SEQ ID NO: 109241 - DNA, 20 bp, Artificial sequence
  SiRNA target sequence
caaatttttgtaagttattt

SEQ ID NO: 109242 - DNA, 20 bp, Artificial sequence
  SiRNA target sequence
aaatttttgtaagttatttt

SEQ ID NO: 109243 - DNA, 20 bp, Artificial sequence
  SiRNA target sequence
aatttttgtaagttattttt

SEQ ID NO: 109244 - DNA, 20 bp, Artificial sequence
  SiRNA target sequence
atttttgtaagttatttttt

SEQ ID NO: 109245 - DNA, 20 bp, Artificial sequence
  SiRNA target sequence
tttttgtaagttattttttg

SEQ ID NO: 109246 - DNA, 20 bp, Artificial sequence
  SiRNA target sequence
ttttgtaagttattttttgc

SEQ ID NO: 109247 - DNA, 20 bp, Artificial sequence
  SiRNA target sequence
tttgtaagttattttttgct

SEQ ID NO: 109248 - DNA, 20 bp, Artificial sequence
  SiRNA target sequence
ttgtaagttattttttgctt

SEQ ID NO: 109249 - DNA, 20 bp, Artificial sequence
  SiRNA target sequence
tgtaagttattttttgcttc

SEQ ID NO: 109250 - DNA, 20 bp, Artificial sequence
  SiRNA target sequence
gtaagttattttttgcttct

SEQ ID NO: 109251 - DNA, 20 bp, Artificial sequence
  SiRNA target sequence
taagttattttttgcttctt

SEQ ID NO: 109252 - DNA, 20 bp, Artificial sequence
  SiRNA target sequence
aagttattttttgcttcttt

SEQ ID NO: 109253 - DNA, 20 bp, Artificial sequence
  SiRNA target sequence
agttattttttgcttcttta

SEQ ID NO: 109254 - DNA, 20 bp, Artificial sequence
  SiRNA target sequence
gttattttttgcttctttaa

SEQ ID NO: 109255 - DNA, 20 bp, Artificial sequence
  SiRNA target sequence
ttattttttgcttctttaag

SEQ ID NO: 109256 - DNA, 20 bp, Artificial sequence
  SiRNA target sequence
tattttttgcttctttaagg

SEQ ID NO: 109257 - DNA, 20 bp, Artificial sequence
  SiRNA target sequence
attttttgcttctttaaggc

SEQ ID NO: 109258 - DNA, 20 bp, Artificial sequence
  SiRNA target sequence
ttttttgcttctttaaggca

SEQ ID NO: 109259 - DNA, 20 bp, Artificial sequence
  SiRNA target sequence
tttttgcttctttaaggcaa

SEQ ID NO: 109260 - DNA, 20 bp, Artificial sequence
  SiRNA target sequence
ttttgcttctttaaggcaat

SEQ ID NO: 109261 - DNA, 20 bp, Artificial sequence
  SiRNA target sequence
tttgcttctttaaggcaatc

SEQ ID NO: 109262 - DNA, 20 bp, Artificial sequence
  SiRNA target sequence
ttgcttctttaaggcaatca

SEQ ID NO: 109263 - DNA, 20 bp, Artificial sequence
  SiRNA target sequence
tgcttctttaaggcaatcat

SEQ ID NO: 109264 - DNA, 20 bp, Artificial sequence
  SiRNA target sequence
gcttctttaaggcaatcatt

SEQ ID NO: 109265 - DNA, 20 bp, Artificial sequence
  SiRNA target sequence
cttctttaaggcaatcatta

SEQ ID NO: 109266 - DNA, 20 bp, Artificial sequence
  SiRNA target sequence
ttctttaaggcaatcattat

SEQ ID NO: 109267 - DNA, 20 bp, Artificial sequence
  SiRNA target sequence
tctttaaggcaatcattatt

SEQ ID NO: 109268 - DNA, 20 bp, Artificial sequence
  SiRNA target sequence
ctttaaggcaatcattattt

SEQ ID NO: 109269 - DNA, 20 bp, Artificial sequence
  SiRNA target sequence
tttaaggcaatcattatttt

SEQ ID NO: 109270 - DNA, 20 bp, Artificial sequence
  SiRNA target sequence
ttaaggcaatcattattttt

SEQ ID NO: 109271 - DNA, 20 bp, Artificial sequence
  SiRNA target sequence
taaggcaatcattatttttt

SEQ ID NO: 109272 - DNA, 20 bp, Artificial sequence
  SiRNA target sequence
aaggcaatcattattttttt

SEQ ID NO: 109273 - DNA, 20 bp, Artificial sequence
  SiRNA target sequence
aggcaatcattatttttttt

SEQ ID NO: 109274 - DNA, 20 bp, Artificial sequence
  SiRNA target sequence
ggcaatcattattttttttt

SEQ ID NO: 109275 - DNA, 20 bp, Artificial sequence
  SiRNA target sequence
gcaatcattatttttttttt

SEQ ID NO: 109276 - DNA, 20 bp, Artificial sequence
  SiRNA target sequence
caatcattattttttttttc

SEQ ID NO: 109277 - DNA, 20 bp, Artificial sequence
  SiRNA target sequence
aatcattattttttttttca

SEQ ID NO: 109278 - DNA, 20 bp, Artificial sequence
  SiRNA target sequence
atcattattttttttttcat

SEQ ID NO: 109279 - DNA, 20 bp, Artificial sequence
  SiRNA target sequence
tcattattttttttttcatt

SEQ ID NO: 109280 - DNA, 20 bp, Artificial sequence
  SiRNA target sequence
cattattttttttttcatta

SEQ ID NO: 109281 - DNA, 20 bp, Artificial sequence
  SiRNA target sequence
attattttttttttcattaa

SEQ ID NO: 109282 - DNA, 20 bp, Artificial sequence
  SiRNA target sequence
ttattttttttttcattaat

SEQ ID NO: 109283 - DNA, 20 bp, Artificial sequence
  SiRNA target sequence
tattttttttttcattaatt

SEQ ID NO: 109284 - DNA, 20 bp, Artificial sequence
  SiRNA target sequence
attttttttttcattaattt

SEQ ID NO: 109285 - DNA, 20 bp, Artificial sequence
  SiRNA target sequence
ttttttttttcattaatttc

SEQ ID NO: 109286 - DNA, 20 bp, Artificial sequence
  SiRNA target sequence
tttttttttcattaatttcc

SEQ ID NO: 109287 - DNA, 20 bp, Artificial sequence
  SiRNA target sequence
ttttttttcattaatttcct

SEQ ID NO: 109288 - DNA, 20 bp, Artificial sequence
  SiRNA target sequence
tttttttcattaatttcctc

SEQ ID NO: 109289 - DNA, 20 bp, Artificial sequence
  SiRNA target sequence
ttttttcattaatttcctcc

SEQ ID NO: 109290 - DNA, 20 bp, Artificial sequence
  SiRNA target sequence
tttttcattaatttcctccg

SEQ ID NO: 109291 - DNA, 20 bp, Artificial sequence
  SiRNA target sequence
ttttcattaatttcctccgt

SEQ ID NO: 109292 - DNA, 20 bp, Artificial sequence
  SiRNA target sequence
tttcattaatttcctccgtg

SEQ ID NO: 109293 - DNA, 20 bp, Artificial sequence
  SiRNA target sequence
ttcattaatttcctccgtgg

SEQ ID NO: 109294 - DNA, 20 bp, Artificial sequence
  SiRNA target sequence
tcattaatttcctccgtgga

SEQ ID NO: 109295 - DNA, 20 bp, Artificial sequence
  SiRNA target sequence
cattaatttcctccgtggat

SEQ ID NO: 109296 - DNA, 20 bp, Artificial sequence
  SiRNA target sequence
attaatttcctccgtggatc

SEQ ID NO: 109297 - DNA, 20 bp, Artificial sequence
  SiRNA target sequence
ttaatttcctccgtggatct

SEQ ID NO: 109298 - DNA, 20 bp, Artificial sequence
  SiRNA target sequence
taatttcctccgtggatctg

SEQ ID NO: 109299 - DNA, 20 bp, Artificial sequence
  SiRNA target sequence
aatttcctccgtggatctgt

SEQ ID NO: 109300 - DNA, 20 bp, Artificial sequence
  SiRNA target sequence
atttcctccgtggatctgta

SEQ ID NO: 109301 - DNA, 20 bp, Artificial sequence
  SiRNA target sequence
tttcctccgtggatctgtaa

SEQ ID NO: 109302 - DNA, 20 bp, Artificial sequence
  SiRNA target sequence
ttcctccgtggatctgtaaa

SEQ ID NO: 109303 - DNA, 20 bp, Artificial sequence
  SiRNA target sequence
tcctccgtggatctgtaaaa

SEQ ID NO: 109304 - DNA, 20 bp, Artificial sequence
  SiRNA target sequence
cctccgtggatctgtaaaaa

SEQ ID NO: 109305 - DNA, 20 bp, Artificial sequence
  SiRNA target sequence
ctccgtggatctgtaaaaat

SEQ ID NO: 109306 - DNA, 20 bp, Artificial sequence
  SiRNA target sequence
tccgtggatctgtaaaaatc

SEQ ID NO: 109307 - DNA, 20 bp, Artificial sequence
  SiRNA target sequence
ccgtggatctgtaaaaatcg

SEQ ID NO: 109308 - DNA, 20 bp, Artificial sequence
  SiRNA target sequence
cgtggatctgtaaaaatcgt

SEQ ID NO: 109309 - DNA, 20 bp, Artificial sequence
  SiRNA target sequence
gtggatctgtaaaaatcgtt

SEQ ID NO: 109310 - DNA, 20 bp, Artificial sequence
  SiRNA target sequence
tggatctgtaaaaatcgtta

SEQ ID NO: 109311 - DNA, 20 bp, Artificial sequence
  SiRNA target sequence
ggatctgtaaaaatcgttaa

SEQ ID NO: 109312 - DNA, 20 bp, Artificial sequence
  SiRNA target sequence
gatctgtaaaaatcgttaac

SEQ ID NO: 109313 - DNA, 20 bp, Artificial sequence
  SiRNA target sequence
atctgtaaaaatcgttaaca

SEQ ID NO: 109314 - DNA, 20 bp, Artificial sequence
  SiRNA target sequence
tctgtaaaaatcgttaacat

SEQ ID NO: 109315 - DNA, 20 bp, Artificial sequence
  SiRNA target sequence
ctgtaaaaatcgttaacatc

SEQ ID NO: 109316 - DNA, 20 bp, Artificial sequence
  SiRNA target sequence
tgtaaaaatcgttaacatct

SEQ ID NO: 109317 - DNA, 20 bp, Artificial sequence
  SiRNA target sequence
gtaaaaatcgttaacatcta

SEQ ID NO: 109318 - DNA, 20 bp, Artificial sequence
  SiRNA target sequence
taaaaatcgttaacatctaa

SEQ ID NO: 109319 - DNA, 20 bp, Artificial sequence
  SiRNA target sequence
aaaaatcgttaacatctaaa

SEQ ID NO: 109320 - DNA, 20 bp, Artificial sequence
  SiRNA target sequence
aaaatcgttaacatctaaac

SEQ ID NO: 109321 - DNA, 20 bp, Artificial sequence
  SiRNA target sequence
aaatcgttaacatctaaaca

SEQ ID NO: 109322 - DNA, 20 bp, Artificial sequence
  SiRNA target sequence
aatcgttaacatctaaacag

SEQ ID NO: 109323 - DNA, 20 bp, Artificial sequence
  SiRNA target sequence
atcgttaacatctaaacagg

SEQ ID NO: 109324 - DNA, 20 bp, Artificial sequence
  SiRNA target sequence
tcgttaacatctaaacagga

SEQ ID NO: 109325 - DNA, 20 bp, Artificial sequence
  SiRNA target sequence
cgttaacatctaaacaggag

SEQ ID NO: 109326 - DNA, 20 bp, Artificial sequence
  SiRNA target sequence
gttaacatctaaacaggagt

SEQ ID NO: 109327 - DNA, 20 bp, Artificial sequence
  SiRNA target sequence
ttaacatctaaacaggagtg

SEQ ID NO: 109328 - DNA, 20 bp, Artificial sequence
  SiRNA target sequence
taacatctaaacaggagtgc

SEQ ID NO: 109329 - DNA, 20 bp, Artificial sequence
  SiRNA target sequence
aacatctaaacaggagtgcc

SEQ ID NO: 109330 - DNA, 20 bp, Artificial sequence
  SiRNA target sequence
acatctaaacaggagtgccc

SEQ ID NO: 109331 - DNA, 20 bp, Artificial sequence
  SiRNA target sequence
catctaaacaggagtgccca

SEQ ID NO: 109332 - DNA, 20 bp, Artificial sequence
  SiRNA target sequence
atctaaacaggagtgcccac

SEQ ID NO: 109333 - DNA, 20 bp, Artificial sequence
  SiRNA target sequence
tctaaacaggagtgcccaca

SEQ ID NO: 109334 - DNA, 20 bp, Artificial sequence
  SiRNA target sequence
ctaaacaggagtgcccacat

SEQ ID NO: 109335 - DNA, 20 bp, Artificial sequence
  SiRNA target sequence
taaacaggagtgcccacatg

SEQ ID NO: 109336 - DNA, 20 bp, Artificial sequence
  SiRNA target sequence
aaacaggagtgcccacatgt

SEQ ID NO: 109337 - DNA, 20 bp, Artificial sequence
  SiRNA target sequence
aacaggagtgcccacatgtc

SEQ ID NO: 109338 - DNA, 20 bp, Artificial sequence
  SiRNA target sequence
acaggagtgcccacatgtcc

SEQ ID NO: 109339 - DNA, 20 bp, Artificial sequence
  SiRNA target sequence
caggagtgcccacatgtcct

SEQ ID NO: 109340 - DNA, 20 bp, Artificial sequence
  SiRNA target sequence
aggagtgcccacatgtcctg

SEQ ID NO: 109341 - DNA, 20 bp, Artificial sequence
  SiRNA target sequence
ggagtgcccacatgtcctgt

SEQ ID NO: 109342 - DNA, 20 bp, Artificial sequence
  SiRNA target sequence
gagtgcccacatgtcctgta

SEQ ID NO: 109343 - DNA, 20 bp, Artificial sequence
  SiRNA target sequence
agtgcccacatgtcctgtac

SEQ ID NO: 109344 - DNA, 20 bp, Artificial sequence
  SiRNA target sequence
gtgcccacatgtcctgtacg

SEQ ID NO: 109345 - DNA, 20 bp, Artificial sequence
  SiRNA target sequence
tgcccacatgtcctgtacgt

SEQ ID NO: 109346 - DNA, 20 bp, Artificial sequence
  SiRNA target sequence
gcccacatgtcctgtacgta

SEQ ID NO: 109347 - DNA, 20 bp, Artificial sequence
  SiRNA target sequence
cccacatgtcctgtacgtat

SEQ ID NO: 109348 - DNA, 20 bp, Artificial sequence
  SiRNA target sequence
ccacatgtcctgtacgtatc

SEQ ID NO: 109349 - DNA, 20 bp, Artificial sequence
  SiRNA target sequence
cacatgtcctgtacgtatca

SEQ ID NO: 109350 - DNA, 20 bp, Artificial sequence
  SiRNA target sequence
acatgtcctgtacgtatcaa

SEQ ID NO: 109351 - DNA, 20 bp, Artificial sequence
  SiRNA target sequence
catgtcctgtacgtatcaat

SEQ ID NO: 109352 - DNA, 20 bp, Artificial sequence
  SiRNA target sequence
atgtcctgtacgtatcaatt

SEQ ID NO: 109353 - DNA, 20 bp, Artificial sequence
  SiRNA target sequence
tgtcctgtacgtatcaattt

SEQ ID NO: 109354 - DNA, 20 bp, Artificial sequence
  SiRNA target sequence
gtcctgtacgtatcaatttg

SEQ ID NO: 109355 - DNA, 20 bp, Artificial sequence
  SiRNA target sequence
tcctgtacgtatcaatttgc

SEQ ID NO: 109356 - DNA, 20 bp, Artificial sequence
  SiRNA target sequence
cctgtacgtatcaatttgca

SEQ ID NO: 109357 - DNA, 20 bp, Artificial sequence
  SiRNA target sequence
ctgtacgtatcaatttgcaa

SEQ ID NO: 109358 - DNA, 20 bp, Artificial sequence
  SiRNA target sequence
tgtacgtatcaatttgcaag

SEQ ID NO: 109359 - DNA, 20 bp, Artificial sequence
  SiRNA target sequence
gtacgtatcaatttgcaaga

SEQ ID NO: 109360 - DNA, 20 bp, Artificial sequence
  SiRNA target sequence
tacgtatcaatttgcaagat

SEQ ID NO: 109361 - DNA, 20 bp, Artificial sequence
  SiRNA target sequence
acgtatcaatttgcaagatg

SEQ ID NO: 109362 - DNA, 20 bp, Artificial sequence
  SiRNA target sequence
cgtatcaatttgcaagatga

SEQ ID NO: 109363 - DNA, 20 bp, Artificial sequence
  SiRNA target sequence
gtatcaatttgcaagatgat

SEQ ID NO: 109364 - DNA, 20 bp, Artificial sequence
  SiRNA target sequence
tatcaatttgcaagatgata

SEQ ID NO: 109365 - DNA, 20 bp, Artificial sequence
  SiRNA target sequence
atcaatttgcaagatgatag

SEQ ID NO: 109366 - DNA, 20 bp, Artificial sequence
  SiRNA target sequence
tcaatttgcaagatgatagg

SEQ ID NO: 109367 - DNA, 20 bp, Artificial sequence
  SiRNA target sequence
caatttgcaagatgataggt

SEQ ID NO: 109368 - DNA, 20 bp, Artificial sequence
  SiRNA target sequence
aatttgcaagatgataggtc

SEQ ID NO: 109369 - DNA, 20 bp, Artificial sequence
  SiRNA target sequence
atttgcaagatgataggtcc

SEQ ID NO: 109370 - DNA, 20 bp, Artificial sequence
  SiRNA target sequence
tttgcaagatgataggtcct

SEQ ID NO: 109371 - DNA, 20 bp, Artificial sequence
  SiRNA target sequence
ttgcaagatgataggtcctt

SEQ ID NO: 109372 - DNA, 20 bp, Artificial sequence
  SiRNA target sequence
tgcaagatgataggtccttt

SEQ ID NO: 109373 - DNA, 20 bp, Artificial sequence
  SiRNA target sequence
gcaagatgataggtcctttt

SEQ ID NO: 109374 - DNA, 20 bp, Artificial sequence
  SiRNA target sequence
caagatgataggtccttttt

SEQ ID NO: 109375 - DNA, 20 bp, Artificial sequence
  SiRNA target sequence
aagatgataggtcctttttc

SEQ ID NO: 109376 - DNA, 20 bp, Artificial sequence
  SiRNA target sequence
agatgataggtcctttttct

SEQ ID NO: 109377 - DNA, 20 bp, Artificial sequence
  SiRNA target sequence
gatgataggtcctttttcta

SEQ ID NO: 109378 - DNA, 20 bp, Artificial sequence
  SiRNA target sequence
atgataggtcctttttctat

SEQ ID NO: 109379 - DNA, 20 bp, Artificial sequence
  SiRNA target sequence
tgataggtcctttttctatt

SEQ ID NO: 109380 - DNA, 20 bp, Artificial sequence
  SiRNA target sequence
gataggtcctttttctattg

SEQ ID NO: 109381 - DNA, 20 bp, Artificial sequence
  SiRNA target sequence
ataggtcctttttctattgc

SEQ ID NO: 109382 - DNA, 20 bp, Artificial sequence
  SiRNA target sequence
taggtcctttttctattgca

SEQ ID NO: 109383 - DNA, 20 bp, Artificial sequence
  SiRNA target sequence
aggtcctttttctattgcat

SEQ ID NO: 109384 - DNA, 20 bp, Artificial sequence
  SiRNA target sequence
ggtcctttttctattgcatg

SEQ ID NO: 109385 - DNA, 20 bp, Artificial sequence
  SiRNA target sequence
gtcctttttctattgcatgt

SEQ ID NO: 109386 - DNA, 20 bp, Artificial sequence
  SiRNA target sequence
tcctttttctattgcatgtt

SEQ ID NO: 109387 - DNA, 20 bp, Artificial sequence
  SiRNA target sequence
cctttttctattgcatgttg

SEQ ID NO: 109388 - DNA, 20 bp, Artificial sequence
  SiRNA target sequence
ctttttctattgcatgttgt

SEQ ID NO: 109389 - DNA, 20 bp, Artificial sequence
  SiRNA target sequence
tttttctattgcatgttgtc

SEQ ID NO: 109390 - DNA, 20 bp, Artificial sequence
  SiRNA target sequence
ttttctattgcatgttgtct

SEQ ID NO: 109391 - DNA, 20 bp, Artificial sequence
  SiRNA target sequence
tttctattgcatgttgtcta

SEQ ID NO: 109392 - DNA, 20 bp, Artificial sequence
  SiRNA target sequence
ttctattgcatgttgtctag

SEQ ID NO: 109393 - DNA, 20 bp, Artificial sequence
  SiRNA target sequence
tctattgcatgttgtctagc

SEQ ID NO: 109394 - DNA, 20 bp, Artificial sequence
  SiRNA target sequence
ctattgcatgttgtctagca

SEQ ID NO: 109395 - DNA, 20 bp, Artificial sequence
  SiRNA target sequence
tattgcatgttgtctagcaa

SEQ ID NO: 109396 - DNA, 20 bp, Artificial sequence
  SiRNA target sequence
attgcatgttgtctagcaaa

SEQ ID NO: 109397 - DNA, 20 bp, Artificial sequence
  SiRNA target sequence
ttgcatgttgtctagcaaat

SEQ ID NO: 109398 - DNA, 20 bp, Artificial sequence
  SiRNA target sequence
tgcatgttgtctagcaaatg

SEQ ID NO: 109399 - DNA, 20 bp, Artificial sequence
  SiRNA target sequence
gcatgttgtctagcaaatgt

SEQ ID NO: 109400 - DNA, 20 bp, Artificial sequence
  SiRNA target sequence
catgttgtctagcaaatgta

SEQ ID NO: 109401 - DNA, 20 bp, Artificial sequence
  SiRNA target sequence
atgttgtctagcaaatgtaa

SEQ ID NO: 109402 - DNA, 20 bp, Artificial sequence
  SiRNA target sequence
tgttgtctagcaaatgtaaa

SEQ ID NO: 109403 - DNA, 20 bp, Artificial sequence
  SiRNA target sequence
gttgtctagcaaatgtaaat

SEQ ID NO: 109404 - DNA, 20 bp, Artificial sequence
  SiRNA target sequence
ttgtctagcaaatgtaaata

SEQ ID NO: 109405 - DNA, 20 bp, Artificial sequence
  SiRNA target sequence
tgtctagcaaatgtaaatac

SEQ ID NO: 109406 - DNA, 20 bp, Artificial sequence
  SiRNA target sequence
gtctagcaaatgtaaataca

SEQ ID NO: 109407 - DNA, 20 bp, Artificial sequence
  SiRNA target sequence
tctagcaaatgtaaatacat

SEQ ID NO: 109408 - DNA, 20 bp, Artificial sequence
  SiRNA target sequence
ctagcaaatgtaaatacatc

SEQ ID NO: 109409 - DNA, 20 bp, Artificial sequence
  SiRNA target sequence
tagcaaatgtaaatacatca

SEQ ID NO: 109410 - DNA, 20 bp, Artificial sequence
  SiRNA target sequence
agcaaatgtaaatacatcaa

SEQ ID NO: 109411 - DNA, 20 bp, Artificial sequence
  SiRNA target sequence
gcaaatgtaaatacatcaat

SEQ ID NO: 109412 - DNA, 20 bp, Artificial sequence
  SiRNA target sequence
caaatgtaaatacatcaatc

SEQ ID NO: 109413 - DNA, 20 bp, Artificial sequence
  SiRNA target sequence
aaatgtaaatacatcaatca

SEQ ID NO: 109414 - DNA, 20 bp, Artificial sequence
  SiRNA target sequence
aatgtaaatacatcaatcag

SEQ ID NO: 109415 - DNA, 20 bp, Artificial sequence
  SiRNA target sequence
atgtaaatacatcaatcagt

SEQ ID NO: 109416 - DNA, 20 bp, Artificial sequence
  SiRNA target sequence
tgtaaatacatcaatcagtt

SEQ ID NO: 109417 - DNA, 20 bp, Artificial sequence
  SiRNA target sequence
gtaaatacatcaatcagttg

SEQ ID NO: 109418 - DNA, 20 bp, Artificial sequence
  SiRNA target sequence
taaatacatcaatcagttga

SEQ ID NO: 109419 - DNA, 20 bp, Artificial sequence
  SiRNA target sequence
aaatacatcaatcagttgag

SEQ ID NO: 109420 - DNA, 20 bp, Artificial sequence
  SiRNA target sequence
aatacatcaatcagttgagt

SEQ ID NO: 109421 - DNA, 20 bp, Artificial sequence
  SiRNA target sequence
atacatcaatcagttgagtt

SEQ ID NO: 109422 - DNA, 20 bp, Artificial sequence
  SiRNA target sequence
tacatcaatcagttgagtta

SEQ ID NO: 109423 - DNA, 20 bp, Artificial sequence
  SiRNA target sequence
acatcaatcagttgagttat

SEQ ID NO: 109424 - DNA, 20 bp, Artificial sequence
  SiRNA target sequence
catcaatcagttgagttatg

SEQ ID NO: 109425 - DNA, 20 bp, Artificial sequence
  SiRNA target sequence
atcaatcagttgagttatgt

SEQ ID NO: 109426 - DNA, 20 bp, Artificial sequence
  SiRNA target sequence
tcaatcagttgagttatgtt

SEQ ID NO: 109427 - DNA, 20 bp, Artificial sequence
  SiRNA target sequence
caatcagttgagttatgttt

SEQ ID NO: 109428 - DNA, 20 bp, Artificial sequence
  SiRNA target sequence
aatcagttgagttatgtttt

SEQ ID NO: 109429 - DNA, 20 bp, Artificial sequence
  SiRNA target sequence
atcagttgagttatgttttt

SEQ ID NO: 109430 - DNA, 20 bp, Artificial sequence
  SiRNA target sequence
tcagttgagttatgttttta

SEQ ID NO: 109431 - DNA, 20 bp, Artificial sequence
  SiRNA target sequence
cagttgagttatgtttttat

SEQ ID NO: 109432 - DNA, 20 bp, Artificial sequence
  SiRNA target sequence
agttgagttatgtttttatc

SEQ ID NO: 109433 - DNA, 20 bp, Artificial sequence
  SiRNA target sequence
gttgagttatgtttttatct

SEQ ID NO: 109434 - DNA, 20 bp, Artificial sequence
  SiRNA target sequence
ttgagttatgtttttatctg

SEQ ID NO: 109435 - DNA, 20 bp, Artificial sequence
  SiRNA target sequence
tgagttatgtttttatctgt

SEQ ID NO: 109436 - DNA, 20 bp, Artificial sequence
  SiRNA target sequence
gagttatgtttttatctgta

SEQ ID NO: 109437 - DNA, 20 bp, Artificial sequence
  SiRNA target sequence
agttatgtttttatctgtaa

SEQ ID NO: 109438 - DNA, 20 bp, Artificial sequence
  SiRNA target sequence
gttatgtttttatctgtaag

SEQ ID NO: 109439 - DNA, 20 bp, Artificial sequence
  SiRNA target sequence
ttatgtttttatctgtaaga

SEQ ID NO: 109440 - DNA, 20 bp, Artificial sequence
  SiRNA target sequence
tatgtttttatctgtaagac

SEQ ID NO: 109441 - DNA, 20 bp, Artificial sequence
  SiRNA target sequence
atgtttttatctgtaagacg

SEQ ID NO: 109442 - DNA, 20 bp, Artificial sequence
  SiRNA target sequence
tgtttttatctgtaagacgt

SEQ ID NO: 109443 - DNA, 20 bp, Artificial sequence
  SiRNA target sequence
gtttttatctgtaagacgta

SEQ ID NO: 109444 - DNA, 20 bp, Artificial sequence
  SiRNA target sequence
tttttatctgtaagacgtat

SEQ ID NO: 109445 - DNA, 20 bp, Artificial sequence
  SiRNA target sequence
ttttatctgtaagacgtata

SEQ ID NO: 109446 - DNA, 20 bp, Artificial sequence
  SiRNA target sequence
tttatctgtaagacgtatac

SEQ ID NO: 109447 - DNA, 20 bp, Artificial sequence
  SiRNA target sequence
ttatctgtaagacgtatacc

SEQ ID NO: 109448 - DNA, 20 bp, Artificial sequence
  SiRNA target sequence
tatctgtaagacgtatacct

SEQ ID NO: 109449 - DNA, 20 bp, Artificial sequence
  SiRNA target sequence
atctgtaagacgtatacctg

SEQ ID NO: 109450 - DNA, 20 bp, Artificial sequence
  SiRNA target sequence
tctgtaagacgtatacctgg

SEQ ID NO: 109451 - DNA, 20 bp, Artificial sequence
  SiRNA target sequence
ctgtaagacgtatacctgga

SEQ ID NO: 109452 - DNA, 20 bp, Artificial sequence
  SiRNA target sequence
tgtaagacgtatacctggaa

SEQ ID NO: 109453 - DNA, 20 bp, Artificial sequence
  SiRNA target sequence
gtaagacgtatacctggaat

SEQ ID NO: 109454 - DNA, 20 bp, Artificial sequence
  SiRNA target sequence
taagacgtatacctggaata

SEQ ID NO: 109455 - DNA, 20 bp, Artificial sequence
  SiRNA target sequence
aagacgtatacctggaatat

SEQ ID NO: 109456 - DNA, 20 bp, Artificial sequence
  SiRNA target sequence
agacgtatacctggaatatt

SEQ ID NO: 109457 - DNA, 20 bp, Artificial sequence
  SiRNA target sequence
gacgtatacctggaatatta

SEQ ID NO: 109458 - DNA, 20 bp, Artificial sequence
  SiRNA target sequence
acgtatacctggaatattat

SEQ ID NO: 109459 - DNA, 20 bp, Artificial sequence
  SiRNA target sequence
cgtatacctggaatattata

SEQ ID NO: 109460 - DNA, 20 bp, Artificial sequence
  SiRNA target sequence
gtatacctggaatattatat

SEQ ID NO: 109461 - DNA, 20 bp, Artificial sequence
  SiRNA target sequence
tatacctggaatattatatc

SEQ ID NO: 109462 - DNA, 20 bp, Artificial sequence
  SiRNA target sequence
atacctggaatattatatcc

SEQ ID NO: 109463 - DNA, 20 bp, Artificial sequence
  SiRNA target sequence
tacctggaatattatatccc

SEQ ID NO: 109464 - DNA, 20 bp, Artificial sequence
  SiRNA target sequence
acctggaatattatatcccc

SEQ ID NO: 109465 - DNA, 20 bp, Artificial sequence
  SiRNA target sequence
cctggaatattatatcccct

SEQ ID NO: 109466 - DNA, 20 bp, Artificial sequence
  SiRNA target sequence
ctggaatattatatcccctt

SEQ ID NO: 109467 - DNA, 20 bp, Artificial sequence
  SiRNA target sequence
tggaatattatatccccttt

SEQ ID NO: 109468 - DNA, 20 bp, Artificial sequence
  SiRNA target sequence
ggaatattatatcccctttt

SEQ ID NO: 109469 - DNA, 20 bp, Artificial sequence
  SiRNA target sequence
gaatattatatcccctttta

SEQ ID NO: 109470 - DNA, 20 bp, Artificial sequence
  SiRNA target sequence
aatattatatccccttttaa

SEQ ID NO: 109471 - DNA, 20 bp, Artificial sequence
  SiRNA target sequence
atattatatccccttttaaa

SEQ ID NO: 109472 - DNA, 20 bp, Artificial sequence
  SiRNA target sequence
tattatatccccttttaaaa

SEQ ID NO: 109473 - DNA, 20 bp, Artificial sequence
  SiRNA target sequence
attatatccccttttaaaat

SEQ ID NO: 109474 - DNA, 20 bp, Artificial sequence
  SiRNA target sequence
ttatatccccttttaaaata

SEQ ID NO: 109475 - DNA, 20 bp, Artificial sequence
  SiRNA target sequence
tatatccccttttaaaatat

SEQ ID NO: 109476 - DNA, 20 bp, Artificial sequence
  SiRNA target sequence
atatccccttttaaaatatt

SEQ ID NO: 109477 - DNA, 20 bp, Artificial sequence
  SiRNA target sequence
tatccccttttaaaatattc

SEQ ID NO: 109478 - DNA, 20 bp, Artificial sequence
  SiRNA target sequence
atccccttttaaaatattca

SEQ ID NO: 109479 - DNA, 20 bp, Artificial sequence
  SiRNA target sequence
tccccttttaaaatattcag

SEQ ID NO: 109480 - DNA, 20 bp, Artificial sequence
  SiRNA target sequence
ccccttttaaaatattcagg

SEQ ID NO: 109481 - DNA, 20 bp, Artificial sequence
  SiRNA target sequence
cccttttaaaatattcagga

SEQ ID NO: 109482 - DNA, 20 bp, Artificial sequence
  SiRNA target sequence
ccttttaaaatattcaggat

SEQ ID NO: 109483 - DNA, 20 bp, Artificial sequence
  SiRNA target sequence
cttttaaaatattcaggata

SEQ ID NO: 109484 - DNA, 20 bp, Artificial sequence
  SiRNA target sequence
ttttaaaatattcaggatat

SEQ ID NO: 109485 - DNA, 20 bp, Artificial sequence
  SiRNA target sequence
tttaaaatattcaggatatg

SEQ ID NO: 109486 - DNA, 20 bp, Artificial sequence
  SiRNA target sequence
ttaaaatattcaggatatgt

SEQ ID NO: 109487 - DNA, 20 bp, Artificial sequence
  SiRNA target sequence
taaaatattcaggatatgta

SEQ ID NO: 109488 - DNA, 20 bp, Artificial sequence
  SiRNA target sequence
aaaatattcaggatatgtag

SEQ ID NO: 109489 - DNA, 20 bp, Artificial sequence
  SiRNA target sequence
aaatattcaggatatgtagt

SEQ ID NO: 109490 - DNA, 20 bp, Artificial sequence
  SiRNA target sequence
aatattcaggatatgtagtg

SEQ ID NO: 109491 - DNA, 20 bp, Artificial sequence
  SiRNA target sequence
atattcaggatatgtagtgg

SEQ ID NO: 109492 - DNA, 20 bp, Artificial sequence
  SiRNA target sequence
tattcaggatatgtagtgga

SEQ ID NO: 109493 - DNA, 20 bp, Artificial sequence
  SiRNA target sequence
attcaggatatgtagtggaa

SEQ ID NO: 109494 - DNA, 20 bp, Artificial sequence
  SiRNA target sequence
ttcaggatatgtagtggaat

SEQ ID NO: 109495 - DNA, 20 bp, Artificial sequence
  SiRNA target sequence
tcaggatatgtagtggaatt

SEQ ID NO: 109496 - DNA, 20 bp, Artificial sequence
  SiRNA target sequence
caggatatgtagtggaatta

SEQ ID NO: 109497 - DNA, 20 bp, Artificial sequence
  SiRNA target sequence
aggatatgtagtggaattac

SEQ ID NO: 109498 - DNA, 20 bp, Artificial sequence
  SiRNA target sequence
ggatatgtagtggaattact

SEQ ID NO: 109499 - DNA, 20 bp, Artificial sequence
  SiRNA target sequence
gatatgtagtggaattactt

SEQ ID NO: 109500 - DNA, 20 bp, Artificial sequence
  SiRNA target sequence
atatgtagtggaattacttt

SEQ ID NO: 109501 - DNA, 20 bp, Artificial sequence
  SiRNA target sequence
tatgtagtggaattactttc

SEQ ID NO: 109502 - DNA, 20 bp, Artificial sequence
  SiRNA target sequence
atgtagtggaattactttca

SEQ ID NO: 109503 - DNA, 20 bp, Artificial sequence
  SiRNA target sequence
tgtagtggaattactttcag

SEQ ID NO: 109504 - DNA, 20 bp, Artificial sequence
  SiRNA target sequence
gtagtggaattactttcagg

SEQ ID NO: 109505 - DNA, 20 bp, Artificial sequence
  SiRNA target sequence
tagtggaattactttcaggt

SEQ ID NO: 109506 - DNA, 20 bp, Artificial sequence
  SiRNA target sequence
agtggaattactttcaggtg

SEQ ID NO: 109507 - DNA, 20 bp, Artificial sequence
  SiRNA target sequence
gtggaattactttcaggtgt

SEQ ID NO: 109508 - DNA, 20 bp, Artificial sequence
  SiRNA target sequence
tggaattactttcaggtgtc

SEQ ID NO: 109509 - DNA, 20 bp, Artificial sequence
  SiRNA target sequence
ggaattactttcaggtgtcc

SEQ ID NO: 109510 - DNA, 20 bp, Artificial sequence
  SiRNA target sequence
gaattactttcaggtgtcca

SEQ ID NO: 109511 - DNA, 20 bp, Artificial sequence
  SiRNA target sequence
aattactttcaggtgtccac

SEQ ID NO: 109512 - DNA, 20 bp, Artificial sequence
  SiRNA target sequence
attactttcaggtgtccaca

SEQ ID NO: 109513 - DNA, 20 bp, Artificial sequence
  SiRNA target sequence
ttactttcaggtgtccacat

SEQ ID NO: 109514 - DNA, 20 bp, Artificial sequence
  SiRNA target sequence
tactttcaggtgtccacata

SEQ ID NO: 109515 - DNA, 20 bp, Artificial sequence
  SiRNA target sequence
actttcaggtgtccacatac

SEQ ID NO: 109516 - DNA, 20 bp, Artificial sequence
  SiRNA target sequence
ctttcaggtgtccacatact

SEQ ID NO: 109517 - DNA, 20 bp, Artificial sequence
  SiRNA target sequence
tttcaggtgtccacatacta

SEQ ID NO: 109518 - DNA, 20 bp, Artificial sequence
  SiRNA target sequence
ttcaggtgtccacatactat

SEQ ID NO: 109519 - DNA, 20 bp, Artificial sequence
  SiRNA target sequence
tcaggtgtccacatactata

SEQ ID NO: 109520 - DNA, 20 bp, Artificial sequence
  SiRNA target sequence
caggtgtccacatactataa

SEQ ID NO: 109521 - DNA, 20 bp, Artificial sequence
  SiRNA target sequence
aggtgtccacatactataat

SEQ ID NO: 109522 - DNA, 20 bp, Artificial sequence
  SiRNA target sequence
ggtgtccacatactataatg

SEQ ID NO: 109523 - DNA, 20 bp, Artificial sequence
  SiRNA target sequence
gtgtccacatactataatga

SEQ ID NO: 109524 - DNA, 20 bp, Artificial sequence
  SiRNA target sequence
tgtccacatactataatgat

SEQ ID NO: 109525 - DNA, 20 bp, Artificial sequence
  SiRNA target sequence
gtccacatactataatgatt

SEQ ID NO: 109526 - DNA, 20 bp, Artificial sequence
  SiRNA target sequence
tccacatactataatgatta

SEQ ID NO: 109527 - DNA, 20 bp, Artificial sequence
  SiRNA target sequence
ccacatactataatgattat

SEQ ID NO: 109528 - DNA, 20 bp, Artificial sequence
  SiRNA target sequence
cacatactataatgattatt

SEQ ID NO: 109529 - DNA, 20 bp, Artificial sequence
  SiRNA target sequence
acatactataatgattattt

SEQ ID NO: 109530 - DNA, 20 bp, Artificial sequence
  SiRNA target sequence
catactataatgattatttt

SEQ ID NO: 109531 - DNA, 20 bp, Artificial sequence
  SiRNA target sequence
atactataatgattattttc

SEQ ID NO: 109532 - DNA, 20 bp, Artificial sequence
  SiRNA target sequence
tactataatgattattttca

SEQ ID NO: 109533 - DNA, 20 bp, Artificial sequence
  SiRNA target sequence
actataatgattattttcac

SEQ ID NO: 109534 - DNA, 20 bp, Artificial sequence
  SiRNA target sequence
ctataatgattattttcaca

SEQ ID NO: 109535 - DNA, 20 bp, Artificial sequence
  SiRNA target sequence
tataatgattattttcacat

SEQ ID NO: 109536 - DNA, 20 bp, Artificial sequence
  SiRNA target sequence
ataatgattattttcacata

SEQ ID NO: 109537 - DNA, 20 bp, Artificial sequence
  SiRNA target sequence
taatgattattttcacatac

SEQ ID NO: 109538 - DNA, 20 bp, Artificial sequence
  SiRNA target sequence
aatgattattttcacataca

SEQ ID NO: 109539 - DNA, 20 bp, Artificial sequence
  SiRNA target sequence
atgattattttcacatacat

SEQ ID NO: 109540 - DNA, 20 bp, Artificial sequence
  SiRNA target sequence
tgattattttcacatacata

SEQ ID NO: 109541 - DNA, 20 bp, Artificial sequence
  SiRNA target sequence
gattattttcacatacataa

SEQ ID NO: 109542 - DNA, 20 bp, Artificial sequence
  SiRNA target sequence
attattttcacatacataaa

SEQ ID NO: 109543 - DNA, 20 bp, Artificial sequence
  SiRNA target sequence
ttattttcacatacataaac

SEQ ID NO: 109544 - DNA, 20 bp, Artificial sequence
  SiRNA target sequence
tattttcacatacataaacc

SEQ ID NO: 109545 - DNA, 20 bp, Artificial sequence
  SiRNA target sequence
attttcacatacataaacca

SEQ ID NO: 109546 - DNA, 20 bp, Artificial sequence
  SiRNA target sequence
ttttcacatacataaaccac

SEQ ID NO: 109547 - DNA, 20 bp, Artificial sequence
  SiRNA target sequence
tttcacatacataaaccaca

SEQ ID NO: 109548 - DNA, 20 bp, Artificial sequence
  SiRNA target sequence
ttcacatacataaaccacag

SEQ ID NO: 109549 - DNA, 20 bp, Artificial sequence
  SiRNA target sequence
tcacatacataaaccacagg

SEQ ID NO: 109550 - DNA, 20 bp, Artificial sequence
  SiRNA target sequence
cacatacataaaccacagga

SEQ ID NO: 109551 - DNA, 20 bp, Artificial sequence
  SiRNA target sequence
acatacataaaccacaggaa

SEQ ID NO: 109552 - DNA, 20 bp, Artificial sequence
  SiRNA target sequence
catacataaaccacaggaag

SEQ ID NO: 109553 - DNA, 20 bp, Artificial sequence
  SiRNA target sequence
atacataaaccacaggaagt

SEQ ID NO: 109554 - DNA, 20 bp, Artificial sequence
  SiRNA target sequence
tacataaaccacaggaagtt

SEQ ID NO: 109555 - DNA, 20 bp, Artificial sequence
  SiRNA target sequence
acataaaccacaggaagttt

SEQ ID NO: 109556 - DNA, 20 bp, Artificial sequence
  SiRNA target sequence
cataaaccacaggaagtttc

SEQ ID NO: 109557 - DNA, 20 bp, Artificial sequence
  SiRNA target sequence
ataaaccacaggaagtttcc

SEQ ID NO: 109558 - DNA, 20 bp, Artificial sequence
  SiRNA target sequence
taaaccacaggaagtttcca

SEQ ID NO: 109559 - DNA, 20 bp, Artificial sequence
  SiRNA target sequence
aaaccacaggaagtttccat

SEQ ID NO: 109560 - DNA, 20 bp, Artificial sequence
  SiRNA target sequence
aaccacaggaagtttccata

SEQ ID NO: 109561 - DNA, 20 bp, Artificial sequence
  SiRNA target sequence
accacaggaagtttccataa

SEQ ID NO: 109562 - DNA, 20 bp, Artificial sequence
  SiRNA target sequence
ccacaggaagtttccataat

SEQ ID NO: 109563 - DNA, 20 bp, Artificial sequence
  SiRNA target sequence
cacaggaagtttccataatg

SEQ ID NO: 109564 - DNA, 20 bp, Artificial sequence
  SiRNA target sequence
acaggaagtttccataatgc

SEQ ID NO: 109565 - DNA, 20 bp, Artificial sequence
  SiRNA target sequence
caggaagtttccataatgca

SEQ ID NO: 109566 - DNA, 20 bp, Artificial sequence
  SiRNA target sequence
aggaagtttccataatgcag

SEQ ID NO: 109567 - DNA, 20 bp, Artificial sequence
  SiRNA target sequence
ggaagtttccataatgcagc

SEQ ID NO: 109568 - DNA, 20 bp, Artificial sequence
  SiRNA target sequence
gaagtttccataatgcagcc

SEQ ID NO: 109569 - DNA, 20 bp, Artificial sequence
  SiRNA target sequence
aagtttccataatgcagcca

SEQ ID NO: 109570 - DNA, 20 bp, Artificial sequence
  SiRNA target sequence
agtttccataatgcagccat

SEQ ID NO: 109571 - DNA, 20 bp, Artificial sequence
  SiRNA target sequence
gtttccataatgcagccata

SEQ ID NO: 109572 - DNA, 20 bp, Artificial sequence
  SiRNA target sequence
tttccataatgcagccatat

SEQ ID NO: 109573 - DNA, 20 bp, Artificial sequence
  SiRNA target sequence
ttccataatgcagccatatt

SEQ ID NO: 109574 - DNA, 20 bp, Artificial sequence
  SiRNA target sequence
tccataatgcagccatattg

SEQ ID NO: 109575 - DNA, 20 bp, Artificial sequence
  SiRNA target sequence
ccataatgcagccatattga

SEQ ID NO: 109576 - DNA, 20 bp, Artificial sequence
  SiRNA target sequence
cataatgcagccatattgaa

SEQ ID NO: 109577 - DNA, 20 bp, Artificial sequence
  SiRNA target sequence
ataatgcagccatattgaac

SEQ ID NO: 109578 - DNA, 20 bp, Artificial sequence
  SiRNA target sequence
taatgcagccatattgaacg

SEQ ID NO: 109579 - DNA, 20 bp, Artificial sequence
  SiRNA target sequence
aatgcagccatattgaacga

SEQ ID NO: 109580 - DNA, 20 bp, Artificial sequence
  SiRNA target sequence
atgcagccatattgaacgac

SEQ ID NO: 109581 - DNA, 20 bp, Artificial sequence
  SiRNA target sequence
tgcagccatattgaacgact

SEQ ID NO: 109582 - DNA, 20 bp, Artificial sequence
  SiRNA target sequence
gcagccatattgaacgactc

SEQ ID NO: 109583 - DNA, 20 bp, Artificial sequence
  SiRNA target sequence
cagccatattgaacgactcc

SEQ ID NO: 109584 - DNA, 20 bp, Artificial sequence
  SiRNA target sequence
agccatattgaacgactccc

SEQ ID NO: 109585 - DNA, 20 bp, Artificial sequence
  SiRNA target sequence
gccatattgaacgactccca

SEQ ID NO: 109586 - DNA, 20 bp, Artificial sequence
  SiRNA target sequence
ccatattgaacgactcccag

SEQ ID NO: 109587 - DNA, 20 bp, Artificial sequence
  SiRNA target sequence
catattgaacgactcccaga

SEQ ID NO: 109588 - DNA, 20 bp, Artificial sequence
  SiRNA target sequence
atattgaacgactcccagac

SEQ ID NO: 109589 - DNA, 20 bp, Artificial sequence
  SiRNA target sequence
tattgaacgactcccagacc

SEQ ID NO: 109590 - DNA, 20 bp, Artificial sequence
  SiRNA target sequence
attgaacgactcccagacct

SEQ ID NO: 109591 - DNA, 20 bp, Artificial sequence
  SiRNA target sequence
ttgaacgactcccagacctg

SEQ ID NO: 109592 - DNA, 20 bp, Artificial sequence
  SiRNA target sequence
tgaacgactcccagacctgt

SEQ ID NO: 109593 - DNA, 20 bp, Artificial sequence
  SiRNA target sequence
gaacgactcccagacctgtc

SEQ ID NO: 109594 - DNA, 20 bp, Artificial sequence
  SiRNA target sequence
aacgactcccagacctgtcc

SEQ ID NO: 109595 - DNA, 20 bp, Artificial sequence
  SiRNA target sequence
acgactcccagacctgtccc

SEQ ID NO: 109596 - DNA, 20 bp, Artificial sequence
  SiRNA target sequence
cgactcccagacctgtccct

SEQ ID NO: 109597 - DNA, 20 bp, Artificial sequence
  SiRNA target sequence
gactcccagacctgtccctg

SEQ ID NO: 109598 - DNA, 20 bp, Artificial sequence
  SiRNA target sequence
actcccagacctgtccctga

SEQ ID NO: 109599 - DNA, 20 bp, Artificial sequence
  SiRNA target sequence
ctcccagacctgtccctgat

SEQ ID NO: 109600 - DNA, 20 bp, Artificial sequence
  SiRNA target sequence
tcccagacctgtccctgatt

SEQ ID NO: 109601 - DNA, 20 bp, Artificial sequence
  SiRNA target sequence
cccagacctgtccctgattt

SEQ ID NO: 109602 - DNA, 20 bp, Artificial sequence
  SiRNA target sequence
ccagacctgtccctgatttg

SEQ ID NO: 109603 - DNA, 20 bp, Artificial sequence
  SiRNA target sequence
cagacctgtccctgatttgc

SEQ ID NO: 109604 - DNA, 20 bp, Artificial sequence
  SiRNA target sequence
agacctgtccctgatttgca

SEQ ID NO: 109605 - DNA, 20 bp, Artificial sequence
  SiRNA target sequence
gacctgtccctgatttgcag

SEQ ID NO: 109606 - DNA, 20 bp, Artificial sequence
  SiRNA target sequence
acctgtccctgatttgcagc

SEQ ID NO: 109607 - DNA, 20 bp, Artificial sequence
  SiRNA target sequence
cctgtccctgatttgcagca

SEQ ID NO: 109608 - DNA, 20 bp, Artificial sequence
  SiRNA target sequence
ctgtccctgatttgcagcac

SEQ ID NO: 109609 - DNA, 20 bp, Artificial sequence
  SiRNA target sequence
tgtccctgatttgcagcacc

SEQ ID NO: 109610 - DNA, 20 bp, Artificial sequence
  SiRNA target sequence
gtccctgatttgcagcacca

SEQ ID NO: 109611 - DNA, 20 bp, Artificial sequence
  SiRNA target sequence
tccctgatttgcagcaccat

SEQ ID NO: 109612 - DNA, 20 bp, Artificial sequence
  SiRNA target sequence
ccctgatttgcagcaccatc

SEQ ID NO: 109613 - DNA, 20 bp, Artificial sequence
  SiRNA target sequence
cctgatttgcagcaccatcc

SEQ ID NO: 109614 - DNA, 20 bp, Artificial sequence
  SiRNA target sequence
ctgatttgcagcaccatccc

SEQ ID NO: 109615 - DNA, 20 bp, Artificial sequence
  SiRNA target sequence
tgatttgcagcaccatcccc

SEQ ID NO: 109616 - DNA, 20 bp, Artificial sequence
  SiRNA target sequence
gatttgcagcaccatccccg

SEQ ID NO: 109617 - DNA, 20 bp, Artificial sequence
  SiRNA target sequence
atttgcagcaccatccccga

SEQ ID NO: 109618 - DNA, 20 bp, Artificial sequence
  SiRNA target sequence
tttgcagcaccatccccgaa

SEQ ID NO: 109619 - DNA, 20 bp, Artificial sequence
  SiRNA target sequence
ttgcagcaccatccccgaaa

SEQ ID NO: 109620 - DNA, 20 bp, Artificial sequence
  SiRNA target sequence
tgcagcaccatccccgaaaa

SEQ ID NO: 109621 - DNA, 20 bp, Artificial sequence
  SiRNA target sequence
gcagcaccatccccgaaaaa

SEQ ID NO: 109622 - DNA, 20 bp, Artificial sequence
  SiRNA target sequence
cagcaccatccccgaaaaat

SEQ ID NO: 109623 - DNA, 20 bp, Artificial sequence
  SiRNA target sequence
agcaccatccccgaaaaata

SEQ ID NO: 109624 - DNA, 20 bp, Artificial sequence
  SiRNA target sequence
gcaccatccccgaaaaatac

SEQ ID NO: 109625 - DNA, 20 bp, Artificial sequence
  SiRNA target sequence
caccatccccgaaaaataca

SEQ ID NO: 109626 - DNA, 20 bp, Artificial sequence
  SiRNA target sequence
accatccccgaaaaatacaa

SEQ ID NO: 109627 - DNA, 20 bp, Artificial sequence
  SiRNA target sequence
ccatccccgaaaaatacaaa

SEQ ID NO: 109628 - DNA, 20 bp, Artificial sequence
  SiRNA target sequence
catccccgaaaaatacaaat

SEQ ID NO: 109629 - DNA, 20 bp, Artificial sequence
  SiRNA target sequence
atccccgaaaaatacaaatg

SEQ ID NO: 109630 - DNA, 20 bp, Artificial sequence
  SiRNA target sequence
tccccgaaaaatacaaatgc

SEQ ID NO: 109631 - DNA, 20 bp, Artificial sequence
  SiRNA target sequence
ccccgaaaaatacaaatgct

SEQ ID NO: 109632 - DNA, 20 bp, Artificial sequence
  SiRNA target sequence
cccgaaaaatacaaatgcta

SEQ ID NO: 109633 - DNA, 20 bp, Artificial sequence
  SiRNA target sequence
ccgaaaaatacaaatgctac

SEQ ID NO: 109634 - DNA, 20 bp, Artificial sequence
  SiRNA target sequence
cgaaaaatacaaatgctaca

SEQ ID NO: 109635 - DNA, 20 bp, Artificial sequence
  SiRNA target sequence
gaaaaatacaaatgctacat

SEQ ID NO: 109636 - DNA, 20 bp, Artificial sequence
  SiRNA target sequence
aaaaatacaaatgctacatt

SEQ ID NO: 109637 - DNA, 20 bp, Artificial sequence
  SiRNA target sequence
aaaatacaaatgctacattt

SEQ ID NO: 109638 - DNA, 20 bp, Artificial sequence
  SiRNA target sequence
aaatacaaatgctacatttt

SEQ ID NO: 109639 - DNA, 20 bp, Artificial sequence
  SiRNA target sequence
aatacaaatgctacattttt

SEQ ID NO: 109640 - DNA, 20 bp, Artificial sequence
  SiRNA target sequence
atacaaatgctacatttttt

SEQ ID NO: 109641 - DNA, 20 bp, Artificial sequence
  SiRNA target sequence
tacaaatgctacatttttta

SEQ ID NO: 109642 - DNA, 20 bp, Artificial sequence
  SiRNA target sequence
acaaatgctacattttttac

SEQ ID NO: 109643 - DNA, 20 bp, Artificial sequence
  SiRNA target sequence
caaatgctacattttttact

SEQ ID NO: 109644 - DNA, 20 bp, Artificial sequence
  SiRNA target sequence
aaatgctacattttttactt

SEQ ID NO: 109645 - DNA, 20 bp, Artificial sequence
  SiRNA target sequence
aatgctacattttttacttt

SEQ ID NO: 109646 - DNA, 20 bp, Artificial sequence
  SiRNA target sequence
atgctacattttttactttt

SEQ ID NO: 109647 - DNA, 20 bp, Artificial sequence
  SiRNA target sequence
tgctacattttttacttttt

SEQ ID NO: 109648 - DNA, 20 bp, Artificial sequence
  SiRNA target sequence
gctacattttttactttttt

SEQ ID NO: 109649 - DNA, 20 bp, Artificial sequence
  SiRNA target sequence
ctacattttttactttttta

SEQ ID NO: 109650 - DNA, 20 bp, Artificial sequence
  SiRNA target sequence
tacattttttacttttttat

SEQ ID NO: 109651 - DNA, 20 bp, Artificial sequence
  SiRNA target sequence
acattttttacttttttata

SEQ ID NO: 109652 - DNA, 20 bp, Artificial sequence
  SiRNA target sequence
cattttttacttttttatat

SEQ ID NO: 109653 - DNA, 20 bp, Artificial sequence
  SiRNA target sequence
attttttacttttttatatt

SEQ ID NO: 109654 - DNA, 20 bp, Artificial sequence
  SiRNA target sequence
ttttttacttttttatattg

SEQ ID NO: 109655 - DNA, 20 bp, Artificial sequence
  SiRNA target sequence
tttttacttttttatattgt

SEQ ID NO: 109656 - DNA, 20 bp, Artificial sequence
  SiRNA target sequence
ttttacttttttatattgta

SEQ ID NO: 109657 - DNA, 20 bp, Artificial sequence
  SiRNA target sequence
tttacttttttatattgtaa

SEQ ID NO: 109658 - DNA, 20 bp, Artificial sequence
  SiRNA target sequence
ttacttttttatattgtaaa

SEQ ID NO: 109659 - DNA, 20 bp, Artificial sequence
  SiRNA target sequence
tacttttttatattgtaaag

SEQ ID NO: 109660 - DNA, 20 bp, Artificial sequence
  SiRNA target sequence
acttttttatattgtaaagc

SEQ ID NO: 109661 - DNA, 20 bp, Artificial sequence
  SiRNA target sequence
cttttttatattgtaaagca

SEQ ID NO: 109662 - DNA, 20 bp, Artificial sequence
  SiRNA target sequence
ttttttatattgtaaagcaa

SEQ ID NO: 109663 - DNA, 20 bp, Artificial sequence
  SiRNA target sequence
tttttatattgtaaagcaaa

SEQ ID NO: 109664 - DNA, 20 bp, Artificial sequence
  SiRNA target sequence
ttttatattgtaaagcaaat

SEQ ID NO: 109665 - DNA, 20 bp, Artificial sequence
  SiRNA target sequence
tttatattgtaaagcaaatc

SEQ ID NO: 109666 - DNA, 20 bp, Artificial sequence
  SiRNA target sequence
ttatattgtaaagcaaatcc

SEQ ID NO: 109667 - DNA, 20 bp, Artificial sequence
  SiRNA target sequence
tatattgtaaagcaaatccc

SEQ ID NO: 109668 - DNA, 20 bp, Artificial sequence
  SiRNA target sequence
atattgtaaagcaaatccca

SEQ ID NO: 109669 - DNA, 20 bp, Artificial sequence
  SiRNA target sequence
tattgtaaagcaaatcccaa

SEQ ID NO: 109670 - DNA, 20 bp, Artificial sequence
  SiRNA target sequence
attgtaaagcaaatcccaat

SEQ ID NO: 109671 - DNA, 20 bp, Artificial sequence
  SiRNA target sequence
ttgtaaagcaaatcccaatc

SEQ ID NO: 109672 - DNA, 20 bp, Artificial sequence
  SiRNA target sequence
tgtaaagcaaatcccaatcc

SEQ ID NO: 109673 - DNA, 20 bp, Artificial sequence
  SiRNA target sequence
gtaaagcaaatcccaatcct

SEQ ID NO: 109674 - DNA, 20 bp, Artificial sequence
  SiRNA target sequence
taaagcaaatcccaatcctg

SEQ ID NO: 109675 - DNA, 20 bp, Artificial sequence
  SiRNA target sequence
aaagcaaatcccaatcctgt

SEQ ID NO: 109676 - DNA, 20 bp, Artificial sequence
  SiRNA target sequence
aagcaaatcccaatcctgta

SEQ ID NO: 109677 - DNA, 20 bp, Artificial sequence
  SiRNA target sequence
agcaaatcccaatcctgtac

SEQ ID NO: 109678 - DNA, 20 bp, Artificial sequence
  SiRNA target sequence
gcaaatcccaatcctgtacc

SEQ ID NO: 109679 - DNA, 20 bp, Artificial sequence
  SiRNA target sequence
caaatcccaatcctgtacca

SEQ ID NO: 109680 - DNA, 20 bp, Artificial sequence
  SiRNA target sequence
aaatcccaatcctgtaccaa

SEQ ID NO: 109681 - DNA, 20 bp, Artificial sequence
  SiRNA target sequence
aatcccaatcctgtaccaag

SEQ ID NO: 109682 - DNA, 20 bp, Artificial sequence
  SiRNA target sequence
atcccaatcctgtaccaagc

SEQ ID NO: 109683 - DNA, 20 bp, Artificial sequence
  SiRNA target sequence
tcccaatcctgtaccaagcg

SEQ ID NO: 109684 - DNA, 20 bp, Artificial sequence
  SiRNA target sequence
cccaatcctgtaccaagcga

SEQ ID NO: 109685 - DNA, 20 bp, Artificial sequence
  SiRNA target sequence
ccaatcctgtaccaagcgat

SEQ ID NO: 109686 - DNA, 20 bp, Artificial sequence
  SiRNA target sequence
caatcctgtaccaagcgata

SEQ ID NO: 109687 - DNA, 20 bp, Artificial sequence
  SiRNA target sequence
aatcctgtaccaagcgatac

SEQ ID NO: 109688 - DNA, 20 bp, Artificial sequence
  SiRNA target sequence
atcctgtaccaagcgatacc

SEQ ID NO: 109689 - DNA, 20 bp, Artificial sequence
  SiRNA target sequence
tcctgtaccaagcgatacct

SEQ ID NO: 109690 - DNA, 20 bp, Artificial sequence
  SiRNA target sequence
cctgtaccaagcgatacctg

SEQ ID NO: 109691 - DNA, 20 bp, Artificial sequence
  SiRNA target sequence
ctgtaccaagcgatacctgc

SEQ ID NO: 109692 - DNA, 20 bp, Artificial sequence
  SiRNA target sequence
tgtaccaagcgatacctgcg

SEQ ID NO: 109693 - DNA, 20 bp, Artificial sequence
  SiRNA target sequence
gtaccaagcgatacctgcgc

SEQ ID NO: 109694 - DNA, 20 bp, Artificial sequence
  SiRNA target sequence
taccaagcgatacctgcgca

SEQ ID NO: 109695 - DNA, 20 bp, Artificial sequence
  SiRNA target sequence
accaagcgatacctgcgcac

SEQ ID NO: 109696 - DNA, 20 bp, Artificial sequence
  SiRNA target sequence
ccaagcgatacctgcgcacc

SEQ ID NO: 109697 - DNA, 20 bp, Artificial sequence
  SiRNA target sequence
caagcgatacctgcgcacct

SEQ ID NO: 109698 - DNA, 20 bp, Artificial sequence
  SiRNA target sequence
aagcgatacctgcgcaccta

SEQ ID NO: 109699 - DNA, 20 bp, Artificial sequence
  SiRNA target sequence
agcgatacctgcgcacctac

SEQ ID NO: 109700 - DNA, 20 bp, Artificial sequence
  SiRNA target sequence
gcgatacctgcgcacctact

SEQ ID NO: 109701 - DNA, 20 bp, Artificial sequence
  SiRNA target sequence
cgatacctgcgcacctacta

SEQ ID NO: 109702 - DNA, 20 bp, Artificial sequence
  SiRNA target sequence
gatacctgcgcacctactat

SEQ ID NO: 109703 - DNA, 20 bp, Artificial sequence
  SiRNA target sequence
atacctgcgcacctactata

SEQ ID NO: 109704 - DNA, 20 bp, Artificial sequence
  SiRNA target sequence
tacctgcgcacctactatac

SEQ ID NO: 109705 - DNA, 20 bp, Artificial sequence
  SiRNA target sequence
acctgcgcacctactatacc

SEQ ID NO: 109706 - DNA, 20 bp, Artificial sequence
  SiRNA target sequence
cctgcgcacctactataccg

SEQ ID NO: 109707 - DNA, 20 bp, Artificial sequence
  SiRNA target sequence
ctgcgcacctactataccgt

SEQ ID NO: 109708 - DNA, 20 bp, Artificial sequence
  SiRNA target sequence
tgcgcacctactataccgtg

SEQ ID NO: 109709 - DNA, 20 bp, Artificial sequence
  SiRNA target sequence
gcgcacctactataccgtgt

SEQ ID NO: 109710 - DNA, 20 bp, Artificial sequence
  SiRNA target sequence
cgcacctactataccgtgtc

SEQ ID NO: 109711 - DNA, 20 bp, Artificial sequence
  SiRNA target sequence
gcacctactataccgtgtcc

SEQ ID NO: 109712 - DNA, 20 bp, Artificial sequence
  SiRNA target sequence
cacctactataccgtgtccc

SEQ ID NO: 109713 - DNA, 20 bp, Artificial sequence
  SiRNA target sequence
acctactataccgtgtcccc

SEQ ID NO: 109714 - DNA, 20 bp, Artificial sequence
  SiRNA target sequence
cctactataccgtgtccccc

SEQ ID NO: 109715 - DNA, 20 bp, Artificial sequence
  SiRNA target sequence
ctactataccgtgtccccca

SEQ ID NO: 109716 - DNA, 20 bp, Artificial sequence
  SiRNA target sequence
tactataccgtgtcccccat

SEQ ID NO: 109717 - DNA, 20 bp, Artificial sequence
  SiRNA target sequence
actataccgtgtcccccata

SEQ ID NO: 109718 - DNA, 20 bp, Artificial sequence
  SiRNA target sequence
ctataccgtgtcccccataa

SEQ ID NO: 109719 - DNA, 20 bp, Artificial sequence
  SiRNA target sequence
tataccgtgtcccccataaa

SEQ ID NO: 109720 - DNA, 20 bp, Artificial sequence
  SiRNA target sequence
ataccgtgtcccccataaaa

SEQ ID NO: 109721 - DNA, 20 bp, Artificial sequence
  SiRNA target sequence
taccgtgtcccccataaaat

SEQ ID NO: 109722 - DNA, 20 bp, Artificial sequence
  SiRNA target sequence
accgtgtcccccataaaatt

SEQ ID NO: 109723 - DNA, 20 bp, Artificial sequence
  SiRNA target sequence
ccgtgtcccccataaaattg

SEQ ID NO: 109724 - DNA, 20 bp, Artificial sequence
  SiRNA target sequence
cgtgtcccccataaaattgg

SEQ ID NO: 109725 - DNA, 20 bp, Artificial sequence
  SiRNA target sequence
gtgtcccccataaaattggt

SEQ ID NO: 109726 - DNA, 20 bp, Artificial sequence
  SiRNA target sequence
tgtcccccataaaattggtc

SEQ ID NO: 109727 - DNA, 20 bp, Artificial sequence
  SiRNA target sequence
gtcccccataaaattggtca

SEQ ID NO: 109728 - DNA, 20 bp, Artificial sequence
  SiRNA target sequence
tcccccataaaattggtcat

SEQ ID NO: 109729 - DNA, 20 bp, Artificial sequence
  SiRNA target sequence
cccccataaaattggtcatt

SEQ ID NO: 109730 - DNA, 20 bp, Artificial sequence
  SiRNA target sequence
ccccataaaattggtcatta

SEQ ID NO: 109731 - DNA, 20 bp, Artificial sequence
  SiRNA target sequence
cccataaaattggtcattat

SEQ ID NO: 109732 - DNA, 20 bp, Artificial sequence
  SiRNA target sequence
ccataaaattggtcattata

SEQ ID NO: 109733 - DNA, 20 bp, Artificial sequence
  SiRNA target sequence
cataaaattggtcattatac

SEQ ID NO: 109734 - DNA, 20 bp, Artificial sequence
  SiRNA target sequence
ataaaattggtcattataca

SEQ ID NO: 109735 - DNA, 20 bp, Artificial sequence
  SiRNA target sequence
taaaattggtcattatacaa

SEQ ID NO: 109736 - DNA, 20 bp, Artificial sequence
  SiRNA target sequence
aaaattggtcattatacaaa

SEQ ID NO: 109737 - DNA, 20 bp, Artificial sequence
  SiRNA target sequence
aaattggtcattatacaaat

SEQ ID NO: 109738 - DNA, 20 bp, Artificial sequence
  SiRNA target sequence
aattggtcattatacaaatg

SEQ ID NO: 109739 - DNA, 20 bp, Artificial sequence
  SiRNA target sequence
attggtcattatacaaatgc

SEQ ID NO: 109740 - DNA, 20 bp, Artificial sequence
  SiRNA target sequence
ttggtcattatacaaatgca

SEQ ID NO: 109741 - DNA, 20 bp, Artificial sequence
  SiRNA target sequence
tggtcattatacaaatgcat

SEQ ID NO: 109742 - DNA, 20 bp, Artificial sequence
  SiRNA target sequence
ggtcattatacaaatgcatc

SEQ ID NO: 109743 - DNA, 20 bp, Artificial sequence
  SiRNA target sequence
gtcattatacaaatgcatcg

SEQ ID NO: 109744 - DNA, 20 bp, Artificial sequence
  SiRNA target sequence
tcattatacaaatgcatcga

SEQ ID NO: 109745 - DNA, 20 bp, Artificial sequence
  SiRNA target sequence
cattatacaaatgcatcgat

SEQ ID NO: 109746 - DNA, 20 bp, Artificial sequence
  SiRNA target sequence
attatacaaatgcatcgatc

SEQ ID NO: 109747 - DNA, 20 bp, Artificial sequence
  SiRNA target sequence
ttatacaaatgcatcgatcc

SEQ ID NO: 109748 - DNA, 20 bp, Artificial sequence
  SiRNA target sequence
tatacaaatgcatcgatcct

SEQ ID NO: 109749 - DNA, 20 bp, Artificial sequence
  SiRNA target sequence
atacaaatgcatcgatcctc

SEQ ID NO: 109750 - DNA, 20 bp, Artificial sequence
  SiRNA target sequence
tacaaatgcatcgatcctcc

SEQ ID NO: 109751 - DNA, 20 bp, Artificial sequence
  SiRNA target sequence
acaaatgcatcgatcctcct

SEQ ID NO: 109752 - DNA, 20 bp, Artificial sequence
  SiRNA target sequence
caaatgcatcgatcctcctt

SEQ ID NO: 109753 - DNA, 20 bp, Artificial sequence
  SiRNA target sequence
aaatgcatcgatcctccttt

SEQ ID NO: 109754 - DNA, 20 bp, Artificial sequence
  SiRNA target sequence
aatgcatcgatcctcctttt

SEQ ID NO: 109755 - DNA, 20 bp, Artificial sequence
  SiRNA target sequence
atgcatcgatcctccttttc

SEQ ID NO: 109756 - DNA, 20 bp, Artificial sequence
  SiRNA target sequence
tgcatcgatcctccttttcc

SEQ ID NO: 109757 - DNA, 20 bp, Artificial sequence
  SiRNA target sequence
gcatcgatcctccttttcct

SEQ ID NO: 109758 - DNA, 20 bp, Artificial sequence
  SiRNA target sequence
catcgatcctccttttcctt

SEQ ID NO: 109759 - DNA, 20 bp, Artificial sequence
  SiRNA target sequence
atcgatcctccttttccttt

SEQ ID NO: 109760 - DNA, 20 bp, Artificial sequence
  SiRNA target sequence
tcgatcctccttttcctttg

SEQ ID NO: 109761 - DNA, 20 bp, Artificial sequence
  SiRNA target sequence
cgatcctccttttcctttgc

SEQ ID NO: 109762 - DNA, 20 bp, Artificial sequence
  SiRNA target sequence
gatcctccttttcctttgca

SEQ ID NO: 109763 - DNA, 20 bp, Artificial sequence
  SiRNA target sequence
atcctccttttcctttgcaa

SEQ ID NO: 109764 - DNA, 20 bp, Artificial sequence
  SiRNA target sequence
tcctccttttcctttgcaat

SEQ ID NO: 109765 - DNA, 20 bp, Artificial sequence
  SiRNA target sequence
cctccttttcctttgcaatt

SEQ ID NO: 109766 - DNA, 20 bp, Artificial sequence
  SiRNA target sequence
ctccttttcctttgcaatta

SEQ ID NO: 109767 - DNA, 20 bp, Artificial sequence
  SiRNA target sequence
tccttttcctttgcaattac

SEQ ID NO: 109768 - DNA, 20 bp, Artificial sequence
  SiRNA target sequence
ccttttcctttgcaattacc

SEQ ID NO: 109769 - DNA, 20 bp, Artificial sequence
  SiRNA target sequence
cttttcctttgcaattacca

SEQ ID NO: 109770 - DNA, 20 bp, Artificial sequence
  SiRNA target sequence
ttttcctttgcaattaccaa

SEQ ID NO: 109771 - DNA, 20 bp, Artificial sequence
  SiRNA target sequence
tttcctttgcaattaccaat

SEQ ID NO: 109772 - DNA, 20 bp, Artificial sequence
  SiRNA target sequence
ttcctttgcaattaccaata

SEQ ID NO: 109773 - DNA, 20 bp, Artificial sequence
  SiRNA target sequence
tcctttgcaattaccaatag

SEQ ID NO: 109774 - DNA, 20 bp, Artificial sequence
  SiRNA target sequence
cctttgcaattaccaatagc

SEQ ID NO: 109775 - DNA, 20 bp, Artificial sequence
  SiRNA target sequence
ctttgcaattaccaatagcc

SEQ ID NO: 109776 - DNA, 20 bp, Artificial sequence
  SiRNA target sequence
tttgcaattaccaatagcct

SEQ ID NO: 109777 - DNA, 20 bp, Artificial sequence
  SiRNA target sequence
ttgcaattaccaatagcctt

SEQ ID NO: 109778 - DNA, 20 bp, Artificial sequence
  SiRNA target sequence
tgcaattaccaatagccttt

SEQ ID NO: 109779 - DNA, 20 bp, Artificial sequence
  SiRNA target sequence
gcaattaccaatagcctttc

SEQ ID NO: 109780 - DNA, 20 bp, Artificial sequence
  SiRNA target sequence
caattaccaatagcctttcc

SEQ ID NO: 109781 - DNA, 20 bp, Artificial sequence
  SiRNA target sequence
aattaccaatagcctttcct

SEQ ID NO: 109782 - DNA, 20 bp, Artificial sequence
  SiRNA target sequence
attaccaatagcctttccta

SEQ ID NO: 109783 - DNA, 20 bp, Artificial sequence
  SiRNA target sequence
ttaccaatagcctttcctaa

SEQ ID NO: 109784 - DNA, 20 bp, Artificial sequence
  SiRNA target sequence
taccaatagcctttcctaat

SEQ ID NO: 109785 - DNA, 20 bp, Artificial sequence
  SiRNA target sequence
accaatagcctttcctaata

SEQ ID NO: 109786 - DNA, 20 bp, Artificial sequence
  SiRNA target sequence
ccaatagcctttcctaataa

SEQ ID NO: 109787 - DNA, 20 bp, Artificial sequence
  SiRNA target sequence
caatagcctttcctaataat

SEQ ID NO: 109788 - DNA, 20 bp, Artificial sequence
  SiRNA target sequence
aatagcctttcctaataatt

SEQ ID NO: 109789 - DNA, 20 bp, Artificial sequence
  SiRNA target sequence
atagcctttcctaataattc

SEQ ID NO: 109790 - DNA, 20 bp, Artificial sequence
  SiRNA target sequence
tagcctttcctaataattcc

SEQ ID NO: 109791 - DNA, 20 bp, Artificial sequence
  SiRNA target sequence
agcctttcctaataattccc

SEQ ID NO: 109792 - DNA, 20 bp, Artificial sequence
  SiRNA target sequence
gcctttcctaataattcccc

SEQ ID NO: 109793 - DNA, 20 bp, Artificial sequence
  SiRNA target sequence
cctttcctaataattcccct

SEQ ID NO: 109794 - DNA, 20 bp, Artificial sequence
  SiRNA target sequence
ctttcctaataattccccta

SEQ ID NO: 109795 - DNA, 20 bp, Artificial sequence
  SiRNA target sequence
tttcctaataattcccctat

SEQ ID NO: 109796 - DNA, 20 bp, Artificial sequence
  SiRNA target sequence
ttcctaataattcccctata

SEQ ID NO: 109797 - DNA, 20 bp, Artificial sequence
  SiRNA target sequence
tcctaataattcccctataa

SEQ ID NO: 109798 - DNA, 20 bp, Artificial sequence
  SiRNA target sequence
cctaataattcccctataat

SEQ ID NO: 109799 - DNA, 20 bp, Artificial sequence
  SiRNA target sequence
ctaataattcccctataata

SEQ ID NO: 109800 - DNA, 20 bp, Artificial sequence
  SiRNA target sequence
taataattcccctataatac

SEQ ID NO: 109801 - DNA, 20 bp, Artificial sequence
  SiRNA target sequence
aataattcccctataatact

SEQ ID NO: 109802 - DNA, 20 bp, Artificial sequence
  SiRNA target sequence
ataattcccctataatactt

SEQ ID NO: 109803 - DNA, 20 bp, Artificial sequence
  SiRNA target sequence
taattcccctataatacttt

SEQ ID NO: 109804 - DNA, 20 bp, Artificial sequence
  SiRNA target sequence
aattcccctataatactttc

SEQ ID NO: 109805 - DNA, 20 bp, Artificial sequence
  SiRNA target sequence
attcccctataatactttct

SEQ ID NO: 109806 - DNA, 20 bp, Artificial sequence
  SiRNA target sequence
ttcccctataatactttcta

SEQ ID NO: 109807 - DNA, 20 bp, Artificial sequence
  SiRNA target sequence
tcccctataatactttctat

SEQ ID NO: 109808 - DNA, 20 bp, Artificial sequence
  SiRNA target sequence
cccctataatactttctata

SEQ ID NO: 109809 - DNA, 20 bp, Artificial sequence
  SiRNA target sequence
ccctataatactttctatac

SEQ ID NO: 109810 - DNA, 20 bp, Artificial sequence
  SiRNA target sequence
cctataatactttctatact

SEQ ID NO: 109811 - DNA, 20 bp, Artificial sequence
  SiRNA target sequence
ctataatactttctatactg

SEQ ID NO: 109812 - DNA, 20 bp, Artificial sequence
  SiRNA target sequence
tataatactttctatactga

SEQ ID NO: 109813 - DNA, 20 bp, Artificial sequence
  SiRNA target sequence
ataatactttctatactgat

SEQ ID NO: 109814 - DNA, 20 bp, Artificial sequence
  SiRNA target sequence
taatactttctatactgatt

SEQ ID NO: 109815 - DNA, 20 bp, Artificial sequence
  SiRNA target sequence
aatactttctatactgattc

SEQ ID NO: 109816 - DNA, 20 bp, Artificial sequence
  SiRNA target sequence
atactttctatactgattcc

SEQ ID NO: 109817 - DNA, 20 bp, Artificial sequence
  SiRNA target sequence
tactttctatactgattcca

SEQ ID NO: 109818 - DNA, 20 bp, Artificial sequence
  SiRNA target sequence
actttctatactgattccac

SEQ ID NO: 109819 - DNA, 20 bp, Artificial sequence
  SiRNA target sequence
ctttctatactgattccaca

SEQ ID NO: 109820 - DNA, 20 bp, Artificial sequence
  SiRNA target sequence
tttctatactgattccacaa

SEQ ID NO: 109821 - DNA, 20 bp, Artificial sequence
  SiRNA target sequence
ttctatactgattccacaaa

SEQ ID NO: 109822 - DNA, 20 bp, Artificial sequence
  SiRNA target sequence
tctatactgattccacaaat

SEQ ID NO: 109823 - DNA, 20 bp, Artificial sequence
  SiRNA target sequence
ctatactgattccacaaata

SEQ ID NO: 109824 - DNA, 20 bp, Artificial sequence
  SiRNA target sequence
tatactgattccacaaataa

SEQ ID NO: 109825 - DNA, 20 bp, Artificial sequence
  SiRNA target sequence
atactgattccacaaataaa

SEQ ID NO: 109826 - DNA, 20 bp, Artificial sequence
  SiRNA target sequence
tactgattccacaaataaat

SEQ ID NO: 109827 - DNA, 20 bp, Artificial sequence
  SiRNA target sequence
actgattccacaaataaatg

SEQ ID NO: 109828 - DNA, 20 bp, Artificial sequence
  SiRNA target sequence
ctgattccacaaataaatgc

SEQ ID NO: 109829 - DNA, 20 bp, Artificial sequence
  SiRNA target sequence
tgattccacaaataaatgct

SEQ ID NO: 109830 - DNA, 20 bp, Artificial sequence
  SiRNA target sequence
gattccacaaataaatgcta

SEQ ID NO: 109831 - DNA, 20 bp, Artificial sequence
  SiRNA target sequence
attccacaaataaatgctaa

SEQ ID NO: 109832 - DNA, 20 bp, Artificial sequence
  SiRNA target sequence
ttccacaaataaatgctaat

SEQ ID NO: 109833 - DNA, 20 bp, Artificial sequence
  SiRNA target sequence
tccacaaataaatgctaatc

SEQ ID NO: 109834 - DNA, 20 bp, Artificial sequence
  SiRNA target sequence
ccacaaataaatgctaatcc

SEQ ID NO: 109835 - DNA, 20 bp, Artificial sequence
  SiRNA target sequence
cacaaataaatgctaatcca

SEQ ID NO: 109836 - DNA, 20 bp, Artificial sequence
  SiRNA target sequence
acaaataaatgctaatccat

SEQ ID NO: 109837 - DNA, 20 bp, Artificial sequence
  SiRNA target sequence
caaataaatgctaatccatg

SEQ ID NO: 109838 - DNA, 20 bp, Artificial sequence
  SiRNA target sequence
aaataaatgctaatccatgg

SEQ ID NO: 109839 - DNA, 20 bp, Artificial sequence
  SiRNA target sequence
aataaatgctaatccatggc

SEQ ID NO: 109840 - DNA, 20 bp, Artificial sequence
  SiRNA target sequence
ataaatgctaatccatggca

SEQ ID NO: 109841 - DNA, 20 bp, Artificial sequence
  SiRNA target sequence
taaatgctaatccatggcat

SEQ ID NO: 109842 - DNA, 20 bp, Artificial sequence
  SiRNA target sequence
aaatgctaatccatggcatc

SEQ ID NO: 109843 - DNA, 20 bp, Artificial sequence
  SiRNA target sequence
aatgctaatccatggcatct

SEQ ID NO: 109844 - DNA, 20 bp, Artificial sequence
  SiRNA target sequence
atgctaatccatggcatcta

SEQ ID NO: 109845 - DNA, 20 bp, Artificial sequence
  SiRNA target sequence
tgctaatccatggcatctat

SEQ ID NO: 109846 - DNA, 20 bp, Artificial sequence
  SiRNA target sequence
gctaatccatggcatctata

SEQ ID NO: 109847 - DNA, 20 bp, Artificial sequence
  SiRNA target sequence
ctaatccatggcatctataa

SEQ ID NO: 109848 - DNA, 20 bp, Artificial sequence
  SiRNA target sequence
taatccatggcatctataag

SEQ ID NO: 109849 - DNA, 20 bp, Artificial sequence
  SiRNA target sequence
aatccatggcatctataaga

SEQ ID NO: 109850 - DNA, 20 bp, Artificial sequence
  SiRNA target sequence
atccatggcatctataagat

SEQ ID NO: 109851 - DNA, 20 bp, Artificial sequence
  SiRNA target sequence
tccatggcatctataagatc

SEQ ID NO: 109852 - DNA, 20 bp, Artificial sequence
  SiRNA target sequence
ccatggcatctataagatcc

SEQ ID NO: 109853 - DNA, 20 bp, Artificial sequence
  SiRNA target sequence
catggcatctataagatcct

SEQ ID NO: 109854 - DNA, 20 bp, Artificial sequence
  SiRNA target sequence
atggcatctataagatccta

SEQ ID NO: 109855 - DNA, 20 bp, Artificial sequence
  SiRNA target sequence
tggcatctataagatcctat

SEQ ID NO: 109856 - DNA, 20 bp, Artificial sequence
  SiRNA target sequence
ggcatctataagatcctatg

SEQ ID NO: 109857 - DNA, 20 bp, Artificial sequence
  SiRNA target sequence
gcatctataagatcctatga

SEQ ID NO: 109858 - DNA, 20 bp, Artificial sequence
  SiRNA target sequence
catctataagatcctatgac

SEQ ID NO: 109859 - DNA, 20 bp, Artificial sequence
  SiRNA target sequence
atctataagatcctatgact

SEQ ID NO: 109860 - DNA, 20 bp, Artificial sequence
  SiRNA target sequence
tctataagatcctatgactt

SEQ ID NO: 109861 - DNA, 20 bp, Artificial sequence
  SiRNA target sequence
ctataagatcctatgacttt

SEQ ID NO: 109862 - DNA, 20 bp, Artificial sequence
  SiRNA target sequence
tataagatcctatgacttta

SEQ ID NO: 109863 - DNA, 20 bp, Artificial sequence
  SiRNA target sequence
ataagatcctatgactttat

SEQ ID NO: 109864 - DNA, 20 bp, Artificial sequence
  SiRNA target sequence
taagatcctatgactttatc

SEQ ID NO: 109865 - DNA, 20 bp, Artificial sequence
  SiRNA target sequence
aagatcctatgactttatca

SEQ ID NO: 109866 - DNA, 20 bp, Artificial sequence
  SiRNA target sequence
agatcctatgactttatcat

SEQ ID NO: 109867 - DNA, 20 bp, Artificial sequence
  SiRNA target sequence
gatcctatgactttatcatt

SEQ ID NO: 109868 - DNA, 20 bp, Artificial sequence
  SiRNA target sequence
atcctatgactttatcattt

SEQ ID NO: 109869 - DNA, 20 bp, Artificial sequence
  SiRNA target sequence
tcctatgactttatcatttt

SEQ ID NO: 109870 - DNA, 20 bp, Artificial sequence
  SiRNA target sequence
cctatgactttatcattttt

SEQ ID NO: 109871 - DNA, 20 bp, Artificial sequence
  SiRNA target sequence
ctatgactttatcattttta

SEQ ID NO: 109872 - DNA, 20 bp, Artificial sequence
  SiRNA target sequence
tatgactttatcatttttat

SEQ ID NO: 109873 - DNA, 20 bp, Artificial sequence
  SiRNA target sequence
atgactttatcatttttatc

SEQ ID NO: 109874 - DNA, 20 bp, Artificial sequence
  SiRNA target sequence
tgactttatcatttttatct

SEQ ID NO: 109875 - DNA, 20 bp, Artificial sequence
  SiRNA target sequence
gactttatcatttttatcta

SEQ ID NO: 109876 - DNA, 20 bp, Artificial sequence
  SiRNA target sequence
actttatcatttttatctag

SEQ ID NO: 109877 - DNA, 20 bp, Artificial sequence
  SiRNA target sequence
ctttatcatttttatctagt

SEQ ID NO: 109878 - DNA, 20 bp, Artificial sequence
  SiRNA target sequence
tttatcatttttatctagta

SEQ ID NO: 109879 - DNA, 20 bp, Artificial sequence
  SiRNA target sequence
ttatcatttttatctagtac

SEQ ID NO: 109880 - DNA, 20 bp, Artificial sequence
  SiRNA target sequence
tatcatttttatctagtacc

SEQ ID NO: 109881 - DNA, 20 bp, Artificial sequence
  SiRNA target sequence
atcatttttatctagtacct

SEQ ID NO: 109882 - DNA, 20 bp, Artificial sequence
  SiRNA target sequence
tcatttttatctagtacctt

SEQ ID NO: 109883 - DNA, 20 bp, Artificial sequence
  SiRNA target sequence
catttttatctagtaccttt

SEQ ID NO: 109884 - DNA, 20 bp, Artificial sequence
  SiRNA target sequence
atttttatctagtacctttt

SEQ ID NO: 109885 - DNA, 20 bp, Artificial sequence
  SiRNA target sequence
tttttatctagtaccttttg

SEQ ID NO: 109886 - DNA, 20 bp, Artificial sequence
  SiRNA target sequence
ttttatctagtaccttttgt

SEQ ID NO: 109887 - DNA, 20 bp, Artificial sequence
  SiRNA target sequence
tttatctagtaccttttgta

SEQ ID NO: 109888 - DNA, 20 bp, Artificial sequence
  SiRNA target sequence
ttatctagtaccttttgtaa

SEQ ID NO: 109889 - DNA, 20 bp, Artificial sequence
  SiRNA target sequence
tatctagtaccttttgtaaa

SEQ ID NO: 109890 - DNA, 20 bp, Artificial sequence
  SiRNA target sequence
atctagtaccttttgtaaac

SEQ ID NO: 109891 - DNA, 20 bp, Artificial sequence
  SiRNA target sequence
tctagtaccttttgtaaact

SEQ ID NO: 109892 - DNA, 20 bp, Artificial sequence
  SiRNA target sequence
ctagtaccttttgtaaactc

SEQ ID NO: 109893 - DNA, 20 bp, Artificial sequence
  SiRNA target sequence
tagtaccttttgtaaactca

SEQ ID NO: 109894 - DNA, 20 bp, Artificial sequence
  SiRNA target sequence
agtaccttttgtaaactcat

SEQ ID NO: 109895 - DNA, 20 bp, Artificial sequence
  SiRNA target sequence
gtaccttttgtaaactcata

SEQ ID NO: 109896 - DNA, 20 bp, Artificial sequence
  SiRNA target sequence
taccttttgtaaactcatat

SEQ ID NO: 109897 - DNA, 20 bp, Artificial sequence
  SiRNA target sequence
accttttgtaaactcatata

SEQ ID NO: 109898 - DNA, 20 bp, Artificial sequence
  SiRNA target sequence
ccttttgtaaactcatataa

SEQ ID NO: 109899 - DNA, 20 bp, Artificial sequence
  SiRNA target sequence
cttttgtaaactcatataaa

SEQ ID NO: 109900 - DNA, 20 bp, Artificial sequence
  SiRNA target sequence
ttttgtaaactcatataaat

SEQ ID NO: 109901 - DNA, 20 bp, Artificial sequence
  SiRNA target sequence
tttgtaaactcatataaatg

SEQ ID NO: 109902 - DNA, 20 bp, Artificial sequence
  SiRNA target sequence
ttgtaaactcatataaatgt

SEQ ID NO: 109903 - DNA, 20 bp, Artificial sequence
  SiRNA target sequence
tgtaaactcatataaatgtt

SEQ ID NO: 109904 - DNA, 20 bp, Artificial sequence
  SiRNA target sequence
gtaaactcatataaatgttt

SEQ ID NO: 109905 - DNA, 20 bp, Artificial sequence
  SiRNA target sequence
taaactcatataaatgtttt

SEQ ID NO: 109906 - DNA, 20 bp, Artificial sequence
  SiRNA target sequence
aaactcatataaatgttttc

SEQ ID NO: 109907 - DNA, 20 bp, Artificial sequence
  SiRNA target sequence
aactcatataaatgttttcc

SEQ ID NO: 109908 - DNA, 20 bp, Artificial sequence
  SiRNA target sequence
actcatataaatgttttcct

SEQ ID NO: 109909 - DNA, 20 bp, Artificial sequence
  SiRNA target sequence
ctcatataaatgttttcctg

SEQ ID NO: 109910 - DNA, 20 bp, Artificial sequence
  SiRNA target sequence
tcatataaatgttttcctgt

SEQ ID NO: 109911 - DNA, 20 bp, Artificial sequence
  SiRNA target sequence
catataaatgttttcctgtc

SEQ ID NO: 109912 - DNA, 20 bp, Artificial sequence
  SiRNA target sequence
atataaatgttttcctgtcc

SEQ ID NO: 109913 - DNA, 20 bp, Artificial sequence
  SiRNA target sequence
tataaatgttttcctgtcct

SEQ ID NO: 109914 - DNA, 20 bp, Artificial sequence
  SiRNA target sequence
ataaatgttttcctgtccta

SEQ ID NO: 109915 - DNA, 20 bp, Artificial sequence
  SiRNA target sequence
taaatgttttcctgtcctat

SEQ ID NO: 109916 - DNA, 20 bp, Artificial sequence
  SiRNA target sequence
aaatgttttcctgtcctatt

SEQ ID NO: 109917 - DNA, 20 bp, Artificial sequence
  SiRNA target sequence
aatgttttcctgtcctatta

SEQ ID NO: 109918 - DNA, 20 bp, Artificial sequence
  SiRNA target sequence
atgttttcctgtcctattac

SEQ ID NO: 109919 - DNA, 20 bp, Artificial sequence
  SiRNA target sequence
tgttttcctgtcctattact

SEQ ID NO: 109920 - DNA, 20 bp, Artificial sequence
  SiRNA target sequence
gttttcctgtcctattacta

SEQ ID NO: 109921 - DNA, 20 bp, Artificial sequence
  SiRNA target sequence
ttttcctgtcctattactaa

SEQ ID NO: 109922 - DNA, 20 bp, Artificial sequence
  SiRNA target sequence
tttcctgtcctattactaaa

SEQ ID NO: 109923 - DNA, 20 bp, Artificial sequence
  SiRNA target sequence
ttcctgtcctattactaaat

SEQ ID NO: 109924 - DNA, 20 bp, Artificial sequence
  SiRNA target sequence
tcctgtcctattactaaatg

SEQ ID NO: 109925 - DNA, 20 bp, Artificial sequence
  SiRNA target sequence
cctgtcctattactaaatga

SEQ ID NO: 109926 - DNA, 20 bp, Artificial sequence
  SiRNA target sequence
ctgtcctattactaaatgac

SEQ ID NO: 109927 - DNA, 20 bp, Artificial sequence
  SiRNA target sequence
tgtcctattactaaatgaca

SEQ ID NO: 109928 - DNA, 20 bp, Artificial sequence
  SiRNA target sequence
gtcctattactaaatgacag

SEQ ID NO: 109929 - DNA, 20 bp, Artificial sequence
  SiRNA target sequence
tcctattactaaatgacaga

SEQ ID NO: 109930 - DNA, 20 bp, Artificial sequence
  SiRNA target sequence
cctattactaaatgacagaa

SEQ ID NO: 109931 - DNA, 20 bp, Artificial sequence
  SiRNA target sequence
ctattactaaatgacagaag

SEQ ID NO: 109932 - DNA, 20 bp, Artificial sequence
  SiRNA target sequence
tattactaaatgacagaagc

SEQ ID NO: 109933 - DNA, 20 bp, Artificial sequence
  SiRNA target sequence
attactaaatgacagaagcc

SEQ ID NO: 109934 - DNA, 20 bp, Artificial sequence
  SiRNA target sequence
ttactaaatgacagaagcct

SEQ ID NO: 109935 - DNA, 20 bp, Artificial sequence
  SiRNA target sequence
tactaaatgacagaagcctc

SEQ ID NO: 109936 - DNA, 20 bp, Artificial sequence
  SiRNA target sequence
actaaatgacagaagcctct

SEQ ID NO: 109937 - DNA, 20 bp, Artificial sequence
  SiRNA target sequence
ctaaatgacagaagcctctt

SEQ ID NO: 109938 - DNA, 20 bp, Artificial sequence
  SiRNA target sequence
taaatgacagaagcctctta

SEQ ID NO: 109939 - DNA, 20 bp, Artificial sequence
  SiRNA target sequence
aaatgacagaagcctcttat

SEQ ID NO: 109940 - DNA, 20 bp, Artificial sequence
  SiRNA target sequence
aatgacagaagcctcttata

SEQ ID NO: 109941 - DNA, 20 bp, Artificial sequence
  SiRNA target sequence
atgacagaagcctcttatat

SEQ ID NO: 109942 - DNA, 20 bp, Artificial sequence
  SiRNA target sequence
tgacagaagcctcttatatt

SEQ ID NO: 109943 - DNA, 20 bp, Artificial sequence
  SiRNA target sequence
gacagaagcctcttatattt

SEQ ID NO: 109944 - DNA, 20 bp, Artificial sequence
  SiRNA target sequence
acagaagcctcttatatttc

SEQ ID NO: 109945 - DNA, 20 bp, Artificial sequence
  SiRNA target sequence
cagaagcctcttatatttcc

SEQ ID NO: 109946 - DNA, 20 bp, Artificial sequence
  SiRNA target sequence
agaagcctcttatatttcct

SEQ ID NO: 109947 - DNA, 20 bp, Artificial sequence
  SiRNA target sequence
gaagcctcttatatttcctt

SEQ ID NO: 109948 - DNA, 20 bp, Artificial sequence
  SiRNA target sequence
aagcctcttatatttccttt

SEQ ID NO: 109949 - DNA, 20 bp, Artificial sequence
  SiRNA target sequence
agcctcttatatttcctttt

SEQ ID NO: 109950 - DNA, 20 bp, Artificial sequence
  SiRNA target sequence
gcctcttatatttccttttt

SEQ ID NO: 109951 - DNA, 20 bp, Artificial sequence
  SiRNA target sequence
cctcttatatttcctttttt

SEQ ID NO: 109952 - DNA, 20 bp, Artificial sequence
  SiRNA target sequence
ctcttatatttcctttttta

SEQ ID NO: 109953 - DNA, 20 bp, Artificial sequence
  SiRNA target sequence
tcttatatttccttttttat

SEQ ID NO: 109954 - DNA, 20 bp, Artificial sequence
  SiRNA target sequence
cttatatttccttttttata

SEQ ID NO: 109955 - DNA, 20 bp, Artificial sequence
  SiRNA target sequence
ttatatttccttttttatac

SEQ ID NO: 109956 - DNA, 20 bp, Artificial sequence
  SiRNA target sequence
tatatttccttttttatact

SEQ ID NO: 109957 - DNA, 20 bp, Artificial sequence
  SiRNA target sequence
atatttccttttttatactt

SEQ ID NO: 109958 - DNA, 20 bp, Artificial sequence
  SiRNA target sequence
tatttccttttttatactta

SEQ ID NO: 109959 - DNA, 20 bp, Artificial sequence
  SiRNA target sequence
atttccttttttatacttag

SEQ ID NO: 109960 - DNA, 20 bp, Artificial sequence
  SiRNA target sequence
tttccttttttatacttaga

SEQ ID NO: 109961 - DNA, 20 bp, Artificial sequence
  SiRNA target sequence
ttccttttttatacttagag

SEQ ID NO: 109962 - DNA, 20 bp, Artificial sequence
  SiRNA target sequence
tccttttttatacttagagt

SEQ ID NO: 109963 - DNA, 20 bp, Artificial sequence
  SiRNA target sequence
ccttttttatacttagagtt

SEQ ID NO: 109964 - DNA, 20 bp, Artificial sequence
  SiRNA target sequence
cttttttatacttagagtta

SEQ ID NO: 109965 - DNA, 20 bp, Artificial sequence
  SiRNA target sequence
ttttttatacttagagttag

SEQ ID NO: 109966 - DNA, 20 bp, Artificial sequence
  SiRNA target sequence
tttttatacttagagttagc

SEQ ID NO: 109967 - DNA, 20 bp, Artificial sequence
  SiRNA target sequence
ttttatacttagagttagca

SEQ ID NO: 109968 - DNA, 20 bp, Artificial sequence
  SiRNA target sequence
tttatacttagagttagcat

SEQ ID NO: 109969 - DNA, 20 bp, Artificial sequence
  SiRNA target sequence
ttatacttagagttagcata

SEQ ID NO: 109970 - DNA, 20 bp, Artificial sequence
  SiRNA target sequence
tatacttagagttagcatat

SEQ ID NO: 109971 - DNA, 20 bp, Artificial sequence
  SiRNA target sequence
atacttagagttagcatatt

SEQ ID NO: 109972 - DNA, 20 bp, Artificial sequence
  SiRNA target sequence
tacttagagttagcatattc

SEQ ID NO: 109973 - DNA, 20 bp, Artificial sequence
  SiRNA target sequence
acttagagttagcatattct

SEQ ID NO: 109974 - DNA, 20 bp, Artificial sequence
  SiRNA target sequence
cttagagttagcatattctt

SEQ ID NO: 109975 - DNA, 20 bp, Artificial sequence
  SiRNA target sequence
ttagagttagcatattcttc

SEQ ID NO: 109976 - DNA, 20 bp, Artificial sequence
  SiRNA target sequence
tagagttagcatattcttcg

SEQ ID NO: 109977 - DNA, 20 bp, Artificial sequence
  SiRNA target sequence
agagttagcatattcttcga

SEQ ID NO: 109978 - DNA, 20 bp, Artificial sequence
  SiRNA target sequence
gagttagcatattcttcgat

SEQ ID NO: 109979 - DNA, 20 bp, Artificial sequence
  SiRNA target sequence
agttagcatattcttcgata

SEQ ID NO: 109980 - DNA, 20 bp, Artificial sequence
  SiRNA target sequence
gttagcatattcttcgataa

SEQ ID NO: 109981 - DNA, 20 bp, Artificial sequence
  SiRNA target sequence
ttagcatattcttcgataag

SEQ ID NO: 109982 - DNA, 20 bp, Artificial sequence
  SiRNA target sequence
tagcatattcttcgataaga

SEQ ID NO: 109983 - DNA, 20 bp, Artificial sequence
  SiRNA target sequence
agcatattcttcgataagac

SEQ ID NO: 109984 - DNA, 20 bp, Artificial sequence
  SiRNA target sequence
gcatattcttcgataagacg

SEQ ID NO: 109985 - DNA, 20 bp, Artificial sequence
  SiRNA target sequence
catattcttcgataagacgt

SEQ ID NO: 109986 - DNA, 20 bp, Artificial sequence
  SiRNA target sequence
atattcttcgataagacgta

SEQ ID NO: 109987 - DNA, 20 bp, Artificial sequence
  SiRNA target sequence
tattcttcgataagacgtag

SEQ ID NO: 109988 - DNA, 20 bp, Artificial sequence
  SiRNA target sequence
attcttcgataagacgtaga

SEQ ID NO: 109989 - DNA, 20 bp, Artificial sequence
  SiRNA target sequence
ttcttcgataagacgtagaa

SEQ ID NO: 109990 - DNA, 20 bp, Artificial sequence
  SiRNA target sequence
tcttcgataagacgtagaat

SEQ ID NO: 109991 - DNA, 20 bp, Artificial sequence
  SiRNA target sequence
cttcgataagacgtagaatt

SEQ ID NO: 109992 - DNA, 20 bp, Artificial sequence
  SiRNA target sequence
ttcgataagacgtagaatta

SEQ ID NO: 109993 - DNA, 20 bp, Artificial sequence
  SiRNA target sequence
tcgataagacgtagaattaa

SEQ ID NO: 109994 - DNA, 20 bp, Artificial sequence
  SiRNA target sequence
cgataagacgtagaattaac

SEQ ID NO: 109995 - DNA, 20 bp, Artificial sequence
  SiRNA target sequence
gataagacgtagaattaaca

SEQ ID NO: 109996 - DNA, 20 bp, Artificial sequence
  SiRNA target sequence
ataagacgtagaattaacat

SEQ ID NO: 109997 - DNA, 20 bp, Artificial sequence
  SiRNA target sequence
taagacgtagaattaacata

SEQ ID NO: 109998 - DNA, 20 bp, Artificial sequence
  SiRNA target sequence
aagacgtagaattaacatat

SEQ ID NO: 109999 - DNA, 20 bp, Artificial sequence
  SiRNA target sequence
agacgtagaattaacatatt

SEQ ID NO: 110000 - DNA, 20 bp, Artificial sequence
  SiRNA target sequence
gacgtagaattaacatattt

SEQ ID NO: 110001 - DNA, 20 bp, Artificial sequence
  SiRNA target sequence
acgtagaattaacatatttc

SEQ ID NO: 110002 - DNA, 20 bp, Artificial sequence
  SiRNA target sequence
cgtagaattaacatatttct

SEQ ID NO: 110003 - DNA, 20 bp, Artificial sequence
  SiRNA target sequence
gtagaattaacatatttcta

SEQ ID NO: 110004 - DNA, 20 bp, Artificial sequence
  SiRNA target sequence
tagaattaacatatttctat

SEQ ID NO: 110005 - DNA, 20 bp, Artificial sequence
  SiRNA target sequence
agaattaacatatttctata

SEQ ID NO: 110006 - DNA, 20 bp, Artificial sequence
  SiRNA target sequence
gaattaacatatttctataa

SEQ ID NO: 110007 - DNA, 20 bp, Artificial sequence
  SiRNA target sequence
aattaacatatttctataaa

SEQ ID NO: 110008 - DNA, 20 bp, Artificial sequence
  SiRNA target sequence
attaacatatttctataaac

SEQ ID NO: 110009 - DNA, 20 bp, Artificial sequence
  SiRNA target sequence
ttaacatatttctataaaca

SEQ ID NO: 110010 - DNA, 20 bp, Artificial sequence
  SiRNA target sequence
taacatatttctataaacat

SEQ ID NO: 110011 - DNA, 20 bp, Artificial sequence
  SiRNA target sequence
aacatatttctataaacatc

SEQ ID NO: 110012 - DNA, 20 bp, Artificial sequence
  SiRNA target sequence
acatatttctataaacatct

SEQ ID NO: 110013 - DNA, 20 bp, Artificial sequence
  SiRNA target sequence
catatttctataaacatctt

SEQ ID NO: 110014 - DNA, 20 bp, Artificial sequence
  SiRNA target sequence
atatttctataaacatcttg

SEQ ID NO: 110015 - DNA, 20 bp, Artificial sequence
  SiRNA target sequence
tatttctataaacatcttgt

SEQ ID NO: 110016 - DNA, 20 bp, Artificial sequence
  SiRNA target sequence
atttctataaacatcttgta

SEQ ID NO: 110017 - DNA, 20 bp, Artificial sequence
  SiRNA target sequence
tttctataaacatcttgtac

SEQ ID NO: 110018 - DNA, 20 bp, Artificial sequence
  SiRNA target sequence
ttctataaacatcttgtaca

SEQ ID NO: 110019 - DNA, 20 bp, Artificial sequence
  SiRNA target sequence
tctataaacatcttgtacaa

SEQ ID NO: 110020 - DNA, 20 bp, Artificial sequence
  SiRNA target sequence
ctataaacatcttgtacaag

SEQ ID NO: 110021 - DNA, 20 bp, Artificial sequence
  SiRNA target sequence
tataaacatcttgtacaagt

SEQ ID NO: 110022 - DNA, 20 bp, Artificial sequence
  SiRNA target sequence
ataaacatcttgtacaagtt

SEQ ID NO: 110023 - DNA, 20 bp, Artificial sequence
  SiRNA target sequence
taaacatcttgtacaagttc

SEQ ID NO: 110024 - DNA, 20 bp, Artificial sequence
  SiRNA target sequence
aaacatcttgtacaagttct

SEQ ID NO: 110025 - DNA, 20 bp, Artificial sequence
  SiRNA target sequence
aacatcttgtacaagttctt

SEQ ID NO: 110026 - DNA, 20 bp, Artificial sequence
  SiRNA target sequence
acatcttgtacaagttcttt

SEQ ID NO: 110027 - DNA, 20 bp, Artificial sequence
  SiRNA target sequence
catcttgtacaagttctttg

SEQ ID NO: 110028 - DNA, 20 bp, Artificial sequence
  SiRNA target sequence
atcttgtacaagttctttgt

SEQ ID NO: 110029 - DNA, 20 bp, Artificial sequence
  SiRNA target sequence
tcttgtacaagttctttgtt

SEQ ID NO: 110030 - DNA, 20 bp, Artificial sequence
  SiRNA target sequence
cttgtacaagttctttgttt

SEQ ID NO: 110031 - DNA, 20 bp, Artificial sequence
  SiRNA target sequence
ttgtacaagttctttgttta

SEQ ID NO: 110032 - DNA, 20 bp, Artificial sequence
  SiRNA target sequence
tgtacaagttctttgtttaa

SEQ ID NO: 110033 - DNA, 20 bp, Artificial sequence
  SiRNA target sequence
gtacaagttctttgtttaaa

SEQ ID NO: 110034 - DNA, 20 bp, Artificial sequence
  SiRNA target sequence
tacaagttctttgtttaaag

SEQ ID NO: 110035 - DNA, 20 bp, Artificial sequence
  SiRNA target sequence
acaagttctttgtttaaagt

SEQ ID NO: 110036 - DNA, 20 bp, Artificial sequence
  SiRNA target sequence
caagttctttgtttaaagta

SEQ ID NO: 110037 - DNA, 20 bp, Artificial sequence
  SiRNA target sequence
aagttctttgtttaaagtag

SEQ ID NO: 110038 - DNA, 20 bp, Artificial sequence
  SiRNA target sequence
agttctttgtttaaagtagt

SEQ ID NO: 110039 - DNA, 20 bp, Artificial sequence
  SiRNA target sequence
gttctttgtttaaagtagtt

SEQ ID NO: 110040 - DNA, 20 bp, Artificial sequence
  SiRNA target sequence
ttctttgtttaaagtagttt

SEQ ID NO: 110041 - DNA, 20 bp, Artificial sequence
  SiRNA target sequence
tctttgtttaaagtagtttt

SEQ ID NO: 110042 - DNA, 20 bp, Artificial sequence
  SiRNA target sequence
ctttgtttaaagtagttttc

SEQ ID NO: 110043 - DNA, 20 bp, Artificial sequence
  SiRNA target sequence
tttgtttaaagtagttttca

SEQ ID NO: 110044 - DNA, 20 bp, Artificial sequence
  SiRNA target sequence
ttgtttaaagtagttttcag

SEQ ID NO: 110045 - DNA, 20 bp, Artificial sequence
  SiRNA target sequence
tgtttaaagtagttttcagt

SEQ ID NO: 110046 - DNA, 20 bp, Artificial sequence
  SiRNA target sequence
gtttaaagtagttttcagtt

SEQ ID NO: 110047 - DNA, 20 bp, Artificial sequence
  SiRNA target sequence
tttaaagtagttttcagttt

SEQ ID NO: 110048 - DNA, 20 bp, Artificial sequence
  SiRNA target sequence
ttaaagtagttttcagttta

SEQ ID NO: 110049 - DNA, 20 bp, Artificial sequence
  SiRNA target sequence
taaagtagttttcagtttaa

SEQ ID NO: 110050 - DNA, 20 bp, Artificial sequence
  SiRNA target sequence
aaagtagttttcagtttaac

SEQ ID NO: 110051 - DNA, 20 bp, Artificial sequence
  SiRNA target sequence
aagtagttttcagtttaact

SEQ ID NO: 110052 - DNA, 20 bp, Artificial sequence
  SiRNA target sequence
agtagttttcagtttaactg

SEQ ID NO: 110053 - DNA, 20 bp, Artificial sequence
  SiRNA target sequence
gtagttttcagtttaactgt

SEQ ID NO: 110054 - DNA, 20 bp, Artificial sequence
  SiRNA target sequence
tagttttcagtttaactgta

SEQ ID NO: 110055 - DNA, 20 bp, Artificial sequence
  SiRNA target sequence
agttttcagtttaactgtat

SEQ ID NO: 110056 - DNA, 20 bp, Artificial sequence
  SiRNA target sequence
gttttcagtttaactgtatt

SEQ ID NO: 110057 - DNA, 20 bp, Artificial sequence
  SiRNA target sequence
ttttcagtttaactgtattt

SEQ ID NO: 110058 - DNA, 20 bp, Artificial sequence
  SiRNA target sequence
tttcagtttaactgtatttt

SEQ ID NO: 110059 - DNA, 20 bp, Artificial sequence
  SiRNA target sequence
ttcagtttaactgtattttt

SEQ ID NO: 110060 - DNA, 20 bp, Artificial sequence
  SiRNA target sequence
tcagtttaactgtattttta

SEQ ID NO: 110061 - DNA, 20 bp, Artificial sequence
  SiRNA target sequence
cagtttaactgtatttttat

SEQ ID NO: 110062 - DNA, 20 bp, Artificial sequence
  SiRNA target sequence
agtttaactgtatttttatc

SEQ ID NO: 110063 - DNA, 20 bp, Artificial sequence
  SiRNA target sequence
gtttaactgtatttttatct

SEQ ID NO: 110064 - DNA, 20 bp, Artificial sequence
  SiRNA target sequence
tttaactgtatttttatcta

SEQ ID NO: 110065 - DNA, 20 bp, Artificial sequence
  SiRNA target sequence
ttaactgtatttttatctac

SEQ ID NO: 110066 - DNA, 20 bp, Artificial sequence
  SiRNA target sequence
taactgtatttttatctacc

SEQ ID NO: 110067 - DNA, 20 bp, Artificial sequence
  SiRNA target sequence
aactgtatttttatctacca

SEQ ID NO: 110068 - DNA, 20 bp, Artificial sequence
  SiRNA target sequence
actgtatttttatctaccaa

SEQ ID NO: 110069 - DNA, 20 bp, Artificial sequence
  SiRNA target sequence
ctgtatttttatctaccaaa

SEQ ID NO: 110070 - DNA, 20 bp, Artificial sequence
  SiRNA target sequence
tgtatttttatctaccaaat

SEQ ID NO: 110071 - DNA, 20 bp, Artificial sequence
  SiRNA target sequence
gtatttttatctaccaaata

SEQ ID NO: 110072 - DNA, 20 bp, Artificial sequence
  SiRNA target sequence
tatttttatctaccaaataa

SEQ ID NO: 110073 - DNA, 20 bp, Artificial sequence
  SiRNA target sequence
atttttatctaccaaataat

SEQ ID NO: 110074 - DNA, 20 bp, Artificial sequence
  SiRNA target sequence
tttttatctaccaaataata

SEQ ID NO: 110075 - DNA, 20 bp, Artificial sequence
  SiRNA target sequence
ttttatctaccaaataataa

SEQ ID NO: 110076 - DNA, 20 bp, Artificial sequence
  SiRNA target sequence
tttatctaccaaataataat

SEQ ID NO: 110077 - DNA, 20 bp, Artificial sequence
  SiRNA target sequence
ttatctaccaaataataatc

SEQ ID NO: 110078 - DNA, 20 bp, Artificial sequence
  SiRNA target sequence
tatctaccaaataataatct

SEQ ID NO: 110079 - DNA, 20 bp, Artificial sequence
  SiRNA target sequence
atctaccaaataataatcta

SEQ ID NO: 110080 - DNA, 20 bp, Artificial sequence
  SiRNA target sequence
tctaccaaataataatctat

SEQ ID NO: 110081 - DNA, 20 bp, Artificial sequence
  SiRNA target sequence
ctaccaaataataatctatc

SEQ ID NO: 110082 - DNA, 20 bp, Artificial sequence
  SiRNA target sequence
taccaaataataatctatca

SEQ ID NO: 110083 - DNA, 20 bp, Artificial sequence
  SiRNA target sequence
accaaataataatctatcat

SEQ ID NO: 110084 - DNA, 21 bp, Artificial sequence
  SiRNA target sequence
ttattcagaataaacatcttt

SEQ ID NO: 110085 - DNA, 21 bp, Artificial sequence
  SiRNA target sequence
tattcagaataaacatctttt

SEQ ID NO: 110086 - DNA, 21 bp, Artificial sequence
  SiRNA target sequence
attcagaataaacatctttta

SEQ ID NO: 110087 - DNA, 21 bp, Artificial sequence
  SiRNA target sequence
ttcagaataaacatcttttaa

SEQ ID NO: 110088 - DNA, 21 bp, Artificial sequence
  SiRNA target sequence
tcagaataaacatcttttaaa

SEQ ID NO: 110089 - DNA, 21 bp, Artificial sequence
  SiRNA target sequence
cagaataaacatcttttaaaa

SEQ ID NO: 110090 - DNA, 21 bp, Artificial sequence
  SiRNA target sequence
agaataaacatcttttaaaag

SEQ ID NO: 110091 - DNA, 21 bp, Artificial sequence
  SiRNA target sequence
gaataaacatcttttaaaagt

SEQ ID NO: 110092 - DNA, 21 bp, Artificial sequence
  SiRNA target sequence
aataaacatcttttaaaagtt

SEQ ID NO: 110093 - DNA, 21 bp, Artificial sequence
  SiRNA target sequence
ataaacatcttttaaaagttc

SEQ ID NO: 110094 - DNA, 21 bp, Artificial sequence
  SiRNA target sequence
taaacatcttttaaaagttca

SEQ ID NO: 110095 - DNA, 21 bp, Artificial sequence
  SiRNA target sequence
aaacatcttttaaaagttcat

SEQ ID NO: 110096 - DNA, 21 bp, Artificial sequence
  SiRNA target sequence
aacatcttttaaaagttcatc

SEQ ID NO: 110097 - DNA, 21 bp, Artificial sequence
  SiRNA target sequence
acatcttttaaaagttcatcg

SEQ ID NO: 110098 - DNA, 21 bp, Artificial sequence
  SiRNA target sequence
catcttttaaaagttcatcga

SEQ ID NO: 110099 - DNA, 21 bp, Artificial sequence
  SiRNA target sequence
atcttttaaaagttcatcgat

SEQ ID NO: 110100 - DNA, 21 bp, Artificial sequence
  SiRNA target sequence
tcttttaaaagttcatcgata

SEQ ID NO: 110101 - DNA, 21 bp, Artificial sequence
  SiRNA target sequence
cttttaaaagttcatcgatat

SEQ ID NO: 110102 - DNA, 21 bp, Artificial sequence
  SiRNA target sequence
ttttaaaagttcatcgatatc

SEQ ID NO: 110103 - DNA, 21 bp, Artificial sequence
  SiRNA target sequence
tttaaaagttcatcgatatcg

SEQ ID NO: 110104 - DNA, 21 bp, Artificial sequence
  SiRNA target sequence
ttaaaagttcatcgatatcgg

SEQ ID NO: 110105 - DNA, 21 bp, Artificial sequence
  SiRNA target sequence
taaaagttcatcgatatcggg

SEQ ID NO: 110106 - DNA, 21 bp, Artificial sequence
  SiRNA target sequence
aaaagttcatcgatatcgggt

SEQ ID NO: 110107 - DNA, 21 bp, Artificial sequence
  SiRNA target sequence
aaagttcatcgatatcgggtt

SEQ ID NO: 110108 - DNA, 21 bp, Artificial sequence
  SiRNA target sequence
aagttcatcgatatcgggttc

SEQ ID NO: 110109 - DNA, 21 bp, Artificial sequence
  SiRNA target sequence
agttcatcgatatcgggttct

SEQ ID NO: 110110 - DNA, 21 bp, Artificial sequence
  SiRNA target sequence
gttcatcgatatcgggttctt

SEQ ID NO: 110111 - DNA, 21 bp, Artificial sequence
  SiRNA target sequence
ttcatcgatatcgggttcttt

SEQ ID NO: 110112 - DNA, 21 bp, Artificial sequence
  SiRNA target sequence
tcatcgatatcgggttcttta

SEQ ID NO: 110113 - DNA, 21 bp, Artificial sequence
  SiRNA target sequence
catcgatatcgggttctttag

SEQ ID NO: 110114 - DNA, 21 bp, Artificial sequence
  SiRNA target sequence
atcgatatcgggttctttaga

SEQ ID NO: 110115 - DNA, 21 bp, Artificial sequence
  SiRNA target sequence
tcgatatcgggttctttagaa

SEQ ID NO: 110116 - DNA, 21 bp, Artificial sequence
  SiRNA target sequence
cgatatcgggttctttagaaa

SEQ ID NO: 110117 - DNA, 21 bp, Artificial sequence
  SiRNA target sequence
gatatcgggttctttagaaaa

SEQ ID NO: 110118 - DNA, 21 bp, Artificial sequence
  SiRNA target sequence
atatcgggttctttagaaaaa

SEQ ID NO: 110119 - DNA, 21 bp, Artificial sequence
  SiRNA target sequence
tatcgggttctttagaaaaaa

SEQ ID NO: 110120 - DNA, 21 bp, Artificial sequence
  SiRNA target sequence
atcgggttctttagaaaaaat

SEQ ID NO: 110121 - DNA, 21 bp, Artificial sequence
  SiRNA target sequence
tcgggttctttagaaaaaata

SEQ ID NO: 110122 - DNA, 21 bp, Artificial sequence
  SiRNA target sequence
cgggttctttagaaaaaataa

SEQ ID NO: 110123 - DNA, 21 bp, Artificial sequence
  SiRNA target sequence
gggttctttagaaaaaataac

SEQ ID NO: 110124 - DNA, 21 bp, Artificial sequence
  SiRNA target sequence
ggttctttagaaaaaataact

SEQ ID NO: 110125 - DNA, 21 bp, Artificial sequence
  SiRNA target sequence
gttctttagaaaaaataactt

SEQ ID NO: 110126 - DNA, 21 bp, Artificial sequence
  SiRNA target sequence
ttctttagaaaaaataacttt

SEQ ID NO: 110127 - DNA, 21 bp, Artificial sequence
  SiRNA target sequence
tctttagaaaaaataactttt

SEQ ID NO: 110128 - DNA, 21 bp, Artificial sequence
  SiRNA target sequence
ctttagaaaaaataacttttt

SEQ ID NO: 110129 - DNA, 21 bp, Artificial sequence
  SiRNA target sequence
tttagaaaaaataactttttt

SEQ ID NO: 110130 - DNA, 21 bp, Artificial sequence
  SiRNA target sequence
ttagaaaaaataactttttta

SEQ ID NO: 110131 - DNA, 21 bp, Artificial sequence
  SiRNA target sequence
tagaaaaaataacttttttaa

SEQ ID NO: 110132 - DNA, 21 bp, Artificial sequence
  SiRNA target sequence
agaaaaaataacttttttaac

SEQ ID NO: 110133 - DNA, 21 bp, Artificial sequence
  SiRNA target sequence
gaaaaaataacttttttaaca

SEQ ID NO: 110134 - DNA, 21 bp, Artificial sequence
  SiRNA target sequence
aaaaaataacttttttaacac

SEQ ID NO: 110135 - DNA, 21 bp, Artificial sequence
  SiRNA target sequence
aaaaataacttttttaacacc

SEQ ID NO: 110136 - DNA, 21 bp, Artificial sequence
  SiRNA target sequence
aaaataacttttttaacacct

SEQ ID NO: 110137 - DNA, 21 bp, Artificial sequence
  SiRNA target sequence
aaataacttttttaacacctt

SEQ ID NO: 110138 - DNA, 21 bp, Artificial sequence
  SiRNA target sequence
aataacttttttaacaccttc

SEQ ID NO: 110139 - DNA, 21 bp, Artificial sequence
  SiRNA target sequence
ataacttttttaacaccttct

SEQ ID NO: 110140 - DNA, 21 bp, Artificial sequence
  SiRNA target sequence
taacttttttaacaccttctt

SEQ ID NO: 110141 - DNA, 21 bp, Artificial sequence
  SiRNA target sequence
aacttttttaacaccttcttc

SEQ ID NO: 110142 - DNA, 21 bp, Artificial sequence
  SiRNA target sequence
acttttttaacaccttcttca

SEQ ID NO: 110143 - DNA, 21 bp, Artificial sequence
  SiRNA target sequence
cttttttaacaccttcttcaa

SEQ ID NO: 110144 - DNA, 21 bp, Artificial sequence
  SiRNA target sequence
ttttttaacaccttcttcaaa

SEQ ID NO: 110145 - DNA, 21 bp, Artificial sequence
  SiRNA target sequence
tttttaacaccttcttcaaag

SEQ ID NO: 110146 - DNA, 21 bp, Artificial sequence
  SiRNA target sequence
ttttaacaccttcttcaaagc

SEQ ID NO: 110147 - DNA, 21 bp, Artificial sequence
  SiRNA target sequence
tttaacaccttcttcaaagca

SEQ ID NO: 110148 - DNA, 21 bp, Artificial sequence
  SiRNA target sequence
ttaacaccttcttcaaagcag

SEQ ID NO: 110149 - DNA, 21 bp, Artificial sequence
  SiRNA target sequence
taacaccttcttcaaagcagg

SEQ ID NO: 110150 - DNA, 21 bp, Artificial sequence
  SiRNA target sequence
aacaccttcttcaaagcagga

SEQ ID NO: 110151 - DNA, 21 bp, Artificial sequence
  SiRNA target sequence
acaccttcttcaaagcaggaa

SEQ ID NO: 110152 - DNA, 21 bp, Artificial sequence
  SiRNA target sequence
caccttcttcaaagcaggaaa

SEQ ID NO: 110153 - DNA, 21 bp, Artificial sequence
  SiRNA target sequence
accttcttcaaagcaggaaat

SEQ ID NO: 110154 - DNA, 21 bp, Artificial sequence
  SiRNA target sequence
ccttcttcaaagcaggaaatt

SEQ ID NO: 110155 - DNA, 21 bp, Artificial sequence
  SiRNA target sequence
cttcttcaaagcaggaaatta

SEQ ID NO: 110156 - DNA, 21 bp, Artificial sequence
  SiRNA target sequence
ttcttcaaagcaggaaattac

SEQ ID NO: 110157 - DNA, 21 bp, Artificial sequence
  SiRNA target sequence
tcttcaaagcaggaaattacc

SEQ ID NO: 110158 - DNA, 21 bp, Artificial sequence
  SiRNA target sequence
cttcaaagcaggaaattacct

SEQ ID NO: 110159 - DNA, 21 bp, Artificial sequence
  SiRNA target sequence
ttcaaagcaggaaattacctc

SEQ ID NO: 110160 - DNA, 21 bp, Artificial sequence
  SiRNA target sequence
tcaaagcaggaaattacctca

SEQ ID NO: 110161 - DNA, 21 bp, Artificial sequence
  SiRNA target sequence
caaagcaggaaattacctcat

SEQ ID NO: 110162 - DNA, 21 bp, Artificial sequence
  SiRNA target sequence
aaagcaggaaattacctcatc

SEQ ID NO: 110163 - DNA, 21 bp, Artificial sequence
  SiRNA target sequence
aagcaggaaattacctcatct

SEQ ID NO: 110164 - DNA, 21 bp, Artificial sequence
  SiRNA target sequence
agcaggaaattacctcatctt

SEQ ID NO: 110165 - DNA, 21 bp, Artificial sequence
  SiRNA target sequence
gcaggaaattacctcatcttc

SEQ ID NO: 110166 - DNA, 21 bp, Artificial sequence
  SiRNA target sequence
caggaaattacctcatcttcg

SEQ ID NO: 110167 - DNA, 21 bp, Artificial sequence
  SiRNA target sequence
aggaaattacctcatcttcga

SEQ ID NO: 110168 - DNA, 21 bp, Artificial sequence
  SiRNA target sequence
ggaaattacctcatcttcgat

SEQ ID NO: 110169 - DNA, 21 bp, Artificial sequence
  SiRNA target sequence
gaaattacctcatcttcgata

SEQ ID NO: 110170 - DNA, 21 bp, Artificial sequence
  SiRNA target sequence
aaattacctcatcttcgataa

SEQ ID NO: 110171 - DNA, 21 bp, Artificial sequence
  SiRNA target sequence
aattacctcatcttcgataat

SEQ ID NO: 110172 - DNA, 21 bp, Artificial sequence
  SiRNA target sequence
attacctcatcttcgataatt

SEQ ID NO: 110173 - DNA, 21 bp, Artificial sequence
  SiRNA target sequence
ttacctcatcttcgataattt

SEQ ID NO: 110174 - DNA, 21 bp, Artificial sequence
  SiRNA target sequence
tacctcatcttcgataatttt

SEQ ID NO: 110175 - DNA, 21 bp, Artificial sequence
  SiRNA target sequence
acctcatcttcgataattttt

SEQ ID NO: 110176 - DNA, 21 bp, Artificial sequence
  SiRNA target sequence
cctcatcttcgataattttta

SEQ ID NO: 110177 - DNA, 21 bp, Artificial sequence
  SiRNA target sequence
ctcatcttcgataatttttac

SEQ ID NO: 110178 - DNA, 21 bp, Artificial sequence
  SiRNA target sequence
tcatcttcgataatttttact

SEQ ID NO: 110179 - DNA, 21 bp, Artificial sequence
  SiRNA target sequence
catcttcgataatttttactt

SEQ ID NO: 110180 - DNA, 21 bp, Artificial sequence
  SiRNA target sequence
atcttcgataatttttacttc

SEQ ID NO: 110181 - DNA, 21 bp, Artificial sequence
  SiRNA target sequence
tcttcgataatttttacttct

SEQ ID NO: 110182 - DNA, 21 bp, Artificial sequence
  SiRNA target sequence
cttcgataatttttacttctt

SEQ ID NO: 110183 - DNA, 21 bp, Artificial sequence
  SiRNA target sequence
ttcgataatttttacttcttc

SEQ ID NO: 110184 - DNA, 21 bp, Artificial sequence
  SiRNA target sequence
tcgataatttttacttcttca

SEQ ID NO: 110185 - DNA, 21 bp, Artificial sequence
  SiRNA target sequence
cgataatttttacttcttcac

SEQ ID NO: 110186 - DNA, 21 bp, Artificial sequence
  SiRNA target sequence
gataatttttacttcttcaca

SEQ ID NO: 110187 - DNA, 21 bp, Artificial sequence
  SiRNA target sequence
ataatttttacttcttcacaa

SEQ ID NO: 110188 - DNA, 21 bp, Artificial sequence
  SiRNA target sequence
taatttttacttcttcacaag

SEQ ID NO: 110189 - DNA, 21 bp, Artificial sequence
  SiRNA target sequence
aatttttacttcttcacaagt

SEQ ID NO: 110190 - DNA, 21 bp, Artificial sequence
  SiRNA target sequence
atttttacttcttcacaagtc

SEQ ID NO: 110191 - DNA, 21 bp, Artificial sequence
  SiRNA target sequence
tttttacttcttcacaagtcg

SEQ ID NO: 110192 - DNA, 21 bp, Artificial sequence
  SiRNA target sequence
ttttacttcttcacaagtcgc

SEQ ID NO: 110193 - DNA, 21 bp, Artificial sequence
  SiRNA target sequence
tttacttcttcacaagtcgca

SEQ ID NO: 110194 - DNA, 21 bp, Artificial sequence
  SiRNA target sequence
ttacttcttcacaagtcgcaa

SEQ ID NO: 110195 - DNA, 21 bp, Artificial sequence
  SiRNA target sequence
tacttcttcacaagtcgcaaa

SEQ ID NO: 110196 - DNA, 21 bp, Artificial sequence
  SiRNA target sequence
acttcttcacaagtcgcaaat

SEQ ID NO: 110197 - DNA, 21 bp, Artificial sequence
  SiRNA target sequence
cttcttcacaagtcgcaaatt

SEQ ID NO: 110198 - DNA, 21 bp, Artificial sequence
  SiRNA target sequence
ttcttcacaagtcgcaaattt

SEQ ID NO: 110199 - DNA, 21 bp, Artificial sequence
  SiRNA target sequence
tcttcacaagtcgcaaatttt

SEQ ID NO: 110200 - DNA, 21 bp, Artificial sequence
  SiRNA target sequence
cttcacaagtcgcaaattttt

SEQ ID NO: 110201 - DNA, 21 bp, Artificial sequence
  SiRNA target sequence
ttcacaagtcgcaaatttttg

SEQ ID NO: 110202 - DNA, 21 bp, Artificial sequence
  SiRNA target sequence
tcacaagtcgcaaatttttgt

SEQ ID NO: 110203 - DNA, 21 bp, Artificial sequence
  SiRNA target sequence
cacaagtcgcaaatttttgta

SEQ ID NO: 110204 - DNA, 21 bp, Artificial sequence
  SiRNA target sequence
acaagtcgcaaatttttgtaa

SEQ ID NO: 110205 - DNA, 21 bp, Artificial sequence
  SiRNA target sequence
caagtcgcaaatttttgtaag

SEQ ID NO: 110206 - DNA, 21 bp, Artificial sequence
  SiRNA target sequence
aagtcgcaaatttttgtaagt

SEQ ID NO: 110207 - DNA, 21 bp, Artificial sequence
  SiRNA target sequence
agtcgcaaatttttgtaagtt

SEQ ID NO: 110208 - DNA, 21 bp, Artificial sequence
  SiRNA target sequence
gtcgcaaatttttgtaagtta

SEQ ID NO: 110209 - DNA, 21 bp, Artificial sequence
  SiRNA target sequence
tcgcaaatttttgtaagttat

SEQ ID NO: 110210 - DNA, 21 bp, Artificial sequence
  SiRNA target sequence
cgcaaatttttgtaagttatt

SEQ ID NO: 110211 - DNA, 21 bp, Artificial sequence
  SiRNA target sequence
gcaaatttttgtaagttattt

SEQ ID NO: 110212 - DNA, 21 bp, Artificial sequence
  SiRNA target sequence
caaatttttgtaagttatttt

SEQ ID NO: 110213 - DNA, 21 bp, Artificial sequence
  SiRNA target sequence
aaatttttgtaagttattttt

SEQ ID NO: 110214 - DNA, 21 bp, Artificial sequence
  SiRNA target sequence
aatttttgtaagttatttttt

SEQ ID NO: 110215 - DNA, 21 bp, Artificial sequence
  SiRNA target sequence
atttttgtaagttattttttg

SEQ ID NO: 110216 - DNA, 21 bp, Artificial sequence
  SiRNA target sequence
tttttgtaagttattttttgc

SEQ ID NO: 110217 - DNA, 21 bp, Artificial sequence
  SiRNA target sequence
ttttgtaagttattttttgct

SEQ ID NO: 110218 - DNA, 21 bp, Artificial sequence
  SiRNA target sequence
tttgtaagttattttttgctt

SEQ ID NO: 110219 - DNA, 21 bp, Artificial sequence
  SiRNA target sequence
ttgtaagttattttttgcttc

SEQ ID NO: 110220 - DNA, 21 bp, Artificial sequence
  SiRNA target sequence
tgtaagttattttttgcttct

SEQ ID NO: 110221 - DNA, 21 bp, Artificial sequence
  SiRNA target sequence
gtaagttattttttgcttctt

SEQ ID NO: 110222 - DNA, 21 bp, Artificial sequence
  SiRNA target sequence
taagttattttttgcttcttt

SEQ ID NO: 110223 - DNA, 21 bp, Artificial sequence
  SiRNA target sequence
aagttattttttgcttcttta

SEQ ID NO: 110224 - DNA, 21 bp, Artificial sequence
  SiRNA target sequence
agttattttttgcttctttaa

SEQ ID NO: 110225 - DNA, 21 bp, Artificial sequence
  SiRNA target sequence
gttattttttgcttctttaag

SEQ ID NO: 110226 - DNA, 21 bp, Artificial sequence
  SiRNA target sequence
ttattttttgcttctttaagg

SEQ ID NO: 110227 - DNA, 21 bp, Artificial sequence
  SiRNA target sequence
tattttttgcttctttaaggc

SEQ ID NO: 110228 - DNA, 21 bp, Artificial sequence
  SiRNA target sequence
attttttgcttctttaaggca

SEQ ID NO: 110229 - DNA, 21 bp, Artificial sequence
  SiRNA target sequence
ttttttgcttctttaaggcaa

SEQ ID NO: 110230 - DNA, 21 bp, Artificial sequence
  SiRNA target sequence
tttttgcttctttaaggcaat

SEQ ID NO: 110231 - DNA, 21 bp, Artificial sequence
  SiRNA target sequence
ttttgcttctttaaggcaatc

SEQ ID NO: 110232 - DNA, 21 bp, Artificial sequence
  SiRNA target sequence
tttgcttctttaaggcaatca

SEQ ID NO: 110233 - DNA, 21 bp, Artificial sequence
  SiRNA target sequence
ttgcttctttaaggcaatcat

SEQ ID NO: 110234 - DNA, 21 bp, Artificial sequence
  SiRNA target sequence
tgcttctttaaggcaatcatt

SEQ ID NO: 110235 - DNA, 21 bp, Artificial sequence
  SiRNA target sequence
gcttctttaaggcaatcatta

SEQ ID NO: 110236 - DNA, 21 bp, Artificial sequence
  SiRNA target sequence
cttctttaaggcaatcattat

SEQ ID NO: 110237 - DNA, 21 bp, Artificial sequence
  SiRNA target sequence
ttctttaaggcaatcattatt

SEQ ID NO: 110238 - DNA, 21 bp, Artificial sequence
  SiRNA target sequence
tctttaaggcaatcattattt

SEQ ID NO: 110239 - DNA, 21 bp, Artificial sequence
  SiRNA target sequence
ctttaaggcaatcattatttt

SEQ ID NO: 110240 - DNA, 21 bp, Artificial sequence
  SiRNA target sequence
tttaaggcaatcattattttt

SEQ ID NO: 110241 - DNA, 21 bp, Artificial sequence
  SiRNA target sequence
ttaaggcaatcattatttttt

SEQ ID NO: 110242 - DNA, 21 bp, Artificial sequence
  SiRNA target sequence
taaggcaatcattattttttt

SEQ ID NO: 110243 - DNA, 21 bp, Artificial sequence
  SiRNA target sequence
aaggcaatcattatttttttt

SEQ ID NO: 110244 - DNA, 21 bp, Artificial sequence
  SiRNA target sequence
aggcaatcattattttttttt

SEQ ID NO: 110245 - DNA, 21 bp, Artificial sequence
  SiRNA target sequence
ggcaatcattatttttttttt

SEQ ID NO: 110246 - DNA, 21 bp, Artificial sequence
  SiRNA target sequence
gcaatcattattttttttttc

SEQ ID NO: 110247 - DNA, 21 bp, Artificial sequence
  SiRNA target sequence
caatcattattttttttttca

SEQ ID NO: 110248 - DNA, 21 bp, Artificial sequence
  SiRNA target sequence
aatcattattttttttttcat

SEQ ID NO: 110249 - DNA, 21 bp, Artificial sequence
  SiRNA target sequence
atcattattttttttttcatt

SEQ ID NO: 110250 - DNA, 21 bp, Artificial sequence
  SiRNA target sequence
tcattattttttttttcatta

SEQ ID NO: 110251 - DNA, 21 bp, Artificial sequence
  SiRNA target sequence
cattattttttttttcattaa

SEQ ID NO: 110252 - DNA, 21 bp, Artificial sequence
  SiRNA target sequence
attattttttttttcattaat

SEQ ID NO: 110253 - DNA, 21 bp, Artificial sequence
  SiRNA target sequence
ttattttttttttcattaatt

SEQ ID NO: 110254 - DNA, 21 bp, Artificial sequence
  SiRNA target sequence
tattttttttttcattaattt

SEQ ID NO: 110255 - DNA, 21 bp, Artificial sequence
  SiRNA target sequence
attttttttttcattaatttc

SEQ ID NO: 110256 - DNA, 21 bp, Artificial sequence
  SiRNA target sequence
ttttttttttcattaatttcc

SEQ ID NO: 110257 - DNA, 21 bp, Artificial sequence
  SiRNA target sequence
tttttttttcattaatttcct

SEQ ID NO: 110258 - DNA, 21 bp, Artificial sequence
  SiRNA target sequence
ttttttttcattaatttcctc

SEQ ID NO: 110259 - DNA, 21 bp, Artificial sequence
  SiRNA target sequence
tttttttcattaatttcctcc

SEQ ID NO: 110260 - DNA, 21 bp, Artificial sequence
  SiRNA target sequence
ttttttcattaatttcctccg

SEQ ID NO: 110261 - DNA, 21 bp, Artificial sequence
  SiRNA target sequence
tttttcattaatttcctccgt

SEQ ID NO: 110262 - DNA, 21 bp, Artificial sequence
  SiRNA target sequence
ttttcattaatttcctccgtg

SEQ ID NO: 110263 - DNA, 21 bp, Artificial sequence
  SiRNA target sequence
tttcattaatttcctccgtgg

SEQ ID NO: 110264 - DNA, 21 bp, Artificial sequence
  SiRNA target sequence
ttcattaatttcctccgtgga

SEQ ID NO: 110265 - DNA, 21 bp, Artificial sequence
  SiRNA target sequence
tcattaatttcctccgtggat

SEQ ID NO: 110266 - DNA, 21 bp, Artificial sequence
  SiRNA target sequence
cattaatttcctccgtggatc

SEQ ID NO: 110267 - DNA, 21 bp, Artificial sequence
  SiRNA target sequence
attaatttcctccgtggatct

SEQ ID NO: 110268 - DNA, 21 bp, Artificial sequence
  SiRNA target sequence
ttaatttcctccgtggatctg

SEQ ID NO: 110269 - DNA, 21 bp, Artificial sequence
  SiRNA target sequence
taatttcctccgtggatctgt

SEQ ID NO: 110270 - DNA, 21 bp, Artificial sequence
  SiRNA target sequence
aatttcctccgtggatctgta

SEQ ID NO: 110271 - DNA, 21 bp, Artificial sequence
  SiRNA target sequence
atttcctccgtggatctgtaa

SEQ ID NO: 110272 - DNA, 21 bp, Artificial sequence
  SiRNA target sequence
tttcctccgtggatctgtaaa

SEQ ID NO: 110273 - DNA, 21 bp, Artificial sequence
  SiRNA target sequence
ttcctccgtggatctgtaaaa

SEQ ID NO: 110274 - DNA, 21 bp, Artificial sequence
  SiRNA target sequence
tcctccgtggatctgtaaaaa

SEQ ID NO: 110275 - DNA, 21 bp, Artificial sequence
  SiRNA target sequence
cctccgtggatctgtaaaaat

SEQ ID NO: 110276 - DNA, 21 bp, Artificial sequence
  SiRNA target sequence
ctccgtggatctgtaaaaatc

SEQ ID NO: 110277 - DNA, 21 bp, Artificial sequence
  SiRNA target sequence
tccgtggatctgtaaaaatcg

SEQ ID NO: 110278 - DNA, 21 bp, Artificial sequence
  SiRNA target sequence
ccgtggatctgtaaaaatcgt

SEQ ID NO: 110279 - DNA, 21 bp, Artificial sequence
  SiRNA target sequence
cgtggatctgtaaaaatcgtt

SEQ ID NO: 110280 - DNA, 21 bp, Artificial sequence
  SiRNA target sequence
gtggatctgtaaaaatcgtta

SEQ ID NO: 110281 - DNA, 21 bp, Artificial sequence
  SiRNA target sequence
tggatctgtaaaaatcgttaa

SEQ ID NO: 110282 - DNA, 21 bp, Artificial sequence
  SiRNA target sequence
ggatctgtaaaaatcgttaac

SEQ ID NO: 110283 - DNA, 21 bp, Artificial sequence
  SiRNA target sequence
gatctgtaaaaatcgttaaca

SEQ ID NO: 110284 - DNA, 21 bp, Artificial sequence
  SiRNA target sequence
atctgtaaaaatcgttaacat

SEQ ID NO: 110285 - DNA, 21 bp, Artificial sequence
  SiRNA target sequence
tctgtaaaaatcgttaacatc

SEQ ID NO: 110286 - DNA, 21 bp, Artificial sequence
  SiRNA target sequence
ctgtaaaaatcgttaacatct

SEQ ID NO: 110287 - DNA, 21 bp, Artificial sequence
  SiRNA target sequence
tgtaaaaatcgttaacatcta

SEQ ID NO: 110288 - DNA, 21 bp, Artificial sequence
  SiRNA target sequence
gtaaaaatcgttaacatctaa

SEQ ID NO: 110289 - DNA, 21 bp, Artificial sequence
  SiRNA target sequence
taaaaatcgttaacatctaaa

SEQ ID NO: 110290 - DNA, 21 bp, Artificial sequence
  SiRNA target sequence
aaaaatcgttaacatctaaac

SEQ ID NO: 110291 - DNA, 21 bp, Artificial sequence
  SiRNA target sequence
aaaatcgttaacatctaaaca

SEQ ID NO: 110292 - DNA, 21 bp, Artificial sequence
  SiRNA target sequence
aaatcgttaacatctaaacag

SEQ ID NO: 110293 - DNA, 21 bp, Artificial sequence
  SiRNA target sequence
aatcgttaacatctaaacagg

SEQ ID NO: 110294 - DNA, 21 bp, Artificial sequence
  SiRNA target sequence
atcgttaacatctaaacagga

SEQ ID NO: 110295 - DNA, 21 bp, Artificial sequence
  SiRNA target sequence
tcgttaacatctaaacaggag

SEQ ID NO: 110296 - DNA, 21 bp, Artificial sequence
  SiRNA target sequence
cgttaacatctaaacaggagt

SEQ ID NO: 110297 - DNA, 21 bp, Artificial sequence
  SiRNA target sequence
gttaacatctaaacaggagtg

SEQ ID NO: 110298 - DNA, 21 bp, Artificial sequence
  SiRNA target sequence
ttaacatctaaacaggagtgc

SEQ ID NO: 110299 - DNA, 21 bp, Artificial sequence
  SiRNA target sequence
taacatctaaacaggagtgcc

SEQ ID NO: 110300 - DNA, 21 bp, Artificial sequence
  SiRNA target sequence
aacatctaaacaggagtgccc

SEQ ID NO: 110301 - DNA, 21 bp, Artificial sequence
  SiRNA target sequence
acatctaaacaggagtgccca

SEQ ID NO: 110302 - DNA, 21 bp, Artificial sequence
  SiRNA target sequence
catctaaacaggagtgcccac

SEQ ID NO: 110303 - DNA, 21 bp, Artificial sequence
  SiRNA target sequence
atctaaacaggagtgcccaca

SEQ ID NO: 110304 - DNA, 21 bp, Artificial sequence
  SiRNA target sequence
tctaaacaggagtgcccacat

SEQ ID NO: 110305 - DNA, 21 bp, Artificial sequence
  SiRNA target sequence
ctaaacaggagtgcccacatg

SEQ ID NO: 110306 - DNA, 21 bp, Artificial sequence
  SiRNA target sequence
taaacaggagtgcccacatgt

SEQ ID NO: 110307 - DNA, 21 bp, Artificial sequence
  SiRNA target sequence
aaacaggagtgcccacatgtc

SEQ ID NO: 110308 - DNA, 21 bp, Artificial sequence
  SiRNA target sequence
aacaggagtgcccacatgtcc

SEQ ID NO: 110309 - DNA, 21 bp, Artificial sequence
  SiRNA target sequence
acaggagtgcccacatgtcct

SEQ ID NO: 110310 - DNA, 21 bp, Artificial sequence
  SiRNA target sequence
caggagtgcccacatgtcctg

SEQ ID NO: 110311 - DNA, 21 bp, Artificial sequence
  SiRNA target sequence
aggagtgcccacatgtcctgt

SEQ ID NO: 110312 - DNA, 21 bp, Artificial sequence
  SiRNA target sequence
ggagtgcccacatgtcctgta

SEQ ID NO: 110313 - DNA, 21 bp, Artificial sequence
  SiRNA target sequence
gagtgcccacatgtcctgtac

SEQ ID NO: 110314 - DNA, 21 bp, Artificial sequence
  SiRNA target sequence
agtgcccacatgtcctgtacg

SEQ ID NO: 110315 - DNA, 21 bp, Artificial sequence
  SiRNA target sequence
gtgcccacatgtcctgtacgt

SEQ ID NO: 110316 - DNA, 21 bp, Artificial sequence
  SiRNA target sequence
tgcccacatgtcctgtacgta

SEQ ID NO: 110317 - DNA, 21 bp, Artificial sequence
  SiRNA target sequence
gcccacatgtcctgtacgtat

SEQ ID NO: 110318 - DNA, 21 bp, Artificial sequence
  SiRNA target sequence
cccacatgtcctgtacgtatc

SEQ ID NO: 110319 - DNA, 21 bp, Artificial sequence
  SiRNA target sequence
ccacatgtcctgtacgtatca

SEQ ID NO: 110320 - DNA, 21 bp, Artificial sequence
  SiRNA target sequence
cacatgtcctgtacgtatcaa

SEQ ID NO: 110321 - DNA, 21 bp, Artificial sequence
  SiRNA target sequence
acatgtcctgtacgtatcaat

SEQ ID NO: 110322 - DNA, 21 bp, Artificial sequence
  SiRNA target sequence
catgtcctgtacgtatcaatt

SEQ ID NO: 110323 - DNA, 21 bp, Artificial sequence
  SiRNA target sequence
atgtcctgtacgtatcaattt

SEQ ID NO: 110324 - DNA, 21 bp, Artificial sequence
  SiRNA target sequence
tgtcctgtacgtatcaatttg

SEQ ID NO: 110325 - DNA, 21 bp, Artificial sequence
  SiRNA target sequence
gtcctgtacgtatcaatttgc

SEQ ID NO: 110326 - DNA, 21 bp, Artificial sequence
  SiRNA target sequence
tcctgtacgtatcaatttgca

SEQ ID NO: 110327 - DNA, 21 bp, Artificial sequence
  SiRNA target sequence
cctgtacgtatcaatttgcaa

SEQ ID NO: 110328 - DNA, 21 bp, Artificial sequence
  SiRNA target sequence
ctgtacgtatcaatttgcaag

SEQ ID NO: 110329 - DNA, 21 bp, Artificial sequence
  SiRNA target sequence
tgtacgtatcaatttgcaaga

SEQ ID NO: 110330 - DNA, 21 bp, Artificial sequence
  SiRNA target sequence
gtacgtatcaatttgcaagat

SEQ ID NO: 110331 - DNA, 21 bp, Artificial sequence
  SiRNA target sequence
tacgtatcaatttgcaagatg

SEQ ID NO: 110332 - DNA, 21 bp, Artificial sequence
  SiRNA target sequence
acgtatcaatttgcaagatga

SEQ ID NO: 110333 - DNA, 21 bp, Artificial sequence
  SiRNA target sequence
cgtatcaatttgcaagatgat

SEQ ID NO: 110334 - DNA, 21 bp, Artificial sequence
  SiRNA target sequence
gtatcaatttgcaagatgata

SEQ ID NO: 110335 - DNA, 21 bp, Artificial sequence
  SiRNA target sequence
tatcaatttgcaagatgatag

SEQ ID NO: 110336 - DNA, 21 bp, Artificial sequence
  SiRNA target sequence
atcaatttgcaagatgatagg

SEQ ID NO: 110337 - DNA, 21 bp, Artificial sequence
  SiRNA target sequence
tcaatttgcaagatgataggt

SEQ ID NO: 110338 - DNA, 21 bp, Artificial sequence
  SiRNA target sequence
caatttgcaagatgataggtc

SEQ ID NO: 110339 - DNA, 21 bp, Artificial sequence
  SiRNA target sequence
aatttgcaagatgataggtcc

SEQ ID NO: 110340 - DNA, 21 bp, Artificial sequence
  SiRNA target sequence
atttgcaagatgataggtcct

SEQ ID NO: 110341 - DNA, 21 bp, Artificial sequence
  SiRNA target sequence
tttgcaagatgataggtcctt

SEQ ID NO: 110342 - DNA, 21 bp, Artificial sequence
  SiRNA target sequence
ttgcaagatgataggtccttt

SEQ ID NO: 110343 - DNA, 21 bp, Artificial sequence
  SiRNA target sequence
tgcaagatgataggtcctttt

SEQ ID NO: 110344 - DNA, 21 bp, Artificial sequence
  SiRNA target sequence
gcaagatgataggtccttttt

SEQ ID NO: 110345 - DNA, 21 bp, Artificial sequence
  SiRNA target sequence
caagatgataggtcctttttc

SEQ ID NO: 110346 - DNA, 21 bp, Artificial sequence
  SiRNA target sequence
aagatgataggtcctttttct

SEQ ID NO: 110347 - DNA, 21 bp, Artificial sequence
  SiRNA target sequence
agatgataggtcctttttcta

SEQ ID NO: 110348 - DNA, 21 bp, Artificial sequence
  SiRNA target sequence
gatgataggtcctttttctat

SEQ ID NO: 110349 - DNA, 21 bp, Artificial sequence
  SiRNA target sequence
atgataggtcctttttctatt

SEQ ID NO: 110350 - DNA, 21 bp, Artificial sequence
  SiRNA target sequence
tgataggtcctttttctattg

SEQ ID NO: 110351 - DNA, 21 bp, Artificial sequence
  SiRNA target sequence
gataggtcctttttctattgc

SEQ ID NO: 110352 - DNA, 21 bp, Artificial sequence
  SiRNA target sequence
ataggtcctttttctattgca

SEQ ID NO: 110353 - DNA, 21 bp, Artificial sequence
  SiRNA target sequence
taggtcctttttctattgcat

SEQ ID NO: 110354 - DNA, 21 bp, Artificial sequence
  SiRNA target sequence
aggtcctttttctattgcatg

SEQ ID NO: 110355 - DNA, 21 bp, Artificial sequence
  SiRNA target sequence
ggtcctttttctattgcatgt

SEQ ID NO: 110356 - DNA, 21 bp, Artificial sequence
  SiRNA target sequence
gtcctttttctattgcatgtt

SEQ ID NO: 110357 - DNA, 21 bp, Artificial sequence
  SiRNA target sequence
tcctttttctattgcatgttg

SEQ ID NO: 110358 - DNA, 21 bp, Artificial sequence
  SiRNA target sequence
cctttttctattgcatgttgt

SEQ ID NO: 110359 - DNA, 21 bp, Artificial sequence
  SiRNA target sequence
ctttttctattgcatgttgtc

SEQ ID NO: 110360 - DNA, 21 bp, Artificial sequence
  SiRNA target sequence
tttttctattgcatgttgtct

SEQ ID NO: 110361 - DNA, 21 bp, Artificial sequence
  SiRNA target sequence
ttttctattgcatgttgtcta

SEQ ID NO: 110362 - DNA, 21 bp, Artificial sequence
  SiRNA target sequence
tttctattgcatgttgtctag

SEQ ID NO: 110363 - DNA, 21 bp, Artificial sequence
  SiRNA target sequence
ttctattgcatgttgtctagc

SEQ ID NO: 110364 - DNA, 21 bp, Artificial sequence
  SiRNA target sequence
tctattgcatgttgtctagca

SEQ ID NO: 110365 - DNA, 21 bp, Artificial sequence
  SiRNA target sequence
ctattgcatgttgtctagcaa

SEQ ID NO: 110366 - DNA, 21 bp, Artificial sequence
  SiRNA target sequence
tattgcatgttgtctagcaaa

SEQ ID NO: 110367 - DNA, 21 bp, Artificial sequence
  SiRNA target sequence
attgcatgttgtctagcaaat

SEQ ID NO: 110368 - DNA, 21 bp, Artificial sequence
  SiRNA target sequence
ttgcatgttgtctagcaaatg

SEQ ID NO: 110369 - DNA, 21 bp, Artificial sequence
  SiRNA target sequence
tgcatgttgtctagcaaatgt

SEQ ID NO: 110370 - DNA, 21 bp, Artificial sequence
  SiRNA target sequence
gcatgttgtctagcaaatgta

SEQ ID NO: 110371 - DNA, 21 bp, Artificial sequence
  SiRNA target sequence
catgttgtctagcaaatgtaa

SEQ ID NO: 110372 - DNA, 21 bp, Artificial sequence
  SiRNA target sequence
atgttgtctagcaaatgtaaa

SEQ ID NO: 110373 - DNA, 21 bp, Artificial sequence
  SiRNA target sequence
tgttgtctagcaaatgtaaat

SEQ ID NO: 110374 - DNA, 21 bp, Artificial sequence
  SiRNA target sequence
gttgtctagcaaatgtaaata

SEQ ID NO: 110375 - DNA, 21 bp, Artificial sequence
  SiRNA target sequence
ttgtctagcaaatgtaaatac

SEQ ID NO: 110376 - DNA, 21 bp, Artificial sequence
  SiRNA target sequence
tgtctagcaaatgtaaataca

SEQ ID NO: 110377 - DNA, 21 bp, Artificial sequence
  SiRNA target sequence
gtctagcaaatgtaaatacat

SEQ ID NO: 110378 - DNA, 21 bp, Artificial sequence
  SiRNA target sequence
tctagcaaatgtaaatacatc

SEQ ID NO: 110379 - DNA, 21 bp, Artificial sequence
  SiRNA target sequence
ctagcaaatgtaaatacatca

SEQ ID NO: 110380 - DNA, 21 bp, Artificial sequence
  SiRNA target sequence
tagcaaatgtaaatacatcaa

SEQ ID NO: 110381 - DNA, 21 bp, Artificial sequence
  SiRNA target sequence
agcaaatgtaaatacatcaat

SEQ ID NO: 110382 - DNA, 21 bp, Artificial sequence
  SiRNA target sequence
gcaaatgtaaatacatcaatc

SEQ ID NO: 110383 - DNA, 21 bp, Artificial sequence
  SiRNA target sequence
caaatgtaaatacatcaatca

SEQ ID NO: 110384 - DNA, 21 bp, Artificial sequence
  SiRNA target sequence
aaatgtaaatacatcaatcag

SEQ ID NO: 110385 - DNA, 21 bp, Artificial sequence
  SiRNA target sequence
aatgtaaatacatcaatcagt

SEQ ID NO: 110386 - DNA, 21 bp, Artificial sequence
  SiRNA target sequence
atgtaaatacatcaatcagtt

SEQ ID NO: 110387 - DNA, 21 bp, Artificial sequence
  SiRNA target sequence
tgtaaatacatcaatcagttg

SEQ ID NO: 110388 - DNA, 21 bp, Artificial sequence
  SiRNA target sequence
gtaaatacatcaatcagttga

SEQ ID NO: 110389 - DNA, 21 bp, Artificial sequence
  SiRNA target sequence
taaatacatcaatcagttgag

SEQ ID NO: 110390 - DNA, 21 bp, Artificial sequence
  SiRNA target sequence
aaatacatcaatcagttgagt

SEQ ID NO: 110391 - DNA, 21 bp, Artificial sequence
  SiRNA target sequence
aatacatcaatcagttgagtt

SEQ ID NO: 110392 - DNA, 21 bp, Artificial sequence
  SiRNA target sequence
atacatcaatcagttgagtta

SEQ ID NO: 110393 - DNA, 21 bp, Artificial sequence
  SiRNA target sequence
tacatcaatcagttgagttat

SEQ ID NO: 110394 - DNA, 21 bp, Artificial sequence
  SiRNA target sequence
acatcaatcagttgagttatg

SEQ ID NO: 110395 - DNA, 21 bp, Artificial sequence
  SiRNA target sequence
catcaatcagttgagttatgt

SEQ ID NO: 110396 - DNA, 21 bp, Artificial sequence
  SiRNA target sequence
atcaatcagttgagttatgtt

SEQ ID NO: 110397 - DNA, 21 bp, Artificial sequence
  SiRNA target sequence
tcaatcagttgagttatgttt

SEQ ID NO: 110398 - DNA, 21 bp, Artificial sequence
  SiRNA target sequence
caatcagttgagttatgtttt

SEQ ID NO: 110399 - DNA, 21 bp, Artificial sequence
  SiRNA target sequence
aatcagttgagttatgttttt

SEQ ID NO: 110400 - DNA, 21 bp, Artificial sequence
  SiRNA target sequence
atcagttgagttatgttttta

SEQ ID NO: 110401 - DNA, 21 bp, Artificial sequence
  SiRNA target sequence
tcagttgagttatgtttttat

SEQ ID NO: 110402 - DNA, 21 bp, Artificial sequence
  SiRNA target sequence
cagttgagttatgtttttatc

SEQ ID NO: 110403 - DNA, 21 bp, Artificial sequence
  SiRNA target sequence
agttgagttatgtttttatct

SEQ ID NO: 110404 - DNA, 21 bp, Artificial sequence
  SiRNA target sequence
gttgagttatgtttttatctg

SEQ ID NO: 110405 - DNA, 21 bp, Artificial sequence
  SiRNA target sequence
ttgagttatgtttttatctgt

SEQ ID NO: 110406 - DNA, 21 bp, Artificial sequence
  SiRNA target sequence
tgagttatgtttttatctgta

SEQ ID NO: 110407 - DNA, 21 bp, Artificial sequence
  SiRNA target sequence
gagttatgtttttatctgtaa

SEQ ID NO: 110408 - DNA, 21 bp, Artificial sequence
  SiRNA target sequence
agttatgtttttatctgtaag

SEQ ID NO: 110409 - DNA, 21 bp, Artificial sequence
  SiRNA target sequence
gttatgtttttatctgtaaga

SEQ ID NO: 110410 - DNA, 21 bp, Artificial sequence
  SiRNA target sequence
ttatgtttttatctgtaagac

SEQ ID NO: 110411 - DNA, 21 bp, Artificial sequence
  SiRNA target sequence
tatgtttttatctgtaagacg

SEQ ID NO: 110412 - DNA, 21 bp, Artificial sequence
  SiRNA target sequence
atgtttttatctgtaagacgt

SEQ ID NO: 110413 - DNA, 21 bp, Artificial sequence
  SiRNA target sequence
tgtttttatctgtaagacgta

SEQ ID NO: 110414 - DNA, 21 bp, Artificial sequence
  SiRNA target sequence
gtttttatctgtaagacgtat

SEQ ID NO: 110415 - DNA, 21 bp, Artificial sequence
  SiRNA target sequence
tttttatctgtaagacgtata

SEQ ID NO: 110416 - DNA, 21 bp, Artificial sequence
  SiRNA target sequence
ttttatctgtaagacgtatac

SEQ ID NO: 110417 - DNA, 21 bp, Artificial sequence
  SiRNA target sequence
tttatctgtaagacgtatacc

SEQ ID NO: 110418 - DNA, 21 bp, Artificial sequence
  SiRNA target sequence
ttatctgtaagacgtatacct

SEQ ID NO: 110419 - DNA, 21 bp, Artificial sequence
  SiRNA target sequence
tatctgtaagacgtatacctg

SEQ ID NO: 110420 - DNA, 21 bp, Artificial sequence
  SiRNA target sequence
atctgtaagacgtatacctgg

SEQ ID NO: 110421 - DNA, 21 bp, Artificial sequence
  SiRNA target sequence
tctgtaagacgtatacctgga

SEQ ID NO: 110422 - DNA, 21 bp, Artificial sequence
  SiRNA target sequence
ctgtaagacgtatacctggaa

SEQ ID NO: 110423 - DNA, 21 bp, Artificial sequence
  SiRNA target sequence
tgtaagacgtatacctggaat

SEQ ID NO: 110424 - DNA, 21 bp, Artificial sequence
  SiRNA target sequence
gtaagacgtatacctggaata

SEQ ID NO: 110425 - DNA, 21 bp, Artificial sequence
  SiRNA target sequence
taagacgtatacctggaatat

SEQ ID NO: 110426 - DNA, 21 bp, Artificial sequence
  SiRNA target sequence
aagacgtatacctggaatatt

SEQ ID NO: 110427 - DNA, 21 bp, Artificial sequence
  SiRNA target sequence
agacgtatacctggaatatta

SEQ ID NO: 110428 - DNA, 21 bp, Artificial sequence
  SiRNA target sequence
gacgtatacctggaatattat

SEQ ID NO: 110429 - DNA, 21 bp, Artificial sequence
  SiRNA target sequence
acgtatacctggaatattata

SEQ ID NO: 110430 - DNA, 21 bp, Artificial sequence
  SiRNA target sequence
cgtatacctggaatattatat

SEQ ID NO: 110431 - DNA, 21 bp, Artificial sequence
  SiRNA target sequence
gtatacctggaatattatatc

SEQ ID NO: 110432 - DNA, 21 bp, Artificial sequence
  SiRNA target sequence
tatacctggaatattatatcc

SEQ ID NO: 110433 - DNA, 21 bp, Artificial sequence
  SiRNA target sequence
atacctggaatattatatccc

SEQ ID NO: 110434 - DNA, 21 bp, Artificial sequence
  SiRNA target sequence
tacctggaatattatatcccc

SEQ ID NO: 110435 - DNA, 21 bp, Artificial sequence
  SiRNA target sequence
acctggaatattatatcccct

SEQ ID NO: 110436 - DNA, 21 bp, Artificial sequence
  SiRNA target sequence
cctggaatattatatcccctt

SEQ ID NO: 110437 - DNA, 21 bp, Artificial sequence
  SiRNA target sequence
ctggaatattatatccccttt

SEQ ID NO: 110438 - DNA, 21 bp, Artificial sequence
  SiRNA target sequence
tggaatattatatcccctttt

SEQ ID NO: 110439 - DNA, 21 bp, Artificial sequence
  SiRNA target sequence
ggaatattatatcccctttta

SEQ ID NO: 110440 - DNA, 21 bp, Artificial sequence
  SiRNA target sequence
gaatattatatccccttttaa

SEQ ID NO: 110441 - DNA, 21 bp, Artificial sequence
  SiRNA target sequence
aatattatatccccttttaaa

SEQ ID NO: 110442 - DNA, 21 bp, Artificial sequence
  SiRNA target sequence
atattatatccccttttaaaa

SEQ ID NO: 110443 - DNA, 21 bp, Artificial sequence
  SiRNA target sequence
tattatatccccttttaaaat

SEQ ID NO: 110444 - DNA, 21 bp, Artificial sequence
  SiRNA target sequence
attatatccccttttaaaata

SEQ ID NO: 110445 - DNA, 21 bp, Artificial sequence
  SiRNA target sequence
ttatatccccttttaaaatat

SEQ ID NO: 110446 - DNA, 21 bp, Artificial sequence
  SiRNA target sequence
tatatccccttttaaaatatt

SEQ ID NO: 110447 - DNA, 21 bp, Artificial sequence
  SiRNA target sequence
atatccccttttaaaatattc

SEQ ID NO: 110448 - DNA, 21 bp, Artificial sequence
  SiRNA target sequence
tatccccttttaaaatattca

SEQ ID NO: 110449 - DNA, 21 bp, Artificial sequence
  SiRNA target sequence
atccccttttaaaatattcag

SEQ ID NO: 110450 - DNA, 21 bp, Artificial sequence
  SiRNA target sequence
tccccttttaaaatattcagg

SEQ ID NO: 110451 - DNA, 21 bp, Artificial sequence
  SiRNA target sequence
ccccttttaaaatattcagga

SEQ ID NO: 110452 - DNA, 21 bp, Artificial sequence
  SiRNA target sequence
cccttttaaaatattcaggat

SEQ ID NO: 110453 - DNA, 21 bp, Artificial sequence
  SiRNA target sequence
ccttttaaaatattcaggata

SEQ ID NO: 110454 - DNA, 21 bp, Artificial sequence
  SiRNA target sequence
cttttaaaatattcaggatat

SEQ ID NO: 110455 - DNA, 21 bp, Artificial sequence
  SiRNA target sequence
ttttaaaatattcaggatatg

SEQ ID NO: 110456 - DNA, 21 bp, Artificial sequence
  SiRNA target sequence
tttaaaatattcaggatatgt

SEQ ID NO: 110457 - DNA, 21 bp, Artificial sequence
  SiRNA target sequence
ttaaaatattcaggatatgta

SEQ ID NO: 110458 - DNA, 21 bp, Artificial sequence
  SiRNA target sequence
taaaatattcaggatatgtag

SEQ ID NO: 110459 - DNA, 21 bp, Artificial sequence
  SiRNA target sequence
aaaatattcaggatatgtagt

SEQ ID NO: 110460 - DNA, 21 bp, Artificial sequence
  SiRNA target sequence
aaatattcaggatatgtagtg

SEQ ID NO: 110461 - DNA, 21 bp, Artificial sequence
  SiRNA target sequence
aatattcaggatatgtagtgg

SEQ ID NO: 110462 - DNA, 21 bp, Artificial sequence
  SiRNA target sequence
atattcaggatatgtagtgga

SEQ ID NO: 110463 - DNA, 21 bp, Artificial sequence
  SiRNA target sequence
tattcaggatatgtagtggaa

SEQ ID NO: 110464 - DNA, 21 bp, Artificial sequence
  SiRNA target sequence
attcaggatatgtagtggaat

SEQ ID NO: 110465 - DNA, 21 bp, Artificial sequence
  SiRNA target sequence
ttcaggatatgtagtggaatt

SEQ ID NO: 110466 - DNA, 21 bp, Artificial sequence
  SiRNA target sequence
tcaggatatgtagtggaatta

SEQ ID NO: 110467 - DNA, 21 bp, Artificial sequence
  SiRNA target sequence
caggatatgtagtggaattac

SEQ ID NO: 110468 - DNA, 21 bp, Artificial sequence
  SiRNA target sequence
aggatatgtagtggaattact

SEQ ID NO: 110469 - DNA, 21 bp, Artificial sequence
  SiRNA target sequence
ggatatgtagtggaattactt

SEQ ID NO: 110470 - DNA, 21 bp, Artificial sequence
  SiRNA target sequence
gatatgtagtggaattacttt

SEQ ID NO: 110471 - DNA, 21 bp, Artificial sequence
  SiRNA target sequence
atatgtagtggaattactttc

SEQ ID NO: 110472 - DNA, 21 bp, Artificial sequence
  SiRNA target sequence
tatgtagtggaattactttca

SEQ ID NO: 110473 - DNA, 21 bp, Artificial sequence
  SiRNA target sequence
atgtagtggaattactttcag

SEQ ID NO: 110474 - DNA, 21 bp, Artificial sequence
  SiRNA target sequence
tgtagtggaattactttcagg

SEQ ID NO: 110475 - DNA, 21 bp, Artificial sequence
  SiRNA target sequence
gtagtggaattactttcaggt

SEQ ID NO: 110476 - DNA, 21 bp, Artificial sequence
  SiRNA target sequence
tagtggaattactttcaggtg

SEQ ID NO: 110477 - DNA, 21 bp, Artificial sequence
  SiRNA target sequence
agtggaattactttcaggtgt

SEQ ID NO: 110478 - DNA, 21 bp, Artificial sequence
  SiRNA target sequence
gtggaattactttcaggtgtc

SEQ ID NO: 110479 - DNA, 21 bp, Artificial sequence
  SiRNA target sequence
tggaattactttcaggtgtcc

SEQ ID NO: 110480 - DNA, 21 bp, Artificial sequence
  SiRNA target sequence
ggaattactttcaggtgtcca

SEQ ID NO: 110481 - DNA, 21 bp, Artificial sequence
  SiRNA target sequence
gaattactttcaggtgtccac

SEQ ID NO: 110482 - DNA, 21 bp, Artificial sequence
  SiRNA target sequence
aattactttcaggtgtccaca

SEQ ID NO: 110483 - DNA, 21 bp, Artificial sequence
  SiRNA target sequence
attactttcaggtgtccacat

SEQ ID NO: 110484 - DNA, 21 bp, Artificial sequence
  SiRNA target sequence
ttactttcaggtgtccacata

SEQ ID NO: 110485 - DNA, 21 bp, Artificial sequence
  SiRNA target sequence
tactttcaggtgtccacatac

SEQ ID NO: 110486 - DNA, 21 bp, Artificial sequence
  SiRNA target sequence
actttcaggtgtccacatact

SEQ ID NO: 110487 - DNA, 21 bp, Artificial sequence
  SiRNA target sequence
ctttcaggtgtccacatacta

SEQ ID NO: 110488 - DNA, 21 bp, Artificial sequence
  SiRNA target sequence
tttcaggtgtccacatactat

SEQ ID NO: 110489 - DNA, 21 bp, Artificial sequence
  SiRNA target sequence
ttcaggtgtccacatactata

SEQ ID NO: 110490 - DNA, 21 bp, Artificial sequence
  SiRNA target sequence
tcaggtgtccacatactataa

SEQ ID NO: 110491 - DNA, 21 bp, Artificial sequence
  SiRNA target sequence
caggtgtccacatactataat

SEQ ID NO: 110492 - DNA, 21 bp, Artificial sequence
  SiRNA target sequence
aggtgtccacatactataatg

SEQ ID NO: 110493 - DNA, 21 bp, Artificial sequence
  SiRNA target sequence
ggtgtccacatactataatga

SEQ ID NO: 110494 - DNA, 21 bp, Artificial sequence
  SiRNA target sequence
gtgtccacatactataatgat

SEQ ID NO: 110495 - DNA, 21 bp, Artificial sequence
  SiRNA target sequence
tgtccacatactataatgatt

SEQ ID NO: 110496 - DNA, 21 bp, Artificial sequence
  SiRNA target sequence
gtccacatactataatgatta

SEQ ID NO: 110497 - DNA, 21 bp, Artificial sequence
  SiRNA target sequence
tccacatactataatgattat

SEQ ID NO: 110498 - DNA, 21 bp, Artificial sequence
  SiRNA target sequence
ccacatactataatgattatt

SEQ ID NO: 110499 - DNA, 21 bp, Artificial sequence
  SiRNA target sequence
cacatactataatgattattt

SEQ ID NO: 110500 - DNA, 21 bp, Artificial sequence
  SiRNA target sequence
acatactataatgattatttt

SEQ ID NO: 110501 - DNA, 21 bp, Artificial sequence
  SiRNA target sequence
catactataatgattattttc

SEQ ID NO: 110502 - DNA, 21 bp, Artificial sequence
  SiRNA target sequence
atactataatgattattttca

SEQ ID NO: 110503 - DNA, 21 bp, Artificial sequence
  SiRNA target sequence
tactataatgattattttcac

SEQ ID NO: 110504 - DNA, 21 bp, Artificial sequence
  SiRNA target sequence
actataatgattattttcaca

SEQ ID NO: 110505 - DNA, 21 bp, Artificial sequence
  SiRNA target sequence
ctataatgattattttcacat

SEQ ID NO: 110506 - DNA, 21 bp, Artificial sequence
  SiRNA target sequence
tataatgattattttcacata

SEQ ID NO: 110507 - DNA, 21 bp, Artificial sequence
  SiRNA target sequence
ataatgattattttcacatac

SEQ ID NO: 110508 - DNA, 21 bp, Artificial sequence
  SiRNA target sequence
taatgattattttcacataca

SEQ ID NO: 110509 - DNA, 21 bp, Artificial sequence
  SiRNA target sequence
aatgattattttcacatacat

SEQ ID NO: 110510 - DNA, 21 bp, Artificial sequence
  SiRNA target sequence
atgattattttcacatacata

SEQ ID NO: 110511 - DNA, 21 bp, Artificial sequence
  SiRNA target sequence
tgattattttcacatacataa

SEQ ID NO: 110512 - DNA, 21 bp, Artificial sequence
  SiRNA target sequence
gattattttcacatacataaa

SEQ ID NO: 110513 - DNA, 21 bp, Artificial sequence
  SiRNA target sequence
attattttcacatacataaac

SEQ ID NO: 110514 - DNA, 21 bp, Artificial sequence
  SiRNA target sequence
ttattttcacatacataaacc

SEQ ID NO: 110515 - DNA, 21 bp, Artificial sequence
  SiRNA target sequence
tattttcacatacataaacca

SEQ ID NO: 110516 - DNA, 21 bp, Artificial sequence
  SiRNA target sequence
attttcacatacataaaccac

SEQ ID NO: 110517 - DNA, 21 bp, Artificial sequence
  SiRNA target sequence
ttttcacatacataaaccaca

SEQ ID NO: 110518 - DNA, 21 bp, Artificial sequence
  SiRNA target sequence
tttcacatacataaaccacag

SEQ ID NO: 110519 - DNA, 21 bp, Artificial sequence
  SiRNA target sequence
ttcacatacataaaccacagg

SEQ ID NO: 110520 - DNA, 21 bp, Artificial sequence
  SiRNA target sequence
tcacatacataaaccacagga

SEQ ID NO: 110521 - DNA, 21 bp, Artificial sequence
  SiRNA target sequence
cacatacataaaccacaggaa

SEQ ID NO: 110522 - DNA, 21 bp, Artificial sequence
  SiRNA target sequence
acatacataaaccacaggaag

SEQ ID NO: 110523 - DNA, 21 bp, Artificial sequence
  SiRNA target sequence
catacataaaccacaggaagt

SEQ ID NO: 110524 - DNA, 21 bp, Artificial sequence
  SiRNA target sequence
atacataaaccacaggaagtt

SEQ ID NO: 110525 - DNA, 21 bp, Artificial sequence
  SiRNA target sequence
tacataaaccacaggaagttt

SEQ ID NO: 110526 - DNA, 21 bp, Artificial sequence
  SiRNA target sequence
acataaaccacaggaagtttc

SEQ ID NO: 110527 - DNA, 21 bp, Artificial sequence
  SiRNA target sequence
cataaaccacaggaagtttcc

SEQ ID NO: 110528 - DNA, 21 bp, Artificial sequence
  SiRNA target sequence
ataaaccacaggaagtttcca

SEQ ID NO: 110529 - DNA, 21 bp, Artificial sequence
  SiRNA target sequence
taaaccacaggaagtttccat

SEQ ID NO: 110530 - DNA, 21 bp, Artificial sequence
  SiRNA target sequence
aaaccacaggaagtttccata

SEQ ID NO: 110531 - DNA, 21 bp, Artificial sequence
  SiRNA target sequence
aaccacaggaagtttccataa

SEQ ID NO: 110532 - DNA, 21 bp, Artificial sequence
  SiRNA target sequence
accacaggaagtttccataat

SEQ ID NO: 110533 - DNA, 21 bp, Artificial sequence
  SiRNA target sequence
ccacaggaagtttccataatg

SEQ ID NO: 110534 - DNA, 21 bp, Artificial sequence
  SiRNA target sequence
cacaggaagtttccataatgc

SEQ ID NO: 110535 - DNA, 21 bp, Artificial sequence
  SiRNA target sequence
acaggaagtttccataatgca

SEQ ID NO: 110536 - DNA, 21 bp, Artificial sequence
  SiRNA target sequence
caggaagtttccataatgcag

SEQ ID NO: 110537 - DNA, 21 bp, Artificial sequence
  SiRNA target sequence
aggaagtttccataatgcagc

SEQ ID NO: 110538 - DNA, 21 bp, Artificial sequence
  SiRNA target sequence
ggaagtttccataatgcagcc

SEQ ID NO: 110539 - DNA, 21 bp, Artificial sequence
  SiRNA target sequence
gaagtttccataatgcagcca

SEQ ID NO: 110540 - DNA, 21 bp, Artificial sequence
  SiRNA target sequence
aagtttccataatgcagccat

SEQ ID NO: 110541 - DNA, 21 bp, Artificial sequence
  SiRNA target sequence
agtttccataatgcagccata

SEQ ID NO: 110542 - DNA, 21 bp, Artificial sequence
  SiRNA target sequence
gtttccataatgcagccatat

SEQ ID NO: 110543 - DNA, 21 bp, Artificial sequence
  SiRNA target sequence
tttccataatgcagccatatt

SEQ ID NO: 110544 - DNA, 21 bp, Artificial sequence
  SiRNA target sequence
ttccataatgcagccatattg

SEQ ID NO: 110545 - DNA, 21 bp, Artificial sequence
  SiRNA target sequence
tccataatgcagccatattga

SEQ ID NO: 110546 - DNA, 21 bp, Artificial sequence
  SiRNA target sequence
ccataatgcagccatattgaa

SEQ ID NO: 110547 - DNA, 21 bp, Artificial sequence
  SiRNA target sequence
cataatgcagccatattgaac

SEQ ID NO: 110548 - DNA, 21 bp, Artificial sequence
  SiRNA target sequence
ataatgcagccatattgaacg

SEQ ID NO: 110549 - DNA, 21 bp, Artificial sequence
  SiRNA target sequence
taatgcagccatattgaacga

SEQ ID NO: 110550 - DNA, 21 bp, Artificial sequence
  SiRNA target sequence
aatgcagccatattgaacgac

SEQ ID NO: 110551 - DNA, 21 bp, Artificial sequence
  SiRNA target sequence
atgcagccatattgaacgact

SEQ ID NO: 110552 - DNA, 21 bp, Artificial sequence
  SiRNA target sequence
tgcagccatattgaacgactc

SEQ ID NO: 110553 - DNA, 21 bp, Artificial sequence
  SiRNA target sequence
gcagccatattgaacgactcc

SEQ ID NO: 110554 - DNA, 21 bp, Artificial sequence
  SiRNA target sequence
cagccatattgaacgactccc

SEQ ID NO: 110555 - DNA, 21 bp, Artificial sequence
  SiRNA target sequence
agccatattgaacgactccca

SEQ ID NO: 110556 - DNA, 21 bp, Artificial sequence
  SiRNA target sequence
gccatattgaacgactcccag

SEQ ID NO: 110557 - DNA, 21 bp, Artificial sequence
  SiRNA target sequence
ccatattgaacgactcccaga

SEQ ID NO: 110558 - DNA, 21 bp, Artificial sequence
  SiRNA target sequence
catattgaacgactcccagac

SEQ ID NO: 110559 - DNA, 21 bp, Artificial sequence
  SiRNA target sequence
atattgaacgactcccagacc

SEQ ID NO: 110560 - DNA, 21 bp, Artificial sequence
  SiRNA target sequence
tattgaacgactcccagacct

SEQ ID NO: 110561 - DNA, 21 bp, Artificial sequence
  SiRNA target sequence
attgaacgactcccagacctg

SEQ ID NO: 110562 - DNA, 21 bp, Artificial sequence
  SiRNA target sequence
ttgaacgactcccagacctgt

SEQ ID NO: 110563 - DNA, 21 bp, Artificial sequence
  SiRNA target sequence
tgaacgactcccagacctgtc

SEQ ID NO: 110564 - DNA, 21 bp, Artificial sequence
  SiRNA target sequence
gaacgactcccagacctgtcc

SEQ ID NO: 110565 - DNA, 21 bp, Artificial sequence
  SiRNA target sequence
aacgactcccagacctgtccc

SEQ ID NO: 110566 - DNA, 21 bp, Artificial sequence
  SiRNA target sequence
acgactcccagacctgtccct

SEQ ID NO: 110567 - DNA, 21 bp, Artificial sequence
  SiRNA target sequence
cgactcccagacctgtccctg

SEQ ID NO: 110568 - DNA, 21 bp, Artificial sequence
  SiRNA target sequence
gactcccagacctgtccctga

SEQ ID NO: 110569 - DNA, 21 bp, Artificial sequence
  SiRNA target sequence
actcccagacctgtccctgat

SEQ ID NO: 110570 - DNA, 21 bp, Artificial sequence
  SiRNA target sequence
ctcccagacctgtccctgatt

SEQ ID NO: 110571 - DNA, 21 bp, Artificial sequence
  SiRNA target sequence
tcccagacctgtccctgattt

SEQ ID NO: 110572 - DNA, 21 bp, Artificial sequence
  SiRNA target sequence
cccagacctgtccctgatttg

SEQ ID NO: 110573 - DNA, 21 bp, Artificial sequence
  SiRNA target sequence
ccagacctgtccctgatttgc

SEQ ID NO: 110574 - DNA, 21 bp, Artificial sequence
  SiRNA target sequence
cagacctgtccctgatttgca

SEQ ID NO: 110575 - DNA, 21 bp, Artificial sequence
  SiRNA target sequence
agacctgtccctgatttgcag

SEQ ID NO: 110576 - DNA, 21 bp, Artificial sequence
  SiRNA target sequence
gacctgtccctgatttgcagc

SEQ ID NO: 110577 - DNA, 21 bp, Artificial sequence
  SiRNA target sequence
acctgtccctgatttgcagca

SEQ ID NO: 110578 - DNA, 21 bp, Artificial sequence
  SiRNA target sequence
cctgtccctgatttgcagcac

SEQ ID NO: 110579 - DNA, 21 bp, Artificial sequence
  SiRNA target sequence
ctgtccctgatttgcagcacc

SEQ ID NO: 110580 - DNA, 21 bp, Artificial sequence
  SiRNA target sequence
tgtccctgatttgcagcacca

SEQ ID NO: 110581 - DNA, 21 bp, Artificial sequence
  SiRNA target sequence
gtccctgatttgcagcaccat

SEQ ID NO: 110582 - DNA, 21 bp, Artificial sequence
  SiRNA target sequence
tccctgatttgcagcaccatc

SEQ ID NO: 110583 - DNA, 21 bp, Artificial sequence
  SiRNA target sequence
ccctgatttgcagcaccatcc

SEQ ID NO: 110584 - DNA, 21 bp, Artificial sequence
  SiRNA target sequence
cctgatttgcagcaccatccc

SEQ ID NO: 110585 - DNA, 21 bp, Artificial sequence
  SiRNA target sequence
ctgatttgcagcaccatcccc

SEQ ID NO: 110586 - DNA, 21 bp, Artificial sequence
  SiRNA target sequence
tgatttgcagcaccatccccg

SEQ ID NO: 110587 - DNA, 21 bp, Artificial sequence
  SiRNA target sequence
gatttgcagcaccatccccga

SEQ ID NO: 110588 - DNA, 21 bp, Artificial sequence
  SiRNA target sequence
atttgcagcaccatccccgaa

SEQ ID NO: 110589 - DNA, 21 bp, Artificial sequence
  SiRNA target sequence
tttgcagcaccatccccgaaa

SEQ ID NO: 110590 - DNA, 21 bp, Artificial sequence
  SiRNA target sequence
ttgcagcaccatccccgaaaa

SEQ ID NO: 110591 - DNA, 21 bp, Artificial sequence
  SiRNA target sequence
tgcagcaccatccccgaaaaa

SEQ ID NO: 110592 - DNA, 21 bp, Artificial sequence
  SiRNA target sequence
gcagcaccatccccgaaaaat

SEQ ID NO: 110593 - DNA, 21 bp, Artificial sequence
  SiRNA target sequence
cagcaccatccccgaaaaata

SEQ ID NO: 110594 - DNA, 21 bp, Artificial sequence
  SiRNA target sequence
agcaccatccccgaaaaatac

SEQ ID NO: 110595 - DNA, 21 bp, Artificial sequence
  SiRNA target sequence
gcaccatccccgaaaaataca

SEQ ID NO: 110596 - DNA, 21 bp, Artificial sequence
  SiRNA target sequence
caccatccccgaaaaatacaa

SEQ ID NO: 110597 - DNA, 21 bp, Artificial sequence
  SiRNA target sequence
accatccccgaaaaatacaaa

SEQ ID NO: 110598 - DNA, 21 bp, Artificial sequence
  SiRNA target sequence
ccatccccgaaaaatacaaat

SEQ ID NO: 110599 - DNA, 21 bp, Artificial sequence
  SiRNA target sequence
catccccgaaaaatacaaatg

SEQ ID NO: 110600 - DNA, 21 bp, Artificial sequence
  SiRNA target sequence
atccccgaaaaatacaaatgc

SEQ ID NO: 110601 - DNA, 21 bp, Artificial sequence
  SiRNA target sequence
tccccgaaaaatacaaatgct

SEQ ID NO: 110602 - DNA, 21 bp, Artificial sequence
  SiRNA target sequence
ccccgaaaaatacaaatgcta

SEQ ID NO: 110603 - DNA, 21 bp, Artificial sequence
  SiRNA target sequence
cccgaaaaatacaaatgctac

SEQ ID NO: 110604 - DNA, 21 bp, Artificial sequence
  SiRNA target sequence
ccgaaaaatacaaatgctaca

SEQ ID NO: 110605 - DNA, 21 bp, Artificial sequence
  SiRNA target sequence
cgaaaaatacaaatgctacat

SEQ ID NO: 110606 - DNA, 21 bp, Artificial sequence
  SiRNA target sequence
gaaaaatacaaatgctacatt

SEQ ID NO: 110607 - DNA, 21 bp, Artificial sequence
  SiRNA target sequence
aaaaatacaaatgctacattt

SEQ ID NO: 110608 - DNA, 21 bp, Artificial sequence
  SiRNA target sequence
aaaatacaaatgctacatttt

SEQ ID NO: 110609 - DNA, 21 bp, Artificial sequence
  SiRNA target sequence
aaatacaaatgctacattttt

SEQ ID NO: 110610 - DNA, 21 bp, Artificial sequence
  SiRNA target sequence
aatacaaatgctacatttttt

SEQ ID NO: 110611 - DNA, 21 bp, Artificial sequence
  SiRNA target sequence
atacaaatgctacatttttta

SEQ ID NO: 110612 - DNA, 21 bp, Artificial sequence
  SiRNA target sequence
tacaaatgctacattttttac

SEQ ID NO: 110613 - DNA, 21 bp, Artificial sequence
  SiRNA target sequence
acaaatgctacattttttact

SEQ ID NO: 110614 - DNA, 21 bp, Artificial sequence
  SiRNA target sequence
caaatgctacattttttactt

SEQ ID NO: 110615 - DNA, 21 bp, Artificial sequence
  SiRNA target sequence
aaatgctacattttttacttt

SEQ ID NO: 110616 - DNA, 21 bp, Artificial sequence
  SiRNA target sequence
aatgctacattttttactttt

SEQ ID NO: 110617 - DNA, 21 bp, Artificial sequence
  SiRNA target sequence
atgctacattttttacttttt

SEQ ID NO: 110618 - DNA, 21 bp, Artificial sequence
  SiRNA target sequence
tgctacattttttactttttt

SEQ ID NO: 110619 - DNA, 21 bp, Artificial sequence
  SiRNA target sequence
gctacattttttactttttta

SEQ ID NO: 110620 - DNA, 21 bp, Artificial sequence
  SiRNA target sequence
ctacattttttacttttttat

SEQ ID NO: 110621 - DNA, 21 bp, Artificial sequence
  SiRNA target sequence
tacattttttacttttttata

SEQ ID NO: 110622 - DNA, 21 bp, Artificial sequence
  SiRNA target sequence
acattttttacttttttatat

SEQ ID NO: 110623 - DNA, 21 bp, Artificial sequence
  SiRNA target sequence
cattttttacttttttatatt

SEQ ID NO: 110624 - DNA, 21 bp, Artificial sequence
  SiRNA target sequence
attttttacttttttatattg

SEQ ID NO: 110625 - DNA, 21 bp, Artificial sequence
  SiRNA target sequence
ttttttacttttttatattgt

SEQ ID NO: 110626 - DNA, 21 bp, Artificial sequence
  SiRNA target sequence
tttttacttttttatattgta

SEQ ID NO: 110627 - DNA, 21 bp, Artificial sequence
  SiRNA target sequence
ttttacttttttatattgtaa

SEQ ID NO: 110628 - DNA, 21 bp, Artificial sequence
  SiRNA target sequence
tttacttttttatattgtaaa

SEQ ID NO: 110629 - DNA, 21 bp, Artificial sequence
  SiRNA target sequence
ttacttttttatattgtaaag

SEQ ID NO: 110630 - DNA, 21 bp, Artificial sequence
  SiRNA target sequence
tacttttttatattgtaaagc

SEQ ID NO: 110631 - DNA, 21 bp, Artificial sequence
  SiRNA target sequence
acttttttatattgtaaagca

SEQ ID NO: 110632 - DNA, 21 bp, Artificial sequence
  SiRNA target sequence
cttttttatattgtaaagcaa

SEQ ID NO: 110633 - DNA, 21 bp, Artificial sequence
  SiRNA target sequence
ttttttatattgtaaagcaaa

SEQ ID NO: 110634 - DNA, 21 bp, Artificial sequence
  SiRNA target sequence
tttttatattgtaaagcaaat

SEQ ID NO: 110635 - DNA, 21 bp, Artificial sequence
  SiRNA target sequence
ttttatattgtaaagcaaatc

SEQ ID NO: 110636 - DNA, 21 bp, Artificial sequence
  SiRNA target sequence
tttatattgtaaagcaaatcc

SEQ ID NO: 110637 - DNA, 21 bp, Artificial sequence
  SiRNA target sequence
ttatattgtaaagcaaatccc

SEQ ID NO: 110638 - DNA, 21 bp, Artificial sequence
  SiRNA target sequence
tatattgtaaagcaaatccca

SEQ ID NO: 110639 - DNA, 21 bp, Artificial sequence
  SiRNA target sequence
atattgtaaagcaaatcccaa

SEQ ID NO: 110640 - DNA, 21 bp, Artificial sequence
  SiRNA target sequence
tattgtaaagcaaatcccaat

SEQ ID NO: 110641 - DNA, 21 bp, Artificial sequence
  SiRNA target sequence
attgtaaagcaaatcccaatc

SEQ ID NO: 110642 - DNA, 21 bp, Artificial sequence
  SiRNA target sequence
ttgtaaagcaaatcccaatcc

SEQ ID NO: 110643 - DNA, 21 bp, Artificial sequence
  SiRNA target sequence
tgtaaagcaaatcccaatcct

SEQ ID NO: 110644 - DNA, 21 bp, Artificial sequence
  SiRNA target sequence
gtaaagcaaatcccaatcctg

SEQ ID NO: 110645 - DNA, 21 bp, Artificial sequence
  SiRNA target sequence
taaagcaaatcccaatcctgt

SEQ ID NO: 110646 - DNA, 21 bp, Artificial sequence
  SiRNA target sequence
aaagcaaatcccaatcctgta

SEQ ID NO: 110647 - DNA, 21 bp, Artificial sequence
  SiRNA target sequence
aagcaaatcccaatcctgtac

SEQ ID NO: 110648 - DNA, 21 bp, Artificial sequence
  SiRNA target sequence
agcaaatcccaatcctgtacc

SEQ ID NO: 110649 - DNA, 21 bp, Artificial sequence
  SiRNA target sequence
gcaaatcccaatcctgtacca

SEQ ID NO: 110650 - DNA, 21 bp, Artificial sequence
  SiRNA target sequence
caaatcccaatcctgtaccaa

SEQ ID NO: 110651 - DNA, 21 bp, Artificial sequence
  SiRNA target sequence
aaatcccaatcctgtaccaag

SEQ ID NO: 110652 - DNA, 21 bp, Artificial sequence
  SiRNA target sequence
aatcccaatcctgtaccaagc

SEQ ID NO: 110653 - DNA, 21 bp, Artificial sequence
  SiRNA target sequence
atcccaatcctgtaccaagcg

SEQ ID NO: 110654 - DNA, 21 bp, Artificial sequence
  SiRNA target sequence
tcccaatcctgtaccaagcga

SEQ ID NO: 110655 - DNA, 21 bp, Artificial sequence
  SiRNA target sequence
cccaatcctgtaccaagcgat

SEQ ID NO: 110656 - DNA, 21 bp, Artificial sequence
  SiRNA target sequence
ccaatcctgtaccaagcgata

SEQ ID NO: 110657 - DNA, 21 bp, Artificial sequence
  SiRNA target sequence
caatcctgtaccaagcgatac

SEQ ID NO: 110658 - DNA, 21 bp, Artificial sequence
  SiRNA target sequence
aatcctgtaccaagcgatacc

SEQ ID NO: 110659 - DNA, 21 bp, Artificial sequence
  SiRNA target sequence
atcctgtaccaagcgatacct

SEQ ID NO: 110660 - DNA, 21 bp, Artificial sequence
  SiRNA target sequence
tcctgtaccaagcgatacctg

SEQ ID NO: 110661 - DNA, 21 bp, Artificial sequence
  SiRNA target sequence
cctgtaccaagcgatacctgc

SEQ ID NO: 110662 - DNA, 21 bp, Artificial sequence
  SiRNA target sequence
ctgtaccaagcgatacctgcg

SEQ ID NO: 110663 - DNA, 21 bp, Artificial sequence
  SiRNA target sequence
tgtaccaagcgatacctgcgc

SEQ ID NO: 110664 - DNA, 21 bp, Artificial sequence
  SiRNA target sequence
gtaccaagcgatacctgcgca

SEQ ID NO: 110665 - DNA, 21 bp, Artificial sequence
  SiRNA target sequence
taccaagcgatacctgcgcac

SEQ ID NO: 110666 - DNA, 21 bp, Artificial sequence
  SiRNA target sequence
accaagcgatacctgcgcacc

SEQ ID NO: 110667 - DNA, 21 bp, Artificial sequence
  SiRNA target sequence
ccaagcgatacctgcgcacct

SEQ ID NO: 110668 - DNA, 21 bp, Artificial sequence
  SiRNA target sequence
caagcgatacctgcgcaccta

SEQ ID NO: 110669 - DNA, 21 bp, Artificial sequence
  SiRNA target sequence
aagcgatacctgcgcacctac

SEQ ID NO: 110670 - DNA, 21 bp, Artificial sequence
  SiRNA target sequence
agcgatacctgcgcacctact

SEQ ID NO: 110671 - DNA, 21 bp, Artificial sequence
  SiRNA target sequence
gcgatacctgcgcacctacta

SEQ ID NO: 110672 - DNA, 21 bp, Artificial sequence
  SiRNA target sequence
cgatacctgcgcacctactat

SEQ ID NO: 110673 - DNA, 21 bp, Artificial sequence
  SiRNA target sequence
gatacctgcgcacctactata

SEQ ID NO: 110674 - DNA, 21 bp, Artificial sequence
  SiRNA target sequence
atacctgcgcacctactatac

SEQ ID NO: 110675 - DNA, 21 bp, Artificial sequence
  SiRNA target sequence
tacctgcgcacctactatacc

SEQ ID NO: 110676 - DNA, 21 bp, Artificial sequence
  SiRNA target sequence
acctgcgcacctactataccg

SEQ ID NO: 110677 - DNA, 21 bp, Artificial sequence
  SiRNA target sequence
cctgcgcacctactataccgt

SEQ ID NO: 110678 - DNA, 21 bp, Artificial sequence
  SiRNA target sequence
ctgcgcacctactataccgtg

SEQ ID NO: 110679 - DNA, 21 bp, Artificial sequence
  SiRNA target sequence
tgcgcacctactataccgtgt

SEQ ID NO: 110680 - DNA, 21 bp, Artificial sequence
  SiRNA target sequence
gcgcacctactataccgtgtc

SEQ ID NO: 110681 - DNA, 21 bp, Artificial sequence
  SiRNA target sequence
cgcacctactataccgtgtcc

SEQ ID NO: 110682 - DNA, 21 bp, Artificial sequence
  SiRNA target sequence
gcacctactataccgtgtccc

SEQ ID NO: 110683 - DNA, 21 bp, Artificial sequence
  SiRNA target sequence
cacctactataccgtgtcccc

SEQ ID NO: 110684 - DNA, 21 bp, Artificial sequence
  SiRNA target sequence
acctactataccgtgtccccc

SEQ ID NO: 110685 - DNA, 21 bp, Artificial sequence
  SiRNA target sequence
cctactataccgtgtccccca

SEQ ID NO: 110686 - DNA, 21 bp, Artificial sequence
  SiRNA target sequence
ctactataccgtgtcccccat

SEQ ID NO: 110687 - DNA, 21 bp, Artificial sequence
  SiRNA target sequence
tactataccgtgtcccccata

SEQ ID NO: 110688 - DNA, 21 bp, Artificial sequence
  SiRNA target sequence
actataccgtgtcccccataa

SEQ ID NO: 110689 - DNA, 21 bp, Artificial sequence
  SiRNA target sequence
ctataccgtgtcccccataaa

SEQ ID NO: 110690 - DNA, 21 bp, Artificial sequence
  SiRNA target sequence
tataccgtgtcccccataaaa

SEQ ID NO: 110691 - DNA, 21 bp, Artificial sequence
  SiRNA target sequence
ataccgtgtcccccataaaat

SEQ ID NO: 110692 - DNA, 21 bp, Artificial sequence
  SiRNA target sequence
taccgtgtcccccataaaatt

SEQ ID NO: 110693 - DNA, 21 bp, Artificial sequence
  SiRNA target sequence
accgtgtcccccataaaattg

SEQ ID NO: 110694 - DNA, 21 bp, Artificial sequence
  SiRNA target sequence
ccgtgtcccccataaaattgg

SEQ ID NO: 110695 - DNA, 21 bp, Artificial sequence
  SiRNA target sequence
cgtgtcccccataaaattggt

SEQ ID NO: 110696 - DNA, 21 bp, Artificial sequence
  SiRNA target sequence
gtgtcccccataaaattggtc

SEQ ID NO: 110697 - DNA, 21 bp, Artificial sequence
  SiRNA target sequence
tgtcccccataaaattggtca

SEQ ID NO: 110698 - DNA, 21 bp, Artificial sequence
  SiRNA target sequence
gtcccccataaaattggtcat

SEQ ID NO: 110699 - DNA, 21 bp, Artificial sequence
  SiRNA target sequence
tcccccataaaattggtcatt

SEQ ID NO: 110700 - DNA, 21 bp, Artificial sequence
  SiRNA target sequence
cccccataaaattggtcatta

SEQ ID NO: 110701 - DNA, 21 bp, Artificial sequence
  SiRNA target sequence
ccccataaaattggtcattat

SEQ ID NO: 110702 - DNA, 21 bp, Artificial sequence
  SiRNA target sequence
cccataaaattggtcattata

SEQ ID NO: 110703 - DNA, 21 bp, Artificial sequence
  SiRNA target sequence
ccataaaattggtcattatac

SEQ ID NO: 110704 - DNA, 21 bp, Artificial sequence
  SiRNA target sequence
cataaaattggtcattataca

SEQ ID NO: 110705 - DNA, 21 bp, Artificial sequence
  SiRNA target sequence
ataaaattggtcattatacaa

SEQ ID NO: 110706 - DNA, 21 bp, Artificial sequence
  SiRNA target sequence
taaaattggtcattatacaaa

SEQ ID NO: 110707 - DNA, 21 bp, Artificial sequence
  SiRNA target sequence
aaaattggtcattatacaaat

SEQ ID NO: 110708 - DNA, 21 bp, Artificial sequence
  SiRNA target sequence
aaattggtcattatacaaatg

SEQ ID NO: 110709 - DNA, 21 bp, Artificial sequence
  SiRNA target sequence
aattggtcattatacaaatgc

SEQ ID NO: 110710 - DNA, 21 bp, Artificial sequence
  SiRNA target sequence
attggtcattatacaaatgca

SEQ ID NO: 110711 - DNA, 21 bp, Artificial sequence
  SiRNA target sequence
ttggtcattatacaaatgcat

SEQ ID NO: 110712 - DNA, 21 bp, Artificial sequence
  SiRNA target sequence
tggtcattatacaaatgcatc

SEQ ID NO: 110713 - DNA, 21 bp, Artificial sequence
  SiRNA target sequence
ggtcattatacaaatgcatcg

SEQ ID NO: 110714 - DNA, 21 bp, Artificial sequence
  SiRNA target sequence
gtcattatacaaatgcatcga

SEQ ID NO: 110715 - DNA, 21 bp, Artificial sequence
  SiRNA target sequence
tcattatacaaatgcatcgat

SEQ ID NO: 110716 - DNA, 21 bp, Artificial sequence
  SiRNA target sequence
cattatacaaatgcatcgatc

SEQ ID NO: 110717 - DNA, 21 bp, Artificial sequence
  SiRNA target sequence
attatacaaatgcatcgatcc

SEQ ID NO: 110718 - DNA, 21 bp, Artificial sequence
  SiRNA target sequence
ttatacaaatgcatcgatcct

SEQ ID NO: 110719 - DNA, 21 bp, Artificial sequence
  SiRNA target sequence
tatacaaatgcatcgatcctc

SEQ ID NO: 110720 - DNA, 21 bp, Artificial sequence
  SiRNA target sequence
atacaaatgcatcgatcctcc

SEQ ID NO: 110721 - DNA, 21 bp, Artificial sequence
  SiRNA target sequence
tacaaatgcatcgatcctcct

SEQ ID NO: 110722 - DNA, 21 bp, Artificial sequence
  SiRNA target sequence
acaaatgcatcgatcctcctt

SEQ ID NO: 110723 - DNA, 21 bp, Artificial sequence
  SiRNA target sequence
caaatgcatcgatcctccttt

SEQ ID NO: 110724 - DNA, 21 bp, Artificial sequence
  SiRNA target sequence
aaatgcatcgatcctcctttt

SEQ ID NO: 110725 - DNA, 21 bp, Artificial sequence
  SiRNA target sequence
aatgcatcgatcctccttttc

SEQ ID NO: 110726 - DNA, 21 bp, Artificial sequence
  SiRNA target sequence
atgcatcgatcctccttttcc

SEQ ID NO: 110727 - DNA, 21 bp, Artificial sequence
  SiRNA target sequence
tgcatcgatcctccttttcct

SEQ ID NO: 110728 - DNA, 21 bp, Artificial sequence
  SiRNA target sequence
gcatcgatcctccttttcctt

SEQ ID NO: 110729 - DNA, 21 bp, Artificial sequence
  SiRNA target sequence
catcgatcctccttttccttt

SEQ ID NO: 110730 - DNA, 21 bp, Artificial sequence
  SiRNA target sequence
atcgatcctccttttcctttg

SEQ ID NO: 110731 - DNA, 21 bp, Artificial sequence
  SiRNA target sequence
tcgatcctccttttcctttgc

SEQ ID NO: 110732 - DNA, 21 bp, Artificial sequence
  SiRNA target sequence
cgatcctccttttcctttgca

SEQ ID NO: 110733 - DNA, 21 bp, Artificial sequence
  SiRNA target sequence
gatcctccttttcctttgcaa

SEQ ID NO: 110734 - DNA, 21 bp, Artificial sequence
  SiRNA target sequence
atcctccttttcctttgcaat

SEQ ID NO: 110735 - DNA, 21 bp, Artificial sequence
  SiRNA target sequence
tcctccttttcctttgcaatt

SEQ ID NO: 110736 - DNA, 21 bp, Artificial sequence
  SiRNA target sequence
cctccttttcctttgcaatta

SEQ ID NO: 110737 - DNA, 21 bp, Artificial sequence
  SiRNA target sequence
ctccttttcctttgcaattac

SEQ ID NO: 110738 - DNA, 21 bp, Artificial sequence
  SiRNA target sequence
tccttttcctttgcaattacc

SEQ ID NO: 110739 - DNA, 21 bp, Artificial sequence
  SiRNA target sequence
ccttttcctttgcaattacca

SEQ ID NO: 110740 - DNA, 21 bp, Artificial sequence
  SiRNA target sequence
cttttcctttgcaattaccaa

SEQ ID NO: 110741 - DNA, 21 bp, Artificial sequence
  SiRNA target sequence
ttttcctttgcaattaccaat

SEQ ID NO: 110742 - DNA, 21 bp, Artificial sequence
  SiRNA target sequence
tttcctttgcaattaccaata

SEQ ID NO: 110743 - DNA, 21 bp, Artificial sequence
  SiRNA target sequence
ttcctttgcaattaccaatag

SEQ ID NO: 110744 - DNA, 21 bp, Artificial sequence
  SiRNA target sequence
tcctttgcaattaccaatagc

SEQ ID NO: 110745 - DNA, 21 bp, Artificial sequence
  SiRNA target sequence
cctttgcaattaccaatagcc

SEQ ID NO: 110746 - DNA, 21 bp, Artificial sequence
  SiRNA target sequence
ctttgcaattaccaatagcct

SEQ ID NO: 110747 - DNA, 21 bp, Artificial sequence
  SiRNA target sequence
tttgcaattaccaatagcctt

SEQ ID NO: 110748 - DNA, 21 bp, Artificial sequence
  SiRNA target sequence
ttgcaattaccaatagccttt

SEQ ID NO: 110749 - DNA, 21 bp, Artificial sequence
  SiRNA target sequence
tgcaattaccaatagcctttc

SEQ ID NO: 110750 - DNA, 21 bp, Artificial sequence
  SiRNA target sequence
gcaattaccaatagcctttcc

SEQ ID NO: 110751 - DNA, 21 bp, Artificial sequence
  SiRNA target sequence
caattaccaatagcctttcct

SEQ ID NO: 110752 - DNA, 21 bp, Artificial sequence
  SiRNA target sequence
aattaccaatagcctttccta

SEQ ID NO: 110753 - DNA, 21 bp, Artificial sequence
  SiRNA target sequence
attaccaatagcctttcctaa

SEQ ID NO: 110754 - DNA, 21 bp, Artificial sequence
  SiRNA target sequence
ttaccaatagcctttcctaat

SEQ ID NO: 110755 - DNA, 21 bp, Artificial sequence
  SiRNA target sequence
taccaatagcctttcctaata

SEQ ID NO: 110756 - DNA, 21 bp, Artificial sequence
  SiRNA target sequence
accaatagcctttcctaataa

SEQ ID NO: 110757 - DNA, 21 bp, Artificial sequence
  SiRNA target sequence
ccaatagcctttcctaataat

SEQ ID NO: 110758 - DNA, 21 bp, Artificial sequence
  SiRNA target sequence
caatagcctttcctaataatt

SEQ ID NO: 110759 - DNA, 21 bp, Artificial sequence
  SiRNA target sequence
aatagcctttcctaataattc

SEQ ID NO: 110760 - DNA, 21 bp, Artificial sequence
  SiRNA target sequence
atagcctttcctaataattcc

SEQ ID NO: 110761 - DNA, 21 bp, Artificial sequence
  SiRNA target sequence
tagcctttcctaataattccc

SEQ ID NO: 110762 - DNA, 21 bp, Artificial sequence
  SiRNA target sequence
agcctttcctaataattcccc

SEQ ID NO: 110763 - DNA, 21 bp, Artificial sequence
  SiRNA target sequence
gcctttcctaataattcccct

SEQ ID NO: 110764 - DNA, 21 bp, Artificial sequence
  SiRNA target sequence
cctttcctaataattccccta

SEQ ID NO: 110765 - DNA, 21 bp, Artificial sequence
  SiRNA target sequence
ctttcctaataattcccctat

SEQ ID NO: 110766 - DNA, 21 bp, Artificial sequence
  SiRNA target sequence
tttcctaataattcccctata

SEQ ID NO: 110767 - DNA, 21 bp, Artificial sequence
  SiRNA target sequence
ttcctaataattcccctataa

SEQ ID NO: 110768 - DNA, 21 bp, Artificial sequence
  SiRNA target sequence
tcctaataattcccctataat

SEQ ID NO: 110769 - DNA, 21 bp, Artificial sequence
  SiRNA target sequence
cctaataattcccctataata

SEQ ID NO: 110770 - DNA, 21 bp, Artificial sequence
  SiRNA target sequence
ctaataattcccctataatac

SEQ ID NO: 110771 - DNA, 21 bp, Artificial sequence
  SiRNA target sequence
taataattcccctataatact

SEQ ID NO: 110772 - DNA, 21 bp, Artificial sequence
  SiRNA target sequence
aataattcccctataatactt

SEQ ID NO: 110773 - DNA, 21 bp, Artificial sequence
  SiRNA target sequence
ataattcccctataatacttt

SEQ ID NO: 110774 - DNA, 21 bp, Artificial sequence
  SiRNA target sequence
taattcccctataatactttc

SEQ ID NO: 110775 - DNA, 21 bp, Artificial sequence
  SiRNA target sequence
aattcccctataatactttct

SEQ ID NO: 110776 - DNA, 21 bp, Artificial sequence
  SiRNA target sequence
attcccctataatactttcta

SEQ ID NO: 110777 - DNA, 21 bp, Artificial sequence
  SiRNA target sequence
ttcccctataatactttctat

SEQ ID NO: 110778 - DNA, 21 bp, Artificial sequence
  SiRNA target sequence
tcccctataatactttctata

SEQ ID NO: 110779 - DNA, 21 bp, Artificial sequence
  SiRNA target sequence
cccctataatactttctatac

SEQ ID NO: 110780 - DNA, 21 bp, Artificial sequence
  SiRNA target sequence
ccctataatactttctatact

SEQ ID NO: 110781 - DNA, 21 bp, Artificial sequence
  SiRNA target sequence
cctataatactttctatactg

SEQ ID NO: 110782 - DNA, 21 bp, Artificial sequence
  SiRNA target sequence
ctataatactttctatactga

SEQ ID NO: 110783 - DNA, 21 bp, Artificial sequence
  SiRNA target sequence
tataatactttctatactgat

SEQ ID NO: 110784 - DNA, 21 bp, Artificial sequence
  SiRNA target sequence
ataatactttctatactgatt

SEQ ID NO: 110785 - DNA, 21 bp, Artificial sequence
  SiRNA target sequence
taatactttctatactgattc

SEQ ID NO: 110786 - DNA, 21 bp, Artificial sequence
  SiRNA target sequence
aatactttctatactgattcc

SEQ ID NO: 110787 - DNA, 21 bp, Artificial sequence
  SiRNA target sequence
atactttctatactgattcca

SEQ ID NO: 110788 - DNA, 21 bp, Artificial sequence
  SiRNA target sequence
tactttctatactgattccac

SEQ ID NO: 110789 - DNA, 21 bp, Artificial sequence
  SiRNA target sequence
actttctatactgattccaca

SEQ ID NO: 110790 - DNA, 21 bp, Artificial sequence
  SiRNA target sequence
ctttctatactgattccacaa

SEQ ID NO: 110791 - DNA, 21 bp, Artificial sequence
  SiRNA target sequence
tttctatactgattccacaaa

SEQ ID NO: 110792 - DNA, 21 bp, Artificial sequence
  SiRNA target sequence
ttctatactgattccacaaat

SEQ ID NO: 110793 - DNA, 21 bp, Artificial sequence
  SiRNA target sequence
tctatactgattccacaaata

SEQ ID NO: 110794 - DNA, 21 bp, Artificial sequence
  SiRNA target sequence
ctatactgattccacaaataa

SEQ ID NO: 110795 - DNA, 21 bp, Artificial sequence
  SiRNA target sequence
tatactgattccacaaataaa

SEQ ID NO: 110796 - DNA, 21 bp, Artificial sequence
  SiRNA target sequence
atactgattccacaaataaat

SEQ ID NO: 110797 - DNA, 21 bp, Artificial sequence
  SiRNA target sequence
tactgattccacaaataaatg

SEQ ID NO: 110798 - DNA, 21 bp, Artificial sequence
  SiRNA target sequence
actgattccacaaataaatgc

SEQ ID NO: 110799 - DNA, 21 bp, Artificial sequence
  SiRNA target sequence
ctgattccacaaataaatgct

SEQ ID NO: 110800 - DNA, 21 bp, Artificial sequence
  SiRNA target sequence
tgattccacaaataaatgcta

SEQ ID NO: 110801 - DNA, 21 bp, Artificial sequence
  SiRNA target sequence
gattccacaaataaatgctaa

SEQ ID NO: 110802 - DNA, 21 bp, Artificial sequence
  SiRNA target sequence
attccacaaataaatgctaat

SEQ ID NO: 110803 - DNA, 21 bp, Artificial sequence
  SiRNA target sequence
ttccacaaataaatgctaatc

SEQ ID NO: 110804 - DNA, 21 bp, Artificial sequence
  SiRNA target sequence
tccacaaataaatgctaatcc

SEQ ID NO: 110805 - DNA, 21 bp, Artificial sequence
  SiRNA target sequence
ccacaaataaatgctaatcca

SEQ ID NO: 110806 - DNA, 21 bp, Artificial sequence
  SiRNA target sequence
cacaaataaatgctaatccat

SEQ ID NO: 110807 - DNA, 21 bp, Artificial sequence
  SiRNA target sequence
acaaataaatgctaatccatg

SEQ ID NO: 110808 - DNA, 21 bp, Artificial sequence
  SiRNA target sequence
caaataaatgctaatccatgg

SEQ ID NO: 110809 - DNA, 21 bp, Artificial sequence
  SiRNA target sequence
aaataaatgctaatccatggc

SEQ ID NO: 110810 - DNA, 21 bp, Artificial sequence
  SiRNA target sequence
aataaatgctaatccatggca

SEQ ID NO: 110811 - DNA, 21 bp, Artificial sequence
  SiRNA target sequence
ataaatgctaatccatggcat

SEQ ID NO: 110812 - DNA, 21 bp, Artificial sequence
  SiRNA target sequence
taaatgctaatccatggcatc

SEQ ID NO: 110813 - DNA, 21 bp, Artificial sequence
  SiRNA target sequence
aaatgctaatccatggcatct

SEQ ID NO: 110814 - DNA, 21 bp, Artificial sequence
  SiRNA target sequence
aatgctaatccatggcatcta

SEQ ID NO: 110815 - DNA, 21 bp, Artificial sequence
  SiRNA target sequence
atgctaatccatggcatctat

SEQ ID NO: 110816 - DNA, 21 bp, Artificial sequence
  SiRNA target sequence
tgctaatccatggcatctata

SEQ ID NO: 110817 - DNA, 21 bp, Artificial sequence
  SiRNA target sequence
gctaatccatggcatctataa

SEQ ID NO: 110818 - DNA, 21 bp, Artificial sequence
  SiRNA target sequence
ctaatccatggcatctataag

SEQ ID NO: 110819 - DNA, 21 bp, Artificial sequence
  SiRNA target sequence
taatccatggcatctataaga

SEQ ID NO: 110820 - DNA, 21 bp, Artificial sequence
  SiRNA target sequence
aatccatggcatctataagat

SEQ ID NO: 110821 - DNA, 21 bp, Artificial sequence
  SiRNA target sequence
atccatggcatctataagatc

SEQ ID NO: 110822 - DNA, 21 bp, Artificial sequence
  SiRNA target sequence
tccatggcatctataagatcc

SEQ ID NO: 110823 - DNA, 21 bp, Artificial sequence
  SiRNA target sequence
ccatggcatctataagatcct

SEQ ID NO: 110824 - DNA, 21 bp, Artificial sequence
  SiRNA target sequence
catggcatctataagatccta

SEQ ID NO: 110825 - DNA, 21 bp, Artificial sequence
  SiRNA target sequence
atggcatctataagatcctat

SEQ ID NO: 110826 - DNA, 21 bp, Artificial sequence
  SiRNA target sequence
tggcatctataagatcctatg

SEQ ID NO: 110827 - DNA, 21 bp, Artificial sequence
  SiRNA target sequence
ggcatctataagatcctatga

SEQ ID NO: 110828 - DNA, 21 bp, Artificial sequence
  SiRNA target sequence
gcatctataagatcctatgac

SEQ ID NO: 110829 - DNA, 21 bp, Artificial sequence
  SiRNA target sequence
catctataagatcctatgact

SEQ ID NO: 110830 - DNA, 21 bp, Artificial sequence
  SiRNA target sequence
atctataagatcctatgactt

SEQ ID NO: 110831 - DNA, 21 bp, Artificial sequence
  SiRNA target sequence
tctataagatcctatgacttt

SEQ ID NO: 110832 - DNA, 21 bp, Artificial sequence
  SiRNA target sequence
ctataagatcctatgacttta

SEQ ID NO: 110833 - DNA, 21 bp, Artificial sequence
  SiRNA target sequence
tataagatcctatgactttat

SEQ ID NO: 110834 - DNA, 21 bp, Artificial sequence
  SiRNA target sequence
ataagatcctatgactttatc

SEQ ID NO: 110835 - DNA, 21 bp, Artificial sequence
  SiRNA target sequence
taagatcctatgactttatca

SEQ ID NO: 110836 - DNA, 21 bp, Artificial sequence
  SiRNA target sequence
aagatcctatgactttatcat

SEQ ID NO: 110837 - DNA, 21 bp, Artificial sequence
  SiRNA target sequence
agatcctatgactttatcatt

SEQ ID NO: 110838 - DNA, 21 bp, Artificial sequence
  SiRNA target sequence
gatcctatgactttatcattt

SEQ ID NO: 110839 - DNA, 21 bp, Artificial sequence
  SiRNA target sequence
atcctatgactttatcatttt

SEQ ID NO: 110840 - DNA, 21 bp, Artificial sequence
  SiRNA target sequence
tcctatgactttatcattttt

SEQ ID NO: 110841 - DNA, 21 bp, Artificial sequence
  SiRNA target sequence
cctatgactttatcattttta

SEQ ID NO: 110842 - DNA, 21 bp, Artificial sequence
  SiRNA target sequence
ctatgactttatcatttttat

SEQ ID NO: 110843 - DNA, 21 bp, Artificial sequence
  SiRNA target sequence
tatgactttatcatttttatc

SEQ ID NO: 110844 - DNA, 21 bp, Artificial sequence
  SiRNA target sequence
atgactttatcatttttatct

SEQ ID NO: 110845 - DNA, 21 bp, Artificial sequence
  SiRNA target sequence
tgactttatcatttttatcta

SEQ ID NO: 110846 - DNA, 21 bp, Artificial sequence
  SiRNA target sequence
gactttatcatttttatctag

SEQ ID NO: 110847 - DNA, 21 bp, Artificial sequence
  SiRNA target sequence
actttatcatttttatctagt

SEQ ID NO: 110848 - DNA, 21 bp, Artificial sequence
  SiRNA target sequence
ctttatcatttttatctagta

SEQ ID NO: 110849 - DNA, 21 bp, Artificial sequence
  SiRNA target sequence
tttatcatttttatctagtac

SEQ ID NO: 110850 - DNA, 21 bp, Artificial sequence
  SiRNA target sequence
ttatcatttttatctagtacc

SEQ ID NO: 110851 - DNA, 21 bp, Artificial sequence
  SiRNA target sequence
tatcatttttatctagtacct

SEQ ID NO: 110852 - DNA, 21 bp, Artificial sequence
  SiRNA target sequence
atcatttttatctagtacctt

SEQ ID NO: 110853 - DNA, 21 bp, Artificial sequence
  SiRNA target sequence
tcatttttatctagtaccttt

SEQ ID NO: 110854 - DNA, 21 bp, Artificial sequence
  SiRNA target sequence
catttttatctagtacctttt

SEQ ID NO: 110855 - DNA, 21 bp, Artificial sequence
  SiRNA target sequence
atttttatctagtaccttttg

SEQ ID NO: 110856 - DNA, 21 bp, Artificial sequence
  SiRNA target sequence
tttttatctagtaccttttgt

SEQ ID NO: 110857 - DNA, 21 bp, Artificial sequence
  SiRNA target sequence
ttttatctagtaccttttgta

SEQ ID NO: 110858 - DNA, 21 bp, Artificial sequence
  SiRNA target sequence
tttatctagtaccttttgtaa

SEQ ID NO: 110859 - DNA, 21 bp, Artificial sequence
  SiRNA target sequence
ttatctagtaccttttgtaaa

SEQ ID NO: 110860 - DNA, 21 bp, Artificial sequence
  SiRNA target sequence
tatctagtaccttttgtaaac

SEQ ID NO: 110861 - DNA, 21 bp, Artificial sequence
  SiRNA target sequence
atctagtaccttttgtaaact

SEQ ID NO: 110862 - DNA, 21 bp, Artificial sequence
  SiRNA target sequence
tctagtaccttttgtaaactc

SEQ ID NO: 110863 - DNA, 21 bp, Artificial sequence
  SiRNA target sequence
ctagtaccttttgtaaactca

SEQ ID NO: 110864 - DNA, 21 bp, Artificial sequence
  SiRNA target sequence
tagtaccttttgtaaactcat

SEQ ID NO: 110865 - DNA, 21 bp, Artificial sequence
  SiRNA target sequence
agtaccttttgtaaactcata

SEQ ID NO: 110866 - DNA, 21 bp, Artificial sequence
  SiRNA target sequence
gtaccttttgtaaactcatat

SEQ ID NO: 110867 - DNA, 21 bp, Artificial sequence
  SiRNA target sequence
taccttttgtaaactcatata

SEQ ID NO: 110868 - DNA, 21 bp, Artificial sequence
  SiRNA target sequence
accttttgtaaactcatataa

SEQ ID NO: 110869 - DNA, 21 bp, Artificial sequence
  SiRNA target sequence
ccttttgtaaactcatataaa

SEQ ID NO: 110870 - DNA, 21 bp, Artificial sequence
  SiRNA target sequence
cttttgtaaactcatataaat

SEQ ID NO: 110871 - DNA, 21 bp, Artificial sequence
  SiRNA target sequence
ttttgtaaactcatataaatg

SEQ ID NO: 110872 - DNA, 21 bp, Artificial sequence
  SiRNA target sequence
tttgtaaactcatataaatgt

SEQ ID NO: 110873 - DNA, 21 bp, Artificial sequence
  SiRNA target sequence
ttgtaaactcatataaatgtt

SEQ ID NO: 110874 - DNA, 21 bp, Artificial sequence
  SiRNA target sequence
tgtaaactcatataaatgttt

SEQ ID NO: 110875 - DNA, 21 bp, Artificial sequence
  SiRNA target sequence
gtaaactcatataaatgtttt

SEQ ID NO: 110876 - DNA, 21 bp, Artificial sequence
  SiRNA target sequence
taaactcatataaatgttttc

SEQ ID NO: 110877 - DNA, 21 bp, Artificial sequence
  SiRNA target sequence
aaactcatataaatgttttcc

SEQ ID NO: 110878 - DNA, 21 bp, Artificial sequence
  SiRNA target sequence
aactcatataaatgttttcct

SEQ ID NO: 110879 - DNA, 21 bp, Artificial sequence
  SiRNA target sequence
actcatataaatgttttcctg

SEQ ID NO: 110880 - DNA, 21 bp, Artificial sequence
  SiRNA target sequence
ctcatataaatgttttcctgt

SEQ ID NO: 110881 - DNA, 21 bp, Artificial sequence
  SiRNA target sequence
tcatataaatgttttcctgtc

SEQ ID NO: 110882 - DNA, 21 bp, Artificial sequence
  SiRNA target sequence
catataaatgttttcctgtcc

SEQ ID NO: 110883 - DNA, 21 bp, Artificial sequence
  SiRNA target sequence
atataaatgttttcctgtcct

SEQ ID NO: 110884 - DNA, 21 bp, Artificial sequence
  SiRNA target sequence
tataaatgttttcctgtccta

SEQ ID NO: 110885 - DNA, 21 bp, Artificial sequence
  SiRNA target sequence
ataaatgttttcctgtcctat

SEQ ID NO: 110886 - DNA, 21 bp, Artificial sequence
  SiRNA target sequence
taaatgttttcctgtcctatt

SEQ ID NO: 110887 - DNA, 21 bp, Artificial sequence
  SiRNA target sequence
aaatgttttcctgtcctatta

SEQ ID NO: 110888 - DNA, 21 bp, Artificial sequence
  SiRNA target sequence
aatgttttcctgtcctattac

SEQ ID NO: 110889 - DNA, 21 bp, Artificial sequence
  SiRNA target sequence
atgttttcctgtcctattact

SEQ ID NO: 110890 - DNA, 21 bp, Artificial sequence
  SiRNA target sequence
tgttttcctgtcctattacta

SEQ ID NO: 110891 - DNA, 21 bp, Artificial sequence
  SiRNA target sequence
gttttcctgtcctattactaa

SEQ ID NO: 110892 - DNA, 21 bp, Artificial sequence
  SiRNA target sequence
ttttcctgtcctattactaaa

SEQ ID NO: 110893 - DNA, 21 bp, Artificial sequence
  SiRNA target sequence
tttcctgtcctattactaaat

SEQ ID NO: 110894 - DNA, 21 bp, Artificial sequence
  SiRNA target sequence
ttcctgtcctattactaaatg

SEQ ID NO: 110895 - DNA, 21 bp, Artificial sequence
  SiRNA target sequence
tcctgtcctattactaaatga

SEQ ID NO: 110896 - DNA, 21 bp, Artificial sequence
  SiRNA target sequence
cctgtcctattactaaatgac

SEQ ID NO: 110897 - DNA, 21 bp, Artificial sequence
  SiRNA target sequence
ctgtcctattactaaatgaca

SEQ ID NO: 110898 - DNA, 21 bp, Artificial sequence
  SiRNA target sequence
tgtcctattactaaatgacag

SEQ ID NO: 110899 - DNA, 21 bp, Artificial sequence
  SiRNA target sequence
gtcctattactaaatgacaga

SEQ ID NO: 110900 - DNA, 21 bp, Artificial sequence
  SiRNA target sequence
tcctattactaaatgacagaa

SEQ ID NO: 110901 - DNA, 21 bp, Artificial sequence
  SiRNA target sequence
cctattactaaatgacagaag

SEQ ID NO: 110902 - DNA, 21 bp, Artificial sequence
  SiRNA target sequence
ctattactaaatgacagaagc

SEQ ID NO: 110903 - DNA, 21 bp, Artificial sequence
  SiRNA target sequence
tattactaaatgacagaagcc

SEQ ID NO: 110904 - DNA, 21 bp, Artificial sequence
  SiRNA target sequence
attactaaatgacagaagcct

SEQ ID NO: 110905 - DNA, 21 bp, Artificial sequence
  SiRNA target sequence
ttactaaatgacagaagcctc

SEQ ID NO: 110906 - DNA, 21 bp, Artificial sequence
  SiRNA target sequence
tactaaatgacagaagcctct

SEQ ID NO: 110907 - DNA, 21 bp, Artificial sequence
  SiRNA target sequence
actaaatgacagaagcctctt

SEQ ID NO: 110908 - DNA, 21 bp, Artificial sequence
  SiRNA target sequence
ctaaatgacagaagcctctta

SEQ ID NO: 110909 - DNA, 21 bp, Artificial sequence
  SiRNA target sequence
taaatgacagaagcctcttat

SEQ ID NO: 110910 - DNA, 21 bp, Artificial sequence
  SiRNA target sequence
aaatgacagaagcctcttata

SEQ ID NO: 110911 - DNA, 21 bp, Artificial sequence
  SiRNA target sequence
aatgacagaagcctcttatat

SEQ ID NO: 110912 - DNA, 21 bp, Artificial sequence
  SiRNA target sequence
atgacagaagcctcttatatt

SEQ ID NO: 110913 - DNA, 21 bp, Artificial sequence
  SiRNA target sequence
tgacagaagcctcttatattt

SEQ ID NO: 110914 - DNA, 21 bp, Artificial sequence
  SiRNA target sequence
gacagaagcctcttatatttc

SEQ ID NO: 110915 - DNA, 21 bp, Artificial sequence
  SiRNA target sequence
acagaagcctcttatatttcc

SEQ ID NO: 110916 - DNA, 21 bp, Artificial sequence
  SiRNA target sequence
cagaagcctcttatatttcct

SEQ ID NO: 110917 - DNA, 21 bp, Artificial sequence
  SiRNA target sequence
agaagcctcttatatttcctt

SEQ ID NO: 110918 - DNA, 21 bp, Artificial sequence
  SiRNA target sequence
gaagcctcttatatttccttt

SEQ ID NO: 110919 - DNA, 21 bp, Artificial sequence
  SiRNA target sequence
aagcctcttatatttcctttt

SEQ ID NO: 110920 - DNA, 21 bp, Artificial sequence
  SiRNA target sequence
agcctcttatatttccttttt

SEQ ID NO: 110921 - DNA, 21 bp, Artificial sequence
  SiRNA target sequence
gcctcttatatttcctttttt

SEQ ID NO: 110922 - DNA, 21 bp, Artificial sequence
  SiRNA target sequence
cctcttatatttcctttttta

SEQ ID NO: 110923 - DNA, 21 bp, Artificial sequence
  SiRNA target sequence
ctcttatatttccttttttat

SEQ ID NO: 110924 - DNA, 21 bp, Artificial sequence
  SiRNA target sequence
tcttatatttccttttttata

SEQ ID NO: 110925 - DNA, 21 bp, Artificial sequence
  SiRNA target sequence
cttatatttccttttttatac

SEQ ID NO: 110926 - DNA, 21 bp, Artificial sequence
  SiRNA target sequence
ttatatttccttttttatact

SEQ ID NO: 110927 - DNA, 21 bp, Artificial sequence
  SiRNA target sequence
tatatttccttttttatactt

SEQ ID NO: 110928 - DNA, 21 bp, Artificial sequence
  SiRNA target sequence
atatttccttttttatactta

SEQ ID NO: 110929 - DNA, 21 bp, Artificial sequence
  SiRNA target sequence
tatttccttttttatacttag

SEQ ID NO: 110930 - DNA, 21 bp, Artificial sequence
  SiRNA target sequence
atttccttttttatacttaga

SEQ ID NO: 110931 - DNA, 21 bp, Artificial sequence
  SiRNA target sequence
tttccttttttatacttagag

SEQ ID NO: 110932 - DNA, 21 bp, Artificial sequence
  SiRNA target sequence
ttccttttttatacttagagt

SEQ ID NO: 110933 - DNA, 21 bp, Artificial sequence
  SiRNA target sequence
tccttttttatacttagagtt

SEQ ID NO: 110934 - DNA, 21 bp, Artificial sequence
  SiRNA target sequence
ccttttttatacttagagtta

SEQ ID NO: 110935 - DNA, 21 bp, Artificial sequence
  SiRNA target sequence
cttttttatacttagagttag

SEQ ID NO: 110936 - DNA, 21 bp, Artificial sequence
  SiRNA target sequence
ttttttatacttagagttagc

SEQ ID NO: 110937 - DNA, 21 bp, Artificial sequence
  SiRNA target sequence
tttttatacttagagttagca

SEQ ID NO: 110938 - DNA, 21 bp, Artificial sequence
  SiRNA target sequence
ttttatacttagagttagcat

SEQ ID NO: 110939 - DNA, 21 bp, Artificial sequence
  SiRNA target sequence
tttatacttagagttagcata

SEQ ID NO: 110940 - DNA, 21 bp, Artificial sequence
  SiRNA target sequence
ttatacttagagttagcatat

SEQ ID NO: 110941 - DNA, 21 bp, Artificial sequence
  SiRNA target sequence
tatacttagagttagcatatt

SEQ ID NO: 110942 - DNA, 21 bp, Artificial sequence
  SiRNA target sequence
atacttagagttagcatattc

SEQ ID NO: 110943 - DNA, 21 bp, Artificial sequence
  SiRNA target sequence
tacttagagttagcatattct

SEQ ID NO: 110944 - DNA, 21 bp, Artificial sequence
  SiRNA target sequence
acttagagttagcatattctt

SEQ ID NO: 110945 - DNA, 21 bp, Artificial sequence
  SiRNA target sequence
cttagagttagcatattcttc

SEQ ID NO: 110946 - DNA, 21 bp, Artificial sequence
  SiRNA target sequence
ttagagttagcatattcttcg

SEQ ID NO: 110947 - DNA, 21 bp, Artificial sequence
  SiRNA target sequence
tagagttagcatattcttcga

SEQ ID NO: 110948 - DNA, 21 bp, Artificial sequence
  SiRNA target sequence
agagttagcatattcttcgat

SEQ ID NO: 110949 - DNA, 21 bp, Artificial sequence
  SiRNA target sequence
gagttagcatattcttcgata

SEQ ID NO: 110950 - DNA, 21 bp, Artificial sequence
  SiRNA target sequence
agttagcatattcttcgataa

SEQ ID NO: 110951 - DNA, 21 bp, Artificial sequence
  SiRNA target sequence
gttagcatattcttcgataag

SEQ ID NO: 110952 - DNA, 21 bp, Artificial sequence
  SiRNA target sequence
ttagcatattcttcgataaga

SEQ ID NO: 110953 - DNA, 21 bp, Artificial sequence
  SiRNA target sequence
tagcatattcttcgataagac

SEQ ID NO: 110954 - DNA, 21 bp, Artificial sequence
  SiRNA target sequence
agcatattcttcgataagacg

SEQ ID NO: 110955 - DNA, 21 bp, Artificial sequence
  SiRNA target sequence
gcatattcttcgataagacgt

SEQ ID NO: 110956 - DNA, 21 bp, Artificial sequence
  SiRNA target sequence
catattcttcgataagacgta

SEQ ID NO: 110957 - DNA, 21 bp, Artificial sequence
  SiRNA target sequence
atattcttcgataagacgtag

SEQ ID NO: 110958 - DNA, 21 bp, Artificial sequence
  SiRNA target sequence
tattcttcgataagacgtaga

SEQ ID NO: 110959 - DNA, 21 bp, Artificial sequence
  SiRNA target sequence
attcttcgataagacgtagaa

SEQ ID NO: 110960 - DNA, 21 bp, Artificial sequence
  SiRNA target sequence
ttcttcgataagacgtagaat

SEQ ID NO: 110961 - DNA, 21 bp, Artificial sequence
  SiRNA target sequence
tcttcgataagacgtagaatt

SEQ ID NO: 110962 - DNA, 21 bp, Artificial sequence
  SiRNA target sequence
cttcgataagacgtagaatta

SEQ ID NO: 110963 - DNA, 21 bp, Artificial sequence
  SiRNA target sequence
ttcgataagacgtagaattaa

SEQ ID NO: 110964 - DNA, 21 bp, Artificial sequence
  SiRNA target sequence
tcgataagacgtagaattaac

SEQ ID NO: 110965 - DNA, 21 bp, Artificial sequence
  SiRNA target sequence
cgataagacgtagaattaaca

SEQ ID NO: 110966 - DNA, 21 bp, Artificial sequence
  SiRNA target sequence
gataagacgtagaattaacat

SEQ ID NO: 110967 - DNA, 21 bp, Artificial sequence
  SiRNA target sequence
ataagacgtagaattaacata

SEQ ID NO: 110968 - DNA, 21 bp, Artificial sequence
  SiRNA target sequence
taagacgtagaattaacatat

SEQ ID NO: 110969 - DNA, 21 bp, Artificial sequence
  SiRNA target sequence
aagacgtagaattaacatatt

SEQ ID NO: 110970 - DNA, 21 bp, Artificial sequence
  SiRNA target sequence
agacgtagaattaacatattt

SEQ ID NO: 110971 - DNA, 21 bp, Artificial sequence
  SiRNA target sequence
gacgtagaattaacatatttc

SEQ ID NO: 110972 - DNA, 21 bp, Artificial sequence
  SiRNA target sequence
acgtagaattaacatatttct

SEQ ID NO: 110973 - DNA, 21 bp, Artificial sequence
  SiRNA target sequence
cgtagaattaacatatttcta

SEQ ID NO: 110974 - DNA, 21 bp, Artificial sequence
  SiRNA target sequence
gtagaattaacatatttctat

SEQ ID NO: 110975 - DNA, 21 bp, Artificial sequence
  SiRNA target sequence
tagaattaacatatttctata

SEQ ID NO: 110976 - DNA, 21 bp, Artificial sequence
  SiRNA target sequence
agaattaacatatttctataa

SEQ ID NO: 110977 - DNA, 21 bp, Artificial sequence
  SiRNA target sequence
gaattaacatatttctataaa

SEQ ID NO: 110978 - DNA, 21 bp, Artificial sequence
  SiRNA target sequence
aattaacatatttctataaac

SEQ ID NO: 110979 - DNA, 21 bp, Artificial sequence
  SiRNA target sequence
attaacatatttctataaaca

SEQ ID NO: 110980 - DNA, 21 bp, Artificial sequence
  SiRNA target sequence
ttaacatatttctataaacat

SEQ ID NO: 110981 - DNA, 21 bp, Artificial sequence
  SiRNA target sequence
taacatatttctataaacatc

SEQ ID NO: 110982 - DNA, 21 bp, Artificial sequence
  SiRNA target sequence
aacatatttctataaacatct

SEQ ID NO: 110983 - DNA, 21 bp, Artificial sequence
  SiRNA target sequence
acatatttctataaacatctt

SEQ ID NO: 110984 - DNA, 21 bp, Artificial sequence
  SiRNA target sequence
catatttctataaacatcttg

SEQ ID NO: 110985 - DNA, 21 bp, Artificial sequence
  SiRNA target sequence
atatttctataaacatcttgt

SEQ ID NO: 110986 - DNA, 21 bp, Artificial sequence
  SiRNA target sequence
tatttctataaacatcttgta

SEQ ID NO: 110987 - DNA, 21 bp, Artificial sequence
  SiRNA target sequence
atttctataaacatcttgtac

SEQ ID NO: 110988 - DNA, 21 bp, Artificial sequence
  SiRNA target sequence
tttctataaacatcttgtaca

SEQ ID NO: 110989 - DNA, 21 bp, Artificial sequence
  SiRNA target sequence
ttctataaacatcttgtacaa

SEQ ID NO: 110990 - DNA, 21 bp, Artificial sequence
  SiRNA target sequence
tctataaacatcttgtacaag

SEQ ID NO: 110991 - DNA, 21 bp, Artificial sequence
  SiRNA target sequence
ctataaacatcttgtacaagt

SEQ ID NO: 110992 - DNA, 21 bp, Artificial sequence
  SiRNA target sequence
tataaacatcttgtacaagtt

SEQ ID NO: 110993 - DNA, 21 bp, Artificial sequence
  SiRNA target sequence
ataaacatcttgtacaagttc

SEQ ID NO: 110994 - DNA, 21 bp, Artificial sequence
  SiRNA target sequence
taaacatcttgtacaagttct

SEQ ID NO: 110995 - DNA, 21 bp, Artificial sequence
  SiRNA target sequence
aaacatcttgtacaagttctt

SEQ ID NO: 110996 - DNA, 21 bp, Artificial sequence
  SiRNA target sequence
aacatcttgtacaagttcttt

SEQ ID NO: 110997 - DNA, 21 bp, Artificial sequence
  SiRNA target sequence
acatcttgtacaagttctttg

SEQ ID NO: 110998 - DNA, 21 bp, Artificial sequence
  SiRNA target sequence
catcttgtacaagttctttgt

SEQ ID NO: 110999 - DNA, 21 bp, Artificial sequence
  SiRNA target sequence
atcttgtacaagttctttgtt

SEQ ID NO: 111000 - DNA, 21 bp, Artificial sequence
  SiRNA target sequence
tcttgtacaagttctttgttt

SEQ ID NO: 111001 - DNA, 21 bp, Artificial sequence
  SiRNA target sequence
cttgtacaagttctttgttta

SEQ ID NO: 111002 - DNA, 21 bp, Artificial sequence
  SiRNA target sequence
ttgtacaagttctttgtttaa

SEQ ID NO: 111003 - DNA, 21 bp, Artificial sequence
  SiRNA target sequence
tgtacaagttctttgtttaaa

SEQ ID NO: 111004 - DNA, 21 bp, Artificial sequence
  SiRNA target sequence
gtacaagttctttgtttaaag

SEQ ID NO: 111005 - DNA, 21 bp, Artificial sequence
  SiRNA target sequence
tacaagttctttgtttaaagt

SEQ ID NO: 111006 - DNA, 21 bp, Artificial sequence
  SiRNA target sequence
acaagttctttgtttaaagta

SEQ ID NO: 111007 - DNA, 21 bp, Artificial sequence
  SiRNA target sequence
caagttctttgtttaaagtag

SEQ ID NO: 111008 - DNA, 21 bp, Artificial sequence
  SiRNA target sequence
aagttctttgtttaaagtagt

SEQ ID NO: 111009 - DNA, 21 bp, Artificial sequence
  SiRNA target sequence
agttctttgtttaaagtagtt

SEQ ID NO: 111010 - DNA, 21 bp, Artificial sequence
  SiRNA target sequence
gttctttgtttaaagtagttt

SEQ ID NO: 111011 - DNA, 21 bp, Artificial sequence
  SiRNA target sequence
ttctttgtttaaagtagtttt

SEQ ID NO: 111012 - DNA, 21 bp, Artificial sequence
  SiRNA target sequence
tctttgtttaaagtagttttc

SEQ ID NO: 111013 - DNA, 21 bp, Artificial sequence
  SiRNA target sequence
ctttgtttaaagtagttttca

SEQ ID NO: 111014 - DNA, 21 bp, Artificial sequence
  SiRNA target sequence
tttgtttaaagtagttttcag

SEQ ID NO: 111015 - DNA, 21 bp, Artificial sequence
  SiRNA target sequence
ttgtttaaagtagttttcagt

SEQ ID NO: 111016 - DNA, 21 bp, Artificial sequence
  SiRNA target sequence
tgtttaaagtagttttcagtt

SEQ ID NO: 111017 - DNA, 21 bp, Artificial sequence
  SiRNA target sequence
gtttaaagtagttttcagttt

SEQ ID NO: 111018 - DNA, 21 bp, Artificial sequence
  SiRNA target sequence
tttaaagtagttttcagttta

SEQ ID NO: 111019 - DNA, 21 bp, Artificial sequence
  SiRNA target sequence
ttaaagtagttttcagtttaa

SEQ ID NO: 111020 - DNA, 21 bp, Artificial sequence
  SiRNA target sequence
taaagtagttttcagtttaac

SEQ ID NO: 111021 - DNA, 21 bp, Artificial sequence
  SiRNA target sequence
aaagtagttttcagtttaact

SEQ ID NO: 111022 - DNA, 21 bp, Artificial sequence
  SiRNA target sequence
aagtagttttcagtttaactg

SEQ ID NO: 111023 - DNA, 21 bp, Artificial sequence
  SiRNA target sequence
agtagttttcagtttaactgt

SEQ ID NO: 111024 - DNA, 21 bp, Artificial sequence
  SiRNA target sequence
gtagttttcagtttaactgta

SEQ ID NO: 111025 - DNA, 21 bp, Artificial sequence
  SiRNA target sequence
tagttttcagtttaactgtat

SEQ ID NO: 111026 - DNA, 21 bp, Artificial sequence
  SiRNA target sequence
agttttcagtttaactgtatt

SEQ ID NO: 111027 - DNA, 21 bp, Artificial sequence
  SiRNA target sequence
gttttcagtttaactgtattt

SEQ ID NO: 111028 - DNA, 21 bp, Artificial sequence
  SiRNA target sequence
ttttcagtttaactgtatttt

SEQ ID NO: 111029 - DNA, 21 bp, Artificial sequence
  SiRNA target sequence
tttcagtttaactgtattttt

SEQ ID NO: 111030 - DNA, 21 bp, Artificial sequence
  SiRNA target sequence
ttcagtttaactgtattttta

SEQ ID NO: 111031 - DNA, 21 bp, Artificial sequence
  SiRNA target sequence
tcagtttaactgtatttttat

SEQ ID NO: 111032 - DNA, 21 bp, Artificial sequence
  SiRNA target sequence
cagtttaactgtatttttatc

SEQ ID NO: 111033 - DNA, 21 bp, Artificial sequence
  SiRNA target sequence
agtttaactgtatttttatct

SEQ ID NO: 111034 - DNA, 21 bp, Artificial sequence
  SiRNA target sequence
gtttaactgtatttttatcta

SEQ ID NO: 111035 - DNA, 21 bp, Artificial sequence
  SiRNA target sequence
tttaactgtatttttatctac

SEQ ID NO: 111036 - DNA, 21 bp, Artificial sequence
  SiRNA target sequence
ttaactgtatttttatctacc

SEQ ID NO: 111037 - DNA, 21 bp, Artificial sequence
  SiRNA target sequence
taactgtatttttatctacca

SEQ ID NO: 111038 - DNA, 21 bp, Artificial sequence
  SiRNA target sequence
aactgtatttttatctaccaa

SEQ ID NO: 111039 - DNA, 21 bp, Artificial sequence
  SiRNA target sequence
actgtatttttatctaccaaa

SEQ ID NO: 111040 - DNA, 21 bp, Artificial sequence
  SiRNA target sequence
ctgtatttttatctaccaaat

SEQ ID NO: 111041 - DNA, 21 bp, Artificial sequence
  SiRNA target sequence
tgtatttttatctaccaaata

SEQ ID NO: 111042 - DNA, 21 bp, Artificial sequence
  SiRNA target sequence
gtatttttatctaccaaataa

SEQ ID NO: 111043 - DNA, 21 bp, Artificial sequence
  SiRNA target sequence
tatttttatctaccaaataat

SEQ ID NO: 111044 - DNA, 21 bp, Artificial sequence
  SiRNA target sequence
atttttatctaccaaataata

SEQ ID NO: 111045 - DNA, 21 bp, Artificial sequence
  SiRNA target sequence
tttttatctaccaaataataa

SEQ ID NO: 111046 - DNA, 21 bp, Artificial sequence
  SiRNA target sequence
ttttatctaccaaataataat

SEQ ID NO: 111047 - DNA, 21 bp, Artificial sequence
  SiRNA target sequence
tttatctaccaaataataatc

SEQ ID NO: 111048 - DNA, 21 bp, Artificial sequence
  SiRNA target sequence
ttatctaccaaataataatct

SEQ ID NO: 111049 - DNA, 21 bp, Artificial sequence
  SiRNA target sequence
tatctaccaaataataatcta

SEQ ID NO: 111050 - DNA, 21 bp, Artificial sequence
  SiRNA target sequence
atctaccaaataataatctat

SEQ ID NO: 111051 - DNA, 21 bp, Artificial sequence
  SiRNA target sequence
tctaccaaataataatctatc

SEQ ID NO: 111052 - DNA, 21 bp, Artificial sequence
  SiRNA target sequence
ctaccaaataataatctatca

SEQ ID NO: 111053 - DNA, 21 bp, Artificial sequence
  SiRNA target sequence
taccaaataataatctatcat

SEQ ID NO: 111054 - DNA, 22 bp, Artificial sequence
  SiRNA target sequence
ttattcagaataaacatctttt

SEQ ID NO: 111055 - DNA, 22 bp, Artificial sequence
  SiRNA target sequence
tattcagaataaacatctttta

SEQ ID NO: 111056 - DNA, 22 bp, Artificial sequence
  SiRNA target sequence
attcagaataaacatcttttaa

SEQ ID NO: 111057 - DNA, 22 bp, Artificial sequence
  SiRNA target sequence
ttcagaataaacatcttttaaa

SEQ ID NO: 111058 - DNA, 22 bp, Artificial sequence
  SiRNA target sequence
tcagaataaacatcttttaaaa

SEQ ID NO: 111059 - DNA, 22 bp, Artificial sequence
  SiRNA target sequence
cagaataaacatcttttaaaag

SEQ ID NO: 111060 - DNA, 22 bp, Artificial sequence
  SiRNA target sequence
agaataaacatcttttaaaagt

SEQ ID NO: 111061 - DNA, 22 bp, Artificial sequence
  SiRNA target sequence
gaataaacatcttttaaaagtt

SEQ ID NO: 111062 - DNA, 22 bp, Artificial sequence
  SiRNA target sequence
aataaacatcttttaaaagttc

SEQ ID NO: 111063 - DNA, 22 bp, Artificial sequence
  SiRNA target sequence
ataaacatcttttaaaagttca

SEQ ID NO: 111064 - DNA, 22 bp, Artificial sequence
  SiRNA target sequence
taaacatcttttaaaagttcat

SEQ ID NO: 111065 - DNA, 22 bp, Artificial sequence
  SiRNA target sequence
aaacatcttttaaaagttcatc

SEQ ID NO: 111066 - DNA, 22 bp, Artificial sequence
  SiRNA target sequence
aacatcttttaaaagttcatcg

SEQ ID NO: 111067 - DNA, 22 bp, Artificial sequence
  SiRNA target sequence
acatcttttaaaagttcatcga

SEQ ID NO: 111068 - DNA, 22 bp, Artificial sequence
  SiRNA target sequence
catcttttaaaagttcatcgat

SEQ ID NO: 111069 - DNA, 22 bp, Artificial sequence
  SiRNA target sequence
atcttttaaaagttcatcgata

SEQ ID NO: 111070 - DNA, 22 bp, Artificial sequence
  SiRNA target sequence
tcttttaaaagttcatcgatat

SEQ ID NO: 111071 - DNA, 22 bp, Artificial sequence
  SiRNA target sequence
cttttaaaagttcatcgatatc

SEQ ID NO: 111072 - DNA, 22 bp, Artificial sequence
  SiRNA target sequence
ttttaaaagttcatcgatatcg

SEQ ID NO: 111073 - DNA, 22 bp, Artificial sequence
  SiRNA target sequence
tttaaaagttcatcgatatcgg

SEQ ID NO: 111074 - DNA, 22 bp, Artificial sequence
  SiRNA target sequence
ttaaaagttcatcgatatcggg

SEQ ID NO: 111075 - DNA, 22 bp, Artificial sequence
  SiRNA target sequence
taaaagttcatcgatatcgggt

SEQ ID NO: 111076 - DNA, 22 bp, Artificial sequence
  SiRNA target sequence
aaaagttcatcgatatcgggtt

SEQ ID NO: 111077 - DNA, 22 bp, Artificial sequence
  SiRNA target sequence
aaagttcatcgatatcgggttc

SEQ ID NO: 111078 - DNA, 22 bp, Artificial sequence
  SiRNA target sequence
aagttcatcgatatcgggttct

SEQ ID NO: 111079 - DNA, 22 bp, Artificial sequence
  SiRNA target sequence
agttcatcgatatcgggttctt

SEQ ID NO: 111080 - DNA, 22 bp, Artificial sequence
  SiRNA target sequence
gttcatcgatatcgggttcttt

SEQ ID NO: 111081 - DNA, 22 bp, Artificial sequence
  SiRNA target sequence
ttcatcgatatcgggttcttta

SEQ ID NO: 111082 - DNA, 22 bp, Artificial sequence
  SiRNA target sequence
tcatcgatatcgggttctttag

SEQ ID NO: 111083 - DNA, 22 bp, Artificial sequence
  SiRNA target sequence
catcgatatcgggttctttaga

SEQ ID NO: 111084 - DNA, 22 bp, Artificial sequence
  SiRNA target sequence
atcgatatcgggttctttagaa

SEQ ID NO: 111085 - DNA, 22 bp, Artificial sequence
  SiRNA target sequence
tcgatatcgggttctttagaaa

SEQ ID NO: 111086 - DNA, 22 bp, Artificial sequence
  SiRNA target sequence
cgatatcgggttctttagaaaa

SEQ ID NO: 111087 - DNA, 22 bp, Artificial sequence
  SiRNA target sequence
gatatcgggttctttagaaaaa

SEQ ID NO: 111088 - DNA, 22 bp, Artificial sequence
  SiRNA target sequence
atatcgggttctttagaaaaaa

SEQ ID NO: 111089 - DNA, 22 bp, Artificial sequence
  SiRNA target sequence
tatcgggttctttagaaaaaat

SEQ ID NO: 111090 - DNA, 22 bp, Artificial sequence
  SiRNA target sequence
atcgggttctttagaaaaaata

SEQ ID NO: 111091 - DNA, 22 bp, Artificial sequence
  SiRNA target sequence
tcgggttctttagaaaaaataa

SEQ ID NO: 111092 - DNA, 22 bp, Artificial sequence
  SiRNA target sequence
cgggttctttagaaaaaataac

SEQ ID NO: 111093 - DNA, 22 bp, Artificial sequence
  SiRNA target sequence
gggttctttagaaaaaataact

SEQ ID NO: 111094 - DNA, 22 bp, Artificial sequence
  SiRNA target sequence
ggttctttagaaaaaataactt

SEQ ID NO: 111095 - DNA, 22 bp, Artificial sequence
  SiRNA target sequence
gttctttagaaaaaataacttt

SEQ ID NO: 111096 - DNA, 22 bp, Artificial sequence
  SiRNA target sequence
ttctttagaaaaaataactttt

SEQ ID NO: 111097 - DNA, 22 bp, Artificial sequence
  SiRNA target sequence
tctttagaaaaaataacttttt

SEQ ID NO: 111098 - DNA, 22 bp, Artificial sequence
  SiRNA target sequence
ctttagaaaaaataactttttt

SEQ ID NO: 111099 - DNA, 22 bp, Artificial sequence
  SiRNA target sequence
tttagaaaaaataactttttta

SEQ ID NO: 111100 - DNA, 22 bp, Artificial sequence
  SiRNA target sequence
ttagaaaaaataacttttttaa

SEQ ID NO: 111101 - DNA, 22 bp, Artificial sequence
  SiRNA target sequence
tagaaaaaataacttttttaac

SEQ ID NO: 111102 - DNA, 22 bp, Artificial sequence
  SiRNA target sequence
agaaaaaataacttttttaaca

SEQ ID NO: 111103 - DNA, 22 bp, Artificial sequence
  SiRNA target sequence
gaaaaaataacttttttaacac

SEQ ID NO: 111104 - DNA, 22 bp, Artificial sequence
  SiRNA target sequence
aaaaaataacttttttaacacc

SEQ ID NO: 111105 - DNA, 22 bp, Artificial sequence
  SiRNA target sequence
aaaaataacttttttaacacct

SEQ ID NO: 111106 - DNA, 22 bp, Artificial sequence
  SiRNA target sequence
aaaataacttttttaacacctt

SEQ ID NO: 111107 - DNA, 22 bp, Artificial sequence
  SiRNA target sequence
aaataacttttttaacaccttc

SEQ ID NO: 111108 - DNA, 22 bp, Artificial sequence
  SiRNA target sequence
aataacttttttaacaccttct

SEQ ID NO: 111109 - DNA, 22 bp, Artificial sequence
  SiRNA target sequence
ataacttttttaacaccttctt

SEQ ID NO: 111110 - DNA, 22 bp, Artificial sequence
  SiRNA target sequence
taacttttttaacaccttcttc

SEQ ID NO: 111111 - DNA, 22 bp, Artificial sequence
  SiRNA target sequence
aacttttttaacaccttcttca

SEQ ID NO: 111112 - DNA, 22 bp, Artificial sequence
  SiRNA target sequence
acttttttaacaccttcttcaa

SEQ ID NO: 111113 - DNA, 22 bp, Artificial sequence
  SiRNA target sequence
cttttttaacaccttcttcaaa

SEQ ID NO: 111114 - DNA, 22 bp, Artificial sequence
  SiRNA target sequence
ttttttaacaccttcttcaaag

SEQ ID NO: 111115 - DNA, 22 bp, Artificial sequence
  SiRNA target sequence
tttttaacaccttcttcaaagc

SEQ ID NO: 111116 - DNA, 22 bp, Artificial sequence
  SiRNA target sequence
ttttaacaccttcttcaaagca

SEQ ID NO: 111117 - DNA, 22 bp, Artificial sequence
  SiRNA target sequence
tttaacaccttcttcaaagcag

SEQ ID NO: 111118 - DNA, 22 bp, Artificial sequence
  SiRNA target sequence
ttaacaccttcttcaaagcagg

SEQ ID NO: 111119 - DNA, 22 bp, Artificial sequence
  SiRNA target sequence
taacaccttcttcaaagcagga

SEQ ID NO: 111120 - DNA, 22 bp, Artificial sequence
  SiRNA target sequence
aacaccttcttcaaagcaggaa

SEQ ID NO: 111121 - DNA, 22 bp, Artificial sequence
  SiRNA target sequence
acaccttcttcaaagcaggaaa

SEQ ID NO: 111122 - DNA, 22 bp, Artificial sequence
  SiRNA target sequence
caccttcttcaaagcaggaaat

SEQ ID NO: 111123 - DNA, 22 bp, Artificial sequence
  SiRNA target sequence
accttcttcaaagcaggaaatt

SEQ ID NO: 111124 - DNA, 22 bp, Artificial sequence
  SiRNA target sequence
ccttcttcaaagcaggaaatta

SEQ ID NO: 111125 - DNA, 22 bp, Artificial sequence
  SiRNA target sequence
cttcttcaaagcaggaaattac

SEQ ID NO: 111126 - DNA, 22 bp, Artificial sequence
  SiRNA target sequence
ttcttcaaagcaggaaattacc

SEQ ID NO: 111127 - DNA, 22 bp, Artificial sequence
  SiRNA target sequence
tcttcaaagcaggaaattacct

SEQ ID NO: 111128 - DNA, 22 bp, Artificial sequence
  SiRNA target sequence
cttcaaagcaggaaattacctc

SEQ ID NO: 111129 - DNA, 22 bp, Artificial sequence
  SiRNA target sequence
ttcaaagcaggaaattacctca

SEQ ID NO: 111130 - DNA, 22 bp, Artificial sequence
  SiRNA target sequence
tcaaagcaggaaattacctcat

SEQ ID NO: 111131 - DNA, 22 bp, Artificial sequence
  SiRNA target sequence
caaagcaggaaattacctcatc

SEQ ID NO: 111132 - DNA, 22 bp, Artificial sequence
  SiRNA target sequence
aaagcaggaaattacctcatct

SEQ ID NO: 111133 - DNA, 22 bp, Artificial sequence
  SiRNA target sequence
aagcaggaaattacctcatctt

SEQ ID NO: 111134 - DNA, 22 bp, Artificial sequence
  SiRNA target sequence
agcaggaaattacctcatcttc

SEQ ID NO: 111135 - DNA, 22 bp, Artificial sequence
  SiRNA target sequence
gcaggaaattacctcatcttcg

SEQ ID NO: 111136 - DNA, 22 bp, Artificial sequence
  SiRNA target sequence
caggaaattacctcatcttcga

SEQ ID NO: 111137 - DNA, 22 bp, Artificial sequence
  SiRNA target sequence
aggaaattacctcatcttcgat

SEQ ID NO: 111138 - DNA, 22 bp, Artificial sequence
  SiRNA target sequence
ggaaattacctcatcttcgata

SEQ ID NO: 111139 - DNA, 22 bp, Artificial sequence
  SiRNA target sequence
gaaattacctcatcttcgataa

SEQ ID NO: 111140 - DNA, 22 bp, Artificial sequence
  SiRNA target sequence
aaattacctcatcttcgataat

SEQ ID NO: 111141 - DNA, 22 bp, Artificial sequence
  SiRNA target sequence
aattacctcatcttcgataatt

SEQ ID NO: 111142 - DNA, 22 bp, Artificial sequence
  SiRNA target sequence
attacctcatcttcgataattt

SEQ ID NO: 111143 - DNA, 22 bp, Artificial sequence
  SiRNA target sequence
ttacctcatcttcgataatttt

SEQ ID NO: 111144 - DNA, 22 bp, Artificial sequence
  SiRNA target sequence
tacctcatcttcgataattttt

SEQ ID NO: 111145 - DNA, 22 bp, Artificial sequence
  SiRNA target sequence
acctcatcttcgataattttta

SEQ ID NO: 111146 - DNA, 22 bp, Artificial sequence
  SiRNA target sequence
cctcatcttcgataatttttac

SEQ ID NO: 111147 - DNA, 22 bp, Artificial sequence
  SiRNA target sequence
ctcatcttcgataatttttact

SEQ ID NO: 111148 - DNA, 22 bp, Artificial sequence
  SiRNA target sequence
tcatcttcgataatttttactt

SEQ ID NO: 111149 - DNA, 22 bp, Artificial sequence
  SiRNA target sequence
catcttcgataatttttacttc

SEQ ID NO: 111150 - DNA, 22 bp, Artificial sequence
  SiRNA target sequence
atcttcgataatttttacttct

SEQ ID NO: 111151 - DNA, 22 bp, Artificial sequence
  SiRNA target sequence
tcttcgataatttttacttctt

SEQ ID NO: 111152 - DNA, 22 bp, Artificial sequence
  SiRNA target sequence
cttcgataatttttacttcttc

SEQ ID NO: 111153 - DNA, 22 bp, Artificial sequence
  SiRNA target sequence
ttcgataatttttacttcttca

SEQ ID NO: 111154 - DNA, 22 bp, Artificial sequence
  SiRNA target sequence
tcgataatttttacttcttcac

SEQ ID NO: 111155 - DNA, 22 bp, Artificial sequence
  SiRNA target sequence
cgataatttttacttcttcaca

SEQ ID NO: 111156 - DNA, 22 bp, Artificial sequence
  SiRNA target sequence
gataatttttacttcttcacaa

SEQ ID NO: 111157 - DNA, 22 bp, Artificial sequence
  SiRNA target sequence
ataatttttacttcttcacaag

SEQ ID NO: 111158 - DNA, 22 bp, Artificial sequence
  SiRNA target sequence
taatttttacttcttcacaagt

SEQ ID NO: 111159 - DNA, 22 bp, Artificial sequence
  SiRNA target sequence
aatttttacttcttcacaagtc

SEQ ID NO: 111160 - DNA, 22 bp, Artificial sequence
  SiRNA target sequence
atttttacttcttcacaagtcg

SEQ ID NO: 111161 - DNA, 22 bp, Artificial sequence
  SiRNA target sequence
tttttacttcttcacaagtcgc

SEQ ID NO: 111162 - DNA, 22 bp, Artificial sequence
  SiRNA target sequence
ttttacttcttcacaagtcgca

SEQ ID NO: 111163 - DNA, 22 bp, Artificial sequence
  SiRNA target sequence
tttacttcttcacaagtcgcaa

SEQ ID NO: 111164 - DNA, 22 bp, Artificial sequence
  SiRNA target sequence
ttacttcttcacaagtcgcaaa

SEQ ID NO: 111165 - DNA, 22 bp, Artificial sequence
  SiRNA target sequence
tacttcttcacaagtcgcaaat

SEQ ID NO: 111166 - DNA, 22 bp, Artificial sequence
  SiRNA target sequence
acttcttcacaagtcgcaaatt

SEQ ID NO: 111167 - DNA, 22 bp, Artificial sequence
  SiRNA target sequence
cttcttcacaagtcgcaaattt

SEQ ID NO: 111168 - DNA, 22 bp, Artificial sequence
  SiRNA target sequence
ttcttcacaagtcgcaaatttt

SEQ ID NO: 111169 - DNA, 22 bp, Artificial sequence
  SiRNA target sequence
tcttcacaagtcgcaaattttt

SEQ ID NO: 111170 - DNA, 22 bp, Artificial sequence
  SiRNA target sequence
cttcacaagtcgcaaatttttg

SEQ ID NO: 111171 - DNA, 22 bp, Artificial sequence
  SiRNA target sequence
ttcacaagtcgcaaatttttgt

SEQ ID NO: 111172 - DNA, 22 bp, Artificial sequence
  SiRNA target sequence
tcacaagtcgcaaatttttgta

SEQ ID NO: 111173 - DNA, 22 bp, Artificial sequence
  SiRNA target sequence
cacaagtcgcaaatttttgtaa

SEQ ID NO: 111174 - DNA, 22 bp, Artificial sequence
  SiRNA target sequence
acaagtcgcaaatttttgtaag

SEQ ID NO: 111175 - DNA, 22 bp, Artificial sequence
  SiRNA target sequence
caagtcgcaaatttttgtaagt

SEQ ID NO: 111176 - DNA, 22 bp, Artificial sequence
  SiRNA target sequence
aagtcgcaaatttttgtaagtt

SEQ ID NO: 111177 - DNA, 22 bp, Artificial sequence
  SiRNA target sequence
agtcgcaaatttttgtaagtta

SEQ ID NO: 111178 - DNA, 22 bp, Artificial sequence
  SiRNA target sequence
gtcgcaaatttttgtaagttat

SEQ ID NO: 111179 - DNA, 22 bp, Artificial sequence
  SiRNA target sequence
tcgcaaatttttgtaagttatt

SEQ ID NO: 111180 - DNA, 22 bp, Artificial sequence
  SiRNA target sequence
cgcaaatttttgtaagttattt

SEQ ID NO: 111181 - DNA, 22 bp, Artificial sequence
  SiRNA target sequence
gcaaatttttgtaagttatttt

SEQ ID NO: 111182 - DNA, 22 bp, Artificial sequence
  SiRNA target sequence
caaatttttgtaagttattttt

SEQ ID NO: 111183 - DNA, 22 bp, Artificial sequence
  SiRNA target sequence
aaatttttgtaagttatttttt

SEQ ID NO: 111184 - DNA, 22 bp, Artificial sequence
  SiRNA target sequence
aatttttgtaagttattttttg

SEQ ID NO: 111185 - DNA, 22 bp, Artificial sequence
  SiRNA target sequence
atttttgtaagttattttttgc

SEQ ID NO: 111186 - DNA, 22 bp, Artificial sequence
  SiRNA target sequence
tttttgtaagttattttttgct

SEQ ID NO: 111187 - DNA, 22 bp, Artificial sequence
  SiRNA target sequence
ttttgtaagttattttttgctt

SEQ ID NO: 111188 - DNA, 22 bp, Artificial sequence
  SiRNA target sequence
tttgtaagttattttttgcttc

SEQ ID NO: 111189 - DNA, 22 bp, Artificial sequence
  SiRNA target sequence
ttgtaagttattttttgcttct

SEQ ID NO: 111190 - DNA, 22 bp, Artificial sequence
  SiRNA target sequence
tgtaagttattttttgcttctt

SEQ ID NO: 111191 - DNA, 22 bp, Artificial sequence
  SiRNA target sequence
gtaagttattttttgcttcttt

SEQ ID NO: 111192 - DNA, 22 bp, Artificial sequence
  SiRNA target sequence
taagttattttttgcttcttta

SEQ ID NO: 111193 - DNA, 22 bp, Artificial sequence
  SiRNA target sequence
aagttattttttgcttctttaa

SEQ ID NO: 111194 - DNA, 22 bp, Artificial sequence
  SiRNA target sequence
agttattttttgcttctttaag

SEQ ID NO: 111195 - DNA, 22 bp, Artificial sequence
  SiRNA target sequence
gttattttttgcttctttaagg

SEQ ID NO: 111196 - DNA, 22 bp, Artificial sequence
  SiRNA target sequence
ttattttttgcttctttaaggc

SEQ ID NO: 111197 - DNA, 22 bp, Artificial sequence
  SiRNA target sequence
tattttttgcttctttaaggca

SEQ ID NO: 111198 - DNA, 22 bp, Artificial sequence
  SiRNA target sequence
attttttgcttctttaaggcaa

SEQ ID NO: 111199 - DNA, 22 bp, Artificial sequence
  SiRNA target sequence
ttttttgcttctttaaggcaat

SEQ ID NO: 111200 - DNA, 22 bp, Artificial sequence
  SiRNA target sequence
tttttgcttctttaaggcaatc

SEQ ID NO: 111201 - DNA, 22 bp, Artificial sequence
  SiRNA target sequence
ttttgcttctttaaggcaatca

SEQ ID NO: 111202 - DNA, 22 bp, Artificial sequence
  SiRNA target sequence
tttgcttctttaaggcaatcat

SEQ ID NO: 111203 - DNA, 22 bp, Artificial sequence
  SiRNA target sequence
ttgcttctttaaggcaatcatt

SEQ ID NO: 111204 - DNA, 22 bp, Artificial sequence
  SiRNA target sequence
tgcttctttaaggcaatcatta

SEQ ID NO: 111205 - DNA, 22 bp, Artificial sequence
  SiRNA target sequence
gcttctttaaggcaatcattat

SEQ ID NO: 111206 - DNA, 22 bp, Artificial sequence
  SiRNA target sequence
cttctttaaggcaatcattatt

SEQ ID NO: 111207 - DNA, 22 bp, Artificial sequence
  SiRNA target sequence
ttctttaaggcaatcattattt

SEQ ID NO: 111208 - DNA, 22 bp, Artificial sequence
  SiRNA target sequence
tctttaaggcaatcattatttt

SEQ ID NO: 111209 - DNA, 22 bp, Artificial sequence
  SiRNA target sequence
ctttaaggcaatcattattttt

SEQ ID NO: 111210 - DNA, 22 bp, Artificial sequence
  SiRNA target sequence
tttaaggcaatcattatttttt

SEQ ID NO: 111211 - DNA, 22 bp, Artificial sequence
  SiRNA target sequence
ttaaggcaatcattattttttt

SEQ ID NO: 111212 - DNA, 22 bp, Artificial sequence
  SiRNA target sequence
taaggcaatcattatttttttt

SEQ ID NO: 111213 - DNA, 22 bp, Artificial sequence
  SiRNA target sequence
aaggcaatcattattttttttt

SEQ ID NO: 111214 - DNA, 22 bp, Artificial sequence
  SiRNA target sequence
aggcaatcattatttttttttt

SEQ ID NO: 111215 - DNA, 22 bp, Artificial sequence
  SiRNA target sequence
ggcaatcattattttttttttc

SEQ ID NO: 111216 - DNA, 22 bp, Artificial sequence
  SiRNA target sequence
gcaatcattattttttttttca

SEQ ID NO: 111217 - DNA, 22 bp, Artificial sequence
  SiRNA target sequence
caatcattattttttttttcat

SEQ ID NO: 111218 - DNA, 22 bp, Artificial sequence
  SiRNA target sequence
aatcattattttttttttcatt

SEQ ID NO: 111219 - DNA, 22 bp, Artificial sequence
  SiRNA target sequence
atcattattttttttttcatta

SEQ ID NO: 111220 - DNA, 22 bp, Artificial sequence
  SiRNA target sequence
tcattattttttttttcattaa

SEQ ID NO: 111221 - DNA, 22 bp, Artificial sequence
  SiRNA target sequence
cattattttttttttcattaat

SEQ ID NO: 111222 - DNA, 22 bp, Artificial sequence
  SiRNA target sequence
attattttttttttcattaatt

SEQ ID NO: 111223 - DNA, 22 bp, Artificial sequence
  SiRNA target sequence
ttattttttttttcattaattt

SEQ ID NO: 111224 - DNA, 22 bp, Artificial sequence
  SiRNA target sequence
tattttttttttcattaatttc

SEQ ID NO: 111225 - DNA, 22 bp, Artificial sequence
  SiRNA target sequence
attttttttttcattaatttcc

SEQ ID NO: 111226 - DNA, 22 bp, Artificial sequence
  SiRNA target sequence
ttttttttttcattaatttcct

SEQ ID NO: 111227 - DNA, 22 bp, Artificial sequence
  SiRNA target sequence
tttttttttcattaatttcctc

SEQ ID NO: 111228 - DNA, 22 bp, Artificial sequence
  SiRNA target sequence
ttttttttcattaatttcctcc

SEQ ID NO: 111229 - DNA, 22 bp, Artificial sequence
  SiRNA target sequence
tttttttcattaatttcctccg

SEQ ID NO: 111230 - DNA, 22 bp, Artificial sequence
  SiRNA target sequence
ttttttcattaatttcctccgt

SEQ ID NO: 111231 - DNA, 22 bp, Artificial sequence
  SiRNA target sequence
tttttcattaatttcctccgtg

SEQ ID NO: 111232 - DNA, 22 bp, Artificial sequence
  SiRNA target sequence
ttttcattaatttcctccgtgg

SEQ ID NO: 111233 - DNA, 22 bp, Artificial sequence
  SiRNA target sequence
tttcattaatttcctccgtgga

SEQ ID NO: 111234 - DNA, 22 bp, Artificial sequence
  SiRNA target sequence
ttcattaatttcctccgtggat

SEQ ID NO: 111235 - DNA, 22 bp, Artificial sequence
  SiRNA target sequence
tcattaatttcctccgtggatc

SEQ ID NO: 111236 - DNA, 22 bp, Artificial sequence
  SiRNA target sequence
cattaatttcctccgtggatct

SEQ ID NO: 111237 - DNA, 22 bp, Artificial sequence
  SiRNA target sequence
attaatttcctccgtggatctg

SEQ ID NO: 111238 - DNA, 22 bp, Artificial sequence
  SiRNA target sequence
ttaatttcctccgtggatctgt

SEQ ID NO: 111239 - DNA, 22 bp, Artificial sequence
  SiRNA target sequence
taatttcctccgtggatctgta

SEQ ID NO: 111240 - DNA, 22 bp, Artificial sequence
  SiRNA target sequence
aatttcctccgtggatctgtaa

SEQ ID NO: 111241 - DNA, 22 bp, Artificial sequence
  SiRNA target sequence
atttcctccgtggatctgtaaa

SEQ ID NO: 111242 - DNA, 22 bp, Artificial sequence
  SiRNA target sequence
tttcctccgtggatctgtaaaa

SEQ ID NO: 111243 - DNA, 22 bp, Artificial sequence
  SiRNA target sequence
ttcctccgtggatctgtaaaaa

SEQ ID NO: 111244 - DNA, 22 bp, Artificial sequence
  SiRNA target sequence
tcctccgtggatctgtaaaaat

SEQ ID NO: 111245 - DNA, 22 bp, Artificial sequence
  SiRNA target sequence
cctccgtggatctgtaaaaatc

SEQ ID NO: 111246 - DNA, 22 bp, Artificial sequence
  SiRNA target sequence
ctccgtggatctgtaaaaatcg

SEQ ID NO: 111247 - DNA, 22 bp, Artificial sequence
  SiRNA target sequence
tccgtggatctgtaaaaatcgt

SEQ ID NO: 111248 - DNA, 22 bp, Artificial sequence
  SiRNA target sequence
ccgtggatctgtaaaaatcgtt

SEQ ID NO: 111249 - DNA, 22 bp, Artificial sequence
  SiRNA target sequence
cgtggatctgtaaaaatcgtta

SEQ ID NO: 111250 - DNA, 22 bp, Artificial sequence
  SiRNA target sequence
gtggatctgtaaaaatcgttaa

SEQ ID NO: 111251 - DNA, 22 bp, Artificial sequence
  SiRNA target sequence
tggatctgtaaaaatcgttaac

SEQ ID NO: 111252 - DNA, 22 bp, Artificial sequence
  SiRNA target sequence
ggatctgtaaaaatcgttaaca

SEQ ID NO: 111253 - DNA, 22 bp, Artificial sequence
  SiRNA target sequence
gatctgtaaaaatcgttaacat

SEQ ID NO: 111254 - DNA, 22 bp, Artificial sequence
  SiRNA target sequence
atctgtaaaaatcgttaacatc

SEQ ID NO: 111255 - DNA, 22 bp, Artificial sequence
  SiRNA target sequence
tctgtaaaaatcgttaacatct

SEQ ID NO: 111256 - DNA, 22 bp, Artificial sequence
  SiRNA target sequence
ctgtaaaaatcgttaacatcta

SEQ ID NO: 111257 - DNA, 22 bp, Artificial sequence
  SiRNA target sequence
tgtaaaaatcgttaacatctaa

SEQ ID NO: 111258 - DNA, 22 bp, Artificial sequence
  SiRNA target sequence
gtaaaaatcgttaacatctaaa

SEQ ID NO: 111259 - DNA, 22 bp, Artificial sequence
  SiRNA target sequence
taaaaatcgttaacatctaaac

SEQ ID NO: 111260 - DNA, 22 bp, Artificial sequence
  SiRNA target sequence
aaaaatcgttaacatctaaaca

SEQ ID NO: 111261 - DNA, 22 bp, Artificial sequence
  SiRNA target sequence
aaaatcgttaacatctaaacag

SEQ ID NO: 111262 - DNA, 22 bp, Artificial sequence
  SiRNA target sequence
aaatcgttaacatctaaacagg

SEQ ID NO: 111263 - DNA, 22 bp, Artificial sequence
  SiRNA target sequence
aatcgttaacatctaaacagga

SEQ ID NO: 111264 - DNA, 22 bp, Artificial sequence
  SiRNA target sequence
atcgttaacatctaaacaggag

SEQ ID NO: 111265 - DNA, 22 bp, Artificial sequence
  SiRNA target sequence
tcgttaacatctaaacaggagt

SEQ ID NO: 111266 - DNA, 22 bp, Artificial sequence
  SiRNA target sequence
cgttaacatctaaacaggagtg

SEQ ID NO: 111267 - DNA, 22 bp, Artificial sequence
  SiRNA target sequence
gttaacatctaaacaggagtgc

SEQ ID NO: 111268 - DNA, 22 bp, Artificial sequence
  SiRNA target sequence
ttaacatctaaacaggagtgcc

SEQ ID NO: 111269 - DNA, 22 bp, Artificial sequence
  SiRNA target sequence
taacatctaaacaggagtgccc

SEQ ID NO: 111270 - DNA, 22 bp, Artificial sequence
  SiRNA target sequence
aacatctaaacaggagtgccca

SEQ ID NO: 111271 - DNA, 22 bp, Artificial sequence
  SiRNA target sequence
acatctaaacaggagtgcccac

SEQ ID NO: 111272 - DNA, 22 bp, Artificial sequence
  SiRNA target sequence
catctaaacaggagtgcccaca

SEQ ID NO: 111273 - DNA, 22 bp, Artificial sequence
  SiRNA target sequence
atctaaacaggagtgcccacat

SEQ ID NO: 111274 - DNA, 22 bp, Artificial sequence
  SiRNA target sequence
tctaaacaggagtgcccacatg

SEQ ID NO: 111275 - DNA, 22 bp, Artificial sequence
  SiRNA target sequence
ctaaacaggagtgcccacatgt

SEQ ID NO: 111276 - DNA, 22 bp, Artificial sequence
  SiRNA target sequence
taaacaggagtgcccacatgtc

SEQ ID NO: 111277 - DNA, 22 bp, Artificial sequence
  SiRNA target sequence
aaacaggagtgcccacatgtcc

SEQ ID NO: 111278 - DNA, 22 bp, Artificial sequence
  SiRNA target sequence
aacaggagtgcccacatgtcct

SEQ ID NO: 111279 - DNA, 22 bp, Artificial sequence
  SiRNA target sequence
acaggagtgcccacatgtcctg

SEQ ID NO: 111280 - DNA, 22 bp, Artificial sequence
  SiRNA target sequence
caggagtgcccacatgtcctgt

SEQ ID NO: 111281 - DNA, 22 bp, Artificial sequence
  SiRNA target sequence
aggagtgcccacatgtcctgta

SEQ ID NO: 111282 - DNA, 22 bp, Artificial sequence
  SiRNA target sequence
ggagtgcccacatgtcctgtac

SEQ ID NO: 111283 - DNA, 22 bp, Artificial sequence
  SiRNA target sequence
gagtgcccacatgtcctgtacg

SEQ ID NO: 111284 - DNA, 22 bp, Artificial sequence
  SiRNA target sequence
agtgcccacatgtcctgtacgt

SEQ ID NO: 111285 - DNA, 22 bp, Artificial sequence
  SiRNA target sequence
gtgcccacatgtcctgtacgta

SEQ ID NO: 111286 - DNA, 22 bp, Artificial sequence
  SiRNA target sequence
tgcccacatgtcctgtacgtat

SEQ ID NO: 111287 - DNA, 22 bp, Artificial sequence
  SiRNA target sequence
gcccacatgtcctgtacgtatc

SEQ ID NO: 111288 - DNA, 22 bp, Artificial sequence
  SiRNA target sequence
cccacatgtcctgtacgtatca

SEQ ID NO: 111289 - DNA, 22 bp, Artificial sequence
  SiRNA target sequence
ccacatgtcctgtacgtatcaa

SEQ ID NO: 111290 - DNA, 22 bp, Artificial sequence
  SiRNA target sequence
cacatgtcctgtacgtatcaat

SEQ ID NO: 111291 - DNA, 22 bp, Artificial sequence
  SiRNA target sequence
acatgtcctgtacgtatcaatt

SEQ ID NO: 111292 - DNA, 22 bp, Artificial sequence
  SiRNA target sequence
catgtcctgtacgtatcaattt

SEQ ID NO: 111293 - DNA, 22 bp, Artificial sequence
  SiRNA target sequence
atgtcctgtacgtatcaatttg

SEQ ID NO: 111294 - DNA, 22 bp, Artificial sequence
  SiRNA target sequence
tgtcctgtacgtatcaatttgc

SEQ ID NO: 111295 - DNA, 22 bp, Artificial sequence
  SiRNA target sequence
gtcctgtacgtatcaatttgca

SEQ ID NO: 111296 - DNA, 22 bp, Artificial sequence
  SiRNA target sequence
tcctgtacgtatcaatttgcaa

SEQ ID NO: 111297 - DNA, 22 bp, Artificial sequence
  SiRNA target sequence
cctgtacgtatcaatttgcaag

SEQ ID NO: 111298 - DNA, 22 bp, Artificial sequence
  SiRNA target sequence
ctgtacgtatcaatttgcaaga

SEQ ID NO: 111299 - DNA, 22 bp, Artificial sequence
  SiRNA target sequence
tgtacgtatcaatttgcaagat

SEQ ID NO: 111300 - DNA, 22 bp, Artificial sequence
  SiRNA target sequence
gtacgtatcaatttgcaagatg

SEQ ID NO: 111301 - DNA, 22 bp, Artificial sequence
  SiRNA target sequence
tacgtatcaatttgcaagatga

SEQ ID NO: 111302 - DNA, 22 bp, Artificial sequence
  SiRNA target sequence
acgtatcaatttgcaagatgat

SEQ ID NO: 111303 - DNA, 22 bp, Artificial sequence
  SiRNA target sequence
cgtatcaatttgcaagatgata

SEQ ID NO: 111304 - DNA, 22 bp, Artificial sequence
  SiRNA target sequence
gtatcaatttgcaagatgatag

SEQ ID NO: 111305 - DNA, 22 bp, Artificial sequence
  SiRNA target sequence
tatcaatttgcaagatgatagg

SEQ ID NO: 111306 - DNA, 22 bp, Artificial sequence
  SiRNA target sequence
atcaatttgcaagatgataggt

SEQ ID NO: 111307 - DNA, 22 bp, Artificial sequence
  SiRNA target sequence
tcaatttgcaagatgataggtc

SEQ ID NO: 111308 - DNA, 22 bp, Artificial sequence
  SiRNA target sequence
caatttgcaagatgataggtcc

SEQ ID NO: 111309 - DNA, 22 bp, Artificial sequence
  SiRNA target sequence
aatttgcaagatgataggtcct

SEQ ID NO: 111310 - DNA, 22 bp, Artificial sequence
  SiRNA target sequence
atttgcaagatgataggtcctt

SEQ ID NO: 111311 - DNA, 22 bp, Artificial sequence
  SiRNA target sequence
tttgcaagatgataggtccttt

SEQ ID NO: 111312 - DNA, 22 bp, Artificial sequence
  SiRNA target sequence
ttgcaagatgataggtcctttt

SEQ ID NO: 111313 - DNA, 22 bp, Artificial sequence
  SiRNA target sequence
tgcaagatgataggtccttttt

SEQ ID NO: 111314 - DNA, 22 bp, Artificial sequence
  SiRNA target sequence
gcaagatgataggtcctttttc

SEQ ID NO: 111315 - DNA, 22 bp, Artificial sequence
  SiRNA target sequence
caagatgataggtcctttttct

SEQ ID NO: 111316 - DNA, 22 bp, Artificial sequence
  SiRNA target sequence
aagatgataggtcctttttcta

SEQ ID NO: 111317 - DNA, 22 bp, Artificial sequence
  SiRNA target sequence
agatgataggtcctttttctat

SEQ ID NO: 111318 - DNA, 22 bp, Artificial sequence
  SiRNA target sequence
gatgataggtcctttttctatt

SEQ ID NO: 111319 - DNA, 22 bp, Artificial sequence
  SiRNA target sequence
atgataggtcctttttctattg

SEQ ID NO: 111320 - DNA, 22 bp, Artificial sequence
  SiRNA target sequence
tgataggtcctttttctattgc

SEQ ID NO: 111321 - DNA, 22 bp, Artificial sequence
  SiRNA target sequence
gataggtcctttttctattgca

SEQ ID NO: 111322 - DNA, 22 bp, Artificial sequence
  SiRNA target sequence
ataggtcctttttctattgcat

SEQ ID NO: 111323 - DNA, 22 bp, Artificial sequence
  SiRNA target sequence
taggtcctttttctattgcatg

SEQ ID NO: 111324 - DNA, 22 bp, Artificial sequence
  SiRNA target sequence
aggtcctttttctattgcatgt

SEQ ID NO: 111325 - DNA, 22 bp, Artificial sequence
  SiRNA target sequence
ggtcctttttctattgcatgtt

SEQ ID NO: 111326 - DNA, 22 bp, Artificial sequence
  SiRNA target sequence
gtcctttttctattgcatgttg

SEQ ID NO: 111327 - DNA, 22 bp, Artificial sequence
  SiRNA target sequence
tcctttttctattgcatgttgt

SEQ ID NO: 111328 - DNA, 22 bp, Artificial sequence
  SiRNA target sequence
cctttttctattgcatgttgtc

SEQ ID NO: 111329 - DNA, 22 bp, Artificial sequence
  SiRNA target sequence
ctttttctattgcatgttgtct

SEQ ID NO: 111330 - DNA, 22 bp, Artificial sequence
  SiRNA target sequence
tttttctattgcatgttgtcta

SEQ ID NO: 111331 - DNA, 22 bp, Artificial sequence
  SiRNA target sequence
ttttctattgcatgttgtctag

SEQ ID NO: 111332 - DNA, 22 bp, Artificial sequence
  SiRNA target sequence
tttctattgcatgttgtctagc

SEQ ID NO: 111333 - DNA, 22 bp, Artificial sequence
  SiRNA target sequence
ttctattgcatgttgtctagca

SEQ ID NO: 111334 - DNA, 22 bp, Artificial sequence
  SiRNA target sequence
tctattgcatgttgtctagcaa

SEQ ID NO: 111335 - DNA, 22 bp, Artificial sequence
  SiRNA target sequence
ctattgcatgttgtctagcaaa

SEQ ID NO: 111336 - DNA, 22 bp, Artificial sequence
  SiRNA target sequence
tattgcatgttgtctagcaaat

SEQ ID NO: 111337 - DNA, 22 bp, Artificial sequence
  SiRNA target sequence
attgcatgttgtctagcaaatg

SEQ ID NO: 111338 - DNA, 22 bp, Artificial sequence
  SiRNA target sequence
ttgcatgttgtctagcaaatgt

SEQ ID NO: 111339 - DNA, 22 bp, Artificial sequence
  SiRNA target sequence
tgcatgttgtctagcaaatgta

SEQ ID NO: 111340 - DNA, 22 bp, Artificial sequence
  SiRNA target sequence
gcatgttgtctagcaaatgtaa

SEQ ID NO: 111341 - DNA, 22 bp, Artificial sequence
  SiRNA target sequence
catgttgtctagcaaatgtaaa

SEQ ID NO: 111342 - DNA, 22 bp, Artificial sequence
  SiRNA target sequence
atgttgtctagcaaatgtaaat

SEQ ID NO: 111343 - DNA, 22 bp, Artificial sequence
  SiRNA target sequence
tgttgtctagcaaatgtaaata

SEQ ID NO: 111344 - DNA, 22 bp, Artificial sequence
  SiRNA target sequence
gttgtctagcaaatgtaaatac

SEQ ID NO: 111345 - DNA, 22 bp, Artificial sequence
  SiRNA target sequence
ttgtctagcaaatgtaaataca

SEQ ID NO: 111346 - DNA, 22 bp, Artificial sequence
  SiRNA target sequence
tgtctagcaaatgtaaatacat

SEQ ID NO: 111347 - DNA, 22 bp, Artificial sequence
  SiRNA target sequence
gtctagcaaatgtaaatacatc

SEQ ID NO: 111348 - DNA, 22 bp, Artificial sequence
  SiRNA target sequence
tctagcaaatgtaaatacatca

SEQ ID NO: 111349 - DNA, 22 bp, Artificial sequence
  SiRNA target sequence
ctagcaaatgtaaatacatcaa

SEQ ID NO: 111350 - DNA, 22 bp, Artificial sequence
  SiRNA target sequence
tagcaaatgtaaatacatcaat

SEQ ID NO: 111351 - DNA, 22 bp, Artificial sequence
  SiRNA target sequence
agcaaatgtaaatacatcaatc

SEQ ID NO: 111352 - DNA, 22 bp, Artificial sequence
  SiRNA target sequence
gcaaatgtaaatacatcaatca

SEQ ID NO: 111353 - DNA, 22 bp, Artificial sequence
  SiRNA target sequence
caaatgtaaatacatcaatcag

SEQ ID NO: 111354 - DNA, 22 bp, Artificial sequence
  SiRNA target sequence
aaatgtaaatacatcaatcagt

SEQ ID NO: 111355 - DNA, 22 bp, Artificial sequence
  SiRNA target sequence
aatgtaaatacatcaatcagtt

SEQ ID NO: 111356 - DNA, 22 bp, Artificial sequence
  SiRNA target sequence
atgtaaatacatcaatcagttg

SEQ ID NO: 111357 - DNA, 22 bp, Artificial sequence
  SiRNA target sequence
tgtaaatacatcaatcagttga

SEQ ID NO: 111358 - DNA, 22 bp, Artificial sequence
  SiRNA target sequence
gtaaatacatcaatcagttgag

SEQ ID NO: 111359 - DNA, 22 bp, Artificial sequence
  SiRNA target sequence
taaatacatcaatcagttgagt

SEQ ID NO: 111360 - DNA, 22 bp, Artificial sequence
  SiRNA target sequence
aaatacatcaatcagttgagtt

SEQ ID NO: 111361 - DNA, 22 bp, Artificial sequence
  SiRNA target sequence
aatacatcaatcagttgagtta

SEQ ID NO: 111362 - DNA, 22 bp, Artificial sequence
  SiRNA target sequence
atacatcaatcagttgagttat

SEQ ID NO: 111363 - DNA, 22 bp, Artificial sequence
  SiRNA target sequence
tacatcaatcagttgagttatg

SEQ ID NO: 111364 - DNA, 22 bp, Artificial sequence
  SiRNA target sequence
acatcaatcagttgagttatgt

SEQ ID NO: 111365 - DNA, 22 bp, Artificial sequence
  SiRNA target sequence
catcaatcagttgagttatgtt

SEQ ID NO: 111366 - DNA, 22 bp, Artificial sequence
  SiRNA target sequence
atcaatcagttgagttatgttt

SEQ ID NO: 111367 - DNA, 22 bp, Artificial sequence
  SiRNA target sequence
tcaatcagttgagttatgtttt

SEQ ID NO: 111368 - DNA, 22 bp, Artificial sequence
  SiRNA target sequence
caatcagttgagttatgttttt

SEQ ID NO: 111369 - DNA, 22 bp, Artificial sequence
  SiRNA target sequence
aatcagttgagttatgttttta

SEQ ID NO: 111370 - DNA, 22 bp, Artificial sequence
  SiRNA target sequence
atcagttgagttatgtttttat

SEQ ID NO: 111371 - DNA, 22 bp, Artificial sequence
  SiRNA target sequence
tcagttgagttatgtttttatc

SEQ ID NO: 111372 - DNA, 22 bp, Artificial sequence
  SiRNA target sequence
cagttgagttatgtttttatct

SEQ ID NO: 111373 - DNA, 22 bp, Artificial sequence
  SiRNA target sequence
agttgagttatgtttttatctg

SEQ ID NO: 111374 - DNA, 22 bp, Artificial sequence
  SiRNA target sequence
gttgagttatgtttttatctgt

SEQ ID NO: 111375 - DNA, 22 bp, Artificial sequence
  SiRNA target sequence
ttgagttatgtttttatctgta

SEQ ID NO: 111376 - DNA, 22 bp, Artificial sequence
  SiRNA target sequence
tgagttatgtttttatctgtaa

SEQ ID NO: 111377 - DNA, 22 bp, Artificial sequence
  SiRNA target sequence
gagttatgtttttatctgtaag

SEQ ID NO: 111378 - DNA, 22 bp, Artificial sequence
  SiRNA target sequence
agttatgtttttatctgtaaga

SEQ ID NO: 111379 - DNA, 22 bp, Artificial sequence
  SiRNA target sequence
gttatgtttttatctgtaagac

SEQ ID NO: 111380 - DNA, 22 bp, Artificial sequence
  SiRNA target sequence
ttatgtttttatctgtaagacg

SEQ ID NO: 111381 - DNA, 22 bp, Artificial sequence
  SiRNA target sequence
tatgtttttatctgtaagacgt

SEQ ID NO: 111382 - DNA, 22 bp, Artificial sequence
  SiRNA target sequence
atgtttttatctgtaagacgta

SEQ ID NO: 111383 - DNA, 22 bp, Artificial sequence
  SiRNA target sequence
tgtttttatctgtaagacgtat

SEQ ID NO: 111384 - DNA, 22 bp, Artificial sequence
  SiRNA target sequence
gtttttatctgtaagacgtata

SEQ ID NO: 111385 - DNA, 22 bp, Artificial sequence
  SiRNA target sequence
tttttatctgtaagacgtatac

SEQ ID NO: 111386 - DNA, 22 bp, Artificial sequence
  SiRNA target sequence
ttttatctgtaagacgtatacc

SEQ ID NO: 111387 - DNA, 22 bp, Artificial sequence
  SiRNA target sequence
tttatctgtaagacgtatacct

SEQ ID NO: 111388 - DNA, 22 bp, Artificial sequence
  SiRNA target sequence
ttatctgtaagacgtatacctg

SEQ ID NO: 111389 - DNA, 22 bp, Artificial sequence
  SiRNA target sequence
tatctgtaagacgtatacctgg

SEQ ID NO: 111390 - DNA, 22 bp, Artificial sequence
  SiRNA target sequence
atctgtaagacgtatacctgga

SEQ ID NO: 111391 - DNA, 22 bp, Artificial sequence
  SiRNA target sequence
tctgtaagacgtatacctggaa

SEQ ID NO: 111392 - DNA, 22 bp, Artificial sequence
  SiRNA target sequence
ctgtaagacgtatacctggaat

SEQ ID NO: 111393 - DNA, 22 bp, Artificial sequence
  SiRNA target sequence
tgtaagacgtatacctggaata

SEQ ID NO: 111394 - DNA, 22 bp, Artificial sequence
  SiRNA target sequence
gtaagacgtatacctggaatat

SEQ ID NO: 111395 - DNA, 22 bp, Artificial sequence
  SiRNA target sequence
taagacgtatacctggaatatt

SEQ ID NO: 111396 - DNA, 22 bp, Artificial sequence
  SiRNA target sequence
aagacgtatacctggaatatta

SEQ ID NO: 111397 - DNA, 22 bp, Artificial sequence
  SiRNA target sequence
agacgtatacctggaatattat

SEQ ID NO: 111398 - DNA, 22 bp, Artificial sequence
  SiRNA target sequence
gacgtatacctggaatattata

SEQ ID NO: 111399 - DNA, 22 bp, Artificial sequence
  SiRNA target sequence
acgtatacctggaatattatat

SEQ ID NO: 111400 - DNA, 22 bp, Artificial sequence
  SiRNA target sequence
cgtatacctggaatattatatc

SEQ ID NO: 111401 - DNA, 22 bp, Artificial sequence
  SiRNA target sequence
gtatacctggaatattatatcc

SEQ ID NO: 111402 - DNA, 22 bp, Artificial sequence
  SiRNA target sequence
tatacctggaatattatatccc

SEQ ID NO: 111403 - DNA, 22 bp, Artificial sequence
  SiRNA target sequence
atacctggaatattatatcccc

SEQ ID NO: 111404 - DNA, 22 bp, Artificial sequence
  SiRNA target sequence
tacctggaatattatatcccct

SEQ ID NO: 111405 - DNA, 22 bp, Artificial sequence
  SiRNA target sequence
acctggaatattatatcccctt

SEQ ID NO: 111406 - DNA, 22 bp, Artificial sequence
  SiRNA target sequence
cctggaatattatatccccttt

SEQ ID NO: 111407 - DNA, 22 bp, Artificial sequence
  SiRNA target sequence
ctggaatattatatcccctttt

SEQ ID NO: 111408 - DNA, 22 bp, Artificial sequence
  SiRNA target sequence
tggaatattatatcccctttta

SEQ ID NO: 111409 - DNA, 22 bp, Artificial sequence
  SiRNA target sequence
ggaatattatatccccttttaa

SEQ ID NO: 111410 - DNA, 22 bp, Artificial sequence
  SiRNA target sequence
gaatattatatccccttttaaa

SEQ ID NO: 111411 - DNA, 22 bp, Artificial sequence
  SiRNA target sequence
aatattatatccccttttaaaa

SEQ ID NO: 111412 - DNA, 22 bp, Artificial sequence
  SiRNA target sequence
atattatatccccttttaaaat

SEQ ID NO: 111413 - DNA, 22 bp, Artificial sequence
  SiRNA target sequence
tattatatccccttttaaaata

SEQ ID NO: 111414 - DNA, 22 bp, Artificial sequence
  SiRNA target sequence
attatatccccttttaaaatat

SEQ ID NO: 111415 - DNA, 22 bp, Artificial sequence
  SiRNA target sequence
ttatatccccttttaaaatatt

SEQ ID NO: 111416 - DNA, 22 bp, Artificial sequence
  SiRNA target sequence
tatatccccttttaaaatattc

SEQ ID NO: 111417 - DNA, 22 bp, Artificial sequence
  SiRNA target sequence
atatccccttttaaaatattca

SEQ ID NO: 111418 - DNA, 22 bp, Artificial sequence
  SiRNA target sequence
tatccccttttaaaatattcag

SEQ ID NO: 111419 - DNA, 22 bp, Artificial sequence
  SiRNA target sequence
atccccttttaaaatattcagg

SEQ ID NO: 111420 - DNA, 22 bp, Artificial sequence
  SiRNA target sequence
tccccttttaaaatattcagga

SEQ ID NO: 111421 - DNA, 22 bp, Artificial sequence
  SiRNA target sequence
ccccttttaaaatattcaggat

SEQ ID NO: 111422 - DNA, 22 bp, Artificial sequence
  SiRNA target sequence
cccttttaaaatattcaggata

SEQ ID NO: 111423 - DNA, 22 bp, Artificial sequence
  SiRNA target sequence
ccttttaaaatattcaggatat

SEQ ID NO: 111424 - DNA, 22 bp, Artificial sequence
  SiRNA target sequence
cttttaaaatattcaggatatg

SEQ ID NO: 111425 - DNA, 22 bp, Artificial sequence
  SiRNA target sequence
ttttaaaatattcaggatatgt

SEQ ID NO: 111426 - DNA, 22 bp, Artificial sequence
  SiRNA target sequence
tttaaaatattcaggatatgta

SEQ ID NO: 111427 - DNA, 22 bp, Artificial sequence
  SiRNA target sequence
ttaaaatattcaggatatgtag

SEQ ID NO: 111428 - DNA, 22 bp, Artificial sequence
  SiRNA target sequence
taaaatattcaggatatgtagt

SEQ ID NO: 111429 - DNA, 22 bp, Artificial sequence
  SiRNA target sequence
aaaatattcaggatatgtagtg

SEQ ID NO: 111430 - DNA, 22 bp, Artificial sequence
  SiRNA target sequence
aaatattcaggatatgtagtgg

SEQ ID NO: 111431 - DNA, 22 bp, Artificial sequence
  SiRNA target sequence
aatattcaggatatgtagtgga

SEQ ID NO: 111432 - DNA, 22 bp, Artificial sequence
  SiRNA target sequence
atattcaggatatgtagtggaa

SEQ ID NO: 111433 - DNA, 22 bp, Artificial sequence
  SiRNA target sequence
tattcaggatatgtagtggaat

SEQ ID NO: 111434 - DNA, 22 bp, Artificial sequence
  SiRNA target sequence
attcaggatatgtagtggaatt

SEQ ID NO: 111435 - DNA, 22 bp, Artificial sequence
  SiRNA target sequence
ttcaggatatgtagtggaatta

SEQ ID NO: 111436 - DNA, 22 bp, Artificial sequence
  SiRNA target sequence
tcaggatatgtagtggaattac

SEQ ID NO: 111437 - DNA, 22 bp, Artificial sequence
  SiRNA target sequence
caggatatgtagtggaattact

SEQ ID NO: 111438 - DNA, 22 bp, Artificial sequence
  SiRNA target sequence
aggatatgtagtggaattactt

SEQ ID NO: 111439 - DNA, 22 bp, Artificial sequence
  SiRNA target sequence
ggatatgtagtggaattacttt

SEQ ID NO: 111440 - DNA, 22 bp, Artificial sequence
  SiRNA target sequence
gatatgtagtggaattactttc

SEQ ID NO: 111441 - DNA, 22 bp, Artificial sequence
  SiRNA target sequence
atatgtagtggaattactttca

SEQ ID NO: 111442 - DNA, 22 bp, Artificial sequence
  SiRNA target sequence
tatgtagtggaattactttcag

SEQ ID NO: 111443 - DNA, 22 bp, Artificial sequence
  SiRNA target sequence
atgtagtggaattactttcagg

SEQ ID NO: 111444 - DNA, 22 bp, Artificial sequence
  SiRNA target sequence
tgtagtggaattactttcaggt

SEQ ID NO: 111445 - DNA, 22 bp, Artificial sequence
  SiRNA target sequence
gtagtggaattactttcaggtg

SEQ ID NO: 111446 - DNA, 22 bp, Artificial sequence
  SiRNA target sequence
tagtggaattactttcaggtgt

SEQ ID NO: 111447 - DNA, 22 bp, Artificial sequence
  SiRNA target sequence
agtggaattactttcaggtgtc

SEQ ID NO: 111448 - DNA, 22 bp, Artificial sequence
  SiRNA target sequence
gtggaattactttcaggtgtcc

SEQ ID NO: 111449 - DNA, 22 bp, Artificial sequence
  SiRNA target sequence
tggaattactttcaggtgtcca

SEQ ID NO: 111450 - DNA, 22 bp, Artificial sequence
  SiRNA target sequence
ggaattactttcaggtgtccac

SEQ ID NO: 111451 - DNA, 22 bp, Artificial sequence
  SiRNA target sequence
gaattactttcaggtgtccaca

SEQ ID NO: 111452 - DNA, 22 bp, Artificial sequence
  SiRNA target sequence
aattactttcaggtgtccacat

SEQ ID NO: 111453 - DNA, 22 bp, Artificial sequence
  SiRNA target sequence
attactttcaggtgtccacata

SEQ ID NO: 111454 - DNA, 22 bp, Artificial sequence
  SiRNA target sequence
ttactttcaggtgtccacatac

SEQ ID NO: 111455 - DNA, 22 bp, Artificial sequence
  SiRNA target sequence
tactttcaggtgtccacatact

SEQ ID NO: 111456 - DNA, 22 bp, Artificial sequence
  SiRNA target sequence
actttcaggtgtccacatacta

SEQ ID NO: 111457 - DNA, 22 bp, Artificial sequence
  SiRNA target sequence
ctttcaggtgtccacatactat

SEQ ID NO: 111458 - DNA, 22 bp, Artificial sequence
  SiRNA target sequence
tttcaggtgtccacatactata

SEQ ID NO: 111459 - DNA, 22 bp, Artificial sequence
  SiRNA target sequence
ttcaggtgtccacatactataa

SEQ ID NO: 111460 - DNA, 22 bp, Artificial sequence
  SiRNA target sequence
tcaggtgtccacatactataat

SEQ ID NO: 111461 - DNA, 22 bp, Artificial sequence
  SiRNA target sequence
caggtgtccacatactataatg

SEQ ID NO: 111462 - DNA, 22 bp, Artificial sequence
  SiRNA target sequence
aggtgtccacatactataatga

SEQ ID NO: 111463 - DNA, 22 bp, Artificial sequence
  SiRNA target sequence
ggtgtccacatactataatgat

SEQ ID NO: 111464 - DNA, 22 bp, Artificial sequence
  SiRNA target sequence
gtgtccacatactataatgatt

SEQ ID NO: 111465 - DNA, 22 bp, Artificial sequence
  SiRNA target sequence
tgtccacatactataatgatta

SEQ ID NO: 111466 - DNA, 22 bp, Artificial sequence
  SiRNA target sequence
gtccacatactataatgattat

SEQ ID NO: 111467 - DNA, 22 bp, Artificial sequence
  SiRNA target sequence
tccacatactataatgattatt

SEQ ID NO: 111468 - DNA, 22 bp, Artificial sequence
  SiRNA target sequence
ccacatactataatgattattt

SEQ ID NO: 111469 - DNA, 22 bp, Artificial sequence
  SiRNA target sequence
cacatactataatgattatttt

SEQ ID NO: 111470 - DNA, 22 bp, Artificial sequence
  SiRNA target sequence
acatactataatgattattttc

SEQ ID NO: 111471 - DNA, 22 bp, Artificial sequence
  SiRNA target sequence
catactataatgattattttca

SEQ ID NO: 111472 - DNA, 22 bp, Artificial sequence
  SiRNA target sequence
atactataatgattattttcac

SEQ ID NO: 111473 - DNA, 22 bp, Artificial sequence
  SiRNA target sequence
tactataatgattattttcaca

SEQ ID NO: 111474 - DNA, 22 bp, Artificial sequence
  SiRNA target sequence
actataatgattattttcacat

SEQ ID NO: 111475 - DNA, 22 bp, Artificial sequence
  SiRNA target sequence
ctataatgattattttcacata

SEQ ID NO: 111476 - DNA, 22 bp, Artificial sequence
  SiRNA target sequence
tataatgattattttcacatac

SEQ ID NO: 111477 - DNA, 22 bp, Artificial sequence
  SiRNA target sequence
ataatgattattttcacataca

SEQ ID NO: 111478 - DNA, 22 bp, Artificial sequence
  SiRNA target sequence
taatgattattttcacatacat

SEQ ID NO: 111479 - DNA, 22 bp, Artificial sequence
  SiRNA target sequence
aatgattattttcacatacata

SEQ ID NO: 111480 - DNA, 22 bp, Artificial sequence
  SiRNA target sequence
atgattattttcacatacataa

SEQ ID NO: 111481 - DNA, 22 bp, Artificial sequence
  SiRNA target sequence
tgattattttcacatacataaa

SEQ ID NO: 111482 - DNA, 22 bp, Artificial sequence
  SiRNA target sequence
gattattttcacatacataaac

SEQ ID NO: 111483 - DNA, 22 bp, Artificial sequence
  SiRNA target sequence
attattttcacatacataaacc

SEQ ID NO: 111484 - DNA, 22 bp, Artificial sequence
  SiRNA target sequence
ttattttcacatacataaacca

SEQ ID NO: 111485 - DNA, 22 bp, Artificial sequence
  SiRNA target sequence
tattttcacatacataaaccac

SEQ ID NO: 111486 - DNA, 22 bp, Artificial sequence
  SiRNA target sequence
attttcacatacataaaccaca

SEQ ID NO: 111487 - DNA, 22 bp, Artificial sequence
  SiRNA target sequence
ttttcacatacataaaccacag

SEQ ID NO: 111488 - DNA, 22 bp, Artificial sequence
  SiRNA target sequence
tttcacatacataaaccacagg

SEQ ID NO: 111489 - DNA, 22 bp, Artificial sequence
  SiRNA target sequence
ttcacatacataaaccacagga

SEQ ID NO: 111490 - DNA, 22 bp, Artificial sequence
  SiRNA target sequence
tcacatacataaaccacaggaa

SEQ ID NO: 111491 - DNA, 22 bp, Artificial sequence
  SiRNA target sequence
cacatacataaaccacaggaag

SEQ ID NO: 111492 - DNA, 22 bp, Artificial sequence
  SiRNA target sequence
acatacataaaccacaggaagt

SEQ ID NO: 111493 - DNA, 22 bp, Artificial sequence
  SiRNA target sequence
catacataaaccacaggaagtt

SEQ ID NO: 111494 - DNA, 22 bp, Artificial sequence
  SiRNA target sequence
atacataaaccacaggaagttt

SEQ ID NO: 111495 - DNA, 22 bp, Artificial sequence
  SiRNA target sequence
tacataaaccacaggaagtttc

SEQ ID NO: 111496 - DNA, 22 bp, Artificial sequence
  SiRNA target sequence
acataaaccacaggaagtttcc

SEQ ID NO: 111497 - DNA, 22 bp, Artificial sequence
  SiRNA target sequence
cataaaccacaggaagtttcca

SEQ ID NO: 111498 - DNA, 22 bp, Artificial sequence
  SiRNA target sequence
ataaaccacaggaagtttccat

SEQ ID NO: 111499 - DNA, 22 bp, Artificial sequence
  SiRNA target sequence
taaaccacaggaagtttccata

SEQ ID NO: 111500 - DNA, 22 bp, Artificial sequence
  SiRNA target sequence
aaaccacaggaagtttccataa

SEQ ID NO: 111501 - DNA, 22 bp, Artificial sequence
  SiRNA target sequence
aaccacaggaagtttccataat

SEQ ID NO: 111502 - DNA, 22 bp, Artificial sequence
  SiRNA target sequence
accacaggaagtttccataatg

SEQ ID NO: 111503 - DNA, 22 bp, Artificial sequence
  SiRNA target sequence
ccacaggaagtttccataatgc

SEQ ID NO: 111504 - DNA, 22 bp, Artificial sequence
  SiRNA target sequence
cacaggaagtttccataatgca

SEQ ID NO: 111505 - DNA, 22 bp, Artificial sequence
  SiRNA target sequence
acaggaagtttccataatgcag

SEQ ID NO: 111506 - DNA, 22 bp, Artificial sequence
  SiRNA target sequence
caggaagtttccataatgcagc

SEQ ID NO: 111507 - DNA, 22 bp, Artificial sequence
  SiRNA target sequence
aggaagtttccataatgcagcc

SEQ ID NO: 111508 - DNA, 22 bp, Artificial sequence
  SiRNA target sequence
ggaagtttccataatgcagcca

SEQ ID NO: 111509 - DNA, 22 bp, Artificial sequence
  SiRNA target sequence
gaagtttccataatgcagccat

SEQ ID NO: 111510 - DNA, 22 bp, Artificial sequence
  SiRNA target sequence
aagtttccataatgcagccata

SEQ ID NO: 111511 - DNA, 22 bp, Artificial sequence
  SiRNA target sequence
agtttccataatgcagccatat

SEQ ID NO: 111512 - DNA, 22 bp, Artificial sequence
  SiRNA target sequence
gtttccataatgcagccatatt

SEQ ID NO: 111513 - DNA, 22 bp, Artificial sequence
  SiRNA target sequence
tttccataatgcagccatattg

SEQ ID NO: 111514 - DNA, 22 bp, Artificial sequence
  SiRNA target sequence
ttccataatgcagccatattga

SEQ ID NO: 111515 - DNA, 22 bp, Artificial sequence
  SiRNA target sequence
tccataatgcagccatattgaa

SEQ ID NO: 111516 - DNA, 22 bp, Artificial sequence
  SiRNA target sequence
ccataatgcagccatattgaac

SEQ ID NO: 111517 - DNA, 22 bp, Artificial sequence
  SiRNA target sequence
cataatgcagccatattgaacg

SEQ ID NO: 111518 - DNA, 22 bp, Artificial sequence
  SiRNA target sequence
ataatgcagccatattgaacga

SEQ ID NO: 111519 - DNA, 22 bp, Artificial sequence
  SiRNA target sequence
taatgcagccatattgaacgac

SEQ ID NO: 111520 - DNA, 22 bp, Artificial sequence
  SiRNA target sequence
aatgcagccatattgaacgact

SEQ ID NO: 111521 - DNA, 22 bp, Artificial sequence
  SiRNA target sequence
atgcagccatattgaacgactc

SEQ ID NO: 111522 - DNA, 22 bp, Artificial sequence
  SiRNA target sequence
tgcagccatattgaacgactcc

SEQ ID NO: 111523 - DNA, 22 bp, Artificial sequence
  SiRNA target sequence
gcagccatattgaacgactccc

SEQ ID NO: 111524 - DNA, 22 bp, Artificial sequence
  SiRNA target sequence
cagccatattgaacgactccca

SEQ ID NO: 111525 - DNA, 22 bp, Artificial sequence
  SiRNA target sequence
agccatattgaacgactcccag

SEQ ID NO: 111526 - DNA, 22 bp, Artificial sequence
  SiRNA target sequence
gccatattgaacgactcccaga

SEQ ID NO: 111527 - DNA, 22 bp, Artificial sequence
  SiRNA target sequence
ccatattgaacgactcccagac

SEQ ID NO: 111528 - DNA, 22 bp, Artificial sequence
  SiRNA target sequence
catattgaacgactcccagacc

SEQ ID NO: 111529 - DNA, 22 bp, Artificial sequence
  SiRNA target sequence
atattgaacgactcccagacct

SEQ ID NO: 111530 - DNA, 22 bp, Artificial sequence
  SiRNA target sequence
tattgaacgactcccagacctg

SEQ ID NO: 111531 - DNA, 22 bp, Artificial sequence
  SiRNA target sequence
attgaacgactcccagacctgt

SEQ ID NO: 111532 - DNA, 22 bp, Artificial sequence
  SiRNA target sequence
ttgaacgactcccagacctgtc

SEQ ID NO: 111533 - DNA, 22 bp, Artificial sequence
  SiRNA target sequence
tgaacgactcccagacctgtcc

SEQ ID NO: 111534 - DNA, 22 bp, Artificial sequence
  SiRNA target sequence
gaacgactcccagacctgtccc

SEQ ID NO: 111535 - DNA, 22 bp, Artificial sequence
  SiRNA target sequence
aacgactcccagacctgtccct

SEQ ID NO: 111536 - DNA, 22 bp, Artificial sequence
  SiRNA target sequence
acgactcccagacctgtccctg

SEQ ID NO: 111537 - DNA, 22 bp, Artificial sequence
  SiRNA target sequence
cgactcccagacctgtccctga

SEQ ID NO: 111538 - DNA, 22 bp, Artificial sequence
  SiRNA target sequence
gactcccagacctgtccctgat

SEQ ID NO: 111539 - DNA, 22 bp, Artificial sequence
  SiRNA target sequence
actcccagacctgtccctgatt

SEQ ID NO: 111540 - DNA, 22 bp, Artificial sequence
  SiRNA target sequence
ctcccagacctgtccctgattt

SEQ ID NO: 111541 - DNA, 22 bp, Artificial sequence
  SiRNA target sequence
tcccagacctgtccctgatttg

SEQ ID NO: 111542 - DNA, 22 bp, Artificial sequence
  SiRNA target sequence
cccagacctgtccctgatttgc

SEQ ID NO: 111543 - DNA, 22 bp, Artificial sequence
  SiRNA target sequence
ccagacctgtccctgatttgca

SEQ ID NO: 111544 - DNA, 22 bp, Artificial sequence
  SiRNA target sequence
cagacctgtccctgatttgcag

SEQ ID NO: 111545 - DNA, 22 bp, Artificial sequence
  SiRNA target sequence
agacctgtccctgatttgcagc

SEQ ID NO: 111546 - DNA, 22 bp, Artificial sequence
  SiRNA target sequence
gacctgtccctgatttgcagca

SEQ ID NO: 111547 - DNA, 22 bp, Artificial sequence
  SiRNA target sequence
acctgtccctgatttgcagcac

SEQ ID NO: 111548 - DNA, 22 bp, Artificial sequence
  SiRNA target sequence
cctgtccctgatttgcagcacc

SEQ ID NO: 111549 - DNA, 22 bp, Artificial sequence
  SiRNA target sequence
ctgtccctgatttgcagcacca

SEQ ID NO: 111550 - DNA, 22 bp, Artificial sequence
  SiRNA target sequence
tgtccctgatttgcagcaccat

SEQ ID NO: 111551 - DNA, 22 bp, Artificial sequence
  SiRNA target sequence
gtccctgatttgcagcaccatc

SEQ ID NO: 111552 - DNA, 22 bp, Artificial sequence
  SiRNA target sequence
tccctgatttgcagcaccatcc

SEQ ID NO: 111553 - DNA, 22 bp, Artificial sequence
  SiRNA target sequence
ccctgatttgcagcaccatccc

SEQ ID NO: 111554 - DNA, 22 bp, Artificial sequence
  SiRNA target sequence
cctgatttgcagcaccatcccc

SEQ ID NO: 111555 - DNA, 22 bp, Artificial sequence
  SiRNA target sequence
ctgatttgcagcaccatccccg

SEQ ID NO: 111556 - DNA, 22 bp, Artificial sequence
  SiRNA target sequence
tgatttgcagcaccatccccga

SEQ ID NO: 111557 - DNA, 22 bp, Artificial sequence
  SiRNA target sequence
gatttgcagcaccatccccgaa

SEQ ID NO: 111558 - DNA, 22 bp, Artificial sequence
  SiRNA target sequence
atttgcagcaccatccccgaaa

SEQ ID NO: 111559 - DNA, 22 bp, Artificial sequence
  SiRNA target sequence
tttgcagcaccatccccgaaaa

SEQ ID NO: 111560 - DNA, 22 bp, Artificial sequence
  SiRNA target sequence
ttgcagcaccatccccgaaaaa

SEQ ID NO: 111561 - DNA, 22 bp, Artificial sequence
  SiRNA target sequence
tgcagcaccatccccgaaaaat

SEQ ID NO: 111562 - DNA, 22 bp, Artificial sequence
  SiRNA target sequence
gcagcaccatccccgaaaaata

SEQ ID NO: 111563 - DNA, 22 bp, Artificial sequence
  SiRNA target sequence
cagcaccatccccgaaaaatac

SEQ ID NO: 111564 - DNA, 22 bp, Artificial sequence
  SiRNA target sequence
agcaccatccccgaaaaataca

SEQ ID NO: 111565 - DNA, 22 bp, Artificial sequence
  SiRNA target sequence
gcaccatccccgaaaaatacaa

SEQ ID NO: 111566 - DNA, 22 bp, Artificial sequence
  SiRNA target sequence
caccatccccgaaaaatacaaa

SEQ ID NO: 111567 - DNA, 22 bp, Artificial sequence
  SiRNA target sequence
accatccccgaaaaatacaaat

SEQ ID NO: 111568 - DNA, 22 bp, Artificial sequence
  SiRNA target sequence
ccatccccgaaaaatacaaatg

SEQ ID NO: 111569 - DNA, 22 bp, Artificial sequence
  SiRNA target sequence
catccccgaaaaatacaaatgc

SEQ ID NO: 111570 - DNA, 22 bp, Artificial sequence
  SiRNA target sequence
atccccgaaaaatacaaatgct

SEQ ID NO: 111571 - DNA, 22 bp, Artificial sequence
  SiRNA target sequence
tccccgaaaaatacaaatgcta

SEQ ID NO: 111572 - DNA, 22 bp, Artificial sequence
  SiRNA target sequence
ccccgaaaaatacaaatgctac

SEQ ID NO: 111573 - DNA, 22 bp, Artificial sequence
  SiRNA target sequence
cccgaaaaatacaaatgctaca

SEQ ID NO: 111574 - DNA, 22 bp, Artificial sequence
  SiRNA target sequence
ccgaaaaatacaaatgctacat

SEQ ID NO: 111575 - DNA, 22 bp, Artificial sequence
  SiRNA target sequence
cgaaaaatacaaatgctacatt

SEQ ID NO: 111576 - DNA, 22 bp, Artificial sequence
  SiRNA target sequence
gaaaaatacaaatgctacattt

SEQ ID NO: 111577 - DNA, 22 bp, Artificial sequence
  SiRNA target sequence
aaaaatacaaatgctacatttt

SEQ ID NO: 111578 - DNA, 22 bp, Artificial sequence
  SiRNA target sequence
aaaatacaaatgctacattttt

SEQ ID NO: 111579 - DNA, 22 bp, Artificial sequence
  SiRNA target sequence
aaatacaaatgctacatttttt

SEQ ID NO: 111580 - DNA, 22 bp, Artificial sequence
  SiRNA target sequence
aatacaaatgctacatttttta

SEQ ID NO: 111581 - DNA, 22 bp, Artificial sequence
  SiRNA target sequence
atacaaatgctacattttttac

SEQ ID NO: 111582 - DNA, 22 bp, Artificial sequence
  SiRNA target sequence
tacaaatgctacattttttact

SEQ ID NO: 111583 - DNA, 22 bp, Artificial sequence
  SiRNA target sequence
acaaatgctacattttttactt

SEQ ID NO: 111584 - DNA, 22 bp, Artificial sequence
  SiRNA target sequence
caaatgctacattttttacttt

SEQ ID NO: 111585 - DNA, 22 bp, Artificial sequence
  SiRNA target sequence
aaatgctacattttttactttt

SEQ ID NO: 111586 - DNA, 22 bp, Artificial sequence
  SiRNA target sequence
aatgctacattttttacttttt

SEQ ID NO: 111587 - DNA, 22 bp, Artificial sequence
  SiRNA target sequence
atgctacattttttactttttt

SEQ ID NO: 111588 - DNA, 22 bp, Artificial sequence
  SiRNA target sequence
tgctacattttttactttttta

SEQ ID NO: 111589 - DNA, 22 bp, Artificial sequence
  SiRNA target sequence
gctacattttttacttttttat

SEQ ID NO: 111590 - DNA, 22 bp, Artificial sequence
  SiRNA target sequence
ctacattttttacttttttata

SEQ ID NO: 111591 - DNA, 22 bp, Artificial sequence
  SiRNA target sequence
tacattttttacttttttatat

SEQ ID NO: 111592 - DNA, 22 bp, Artificial sequence
  SiRNA target sequence
acattttttacttttttatatt

SEQ ID NO: 111593 - DNA, 22 bp, Artificial sequence
  SiRNA target sequence
cattttttacttttttatattg

SEQ ID NO: 111594 - DNA, 22 bp, Artificial sequence
  SiRNA target sequence
attttttacttttttatattgt

SEQ ID NO: 111595 - DNA, 22 bp, Artificial sequence
  SiRNA target sequence
ttttttacttttttatattgta

SEQ ID NO: 111596 - DNA, 22 bp, Artificial sequence
  SiRNA target sequence
tttttacttttttatattgtaa

SEQ ID NO: 111597 - DNA, 22 bp, Artificial sequence
  SiRNA target sequence
ttttacttttttatattgtaaa

SEQ ID NO: 111598 - DNA, 22 bp, Artificial sequence
  SiRNA target sequence
tttacttttttatattgtaaag

SEQ ID NO: 111599 - DNA, 22 bp, Artificial sequence
  SiRNA target sequence
ttacttttttatattgtaaagc

SEQ ID NO: 111600 - DNA, 22 bp, Artificial sequence
  SiRNA target sequence
tacttttttatattgtaaagca

SEQ ID NO: 111601 - DNA, 22 bp, Artificial sequence
  SiRNA target sequence
acttttttatattgtaaagcaa

SEQ ID NO: 111602 - DNA, 22 bp, Artificial sequence
  SiRNA target sequence
cttttttatattgtaaagcaaa

SEQ ID NO: 111603 - DNA, 22 bp, Artificial sequence
  SiRNA target sequence
ttttttatattgtaaagcaaat

SEQ ID NO: 111604 - DNA, 22 bp, Artificial sequence
  SiRNA target sequence
tttttatattgtaaagcaaatc

SEQ ID NO: 111605 - DNA, 22 bp, Artificial sequence
  SiRNA target sequence
ttttatattgtaaagcaaatcc

SEQ ID NO: 111606 - DNA, 22 bp, Artificial sequence
  SiRNA target sequence
tttatattgtaaagcaaatccc

SEQ ID NO: 111607 - DNA, 22 bp, Artificial sequence
  SiRNA target sequence
ttatattgtaaagcaaatccca

SEQ ID NO: 111608 - DNA, 22 bp, Artificial sequence
  SiRNA target sequence
tatattgtaaagcaaatcccaa

SEQ ID NO: 111609 - DNA, 22 bp, Artificial sequence
  SiRNA target sequence
atattgtaaagcaaatcccaat

SEQ ID NO: 111610 - DNA, 22 bp, Artificial sequence
  SiRNA target sequence
tattgtaaagcaaatcccaatc

SEQ ID NO: 111611 - DNA, 22 bp, Artificial sequence
  SiRNA target sequence
attgtaaagcaaatcccaatcc

SEQ ID NO: 111612 - DNA, 22 bp, Artificial sequence
  SiRNA target sequence
ttgtaaagcaaatcccaatcct

SEQ ID NO: 111613 - DNA, 22 bp, Artificial sequence
  SiRNA target sequence
tgtaaagcaaatcccaatcctg

SEQ ID NO: 111614 - DNA, 22 bp, Artificial sequence
  SiRNA target sequence
gtaaagcaaatcccaatcctgt

SEQ ID NO: 111615 - DNA, 22 bp, Artificial sequence
  SiRNA target sequence
taaagcaaatcccaatcctgta

SEQ ID NO: 111616 - DNA, 22 bp, Artificial sequence
  SiRNA target sequence
aaagcaaatcccaatcctgtac

SEQ ID NO: 111617 - DNA, 22 bp, Artificial sequence
  SiRNA target sequence
aagcaaatcccaatcctgtacc

SEQ ID NO: 111618 - DNA, 22 bp, Artificial sequence
  SiRNA target sequence
agcaaatcccaatcctgtacca

SEQ ID NO: 111619 - DNA, 22 bp, Artificial sequence
  SiRNA target sequence
gcaaatcccaatcctgtaccaa

SEQ ID NO: 111620 - DNA, 22 bp, Artificial sequence
  SiRNA target sequence
caaatcccaatcctgtaccaag

SEQ ID NO: 111621 - DNA, 22 bp, Artificial sequence
  SiRNA target sequence
aaatcccaatcctgtaccaagc

SEQ ID NO: 111622 - DNA, 22 bp, Artificial sequence
  SiRNA target sequence
aatcccaatcctgtaccaagcg

SEQ ID NO: 111623 - DNA, 22 bp, Artificial sequence
  SiRNA target sequence
atcccaatcctgtaccaagcga

SEQ ID NO: 111624 - DNA, 22 bp, Artificial sequence
  SiRNA target sequence
tcccaatcctgtaccaagcgat

SEQ ID NO: 111625 - DNA, 22 bp, Artificial sequence
  SiRNA target sequence
cccaatcctgtaccaagcgata

SEQ ID NO: 111626 - DNA, 22 bp, Artificial sequence
  SiRNA target sequence
ccaatcctgtaccaagcgatac

SEQ ID NO: 111627 - DNA, 22 bp, Artificial sequence
  SiRNA target sequence
caatcctgtaccaagcgatacc

SEQ ID NO: 111628 - DNA, 22 bp, Artificial sequence
  SiRNA target sequence
aatcctgtaccaagcgatacct

SEQ ID NO: 111629 - DNA, 22 bp, Artificial sequence
  SiRNA target sequence
atcctgtaccaagcgatacctg

SEQ ID NO: 111630 - DNA, 22 bp, Artificial sequence
  SiRNA target sequence
tcctgtaccaagcgatacctgc

SEQ ID NO: 111631 - DNA, 22 bp, Artificial sequence
  SiRNA target sequence
cctgtaccaagcgatacctgcg

SEQ ID NO: 111632 - DNA, 22 bp, Artificial sequence
  SiRNA target sequence
ctgtaccaagcgatacctgcgc

SEQ ID NO: 111633 - DNA, 22 bp, Artificial sequence
  SiRNA target sequence
tgtaccaagcgatacctgcgca

SEQ ID NO: 111634 - DNA, 22 bp, Artificial sequence
  SiRNA target sequence
gtaccaagcgatacctgcgcac

SEQ ID NO: 111635 - DNA, 22 bp, Artificial sequence
  SiRNA target sequence
taccaagcgatacctgcgcacc

SEQ ID NO: 111636 - DNA, 22 bp, Artificial sequence
  SiRNA target sequence
accaagcgatacctgcgcacct

SEQ ID NO: 111637 - DNA, 22 bp, Artificial sequence
  SiRNA target sequence
ccaagcgatacctgcgcaccta

SEQ ID NO: 111638 - DNA, 22 bp, Artificial sequence
  SiRNA target sequence
caagcgatacctgcgcacctac

SEQ ID NO: 111639 - DNA, 22 bp, Artificial sequence
  SiRNA target sequence
aagcgatacctgcgcacctact

SEQ ID NO: 111640 - DNA, 22 bp, Artificial sequence
  SiRNA target sequence
agcgatacctgcgcacctacta

SEQ ID NO: 111641 - DNA, 22 bp, Artificial sequence
  SiRNA target sequence
gcgatacctgcgcacctactat

SEQ ID NO: 111642 - DNA, 22 bp, Artificial sequence
  SiRNA target sequence
cgatacctgcgcacctactata

SEQ ID NO: 111643 - DNA, 22 bp, Artificial sequence
  SiRNA target sequence
gatacctgcgcacctactatac

SEQ ID NO: 111644 - DNA, 22 bp, Artificial sequence
  SiRNA target sequence
atacctgcgcacctactatacc

SEQ ID NO: 111645 - DNA, 22 bp, Artificial sequence
  SiRNA target sequence
tacctgcgcacctactataccg

SEQ ID NO: 111646 - DNA, 22 bp, Artificial sequence
  SiRNA target sequence
acctgcgcacctactataccgt

SEQ ID NO: 111647 - DNA, 22 bp, Artificial sequence
  SiRNA target sequence
cctgcgcacctactataccgtg

SEQ ID NO: 111648 - DNA, 22 bp, Artificial sequence
  SiRNA target sequence
ctgcgcacctactataccgtgt

SEQ ID NO: 111649 - DNA, 22 bp, Artificial sequence
  SiRNA target sequence
tgcgcacctactataccgtgtc

SEQ ID NO: 111650 - DNA, 22 bp, Artificial sequence
  SiRNA target sequence
gcgcacctactataccgtgtcc

SEQ ID NO: 111651 - DNA, 22 bp, Artificial sequence
  SiRNA target sequence
cgcacctactataccgtgtccc

SEQ ID NO: 111652 - DNA, 22 bp, Artificial sequence
  SiRNA target sequence
gcacctactataccgtgtcccc

SEQ ID NO: 111653 - DNA, 22 bp, Artificial sequence
  SiRNA target sequence
cacctactataccgtgtccccc

SEQ ID NO: 111654 - DNA, 22 bp, Artificial sequence
  SiRNA target sequence
acctactataccgtgtccccca

SEQ ID NO: 111655 - DNA, 22 bp, Artificial sequence
  SiRNA target sequence
cctactataccgtgtcccccat

SEQ ID NO: 111656 - DNA, 22 bp, Artificial sequence
  SiRNA target sequence
ctactataccgtgtcccccata

SEQ ID NO: 111657 - DNA, 22 bp, Artificial sequence
  SiRNA target sequence
tactataccgtgtcccccataa

SEQ ID NO: 111658 - DNA, 22 bp, Artificial sequence
  SiRNA target sequence
actataccgtgtcccccataaa

SEQ ID NO: 111659 - DNA, 22 bp, Artificial sequence
  SiRNA target sequence
ctataccgtgtcccccataaaa

SEQ ID NO: 111660 - DNA, 22 bp, Artificial sequence
  SiRNA target sequence
tataccgtgtcccccataaaat

SEQ ID NO: 111661 - DNA, 22 bp, Artificial sequence
  SiRNA target sequence
ataccgtgtcccccataaaatt

SEQ ID NO: 111662 - DNA, 22 bp, Artificial sequence
  SiRNA target sequence
taccgtgtcccccataaaattg

SEQ ID NO: 111663 - DNA, 22 bp, Artificial sequence
  SiRNA target sequence
accgtgtcccccataaaattgg

SEQ ID NO: 111664 - DNA, 22 bp, Artificial sequence
  SiRNA target sequence
ccgtgtcccccataaaattggt

SEQ ID NO: 111665 - DNA, 22 bp, Artificial sequence
  SiRNA target sequence
cgtgtcccccataaaattggtc

SEQ ID NO: 111666 - DNA, 22 bp, Artificial sequence
  SiRNA target sequence
gtgtcccccataaaattggtca

SEQ ID NO: 111667 - DNA, 22 bp, Artificial sequence
  SiRNA target sequence
tgtcccccataaaattggtcat

SEQ ID NO: 111668 - DNA, 22 bp, Artificial sequence
  SiRNA target sequence
gtcccccataaaattggtcatt

SEQ ID NO: 111669 - DNA, 22 bp, Artificial sequence
  SiRNA target sequence
tcccccataaaattggtcatta

SEQ ID NO: 111670 - DNA, 22 bp, Artificial sequence
  SiRNA target sequence
cccccataaaattggtcattat

SEQ ID NO: 111671 - DNA, 22 bp, Artificial sequence
  SiRNA target sequence
ccccataaaattggtcattata

SEQ ID NO: 111672 - DNA, 22 bp, Artificial sequence
  SiRNA target sequence
cccataaaattggtcattatac

SEQ ID NO: 111673 - DNA, 22 bp, Artificial sequence
  SiRNA target sequence
ccataaaattggtcattataca

SEQ ID NO: 111674 - DNA, 22 bp, Artificial sequence
  SiRNA target sequence
cataaaattggtcattatacaa

SEQ ID NO: 111675 - DNA, 22 bp, Artificial sequence
  SiRNA target sequence
ataaaattggtcattatacaaa

SEQ ID NO: 111676 - DNA, 22 bp, Artificial sequence
  SiRNA target sequence
taaaattggtcattatacaaat

SEQ ID NO: 111677 - DNA, 22 bp, Artificial sequence
  SiRNA target sequence
aaaattggtcattatacaaatg

SEQ ID NO: 111678 - DNA, 22 bp, Artificial sequence
  SiRNA target sequence
aaattggtcattatacaaatgc

SEQ ID NO: 111679 - DNA, 22 bp, Artificial sequence
  SiRNA target sequence
aattggtcattatacaaatgca

SEQ ID NO: 111680 - DNA, 22 bp, Artificial sequence
  SiRNA target sequence
attggtcattatacaaatgcat

SEQ ID NO: 111681 - DNA, 22 bp, Artificial sequence
  SiRNA target sequence
ttggtcattatacaaatgcatc

SEQ ID NO: 111682 - DNA, 22 bp, Artificial sequence
  SiRNA target sequence
tggtcattatacaaatgcatcg

SEQ ID NO: 111683 - DNA, 22 bp, Artificial sequence
  SiRNA target sequence
ggtcattatacaaatgcatcga

SEQ ID NO: 111684 - DNA, 22 bp, Artificial sequence
  SiRNA target sequence
gtcattatacaaatgcatcgat

SEQ ID NO: 111685 - DNA, 22 bp, Artificial sequence
  SiRNA target sequence
tcattatacaaatgcatcgatc

SEQ ID NO: 111686 - DNA, 22 bp, Artificial sequence
  SiRNA target sequence
cattatacaaatgcatcgatcc

SEQ ID NO: 111687 - DNA, 22 bp, Artificial sequence
  SiRNA target sequence
attatacaaatgcatcgatcct

SEQ ID NO: 111688 - DNA, 22 bp, Artificial sequence
  SiRNA target sequence
ttatacaaatgcatcgatcctc

SEQ ID NO: 111689 - DNA, 22 bp, Artificial sequence
  SiRNA target sequence
tatacaaatgcatcgatcctcc

SEQ ID NO: 111690 - DNA, 22 bp, Artificial sequence
  SiRNA target sequence
atacaaatgcatcgatcctcct

SEQ ID NO: 111691 - DNA, 22 bp, Artificial sequence
  SiRNA target sequence
tacaaatgcatcgatcctcctt

SEQ ID NO: 111692 - DNA, 22 bp, Artificial sequence
  SiRNA target sequence
acaaatgcatcgatcctccttt

SEQ ID NO: 111693 - DNA, 22 bp, Artificial sequence
  SiRNA target sequence
caaatgcatcgatcctcctttt

SEQ ID NO: 111694 - DNA, 22 bp, Artificial sequence
  SiRNA target sequence
aaatgcatcgatcctccttttc

SEQ ID NO: 111695 - DNA, 22 bp, Artificial sequence
  SiRNA target sequence
aatgcatcgatcctccttttcc

SEQ ID NO: 111696 - DNA, 22 bp, Artificial sequence
  SiRNA target sequence
atgcatcgatcctccttttcct

SEQ ID NO: 111697 - DNA, 22 bp, Artificial sequence
  SiRNA target sequence
tgcatcgatcctccttttcctt

SEQ ID NO: 111698 - DNA, 22 bp, Artificial sequence
  SiRNA target sequence
gcatcgatcctccttttccttt

SEQ ID NO: 111699 - DNA, 22 bp, Artificial sequence
  SiRNA target sequence
catcgatcctccttttcctttg

SEQ ID NO: 111700 - DNA, 22 bp, Artificial sequence
  SiRNA target sequence
atcgatcctccttttcctttgc

SEQ ID NO: 111701 - DNA, 22 bp, Artificial sequence
  SiRNA target sequence
tcgatcctccttttcctttgca

SEQ ID NO: 111702 - DNA, 22 bp, Artificial sequence
  SiRNA target sequence
cgatcctccttttcctttgcaa

SEQ ID NO: 111703 - DNA, 22 bp, Artificial sequence
  SiRNA target sequence
gatcctccttttcctttgcaat

SEQ ID NO: 111704 - DNA, 22 bp, Artificial sequence
  SiRNA target sequence
atcctccttttcctttgcaatt

SEQ ID NO: 111705 - DNA, 22 bp, Artificial sequence
  SiRNA target sequence
tcctccttttcctttgcaatta

SEQ ID NO: 111706 - DNA, 22 bp, Artificial sequence
  SiRNA target sequence
cctccttttcctttgcaattac

SEQ ID NO: 111707 - DNA, 22 bp, Artificial sequence
  SiRNA target sequence
ctccttttcctttgcaattacc

SEQ ID NO: 111708 - DNA, 22 bp, Artificial sequence
  SiRNA target sequence
tccttttcctttgcaattacca

SEQ ID NO: 111709 - DNA, 22 bp, Artificial sequence
  SiRNA target sequence
ccttttcctttgcaattaccaa

SEQ ID NO: 111710 - DNA, 22 bp, Artificial sequence
  SiRNA target sequence
cttttcctttgcaattaccaat

SEQ ID NO: 111711 - DNA, 22 bp, Artificial sequence
  SiRNA target sequence
ttttcctttgcaattaccaata

SEQ ID NO: 111712 - DNA, 22 bp, Artificial sequence
  SiRNA target sequence
tttcctttgcaattaccaatag

SEQ ID NO: 111713 - DNA, 22 bp, Artificial sequence
  SiRNA target sequence
ttcctttgcaattaccaatagc

SEQ ID NO: 111714 - DNA, 22 bp, Artificial sequence
  SiRNA target sequence
tcctttgcaattaccaatagcc

SEQ ID NO: 111715 - DNA, 22 bp, Artificial sequence
  SiRNA target sequence
cctttgcaattaccaatagcct

SEQ ID NO: 111716 - DNA, 22 bp, Artificial sequence
  SiRNA target sequence
ctttgcaattaccaatagcctt

SEQ ID NO: 111717 - DNA, 22 bp, Artificial sequence
  SiRNA target sequence
tttgcaattaccaatagccttt

SEQ ID NO: 111718 - DNA, 22 bp, Artificial sequence
  SiRNA target sequence
ttgcaattaccaatagcctttc

SEQ ID NO: 111719 - DNA, 22 bp, Artificial sequence
  SiRNA target sequence
tgcaattaccaatagcctttcc

SEQ ID NO: 111720 - DNA, 22 bp, Artificial sequence
  SiRNA target sequence
gcaattaccaatagcctttcct

SEQ ID NO: 111721 - DNA, 22 bp, Artificial sequence
  SiRNA target sequence
caattaccaatagcctttccta

SEQ ID NO: 111722 - DNA, 22 bp, Artificial sequence
  SiRNA target sequence
aattaccaatagcctttcctaa

SEQ ID NO: 111723 - DNA, 22 bp, Artificial sequence
  SiRNA target sequence
attaccaatagcctttcctaat

SEQ ID NO: 111724 - DNA, 22 bp, Artificial sequence
  SiRNA target sequence
ttaccaatagcctttcctaata

SEQ ID NO: 111725 - DNA, 22 bp, Artificial sequence
  SiRNA target sequence
taccaatagcctttcctaataa

SEQ ID NO: 111726 - DNA, 22 bp, Artificial sequence
  SiRNA target sequence
accaatagcctttcctaataat

SEQ ID NO: 111727 - DNA, 22 bp, Artificial sequence
  SiRNA target sequence
ccaatagcctttcctaataatt

SEQ ID NO: 111728 - DNA, 22 bp, Artificial sequence
  SiRNA target sequence
caatagcctttcctaataattc

SEQ ID NO: 111729 - DNA, 22 bp, Artificial sequence
  SiRNA target sequence
aatagcctttcctaataattcc

SEQ ID NO: 111730 - DNA, 22 bp, Artificial sequence
  SiRNA target sequence
atagcctttcctaataattccc

SEQ ID NO: 111731 - DNA, 22 bp, Artificial sequence
  SiRNA target sequence
tagcctttcctaataattcccc

SEQ ID NO: 111732 - DNA, 22 bp, Artificial sequence
  SiRNA target sequence
agcctttcctaataattcccct

SEQ ID NO: 111733 - DNA, 22 bp, Artificial sequence
  SiRNA target sequence
gcctttcctaataattccccta

SEQ ID NO: 111734 - DNA, 22 bp, Artificial sequence
  SiRNA target sequence
cctttcctaataattcccctat

SEQ ID NO: 111735 - DNA, 22 bp, Artificial sequence
  SiRNA target sequence
ctttcctaataattcccctata

SEQ ID NO: 111736 - DNA, 22 bp, Artificial sequence
  SiRNA target sequence
tttcctaataattcccctataa

SEQ ID NO: 111737 - DNA, 22 bp, Artificial sequence
  SiRNA target sequence
ttcctaataattcccctataat

SEQ ID NO: 111738 - DNA, 22 bp, Artificial sequence
  SiRNA target sequence
tcctaataattcccctataata

SEQ ID NO: 111739 - DNA, 22 bp, Artificial sequence
  SiRNA target sequence
cctaataattcccctataatac

SEQ ID NO: 111740 - DNA, 22 bp, Artificial sequence
  SiRNA target sequence
ctaataattcccctataatact

SEQ ID NO: 111741 - DNA, 22 bp, Artificial sequence
  SiRNA target sequence
taataattcccctataatactt

SEQ ID NO: 111742 - DNA, 22 bp, Artificial sequence
  SiRNA target sequence
aataattcccctataatacttt

SEQ ID NO: 111743 - DNA, 22 bp, Artificial sequence
  SiRNA target sequence
ataattcccctataatactttc

SEQ ID NO: 111744 - DNA, 22 bp, Artificial sequence
  SiRNA target sequence
taattcccctataatactttct

SEQ ID NO: 111745 - DNA, 22 bp, Artificial sequence
  SiRNA target sequence
aattcccctataatactttcta

SEQ ID NO: 111746 - DNA, 22 bp, Artificial sequence
  SiRNA target sequence
attcccctataatactttctat

SEQ ID NO: 111747 - DNA, 22 bp, Artificial sequence
  SiRNA target sequence
ttcccctataatactttctata

SEQ ID NO: 111748 - DNA, 22 bp, Artificial sequence
  SiRNA target sequence
tcccctataatactttctatac

SEQ ID NO: 111749 - DNA, 22 bp, Artificial sequence
  SiRNA target sequence
cccctataatactttctatact

SEQ ID NO: 111750 - DNA, 22 bp, Artificial sequence
  SiRNA target sequence
ccctataatactttctatactg

SEQ ID NO: 111751 - DNA, 22 bp, Artificial sequence
  SiRNA target sequence
cctataatactttctatactga

SEQ ID NO: 111752 - DNA, 22 bp, Artificial sequence
  SiRNA target sequence
ctataatactttctatactgat

SEQ ID NO: 111753 - DNA, 22 bp, Artificial sequence
  SiRNA target sequence
tataatactttctatactgatt

SEQ ID NO: 111754 - DNA, 22 bp, Artificial sequence
  SiRNA target sequence
ataatactttctatactgattc

SEQ ID NO: 111755 - DNA, 22 bp, Artificial sequence
  SiRNA target sequence
taatactttctatactgattcc

SEQ ID NO: 111756 - DNA, 22 bp, Artificial sequence
  SiRNA target sequence
aatactttctatactgattcca

SEQ ID NO: 111757 - DNA, 22 bp, Artificial sequence
  SiRNA target sequence
atactttctatactgattccac

SEQ ID NO: 111758 - DNA, 22 bp, Artificial sequence
  SiRNA target sequence
tactttctatactgattccaca

SEQ ID NO: 111759 - DNA, 22 bp, Artificial sequence
  SiRNA target sequence
actttctatactgattccacaa

SEQ ID NO: 111760 - DNA, 22 bp, Artificial sequence
  SiRNA target sequence
ctttctatactgattccacaaa

SEQ ID NO: 111761 - DNA, 22 bp, Artificial sequence
  SiRNA target sequence
tttctatactgattccacaaat

SEQ ID NO: 111762 - DNA, 22 bp, Artificial sequence
  SiRNA target sequence
ttctatactgattccacaaata

SEQ ID NO: 111763 - DNA, 22 bp, Artificial sequence
  SiRNA target sequence
tctatactgattccacaaataa

SEQ ID NO: 111764 - DNA, 22 bp, Artificial sequence
  SiRNA target sequence
ctatactgattccacaaataaa

SEQ ID NO: 111765 - DNA, 22 bp, Artificial sequence
  SiRNA target sequence
tatactgattccacaaataaat

SEQ ID NO: 111766 - DNA, 22 bp, Artificial sequence
  SiRNA target sequence
atactgattccacaaataaatg

SEQ ID NO: 111767 - DNA, 22 bp, Artificial sequence
  SiRNA target sequence
tactgattccacaaataaatgc

SEQ ID NO: 111768 - DNA, 22 bp, Artificial sequence
  SiRNA target sequence
actgattccacaaataaatgct

SEQ ID NO: 111769 - DNA, 22 bp, Artificial sequence
  SiRNA target sequence
ctgattccacaaataaatgcta

SEQ ID NO: 111770 - DNA, 22 bp, Artificial sequence
  SiRNA target sequence
tgattccacaaataaatgctaa

SEQ ID NO: 111771 - DNA, 22 bp, Artificial sequence
  SiRNA target sequence
gattccacaaataaatgctaat

SEQ ID NO: 111772 - DNA, 22 bp, Artificial sequence
  SiRNA target sequence
attccacaaataaatgctaatc

SEQ ID NO: 111773 - DNA, 22 bp, Artificial sequence
  SiRNA target sequence
ttccacaaataaatgctaatcc

SEQ ID NO: 111774 - DNA, 22 bp, Artificial sequence
  SiRNA target sequence
tccacaaataaatgctaatcca

SEQ ID NO: 111775 - DNA, 22 bp, Artificial sequence
  SiRNA target sequence
ccacaaataaatgctaatccat

SEQ ID NO: 111776 - DNA, 22 bp, Artificial sequence
  SiRNA target sequence
cacaaataaatgctaatccatg

SEQ ID NO: 111777 - DNA, 22 bp, Artificial sequence
  SiRNA target sequence
acaaataaatgctaatccatgg

SEQ ID NO: 111778 - DNA, 22 bp, Artificial sequence
  SiRNA target sequence
caaataaatgctaatccatggc

SEQ ID NO: 111779 - DNA, 22 bp, Artificial sequence
  SiRNA target sequence
aaataaatgctaatccatggca

SEQ ID NO: 111780 - DNA, 22 bp, Artificial sequence
  SiRNA target sequence
aataaatgctaatccatggcat

SEQ ID NO: 111781 - DNA, 22 bp, Artificial sequence
  SiRNA target sequence
ataaatgctaatccatggcatc

SEQ ID NO: 111782 - DNA, 22 bp, Artificial sequence
  SiRNA target sequence
taaatgctaatccatggcatct

SEQ ID NO: 111783 - DNA, 22 bp, Artificial sequence
  SiRNA target sequence
aaatgctaatccatggcatcta

SEQ ID NO: 111784 - DNA, 22 bp, Artificial sequence
  SiRNA target sequence
aatgctaatccatggcatctat

SEQ ID NO: 111785 - DNA, 22 bp, Artificial sequence
  SiRNA target sequence
atgctaatccatggcatctata

SEQ ID NO: 111786 - DNA, 22 bp, Artificial sequence
  SiRNA target sequence
tgctaatccatggcatctataa

SEQ ID NO: 111787 - DNA, 22 bp, Artificial sequence
  SiRNA target sequence
gctaatccatggcatctataag

SEQ ID NO: 111788 - DNA, 22 bp, Artificial sequence
  SiRNA target sequence
ctaatccatggcatctataaga

SEQ ID NO: 111789 - DNA, 22 bp, Artificial sequence
  SiRNA target sequence
taatccatggcatctataagat

SEQ ID NO: 111790 - DNA, 22 bp, Artificial sequence
  SiRNA target sequence
aatccatggcatctataagatc

SEQ ID NO: 111791 - DNA, 22 bp, Artificial sequence
  SiRNA target sequence
atccatggcatctataagatcc

SEQ ID NO: 111792 - DNA, 22 bp, Artificial sequence
  SiRNA target sequence
tccatggcatctataagatcct

SEQ ID NO: 111793 - DNA, 22 bp, Artificial sequence
  SiRNA target sequence
ccatggcatctataagatccta

SEQ ID NO: 111794 - DNA, 22 bp, Artificial sequence
  SiRNA target sequence
catggcatctataagatcctat

SEQ ID NO: 111795 - DNA, 22 bp, Artificial sequence
  SiRNA target sequence
atggcatctataagatcctatg

SEQ ID NO: 111796 - DNA, 22 bp, Artificial sequence
  SiRNA target sequence
tggcatctataagatcctatga

SEQ ID NO: 111797 - DNA, 22 bp, Artificial sequence
  SiRNA target sequence
ggcatctataagatcctatgac

SEQ ID NO: 111798 - DNA, 22 bp, Artificial sequence
  SiRNA target sequence
gcatctataagatcctatgact

SEQ ID NO: 111799 - DNA, 22 bp, Artificial sequence
  SiRNA target sequence
catctataagatcctatgactt

SEQ ID NO: 111800 - DNA, 22 bp, Artificial sequence
  SiRNA target sequence
atctataagatcctatgacttt

SEQ ID NO: 111801 - DNA, 22 bp, Artificial sequence
  SiRNA target sequence
tctataagatcctatgacttta

SEQ ID NO: 111802 - DNA, 22 bp, Artificial sequence
  SiRNA target sequence
ctataagatcctatgactttat

SEQ ID NO: 111803 - DNA, 22 bp, Artificial sequence
  SiRNA target sequence
tataagatcctatgactttatc

SEQ ID NO: 111804 - DNA, 22 bp, Artificial sequence
  SiRNA target sequence
ataagatcctatgactttatca

SEQ ID NO: 111805 - DNA, 22 bp, Artificial sequence
  SiRNA target sequence
taagatcctatgactttatcat

SEQ ID NO: 111806 - DNA, 22 bp, Artificial sequence
  SiRNA target sequence
aagatcctatgactttatcatt

SEQ ID NO: 111807 - DNA, 22 bp, Artificial sequence
  SiRNA target sequence
agatcctatgactttatcattt

SEQ ID NO: 111808 - DNA, 22 bp, Artificial sequence
  SiRNA target sequence
gatcctatgactttatcatttt

SEQ ID NO: 111809 - DNA, 22 bp, Artificial sequence
  SiRNA target sequence
atcctatgactttatcattttt

SEQ ID NO: 111810 - DNA, 22 bp, Artificial sequence
  SiRNA target sequence
tcctatgactttatcattttta

SEQ ID NO: 111811 - DNA, 22 bp, Artificial sequence
  SiRNA target sequence
cctatgactttatcatttttat

SEQ ID NO: 111812 - DNA, 22 bp, Artificial sequence
  SiRNA target sequence
ctatgactttatcatttttatc

SEQ ID NO: 111813 - DNA, 22 bp, Artificial sequence
  SiRNA target sequence
tatgactttatcatttttatct

SEQ ID NO: 111814 - DNA, 22 bp, Artificial sequence
  SiRNA target sequence
atgactttatcatttttatcta

SEQ ID NO: 111815 - DNA, 22 bp, Artificial sequence
  SiRNA target sequence
tgactttatcatttttatctag

SEQ ID NO: 111816 - DNA, 22 bp, Artificial sequence
  SiRNA target sequence
gactttatcatttttatctagt

SEQ ID NO: 111817 - DNA, 22 bp, Artificial sequence
  SiRNA target sequence
actttatcatttttatctagta

SEQ ID NO: 111818 - DNA, 22 bp, Artificial sequence
  SiRNA target sequence
ctttatcatttttatctagtac

SEQ ID NO: 111819 - DNA, 22 bp, Artificial sequence
  SiRNA target sequence
tttatcatttttatctagtacc

SEQ ID NO: 111820 - DNA, 22 bp, Artificial sequence
  SiRNA target sequence
ttatcatttttatctagtacct

SEQ ID NO: 111821 - DNA, 22 bp, Artificial sequence
  SiRNA target sequence
tatcatttttatctagtacctt

SEQ ID NO: 111822 - DNA, 22 bp, Artificial sequence
  SiRNA target sequence
atcatttttatctagtaccttt

SEQ ID NO: 111823 - DNA, 22 bp, Artificial sequence
  SiRNA target sequence
tcatttttatctagtacctttt

SEQ ID NO: 111824 - DNA, 22 bp, Artificial sequence
  SiRNA target sequence
catttttatctagtaccttttg

SEQ ID NO: 111825 - DNA, 22 bp, Artificial sequence
  SiRNA target sequence
atttttatctagtaccttttgt

SEQ ID NO: 111826 - DNA, 22 bp, Artificial sequence
  SiRNA target sequence
tttttatctagtaccttttgta

SEQ ID NO: 111827 - DNA, 22 bp, Artificial sequence
  SiRNA target sequence
ttttatctagtaccttttgtaa

SEQ ID NO: 111828 - DNA, 22 bp, Artificial sequence
  SiRNA target sequence
tttatctagtaccttttgtaaa

SEQ ID NO: 111829 - DNA, 22 bp, Artificial sequence
  SiRNA target sequence
ttatctagtaccttttgtaaac

SEQ ID NO: 111830 - DNA, 22 bp, Artificial sequence
  SiRNA target sequence
tatctagtaccttttgtaaact

SEQ ID NO: 111831 - DNA, 22 bp, Artificial sequence
  SiRNA target sequence
atctagtaccttttgtaaactc

SEQ ID NO: 111832 - DNA, 22 bp, Artificial sequence
  SiRNA target sequence
tctagtaccttttgtaaactca

SEQ ID NO: 111833 - DNA, 22 bp, Artificial sequence
  SiRNA target sequence
ctagtaccttttgtaaactcat

SEQ ID NO: 111834 - DNA, 22 bp, Artificial sequence
  SiRNA target sequence
tagtaccttttgtaaactcata

SEQ ID NO: 111835 - DNA, 22 bp, Artificial sequence
  SiRNA target sequence
agtaccttttgtaaactcatat

SEQ ID NO: 111836 - DNA, 22 bp, Artificial sequence
  SiRNA target sequence
gtaccttttgtaaactcatata

SEQ ID NO: 111837 - DNA, 22 bp, Artificial sequence
  SiRNA target sequence
taccttttgtaaactcatataa

SEQ ID NO: 111838 - DNA, 22 bp, Artificial sequence
  SiRNA target sequence
accttttgtaaactcatataaa

SEQ ID NO: 111839 - DNA, 22 bp, Artificial sequence
  SiRNA target sequence
ccttttgtaaactcatataaat

SEQ ID NO: 111840 - DNA, 22 bp, Artificial sequence
  SiRNA target sequence
cttttgtaaactcatataaatg

SEQ ID NO: 111841 - DNA, 22 bp, Artificial sequence
  SiRNA target sequence
ttttgtaaactcatataaatgt

SEQ ID NO: 111842 - DNA, 22 bp, Artificial sequence
  SiRNA target sequence
tttgtaaactcatataaatgtt

SEQ ID NO: 111843 - DNA, 22 bp, Artificial sequence
  SiRNA target sequence
ttgtaaactcatataaatgttt

SEQ ID NO: 111844 - DNA, 22 bp, Artificial sequence
  SiRNA target sequence
tgtaaactcatataaatgtttt

SEQ ID NO: 111845 - DNA, 22 bp, Artificial sequence
  SiRNA target sequence
gtaaactcatataaatgttttc

SEQ ID NO: 111846 - DNA, 22 bp, Artificial sequence
  SiRNA target sequence
taaactcatataaatgttttcc

SEQ ID NO: 111847 - DNA, 22 bp, Artificial sequence
  SiRNA target sequence
aaactcatataaatgttttcct

SEQ ID NO: 111848 - DNA, 22 bp, Artificial sequence
  SiRNA target sequence
aactcatataaatgttttcctg

SEQ ID NO: 111849 - DNA, 22 bp, Artificial sequence
  SiRNA target sequence
actcatataaatgttttcctgt

SEQ ID NO: 111850 - DNA, 22 bp, Artificial sequence
  SiRNA target sequence
ctcatataaatgttttcctgtc

SEQ ID NO: 111851 - DNA, 22 bp, Artificial sequence
  SiRNA target sequence
tcatataaatgttttcctgtcc

SEQ ID NO: 111852 - DNA, 22 bp, Artificial sequence
  SiRNA target sequence
catataaatgttttcctgtcct

SEQ ID NO: 111853 - DNA, 22 bp, Artificial sequence
  SiRNA target sequence
atataaatgttttcctgtccta

SEQ ID NO: 111854 - DNA, 22 bp, Artificial sequence
  SiRNA target sequence
tataaatgttttcctgtcctat

SEQ ID NO: 111855 - DNA, 22 bp, Artificial sequence
  SiRNA target sequence
ataaatgttttcctgtcctatt

SEQ ID NO: 111856 - DNA, 22 bp, Artificial sequence
  SiRNA target sequence
taaatgttttcctgtcctatta

SEQ ID NO: 111857 - DNA, 22 bp, Artificial sequence
  SiRNA target sequence
aaatgttttcctgtcctattac

SEQ ID NO: 111858 - DNA, 22 bp, Artificial sequence
  SiRNA target sequence
aatgttttcctgtcctattact

SEQ ID NO: 111859 - DNA, 22 bp, Artificial sequence
  SiRNA target sequence
atgttttcctgtcctattacta

SEQ ID NO: 111860 - DNA, 22 bp, Artificial sequence
  SiRNA target sequence
tgttttcctgtcctattactaa

SEQ ID NO: 111861 - DNA, 22 bp, Artificial sequence
  SiRNA target sequence
gttttcctgtcctattactaaa

SEQ ID NO: 111862 - DNA, 22 bp, Artificial sequence
  SiRNA target sequence
ttttcctgtcctattactaaat

SEQ ID NO: 111863 - DNA, 22 bp, Artificial sequence
  SiRNA target sequence
tttcctgtcctattactaaatg

SEQ ID NO: 111864 - DNA, 22 bp, Artificial sequence
  SiRNA target sequence
ttcctgtcctattactaaatga

SEQ ID NO: 111865 - DNA, 22 bp, Artificial sequence
  SiRNA target sequence
tcctgtcctattactaaatgac

SEQ ID NO: 111866 - DNA, 22 bp, Artificial sequence
  SiRNA target sequence
cctgtcctattactaaatgaca

SEQ ID NO: 111867 - DNA, 22 bp, Artificial sequence
  SiRNA target sequence
ctgtcctattactaaatgacag

SEQ ID NO: 111868 - DNA, 22 bp, Artificial sequence
  SiRNA target sequence
tgtcctattactaaatgacaga

SEQ ID NO: 111869 - DNA, 22 bp, Artificial sequence
  SiRNA target sequence
gtcctattactaaatgacagaa

SEQ ID NO: 111870 - DNA, 22 bp, Artificial sequence
  SiRNA target sequence
tcctattactaaatgacagaag

SEQ ID NO: 111871 - DNA, 22 bp, Artificial sequence
  SiRNA target sequence
cctattactaaatgacagaagc

SEQ ID NO: 111872 - DNA, 22 bp, Artificial sequence
  SiRNA target sequence
ctattactaaatgacagaagcc

SEQ ID NO: 111873 - DNA, 22 bp, Artificial sequence
  SiRNA target sequence
tattactaaatgacagaagcct

SEQ ID NO: 111874 - DNA, 22 bp, Artificial sequence
  SiRNA target sequence
attactaaatgacagaagcctc

SEQ ID NO: 111875 - DNA, 22 bp, Artificial sequence
  SiRNA target sequence
ttactaaatgacagaagcctct

SEQ ID NO: 111876 - DNA, 22 bp, Artificial sequence
  SiRNA target sequence
tactaaatgacagaagcctctt

SEQ ID NO: 111877 - DNA, 22 bp, Artificial sequence
  SiRNA target sequence
actaaatgacagaagcctctta

SEQ ID NO: 111878 - DNA, 22 bp, Artificial sequence
  SiRNA target sequence
ctaaatgacagaagcctcttat

SEQ ID NO: 111879 - DNA, 22 bp, Artificial sequence
  SiRNA target sequence
taaatgacagaagcctcttata

SEQ ID NO: 111880 - DNA, 22 bp, Artificial sequence
  SiRNA target sequence
aaatgacagaagcctcttatat

SEQ ID NO: 111881 - DNA, 22 bp, Artificial sequence
  SiRNA target sequence
aatgacagaagcctcttatatt

SEQ ID NO: 111882 - DNA, 22 bp, Artificial sequence
  SiRNA target sequence
atgacagaagcctcttatattt

SEQ ID NO: 111883 - DNA, 22 bp, Artificial sequence
  SiRNA target sequence
tgacagaagcctcttatatttc

SEQ ID NO: 111884 - DNA, 22 bp, Artificial sequence
  SiRNA target sequence
gacagaagcctcttatatttcc

SEQ ID NO: 111885 - DNA, 22 bp, Artificial sequence
  SiRNA target sequence
acagaagcctcttatatttcct

SEQ ID NO: 111886 - DNA, 22 bp, Artificial sequence
  SiRNA target sequence
cagaagcctcttatatttcctt

SEQ ID NO: 111887 - DNA, 22 bp, Artificial sequence
  SiRNA target sequence
agaagcctcttatatttccttt

SEQ ID NO: 111888 - DNA, 22 bp, Artificial sequence
  SiRNA target sequence
gaagcctcttatatttcctttt

SEQ ID NO: 111889 - DNA, 22 bp, Artificial sequence
  SiRNA target sequence
aagcctcttatatttccttttt

SEQ ID NO: 111890 - DNA, 22 bp, Artificial sequence
  SiRNA target sequence
agcctcttatatttcctttttt

SEQ ID NO: 111891 - DNA, 22 bp, Artificial sequence
  SiRNA target sequence
gcctcttatatttcctttttta

SEQ ID NO: 111892 - DNA, 22 bp, Artificial sequence
  SiRNA target sequence
cctcttatatttccttttttat

SEQ ID NO: 111893 - DNA, 22 bp, Artificial sequence
  SiRNA target sequence
ctcttatatttccttttttata

SEQ ID NO: 111894 - DNA, 22 bp, Artificial sequence
  SiRNA target sequence
tcttatatttccttttttatac

SEQ ID NO: 111895 - DNA, 22 bp, Artificial sequence
  SiRNA target sequence
cttatatttccttttttatact

SEQ ID NO: 111896 - DNA, 22 bp, Artificial sequence
  SiRNA target sequence
ttatatttccttttttatactt

SEQ ID NO: 111897 - DNA, 22 bp, Artificial sequence
  SiRNA target sequence
tatatttccttttttatactta

SEQ ID NO: 111898 - DNA, 22 bp, Artificial sequence
  SiRNA target sequence
atatttccttttttatacttag

SEQ ID NO: 111899 - DNA, 22 bp, Artificial sequence
  SiRNA target sequence
tatttccttttttatacttaga

SEQ ID NO: 111900 - DNA, 22 bp, Artificial sequence
  SiRNA target sequence
atttccttttttatacttagag

SEQ ID NO: 111901 - DNA, 22 bp, Artificial sequence
  SiRNA target sequence
tttccttttttatacttagagt

SEQ ID NO: 111902 - DNA, 22 bp, Artificial sequence
  SiRNA target sequence
ttccttttttatacttagagtt

SEQ ID NO: 111903 - DNA, 22 bp, Artificial sequence
  SiRNA target sequence
tccttttttatacttagagtta

SEQ ID NO: 111904 - DNA, 22 bp, Artificial sequence
  SiRNA target sequence
ccttttttatacttagagttag

SEQ ID NO: 111905 - DNA, 22 bp, Artificial sequence
  SiRNA target sequence
cttttttatacttagagttagc

SEQ ID NO: 111906 - DNA, 22 bp, Artificial sequence
  SiRNA target sequence
ttttttatacttagagttagca

SEQ ID NO: 111907 - DNA, 22 bp, Artificial sequence
  SiRNA target sequence
tttttatacttagagttagcat

SEQ ID NO: 111908 - DNA, 22 bp, Artificial sequence
  SiRNA target sequence
ttttatacttagagttagcata

SEQ ID NO: 111909 - DNA, 22 bp, Artificial sequence
  SiRNA target sequence
tttatacttagagttagcatat

SEQ ID NO: 111910 - DNA, 22 bp, Artificial sequence
  SiRNA target sequence
ttatacttagagttagcatatt

SEQ ID NO: 111911 - DNA, 22 bp, Artificial sequence
  SiRNA target sequence
tatacttagagttagcatattc

SEQ ID NO: 111912 - DNA, 22 bp, Artificial sequence
  SiRNA target sequence
atacttagagttagcatattct

SEQ ID NO: 111913 - DNA, 22 bp, Artificial sequence
  SiRNA target sequence
tacttagagttagcatattctt

SEQ ID NO: 111914 - DNA, 22 bp, Artificial sequence
  SiRNA target sequence
acttagagttagcatattcttc

SEQ ID NO: 111915 - DNA, 22 bp, Artificial sequence
  SiRNA target sequence
cttagagttagcatattcttcg

SEQ ID NO: 111916 - DNA, 22 bp, Artificial sequence
  SiRNA target sequence
ttagagttagcatattcttcga

SEQ ID NO: 111917 - DNA, 22 bp, Artificial sequence
  SiRNA target sequence
tagagttagcatattcttcgat

SEQ ID NO: 111918 - DNA, 22 bp, Artificial sequence
  SiRNA target sequence
agagttagcatattcttcgata

SEQ ID NO: 111919 - DNA, 22 bp, Artificial sequence
  SiRNA target sequence
gagttagcatattcttcgataa

SEQ ID NO: 111920 - DNA, 22 bp, Artificial sequence
  SiRNA target sequence
agttagcatattcttcgataag

SEQ ID NO: 111921 - DNA, 22 bp, Artificial sequence
  SiRNA target sequence
gttagcatattcttcgataaga

SEQ ID NO: 111922 - DNA, 22 bp, Artificial sequence
  SiRNA target sequence
ttagcatattcttcgataagac

SEQ ID NO: 111923 - DNA, 22 bp, Artificial sequence
  SiRNA target sequence
tagcatattcttcgataagacg

SEQ ID NO: 111924 - DNA, 22 bp, Artificial sequence
  SiRNA target sequence
agcatattcttcgataagacgt

SEQ ID NO: 111925 - DNA, 22 bp, Artificial sequence
  SiRNA target sequence
gcatattcttcgataagacgta

SEQ ID NO: 111926 - DNA, 22 bp, Artificial sequence
  SiRNA target sequence
catattcttcgataagacgtag

SEQ ID NO: 111927 - DNA, 22 bp, Artificial sequence
  SiRNA target sequence
atattcttcgataagacgtaga

SEQ ID NO: 111928 - DNA, 22 bp, Artificial sequence
  SiRNA target sequence
tattcttcgataagacgtagaa

SEQ ID NO: 111929 - DNA, 22 bp, Artificial sequence
  SiRNA target sequence
attcttcgataagacgtagaat

SEQ ID NO: 111930 - DNA, 22 bp, Artificial sequence
  SiRNA target sequence
ttcttcgataagacgtagaatt

SEQ ID NO: 111931 - DNA, 22 bp, Artificial sequence
  SiRNA target sequence
tcttcgataagacgtagaatta

SEQ ID NO: 111932 - DNA, 22 bp, Artificial sequence
  SiRNA target sequence
cttcgataagacgtagaattaa

SEQ ID NO: 111933 - DNA, 22 bp, Artificial sequence
  SiRNA target sequence
ttcgataagacgtagaattaac

SEQ ID NO: 111934 - DNA, 22 bp, Artificial sequence
  SiRNA target sequence
tcgataagacgtagaattaaca

SEQ ID NO: 111935 - DNA, 22 bp, Artificial sequence
  SiRNA target sequence
cgataagacgtagaattaacat

SEQ ID NO: 111936 - DNA, 22 bp, Artificial sequence
  SiRNA target sequence
gataagacgtagaattaacata

SEQ ID NO: 111937 - DNA, 22 bp, Artificial sequence
  SiRNA target sequence
ataagacgtagaattaacatat

SEQ ID NO: 111938 - DNA, 22 bp, Artificial sequence
  SiRNA target sequence
taagacgtagaattaacatatt

SEQ ID NO: 111939 - DNA, 22 bp, Artificial sequence
  SiRNA target sequence
aagacgtagaattaacatattt

SEQ ID NO: 111940 - DNA, 22 bp, Artificial sequence
  SiRNA target sequence
agacgtagaattaacatatttc

SEQ ID NO: 111941 - DNA, 22 bp, Artificial sequence
  SiRNA target sequence
gacgtagaattaacatatttct

SEQ ID NO: 111942 - DNA, 22 bp, Artificial sequence
  SiRNA target sequence
acgtagaattaacatatttcta

SEQ ID NO: 111943 - DNA, 22 bp, Artificial sequence
  SiRNA target sequence
cgtagaattaacatatttctat

SEQ ID NO: 111944 - DNA, 22 bp, Artificial sequence
  SiRNA target sequence
gtagaattaacatatttctata

SEQ ID NO: 111945 - DNA, 22 bp, Artificial sequence
  SiRNA target sequence
tagaattaacatatttctataa

SEQ ID NO: 111946 - DNA, 22 bp, Artificial sequence
  SiRNA target sequence
agaattaacatatttctataaa

SEQ ID NO: 111947 - DNA, 22 bp, Artificial sequence
  SiRNA target sequence
gaattaacatatttctataaac

SEQ ID NO: 111948 - DNA, 22 bp, Artificial sequence
  SiRNA target sequence
aattaacatatttctataaaca

SEQ ID NO: 111949 - DNA, 22 bp, Artificial sequence
  SiRNA target sequence
attaacatatttctataaacat

SEQ ID NO: 111950 - DNA, 22 bp, Artificial sequence
  SiRNA target sequence
ttaacatatttctataaacatc

SEQ ID NO: 111951 - DNA, 22 bp, Artificial sequence
  SiRNA target sequence
taacatatttctataaacatct

SEQ ID NO: 111952 - DNA, 22 bp, Artificial sequence
  SiRNA target sequence
aacatatttctataaacatctt

SEQ ID NO: 111953 - DNA, 22 bp, Artificial sequence
  SiRNA target sequence
acatatttctataaacatcttg

SEQ ID NO: 111954 - DNA, 22 bp, Artificial sequence
  SiRNA target sequence
catatttctataaacatcttgt

SEQ ID NO: 111955 - DNA, 22 bp, Artificial sequence
  SiRNA target sequence
atatttctataaacatcttgta

SEQ ID NO: 111956 - DNA, 22 bp, Artificial sequence
  SiRNA target sequence
tatttctataaacatcttgtac

SEQ ID NO: 111957 - DNA, 22 bp, Artificial sequence
  SiRNA target sequence
atttctataaacatcttgtaca

SEQ ID NO: 111958 - DNA, 22 bp, Artificial sequence
  SiRNA target sequence
tttctataaacatcttgtacaa

SEQ ID NO: 111959 - DNA, 22 bp, Artificial sequence
  SiRNA target sequence
ttctataaacatcttgtacaag

SEQ ID NO: 111960 - DNA, 22 bp, Artificial sequence
  SiRNA target sequence
tctataaacatcttgtacaagt

SEQ ID NO: 111961 - DNA, 22 bp, Artificial sequence
  SiRNA target sequence
ctataaacatcttgtacaagtt

SEQ ID NO: 111962 - DNA, 22 bp, Artificial sequence
  SiRNA target sequence
tataaacatcttgtacaagttc

SEQ ID NO: 111963 - DNA, 22 bp, Artificial sequence
  SiRNA target sequence
ataaacatcttgtacaagttct

SEQ ID NO: 111964 - DNA, 22 bp, Artificial sequence
  SiRNA target sequence
taaacatcttgtacaagttctt

SEQ ID NO: 111965 - DNA, 22 bp, Artificial sequence
  SiRNA target sequence
aaacatcttgtacaagttcttt

SEQ ID NO: 111966 - DNA, 22 bp, Artificial sequence
  SiRNA target sequence
aacatcttgtacaagttctttg

SEQ ID NO: 111967 - DNA, 22 bp, Artificial sequence
  SiRNA target sequence
acatcttgtacaagttctttgt

SEQ ID NO: 111968 - DNA, 22 bp, Artificial sequence
  SiRNA target sequence
catcttgtacaagttctttgtt

SEQ ID NO: 111969 - DNA, 22 bp, Artificial sequence
  SiRNA target sequence
atcttgtacaagttctttgttt

SEQ ID NO: 111970 - DNA, 22 bp, Artificial sequence
  SiRNA target sequence
tcttgtacaagttctttgttta

SEQ ID NO: 111971 - DNA, 22 bp, Artificial sequence
  SiRNA target sequence
cttgtacaagttctttgtttaa

SEQ ID NO: 111972 - DNA, 22 bp, Artificial sequence
  SiRNA target sequence
ttgtacaagttctttgtttaaa

SEQ ID NO: 111973 - DNA, 22 bp, Artificial sequence
  SiRNA target sequence
tgtacaagttctttgtttaaag

SEQ ID NO: 111974 - DNA, 22 bp, Artificial sequence
  SiRNA target sequence
gtacaagttctttgtttaaagt

SEQ ID NO: 111975 - DNA, 22 bp, Artificial sequence
  SiRNA target sequence
tacaagttctttgtttaaagta

SEQ ID NO: 111976 - DNA, 22 bp, Artificial sequence
  SiRNA target sequence
acaagttctttgtttaaagtag

SEQ ID NO: 111977 - DNA, 22 bp, Artificial sequence
  SiRNA target sequence
caagttctttgtttaaagtagt

SEQ ID NO: 111978 - DNA, 22 bp, Artificial sequence
  SiRNA target sequence
aagttctttgtttaaagtagtt

SEQ ID NO: 111979 - DNA, 22 bp, Artificial sequence
  SiRNA target sequence
agttctttgtttaaagtagttt

SEQ ID NO: 111980 - DNA, 22 bp, Artificial sequence
  SiRNA target sequence
gttctttgtttaaagtagtttt

SEQ ID NO: 111981 - DNA, 22 bp, Artificial sequence
  SiRNA target sequence
ttctttgtttaaagtagttttc

SEQ ID NO: 111982 - DNA, 22 bp, Artificial sequence
  SiRNA target sequence
tctttgtttaaagtagttttca

SEQ ID NO: 111983 - DNA, 22 bp, Artificial sequence
  SiRNA target sequence
ctttgtttaaagtagttttcag

SEQ ID NO: 111984 - DNA, 22 bp, Artificial sequence
  SiRNA target sequence
tttgtttaaagtagttttcagt

SEQ ID NO: 111985 - DNA, 22 bp, Artificial sequence
  SiRNA target sequence
ttgtttaaagtagttttcagtt

SEQ ID NO: 111986 - DNA, 22 bp, Artificial sequence
  SiRNA target sequence
tgtttaaagtagttttcagttt

SEQ ID NO: 111987 - DNA, 22 bp, Artificial sequence
  SiRNA target sequence
gtttaaagtagttttcagttta

SEQ ID NO: 111988 - DNA, 22 bp, Artificial sequence
  SiRNA target sequence
tttaaagtagttttcagtttaa

SEQ ID NO: 111989 - DNA, 22 bp, Artificial sequence
  SiRNA target sequence
ttaaagtagttttcagtttaac

SEQ ID NO: 111990 - DNA, 22 bp, Artificial sequence
  SiRNA target sequence
taaagtagttttcagtttaact

SEQ ID NO: 111991 - DNA, 22 bp, Artificial sequence
  SiRNA target sequence
aaagtagttttcagtttaactg

SEQ ID NO: 111992 - DNA, 22 bp, Artificial sequence
  SiRNA target sequence
aagtagttttcagtttaactgt

SEQ ID NO: 111993 - DNA, 22 bp, Artificial sequence
  SiRNA target sequence
agtagttttcagtttaactgta

SEQ ID NO: 111994 - DNA, 22 bp, Artificial sequence
  SiRNA target sequence
gtagttttcagtttaactgtat

SEQ ID NO: 111995 - DNA, 22 bp, Artificial sequence
  SiRNA target sequence
tagttttcagtttaactgtatt

SEQ ID NO: 111996 - DNA, 22 bp, Artificial sequence
  SiRNA target sequence
agttttcagtttaactgtattt

SEQ ID NO: 111997 - DNA, 22 bp, Artificial sequence
  SiRNA target sequence
gttttcagtttaactgtatttt

SEQ ID NO: 111998 - DNA, 22 bp, Artificial sequence
  SiRNA target sequence
ttttcagtttaactgtattttt

SEQ ID NO: 111999 - DNA, 22 bp, Artificial sequence
  SiRNA target sequence
tttcagtttaactgtattttta

SEQ ID NO: 112000 - DNA, 22 bp, Artificial sequence
  SiRNA target sequence
ttcagtttaactgtatttttat

SEQ ID NO: 112001 - DNA, 22 bp, Artificial sequence
  SiRNA target sequence
tcagtttaactgtatttttatc

SEQ ID NO: 112002 - DNA, 22 bp, Artificial sequence
  SiRNA target sequence
cagtttaactgtatttttatct

SEQ ID NO: 112003 - DNA, 22 bp, Artificial sequence
  SiRNA target sequence
agtttaactgtatttttatcta

SEQ ID NO: 112004 - DNA, 22 bp, Artificial sequence
  SiRNA target sequence
gtttaactgtatttttatctac

SEQ ID NO: 112005 - DNA, 22 bp, Artificial sequence
  SiRNA target sequence
tttaactgtatttttatctacc

SEQ ID NO: 112006 - DNA, 22 bp, Artificial sequence
  SiRNA target sequence
ttaactgtatttttatctacca

SEQ ID NO: 112007 - DNA, 22 bp, Artificial sequence
  SiRNA target sequence
taactgtatttttatctaccaa

SEQ ID NO: 112008 - DNA, 22 bp, Artificial sequence
  SiRNA target sequence
aactgtatttttatctaccaaa

SEQ ID NO: 112009 - DNA, 22 bp, Artificial sequence
  SiRNA target sequence
actgtatttttatctaccaaat

SEQ ID NO: 112010 - DNA, 22 bp, Artificial sequence
  SiRNA target sequence
ctgtatttttatctaccaaata

SEQ ID NO: 112011 - DNA, 22 bp, Artificial sequence
  SiRNA target sequence
tgtatttttatctaccaaataa

SEQ ID NO: 112012 - DNA, 22 bp, Artificial sequence
  SiRNA target sequence
gtatttttatctaccaaataat

SEQ ID NO: 112013 - DNA, 22 bp, Artificial sequence
  SiRNA target sequence
tatttttatctaccaaataata

SEQ ID NO: 112014 - DNA, 22 bp, Artificial sequence
  SiRNA target sequence
atttttatctaccaaataataa

SEQ ID NO: 112015 - DNA, 22 bp, Artificial sequence
  SiRNA target sequence
tttttatctaccaaataataat

SEQ ID NO: 112016 - DNA, 22 bp, Artificial sequence
  SiRNA target sequence
ttttatctaccaaataataatc

SEQ ID NO: 112017 - DNA, 22 bp, Artificial sequence
  SiRNA target sequence
tttatctaccaaataataatct

SEQ ID NO: 112018 - DNA, 22 bp, Artificial sequence
  SiRNA target sequence
ttatctaccaaataataatcta

SEQ ID NO: 112019 - DNA, 22 bp, Artificial sequence
  SiRNA target sequence
tatctaccaaataataatctat

SEQ ID NO: 112020 - DNA, 22 bp, Artificial sequence
  SiRNA target sequence
atctaccaaataataatctatc

SEQ ID NO: 112021 - DNA, 22 bp, Artificial sequence
  SiRNA target sequence
tctaccaaataataatctatca

SEQ ID NO: 112022 - DNA, 22 bp, Artificial sequence
  SiRNA target sequence
ctaccaaataataatctatcat

SEQ ID NO: 112023 - DNA, 23 bp, Artificial sequence
  SiRNA target sequence
ttattcagaataaacatctttta

SEQ ID NO: 112024 - DNA, 23 bp, Artificial sequence
  SiRNA target sequence
tattcagaataaacatcttttaa

SEQ ID NO: 112025 - DNA, 23 bp, Artificial sequence
  SiRNA target sequence
attcagaataaacatcttttaaa

SEQ ID NO: 112026 - DNA, 23 bp, Artificial sequence
  SiRNA target sequence
ttcagaataaacatcttttaaaa

SEQ ID NO: 112027 - DNA, 23 bp, Artificial sequence
  SiRNA target sequence
tcagaataaacatcttttaaaag

SEQ ID NO: 112028 - DNA, 23 bp, Artificial sequence
  SiRNA target sequence
cagaataaacatcttttaaaagt

SEQ ID NO: 112029 - DNA, 23 bp, Artificial sequence
  SiRNA target sequence
agaataaacatcttttaaaagtt

SEQ ID NO: 112030 - DNA, 23 bp, Artificial sequence
  SiRNA target sequence
gaataaacatcttttaaaagttc

SEQ ID NO: 112031 - DNA, 23 bp, Artificial sequence
  SiRNA target sequence
aataaacatcttttaaaagttca

SEQ ID NO: 112032 - DNA, 23 bp, Artificial sequence
  SiRNA target sequence
ataaacatcttttaaaagttcat

SEQ ID NO: 112033 - DNA, 23 bp, Artificial sequence
  SiRNA target sequence
taaacatcttttaaaagttcatc

SEQ ID NO: 112034 - DNA, 23 bp, Artificial sequence
  SiRNA target sequence
aaacatcttttaaaagttcatcg

SEQ ID NO: 112035 - DNA, 23 bp, Artificial sequence
  SiRNA target sequence
aacatcttttaaaagttcatcga

SEQ ID NO: 112036 - DNA, 23 bp, Artificial sequence
  SiRNA target sequence
acatcttttaaaagttcatcgat

SEQ ID NO: 112037 - DNA, 23 bp, Artificial sequence
  SiRNA target sequence
catcttttaaaagttcatcgata

SEQ ID NO: 112038 - DNA, 23 bp, Artificial sequence
  SiRNA target sequence
atcttttaaaagttcatcgatat

SEQ ID NO: 112039 - DNA, 23 bp, Artificial sequence
  SiRNA target sequence
tcttttaaaagttcatcgatatc

SEQ ID NO: 112040 - DNA, 23 bp, Artificial sequence
  SiRNA target sequence
cttttaaaagttcatcgatatcg

SEQ ID NO: 112041 - DNA, 23 bp, Artificial sequence
  SiRNA target sequence
ttttaaaagttcatcgatatcgg

SEQ ID NO: 112042 - DNA, 23 bp, Artificial sequence
  SiRNA target sequence
tttaaaagttcatcgatatcggg

SEQ ID NO: 112043 - DNA, 23 bp, Artificial sequence
  SiRNA target sequence
ttaaaagttcatcgatatcgggt

SEQ ID NO: 112044 - DNA, 23 bp, Artificial sequence
  SiRNA target sequence
taaaagttcatcgatatcgggtt

SEQ ID NO: 112045 - DNA, 23 bp, Artificial sequence
  SiRNA target sequence
aaaagttcatcgatatcgggttc

SEQ ID NO: 112046 - DNA, 23 bp, Artificial sequence
  SiRNA target sequence
aaagttcatcgatatcgggttct

SEQ ID NO: 112047 - DNA, 23 bp, Artificial sequence
  SiRNA target sequence
aagttcatcgatatcgggttctt

SEQ ID NO: 112048 - DNA, 23 bp, Artificial sequence
  SiRNA target sequence
agttcatcgatatcgggttcttt

SEQ ID NO: 112049 - DNA, 23 bp, Artificial sequence
  SiRNA target sequence
gttcatcgatatcgggttcttta

SEQ ID NO: 112050 - DNA, 23 bp, Artificial sequence
  SiRNA target sequence
ttcatcgatatcgggttctttag

SEQ ID NO: 112051 - DNA, 23 bp, Artificial sequence
  SiRNA target sequence
tcatcgatatcgggttctttaga

SEQ ID NO: 112052 - DNA, 23 bp, Artificial sequence
  SiRNA target sequence
catcgatatcgggttctttagaa

SEQ ID NO: 112053 - DNA, 23 bp, Artificial sequence
  SiRNA target sequence
atcgatatcgggttctttagaaa

SEQ ID NO: 112054 - DNA, 23 bp, Artificial sequence
  SiRNA target sequence
tcgatatcgggttctttagaaaa

SEQ ID NO: 112055 - DNA, 23 bp, Artificial sequence
  SiRNA target sequence
cgatatcgggttctttagaaaaa

SEQ ID NO: 112056 - DNA, 23 bp, Artificial sequence
  SiRNA target sequence
gatatcgggttctttagaaaaaa

SEQ ID NO: 112057 - DNA, 23 bp, Artificial sequence
  SiRNA target sequence
atatcgggttctttagaaaaaat

SEQ ID NO: 112058 - DNA, 23 bp, Artificial sequence
  SiRNA target sequence
tatcgggttctttagaaaaaata

SEQ ID NO: 112059 - DNA, 23 bp, Artificial sequence
  SiRNA target sequence
atcgggttctttagaaaaaataa

SEQ ID NO: 112060 - DNA, 23 bp, Artificial sequence
  SiRNA target sequence
tcgggttctttagaaaaaataac

SEQ ID NO: 112061 - DNA, 23 bp, Artificial sequence
  SiRNA target sequence
cgggttctttagaaaaaataact

SEQ ID NO: 112062 - DNA, 23 bp, Artificial sequence
  SiRNA target sequence
gggttctttagaaaaaataactt

SEQ ID NO: 112063 - DNA, 23 bp, Artificial sequence
  SiRNA target sequence
ggttctttagaaaaaataacttt

SEQ ID NO: 112064 - DNA, 23 bp, Artificial sequence
  SiRNA target sequence
gttctttagaaaaaataactttt

SEQ ID NO: 112065 - DNA, 23 bp, Artificial sequence
  SiRNA target sequence
ttctttagaaaaaataacttttt

SEQ ID NO: 112066 - DNA, 23 bp, Artificial sequence
  SiRNA target sequence
tctttagaaaaaataactttttt

SEQ ID NO: 112067 - DNA, 23 bp, Artificial sequence
  SiRNA target sequence
ctttagaaaaaataactttttta

SEQ ID NO: 112068 - DNA, 23 bp, Artificial sequence
  SiRNA target sequence
tttagaaaaaataacttttttaa

SEQ ID NO: 112069 - DNA, 23 bp, Artificial sequence
  SiRNA target sequence
ttagaaaaaataacttttttaac

SEQ ID NO: 112070 - DNA, 23 bp, Artificial sequence
  SiRNA target sequence
tagaaaaaataacttttttaaca

SEQ ID NO: 112071 - DNA, 23 bp, Artificial sequence
  SiRNA target sequence
agaaaaaataacttttttaacac

SEQ ID NO: 112072 - DNA, 23 bp, Artificial sequence
  SiRNA target sequence
gaaaaaataacttttttaacacc

SEQ ID NO: 112073 - DNA, 23 bp, Artificial sequence
  SiRNA target sequence
aaaaaataacttttttaacacct

SEQ ID NO: 112074 - DNA, 23 bp, Artificial sequence
  SiRNA target sequence
aaaaataacttttttaacacctt

SEQ ID NO: 112075 - DNA, 23 bp, Artificial sequence
  SiRNA target sequence
aaaataacttttttaacaccttc

SEQ ID NO: 112076 - DNA, 23 bp, Artificial sequence
  SiRNA target sequence
aaataacttttttaacaccttct

SEQ ID NO: 112077 - DNA, 23 bp, Artificial sequence
  SiRNA target sequence
aataacttttttaacaccttctt

SEQ ID NO: 112078 - DNA, 23 bp, Artificial sequence
  SiRNA target sequence
ataacttttttaacaccttcttc

SEQ ID NO: 112079 - DNA, 23 bp, Artificial sequence
  SiRNA target sequence
taacttttttaacaccttcttca

SEQ ID NO: 112080 - DNA, 23 bp, Artificial sequence
  SiRNA target sequence
aacttttttaacaccttcttcaa

SEQ ID NO: 112081 - DNA, 23 bp, Artificial sequence
  SiRNA target sequence
acttttttaacaccttcttcaaa

SEQ ID NO: 112082 - DNA, 23 bp, Artificial sequence
  SiRNA target sequence
cttttttaacaccttcttcaaag

SEQ ID NO: 112083 - DNA, 23 bp, Artificial sequence
  SiRNA target sequence
ttttttaacaccttcttcaaagc

SEQ ID NO: 112084 - DNA, 23 bp, Artificial sequence
  SiRNA target sequence
tttttaacaccttcttcaaagca

SEQ ID NO: 112085 - DNA, 23 bp, Artificial sequence
  SiRNA target sequence
ttttaacaccttcttcaaagcag

SEQ ID NO: 112086 - DNA, 23 bp, Artificial sequence
  SiRNA target sequence
tttaacaccttcttcaaagcagg

SEQ ID NO: 112087 - DNA, 23 bp, Artificial sequence
  SiRNA target sequence
ttaacaccttcttcaaagcagga

SEQ ID NO: 112088 - DNA, 23 bp, Artificial sequence
  SiRNA target sequence
taacaccttcttcaaagcaggaa

SEQ ID NO: 112089 - DNA, 23 bp, Artificial sequence
  SiRNA target sequence
aacaccttcttcaaagcaggaaa

SEQ ID NO: 112090 - DNA, 23 bp, Artificial sequence
  SiRNA target sequence
acaccttcttcaaagcaggaaat

SEQ ID NO: 112091 - DNA, 23 bp, Artificial sequence
  SiRNA target sequence
caccttcttcaaagcaggaaatt

SEQ ID NO: 112092 - DNA, 23 bp, Artificial sequence
  SiRNA target sequence
accttcttcaaagcaggaaatta

SEQ ID NO: 112093 - DNA, 23 bp, Artificial sequence
  SiRNA target sequence
ccttcttcaaagcaggaaattac

SEQ ID NO: 112094 - DNA, 23 bp, Artificial sequence
  SiRNA target sequence
cttcttcaaagcaggaaattacc

SEQ ID NO: 112095 - DNA, 23 bp, Artificial sequence
  SiRNA target sequence
ttcttcaaagcaggaaattacct

SEQ ID NO: 112096 - DNA, 23 bp, Artificial sequence
  SiRNA target sequence
tcttcaaagcaggaaattacctc

SEQ ID NO: 112097 - DNA, 23 bp, Artificial sequence
  SiRNA target sequence
cttcaaagcaggaaattacctca

SEQ ID NO: 112098 - DNA, 23 bp, Artificial sequence
  SiRNA target sequence
ttcaaagcaggaaattacctcat

SEQ ID NO: 112099 - DNA, 23 bp, Artificial sequence
  SiRNA target sequence
tcaaagcaggaaattacctcatc

SEQ ID NO: 112100 - DNA, 23 bp, Artificial sequence
  SiRNA target sequence
caaagcaggaaattacctcatct

SEQ ID NO: 112101 - DNA, 23 bp, Artificial sequence
  SiRNA target sequence
aaagcaggaaattacctcatctt

SEQ ID NO: 112102 - DNA, 23 bp, Artificial sequence
  SiRNA target sequence
aagcaggaaattacctcatcttc

SEQ ID NO: 112103 - DNA, 23 bp, Artificial sequence
  SiRNA target sequence
agcaggaaattacctcatcttcg

SEQ ID NO: 112104 - DNA, 23 bp, Artificial sequence
  SiRNA target sequence
gcaggaaattacctcatcttcga

SEQ ID NO: 112105 - DNA, 23 bp, Artificial sequence
  SiRNA target sequence
caggaaattacctcatcttcgat

SEQ ID NO: 112106 - DNA, 23 bp, Artificial sequence
  SiRNA target sequence
aggaaattacctcatcttcgata

SEQ ID NO: 112107 - DNA, 23 bp, Artificial sequence
  SiRNA target sequence
ggaaattacctcatcttcgataa

SEQ ID NO: 112108 - DNA, 23 bp, Artificial sequence
  SiRNA target sequence
gaaattacctcatcttcgataat

SEQ ID NO: 112109 - DNA, 23 bp, Artificial sequence
  SiRNA target sequence
aaattacctcatcttcgataatt

SEQ ID NO: 112110 - DNA, 23 bp, Artificial sequence
  SiRNA target sequence
aattacctcatcttcgataattt

SEQ ID NO: 112111 - DNA, 23 bp, Artificial sequence
  SiRNA target sequence
attacctcatcttcgataatttt

SEQ ID NO: 112112 - DNA, 23 bp, Artificial sequence
  SiRNA target sequence
ttacctcatcttcgataattttt

SEQ ID NO: 112113 - DNA, 23 bp, Artificial sequence
  SiRNA target sequence
tacctcatcttcgataattttta

SEQ ID NO: 112114 - DNA, 23 bp, Artificial sequence
  SiRNA target sequence
acctcatcttcgataatttttac

SEQ ID NO: 112115 - DNA, 23 bp, Artificial sequence
  SiRNA target sequence
cctcatcttcgataatttttact

SEQ ID NO: 112116 - DNA, 23 bp, Artificial sequence
  SiRNA target sequence
ctcatcttcgataatttttactt

SEQ ID NO: 112117 - DNA, 23 bp, Artificial sequence
  SiRNA target sequence
tcatcttcgataatttttacttc

SEQ ID NO: 112118 - DNA, 23 bp, Artificial sequence
  SiRNA target sequence
catcttcgataatttttacttct

SEQ ID NO: 112119 - DNA, 23 bp, Artificial sequence
  SiRNA target sequence
atcttcgataatttttacttctt

SEQ ID NO: 112120 - DNA, 23 bp, Artificial sequence
  SiRNA target sequence
tcttcgataatttttacttcttc

SEQ ID NO: 112121 - DNA, 23 bp, Artificial sequence
  SiRNA target sequence
cttcgataatttttacttcttca

SEQ ID NO: 112122 - DNA, 23 bp, Artificial sequence
  SiRNA target sequence
ttcgataatttttacttcttcac

SEQ ID NO: 112123 - DNA, 23 bp, Artificial sequence
  SiRNA target sequence
tcgataatttttacttcttcaca

SEQ ID NO: 112124 - DNA, 23 bp, Artificial sequence
  SiRNA target sequence
cgataatttttacttcttcacaa

SEQ ID NO: 112125 - DNA, 23 bp, Artificial sequence
  SiRNA target sequence
gataatttttacttcttcacaag

SEQ ID NO: 112126 - DNA, 23 bp, Artificial sequence
  SiRNA target sequence
ataatttttacttcttcacaagt

SEQ ID NO: 112127 - DNA, 23 bp, Artificial sequence
  SiRNA target sequence
taatttttacttcttcacaagtc

SEQ ID NO: 112128 - DNA, 23 bp, Artificial sequence
  SiRNA target sequence
aatttttacttcttcacaagtcg

SEQ ID NO: 112129 - DNA, 23 bp, Artificial sequence
  SiRNA target sequence
atttttacttcttcacaagtcgc

SEQ ID NO: 112130 - DNA, 23 bp, Artificial sequence
  SiRNA target sequence
tttttacttcttcacaagtcgca

SEQ ID NO: 112131 - DNA, 23 bp, Artificial sequence
  SiRNA target sequence
ttttacttcttcacaagtcgcaa

SEQ ID NO: 112132 - DNA, 23 bp, Artificial sequence
  SiRNA target sequence
tttacttcttcacaagtcgcaaa

SEQ ID NO: 112133 - DNA, 23 bp, Artificial sequence
  SiRNA target sequence
ttacttcttcacaagtcgcaaat

SEQ ID NO: 112134 - DNA, 23 bp, Artificial sequence
  SiRNA target sequence
tacttcttcacaagtcgcaaatt

SEQ ID NO: 112135 - DNA, 23 bp, Artificial sequence
  SiRNA target sequence
acttcttcacaagtcgcaaattt

SEQ ID NO: 112136 - DNA, 23 bp, Artificial sequence
  SiRNA target sequence
cttcttcacaagtcgcaaatttt

SEQ ID NO: 112137 - DNA, 23 bp, Artificial sequence
  SiRNA target sequence
ttcttcacaagtcgcaaattttt

SEQ ID NO: 112138 - DNA, 23 bp, Artificial sequence
  SiRNA target sequence
tcttcacaagtcgcaaatttttg

SEQ ID NO: 112139 - DNA, 23 bp, Artificial sequence
  SiRNA target sequence
cttcacaagtcgcaaatttttgt

SEQ ID NO: 112140 - DNA, 23 bp, Artificial sequence
  SiRNA target sequence
ttcacaagtcgcaaatttttgta

SEQ ID NO: 112141 - DNA, 23 bp, Artificial sequence
  SiRNA target sequence
tcacaagtcgcaaatttttgtaa

SEQ ID NO: 112142 - DNA, 23 bp, Artificial sequence
  SiRNA target sequence
cacaagtcgcaaatttttgtaag

SEQ ID NO: 112143 - DNA, 23 bp, Artificial sequence
  SiRNA target sequence
acaagtcgcaaatttttgtaagt

SEQ ID NO: 112144 - DNA, 23 bp, Artificial sequence
  SiRNA target sequence
caagtcgcaaatttttgtaagtt

SEQ ID NO: 112145 - DNA, 23 bp, Artificial sequence
  SiRNA target sequence
aagtcgcaaatttttgtaagtta

SEQ ID NO: 112146 - DNA, 23 bp, Artificial sequence
  SiRNA target sequence
agtcgcaaatttttgtaagttat

SEQ ID NO: 112147 - DNA, 23 bp, Artificial sequence
  SiRNA target sequence
gtcgcaaatttttgtaagttatt

SEQ ID NO: 112148 - DNA, 23 bp, Artificial sequence
  SiRNA target sequence
tcgcaaatttttgtaagttattt

SEQ ID NO: 112149 - DNA, 23 bp, Artificial sequence
  SiRNA target sequence
cgcaaatttttgtaagttatttt

SEQ ID NO: 112150 - DNA, 23 bp, Artificial sequence
  SiRNA target sequence
gcaaatttttgtaagttattttt

SEQ ID NO: 112151 - DNA, 23 bp, Artificial sequence
  SiRNA target sequence
caaatttttgtaagttatttttt

SEQ ID NO: 112152 - DNA, 23 bp, Artificial sequence
  SiRNA target sequence
aaatttttgtaagttattttttg

SEQ ID NO: 112153 - DNA, 23 bp, Artificial sequence
  SiRNA target sequence
aatttttgtaagttattttttgc

SEQ ID NO: 112154 - DNA, 23 bp, Artificial sequence
  SiRNA target sequence
atttttgtaagttattttttgct

SEQ ID NO: 112155 - DNA, 23 bp, Artificial sequence
  SiRNA target sequence
tttttgtaagttattttttgctt

SEQ ID NO: 112156 - DNA, 23 bp, Artificial sequence
  SiRNA target sequence
ttttgtaagttattttttgcttc

SEQ ID NO: 112157 - DNA, 23 bp, Artificial sequence
  SiRNA target sequence
tttgtaagttattttttgcttct

SEQ ID NO: 112158 - DNA, 23 bp, Artificial sequence
  SiRNA target sequence
ttgtaagttattttttgcttctt

SEQ ID NO: 112159 - DNA, 23 bp, Artificial sequence
  SiRNA target sequence
tgtaagttattttttgcttcttt

SEQ ID NO: 112160 - DNA, 23 bp, Artificial sequence
  SiRNA target sequence
gtaagttattttttgcttcttta

SEQ ID NO: 112161 - DNA, 23 bp, Artificial sequence
  SiRNA target sequence
taagttattttttgcttctttaa

SEQ ID NO: 112162 - DNA, 23 bp, Artificial sequence
  SiRNA target sequence
aagttattttttgcttctttaag

SEQ ID NO: 112163 - DNA, 23 bp, Artificial sequence
  SiRNA target sequence
agttattttttgcttctttaagg

SEQ ID NO: 112164 - DNA, 23 bp, Artificial sequence
  SiRNA target sequence
gttattttttgcttctttaaggc

SEQ ID NO: 112165 - DNA, 23 bp, Artificial sequence
  SiRNA target sequence
ttattttttgcttctttaaggca

SEQ ID NO: 112166 - DNA, 23 bp, Artificial sequence
  SiRNA target sequence
tattttttgcttctttaaggcaa

SEQ ID NO: 112167 - DNA, 23 bp, Artificial sequence
  SiRNA target sequence
attttttgcttctttaaggcaat

SEQ ID NO: 112168 - DNA, 23 bp, Artificial sequence
  SiRNA target sequence
ttttttgcttctttaaggcaatc

SEQ ID NO: 112169 - DNA, 23 bp, Artificial sequence
  SiRNA target sequence
tttttgcttctttaaggcaatca

SEQ ID NO: 112170 - DNA, 23 bp, Artificial sequence
  SiRNA target sequence
ttttgcttctttaaggcaatcat

SEQ ID NO: 112171 - DNA, 23 bp, Artificial sequence
  SiRNA target sequence
tttgcttctttaaggcaatcatt

SEQ ID NO: 112172 - DNA, 23 bp, Artificial sequence
  SiRNA target sequence
ttgcttctttaaggcaatcatta

SEQ ID NO: 112173 - DNA, 23 bp, Artificial sequence
  SiRNA target sequence
tgcttctttaaggcaatcattat

SEQ ID NO: 112174 - DNA, 23 bp, Artificial sequence
  SiRNA target sequence
gcttctttaaggcaatcattatt

SEQ ID NO: 112175 - DNA, 23 bp, Artificial sequence
  SiRNA target sequence
cttctttaaggcaatcattattt

SEQ ID NO: 112176 - DNA, 23 bp, Artificial sequence
  SiRNA target sequence
ttctttaaggcaatcattatttt

SEQ ID NO: 112177 - DNA, 23 bp, Artificial sequence
  SiRNA target sequence
tctttaaggcaatcattattttt

SEQ ID NO: 112178 - DNA, 23 bp, Artificial sequence
  SiRNA target sequence
ctttaaggcaatcattatttttt

SEQ ID NO: 112179 - DNA, 23 bp, Artificial sequence
  SiRNA target sequence
tttaaggcaatcattattttttt

SEQ ID NO: 112180 - DNA, 23 bp, Artificial sequence
  SiRNA target sequence
ttaaggcaatcattatttttttt

SEQ ID NO: 112181 - DNA, 23 bp, Artificial sequence
  SiRNA target sequence
taaggcaatcattattttttttt

SEQ ID NO: 112182 - DNA, 23 bp, Artificial sequence
  SiRNA target sequence
aaggcaatcattatttttttttt

SEQ ID NO: 112183 - DNA, 23 bp, Artificial sequence
  SiRNA target sequence
aggcaatcattattttttttttc

SEQ ID NO: 112184 - DNA, 23 bp, Artificial sequence
  SiRNA target sequence
ggcaatcattattttttttttca

SEQ ID NO: 112185 - DNA, 23 bp, Artificial sequence
  SiRNA target sequence
gcaatcattattttttttttcat

SEQ ID NO: 112186 - DNA, 23 bp, Artificial sequence
  SiRNA target sequence
caatcattattttttttttcatt

SEQ ID NO: 112187 - DNA, 23 bp, Artificial sequence
  SiRNA target sequence
aatcattattttttttttcatta

SEQ ID NO: 112188 - DNA, 23 bp, Artificial sequence
  SiRNA target sequence
atcattattttttttttcattaa

SEQ ID NO: 112189 - DNA, 23 bp, Artificial sequence
  SiRNA target sequence
tcattattttttttttcattaat

SEQ ID NO: 112190 - DNA, 23 bp, Artificial sequence
  SiRNA target sequence
cattattttttttttcattaatt

SEQ ID NO: 112191 - DNA, 23 bp, Artificial sequence
  SiRNA target sequence
attattttttttttcattaattt

SEQ ID NO: 112192 - DNA, 23 bp, Artificial sequence
  SiRNA target sequence
ttattttttttttcattaatttc

SEQ ID NO: 112193 - DNA, 23 bp, Artificial sequence
  SiRNA target sequence
tattttttttttcattaatttcc

SEQ ID NO: 112194 - DNA, 23 bp, Artificial sequence
  SiRNA target sequence
attttttttttcattaatttcct

SEQ ID NO: 112195 - DNA, 23 bp, Artificial sequence
  SiRNA target sequence
ttttttttttcattaatttcctc

SEQ ID NO: 112196 - DNA, 23 bp, Artificial sequence
  SiRNA target sequence
tttttttttcattaatttcctcc

SEQ ID NO: 112197 - DNA, 23 bp, Artificial sequence
  SiRNA target sequence
ttttttttcattaatttcctccg

SEQ ID NO: 112198 - DNA, 23 bp, Artificial sequence
  SiRNA target sequence
tttttttcattaatttcctccgt

SEQ ID NO: 112199 - DNA, 23 bp, Artificial sequence
  SiRNA target sequence
ttttttcattaatttcctccgtg

SEQ ID NO: 112200 - DNA, 23 bp, Artificial sequence
  SiRNA target sequence
tttttcattaatttcctccgtgg

SEQ ID NO: 112201 - DNA, 23 bp, Artificial sequence
  SiRNA target sequence
ttttcattaatttcctccgtgga

SEQ ID NO: 112202 - DNA, 23 bp, Artificial sequence
  SiRNA target sequence
tttcattaatttcctccgtggat

SEQ ID NO: 112203 - DNA, 23 bp, Artificial sequence
  SiRNA target sequence
ttcattaatttcctccgtggatc

SEQ ID NO: 112204 - DNA, 23 bp, Artificial sequence
  SiRNA target sequence
tcattaatttcctccgtggatct

SEQ ID NO: 112205 - DNA, 23 bp, Artificial sequence
  SiRNA target sequence
cattaatttcctccgtggatctg

SEQ ID NO: 112206 - DNA, 23 bp, Artificial sequence
  SiRNA target sequence
attaatttcctccgtggatctgt

SEQ ID NO: 112207 - DNA, 23 bp, Artificial sequence
  SiRNA target sequence
ttaatttcctccgtggatctgta

SEQ ID NO: 112208 - DNA, 23 bp, Artificial sequence
  SiRNA target sequence
taatttcctccgtggatctgtaa

SEQ ID NO: 112209 - DNA, 23 bp, Artificial sequence
  SiRNA target sequence
aatttcctccgtggatctgtaaa

SEQ ID NO: 112210 - DNA, 23 bp, Artificial sequence
  SiRNA target sequence
atttcctccgtggatctgtaaaa

SEQ ID NO: 112211 - DNA, 23 bp, Artificial sequence
  SiRNA target sequence
tttcctccgtggatctgtaaaaa

SEQ ID NO: 112212 - DNA, 23 bp, Artificial sequence
  SiRNA target sequence
ttcctccgtggatctgtaaaaat

SEQ ID NO: 112213 - DNA, 23 bp, Artificial sequence
  SiRNA target sequence
tcctccgtggatctgtaaaaatc

SEQ ID NO: 112214 - DNA, 23 bp, Artificial sequence
  SiRNA target sequence
cctccgtggatctgtaaaaatcg

SEQ ID NO: 112215 - DNA, 23 bp, Artificial sequence
  SiRNA target sequence
ctccgtggatctgtaaaaatcgt

SEQ ID NO: 112216 - DNA, 23 bp, Artificial sequence
  SiRNA target sequence
tccgtggatctgtaaaaatcgtt

SEQ ID NO: 112217 - DNA, 23 bp, Artificial sequence
  SiRNA target sequence
ccgtggatctgtaaaaatcgtta

SEQ ID NO: 112218 - DNA, 23 bp, Artificial sequence
  SiRNA target sequence
cgtggatctgtaaaaatcgttaa

SEQ ID NO: 112219 - DNA, 23 bp, Artificial sequence
  SiRNA target sequence
gtggatctgtaaaaatcgttaac

SEQ ID NO: 112220 - DNA, 23 bp, Artificial sequence
  SiRNA target sequence
tggatctgtaaaaatcgttaaca

SEQ ID NO: 112221 - DNA, 23 bp, Artificial sequence
  SiRNA target sequence
ggatctgtaaaaatcgttaacat

SEQ ID NO: 112222 - DNA, 23 bp, Artificial sequence
  SiRNA target sequence
gatctgtaaaaatcgttaacatc

SEQ ID NO: 112223 - DNA, 23 bp, Artificial sequence
  SiRNA target sequence
atctgtaaaaatcgttaacatct

SEQ ID NO: 112224 - DNA, 23 bp, Artificial sequence
  SiRNA target sequence
tctgtaaaaatcgttaacatcta

SEQ ID NO: 112225 - DNA, 23 bp, Artificial sequence
  SiRNA target sequence
ctgtaaaaatcgttaacatctaa

SEQ ID NO: 112226 - DNA, 23 bp, Artificial sequence
  SiRNA target sequence
tgtaaaaatcgttaacatctaaa

SEQ ID NO: 112227 - DNA, 23 bp, Artificial sequence
  SiRNA target sequence
gtaaaaatcgttaacatctaaac

SEQ ID NO: 112228 - DNA, 23 bp, Artificial sequence
  SiRNA target sequence
taaaaatcgttaacatctaaaca

SEQ ID NO: 112229 - DNA, 23 bp, Artificial sequence
  SiRNA target sequence
aaaaatcgttaacatctaaacag

SEQ ID NO: 112230 - DNA, 23 bp, Artificial sequence
  SiRNA target sequence
aaaatcgttaacatctaaacagg

SEQ ID NO: 112231 - DNA, 23 bp, Artificial sequence
  SiRNA target sequence
aaatcgttaacatctaaacagga

SEQ ID NO: 112232 - DNA, 23 bp, Artificial sequence
  SiRNA target sequence
aatcgttaacatctaaacaggag

SEQ ID NO: 112233 - DNA, 23 bp, Artificial sequence
  SiRNA target sequence
atcgttaacatctaaacaggagt

SEQ ID NO: 112234 - DNA, 23 bp, Artificial sequence
  SiRNA target sequence
tcgttaacatctaaacaggagtg

SEQ ID NO: 112235 - DNA, 23 bp, Artificial sequence
  SiRNA target sequence
cgttaacatctaaacaggagtgc

SEQ ID NO: 112236 - DNA, 23 bp, Artificial sequence
  SiRNA target sequence
gttaacatctaaacaggagtgcc

SEQ ID NO: 112237 - DNA, 23 bp, Artificial sequence
  SiRNA target sequence
ttaacatctaaacaggagtgccc

SEQ ID NO: 112238 - DNA, 23 bp, Artificial sequence
  SiRNA target sequence
taacatctaaacaggagtgccca

SEQ ID NO: 112239 - DNA, 23 bp, Artificial sequence
  SiRNA target sequence
aacatctaaacaggagtgcccac

SEQ ID NO: 112240 - DNA, 23 bp, Artificial sequence
  SiRNA target sequence
acatctaaacaggagtgcccaca

SEQ ID NO: 112241 - DNA, 23 bp, Artificial sequence
  SiRNA target sequence
catctaaacaggagtgcccacat

SEQ ID NO: 112242 - DNA, 23 bp, Artificial sequence
  SiRNA target sequence
atctaaacaggagtgcccacatg

SEQ ID NO: 112243 - DNA, 23 bp, Artificial sequence
  SiRNA target sequence
tctaaacaggagtgcccacatgt

SEQ ID NO: 112244 - DNA, 23 bp, Artificial sequence
  SiRNA target sequence
ctaaacaggagtgcccacatgtc

SEQ ID NO: 112245 - DNA, 23 bp, Artificial sequence
  SiRNA target sequence
taaacaggagtgcccacatgtcc

SEQ ID NO: 112246 - DNA, 23 bp, Artificial sequence
  SiRNA target sequence
aaacaggagtgcccacatgtcct

SEQ ID NO: 112247 - DNA, 23 bp, Artificial sequence
  SiRNA target sequence
aacaggagtgcccacatgtcctg

SEQ ID NO: 112248 - DNA, 23 bp, Artificial sequence
  SiRNA target sequence
acaggagtgcccacatgtcctgt

SEQ ID NO: 112249 - DNA, 23 bp, Artificial sequence
  SiRNA target sequence
caggagtgcccacatgtcctgta

SEQ ID NO: 112250 - DNA, 23 bp, Artificial sequence
  SiRNA target sequence
aggagtgcccacatgtcctgtac

SEQ ID NO: 112251 - DNA, 23 bp, Artificial sequence
  SiRNA target sequence
ggagtgcccacatgtcctgtacg

SEQ ID NO: 112252 - DNA, 23 bp, Artificial sequence
  SiRNA target sequence
gagtgcccacatgtcctgtacgt

SEQ ID NO: 112253 - DNA, 23 bp, Artificial sequence
  SiRNA target sequence
agtgcccacatgtcctgtacgta

SEQ ID NO: 112254 - DNA, 23 bp, Artificial sequence
  SiRNA target sequence
gtgcccacatgtcctgtacgtat

SEQ ID NO: 112255 - DNA, 23 bp, Artificial sequence
  SiRNA target sequence
tgcccacatgtcctgtacgtatc

SEQ ID NO: 112256 - DNA, 23 bp, Artificial sequence
  SiRNA target sequence
gcccacatgtcctgtacgtatca

SEQ ID NO: 112257 - DNA, 23 bp, Artificial sequence
  SiRNA target sequence
cccacatgtcctgtacgtatcaa

SEQ ID NO: 112258 - DNA, 23 bp, Artificial sequence
  SiRNA target sequence
ccacatgtcctgtacgtatcaat

SEQ ID NO: 112259 - DNA, 23 bp, Artificial sequence
  SiRNA target sequence
cacatgtcctgtacgtatcaatt

SEQ ID NO: 112260 - DNA, 23 bp, Artificial sequence
  SiRNA target sequence
acatgtcctgtacgtatcaattt

SEQ ID NO: 112261 - DNA, 23 bp, Artificial sequence
  SiRNA target sequence
catgtcctgtacgtatcaatttg

SEQ ID NO: 112262 - DNA, 23 bp, Artificial sequence
  SiRNA target sequence
atgtcctgtacgtatcaatttgc

SEQ ID NO: 112263 - DNA, 23 bp, Artificial sequence
  SiRNA target sequence
tgtcctgtacgtatcaatttgca

SEQ ID NO: 112264 - DNA, 23 bp, Artificial sequence
  SiRNA target sequence
gtcctgtacgtatcaatttgcaa

SEQ ID NO: 112265 - DNA, 23 bp, Artificial sequence
  SiRNA target sequence
tcctgtacgtatcaatttgcaag

SEQ ID NO: 112266 - DNA, 23 bp, Artificial sequence
  SiRNA target sequence
cctgtacgtatcaatttgcaaga

SEQ ID NO: 112267 - DNA, 23 bp, Artificial sequence
  SiRNA target sequence
ctgtacgtatcaatttgcaagat

SEQ ID NO: 112268 - DNA, 23 bp, Artificial sequence
  SiRNA target sequence
tgtacgtatcaatttgcaagatg

SEQ ID NO: 112269 - DNA, 23 bp, Artificial sequence
  SiRNA target sequence
gtacgtatcaatttgcaagatga

SEQ ID NO: 112270 - DNA, 23 bp, Artificial sequence
  SiRNA target sequence
tacgtatcaatttgcaagatgat

SEQ ID NO: 112271 - DNA, 23 bp, Artificial sequence
  SiRNA target sequence
acgtatcaatttgcaagatgata

SEQ ID NO: 112272 - DNA, 23 bp, Artificial sequence
  SiRNA target sequence
cgtatcaatttgcaagatgatag

SEQ ID NO: 112273 - DNA, 23 bp, Artificial sequence
  SiRNA target sequence
gtatcaatttgcaagatgatagg

SEQ ID NO: 112274 - DNA, 23 bp, Artificial sequence
  SiRNA target sequence
tatcaatttgcaagatgataggt

SEQ ID NO: 112275 - DNA, 23 bp, Artificial sequence
  SiRNA target sequence
atcaatttgcaagatgataggtc

SEQ ID NO: 112276 - DNA, 23 bp, Artificial sequence
  SiRNA target sequence
tcaatttgcaagatgataggtcc

SEQ ID NO: 112277 - DNA, 23 bp, Artificial sequence
  SiRNA target sequence
caatttgcaagatgataggtcct

SEQ ID NO: 112278 - DNA, 23 bp, Artificial sequence
  SiRNA target sequence
aatttgcaagatgataggtcctt

SEQ ID NO: 112279 - DNA, 23 bp, Artificial sequence
  SiRNA target sequence
atttgcaagatgataggtccttt

SEQ ID NO: 112280 - DNA, 23 bp, Artificial sequence
  SiRNA target sequence
tttgcaagatgataggtcctttt

SEQ ID NO: 112281 - DNA, 23 bp, Artificial sequence
  SiRNA target sequence
ttgcaagatgataggtccttttt

SEQ ID NO: 112282 - DNA, 23 bp, Artificial sequence
  SiRNA target sequence
tgcaagatgataggtcctttttc

SEQ ID NO: 112283 - DNA, 23 bp, Artificial sequence
  SiRNA target sequence
gcaagatgataggtcctttttct

SEQ ID NO: 112284 - DNA, 23 bp, Artificial sequence
  SiRNA target sequence
caagatgataggtcctttttcta

SEQ ID NO: 112285 - DNA, 23 bp, Artificial sequence
  SiRNA target sequence
aagatgataggtcctttttctat

SEQ ID NO: 112286 - DNA, 23 bp, Artificial sequence
  SiRNA target sequence
agatgataggtcctttttctatt

SEQ ID NO: 112287 - DNA, 23 bp, Artificial sequence
  SiRNA target sequence
gatgataggtcctttttctattg

SEQ ID NO: 112288 - DNA, 23 bp, Artificial sequence
  SiRNA target sequence
atgataggtcctttttctattgc

SEQ ID NO: 112289 - DNA, 23 bp, Artificial sequence
  SiRNA target sequence
tgataggtcctttttctattgca

SEQ ID NO: 112290 - DNA, 23 bp, Artificial sequence
  SiRNA target sequence
gataggtcctttttctattgcat

SEQ ID NO: 112291 - DNA, 23 bp, Artificial sequence
  SiRNA target sequence
ataggtcctttttctattgcatg

SEQ ID NO: 112292 - DNA, 23 bp, Artificial sequence
  SiRNA target sequence
taggtcctttttctattgcatgt

SEQ ID NO: 112293 - DNA, 23 bp, Artificial sequence
  SiRNA target sequence
aggtcctttttctattgcatgtt

SEQ ID NO: 112294 - DNA, 23 bp, Artificial sequence
  SiRNA target sequence
ggtcctttttctattgcatgttg

SEQ ID NO: 112295 - DNA, 23 bp, Artificial sequence
  SiRNA target sequence
gtcctttttctattgcatgttgt

SEQ ID NO: 112296 - DNA, 23 bp, Artificial sequence
  SiRNA target sequence
tcctttttctattgcatgttgtc

SEQ ID NO: 112297 - DNA, 23 bp, Artificial sequence
  SiRNA target sequence
cctttttctattgcatgttgtct

SEQ ID NO: 112298 - DNA, 23 bp, Artificial sequence
  SiRNA target sequence
ctttttctattgcatgttgtcta

SEQ ID NO: 112299 - DNA, 23 bp, Artificial sequence
  SiRNA target sequence
tttttctattgcatgttgtctag

SEQ ID NO: 112300 - DNA, 23 bp, Artificial sequence
  SiRNA target sequence
ttttctattgcatgttgtctagc

SEQ ID NO: 112301 - DNA, 23 bp, Artificial sequence
  SiRNA target sequence
tttctattgcatgttgtctagca

SEQ ID NO: 112302 - DNA, 23 bp, Artificial sequence
  SiRNA target sequence
ttctattgcatgttgtctagcaa

SEQ ID NO: 112303 - DNA, 23 bp, Artificial sequence
  SiRNA target sequence
tctattgcatgttgtctagcaaa

SEQ ID NO: 112304 - DNA, 23 bp, Artificial sequence
  SiRNA target sequence
ctattgcatgttgtctagcaaat

SEQ ID NO: 112305 - DNA, 23 bp, Artificial sequence
  SiRNA target sequence
tattgcatgttgtctagcaaatg

SEQ ID NO: 112306 - DNA, 23 bp, Artificial sequence
  SiRNA target sequence
attgcatgttgtctagcaaatgt

SEQ ID NO: 112307 - DNA, 23 bp, Artificial sequence
  SiRNA target sequence
ttgcatgttgtctagcaaatgta

SEQ ID NO: 112308 - DNA, 23 bp, Artificial sequence
  SiRNA target sequence
tgcatgttgtctagcaaatgtaa

SEQ ID NO: 112309 - DNA, 23 bp, Artificial sequence
  SiRNA target sequence
gcatgttgtctagcaaatgtaaa

SEQ ID NO: 112310 - DNA, 23 bp, Artificial sequence
  SiRNA target sequence
catgttgtctagcaaatgtaaat

SEQ ID NO: 112311 - DNA, 23 bp, Artificial sequence
  SiRNA target sequence
atgttgtctagcaaatgtaaata

SEQ ID NO: 112312 - DNA, 23 bp, Artificial sequence
  SiRNA target sequence
tgttgtctagcaaatgtaaatac

SEQ ID NO: 112313 - DNA, 23 bp, Artificial sequence
  SiRNA target sequence
gttgtctagcaaatgtaaataca

SEQ ID NO: 112314 - DNA, 23 bp, Artificial sequence
  SiRNA target sequence
ttgtctagcaaatgtaaatacat

SEQ ID NO: 112315 - DNA, 23 bp, Artificial sequence
  SiRNA target sequence
tgtctagcaaatgtaaatacatc

SEQ ID NO: 112316 - DNA, 23 bp, Artificial sequence
  SiRNA target sequence
gtctagcaaatgtaaatacatca

SEQ ID NO: 112317 - DNA, 23 bp, Artificial sequence
  SiRNA target sequence
tctagcaaatgtaaatacatcaa

SEQ ID NO: 112318 - DNA, 23 bp, Artificial sequence
  SiRNA target sequence
ctagcaaatgtaaatacatcaat

SEQ ID NO: 112319 - DNA, 23 bp, Artificial sequence
  SiRNA target sequence
tagcaaatgtaaatacatcaatc

SEQ ID NO: 112320 - DNA, 23 bp, Artificial sequence
  SiRNA target sequence
agcaaatgtaaatacatcaatca

SEQ ID NO: 112321 - DNA, 23 bp, Artificial sequence
  SiRNA target sequence
gcaaatgtaaatacatcaatcag

SEQ ID NO: 112322 - DNA, 23 bp, Artificial sequence
  SiRNA target sequence
caaatgtaaatacatcaatcagt

SEQ ID NO: 112323 - DNA, 23 bp, Artificial sequence
  SiRNA target sequence
aaatgtaaatacatcaatcagtt

SEQ ID NO: 112324 - DNA, 23 bp, Artificial sequence
  SiRNA target sequence
aatgtaaatacatcaatcagttg

SEQ ID NO: 112325 - DNA, 23 bp, Artificial sequence
  SiRNA target sequence
atgtaaatacatcaatcagttga

SEQ ID NO: 112326 - DNA, 23 bp, Artificial sequence
  SiRNA target sequence
tgtaaatacatcaatcagttgag

SEQ ID NO: 112327 - DNA, 23 bp, Artificial sequence
  SiRNA target sequence
gtaaatacatcaatcagttgagt

SEQ ID NO: 112328 - DNA, 23 bp, Artificial sequence
  SiRNA target sequence
taaatacatcaatcagttgagtt

SEQ ID NO: 112329 - DNA, 23 bp, Artificial sequence
  SiRNA target sequence
aaatacatcaatcagttgagtta

SEQ ID NO: 112330 - DNA, 23 bp, Artificial sequence
  SiRNA target sequence
aatacatcaatcagttgagttat

SEQ ID NO: 112331 - DNA, 23 bp, Artificial sequence
  SiRNA target sequence
atacatcaatcagttgagttatg

SEQ ID NO: 112332 - DNA, 23 bp, Artificial sequence
  SiRNA target sequence
tacatcaatcagttgagttatgt

SEQ ID NO: 112333 - DNA, 23 bp, Artificial sequence
  SiRNA target sequence
acatcaatcagttgagttatgtt

SEQ ID NO: 112334 - DNA, 23 bp, Artificial sequence
  SiRNA target sequence
catcaatcagttgagttatgttt

SEQ ID NO: 112335 - DNA, 23 bp, Artificial sequence
  SiRNA target sequence
atcaatcagttgagttatgtttt

SEQ ID NO: 112336 - DNA, 23 bp, Artificial sequence
  SiRNA target sequence
tcaatcagttgagttatgttttt

SEQ ID NO: 112337 - DNA, 23 bp, Artificial sequence
  SiRNA target sequence
caatcagttgagttatgttttta

SEQ ID NO: 112338 - DNA, 23 bp, Artificial sequence
  SiRNA target sequence
aatcagttgagttatgtttttat

SEQ ID NO: 112339 - DNA, 23 bp, Artificial sequence
  SiRNA target sequence
atcagttgagttatgtttttatc

SEQ ID NO: 112340 - DNA, 23 bp, Artificial sequence
  SiRNA target sequence
tcagttgagttatgtttttatct

SEQ ID NO: 112341 - DNA, 23 bp, Artificial sequence
  SiRNA target sequence
cagttgagttatgtttttatctg

SEQ ID NO: 112342 - DNA, 23 bp, Artificial sequence
  SiRNA target sequence
agttgagttatgtttttatctgt

SEQ ID NO: 112343 - DNA, 23 bp, Artificial sequence
  SiRNA target sequence
gttgagttatgtttttatctgta

SEQ ID NO: 112344 - DNA, 23 bp, Artificial sequence
  SiRNA target sequence
ttgagttatgtttttatctgtaa

SEQ ID NO: 112345 - DNA, 23 bp, Artificial sequence
  SiRNA target sequence
tgagttatgtttttatctgtaag

SEQ ID NO: 112346 - DNA, 23 bp, Artificial sequence
  SiRNA target sequence
gagttatgtttttatctgtaaga

SEQ ID NO: 112347 - DNA, 23 bp, Artificial sequence
  SiRNA target sequence
agttatgtttttatctgtaagac

SEQ ID NO: 112348 - DNA, 23 bp, Artificial sequence
  SiRNA target sequence
gttatgtttttatctgtaagacg

SEQ ID NO: 112349 - DNA, 23 bp, Artificial sequence
  SiRNA target sequence
ttatgtttttatctgtaagacgt

SEQ ID NO: 112350 - DNA, 23 bp, Artificial sequence
  SiRNA target sequence
tatgtttttatctgtaagacgta

SEQ ID NO: 112351 - DNA, 23 bp, Artificial sequence
  SiRNA target sequence
atgtttttatctgtaagacgtat

SEQ ID NO: 112352 - DNA, 23 bp, Artificial sequence
  SiRNA target sequence
tgtttttatctgtaagacgtata

SEQ ID NO: 112353 - DNA, 23 bp, Artificial sequence
  SiRNA target sequence
gtttttatctgtaagacgtatac

SEQ ID NO: 112354 - DNA, 23 bp, Artificial sequence
  SiRNA target sequence
tttttatctgtaagacgtatacc

SEQ ID NO: 112355 - DNA, 23 bp, Artificial sequence
  SiRNA target sequence
ttttatctgtaagacgtatacct

SEQ ID NO: 112356 - DNA, 23 bp, Artificial sequence
  SiRNA target sequence
tttatctgtaagacgtatacctg

SEQ ID NO: 112357 - DNA, 23 bp, Artificial sequence
  SiRNA target sequence
ttatctgtaagacgtatacctgg

SEQ ID NO: 112358 - DNA, 23 bp, Artificial sequence
  SiRNA target sequence
tatctgtaagacgtatacctgga

SEQ ID NO: 112359 - DNA, 23 bp, Artificial sequence
  SiRNA target sequence
atctgtaagacgtatacctggaa

SEQ ID NO: 112360 - DNA, 23 bp, Artificial sequence
  SiRNA target sequence
tctgtaagacgtatacctggaat

SEQ ID NO: 112361 - DNA, 23 bp, Artificial sequence
  SiRNA target sequence
ctgtaagacgtatacctggaata

SEQ ID NO: 112362 - DNA, 23 bp, Artificial sequence
  SiRNA target sequence
tgtaagacgtatacctggaatat

SEQ ID NO: 112363 - DNA, 23 bp, Artificial sequence
  SiRNA target sequence
gtaagacgtatacctggaatatt

SEQ ID NO: 112364 - DNA, 23 bp, Artificial sequence
  SiRNA target sequence
taagacgtatacctggaatatta

SEQ ID NO: 112365 - DNA, 23 bp, Artificial sequence
  SiRNA target sequence
aagacgtatacctggaatattat

SEQ ID NO: 112366 - DNA, 23 bp, Artificial sequence
  SiRNA target sequence
agacgtatacctggaatattata

SEQ ID NO: 112367 - DNA, 23 bp, Artificial sequence
  SiRNA target sequence
gacgtatacctggaatattatat

SEQ ID NO: 112368 - DNA, 23 bp, Artificial sequence
  SiRNA target sequence
acgtatacctggaatattatatc

SEQ ID NO: 112369 - DNA, 23 bp, Artificial sequence
  SiRNA target sequence
cgtatacctggaatattatatcc

SEQ ID NO: 112370 - DNA, 23 bp, Artificial sequence
  SiRNA target sequence
gtatacctggaatattatatccc

SEQ ID NO: 112371 - DNA, 23 bp, Artificial sequence
  SiRNA target sequence
tatacctggaatattatatcccc

SEQ ID NO: 112372 - DNA, 23 bp, Artificial sequence
  SiRNA target sequence
atacctggaatattatatcccct

SEQ ID NO: 112373 - DNA, 23 bp, Artificial sequence
  SiRNA target sequence
tacctggaatattatatcccctt

SEQ ID NO: 112374 - DNA, 23 bp, Artificial sequence
  SiRNA target sequence
acctggaatattatatccccttt

SEQ ID NO: 112375 - DNA, 23 bp, Artificial sequence
  SiRNA target sequence
cctggaatattatatcccctttt

SEQ ID NO: 112376 - DNA, 23 bp, Artificial sequence
  SiRNA target sequence
ctggaatattatatcccctttta

SEQ ID NO: 112377 - DNA, 23 bp, Artificial sequence
  SiRNA target sequence
tggaatattatatccccttttaa

SEQ ID NO: 112378 - DNA, 23 bp, Artificial sequence
  SiRNA target sequence
ggaatattatatccccttttaaa

SEQ ID NO: 112379 - DNA, 23 bp, Artificial sequence
  SiRNA target sequence
gaatattatatccccttttaaaa

SEQ ID NO: 112380 - DNA, 23 bp, Artificial sequence
  SiRNA target sequence
aatattatatccccttttaaaat

SEQ ID NO: 112381 - DNA, 23 bp, Artificial sequence
  SiRNA target sequence
atattatatccccttttaaaata

SEQ ID NO: 112382 - DNA, 23 bp, Artificial sequence
  SiRNA target sequence
tattatatccccttttaaaatat

SEQ ID NO: 112383 - DNA, 23 bp, Artificial sequence
  SiRNA target sequence
attatatccccttttaaaatatt

SEQ ID NO: 112384 - DNA, 23 bp, Artificial sequence
  SiRNA target sequence
ttatatccccttttaaaatattc

SEQ ID NO: 112385 - DNA, 23 bp, Artificial sequence
  SiRNA target sequence
tatatccccttttaaaatattca

SEQ ID NO: 112386 - DNA, 23 bp, Artificial sequence
  SiRNA target sequence
atatccccttttaaaatattcag

SEQ ID NO: 112387 - DNA, 23 bp, Artificial sequence
  SiRNA target sequence
tatccccttttaaaatattcagg

SEQ ID NO: 112388 - DNA, 23 bp, Artificial sequence
  SiRNA target sequence
atccccttttaaaatattcagga

SEQ ID NO: 112389 - DNA, 23 bp, Artificial sequence
  SiRNA target sequence
tccccttttaaaatattcaggat

SEQ ID NO: 112390 - DNA, 23 bp, Artificial sequence
  SiRNA target sequence
ccccttttaaaatattcaggata

SEQ ID NO: 112391 - DNA, 23 bp, Artificial sequence
  SiRNA target sequence
cccttttaaaatattcaggatat

SEQ ID NO: 112392 - DNA, 23 bp, Artificial sequence
  SiRNA target sequence
ccttttaaaatattcaggatatg

SEQ ID NO: 112393 - DNA, 23 bp, Artificial sequence
  SiRNA target sequence
cttttaaaatattcaggatatgt

SEQ ID NO: 112394 - DNA, 23 bp, Artificial sequence
  SiRNA target sequence
ttttaaaatattcaggatatgta

SEQ ID NO: 112395 - DNA, 23 bp, Artificial sequence
  SiRNA target sequence
tttaaaatattcaggatatgtag

SEQ ID NO: 112396 - DNA, 23 bp, Artificial sequence
  SiRNA target sequence
ttaaaatattcaggatatgtagt

SEQ ID NO: 112397 - DNA, 23 bp, Artificial sequence
  SiRNA target sequence
taaaatattcaggatatgtagtg

SEQ ID NO: 112398 - DNA, 23 bp, Artificial sequence
  SiRNA target sequence
aaaatattcaggatatgtagtgg

SEQ ID NO: 112399 - DNA, 23 bp, Artificial sequence
  SiRNA target sequence
aaatattcaggatatgtagtgga

SEQ ID NO: 112400 - DNA, 23 bp, Artificial sequence
  SiRNA target sequence
aatattcaggatatgtagtggaa

SEQ ID NO: 112401 - DNA, 23 bp, Artificial sequence
  SiRNA target sequence
atattcaggatatgtagtggaat

SEQ ID NO: 112402 - DNA, 23 bp, Artificial sequence
  SiRNA target sequence
tattcaggatatgtagtggaatt

SEQ ID NO: 112403 - DNA, 23 bp, Artificial sequence
  SiRNA target sequence
attcaggatatgtagtggaatta

SEQ ID NO: 112404 - DNA, 23 bp, Artificial sequence
  SiRNA target sequence
ttcaggatatgtagtggaattac

SEQ ID NO: 112405 - DNA, 23 bp, Artificial sequence
  SiRNA target sequence
tcaggatatgtagtggaattact

SEQ ID NO: 112406 - DNA, 23 bp, Artificial sequence
  SiRNA target sequence
caggatatgtagtggaattactt

SEQ ID NO: 112407 - DNA, 23 bp, Artificial sequence
  SiRNA target sequence
aggatatgtagtggaattacttt

SEQ ID NO: 112408 - DNA, 23 bp, Artificial sequence
  SiRNA target sequence
ggatatgtagtggaattactttc

SEQ ID NO: 112409 - DNA, 23 bp, Artificial sequence
  SiRNA target sequence
gatatgtagtggaattactttca

SEQ ID NO: 112410 - DNA, 23 bp, Artificial sequence
  SiRNA target sequence
atatgtagtggaattactttcag

SEQ ID NO: 112411 - DNA, 23 bp, Artificial sequence
  SiRNA target sequence
tatgtagtggaattactttcagg

SEQ ID NO: 112412 - DNA, 23 bp, Artificial sequence
  SiRNA target sequence
atgtagtggaattactttcaggt

SEQ ID NO: 112413 - DNA, 23 bp, Artificial sequence
  SiRNA target sequence
tgtagtggaattactttcaggtg

SEQ ID NO: 112414 - DNA, 23 bp, Artificial sequence
  SiRNA target sequence
gtagtggaattactttcaggtgt

SEQ ID NO: 112415 - DNA, 23 bp, Artificial sequence
  SiRNA target sequence
tagtggaattactttcaggtgtc

SEQ ID NO: 112416 - DNA, 23 bp, Artificial sequence
  SiRNA target sequence
agtggaattactttcaggtgtcc

SEQ ID NO: 112417 - DNA, 23 bp, Artificial sequence
  SiRNA target sequence
gtggaattactttcaggtgtcca

SEQ ID NO: 112418 - DNA, 23 bp, Artificial sequence
  SiRNA target sequence
tggaattactttcaggtgtccac

SEQ ID NO: 112419 - DNA, 23 bp, Artificial sequence
  SiRNA target sequence
ggaattactttcaggtgtccaca

SEQ ID NO: 112420 - DNA, 23 bp, Artificial sequence
  SiRNA target sequence
gaattactttcaggtgtccacat

SEQ ID NO: 112421 - DNA, 23 bp, Artificial sequence
  SiRNA target sequence
aattactttcaggtgtccacata

SEQ ID NO: 112422 - DNA, 23 bp, Artificial sequence
  SiRNA target sequence
attactttcaggtgtccacatac

SEQ ID NO: 112423 - DNA, 23 bp, Artificial sequence
  SiRNA target sequence
ttactttcaggtgtccacatact

SEQ ID NO: 112424 - DNA, 23 bp, Artificial sequence
  SiRNA target sequence
tactttcaggtgtccacatacta

SEQ ID NO: 112425 - DNA, 23 bp, Artificial sequence
  SiRNA target sequence
actttcaggtgtccacatactat

SEQ ID NO: 112426 - DNA, 23 bp, Artificial sequence
  SiRNA target sequence
ctttcaggtgtccacatactata

SEQ ID NO: 112427 - DNA, 23 bp, Artificial sequence
  SiRNA target sequence
tttcaggtgtccacatactataa

SEQ ID NO: 112428 - DNA, 23 bp, Artificial sequence
  SiRNA target sequence
ttcaggtgtccacatactataat

SEQ ID NO: 112429 - DNA, 23 bp, Artificial sequence
  SiRNA target sequence
tcaggtgtccacatactataatg

SEQ ID NO: 112430 - DNA, 23 bp, Artificial sequence
  SiRNA target sequence
caggtgtccacatactataatga

SEQ ID NO: 112431 - DNA, 23 bp, Artificial sequence
  SiRNA target sequence
aggtgtccacatactataatgat

SEQ ID NO: 112432 - DNA, 23 bp, Artificial sequence
  SiRNA target sequence
ggtgtccacatactataatgatt

SEQ ID NO: 112433 - DNA, 23 bp, Artificial sequence
  SiRNA target sequence
gtgtccacatactataatgatta

SEQ ID NO: 112434 - DNA, 23 bp, Artificial sequence
  SiRNA target sequence
tgtccacatactataatgattat

SEQ ID NO: 112435 - DNA, 23 bp, Artificial sequence
  SiRNA target sequence
gtccacatactataatgattatt

SEQ ID NO: 112436 - DNA, 23 bp, Artificial sequence
  SiRNA target sequence
tccacatactataatgattattt

SEQ ID NO: 112437 - DNA, 23 bp, Artificial sequence
  SiRNA target sequence
ccacatactataatgattatttt

SEQ ID NO: 112438 - DNA, 23 bp, Artificial sequence
  SiRNA target sequence
cacatactataatgattattttc

SEQ ID NO: 112439 - DNA, 23 bp, Artificial sequence
  SiRNA target sequence
acatactataatgattattttca

SEQ ID NO: 112440 - DNA, 23 bp, Artificial sequence
  SiRNA target sequence
catactataatgattattttcac

SEQ ID NO: 112441 - DNA, 23 bp, Artificial sequence
  SiRNA target sequence
atactataatgattattttcaca

SEQ ID NO: 112442 - DNA, 23 bp, Artificial sequence
  SiRNA target sequence
tactataatgattattttcacat

SEQ ID NO: 112443 - DNA, 23 bp, Artificial sequence
  SiRNA target sequence
actataatgattattttcacata

SEQ ID NO: 112444 - DNA, 23 bp, Artificial sequence
  SiRNA target sequence
ctataatgattattttcacatac

SEQ ID NO: 112445 - DNA, 23 bp, Artificial sequence
  SiRNA target sequence
tataatgattattttcacataca

SEQ ID NO: 112446 - DNA, 23 bp, Artificial sequence
  SiRNA target sequence
ataatgattattttcacatacat

SEQ ID NO: 112447 - DNA, 23 bp, Artificial sequence
  SiRNA target sequence
taatgattattttcacatacata

SEQ ID NO: 112448 - DNA, 23 bp, Artificial sequence
  SiRNA target sequence
aatgattattttcacatacataa

SEQ ID NO: 112449 - DNA, 23 bp, Artificial sequence
  SiRNA target sequence
atgattattttcacatacataaa

SEQ ID NO: 112450 - DNA, 23 bp, Artificial sequence
  SiRNA target sequence
tgattattttcacatacataaac

SEQ ID NO: 112451 - DNA, 23 bp, Artificial sequence
  SiRNA target sequence
gattattttcacatacataaacc

SEQ ID NO: 112452 - DNA, 23 bp, Artificial sequence
  SiRNA target sequence
attattttcacatacataaacca

SEQ ID NO: 112453 - DNA, 23 bp, Artificial sequence
  SiRNA target sequence
ttattttcacatacataaaccac

SEQ ID NO: 112454 - DNA, 23 bp, Artificial sequence
  SiRNA target sequence
tattttcacatacataaaccaca

SEQ ID NO: 112455 - DNA, 23 bp, Artificial sequence
  SiRNA target sequence
attttcacatacataaaccacag

SEQ ID NO: 112456 - DNA, 23 bp, Artificial sequence
  SiRNA target sequence
ttttcacatacataaaccacagg

SEQ ID NO: 112457 - DNA, 23 bp, Artificial sequence
  SiRNA target sequence
tttcacatacataaaccacagga

SEQ ID NO: 112458 - DNA, 23 bp, Artificial sequence
  SiRNA target sequence
ttcacatacataaaccacaggaa

SEQ ID NO: 112459 - DNA, 23 bp, Artificial sequence
  SiRNA target sequence
tcacatacataaaccacaggaag

SEQ ID NO: 112460 - DNA, 23 bp, Artificial sequence
  SiRNA target sequence
cacatacataaaccacaggaagt

SEQ ID NO: 112461 - DNA, 23 bp, Artificial sequence
  SiRNA target sequence
acatacataaaccacaggaagtt

SEQ ID NO: 112462 - DNA, 23 bp, Artificial sequence
  SiRNA target sequence
catacataaaccacaggaagttt

SEQ ID NO: 112463 - DNA, 23 bp, Artificial sequence
  SiRNA target sequence
atacataaaccacaggaagtttc

SEQ ID NO: 112464 - DNA, 23 bp, Artificial sequence
  SiRNA target sequence
tacataaaccacaggaagtttcc

SEQ ID NO: 112465 - DNA, 23 bp, Artificial sequence
  SiRNA target sequence
acataaaccacaggaagtttcca

SEQ ID NO: 112466 - DNA, 23 bp, Artificial sequence
  SiRNA target sequence
cataaaccacaggaagtttccat

SEQ ID NO: 112467 - DNA, 23 bp, Artificial sequence
  SiRNA target sequence
ataaaccacaggaagtttccata

SEQ ID NO: 112468 - DNA, 23 bp, Artificial sequence
  SiRNA target sequence
taaaccacaggaagtttccataa

SEQ ID NO: 112469 - DNA, 23 bp, Artificial sequence
  SiRNA target sequence
aaaccacaggaagtttccataat

SEQ ID NO: 112470 - DNA, 23 bp, Artificial sequence
  SiRNA target sequence
aaccacaggaagtttccataatg

SEQ ID NO: 112471 - DNA, 23 bp, Artificial sequence
  SiRNA target sequence
accacaggaagtttccataatgc

SEQ ID NO: 112472 - DNA, 23 bp, Artificial sequence
  SiRNA target sequence
ccacaggaagtttccataatgca

SEQ ID NO: 112473 - DNA, 23 bp, Artificial sequence
  SiRNA target sequence
cacaggaagtttccataatgcag

SEQ ID NO: 112474 - DNA, 23 bp, Artificial sequence
  SiRNA target sequence
acaggaagtttccataatgcagc

SEQ ID NO: 112475 - DNA, 23 bp, Artificial sequence
  SiRNA target sequence
caggaagtttccataatgcagcc

SEQ ID NO: 112476 - DNA, 23 bp, Artificial sequence
  SiRNA target sequence
aggaagtttccataatgcagcca

SEQ ID NO: 112477 - DNA, 23 bp, Artificial sequence
  SiRNA target sequence
ggaagtttccataatgcagccat

SEQ ID NO: 112478 - DNA, 23 bp, Artificial sequence
  SiRNA target sequence
gaagtttccataatgcagccata

SEQ ID NO: 112479 - DNA, 23 bp, Artificial sequence
  SiRNA target sequence
aagtttccataatgcagccatat

SEQ ID NO: 112480 - DNA, 23 bp, Artificial sequence
  SiRNA target sequence
agtttccataatgcagccatatt

SEQ ID NO: 112481 - DNA, 23 bp, Artificial sequence
  SiRNA target sequence
gtttccataatgcagccatattg

SEQ ID NO: 112482 - DNA, 23 bp, Artificial sequence
  SiRNA target sequence
tttccataatgcagccatattga

SEQ ID NO: 112483 - DNA, 23 bp, Artificial sequence
  SiRNA target sequence
ttccataatgcagccatattgaa

SEQ ID NO: 112484 - DNA, 23 bp, Artificial sequence
  SiRNA target sequence
tccataatgcagccatattgaac

SEQ ID NO: 112485 - DNA, 23 bp, Artificial sequence
  SiRNA target sequence
ccataatgcagccatattgaacg

SEQ ID NO: 112486 - DNA, 23 bp, Artificial sequence
  SiRNA target sequence
cataatgcagccatattgaacga

SEQ ID NO: 112487 - DNA, 23 bp, Artificial sequence
  SiRNA target sequence
ataatgcagccatattgaacgac

SEQ ID NO: 112488 - DNA, 23 bp, Artificial sequence
  SiRNA target sequence
taatgcagccatattgaacgact

SEQ ID NO: 112489 - DNA, 23 bp, Artificial sequence
  SiRNA target sequence
aatgcagccatattgaacgactc

SEQ ID NO: 112490 - DNA, 23 bp, Artificial sequence
  SiRNA target sequence
atgcagccatattgaacgactcc

SEQ ID NO: 112491 - DNA, 23 bp, Artificial sequence
  SiRNA target sequence
tgcagccatattgaacgactccc

SEQ ID NO: 112492 - DNA, 23 bp, Artificial sequence
  SiRNA target sequence
gcagccatattgaacgactccca

SEQ ID NO: 112493 - DNA, 23 bp, Artificial sequence
  SiRNA target sequence
cagccatattgaacgactcccag

SEQ ID NO: 112494 - DNA, 23 bp, Artificial sequence
  SiRNA target sequence
agccatattgaacgactcccaga

SEQ ID NO: 112495 - DNA, 23 bp, Artificial sequence
  SiRNA target sequence
gccatattgaacgactcccagac

SEQ ID NO: 112496 - DNA, 23 bp, Artificial sequence
  SiRNA target sequence
ccatattgaacgactcccagacc

SEQ ID NO: 112497 - DNA, 23 bp, Artificial sequence
  SiRNA target sequence
catattgaacgactcccagacct

SEQ ID NO: 112498 - DNA, 23 bp, Artificial sequence
  SiRNA target sequence
atattgaacgactcccagacctg

SEQ ID NO: 112499 - DNA, 23 bp, Artificial sequence
  SiRNA target sequence
tattgaacgactcccagacctgt

SEQ ID NO: 112500 - DNA, 23 bp, Artificial sequence
  SiRNA target sequence
attgaacgactcccagacctgtc

SEQ ID NO: 112501 - DNA, 23 bp, Artificial sequence
  SiRNA target sequence
ttgaacgactcccagacctgtcc

SEQ ID NO: 112502 - DNA, 23 bp, Artificial sequence
  SiRNA target sequence
tgaacgactcccagacctgtccc

SEQ ID NO: 112503 - DNA, 23 bp, Artificial sequence
  SiRNA target sequence
gaacgactcccagacctgtccct

SEQ ID NO: 112504 - DNA, 23 bp, Artificial sequence
  SiRNA target sequence
aacgactcccagacctgtccctg

SEQ ID NO: 112505 - DNA, 23 bp, Artificial sequence
  SiRNA target sequence
acgactcccagacctgtccctga

SEQ ID NO: 112506 - DNA, 23 bp, Artificial sequence
  SiRNA target sequence
cgactcccagacctgtccctgat

SEQ ID NO: 112507 - DNA, 23 bp, Artificial sequence
  SiRNA target sequence
gactcccagacctgtccctgatt

SEQ ID NO: 112508 - DNA, 23 bp, Artificial sequence
  SiRNA target sequence
actcccagacctgtccctgattt

SEQ ID NO: 112509 - DNA, 23 bp, Artificial sequence
  SiRNA target sequence
ctcccagacctgtccctgatttg

SEQ ID NO: 112510 - DNA, 23 bp, Artificial sequence
  SiRNA target sequence
tcccagacctgtccctgatttgc

SEQ ID NO: 112511 - DNA, 23 bp, Artificial sequence
  SiRNA target sequence
cccagacctgtccctgatttgca

SEQ ID NO: 112512 - DNA, 23 bp, Artificial sequence
  SiRNA target sequence
ccagacctgtccctgatttgcag

SEQ ID NO: 112513 - DNA, 23 bp, Artificial sequence
  SiRNA target sequence
cagacctgtccctgatttgcagc

SEQ ID NO: 112514 - DNA, 23 bp, Artificial sequence
  SiRNA target sequence
agacctgtccctgatttgcagca

SEQ ID NO: 112515 - DNA, 23 bp, Artificial sequence
  SiRNA target sequence
gacctgtccctgatttgcagcac

SEQ ID NO: 112516 - DNA, 23 bp, Artificial sequence
  SiRNA target sequence
acctgtccctgatttgcagcacc

SEQ ID NO: 112517 - DNA, 23 bp, Artificial sequence
  SiRNA target sequence
cctgtccctgatttgcagcacca

SEQ ID NO: 112518 - DNA, 23 bp, Artificial sequence
  SiRNA target sequence
ctgtccctgatttgcagcaccat

SEQ ID NO: 112519 - DNA, 23 bp, Artificial sequence
  SiRNA target sequence
tgtccctgatttgcagcaccatc

SEQ ID NO: 112520 - DNA, 23 bp, Artificial sequence
  SiRNA target sequence
gtccctgatttgcagcaccatcc

SEQ ID NO: 112521 - DNA, 23 bp, Artificial sequence
  SiRNA target sequence
tccctgatttgcagcaccatccc

SEQ ID NO: 112522 - DNA, 23 bp, Artificial sequence
  SiRNA target sequence
ccctgatttgcagcaccatcccc

SEQ ID NO: 112523 - DNA, 23 bp, Artificial sequence
  SiRNA target sequence
cctgatttgcagcaccatccccg

SEQ ID NO: 112524 - DNA, 23 bp, Artificial sequence
  SiRNA target sequence
ctgatttgcagcaccatccccga

SEQ ID NO: 112525 - DNA, 23 bp, Artificial sequence
  SiRNA target sequence
tgatttgcagcaccatccccgaa

SEQ ID NO: 112526 - DNA, 23 bp, Artificial sequence
  SiRNA target sequence
gatttgcagcaccatccccgaaa

SEQ ID NO: 112527 - DNA, 23 bp, Artificial sequence
  SiRNA target sequence
atttgcagcaccatccccgaaaa

SEQ ID NO: 112528 - DNA, 23 bp, Artificial sequence
  SiRNA target sequence
tttgcagcaccatccccgaaaaa

SEQ ID NO: 112529 - DNA, 23 bp, Artificial sequence
  SiRNA target sequence
ttgcagcaccatccccgaaaaat

SEQ ID NO: 112530 - DNA, 23 bp, Artificial sequence
  SiRNA target sequence
tgcagcaccatccccgaaaaata

SEQ ID NO: 112531 - DNA, 23 bp, Artificial sequence
  SiRNA target sequence
gcagcaccatccccgaaaaatac

SEQ ID NO: 112532 - DNA, 23 bp, Artificial sequence
  SiRNA target sequence
cagcaccatccccgaaaaataca

SEQ ID NO: 112533 - DNA, 23 bp, Artificial sequence
  SiRNA target sequence
agcaccatccccgaaaaatacaa

SEQ ID NO: 112534 - DNA, 23 bp, Artificial sequence
  SiRNA target sequence
gcaccatccccgaaaaatacaaa

SEQ ID NO: 112535 - DNA, 23 bp, Artificial sequence
  SiRNA target sequence
caccatccccgaaaaatacaaat

SEQ ID NO: 112536 - DNA, 23 bp, Artificial sequence
  SiRNA target sequence
accatccccgaaaaatacaaatg

SEQ ID NO: 112537 - DNA, 23 bp, Artificial sequence
  SiRNA target sequence
ccatccccgaaaaatacaaatgc

SEQ ID NO: 112538 - DNA, 23 bp, Artificial sequence
  SiRNA target sequence
catccccgaaaaatacaaatgct

SEQ ID NO: 112539 - DNA, 23 bp, Artificial sequence
  SiRNA target sequence
atccccgaaaaatacaaatgcta

SEQ ID NO: 112540 - DNA, 23 bp, Artificial sequence
  SiRNA target sequence
tccccgaaaaatacaaatgctac

SEQ ID NO: 112541 - DNA, 23 bp, Artificial sequence
  SiRNA target sequence
ccccgaaaaatacaaatgctaca

SEQ ID NO: 112542 - DNA, 23 bp, Artificial sequence
  SiRNA target sequence
cccgaaaaatacaaatgctacat

SEQ ID NO: 112543 - DNA, 23 bp, Artificial sequence
  SiRNA target sequence
ccgaaaaatacaaatgctacatt

SEQ ID NO: 112544 - DNA, 23 bp, Artificial sequence
  SiRNA target sequence
cgaaaaatacaaatgctacattt

SEQ ID NO: 112545 - DNA, 23 bp, Artificial sequence
  SiRNA target sequence
gaaaaatacaaatgctacatttt

SEQ ID NO: 112546 - DNA, 23 bp, Artificial sequence
  SiRNA target sequence
aaaaatacaaatgctacattttt

SEQ ID NO: 112547 - DNA, 23 bp, Artificial sequence
  SiRNA target sequence
aaaatacaaatgctacatttttt

SEQ ID NO: 112548 - DNA, 23 bp, Artificial sequence
  SiRNA target sequence
aaatacaaatgctacatttttta

SEQ ID NO: 112549 - DNA, 23 bp, Artificial sequence
  SiRNA target sequence
aatacaaatgctacattttttac

SEQ ID NO: 112550 - DNA, 23 bp, Artificial sequence
  SiRNA target sequence
atacaaatgctacattttttact

SEQ ID NO: 112551 - DNA, 23 bp, Artificial sequence
  SiRNA target sequence
tacaaatgctacattttttactt

SEQ ID NO: 112552 - DNA, 23 bp, Artificial sequence
  SiRNA target sequence
acaaatgctacattttttacttt

SEQ ID NO: 112553 - DNA, 23 bp, Artificial sequence
  SiRNA target sequence
caaatgctacattttttactttt

SEQ ID NO: 112554 - DNA, 23 bp, Artificial sequence
  SiRNA target sequence
aaatgctacattttttacttttt

SEQ ID NO: 112555 - DNA, 23 bp, Artificial sequence
  SiRNA target sequence
aatgctacattttttactttttt

SEQ ID NO: 112556 - DNA, 23 bp, Artificial sequence
  SiRNA target sequence
atgctacattttttactttttta

SEQ ID NO: 112557 - DNA, 23 bp, Artificial sequence
  SiRNA target sequence
tgctacattttttacttttttat

SEQ ID NO: 112558 - DNA, 23 bp, Artificial sequence
  SiRNA target sequence
gctacattttttacttttttata

SEQ ID NO: 112559 - DNA, 23 bp, Artificial sequence
  SiRNA target sequence
ctacattttttacttttttatat

SEQ ID NO: 112560 - DNA, 23 bp, Artificial sequence
  SiRNA target sequence
tacattttttacttttttatatt

SEQ ID NO: 112561 - DNA, 23 bp, Artificial sequence
  SiRNA target sequence
acattttttacttttttatattg

SEQ ID NO: 112562 - DNA, 23 bp, Artificial sequence
  SiRNA target sequence
cattttttacttttttatattgt

SEQ ID NO: 112563 - DNA, 23 bp, Artificial sequence
  SiRNA target sequence
attttttacttttttatattgta

SEQ ID NO: 112564 - DNA, 23 bp, Artificial sequence
  SiRNA target sequence
ttttttacttttttatattgtaa

SEQ ID NO: 112565 - DNA, 23 bp, Artificial sequence
  SiRNA target sequence
tttttacttttttatattgtaaa

SEQ ID NO: 112566 - DNA, 23 bp, Artificial sequence
  SiRNA target sequence
ttttacttttttatattgtaaag

SEQ ID NO: 112567 - DNA, 23 bp, Artificial sequence
  SiRNA target sequence
tttacttttttatattgtaaagc

SEQ ID NO: 112568 - DNA, 23 bp, Artificial sequence
  SiRNA target sequence
ttacttttttatattgtaaagca

SEQ ID NO: 112569 - DNA, 23 bp, Artificial sequence
  SiRNA target sequence
tacttttttatattgtaaagcaa

SEQ ID NO: 112570 - DNA, 23 bp, Artificial sequence
  SiRNA target sequence
acttttttatattgtaaagcaaa

SEQ ID NO: 112571 - DNA, 23 bp, Artificial sequence
  SiRNA target sequence
cttttttatattgtaaagcaaat

SEQ ID NO: 112572 - DNA, 23 bp, Artificial sequence
  SiRNA target sequence
ttttttatattgtaaagcaaatc

SEQ ID NO: 112573 - DNA, 23 bp, Artificial sequence
  SiRNA target sequence
tttttatattgtaaagcaaatcc

SEQ ID NO: 112574 - DNA, 23 bp, Artificial sequence
  SiRNA target sequence
ttttatattgtaaagcaaatccc

SEQ ID NO: 112575 - DNA, 23 bp, Artificial sequence
  SiRNA target sequence
tttatattgtaaagcaaatccca

SEQ ID NO: 112576 - DNA, 23 bp, Artificial sequence
  SiRNA target sequence
ttatattgtaaagcaaatcccaa

SEQ ID NO: 112577 - DNA, 23 bp, Artificial sequence
  SiRNA target sequence
tatattgtaaagcaaatcccaat

SEQ ID NO: 112578 - DNA, 23 bp, Artificial sequence
  SiRNA target sequence
atattgtaaagcaaatcccaatc

SEQ ID NO: 112579 - DNA, 23 bp, Artificial sequence
  SiRNA target sequence
tattgtaaagcaaatcccaatcc

SEQ ID NO: 112580 - DNA, 23 bp, Artificial sequence
  SiRNA target sequence
attgtaaagcaaatcccaatcct

SEQ ID NO: 112581 - DNA, 23 bp, Artificial sequence
  SiRNA target sequence
ttgtaaagcaaatcccaatcctg

SEQ ID NO: 112582 - DNA, 23 bp, Artificial sequence
  SiRNA target sequence
tgtaaagcaaatcccaatcctgt

SEQ ID NO: 112583 - DNA, 23 bp, Artificial sequence
  SiRNA target sequence
gtaaagcaaatcccaatcctgta

SEQ ID NO: 112584 - DNA, 23 bp, Artificial sequence
  SiRNA target sequence
taaagcaaatcccaatcctgtac

SEQ ID NO: 112585 - DNA, 23 bp, Artificial sequence
  SiRNA target sequence
aaagcaaatcccaatcctgtacc

SEQ ID NO: 112586 - DNA, 23 bp, Artificial sequence
  SiRNA target sequence
aagcaaatcccaatcctgtacca

SEQ ID NO: 112587 - DNA, 23 bp, Artificial sequence
  SiRNA target sequence
agcaaatcccaatcctgtaccaa

SEQ ID NO: 112588 - DNA, 23 bp, Artificial sequence
  SiRNA target sequence
gcaaatcccaatcctgtaccaag

SEQ ID NO: 112589 - DNA, 23 bp, Artificial sequence
  SiRNA target sequence
caaatcccaatcctgtaccaagc

SEQ ID NO: 112590 - DNA, 23 bp, Artificial sequence
  SiRNA target sequence
aaatcccaatcctgtaccaagcg

SEQ ID NO: 112591 - DNA, 23 bp, Artificial sequence
  SiRNA target sequence
aatcccaatcctgtaccaagcga

SEQ ID NO: 112592 - DNA, 23 bp, Artificial sequence
  SiRNA target sequence
atcccaatcctgtaccaagcgat

SEQ ID NO: 112593 - DNA, 23 bp, Artificial sequence
  SiRNA target sequence
tcccaatcctgtaccaagcgata

SEQ ID NO: 112594 - DNA, 23 bp, Artificial sequence
  SiRNA target sequence
cccaatcctgtaccaagcgatac

SEQ ID NO: 112595 - DNA, 23 bp, Artificial sequence
  SiRNA target sequence
ccaatcctgtaccaagcgatacc

SEQ ID NO: 112596 - DNA, 23 bp, Artificial sequence
  SiRNA target sequence
caatcctgtaccaagcgatacct

SEQ ID NO: 112597 - DNA, 23 bp, Artificial sequence
  SiRNA target sequence
aatcctgtaccaagcgatacctg

SEQ ID NO: 112598 - DNA, 23 bp, Artificial sequence
  SiRNA target sequence
atcctgtaccaagcgatacctgc

SEQ ID NO: 112599 - DNA, 23 bp, Artificial sequence
  SiRNA target sequence
tcctgtaccaagcgatacctgcg

SEQ ID NO: 112600 - DNA, 23 bp, Artificial sequence
  SiRNA target sequence
cctgtaccaagcgatacctgcgc

SEQ ID NO: 112601 - DNA, 23 bp, Artificial sequence
  SiRNA target sequence
ctgtaccaagcgatacctgcgca

SEQ ID NO: 112602 - DNA, 23 bp, Artificial sequence
  SiRNA target sequence
tgtaccaagcgatacctgcgcac

SEQ ID NO: 112603 - DNA, 23 bp, Artificial sequence
  SiRNA target sequence
gtaccaagcgatacctgcgcacc

SEQ ID NO: 112604 - DNA, 23 bp, Artificial sequence
  SiRNA target sequence
taccaagcgatacctgcgcacct

SEQ ID NO: 112605 - DNA, 23 bp, Artificial sequence
  SiRNA target sequence
accaagcgatacctgcgcaccta

SEQ ID NO: 112606 - DNA, 23 bp, Artificial sequence
  SiRNA target sequence
ccaagcgatacctgcgcacctac

SEQ ID NO: 112607 - DNA, 23 bp, Artificial sequence
  SiRNA target sequence
caagcgatacctgcgcacctact

SEQ ID NO: 112608 - DNA, 23 bp, Artificial sequence
  SiRNA target sequence
aagcgatacctgcgcacctacta

SEQ ID NO: 112609 - DNA, 23 bp, Artificial sequence
  SiRNA target sequence
agcgatacctgcgcacctactat

SEQ ID NO: 112610 - DNA, 23 bp, Artificial sequence
  SiRNA target sequence
gcgatacctgcgcacctactata

SEQ ID NO: 112611 - DNA, 23 bp, Artificial sequence
  SiRNA target sequence
cgatacctgcgcacctactatac

SEQ ID NO: 112612 - DNA, 23 bp, Artificial sequence
  SiRNA target sequence
gatacctgcgcacctactatacc

SEQ ID NO: 112613 - DNA, 23 bp, Artificial sequence
  SiRNA target sequence
atacctgcgcacctactataccg

SEQ ID NO: 112614 - DNA, 23 bp, Artificial sequence
  SiRNA target sequence
tacctgcgcacctactataccgt

SEQ ID NO: 112615 - DNA, 23 bp, Artificial sequence
  SiRNA target sequence
acctgcgcacctactataccgtg

SEQ ID NO: 112616 - DNA, 23 bp, Artificial sequence
  SiRNA target sequence
cctgcgcacctactataccgtgt

SEQ ID NO: 112617 - DNA, 23 bp, Artificial sequence
  SiRNA target sequence
ctgcgcacctactataccgtgtc

SEQ ID NO: 112618 - DNA, 23 bp, Artificial sequence
  SiRNA target sequence
tgcgcacctactataccgtgtcc

SEQ ID NO: 112619 - DNA, 23 bp, Artificial sequence
  SiRNA target sequence
gcgcacctactataccgtgtccc

SEQ ID NO: 112620 - DNA, 23 bp, Artificial sequence
  SiRNA target sequence
cgcacctactataccgtgtcccc

SEQ ID NO: 112621 - DNA, 23 bp, Artificial sequence
  SiRNA target sequence
gcacctactataccgtgtccccc

SEQ ID NO: 112622 - DNA, 23 bp, Artificial sequence
  SiRNA target sequence
cacctactataccgtgtccccca

SEQ ID NO: 112623 - DNA, 23 bp, Artificial sequence
  SiRNA target sequence
acctactataccgtgtcccccat

SEQ ID NO: 112624 - DNA, 23 bp, Artificial sequence
  SiRNA target sequence
cctactataccgtgtcccccata

SEQ ID NO: 112625 - DNA, 23 bp, Artificial sequence
  SiRNA target sequence
ctactataccgtgtcccccataa

SEQ ID NO: 112626 - DNA, 23 bp, Artificial sequence
  SiRNA target sequence
tactataccgtgtcccccataaa

SEQ ID NO: 112627 - DNA, 23 bp, Artificial sequence
  SiRNA target sequence
actataccgtgtcccccataaaa

SEQ ID NO: 112628 - DNA, 23 bp, Artificial sequence
  SiRNA target sequence
ctataccgtgtcccccataaaat

SEQ ID NO: 112629 - DNA, 23 bp, Artificial sequence
  SiRNA target sequence
tataccgtgtcccccataaaatt

SEQ ID NO: 112630 - DNA, 23 bp, Artificial sequence
  SiRNA target sequence
ataccgtgtcccccataaaattg

SEQ ID NO: 112631 - DNA, 23 bp, Artificial sequence
  SiRNA target sequence
taccgtgtcccccataaaattgg

SEQ ID NO: 112632 - DNA, 23 bp, Artificial sequence
  SiRNA target sequence
accgtgtcccccataaaattggt

SEQ ID NO: 112633 - DNA, 23 bp, Artificial sequence
  SiRNA target sequence
ccgtgtcccccataaaattggtc

SEQ ID NO: 112634 - DNA, 23 bp, Artificial sequence
  SiRNA target sequence
cgtgtcccccataaaattggtca

SEQ ID NO: 112635 - DNA, 23 bp, Artificial sequence
  SiRNA target sequence
gtgtcccccataaaattggtcat

SEQ ID NO: 112636 - DNA, 23 bp, Artificial sequence
  SiRNA target sequence
tgtcccccataaaattggtcatt

SEQ ID NO: 112637 - DNA, 23 bp, Artificial sequence
  SiRNA target sequence
gtcccccataaaattggtcatta

SEQ ID NO: 112638 - DNA, 23 bp, Artificial sequence
  SiRNA target sequence
tcccccataaaattggtcattat

SEQ ID NO: 112639 - DNA, 23 bp, Artificial sequence
  SiRNA target sequence
cccccataaaattggtcattata

SEQ ID NO: 112640 - DNA, 23 bp, Artificial sequence
  SiRNA target sequence
ccccataaaattggtcattatac

SEQ ID NO: 112641 - DNA, 23 bp, Artificial sequence
  SiRNA target sequence
cccataaaattggtcattataca

SEQ ID NO: 112642 - DNA, 23 bp, Artificial sequence
  SiRNA target sequence
ccataaaattggtcattatacaa

SEQ ID NO: 112643 - DNA, 23 bp, Artificial sequence
  SiRNA target sequence
cataaaattggtcattatacaaa

SEQ ID NO: 112644 - DNA, 23 bp, Artificial sequence
  SiRNA target sequence
ataaaattggtcattatacaaat

SEQ ID NO: 112645 - DNA, 23 bp, Artificial sequence
  SiRNA target sequence
taaaattggtcattatacaaatg

SEQ ID NO: 112646 - DNA, 23 bp, Artificial sequence
  SiRNA target sequence
aaaattggtcattatacaaatgc

SEQ ID NO: 112647 - DNA, 23 bp, Artificial sequence
  SiRNA target sequence
aaattggtcattatacaaatgca

SEQ ID NO: 112648 - DNA, 23 bp, Artificial sequence
  SiRNA target sequence
aattggtcattatacaaatgcat

SEQ ID NO: 112649 - DNA, 23 bp, Artificial sequence
  SiRNA target sequence
attggtcattatacaaatgcatc

SEQ ID NO: 112650 - DNA, 23 bp, Artificial sequence
  SiRNA target sequence
ttggtcattatacaaatgcatcg

SEQ ID NO: 112651 - DNA, 23 bp, Artificial sequence
  SiRNA target sequence
tggtcattatacaaatgcatcga

SEQ ID NO: 112652 - DNA, 23 bp, Artificial sequence
  SiRNA target sequence
ggtcattatacaaatgcatcgat

SEQ ID NO: 112653 - DNA, 23 bp, Artificial sequence
  SiRNA target sequence
gtcattatacaaatgcatcgatc

SEQ ID NO: 112654 - DNA, 23 bp, Artificial sequence
  SiRNA target sequence
tcattatacaaatgcatcgatcc

SEQ ID NO: 112655 - DNA, 23 bp, Artificial sequence
  SiRNA target sequence
cattatacaaatgcatcgatcct

SEQ ID NO: 112656 - DNA, 23 bp, Artificial sequence
  SiRNA target sequence
attatacaaatgcatcgatcctc

SEQ ID NO: 112657 - DNA, 23 bp, Artificial sequence
  SiRNA target sequence
ttatacaaatgcatcgatcctcc

SEQ ID NO: 112658 - DNA, 23 bp, Artificial sequence
  SiRNA target sequence
tatacaaatgcatcgatcctcct

SEQ ID NO: 112659 - DNA, 23 bp, Artificial sequence
  SiRNA target sequence
atacaaatgcatcgatcctcctt

SEQ ID NO: 112660 - DNA, 23 bp, Artificial sequence
  SiRNA target sequence
tacaaatgcatcgatcctccttt

SEQ ID NO: 112661 - DNA, 23 bp, Artificial sequence
  SiRNA target sequence
acaaatgcatcgatcctcctttt

SEQ ID NO: 112662 - DNA, 23 bp, Artificial sequence
  SiRNA target sequence
caaatgcatcgatcctccttttc

SEQ ID NO: 112663 - DNA, 23 bp, Artificial sequence
  SiRNA target sequence
aaatgcatcgatcctccttttcc

SEQ ID NO: 112664 - DNA, 23 bp, Artificial sequence
  SiRNA target sequence
aatgcatcgatcctccttttcct

SEQ ID NO: 112665 - DNA, 23 bp, Artificial sequence
  SiRNA target sequence
atgcatcgatcctccttttcctt

SEQ ID NO: 112666 - DNA, 23 bp, Artificial sequence
  SiRNA target sequence
tgcatcgatcctccttttccttt

SEQ ID NO: 112667 - DNA, 23 bp, Artificial sequence
  SiRNA target sequence
gcatcgatcctccttttcctttg

SEQ ID NO: 112668 - DNA, 23 bp, Artificial sequence
  SiRNA target sequence
catcgatcctccttttcctttgc

SEQ ID NO: 112669 - DNA, 23 bp, Artificial sequence
  SiRNA target sequence
atcgatcctccttttcctttgca

SEQ ID NO: 112670 - DNA, 23 bp, Artificial sequence
  SiRNA target sequence
tcgatcctccttttcctttgcaa

SEQ ID NO: 112671 - DNA, 23 bp, Artificial sequence
  SiRNA target sequence
cgatcctccttttcctttgcaat

SEQ ID NO: 112672 - DNA, 23 bp, Artificial sequence
  SiRNA target sequence
gatcctccttttcctttgcaatt

SEQ ID NO: 112673 - DNA, 23 bp, Artificial sequence
  SiRNA target sequence
atcctccttttcctttgcaatta

SEQ ID NO: 112674 - DNA, 23 bp, Artificial sequence
  SiRNA target sequence
tcctccttttcctttgcaattac

SEQ ID NO: 112675 - DNA, 23 bp, Artificial sequence
  SiRNA target sequence
cctccttttcctttgcaattacc

SEQ ID NO: 112676 - DNA, 23 bp, Artificial sequence
  SiRNA target sequence
ctccttttcctttgcaattacca

SEQ ID NO: 112677 - DNA, 23 bp, Artificial sequence
  SiRNA target sequence
tccttttcctttgcaattaccaa

SEQ ID NO: 112678 - DNA, 23 bp, Artificial sequence
  SiRNA target sequence
ccttttcctttgcaattaccaat

SEQ ID NO: 112679 - DNA, 23 bp, Artificial sequence
  SiRNA target sequence
cttttcctttgcaattaccaata

SEQ ID NO: 112680 - DNA, 23 bp, Artificial sequence
  SiRNA target sequence
ttttcctttgcaattaccaatag

SEQ ID NO: 112681 - DNA, 23 bp, Artificial sequence
  SiRNA target sequence
tttcctttgcaattaccaatagc

SEQ ID NO: 112682 - DNA, 23 bp, Artificial sequence
  SiRNA target sequence
ttcctttgcaattaccaatagcc

SEQ ID NO: 112683 - DNA, 23 bp, Artificial sequence
  SiRNA target sequence
tcctttgcaattaccaatagcct

SEQ ID NO: 112684 - DNA, 23 bp, Artificial sequence
  SiRNA target sequence
cctttgcaattaccaatagcctt

SEQ ID NO: 112685 - DNA, 23 bp, Artificial sequence
  SiRNA target sequence
ctttgcaattaccaatagccttt

SEQ ID NO: 112686 - DNA, 23 bp, Artificial sequence
  SiRNA target sequence
tttgcaattaccaatagcctttc

SEQ ID NO: 112687 - DNA, 23 bp, Artificial sequence
  SiRNA target sequence
ttgcaattaccaatagcctttcc

SEQ ID NO: 112688 - DNA, 23 bp, Artificial sequence
  SiRNA target sequence
tgcaattaccaatagcctttcct

SEQ ID NO: 112689 - DNA, 23 bp, Artificial sequence
  SiRNA target sequence
gcaattaccaatagcctttccta

SEQ ID NO: 112690 - DNA, 23 bp, Artificial sequence
  SiRNA target sequence
caattaccaatagcctttcctaa

SEQ ID NO: 112691 - DNA, 23 bp, Artificial sequence
  SiRNA target sequence
aattaccaatagcctttcctaat

SEQ ID NO: 112692 - DNA, 23 bp, Artificial sequence
  SiRNA target sequence
attaccaatagcctttcctaata

SEQ ID NO: 112693 - DNA, 23 bp, Artificial sequence
  SiRNA target sequence
ttaccaatagcctttcctaataa

SEQ ID NO: 112694 - DNA, 23 bp, Artificial sequence
  SiRNA target sequence
taccaatagcctttcctaataat

SEQ ID NO: 112695 - DNA, 23 bp, Artificial sequence
  SiRNA target sequence
accaatagcctttcctaataatt

SEQ ID NO: 112696 - DNA, 23 bp, Artificial sequence
  SiRNA target sequence
ccaatagcctttcctaataattc

SEQ ID NO: 112697 - DNA, 23 bp, Artificial sequence
  SiRNA target sequence
caatagcctttcctaataattcc

SEQ ID NO: 112698 - DNA, 23 bp, Artificial sequence
  SiRNA target sequence
aatagcctttcctaataattccc

SEQ ID NO: 112699 - DNA, 23 bp, Artificial sequence
  SiRNA target sequence
atagcctttcctaataattcccc

SEQ ID NO: 112700 - DNA, 23 bp, Artificial sequence
  SiRNA target sequence
tagcctttcctaataattcccct

SEQ ID NO: 112701 - DNA, 23 bp, Artificial sequence
  SiRNA target sequence
agcctttcctaataattccccta

SEQ ID NO: 112702 - DNA, 23 bp, Artificial sequence
  SiRNA target sequence
gcctttcctaataattcccctat

SEQ ID NO: 112703 - DNA, 23 bp, Artificial sequence
  SiRNA target sequence
cctttcctaataattcccctata

SEQ ID NO: 112704 - DNA, 23 bp, Artificial sequence
  SiRNA target sequence
ctttcctaataattcccctataa

SEQ ID NO: 112705 - DNA, 23 bp, Artificial sequence
  SiRNA target sequence
tttcctaataattcccctataat

SEQ ID NO: 112706 - DNA, 23 bp, Artificial sequence
  SiRNA target sequence
ttcctaataattcccctataata

SEQ ID NO: 112707 - DNA, 23 bp, Artificial sequence
  SiRNA target sequence
tcctaataattcccctataatac

SEQ ID NO: 112708 - DNA, 23 bp, Artificial sequence
  SiRNA target sequence
cctaataattcccctataatact

SEQ ID NO: 112709 - DNA, 23 bp, Artificial sequence
  SiRNA target sequence
ctaataattcccctataatactt

SEQ ID NO: 112710 - DNA, 23 bp, Artificial sequence
  SiRNA target sequence
taataattcccctataatacttt

SEQ ID NO: 112711 - DNA, 23 bp, Artificial sequence
  SiRNA target sequence
aataattcccctataatactttc

SEQ ID NO: 112712 - DNA, 23 bp, Artificial sequence
  SiRNA target sequence
ataattcccctataatactttct

SEQ ID NO: 112713 - DNA, 23 bp, Artificial sequence
  SiRNA target sequence
taattcccctataatactttcta

SEQ ID NO: 112714 - DNA, 23 bp, Artificial sequence
  SiRNA target sequence
aattcccctataatactttctat

SEQ ID NO: 112715 - DNA, 23 bp, Artificial sequence
  SiRNA target sequence
attcccctataatactttctata

SEQ ID NO: 112716 - DNA, 23 bp, Artificial sequence
  SiRNA target sequence
ttcccctataatactttctatac

SEQ ID NO: 112717 - DNA, 23 bp, Artificial sequence
  SiRNA target sequence
tcccctataatactttctatact

SEQ ID NO: 112718 - DNA, 23 bp, Artificial sequence
  SiRNA target sequence
cccctataatactttctatactg

SEQ ID NO: 112719 - DNA, 23 bp, Artificial sequence
  SiRNA target sequence
ccctataatactttctatactga

SEQ ID NO: 112720 - DNA, 23 bp, Artificial sequence
  SiRNA target sequence
cctataatactttctatactgat

SEQ ID NO: 112721 - DNA, 23 bp, Artificial sequence
  SiRNA target sequence
ctataatactttctatactgatt

SEQ ID NO: 112722 - DNA, 23 bp, Artificial sequence
  SiRNA target sequence
tataatactttctatactgattc

SEQ ID NO: 112723 - DNA, 23 bp, Artificial sequence
  SiRNA target sequence
ataatactttctatactgattcc

SEQ ID NO: 112724 - DNA, 23 bp, Artificial sequence
  SiRNA target sequence
taatactttctatactgattcca

SEQ ID NO: 112725 - DNA, 23 bp, Artificial sequence
  SiRNA target sequence
aatactttctatactgattccac

SEQ ID NO: 112726 - DNA, 23 bp, Artificial sequence
  SiRNA target sequence
atactttctatactgattccaca

SEQ ID NO: 112727 - DNA, 23 bp, Artificial sequence
  SiRNA target sequence
tactttctatactgattccacaa

SEQ ID NO: 112728 - DNA, 23 bp, Artificial sequence
  SiRNA target sequence
actttctatactgattccacaaa

SEQ ID NO: 112729 - DNA, 23 bp, Artificial sequence
  SiRNA target sequence
ctttctatactgattccacaaat

SEQ ID NO: 112730 - DNA, 23 bp, Artificial sequence
  SiRNA target sequence
tttctatactgattccacaaata

SEQ ID NO: 112731 - DNA, 23 bp, Artificial sequence
  SiRNA target sequence
ttctatactgattccacaaataa

SEQ ID NO: 112732 - DNA, 23 bp, Artificial sequence
  SiRNA target sequence
tctatactgattccacaaataaa

SEQ ID NO: 112733 - DNA, 23 bp, Artificial sequence
  SiRNA target sequence
ctatactgattccacaaataaat

SEQ ID NO: 112734 - DNA, 23 bp, Artificial sequence
  SiRNA target sequence
tatactgattccacaaataaatg

SEQ ID NO: 112735 - DNA, 23 bp, Artificial sequence
  SiRNA target sequence
atactgattccacaaataaatgc

SEQ ID NO: 112736 - DNA, 23 bp, Artificial sequence
  SiRNA target sequence
tactgattccacaaataaatgct

SEQ ID NO: 112737 - DNA, 23 bp, Artificial sequence
  SiRNA target sequence
actgattccacaaataaatgcta

SEQ ID NO: 112738 - DNA, 23 bp, Artificial sequence
  SiRNA target sequence
ctgattccacaaataaatgctaa

SEQ ID NO: 112739 - DNA, 23 bp, Artificial sequence
  SiRNA target sequence
tgattccacaaataaatgctaat

SEQ ID NO: 112740 - DNA, 23 bp, Artificial sequence
  SiRNA target sequence
gattccacaaataaatgctaatc

SEQ ID NO: 112741 - DNA, 23 bp, Artificial sequence
  SiRNA target sequence
attccacaaataaatgctaatcc

SEQ ID NO: 112742 - DNA, 23 bp, Artificial sequence
  SiRNA target sequence
ttccacaaataaatgctaatcca

SEQ ID NO: 112743 - DNA, 23 bp, Artificial sequence
  SiRNA target sequence
tccacaaataaatgctaatccat

SEQ ID NO: 112744 - DNA, 23 bp, Artificial sequence
  SiRNA target sequence
ccacaaataaatgctaatccatg

SEQ ID NO: 112745 - DNA, 23 bp, Artificial sequence
  SiRNA target sequence
cacaaataaatgctaatccatgg

SEQ ID NO: 112746 - DNA, 23 bp, Artificial sequence
  SiRNA target sequence
acaaataaatgctaatccatggc

SEQ ID NO: 112747 - DNA, 23 bp, Artificial sequence
  SiRNA target sequence
caaataaatgctaatccatggca

SEQ ID NO: 112748 - DNA, 23 bp, Artificial sequence
  SiRNA target sequence
aaataaatgctaatccatggcat

SEQ ID NO: 112749 - DNA, 23 bp, Artificial sequence
  SiRNA target sequence
aataaatgctaatccatggcatc

SEQ ID NO: 112750 - DNA, 23 bp, Artificial sequence
  SiRNA target sequence
ataaatgctaatccatggcatct

SEQ ID NO: 112751 - DNA, 23 bp, Artificial sequence
  SiRNA target sequence
taaatgctaatccatggcatcta

SEQ ID NO: 112752 - DNA, 23 bp, Artificial sequence
  SiRNA target sequence
aaatgctaatccatggcatctat

SEQ ID NO: 112753 - DNA, 23 bp, Artificial sequence
  SiRNA target sequence
aatgctaatccatggcatctata

SEQ ID NO: 112754 - DNA, 23 bp, Artificial sequence
  SiRNA target sequence
atgctaatccatggcatctataa

SEQ ID NO: 112755 - DNA, 23 bp, Artificial sequence
  SiRNA target sequence
tgctaatccatggcatctataag

SEQ ID NO: 112756 - DNA, 23 bp, Artificial sequence
  SiRNA target sequence
gctaatccatggcatctataaga

SEQ ID NO: 112757 - DNA, 23 bp, Artificial sequence
  SiRNA target sequence
ctaatccatggcatctataagat

SEQ ID NO: 112758 - DNA, 23 bp, Artificial sequence
  SiRNA target sequence
taatccatggcatctataagatc

SEQ ID NO: 112759 - DNA, 23 bp, Artificial sequence
  SiRNA target sequence
aatccatggcatctataagatcc

SEQ ID NO: 112760 - DNA, 23 bp, Artificial sequence
  SiRNA target sequence
atccatggcatctataagatcct

SEQ ID NO: 112761 - DNA, 23 bp, Artificial sequence
  SiRNA target sequence
tccatggcatctataagatccta

SEQ ID NO: 112762 - DNA, 23 bp, Artificial sequence
  SiRNA target sequence
ccatggcatctataagatcctat

SEQ ID NO: 112763 - DNA, 23 bp, Artificial sequence
  SiRNA target sequence
catggcatctataagatcctatg

SEQ ID NO: 112764 - DNA, 23 bp, Artificial sequence
  SiRNA target sequence
atggcatctataagatcctatga

SEQ ID NO: 112765 - DNA, 23 bp, Artificial sequence
  SiRNA target sequence
tggcatctataagatcctatgac

SEQ ID NO: 112766 - DNA, 23 bp, Artificial sequence
  SiRNA target sequence
ggcatctataagatcctatgact

SEQ ID NO: 112767 - DNA, 23 bp, Artificial sequence
  SiRNA target sequence
gcatctataagatcctatgactt

SEQ ID NO: 112768 - DNA, 23 bp, Artificial sequence
  SiRNA target sequence
catctataagatcctatgacttt

SEQ ID NO: 112769 - DNA, 23 bp, Artificial sequence
  SiRNA target sequence
atctataagatcctatgacttta

SEQ ID NO: 112770 - DNA, 23 bp, Artificial sequence
  SiRNA target sequence
tctataagatcctatgactttat

SEQ ID NO: 112771 - DNA, 23 bp, Artificial sequence
  SiRNA target sequence
ctataagatcctatgactttatc

SEQ ID NO: 112772 - DNA, 23 bp, Artificial sequence
  SiRNA target sequence
tataagatcctatgactttatca

SEQ ID NO: 112773 - DNA, 23 bp, Artificial sequence
  SiRNA target sequence
ataagatcctatgactttatcat

SEQ ID NO: 112774 - DNA, 23 bp, Artificial sequence
  SiRNA target sequence
taagatcctatgactttatcatt

SEQ ID NO: 112775 - DNA, 23 bp, Artificial sequence
  SiRNA target sequence
aagatcctatgactttatcattt

SEQ ID NO: 112776 - DNA, 23 bp, Artificial sequence
  SiRNA target sequence
agatcctatgactttatcatttt

SEQ ID NO: 112777 - DNA, 23 bp, Artificial sequence
  SiRNA target sequence
gatcctatgactttatcattttt

SEQ ID NO: 112778 - DNA, 23 bp, Artificial sequence
  SiRNA target sequence
atcctatgactttatcattttta

SEQ ID NO: 112779 - DNA, 23 bp, Artificial sequence
  SiRNA target sequence
tcctatgactttatcatttttat

SEQ ID NO: 112780 - DNA, 23 bp, Artificial sequence
  SiRNA target sequence
cctatgactttatcatttttatc

SEQ ID NO: 112781 - DNA, 23 bp, Artificial sequence
  SiRNA target sequence
ctatgactttatcatttttatct

SEQ ID NO: 112782 - DNA, 23 bp, Artificial sequence
  SiRNA target sequence
tatgactttatcatttttatcta

SEQ ID NO: 112783 - DNA, 23 bp, Artificial sequence
  SiRNA target sequence
atgactttatcatttttatctag

SEQ ID NO: 112784 - DNA, 23 bp, Artificial sequence
  SiRNA target sequence
tgactttatcatttttatctagt

SEQ ID NO: 112785 - DNA, 23 bp, Artificial sequence
  SiRNA target sequence
gactttatcatttttatctagta

SEQ ID NO: 112786 - DNA, 23 bp, Artificial sequence
  SiRNA target sequence
actttatcatttttatctagtac

SEQ ID NO: 112787 - DNA, 23 bp, Artificial sequence
  SiRNA target sequence
ctttatcatttttatctagtacc

SEQ ID NO: 112788 - DNA, 23 bp, Artificial sequence
  SiRNA target sequence
tttatcatttttatctagtacct

SEQ ID NO: 112789 - DNA, 23 bp, Artificial sequence
  SiRNA target sequence
ttatcatttttatctagtacctt

SEQ ID NO: 112790 - DNA, 23 bp, Artificial sequence
  SiRNA target sequence
tatcatttttatctagtaccttt

SEQ ID NO: 112791 - DNA, 23 bp, Artificial sequence
  SiRNA target sequence
atcatttttatctagtacctttt

SEQ ID NO: 112792 - DNA, 23 bp, Artificial sequence
  SiRNA target sequence
tcatttttatctagtaccttttg

SEQ ID NO: 112793 - DNA, 23 bp, Artificial sequence
  SiRNA target sequence
catttttatctagtaccttttgt

SEQ ID NO: 112794 - DNA, 23 bp, Artificial sequence
  SiRNA target sequence
atttttatctagtaccttttgta

SEQ ID NO: 112795 - DNA, 23 bp, Artificial sequence
  SiRNA target sequence
tttttatctagtaccttttgtaa

SEQ ID NO: 112796 - DNA, 23 bp, Artificial sequence
  SiRNA target sequence
ttttatctagtaccttttgtaaa

SEQ ID NO: 112797 - DNA, 23 bp, Artificial sequence
  SiRNA target sequence
tttatctagtaccttttgtaaac

SEQ ID NO: 112798 - DNA, 23 bp, Artificial sequence
  SiRNA target sequence
ttatctagtaccttttgtaaact

SEQ ID NO: 112799 - DNA, 23 bp, Artificial sequence
  SiRNA target sequence
tatctagtaccttttgtaaactc

SEQ ID NO: 112800 - DNA, 23 bp, Artificial sequence
  SiRNA target sequence
atctagtaccttttgtaaactca

SEQ ID NO: 112801 - DNA, 23 bp, Artificial sequence
  SiRNA target sequence
tctagtaccttttgtaaactcat

SEQ ID NO: 112802 - DNA, 23 bp, Artificial sequence
  SiRNA target sequence
ctagtaccttttgtaaactcata

SEQ ID NO: 112803 - DNA, 23 bp, Artificial sequence
  SiRNA target sequence
tagtaccttttgtaaactcatat

SEQ ID NO: 112804 - DNA, 23 bp, Artificial sequence
  SiRNA target sequence
agtaccttttgtaaactcatata

SEQ ID NO: 112805 - DNA, 23 bp, Artificial sequence
  SiRNA target sequence
gtaccttttgtaaactcatataa

SEQ ID NO: 112806 - DNA, 23 bp, Artificial sequence
  SiRNA target sequence
taccttttgtaaactcatataaa

SEQ ID NO: 112807 - DNA, 23 bp, Artificial sequence
  SiRNA target sequence
accttttgtaaactcatataaat

SEQ ID NO: 112808 - DNA, 23 bp, Artificial sequence
  SiRNA target sequence
ccttttgtaaactcatataaatg

SEQ ID NO: 112809 - DNA, 23 bp, Artificial sequence
  SiRNA target sequence
cttttgtaaactcatataaatgt

SEQ ID NO: 112810 - DNA, 23 bp, Artificial sequence
  SiRNA target sequence
ttttgtaaactcatataaatgtt

SEQ ID NO: 112811 - DNA, 23 bp, Artificial sequence
  SiRNA target sequence
tttgtaaactcatataaatgttt

SEQ ID NO: 112812 - DNA, 23 bp, Artificial sequence
  SiRNA target sequence
ttgtaaactcatataaatgtttt

SEQ ID NO: 112813 - DNA, 23 bp, Artificial sequence
  SiRNA target sequence
tgtaaactcatataaatgttttc

SEQ ID NO: 112814 - DNA, 23 bp, Artificial sequence
  SiRNA target sequence
gtaaactcatataaatgttttcc

SEQ ID NO: 112815 - DNA, 23 bp, Artificial sequence
  SiRNA target sequence
taaactcatataaatgttttcct

SEQ ID NO: 112816 - DNA, 23 bp, Artificial sequence
  SiRNA target sequence
aaactcatataaatgttttcctg

SEQ ID NO: 112817 - DNA, 23 bp, Artificial sequence
  SiRNA target sequence
aactcatataaatgttttcctgt

SEQ ID NO: 112818 - DNA, 23 bp, Artificial sequence
  SiRNA target sequence
actcatataaatgttttcctgtc

SEQ ID NO: 112819 - DNA, 23 bp, Artificial sequence
  SiRNA target sequence
ctcatataaatgttttcctgtcc

SEQ ID NO: 112820 - DNA, 23 bp, Artificial sequence
  SiRNA target sequence
tcatataaatgttttcctgtcct

SEQ ID NO: 112821 - DNA, 23 bp, Artificial sequence
  SiRNA target sequence
catataaatgttttcctgtccta

SEQ ID NO: 112822 - DNA, 23 bp, Artificial sequence
  SiRNA target sequence
atataaatgttttcctgtcctat

SEQ ID NO: 112823 - DNA, 23 bp, Artificial sequence
  SiRNA target sequence
tataaatgttttcctgtcctatt

SEQ ID NO: 112824 - DNA, 23 bp, Artificial sequence
  SiRNA target sequence
ataaatgttttcctgtcctatta

SEQ ID NO: 112825 - DNA, 23 bp, Artificial sequence
  SiRNA target sequence
taaatgttttcctgtcctattac

SEQ ID NO: 112826 - DNA, 23 bp, Artificial sequence
  SiRNA target sequence
aaatgttttcctgtcctattact

SEQ ID NO: 112827 - DNA, 23 bp, Artificial sequence
  SiRNA target sequence
aatgttttcctgtcctattacta

SEQ ID NO: 112828 - DNA, 23 bp, Artificial sequence
  SiRNA target sequence
atgttttcctgtcctattactaa

SEQ ID NO: 112829 - DNA, 23 bp, Artificial sequence
  SiRNA target sequence
tgttttcctgtcctattactaaa

SEQ ID NO: 112830 - DNA, 23 bp, Artificial sequence
  SiRNA target sequence
gttttcctgtcctattactaaat

SEQ ID NO: 112831 - DNA, 23 bp, Artificial sequence
  SiRNA target sequence
ttttcctgtcctattactaaatg

SEQ ID NO: 112832 - DNA, 23 bp, Artificial sequence
  SiRNA target sequence
tttcctgtcctattactaaatga

SEQ ID NO: 112833 - DNA, 23 bp, Artificial sequence
  SiRNA target sequence
ttcctgtcctattactaaatgac

SEQ ID NO: 112834 - DNA, 23 bp, Artificial sequence
  SiRNA target sequence
tcctgtcctattactaaatgaca

SEQ ID NO: 112835 - DNA, 23 bp, Artificial sequence
  SiRNA target sequence
cctgtcctattactaaatgacag

SEQ ID NO: 112836 - DNA, 23 bp, Artificial sequence
  SiRNA target sequence
ctgtcctattactaaatgacaga

SEQ ID NO: 112837 - DNA, 23 bp, Artificial sequence
  SiRNA target sequence
tgtcctattactaaatgacagaa

SEQ ID NO: 112838 - DNA, 23 bp, Artificial sequence
  SiRNA target sequence
gtcctattactaaatgacagaag

SEQ ID NO: 112839 - DNA, 23 bp, Artificial sequence
  SiRNA target sequence
tcctattactaaatgacagaagc

SEQ ID NO: 112840 - DNA, 23 bp, Artificial sequence
  SiRNA target sequence
cctattactaaatgacagaagcc

SEQ ID NO: 112841 - DNA, 23 bp, Artificial sequence
  SiRNA target sequence
ctattactaaatgacagaagcct

SEQ ID NO: 112842 - DNA, 23 bp, Artificial sequence
  SiRNA target sequence
tattactaaatgacagaagcctc

SEQ ID NO: 112843 - DNA, 23 bp, Artificial sequence
  SiRNA target sequence
attactaaatgacagaagcctct

SEQ ID NO: 112844 - DNA, 23 bp, Artificial sequence
  SiRNA target sequence
ttactaaatgacagaagcctctt

SEQ ID NO: 112845 - DNA, 23 bp, Artificial sequence
  SiRNA target sequence
tactaaatgacagaagcctctta

SEQ ID NO: 112846 - DNA, 23 bp, Artificial sequence
  SiRNA target sequence
actaaatgacagaagcctcttat

SEQ ID NO: 112847 - DNA, 23 bp, Artificial sequence
  SiRNA target sequence
ctaaatgacagaagcctcttata

SEQ ID NO: 112848 - DNA, 23 bp, Artificial sequence
  SiRNA target sequence
taaatgacagaagcctcttatat

SEQ ID NO: 112849 - DNA, 23 bp, Artificial sequence
  SiRNA target sequence
aaatgacagaagcctcttatatt

SEQ ID NO: 112850 - DNA, 23 bp, Artificial sequence
  SiRNA target sequence
aatgacagaagcctcttatattt

SEQ ID NO: 112851 - DNA, 23 bp, Artificial sequence
  SiRNA target sequence
atgacagaagcctcttatatttc

SEQ ID NO: 112852 - DNA, 23 bp, Artificial sequence
  SiRNA target sequence
tgacagaagcctcttatatttcc

SEQ ID NO: 112853 - DNA, 23 bp, Artificial sequence
  SiRNA target sequence
gacagaagcctcttatatttcct

SEQ ID NO: 112854 - DNA, 23 bp, Artificial sequence
  SiRNA target sequence
acagaagcctcttatatttcctt

SEQ ID NO: 112855 - DNA, 23 bp, Artificial sequence
  SiRNA target sequence
cagaagcctcttatatttccttt

SEQ ID NO: 112856 - DNA, 23 bp, Artificial sequence
  SiRNA target sequence
agaagcctcttatatttcctttt

SEQ ID NO: 112857 - DNA, 23 bp, Artificial sequence
  SiRNA target sequence
gaagcctcttatatttccttttt

SEQ ID NO: 112858 - DNA, 23 bp, Artificial sequence
  SiRNA target sequence
aagcctcttatatttcctttttt

SEQ ID NO: 112859 - DNA, 23 bp, Artificial sequence
  SiRNA target sequence
agcctcttatatttcctttttta

SEQ ID NO: 112860 - DNA, 23 bp, Artificial sequence
  SiRNA target sequence
gcctcttatatttccttttttat

SEQ ID NO: 112861 - DNA, 23 bp, Artificial sequence
  SiRNA target sequence
cctcttatatttccttttttata

SEQ ID NO: 112862 - DNA, 23 bp, Artificial sequence
  SiRNA target sequence
ctcttatatttccttttttatac

SEQ ID NO: 112863 - DNA, 23 bp, Artificial sequence
  SiRNA target sequence
tcttatatttccttttttatact

SEQ ID NO: 112864 - DNA, 23 bp, Artificial sequence
  SiRNA target sequence
cttatatttccttttttatactt

SEQ ID NO: 112865 - DNA, 23 bp, Artificial sequence
  SiRNA target sequence
ttatatttccttttttatactta

SEQ ID NO: 112866 - DNA, 23 bp, Artificial sequence
  SiRNA target sequence
tatatttccttttttatacttag

SEQ ID NO: 112867 - DNA, 23 bp, Artificial sequence
  SiRNA target sequence
atatttccttttttatacttaga

SEQ ID NO: 112868 - DNA, 23 bp, Artificial sequence
  SiRNA target sequence
tatttccttttttatacttagag

SEQ ID NO: 112869 - DNA, 23 bp, Artificial sequence
  SiRNA target sequence
atttccttttttatacttagagt

SEQ ID NO: 112870 - DNA, 23 bp, Artificial sequence
  SiRNA target sequence
tttccttttttatacttagagtt

SEQ ID NO: 112871 - DNA, 23 bp, Artificial sequence
  SiRNA target sequence
ttccttttttatacttagagtta

SEQ ID NO: 112872 - DNA, 23 bp, Artificial sequence
  SiRNA target sequence
tccttttttatacttagagttag

SEQ ID NO: 112873 - DNA, 23 bp, Artificial sequence
  SiRNA target sequence
ccttttttatacttagagttagc

SEQ ID NO: 112874 - DNA, 23 bp, Artificial sequence
  SiRNA target sequence
cttttttatacttagagttagca

SEQ ID NO: 112875 - DNA, 23 bp, Artificial sequence
  SiRNA target sequence
ttttttatacttagagttagcat

SEQ ID NO: 112876 - DNA, 23 bp, Artificial sequence
  SiRNA target sequence
tttttatacttagagttagcata

SEQ ID NO: 112877 - DNA, 23 bp, Artificial sequence
  SiRNA target sequence
ttttatacttagagttagcatat

SEQ ID NO: 112878 - DNA, 23 bp, Artificial sequence
  SiRNA target sequence
tttatacttagagttagcatatt

SEQ ID NO: 112879 - DNA, 23 bp, Artificial sequence
  SiRNA target sequence
ttatacttagagttagcatattc

SEQ ID NO: 112880 - DNA, 23 bp, Artificial sequence
  SiRNA target sequence
tatacttagagttagcatattct

SEQ ID NO: 112881 - DNA, 23 bp, Artificial sequence
  SiRNA target sequence
atacttagagttagcatattctt

SEQ ID NO: 112882 - DNA, 23 bp, Artificial sequence
  SiRNA target sequence
tacttagagttagcatattcttc

SEQ ID NO: 112883 - DNA, 23 bp, Artificial sequence
  SiRNA target sequence
acttagagttagcatattcttcg

SEQ ID NO: 112884 - DNA, 23 bp, Artificial sequence
  SiRNA target sequence
cttagagttagcatattcttcga

SEQ ID NO: 112885 - DNA, 23 bp, Artificial sequence
  SiRNA target sequence
ttagagttagcatattcttcgat

SEQ ID NO: 112886 - DNA, 23 bp, Artificial sequence
  SiRNA target sequence
tagagttagcatattcttcgata

SEQ ID NO: 112887 - DNA, 23 bp, Artificial sequence
  SiRNA target sequence
agagttagcatattcttcgataa

SEQ ID NO: 112888 - DNA, 23 bp, Artificial sequence
  SiRNA target sequence
gagttagcatattcttcgataag

SEQ ID NO: 112889 - DNA, 23 bp, Artificial sequence
  SiRNA target sequence
agttagcatattcttcgataaga

SEQ ID NO: 112890 - DNA, 23 bp, Artificial sequence
  SiRNA target sequence
gttagcatattcttcgataagac

SEQ ID NO: 112891 - DNA, 23 bp, Artificial sequence
  SiRNA target sequence
ttagcatattcttcgataagacg

SEQ ID NO: 112892 - DNA, 23 bp, Artificial sequence
  SiRNA target sequence
tagcatattcttcgataagacgt

SEQ ID NO: 112893 - DNA, 23 bp, Artificial sequence
  SiRNA target sequence
agcatattcttcgataagacgta

SEQ ID NO: 112894 - DNA, 23 bp, Artificial sequence
  SiRNA target sequence
gcatattcttcgataagacgtag

SEQ ID NO: 112895 - DNA, 23 bp, Artificial sequence
  SiRNA target sequence
catattcttcgataagacgtaga

SEQ ID NO: 112896 - DNA, 23 bp, Artificial sequence
  SiRNA target sequence
atattcttcgataagacgtagaa

SEQ ID NO: 112897 - DNA, 23 bp, Artificial sequence
  SiRNA target sequence
tattcttcgataagacgtagaat

SEQ ID NO: 112898 - DNA, 23 bp, Artificial sequence
  SiRNA target sequence
attcttcgataagacgtagaatt

SEQ ID NO: 112899 - DNA, 23 bp, Artificial sequence
  SiRNA target sequence
ttcttcgataagacgtagaatta

SEQ ID NO: 112900 - DNA, 23 bp, Artificial sequence
  SiRNA target sequence
tcttcgataagacgtagaattaa

SEQ ID NO: 112901 - DNA, 23 bp, Artificial sequence
  SiRNA target sequence
cttcgataagacgtagaattaac

SEQ ID NO: 112902 - DNA, 23 bp, Artificial sequence
  SiRNA target sequence
ttcgataagacgtagaattaaca

SEQ ID NO: 112903 - DNA, 23 bp, Artificial sequence
  SiRNA target sequence
tcgataagacgtagaattaacat

SEQ ID NO: 112904 - DNA, 23 bp, Artificial sequence
  SiRNA target sequence
cgataagacgtagaattaacata

SEQ ID NO: 112905 - DNA, 23 bp, Artificial sequence
  SiRNA target sequence
gataagacgtagaattaacatat

SEQ ID NO: 112906 - DNA, 23 bp, Artificial sequence
  SiRNA target sequence
ataagacgtagaattaacatatt

SEQ ID NO: 112907 - DNA, 23 bp, Artificial sequence
  SiRNA target sequence
taagacgtagaattaacatattt

SEQ ID NO: 112908 - DNA, 23 bp, Artificial sequence
  SiRNA target sequence
aagacgtagaattaacatatttc

SEQ ID NO: 112909 - DNA, 23 bp, Artificial sequence
  SiRNA target sequence
agacgtagaattaacatatttct

SEQ ID NO: 112910 - DNA, 23 bp, Artificial sequence
  SiRNA target sequence
gacgtagaattaacatatttcta

SEQ ID NO: 112911 - DNA, 23 bp, Artificial sequence
  SiRNA target sequence
acgtagaattaacatatttctat

SEQ ID NO: 112912 - DNA, 23 bp, Artificial sequence
  SiRNA target sequence
cgtagaattaacatatttctata

SEQ ID NO: 112913 - DNA, 23 bp, Artificial sequence
  SiRNA target sequence
gtagaattaacatatttctataa

SEQ ID NO: 112914 - DNA, 23 bp, Artificial sequence
  SiRNA target sequence
tagaattaacatatttctataaa

SEQ ID NO: 112915 - DNA, 23 bp, Artificial sequence
  SiRNA target sequence
agaattaacatatttctataaac

SEQ ID NO: 112916 - DNA, 23 bp, Artificial sequence
  SiRNA target sequence
gaattaacatatttctataaaca

SEQ ID NO: 112917 - DNA, 23 bp, Artificial sequence
  SiRNA target sequence
aattaacatatttctataaacat

SEQ ID NO: 112918 - DNA, 23 bp, Artificial sequence
  SiRNA target sequence
attaacatatttctataaacatc

SEQ ID NO: 112919 - DNA, 23 bp, Artificial sequence
  SiRNA target sequence
ttaacatatttctataaacatct

SEQ ID NO: 112920 - DNA, 23 bp, Artificial sequence
  SiRNA target sequence
taacatatttctataaacatctt

SEQ ID NO: 112921 - DNA, 23 bp, Artificial sequence
  SiRNA target sequence
aacatatttctataaacatcttg

SEQ ID NO: 112922 - DNA, 23 bp, Artificial sequence
  SiRNA target sequence
acatatttctataaacatcttgt

SEQ ID NO: 112923 - DNA, 23 bp, Artificial sequence
  SiRNA target sequence
catatttctataaacatcttgta

SEQ ID NO: 112924 - DNA, 23 bp, Artificial sequence
  SiRNA target sequence
atatttctataaacatcttgtac

SEQ ID NO: 112925 - DNA, 23 bp, Artificial sequence
  SiRNA target sequence
tatttctataaacatcttgtaca

SEQ ID NO: 112926 - DNA, 23 bp, Artificial sequence
  SiRNA target sequence
atttctataaacatcttgtacaa

SEQ ID NO: 112927 - DNA, 23 bp, Artificial sequence
  SiRNA target sequence
tttctataaacatcttgtacaag

SEQ ID NO: 112928 - DNA, 23 bp, Artificial sequence
  SiRNA target sequence
ttctataaacatcttgtacaagt

SEQ ID NO: 112929 - DNA, 23 bp, Artificial sequence
  SiRNA target sequence
tctataaacatcttgtacaagtt

SEQ ID NO: 112930 - DNA, 23 bp, Artificial sequence
  SiRNA target sequence
ctataaacatcttgtacaagttc

SEQ ID NO: 112931 - DNA, 23 bp, Artificial sequence
  SiRNA target sequence
tataaacatcttgtacaagttct

SEQ ID NO: 112932 - DNA, 23 bp, Artificial sequence
  SiRNA target sequence
ataaacatcttgtacaagttctt

SEQ ID NO: 112933 - DNA, 23 bp, Artificial sequence
  SiRNA target sequence
taaacatcttgtacaagttcttt

SEQ ID NO: 112934 - DNA, 23 bp, Artificial sequence
  SiRNA target sequence
aaacatcttgtacaagttctttg

SEQ ID NO: 112935 - DNA, 23 bp, Artificial sequence
  SiRNA target sequence
aacatcttgtacaagttctttgt

SEQ ID NO: 112936 - DNA, 23 bp, Artificial sequence
  SiRNA target sequence
acatcttgtacaagttctttgtt

SEQ ID NO: 112937 - DNA, 23 bp, Artificial sequence
  SiRNA target sequence
catcttgtacaagttctttgttt

SEQ ID NO: 112938 - DNA, 23 bp, Artificial sequence
  SiRNA target sequence
atcttgtacaagttctttgttta

SEQ ID NO: 112939 - DNA, 23 bp, Artificial sequence
  SiRNA target sequence
tcttgtacaagttctttgtttaa

SEQ ID NO: 112940 - DNA, 23 bp, Artificial sequence
  SiRNA target sequence
cttgtacaagttctttgtttaaa

SEQ ID NO: 112941 - DNA, 23 bp, Artificial sequence
  SiRNA target sequence
ttgtacaagttctttgtttaaag

SEQ ID NO: 112942 - DNA, 23 bp, Artificial sequence
  SiRNA target sequence
tgtacaagttctttgtttaaagt

SEQ ID NO: 112943 - DNA, 23 bp, Artificial sequence
  SiRNA target sequence
gtacaagttctttgtttaaagta

SEQ ID NO: 112944 - DNA, 23 bp, Artificial sequence
  SiRNA target sequence
tacaagttctttgtttaaagtag

SEQ ID NO: 112945 - DNA, 23 bp, Artificial sequence
  SiRNA target sequence
acaagttctttgtttaaagtagt

SEQ ID NO: 112946 - DNA, 23 bp, Artificial sequence
  SiRNA target sequence
caagttctttgtttaaagtagtt

SEQ ID NO: 112947 - DNA, 23 bp, Artificial sequence
  SiRNA target sequence
aagttctttgtttaaagtagttt

SEQ ID NO: 112948 - DNA, 23 bp, Artificial sequence
  SiRNA target sequence
agttctttgtttaaagtagtttt

SEQ ID NO: 112949 - DNA, 23 bp, Artificial sequence
  SiRNA target sequence
gttctttgtttaaagtagttttc

SEQ ID NO: 112950 - DNA, 23 bp, Artificial sequence
  SiRNA target sequence
ttctttgtttaaagtagttttca

SEQ ID NO: 112951 - DNA, 23 bp, Artificial sequence
  SiRNA target sequence
tctttgtttaaagtagttttcag

SEQ ID NO: 112952 - DNA, 23 bp, Artificial sequence
  SiRNA target sequence
ctttgtttaaagtagttttcagt

SEQ ID NO: 112953 - DNA, 23 bp, Artificial sequence
  SiRNA target sequence
tttgtttaaagtagttttcagtt

SEQ ID NO: 112954 - DNA, 23 bp, Artificial sequence
  SiRNA target sequence
ttgtttaaagtagttttcagttt

SEQ ID NO: 112955 - DNA, 23 bp, Artificial sequence
  SiRNA target sequence
tgtttaaagtagttttcagttta

SEQ ID NO: 112956 - DNA, 23 bp, Artificial sequence
  SiRNA target sequence
gtttaaagtagttttcagtttaa

SEQ ID NO: 112957 - DNA, 23 bp, Artificial sequence
  SiRNA target sequence
tttaaagtagttttcagtttaac

SEQ ID NO: 112958 - DNA, 23 bp, Artificial sequence
  SiRNA target sequence
ttaaagtagttttcagtttaact

SEQ ID NO: 112959 - DNA, 23 bp, Artificial sequence
  SiRNA target sequence
taaagtagttttcagtttaactg

SEQ ID NO: 112960 - DNA, 23 bp, Artificial sequence
  SiRNA target sequence
aaagtagttttcagtttaactgt

SEQ ID NO: 112961 - DNA, 23 bp, Artificial sequence
  SiRNA target sequence
aagtagttttcagtttaactgta

SEQ ID NO: 112962 - DNA, 23 bp, Artificial sequence
  SiRNA target sequence
agtagttttcagtttaactgtat

SEQ ID NO: 112963 - DNA, 23 bp, Artificial sequence
  SiRNA target sequence
gtagttttcagtttaactgtatt

SEQ ID NO: 112964 - DNA, 23 bp, Artificial sequence
  SiRNA target sequence
tagttttcagtttaactgtattt

SEQ ID NO: 112965 - DNA, 23 bp, Artificial sequence
  SiRNA target sequence
agttttcagtttaactgtatttt

SEQ ID NO: 112966 - DNA, 23 bp, Artificial sequence
  SiRNA target sequence
gttttcagtttaactgtattttt

SEQ ID NO: 112967 - DNA, 23 bp, Artificial sequence
  SiRNA target sequence
ttttcagtttaactgtattttta

SEQ ID NO: 112968 - DNA, 23 bp, Artificial sequence
  SiRNA target sequence
tttcagtttaactgtatttttat

SEQ ID NO: 112969 - DNA, 23 bp, Artificial sequence
  SiRNA target sequence
ttcagtttaactgtatttttatc

SEQ ID NO: 112970 - DNA, 23 bp, Artificial sequence
  SiRNA target sequence
tcagtttaactgtatttttatct

SEQ ID NO: 112971 - DNA, 23 bp, Artificial sequence
  SiRNA target sequence
cagtttaactgtatttttatcta

SEQ ID NO: 112972 - DNA, 23 bp, Artificial sequence
  SiRNA target sequence
agtttaactgtatttttatctac

SEQ ID NO: 112973 - DNA, 23 bp, Artificial sequence
  SiRNA target sequence
gtttaactgtatttttatctacc

SEQ ID NO: 112974 - DNA, 23 bp, Artificial sequence
  SiRNA target sequence
tttaactgtatttttatctacca

SEQ ID NO: 112975 - DNA, 23 bp, Artificial sequence
  SiRNA target sequence
ttaactgtatttttatctaccaa

SEQ ID NO: 112976 - DNA, 23 bp, Artificial sequence
  SiRNA target sequence
taactgtatttttatctaccaaa

SEQ ID NO: 112977 - DNA, 23 bp, Artificial sequence
  SiRNA target sequence
aactgtatttttatctaccaaat

SEQ ID NO: 112978 - DNA, 23 bp, Artificial sequence
  SiRNA target sequence
actgtatttttatctaccaaata

SEQ ID NO: 112979 - DNA, 23 bp, Artificial sequence
  SiRNA target sequence
ctgtatttttatctaccaaataa

SEQ ID NO: 112980 - DNA, 23 bp, Artificial sequence
  SiRNA target sequence
tgtatttttatctaccaaataat

SEQ ID NO: 112981 - DNA, 23 bp, Artificial sequence
  SiRNA target sequence
gtatttttatctaccaaataata

SEQ ID NO: 112982 - DNA, 23 bp, Artificial sequence
  SiRNA target sequence
tatttttatctaccaaataataa

SEQ ID NO: 112983 - DNA, 23 bp, Artificial sequence
  SiRNA target sequence
atttttatctaccaaataataat

SEQ ID NO: 112984 - DNA, 23 bp, Artificial sequence
  SiRNA target sequence
tttttatctaccaaataataatc

SEQ ID NO: 112985 - DNA, 23 bp, Artificial sequence
  SiRNA target sequence
ttttatctaccaaataataatct

SEQ ID NO: 112986 - DNA, 23 bp, Artificial sequence
  SiRNA target sequence
tttatctaccaaataataatcta

SEQ ID NO: 112987 - DNA, 23 bp, Artificial sequence
  SiRNA target sequence
ttatctaccaaataataatctat

SEQ ID NO: 112988 - DNA, 23 bp, Artificial sequence
  SiRNA target sequence
tatctaccaaataataatctatc

SEQ ID NO: 112989 - DNA, 23 bp, Artificial sequence
  SiRNA target sequence
atctaccaaataataatctatca

SEQ ID NO: 112990 - DNA, 23 bp, Artificial sequence
  SiRNA target sequence
tctaccaaataataatctatcat

SEQ ID NO: 112991 - DNA, 24 bp, Artificial sequence
  SiRNA target sequence
ttattcagaataaacatcttttaa

SEQ ID NO: 112992 - DNA, 24 bp, Artificial sequence
  SiRNA target sequence
tattcagaataaacatcttttaaa

SEQ ID NO: 112993 - DNA, 24 bp, Artificial sequence
  SiRNA target sequence
attcagaataaacatcttttaaaa

SEQ ID NO: 112994 - DNA, 24 bp, Artificial sequence
  SiRNA target sequence
ttcagaataaacatcttttaaaag

SEQ ID NO: 112995 - DNA, 24 bp, Artificial sequence
  SiRNA target sequence
tcagaataaacatcttttaaaagt

SEQ ID NO: 112996 - DNA, 24 bp, Artificial sequence
  SiRNA target sequence
cagaataaacatcttttaaaagtt

SEQ ID NO: 112997 - DNA, 24 bp, Artificial sequence
  SiRNA target sequence
agaataaacatcttttaaaagttc

SEQ ID NO: 112998 - DNA, 24 bp, Artificial sequence
  SiRNA target sequence
gaataaacatcttttaaaagttca

SEQ ID NO: 112999 - DNA, 24 bp, Artificial sequence
  SiRNA target sequence
aataaacatcttttaaaagttcat

SEQ ID NO: 113000 - DNA, 24 bp, Artificial sequence
  SiRNA target sequence
ataaacatcttttaaaagttcatc

SEQ ID NO: 113001 - DNA, 24 bp, Artificial sequence
  SiRNA target sequence
taaacatcttttaaaagttcatcg

SEQ ID NO: 113002 - DNA, 24 bp, Artificial sequence
  SiRNA target sequence
aaacatcttttaaaagttcatcga

SEQ ID NO: 113003 - DNA, 24 bp, Artificial sequence
  SiRNA target sequence
aacatcttttaaaagttcatcgat

SEQ ID NO: 113004 - DNA, 24 bp, Artificial sequence
  SiRNA target sequence
acatcttttaaaagttcatcgata

SEQ ID NO: 113005 - DNA, 24 bp, Artificial sequence
  SiRNA target sequence
catcttttaaaagttcatcgatat

SEQ ID NO: 113006 - DNA, 24 bp, Artificial sequence
  SiRNA target sequence
atcttttaaaagttcatcgatatc

SEQ ID NO: 113007 - DNA, 24 bp, Artificial sequence
  SiRNA target sequence
tcttttaaaagttcatcgatatcg

SEQ ID NO: 113008 - DNA, 24 bp, Artificial sequence
  SiRNA target sequence
cttttaaaagttcatcgatatcgg

SEQ ID NO: 113009 - DNA, 24 bp, Artificial sequence
  SiRNA target sequence
ttttaaaagttcatcgatatcggg

SEQ ID NO: 113010 - DNA, 24 bp, Artificial sequence
  SiRNA target sequence
tttaaaagttcatcgatatcgggt

SEQ ID NO: 113011 - DNA, 24 bp, Artificial sequence
  SiRNA target sequence
ttaaaagttcatcgatatcgggtt

SEQ ID NO: 113012 - DNA, 24 bp, Artificial sequence
  SiRNA target sequence
taaaagttcatcgatatcgggttc

SEQ ID NO: 113013 - DNA, 24 bp, Artificial sequence
  SiRNA target sequence
aaaagttcatcgatatcgggttct

SEQ ID NO: 113014 - DNA, 24 bp, Artificial sequence
  SiRNA target sequence
aaagttcatcgatatcgggttctt

SEQ ID NO: 113015 - DNA, 24 bp, Artificial sequence
  SiRNA target sequence
aagttcatcgatatcgggttcttt

SEQ ID NO: 113016 - DNA, 24 bp, Artificial sequence
  SiRNA target sequence
agttcatcgatatcgggttcttta

SEQ ID NO: 113017 - DNA, 24 bp, Artificial sequence
  SiRNA target sequence
gttcatcgatatcgggttctttag

SEQ ID NO: 113018 - DNA, 24 bp, Artificial sequence
  SiRNA target sequence
ttcatcgatatcgggttctttaga

SEQ ID NO: 113019 - DNA, 24 bp, Artificial sequence
  SiRNA target sequence
tcatcgatatcgggttctttagaa

SEQ ID NO: 113020 - DNA, 24 bp, Artificial sequence
  SiRNA target sequence
catcgatatcgggttctttagaaa

SEQ ID NO: 113021 - DNA, 24 bp, Artificial sequence
  SiRNA target sequence
atcgatatcgggttctttagaaaa

SEQ ID NO: 113022 - DNA, 24 bp, Artificial sequence
  SiRNA target sequence
tcgatatcgggttctttagaaaaa

SEQ ID NO: 113023 - DNA, 24 bp, Artificial sequence
  SiRNA target sequence
cgatatcgggttctttagaaaaaa

SEQ ID NO: 113024 - DNA, 24 bp, Artificial sequence
  SiRNA target sequence
gatatcgggttctttagaaaaaat

SEQ ID NO: 113025 - DNA, 24 bp, Artificial sequence
  SiRNA target sequence
atatcgggttctttagaaaaaata

SEQ ID NO: 113026 - DNA, 24 bp, Artificial sequence
  SiRNA target sequence
tatcgggttctttagaaaaaataa

SEQ ID NO: 113027 - DNA, 24 bp, Artificial sequence
  SiRNA target sequence
atcgggttctttagaaaaaataac

SEQ ID NO: 113028 - DNA, 24 bp, Artificial sequence
  SiRNA target sequence
tcgggttctttagaaaaaataact

SEQ ID NO: 113029 - DNA, 24 bp, Artificial sequence
  SiRNA target sequence
cgggttctttagaaaaaataactt

SEQ ID NO: 113030 - DNA, 24 bp, Artificial sequence
  SiRNA target sequence
gggttctttagaaaaaataacttt

SEQ ID NO: 113031 - DNA, 24 bp, Artificial sequence
  SiRNA target sequence
ggttctttagaaaaaataactttt

SEQ ID NO: 113032 - DNA, 24 bp, Artificial sequence
  SiRNA target sequence
gttctttagaaaaaataacttttt

SEQ ID NO: 113033 - DNA, 24 bp, Artificial sequence
  SiRNA target sequence
ttctttagaaaaaataactttttt

SEQ ID NO: 113034 - DNA, 24 bp, Artificial sequence
  SiRNA target sequence
tctttagaaaaaataactttttta

SEQ ID NO: 113035 - DNA, 24 bp, Artificial sequence
  SiRNA target sequence
ctttagaaaaaataacttttttaa

SEQ ID NO: 113036 - DNA, 24 bp, Artificial sequence
  SiRNA target sequence
tttagaaaaaataacttttttaac

SEQ ID NO: 113037 - DNA, 24 bp, Artificial sequence
  SiRNA target sequence
ttagaaaaaataacttttttaaca

SEQ ID NO: 113038 - DNA, 24 bp, Artificial sequence
  SiRNA target sequence
tagaaaaaataacttttttaacac

SEQ ID NO: 113039 - DNA, 24 bp, Artificial sequence
  SiRNA target sequence
agaaaaaataacttttttaacacc

SEQ ID NO: 113040 - DNA, 24 bp, Artificial sequence
  SiRNA target sequence
gaaaaaataacttttttaacacct

SEQ ID NO: 113041 - DNA, 24 bp, Artificial sequence
  SiRNA target sequence
aaaaaataacttttttaacacctt

SEQ ID NO: 113042 - DNA, 24 bp, Artificial sequence
  SiRNA target sequence
aaaaataacttttttaacaccttc

SEQ ID NO: 113043 - DNA, 24 bp, Artificial sequence
  SiRNA target sequence
aaaataacttttttaacaccttct

SEQ ID NO: 113044 - DNA, 24 bp, Artificial sequence
  SiRNA target sequence
aaataacttttttaacaccttctt

SEQ ID NO: 113045 - DNA, 24 bp, Artificial sequence
  SiRNA target sequence
aataacttttttaacaccttcttc

SEQ ID NO: 113046 - DNA, 24 bp, Artificial sequence
  SiRNA target sequence
ataacttttttaacaccttcttca

SEQ ID NO: 113047 - DNA, 24 bp, Artificial sequence
  SiRNA target sequence
taacttttttaacaccttcttcaa

SEQ ID NO: 113048 - DNA, 24 bp, Artificial sequence
  SiRNA target sequence
aacttttttaacaccttcttcaaa

SEQ ID NO: 113049 - DNA, 24 bp, Artificial sequence
  SiRNA target sequence
acttttttaacaccttcttcaaag

SEQ ID NO: 113050 - DNA, 24 bp, Artificial sequence
  SiRNA target sequence
cttttttaacaccttcttcaaagc

SEQ ID NO: 113051 - DNA, 24 bp, Artificial sequence
  SiRNA target sequence
ttttttaacaccttcttcaaagca

SEQ ID NO: 113052 - DNA, 24 bp, Artificial sequence
  SiRNA target sequence
tttttaacaccttcttcaaagcag

SEQ ID NO: 113053 - DNA, 24 bp, Artificial sequence
  SiRNA target sequence
ttttaacaccttcttcaaagcagg

SEQ ID NO: 113054 - DNA, 24 bp, Artificial sequence
  SiRNA target sequence
tttaacaccttcttcaaagcagga

SEQ ID NO: 113055 - DNA, 24 bp, Artificial sequence
  SiRNA target sequence
ttaacaccttcttcaaagcaggaa

SEQ ID NO: 113056 - DNA, 24 bp, Artificial sequence
  SiRNA target sequence
taacaccttcttcaaagcaggaaa

SEQ ID NO: 113057 - DNA, 24 bp, Artificial sequence
  SiRNA target sequence
aacaccttcttcaaagcaggaaat

SEQ ID NO: 113058 - DNA, 24 bp, Artificial sequence
  SiRNA target sequence
acaccttcttcaaagcaggaaatt

SEQ ID NO: 113059 - DNA, 24 bp, Artificial sequence
  SiRNA target sequence
caccttcttcaaagcaggaaatta

SEQ ID NO: 113060 - DNA, 24 bp, Artificial sequence
  SiRNA target sequence
accttcttcaaagcaggaaattac

SEQ ID NO: 113061 - DNA, 24 bp, Artificial sequence
  SiRNA target sequence
ccttcttcaaagcaggaaattacc

SEQ ID NO: 113062 - DNA, 24 bp, Artificial sequence
  SiRNA target sequence
cttcttcaaagcaggaaattacct

SEQ ID NO: 113063 - DNA, 24 bp, Artificial sequence
  SiRNA target sequence
ttcttcaaagcaggaaattacctc

SEQ ID NO: 113064 - DNA, 24 bp, Artificial sequence
  SiRNA target sequence
tcttcaaagcaggaaattacctca

SEQ ID NO: 113065 - DNA, 24 bp, Artificial sequence
  SiRNA target sequence
cttcaaagcaggaaattacctcat

SEQ ID NO: 113066 - DNA, 24 bp, Artificial sequence
  SiRNA target sequence
ttcaaagcaggaaattacctcatc

SEQ ID NO: 113067 - DNA, 24 bp, Artificial sequence
  SiRNA target sequence
tcaaagcaggaaattacctcatct

SEQ ID NO: 113068 - DNA, 24 bp, Artificial sequence
  SiRNA target sequence
caaagcaggaaattacctcatctt

SEQ ID NO: 113069 - DNA, 24 bp, Artificial sequence
  SiRNA target sequence
aaagcaggaaattacctcatcttc

SEQ ID NO: 113070 - DNA, 24 bp, Artificial sequence
  SiRNA target sequence
aagcaggaaattacctcatcttcg

SEQ ID NO: 113071 - DNA, 24 bp, Artificial sequence
  SiRNA target sequence
agcaggaaattacctcatcttcga

SEQ ID NO: 113072 - DNA, 24 bp, Artificial sequence
  SiRNA target sequence
gcaggaaattacctcatcttcgat

SEQ ID NO: 113073 - DNA, 24 bp, Artificial sequence
  SiRNA target sequence
caggaaattacctcatcttcgata

SEQ ID NO: 113074 - DNA, 24 bp, Artificial sequence
  SiRNA target sequence
aggaaattacctcatcttcgataa

SEQ ID NO: 113075 - DNA, 24 bp, Artificial sequence
  SiRNA target sequence
ggaaattacctcatcttcgataat

SEQ ID NO: 113076 - DNA, 24 bp, Artificial sequence
  SiRNA target sequence
gaaattacctcatcttcgataatt

SEQ ID NO: 113077 - DNA, 24 bp, Artificial sequence
  SiRNA target sequence
aaattacctcatcttcgataattt

SEQ ID NO: 113078 - DNA, 24 bp, Artificial sequence
  SiRNA target sequence
aattacctcatcttcgataatttt

SEQ ID NO: 113079 - DNA, 24 bp, Artificial sequence
  SiRNA target sequence
attacctcatcttcgataattttt

SEQ ID NO: 113080 - DNA, 24 bp, Artificial sequence
  SiRNA target sequence
ttacctcatcttcgataattttta

SEQ ID NO: 113081 - DNA, 24 bp, Artificial sequence
  SiRNA target sequence
tacctcatcttcgataatttttac

SEQ ID NO: 113082 - DNA, 24 bp, Artificial sequence
  SiRNA target sequence
acctcatcttcgataatttttact

SEQ ID NO: 113083 - DNA, 24 bp, Artificial sequence
  SiRNA target sequence
cctcatcttcgataatttttactt

SEQ ID NO: 113084 - DNA, 24 bp, Artificial sequence
  SiRNA target sequence
ctcatcttcgataatttttacttc

SEQ ID NO: 113085 - DNA, 24 bp, Artificial sequence
  SiRNA target sequence
tcatcttcgataatttttacttct

SEQ ID NO: 113086 - DNA, 24 bp, Artificial sequence
  SiRNA target sequence
catcttcgataatttttacttctt

SEQ ID NO: 113087 - DNA, 24 bp, Artificial sequence
  SiRNA target sequence
atcttcgataatttttacttcttc

SEQ ID NO: 113088 - DNA, 24 bp, Artificial sequence
  SiRNA target sequence
tcttcgataatttttacttcttca

SEQ ID NO: 113089 - DNA, 24 bp, Artificial sequence
  SiRNA target sequence
cttcgataatttttacttcttcac

SEQ ID NO: 113090 - DNA, 24 bp, Artificial sequence
  SiRNA target sequence
ttcgataatttttacttcttcaca

SEQ ID NO: 113091 - DNA, 24 bp, Artificial sequence
  SiRNA target sequence
tcgataatttttacttcttcacaa

SEQ ID NO: 113092 - DNA, 24 bp, Artificial sequence
  SiRNA target sequence
cgataatttttacttcttcacaag

SEQ ID NO: 113093 - DNA, 24 bp, Artificial sequence
  SiRNA target sequence
gataatttttacttcttcacaagt

SEQ ID NO: 113094 - DNA, 24 bp, Artificial sequence
  SiRNA target sequence
ataatttttacttcttcacaagtc

SEQ ID NO: 113095 - DNA, 24 bp, Artificial sequence
  SiRNA target sequence
taatttttacttcttcacaagtcg

SEQ ID NO: 113096 - DNA, 24 bp, Artificial sequence
  SiRNA target sequence
aatttttacttcttcacaagtcgc

SEQ ID NO: 113097 - DNA, 24 bp, Artificial sequence
  SiRNA target sequence
atttttacttcttcacaagtcgca

SEQ ID NO: 113098 - DNA, 24 bp, Artificial sequence
  SiRNA target sequence
tttttacttcttcacaagtcgcaa

SEQ ID NO: 113099 - DNA, 24 bp, Artificial sequence
  SiRNA target sequence
ttttacttcttcacaagtcgcaaa

SEQ ID NO: 113100 - DNA, 24 bp, Artificial sequence
  SiRNA target sequence
tttacttcttcacaagtcgcaaat

SEQ ID NO: 113101 - DNA, 24 bp, Artificial sequence
  SiRNA target sequence
ttacttcttcacaagtcgcaaatt

SEQ ID NO: 113102 - DNA, 24 bp, Artificial sequence
  SiRNA target sequence
tacttcttcacaagtcgcaaattt

SEQ ID NO: 113103 - DNA, 24 bp, Artificial sequence
  SiRNA target sequence
acttcttcacaagtcgcaaatttt

SEQ ID NO: 113104 - DNA, 24 bp, Artificial sequence
  SiRNA target sequence
cttcttcacaagtcgcaaattttt

SEQ ID NO: 113105 - DNA, 24 bp, Artificial sequence
  SiRNA target sequence
ttcttcacaagtcgcaaatttttg

SEQ ID NO: 113106 - DNA, 24 bp, Artificial sequence
  SiRNA target sequence
tcttcacaagtcgcaaatttttgt

SEQ ID NO: 113107 - DNA, 24 bp, Artificial sequence
  SiRNA target sequence
cttcacaagtcgcaaatttttgta

SEQ ID NO: 113108 - DNA, 24 bp, Artificial sequence
  SiRNA target sequence
ttcacaagtcgcaaatttttgtaa

SEQ ID NO: 113109 - DNA, 24 bp, Artificial sequence
  SiRNA target sequence
tcacaagtcgcaaatttttgtaag

SEQ ID NO: 113110 - DNA, 24 bp, Artificial sequence
  SiRNA target sequence
cacaagtcgcaaatttttgtaagt

SEQ ID NO: 113111 - DNA, 24 bp, Artificial sequence
  SiRNA target sequence
acaagtcgcaaatttttgtaagtt

SEQ ID NO: 113112 - DNA, 24 bp, Artificial sequence
  SiRNA target sequence
caagtcgcaaatttttgtaagtta

SEQ ID NO: 113113 - DNA, 24 bp, Artificial sequence
  SiRNA target sequence
aagtcgcaaatttttgtaagttat

SEQ ID NO: 113114 - DNA, 24 bp, Artificial sequence
  SiRNA target sequence
agtcgcaaatttttgtaagttatt

SEQ ID NO: 113115 - DNA, 24 bp, Artificial sequence
  SiRNA target sequence
gtcgcaaatttttgtaagttattt

SEQ ID NO: 113116 - DNA, 24 bp, Artificial sequence
  SiRNA target sequence
tcgcaaatttttgtaagttatttt

SEQ ID NO: 113117 - DNA, 24 bp, Artificial sequence
  SiRNA target sequence
cgcaaatttttgtaagttattttt

SEQ ID NO: 113118 - DNA, 24 bp, Artificial sequence
  SiRNA target sequence
gcaaatttttgtaagttatttttt

SEQ ID NO: 113119 - DNA, 24 bp, Artificial sequence
  SiRNA target sequence
caaatttttgtaagttattttttg

SEQ ID NO: 113120 - DNA, 24 bp, Artificial sequence
  SiRNA target sequence
aaatttttgtaagttattttttgc

SEQ ID NO: 113121 - DNA, 24 bp, Artificial sequence
  SiRNA target sequence
aatttttgtaagttattttttgct

SEQ ID NO: 113122 - DNA, 24 bp, Artificial sequence
  SiRNA target sequence
atttttgtaagttattttttgctt

SEQ ID NO: 113123 - DNA, 24 bp, Artificial sequence
  SiRNA target sequence
tttttgtaagttattttttgcttc

SEQ ID NO: 113124 - DNA, 24 bp, Artificial sequence
  SiRNA target sequence
ttttgtaagttattttttgcttct

SEQ ID NO: 113125 - DNA, 24 bp, Artificial sequence
  SiRNA target sequence
tttgtaagttattttttgcttctt

SEQ ID NO: 113126 - DNA, 24 bp, Artificial sequence
  SiRNA target sequence
ttgtaagttattttttgcttcttt

SEQ ID NO: 113127 - DNA, 24 bp, Artificial sequence
  SiRNA target sequence
tgtaagttattttttgcttcttta

SEQ ID NO: 113128 - DNA, 24 bp, Artificial sequence
  SiRNA target sequence
gtaagttattttttgcttctttaa

SEQ ID NO: 113129 - DNA, 24 bp, Artificial sequence
  SiRNA target sequence
taagttattttttgcttctttaag

SEQ ID NO: 113130 - DNA, 24 bp, Artificial sequence
  SiRNA target sequence
aagttattttttgcttctttaagg

SEQ ID NO: 113131 - DNA, 24 bp, Artificial sequence
  SiRNA target sequence
agttattttttgcttctttaaggc

SEQ ID NO: 113132 - DNA, 24 bp, Artificial sequence
  SiRNA target sequence
gttattttttgcttctttaaggca

SEQ ID NO: 113133 - DNA, 24 bp, Artificial sequence
  SiRNA target sequence
ttattttttgcttctttaaggcaa

SEQ ID NO: 113134 - DNA, 24 bp, Artificial sequence
  SiRNA target sequence
tattttttgcttctttaaggcaat

SEQ ID NO: 113135 - DNA, 24 bp, Artificial sequence
  SiRNA target sequence
attttttgcttctttaaggcaatc

SEQ ID NO: 113136 - DNA, 24 bp, Artificial sequence
  SiRNA target sequence
ttttttgcttctttaaggcaatca

SEQ ID NO: 113137 - DNA, 24 bp, Artificial sequence
  SiRNA target sequence
tttttgcttctttaaggcaatcat

SEQ ID NO: 113138 - DNA, 24 bp, Artificial sequence
  SiRNA target sequence
ttttgcttctttaaggcaatcatt

SEQ ID NO: 113139 - DNA, 24 bp, Artificial sequence
  SiRNA target sequence
tttgcttctttaaggcaatcatta

SEQ ID NO: 113140 - DNA, 24 bp, Artificial sequence
  SiRNA target sequence
ttgcttctttaaggcaatcattat

SEQ ID NO: 113141 - DNA, 24 bp, Artificial sequence
  SiRNA target sequence
tgcttctttaaggcaatcattatt

SEQ ID NO: 113142 - DNA, 24 bp, Artificial sequence
  SiRNA target sequence
gcttctttaaggcaatcattattt

SEQ ID NO: 113143 - DNA, 24 bp, Artificial sequence
  SiRNA target sequence
cttctttaaggcaatcattatttt

SEQ ID NO: 113144 - DNA, 24 bp, Artificial sequence
  SiRNA target sequence
ttctttaaggcaatcattattttt

SEQ ID NO: 113145 - DNA, 24 bp, Artificial sequence
  SiRNA target sequence
tctttaaggcaatcattatttttt

SEQ ID NO: 113146 - DNA, 24 bp, Artificial sequence
  SiRNA target sequence
ctttaaggcaatcattattttttt

SEQ ID NO: 113147 - DNA, 24 bp, Artificial sequence
  SiRNA target sequence
tttaaggcaatcattatttttttt

SEQ ID NO: 113148 - DNA, 24 bp, Artificial sequence
  SiRNA target sequence
ttaaggcaatcattattttttttt

SEQ ID NO: 113149 - DNA, 24 bp, Artificial sequence
  SiRNA target sequence
taaggcaatcattatttttttttt

SEQ ID NO: 113150 - DNA, 24 bp, Artificial sequence
  SiRNA target sequence
aaggcaatcattattttttttttc

SEQ ID NO: 113151 - DNA, 24 bp, Artificial sequence
  SiRNA target sequence
aggcaatcattattttttttttca

SEQ ID NO: 113152 - DNA, 24 bp, Artificial sequence
  SiRNA target sequence
ggcaatcattattttttttttcat

SEQ ID NO: 113153 - DNA, 24 bp, Artificial sequence
  SiRNA target sequence
gcaatcattattttttttttcatt

SEQ ID NO: 113154 - DNA, 24 bp, Artificial sequence
  SiRNA target sequence
caatcattattttttttttcatta

SEQ ID NO: 113155 - DNA, 24 bp, Artificial sequence
  SiRNA target sequence
aatcattattttttttttcattaa

SEQ ID NO: 113156 - DNA, 24 bp, Artificial sequence
  SiRNA target sequence
atcattattttttttttcattaat

SEQ ID NO: 113157 - DNA, 24 bp, Artificial sequence
  SiRNA target sequence
tcattattttttttttcattaatt

SEQ ID NO: 113158 - DNA, 24 bp, Artificial sequence
  SiRNA target sequence
cattattttttttttcattaattt

SEQ ID NO: 113159 - DNA, 24 bp, Artificial sequence
  SiRNA target sequence
attattttttttttcattaatttc

SEQ ID NO: 113160 - DNA, 24 bp, Artificial sequence
  SiRNA target sequence
ttattttttttttcattaatttcc

SEQ ID NO: 113161 - DNA, 24 bp, Artificial sequence
  SiRNA target sequence
tattttttttttcattaatttcct

SEQ ID NO: 113162 - DNA, 24 bp, Artificial sequence
  SiRNA target sequence
attttttttttcattaatttcctc

SEQ ID NO: 113163 - DNA, 24 bp, Artificial sequence
  SiRNA target sequence
ttttttttttcattaatttcctcc

SEQ ID NO: 113164 - DNA, 24 bp, Artificial sequence
  SiRNA target sequence
tttttttttcattaatttcctccg

SEQ ID NO: 113165 - DNA, 24 bp, Artificial sequence
  SiRNA target sequence
ttttttttcattaatttcctccgt

SEQ ID NO: 113166 - DNA, 24 bp, Artificial sequence
  SiRNA target sequence
tttttttcattaatttcctccgtg

SEQ ID NO: 113167 - DNA, 24 bp, Artificial sequence
  SiRNA target sequence
ttttttcattaatttcctccgtgg

SEQ ID NO: 113168 - DNA, 24 bp, Artificial sequence
  SiRNA target sequence
tttttcattaatttcctccgtgga

SEQ ID NO: 113169 - DNA, 24 bp, Artificial sequence
  SiRNA target sequence
ttttcattaatttcctccgtggat

SEQ ID NO: 113170 - DNA, 24 bp, Artificial sequence
  SiRNA target sequence
tttcattaatttcctccgtggatc

SEQ ID NO: 113171 - DNA, 24 bp, Artificial sequence
  SiRNA target sequence
ttcattaatttcctccgtggatct

SEQ ID NO: 113172 - DNA, 24 bp, Artificial sequence
  SiRNA target sequence
tcattaatttcctccgtggatctg

SEQ ID NO: 113173 - DNA, 24 bp, Artificial sequence
  SiRNA target sequence
cattaatttcctccgtggatctgt

SEQ ID NO: 113174 - DNA, 24 bp, Artificial sequence
  SiRNA target sequence
attaatttcctccgtggatctgta

SEQ ID NO: 113175 - DNA, 24 bp, Artificial sequence
  SiRNA target sequence
ttaatttcctccgtggatctgtaa

SEQ ID NO: 113176 - DNA, 24 bp, Artificial sequence
  SiRNA target sequence
taatttcctccgtggatctgtaaa

SEQ ID NO: 113177 - DNA, 24 bp, Artificial sequence
  SiRNA target sequence
aatttcctccgtggatctgtaaaa

SEQ ID NO: 113178 - DNA, 24 bp, Artificial sequence
  SiRNA target sequence
atttcctccgtggatctgtaaaaa

SEQ ID NO: 113179 - DNA, 24 bp, Artificial sequence
  SiRNA target sequence
tttcctccgtggatctgtaaaaat

SEQ ID NO: 113180 - DNA, 24 bp, Artificial sequence
  SiRNA target sequence
ttcctccgtggatctgtaaaaatc

SEQ ID NO: 113181 - DNA, 24 bp, Artificial sequence
  SiRNA target sequence
tcctccgtggatctgtaaaaatcg

SEQ ID NO: 113182 - DNA, 24 bp, Artificial sequence
  SiRNA target sequence
cctccgtggatctgtaaaaatcgt

SEQ ID NO: 113183 - DNA, 24 bp, Artificial sequence
  SiRNA target sequence
ctccgtggatctgtaaaaatcgtt

SEQ ID NO: 113184 - DNA, 24 bp, Artificial sequence
  SiRNA target sequence
tccgtggatctgtaaaaatcgtta

SEQ ID NO: 113185 - DNA, 24 bp, Artificial sequence
  SiRNA target sequence
ccgtggatctgtaaaaatcgttaa

SEQ ID NO: 113186 - DNA, 24 bp, Artificial sequence
  SiRNA target sequence
cgtggatctgtaaaaatcgttaac

SEQ ID NO: 113187 - DNA, 24 bp, Artificial sequence
  SiRNA target sequence
gtggatctgtaaaaatcgttaaca

SEQ ID NO: 113188 - DNA, 24 bp, Artificial sequence
  SiRNA target sequence
tggatctgtaaaaatcgttaacat

SEQ ID NO: 113189 - DNA, 24 bp, Artificial sequence
  SiRNA target sequence
ggatctgtaaaaatcgttaacatc

SEQ ID NO: 113190 - DNA, 24 bp, Artificial sequence
  SiRNA target sequence
gatctgtaaaaatcgttaacatct

SEQ ID NO: 113191 - DNA, 24 bp, Artificial sequence
  SiRNA target sequence
atctgtaaaaatcgttaacatcta

SEQ ID NO: 113192 - DNA, 24 bp, Artificial sequence
  SiRNA target sequence
tctgtaaaaatcgttaacatctaa

SEQ ID NO: 113193 - DNA, 24 bp, Artificial sequence
  SiRNA target sequence
ctgtaaaaatcgttaacatctaaa

SEQ ID NO: 113194 - DNA, 24 bp, Artificial sequence
  SiRNA target sequence
tgtaaaaatcgttaacatctaaac

SEQ ID NO: 113195 - DNA, 24 bp, Artificial sequence
  SiRNA target sequence
gtaaaaatcgttaacatctaaaca

SEQ ID NO: 113196 - DNA, 24 bp, Artificial sequence
  SiRNA target sequence
taaaaatcgttaacatctaaacag

SEQ ID NO: 113197 - DNA, 24 bp, Artificial sequence
  SiRNA target sequence
aaaaatcgttaacatctaaacagg

SEQ ID NO: 113198 - DNA, 24 bp, Artificial sequence
  SiRNA target sequence
aaaatcgttaacatctaaacagga

SEQ ID NO: 113199 - DNA, 24 bp, Artificial sequence
  SiRNA target sequence
aaatcgttaacatctaaacaggag

SEQ ID NO: 113200 - DNA, 24 bp, Artificial sequence
  SiRNA target sequence
aatcgttaacatctaaacaggagt

SEQ ID NO: 113201 - DNA, 24 bp, Artificial sequence
  SiRNA target sequence
atcgttaacatctaaacaggagtg

SEQ ID NO: 113202 - DNA, 24 bp, Artificial sequence
  SiRNA target sequence
tcgttaacatctaaacaggagtgc

SEQ ID NO: 113203 - DNA, 24 bp, Artificial sequence
  SiRNA target sequence
cgttaacatctaaacaggagtgcc

SEQ ID NO: 113204 - DNA, 24 bp, Artificial sequence
  SiRNA target sequence
gttaacatctaaacaggagtgccc

SEQ ID NO: 113205 - DNA, 24 bp, Artificial sequence
  SiRNA target sequence
ttaacatctaaacaggagtgccca

SEQ ID NO: 113206 - DNA, 24 bp, Artificial sequence
  SiRNA target sequence
taacatctaaacaggagtgcccac

SEQ ID NO: 113207 - DNA, 24 bp, Artificial sequence
  SiRNA target sequence
aacatctaaacaggagtgcccaca

SEQ ID NO: 113208 - DNA, 24 bp, Artificial sequence
  SiRNA target sequence
acatctaaacaggagtgcccacat

SEQ ID NO: 113209 - DNA, 24 bp, Artificial sequence
  SiRNA target sequence
catctaaacaggagtgcccacatg

SEQ ID NO: 113210 - DNA, 24 bp, Artificial sequence
  SiRNA target sequence
atctaaacaggagtgcccacatgt

SEQ ID NO: 113211 - DNA, 24 bp, Artificial sequence
  SiRNA target sequence
tctaaacaggagtgcccacatgtc

SEQ ID NO: 113212 - DNA, 24 bp, Artificial sequence
  SiRNA target sequence
ctaaacaggagtgcccacatgtcc

SEQ ID NO: 113213 - DNA, 24 bp, Artificial sequence
  SiRNA target sequence
taaacaggagtgcccacatgtcct

SEQ ID NO: 113214 - DNA, 24 bp, Artificial sequence
  SiRNA target sequence
aaacaggagtgcccacatgtcctg

SEQ ID NO: 113215 - DNA, 24 bp, Artificial sequence
  SiRNA target sequence
aacaggagtgcccacatgtcctgt

SEQ ID NO: 113216 - DNA, 24 bp, Artificial sequence
  SiRNA target sequence
acaggagtgcccacatgtcctgta

SEQ ID NO: 113217 - DNA, 24 bp, Artificial sequence
  SiRNA target sequence
caggagtgcccacatgtcctgtac

SEQ ID NO: 113218 - DNA, 24 bp, Artificial sequence
  SiRNA target sequence
aggagtgcccacatgtcctgtacg

SEQ ID NO: 113219 - DNA, 24 bp, Artificial sequence
  SiRNA target sequence
ggagtgcccacatgtcctgtacgt

SEQ ID NO: 113220 - DNA, 24 bp, Artificial sequence
  SiRNA target sequence
gagtgcccacatgtcctgtacgta

SEQ ID NO: 113221 - DNA, 24 bp, Artificial sequence
  SiRNA target sequence
agtgcccacatgtcctgtacgtat

SEQ ID NO: 113222 - DNA, 24 bp, Artificial sequence
  SiRNA target sequence
gtgcccacatgtcctgtacgtatc

SEQ ID NO: 113223 - DNA, 24 bp, Artificial sequence
  SiRNA target sequence
tgcccacatgtcctgtacgtatca

SEQ ID NO: 113224 - DNA, 24 bp, Artificial sequence
  SiRNA target sequence
gcccacatgtcctgtacgtatcaa

SEQ ID NO: 113225 - DNA, 24 bp, Artificial sequence
  SiRNA target sequence
cccacatgtcctgtacgtatcaat

SEQ ID NO: 113226 - DNA, 24 bp, Artificial sequence
  SiRNA target sequence
ccacatgtcctgtacgtatcaatt

SEQ ID NO: 113227 - DNA, 24 bp, Artificial sequence
  SiRNA target sequence
cacatgtcctgtacgtatcaattt

SEQ ID NO: 113228 - DNA, 24 bp, Artificial sequence
  SiRNA target sequence
acatgtcctgtacgtatcaatttg

SEQ ID NO: 113229 - DNA, 24 bp, Artificial sequence
  SiRNA target sequence
catgtcctgtacgtatcaatttgc

SEQ ID NO: 113230 - DNA, 24 bp, Artificial sequence
  SiRNA target sequence
atgtcctgtacgtatcaatttgca

SEQ ID NO: 113231 - DNA, 24 bp, Artificial sequence
  SiRNA target sequence
tgtcctgtacgtatcaatttgcaa

SEQ ID NO: 113232 - DNA, 24 bp, Artificial sequence
  SiRNA target sequence
gtcctgtacgtatcaatttgcaag

SEQ ID NO: 113233 - DNA, 24 bp, Artificial sequence
  SiRNA target sequence
tcctgtacgtatcaatttgcaaga

SEQ ID NO: 113234 - DNA, 24 bp, Artificial sequence
  SiRNA target sequence
cctgtacgtatcaatttgcaagat

SEQ ID NO: 113235 - DNA, 24 bp, Artificial sequence
  SiRNA target sequence
ctgtacgtatcaatttgcaagatg

SEQ ID NO: 113236 - DNA, 24 bp, Artificial sequence
  SiRNA target sequence
tgtacgtatcaatttgcaagatga

SEQ ID NO: 113237 - DNA, 24 bp, Artificial sequence
  SiRNA target sequence
gtacgtatcaatttgcaagatgat

SEQ ID NO: 113238 - DNA, 24 bp, Artificial sequence
  SiRNA target sequence
tacgtatcaatttgcaagatgata

SEQ ID NO: 113239 - DNA, 24 bp, Artificial sequence
  SiRNA target sequence
acgtatcaatttgcaagatgatag

SEQ ID NO: 113240 - DNA, 24 bp, Artificial sequence
  SiRNA target sequence
cgtatcaatttgcaagatgatagg

SEQ ID NO: 113241 - DNA, 24 bp, Artificial sequence
  SiRNA target sequence
gtatcaatttgcaagatgataggt

SEQ ID NO: 113242 - DNA, 24 bp, Artificial sequence
  SiRNA target sequence
tatcaatttgcaagatgataggtc

SEQ ID NO: 113243 - DNA, 24 bp, Artificial sequence
  SiRNA target sequence
atcaatttgcaagatgataggtcc

SEQ ID NO: 113244 - DNA, 24 bp, Artificial sequence
  SiRNA target sequence
tcaatttgcaagatgataggtcct

SEQ ID NO: 113245 - DNA, 24 bp, Artificial sequence
  SiRNA target sequence
caatttgcaagatgataggtcctt

SEQ ID NO: 113246 - DNA, 24 bp, Artificial sequence
  SiRNA target sequence
aatttgcaagatgataggtccttt

SEQ ID NO: 113247 - DNA, 24 bp, Artificial sequence
  SiRNA target sequence
atttgcaagatgataggtcctttt

SEQ ID NO: 113248 - DNA, 24 bp, Artificial sequence
  SiRNA target sequence
tttgcaagatgataggtccttttt

SEQ ID NO: 113249 - DNA, 24 bp, Artificial sequence
  SiRNA target sequence
ttgcaagatgataggtcctttttc

SEQ ID NO: 113250 - DNA, 24 bp, Artificial sequence
  SiRNA target sequence
tgcaagatgataggtcctttttct

SEQ ID NO: 113251 - DNA, 24 bp, Artificial sequence
  SiRNA target sequence
gcaagatgataggtcctttttcta

SEQ ID NO: 113252 - DNA, 24 bp, Artificial sequence
  SiRNA target sequence
caagatgataggtcctttttctat

SEQ ID NO: 113253 - DNA, 24 bp, Artificial sequence
  SiRNA target sequence
aagatgataggtcctttttctatt

SEQ ID NO: 113254 - DNA, 24 bp, Artificial sequence
  SiRNA target sequence
agatgataggtcctttttctattg

SEQ ID NO: 113255 - DNA, 24 bp, Artificial sequence
  SiRNA target sequence
gatgataggtcctttttctattgc

SEQ ID NO: 113256 - DNA, 24 bp, Artificial sequence
  SiRNA target sequence
atgataggtcctttttctattgca

SEQ ID NO: 113257 - DNA, 24 bp, Artificial sequence
  SiRNA target sequence
tgataggtcctttttctattgcat

SEQ ID NO: 113258 - DNA, 24 bp, Artificial sequence
  SiRNA target sequence
gataggtcctttttctattgcatg

SEQ ID NO: 113259 - DNA, 24 bp, Artificial sequence
  SiRNA target sequence
ataggtcctttttctattgcatgt

SEQ ID NO: 113260 - DNA, 24 bp, Artificial sequence
  SiRNA target sequence
taggtcctttttctattgcatgtt

SEQ ID NO: 113261 - DNA, 24 bp, Artificial sequence
  SiRNA target sequence
aggtcctttttctattgcatgttg

SEQ ID NO: 113262 - DNA, 24 bp, Artificial sequence
  SiRNA target sequence
ggtcctttttctattgcatgttgt

SEQ ID NO: 113263 - DNA, 24 bp, Artificial sequence
  SiRNA target sequence
gtcctttttctattgcatgttgtc

SEQ ID NO: 113264 - DNA, 24 bp, Artificial sequence
  SiRNA target sequence
tcctttttctattgcatgttgtct

SEQ ID NO: 113265 - DNA, 24 bp, Artificial sequence
  SiRNA target sequence
cctttttctattgcatgttgtcta

SEQ ID NO: 113266 - DNA, 24 bp, Artificial sequence
  SiRNA target sequence
ctttttctattgcatgttgtctag

SEQ ID NO: 113267 - DNA, 24 bp, Artificial sequence
  SiRNA target sequence
tttttctattgcatgttgtctagc

SEQ ID NO: 113268 - DNA, 24 bp, Artificial sequence
  SiRNA target sequence
ttttctattgcatgttgtctagca

SEQ ID NO: 113269 - DNA, 24 bp, Artificial sequence
  SiRNA target sequence
tttctattgcatgttgtctagcaa

SEQ ID NO: 113270 - DNA, 24 bp, Artificial sequence
  SiRNA target sequence
ttctattgcatgttgtctagcaaa

SEQ ID NO: 113271 - DNA, 24 bp, Artificial sequence
  SiRNA target sequence
tctattgcatgttgtctagcaaat

SEQ ID NO: 113272 - DNA, 24 bp, Artificial sequence
  SiRNA target sequence
ctattgcatgttgtctagcaaatg

SEQ ID NO: 113273 - DNA, 24 bp, Artificial sequence
  SiRNA target sequence
tattgcatgttgtctagcaaatgt

SEQ ID NO: 113274 - DNA, 24 bp, Artificial sequence
  SiRNA target sequence
attgcatgttgtctagcaaatgta

SEQ ID NO: 113275 - DNA, 24 bp, Artificial sequence
  SiRNA target sequence
ttgcatgttgtctagcaaatgtaa

SEQ ID NO: 113276 - DNA, 24 bp, Artificial sequence
  SiRNA target sequence
tgcatgttgtctagcaaatgtaaa

SEQ ID NO: 113277 - DNA, 24 bp, Artificial sequence
  SiRNA target sequence
gcatgttgtctagcaaatgtaaat

SEQ ID NO: 113278 - DNA, 24 bp, Artificial sequence
  SiRNA target sequence
catgttgtctagcaaatgtaaata

SEQ ID NO: 113279 - DNA, 24 bp, Artificial sequence
  SiRNA target sequence
atgttgtctagcaaatgtaaatac

SEQ ID NO: 113280 - DNA, 24 bp, Artificial sequence
  SiRNA target sequence
tgttgtctagcaaatgtaaataca

SEQ ID NO: 113281 - DNA, 24 bp, Artificial sequence
  SiRNA target sequence
gttgtctagcaaatgtaaatacat

SEQ ID NO: 113282 - DNA, 24 bp, Artificial sequence
  SiRNA target sequence
ttgtctagcaaatgtaaatacatc

SEQ ID NO: 113283 - DNA, 24 bp, Artificial sequence
  SiRNA target sequence
tgtctagcaaatgtaaatacatca

SEQ ID NO: 113284 - DNA, 24 bp, Artificial sequence
  SiRNA target sequence
gtctagcaaatgtaaatacatcaa

SEQ ID NO: 113285 - DNA, 24 bp, Artificial sequence
  SiRNA target sequence
tctagcaaatgtaaatacatcaat

SEQ ID NO: 113286 - DNA, 24 bp, Artificial sequence
  SiRNA target sequence
ctagcaaatgtaaatacatcaatc

SEQ ID NO: 113287 - DNA, 24 bp, Artificial sequence
  SiRNA target sequence
tagcaaatgtaaatacatcaatca

SEQ ID NO: 113288 - DNA, 24 bp, Artificial sequence
  SiRNA target sequence
agcaaatgtaaatacatcaatcag

SEQ ID NO: 113289 - DNA, 24 bp, Artificial sequence
  SiRNA target sequence
gcaaatgtaaatacatcaatcagt

SEQ ID NO: 113290 - DNA, 24 bp, Artificial sequence
  SiRNA target sequence
caaatgtaaatacatcaatcagtt

SEQ ID NO: 113291 - DNA, 24 bp, Artificial sequence
  SiRNA target sequence
aaatgtaaatacatcaatcagttg

SEQ ID NO: 113292 - DNA, 24 bp, Artificial sequence
  SiRNA target sequence
aatgtaaatacatcaatcagttga

SEQ ID NO: 113293 - DNA, 24 bp, Artificial sequence
  SiRNA target sequence
atgtaaatacatcaatcagttgag

SEQ ID NO: 113294 - DNA, 24 bp, Artificial sequence
  SiRNA target sequence
tgtaaatacatcaatcagttgagt

SEQ ID NO: 113295 - DNA, 24 bp, Artificial sequence
  SiRNA target sequence
gtaaatacatcaatcagttgagtt

SEQ ID NO: 113296 - DNA, 24 bp, Artificial sequence
  SiRNA target sequence
taaatacatcaatcagttgagtta

SEQ ID NO: 113297 - DNA, 24 bp, Artificial sequence
  SiRNA target sequence
aaatacatcaatcagttgagttat

SEQ ID NO: 113298 - DNA, 24 bp, Artificial sequence
  SiRNA target sequence
aatacatcaatcagttgagttatg

SEQ ID NO: 113299 - DNA, 24 bp, Artificial sequence
  SiRNA target sequence
atacatcaatcagttgagttatgt

SEQ ID NO: 113300 - DNA, 24 bp, Artificial sequence
  SiRNA target sequence
tacatcaatcagttgagttatgtt

SEQ ID NO: 113301 - DNA, 24 bp, Artificial sequence
  SiRNA target sequence
acatcaatcagttgagttatgttt

SEQ ID NO: 113302 - DNA, 24 bp, Artificial sequence
  SiRNA target sequence
catcaatcagttgagttatgtttt

SEQ ID NO: 113303 - DNA, 24 bp, Artificial sequence
  SiRNA target sequence
atcaatcagttgagttatgttttt

SEQ ID NO: 113304 - DNA, 24 bp, Artificial sequence
  SiRNA target sequence
tcaatcagttgagttatgttttta

SEQ ID NO: 113305 - DNA, 24 bp, Artificial sequence
  SiRNA target sequence
caatcagttgagttatgtttttat

SEQ ID NO: 113306 - DNA, 24 bp, Artificial sequence
  SiRNA target sequence
aatcagttgagttatgtttttatc

SEQ ID NO: 113307 - DNA, 24 bp, Artificial sequence
  SiRNA target sequence
atcagttgagttatgtttttatct

SEQ ID NO: 113308 - DNA, 24 bp, Artificial sequence
  SiRNA target sequence
tcagttgagttatgtttttatctg

SEQ ID NO: 113309 - DNA, 24 bp, Artificial sequence
  SiRNA target sequence
cagttgagttatgtttttatctgt

SEQ ID NO: 113310 - DNA, 24 bp, Artificial sequence
  SiRNA target sequence
agttgagttatgtttttatctgta

SEQ ID NO: 113311 - DNA, 24 bp, Artificial sequence
  SiRNA target sequence
gttgagttatgtttttatctgtaa

SEQ ID NO: 113312 - DNA, 24 bp, Artificial sequence
  SiRNA target sequence
ttgagttatgtttttatctgtaag

SEQ ID NO: 113313 - DNA, 24 bp, Artificial sequence
  SiRNA target sequence
tgagttatgtttttatctgtaaga

SEQ ID NO: 113314 - DNA, 24 bp, Artificial sequence
  SiRNA target sequence
gagttatgtttttatctgtaagac

SEQ ID NO: 113315 - DNA, 24 bp, Artificial sequence
  SiRNA target sequence
agttatgtttttatctgtaagacg

SEQ ID NO: 113316 - DNA, 24 bp, Artificial sequence
  SiRNA target sequence
gttatgtttttatctgtaagacgt

SEQ ID NO: 113317 - DNA, 24 bp, Artificial sequence
  SiRNA target sequence
ttatgtttttatctgtaagacgta

SEQ ID NO: 113318 - DNA, 24 bp, Artificial sequence
  SiRNA target sequence
tatgtttttatctgtaagacgtat

SEQ ID NO: 113319 - DNA, 24 bp, Artificial sequence
  SiRNA target sequence
atgtttttatctgtaagacgtata

SEQ ID NO: 113320 - DNA, 24 bp, Artificial sequence
  SiRNA target sequence
tgtttttatctgtaagacgtatac

SEQ ID NO: 113321 - DNA, 24 bp, Artificial sequence
  SiRNA target sequence
gtttttatctgtaagacgtatacc

SEQ ID NO: 113322 - DNA, 24 bp, Artificial sequence
  SiRNA target sequence
tttttatctgtaagacgtatacct

SEQ ID NO: 113323 - DNA, 24 bp, Artificial sequence
  SiRNA target sequence
ttttatctgtaagacgtatacctg

SEQ ID NO: 113324 - DNA, 24 bp, Artificial sequence
  SiRNA target sequence
tttatctgtaagacgtatacctgg

SEQ ID NO: 113325 - DNA, 24 bp, Artificial sequence
  SiRNA target sequence
ttatctgtaagacgtatacctgga

SEQ ID NO: 113326 - DNA, 24 bp, Artificial sequence
  SiRNA target sequence
tatctgtaagacgtatacctggaa

SEQ ID NO: 113327 - DNA, 24 bp, Artificial sequence
  SiRNA target sequence
atctgtaagacgtatacctggaat

SEQ ID NO: 113328 - DNA, 24 bp, Artificial sequence
  SiRNA target sequence
tctgtaagacgtatacctggaata

SEQ ID NO: 113329 - DNA, 24 bp, Artificial sequence
  SiRNA target sequence
ctgtaagacgtatacctggaatat

SEQ ID NO: 113330 - DNA, 24 bp, Artificial sequence
  SiRNA target sequence
tgtaagacgtatacctggaatatt

SEQ ID NO: 113331 - DNA, 24 bp, Artificial sequence
  SiRNA target sequence
gtaagacgtatacctggaatatta

SEQ ID NO: 113332 - DNA, 24 bp, Artificial sequence
  SiRNA target sequence
taagacgtatacctggaatattat

SEQ ID NO: 113333 - DNA, 24 bp, Artificial sequence
  SiRNA target sequence
aagacgtatacctggaatattata

SEQ ID NO: 113334 - DNA, 24 bp, Artificial sequence
  SiRNA target sequence
agacgtatacctggaatattatat

SEQ ID NO: 113335 - DNA, 24 bp, Artificial sequence
  SiRNA target sequence
gacgtatacctggaatattatatc

SEQ ID NO: 113336 - DNA, 24 bp, Artificial sequence
  SiRNA target sequence
acgtatacctggaatattatatcc

SEQ ID NO: 113337 - DNA, 24 bp, Artificial sequence
  SiRNA target sequence
cgtatacctggaatattatatccc

SEQ ID NO: 113338 - DNA, 24 bp, Artificial sequence
  SiRNA target sequence
gtatacctggaatattatatcccc

SEQ ID NO: 113339 - DNA, 24 bp, Artificial sequence
  SiRNA target sequence
tatacctggaatattatatcccct

SEQ ID NO: 113340 - DNA, 24 bp, Artificial sequence
  SiRNA target sequence
atacctggaatattatatcccctt

SEQ ID NO: 113341 - DNA, 24 bp, Artificial sequence
  SiRNA target sequence
tacctggaatattatatccccttt

SEQ ID NO: 113342 - DNA, 24 bp, Artificial sequence
  SiRNA target sequence
acctggaatattatatcccctttt

SEQ ID NO: 113343 - DNA, 24 bp, Artificial sequence
  SiRNA target sequence
cctggaatattatatcccctttta

SEQ ID NO: 113344 - DNA, 24 bp, Artificial sequence
  SiRNA target sequence
ctggaatattatatccccttttaa

SEQ ID NO: 113345 - DNA, 24 bp, Artificial sequence
  SiRNA target sequence
tggaatattatatccccttttaaa

SEQ ID NO: 113346 - DNA, 24 bp, Artificial sequence
  SiRNA target sequence
ggaatattatatccccttttaaaa

SEQ ID NO: 113347 - DNA, 24 bp, Artificial sequence
  SiRNA target sequence
gaatattatatccccttttaaaat

SEQ ID NO: 113348 - DNA, 24 bp, Artificial sequence
  SiRNA target sequence
aatattatatccccttttaaaata

SEQ ID NO: 113349 - DNA, 24 bp, Artificial sequence
  SiRNA target sequence
atattatatccccttttaaaatat

SEQ ID NO: 113350 - DNA, 24 bp, Artificial sequence
  SiRNA target sequence
tattatatccccttttaaaatatt

SEQ ID NO: 113351 - DNA, 24 bp, Artificial sequence
  SiRNA target sequence
attatatccccttttaaaatattc

SEQ ID NO: 113352 - DNA, 24 bp, Artificial sequence
  SiRNA target sequence
ttatatccccttttaaaatattca

SEQ ID NO: 113353 - DNA, 24 bp, Artificial sequence
  SiRNA target sequence
tatatccccttttaaaatattcag

SEQ ID NO: 113354 - DNA, 24 bp, Artificial sequence
  SiRNA target sequence
atatccccttttaaaatattcagg

SEQ ID NO: 113355 - DNA, 24 bp, Artificial sequence
  SiRNA target sequence
tatccccttttaaaatattcagga

SEQ ID NO: 113356 - DNA, 24 bp, Artificial sequence
  SiRNA target sequence
atccccttttaaaatattcaggat

SEQ ID NO: 113357 - DNA, 24 bp, Artificial sequence
  SiRNA target sequence
tccccttttaaaatattcaggata

SEQ ID NO: 113358 - DNA, 24 bp, Artificial sequence
  SiRNA target sequence
ccccttttaaaatattcaggatat

SEQ ID NO: 113359 - DNA, 24 bp, Artificial sequence
  SiRNA target sequence
cccttttaaaatattcaggatatg

SEQ ID NO: 113360 - DNA, 24 bp, Artificial sequence
  SiRNA target sequence
ccttttaaaatattcaggatatgt

SEQ ID NO: 113361 - DNA, 24 bp, Artificial sequence
  SiRNA target sequence
cttttaaaatattcaggatatgta

SEQ ID NO: 113362 - DNA, 24 bp, Artificial sequence
  SiRNA target sequence
ttttaaaatattcaggatatgtag

SEQ ID NO: 113363 - DNA, 24 bp, Artificial sequence
  SiRNA target sequence
tttaaaatattcaggatatgtagt

SEQ ID NO: 113364 - DNA, 24 bp, Artificial sequence
  SiRNA target sequence
ttaaaatattcaggatatgtagtg

SEQ ID NO: 113365 - DNA, 24 bp, Artificial sequence
  SiRNA target sequence
taaaatattcaggatatgtagtgg

SEQ ID NO: 113366 - DNA, 24 bp, Artificial sequence
  SiRNA target sequence
aaaatattcaggatatgtagtgga

SEQ ID NO: 113367 - DNA, 24 bp, Artificial sequence
  SiRNA target sequence
aaatattcaggatatgtagtggaa

SEQ ID NO: 113368 - DNA, 24 bp, Artificial sequence
  SiRNA target sequence
aatattcaggatatgtagtggaat

SEQ ID NO: 113369 - DNA, 24 bp, Artificial sequence
  SiRNA target sequence
atattcaggatatgtagtggaatt

SEQ ID NO: 113370 - DNA, 24 bp, Artificial sequence
  SiRNA target sequence
tattcaggatatgtagtggaatta

SEQ ID NO: 113371 - DNA, 24 bp, Artificial sequence
  SiRNA target sequence
attcaggatatgtagtggaattac

SEQ ID NO: 113372 - DNA, 24 bp, Artificial sequence
  SiRNA target sequence
ttcaggatatgtagtggaattact

SEQ ID NO: 113373 - DNA, 24 bp, Artificial sequence
  SiRNA target sequence
tcaggatatgtagtggaattactt

SEQ ID NO: 113374 - DNA, 24 bp, Artificial sequence
  SiRNA target sequence
caggatatgtagtggaattacttt

SEQ ID NO: 113375 - DNA, 24 bp, Artificial sequence
  SiRNA target sequence
aggatatgtagtggaattactttc

SEQ ID NO: 113376 - DNA, 24 bp, Artificial sequence
  SiRNA target sequence
ggatatgtagtggaattactttca

SEQ ID NO: 113377 - DNA, 24 bp, Artificial sequence
  SiRNA target sequence
gatatgtagtggaattactttcag

SEQ ID NO: 113378 - DNA, 24 bp, Artificial sequence
  SiRNA target sequence
atatgtagtggaattactttcagg

SEQ ID NO: 113379 - DNA, 24 bp, Artificial sequence
  SiRNA target sequence
tatgtagtggaattactttcaggt

SEQ ID NO: 113380 - DNA, 24 bp, Artificial sequence
  SiRNA target sequence
atgtagtggaattactttcaggtg

SEQ ID NO: 113381 - DNA, 24 bp, Artificial sequence
  SiRNA target sequence
tgtagtggaattactttcaggtgt

SEQ ID NO: 113382 - DNA, 24 bp, Artificial sequence
  SiRNA target sequence
gtagtggaattactttcaggtgtc

SEQ ID NO: 113383 - DNA, 24 bp, Artificial sequence
  SiRNA target sequence
tagtggaattactttcaggtgtcc

SEQ ID NO: 113384 - DNA, 24 bp, Artificial sequence
  SiRNA target sequence
agtggaattactttcaggtgtcca

SEQ ID NO: 113385 - DNA, 24 bp, Artificial sequence
  SiRNA target sequence
gtggaattactttcaggtgtccac

SEQ ID NO: 113386 - DNA, 24 bp, Artificial sequence
  SiRNA target sequence
tggaattactttcaggtgtccaca

SEQ ID NO: 113387 - DNA, 24 bp, Artificial sequence
  SiRNA target sequence
ggaattactttcaggtgtccacat

SEQ ID NO: 113388 - DNA, 24 bp, Artificial sequence
  SiRNA target sequence
gaattactttcaggtgtccacata

SEQ ID NO: 113389 - DNA, 24 bp, Artificial sequence
  SiRNA target sequence
aattactttcaggtgtccacatac

SEQ ID NO: 113390 - DNA, 24 bp, Artificial sequence
  SiRNA target sequence
attactttcaggtgtccacatact

SEQ ID NO: 113391 - DNA, 24 bp, Artificial sequence
  SiRNA target sequence
ttactttcaggtgtccacatacta

SEQ ID NO: 113392 - DNA, 24 bp, Artificial sequence
  SiRNA target sequence
tactttcaggtgtccacatactat

SEQ ID NO: 113393 - DNA, 24 bp, Artificial sequence
  SiRNA target sequence
actttcaggtgtccacatactata

SEQ ID NO: 113394 - DNA, 24 bp, Artificial sequence
  SiRNA target sequence
ctttcaggtgtccacatactataa

SEQ ID NO: 113395 - DNA, 24 bp, Artificial sequence
  SiRNA target sequence
tttcaggtgtccacatactataat

SEQ ID NO: 113396 - DNA, 24 bp, Artificial sequence
  SiRNA target sequence
ttcaggtgtccacatactataatg

SEQ ID NO: 113397 - DNA, 24 bp, Artificial sequence
  SiRNA target sequence
tcaggtgtccacatactataatga

SEQ ID NO: 113398 - DNA, 24 bp, Artificial sequence
  SiRNA target sequence
caggtgtccacatactataatgat

SEQ ID NO: 113399 - DNA, 24 bp, Artificial sequence
  SiRNA target sequence
aggtgtccacatactataatgatt

SEQ ID NO: 113400 - DNA, 24 bp, Artificial sequence
  SiRNA target sequence
ggtgtccacatactataatgatta

SEQ ID NO: 113401 - DNA, 24 bp, Artificial sequence
  SiRNA target sequence
gtgtccacatactataatgattat

SEQ ID NO: 113402 - DNA, 24 bp, Artificial sequence
  SiRNA target sequence
tgtccacatactataatgattatt

SEQ ID NO: 113403 - DNA, 24 bp, Artificial sequence
  SiRNA target sequence
gtccacatactataatgattattt

SEQ ID NO: 113404 - DNA, 24 bp, Artificial sequence
  SiRNA target sequence
tccacatactataatgattatttt

SEQ ID NO: 113405 - DNA, 24 bp, Artificial sequence
  SiRNA target sequence
ccacatactataatgattattttc

SEQ ID NO: 113406 - DNA, 24 bp, Artificial sequence
  SiRNA target sequence
cacatactataatgattattttca

SEQ ID NO: 113407 - DNA, 24 bp, Artificial sequence
  SiRNA target sequence
acatactataatgattattttcac

SEQ ID NO: 113408 - DNA, 24 bp, Artificial sequence
  SiRNA target sequence
catactataatgattattttcaca

SEQ ID NO: 113409 - DNA, 24 bp, Artificial sequence
  SiRNA target sequence
atactataatgattattttcacat

SEQ ID NO: 113410 - DNA, 24 bp, Artificial sequence
  SiRNA target sequence
tactataatgattattttcacata

SEQ ID NO: 113411 - DNA, 24 bp, Artificial sequence
  SiRNA target sequence
actataatgattattttcacatac

SEQ ID NO: 113412 - DNA, 24 bp, Artificial sequence
  SiRNA target sequence
ctataatgattattttcacataca

SEQ ID NO: 113413 - DNA, 24 bp, Artificial sequence
  SiRNA target sequence
tataatgattattttcacatacat

SEQ ID NO: 113414 - DNA, 24 bp, Artificial sequence
  SiRNA target sequence
ataatgattattttcacatacata

SEQ ID NO: 113415 - DNA, 24 bp, Artificial sequence
  SiRNA target sequence
taatgattattttcacatacataa

SEQ ID NO: 113416 - DNA, 24 bp, Artificial sequence
  SiRNA target sequence
aatgattattttcacatacataaa

SEQ ID NO: 113417 - DNA, 24 bp, Artificial sequence
  SiRNA target sequence
atgattattttcacatacataaac

SEQ ID NO: 113418 - DNA, 24 bp, Artificial sequence
  SiRNA target sequence
tgattattttcacatacataaacc

SEQ ID NO: 113419 - DNA, 24 bp, Artificial sequence
  SiRNA target sequence
gattattttcacatacataaacca

SEQ ID NO: 113420 - DNA, 24 bp, Artificial sequence
  SiRNA target sequence
attattttcacatacataaaccac

SEQ ID NO: 113421 - DNA, 24 bp, Artificial sequence
  SiRNA target sequence
ttattttcacatacataaaccaca

SEQ ID NO: 113422 - DNA, 24 bp, Artificial sequence
  SiRNA target sequence
tattttcacatacataaaccacag

SEQ ID NO: 113423 - DNA, 24 bp, Artificial sequence
  SiRNA target sequence
attttcacatacataaaccacagg

SEQ ID NO: 113424 - DNA, 24 bp, Artificial sequence
  SiRNA target sequence
ttttcacatacataaaccacagga

SEQ ID NO: 113425 - DNA, 24 bp, Artificial sequence
  SiRNA target sequence
tttcacatacataaaccacaggaa

SEQ ID NO: 113426 - DNA, 24 bp, Artificial sequence
  SiRNA target sequence
ttcacatacataaaccacaggaag

SEQ ID NO: 113427 - DNA, 24 bp, Artificial sequence
  SiRNA target sequence
tcacatacataaaccacaggaagt

SEQ ID NO: 113428 - DNA, 24 bp, Artificial sequence
  SiRNA target sequence
cacatacataaaccacaggaagtt

SEQ ID NO: 113429 - DNA, 24 bp, Artificial sequence
  SiRNA target sequence
acatacataaaccacaggaagttt

SEQ ID NO: 113430 - DNA, 24 bp, Artificial sequence
  SiRNA target sequence
catacataaaccacaggaagtttc

SEQ ID NO: 113431 - DNA, 24 bp, Artificial sequence
  SiRNA target sequence
atacataaaccacaggaagtttcc

SEQ ID NO: 113432 - DNA, 24 bp, Artificial sequence
  SiRNA target sequence
tacataaaccacaggaagtttcca

SEQ ID NO: 113433 - DNA, 24 bp, Artificial sequence
  SiRNA target sequence
acataaaccacaggaagtttccat

SEQ ID NO: 113434 - DNA, 24 bp, Artificial sequence
  SiRNA target sequence
cataaaccacaggaagtttccata

SEQ ID NO: 113435 - DNA, 24 bp, Artificial sequence
  SiRNA target sequence
ataaaccacaggaagtttccataa

SEQ ID NO: 113436 - DNA, 24 bp, Artificial sequence
  SiRNA target sequence
taaaccacaggaagtttccataat

SEQ ID NO: 113437 - DNA, 24 bp, Artificial sequence
  SiRNA target sequence
aaaccacaggaagtttccataatg

SEQ ID NO: 113438 - DNA, 24 bp, Artificial sequence
  SiRNA target sequence
aaccacaggaagtttccataatgc

SEQ ID NO: 113439 - DNA, 24 bp, Artificial sequence
  SiRNA target sequence
accacaggaagtttccataatgca

SEQ ID NO: 113440 - DNA, 24 bp, Artificial sequence
  SiRNA target sequence
ccacaggaagtttccataatgcag

SEQ ID NO: 113441 - DNA, 24 bp, Artificial sequence
  SiRNA target sequence
cacaggaagtttccataatgcagc

SEQ ID NO: 113442 - DNA, 24 bp, Artificial sequence
  SiRNA target sequence
acaggaagtttccataatgcagcc

SEQ ID NO: 113443 - DNA, 24 bp, Artificial sequence
  SiRNA target sequence
caggaagtttccataatgcagcca

SEQ ID NO: 113444 - DNA, 24 bp, Artificial sequence
  SiRNA target sequence
aggaagtttccataatgcagccat

SEQ ID NO: 113445 - DNA, 24 bp, Artificial sequence
  SiRNA target sequence
ggaagtttccataatgcagccata

SEQ ID NO: 113446 - DNA, 24 bp, Artificial sequence
  SiRNA target sequence
gaagtttccataatgcagccatat

SEQ ID NO: 113447 - DNA, 24 bp, Artificial sequence
  SiRNA target sequence
aagtttccataatgcagccatatt

SEQ ID NO: 113448 - DNA, 24 bp, Artificial sequence
  SiRNA target sequence
agtttccataatgcagccatattg

SEQ ID NO: 113449 - DNA, 24 bp, Artificial sequence
  SiRNA target sequence
gtttccataatgcagccatattga

SEQ ID NO: 113450 - DNA, 24 bp, Artificial sequence
  SiRNA target sequence
tttccataatgcagccatattgaa

SEQ ID NO: 113451 - DNA, 24 bp, Artificial sequence
  SiRNA target sequence
ttccataatgcagccatattgaac

SEQ ID NO: 113452 - DNA, 24 bp, Artificial sequence
  SiRNA target sequence
tccataatgcagccatattgaacg

SEQ ID NO: 113453 - DNA, 24 bp, Artificial sequence
  SiRNA target sequence
ccataatgcagccatattgaacga

SEQ ID NO: 113454 - DNA, 24 bp, Artificial sequence
  SiRNA target sequence
cataatgcagccatattgaacgac

SEQ ID NO: 113455 - DNA, 24 bp, Artificial sequence
  SiRNA target sequence
ataatgcagccatattgaacgact

SEQ ID NO: 113456 - DNA, 24 bp, Artificial sequence
  SiRNA target sequence
taatgcagccatattgaacgactc

SEQ ID NO: 113457 - DNA, 24 bp, Artificial sequence
  SiRNA target sequence
aatgcagccatattgaacgactcc

SEQ ID NO: 113458 - DNA, 24 bp, Artificial sequence
  SiRNA target sequence
atgcagccatattgaacgactccc

SEQ ID NO: 113459 - DNA, 24 bp, Artificial sequence
  SiRNA target sequence
tgcagccatattgaacgactccca

SEQ ID NO: 113460 - DNA, 24 bp, Artificial sequence
  SiRNA target sequence
gcagccatattgaacgactcccag

SEQ ID NO: 113461 - DNA, 24 bp, Artificial sequence
  SiRNA target sequence
cagccatattgaacgactcccaga

SEQ ID NO: 113462 - DNA, 24 bp, Artificial sequence
  SiRNA target sequence
agccatattgaacgactcccagac

SEQ ID NO: 113463 - DNA, 24 bp, Artificial sequence
  SiRNA target sequence
gccatattgaacgactcccagacc

SEQ ID NO: 113464 - DNA, 24 bp, Artificial sequence
  SiRNA target sequence
ccatattgaacgactcccagacct

SEQ ID NO: 113465 - DNA, 24 bp, Artificial sequence
  SiRNA target sequence
catattgaacgactcccagacctg

SEQ ID NO: 113466 - DNA, 24 bp, Artificial sequence
  SiRNA target sequence
atattgaacgactcccagacctgt

SEQ ID NO: 113467 - DNA, 24 bp, Artificial sequence
  SiRNA target sequence
tattgaacgactcccagacctgtc

SEQ ID NO: 113468 - DNA, 24 bp, Artificial sequence
  SiRNA target sequence
attgaacgactcccagacctgtcc

SEQ ID NO: 113469 - DNA, 24 bp, Artificial sequence
  SiRNA target sequence
ttgaacgactcccagacctgtccc

SEQ ID NO: 113470 - DNA, 24 bp, Artificial sequence
  SiRNA target sequence
tgaacgactcccagacctgtccct

SEQ ID NO: 113471 - DNA, 24 bp, Artificial sequence
  SiRNA target sequence
gaacgactcccagacctgtccctg

SEQ ID NO: 113472 - DNA, 24 bp, Artificial sequence
  SiRNA target sequence
aacgactcccagacctgtccctga

SEQ ID NO: 113473 - DNA, 24 bp, Artificial sequence
  SiRNA target sequence
acgactcccagacctgtccctgat

SEQ ID NO: 113474 - DNA, 24 bp, Artificial sequence
  SiRNA target sequence
cgactcccagacctgtccctgatt

SEQ ID NO: 113475 - DNA, 24 bp, Artificial sequence
  SiRNA target sequence
gactcccagacctgtccctgattt

SEQ ID NO: 113476 - DNA, 24 bp, Artificial sequence
  SiRNA target sequence
actcccagacctgtccctgatttg

SEQ ID NO: 113477 - DNA, 24 bp, Artificial sequence
  SiRNA target sequence
ctcccagacctgtccctgatttgc

SEQ ID NO: 113478 - DNA, 24 bp, Artificial sequence
  SiRNA target sequence
tcccagacctgtccctgatttgca

SEQ ID NO: 113479 - DNA, 24 bp, Artificial sequence
  SiRNA target sequence
cccagacctgtccctgatttgcag

SEQ ID NO: 113480 - DNA, 24 bp, Artificial sequence
  SiRNA target sequence
ccagacctgtccctgatttgcagc

SEQ ID NO: 113481 - DNA, 24 bp, Artificial sequence
  SiRNA target sequence
cagacctgtccctgatttgcagca

SEQ ID NO: 113482 - DNA, 24 bp, Artificial sequence
  SiRNA target sequence
agacctgtccctgatttgcagcac

SEQ ID NO: 113483 - DNA, 24 bp, Artificial sequence
  SiRNA target sequence
gacctgtccctgatttgcagcacc

SEQ ID NO: 113484 - DNA, 24 bp, Artificial sequence
  SiRNA target sequence
acctgtccctgatttgcagcacca

SEQ ID NO: 113485 - DNA, 24 bp, Artificial sequence
  SiRNA target sequence
cctgtccctgatttgcagcaccat

SEQ ID NO: 113486 - DNA, 24 bp, Artificial sequence
  SiRNA target sequence
ctgtccctgatttgcagcaccatc

SEQ ID NO: 113487 - DNA, 24 bp, Artificial sequence
  SiRNA target sequence
tgtccctgatttgcagcaccatcc

SEQ ID NO: 113488 - DNA, 24 bp, Artificial sequence
  SiRNA target sequence
gtccctgatttgcagcaccatccc

SEQ ID NO: 113489 - DNA, 24 bp, Artificial sequence
  SiRNA target sequence
tccctgatttgcagcaccatcccc

SEQ ID NO: 113490 - DNA, 24 bp, Artificial sequence
  SiRNA target sequence
ccctgatttgcagcaccatccccg

SEQ ID NO: 113491 - DNA, 24 bp, Artificial sequence
  SiRNA target sequence
cctgatttgcagcaccatccccga

SEQ ID NO: 113492 - DNA, 24 bp, Artificial sequence
  SiRNA target sequence
ctgatttgcagcaccatccccgaa

SEQ ID NO: 113493 - DNA, 24 bp, Artificial sequence
  SiRNA target sequence
tgatttgcagcaccatccccgaaa

SEQ ID NO: 113494 - DNA, 24 bp, Artificial sequence
  SiRNA target sequence
gatttgcagcaccatccccgaaaa

SEQ ID NO: 113495 - DNA, 24 bp, Artificial sequence
  SiRNA target sequence
atttgcagcaccatccccgaaaaa

SEQ ID NO: 113496 - DNA, 24 bp, Artificial sequence
  SiRNA target sequence
tttgcagcaccatccccgaaaaat

SEQ ID NO: 113497 - DNA, 24 bp, Artificial sequence
  SiRNA target sequence
ttgcagcaccatccccgaaaaata

SEQ ID NO: 113498 - DNA, 24 bp, Artificial sequence
  SiRNA target sequence
tgcagcaccatccccgaaaaatac

SEQ ID NO: 113499 - DNA, 24 bp, Artificial sequence
  SiRNA target sequence
gcagcaccatccccgaaaaataca

SEQ ID NO: 113500 - DNA, 24 bp, Artificial sequence
  SiRNA target sequence
cagcaccatccccgaaaaatacaa

SEQ ID NO: 113501 - DNA, 24 bp, Artificial sequence
  SiRNA target sequence
agcaccatccccgaaaaatacaaa

SEQ ID NO: 113502 - DNA, 24 bp, Artificial sequence
  SiRNA target sequence
gcaccatccccgaaaaatacaaat

SEQ ID NO: 113503 - DNA, 24 bp, Artificial sequence
  SiRNA target sequence
caccatccccgaaaaatacaaatg

SEQ ID NO: 113504 - DNA, 24 bp, Artificial sequence
  SiRNA target sequence
accatccccgaaaaatacaaatgc

SEQ ID NO: 113505 - DNA, 24 bp, Artificial sequence
  SiRNA target sequence
ccatccccgaaaaatacaaatgct

SEQ ID NO: 113506 - DNA, 24 bp, Artificial sequence
  SiRNA target sequence
catccccgaaaaatacaaatgcta

SEQ ID NO: 113507 - DNA, 24 bp, Artificial sequence
  SiRNA target sequence
atccccgaaaaatacaaatgctac

SEQ ID NO: 113508 - DNA, 24 bp, Artificial sequence
  SiRNA target sequence
tccccgaaaaatacaaatgctaca

SEQ ID NO: 113509 - DNA, 24 bp, Artificial sequence
  SiRNA target sequence
ccccgaaaaatacaaatgctacat

SEQ ID NO: 113510 - DNA, 24 bp, Artificial sequence
  SiRNA target sequence
cccgaaaaatacaaatgctacatt

SEQ ID NO: 113511 - DNA, 24 bp, Artificial sequence
  SiRNA target sequence
ccgaaaaatacaaatgctacattt

SEQ ID NO: 113512 - DNA, 24 bp, Artificial sequence
  SiRNA target sequence
cgaaaaatacaaatgctacatttt

SEQ ID NO: 113513 - DNA, 24 bp, Artificial sequence
  SiRNA target sequence
gaaaaatacaaatgctacattttt

SEQ ID NO: 113514 - DNA, 24 bp, Artificial sequence
  SiRNA target sequence
aaaaatacaaatgctacatttttt

SEQ ID NO: 113515 - DNA, 24 bp, Artificial sequence
  SiRNA target sequence
aaaatacaaatgctacatttttta

SEQ ID NO: 113516 - DNA, 24 bp, Artificial sequence
  SiRNA target sequence
aaatacaaatgctacattttttac

SEQ ID NO: 113517 - DNA, 24 bp, Artificial sequence
  SiRNA target sequence
aatacaaatgctacattttttact

SEQ ID NO: 113518 - DNA, 24 bp, Artificial sequence
  SiRNA target sequence
atacaaatgctacattttttactt

SEQ ID NO: 113519 - DNA, 24 bp, Artificial sequence
  SiRNA target sequence
tacaaatgctacattttttacttt

SEQ ID NO: 113520 - DNA, 24 bp, Artificial sequence
  SiRNA target sequence
acaaatgctacattttttactttt

SEQ ID NO: 113521 - DNA, 24 bp, Artificial sequence
  SiRNA target sequence
caaatgctacattttttacttttt

SEQ ID NO: 113522 - DNA, 24 bp, Artificial sequence
  SiRNA target sequence
aaatgctacattttttactttttt

SEQ ID NO: 113523 - DNA, 24 bp, Artificial sequence
  SiRNA target sequence
aatgctacattttttactttttta

SEQ ID NO: 113524 - DNA, 24 bp, Artificial sequence
  SiRNA target sequence
atgctacattttttacttttttat

SEQ ID NO: 113525 - DNA, 24 bp, Artificial sequence
  SiRNA target sequence
tgctacattttttacttttttata

SEQ ID NO: 113526 - DNA, 24 bp, Artificial sequence
  SiRNA target sequence
gctacattttttacttttttatat

SEQ ID NO: 113527 - DNA, 24 bp, Artificial sequence
  SiRNA target sequence
ctacattttttacttttttatatt

SEQ ID NO: 113528 - DNA, 24 bp, Artificial sequence
  SiRNA target sequence
tacattttttacttttttatattg

SEQ ID NO: 113529 - DNA, 24 bp, Artificial sequence
  SiRNA target sequence
acattttttacttttttatattgt

SEQ ID NO: 113530 - DNA, 24 bp, Artificial sequence
  SiRNA target sequence
cattttttacttttttatattgta

SEQ ID NO: 113531 - DNA, 24 bp, Artificial sequence
  SiRNA target sequence
attttttacttttttatattgtaa

SEQ ID NO: 113532 - DNA, 24 bp, Artificial sequence
  SiRNA target sequence
ttttttacttttttatattgtaaa

SEQ ID NO: 113533 - DNA, 24 bp, Artificial sequence
  SiRNA target sequence
tttttacttttttatattgtaaag

SEQ ID NO: 113534 - DNA, 24 bp, Artificial sequence
  SiRNA target sequence
ttttacttttttatattgtaaagc

SEQ ID NO: 113535 - DNA, 24 bp, Artificial sequence
  SiRNA target sequence
tttacttttttatattgtaaagca

SEQ ID NO: 113536 - DNA, 24 bp, Artificial sequence
  SiRNA target sequence
ttacttttttatattgtaaagcaa

SEQ ID NO: 113537 - DNA, 24 bp, Artificial sequence
  SiRNA target sequence
tacttttttatattgtaaagcaaa

SEQ ID NO: 113538 - DNA, 24 bp, Artificial sequence
  SiRNA target sequence
acttttttatattgtaaagcaaat

SEQ ID NO: 113539 - DNA, 24 bp, Artificial sequence
  SiRNA target sequence
cttttttatattgtaaagcaaatc

SEQ ID NO: 113540 - DNA, 24 bp, Artificial sequence
  SiRNA target sequence
ttttttatattgtaaagcaaatcc

SEQ ID NO: 113541 - DNA, 24 bp, Artificial sequence
  SiRNA target sequence
tttttatattgtaaagcaaatccc

SEQ ID NO: 113542 - DNA, 24 bp, Artificial sequence
  SiRNA target sequence
ttttatattgtaaagcaaatccca

SEQ ID NO: 113543 - DNA, 24 bp, Artificial sequence
  SiRNA target sequence
tttatattgtaaagcaaatcccaa

SEQ ID NO: 113544 - DNA, 24 bp, Artificial sequence
  SiRNA target sequence
ttatattgtaaagcaaatcccaat

SEQ ID NO: 113545 - DNA, 24 bp, Artificial sequence
  SiRNA target sequence
tatattgtaaagcaaatcccaatc

SEQ ID NO: 113546 - DNA, 24 bp, Artificial sequence
  SiRNA target sequence
atattgtaaagcaaatcccaatcc

SEQ ID NO: 113547 - DNA, 24 bp, Artificial sequence
  SiRNA target sequence
tattgtaaagcaaatcccaatcct

SEQ ID NO: 113548 - DNA, 24 bp, Artificial sequence
  SiRNA target sequence
attgtaaagcaaatcccaatcctg

SEQ ID NO: 113549 - DNA, 24 bp, Artificial sequence
  SiRNA target sequence
ttgtaaagcaaatcccaatcctgt

SEQ ID NO: 113550 - DNA, 24 bp, Artificial sequence
  SiRNA target sequence
tgtaaagcaaatcccaatcctgta

SEQ ID NO: 113551 - DNA, 24 bp, Artificial sequence
  SiRNA target sequence
gtaaagcaaatcccaatcctgtac

SEQ ID NO: 113552 - DNA, 24 bp, Artificial sequence
  SiRNA target sequence
taaagcaaatcccaatcctgtacc

SEQ ID NO: 113553 - DNA, 24 bp, Artificial sequence
  SiRNA target sequence
aaagcaaatcccaatcctgtacca

SEQ ID NO: 113554 - DNA, 24 bp, Artificial sequence
  SiRNA target sequence
aagcaaatcccaatcctgtaccaa

SEQ ID NO: 113555 - DNA, 24 bp, Artificial sequence
  SiRNA target sequence
agcaaatcccaatcctgtaccaag

SEQ ID NO: 113556 - DNA, 24 bp, Artificial sequence
  SiRNA target sequence
gcaaatcccaatcctgtaccaagc

SEQ ID NO: 113557 - DNA, 24 bp, Artificial sequence
  SiRNA target sequence
caaatcccaatcctgtaccaagcg

SEQ ID NO: 113558 - DNA, 24 bp, Artificial sequence
  SiRNA target sequence
aaatcccaatcctgtaccaagcga

SEQ ID NO: 113559 - DNA, 24 bp, Artificial sequence
  SiRNA target sequence
aatcccaatcctgtaccaagcgat

SEQ ID NO: 113560 - DNA, 24 bp, Artificial sequence
  SiRNA target sequence
atcccaatcctgtaccaagcgata

SEQ ID NO: 113561 - DNA, 24 bp, Artificial sequence
  SiRNA target sequence
tcccaatcctgtaccaagcgatac

SEQ ID NO: 113562 - DNA, 24 bp, Artificial sequence
  SiRNA target sequence
cccaatcctgtaccaagcgatacc

SEQ ID NO: 113563 - DNA, 24 bp, Artificial sequence
  SiRNA target sequence
ccaatcctgtaccaagcgatacct

SEQ ID NO: 113564 - DNA, 24 bp, Artificial sequence
  SiRNA target sequence
caatcctgtaccaagcgatacctg

SEQ ID NO: 113565 - DNA, 24 bp, Artificial sequence
  SiRNA target sequence
aatcctgtaccaagcgatacctgc

SEQ ID NO: 113566 - DNA, 24 bp, Artificial sequence
  SiRNA target sequence
atcctgtaccaagcgatacctgcg

SEQ ID NO: 113567 - DNA, 24 bp, Artificial sequence
  SiRNA target sequence
tcctgtaccaagcgatacctgcgc

SEQ ID NO: 113568 - DNA, 24 bp, Artificial sequence
  SiRNA target sequence
cctgtaccaagcgatacctgcgca

SEQ ID NO: 113569 - DNA, 24 bp, Artificial sequence
  SiRNA target sequence
ctgtaccaagcgatacctgcgcac

SEQ ID NO: 113570 - DNA, 24 bp, Artificial sequence
  SiRNA target sequence
tgtaccaagcgatacctgcgcacc

SEQ ID NO: 113571 - DNA, 24 bp, Artificial sequence
  SiRNA target sequence
gtaccaagcgatacctgcgcacct

SEQ ID NO: 113572 - DNA, 24 bp, Artificial sequence
  SiRNA target sequence
taccaagcgatacctgcgcaccta

SEQ ID NO: 113573 - DNA, 24 bp, Artificial sequence
  SiRNA target sequence
accaagcgatacctgcgcacctac

SEQ ID NO: 113574 - DNA, 24 bp, Artificial sequence
  SiRNA target sequence
ccaagcgatacctgcgcacctact

SEQ ID NO: 113575 - DNA, 24 bp, Artificial sequence
  SiRNA target sequence
caagcgatacctgcgcacctacta

SEQ ID NO: 113576 - DNA, 24 bp, Artificial sequence
  SiRNA target sequence
aagcgatacctgcgcacctactat

SEQ ID NO: 113577 - DNA, 24 bp, Artificial sequence
  SiRNA target sequence
agcgatacctgcgcacctactata

SEQ ID NO: 113578 - DNA, 24 bp, Artificial sequence
  SiRNA target sequence
gcgatacctgcgcacctactatac

SEQ ID NO: 113579 - DNA, 24 bp, Artificial sequence
  SiRNA target sequence
cgatacctgcgcacctactatacc

SEQ ID NO: 113580 - DNA, 24 bp, Artificial sequence
  SiRNA target sequence
gatacctgcgcacctactataccg

SEQ ID NO: 113581 - DNA, 24 bp, Artificial sequence
  SiRNA target sequence
atacctgcgcacctactataccgt

SEQ ID NO: 113582 - DNA, 24 bp, Artificial sequence
  SiRNA target sequence
tacctgcgcacctactataccgtg

SEQ ID NO: 113583 - DNA, 24 bp, Artificial sequence
  SiRNA target sequence
acctgcgcacctactataccgtgt

SEQ ID NO: 113584 - DNA, 24 bp, Artificial sequence
  SiRNA target sequence
cctgcgcacctactataccgtgtc

SEQ ID NO: 113585 - DNA, 24 bp, Artificial sequence
  SiRNA target sequence
ctgcgcacctactataccgtgtcc

SEQ ID NO: 113586 - DNA, 24 bp, Artificial sequence
  SiRNA target sequence
tgcgcacctactataccgtgtccc

SEQ ID NO: 113587 - DNA, 24 bp, Artificial sequence
  SiRNA target sequence
gcgcacctactataccgtgtcccc

SEQ ID NO: 113588 - DNA, 24 bp, Artificial sequence
  SiRNA target sequence
cgcacctactataccgtgtccccc

SEQ ID NO: 113589 - DNA, 24 bp, Artificial sequence
  SiRNA target sequence
gcacctactataccgtgtccccca

SEQ ID NO: 113590 - DNA, 24 bp, Artificial sequence
  SiRNA target sequence
cacctactataccgtgtcccccat

SEQ ID NO: 113591 - DNA, 24 bp, Artificial sequence
  SiRNA target sequence
acctactataccgtgtcccccata

SEQ ID NO: 113592 - DNA, 24 bp, Artificial sequence
  SiRNA target sequence
cctactataccgtgtcccccataa

SEQ ID NO: 113593 - DNA, 24 bp, Artificial sequence
  SiRNA target sequence
ctactataccgtgtcccccataaa

SEQ ID NO: 113594 - DNA, 24 bp, Artificial sequence
  SiRNA target sequence
tactataccgtgtcccccataaaa

SEQ ID NO: 113595 - DNA, 24 bp, Artificial sequence
  SiRNA target sequence
actataccgtgtcccccataaaat

SEQ ID NO: 113596 - DNA, 24 bp, Artificial sequence
  SiRNA target sequence
ctataccgtgtcccccataaaatt

SEQ ID NO: 113597 - DNA, 24 bp, Artificial sequence
  SiRNA target sequence
tataccgtgtcccccataaaattg

SEQ ID NO: 113598 - DNA, 24 bp, Artificial sequence
  SiRNA target sequence
ataccgtgtcccccataaaattgg

SEQ ID NO: 113599 - DNA, 24 bp, Artificial sequence
  SiRNA target sequence
taccgtgtcccccataaaattggt

SEQ ID NO: 113600 - DNA, 24 bp, Artificial sequence
  SiRNA target sequence
accgtgtcccccataaaattggtc

SEQ ID NO: 113601 - DNA, 24 bp, Artificial sequence
  SiRNA target sequence
ccgtgtcccccataaaattggtca

SEQ ID NO: 113602 - DNA, 24 bp, Artificial sequence
  SiRNA target sequence
cgtgtcccccataaaattggtcat

SEQ ID NO: 113603 - DNA, 24 bp, Artificial sequence
  SiRNA target sequence
gtgtcccccataaaattggtcatt

SEQ ID NO: 113604 - DNA, 24 bp, Artificial sequence
  SiRNA target sequence
tgtcccccataaaattggtcatta

SEQ ID NO: 113605 - DNA, 24 bp, Artificial sequence
  SiRNA target sequence
gtcccccataaaattggtcattat

SEQ ID NO: 113606 - DNA, 24 bp, Artificial sequence
  SiRNA target sequence
tcccccataaaattggtcattata

SEQ ID NO: 113607 - DNA, 24 bp, Artificial sequence
  SiRNA target sequence
cccccataaaattggtcattatac

SEQ ID NO: 113608 - DNA, 24 bp, Artificial sequence
  SiRNA target sequence
ccccataaaattggtcattataca

SEQ ID NO: 113609 - DNA, 24 bp, Artificial sequence
  SiRNA target sequence
cccataaaattggtcattatacaa

SEQ ID NO: 113610 - DNA, 24 bp, Artificial sequence
  SiRNA target sequence
ccataaaattggtcattatacaaa

SEQ ID NO: 113611 - DNA, 24 bp, Artificial sequence
  SiRNA target sequence
cataaaattggtcattatacaaat

SEQ ID NO: 113612 - DNA, 24 bp, Artificial sequence
  SiRNA target sequence
ataaaattggtcattatacaaatg

SEQ ID NO: 113613 - DNA, 24 bp, Artificial sequence
  SiRNA target sequence
taaaattggtcattatacaaatgc

SEQ ID NO: 113614 - DNA, 24 bp, Artificial sequence
  SiRNA target sequence
aaaattggtcattatacaaatgca

SEQ ID NO: 113615 - DNA, 24 bp, Artificial sequence
  SiRNA target sequence
aaattggtcattatacaaatgcat

SEQ ID NO: 113616 - DNA, 24 bp, Artificial sequence
  SiRNA target sequence
aattggtcattatacaaatgcatc

SEQ ID NO: 113617 - DNA, 24 bp, Artificial sequence
  SiRNA target sequence
attggtcattatacaaatgcatcg

SEQ ID NO: 113618 - DNA, 24 bp, Artificial sequence
  SiRNA target sequence
ttggtcattatacaaatgcatcga

SEQ ID NO: 113619 - DNA, 24 bp, Artificial sequence
  SiRNA target sequence
tggtcattatacaaatgcatcgat

SEQ ID NO: 113620 - DNA, 24 bp, Artificial sequence
  SiRNA target sequence
ggtcattatacaaatgcatcgatc

SEQ ID NO: 113621 - DNA, 24 bp, Artificial sequence
  SiRNA target sequence
gtcattatacaaatgcatcgatcc

SEQ ID NO: 113622 - DNA, 24 bp, Artificial sequence
  SiRNA target sequence
tcattatacaaatgcatcgatcct

SEQ ID NO: 113623 - DNA, 24 bp, Artificial sequence
  SiRNA target sequence
cattatacaaatgcatcgatcctc

SEQ ID NO: 113624 - DNA, 24 bp, Artificial sequence
  SiRNA target sequence
attatacaaatgcatcgatcctcc

SEQ ID NO: 113625 - DNA, 24 bp, Artificial sequence
  SiRNA target sequence
ttatacaaatgcatcgatcctcct

SEQ ID NO: 113626 - DNA, 24 bp, Artificial sequence
  SiRNA target sequence
tatacaaatgcatcgatcctcctt

SEQ ID NO: 113627 - DNA, 24 bp, Artificial sequence
  SiRNA target sequence
atacaaatgcatcgatcctccttt

SEQ ID NO: 113628 - DNA, 24 bp, Artificial sequence
  SiRNA target sequence
tacaaatgcatcgatcctcctttt

SEQ ID NO: 113629 - DNA, 24 bp, Artificial sequence
  SiRNA target sequence
acaaatgcatcgatcctccttttc

SEQ ID NO: 113630 - DNA, 24 bp, Artificial sequence
  SiRNA target sequence
caaatgcatcgatcctccttttcc

SEQ ID NO: 113631 - DNA, 24 bp, Artificial sequence
  SiRNA target sequence
aaatgcatcgatcctccttttcct

SEQ ID NO: 113632 - DNA, 24 bp, Artificial sequence
  SiRNA target sequence
aatgcatcgatcctccttttcctt

SEQ ID NO: 113633 - DNA, 24 bp, Artificial sequence
  SiRNA target sequence
atgcatcgatcctccttttccttt

SEQ ID NO: 113634 - DNA, 24 bp, Artificial sequence
  SiRNA target sequence
tgcatcgatcctccttttcctttg

SEQ ID NO: 113635 - DNA, 24 bp, Artificial sequence
  SiRNA target sequence
gcatcgatcctccttttcctttgc

SEQ ID NO: 113636 - DNA, 24 bp, Artificial sequence
  SiRNA target sequence
catcgatcctccttttcctttgca

SEQ ID NO: 113637 - DNA, 24 bp, Artificial sequence
  SiRNA target sequence
atcgatcctccttttcctttgcaa

SEQ ID NO: 113638 - DNA, 24 bp, Artificial sequence
  SiRNA target sequence
tcgatcctccttttcctttgcaat

SEQ ID NO: 113639 - DNA, 24 bp, Artificial sequence
  SiRNA target sequence
cgatcctccttttcctttgcaatt

SEQ ID NO: 113640 - DNA, 24 bp, Artificial sequence
  SiRNA target sequence
gatcctccttttcctttgcaatta

SEQ ID NO: 113641 - DNA, 24 bp, Artificial sequence
  SiRNA target sequence
atcctccttttcctttgcaattac

SEQ ID NO: 113642 - DNA, 24 bp, Artificial sequence
  SiRNA target sequence
tcctccttttcctttgcaattacc

SEQ ID NO: 113643 - DNA, 24 bp, Artificial sequence
  SiRNA target sequence
cctccttttcctttgcaattacca

SEQ ID NO: 113644 - DNA, 24 bp, Artificial sequence
  SiRNA target sequence
ctccttttcctttgcaattaccaa

SEQ ID NO: 113645 - DNA, 24 bp, Artificial sequence
  SiRNA target sequence
tccttttcctttgcaattaccaat

SEQ ID NO: 113646 - DNA, 24 bp, Artificial sequence
  SiRNA target sequence
ccttttcctttgcaattaccaata

SEQ ID NO: 113647 - DNA, 24 bp, Artificial sequence
  SiRNA target sequence
cttttcctttgcaattaccaatag

SEQ ID NO: 113648 - DNA, 24 bp, Artificial sequence
  SiRNA target sequence
ttttcctttgcaattaccaatagc

SEQ ID NO: 113649 - DNA, 24 bp, Artificial sequence
  SiRNA target sequence
tttcctttgcaattaccaatagcc

SEQ ID NO: 113650 - DNA, 24 bp, Artificial sequence
  SiRNA target sequence
ttcctttgcaattaccaatagcct

SEQ ID NO: 113651 - DNA, 24 bp, Artificial sequence
  SiRNA target sequence
tcctttgcaattaccaatagcctt

SEQ ID NO: 113652 - DNA, 24 bp, Artificial sequence
  SiRNA target sequence
cctttgcaattaccaatagccttt

SEQ ID NO: 113653 - DNA, 24 bp, Artificial sequence
  SiRNA target sequence
ctttgcaattaccaatagcctttc

SEQ ID NO: 113654 - DNA, 24 bp, Artificial sequence
  SiRNA target sequence
tttgcaattaccaatagcctttcc

SEQ ID NO: 113655 - DNA, 24 bp, Artificial sequence
  SiRNA target sequence
ttgcaattaccaatagcctttcct

SEQ ID NO: 113656 - DNA, 24 bp, Artificial sequence
  SiRNA target sequence
tgcaattaccaatagcctttccta

SEQ ID NO: 113657 - DNA, 24 bp, Artificial sequence
  SiRNA target sequence
gcaattaccaatagcctttcctaa

SEQ ID NO: 113658 - DNA, 24 bp, Artificial sequence
  SiRNA target sequence
caattaccaatagcctttcctaat

SEQ ID NO: 113659 - DNA, 24 bp, Artificial sequence
  SiRNA target sequence
aattaccaatagcctttcctaata

SEQ ID NO: 113660 - DNA, 24 bp, Artificial sequence
  SiRNA target sequence
attaccaatagcctttcctaataa

SEQ ID NO: 113661 - DNA, 24 bp, Artificial sequence
  SiRNA target sequence
ttaccaatagcctttcctaataat

SEQ ID NO: 113662 - DNA, 24 bp, Artificial sequence
  SiRNA target sequence
taccaatagcctttcctaataatt

SEQ ID NO: 113663 - DNA, 24 bp, Artificial sequence
  SiRNA target sequence
accaatagcctttcctaataattc

SEQ ID NO: 113664 - DNA, 24 bp, Artificial sequence
  SiRNA target sequence
ccaatagcctttcctaataattcc

SEQ ID NO: 113665 - DNA, 24 bp, Artificial sequence
  SiRNA target sequence
caatagcctttcctaataattccc

SEQ ID NO: 113666 - DNA, 24 bp, Artificial sequence
  SiRNA target sequence
aatagcctttcctaataattcccc

SEQ ID NO: 113667 - DNA, 24 bp, Artificial sequence
  SiRNA target sequence
atagcctttcctaataattcccct

SEQ ID NO: 113668 - DNA, 24 bp, Artificial sequence
  SiRNA target sequence
tagcctttcctaataattccccta

SEQ ID NO: 113669 - DNA, 24 bp, Artificial sequence
  SiRNA target sequence
agcctttcctaataattcccctat

SEQ ID NO: 113670 - DNA, 24 bp, Artificial sequence
  SiRNA target sequence
gcctttcctaataattcccctata

SEQ ID NO: 113671 - DNA, 24 bp, Artificial sequence
  SiRNA target sequence
cctttcctaataattcccctataa

SEQ ID NO: 113672 - DNA, 24 bp, Artificial sequence
  SiRNA target sequence
ctttcctaataattcccctataat

SEQ ID NO: 113673 - DNA, 24 bp, Artificial sequence
  SiRNA target sequence
tttcctaataattcccctataata

SEQ ID NO: 113674 - DNA, 24 bp, Artificial sequence
  SiRNA target sequence
ttcctaataattcccctataatac

SEQ ID NO: 113675 - DNA, 24 bp, Artificial sequence
  SiRNA target sequence
tcctaataattcccctataatact

SEQ ID NO: 113676 - DNA, 24 bp, Artificial sequence
  SiRNA target sequence
cctaataattcccctataatactt

SEQ ID NO: 113677 - DNA, 24 bp, Artificial sequence
  SiRNA target sequence
ctaataattcccctataatacttt

SEQ ID NO: 113678 - DNA, 24 bp, Artificial sequence
  SiRNA target sequence
taataattcccctataatactttc

SEQ ID NO: 113679 - DNA, 24 bp, Artificial sequence
  SiRNA target sequence
aataattcccctataatactttct

SEQ ID NO: 113680 - DNA, 24 bp, Artificial sequence
  SiRNA target sequence
ataattcccctataatactttcta

SEQ ID NO: 113681 - DNA, 24 bp, Artificial sequence
  SiRNA target sequence
taattcccctataatactttctat

SEQ ID NO: 113682 - DNA, 24 bp, Artificial sequence
  SiRNA target sequence
aattcccctataatactttctata

SEQ ID NO: 113683 - DNA, 24 bp, Artificial sequence
  SiRNA target sequence
attcccctataatactttctatac

SEQ ID NO: 113684 - DNA, 24 bp, Artificial sequence
  SiRNA target sequence
ttcccctataatactttctatact

SEQ ID NO: 113685 - DNA, 24 bp, Artificial sequence
  SiRNA target sequence
tcccctataatactttctatactg

SEQ ID NO: 113686 - DNA, 24 bp, Artificial sequence
  SiRNA target sequence
cccctataatactttctatactga

SEQ ID NO: 113687 - DNA, 24 bp, Artificial sequence
  SiRNA target sequence
ccctataatactttctatactgat

SEQ ID NO: 113688 - DNA, 24 bp, Artificial sequence
  SiRNA target sequence
cctataatactttctatactgatt

SEQ ID NO: 113689 - DNA, 24 bp, Artificial sequence
  SiRNA target sequence
ctataatactttctatactgattc

SEQ ID NO: 113690 - DNA, 24 bp, Artificial sequence
  SiRNA target sequence
tataatactttctatactgattcc

SEQ ID NO: 113691 - DNA, 24 bp, Artificial sequence
  SiRNA target sequence
ataatactttctatactgattcca

SEQ ID NO: 113692 - DNA, 24 bp, Artificial sequence
  SiRNA target sequence
taatactttctatactgattccac

SEQ ID NO: 113693 - DNA, 24 bp, Artificial sequence
  SiRNA target sequence
aatactttctatactgattccaca

SEQ ID NO: 113694 - DNA, 24 bp, Artificial sequence
  SiRNA target sequence
atactttctatactgattccacaa

SEQ ID NO: 113695 - DNA, 24 bp, Artificial sequence
  SiRNA target sequence
tactttctatactgattccacaaa

SEQ ID NO: 113696 - DNA, 24 bp, Artificial sequence
  SiRNA target sequence
actttctatactgattccacaaat

SEQ ID NO: 113697 - DNA, 24 bp, Artificial sequence
  SiRNA target sequence
ctttctatactgattccacaaata

SEQ ID NO: 113698 - DNA, 24 bp, Artificial sequence
  SiRNA target sequence
tttctatactgattccacaaataa

SEQ ID NO: 113699 - DNA, 24 bp, Artificial sequence
  SiRNA target sequence
ttctatactgattccacaaataaa

SEQ ID NO: 113700 - DNA, 24 bp, Artificial sequence
  SiRNA target sequence
tctatactgattccacaaataaat

SEQ ID NO: 113701 - DNA, 24 bp, Artificial sequence
  SiRNA target sequence
ctatactgattccacaaataaatg

SEQ ID NO: 113702 - DNA, 24 bp, Artificial sequence
  SiRNA target sequence
tatactgattccacaaataaatgc

SEQ ID NO: 113703 - DNA, 24 bp, Artificial sequence
  SiRNA target sequence
atactgattccacaaataaatgct

SEQ ID NO: 113704 - DNA, 24 bp, Artificial sequence
  SiRNA target sequence
tactgattccacaaataaatgcta

SEQ ID NO: 113705 - DNA, 24 bp, Artificial sequence
  SiRNA target sequence
actgattccacaaataaatgctaa

SEQ ID NO: 113706 - DNA, 24 bp, Artificial sequence
  SiRNA target sequence
ctgattccacaaataaatgctaat

SEQ ID NO: 113707 - DNA, 24 bp, Artificial sequence
  SiRNA target sequence
tgattccacaaataaatgctaatc

SEQ ID NO: 113708 - DNA, 24 bp, Artificial sequence
  SiRNA target sequence
gattccacaaataaatgctaatcc

SEQ ID NO: 113709 - DNA, 24 bp, Artificial sequence
  SiRNA target sequence
attccacaaataaatgctaatcca

SEQ ID NO: 113710 - DNA, 24 bp, Artificial sequence
  SiRNA target sequence
ttccacaaataaatgctaatccat

SEQ ID NO: 113711 - DNA, 24 bp, Artificial sequence
  SiRNA target sequence
tccacaaataaatgctaatccatg

SEQ ID NO: 113712 - DNA, 24 bp, Artificial sequence
  SiRNA target sequence
ccacaaataaatgctaatccatgg

SEQ ID NO: 113713 - DNA, 24 bp, Artificial sequence
  SiRNA target sequence
cacaaataaatgctaatccatggc

SEQ ID NO: 113714 - DNA, 24 bp, Artificial sequence
  SiRNA target sequence
acaaataaatgctaatccatggca

SEQ ID NO: 113715 - DNA, 24 bp, Artificial sequence
  SiRNA target sequence
caaataaatgctaatccatggcat

SEQ ID NO: 113716 - DNA, 24 bp, Artificial sequence
  SiRNA target sequence
aaataaatgctaatccatggcatc

SEQ ID NO: 113717 - DNA, 24 bp, Artificial sequence
  SiRNA target sequence
aataaatgctaatccatggcatct

SEQ ID NO: 113718 - DNA, 24 bp, Artificial sequence
  SiRNA target sequence
ataaatgctaatccatggcatcta

SEQ ID NO: 113719 - DNA, 24 bp, Artificial sequence
  SiRNA target sequence
taaatgctaatccatggcatctat

SEQ ID NO: 113720 - DNA, 24 bp, Artificial sequence
  SiRNA target sequence
aaatgctaatccatggcatctata

SEQ ID NO: 113721 - DNA, 24 bp, Artificial sequence
  SiRNA target sequence
aatgctaatccatggcatctataa

SEQ ID NO: 113722 - DNA, 24 bp, Artificial sequence
  SiRNA target sequence
atgctaatccatggcatctataag

SEQ ID NO: 113723 - DNA, 24 bp, Artificial sequence
  SiRNA target sequence
tgctaatccatggcatctataaga

SEQ ID NO: 113724 - DNA, 24 bp, Artificial sequence
  SiRNA target sequence
gctaatccatggcatctataagat

SEQ ID NO: 113725 - DNA, 24 bp, Artificial sequence
  SiRNA target sequence
ctaatccatggcatctataagatc

SEQ ID NO: 113726 - DNA, 24 bp, Artificial sequence
  SiRNA target sequence
taatccatggcatctataagatcc

SEQ ID NO: 113727 - DNA, 24 bp, Artificial sequence
  SiRNA target sequence
aatccatggcatctataagatcct

SEQ ID NO: 113728 - DNA, 24 bp, Artificial sequence
  SiRNA target sequence
atccatggcatctataagatccta

SEQ ID NO: 113729 - DNA, 24 bp, Artificial sequence
  SiRNA target sequence
tccatggcatctataagatcctat

SEQ ID NO: 113730 - DNA, 24 bp, Artificial sequence
  SiRNA target sequence
ccatggcatctataagatcctatg

SEQ ID NO: 113731 - DNA, 24 bp, Artificial sequence
  SiRNA target sequence
catggcatctataagatcctatga

SEQ ID NO: 113732 - DNA, 24 bp, Artificial sequence
  SiRNA target sequence
atggcatctataagatcctatgac

SEQ ID NO: 113733 - DNA, 24 bp, Artificial sequence
  SiRNA target sequence
tggcatctataagatcctatgact

SEQ ID NO: 113734 - DNA, 24 bp, Artificial sequence
  SiRNA target sequence
ggcatctataagatcctatgactt

SEQ ID NO: 113735 - DNA, 24 bp, Artificial sequence
  SiRNA target sequence
gcatctataagatcctatgacttt

SEQ ID NO: 113736 - DNA, 24 bp, Artificial sequence
  SiRNA target sequence
catctataagatcctatgacttta

SEQ ID NO: 113737 - DNA, 24 bp, Artificial sequence
  SiRNA target sequence
atctataagatcctatgactttat

SEQ ID NO: 113738 - DNA, 24 bp, Artificial sequence
  SiRNA target sequence
tctataagatcctatgactttatc

SEQ ID NO: 113739 - DNA, 24 bp, Artificial sequence
  SiRNA target sequence
ctataagatcctatgactttatca

SEQ ID NO: 113740 - DNA, 24 bp, Artificial sequence
  SiRNA target sequence
tataagatcctatgactttatcat

SEQ ID NO: 113741 - DNA, 24 bp, Artificial sequence
  SiRNA target sequence
ataagatcctatgactttatcatt

SEQ ID NO: 113742 - DNA, 24 bp, Artificial sequence
  SiRNA target sequence
taagatcctatgactttatcattt

SEQ ID NO: 113743 - DNA, 24 bp, Artificial sequence
  SiRNA target sequence
aagatcctatgactttatcatttt

SEQ ID NO: 113744 - DNA, 24 bp, Artificial sequence
  SiRNA target sequence
agatcctatgactttatcattttt

SEQ ID NO: 113745 - DNA, 24 bp, Artificial sequence
  SiRNA target sequence
gatcctatgactttatcattttta

SEQ ID NO: 113746 - DNA, 24 bp, Artificial sequence
  SiRNA target sequence
atcctatgactttatcatttttat

SEQ ID NO: 113747 - DNA, 24 bp, Artificial sequence
  SiRNA target sequence
tcctatgactttatcatttttatc

SEQ ID NO: 113748 - DNA, 24 bp, Artificial sequence
  SiRNA target sequence
cctatgactttatcatttttatct

SEQ ID NO: 113749 - DNA, 24 bp, Artificial sequence
  SiRNA target sequence
ctatgactttatcatttttatcta

SEQ ID NO: 113750 - DNA, 24 bp, Artificial sequence
  SiRNA target sequence
tatgactttatcatttttatctag

SEQ ID NO: 113751 - DNA, 24 bp, Artificial sequence
  SiRNA target sequence
atgactttatcatttttatctagt

SEQ ID NO: 113752 - DNA, 24 bp, Artificial sequence
  SiRNA target sequence
tgactttatcatttttatctagta

SEQ ID NO: 113753 - DNA, 24 bp, Artificial sequence
  SiRNA target sequence
gactttatcatttttatctagtac

SEQ ID NO: 113754 - DNA, 24 bp, Artificial sequence
  SiRNA target sequence
actttatcatttttatctagtacc

SEQ ID NO: 113755 - DNA, 24 bp, Artificial sequence
  SiRNA target sequence
ctttatcatttttatctagtacct

SEQ ID NO: 113756 - DNA, 24 bp, Artificial sequence
  SiRNA target sequence
tttatcatttttatctagtacctt

SEQ ID NO: 113757 - DNA, 24 bp, Artificial sequence
  SiRNA target sequence
ttatcatttttatctagtaccttt

SEQ ID NO: 113758 - DNA, 24 bp, Artificial sequence
  SiRNA target sequence
tatcatttttatctagtacctttt

SEQ ID NO: 113759 - DNA, 24 bp, Artificial sequence
  SiRNA target sequence
atcatttttatctagtaccttttg

SEQ ID NO: 113760 - DNA, 24 bp, Artificial sequence
  SiRNA target sequence
tcatttttatctagtaccttttgt

SEQ ID NO: 113761 - DNA, 24 bp, Artificial sequence
  SiRNA target sequence
catttttatctagtaccttttgta

SEQ ID NO: 113762 - DNA, 24 bp, Artificial sequence
  SiRNA target sequence
atttttatctagtaccttttgtaa

SEQ ID NO: 113763 - DNA, 24 bp, Artificial sequence
  SiRNA target sequence
tttttatctagtaccttttgtaaa

SEQ ID NO: 113764 - DNA, 24 bp, Artificial sequence
  SiRNA target sequence
ttttatctagtaccttttgtaaac

SEQ ID NO: 113765 - DNA, 24 bp, Artificial sequence
  SiRNA target sequence
tttatctagtaccttttgtaaact

SEQ ID NO: 113766 - DNA, 24 bp, Artificial sequence
  SiRNA target sequence
ttatctagtaccttttgtaaactc

SEQ ID NO: 113767 - DNA, 24 bp, Artificial sequence
  SiRNA target sequence
tatctagtaccttttgtaaactca

SEQ ID NO: 113768 - DNA, 24 bp, Artificial sequence
  SiRNA target sequence
atctagtaccttttgtaaactcat

SEQ ID NO: 113769 - DNA, 24 bp, Artificial sequence
  SiRNA target sequence
tctagtaccttttgtaaactcata

SEQ ID NO: 113770 - DNA, 24 bp, Artificial sequence
  SiRNA target sequence
ctagtaccttttgtaaactcatat

SEQ ID NO: 113771 - DNA, 24 bp, Artificial sequence
  SiRNA target sequence
tagtaccttttgtaaactcatata

SEQ ID NO: 113772 - DNA, 24 bp, Artificial sequence
  SiRNA target sequence
agtaccttttgtaaactcatataa

SEQ ID NO: 113773 - DNA, 24 bp, Artificial sequence
  SiRNA target sequence
gtaccttttgtaaactcatataaa

SEQ ID NO: 113774 - DNA, 24 bp, Artificial sequence
  SiRNA target sequence
taccttttgtaaactcatataaat

SEQ ID NO: 113775 - DNA, 24 bp, Artificial sequence
  SiRNA target sequence
accttttgtaaactcatataaatg

SEQ ID NO: 113776 - DNA, 24 bp, Artificial sequence
  SiRNA target sequence
ccttttgtaaactcatataaatgt

SEQ ID NO: 113777 - DNA, 24 bp, Artificial sequence
  SiRNA target sequence
cttttgtaaactcatataaatgtt

SEQ ID NO: 113778 - DNA, 24 bp, Artificial sequence
  SiRNA target sequence
ttttgtaaactcatataaatgttt

SEQ ID NO: 113779 - DNA, 24 bp, Artificial sequence
  SiRNA target sequence
tttgtaaactcatataaatgtttt

SEQ ID NO: 113780 - DNA, 24 bp, Artificial sequence
  SiRNA target sequence
ttgtaaactcatataaatgttttc

SEQ ID NO: 113781 - DNA, 24 bp, Artificial sequence
  SiRNA target sequence
tgtaaactcatataaatgttttcc

SEQ ID NO: 113782 - DNA, 24 bp, Artificial sequence
  SiRNA target sequence
gtaaactcatataaatgttttcct

SEQ ID NO: 113783 - DNA, 24 bp, Artificial sequence
  SiRNA target sequence
taaactcatataaatgttttcctg

SEQ ID NO: 113784 - DNA, 24 bp, Artificial sequence
  SiRNA target sequence
aaactcatataaatgttttcctgt

SEQ ID NO: 113785 - DNA, 24 bp, Artificial sequence
  SiRNA target sequence
aactcatataaatgttttcctgtc

SEQ ID NO: 113786 - DNA, 24 bp, Artificial sequence
  SiRNA target sequence
actcatataaatgttttcctgtcc

SEQ ID NO: 113787 - DNA, 24 bp, Artificial sequence
  SiRNA target sequence
ctcatataaatgttttcctgtcct

SEQ ID NO: 113788 - DNA, 24 bp, Artificial sequence
  SiRNA target sequence
tcatataaatgttttcctgtccta

SEQ ID NO: 113789 - DNA, 24 bp, Artificial sequence
  SiRNA target sequence
catataaatgttttcctgtcctat

SEQ ID NO: 113790 - DNA, 24 bp, Artificial sequence
  SiRNA target sequence
atataaatgttttcctgtcctatt

SEQ ID NO: 113791 - DNA, 24 bp, Artificial sequence
  SiRNA target sequence
tataaatgttttcctgtcctatta

SEQ ID NO: 113792 - DNA, 24 bp, Artificial sequence
  SiRNA target sequence
ataaatgttttcctgtcctattac

SEQ ID NO: 113793 - DNA, 24 bp, Artificial sequence
  SiRNA target sequence
taaatgttttcctgtcctattact

SEQ ID NO: 113794 - DNA, 24 bp, Artificial sequence
  SiRNA target sequence
aaatgttttcctgtcctattacta

SEQ ID NO: 113795 - DNA, 24 bp, Artificial sequence
  SiRNA target sequence
aatgttttcctgtcctattactaa

SEQ ID NO: 113796 - DNA, 24 bp, Artificial sequence
  SiRNA target sequence
atgttttcctgtcctattactaaa

SEQ ID NO: 113797 - DNA, 24 bp, Artificial sequence
  SiRNA target sequence
tgttttcctgtcctattactaaat

SEQ ID NO: 113798 - DNA, 24 bp, Artificial sequence
  SiRNA target sequence
gttttcctgtcctattactaaatg

SEQ ID NO: 113799 - DNA, 24 bp, Artificial sequence
  SiRNA target sequence
ttttcctgtcctattactaaatga

SEQ ID NO: 113800 - DNA, 24 bp, Artificial sequence
  SiRNA target sequence
tttcctgtcctattactaaatgac

SEQ ID NO: 113801 - DNA, 24 bp, Artificial sequence
  SiRNA target sequence
ttcctgtcctattactaaatgaca

SEQ ID NO: 113802 - DNA, 24 bp, Artificial sequence
  SiRNA target sequence
tcctgtcctattactaaatgacag

SEQ ID NO: 113803 - DNA, 24 bp, Artificial sequence
  SiRNA target sequence
cctgtcctattactaaatgacaga

SEQ ID NO: 113804 - DNA, 24 bp, Artificial sequence
  SiRNA target sequence
ctgtcctattactaaatgacagaa

SEQ ID NO: 113805 - DNA, 24 bp, Artificial sequence
  SiRNA target sequence
tgtcctattactaaatgacagaag

SEQ ID NO: 113806 - DNA, 24 bp, Artificial sequence
  SiRNA target sequence
gtcctattactaaatgacagaagc

SEQ ID NO: 113807 - DNA, 24 bp, Artificial sequence
  SiRNA target sequence
tcctattactaaatgacagaagcc

SEQ ID NO: 113808 - DNA, 24 bp, Artificial sequence
  SiRNA target sequence
cctattactaaatgacagaagcct

SEQ ID NO: 113809 - DNA, 24 bp, Artificial sequence
  SiRNA target sequence
ctattactaaatgacagaagcctc

SEQ ID NO: 113810 - DNA, 24 bp, Artificial sequence
  SiRNA target sequence
tattactaaatgacagaagcctct

SEQ ID NO: 113811 - DNA, 24 bp, Artificial sequence
  SiRNA target sequence
attactaaatgacagaagcctctt

SEQ ID NO: 113812 - DNA, 24 bp, Artificial sequence
  SiRNA target sequence
ttactaaatgacagaagcctctta

SEQ ID NO: 113813 - DNA, 24 bp, Artificial sequence
  SiRNA target sequence
tactaaatgacagaagcctcttat

SEQ ID NO: 113814 - DNA, 24 bp, Artificial sequence
  SiRNA target sequence
actaaatgacagaagcctcttata

SEQ ID NO: 113815 - DNA, 24 bp, Artificial sequence
  SiRNA target sequence
ctaaatgacagaagcctcttatat

SEQ ID NO: 113816 - DNA, 24 bp, Artificial sequence
  SiRNA target sequence
taaatgacagaagcctcttatatt

SEQ ID NO: 113817 - DNA, 24 bp, Artificial sequence
  SiRNA target sequence
aaatgacagaagcctcttatattt

SEQ ID NO: 113818 - DNA, 24 bp, Artificial sequence
  SiRNA target sequence
aatgacagaagcctcttatatttc

SEQ ID NO: 113819 - DNA, 24 bp, Artificial sequence
  SiRNA target sequence
atgacagaagcctcttatatttcc

SEQ ID NO: 113820 - DNA, 24 bp, Artificial sequence
  SiRNA target sequence
tgacagaagcctcttatatttcct

SEQ ID NO: 113821 - DNA, 24 bp, Artificial sequence
  SiRNA target sequence
gacagaagcctcttatatttcctt

SEQ ID NO: 113822 - DNA, 24 bp, Artificial sequence
  SiRNA target sequence
acagaagcctcttatatttccttt

SEQ ID NO: 113823 - DNA, 24 bp, Artificial sequence
  SiRNA target sequence
cagaagcctcttatatttcctttt

SEQ ID NO: 113824 - DNA, 24 bp, Artificial sequence
  SiRNA target sequence
agaagcctcttatatttccttttt

SEQ ID NO: 113825 - DNA, 24 bp, Artificial sequence
  SiRNA target sequence
gaagcctcttatatttcctttttt

SEQ ID NO: 113826 - DNA, 24 bp, Artificial sequence
  SiRNA target sequence
aagcctcttatatttcctttttta

SEQ ID NO: 113827 - DNA, 24 bp, Artificial sequence
  SiRNA target sequence
agcctcttatatttccttttttat

SEQ ID NO: 113828 - DNA, 24 bp, Artificial sequence
  SiRNA target sequence
gcctcttatatttccttttttata

SEQ ID NO: 113829 - DNA, 24 bp, Artificial sequence
  SiRNA target sequence
cctcttatatttccttttttatac

SEQ ID NO: 113830 - DNA, 24 bp, Artificial sequence
  SiRNA target sequence
ctcttatatttccttttttatact

SEQ ID NO: 113831 - DNA, 24 bp, Artificial sequence
  SiRNA target sequence
tcttatatttccttttttatactt

SEQ ID NO: 113832 - DNA, 24 bp, Artificial sequence
  SiRNA target sequence
cttatatttccttttttatactta

SEQ ID NO: 113833 - DNA, 24 bp, Artificial sequence
  SiRNA target sequence
ttatatttccttttttatacttag

SEQ ID NO: 113834 - DNA, 24 bp, Artificial sequence
  SiRNA target sequence
tatatttccttttttatacttaga

SEQ ID NO: 113835 - DNA, 24 bp, Artificial sequence
  SiRNA target sequence
atatttccttttttatacttagag

SEQ ID NO: 113836 - DNA, 24 bp, Artificial sequence
  SiRNA target sequence
tatttccttttttatacttagagt

SEQ ID NO: 113837 - DNA, 24 bp, Artificial sequence
  SiRNA target sequence
atttccttttttatacttagagtt

SEQ ID NO: 113838 - DNA, 24 bp, Artificial sequence
  SiRNA target sequence
tttccttttttatacttagagtta

SEQ ID NO: 113839 - DNA, 24 bp, Artificial sequence
  SiRNA target sequence
ttccttttttatacttagagttag

SEQ ID NO: 113840 - DNA, 24 bp, Artificial sequence
  SiRNA target sequence
tccttttttatacttagagttagc

SEQ ID NO: 113841 - DNA, 24 bp, Artificial sequence
  SiRNA target sequence
ccttttttatacttagagttagca

SEQ ID NO: 113842 - DNA, 24 bp, Artificial sequence
  SiRNA target sequence
cttttttatacttagagttagcat

SEQ ID NO: 113843 - DNA, 24 bp, Artificial sequence
  SiRNA target sequence
ttttttatacttagagttagcata

SEQ ID NO: 113844 - DNA, 24 bp, Artificial sequence
  SiRNA target sequence
tttttatacttagagttagcatat

SEQ ID NO: 113845 - DNA, 24 bp, Artificial sequence
  SiRNA target sequence
ttttatacttagagttagcatatt

SEQ ID NO: 113846 - DNA, 24 bp, Artificial sequence
  SiRNA target sequence
tttatacttagagttagcatattc

SEQ ID NO: 113847 - DNA, 24 bp, Artificial sequence
  SiRNA target sequence
ttatacttagagttagcatattct

SEQ ID NO: 113848 - DNA, 24 bp, Artificial sequence
  SiRNA target sequence
tatacttagagttagcatattctt

SEQ ID NO: 113849 - DNA, 24 bp, Artificial sequence
  SiRNA target sequence
atacttagagttagcatattcttc

SEQ ID NO: 113850 - DNA, 24 bp, Artificial sequence
  SiRNA target sequence
tacttagagttagcatattcttcg

SEQ ID NO: 113851 - DNA, 24 bp, Artificial sequence
  SiRNA target sequence
acttagagttagcatattcttcga

SEQ ID NO: 113852 - DNA, 24 bp, Artificial sequence
  SiRNA target sequence
cttagagttagcatattcttcgat

SEQ ID NO: 113853 - DNA, 24 bp, Artificial sequence
  SiRNA target sequence
ttagagttagcatattcttcgata

SEQ ID NO: 113854 - DNA, 24 bp, Artificial sequence
  SiRNA target sequence
tagagttagcatattcttcgataa

SEQ ID NO: 113855 - DNA, 24 bp, Artificial sequence
  SiRNA target sequence
agagttagcatattcttcgataag

SEQ ID NO: 113856 - DNA, 24 bp, Artificial sequence
  SiRNA target sequence
gagttagcatattcttcgataaga

SEQ ID NO: 113857 - DNA, 24 bp, Artificial sequence
  SiRNA target sequence
agttagcatattcttcgataagac

SEQ ID NO: 113858 - DNA, 24 bp, Artificial sequence
  SiRNA target sequence
gttagcatattcttcgataagacg

SEQ ID NO: 113859 - DNA, 24 bp, Artificial sequence
  SiRNA target sequence
ttagcatattcttcgataagacgt

SEQ ID NO: 113860 - DNA, 24 bp, Artificial sequence
  SiRNA target sequence
tagcatattcttcgataagacgta

SEQ ID NO: 113861 - DNA, 24 bp, Artificial sequence
  SiRNA target sequence
agcatattcttcgataagacgtag

SEQ ID NO: 113862 - DNA, 24 bp, Artificial sequence
  SiRNA target sequence
gcatattcttcgataagacgtaga

SEQ ID NO: 113863 - DNA, 24 bp, Artificial sequence
  SiRNA target sequence
catattcttcgataagacgtagaa

SEQ ID NO: 113864 - DNA, 24 bp, Artificial sequence
  SiRNA target sequence
atattcttcgataagacgtagaat

SEQ ID NO: 113865 - DNA, 24 bp, Artificial sequence
  SiRNA target sequence
tattcttcgataagacgtagaatt

SEQ ID NO: 113866 - DNA, 24 bp, Artificial sequence
  SiRNA target sequence
attcttcgataagacgtagaatta

SEQ ID NO: 113867 - DNA, 24 bp, Artificial sequence
  SiRNA target sequence
ttcttcgataagacgtagaattaa

SEQ ID NO: 113868 - DNA, 24 bp, Artificial sequence
  SiRNA target sequence
tcttcgataagacgtagaattaac

SEQ ID NO: 113869 - DNA, 24 bp, Artificial sequence
  SiRNA target sequence
cttcgataagacgtagaattaaca

SEQ ID NO: 113870 - DNA, 24 bp, Artificial sequence
  SiRNA target sequence
ttcgataagacgtagaattaacat

SEQ ID NO: 113871 - DNA, 24 bp, Artificial sequence
  SiRNA target sequence
tcgataagacgtagaattaacata

SEQ ID NO: 113872 - DNA, 24 bp, Artificial sequence
  SiRNA target sequence
cgataagacgtagaattaacatat

SEQ ID NO: 113873 - DNA, 24 bp, Artificial sequence
  SiRNA target sequence
gataagacgtagaattaacatatt

SEQ ID NO: 113874 - DNA, 24 bp, Artificial sequence
  SiRNA target sequence
ataagacgtagaattaacatattt

SEQ ID NO: 113875 - DNA, 24 bp, Artificial sequence
  SiRNA target sequence
taagacgtagaattaacatatttc

SEQ ID NO: 113876 - DNA, 24 bp, Artificial sequence
  SiRNA target sequence
aagacgtagaattaacatatttct

SEQ ID NO: 113877 - DNA, 24 bp, Artificial sequence
  SiRNA target sequence
agacgtagaattaacatatttcta

SEQ ID NO: 113878 - DNA, 24 bp, Artificial sequence
  SiRNA target sequence
gacgtagaattaacatatttctat

SEQ ID NO: 113879 - DNA, 24 bp, Artificial sequence
  SiRNA target sequence
acgtagaattaacatatttctata

SEQ ID NO: 113880 - DNA, 24 bp, Artificial sequence
  SiRNA target sequence
cgtagaattaacatatttctataa

SEQ ID NO: 113881 - DNA, 24 bp, Artificial sequence
  SiRNA target sequence
gtagaattaacatatttctataaa

SEQ ID NO: 113882 - DNA, 24 bp, Artificial sequence
  SiRNA target sequence
tagaattaacatatttctataaac

SEQ ID NO: 113883 - DNA, 24 bp, Artificial sequence
  SiRNA target sequence
agaattaacatatttctataaaca

SEQ ID NO: 113884 - DNA, 24 bp, Artificial sequence
  SiRNA target sequence
gaattaacatatttctataaacat

SEQ ID NO: 113885 - DNA, 24 bp, Artificial sequence
  SiRNA target sequence
aattaacatatttctataaacatc

SEQ ID NO: 113886 - DNA, 24 bp, Artificial sequence
  SiRNA target sequence
attaacatatttctataaacatct

SEQ ID NO: 113887 - DNA, 24 bp, Artificial sequence
  SiRNA target sequence
ttaacatatttctataaacatctt

SEQ ID NO: 113888 - DNA, 24 bp, Artificial sequence
  SiRNA target sequence
taacatatttctataaacatcttg

SEQ ID NO: 113889 - DNA, 24 bp, Artificial sequence
  SiRNA target sequence
aacatatttctataaacatcttgt

SEQ ID NO: 113890 - DNA, 24 bp, Artificial sequence
  SiRNA target sequence
acatatttctataaacatcttgta

SEQ ID NO: 113891 - DNA, 24 bp, Artificial sequence
  SiRNA target sequence
catatttctataaacatcttgtac

SEQ ID NO: 113892 - DNA, 24 bp, Artificial sequence
  SiRNA target sequence
atatttctataaacatcttgtaca

SEQ ID NO: 113893 - DNA, 24 bp, Artificial sequence
  SiRNA target sequence
tatttctataaacatcttgtacaa

SEQ ID NO: 113894 - DNA, 24 bp, Artificial sequence
  SiRNA target sequence
atttctataaacatcttgtacaag

SEQ ID NO: 113895 - DNA, 24 bp, Artificial sequence
  SiRNA target sequence
tttctataaacatcttgtacaagt

SEQ ID NO: 113896 - DNA, 24 bp, Artificial sequence
  SiRNA target sequence
ttctataaacatcttgtacaagtt

SEQ ID NO: 113897 - DNA, 24 bp, Artificial sequence
  SiRNA target sequence
tctataaacatcttgtacaagttc

SEQ ID NO: 113898 - DNA, 24 bp, Artificial sequence
  SiRNA target sequence
ctataaacatcttgtacaagttct

SEQ ID NO: 113899 - DNA, 24 bp, Artificial sequence
  SiRNA target sequence
tataaacatcttgtacaagttctt

SEQ ID NO: 113900 - DNA, 24 bp, Artificial sequence
  SiRNA target sequence
ataaacatcttgtacaagttcttt

SEQ ID NO: 113901 - DNA, 24 bp, Artificial sequence
  SiRNA target sequence
taaacatcttgtacaagttctttg

SEQ ID NO: 113902 - DNA, 24 bp, Artificial sequence
  SiRNA target sequence
aaacatcttgtacaagttctttgt

SEQ ID NO: 113903 - DNA, 24 bp, Artificial sequence
  SiRNA target sequence
aacatcttgtacaagttctttgtt

SEQ ID NO: 113904 - DNA, 24 bp, Artificial sequence
  SiRNA target sequence
acatcttgtacaagttctttgttt

SEQ ID NO: 113905 - DNA, 24 bp, Artificial sequence
  SiRNA target sequence
catcttgtacaagttctttgttta

SEQ ID NO: 113906 - DNA, 24 bp, Artificial sequence
  SiRNA target sequence
atcttgtacaagttctttgtttaa

SEQ ID NO: 113907 - DNA, 24 bp, Artificial sequence
  SiRNA target sequence
tcttgtacaagttctttgtttaaa

SEQ ID NO: 113908 - DNA, 24 bp, Artificial sequence
  SiRNA target sequence
cttgtacaagttctttgtttaaag

SEQ ID NO: 113909 - DNA, 24 bp, Artificial sequence
  SiRNA target sequence
ttgtacaagttctttgtttaaagt

SEQ ID NO: 113910 - DNA, 24 bp, Artificial sequence
  SiRNA target sequence
tgtacaagttctttgtttaaagta

SEQ ID NO: 113911 - DNA, 24 bp, Artificial sequence
  SiRNA target sequence
gtacaagttctttgtttaaagtag

SEQ ID NO: 113912 - DNA, 24 bp, Artificial sequence
  SiRNA target sequence
tacaagttctttgtttaaagtagt

SEQ ID NO: 113913 - DNA, 24 bp, Artificial sequence
  SiRNA target sequence
acaagttctttgtttaaagtagtt

SEQ ID NO: 113914 - DNA, 24 bp, Artificial sequence
  SiRNA target sequence
caagttctttgtttaaagtagttt

SEQ ID NO: 113915 - DNA, 24 bp, Artificial sequence
  SiRNA target sequence
aagttctttgtttaaagtagtttt

SEQ ID NO: 113916 - DNA, 24 bp, Artificial sequence
  SiRNA target sequence
agttctttgtttaaagtagttttc

SEQ ID NO: 113917 - DNA, 24 bp, Artificial sequence
  SiRNA target sequence
gttctttgtttaaagtagttttca

SEQ ID NO: 113918 - DNA, 24 bp, Artificial sequence
  SiRNA target sequence
ttctttgtttaaagtagttttcag

SEQ ID NO: 113919 - DNA, 24 bp, Artificial sequence
  SiRNA target sequence
tctttgtttaaagtagttttcagt

SEQ ID NO: 113920 - DNA, 24 bp, Artificial sequence
  SiRNA target sequence
ctttgtttaaagtagttttcagtt

SEQ ID NO: 113921 - DNA, 24 bp, Artificial sequence
  SiRNA target sequence
tttgtttaaagtagttttcagttt

SEQ ID NO: 113922 - DNA, 24 bp, Artificial sequence
  SiRNA target sequence
ttgtttaaagtagttttcagttta

SEQ ID NO: 113923 - DNA, 24 bp, Artificial sequence
  SiRNA target sequence
tgtttaaagtagttttcagtttaa

SEQ ID NO: 113924 - DNA, 24 bp, Artificial sequence
  SiRNA target sequence
gtttaaagtagttttcagtttaac

SEQ ID NO: 113925 - DNA, 24 bp, Artificial sequence
  SiRNA target sequence
tttaaagtagttttcagtttaact

SEQ ID NO: 113926 - DNA, 24 bp, Artificial sequence
  SiRNA target sequence
ttaaagtagttttcagtttaactg

SEQ ID NO: 113927 - DNA, 24 bp, Artificial sequence
  SiRNA target sequence
taaagtagttttcagtttaactgt

SEQ ID NO: 113928 - DNA, 24 bp, Artificial sequence
  SiRNA target sequence
aaagtagttttcagtttaactgta

SEQ ID NO: 113929 - DNA, 24 bp, Artificial sequence
  SiRNA target sequence
aagtagttttcagtttaactgtat

SEQ ID NO: 113930 - DNA, 24 bp, Artificial sequence
  SiRNA target sequence
agtagttttcagtttaactgtatt

SEQ ID NO: 113931 - DNA, 24 bp, Artificial sequence
  SiRNA target sequence
gtagttttcagtttaactgtattt

SEQ ID NO: 113932 - DNA, 24 bp, Artificial sequence
  SiRNA target sequence
tagttttcagtttaactgtatttt

SEQ ID NO: 113933 - DNA, 24 bp, Artificial sequence
  SiRNA target sequence
agttttcagtttaactgtattttt

SEQ ID NO: 113934 - DNA, 24 bp, Artificial sequence
  SiRNA target sequence
gttttcagtttaactgtattttta

SEQ ID NO: 113935 - DNA, 24 bp, Artificial sequence
  SiRNA target sequence
ttttcagtttaactgtatttttat

SEQ ID NO: 113936 - DNA, 24 bp, Artificial sequence
  SiRNA target sequence
tttcagtttaactgtatttttatc

SEQ ID NO: 113937 - DNA, 24 bp, Artificial sequence
  SiRNA target sequence
ttcagtttaactgtatttttatct

SEQ ID NO: 113938 - DNA, 24 bp, Artificial sequence
  SiRNA target sequence
tcagtttaactgtatttttatcta

SEQ ID NO: 113939 - DNA, 24 bp, Artificial sequence
  SiRNA target sequence
cagtttaactgtatttttatctac

SEQ ID NO: 113940 - DNA, 24 bp, Artificial sequence
  SiRNA target sequence
agtttaactgtatttttatctacc

SEQ ID NO: 113941 - DNA, 24 bp, Artificial sequence
  SiRNA target sequence
gtttaactgtatttttatctacca

SEQ ID NO: 113942 - DNA, 24 bp, Artificial sequence
  SiRNA target sequence
tttaactgtatttttatctaccaa

SEQ ID NO: 113943 - DNA, 24 bp, Artificial sequence
  SiRNA target sequence
ttaactgtatttttatctaccaaa

SEQ ID NO: 113944 - DNA, 24 bp, Artificial sequence
  SiRNA target sequence
taactgtatttttatctaccaaat

SEQ ID NO: 113945 - DNA, 24 bp, Artificial sequence
  SiRNA target sequence
aactgtatttttatctaccaaata

SEQ ID NO: 113946 - DNA, 24 bp, Artificial sequence
  SiRNA target sequence
actgtatttttatctaccaaataa

SEQ ID NO: 113947 - DNA, 24 bp, Artificial sequence
  SiRNA target sequence
ctgtatttttatctaccaaataat

SEQ ID NO: 113948 - DNA, 24 bp, Artificial sequence
  SiRNA target sequence
tgtatttttatctaccaaataata

SEQ ID NO: 113949 - DNA, 24 bp, Artificial sequence
  SiRNA target sequence
gtatttttatctaccaaataataa

SEQ ID NO: 113950 - DNA, 24 bp, Artificial sequence
  SiRNA target sequence
tatttttatctaccaaataataat

SEQ ID NO: 113951 - DNA, 24 bp, Artificial sequence
  SiRNA target sequence
atttttatctaccaaataataatc

SEQ ID NO: 113952 - DNA, 24 bp, Artificial sequence
  SiRNA target sequence
tttttatctaccaaataataatct

SEQ ID NO: 113953 - DNA, 24 bp, Artificial sequence
  SiRNA target sequence
ttttatctaccaaataataatcta

SEQ ID NO: 113954 - DNA, 24 bp, Artificial sequence
  SiRNA target sequence
tttatctaccaaataataatctat

SEQ ID NO: 113955 - DNA, 24 bp, Artificial sequence
  SiRNA target sequence
ttatctaccaaataataatctatc

SEQ ID NO: 113956 - DNA, 24 bp, Artificial sequence
  SiRNA target sequence
tatctaccaaataataatctatca

SEQ ID NO: 113957 - DNA, 24 bp, Artificial sequence
  SiRNA target sequence
atctaccaaataataatctatcat

SEQ ID NO: 113958 - DNA, 25 bp, Artificial sequence
  SiRNA target sequence
ttattcagaataaacatcttttaaa

SEQ ID NO: 113959 - DNA, 25 bp, Artificial sequence
  SiRNA target sequence
tattcagaataaacatcttttaaaa

SEQ ID NO: 113960 - DNA, 25 bp, Artificial sequence
  SiRNA target sequence
attcagaataaacatcttttaaaag

SEQ ID NO: 113961 - DNA, 25 bp, Artificial sequence
  SiRNA target sequence
ttcagaataaacatcttttaaaagt

SEQ ID NO: 113962 - DNA, 25 bp, Artificial sequence
  SiRNA target sequence
tcagaataaacatcttttaaaagtt

SEQ ID NO: 113963 - DNA, 25 bp, Artificial sequence
  SiRNA target sequence
cagaataaacatcttttaaaagttc

SEQ ID NO: 113964 - DNA, 25 bp, Artificial sequence
  SiRNA target sequence
agaataaacatcttttaaaagttca

SEQ ID NO: 113965 - DNA, 25 bp, Artificial sequence
  SiRNA target sequence
gaataaacatcttttaaaagttcat

SEQ ID NO: 113966 - DNA, 25 bp, Artificial sequence
  SiRNA target sequence
aataaacatcttttaaaagttcatc

SEQ ID NO: 113967 - DNA, 25 bp, Artificial sequence
  SiRNA target sequence
ataaacatcttttaaaagttcatcg

SEQ ID NO: 113968 - DNA, 25 bp, Artificial sequence
  SiRNA target sequence
taaacatcttttaaaagttcatcga

SEQ ID NO: 113969 - DNA, 25 bp, Artificial sequence
  SiRNA target sequence
aaacatcttttaaaagttcatcgat

SEQ ID NO: 113970 - DNA, 25 bp, Artificial sequence
  SiRNA target sequence
aacatcttttaaaagttcatcgata

SEQ ID NO: 113971 - DNA, 25 bp, Artificial sequence
  SiRNA target sequence
acatcttttaaaagttcatcgatat

SEQ ID NO: 113972 - DNA, 25 bp, Artificial sequence
  SiRNA target sequence
catcttttaaaagttcatcgatatc

SEQ ID NO: 113973 - DNA, 25 bp, Artificial sequence
  SiRNA target sequence
atcttttaaaagttcatcgatatcg

SEQ ID NO: 113974 - DNA, 25 bp, Artificial sequence
  SiRNA target sequence
tcttttaaaagttcatcgatatcgg

SEQ ID NO: 113975 - DNA, 25 bp, Artificial sequence
  SiRNA target sequence
cttttaaaagttcatcgatatcggg

SEQ ID NO: 113976 - DNA, 25 bp, Artificial sequence
  SiRNA target sequence
ttttaaaagttcatcgatatcgggt

SEQ ID NO: 113977 - DNA, 25 bp, Artificial sequence
  SiRNA target sequence
tttaaaagttcatcgatatcgggtt

SEQ ID NO: 113978 - DNA, 25 bp, Artificial sequence
  SiRNA target sequence
ttaaaagttcatcgatatcgggttc

SEQ ID NO: 113979 - DNA, 25 bp, Artificial sequence
  SiRNA target sequence
taaaagttcatcgatatcgggttct

SEQ ID NO: 113980 - DNA, 25 bp, Artificial sequence
  SiRNA target sequence
aaaagttcatcgatatcgggttctt

SEQ ID NO: 113981 - DNA, 25 bp, Artificial sequence
  SiRNA target sequence
aaagttcatcgatatcgggttcttt

SEQ ID NO: 113982 - DNA, 25 bp, Artificial sequence
  SiRNA target sequence
aagttcatcgatatcgggttcttta

SEQ ID NO: 113983 - DNA, 25 bp, Artificial sequence
  SiRNA target sequence
agttcatcgatatcgggttctttag

SEQ ID NO: 113984 - DNA, 25 bp, Artificial sequence
  SiRNA target sequence
gttcatcgatatcgggttctttaga

SEQ ID NO: 113985 - DNA, 25 bp, Artificial sequence
  SiRNA target sequence
ttcatcgatatcgggttctttagaa

SEQ ID NO: 113986 - DNA, 25 bp, Artificial sequence
  SiRNA target sequence
tcatcgatatcgggttctttagaaa

SEQ ID NO: 113987 - DNA, 25 bp, Artificial sequence
  SiRNA target sequence
catcgatatcgggttctttagaaaa

SEQ ID NO: 113988 - DNA, 25 bp, Artificial sequence
  SiRNA target sequence
atcgatatcgggttctttagaaaaa

SEQ ID NO: 113989 - DNA, 25 bp, Artificial sequence
  SiRNA target sequence
tcgatatcgggttctttagaaaaaa

SEQ ID NO: 113990 - DNA, 25 bp, Artificial sequence
  SiRNA target sequence
cgatatcgggttctttagaaaaaat

SEQ ID NO: 113991 - DNA, 25 bp, Artificial sequence
  SiRNA target sequence
gatatcgggttctttagaaaaaata

SEQ ID NO: 113992 - DNA, 25 bp, Artificial sequence
  SiRNA target sequence
atatcgggttctttagaaaaaataa

SEQ ID NO: 113993 - DNA, 25 bp, Artificial sequence
  SiRNA target sequence
tatcgggttctttagaaaaaataac

SEQ ID NO: 113994 - DNA, 25 bp, Artificial sequence
  SiRNA target sequence
atcgggttctttagaaaaaataact

SEQ ID NO: 113995 - DNA, 25 bp, Artificial sequence
  SiRNA target sequence
tcgggttctttagaaaaaataactt

SEQ ID NO: 113996 - DNA, 25 bp, Artificial sequence
  SiRNA target sequence
cgggttctttagaaaaaataacttt

SEQ ID NO: 113997 - DNA, 25 bp, Artificial sequence
  SiRNA target sequence
gggttctttagaaaaaataactttt

SEQ ID NO: 113998 - DNA, 25 bp, Artificial sequence
  SiRNA target sequence
ggttctttagaaaaaataacttttt

SEQ ID NO: 113999 - DNA, 25 bp, Artificial sequence
  SiRNA target sequence
gttctttagaaaaaataactttttt

SEQ ID NO: 114000 - DNA, 25 bp, Artificial sequence
  SiRNA target sequence
ttctttagaaaaaataactttttta

SEQ ID NO: 114001 - DNA, 25 bp, Artificial sequence
  SiRNA target sequence
tctttagaaaaaataacttttttaa

SEQ ID NO: 114002 - DNA, 25 bp, Artificial sequence
  SiRNA target sequence
ctttagaaaaaataacttttttaac

SEQ ID NO: 114003 - DNA, 25 bp, Artificial sequence
  SiRNA target sequence
tttagaaaaaataacttttttaaca

SEQ ID NO: 114004 - DNA, 25 bp, Artificial sequence
  SiRNA target sequence
ttagaaaaaataacttttttaacac

SEQ ID NO: 114005 - DNA, 25 bp, Artificial sequence
  SiRNA target sequence
tagaaaaaataacttttttaacacc

SEQ ID NO: 114006 - DNA, 25 bp, Artificial sequence
  SiRNA target sequence
agaaaaaataacttttttaacacct

SEQ ID NO: 114007 - DNA, 25 bp, Artificial sequence
  SiRNA target sequence
gaaaaaataacttttttaacacctt

SEQ ID NO: 114008 - DNA, 25 bp, Artificial sequence
  SiRNA target sequence
aaaaaataacttttttaacaccttc

SEQ ID NO: 114009 - DNA, 25 bp, Artificial sequence
  SiRNA target sequence
aaaaataacttttttaacaccttct

SEQ ID NO: 114010 - DNA, 25 bp, Artificial sequence
  SiRNA target sequence
aaaataacttttttaacaccttctt

SEQ ID NO: 114011 - DNA, 25 bp, Artificial sequence
  SiRNA target sequence
aaataacttttttaacaccttcttc

SEQ ID NO: 114012 - DNA, 25 bp, Artificial sequence
  SiRNA target sequence
aataacttttttaacaccttcttca

SEQ ID NO: 114013 - DNA, 25 bp, Artificial sequence
  SiRNA target sequence
ataacttttttaacaccttcttcaa

SEQ ID NO: 114014 - DNA, 25 bp, Artificial sequence
  SiRNA target sequence
taacttttttaacaccttcttcaaa

SEQ ID NO: 114015 - DNA, 25 bp, Artificial sequence
  SiRNA target sequence
aacttttttaacaccttcttcaaag

SEQ ID NO: 114016 - DNA, 25 bp, Artificial sequence
  SiRNA target sequence
acttttttaacaccttcttcaaagc

SEQ ID NO: 114017 - DNA, 25 bp, Artificial sequence
  SiRNA target sequence
cttttttaacaccttcttcaaagca

SEQ ID NO: 114018 - DNA, 25 bp, Artificial sequence
  SiRNA target sequence
ttttttaacaccttcttcaaagcag

SEQ ID NO: 114019 - DNA, 25 bp, Artificial sequence
  SiRNA target sequence
tttttaacaccttcttcaaagcagg

SEQ ID NO: 114020 - DNA, 25 bp, Artificial sequence
  SiRNA target sequence
ttttaacaccttcttcaaagcagga

SEQ ID NO: 114021 - DNA, 25 bp, Artificial sequence
  SiRNA target sequence
tttaacaccttcttcaaagcaggaa

SEQ ID NO: 114022 - DNA, 25 bp, Artificial sequence
  SiRNA target sequence
ttaacaccttcttcaaagcaggaaa

SEQ ID NO: 114023 - DNA, 25 bp, Artificial sequence
  SiRNA target sequence
taacaccttcttcaaagcaggaaat

SEQ ID NO: 114024 - DNA, 25 bp, Artificial sequence
  SiRNA target sequence
aacaccttcttcaaagcaggaaatt

SEQ ID NO: 114025 - DNA, 25 bp, Artificial sequence
  SiRNA target sequence
acaccttcttcaaagcaggaaatta

SEQ ID NO: 114026 - DNA, 25 bp, Artificial sequence
  SiRNA target sequence
caccttcttcaaagcaggaaattac

SEQ ID NO: 114027 - DNA, 25 bp, Artificial sequence
  SiRNA target sequence
accttcttcaaagcaggaaattacc

SEQ ID NO: 114028 - DNA, 25 bp, Artificial sequence
  SiRNA target sequence
ccttcttcaaagcaggaaattacct

SEQ ID NO: 114029 - DNA, 25 bp, Artificial sequence
  SiRNA target sequence
cttcttcaaagcaggaaattacctc

SEQ ID NO: 114030 - DNA, 25 bp, Artificial sequence
  SiRNA target sequence
ttcttcaaagcaggaaattacctca

SEQ ID NO: 114031 - DNA, 25 bp, Artificial sequence
  SiRNA target sequence
tcttcaaagcaggaaattacctcat

SEQ ID NO: 114032 - DNA, 25 bp, Artificial sequence
  SiRNA target sequence
cttcaaagcaggaaattacctcatc

SEQ ID NO: 114033 - DNA, 25 bp, Artificial sequence
  SiRNA target sequence
ttcaaagcaggaaattacctcatct

SEQ ID NO: 114034 - DNA, 25 bp, Artificial sequence
  SiRNA target sequence
tcaaagcaggaaattacctcatctt

SEQ ID NO: 114035 - DNA, 25 bp, Artificial sequence
  SiRNA target sequence
caaagcaggaaattacctcatcttc

SEQ ID NO: 114036 - DNA, 25 bp, Artificial sequence
  SiRNA target sequence
aaagcaggaaattacctcatcttcg

SEQ ID NO: 114037 - DNA, 25 bp, Artificial sequence
  SiRNA target sequence
aagcaggaaattacctcatcttcga

SEQ ID NO: 114038 - DNA, 25 bp, Artificial sequence
  SiRNA target sequence
agcaggaaattacctcatcttcgat

SEQ ID NO: 114039 - DNA, 25 bp, Artificial sequence
  SiRNA target sequence
gcaggaaattacctcatcttcgata

SEQ ID NO: 114040 - DNA, 25 bp, Artificial sequence
  SiRNA target sequence
caggaaattacctcatcttcgataa

SEQ ID NO: 114041 - DNA, 25 bp, Artificial sequence
  SiRNA target sequence
aggaaattacctcatcttcgataat

SEQ ID NO: 114042 - DNA, 25 bp, Artificial sequence
  SiRNA target sequence
ggaaattacctcatcttcgataatt

SEQ ID NO: 114043 - DNA, 25 bp, Artificial sequence
  SiRNA target sequence
gaaattacctcatcttcgataattt

SEQ ID NO: 114044 - DNA, 25 bp, Artificial sequence
  SiRNA target sequence
aaattacctcatcttcgataatttt

SEQ ID NO: 114045 - DNA, 25 bp, Artificial sequence
  SiRNA target sequence
aattacctcatcttcgataattttt

SEQ ID NO: 114046 - DNA, 25 bp, Artificial sequence
  SiRNA target sequence
attacctcatcttcgataattttta

SEQ ID NO: 114047 - DNA, 25 bp, Artificial sequence
  SiRNA target sequence
ttacctcatcttcgataatttttac

SEQ ID NO: 114048 - DNA, 25 bp, Artificial sequence
  SiRNA target sequence
tacctcatcttcgataatttttact

SEQ ID NO: 114049 - DNA, 25 bp, Artificial sequence
  SiRNA target sequence
acctcatcttcgataatttttactt

SEQ ID NO: 114050 - DNA, 25 bp, Artificial sequence
  SiRNA target sequence
cctcatcttcgataatttttacttc

SEQ ID NO: 114051 - DNA, 25 bp, Artificial sequence
  SiRNA target sequence
ctcatcttcgataatttttacttct

SEQ ID NO: 114052 - DNA, 25 bp, Artificial sequence
  SiRNA target sequence
tcatcttcgataatttttacttctt

SEQ ID NO: 114053 - DNA, 25 bp, Artificial sequence
  SiRNA target sequence
catcttcgataatttttacttcttc

SEQ ID NO: 114054 - DNA, 25 bp, Artificial sequence
  SiRNA target sequence
atcttcgataatttttacttcttca

SEQ ID NO: 114055 - DNA, 25 bp, Artificial sequence
  SiRNA target sequence
tcttcgataatttttacttcttcac

SEQ ID NO: 114056 - DNA, 25 bp, Artificial sequence
  SiRNA target sequence
cttcgataatttttacttcttcaca

SEQ ID NO: 114057 - DNA, 25 bp, Artificial sequence
  SiRNA target sequence
ttcgataatttttacttcttcacaa

SEQ ID NO: 114058 - DNA, 25 bp, Artificial sequence
  SiRNA target sequence
tcgataatttttacttcttcacaag

SEQ ID NO: 114059 - DNA, 25 bp, Artificial sequence
  SiRNA target sequence
cgataatttttacttcttcacaagt

SEQ ID NO: 114060 - DNA, 25 bp, Artificial sequence
  SiRNA target sequence
gataatttttacttcttcacaagtc

SEQ ID NO: 114061 - DNA, 25 bp, Artificial sequence
  SiRNA target sequence
ataatttttacttcttcacaagtcg

SEQ ID NO: 114062 - DNA, 25 bp, Artificial sequence
  SiRNA target sequence
taatttttacttcttcacaagtcgc

SEQ ID NO: 114063 - DNA, 25 bp, Artificial sequence
  SiRNA target sequence
aatttttacttcttcacaagtcgca

SEQ ID NO: 114064 - DNA, 25 bp, Artificial sequence
  SiRNA target sequence
atttttacttcttcacaagtcgcaa

SEQ ID NO: 114065 - DNA, 25 bp, Artificial sequence
  SiRNA target sequence
tttttacttcttcacaagtcgcaaa

SEQ ID NO: 114066 - DNA, 25 bp, Artificial sequence
  SiRNA target sequence
ttttacttcttcacaagtcgcaaat

SEQ ID NO: 114067 - DNA, 25 bp, Artificial sequence
  SiRNA target sequence
tttacttcttcacaagtcgcaaatt

SEQ ID NO: 114068 - DNA, 25 bp, Artificial sequence
  SiRNA target sequence
ttacttcttcacaagtcgcaaattt

SEQ ID NO: 114069 - DNA, 25 bp, Artificial sequence
  SiRNA target sequence
tacttcttcacaagtcgcaaatttt

SEQ ID NO: 114070 - DNA, 25 bp, Artificial sequence
  SiRNA target sequence
acttcttcacaagtcgcaaattttt

SEQ ID NO: 114071 - DNA, 25 bp, Artificial sequence
  SiRNA target sequence
cttcttcacaagtcgcaaatttttg

SEQ ID NO: 114072 - DNA, 25 bp, Artificial sequence
  SiRNA target sequence
ttcttcacaagtcgcaaatttttgt

SEQ ID NO: 114073 - DNA, 25 bp, Artificial sequence
  SiRNA target sequence
tcttcacaagtcgcaaatttttgta

SEQ ID NO: 114074 - DNA, 25 bp, Artificial sequence
  SiRNA target sequence
cttcacaagtcgcaaatttttgtaa

SEQ ID NO: 114075 - DNA, 25 bp, Artificial sequence
  SiRNA target sequence
ttcacaagtcgcaaatttttgtaag

SEQ ID NO: 114076 - DNA, 25 bp, Artificial sequence
  SiRNA target sequence
tcacaagtcgcaaatttttgtaagt

SEQ ID NO: 114077 - DNA, 25 bp, Artificial sequence
  SiRNA target sequence
cacaagtcgcaaatttttgtaagtt

SEQ ID NO: 114078 - DNA, 25 bp, Artificial sequence
  SiRNA target sequence
acaagtcgcaaatttttgtaagtta

SEQ ID NO: 114079 - DNA, 25 bp, Artificial sequence
  SiRNA target sequence
caagtcgcaaatttttgtaagttat

SEQ ID NO: 114080 - DNA, 25 bp, Artificial sequence
  SiRNA target sequence
aagtcgcaaatttttgtaagttatt

SEQ ID NO: 114081 - DNA, 25 bp, Artificial sequence
  SiRNA target sequence
agtcgcaaatttttgtaagttattt

SEQ ID NO: 114082 - DNA, 25 bp, Artificial sequence
  SiRNA target sequence
gtcgcaaatttttgtaagttatttt

SEQ ID NO: 114083 - DNA, 25 bp, Artificial sequence
  SiRNA target sequence
tcgcaaatttttgtaagttattttt

SEQ ID NO: 114084 - DNA, 25 bp, Artificial sequence
  SiRNA target sequence
cgcaaatttttgtaagttatttttt

SEQ ID NO: 114085 - DNA, 25 bp, Artificial sequence
  SiRNA target sequence
gcaaatttttgtaagttattttttg

SEQ ID NO: 114086 - DNA, 25 bp, Artificial sequence
  SiRNA target sequence
caaatttttgtaagttattttttgc

SEQ ID NO: 114087 - DNA, 25 bp, Artificial sequence
  SiRNA target sequence
aaatttttgtaagttattttttgct

SEQ ID NO: 114088 - DNA, 25 bp, Artificial sequence
  SiRNA target sequence
aatttttgtaagttattttttgctt

SEQ ID NO: 114089 - DNA, 25 bp, Artificial sequence
  SiRNA target sequence
atttttgtaagttattttttgcttc

SEQ ID NO: 114090 - DNA, 25 bp, Artificial sequence
  SiRNA target sequence
tttttgtaagttattttttgcttct

SEQ ID NO: 114091 - DNA, 25 bp, Artificial sequence
  SiRNA target sequence
ttttgtaagttattttttgcttctt

SEQ ID NO: 114092 - DNA, 25 bp, Artificial sequence
  SiRNA target sequence
tttgtaagttattttttgcttcttt

SEQ ID NO: 114093 - DNA, 25 bp, Artificial sequence
  SiRNA target sequence
ttgtaagttattttttgcttcttta

SEQ ID NO: 114094 - DNA, 25 bp, Artificial sequence
  SiRNA target sequence
tgtaagttattttttgcttctttaa

SEQ ID NO: 114095 - DNA, 25 bp, Artificial sequence
  SiRNA target sequence
gtaagttattttttgcttctttaag

SEQ ID NO: 114096 - DNA, 25 bp, Artificial sequence
  SiRNA target sequence
taagttattttttgcttctttaagg

SEQ ID NO: 114097 - DNA, 25 bp, Artificial sequence
  SiRNA target sequence
aagttattttttgcttctttaaggc

SEQ ID NO: 114098 - DNA, 25 bp, Artificial sequence
  SiRNA target sequence
agttattttttgcttctttaaggca

SEQ ID NO: 114099 - DNA, 25 bp, Artificial sequence
  SiRNA target sequence
gttattttttgcttctttaaggcaa

SEQ ID NO: 114100 - DNA, 25 bp, Artificial sequence
  SiRNA target sequence
ttattttttgcttctttaaggcaat

SEQ ID NO: 114101 - DNA, 25 bp, Artificial sequence
  SiRNA target sequence
tattttttgcttctttaaggcaatc

SEQ ID NO: 114102 - DNA, 25 bp, Artificial sequence
  SiRNA target sequence
attttttgcttctttaaggcaatca

SEQ ID NO: 114103 - DNA, 25 bp, Artificial sequence
  SiRNA target sequence
ttttttgcttctttaaggcaatcat

SEQ ID NO: 114104 - DNA, 25 bp, Artificial sequence
  SiRNA target sequence
tttttgcttctttaaggcaatcatt

SEQ ID NO: 114105 - DNA, 25 bp, Artificial sequence
  SiRNA target sequence
ttttgcttctttaaggcaatcatta

SEQ ID NO: 114106 - DNA, 25 bp, Artificial sequence
  SiRNA target sequence
tttgcttctttaaggcaatcattat

SEQ ID NO: 114107 - DNA, 25 bp, Artificial sequence
  SiRNA target sequence
ttgcttctttaaggcaatcattatt

SEQ ID NO: 114108 - DNA, 25 bp, Artificial sequence
  SiRNA target sequence
tgcttctttaaggcaatcattattt

SEQ ID NO: 114109 - DNA, 25 bp, Artificial sequence
  SiRNA target sequence
gcttctttaaggcaatcattatttt

SEQ ID NO: 114110 - DNA, 25 bp, Artificial sequence
  SiRNA target sequence
cttctttaaggcaatcattattttt

SEQ ID NO: 114111 - DNA, 25 bp, Artificial sequence
  SiRNA target sequence
ttctttaaggcaatcattatttttt

SEQ ID NO: 114112 - DNA, 25 bp, Artificial sequence
  SiRNA target sequence
tctttaaggcaatcattattttttt

SEQ ID NO: 114113 - DNA, 25 bp, Artificial sequence
  SiRNA target sequence
ctttaaggcaatcattatttttttt

SEQ ID NO: 114114 - DNA, 25 bp, Artificial sequence
  SiRNA target sequence
tttaaggcaatcattattttttttt

SEQ ID NO: 114115 - DNA, 25 bp, Artificial sequence
  SiRNA target sequence
ttaaggcaatcattatttttttttt

SEQ ID NO: 114116 - DNA, 25 bp, Artificial sequence
  SiRNA target sequence
taaggcaatcattattttttttttc

SEQ ID NO: 114117 - DNA, 25 bp, Artificial sequence
  SiRNA target sequence
aaggcaatcattattttttttttca

SEQ ID NO: 114118 - DNA, 25 bp, Artificial sequence
  SiRNA target sequence
aggcaatcattattttttttttcat

SEQ ID NO: 114119 - DNA, 25 bp, Artificial sequence
  SiRNA target sequence
ggcaatcattattttttttttcatt

SEQ ID NO: 114120 - DNA, 25 bp, Artificial sequence
  SiRNA target sequence
gcaatcattattttttttttcatta

SEQ ID NO: 114121 - DNA, 25 bp, Artificial sequence
  SiRNA target sequence
caatcattattttttttttcattaa

SEQ ID NO: 114122 - DNA, 25 bp, Artificial sequence
  SiRNA target sequence
aatcattattttttttttcattaat

SEQ ID NO: 114123 - DNA, 25 bp, Artificial sequence
  SiRNA target sequence
atcattattttttttttcattaatt

SEQ ID NO: 114124 - DNA, 25 bp, Artificial sequence
  SiRNA target sequence
tcattattttttttttcattaattt

SEQ ID NO: 114125 - DNA, 25 bp, Artificial sequence
  SiRNA target sequence
cattattttttttttcattaatttc

SEQ ID NO: 114126 - DNA, 25 bp, Artificial sequence
  SiRNA target sequence
attattttttttttcattaatttcc

SEQ ID NO: 114127 - DNA, 25 bp, Artificial sequence
  SiRNA target sequence
ttattttttttttcattaatttcct

SEQ ID NO: 114128 - DNA, 25 bp, Artificial sequence
  SiRNA target sequence
tattttttttttcattaatttcctc

SEQ ID NO: 114129 - DNA, 25 bp, Artificial sequence
  SiRNA target sequence
attttttttttcattaatttcctcc

SEQ ID NO: 114130 - DNA, 25 bp, Artificial sequence
  SiRNA target sequence
ttttttttttcattaatttcctccg

SEQ ID NO: 114131 - DNA, 25 bp, Artificial sequence
  SiRNA target sequence
tttttttttcattaatttcctccgt

SEQ ID NO: 114132 - DNA, 25 bp, Artificial sequence
  SiRNA target sequence
ttttttttcattaatttcctccgtg

SEQ ID NO: 114133 - DNA, 25 bp, Artificial sequence
  SiRNA target sequence
tttttttcattaatttcctccgtgg

SEQ ID NO: 114134 - DNA, 25 bp, Artificial sequence
  SiRNA target sequence
ttttttcattaatttcctccgtgga

SEQ ID NO: 114135 - DNA, 25 bp, Artificial sequence
  SiRNA target sequence
tttttcattaatttcctccgtggat

SEQ ID NO: 114136 - DNA, 25 bp, Artificial sequence
  SiRNA target sequence
ttttcattaatttcctccgtggatc

SEQ ID NO: 114137 - DNA, 25 bp, Artificial sequence
  SiRNA target sequence
tttcattaatttcctccgtggatct

SEQ ID NO: 114138 - DNA, 25 bp, Artificial sequence
  SiRNA target sequence
ttcattaatttcctccgtggatctg

SEQ ID NO: 114139 - DNA, 25 bp, Artificial sequence
  SiRNA target sequence
tcattaatttcctccgtggatctgt

SEQ ID NO: 114140 - DNA, 25 bp, Artificial sequence
  SiRNA target sequence
cattaatttcctccgtggatctgta

SEQ ID NO: 114141 - DNA, 25 bp, Artificial sequence
  SiRNA target sequence
attaatttcctccgtggatctgtaa

SEQ ID NO: 114142 - DNA, 25 bp, Artificial sequence
  SiRNA target sequence
ttaatttcctccgtggatctgtaaa

SEQ ID NO: 114143 - DNA, 25 bp, Artificial sequence
  SiRNA target sequence
taatttcctccgtggatctgtaaaa

SEQ ID NO: 114144 - DNA, 25 bp, Artificial sequence
  SiRNA target sequence
aatttcctccgtggatctgtaaaaa

SEQ ID NO: 114145 - DNA, 25 bp, Artificial sequence
  SiRNA target sequence
atttcctccgtggatctgtaaaaat

SEQ ID NO: 114146 - DNA, 25 bp, Artificial sequence
  SiRNA target sequence
tttcctccgtggatctgtaaaaatc

SEQ ID NO: 114147 - DNA, 25 bp, Artificial sequence
  SiRNA target sequence
ttcctccgtggatctgtaaaaatcg

SEQ ID NO: 114148 - DNA, 25 bp, Artificial sequence
  SiRNA target sequence
tcctccgtggatctgtaaaaatcgt

SEQ ID NO: 114149 - DNA, 25 bp, Artificial sequence
  SiRNA target sequence
cctccgtggatctgtaaaaatcgtt

SEQ ID NO: 114150 - DNA, 25 bp, Artificial sequence
  SiRNA target sequence
ctccgtggatctgtaaaaatcgtta

SEQ ID NO: 114151 - DNA, 25 bp, Artificial sequence
  SiRNA target sequence
tccgtggatctgtaaaaatcgttaa

SEQ ID NO: 114152 - DNA, 25 bp, Artificial sequence
  SiRNA target sequence
ccgtggatctgtaaaaatcgttaac

SEQ ID NO: 114153 - DNA, 25 bp, Artificial sequence
  SiRNA target sequence
cgtggatctgtaaaaatcgttaaca

SEQ ID NO: 114154 - DNA, 25 bp, Artificial sequence
  SiRNA target sequence
gtggatctgtaaaaatcgttaacat

SEQ ID NO: 114155 - DNA, 25 bp, Artificial sequence
  SiRNA target sequence
tggatctgtaaaaatcgttaacatc

SEQ ID NO: 114156 - DNA, 25 bp, Artificial sequence
  SiRNA target sequence
ggatctgtaaaaatcgttaacatct

SEQ ID NO: 114157 - DNA, 25 bp, Artificial sequence
  SiRNA target sequence
gatctgtaaaaatcgttaacatcta

SEQ ID NO: 114158 - DNA, 25 bp, Artificial sequence
  SiRNA target sequence
atctgtaaaaatcgttaacatctaa

SEQ ID NO: 114159 - DNA, 25 bp, Artificial sequence
  SiRNA target sequence
tctgtaaaaatcgttaacatctaaa

SEQ ID NO: 114160 - DNA, 25 bp, Artificial sequence
  SiRNA target sequence
ctgtaaaaatcgttaacatctaaac

SEQ ID NO: 114161 - DNA, 25 bp, Artificial sequence
  SiRNA target sequence
tgtaaaaatcgttaacatctaaaca

SEQ ID NO: 114162 - DNA, 25 bp, Artificial sequence
  SiRNA target sequence
gtaaaaatcgttaacatctaaacag

SEQ ID NO: 114163 - DNA, 25 bp, Artificial sequence
  SiRNA target sequence
taaaaatcgttaacatctaaacagg

SEQ ID NO: 114164 - DNA, 25 bp, Artificial sequence
  SiRNA target sequence
aaaaatcgttaacatctaaacagga

SEQ ID NO: 114165 - DNA, 25 bp, Artificial sequence
  SiRNA target sequence
aaaatcgttaacatctaaacaggag

SEQ ID NO: 114166 - DNA, 25 bp, Artificial sequence
  SiRNA target sequence
aaatcgttaacatctaaacaggagt

SEQ ID NO: 114167 - DNA, 25 bp, Artificial sequence
  SiRNA target sequence
aatcgttaacatctaaacaggagtg

SEQ ID NO: 114168 - DNA, 25 bp, Artificial sequence
  SiRNA target sequence
atcgttaacatctaaacaggagtgc

SEQ ID NO: 114169 - DNA, 25 bp, Artificial sequence
  SiRNA target sequence
tcgttaacatctaaacaggagtgcc

SEQ ID NO: 114170 - DNA, 25 bp, Artificial sequence
  SiRNA target sequence
cgttaacatctaaacaggagtgccc

SEQ ID NO: 114171 - DNA, 25 bp, Artificial sequence
  SiRNA target sequence
gttaacatctaaacaggagtgccca

SEQ ID NO: 114172 - DNA, 25 bp, Artificial sequence
  SiRNA target sequence
ttaacatctaaacaggagtgcccac

SEQ ID NO: 114173 - DNA, 25 bp, Artificial sequence
  SiRNA target sequence
taacatctaaacaggagtgcccaca

SEQ ID NO: 114174 - DNA, 25 bp, Artificial sequence
  SiRNA target sequence
aacatctaaacaggagtgcccacat

SEQ ID NO: 114175 - DNA, 25 bp, Artificial sequence
  SiRNA target sequence
acatctaaacaggagtgcccacatg

SEQ ID NO: 114176 - DNA, 25 bp, Artificial sequence
  SiRNA target sequence
catctaaacaggagtgcccacatgt

SEQ ID NO: 114177 - DNA, 25 bp, Artificial sequence
  SiRNA target sequence
atctaaacaggagtgcccacatgtc

SEQ ID NO: 114178 - DNA, 25 bp, Artificial sequence
  SiRNA target sequence
tctaaacaggagtgcccacatgtcc

SEQ ID NO: 114179 - DNA, 25 bp, Artificial sequence
  SiRNA target sequence
ctaaacaggagtgcccacatgtcct

SEQ ID NO: 114180 - DNA, 25 bp, Artificial sequence
  SiRNA target sequence
taaacaggagtgcccacatgtcctg

SEQ ID NO: 114181 - DNA, 25 bp, Artificial sequence
  SiRNA target sequence
aaacaggagtgcccacatgtcctgt

SEQ ID NO: 114182 - DNA, 25 bp, Artificial sequence
  SiRNA target sequence
aacaggagtgcccacatgtcctgta

SEQ ID NO: 114183 - DNA, 25 bp, Artificial sequence
  SiRNA target sequence
acaggagtgcccacatgtcctgtac

SEQ ID NO: 114184 - DNA, 25 bp, Artificial sequence
  SiRNA target sequence
caggagtgcccacatgtcctgtacg

SEQ ID NO: 114185 - DNA, 25 bp, Artificial sequence
  SiRNA target sequence
aggagtgcccacatgtcctgtacgt

SEQ ID NO: 114186 - DNA, 25 bp, Artificial sequence
  SiRNA target sequence
ggagtgcccacatgtcctgtacgta

SEQ ID NO: 114187 - DNA, 25 bp, Artificial sequence
  SiRNA target sequence
gagtgcccacatgtcctgtacgtat

SEQ ID NO: 114188 - DNA, 25 bp, Artificial sequence
  SiRNA target sequence
agtgcccacatgtcctgtacgtatc

SEQ ID NO: 114189 - DNA, 25 bp, Artificial sequence
  SiRNA target sequence
gtgcccacatgtcctgtacgtatca

SEQ ID NO: 114190 - DNA, 25 bp, Artificial sequence
  SiRNA target sequence
tgcccacatgtcctgtacgtatcaa

SEQ ID NO: 114191 - DNA, 25 bp, Artificial sequence
  SiRNA target sequence
gcccacatgtcctgtacgtatcaat

SEQ ID NO: 114192 - DNA, 25 bp, Artificial sequence
  SiRNA target sequence
cccacatgtcctgtacgtatcaatt

SEQ ID NO: 114193 - DNA, 25 bp, Artificial sequence
  SiRNA target sequence
ccacatgtcctgtacgtatcaattt

SEQ ID NO: 114194 - DNA, 25 bp, Artificial sequence
  SiRNA target sequence
cacatgtcctgtacgtatcaatttg

SEQ ID NO: 114195 - DNA, 25 bp, Artificial sequence
  SiRNA target sequence
acatgtcctgtacgtatcaatttgc

SEQ ID NO: 114196 - DNA, 25 bp, Artificial sequence
  SiRNA target sequence
catgtcctgtacgtatcaatttgca

SEQ ID NO: 114197 - DNA, 25 bp, Artificial sequence
  SiRNA target sequence
atgtcctgtacgtatcaatttgcaa

SEQ ID NO: 114198 - DNA, 25 bp, Artificial sequence
  SiRNA target sequence
tgtcctgtacgtatcaatttgcaag

SEQ ID NO: 114199 - DNA, 25 bp, Artificial sequence
  SiRNA target sequence
gtcctgtacgtatcaatttgcaaga

SEQ ID NO: 114200 - DNA, 25 bp, Artificial sequence
  SiRNA target sequence
tcctgtacgtatcaatttgcaagat

SEQ ID NO: 114201 - DNA, 25 bp, Artificial sequence
  SiRNA target sequence
cctgtacgtatcaatttgcaagatg

SEQ ID NO: 114202 - DNA, 25 bp, Artificial sequence
  SiRNA target sequence
ctgtacgtatcaatttgcaagatga

SEQ ID NO: 114203 - DNA, 25 bp, Artificial sequence
  SiRNA target sequence
tgtacgtatcaatttgcaagatgat

SEQ ID NO: 114204 - DNA, 25 bp, Artificial sequence
  SiRNA target sequence
gtacgtatcaatttgcaagatgata

SEQ ID NO: 114205 - DNA, 25 bp, Artificial sequence
  SiRNA target sequence
tacgtatcaatttgcaagatgatag

SEQ ID NO: 114206 - DNA, 25 bp, Artificial sequence
  SiRNA target sequence
acgtatcaatttgcaagatgatagg

SEQ ID NO: 114207 - DNA, 25 bp, Artificial sequence
  SiRNA target sequence
cgtatcaatttgcaagatgataggt

SEQ ID NO: 114208 - DNA, 25 bp, Artificial sequence
  SiRNA target sequence
gtatcaatttgcaagatgataggtc

SEQ ID NO: 114209 - DNA, 25 bp, Artificial sequence
  SiRNA target sequence
tatcaatttgcaagatgataggtcc

SEQ ID NO: 114210 - DNA, 25 bp, Artificial sequence
  SiRNA target sequence
atcaatttgcaagatgataggtcct

SEQ ID NO: 114211 - DNA, 25 bp, Artificial sequence
  SiRNA target sequence
tcaatttgcaagatgataggtcctt

SEQ ID NO: 114212 - DNA, 25 bp, Artificial sequence
  SiRNA target sequence
caatttgcaagatgataggtccttt

SEQ ID NO: 114213 - DNA, 25 bp, Artificial sequence
  SiRNA target sequence
aatttgcaagatgataggtcctttt

SEQ ID NO: 114214 - DNA, 25 bp, Artificial sequence
  SiRNA target sequence
atttgcaagatgataggtccttttt

SEQ ID NO: 114215 - DNA, 25 bp, Artificial sequence
  SiRNA target sequence
tttgcaagatgataggtcctttttc

SEQ ID NO: 114216 - DNA, 25 bp, Artificial sequence
  SiRNA target sequence
ttgcaagatgataggtcctttttct

SEQ ID NO: 114217 - DNA, 25 bp, Artificial sequence
  SiRNA target sequence
tgcaagatgataggtcctttttcta

SEQ ID NO: 114218 - DNA, 25 bp, Artificial sequence
  SiRNA target sequence
gcaagatgataggtcctttttctat

SEQ ID NO: 114219 - DNA, 25 bp, Artificial sequence
  SiRNA target sequence
caagatgataggtcctttttctatt

SEQ ID NO: 114220 - DNA, 25 bp, Artificial sequence
  SiRNA target sequence
aagatgataggtcctttttctattg

SEQ ID NO: 114221 - DNA, 25 bp, Artificial sequence
  SiRNA target sequence
agatgataggtcctttttctattgc

SEQ ID NO: 114222 - DNA, 25 bp, Artificial sequence
  SiRNA target sequence
gatgataggtcctttttctattgca

SEQ ID NO: 114223 - DNA, 25 bp, Artificial sequence
  SiRNA target sequence
atgataggtcctttttctattgcat

SEQ ID NO: 114224 - DNA, 25 bp, Artificial sequence
  SiRNA target sequence
tgataggtcctttttctattgcatg

SEQ ID NO: 114225 - DNA, 25 bp, Artificial sequence
  SiRNA target sequence
gataggtcctttttctattgcatgt

SEQ ID NO: 114226 - DNA, 25 bp, Artificial sequence
  SiRNA target sequence
ataggtcctttttctattgcatgtt

SEQ ID NO: 114227 - DNA, 25 bp, Artificial sequence
  SiRNA target sequence
taggtcctttttctattgcatgttg

SEQ ID NO: 114228 - DNA, 25 bp, Artificial sequence
  SiRNA target sequence
aggtcctttttctattgcatgttgt

SEQ ID NO: 114229 - DNA, 25 bp, Artificial sequence
  SiRNA target sequence
ggtcctttttctattgcatgttgtc

SEQ ID NO: 114230 - DNA, 25 bp, Artificial sequence
  SiRNA target sequence
gtcctttttctattgcatgttgtct

SEQ ID NO: 114231 - DNA, 25 bp, Artificial sequence
  SiRNA target sequence
tcctttttctattgcatgttgtcta

SEQ ID NO: 114232 - DNA, 25 bp, Artificial sequence
  SiRNA target sequence
cctttttctattgcatgttgtctag

SEQ ID NO: 114233 - DNA, 25 bp, Artificial sequence
  SiRNA target sequence
ctttttctattgcatgttgtctagc

SEQ ID NO: 114234 - DNA, 25 bp, Artificial sequence
  SiRNA target sequence
tttttctattgcatgttgtctagca

SEQ ID NO: 114235 - DNA, 25 bp, Artificial sequence
  SiRNA target sequence
ttttctattgcatgttgtctagcaa

SEQ ID NO: 114236 - DNA, 25 bp, Artificial sequence
  SiRNA target sequence
tttctattgcatgttgtctagcaaa

SEQ ID NO: 114237 - DNA, 25 bp, Artificial sequence
  SiRNA target sequence
ttctattgcatgttgtctagcaaat

SEQ ID NO: 114238 - DNA, 25 bp, Artificial sequence
  SiRNA target sequence
tctattgcatgttgtctagcaaatg

SEQ ID NO: 114239 - DNA, 25 bp, Artificial sequence
  SiRNA target sequence
ctattgcatgttgtctagcaaatgt

SEQ ID NO: 114240 - DNA, 25 bp, Artificial sequence
  SiRNA target sequence
tattgcatgttgtctagcaaatgta

SEQ ID NO: 114241 - DNA, 25 bp, Artificial sequence
  SiRNA target sequence
attgcatgttgtctagcaaatgtaa

SEQ ID NO: 114242 - DNA, 25 bp, Artificial sequence
  SiRNA target sequence
ttgcatgttgtctagcaaatgtaaa

SEQ ID NO: 114243 - DNA, 25 bp, Artificial sequence
  SiRNA target sequence
tgcatgttgtctagcaaatgtaaat

SEQ ID NO: 114244 - DNA, 25 bp, Artificial sequence
  SiRNA target sequence
gcatgttgtctagcaaatgtaaata

SEQ ID NO: 114245 - DNA, 25 bp, Artificial sequence
  SiRNA target sequence
catgttgtctagcaaatgtaaatac

SEQ ID NO: 114246 - DNA, 25 bp, Artificial sequence
  SiRNA target sequence
atgttgtctagcaaatgtaaataca

SEQ ID NO: 114247 - DNA, 25 bp, Artificial sequence
  SiRNA target sequence
tgttgtctagcaaatgtaaatacat

SEQ ID NO: 114248 - DNA, 25 bp, Artificial sequence
  SiRNA target sequence
gttgtctagcaaatgtaaatacatc

SEQ ID NO: 114249 - DNA, 25 bp, Artificial sequence
  SiRNA target sequence
ttgtctagcaaatgtaaatacatca

SEQ ID NO: 114250 - DNA, 25 bp, Artificial sequence
  SiRNA target sequence
tgtctagcaaatgtaaatacatcaa

SEQ ID NO: 114251 - DNA, 25 bp, Artificial sequence
  SiRNA target sequence
gtctagcaaatgtaaatacatcaat

SEQ ID NO: 114252 - DNA, 25 bp, Artificial sequence
  SiRNA target sequence
tctagcaaatgtaaatacatcaatc

SEQ ID NO: 114253 - DNA, 25 bp, Artificial sequence
  SiRNA target sequence
ctagcaaatgtaaatacatcaatca

SEQ ID NO: 114254 - DNA, 25 bp, Artificial sequence
  SiRNA target sequence
tagcaaatgtaaatacatcaatcag

SEQ ID NO: 114255 - DNA, 25 bp, Artificial sequence
  SiRNA target sequence
agcaaatgtaaatacatcaatcagt

SEQ ID NO: 114256 - DNA, 25 bp, Artificial sequence
  SiRNA target sequence
gcaaatgtaaatacatcaatcagtt

SEQ ID NO: 114257 - DNA, 25 bp, Artificial sequence
  SiRNA target sequence
caaatgtaaatacatcaatcagttg

SEQ ID NO: 114258 - DNA, 25 bp, Artificial sequence
  SiRNA target sequence
aaatgtaaatacatcaatcagttga

SEQ ID NO: 114259 - DNA, 25 bp, Artificial sequence
  SiRNA target sequence
aatgtaaatacatcaatcagttgag

SEQ ID NO: 114260 - DNA, 25 bp, Artificial sequence
  SiRNA target sequence
atgtaaatacatcaatcagttgagt

SEQ ID NO: 114261 - DNA, 25 bp, Artificial sequence
  SiRNA target sequence
tgtaaatacatcaatcagttgagtt

SEQ ID NO: 114262 - DNA, 25 bp, Artificial sequence
  SiRNA target sequence
gtaaatacatcaatcagttgagtta

SEQ ID NO: 114263 - DNA, 25 bp, Artificial sequence
  SiRNA target sequence
taaatacatcaatcagttgagttat

SEQ ID NO: 114264 - DNA, 25 bp, Artificial sequence
  SiRNA target sequence
aaatacatcaatcagttgagttatg

SEQ ID NO: 114265 - DNA, 25 bp, Artificial sequence
  SiRNA target sequence
aatacatcaatcagttgagttatgt

SEQ ID NO: 114266 - DNA, 25 bp, Artificial sequence
  SiRNA target sequence
atacatcaatcagttgagttatgtt

SEQ ID NO: 114267 - DNA, 25 bp, Artificial sequence
  SiRNA target sequence
tacatcaatcagttgagttatgttt

SEQ ID NO: 114268 - DNA, 25 bp, Artificial sequence
  SiRNA target sequence
acatcaatcagttgagttatgtttt

SEQ ID NO: 114269 - DNA, 25 bp, Artificial sequence
  SiRNA target sequence
catcaatcagttgagttatgttttt

SEQ ID NO: 114270 - DNA, 25 bp, Artificial sequence
  SiRNA target sequence
atcaatcagttgagttatgttttta

SEQ ID NO: 114271 - DNA, 25 bp, Artificial sequence
  SiRNA target sequence
tcaatcagttgagttatgtttttat

SEQ ID NO: 114272 - DNA, 25 bp, Artificial sequence
  SiRNA target sequence
caatcagttgagttatgtttttatc

SEQ ID NO: 114273 - DNA, 25 bp, Artificial sequence
  SiRNA target sequence
aatcagttgagttatgtttttatct

SEQ ID NO: 114274 - DNA, 25 bp, Artificial sequence
  SiRNA target sequence
atcagttgagttatgtttttatctg

SEQ ID NO: 114275 - DNA, 25 bp, Artificial sequence
  SiRNA target sequence
tcagttgagttatgtttttatctgt

SEQ ID NO: 114276 - DNA, 25 bp, Artificial sequence
  SiRNA target sequence
cagttgagttatgtttttatctgta

SEQ ID NO: 114277 - DNA, 25 bp, Artificial sequence
  SiRNA target sequence
agttgagttatgtttttatctgtaa

SEQ ID NO: 114278 - DNA, 25 bp, Artificial sequence
  SiRNA target sequence
gttgagttatgtttttatctgtaag

SEQ ID NO: 114279 - DNA, 25 bp, Artificial sequence
  SiRNA target sequence
ttgagttatgtttttatctgtaaga

SEQ ID NO: 114280 - DNA, 25 bp, Artificial sequence
  SiRNA target sequence
tgagttatgtttttatctgtaagac

SEQ ID NO: 114281 - DNA, 25 bp, Artificial sequence
  SiRNA target sequence
gagttatgtttttatctgtaagacg

SEQ ID NO: 114282 - DNA, 25 bp, Artificial sequence
  SiRNA target sequence
agttatgtttttatctgtaagacgt

SEQ ID NO: 114283 - DNA, 25 bp, Artificial sequence
  SiRNA target sequence
gttatgtttttatctgtaagacgta

SEQ ID NO: 114284 - DNA, 25 bp, Artificial sequence
  SiRNA target sequence
ttatgtttttatctgtaagacgtat

SEQ ID NO: 114285 - DNA, 25 bp, Artificial sequence
  SiRNA target sequence
tatgtttttatctgtaagacgtata

SEQ ID NO: 114286 - DNA, 25 bp, Artificial sequence
  SiRNA target sequence
atgtttttatctgtaagacgtatac

SEQ ID NO: 114287 - DNA, 25 bp, Artificial sequence
  SiRNA target sequence
tgtttttatctgtaagacgtatacc

SEQ ID NO: 114288 - DNA, 25 bp, Artificial sequence
  SiRNA target sequence
gtttttatctgtaagacgtatacct

SEQ ID NO: 114289 - DNA, 25 bp, Artificial sequence
  SiRNA target sequence
tttttatctgtaagacgtatacctg

SEQ ID NO: 114290 - DNA, 25 bp, Artificial sequence
  SiRNA target sequence
ttttatctgtaagacgtatacctgg

SEQ ID NO: 114291 - DNA, 25 bp, Artificial sequence
  SiRNA target sequence
tttatctgtaagacgtatacctgga

SEQ ID NO: 114292 - DNA, 25 bp, Artificial sequence
  SiRNA target sequence
ttatctgtaagacgtatacctggaa

SEQ ID NO: 114293 - DNA, 25 bp, Artificial sequence
  SiRNA target sequence
tatctgtaagacgtatacctggaat

SEQ ID NO: 114294 - DNA, 25 bp, Artificial sequence
  SiRNA target sequence
atctgtaagacgtatacctggaata

SEQ ID NO: 114295 - DNA, 25 bp, Artificial sequence
  SiRNA target sequence
tctgtaagacgtatacctggaatat

SEQ ID NO: 114296 - DNA, 25 bp, Artificial sequence
  SiRNA target sequence
ctgtaagacgtatacctggaatatt

SEQ ID NO: 114297 - DNA, 25 bp, Artificial sequence
  SiRNA target sequence
tgtaagacgtatacctggaatatta

SEQ ID NO: 114298 - DNA, 25 bp, Artificial sequence
  SiRNA target sequence
gtaagacgtatacctggaatattat

SEQ ID NO: 114299 - DNA, 25 bp, Artificial sequence
  SiRNA target sequence
taagacgtatacctggaatattata

SEQ ID NO: 114300 - DNA, 25 bp, Artificial sequence
  SiRNA target sequence
aagacgtatacctggaatattatat

SEQ ID NO: 114301 - DNA, 25 bp, Artificial sequence
  SiRNA target sequence
agacgtatacctggaatattatatc

SEQ ID NO: 114302 - DNA, 25 bp, Artificial sequence
  SiRNA target sequence
gacgtatacctggaatattatatcc

SEQ ID NO: 114303 - DNA, 25 bp, Artificial sequence
  SiRNA target sequence
acgtatacctggaatattatatccc

SEQ ID NO: 114304 - DNA, 25 bp, Artificial sequence
  SiRNA target sequence
cgtatacctggaatattatatcccc

SEQ ID NO: 114305 - DNA, 25 bp, Artificial sequence
  SiRNA target sequence
gtatacctggaatattatatcccct

SEQ ID NO: 114306 - DNA, 25 bp, Artificial sequence
  SiRNA target sequence
tatacctggaatattatatcccctt

SEQ ID NO: 114307 - DNA, 25 bp, Artificial sequence
  SiRNA target sequence
atacctggaatattatatccccttt

SEQ ID NO: 114308 - DNA, 25 bp, Artificial sequence
  SiRNA target sequence
tacctggaatattatatcccctttt

SEQ ID NO: 114309 - DNA, 25 bp, Artificial sequence
  SiRNA target sequence
acctggaatattatatcccctttta

SEQ ID NO: 114310 - DNA, 25 bp, Artificial sequence
  SiRNA target sequence
cctggaatattatatccccttttaa

SEQ ID NO: 114311 - DNA, 25 bp, Artificial sequence
  SiRNA target sequence
ctggaatattatatccccttttaaa

SEQ ID NO: 114312 - DNA, 25 bp, Artificial sequence
  SiRNA target sequence
tggaatattatatccccttttaaaa

SEQ ID NO: 114313 - DNA, 25 bp, Artificial sequence
  SiRNA target sequence
ggaatattatatccccttttaaaat

SEQ ID NO: 114314 - DNA, 25 bp, Artificial sequence
  SiRNA target sequence
gaatattatatccccttttaaaata

SEQ ID NO: 114315 - DNA, 25 bp, Artificial sequence
  SiRNA target sequence
aatattatatccccttttaaaatat

SEQ ID NO: 114316 - DNA, 25 bp, Artificial sequence
  SiRNA target sequence
atattatatccccttttaaaatatt

SEQ ID NO: 114317 - DNA, 25 bp, Artificial sequence
  SiRNA target sequence
tattatatccccttttaaaatattc

SEQ ID NO: 114318 - DNA, 25 bp, Artificial sequence
  SiRNA target sequence
attatatccccttttaaaatattca

SEQ ID NO: 114319 - DNA, 25 bp, Artificial sequence
  SiRNA target sequence
ttatatccccttttaaaatattcag

SEQ ID NO: 114320 - DNA, 25 bp, Artificial sequence
  SiRNA target sequence
tatatccccttttaaaatattcagg

SEQ ID NO: 114321 - DNA, 25 bp, Artificial sequence
  SiRNA target sequence
atatccccttttaaaatattcagga

SEQ ID NO: 114322 - DNA, 25 bp, Artificial sequence
  SiRNA target sequence
tatccccttttaaaatattcaggat

SEQ ID NO: 114323 - DNA, 25 bp, Artificial sequence
  SiRNA target sequence
atccccttttaaaatattcaggata

SEQ ID NO: 114324 - DNA, 25 bp, Artificial sequence
  SiRNA target sequence
tccccttttaaaatattcaggatat

SEQ ID NO: 114325 - DNA, 25 bp, Artificial sequence
  SiRNA target sequence
ccccttttaaaatattcaggatatg

SEQ ID NO: 114326 - DNA, 25 bp, Artificial sequence
  SiRNA target sequence
cccttttaaaatattcaggatatgt

SEQ ID NO: 114327 - DNA, 25 bp, Artificial sequence
  SiRNA target sequence
ccttttaaaatattcaggatatgta

SEQ ID NO: 114328 - DNA, 25 bp, Artificial sequence
  SiRNA target sequence
cttttaaaatattcaggatatgtag

SEQ ID NO: 114329 - DNA, 25 bp, Artificial sequence
  SiRNA target sequence
ttttaaaatattcaggatatgtagt

SEQ ID NO: 114330 - DNA, 25 bp, Artificial sequence
  SiRNA target sequence
tttaaaatattcaggatatgtagtg

SEQ ID NO: 114331 - DNA, 25 bp, Artificial sequence
  SiRNA target sequence
ttaaaatattcaggatatgtagtgg

SEQ ID NO: 114332 - DNA, 25 bp, Artificial sequence
  SiRNA target sequence
taaaatattcaggatatgtagtgga

SEQ ID NO: 114333 - DNA, 25 bp, Artificial sequence
  SiRNA target sequence
aaaatattcaggatatgtagtggaa

SEQ ID NO: 114334 - DNA, 25 bp, Artificial sequence
  SiRNA target sequence
aaatattcaggatatgtagtggaat

SEQ ID NO: 114335 - DNA, 25 bp, Artificial sequence
  SiRNA target sequence
aatattcaggatatgtagtggaatt

SEQ ID NO: 114336 - DNA, 25 bp, Artificial sequence
  SiRNA target sequence
atattcaggatatgtagtggaatta

SEQ ID NO: 114337 - DNA, 25 bp, Artificial sequence
  SiRNA target sequence
tattcaggatatgtagtggaattac

SEQ ID NO: 114338 - DNA, 25 bp, Artificial sequence
  SiRNA target sequence
attcaggatatgtagtggaattact

SEQ ID NO: 114339 - DNA, 25 bp, Artificial sequence
  SiRNA target sequence
ttcaggatatgtagtggaattactt

SEQ ID NO: 114340 - DNA, 25 bp, Artificial sequence
  SiRNA target sequence
tcaggatatgtagtggaattacttt

SEQ ID NO: 114341 - DNA, 25 bp, Artificial sequence
  SiRNA target sequence
caggatatgtagtggaattactttc

SEQ ID NO: 114342 - DNA, 25 bp, Artificial sequence
  SiRNA target sequence
aggatatgtagtggaattactttca

SEQ ID NO: 114343 - DNA, 25 bp, Artificial sequence
  SiRNA target sequence
ggatatgtagtggaattactttcag

SEQ ID NO: 114344 - DNA, 25 bp, Artificial sequence
  SiRNA target sequence
gatatgtagtggaattactttcagg

SEQ ID NO: 114345 - DNA, 25 bp, Artificial sequence
  SiRNA target sequence
atatgtagtggaattactttcaggt

SEQ ID NO: 114346 - DNA, 25 bp, Artificial sequence
  SiRNA target sequence
tatgtagtggaattactttcaggtg

SEQ ID NO: 114347 - DNA, 25 bp, Artificial sequence
  SiRNA target sequence
atgtagtggaattactttcaggtgt

SEQ ID NO: 114348 - DNA, 25 bp, Artificial sequence
  SiRNA target sequence
tgtagtggaattactttcaggtgtc

SEQ ID NO: 114349 - DNA, 25 bp, Artificial sequence
  SiRNA target sequence
gtagtggaattactttcaggtgtcc

SEQ ID NO: 114350 - DNA, 25 bp, Artificial sequence
  SiRNA target sequence
tagtggaattactttcaggtgtcca

SEQ ID NO: 114351 - DNA, 25 bp, Artificial sequence
  SiRNA target sequence
agtggaattactttcaggtgtccac

SEQ ID NO: 114352 - DNA, 25 bp, Artificial sequence
  SiRNA target sequence
gtggaattactttcaggtgtccaca

SEQ ID NO: 114353 - DNA, 25 bp, Artificial sequence
  SiRNA target sequence
tggaattactttcaggtgtccacat

SEQ ID NO: 114354 - DNA, 25 bp, Artificial sequence
  SiRNA target sequence
ggaattactttcaggtgtccacata

SEQ ID NO: 114355 - DNA, 25 bp, Artificial sequence
  SiRNA target sequence
gaattactttcaggtgtccacatac

SEQ ID NO: 114356 - DNA, 25 bp, Artificial sequence
  SiRNA target sequence
aattactttcaggtgtccacatact

SEQ ID NO: 114357 - DNA, 25 bp, Artificial sequence
  SiRNA target sequence
attactttcaggtgtccacatacta

SEQ ID NO: 114358 - DNA, 25 bp, Artificial sequence
  SiRNA target sequence
ttactttcaggtgtccacatactat

SEQ ID NO: 114359 - DNA, 25 bp, Artificial sequence
  SiRNA target sequence
tactttcaggtgtccacatactata

SEQ ID NO: 114360 - DNA, 25 bp, Artificial sequence
  SiRNA target sequence
actttcaggtgtccacatactataa

SEQ ID NO: 114361 - DNA, 25 bp, Artificial sequence
  SiRNA target sequence
ctttcaggtgtccacatactataat

SEQ ID NO: 114362 - DNA, 25 bp, Artificial sequence
  SiRNA target sequence
tttcaggtgtccacatactataatg

SEQ ID NO: 114363 - DNA, 25 bp, Artificial sequence
  SiRNA target sequence
ttcaggtgtccacatactataatga

SEQ ID NO: 114364 - DNA, 25 bp, Artificial sequence
  SiRNA target sequence
tcaggtgtccacatactataatgat

SEQ ID NO: 114365 - DNA, 25 bp, Artificial sequence
  SiRNA target sequence
caggtgtccacatactataatgatt

SEQ ID NO: 114366 - DNA, 25 bp, Artificial sequence
  SiRNA target sequence
aggtgtccacatactataatgatta

SEQ ID NO: 114367 - DNA, 25 bp, Artificial sequence
  SiRNA target sequence
ggtgtccacatactataatgattat

SEQ ID NO: 114368 - DNA, 25 bp, Artificial sequence
  SiRNA target sequence
gtgtccacatactataatgattatt

SEQ ID NO: 114369 - DNA, 25 bp, Artificial sequence
  SiRNA target sequence
tgtccacatactataatgattattt

SEQ ID NO: 114370 - DNA, 25 bp, Artificial sequence
  SiRNA target sequence
gtccacatactataatgattatttt

SEQ ID NO: 114371 - DNA, 25 bp, Artificial sequence
  SiRNA target sequence
tccacatactataatgattattttc

SEQ ID NO: 114372 - DNA, 25 bp, Artificial sequence
  SiRNA target sequence
ccacatactataatgattattttca

SEQ ID NO: 114373 - DNA, 25 bp, Artificial sequence
  SiRNA target sequence
cacatactataatgattattttcac

SEQ ID NO: 114374 - DNA, 25 bp, Artificial sequence
  SiRNA target sequence
acatactataatgattattttcaca

SEQ ID NO: 114375 - DNA, 25 bp, Artificial sequence
  SiRNA target sequence
catactataatgattattttcacat

SEQ ID NO: 114376 - DNA, 25 bp, Artificial sequence
  SiRNA target sequence
atactataatgattattttcacata

SEQ ID NO: 114377 - DNA, 25 bp, Artificial sequence
  SiRNA target sequence
tactataatgattattttcacatac

SEQ ID NO: 114378 - DNA, 25 bp, Artificial sequence
  SiRNA target sequence
actataatgattattttcacataca

SEQ ID NO: 114379 - DNA, 25 bp, Artificial sequence
  SiRNA target sequence
ctataatgattattttcacatacat

SEQ ID NO: 114380 - DNA, 25 bp, Artificial sequence
  SiRNA target sequence
tataatgattattttcacatacata

SEQ ID NO: 114381 - DNA, 25 bp, Artificial sequence
  SiRNA target sequence
ataatgattattttcacatacataa

SEQ ID NO: 114382 - DNA, 25 bp, Artificial sequence
  SiRNA target sequence
taatgattattttcacatacataaa

SEQ ID NO: 114383 - DNA, 25 bp, Artificial sequence
  SiRNA target sequence
aatgattattttcacatacataaac

SEQ ID NO: 114384 - DNA, 25 bp, Artificial sequence
  SiRNA target sequence
atgattattttcacatacataaacc

SEQ ID NO: 114385 - DNA, 25 bp, Artificial sequence
  SiRNA target sequence
tgattattttcacatacataaacca

SEQ ID NO: 114386 - DNA, 25 bp, Artificial sequence
  SiRNA target sequence
gattattttcacatacataaaccac

SEQ ID NO: 114387 - DNA, 25 bp, Artificial sequence
  SiRNA target sequence
attattttcacatacataaaccaca

SEQ ID NO: 114388 - DNA, 25 bp, Artificial sequence
  SiRNA target sequence
ttattttcacatacataaaccacag

SEQ ID NO: 114389 - DNA, 25 bp, Artificial sequence
  SiRNA target sequence
tattttcacatacataaaccacagg

SEQ ID NO: 114390 - DNA, 25 bp, Artificial sequence
  SiRNA target sequence
attttcacatacataaaccacagga

SEQ ID NO: 114391 - DNA, 25 bp, Artificial sequence
  SiRNA target sequence
ttttcacatacataaaccacaggaa

SEQ ID NO: 114392 - DNA, 25 bp, Artificial sequence
  SiRNA target sequence
tttcacatacataaaccacaggaag

SEQ ID NO: 114393 - DNA, 25 bp, Artificial sequence
  SiRNA target sequence
ttcacatacataaaccacaggaagt

SEQ ID NO: 114394 - DNA, 25 bp, Artificial sequence
  SiRNA target sequence
tcacatacataaaccacaggaagtt

SEQ ID NO: 114395 - DNA, 25 bp, Artificial sequence
  SiRNA target sequence
cacatacataaaccacaggaagttt

SEQ ID NO: 114396 - DNA, 25 bp, Artificial sequence
  SiRNA target sequence
acatacataaaccacaggaagtttc

SEQ ID NO: 114397 - DNA, 25 bp, Artificial sequence
  SiRNA target sequence
catacataaaccacaggaagtttcc

SEQ ID NO: 114398 - DNA, 25 bp, Artificial sequence
  SiRNA target sequence
atacataaaccacaggaagtttcca

SEQ ID NO: 114399 - DNA, 25 bp, Artificial sequence
  SiRNA target sequence
tacataaaccacaggaagtttccat

SEQ ID NO: 114400 - DNA, 25 bp, Artificial sequence
  SiRNA target sequence
acataaaccacaggaagtttccata

SEQ ID NO: 114401 - DNA, 25 bp, Artificial sequence
  SiRNA target sequence
cataaaccacaggaagtttccataa

SEQ ID NO: 114402 - DNA, 25 bp, Artificial sequence
  SiRNA target sequence
ataaaccacaggaagtttccataat

SEQ ID NO: 114403 - DNA, 25 bp, Artificial sequence
  SiRNA target sequence
taaaccacaggaagtttccataatg

SEQ ID NO: 114404 - DNA, 25 bp, Artificial sequence
  SiRNA target sequence
aaaccacaggaagtttccataatgc

SEQ ID NO: 114405 - DNA, 25 bp, Artificial sequence
  SiRNA target sequence
aaccacaggaagtttccataatgca

SEQ ID NO: 114406 - DNA, 25 bp, Artificial sequence
  SiRNA target sequence
accacaggaagtttccataatgcag

SEQ ID NO: 114407 - DNA, 25 bp, Artificial sequence
  SiRNA target sequence
ccacaggaagtttccataatgcagc

SEQ ID NO: 114408 - DNA, 25 bp, Artificial sequence
  SiRNA target sequence
cacaggaagtttccataatgcagcc

SEQ ID NO: 114409 - DNA, 25 bp, Artificial sequence
  SiRNA target sequence
acaggaagtttccataatgcagcca

SEQ ID NO: 114410 - DNA, 25 bp, Artificial sequence
  SiRNA target sequence
caggaagtttccataatgcagccat

SEQ ID NO: 114411 - DNA, 25 bp, Artificial sequence
  SiRNA target sequence
aggaagtttccataatgcagccata

SEQ ID NO: 114412 - DNA, 25 bp, Artificial sequence
  SiRNA target sequence
ggaagtttccataatgcagccatat

SEQ ID NO: 114413 - DNA, 25 bp, Artificial sequence
  SiRNA target sequence
gaagtttccataatgcagccatatt

SEQ ID NO: 114414 - DNA, 25 bp, Artificial sequence
  SiRNA target sequence
aagtttccataatgcagccatattg

SEQ ID NO: 114415 - DNA, 25 bp, Artificial sequence
  SiRNA target sequence
agtttccataatgcagccatattga

SEQ ID NO: 114416 - DNA, 25 bp, Artificial sequence
  SiRNA target sequence
gtttccataatgcagccatattgaa

SEQ ID NO: 114417 - DNA, 25 bp, Artificial sequence
  SiRNA target sequence
tttccataatgcagccatattgaac

SEQ ID NO: 114418 - DNA, 25 bp, Artificial sequence
  SiRNA target sequence
ttccataatgcagccatattgaacg

SEQ ID NO: 114419 - DNA, 25 bp, Artificial sequence
  SiRNA target sequence
tccataatgcagccatattgaacga

SEQ ID NO: 114420 - DNA, 25 bp, Artificial sequence
  SiRNA target sequence
ccataatgcagccatattgaacgac

SEQ ID NO: 114421 - DNA, 25 bp, Artificial sequence
  SiRNA target sequence
cataatgcagccatattgaacgact

SEQ ID NO: 114422 - DNA, 25 bp, Artificial sequence
  SiRNA target sequence
ataatgcagccatattgaacgactc

SEQ ID NO: 114423 - DNA, 25 bp, Artificial sequence
  SiRNA target sequence
taatgcagccatattgaacgactcc

SEQ ID NO: 114424 - DNA, 25 bp, Artificial sequence
  SiRNA target sequence
aatgcagccatattgaacgactccc

SEQ ID NO: 114425 - DNA, 25 bp, Artificial sequence
  SiRNA target sequence
atgcagccatattgaacgactccca

SEQ ID NO: 114426 - DNA, 25 bp, Artificial sequence
  SiRNA target sequence
tgcagccatattgaacgactcccag

SEQ ID NO: 114427 - DNA, 25 bp, Artificial sequence
  SiRNA target sequence
gcagccatattgaacgactcccaga

SEQ ID NO: 114428 - DNA, 25 bp, Artificial sequence
  SiRNA target sequence
cagccatattgaacgactcccagac

SEQ ID NO: 114429 - DNA, 25 bp, Artificial sequence
  SiRNA target sequence
agccatattgaacgactcccagacc

SEQ ID NO: 114430 - DNA, 25 bp, Artificial sequence
  SiRNA target sequence
gccatattgaacgactcccagacct

SEQ ID NO: 114431 - DNA, 25 bp, Artificial sequence
  SiRNA target sequence
ccatattgaacgactcccagacctg

SEQ ID NO: 114432 - DNA, 25 bp, Artificial sequence
  SiRNA target sequence
catattgaacgactcccagacctgt

SEQ ID NO: 114433 - DNA, 25 bp, Artificial sequence
  SiRNA target sequence
atattgaacgactcccagacctgtc

SEQ ID NO: 114434 - DNA, 25 bp, Artificial sequence
  SiRNA target sequence
tattgaacgactcccagacctgtcc

SEQ ID NO: 114435 - DNA, 25 bp, Artificial sequence
  SiRNA target sequence
attgaacgactcccagacctgtccc

SEQ ID NO: 114436 - DNA, 25 bp, Artificial sequence
  SiRNA target sequence
ttgaacgactcccagacctgtccct

SEQ ID NO: 114437 - DNA, 25 bp, Artificial sequence
  SiRNA target sequence
tgaacgactcccagacctgtccctg

SEQ ID NO: 114438 - DNA, 25 bp, Artificial sequence
  SiRNA target sequence
gaacgactcccagacctgtccctga

SEQ ID NO: 114439 - DNA, 25 bp, Artificial sequence
  SiRNA target sequence
aacgactcccagacctgtccctgat

SEQ ID NO: 114440 - DNA, 25 bp, Artificial sequence
  SiRNA target sequence
acgactcccagacctgtccctgatt

SEQ ID NO: 114441 - DNA, 25 bp, Artificial sequence
  SiRNA target sequence
cgactcccagacctgtccctgattt

SEQ ID NO: 114442 - DNA, 25 bp, Artificial sequence
  SiRNA target sequence
gactcccagacctgtccctgatttg

SEQ ID NO: 114443 - DNA, 25 bp, Artificial sequence
  SiRNA target sequence
actcccagacctgtccctgatttgc

SEQ ID NO: 114444 - DNA, 25 bp, Artificial sequence
  SiRNA target sequence
ctcccagacctgtccctgatttgca

SEQ ID NO: 114445 - DNA, 25 bp, Artificial sequence
  SiRNA target sequence
tcccagacctgtccctgatttgcag

SEQ ID NO: 114446 - DNA, 25 bp, Artificial sequence
  SiRNA target sequence
cccagacctgtccctgatttgcagc

SEQ ID NO: 114447 - DNA, 25 bp, Artificial sequence
  SiRNA target sequence
ccagacctgtccctgatttgcagca

SEQ ID NO: 114448 - DNA, 25 bp, Artificial sequence
  SiRNA target sequence
cagacctgtccctgatttgcagcac

SEQ ID NO: 114449 - DNA, 25 bp, Artificial sequence
  SiRNA target sequence
agacctgtccctgatttgcagcacc

SEQ ID NO: 114450 - DNA, 25 bp, Artificial sequence
  SiRNA target sequence
gacctgtccctgatttgcagcacca

SEQ ID NO: 114451 - DNA, 25 bp, Artificial sequence
  SiRNA target sequence
acctgtccctgatttgcagcaccat

SEQ ID NO: 114452 - DNA, 25 bp, Artificial sequence
  SiRNA target sequence
cctgtccctgatttgcagcaccatc

SEQ ID NO: 114453 - DNA, 25 bp, Artificial sequence
  SiRNA target sequence
ctgtccctgatttgcagcaccatcc

SEQ ID NO: 114454 - DNA, 25 bp, Artificial sequence
  SiRNA target sequence
tgtccctgatttgcagcaccatccc

SEQ ID NO: 114455 - DNA, 25 bp, Artificial sequence
  SiRNA target sequence
gtccctgatttgcagcaccatcccc

SEQ ID NO: 114456 - DNA, 25 bp, Artificial sequence
  SiRNA target sequence
tccctgatttgcagcaccatccccg

SEQ ID NO: 114457 - DNA, 25 bp, Artificial sequence
  SiRNA target sequence
ccctgatttgcagcaccatccccga

SEQ ID NO: 114458 - DNA, 25 bp, Artificial sequence
  SiRNA target sequence
cctgatttgcagcaccatccccgaa

SEQ ID NO: 114459 - DNA, 25 bp, Artificial sequence
  SiRNA target sequence
ctgatttgcagcaccatccccgaaa

SEQ ID NO: 114460 - DNA, 25 bp, Artificial sequence
  SiRNA target sequence
tgatttgcagcaccatccccgaaaa

SEQ ID NO: 114461 - DNA, 25 bp, Artificial sequence
  SiRNA target sequence
gatttgcagcaccatccccgaaaaa

SEQ ID NO: 114462 - DNA, 25 bp, Artificial sequence
  SiRNA target sequence
atttgcagcaccatccccgaaaaat

SEQ ID NO: 114463 - DNA, 25 bp, Artificial sequence
  SiRNA target sequence
tttgcagcaccatccccgaaaaata

SEQ ID NO: 114464 - DNA, 25 bp, Artificial sequence
  SiRNA target sequence
ttgcagcaccatccccgaaaaatac

SEQ ID NO: 114465 - DNA, 25 bp, Artificial sequence
  SiRNA target sequence
tgcagcaccatccccgaaaaataca

SEQ ID NO: 114466 - DNA, 25 bp, Artificial sequence
  SiRNA target sequence
gcagcaccatccccgaaaaatacaa

SEQ ID NO: 114467 - DNA, 25 bp, Artificial sequence
  SiRNA target sequence
cagcaccatccccgaaaaatacaaa

SEQ ID NO: 114468 - DNA, 25 bp, Artificial sequence
  SiRNA target sequence
agcaccatccccgaaaaatacaaat

SEQ ID NO: 114469 - DNA, 25 bp, Artificial sequence
  SiRNA target sequence
gcaccatccccgaaaaatacaaatg

SEQ ID NO: 114470 - DNA, 25 bp, Artificial sequence
  SiRNA target sequence
caccatccccgaaaaatacaaatgc

SEQ ID NO: 114471 - DNA, 25 bp, Artificial sequence
  SiRNA target sequence
accatccccgaaaaatacaaatgct

SEQ ID NO: 114472 - DNA, 25 bp, Artificial sequence
  SiRNA target sequence
ccatccccgaaaaatacaaatgcta

SEQ ID NO: 114473 - DNA, 25 bp, Artificial sequence
  SiRNA target sequence
catccccgaaaaatacaaatgctac

SEQ ID NO: 114474 - DNA, 25 bp, Artificial sequence
  SiRNA target sequence
atccccgaaaaatacaaatgctaca

SEQ ID NO: 114475 - DNA, 25 bp, Artificial sequence
  SiRNA target sequence
tccccgaaaaatacaaatgctacat

SEQ ID NO: 114476 - DNA, 25 bp, Artificial sequence
  SiRNA target sequence
ccccgaaaaatacaaatgctacatt

SEQ ID NO: 114477 - DNA, 25 bp, Artificial sequence
  SiRNA target sequence
cccgaaaaatacaaatgctacattt

SEQ ID NO: 114478 - DNA, 25 bp, Artificial sequence
  SiRNA target sequence
ccgaaaaatacaaatgctacatttt

SEQ ID NO: 114479 - DNA, 25 bp, Artificial sequence
  SiRNA target sequence
cgaaaaatacaaatgctacattttt

SEQ ID NO: 114480 - DNA, 25 bp, Artificial sequence
  SiRNA target sequence
gaaaaatacaaatgctacatttttt

SEQ ID NO: 114481 - DNA, 25 bp, Artificial sequence
  SiRNA target sequence
aaaaatacaaatgctacatttttta

SEQ ID NO: 114482 - DNA, 25 bp, Artificial sequence
  SiRNA target sequence
aaaatacaaatgctacattttttac

SEQ ID NO: 114483 - DNA, 25 bp, Artificial sequence
  SiRNA target sequence
aaatacaaatgctacattttttact

SEQ ID NO: 114484 - DNA, 25 bp, Artificial sequence
  SiRNA target sequence
aatacaaatgctacattttttactt

SEQ ID NO: 114485 - DNA, 25 bp, Artificial sequence
  SiRNA target sequence
atacaaatgctacattttttacttt

SEQ ID NO: 114486 - DNA, 25 bp, Artificial sequence
  SiRNA target sequence
tacaaatgctacattttttactttt

SEQ ID NO: 114487 - DNA, 25 bp, Artificial sequence
  SiRNA target sequence
acaaatgctacattttttacttttt

SEQ ID NO: 114488 - DNA, 25 bp, Artificial sequence
  SiRNA target sequence
caaatgctacattttttactttttt

SEQ ID NO: 114489 - DNA, 25 bp, Artificial sequence
  SiRNA target sequence
aaatgctacattttttactttttta

SEQ ID NO: 114490 - DNA, 25 bp, Artificial sequence
  SiRNA target sequence
aatgctacattttttacttttttat

SEQ ID NO: 114491 - DNA, 25 bp, Artificial sequence
  SiRNA target sequence
atgctacattttttacttttttata

SEQ ID NO: 114492 - DNA, 25 bp, Artificial sequence
  SiRNA target sequence
tgctacattttttacttttttatat

SEQ ID NO: 114493 - DNA, 25 bp, Artificial sequence
  SiRNA target sequence
gctacattttttacttttttatatt

SEQ ID NO: 114494 - DNA, 25 bp, Artificial sequence
  SiRNA target sequence
ctacattttttacttttttatattg

SEQ ID NO: 114495 - DNA, 25 bp, Artificial sequence
  SiRNA target sequence
tacattttttacttttttatattgt

SEQ ID NO: 114496 - DNA, 25 bp, Artificial sequence
  SiRNA target sequence
acattttttacttttttatattgta

SEQ ID NO: 114497 - DNA, 25 bp, Artificial sequence
  SiRNA target sequence
cattttttacttttttatattgtaa

SEQ ID NO: 114498 - DNA, 25 bp, Artificial sequence
  SiRNA target sequence
attttttacttttttatattgtaaa

SEQ ID NO: 114499 - DNA, 25 bp, Artificial sequence
  SiRNA target sequence
ttttttacttttttatattgtaaag

SEQ ID NO: 114500 - DNA, 25 bp, Artificial sequence
  SiRNA target sequence
tttttacttttttatattgtaaagc

SEQ ID NO: 114501 - DNA, 25 bp, Artificial sequence
  SiRNA target sequence
ttttacttttttatattgtaaagca

SEQ ID NO: 114502 - DNA, 25 bp, Artificial sequence
  SiRNA target sequence
tttacttttttatattgtaaagcaa

SEQ ID NO: 114503 - DNA, 25 bp, Artificial sequence
  SiRNA target sequence
ttacttttttatattgtaaagcaaa

SEQ ID NO: 114504 - DNA, 25 bp, Artificial sequence
  SiRNA target sequence
tacttttttatattgtaaagcaaat

SEQ ID NO: 114505 - DNA, 25 bp, Artificial sequence
  SiRNA target sequence
acttttttatattgtaaagcaaatc

SEQ ID NO: 114506 - DNA, 25 bp, Artificial sequence
  SiRNA target sequence
cttttttatattgtaaagcaaatcc

SEQ ID NO: 114507 - DNA, 25 bp, Artificial sequence
  SiRNA target sequence
ttttttatattgtaaagcaaatccc

SEQ ID NO: 114508 - DNA, 25 bp, Artificial sequence
  SiRNA target sequence
tttttatattgtaaagcaaatccca

SEQ ID NO: 114509 - DNA, 25 bp, Artificial sequence
  SiRNA target sequence
ttttatattgtaaagcaaatcccaa

SEQ ID NO: 114510 - DNA, 25 bp, Artificial sequence
  SiRNA target sequence
tttatattgtaaagcaaatcccaat

SEQ ID NO: 114511 - DNA, 25 bp, Artificial sequence
  SiRNA target sequence
ttatattgtaaagcaaatcccaatc

SEQ ID NO: 114512 - DNA, 25 bp, Artificial sequence
  SiRNA target sequence
tatattgtaaagcaaatcccaatcc

SEQ ID NO: 114513 - DNA, 25 bp, Artificial sequence
  SiRNA target sequence
atattgtaaagcaaatcccaatcct

SEQ ID NO: 114514 - DNA, 25 bp, Artificial sequence
  SiRNA target sequence
tattgtaaagcaaatcccaatcctg

SEQ ID NO: 114515 - DNA, 25 bp, Artificial sequence
  SiRNA target sequence
attgtaaagcaaatcccaatcctgt

SEQ ID NO: 114516 - DNA, 25 bp, Artificial sequence
  SiRNA target sequence
ttgtaaagcaaatcccaatcctgta

SEQ ID NO: 114517 - DNA, 25 bp, Artificial sequence
  SiRNA target sequence
tgtaaagcaaatcccaatcctgtac

SEQ ID NO: 114518 - DNA, 25 bp, Artificial sequence
  SiRNA target sequence
gtaaagcaaatcccaatcctgtacc

SEQ ID NO: 114519 - DNA, 25 bp, Artificial sequence
  SiRNA target sequence
taaagcaaatcccaatcctgtacca

SEQ ID NO: 114520 - DNA, 25 bp, Artificial sequence
  SiRNA target sequence
aaagcaaatcccaatcctgtaccaa

SEQ ID NO: 114521 - DNA, 25 bp, Artificial sequence
  SiRNA target sequence
aagcaaatcccaatcctgtaccaag

SEQ ID NO: 114522 - DNA, 25 bp, Artificial sequence
  SiRNA target sequence
agcaaatcccaatcctgtaccaagc

SEQ ID NO: 114523 - DNA, 25 bp, Artificial sequence
  SiRNA target sequence
gcaaatcccaatcctgtaccaagcg

SEQ ID NO: 114524 - DNA, 25 bp, Artificial sequence
  SiRNA target sequence
caaatcccaatcctgtaccaagcga

SEQ ID NO: 114525 - DNA, 25 bp, Artificial sequence
  SiRNA target sequence
aaatcccaatcctgtaccaagcgat

SEQ ID NO: 114526 - DNA, 25 bp, Artificial sequence
  SiRNA target sequence
aatcccaatcctgtaccaagcgata

SEQ ID NO: 114527 - DNA, 25 bp, Artificial sequence
  SiRNA target sequence
atcccaatcctgtaccaagcgatac

SEQ ID NO: 114528 - DNA, 25 bp, Artificial sequence
  SiRNA target sequence
tcccaatcctgtaccaagcgatacc

SEQ ID NO: 114529 - DNA, 25 bp, Artificial sequence
  SiRNA target sequence
cccaatcctgtaccaagcgatacct

SEQ ID NO: 114530 - DNA, 25 bp, Artificial sequence
  SiRNA target sequence
ccaatcctgtaccaagcgatacctg

SEQ ID NO: 114531 - DNA, 25 bp, Artificial sequence
  SiRNA target sequence
caatcctgtaccaagcgatacctgc

SEQ ID NO: 114532 - DNA, 25 bp, Artificial sequence
  SiRNA target sequence
aatcctgtaccaagcgatacctgcg

SEQ ID NO: 114533 - DNA, 25 bp, Artificial sequence
  SiRNA target sequence
atcctgtaccaagcgatacctgcgc

SEQ ID NO: 114534 - DNA, 25 bp, Artificial sequence
  SiRNA target sequence
tcctgtaccaagcgatacctgcgca

SEQ ID NO: 114535 - DNA, 25 bp, Artificial sequence
  SiRNA target sequence
cctgtaccaagcgatacctgcgcac

SEQ ID NO: 114536 - DNA, 25 bp, Artificial sequence
  SiRNA target sequence
ctgtaccaagcgatacctgcgcacc

SEQ ID NO: 114537 - DNA, 25 bp, Artificial sequence
  SiRNA target sequence
tgtaccaagcgatacctgcgcacct

SEQ ID NO: 114538 - DNA, 25 bp, Artificial sequence
  SiRNA target sequence
gtaccaagcgatacctgcgcaccta

SEQ ID NO: 114539 - DNA, 25 bp, Artificial sequence
  SiRNA target sequence
taccaagcgatacctgcgcacctac

SEQ ID NO: 114540 - DNA, 25 bp, Artificial sequence
  SiRNA target sequence
accaagcgatacctgcgcacctact

SEQ ID NO: 114541 - DNA, 25 bp, Artificial sequence
  SiRNA target sequence
ccaagcgatacctgcgcacctacta

SEQ ID NO: 114542 - DNA, 25 bp, Artificial sequence
  SiRNA target sequence
caagcgatacctgcgcacctactat

SEQ ID NO: 114543 - DNA, 25 bp, Artificial sequence
  SiRNA target sequence
aagcgatacctgcgcacctactata

SEQ ID NO: 114544 - DNA, 25 bp, Artificial sequence
  SiRNA target sequence
agcgatacctgcgcacctactatac

SEQ ID NO: 114545 - DNA, 25 bp, Artificial sequence
  SiRNA target sequence
gcgatacctgcgcacctactatacc

SEQ ID NO: 114546 - DNA, 25 bp, Artificial sequence
  SiRNA target sequence
cgatacctgcgcacctactataccg

SEQ ID NO: 114547 - DNA, 25 bp, Artificial sequence
  SiRNA target sequence
gatacctgcgcacctactataccgt

SEQ ID NO: 114548 - DNA, 25 bp, Artificial sequence
  SiRNA target sequence
atacctgcgcacctactataccgtg

SEQ ID NO: 114549 - DNA, 25 bp, Artificial sequence
  SiRNA target sequence
tacctgcgcacctactataccgtgt

SEQ ID NO: 114550 - DNA, 25 bp, Artificial sequence
  SiRNA target sequence
acctgcgcacctactataccgtgtc

SEQ ID NO: 114551 - DNA, 25 bp, Artificial sequence
  SiRNA target sequence
cctgcgcacctactataccgtgtcc

SEQ ID NO: 114552 - DNA, 25 bp, Artificial sequence
  SiRNA target sequence
ctgcgcacctactataccgtgtccc

SEQ ID NO: 114553 - DNA, 25 bp, Artificial sequence
  SiRNA target sequence
tgcgcacctactataccgtgtcccc

SEQ ID NO: 114554 - DNA, 25 bp, Artificial sequence
  SiRNA target sequence
gcgcacctactataccgtgtccccc

SEQ ID NO: 114555 - DNA, 25 bp, Artificial sequence
  SiRNA target sequence
cgcacctactataccgtgtccccca

SEQ ID NO: 114556 - DNA, 25 bp, Artificial sequence
  SiRNA target sequence
gcacctactataccgtgtcccccat

SEQ ID NO: 114557 - DNA, 25 bp, Artificial sequence
  SiRNA target sequence
cacctactataccgtgtcccccata

SEQ ID NO: 114558 - DNA, 25 bp, Artificial sequence
  SiRNA target sequence
acctactataccgtgtcccccataa

SEQ ID NO: 114559 - DNA, 25 bp, Artificial sequence
  SiRNA target sequence
cctactataccgtgtcccccataaa

SEQ ID NO: 114560 - DNA, 25 bp, Artificial sequence
  SiRNA target sequence
ctactataccgtgtcccccataaaa

SEQ ID NO: 114561 - DNA, 25 bp, Artificial sequence
  SiRNA target sequence
tactataccgtgtcccccataaaat

SEQ ID NO: 114562 - DNA, 25 bp, Artificial sequence
  SiRNA target sequence
actataccgtgtcccccataaaatt

SEQ ID NO: 114563 - DNA, 25 bp, Artificial sequence
  SiRNA target sequence
ctataccgtgtcccccataaaattg

SEQ ID NO: 114564 - DNA, 25 bp, Artificial sequence
  SiRNA target sequence
tataccgtgtcccccataaaattgg

SEQ ID NO: 114565 - DNA, 25 bp, Artificial sequence
  SiRNA target sequence
ataccgtgtcccccataaaattggt

SEQ ID NO: 114566 - DNA, 25 bp, Artificial sequence
  SiRNA target sequence
taccgtgtcccccataaaattggtc

SEQ ID NO: 114567 - DNA, 25 bp, Artificial sequence
  SiRNA target sequence
accgtgtcccccataaaattggtca

SEQ ID NO: 114568 - DNA, 25 bp, Artificial sequence
  SiRNA target sequence
ccgtgtcccccataaaattggtcat

SEQ ID NO: 114569 - DNA, 25 bp, Artificial sequence
  SiRNA target sequence
cgtgtcccccataaaattggtcatt

SEQ ID NO: 114570 - DNA, 25 bp, Artificial sequence
  SiRNA target sequence
gtgtcccccataaaattggtcatta

SEQ ID NO: 114571 - DNA, 25 bp, Artificial sequence
  SiRNA target sequence
tgtcccccataaaattggtcattat

SEQ ID NO: 114572 - DNA, 25 bp, Artificial sequence
  SiRNA target sequence
gtcccccataaaattggtcattata

SEQ ID NO: 114573 - DNA, 25 bp, Artificial sequence
  SiRNA target sequence
tcccccataaaattggtcattatac

SEQ ID NO: 114574 - DNA, 25 bp, Artificial sequence
  SiRNA target sequence
cccccataaaattggtcattataca

SEQ ID NO: 114575 - DNA, 25 bp, Artificial sequence
  SiRNA target sequence
ccccataaaattggtcattatacaa

SEQ ID NO: 114576 - DNA, 25 bp, Artificial sequence
  SiRNA target sequence
cccataaaattggtcattatacaaa

SEQ ID NO: 114577 - DNA, 25 bp, Artificial sequence
  SiRNA target sequence
ccataaaattggtcattatacaaat

SEQ ID NO: 114578 - DNA, 25 bp, Artificial sequence
  SiRNA target sequence
cataaaattggtcattatacaaatg

SEQ ID NO: 114579 - DNA, 25 bp, Artificial sequence
  SiRNA target sequence
ataaaattggtcattatacaaatgc

SEQ ID NO: 114580 - DNA, 25 bp, Artificial sequence
  SiRNA target sequence
taaaattggtcattatacaaatgca

SEQ ID NO: 114581 - DNA, 25 bp, Artificial sequence
  SiRNA target sequence
aaaattggtcattatacaaatgcat

SEQ ID NO: 114582 - DNA, 25 bp, Artificial sequence
  SiRNA target sequence
aaattggtcattatacaaatgcatc

SEQ ID NO: 114583 - DNA, 25 bp, Artificial sequence
  SiRNA target sequence
aattggtcattatacaaatgcatcg

SEQ ID NO: 114584 - DNA, 25 bp, Artificial sequence
  SiRNA target sequence
attggtcattatacaaatgcatcga

SEQ ID NO: 114585 - DNA, 25 bp, Artificial sequence
  SiRNA target sequence
ttggtcattatacaaatgcatcgat

SEQ ID NO: 114586 - DNA, 25 bp, Artificial sequence
  SiRNA target sequence
tggtcattatacaaatgcatcgatc

SEQ ID NO: 114587 - DNA, 25 bp, Artificial sequence
  SiRNA target sequence
ggtcattatacaaatgcatcgatcc

SEQ ID NO: 114588 - DNA, 25 bp, Artificial sequence
  SiRNA target sequence
gtcattatacaaatgcatcgatcct

SEQ ID NO: 114589 - DNA, 25 bp, Artificial sequence
  SiRNA target sequence
tcattatacaaatgcatcgatcctc

SEQ ID NO: 114590 - DNA, 25 bp, Artificial sequence
  SiRNA target sequence
cattatacaaatgcatcgatcctcc

SEQ ID NO: 114591 - DNA, 25 bp, Artificial sequence
  SiRNA target sequence
attatacaaatgcatcgatcctcct

SEQ ID NO: 114592 - DNA, 25 bp, Artificial sequence
  SiRNA target sequence
ttatacaaatgcatcgatcctcctt

SEQ ID NO: 114593 - DNA, 25 bp, Artificial sequence
  SiRNA target sequence
tatacaaatgcatcgatcctccttt

SEQ ID NO: 114594 - DNA, 25 bp, Artificial sequence
  SiRNA target sequence
atacaaatgcatcgatcctcctttt

SEQ ID NO: 114595 - DNA, 25 bp, Artificial sequence
  SiRNA target sequence
tacaaatgcatcgatcctccttttc

SEQ ID NO: 114596 - DNA, 25 bp, Artificial sequence
  SiRNA target sequence
acaaatgcatcgatcctccttttcc

SEQ ID NO: 114597 - DNA, 25 bp, Artificial sequence
  SiRNA target sequence
caaatgcatcgatcctccttttcct

SEQ ID NO: 114598 - DNA, 25 bp, Artificial sequence
  SiRNA target sequence
aaatgcatcgatcctccttttcctt

SEQ ID NO: 114599 - DNA, 25 bp, Artificial sequence
  SiRNA target sequence
aatgcatcgatcctccttttccttt

SEQ ID NO: 114600 - DNA, 25 bp, Artificial sequence
  SiRNA target sequence
atgcatcgatcctccttttcctttg

SEQ ID NO: 114601 - DNA, 25 bp, Artificial sequence
  SiRNA target sequence
tgcatcgatcctccttttcctttgc

SEQ ID NO: 114602 - DNA, 25 bp, Artificial sequence
  SiRNA target sequence
gcatcgatcctccttttcctttgca

SEQ ID NO: 114603 - DNA, 25 bp, Artificial sequence
  SiRNA target sequence
catcgatcctccttttcctttgcaa

SEQ ID NO: 114604 - DNA, 25 bp, Artificial sequence
  SiRNA target sequence
atcgatcctccttttcctttgcaat

SEQ ID NO: 114605 - DNA, 25 bp, Artificial sequence
  SiRNA target sequence
tcgatcctccttttcctttgcaatt

SEQ ID NO: 114606 - DNA, 25 bp, Artificial sequence
  SiRNA target sequence
cgatcctccttttcctttgcaatta

SEQ ID NO: 114607 - DNA, 25 bp, Artificial sequence
  SiRNA target sequence
gatcctccttttcctttgcaattac

SEQ ID NO: 114608 - DNA, 25 bp, Artificial sequence
  SiRNA target sequence
atcctccttttcctttgcaattacc

SEQ ID NO: 114609 - DNA, 25 bp, Artificial sequence
  SiRNA target sequence
tcctccttttcctttgcaattacca

SEQ ID NO: 114610 - DNA, 25 bp, Artificial sequence
  SiRNA target sequence
cctccttttcctttgcaattaccaa

SEQ ID NO: 114611 - DNA, 25 bp, Artificial sequence
  SiRNA target sequence
ctccttttcctttgcaattaccaat

SEQ ID NO: 114612 - DNA, 25 bp, Artificial sequence
  SiRNA target sequence
tccttttcctttgcaattaccaata

SEQ ID NO: 114613 - DNA, 25 bp, Artificial sequence
  SiRNA target sequence
ccttttcctttgcaattaccaatag

SEQ ID NO: 114614 - DNA, 25 bp, Artificial sequence
  SiRNA target sequence
cttttcctttgcaattaccaatagc

SEQ ID NO: 114615 - DNA, 25 bp, Artificial sequence
  SiRNA target sequence
ttttcctttgcaattaccaatagcc

SEQ ID NO: 114616 - DNA, 25 bp, Artificial sequence
  SiRNA target sequence
tttcctttgcaattaccaatagcct

SEQ ID NO: 114617 - DNA, 25 bp, Artificial sequence
  SiRNA target sequence
ttcctttgcaattaccaatagcctt

SEQ ID NO: 114618 - DNA, 25 bp, Artificial sequence
  SiRNA target sequence
tcctttgcaattaccaatagccttt

SEQ ID NO: 114619 - DNA, 25 bp, Artificial sequence
  SiRNA target sequence
cctttgcaattaccaatagcctttc

SEQ ID NO: 114620 - DNA, 25 bp, Artificial sequence
  SiRNA target sequence
ctttgcaattaccaatagcctttcc

SEQ ID NO: 114621 - DNA, 25 bp, Artificial sequence
  SiRNA target sequence
tttgcaattaccaatagcctttcct

SEQ ID NO: 114622 - DNA, 25 bp, Artificial sequence
  SiRNA target sequence
ttgcaattaccaatagcctttccta

SEQ ID NO: 114623 - DNA, 25 bp, Artificial sequence
  SiRNA target sequence
tgcaattaccaatagcctttcctaa

SEQ ID NO: 114624 - DNA, 25 bp, Artificial sequence
  SiRNA target sequence
gcaattaccaatagcctttcctaat

SEQ ID NO: 114625 - DNA, 25 bp, Artificial sequence
  SiRNA target sequence
caattaccaatagcctttcctaata

SEQ ID NO: 114626 - DNA, 25 bp, Artificial sequence
  SiRNA target sequence
aattaccaatagcctttcctaataa

SEQ ID NO: 114627 - DNA, 25 bp, Artificial sequence
  SiRNA target sequence
attaccaatagcctttcctaataat

SEQ ID NO: 114628 - DNA, 25 bp, Artificial sequence
  SiRNA target sequence
ttaccaatagcctttcctaataatt

SEQ ID NO: 114629 - DNA, 25 bp, Artificial sequence
  SiRNA target sequence
taccaatagcctttcctaataattc

SEQ ID NO: 114630 - DNA, 25 bp, Artificial sequence
  SiRNA target sequence
accaatagcctttcctaataattcc

SEQ ID NO: 114631 - DNA, 25 bp, Artificial sequence
  SiRNA target sequence
ccaatagcctttcctaataattccc

SEQ ID NO: 114632 - DNA, 25 bp, Artificial sequence
  SiRNA target sequence
caatagcctttcctaataattcccc

SEQ ID NO: 114633 - DNA, 25 bp, Artificial sequence
  SiRNA target sequence
aatagcctttcctaataattcccct

SEQ ID NO: 114634 - DNA, 25 bp, Artificial sequence
  SiRNA target sequence
atagcctttcctaataattccccta

SEQ ID NO: 114635 - DNA, 25 bp, Artificial sequence
  SiRNA target sequence
tagcctttcctaataattcccctat

SEQ ID NO: 114636 - DNA, 25 bp, Artificial sequence
  SiRNA target sequence
agcctttcctaataattcccctata

SEQ ID NO: 114637 - DNA, 25 bp, Artificial sequence
  SiRNA target sequence
gcctttcctaataattcccctataa

SEQ ID NO: 114638 - DNA, 25 bp, Artificial sequence
  SiRNA target sequence
cctttcctaataattcccctataat

SEQ ID NO: 114639 - DNA, 25 bp, Artificial sequence
  SiRNA target sequence
ctttcctaataattcccctataata

SEQ ID NO: 114640 - DNA, 25 bp, Artificial sequence
  SiRNA target sequence
tttcctaataattcccctataatac

SEQ ID NO: 114641 - DNA, 25 bp, Artificial sequence
  SiRNA target sequence
ttcctaataattcccctataatact

SEQ ID NO: 114642 - DNA, 25 bp, Artificial sequence
  SiRNA target sequence
tcctaataattcccctataatactt

SEQ ID NO: 114643 - DNA, 25 bp, Artificial sequence
  SiRNA target sequence
cctaataattcccctataatacttt

SEQ ID NO: 114644 - DNA, 25 bp, Artificial sequence
  SiRNA target sequence
ctaataattcccctataatactttc

SEQ ID NO: 114645 - DNA, 25 bp, Artificial sequence
  SiRNA target sequence
taataattcccctataatactttct

SEQ ID NO: 114646 - DNA, 25 bp, Artificial sequence
  SiRNA target sequence
aataattcccctataatactttcta

SEQ ID NO: 114647 - DNA, 25 bp, Artificial sequence
  SiRNA target sequence
ataattcccctataatactttctat

SEQ ID NO: 114648 - DNA, 25 bp, Artificial sequence
  SiRNA target sequence
taattcccctataatactttctata

SEQ ID NO: 114649 - DNA, 25 bp, Artificial sequence
  SiRNA target sequence
aattcccctataatactttctatac

SEQ ID NO: 114650 - DNA, 25 bp, Artificial sequence
  SiRNA target sequence
attcccctataatactttctatact

SEQ ID NO: 114651 - DNA, 25 bp, Artificial sequence
  SiRNA target sequence
ttcccctataatactttctatactg

SEQ ID NO: 114652 - DNA, 25 bp, Artificial sequence
  SiRNA target sequence
tcccctataatactttctatactga

SEQ ID NO: 114653 - DNA, 25 bp, Artificial sequence
  SiRNA target sequence
cccctataatactttctatactgat

SEQ ID NO: 114654 - DNA, 25 bp, Artificial sequence
  SiRNA target sequence
ccctataatactttctatactgatt

SEQ ID NO: 114655 - DNA, 25 bp, Artificial sequence
  SiRNA target sequence
cctataatactttctatactgattc

SEQ ID NO: 114656 - DNA, 25 bp, Artificial sequence
  SiRNA target sequence
ctataatactttctatactgattcc

SEQ ID NO: 114657 - DNA, 25 bp, Artificial sequence
  SiRNA target sequence
tataatactttctatactgattcca

SEQ ID NO: 114658 - DNA, 25 bp, Artificial sequence
  SiRNA target sequence
ataatactttctatactgattccac

SEQ ID NO: 114659 - DNA, 25 bp, Artificial sequence
  SiRNA target sequence
taatactttctatactgattccaca

SEQ ID NO: 114660 - DNA, 25 bp, Artificial sequence
  SiRNA target sequence
aatactttctatactgattccacaa

SEQ ID NO: 114661 - DNA, 25 bp, Artificial sequence
  SiRNA target sequence
atactttctatactgattccacaaa

SEQ ID NO: 114662 - DNA, 25 bp, Artificial sequence
  SiRNA target sequence
tactttctatactgattccacaaat

SEQ ID NO: 114663 - DNA, 25 bp, Artificial sequence
  SiRNA target sequence
actttctatactgattccacaaata

SEQ ID NO: 114664 - DNA, 25 bp, Artificial sequence
  SiRNA target sequence
ctttctatactgattccacaaataa

SEQ ID NO: 114665 - DNA, 25 bp, Artificial sequence
  SiRNA target sequence
tttctatactgattccacaaataaa

SEQ ID NO: 114666 - DNA, 25 bp, Artificial sequence
  SiRNA target sequence
ttctatactgattccacaaataaat

SEQ ID NO: 114667 - DNA, 25 bp, Artificial sequence
  SiRNA target sequence
tctatactgattccacaaataaatg

SEQ ID NO: 114668 - DNA, 25 bp, Artificial sequence
  SiRNA target sequence
ctatactgattccacaaataaatgc

SEQ ID NO: 114669 - DNA, 25 bp, Artificial sequence
  SiRNA target sequence
tatactgattccacaaataaatgct

SEQ ID NO: 114670 - DNA, 25 bp, Artificial sequence
  SiRNA target sequence
atactgattccacaaataaatgcta

SEQ ID NO: 114671 - DNA, 25 bp, Artificial sequence
  SiRNA target sequence
tactgattccacaaataaatgctaa

SEQ ID NO: 114672 - DNA, 25 bp, Artificial sequence
  SiRNA target sequence
actgattccacaaataaatgctaat

SEQ ID NO: 114673 - DNA, 25 bp, Artificial sequence
  SiRNA target sequence
ctgattccacaaataaatgctaatc

SEQ ID NO: 114674 - DNA, 25 bp, Artificial sequence
  SiRNA target sequence
tgattccacaaataaatgctaatcc

SEQ ID NO: 114675 - DNA, 25 bp, Artificial sequence
  SiRNA target sequence
gattccacaaataaatgctaatcca

SEQ ID NO: 114676 - DNA, 25 bp, Artificial sequence
  SiRNA target sequence
attccacaaataaatgctaatccat

SEQ ID NO: 114677 - DNA, 25 bp, Artificial sequence
  SiRNA target sequence
ttccacaaataaatgctaatccatg

SEQ ID NO: 114678 - DNA, 25 bp, Artificial sequence
  SiRNA target sequence
tccacaaataaatgctaatccatgg

SEQ ID NO: 114679 - DNA, 25 bp, Artificial sequence
  SiRNA target sequence
ccacaaataaatgctaatccatggc

SEQ ID NO: 114680 - DNA, 25 bp, Artificial sequence
  SiRNA target sequence
cacaaataaatgctaatccatggca

SEQ ID NO: 114681 - DNA, 25 bp, Artificial sequence
  SiRNA target sequence
acaaataaatgctaatccatggcat

SEQ ID NO: 114682 - DNA, 25 bp, Artificial sequence
  SiRNA target sequence
caaataaatgctaatccatggcatc

SEQ ID NO: 114683 - DNA, 25 bp, Artificial sequence
  SiRNA target sequence
aaataaatgctaatccatggcatct

SEQ ID NO: 114684 - DNA, 25 bp, Artificial sequence
  SiRNA target sequence
aataaatgctaatccatggcatcta

SEQ ID NO: 114685 - DNA, 25 bp, Artificial sequence
  SiRNA target sequence
ataaatgctaatccatggcatctat

SEQ ID NO: 114686 - DNA, 25 bp, Artificial sequence
  SiRNA target sequence
taaatgctaatccatggcatctata

SEQ ID NO: 114687 - DNA, 25 bp, Artificial sequence
  SiRNA target sequence
aaatgctaatccatggcatctataa

SEQ ID NO: 114688 - DNA, 25 bp, Artificial sequence
  SiRNA target sequence
aatgctaatccatggcatctataag

SEQ ID NO: 114689 - DNA, 25 bp, Artificial sequence
  SiRNA target sequence
atgctaatccatggcatctataaga

SEQ ID NO: 114690 - DNA, 25 bp, Artificial sequence
  SiRNA target sequence
tgctaatccatggcatctataagat

SEQ ID NO: 114691 - DNA, 25 bp, Artificial sequence
  SiRNA target sequence
gctaatccatggcatctataagatc

SEQ ID NO: 114692 - DNA, 25 bp, Artificial sequence
  SiRNA target sequence
ctaatccatggcatctataagatcc

SEQ ID NO: 114693 - DNA, 25 bp, Artificial sequence
  SiRNA target sequence
taatccatggcatctataagatcct

SEQ ID NO: 114694 - DNA, 25 bp, Artificial sequence
  SiRNA target sequence
aatccatggcatctataagatccta

SEQ ID NO: 114695 - DNA, 25 bp, Artificial sequence
  SiRNA target sequence
atccatggcatctataagatcctat

SEQ ID NO: 114696 - DNA, 25 bp, Artificial sequence
  SiRNA target sequence
tccatggcatctataagatcctatg

SEQ ID NO: 114697 - DNA, 25 bp, Artificial sequence
  SiRNA target sequence
ccatggcatctataagatcctatga

SEQ ID NO: 114698 - DNA, 25 bp, Artificial sequence
  SiRNA target sequence
catggcatctataagatcctatgac

SEQ ID NO: 114699 - DNA, 25 bp, Artificial sequence
  SiRNA target sequence
atggcatctataagatcctatgact

SEQ ID NO: 114700 - DNA, 25 bp, Artificial sequence
  SiRNA target sequence
tggcatctataagatcctatgactt

SEQ ID NO: 114701 - DNA, 25 bp, Artificial sequence
  SiRNA target sequence
ggcatctataagatcctatgacttt

SEQ ID NO: 114702 - DNA, 25 bp, Artificial sequence
  SiRNA target sequence
gcatctataagatcctatgacttta

SEQ ID NO: 114703 - DNA, 25 bp, Artificial sequence
  SiRNA target sequence
catctataagatcctatgactttat

SEQ ID NO: 114704 - DNA, 25 bp, Artificial sequence
  SiRNA target sequence
atctataagatcctatgactttatc

SEQ ID NO: 114705 - DNA, 25 bp, Artificial sequence
  SiRNA target sequence
tctataagatcctatgactttatca

SEQ ID NO: 114706 - DNA, 25 bp, Artificial sequence
  SiRNA target sequence
ctataagatcctatgactttatcat

SEQ ID NO: 114707 - DNA, 25 bp, Artificial sequence
  SiRNA target sequence
tataagatcctatgactttatcatt

SEQ ID NO: 114708 - DNA, 25 bp, Artificial sequence
  SiRNA target sequence
ataagatcctatgactttatcattt

SEQ ID NO: 114709 - DNA, 25 bp, Artificial sequence
  SiRNA target sequence
taagatcctatgactttatcatttt

SEQ ID NO: 114710 - DNA, 25 bp, Artificial sequence
  SiRNA target sequence
aagatcctatgactttatcattttt

SEQ ID NO: 114711 - DNA, 25 bp, Artificial sequence
  SiRNA target sequence
agatcctatgactttatcattttta

SEQ ID NO: 114712 - DNA, 25 bp, Artificial sequence
  SiRNA target sequence
gatcctatgactttatcatttttat

SEQ ID NO: 114713 - DNA, 25 bp, Artificial sequence
  SiRNA target sequence
atcctatgactttatcatttttatc

SEQ ID NO: 114714 - DNA, 25 bp, Artificial sequence
  SiRNA target sequence
tcctatgactttatcatttttatct

SEQ ID NO: 114715 - DNA, 25 bp, Artificial sequence
  SiRNA target sequence
cctatgactttatcatttttatcta

SEQ ID NO: 114716 - DNA, 25 bp, Artificial sequence
  SiRNA target sequence
ctatgactttatcatttttatctag

SEQ ID NO: 114717 - DNA, 25 bp, Artificial sequence
  SiRNA target sequence
tatgactttatcatttttatctagt

SEQ ID NO: 114718 - DNA, 25 bp, Artificial sequence
  SiRNA target sequence
atgactttatcatttttatctagta

SEQ ID NO: 114719 - DNA, 25 bp, Artificial sequence
  SiRNA target sequence
tgactttatcatttttatctagtac

SEQ ID NO: 114720 - DNA, 25 bp, Artificial sequence
  SiRNA target sequence
gactttatcatttttatctagtacc

SEQ ID NO: 114721 - DNA, 25 bp, Artificial sequence
  SiRNA target sequence
actttatcatttttatctagtacct

SEQ ID NO: 114722 - DNA, 25 bp, Artificial sequence
  SiRNA target sequence
ctttatcatttttatctagtacctt

SEQ ID NO: 114723 - DNA, 25 bp, Artificial sequence
  SiRNA target sequence
tttatcatttttatctagtaccttt

SEQ ID NO: 114724 - DNA, 25 bp, Artificial sequence
  SiRNA target sequence
ttatcatttttatctagtacctttt

SEQ ID NO: 114725 - DNA, 25 bp, Artificial sequence
  SiRNA target sequence
tatcatttttatctagtaccttttg

SEQ ID NO: 114726 - DNA, 25 bp, Artificial sequence
  SiRNA target sequence
atcatttttatctagtaccttttgt

SEQ ID NO: 114727 - DNA, 25 bp, Artificial sequence
  SiRNA target sequence
tcatttttatctagtaccttttgta

SEQ ID NO: 114728 - DNA, 25 bp, Artificial sequence
  SiRNA target sequence
catttttatctagtaccttttgtaa

SEQ ID NO: 114729 - DNA, 25 bp, Artificial sequence
  SiRNA target sequence
atttttatctagtaccttttgtaaa

SEQ ID NO: 114730 - DNA, 25 bp, Artificial sequence
  SiRNA target sequence
tttttatctagtaccttttgtaaac

SEQ ID NO: 114731 - DNA, 25 bp, Artificial sequence
  SiRNA target sequence
ttttatctagtaccttttgtaaact

SEQ ID NO: 114732 - DNA, 25 bp, Artificial sequence
  SiRNA target sequence
tttatctagtaccttttgtaaactc

SEQ ID NO: 114733 - DNA, 25 bp, Artificial sequence
  SiRNA target sequence
ttatctagtaccttttgtaaactca

SEQ ID NO: 114734 - DNA, 25 bp, Artificial sequence
  SiRNA target sequence
tatctagtaccttttgtaaactcat

SEQ ID NO: 114735 - DNA, 25 bp, Artificial sequence
  SiRNA target sequence
atctagtaccttttgtaaactcata

SEQ ID NO: 114736 - DNA, 25 bp, Artificial sequence
  SiRNA target sequence
tctagtaccttttgtaaactcatat

SEQ ID NO: 114737 - DNA, 25 bp, Artificial sequence
  SiRNA target sequence
ctagtaccttttgtaaactcatata

SEQ ID NO: 114738 - DNA, 25 bp, Artificial sequence
  SiRNA target sequence
tagtaccttttgtaaactcatataa

SEQ ID NO: 114739 - DNA, 25 bp, Artificial sequence
  SiRNA target sequence
agtaccttttgtaaactcatataaa

SEQ ID NO: 114740 - DNA, 25 bp, Artificial sequence
  SiRNA target sequence
gtaccttttgtaaactcatataaat

SEQ ID NO: 114741 - DNA, 25 bp, Artificial sequence
  SiRNA target sequence
taccttttgtaaactcatataaatg

SEQ ID NO: 114742 - DNA, 25 bp, Artificial sequence
  SiRNA target sequence
accttttgtaaactcatataaatgt

SEQ ID NO: 114743 - DNA, 25 bp, Artificial sequence
  SiRNA target sequence
ccttttgtaaactcatataaatgtt

SEQ ID NO: 114744 - DNA, 25 bp, Artificial sequence
  SiRNA target sequence
cttttgtaaactcatataaatgttt

SEQ ID NO: 114745 - DNA, 25 bp, Artificial sequence
  SiRNA target sequence
ttttgtaaactcatataaatgtttt

SEQ ID NO: 114746 - DNA, 25 bp, Artificial sequence
  SiRNA target sequence
tttgtaaactcatataaatgttttc

SEQ ID NO: 114747 - DNA, 25 bp, Artificial sequence
  SiRNA target sequence
ttgtaaactcatataaatgttttcc

SEQ ID NO: 114748 - DNA, 25 bp, Artificial sequence
  SiRNA target sequence
tgtaaactcatataaatgttttcct

SEQ ID NO: 114749 - DNA, 25 bp, Artificial sequence
  SiRNA target sequence
gtaaactcatataaatgttttcctg

SEQ ID NO: 114750 - DNA, 25 bp, Artificial sequence
  SiRNA target sequence
taaactcatataaatgttttcctgt

SEQ ID NO: 114751 - DNA, 25 bp, Artificial sequence
  SiRNA target sequence
aaactcatataaatgttttcctgtc

SEQ ID NO: 114752 - DNA, 25 bp, Artificial sequence
  SiRNA target sequence
aactcatataaatgttttcctgtcc

SEQ ID NO: 114753 - DNA, 25 bp, Artificial sequence
  SiRNA target sequence
actcatataaatgttttcctgtcct

SEQ ID NO: 114754 - DNA, 25 bp, Artificial sequence
  SiRNA target sequence
ctcatataaatgttttcctgtccta

SEQ ID NO: 114755 - DNA, 25 bp, Artificial sequence
  SiRNA target sequence
tcatataaatgttttcctgtcctat

SEQ ID NO: 114756 - DNA, 25 bp, Artificial sequence
  SiRNA target sequence
catataaatgttttcctgtcctatt

SEQ ID NO: 114757 - DNA, 25 bp, Artificial sequence
  SiRNA target sequence
atataaatgttttcctgtcctatta

SEQ ID NO: 114758 - DNA, 25 bp, Artificial sequence
  SiRNA target sequence
tataaatgttttcctgtcctattac

SEQ ID NO: 114759 - DNA, 25 bp, Artificial sequence
  SiRNA target sequence
ataaatgttttcctgtcctattact

SEQ ID NO: 114760 - DNA, 25 bp, Artificial sequence
  SiRNA target sequence
taaatgttttcctgtcctattacta

SEQ ID NO: 114761 - DNA, 25 bp, Artificial sequence
  SiRNA target sequence
aaatgttttcctgtcctattactaa

SEQ ID NO: 114762 - DNA, 25 bp, Artificial sequence
  SiRNA target sequence
aatgttttcctgtcctattactaaa

SEQ ID NO: 114763 - DNA, 25 bp, Artificial sequence
  SiRNA target sequence
atgttttcctgtcctattactaaat

SEQ ID NO: 114764 - DNA, 25 bp, Artificial sequence
  SiRNA target sequence
tgttttcctgtcctattactaaatg

SEQ ID NO: 114765 - DNA, 25 bp, Artificial sequence
  SiRNA target sequence
gttttcctgtcctattactaaatga

SEQ ID NO: 114766 - DNA, 25 bp, Artificial sequence
  SiRNA target sequence
ttttcctgtcctattactaaatgac

SEQ ID NO: 114767 - DNA, 25 bp, Artificial sequence
  SiRNA target sequence
tttcctgtcctattactaaatgaca

SEQ ID NO: 114768 - DNA, 25 bp, Artificial sequence
  SiRNA target sequence
ttcctgtcctattactaaatgacag

SEQ ID NO: 114769 - DNA, 25 bp, Artificial sequence
  SiRNA target sequence
tcctgtcctattactaaatgacaga

SEQ ID NO: 114770 - DNA, 25 bp, Artificial sequence
  SiRNA target sequence
cctgtcctattactaaatgacagaa

SEQ ID NO: 114771 - DNA, 25 bp, Artificial sequence
  SiRNA target sequence
ctgtcctattactaaatgacagaag

SEQ ID NO: 114772 - DNA, 25 bp, Artificial sequence
  SiRNA target sequence
tgtcctattactaaatgacagaagc

SEQ ID NO: 114773 - DNA, 25 bp, Artificial sequence
  SiRNA target sequence
gtcctattactaaatgacagaagcc

SEQ ID NO: 114774 - DNA, 25 bp, Artificial sequence
  SiRNA target sequence
tcctattactaaatgacagaagcct

SEQ ID NO: 114775 - DNA, 25 bp, Artificial sequence
  SiRNA target sequence
cctattactaaatgacagaagcctc

SEQ ID NO: 114776 - DNA, 25 bp, Artificial sequence
  SiRNA target sequence
ctattactaaatgacagaagcctct

SEQ ID NO: 114777 - DNA, 25 bp, Artificial sequence
  SiRNA target sequence
tattactaaatgacagaagcctctt

SEQ ID NO: 114778 - DNA, 25 bp, Artificial sequence
  SiRNA target sequence
attactaaatgacagaagcctctta

SEQ ID NO: 114779 - DNA, 25 bp, Artificial sequence
  SiRNA target sequence
ttactaaatgacagaagcctcttat

SEQ ID NO: 114780 - DNA, 25 bp, Artificial sequence
  SiRNA target sequence
tactaaatgacagaagcctcttata

SEQ ID NO: 114781 - DNA, 25 bp, Artificial sequence
  SiRNA target sequence
actaaatgacagaagcctcttatat

SEQ ID NO: 114782 - DNA, 25 bp, Artificial sequence
  SiRNA target sequence
ctaaatgacagaagcctcttatatt

SEQ ID NO: 114783 - DNA, 25 bp, Artificial sequence
  SiRNA target sequence
taaatgacagaagcctcttatattt

SEQ ID NO: 114784 - DNA, 25 bp, Artificial sequence
  SiRNA target sequence
aaatgacagaagcctcttatatttc

SEQ ID NO: 114785 - DNA, 25 bp, Artificial sequence
  SiRNA target sequence
aatgacagaagcctcttatatttcc

SEQ ID NO: 114786 - DNA, 25 bp, Artificial sequence
  SiRNA target sequence
atgacagaagcctcttatatttcct

SEQ ID NO: 114787 - DNA, 25 bp, Artificial sequence
  SiRNA target sequence
tgacagaagcctcttatatttcctt

SEQ ID NO: 114788 - DNA, 25 bp, Artificial sequence
  SiRNA target sequence
gacagaagcctcttatatttccttt

SEQ ID NO: 114789 - DNA, 25 bp, Artificial sequence
  SiRNA target sequence
acagaagcctcttatatttcctttt

SEQ ID NO: 114790 - DNA, 25 bp, Artificial sequence
  SiRNA target sequence
cagaagcctcttatatttccttttt

SEQ ID NO: 114791 - DNA, 25 bp, Artificial sequence
  SiRNA target sequence
agaagcctcttatatttcctttttt

SEQ ID NO: 114792 - DNA, 25 bp, Artificial sequence
  SiRNA target sequence
gaagcctcttatatttcctttttta

SEQ ID NO: 114793 - DNA, 25 bp, Artificial sequence
  SiRNA target sequence
aagcctcttatatttccttttttat

SEQ ID NO: 114794 - DNA, 25 bp, Artificial sequence
  SiRNA target sequence
agcctcttatatttccttttttata

SEQ ID NO: 114795 - DNA, 25 bp, Artificial sequence
  SiRNA target sequence
gcctcttatatttccttttttatac

SEQ ID NO: 114796 - DNA, 25 bp, Artificial sequence
  SiRNA target sequence
cctcttatatttccttttttatact

SEQ ID NO: 114797 - DNA, 25 bp, Artificial sequence
  SiRNA target sequence
ctcttatatttccttttttatactt

SEQ ID NO: 114798 - DNA, 25 bp, Artificial sequence
  SiRNA target sequence
tcttatatttccttttttatactta

SEQ ID NO: 114799 - DNA, 25 bp, Artificial sequence
  SiRNA target sequence
cttatatttccttttttatacttag

SEQ ID NO: 114800 - DNA, 25 bp, Artificial sequence
  SiRNA target sequence
ttatatttccttttttatacttaga

SEQ ID NO: 114801 - DNA, 25 bp, Artificial sequence
  SiRNA target sequence
tatatttccttttttatacttagag

SEQ ID NO: 114802 - DNA, 25 bp, Artificial sequence
  SiRNA target sequence
atatttccttttttatacttagagt

SEQ ID NO: 114803 - DNA, 25 bp, Artificial sequence
  SiRNA target sequence
tatttccttttttatacttagagtt

SEQ ID NO: 114804 - DNA, 25 bp, Artificial sequence
  SiRNA target sequence
atttccttttttatacttagagtta

SEQ ID NO: 114805 - DNA, 25 bp, Artificial sequence
  SiRNA target sequence
tttccttttttatacttagagttag

SEQ ID NO: 114806 - DNA, 25 bp, Artificial sequence
  SiRNA target sequence
ttccttttttatacttagagttagc

SEQ ID NO: 114807 - DNA, 25 bp, Artificial sequence
  SiRNA target sequence
tccttttttatacttagagttagca

SEQ ID NO: 114808 - DNA, 25 bp, Artificial sequence
  SiRNA target sequence
ccttttttatacttagagttagcat

SEQ ID NO: 114809 - DNA, 25 bp, Artificial sequence
  SiRNA target sequence
cttttttatacttagagttagcata

SEQ ID NO: 114810 - DNA, 25 bp, Artificial sequence
  SiRNA target sequence
ttttttatacttagagttagcatat

SEQ ID NO: 114811 - DNA, 25 bp, Artificial sequence
  SiRNA target sequence
tttttatacttagagttagcatatt

SEQ ID NO: 114812 - DNA, 25 bp, Artificial sequence
  SiRNA target sequence
ttttatacttagagttagcatattc

SEQ ID NO: 114813 - DNA, 25 bp, Artificial sequence
  SiRNA target sequence
tttatacttagagttagcatattct

SEQ ID NO: 114814 - DNA, 25 bp, Artificial sequence
  SiRNA target sequence
ttatacttagagttagcatattctt

SEQ ID NO: 114815 - DNA, 25 bp, Artificial sequence
  SiRNA target sequence
tatacttagagttagcatattcttc

SEQ ID NO: 114816 - DNA, 25 bp, Artificial sequence
  SiRNA target sequence
atacttagagttagcatattcttcg

SEQ ID NO: 114817 - DNA, 25 bp, Artificial sequence
  SiRNA target sequence
tacttagagttagcatattcttcga

SEQ ID NO: 114818 - DNA, 25 bp, Artificial sequence
  SiRNA target sequence
acttagagttagcatattcttcgat

SEQ ID NO: 114819 - DNA, 25 bp, Artificial sequence
  SiRNA target sequence
cttagagttagcatattcttcgata

SEQ ID NO: 114820 - DNA, 25 bp, Artificial sequence
  SiRNA target sequence
ttagagttagcatattcttcgataa

SEQ ID NO: 114821 - DNA, 25 bp, Artificial sequence
  SiRNA target sequence
tagagttagcatattcttcgataag

SEQ ID NO: 114822 - DNA, 25 bp, Artificial sequence
  SiRNA target sequence
agagttagcatattcttcgataaga

SEQ ID NO: 114823 - DNA, 25 bp, Artificial sequence
  SiRNA target sequence
gagttagcatattcttcgataagac

SEQ ID NO: 114824 - DNA, 25 bp, Artificial sequence
  SiRNA target sequence
agttagcatattcttcgataagacg

SEQ ID NO: 114825 - DNA, 25 bp, Artificial sequence
  SiRNA target sequence
gttagcatattcttcgataagacgt

SEQ ID NO: 114826 - DNA, 25 bp, Artificial sequence
  SiRNA target sequence
ttagcatattcttcgataagacgta

SEQ ID NO: 114827 - DNA, 25 bp, Artificial sequence
  SiRNA target sequence
tagcatattcttcgataagacgtag

SEQ ID NO: 114828 - DNA, 25 bp, Artificial sequence
  SiRNA target sequence
agcatattcttcgataagacgtaga

SEQ ID NO: 114829 - DNA, 25 bp, Artificial sequence
  SiRNA target sequence
gcatattcttcgataagacgtagaa

SEQ ID NO: 114830 - DNA, 25 bp, Artificial sequence
  SiRNA target sequence
catattcttcgataagacgtagaat

SEQ ID NO: 114831 - DNA, 25 bp, Artificial sequence
  SiRNA target sequence
atattcttcgataagacgtagaatt

SEQ ID NO: 114832 - DNA, 25 bp, Artificial sequence
  SiRNA target sequence
tattcttcgataagacgtagaatta

SEQ ID NO: 114833 - DNA, 25 bp, Artificial sequence
  SiRNA target sequence
attcttcgataagacgtagaattaa

SEQ ID NO: 114834 - DNA, 25 bp, Artificial sequence
  SiRNA target sequence
ttcttcgataagacgtagaattaac

SEQ ID NO: 114835 - DNA, 25 bp, Artificial sequence
  SiRNA target sequence
tcttcgataagacgtagaattaaca

SEQ ID NO: 114836 - DNA, 25 bp, Artificial sequence
  SiRNA target sequence
cttcgataagacgtagaattaacat

SEQ ID NO: 114837 - DNA, 25 bp, Artificial sequence
  SiRNA target sequence
ttcgataagacgtagaattaacata

SEQ ID NO: 114838 - DNA, 25 bp, Artificial sequence
  SiRNA target sequence
tcgataagacgtagaattaacatat

SEQ ID NO: 114839 - DNA, 25 bp, Artificial sequence
  SiRNA target sequence
cgataagacgtagaattaacatatt

SEQ ID NO: 114840 - DNA, 25 bp, Artificial sequence
  SiRNA target sequence
gataagacgtagaattaacatattt

SEQ ID NO: 114841 - DNA, 25 bp, Artificial sequence
  SiRNA target sequence
ataagacgtagaattaacatatttc

SEQ ID NO: 114842 - DNA, 25 bp, Artificial sequence
  SiRNA target sequence
taagacgtagaattaacatatttct

SEQ ID NO: 114843 - DNA, 25 bp, Artificial sequence
  SiRNA target sequence
aagacgtagaattaacatatttcta

SEQ ID NO: 114844 - DNA, 25 bp, Artificial sequence
  SiRNA target sequence
agacgtagaattaacatatttctat

SEQ ID NO: 114845 - DNA, 25 bp, Artificial sequence
  SiRNA target sequence
gacgtagaattaacatatttctata

SEQ ID NO: 114846 - DNA, 25 bp, Artificial sequence
  SiRNA target sequence
acgtagaattaacatatttctataa

SEQ ID NO: 114847 - DNA, 25 bp, Artificial sequence
  SiRNA target sequence
cgtagaattaacatatttctataaa

SEQ ID NO: 114848 - DNA, 25 bp, Artificial sequence
  SiRNA target sequence
gtagaattaacatatttctataaac

SEQ ID NO: 114849 - DNA, 25 bp, Artificial sequence
  SiRNA target sequence
tagaattaacatatttctataaaca

SEQ ID NO: 114850 - DNA, 25 bp, Artificial sequence
  SiRNA target sequence
agaattaacatatttctataaacat

SEQ ID NO: 114851 - DNA, 25 bp, Artificial sequence
  SiRNA target sequence
gaattaacatatttctataaacatc

SEQ ID NO: 114852 - DNA, 25 bp, Artificial sequence
  SiRNA target sequence
aattaacatatttctataaacatct

SEQ ID NO: 114853 - DNA, 25 bp, Artificial sequence
  SiRNA target sequence
attaacatatttctataaacatctt

SEQ ID NO: 114854 - DNA, 25 bp, Artificial sequence
  SiRNA target sequence
ttaacatatttctataaacatcttg

SEQ ID NO: 114855 - DNA, 25 bp, Artificial sequence
  SiRNA target sequence
taacatatttctataaacatcttgt

SEQ ID NO: 114856 - DNA, 25 bp, Artificial sequence
  SiRNA target sequence
aacatatttctataaacatcttgta

SEQ ID NO: 114857 - DNA, 25 bp, Artificial sequence
  SiRNA target sequence
acatatttctataaacatcttgtac

SEQ ID NO: 114858 - DNA, 25 bp, Artificial sequence
  SiRNA target sequence
catatttctataaacatcttgtaca

SEQ ID NO: 114859 - DNA, 25 bp, Artificial sequence
  SiRNA target sequence
atatttctataaacatcttgtacaa

SEQ ID NO: 114860 - DNA, 25 bp, Artificial sequence
  SiRNA target sequence
tatttctataaacatcttgtacaag

SEQ ID NO: 114861 - DNA, 25 bp, Artificial sequence
  SiRNA target sequence
atttctataaacatcttgtacaagt

SEQ ID NO: 114862 - DNA, 25 bp, Artificial sequence
  SiRNA target sequence
tttctataaacatcttgtacaagtt

SEQ ID NO: 114863 - DNA, 25 bp, Artificial sequence
  SiRNA target sequence
ttctataaacatcttgtacaagttc

SEQ ID NO: 114864 - DNA, 25 bp, Artificial sequence
  SiRNA target sequence
tctataaacatcttgtacaagttct

SEQ ID NO: 114865 - DNA, 25 bp, Artificial sequence
  SiRNA target sequence
ctataaacatcttgtacaagttctt

SEQ ID NO: 114866 - DNA, 25 bp, Artificial sequence
  SiRNA target sequence
tataaacatcttgtacaagttcttt

SEQ ID NO: 114867 - DNA, 25 bp, Artificial sequence
  SiRNA target sequence
ataaacatcttgtacaagttctttg

SEQ ID NO: 114868 - DNA, 25 bp, Artificial sequence
  SiRNA target sequence
taaacatcttgtacaagttctttgt

SEQ ID NO: 114869 - DNA, 25 bp, Artificial sequence
  SiRNA target sequence
aaacatcttgtacaagttctttgtt

SEQ ID NO: 114870 - DNA, 25 bp, Artificial sequence
  SiRNA target sequence
aacatcttgtacaagttctttgttt

SEQ ID NO: 114871 - DNA, 25 bp, Artificial sequence
  SiRNA target sequence
acatcttgtacaagttctttgttta

SEQ ID NO: 114872 - DNA, 25 bp, Artificial sequence
  SiRNA target sequence
catcttgtacaagttctttgtttaa

SEQ ID NO: 114873 - DNA, 25 bp, Artificial sequence
  SiRNA target sequence
atcttgtacaagttctttgtttaaa

SEQ ID NO: 114874 - DNA, 25 bp, Artificial sequence
  SiRNA target sequence
tcttgtacaagttctttgtttaaag

SEQ ID NO: 114875 - DNA, 25 bp, Artificial sequence
  SiRNA target sequence
cttgtacaagttctttgtttaaagt

SEQ ID NO: 114876 - DNA, 25 bp, Artificial sequence
  SiRNA target sequence
ttgtacaagttctttgtttaaagta

SEQ ID NO: 114877 - DNA, 25 bp, Artificial sequence
  SiRNA target sequence
tgtacaagttctttgtttaaagtag

SEQ ID NO: 114878 - DNA, 25 bp, Artificial sequence
  SiRNA target sequence
gtacaagttctttgtttaaagtagt

SEQ ID NO: 114879 - DNA, 25 bp, Artificial sequence
  SiRNA target sequence
tacaagttctttgtttaaagtagtt

SEQ ID NO: 114880 - DNA, 25 bp, Artificial sequence
  SiRNA target sequence
acaagttctttgtttaaagtagttt

SEQ ID NO: 114881 - DNA, 25 bp, Artificial sequence
  SiRNA target sequence
caagttctttgtttaaagtagtttt

SEQ ID NO: 114882 - DNA, 25 bp, Artificial sequence
  SiRNA target sequence
aagttctttgtttaaagtagttttc

SEQ ID NO: 114883 - DNA, 25 bp, Artificial sequence
  SiRNA target sequence
agttctttgtttaaagtagttttca

SEQ ID NO: 114884 - DNA, 25 bp, Artificial sequence
  SiRNA target sequence
gttctttgtttaaagtagttttcag

SEQ ID NO: 114885 - DNA, 25 bp, Artificial sequence
  SiRNA target sequence
ttctttgtttaaagtagttttcagt

SEQ ID NO: 114886 - DNA, 25 bp, Artificial sequence
  SiRNA target sequence
tctttgtttaaagtagttttcagtt

SEQ ID NO: 114887 - DNA, 25 bp, Artificial sequence
  SiRNA target sequence
ctttgtttaaagtagttttcagttt

SEQ ID NO: 114888 - DNA, 25 bp, Artificial sequence
  SiRNA target sequence
tttgtttaaagtagttttcagttta

SEQ ID NO: 114889 - DNA, 25 bp, Artificial sequence
  SiRNA target sequence
ttgtttaaagtagttttcagtttaa

SEQ ID NO: 114890 - DNA, 25 bp, Artificial sequence
  SiRNA target sequence
tgtttaaagtagttttcagtttaac

SEQ ID NO: 114891 - DNA, 25 bp, Artificial sequence
  SiRNA target sequence
gtttaaagtagttttcagtttaact

SEQ ID NO: 114892 - DNA, 25 bp, Artificial sequence
  SiRNA target sequence
tttaaagtagttttcagtttaactg

SEQ ID NO: 114893 - DNA, 25 bp, Artificial sequence
  SiRNA target sequence
ttaaagtagttttcagtttaactgt

SEQ ID NO: 114894 - DNA, 25 bp, Artificial sequence
  SiRNA target sequence
taaagtagttttcagtttaactgta

SEQ ID NO: 114895 - DNA, 25 bp, Artificial sequence
  SiRNA target sequence
aaagtagttttcagtttaactgtat

SEQ ID NO: 114896 - DNA, 25 bp, Artificial sequence
  SiRNA target sequence
aagtagttttcagtttaactgtatt

SEQ ID NO: 114897 - DNA, 25 bp, Artificial sequence
  SiRNA target sequence
agtagttttcagtttaactgtattt

SEQ ID NO: 114898 - DNA, 25 bp, Artificial sequence
  SiRNA target sequence
gtagttttcagtttaactgtatttt

SEQ ID NO: 114899 - DNA, 25 bp, Artificial sequence
  SiRNA target sequence
tagttttcagtttaactgtattttt

SEQ ID NO: 114900 - DNA, 25 bp, Artificial sequence
  SiRNA target sequence
agttttcagtttaactgtattttta

SEQ ID NO: 114901 - DNA, 25 bp, Artificial sequence
  SiRNA target sequence
gttttcagtttaactgtatttttat

SEQ ID NO: 114902 - DNA, 25 bp, Artificial sequence
  SiRNA target sequence
ttttcagtttaactgtatttttatc

SEQ ID NO: 114903 - DNA, 25 bp, Artificial sequence
  SiRNA target sequence
tttcagtttaactgtatttttatct

SEQ ID NO: 114904 - DNA, 25 bp, Artificial sequence
  SiRNA target sequence
ttcagtttaactgtatttttatcta

SEQ ID NO: 114905 - DNA, 25 bp, Artificial sequence
  SiRNA target sequence
tcagtttaactgtatttttatctac

SEQ ID NO: 114906 - DNA, 25 bp, Artificial sequence
  SiRNA target sequence
cagtttaactgtatttttatctacc

SEQ ID NO: 114907 - DNA, 25 bp, Artificial sequence
  SiRNA target sequence
agtttaactgtatttttatctacca

SEQ ID NO: 114908 - DNA, 25 bp, Artificial sequence
  SiRNA target sequence
gtttaactgtatttttatctaccaa

SEQ ID NO: 114909 - DNA, 25 bp, Artificial sequence
  SiRNA target sequence
tttaactgtatttttatctaccaaa

SEQ ID NO: 114910 - DNA, 25 bp, Artificial sequence
  SiRNA target sequence
ttaactgtatttttatctaccaaat

SEQ ID NO: 114911 - DNA, 25 bp, Artificial sequence
  SiRNA target sequence
taactgtatttttatctaccaaata

SEQ ID NO: 114912 - DNA, 25 bp, Artificial sequence
  SiRNA target sequence
aactgtatttttatctaccaaataa

SEQ ID NO: 114913 - DNA, 25 bp, Artificial sequence
  SiRNA target sequence
actgtatttttatctaccaaataat

SEQ ID NO: 114914 - DNA, 25 bp, Artificial sequence
  SiRNA target sequence
ctgtatttttatctaccaaataata

SEQ ID NO: 114915 - DNA, 25 bp, Artificial sequence
  SiRNA target sequence
tgtatttttatctaccaaataataa

SEQ ID NO: 114916 - DNA, 25 bp, Artificial sequence
  SiRNA target sequence
gtatttttatctaccaaataataat

SEQ ID NO: 114917 - DNA, 25 bp, Artificial sequence
  SiRNA target sequence
tatttttatctaccaaataataatc

SEQ ID NO: 114918 - DNA, 25 bp, Artificial sequence
  SiRNA target sequence
atttttatctaccaaataataatct

SEQ ID NO: 114919 - DNA, 25 bp, Artificial sequence
  SiRNA target sequence
tttttatctaccaaataataatcta

SEQ ID NO: 114920 - DNA, 25 bp, Artificial sequence
  SiRNA target sequence
ttttatctaccaaataataatctat

SEQ ID NO: 114921 - DNA, 25 bp, Artificial sequence
  SiRNA target sequence
tttatctaccaaataataatctatc

SEQ ID NO: 114922 - DNA, 25 bp, Artificial sequence
  SiRNA target sequence
ttatctaccaaataataatctatca

SEQ ID NO: 114923 - DNA, 25 bp, Artificial sequence
  SiRNA target sequence
tatctaccaaataataatctatcat

SEQ ID NO: 114924 - DNA, 26 bp, Artificial sequence
  SiRNA target sequence
ttattcagaataaacatcttttaaaa

SEQ ID NO: 114925 - DNA, 26 bp, Artificial sequence
  SiRNA target sequence
tattcagaataaacatcttttaaaag

SEQ ID NO: 114926 - DNA, 26 bp, Artificial sequence
  SiRNA target sequence
attcagaataaacatcttttaaaagt

SEQ ID NO: 114927 - DNA, 26 bp, Artificial sequence
  SiRNA target sequence
ttcagaataaacatcttttaaaagtt

SEQ ID NO: 114928 - DNA, 26 bp, Artificial sequence
  SiRNA target sequence
tcagaataaacatcttttaaaagttc

SEQ ID NO: 114929 - DNA, 26 bp, Artificial sequence
  SiRNA target sequence
cagaataaacatcttttaaaagttca

SEQ ID NO: 114930 - DNA, 26 bp, Artificial sequence
  SiRNA target sequence
agaataaacatcttttaaaagttcat

SEQ ID NO: 114931 - DNA, 26 bp, Artificial sequence
  SiRNA target sequence
gaataaacatcttttaaaagttcatc

SEQ ID NO: 114932 - DNA, 26 bp, Artificial sequence
  SiRNA target sequence
aataaacatcttttaaaagttcatcg

SEQ ID NO: 114933 - DNA, 26 bp, Artificial sequence
  SiRNA target sequence
ataaacatcttttaaaagttcatcga

SEQ ID NO: 114934 - DNA, 26 bp, Artificial sequence
  SiRNA target sequence
taaacatcttttaaaagttcatcgat

SEQ ID NO: 114935 - DNA, 26 bp, Artificial sequence
  SiRNA target sequence
aaacatcttttaaaagttcatcgata

SEQ ID NO: 114936 - DNA, 26 bp, Artificial sequence
  SiRNA target sequence
aacatcttttaaaagttcatcgatat

SEQ ID NO: 114937 - DNA, 26 bp, Artificial sequence
  SiRNA target sequence
acatcttttaaaagttcatcgatatc

SEQ ID NO: 114938 - DNA, 26 bp, Artificial sequence
  SiRNA target sequence
catcttttaaaagttcatcgatatcg

SEQ ID NO: 114939 - DNA, 26 bp, Artificial sequence
  SiRNA target sequence
atcttttaaaagttcatcgatatcgg

SEQ ID NO: 114940 - DNA, 26 bp, Artificial sequence
  SiRNA target sequence
tcttttaaaagttcatcgatatcggg

SEQ ID NO: 114941 - DNA, 26 bp, Artificial sequence
  SiRNA target sequence
cttttaaaagttcatcgatatcgggt

SEQ ID NO: 114942 - DNA, 26 bp, Artificial sequence
  SiRNA target sequence
ttttaaaagttcatcgatatcgggtt

SEQ ID NO: 114943 - DNA, 26 bp, Artificial sequence
  SiRNA target sequence
tttaaaagttcatcgatatcgggttc

SEQ ID NO: 114944 - DNA, 26 bp, Artificial sequence
  SiRNA target sequence
ttaaaagttcatcgatatcgggttct

SEQ ID NO: 114945 - DNA, 26 bp, Artificial sequence
  SiRNA target sequence
taaaagttcatcgatatcgggttctt

SEQ ID NO: 114946 - DNA, 26 bp, Artificial sequence
  SiRNA target sequence
aaaagttcatcgatatcgggttcttt

SEQ ID NO: 114947 - DNA, 26 bp, Artificial sequence
  SiRNA target sequence
aaagttcatcgatatcgggttcttta

SEQ ID NO: 114948 - DNA, 26 bp, Artificial sequence
  SiRNA target sequence
aagttcatcgatatcgggttctttag

SEQ ID NO: 114949 - DNA, 26 bp, Artificial sequence
  SiRNA target sequence
agttcatcgatatcgggttctttaga

SEQ ID NO: 114950 - DNA, 26 bp, Artificial sequence
  SiRNA target sequence
gttcatcgatatcgggttctttagaa

SEQ ID NO: 114951 - DNA, 26 bp, Artificial sequence
  SiRNA target sequence
ttcatcgatatcgggttctttagaaa

SEQ ID NO: 114952 - DNA, 26 bp, Artificial sequence
  SiRNA target sequence
tcatcgatatcgggttctttagaaaa

SEQ ID NO: 114953 - DNA, 26 bp, Artificial sequence
  SiRNA target sequence
catcgatatcgggttctttagaaaaa

SEQ ID NO: 114954 - DNA, 26 bp, Artificial sequence
  SiRNA target sequence
atcgatatcgggttctttagaaaaaa

SEQ ID NO: 114955 - DNA, 26 bp, Artificial sequence
  SiRNA target sequence
tcgatatcgggttctttagaaaaaat

SEQ ID NO: 114956 - DNA, 26 bp, Artificial sequence
  SiRNA target sequence
cgatatcgggttctttagaaaaaata

SEQ ID NO: 114957 - DNA, 26 bp, Artificial sequence
  SiRNA target sequence
gatatcgggttctttagaaaaaataa

SEQ ID NO: 114958 - DNA, 26 bp, Artificial sequence
  SiRNA target sequence
atatcgggttctttagaaaaaataac

SEQ ID NO: 114959 - DNA, 26 bp, Artificial sequence
  SiRNA target sequence
tatcgggttctttagaaaaaataact

SEQ ID NO: 114960 - DNA, 26 bp, Artificial sequence
  SiRNA target sequence
atcgggttctttagaaaaaataactt

SEQ ID NO: 114961 - DNA, 26 bp, Artificial sequence
  SiRNA target sequence
tcgggttctttagaaaaaataacttt

SEQ ID NO: 114962 - DNA, 26 bp, Artificial sequence
  SiRNA target sequence
cgggttctttagaaaaaataactttt

SEQ ID NO: 114963 - DNA, 26 bp, Artificial sequence
  SiRNA target sequence
gggttctttagaaaaaataacttttt

SEQ ID NO: 114964 - DNA, 26 bp, Artificial sequence
  SiRNA target sequence
ggttctttagaaaaaataactttttt

SEQ ID NO: 114965 - DNA, 26 bp, Artificial sequence
  SiRNA target sequence
gttctttagaaaaaataactttttta

SEQ ID NO: 114966 - DNA, 26 bp, Artificial sequence
  SiRNA target sequence
ttctttagaaaaaataacttttttaa

SEQ ID NO: 114967 - DNA, 26 bp, Artificial sequence
  SiRNA target sequence
tctttagaaaaaataacttttttaac

SEQ ID NO: 114968 - DNA, 26 bp, Artificial sequence
  SiRNA target sequence
ctttagaaaaaataacttttttaaca

SEQ ID NO: 114969 - DNA, 26 bp, Artificial sequence
  SiRNA target sequence
tttagaaaaaataacttttttaacac

SEQ ID NO: 114970 - DNA, 26 bp, Artificial sequence
  SiRNA target sequence
ttagaaaaaataacttttttaacacc

SEQ ID NO: 114971 - DNA, 26 bp, Artificial sequence
  SiRNA target sequence
tagaaaaaataacttttttaacacct

SEQ ID NO: 114972 - DNA, 26 bp, Artificial sequence
  SiRNA target sequence
agaaaaaataacttttttaacacctt

SEQ ID NO: 114973 - DNA, 26 bp, Artificial sequence
  SiRNA target sequence
gaaaaaataacttttttaacaccttc

SEQ ID NO: 114974 - DNA, 26 bp, Artificial sequence
  SiRNA target sequence
aaaaaataacttttttaacaccttct

SEQ ID NO: 114975 - DNA, 26 bp, Artificial sequence
  SiRNA target sequence
aaaaataacttttttaacaccttctt

SEQ ID NO: 114976 - DNA, 26 bp, Artificial sequence
  SiRNA target sequence
aaaataacttttttaacaccttcttc

SEQ ID NO: 114977 - DNA, 26 bp, Artificial sequence
  SiRNA target sequence
aaataacttttttaacaccttcttca

SEQ ID NO: 114978 - DNA, 26 bp, Artificial sequence
  SiRNA target sequence
aataacttttttaacaccttcttcaa

SEQ ID NO: 114979 - DNA, 26 bp, Artificial sequence
  SiRNA target sequence
ataacttttttaacaccttcttcaaa

SEQ ID NO: 114980 - DNA, 26 bp, Artificial sequence
  SiRNA target sequence
taacttttttaacaccttcttcaaag

SEQ ID NO: 114981 - DNA, 26 bp, Artificial sequence
  SiRNA target sequence
aacttttttaacaccttcttcaaagc

SEQ ID NO: 114982 - DNA, 26 bp, Artificial sequence
  SiRNA target sequence
acttttttaacaccttcttcaaagca

SEQ ID NO: 114983 - DNA, 26 bp, Artificial sequence
  SiRNA target sequence
cttttttaacaccttcttcaaagcag

SEQ ID NO: 114984 - DNA, 26 bp, Artificial sequence
  SiRNA target sequence
ttttttaacaccttcttcaaagcagg

SEQ ID NO: 114985 - DNA, 26 bp, Artificial sequence
  SiRNA target sequence
tttttaacaccttcttcaaagcagga

SEQ ID NO: 114986 - DNA, 26 bp, Artificial sequence
  SiRNA target sequence
ttttaacaccttcttcaaagcaggaa

SEQ ID NO: 114987 - DNA, 26 bp, Artificial sequence
  SiRNA target sequence
tttaacaccttcttcaaagcaggaaa

SEQ ID NO: 114988 - DNA, 26 bp, Artificial sequence
  SiRNA target sequence
ttaacaccttcttcaaagcaggaaat

SEQ ID NO: 114989 - DNA, 26 bp, Artificial sequence
  SiRNA target sequence
taacaccttcttcaaagcaggaaatt

SEQ ID NO: 114990 - DNA, 26 bp, Artificial sequence
  SiRNA target sequence
aacaccttcttcaaagcaggaaatta

SEQ ID NO: 114991 - DNA, 26 bp, Artificial sequence
  SiRNA target sequence
acaccttcttcaaagcaggaaattac

SEQ ID NO: 114992 - DNA, 26 bp, Artificial sequence
  SiRNA target sequence
caccttcttcaaagcaggaaattacc

SEQ ID NO: 114993 - DNA, 26 bp, Artificial sequence
  SiRNA target sequence
accttcttcaaagcaggaaattacct

SEQ ID NO: 114994 - DNA, 26 bp, Artificial sequence
  SiRNA target sequence
ccttcttcaaagcaggaaattacctc

SEQ ID NO: 114995 - DNA, 26 bp, Artificial sequence
  SiRNA target sequence
cttcttcaaagcaggaaattacctca

SEQ ID NO: 114996 - DNA, 26 bp, Artificial sequence
  SiRNA target sequence
ttcttcaaagcaggaaattacctcat

SEQ ID NO: 114997 - DNA, 26 bp, Artificial sequence
  SiRNA target sequence
tcttcaaagcaggaaattacctcatc

SEQ ID NO: 114998 - DNA, 26 bp, Artificial sequence
  SiRNA target sequence
cttcaaagcaggaaattacctcatct

SEQ ID NO: 114999 - DNA, 26 bp, Artificial sequence
  SiRNA target sequence
ttcaaagcaggaaattacctcatctt

SEQ ID NO: 115000 - DNA, 26 bp, Artificial sequence
  SiRNA target sequence
tcaaagcaggaaattacctcatcttc

SEQ ID NO: 115001 - DNA, 26 bp, Artificial sequence
  SiRNA target sequence
caaagcaggaaattacctcatcttcg

SEQ ID NO: 115002 - DNA, 26 bp, Artificial sequence
  SiRNA target sequence
aaagcaggaaattacctcatcttcga

SEQ ID NO: 115003 - DNA, 26 bp, Artificial sequence
  SiRNA target sequence
aagcaggaaattacctcatcttcgat

SEQ ID NO: 115004 - DNA, 26 bp, Artificial sequence
  SiRNA target sequence
agcaggaaattacctcatcttcgata

SEQ ID NO: 115005 - DNA, 26 bp, Artificial sequence
  SiRNA target sequence
gcaggaaattacctcatcttcgataa

SEQ ID NO: 115006 - DNA, 26 bp, Artificial sequence
  SiRNA target sequence
caggaaattacctcatcttcgataat

SEQ ID NO: 115007 - DNA, 26 bp, Artificial sequence
  SiRNA target sequence
aggaaattacctcatcttcgataatt

SEQ ID NO: 115008 - DNA, 26 bp, Artificial sequence
  SiRNA target sequence
ggaaattacctcatcttcgataattt

SEQ ID NO: 115009 - DNA, 26 bp, Artificial sequence
  SiRNA target sequence
gaaattacctcatcttcgataatttt

SEQ ID NO: 115010 - DNA, 26 bp, Artificial sequence
  SiRNA target sequence
aaattacctcatcttcgataattttt

SEQ ID NO: 115011 - DNA, 26 bp, Artificial sequence
  SiRNA target sequence
aattacctcatcttcgataattttta

SEQ ID NO: 115012 - DNA, 26 bp, Artificial sequence
  SiRNA target sequence
attacctcatcttcgataatttttac

SEQ ID NO: 115013 - DNA, 26 bp, Artificial sequence
  SiRNA target sequence
ttacctcatcttcgataatttttact

SEQ ID NO: 115014 - DNA, 26 bp, Artificial sequence
  SiRNA target sequence
tacctcatcttcgataatttttactt

SEQ ID NO: 115015 - DNA, 26 bp, Artificial sequence
  SiRNA target sequence
acctcatcttcgataatttttacttc

SEQ ID NO: 115016 - DNA, 26 bp, Artificial sequence
  SiRNA target sequence
cctcatcttcgataatttttacttct

SEQ ID NO: 115017 - DNA, 26 bp, Artificial sequence
  SiRNA target sequence
ctcatcttcgataatttttacttctt

SEQ ID NO: 115018 - DNA, 26 bp, Artificial sequence
  SiRNA target sequence
tcatcttcgataatttttacttcttc

SEQ ID NO: 115019 - DNA, 26 bp, Artificial sequence
  SiRNA target sequence
catcttcgataatttttacttcttca

SEQ ID NO: 115020 - DNA, 26 bp, Artificial sequence
  SiRNA target sequence
atcttcgataatttttacttcttcac

SEQ ID NO: 115021 - DNA, 26 bp, Artificial sequence
  SiRNA target sequence
tcttcgataatttttacttcttcaca

SEQ ID NO: 115022 - DNA, 26 bp, Artificial sequence
  SiRNA target sequence
cttcgataatttttacttcttcacaa

SEQ ID NO: 115023 - DNA, 26 bp, Artificial sequence
  SiRNA target sequence
ttcgataatttttacttcttcacaag

SEQ ID NO: 115024 - DNA, 26 bp, Artificial sequence
  SiRNA target sequence
tcgataatttttacttcttcacaagt

SEQ ID NO: 115025 - DNA, 26 bp, Artificial sequence
  SiRNA target sequence
cgataatttttacttcttcacaagtc

SEQ ID NO: 115026 - DNA, 26 bp, Artificial sequence
  SiRNA target sequence
gataatttttacttcttcacaagtcg

SEQ ID NO: 115027 - DNA, 26 bp, Artificial sequence
  SiRNA target sequence
ataatttttacttcttcacaagtcgc

SEQ ID NO: 115028 - DNA, 26 bp, Artificial sequence
  SiRNA target sequence
taatttttacttcttcacaagtcgca

SEQ ID NO: 115029 - DNA, 26 bp, Artificial sequence
  SiRNA target sequence
aatttttacttcttcacaagtcgcaa

SEQ ID NO: 115030 - DNA, 26 bp, Artificial sequence
  SiRNA target sequence
atttttacttcttcacaagtcgcaaa

SEQ ID NO: 115031 - DNA, 26 bp, Artificial sequence
  SiRNA target sequence
tttttacttcttcacaagtcgcaaat

SEQ ID NO: 115032 - DNA, 26 bp, Artificial sequence
  SiRNA target sequence
ttttacttcttcacaagtcgcaaatt

SEQ ID NO: 115033 - DNA, 26 bp, Artificial sequence
  SiRNA target sequence
tttacttcttcacaagtcgcaaattt

SEQ ID NO: 115034 - DNA, 26 bp, Artificial sequence
  SiRNA target sequence
ttacttcttcacaagtcgcaaatttt

SEQ ID NO: 115035 - DNA, 26 bp, Artificial sequence
  SiRNA target sequence
tacttcttcacaagtcgcaaattttt

SEQ ID NO: 115036 - DNA, 26 bp, Artificial sequence
  SiRNA target sequence
acttcttcacaagtcgcaaatttttg

SEQ ID NO: 115037 - DNA, 26 bp, Artificial sequence
  SiRNA target sequence
cttcttcacaagtcgcaaatttttgt

SEQ ID NO: 115038 - DNA, 26 bp, Artificial sequence
  SiRNA target sequence
ttcttcacaagtcgcaaatttttgta

SEQ ID NO: 115039 - DNA, 26 bp, Artificial sequence
  SiRNA target sequence
tcttcacaagtcgcaaatttttgtaa

SEQ ID NO: 115040 - DNA, 26 bp, Artificial sequence
  SiRNA target sequence
cttcacaagtcgcaaatttttgtaag

SEQ ID NO: 115041 - DNA, 26 bp, Artificial sequence
  SiRNA target sequence
ttcacaagtcgcaaatttttgtaagt

SEQ ID NO: 115042 - DNA, 26 bp, Artificial sequence
  SiRNA target sequence
tcacaagtcgcaaatttttgtaagtt

SEQ ID NO: 115043 - DNA, 26 bp, Artificial sequence
  SiRNA target sequence
cacaagtcgcaaatttttgtaagtta

SEQ ID NO: 115044 - DNA, 26 bp, Artificial sequence
  SiRNA target sequence
acaagtcgcaaatttttgtaagttat

SEQ ID NO: 115045 - DNA, 26 bp, Artificial sequence
  SiRNA target sequence
caagtcgcaaatttttgtaagttatt

SEQ ID NO: 115046 - DNA, 26 bp, Artificial sequence
  SiRNA target sequence
aagtcgcaaatttttgtaagttattt

SEQ ID NO: 115047 - DNA, 26 bp, Artificial sequence
  SiRNA target sequence
agtcgcaaatttttgtaagttatttt

SEQ ID NO: 115048 - DNA, 26 bp, Artificial sequence
  SiRNA target sequence
gtcgcaaatttttgtaagttattttt

SEQ ID NO: 115049 - DNA, 26 bp, Artificial sequence
  SiRNA target sequence
tcgcaaatttttgtaagttatttttt

SEQ ID NO: 115050 - DNA, 26 bp, Artificial sequence
  SiRNA target sequence
cgcaaatttttgtaagttattttttg

SEQ ID NO: 115051 - DNA, 26 bp, Artificial sequence
  SiRNA target sequence
gcaaatttttgtaagttattttttgc

SEQ ID NO: 115052 - DNA, 26 bp, Artificial sequence
  SiRNA target sequence
caaatttttgtaagttattttttgct

SEQ ID NO: 115053 - DNA, 26 bp, Artificial sequence
  SiRNA target sequence
aaatttttgtaagttattttttgctt

SEQ ID NO: 115054 - DNA, 26 bp, Artificial sequence
  SiRNA target sequence
aatttttgtaagttattttttgcttc

SEQ ID NO: 115055 - DNA, 26 bp, Artificial sequence
  SiRNA target sequence
atttttgtaagttattttttgcttct

SEQ ID NO: 115056 - DNA, 26 bp, Artificial sequence
  SiRNA target sequence
tttttgtaagttattttttgcttctt

SEQ ID NO: 115057 - DNA, 26 bp, Artificial sequence
  SiRNA target sequence
ttttgtaagttattttttgcttcttt

SEQ ID NO: 115058 - DNA, 26 bp, Artificial sequence
  SiRNA target sequence
tttgtaagttattttttgcttcttta

SEQ ID NO: 115059 - DNA, 26 bp, Artificial sequence
  SiRNA target sequence
ttgtaagttattttttgcttctttaa

SEQ ID NO: 115060 - DNA, 26 bp, Artificial sequence
  SiRNA target sequence
tgtaagttattttttgcttctttaag

SEQ ID NO: 115061 - DNA, 26 bp, Artificial sequence
  SiRNA target sequence
gtaagttattttttgcttctttaagg

SEQ ID NO: 115062 - DNA, 26 bp, Artificial sequence
  SiRNA target sequence
taagttattttttgcttctttaaggc

SEQ ID NO: 115063 - DNA, 26 bp, Artificial sequence
  SiRNA target sequence
aagttattttttgcttctttaaggca

SEQ ID NO: 115064 - DNA, 26 bp, Artificial sequence
  SiRNA target sequence
agttattttttgcttctttaaggcaa

SEQ ID NO: 115065 - DNA, 26 bp, Artificial sequence
  SiRNA target sequence
gttattttttgcttctttaaggcaat

SEQ ID NO: 115066 - DNA, 26 bp, Artificial sequence
  SiRNA target sequence
ttattttttgcttctttaaggcaatc

SEQ ID NO: 115067 - DNA, 26 bp, Artificial sequence
  SiRNA target sequence
tattttttgcttctttaaggcaatca

SEQ ID NO: 115068 - DNA, 26 bp, Artificial sequence
  SiRNA target sequence
attttttgcttctttaaggcaatcat

SEQ ID NO: 115069 - DNA, 26 bp, Artificial sequence
  SiRNA target sequence
ttttttgcttctttaaggcaatcatt

SEQ ID NO: 115070 - DNA, 26 bp, Artificial sequence
  SiRNA target sequence
tttttgcttctttaaggcaatcatta

SEQ ID NO: 115071 - DNA, 26 bp, Artificial sequence
  SiRNA target sequence
ttttgcttctttaaggcaatcattat

SEQ ID NO: 115072 - DNA, 26 bp, Artificial sequence
  SiRNA target sequence
tttgcttctttaaggcaatcattatt

SEQ ID NO: 115073 - DNA, 26 bp, Artificial sequence
  SiRNA target sequence
ttgcttctttaaggcaatcattattt

SEQ ID NO: 115074 - DNA, 26 bp, Artificial sequence
  SiRNA target sequence
tgcttctttaaggcaatcattatttt

SEQ ID NO: 115075 - DNA, 26 bp, Artificial sequence
  SiRNA target sequence
gcttctttaaggcaatcattattttt

SEQ ID NO: 115076 - DNA, 26 bp, Artificial sequence
  SiRNA target sequence
cttctttaaggcaatcattatttttt

SEQ ID NO: 115077 - DNA, 26 bp, Artificial sequence
  SiRNA target sequence
ttctttaaggcaatcattattttttt

SEQ ID NO: 115078 - DNA, 26 bp, Artificial sequence
  SiRNA target sequence
tctttaaggcaatcattatttttttt

SEQ ID NO: 115079 - DNA, 26 bp, Artificial sequence
  SiRNA target sequence
ctttaaggcaatcattattttttttt

SEQ ID NO: 115080 - DNA, 26 bp, Artificial sequence
  SiRNA target sequence
tttaaggcaatcattatttttttttt

SEQ ID NO: 115081 - DNA, 26 bp, Artificial sequence
  SiRNA target sequence
ttaaggcaatcattattttttttttc

SEQ ID NO: 115082 - DNA, 26 bp, Artificial sequence
  SiRNA target sequence
taaggcaatcattattttttttttca

SEQ ID NO: 115083 - DNA, 26 bp, Artificial sequence
  SiRNA target sequence
aaggcaatcattattttttttttcat

SEQ ID NO: 115084 - DNA, 26 bp, Artificial sequence
  SiRNA target sequence
aggcaatcattattttttttttcatt

SEQ ID NO: 115085 - DNA, 26 bp, Artificial sequence
  SiRNA target sequence
ggcaatcattattttttttttcatta

SEQ ID NO: 115086 - DNA, 26 bp, Artificial sequence
  SiRNA target sequence
gcaatcattattttttttttcattaa

SEQ ID NO: 115087 - DNA, 26 bp, Artificial sequence
  SiRNA target sequence
caatcattattttttttttcattaat

SEQ ID NO: 115088 - DNA, 26 bp, Artificial sequence
  SiRNA target sequence
aatcattattttttttttcattaatt

SEQ ID NO: 115089 - DNA, 26 bp, Artificial sequence
  SiRNA target sequence
atcattattttttttttcattaattt

SEQ ID NO: 115090 - DNA, 26 bp, Artificial sequence
  SiRNA target sequence
tcattattttttttttcattaatttc

SEQ ID NO: 115091 - DNA, 26 bp, Artificial sequence
  SiRNA target sequence
cattattttttttttcattaatttcc

SEQ ID NO: 115092 - DNA, 26 bp, Artificial sequence
  SiRNA target sequence
attattttttttttcattaatttcct

SEQ ID NO: 115093 - DNA, 26 bp, Artificial sequence
  SiRNA target sequence
ttattttttttttcattaatttcctc

SEQ ID NO: 115094 - DNA, 26 bp, Artificial sequence
  SiRNA target sequence
tattttttttttcattaatttcctcc

SEQ ID NO: 115095 - DNA, 26 bp, Artificial sequence
  SiRNA target sequence
attttttttttcattaatttcctccg

SEQ ID NO: 115096 - DNA, 26 bp, Artificial sequence
  SiRNA target sequence
ttttttttttcattaatttcctccgt

SEQ ID NO: 115097 - DNA, 26 bp, Artificial sequence
  SiRNA target sequence
tttttttttcattaatttcctccgtg

SEQ ID NO: 115098 - DNA, 26 bp, Artificial sequence
  SiRNA target sequence
ttttttttcattaatttcctccgtgg

SEQ ID NO: 115099 - DNA, 26 bp, Artificial sequence
  SiRNA target sequence
tttttttcattaatttcctccgtgga

SEQ ID NO: 115100 - DNA, 26 bp, Artificial sequence
  SiRNA target sequence
ttttttcattaatttcctccgtggat

SEQ ID NO: 115101 - DNA, 26 bp, Artificial sequence
  SiRNA target sequence
tttttcattaatttcctccgtggatc

SEQ ID NO: 115102 - DNA, 26 bp, Artificial sequence
  SiRNA target sequence
ttttcattaatttcctccgtggatct

SEQ ID NO: 115103 - DNA, 26 bp, Artificial sequence
  SiRNA target sequence
tttcattaatttcctccgtggatctg

SEQ ID NO: 115104 - DNA, 26 bp, Artificial sequence
  SiRNA target sequence
ttcattaatttcctccgtggatctgt

SEQ ID NO: 115105 - DNA, 26 bp, Artificial sequence
  SiRNA target sequence
tcattaatttcctccgtggatctgta

SEQ ID NO: 115106 - DNA, 26 bp, Artificial sequence
  SiRNA target sequence
cattaatttcctccgtggatctgtaa

SEQ ID NO: 115107 - DNA, 26 bp, Artificial sequence
  SiRNA target sequence
attaatttcctccgtggatctgtaaa

SEQ ID NO: 115108 - DNA, 26 bp, Artificial sequence
  SiRNA target sequence
ttaatttcctccgtggatctgtaaaa

SEQ ID NO: 115109 - DNA, 26 bp, Artificial sequence
  SiRNA target sequence
taatttcctccgtggatctgtaaaaa

SEQ ID NO: 115110 - DNA, 26 bp, Artificial sequence
  SiRNA target sequence
aatttcctccgtggatctgtaaaaat

SEQ ID NO: 115111 - DNA, 26 bp, Artificial sequence
  SiRNA target sequence
atttcctccgtggatctgtaaaaatc

SEQ ID NO: 115112 - DNA, 26 bp, Artificial sequence
  SiRNA target sequence
tttcctccgtggatctgtaaaaatcg

SEQ ID NO: 115113 - DNA, 26 bp, Artificial sequence
  SiRNA target sequence
ttcctccgtggatctgtaaaaatcgt

SEQ ID NO: 115114 - DNA, 26 bp, Artificial sequence
  SiRNA target sequence
tcctccgtggatctgtaaaaatcgtt

SEQ ID NO: 115115 - DNA, 26 bp, Artificial sequence
  SiRNA target sequence
cctccgtggatctgtaaaaatcgtta

SEQ ID NO: 115116 - DNA, 26 bp, Artificial sequence
  SiRNA target sequence
ctccgtggatctgtaaaaatcgttaa

SEQ ID NO: 115117 - DNA, 26 bp, Artificial sequence
  SiRNA target sequence
tccgtggatctgtaaaaatcgttaac

SEQ ID NO: 115118 - DNA, 26 bp, Artificial sequence
  SiRNA target sequence
ccgtggatctgtaaaaatcgttaaca

SEQ ID NO: 115119 - DNA, 26 bp, Artificial sequence
  SiRNA target sequence
cgtggatctgtaaaaatcgttaacat

SEQ ID NO: 115120 - DNA, 26 bp, Artificial sequence
  SiRNA target sequence
gtggatctgtaaaaatcgttaacatc

SEQ ID NO: 115121 - DNA, 26 bp, Artificial sequence
  SiRNA target sequence
tggatctgtaaaaatcgttaacatct

SEQ ID NO: 115122 - DNA, 26 bp, Artificial sequence
  SiRNA target sequence
ggatctgtaaaaatcgttaacatcta

SEQ ID NO: 115123 - DNA, 26 bp, Artificial sequence
  SiRNA target sequence
gatctgtaaaaatcgttaacatctaa

SEQ ID NO: 115124 - DNA, 26 bp, Artificial sequence
  SiRNA target sequence
atctgtaaaaatcgttaacatctaaa

SEQ ID NO: 115125 - DNA, 26 bp, Artificial sequence
  SiRNA target sequence
tctgtaaaaatcgttaacatctaaac

SEQ ID NO: 115126 - DNA, 26 bp, Artificial sequence
  SiRNA target sequence
ctgtaaaaatcgttaacatctaaaca

SEQ ID NO: 115127 - DNA, 26 bp, Artificial sequence
  SiRNA target sequence
tgtaaaaatcgttaacatctaaacag

SEQ ID NO: 115128 - DNA, 26 bp, Artificial sequence
  SiRNA target sequence
gtaaaaatcgttaacatctaaacagg

SEQ ID NO: 115129 - DNA, 26 bp, Artificial sequence
  SiRNA target sequence
taaaaatcgttaacatctaaacagga

SEQ ID NO: 115130 - DNA, 26 bp, Artificial sequence
  SiRNA target sequence
aaaaatcgttaacatctaaacaggag

SEQ ID NO: 115131 - DNA, 26 bp, Artificial sequence
  SiRNA target sequence
aaaatcgttaacatctaaacaggagt

SEQ ID NO: 115132 - DNA, 26 bp, Artificial sequence
  SiRNA target sequence
aaatcgttaacatctaaacaggagtg

SEQ ID NO: 115133 - DNA, 26 bp, Artificial sequence
  SiRNA target sequence
aatcgttaacatctaaacaggagtgc

SEQ ID NO: 115134 - DNA, 26 bp, Artificial sequence
  SiRNA target sequence
atcgttaacatctaaacaggagtgcc

SEQ ID NO: 115135 - DNA, 26 bp, Artificial sequence
  SiRNA target sequence
tcgttaacatctaaacaggagtgccc

SEQ ID NO: 115136 - DNA, 26 bp, Artificial sequence
  SiRNA target sequence
cgttaacatctaaacaggagtgccca

SEQ ID NO: 115137 - DNA, 26 bp, Artificial sequence
  SiRNA target sequence
gttaacatctaaacaggagtgcccac

SEQ ID NO: 115138 - DNA, 26 bp, Artificial sequence
  SiRNA target sequence
ttaacatctaaacaggagtgcccaca

SEQ ID NO: 115139 - DNA, 26 bp, Artificial sequence
  SiRNA target sequence
taacatctaaacaggagtgcccacat

SEQ ID NO: 115140 - DNA, 26 bp, Artificial sequence
  SiRNA target sequence
aacatctaaacaggagtgcccacatg

SEQ ID NO: 115141 - DNA, 26 bp, Artificial sequence
  SiRNA target sequence
acatctaaacaggagtgcccacatgt

SEQ ID NO: 115142 - DNA, 26 bp, Artificial sequence
  SiRNA target sequence
catctaaacaggagtgcccacatgtc

SEQ ID NO: 115143 - DNA, 26 bp, Artificial sequence
  SiRNA target sequence
atctaaacaggagtgcccacatgtcc

SEQ ID NO: 115144 - DNA, 26 bp, Artificial sequence
  SiRNA target sequence
tctaaacaggagtgcccacatgtcct

SEQ ID NO: 115145 - DNA, 26 bp, Artificial sequence
  SiRNA target sequence
ctaaacaggagtgcccacatgtcctg

SEQ ID NO: 115146 - DNA, 26 bp, Artificial sequence
  SiRNA target sequence
taaacaggagtgcccacatgtcctgt

SEQ ID NO: 115147 - DNA, 26 bp, Artificial sequence
  SiRNA target sequence
aaacaggagtgcccacatgtcctgta

SEQ ID NO: 115148 - DNA, 26 bp, Artificial sequence
  SiRNA target sequence
aacaggagtgcccacatgtcctgtac

SEQ ID NO: 115149 - DNA, 26 bp, Artificial sequence
  SiRNA target sequence
acaggagtgcccacatgtcctgtacg

SEQ ID NO: 115150 - DNA, 26 bp, Artificial sequence
  SiRNA target sequence
caggagtgcccacatgtcctgtacgt

SEQ ID NO: 115151 - DNA, 26 bp, Artificial sequence
  SiRNA target sequence
aggagtgcccacatgtcctgtacgta

SEQ ID NO: 115152 - DNA, 26 bp, Artificial sequence
  SiRNA target sequence
ggagtgcccacatgtcctgtacgtat

SEQ ID NO: 115153 - DNA, 26 bp, Artificial sequence
  SiRNA target sequence
gagtgcccacatgtcctgtacgtatc

SEQ ID NO: 115154 - DNA, 26 bp, Artificial sequence
  SiRNA target sequence
agtgcccacatgtcctgtacgtatca

SEQ ID NO: 115155 - DNA, 26 bp, Artificial sequence
  SiRNA target sequence
gtgcccacatgtcctgtacgtatcaa

SEQ ID NO: 115156 - DNA, 26 bp, Artificial sequence
  SiRNA target sequence
tgcccacatgtcctgtacgtatcaat

SEQ ID NO: 115157 - DNA, 26 bp, Artificial sequence
  SiRNA target sequence
gcccacatgtcctgtacgtatcaatt

SEQ ID NO: 115158 - DNA, 26 bp, Artificial sequence
  SiRNA target sequence
cccacatgtcctgtacgtatcaattt

SEQ ID NO: 115159 - DNA, 26 bp, Artificial sequence
  SiRNA target sequence
ccacatgtcctgtacgtatcaatttg

SEQ ID NO: 115160 - DNA, 26 bp, Artificial sequence
  SiRNA target sequence
cacatgtcctgtacgtatcaatttgc

SEQ ID NO: 115161 - DNA, 26 bp, Artificial sequence
  SiRNA target sequence
acatgtcctgtacgtatcaatttgca

SEQ ID NO: 115162 - DNA, 26 bp, Artificial sequence
  SiRNA target sequence
catgtcctgtacgtatcaatttgcaa

SEQ ID NO: 115163 - DNA, 26 bp, Artificial sequence
  SiRNA target sequence
atgtcctgtacgtatcaatttgcaag

SEQ ID NO: 115164 - DNA, 26 bp, Artificial sequence
  SiRNA target sequence
tgtcctgtacgtatcaatttgcaaga

SEQ ID NO: 115165 - DNA, 26 bp, Artificial sequence
  SiRNA target sequence
gtcctgtacgtatcaatttgcaagat

SEQ ID NO: 115166 - DNA, 26 bp, Artificial sequence
  SiRNA target sequence
tcctgtacgtatcaatttgcaagatg

SEQ ID NO: 115167 - DNA, 26 bp, Artificial sequence
  SiRNA target sequence
cctgtacgtatcaatttgcaagatga

SEQ ID NO: 115168 - DNA, 26 bp, Artificial sequence
  SiRNA target sequence
ctgtacgtatcaatttgcaagatgat

SEQ ID NO: 115169 - DNA, 26 bp, Artificial sequence
  SiRNA target sequence
tgtacgtatcaatttgcaagatgata

SEQ ID NO: 115170 - DNA, 26 bp, Artificial sequence
  SiRNA target sequence
gtacgtatcaatttgcaagatgatag

SEQ ID NO: 115171 - DNA, 26 bp, Artificial sequence
  SiRNA target sequence
tacgtatcaatttgcaagatgatagg

SEQ ID NO: 115172 - DNA, 26 bp, Artificial sequence
  SiRNA target sequence
acgtatcaatttgcaagatgataggt

SEQ ID NO: 115173 - DNA, 26 bp, Artificial sequence
  SiRNA target sequence
cgtatcaatttgcaagatgataggtc

SEQ ID NO: 115174 - DNA, 26 bp, Artificial sequence
  SiRNA target sequence
gtatcaatttgcaagatgataggtcc

SEQ ID NO: 115175 - DNA, 26 bp, Artificial sequence
  SiRNA target sequence
tatcaatttgcaagatgataggtcct

SEQ ID NO: 115176 - DNA, 26 bp, Artificial sequence
  SiRNA target sequence
atcaatttgcaagatgataggtcctt

SEQ ID NO: 115177 - DNA, 26 bp, Artificial sequence
  SiRNA target sequence
tcaatttgcaagatgataggtccttt

SEQ ID NO: 115178 - DNA, 26 bp, Artificial sequence
  SiRNA target sequence
caatttgcaagatgataggtcctttt

SEQ ID NO: 115179 - DNA, 26 bp, Artificial sequence
  SiRNA target sequence
aatttgcaagatgataggtccttttt

SEQ ID NO: 115180 - DNA, 26 bp, Artificial sequence
  SiRNA target sequence
atttgcaagatgataggtcctttttc

SEQ ID NO: 115181 - DNA, 26 bp, Artificial sequence
  SiRNA target sequence
tttgcaagatgataggtcctttttct

SEQ ID NO: 115182 - DNA, 26 bp, Artificial sequence
  SiRNA target sequence
ttgcaagatgataggtcctttttcta

SEQ ID NO: 115183 - DNA, 26 bp, Artificial sequence
  SiRNA target sequence
tgcaagatgataggtcctttttctat

SEQ ID NO: 115184 - DNA, 26 bp, Artificial sequence
  SiRNA target sequence
gcaagatgataggtcctttttctatt

SEQ ID NO: 115185 - DNA, 26 bp, Artificial sequence
  SiRNA target sequence
caagatgataggtcctttttctattg

SEQ ID NO: 115186 - DNA, 26 bp, Artificial sequence
  SiRNA target sequence
aagatgataggtcctttttctattgc

SEQ ID NO: 115187 - DNA, 26 bp, Artificial sequence
  SiRNA target sequence
agatgataggtcctttttctattgca

SEQ ID NO: 115188 - DNA, 26 bp, Artificial sequence
  SiRNA target sequence
gatgataggtcctttttctattgcat

SEQ ID NO: 115189 - DNA, 26 bp, Artificial sequence
  SiRNA target sequence
atgataggtcctttttctattgcatg

SEQ ID NO: 115190 - DNA, 26 bp, Artificial sequence
  SiRNA target sequence
tgataggtcctttttctattgcatgt

SEQ ID NO: 115191 - DNA, 26 bp, Artificial sequence
  SiRNA target sequence
gataggtcctttttctattgcatgtt

SEQ ID NO: 115192 - DNA, 26 bp, Artificial sequence
  SiRNA target sequence
ataggtcctttttctattgcatgttg

SEQ ID NO: 115193 - DNA, 26 bp, Artificial sequence
  SiRNA target sequence
taggtcctttttctattgcatgttgt

SEQ ID NO: 115194 - DNA, 26 bp, Artificial sequence
  SiRNA target sequence
aggtcctttttctattgcatgttgtc

SEQ ID NO: 115195 - DNA, 26 bp, Artificial sequence
  SiRNA target sequence
ggtcctttttctattgcatgttgtct

SEQ ID NO: 115196 - DNA, 26 bp, Artificial sequence
  SiRNA target sequence
gtcctttttctattgcatgttgtcta

SEQ ID NO: 115197 - DNA, 26 bp, Artificial sequence
  SiRNA target sequence
tcctttttctattgcatgttgtctag

SEQ ID NO: 115198 - DNA, 26 bp, Artificial sequence
  SiRNA target sequence
cctttttctattgcatgttgtctagc

SEQ ID NO: 115199 - DNA, 26 bp, Artificial sequence
  SiRNA target sequence
ctttttctattgcatgttgtctagca

SEQ ID NO: 115200 - DNA, 26 bp, Artificial sequence
  SiRNA target sequence
tttttctattgcatgttgtctagcaa

SEQ ID NO: 115201 - DNA, 26 bp, Artificial sequence
  SiRNA target sequence
ttttctattgcatgttgtctagcaaa

SEQ ID NO: 115202 - DNA, 26 bp, Artificial sequence
  SiRNA target sequence
tttctattgcatgttgtctagcaaat

SEQ ID NO: 115203 - DNA, 26 bp, Artificial sequence
  SiRNA target sequence
ttctattgcatgttgtctagcaaatg

SEQ ID NO: 115204 - DNA, 26 bp, Artificial sequence
  SiRNA target sequence
tctattgcatgttgtctagcaaatgt

SEQ ID NO: 115205 - DNA, 26 bp, Artificial sequence
  SiRNA target sequence
ctattgcatgttgtctagcaaatgta

SEQ ID NO: 115206 - DNA, 26 bp, Artificial sequence
  SiRNA target sequence
tattgcatgttgtctagcaaatgtaa

SEQ ID NO: 115207 - DNA, 26 bp, Artificial sequence
  SiRNA target sequence
attgcatgttgtctagcaaatgtaaa

SEQ ID NO: 115208 - DNA, 26 bp, Artificial sequence
  SiRNA target sequence
ttgcatgttgtctagcaaatgtaaat

SEQ ID NO: 115209 - DNA, 26 bp, Artificial sequence
  SiRNA target sequence
tgcatgttgtctagcaaatgtaaata

SEQ ID NO: 115210 - DNA, 26 bp, Artificial sequence
  SiRNA target sequence
gcatgttgtctagcaaatgtaaatac

SEQ ID NO: 115211 - DNA, 26 bp, Artificial sequence
  SiRNA target sequence
catgttgtctagcaaatgtaaataca

SEQ ID NO: 115212 - DNA, 26 bp, Artificial sequence
  SiRNA target sequence
atgttgtctagcaaatgtaaatacat

SEQ ID NO: 115213 - DNA, 26 bp, Artificial sequence
  SiRNA target sequence
tgttgtctagcaaatgtaaatacatc

SEQ ID NO: 115214 - DNA, 26 bp, Artificial sequence
  SiRNA target sequence
gttgtctagcaaatgtaaatacatca

SEQ ID NO: 115215 - DNA, 26 bp, Artificial sequence
  SiRNA target sequence
ttgtctagcaaatgtaaatacatcaa

SEQ ID NO: 115216 - DNA, 26 bp, Artificial sequence
  SiRNA target sequence
tgtctagcaaatgtaaatacatcaat

SEQ ID NO: 115217 - DNA, 26 bp, Artificial sequence
  SiRNA target sequence
gtctagcaaatgtaaatacatcaatc

SEQ ID NO: 115218 - DNA, 26 bp, Artificial sequence
  SiRNA target sequence
tctagcaaatgtaaatacatcaatca

SEQ ID NO: 115219 - DNA, 26 bp, Artificial sequence
  SiRNA target sequence
ctagcaaatgtaaatacatcaatcag

SEQ ID NO: 115220 - DNA, 26 bp, Artificial sequence
  SiRNA target sequence
tagcaaatgtaaatacatcaatcagt

SEQ ID NO: 115221 - DNA, 26 bp, Artificial sequence
  SiRNA target sequence
agcaaatgtaaatacatcaatcagtt

SEQ ID NO: 115222 - DNA, 26 bp, Artificial sequence
  SiRNA target sequence
gcaaatgtaaatacatcaatcagttg

SEQ ID NO: 115223 - DNA, 26 bp, Artificial sequence
  SiRNA target sequence
caaatgtaaatacatcaatcagttga

SEQ ID NO: 115224 - DNA, 26 bp, Artificial sequence
  SiRNA target sequence
aaatgtaaatacatcaatcagttgag

SEQ ID NO: 115225 - DNA, 26 bp, Artificial sequence
  SiRNA target sequence
aatgtaaatacatcaatcagttgagt

SEQ ID NO: 115226 - DNA, 26 bp, Artificial sequence
  SiRNA target sequence
atgtaaatacatcaatcagttgagtt

SEQ ID NO: 115227 - DNA, 26 bp, Artificial sequence
  SiRNA target sequence
tgtaaatacatcaatcagttgagtta

SEQ ID NO: 115228 - DNA, 26 bp, Artificial sequence
  SiRNA target sequence
gtaaatacatcaatcagttgagttat

SEQ ID NO: 115229 - DNA, 26 bp, Artificial sequence
  SiRNA target sequence
taaatacatcaatcagttgagttatg

SEQ ID NO: 115230 - DNA, 26 bp, Artificial sequence
  SiRNA target sequence
aaatacatcaatcagttgagttatgt

SEQ ID NO: 115231 - DNA, 26 bp, Artificial sequence
  SiRNA target sequence
aatacatcaatcagttgagttatgtt

SEQ ID NO: 115232 - DNA, 26 bp, Artificial sequence
  SiRNA target sequence
atacatcaatcagttgagttatgttt

SEQ ID NO: 115233 - DNA, 26 bp, Artificial sequence
  SiRNA target sequence
tacatcaatcagttgagttatgtttt

SEQ ID NO: 115234 - DNA, 26 bp, Artificial sequence
  SiRNA target sequence
acatcaatcagttgagttatgttttt

SEQ ID NO: 115235 - DNA, 26 bp, Artificial sequence
  SiRNA target sequence
catcaatcagttgagttatgttttta

SEQ ID NO: 115236 - DNA, 26 bp, Artificial sequence
  SiRNA target sequence
atcaatcagttgagttatgtttttat

SEQ ID NO: 115237 - DNA, 26 bp, Artificial sequence
  SiRNA target sequence
tcaatcagttgagttatgtttttatc

SEQ ID NO: 115238 - DNA, 26 bp, Artificial sequence
  SiRNA target sequence
caatcagttgagttatgtttttatct

SEQ ID NO: 115239 - DNA, 26 bp, Artificial sequence
  SiRNA target sequence
aatcagttgagttatgtttttatctg

SEQ ID NO: 115240 - DNA, 26 bp, Artificial sequence
  SiRNA target sequence
atcagttgagttatgtttttatctgt

SEQ ID NO: 115241 - DNA, 26 bp, Artificial sequence
  SiRNA target sequence
tcagttgagttatgtttttatctgta

SEQ ID NO: 115242 - DNA, 26 bp, Artificial sequence
  SiRNA target sequence
cagttgagttatgtttttatctgtaa

SEQ ID NO: 115243 - DNA, 26 bp, Artificial sequence
  SiRNA target sequence
agttgagttatgtttttatctgtaag

SEQ ID NO: 115244 - DNA, 26 bp, Artificial sequence
  SiRNA target sequence
gttgagttatgtttttatctgtaaga

SEQ ID NO: 115245 - DNA, 26 bp, Artificial sequence
  SiRNA target sequence
ttgagttatgtttttatctgtaagac

SEQ ID NO: 115246 - DNA, 26 bp, Artificial sequence
  SiRNA target sequence
tgagttatgtttttatctgtaagacg

SEQ ID NO: 115247 - DNA, 26 bp, Artificial sequence
  SiRNA target sequence
gagttatgtttttatctgtaagacgt

SEQ ID NO: 115248 - DNA, 26 bp, Artificial sequence
  SiRNA target sequence
agttatgtttttatctgtaagacgta

SEQ ID NO: 115249 - DNA, 26 bp, Artificial sequence
  SiRNA target sequence
gttatgtttttatctgtaagacgtat

SEQ ID NO: 115250 - DNA, 26 bp, Artificial sequence
  SiRNA target sequence
ttatgtttttatctgtaagacgtata

SEQ ID NO: 115251 - DNA, 26 bp, Artificial sequence
  SiRNA target sequence
tatgtttttatctgtaagacgtatac

SEQ ID NO: 115252 - DNA, 26 bp, Artificial sequence
  SiRNA target sequence
atgtttttatctgtaagacgtatacc

SEQ ID NO: 115253 - DNA, 26 bp, Artificial sequence
  SiRNA target sequence
tgtttttatctgtaagacgtatacct

SEQ ID NO: 115254 - DNA, 26 bp, Artificial sequence
  SiRNA target sequence
gtttttatctgtaagacgtatacctg

SEQ ID NO: 115255 - DNA, 26 bp, Artificial sequence
  SiRNA target sequence
tttttatctgtaagacgtatacctgg

SEQ ID NO: 115256 - DNA, 26 bp, Artificial sequence
  SiRNA target sequence
ttttatctgtaagacgtatacctgga

SEQ ID NO: 115257 - DNA, 26 bp, Artificial sequence
  SiRNA target sequence
tttatctgtaagacgtatacctggaa

SEQ ID NO: 115258 - DNA, 26 bp, Artificial sequence
  SiRNA target sequence
ttatctgtaagacgtatacctggaat

SEQ ID NO: 115259 - DNA, 26 bp, Artificial sequence
  SiRNA target sequence
tatctgtaagacgtatacctggaata

SEQ ID NO: 115260 - DNA, 26 bp, Artificial sequence
  SiRNA target sequence
atctgtaagacgtatacctggaatat

SEQ ID NO: 115261 - DNA, 26 bp, Artificial sequence
  SiRNA target sequence
tctgtaagacgtatacctggaatatt

SEQ ID NO: 115262 - DNA, 26 bp, Artificial sequence
  SiRNA target sequence
ctgtaagacgtatacctggaatatta

SEQ ID NO: 115263 - DNA, 26 bp, Artificial sequence
  SiRNA target sequence
tgtaagacgtatacctggaatattat

SEQ ID NO: 115264 - DNA, 26 bp, Artificial sequence
  SiRNA target sequence
gtaagacgtatacctggaatattata

SEQ ID NO: 115265 - DNA, 26 bp, Artificial sequence
  SiRNA target sequence
taagacgtatacctggaatattatat

SEQ ID NO: 115266 - DNA, 26 bp, Artificial sequence
  SiRNA target sequence
aagacgtatacctggaatattatatc

SEQ ID NO: 115267 - DNA, 26 bp, Artificial sequence
  SiRNA target sequence
agacgtatacctggaatattatatcc

SEQ ID NO: 115268 - DNA, 26 bp, Artificial sequence
  SiRNA target sequence
gacgtatacctggaatattatatccc

SEQ ID NO: 115269 - DNA, 26 bp, Artificial sequence
  SiRNA target sequence
acgtatacctggaatattatatcccc

SEQ ID NO: 115270 - DNA, 26 bp, Artificial sequence
  SiRNA target sequence
cgtatacctggaatattatatcccct

SEQ ID NO: 115271 - DNA, 26 bp, Artificial sequence
  SiRNA target sequence
gtatacctggaatattatatcccctt

SEQ ID NO: 115272 - DNA, 26 bp, Artificial sequence
  SiRNA target sequence
tatacctggaatattatatccccttt

SEQ ID NO: 115273 - DNA, 26 bp, Artificial sequence
  SiRNA target sequence
atacctggaatattatatcccctttt

SEQ ID NO: 115274 - DNA, 26 bp, Artificial sequence
  SiRNA target sequence
tacctggaatattatatcccctttta

SEQ ID NO: 115275 - DNA, 26 bp, Artificial sequence
  SiRNA target sequence
acctggaatattatatccccttttaa

SEQ ID NO: 115276 - DNA, 26 bp, Artificial sequence
  SiRNA target sequence
cctggaatattatatccccttttaaa

SEQ ID NO: 115277 - DNA, 26 bp, Artificial sequence
  SiRNA target sequence
ctggaatattatatccccttttaaaa

SEQ ID NO: 115278 - DNA, 26 bp, Artificial sequence
  SiRNA target sequence
tggaatattatatccccttttaaaat

SEQ ID NO: 115279 - DNA, 26 bp, Artificial sequence
  SiRNA target sequence
ggaatattatatccccttttaaaata

SEQ ID NO: 115280 - DNA, 26 bp, Artificial sequence
  SiRNA target sequence
gaatattatatccccttttaaaatat

SEQ ID NO: 115281 - DNA, 26 bp, Artificial sequence
  SiRNA target sequence
aatattatatccccttttaaaatatt

SEQ ID NO: 115282 - DNA, 26 bp, Artificial sequence
  SiRNA target sequence
atattatatccccttttaaaatattc

SEQ ID NO: 115283 - DNA, 26 bp, Artificial sequence
  SiRNA target sequence
tattatatccccttttaaaatattca

SEQ ID NO: 115284 - DNA, 26 bp, Artificial sequence
  SiRNA target sequence
attatatccccttttaaaatattcag

SEQ ID NO: 115285 - DNA, 26 bp, Artificial sequence
  SiRNA target sequence
ttatatccccttttaaaatattcagg

SEQ ID NO: 115286 - DNA, 26 bp, Artificial sequence
  SiRNA target sequence
tatatccccttttaaaatattcagga

SEQ ID NO: 115287 - DNA, 26 bp, Artificial sequence
  SiRNA target sequence
atatccccttttaaaatattcaggat

SEQ ID NO: 115288 - DNA, 26 bp, Artificial sequence
  SiRNA target sequence
tatccccttttaaaatattcaggata

SEQ ID NO: 115289 - DNA, 26 bp, Artificial sequence
  SiRNA target sequence
atccccttttaaaatattcaggatat

SEQ ID NO: 115290 - DNA, 26 bp, Artificial sequence
  SiRNA target sequence
tccccttttaaaatattcaggatatg

SEQ ID NO: 115291 - DNA, 26 bp, Artificial sequence
  SiRNA target sequence
ccccttttaaaatattcaggatatgt

SEQ ID NO: 115292 - DNA, 26 bp, Artificial sequence
  SiRNA target sequence
cccttttaaaatattcaggatatgta

SEQ ID NO: 115293 - DNA, 26 bp, Artificial sequence
  SiRNA target sequence
ccttttaaaatattcaggatatgtag

SEQ ID NO: 115294 - DNA, 26 bp, Artificial sequence
  SiRNA target sequence
cttttaaaatattcaggatatgtagt

SEQ ID NO: 115295 - DNA, 26 bp, Artificial sequence
  SiRNA target sequence
ttttaaaatattcaggatatgtagtg

SEQ ID NO: 115296 - DNA, 26 bp, Artificial sequence
  SiRNA target sequence
tttaaaatattcaggatatgtagtgg

SEQ ID NO: 115297 - DNA, 26 bp, Artificial sequence
  SiRNA target sequence
ttaaaatattcaggatatgtagtgga

SEQ ID NO: 115298 - DNA, 26 bp, Artificial sequence
  SiRNA target sequence
taaaatattcaggatatgtagtggaa

SEQ ID NO: 115299 - DNA, 26 bp, Artificial sequence
  SiRNA target sequence
aaaatattcaggatatgtagtggaat

SEQ ID NO: 115300 - DNA, 26 bp, Artificial sequence
  SiRNA target sequence
aaatattcaggatatgtagtggaatt

SEQ ID NO: 115301 - DNA, 26 bp, Artificial sequence
  SiRNA target sequence
aatattcaggatatgtagtggaatta

SEQ ID NO: 115302 - DNA, 26 bp, Artificial sequence
  SiRNA target sequence
atattcaggatatgtagtggaattac

SEQ ID NO: 115303 - DNA, 26 bp, Artificial sequence
  SiRNA target sequence
tattcaggatatgtagtggaattact

SEQ ID NO: 115304 - DNA, 26 bp, Artificial sequence
  SiRNA target sequence
attcaggatatgtagtggaattactt

SEQ ID NO: 115305 - DNA, 26 bp, Artificial sequence
  SiRNA target sequence
ttcaggatatgtagtggaattacttt

SEQ ID NO: 115306 - DNA, 26 bp, Artificial sequence
  SiRNA target sequence
tcaggatatgtagtggaattactttc

SEQ ID NO: 115307 - DNA, 26 bp, Artificial sequence
  SiRNA target sequence
caggatatgtagtggaattactttca

SEQ ID NO: 115308 - DNA, 26 bp, Artificial sequence
  SiRNA target sequence
aggatatgtagtggaattactttcag

SEQ ID NO: 115309 - DNA, 26 bp, Artificial sequence
  SiRNA target sequence
ggatatgtagtggaattactttcagg

SEQ ID NO: 115310 - DNA, 26 bp, Artificial sequence
  SiRNA target sequence
gatatgtagtggaattactttcaggt

SEQ ID NO: 115311 - DNA, 26 bp, Artificial sequence
  SiRNA target sequence
atatgtagtggaattactttcaggtg

SEQ ID NO: 115312 - DNA, 26 bp, Artificial sequence
  SiRNA target sequence
tatgtagtggaattactttcaggtgt

SEQ ID NO: 115313 - DNA, 26 bp, Artificial sequence
  SiRNA target sequence
atgtagtggaattactttcaggtgtc

SEQ ID NO: 115314 - DNA, 26 bp, Artificial sequence
  SiRNA target sequence
tgtagtggaattactttcaggtgtcc

SEQ ID NO: 115315 - DNA, 26 bp, Artificial sequence
  SiRNA target sequence
gtagtggaattactttcaggtgtcca

SEQ ID NO: 115316 - DNA, 26 bp, Artificial sequence
  SiRNA target sequence
tagtggaattactttcaggtgtccac

SEQ ID NO: 115317 - DNA, 26 bp, Artificial sequence
  SiRNA target sequence
agtggaattactttcaggtgtccaca

SEQ ID NO: 115318 - DNA, 26 bp, Artificial sequence
  SiRNA target sequence
gtggaattactttcaggtgtccacat

SEQ ID NO: 115319 - DNA, 26 bp, Artificial sequence
  SiRNA target sequence
tggaattactttcaggtgtccacata

SEQ ID NO: 115320 - DNA, 26 bp, Artificial sequence
  SiRNA target sequence
ggaattactttcaggtgtccacatac

SEQ ID NO: 115321 - DNA, 26 bp, Artificial sequence
  SiRNA target sequence
gaattactttcaggtgtccacatact

SEQ ID NO: 115322 - DNA, 26 bp, Artificial sequence
  SiRNA target sequence
aattactttcaggtgtccacatacta

SEQ ID NO: 115323 - DNA, 26 bp, Artificial sequence
  SiRNA target sequence
attactttcaggtgtccacatactat

SEQ ID NO: 115324 - DNA, 26 bp, Artificial sequence
  SiRNA target sequence
ttactttcaggtgtccacatactata

SEQ ID NO: 115325 - DNA, 26 bp, Artificial sequence
  SiRNA target sequence
tactttcaggtgtccacatactataa

SEQ ID NO: 115326 - DNA, 26 bp, Artificial sequence
  SiRNA target sequence
actttcaggtgtccacatactataat

SEQ ID NO: 115327 - DNA, 26 bp, Artificial sequence
  SiRNA target sequence
ctttcaggtgtccacatactataatg

SEQ ID NO: 115328 - DNA, 26 bp, Artificial sequence
  SiRNA target sequence
tttcaggtgtccacatactataatga

SEQ ID NO: 115329 - DNA, 26 bp, Artificial sequence
  SiRNA target sequence
ttcaggtgtccacatactataatgat

SEQ ID NO: 115330 - DNA, 26 bp, Artificial sequence
  SiRNA target sequence
tcaggtgtccacatactataatgatt

SEQ ID NO: 115331 - DNA, 26 bp, Artificial sequence
  SiRNA target sequence
caggtgtccacatactataatgatta

SEQ ID NO: 115332 - DNA, 26 bp, Artificial sequence
  SiRNA target sequence
aggtgtccacatactataatgattat

SEQ ID NO: 115333 - DNA, 26 bp, Artificial sequence
  SiRNA target sequence
ggtgtccacatactataatgattatt

SEQ ID NO: 115334 - DNA, 26 bp, Artificial sequence
  SiRNA target sequence
gtgtccacatactataatgattattt

SEQ ID NO: 115335 - DNA, 26 bp, Artificial sequence
  SiRNA target sequence
tgtccacatactataatgattatttt

SEQ ID NO: 115336 - DNA, 26 bp, Artificial sequence
  SiRNA target sequence
gtccacatactataatgattattttc

SEQ ID NO: 115337 - DNA, 26 bp, Artificial sequence
  SiRNA target sequence
tccacatactataatgattattttca

SEQ ID NO: 115338 - DNA, 26 bp, Artificial sequence
  SiRNA target sequence
ccacatactataatgattattttcac

SEQ ID NO: 115339 - DNA, 26 bp, Artificial sequence
  SiRNA target sequence
cacatactataatgattattttcaca

SEQ ID NO: 115340 - DNA, 26 bp, Artificial sequence
  SiRNA target sequence
acatactataatgattattttcacat

SEQ ID NO: 115341 - DNA, 26 bp, Artificial sequence
  SiRNA target sequence
catactataatgattattttcacata

SEQ ID NO: 115342 - DNA, 26 bp, Artificial sequence
  SiRNA target sequence
atactataatgattattttcacatac

SEQ ID NO: 115343 - DNA, 26 bp, Artificial sequence
  SiRNA target sequence
tactataatgattattttcacataca

SEQ ID NO: 115344 - DNA, 26 bp, Artificial sequence
  SiRNA target sequence
actataatgattattttcacatacat

SEQ ID NO: 115345 - DNA, 26 bp, Artificial sequence
  SiRNA target sequence
ctataatgattattttcacatacata

SEQ ID NO: 115346 - DNA, 26 bp, Artificial sequence
  SiRNA target sequence
tataatgattattttcacatacataa

SEQ ID NO: 115347 - DNA, 26 bp, Artificial sequence
  SiRNA target sequence
ataatgattattttcacatacataaa

SEQ ID NO: 115348 - DNA, 26 bp, Artificial sequence
  SiRNA target sequence
taatgattattttcacatacataaac

SEQ ID NO: 115349 - DNA, 26 bp, Artificial sequence
  SiRNA target sequence
aatgattattttcacatacataaacc

SEQ ID NO: 115350 - DNA, 26 bp, Artificial sequence
  SiRNA target sequence
atgattattttcacatacataaacca

SEQ ID NO: 115351 - DNA, 26 bp, Artificial sequence
  SiRNA target sequence
tgattattttcacatacataaaccac

SEQ ID NO: 115352 - DNA, 26 bp, Artificial sequence
  SiRNA target sequence
gattattttcacatacataaaccaca

SEQ ID NO: 115353 - DNA, 26 bp, Artificial sequence
  SiRNA target sequence
attattttcacatacataaaccacag

SEQ ID NO: 115354 - DNA, 26 bp, Artificial sequence
  SiRNA target sequence
ttattttcacatacataaaccacagg

SEQ ID NO: 115355 - DNA, 26 bp, Artificial sequence
  SiRNA target sequence
tattttcacatacataaaccacagga

SEQ ID NO: 115356 - DNA, 26 bp, Artificial sequence
  SiRNA target sequence
attttcacatacataaaccacaggaa

SEQ ID NO: 115357 - DNA, 26 bp, Artificial sequence
  SiRNA target sequence
ttttcacatacataaaccacaggaag

SEQ ID NO: 115358 - DNA, 26 bp, Artificial sequence
  SiRNA target sequence
tttcacatacataaaccacaggaagt

SEQ ID NO: 115359 - DNA, 26 bp, Artificial sequence
  SiRNA target sequence
ttcacatacataaaccacaggaagtt

SEQ ID NO: 115360 - DNA, 26 bp, Artificial sequence
  SiRNA target sequence
tcacatacataaaccacaggaagttt

SEQ ID NO: 115361 - DNA, 26 bp, Artificial sequence
  SiRNA target sequence
cacatacataaaccacaggaagtttc

SEQ ID NO: 115362 - DNA, 26 bp, Artificial sequence
  SiRNA target sequence
acatacataaaccacaggaagtttcc

SEQ ID NO: 115363 - DNA, 26 bp, Artificial sequence
  SiRNA target sequence
catacataaaccacaggaagtttcca

SEQ ID NO: 115364 - DNA, 26 bp, Artificial sequence
  SiRNA target sequence
atacataaaccacaggaagtttccat

SEQ ID NO: 115365 - DNA, 26 bp, Artificial sequence
  SiRNA target sequence
tacataaaccacaggaagtttccata

SEQ ID NO: 115366 - DNA, 26 bp, Artificial sequence
  SiRNA target sequence
acataaaccacaggaagtttccataa

SEQ ID NO: 115367 - DNA, 26 bp, Artificial sequence
  SiRNA target sequence
cataaaccacaggaagtttccataat

SEQ ID NO: 115368 - DNA, 26 bp, Artificial sequence
  SiRNA target sequence
ataaaccacaggaagtttccataatg

SEQ ID NO: 115369 - DNA, 26 bp, Artificial sequence
  SiRNA target sequence
taaaccacaggaagtttccataatgc

SEQ ID NO: 115370 - DNA, 26 bp, Artificial sequence
  SiRNA target sequence
aaaccacaggaagtttccataatgca

SEQ ID NO: 115371 - DNA, 26 bp, Artificial sequence
  SiRNA target sequence
aaccacaggaagtttccataatgcag

SEQ ID NO: 115372 - DNA, 26 bp, Artificial sequence
  SiRNA target sequence
accacaggaagtttccataatgcagc

SEQ ID NO: 115373 - DNA, 26 bp, Artificial sequence
  SiRNA target sequence
ccacaggaagtttccataatgcagcc

SEQ ID NO: 115374 - DNA, 26 bp, Artificial sequence
  SiRNA target sequence
cacaggaagtttccataatgcagcca

SEQ ID NO: 115375 - DNA, 26 bp, Artificial sequence
  SiRNA target sequence
acaggaagtttccataatgcagccat

SEQ ID NO: 115376 - DNA, 26 bp, Artificial sequence
  SiRNA target sequence
caggaagtttccataatgcagccata

SEQ ID NO: 115377 - DNA, 26 bp, Artificial sequence
  SiRNA target sequence
aggaagtttccataatgcagccatat

SEQ ID NO: 115378 - DNA, 26 bp, Artificial sequence
  SiRNA target sequence
ggaagtttccataatgcagccatatt

SEQ ID NO: 115379 - DNA, 26 bp, Artificial sequence
  SiRNA target sequence
gaagtttccataatgcagccatattg

SEQ ID NO: 115380 - DNA, 26 bp, Artificial sequence
  SiRNA target sequence
aagtttccataatgcagccatattga

SEQ ID NO: 115381 - DNA, 26 bp, Artificial sequence
  SiRNA target sequence
agtttccataatgcagccatattgaa

SEQ ID NO: 115382 - DNA, 26 bp, Artificial sequence
  SiRNA target sequence
gtttccataatgcagccatattgaac

SEQ ID NO: 115383 - DNA, 26 bp, Artificial sequence
  SiRNA target sequence
tttccataatgcagccatattgaacg

SEQ ID NO: 115384 - DNA, 26 bp, Artificial sequence
  SiRNA target sequence
ttccataatgcagccatattgaacga

SEQ ID NO: 115385 - DNA, 26 bp, Artificial sequence
  SiRNA target sequence
tccataatgcagccatattgaacgac

SEQ ID NO: 115386 - DNA, 26 bp, Artificial sequence
  SiRNA target sequence
ccataatgcagccatattgaacgact

SEQ ID NO: 115387 - DNA, 26 bp, Artificial sequence
  SiRNA target sequence
cataatgcagccatattgaacgactc

SEQ ID NO: 115388 - DNA, 26 bp, Artificial sequence
  SiRNA target sequence
ataatgcagccatattgaacgactcc

SEQ ID NO: 115389 - DNA, 26 bp, Artificial sequence
  SiRNA target sequence
taatgcagccatattgaacgactccc

SEQ ID NO: 115390 - DNA, 26 bp, Artificial sequence
  SiRNA target sequence
aatgcagccatattgaacgactccca

SEQ ID NO: 115391 - DNA, 26 bp, Artificial sequence
  SiRNA target sequence
atgcagccatattgaacgactcccag

SEQ ID NO: 115392 - DNA, 26 bp, Artificial sequence
  SiRNA target sequence
tgcagccatattgaacgactcccaga

SEQ ID NO: 115393 - DNA, 26 bp, Artificial sequence
  SiRNA target sequence
gcagccatattgaacgactcccagac

SEQ ID NO: 115394 - DNA, 26 bp, Artificial sequence
  SiRNA target sequence
cagccatattgaacgactcccagacc

SEQ ID NO: 115395 - DNA, 26 bp, Artificial sequence
  SiRNA target sequence
agccatattgaacgactcccagacct

SEQ ID NO: 115396 - DNA, 26 bp, Artificial sequence
  SiRNA target sequence
gccatattgaacgactcccagacctg

SEQ ID NO: 115397 - DNA, 26 bp, Artificial sequence
  SiRNA target sequence
ccatattgaacgactcccagacctgt

SEQ ID NO: 115398 - DNA, 26 bp, Artificial sequence
  SiRNA target sequence
catattgaacgactcccagacctgtc

SEQ ID NO: 115399 - DNA, 26 bp, Artificial sequence
  SiRNA target sequence
atattgaacgactcccagacctgtcc

SEQ ID NO: 115400 - DNA, 26 bp, Artificial sequence
  SiRNA target sequence
tattgaacgactcccagacctgtccc

SEQ ID NO: 115401 - DNA, 26 bp, Artificial sequence
  SiRNA target sequence
attgaacgactcccagacctgtccct

SEQ ID NO: 115402 - DNA, 26 bp, Artificial sequence
  SiRNA target sequence
ttgaacgactcccagacctgtccctg

SEQ ID NO: 115403 - DNA, 26 bp, Artificial sequence
  SiRNA target sequence
tgaacgactcccagacctgtccctga

SEQ ID NO: 115404 - DNA, 26 bp, Artificial sequence
  SiRNA target sequence
gaacgactcccagacctgtccctgat

SEQ ID NO: 115405 - DNA, 26 bp, Artificial sequence
  SiRNA target sequence
aacgactcccagacctgtccctgatt

SEQ ID NO: 115406 - DNA, 26 bp, Artificial sequence
  SiRNA target sequence
acgactcccagacctgtccctgattt

SEQ ID NO: 115407 - DNA, 26 bp, Artificial sequence
  SiRNA target sequence
cgactcccagacctgtccctgatttg

SEQ ID NO: 115408 - DNA, 26 bp, Artificial sequence
  SiRNA target sequence
gactcccagacctgtccctgatttgc

SEQ ID NO: 115409 - DNA, 26 bp, Artificial sequence
  SiRNA target sequence
actcccagacctgtccctgatttgca

SEQ ID NO: 115410 - DNA, 26 bp, Artificial sequence
  SiRNA target sequence
ctcccagacctgtccctgatttgcag

SEQ ID NO: 115411 - DNA, 26 bp, Artificial sequence
  SiRNA target sequence
tcccagacctgtccctgatttgcagc

SEQ ID NO: 115412 - DNA, 26 bp, Artificial sequence
  SiRNA target sequence
cccagacctgtccctgatttgcagca

SEQ ID NO: 115413 - DNA, 26 bp, Artificial sequence
  SiRNA target sequence
ccagacctgtccctgatttgcagcac

SEQ ID NO: 115414 - DNA, 26 bp, Artificial sequence
  SiRNA target sequence
cagacctgtccctgatttgcagcacc

SEQ ID NO: 115415 - DNA, 26 bp, Artificial sequence
  SiRNA target sequence
agacctgtccctgatttgcagcacca

SEQ ID NO: 115416 - DNA, 26 bp, Artificial sequence
  SiRNA target sequence
gacctgtccctgatttgcagcaccat

SEQ ID NO: 115417 - DNA, 26 bp, Artificial sequence
  SiRNA target sequence
acctgtccctgatttgcagcaccatc

SEQ ID NO: 115418 - DNA, 26 bp, Artificial sequence
  SiRNA target sequence
cctgtccctgatttgcagcaccatcc

SEQ ID NO: 115419 - DNA, 26 bp, Artificial sequence
  SiRNA target sequence
ctgtccctgatttgcagcaccatccc

SEQ ID NO: 115420 - DNA, 26 bp, Artificial sequence
  SiRNA target sequence
tgtccctgatttgcagcaccatcccc

SEQ ID NO: 115421 - DNA, 26 bp, Artificial sequence
  SiRNA target sequence
gtccctgatttgcagcaccatccccg

SEQ ID NO: 115422 - DNA, 26 bp, Artificial sequence
  SiRNA target sequence
tccctgatttgcagcaccatccccga

SEQ ID NO: 115423 - DNA, 26 bp, Artificial sequence
  SiRNA target sequence
ccctgatttgcagcaccatccccgaa

SEQ ID NO: 115424 - DNA, 26 bp, Artificial sequence
  SiRNA target sequence
cctgatttgcagcaccatccccgaaa

SEQ ID NO: 115425 - DNA, 26 bp, Artificial sequence
  SiRNA target sequence
ctgatttgcagcaccatccccgaaaa

SEQ ID NO: 115426 - DNA, 26 bp, Artificial sequence
  SiRNA target sequence
tgatttgcagcaccatccccgaaaaa

SEQ ID NO: 115427 - DNA, 26 bp, Artificial sequence
  SiRNA target sequence
gatttgcagcaccatccccgaaaaat

SEQ ID NO: 115428 - DNA, 26 bp, Artificial sequence
  SiRNA target sequence
atttgcagcaccatccccgaaaaata

SEQ ID NO: 115429 - DNA, 26 bp, Artificial sequence
  SiRNA target sequence
tttgcagcaccatccccgaaaaatac

SEQ ID NO: 115430 - DNA, 26 bp, Artificial sequence
  SiRNA target sequence
ttgcagcaccatccccgaaaaataca

SEQ ID NO: 115431 - DNA, 26 bp, Artificial sequence
  SiRNA target sequence
tgcagcaccatccccgaaaaatacaa

SEQ ID NO: 115432 - DNA, 26 bp, Artificial sequence
  SiRNA target sequence
gcagcaccatccccgaaaaatacaaa

SEQ ID NO: 115433 - DNA, 26 bp, Artificial sequence
  SiRNA target sequence
cagcaccatccccgaaaaatacaaat

SEQ ID NO: 115434 - DNA, 26 bp, Artificial sequence
  SiRNA target sequence
agcaccatccccgaaaaatacaaatg

SEQ ID NO: 115435 - DNA, 26 bp, Artificial sequence
  SiRNA target sequence
gcaccatccccgaaaaatacaaatgc

SEQ ID NO: 115436 - DNA, 26 bp, Artificial sequence
  SiRNA target sequence
caccatccccgaaaaatacaaatgct

SEQ ID NO: 115437 - DNA, 26 bp, Artificial sequence
  SiRNA target sequence
accatccccgaaaaatacaaatgcta

SEQ ID NO: 115438 - DNA, 26 bp, Artificial sequence
  SiRNA target sequence
ccatccccgaaaaatacaaatgctac

SEQ ID NO: 115439 - DNA, 26 bp, Artificial sequence
  SiRNA target sequence
catccccgaaaaatacaaatgctaca

SEQ ID NO: 115440 - DNA, 26 bp, Artificial sequence
  SiRNA target sequence
atccccgaaaaatacaaatgctacat

SEQ ID NO: 115441 - DNA, 26 bp, Artificial sequence
  SiRNA target sequence
tccccgaaaaatacaaatgctacatt

SEQ ID NO: 115442 - DNA, 26 bp, Artificial sequence
  SiRNA target sequence
ccccgaaaaatacaaatgctacattt

SEQ ID NO: 115443 - DNA, 26 bp, Artificial sequence
  SiRNA target sequence
cccgaaaaatacaaatgctacatttt

SEQ ID NO: 115444 - DNA, 26 bp, Artificial sequence
  SiRNA target sequence
ccgaaaaatacaaatgctacattttt

SEQ ID NO: 115445 - DNA, 26 bp, Artificial sequence
  SiRNA target sequence
cgaaaaatacaaatgctacatttttt

SEQ ID NO: 115446 - DNA, 26 bp, Artificial sequence
  SiRNA target sequence
gaaaaatacaaatgctacatttttta

SEQ ID NO: 115447 - DNA, 26 bp, Artificial sequence
  SiRNA target sequence
aaaaatacaaatgctacattttttac

SEQ ID NO: 115448 - DNA, 26 bp, Artificial sequence
  SiRNA target sequence
aaaatacaaatgctacattttttact

SEQ ID NO: 115449 - DNA, 26 bp, Artificial sequence
  SiRNA target sequence
aaatacaaatgctacattttttactt

SEQ ID NO: 115450 - DNA, 26 bp, Artificial sequence
  SiRNA target sequence
aatacaaatgctacattttttacttt

SEQ ID NO: 115451 - DNA, 26 bp, Artificial sequence
  SiRNA target sequence
atacaaatgctacattttttactttt

SEQ ID NO: 115452 - DNA, 26 bp, Artificial sequence
  SiRNA target sequence
tacaaatgctacattttttacttttt

SEQ ID NO: 115453 - DNA, 26 bp, Artificial sequence
  SiRNA target sequence
acaaatgctacattttttactttttt

SEQ ID NO: 115454 - DNA, 26 bp, Artificial sequence
  SiRNA target sequence
caaatgctacattttttactttttta

SEQ ID NO: 115455 - DNA, 26 bp, Artificial sequence
  SiRNA target sequence
aaatgctacattttttacttttttat

SEQ ID NO: 115456 - DNA, 26 bp, Artificial sequence
  SiRNA target sequence
aatgctacattttttacttttttata

SEQ ID NO: 115457 - DNA, 26 bp, Artificial sequence
  SiRNA target sequence
atgctacattttttacttttttatat

SEQ ID NO: 115458 - DNA, 26 bp, Artificial sequence
  SiRNA target sequence
tgctacattttttacttttttatatt

SEQ ID NO: 115459 - DNA, 26 bp, Artificial sequence
  SiRNA target sequence
gctacattttttacttttttatattg

SEQ ID NO: 115460 - DNA, 26 bp, Artificial sequence
  SiRNA target sequence
ctacattttttacttttttatattgt

SEQ ID NO: 115461 - DNA, 26 bp, Artificial sequence
  SiRNA target sequence
tacattttttacttttttatattgta

SEQ ID NO: 115462 - DNA, 26 bp, Artificial sequence
  SiRNA target sequence
acattttttacttttttatattgtaa

SEQ ID NO: 115463 - DNA, 26 bp, Artificial sequence
  SiRNA target sequence
cattttttacttttttatattgtaaa

SEQ ID NO: 115464 - DNA, 26 bp, Artificial sequence
  SiRNA target sequence
attttttacttttttatattgtaaag

SEQ ID NO: 115465 - DNA, 26 bp, Artificial sequence
  SiRNA target sequence
ttttttacttttttatattgtaaagc

SEQ ID NO: 115466 - DNA, 26 bp, Artificial sequence
  SiRNA target sequence
tttttacttttttatattgtaaagca

SEQ ID NO: 115467 - DNA, 26 bp, Artificial sequence
  SiRNA target sequence
ttttacttttttatattgtaaagcaa

SEQ ID NO: 115468 - DNA, 26 bp, Artificial sequence
  SiRNA target sequence
tttacttttttatattgtaaagcaaa

SEQ ID NO: 115469 - DNA, 26 bp, Artificial sequence
  SiRNA target sequence
ttacttttttatattgtaaagcaaat

SEQ ID NO: 115470 - DNA, 26 bp, Artificial sequence
  SiRNA target sequence
tacttttttatattgtaaagcaaatc

SEQ ID NO: 115471 - DNA, 26 bp, Artificial sequence
  SiRNA target sequence
acttttttatattgtaaagcaaatcc

SEQ ID NO: 115472 - DNA, 26 bp, Artificial sequence
  SiRNA target sequence
cttttttatattgtaaagcaaatccc

SEQ ID NO: 115473 - DNA, 26 bp, Artificial sequence
  SiRNA target sequence
ttttttatattgtaaagcaaatccca

SEQ ID NO: 115474 - DNA, 26 bp, Artificial sequence
  SiRNA target sequence
tttttatattgtaaagcaaatcccaa

SEQ ID NO: 115475 - DNA, 26 bp, Artificial sequence
  SiRNA target sequence
ttttatattgtaaagcaaatcccaat

SEQ ID NO: 115476 - DNA, 26 bp, Artificial sequence
  SiRNA target sequence
tttatattgtaaagcaaatcccaatc

SEQ ID NO: 115477 - DNA, 26 bp, Artificial sequence
  SiRNA target sequence
ttatattgtaaagcaaatcccaatcc

SEQ ID NO: 115478 - DNA, 26 bp, Artificial sequence
  SiRNA target sequence
tatattgtaaagcaaatcccaatcct

SEQ ID NO: 115479 - DNA, 26 bp, Artificial sequence
  SiRNA target sequence
atattgtaaagcaaatcccaatcctg

SEQ ID NO: 115480 - DNA, 26 bp, Artificial sequence
  SiRNA target sequence
tattgtaaagcaaatcccaatcctgt

SEQ ID NO: 115481 - DNA, 26 bp, Artificial sequence
  SiRNA target sequence
attgtaaagcaaatcccaatcctgta

SEQ ID NO: 115482 - DNA, 26 bp, Artificial sequence
  SiRNA target sequence
ttgtaaagcaaatcccaatcctgtac

SEQ ID NO: 115483 - DNA, 26 bp, Artificial sequence
  SiRNA target sequence
tgtaaagcaaatcccaatcctgtacc

SEQ ID NO: 115484 - DNA, 26 bp, Artificial sequence
  SiRNA target sequence
gtaaagcaaatcccaatcctgtacca

SEQ ID NO: 115485 - DNA, 26 bp, Artificial sequence
  SiRNA target sequence
taaagcaaatcccaatcctgtaccaa

SEQ ID NO: 115486 - DNA, 26 bp, Artificial sequence
  SiRNA target sequence
aaagcaaatcccaatcctgtaccaag

SEQ ID NO: 115487 - DNA, 26 bp, Artificial sequence
  SiRNA target sequence
aagcaaatcccaatcctgtaccaagc

SEQ ID NO: 115488 - DNA, 26 bp, Artificial sequence
  SiRNA target sequence
agcaaatcccaatcctgtaccaagcg

SEQ ID NO: 115489 - DNA, 26 bp, Artificial sequence
  SiRNA target sequence
gcaaatcccaatcctgtaccaagcga

SEQ ID NO: 115490 - DNA, 26 bp, Artificial sequence
  SiRNA target sequence
caaatcccaatcctgtaccaagcgat

SEQ ID NO: 115491 - DNA, 26 bp, Artificial sequence
  SiRNA target sequence
aaatcccaatcctgtaccaagcgata

SEQ ID NO: 115492 - DNA, 26 bp, Artificial sequence
  SiRNA target sequence
aatcccaatcctgtaccaagcgatac

SEQ ID NO: 115493 - DNA, 26 bp, Artificial sequence
  SiRNA target sequence
atcccaatcctgtaccaagcgatacc

SEQ ID NO: 115494 - DNA, 26 bp, Artificial sequence
  SiRNA target sequence
tcccaatcctgtaccaagcgatacct

SEQ ID NO: 115495 - DNA, 26 bp, Artificial sequence
  SiRNA target sequence
cccaatcctgtaccaagcgatacctg

SEQ ID NO: 115496 - DNA, 26 bp, Artificial sequence
  SiRNA target sequence
ccaatcctgtaccaagcgatacctgc

SEQ ID NO: 115497 - DNA, 26 bp, Artificial sequence
  SiRNA target sequence
caatcctgtaccaagcgatacctgcg

SEQ ID NO: 115498 - DNA, 26 bp, Artificial sequence
  SiRNA target sequence
aatcctgtaccaagcgatacctgcgc

SEQ ID NO: 115499 - DNA, 26 bp, Artificial sequence
  SiRNA target sequence
atcctgtaccaagcgatacctgcgca

SEQ ID NO: 115500 - DNA, 26 bp, Artificial sequence
  SiRNA target sequence
tcctgtaccaagcgatacctgcgcac

SEQ ID NO: 115501 - DNA, 26 bp, Artificial sequence
  SiRNA target sequence
cctgtaccaagcgatacctgcgcacc

SEQ ID NO: 115502 - DNA, 26 bp, Artificial sequence
  SiRNA target sequence
ctgtaccaagcgatacctgcgcacct

SEQ ID NO: 115503 - DNA, 26 bp, Artificial sequence
  SiRNA target sequence
tgtaccaagcgatacctgcgcaccta

SEQ ID NO: 115504 - DNA, 26 bp, Artificial sequence
  SiRNA target sequence
gtaccaagcgatacctgcgcacctac

SEQ ID NO: 115505 - DNA, 26 bp, Artificial sequence
  SiRNA target sequence
taccaagcgatacctgcgcacctact

SEQ ID NO: 115506 - DNA, 26 bp, Artificial sequence
  SiRNA target sequence
accaagcgatacctgcgcacctacta

SEQ ID NO: 115507 - DNA, 26 bp, Artificial sequence
  SiRNA target sequence
ccaagcgatacctgcgcacctactat

SEQ ID NO: 115508 - DNA, 26 bp, Artificial sequence
  SiRNA target sequence
caagcgatacctgcgcacctactata

SEQ ID NO: 115509 - DNA, 26 bp, Artificial sequence
  SiRNA target sequence
aagcgatacctgcgcacctactatac

SEQ ID NO: 115510 - DNA, 26 bp, Artificial sequence
  SiRNA target sequence
agcgatacctgcgcacctactatacc

SEQ ID NO: 115511 - DNA, 26 bp, Artificial sequence
  SiRNA target sequence
gcgatacctgcgcacctactataccg

SEQ ID NO: 115512 - DNA, 26 bp, Artificial sequence
  SiRNA target sequence
cgatacctgcgcacctactataccgt

SEQ ID NO: 115513 - DNA, 26 bp, Artificial sequence
  SiRNA target sequence
gatacctgcgcacctactataccgtg

SEQ ID NO: 115514 - DNA, 26 bp, Artificial sequence
  SiRNA target sequence
atacctgcgcacctactataccgtgt

SEQ ID NO: 115515 - DNA, 26 bp, Artificial sequence
  SiRNA target sequence
tacctgcgcacctactataccgtgtc

SEQ ID NO: 115516 - DNA, 26 bp, Artificial sequence
  SiRNA target sequence
acctgcgcacctactataccgtgtcc

SEQ ID NO: 115517 - DNA, 26 bp, Artificial sequence
  SiRNA target sequence
cctgcgcacctactataccgtgtccc

SEQ ID NO: 115518 - DNA, 26 bp, Artificial sequence
  SiRNA target sequence
ctgcgcacctactataccgtgtcccc

SEQ ID NO: 115519 - DNA, 26 bp, Artificial sequence
  SiRNA target sequence
tgcgcacctactataccgtgtccccc

SEQ ID NO: 115520 - DNA, 26 bp, Artificial sequence
  SiRNA target sequence
gcgcacctactataccgtgtccccca

SEQ ID NO: 115521 - DNA, 26 bp, Artificial sequence
  SiRNA target sequence
cgcacctactataccgtgtcccccat

SEQ ID NO: 115522 - DNA, 26 bp, Artificial sequence
  SiRNA target sequence
gcacctactataccgtgtcccccata

SEQ ID NO: 115523 - DNA, 26 bp, Artificial sequence
  SiRNA target sequence
cacctactataccgtgtcccccataa

SEQ ID NO: 115524 - DNA, 26 bp, Artificial sequence
  SiRNA target sequence
acctactataccgtgtcccccataaa

SEQ ID NO: 115525 - DNA, 26 bp, Artificial sequence
  SiRNA target sequence
cctactataccgtgtcccccataaaa

SEQ ID NO: 115526 - DNA, 26 bp, Artificial sequence
  SiRNA target sequence
ctactataccgtgtcccccataaaat

SEQ ID NO: 115527 - DNA, 26 bp, Artificial sequence
  SiRNA target sequence
tactataccgtgtcccccataaaatt

SEQ ID NO: 115528 - DNA, 26 bp, Artificial sequence
  SiRNA target sequence
actataccgtgtcccccataaaattg

SEQ ID NO: 115529 - DNA, 26 bp, Artificial sequence
  SiRNA target sequence
ctataccgtgtcccccataaaattgg

SEQ ID NO: 115530 - DNA, 26 bp, Artificial sequence
  SiRNA target sequence
tataccgtgtcccccataaaattggt

SEQ ID NO: 115531 - DNA, 26 bp, Artificial sequence
  SiRNA target sequence
ataccgtgtcccccataaaattggtc

SEQ ID NO: 115532 - DNA, 26 bp, Artificial sequence
  SiRNA target sequence
taccgtgtcccccataaaattggtca

SEQ ID NO: 115533 - DNA, 26 bp, Artificial sequence
  SiRNA target sequence
accgtgtcccccataaaattggtcat

SEQ ID NO: 115534 - DNA, 26 bp, Artificial sequence
  SiRNA target sequence
ccgtgtcccccataaaattggtcatt

SEQ ID NO: 115535 - DNA, 26 bp, Artificial sequence
  SiRNA target sequence
cgtgtcccccataaaattggtcatta

SEQ ID NO: 115536 - DNA, 26 bp, Artificial sequence
  SiRNA target sequence
gtgtcccccataaaattggtcattat

SEQ ID NO: 115537 - DNA, 26 bp, Artificial sequence
  SiRNA target sequence
tgtcccccataaaattggtcattata

SEQ ID NO: 115538 - DNA, 26 bp, Artificial sequence
  SiRNA target sequence
gtcccccataaaattggtcattatac

SEQ ID NO: 115539 - DNA, 26 bp, Artificial sequence
  SiRNA target sequence
tcccccataaaattggtcattataca

SEQ ID NO: 115540 - DNA, 26 bp, Artificial sequence
  SiRNA target sequence
cccccataaaattggtcattatacaa

SEQ ID NO: 115541 - DNA, 26 bp, Artificial sequence
  SiRNA target sequence
ccccataaaattggtcattatacaaa

SEQ ID NO: 115542 - DNA, 26 bp, Artificial sequence
  SiRNA target sequence
cccataaaattggtcattatacaaat

SEQ ID NO: 115543 - DNA, 26 bp, Artificial sequence
  SiRNA target sequence
ccataaaattggtcattatacaaatg

SEQ ID NO: 115544 - DNA, 26 bp, Artificial sequence
  SiRNA target sequence
cataaaattggtcattatacaaatgc

SEQ ID NO: 115545 - DNA, 26 bp, Artificial sequence
  SiRNA target sequence
ataaaattggtcattatacaaatgca

SEQ ID NO: 115546 - DNA, 26 bp, Artificial sequence
  SiRNA target sequence
taaaattggtcattatacaaatgcat

SEQ ID NO: 115547 - DNA, 26 bp, Artificial sequence
  SiRNA target sequence
aaaattggtcattatacaaatgcatc

SEQ ID NO: 115548 - DNA, 26 bp, Artificial sequence
  SiRNA target sequence
aaattggtcattatacaaatgcatcg

SEQ ID NO: 115549 - DNA, 26 bp, Artificial sequence
  SiRNA target sequence
aattggtcattatacaaatgcatcga

SEQ ID NO: 115550 - DNA, 26 bp, Artificial sequence
  SiRNA target sequence
attggtcattatacaaatgcatcgat

SEQ ID NO: 115551 - DNA, 26 bp, Artificial sequence
  SiRNA target sequence
ttggtcattatacaaatgcatcgatc

SEQ ID NO: 115552 - DNA, 26 bp, Artificial sequence
  SiRNA target sequence
tggtcattatacaaatgcatcgatcc

SEQ ID NO: 115553 - DNA, 26 bp, Artificial sequence
  SiRNA target sequence
ggtcattatacaaatgcatcgatcct

SEQ ID NO: 115554 - DNA, 26 bp, Artificial sequence
  SiRNA target sequence
gtcattatacaaatgcatcgatcctc

SEQ ID NO: 115555 - DNA, 26 bp, Artificial sequence
  SiRNA target sequence
tcattatacaaatgcatcgatcctcc

SEQ ID NO: 115556 - DNA, 26 bp, Artificial sequence
  SiRNA target sequence
cattatacaaatgcatcgatcctcct

SEQ ID NO: 115557 - DNA, 26 bp, Artificial sequence
  SiRNA target sequence
attatacaaatgcatcgatcctcctt

SEQ ID NO: 115558 - DNA, 26 bp, Artificial sequence
  SiRNA target sequence
ttatacaaatgcatcgatcctccttt

SEQ ID NO: 115559 - DNA, 26 bp, Artificial sequence
  SiRNA target sequence
tatacaaatgcatcgatcctcctttt

SEQ ID NO: 115560 - DNA, 26 bp, Artificial sequence
  SiRNA target sequence
atacaaatgcatcgatcctccttttc

SEQ ID NO: 115561 - DNA, 26 bp, Artificial sequence
  SiRNA target sequence
tacaaatgcatcgatcctccttttcc

SEQ ID NO: 115562 - DNA, 26 bp, Artificial sequence
  SiRNA target sequence
acaaatgcatcgatcctccttttcct

SEQ ID NO: 115563 - DNA, 26 bp, Artificial sequence
  SiRNA target sequence
caaatgcatcgatcctccttttcctt

SEQ ID NO: 115564 - DNA, 26 bp, Artificial sequence
  SiRNA target sequence
aaatgcatcgatcctccttttccttt

SEQ ID NO: 115565 - DNA, 26 bp, Artificial sequence
  SiRNA target sequence
aatgcatcgatcctccttttcctttg

SEQ ID NO: 115566 - DNA, 26 bp, Artificial sequence
  SiRNA target sequence
atgcatcgatcctccttttcctttgc

SEQ ID NO: 115567 - DNA, 26 bp, Artificial sequence
  SiRNA target sequence
tgcatcgatcctccttttcctttgca

SEQ ID NO: 115568 - DNA, 26 bp, Artificial sequence
  SiRNA target sequence
gcatcgatcctccttttcctttgcaa

SEQ ID NO: 115569 - DNA, 26 bp, Artificial sequence
  SiRNA target sequence
catcgatcctccttttcctttgcaat

SEQ ID NO: 115570 - DNA, 26 bp, Artificial sequence
  SiRNA target sequence
atcgatcctccttttcctttgcaatt

SEQ ID NO: 115571 - DNA, 26 bp, Artificial sequence
  SiRNA target sequence
tcgatcctccttttcctttgcaatta

SEQ ID NO: 115572 - DNA, 26 bp, Artificial sequence
  SiRNA target sequence
cgatcctccttttcctttgcaattac

SEQ ID NO: 115573 - DNA, 26 bp, Artificial sequence
  SiRNA target sequence
gatcctccttttcctttgcaattacc

SEQ ID NO: 115574 - DNA, 26 bp, Artificial sequence
  SiRNA target sequence
atcctccttttcctttgcaattacca

SEQ ID NO: 115575 - DNA, 26 bp, Artificial sequence
  SiRNA target sequence
tcctccttttcctttgcaattaccaa

SEQ ID NO: 115576 - DNA, 26 bp, Artificial sequence
  SiRNA target sequence
cctccttttcctttgcaattaccaat

SEQ ID NO: 115577 - DNA, 26 bp, Artificial sequence
  SiRNA target sequence
ctccttttcctttgcaattaccaata

SEQ ID NO: 115578 - DNA, 26 bp, Artificial sequence
  SiRNA target sequence
tccttttcctttgcaattaccaatag

SEQ ID NO: 115579 - DNA, 26 bp, Artificial sequence
  SiRNA target sequence
ccttttcctttgcaattaccaatagc

SEQ ID NO: 115580 - DNA, 26 bp, Artificial sequence
  SiRNA target sequence
cttttcctttgcaattaccaatagcc

SEQ ID NO: 115581 - DNA, 26 bp, Artificial sequence
  SiRNA target sequence
ttttcctttgcaattaccaatagcct

SEQ ID NO: 115582 - DNA, 26 bp, Artificial sequence
  SiRNA target sequence
tttcctttgcaattaccaatagcctt

SEQ ID NO: 115583 - DNA, 26 bp, Artificial sequence
  SiRNA target sequence
ttcctttgcaattaccaatagccttt

SEQ ID NO: 115584 - DNA, 26 bp, Artificial sequence
  SiRNA target sequence
tcctttgcaattaccaatagcctttc

SEQ ID NO: 115585 - DNA, 26 bp, Artificial sequence
  SiRNA target sequence
cctttgcaattaccaatagcctttcc

SEQ ID NO: 115586 - DNA, 26 bp, Artificial sequence
  SiRNA target sequence
ctttgcaattaccaatagcctttcct

SEQ ID NO: 115587 - DNA, 26 bp, Artificial sequence
  SiRNA target sequence
tttgcaattaccaatagcctttccta

SEQ ID NO: 115588 - DNA, 26 bp, Artificial sequence
  SiRNA target sequence
ttgcaattaccaatagcctttcctaa

SEQ ID NO: 115589 - DNA, 26 bp, Artificial sequence
  SiRNA target sequence
tgcaattaccaatagcctttcctaat

SEQ ID NO: 115590 - DNA, 26 bp, Artificial sequence
  SiRNA target sequence
gcaattaccaatagcctttcctaata

SEQ ID NO: 115591 - DNA, 26 bp, Artificial sequence
  SiRNA target sequence
caattaccaatagcctttcctaataa

SEQ ID NO: 115592 - DNA, 26 bp, Artificial sequence
  SiRNA target sequence
aattaccaatagcctttcctaataat

SEQ ID NO: 115593 - DNA, 26 bp, Artificial sequence
  SiRNA target sequence
attaccaatagcctttcctaataatt

SEQ ID NO: 115594 - DNA, 26 bp, Artificial sequence
  SiRNA target sequence
ttaccaatagcctttcctaataattc

SEQ ID NO: 115595 - DNA, 26 bp, Artificial sequence
  SiRNA target sequence
taccaatagcctttcctaataattcc

SEQ ID NO: 115596 - DNA, 26 bp, Artificial sequence
  SiRNA target sequence
accaatagcctttcctaataattccc

SEQ ID NO: 115597 - DNA, 26 bp, Artificial sequence
  SiRNA target sequence
ccaatagcctttcctaataattcccc

SEQ ID NO: 115598 - DNA, 26 bp, Artificial sequence
  SiRNA target sequence
caatagcctttcctaataattcccct

SEQ ID NO: 115599 - DNA, 26 bp, Artificial sequence
  SiRNA target sequence
aatagcctttcctaataattccccta

SEQ ID NO: 115600 - DNA, 26 bp, Artificial sequence
  SiRNA target sequence
atagcctttcctaataattcccctat

SEQ ID NO: 115601 - DNA, 26 bp, Artificial sequence
  SiRNA target sequence
tagcctttcctaataattcccctata

SEQ ID NO: 115602 - DNA, 26 bp, Artificial sequence
  SiRNA target sequence
agcctttcctaataattcccctataa

SEQ ID NO: 115603 - DNA, 26 bp, Artificial sequence
  SiRNA target sequence
gcctttcctaataattcccctataat

SEQ ID NO: 115604 - DNA, 26 bp, Artificial sequence
  SiRNA target sequence
cctttcctaataattcccctataata

SEQ ID NO: 115605 - DNA, 26 bp, Artificial sequence
  SiRNA target sequence
ctttcctaataattcccctataatac

SEQ ID NO: 115606 - DNA, 26 bp, Artificial sequence
  SiRNA target sequence
tttcctaataattcccctataatact

SEQ ID NO: 115607 - DNA, 26 bp, Artificial sequence
  SiRNA target sequence
ttcctaataattcccctataatactt

SEQ ID NO: 115608 - DNA, 26 bp, Artificial sequence
  SiRNA target sequence
tcctaataattcccctataatacttt

SEQ ID NO: 115609 - DNA, 26 bp, Artificial sequence
  SiRNA target sequence
cctaataattcccctataatactttc

SEQ ID NO: 115610 - DNA, 26 bp, Artificial sequence
  SiRNA target sequence
ctaataattcccctataatactttct

SEQ ID NO: 115611 - DNA, 26 bp, Artificial sequence
  SiRNA target sequence
taataattcccctataatactttcta

SEQ ID NO: 115612 - DNA, 26 bp, Artificial sequence
  SiRNA target sequence
aataattcccctataatactttctat

SEQ ID NO: 115613 - DNA, 26 bp, Artificial sequence
  SiRNA target sequence
ataattcccctataatactttctata

SEQ ID NO: 115614 - DNA, 26 bp, Artificial sequence
  SiRNA target sequence
taattcccctataatactttctatac

SEQ ID NO: 115615 - DNA, 26 bp, Artificial sequence
  SiRNA target sequence
aattcccctataatactttctatact

SEQ ID NO: 115616 - DNA, 26 bp, Artificial sequence
  SiRNA target sequence
attcccctataatactttctatactg

SEQ ID NO: 115617 - DNA, 26 bp, Artificial sequence
  SiRNA target sequence
ttcccctataatactttctatactga

SEQ ID NO: 115618 - DNA, 26 bp, Artificial sequence
  SiRNA target sequence
tcccctataatactttctatactgat

SEQ ID NO: 115619 - DNA, 26 bp, Artificial sequence
  SiRNA target sequence
cccctataatactttctatactgatt

SEQ ID NO: 115620 - DNA, 26 bp, Artificial sequence
  SiRNA target sequence
ccctataatactttctatactgattc

SEQ ID NO: 115621 - DNA, 26 bp, Artificial sequence
  SiRNA target sequence
cctataatactttctatactgattcc

SEQ ID NO: 115622 - DNA, 26 bp, Artificial sequence
  SiRNA target sequence
ctataatactttctatactgattcca

SEQ ID NO: 115623 - DNA, 26 bp, Artificial sequence
  SiRNA target sequence
tataatactttctatactgattccac

SEQ ID NO: 115624 - DNA, 26 bp, Artificial sequence
  SiRNA target sequence
ataatactttctatactgattccaca

SEQ ID NO: 115625 - DNA, 26 bp, Artificial sequence
  SiRNA target sequence
taatactttctatactgattccacaa

SEQ ID NO: 115626 - DNA, 26 bp, Artificial sequence
  SiRNA target sequence
aatactttctatactgattccacaaa

SEQ ID NO: 115627 - DNA, 26 bp, Artificial sequence
  SiRNA target sequence
atactttctatactgattccacaaat

SEQ ID NO: 115628 - DNA, 26 bp, Artificial sequence
  SiRNA target sequence
tactttctatactgattccacaaata

SEQ ID NO: 115629 - DNA, 26 bp, Artificial sequence
  SiRNA target sequence
actttctatactgattccacaaataa

SEQ ID NO: 115630 - DNA, 26 bp, Artificial sequence
  SiRNA target sequence
ctttctatactgattccacaaataaa

SEQ ID NO: 115631 - DNA, 26 bp, Artificial sequence
  SiRNA target sequence
tttctatactgattccacaaataaat

SEQ ID NO: 115632 - DNA, 26 bp, Artificial sequence
  SiRNA target sequence
ttctatactgattccacaaataaatg

SEQ ID NO: 115633 - DNA, 26 bp, Artificial sequence
  SiRNA target sequence
tctatactgattccacaaataaatgc

SEQ ID NO: 115634 - DNA, 26 bp, Artificial sequence
  SiRNA target sequence
ctatactgattccacaaataaatgct

SEQ ID NO: 115635 - DNA, 26 bp, Artificial sequence
  SiRNA target sequence
tatactgattccacaaataaatgcta

SEQ ID NO: 115636 - DNA, 26 bp, Artificial sequence
  SiRNA target sequence
atactgattccacaaataaatgctaa

SEQ ID NO: 115637 - DNA, 26 bp, Artificial sequence
  SiRNA target sequence
tactgattccacaaataaatgctaat

SEQ ID NO: 115638 - DNA, 26 bp, Artificial sequence
  SiRNA target sequence
actgattccacaaataaatgctaatc

SEQ ID NO: 115639 - DNA, 26 bp, Artificial sequence
  SiRNA target sequence
ctgattccacaaataaatgctaatcc

SEQ ID NO: 115640 - DNA, 26 bp, Artificial sequence
  SiRNA target sequence
tgattccacaaataaatgctaatcca

SEQ ID NO: 115641 - DNA, 26 bp, Artificial sequence
  SiRNA target sequence
gattccacaaataaatgctaatccat

SEQ ID NO: 115642 - DNA, 26 bp, Artificial sequence
  SiRNA target sequence
attccacaaataaatgctaatccatg

SEQ ID NO: 115643 - DNA, 26 bp, Artificial sequence
  SiRNA target sequence
ttccacaaataaatgctaatccatgg

SEQ ID NO: 115644 - DNA, 26 bp, Artificial sequence
  SiRNA target sequence
tccacaaataaatgctaatccatggc

SEQ ID NO: 115645 - DNA, 26 bp, Artificial sequence
  SiRNA target sequence
ccacaaataaatgctaatccatggca

SEQ ID NO: 115646 - DNA, 26 bp, Artificial sequence
  SiRNA target sequence
cacaaataaatgctaatccatggcat

SEQ ID NO: 115647 - DNA, 26 bp, Artificial sequence
  SiRNA target sequence
acaaataaatgctaatccatggcatc

SEQ ID NO: 115648 - DNA, 26 bp, Artificial sequence
  SiRNA target sequence
caaataaatgctaatccatggcatct

SEQ ID NO: 115649 - DNA, 26 bp, Artificial sequence
  SiRNA target sequence
aaataaatgctaatccatggcatcta

SEQ ID NO: 115650 - DNA, 26 bp, Artificial sequence
  SiRNA target sequence
aataaatgctaatccatggcatctat

SEQ ID NO: 115651 - DNA, 26 bp, Artificial sequence
  SiRNA target sequence
ataaatgctaatccatggcatctata

SEQ ID NO: 115652 - DNA, 26 bp, Artificial sequence
  SiRNA target sequence
taaatgctaatccatggcatctataa

SEQ ID NO: 115653 - DNA, 26 bp, Artificial sequence
  SiRNA target sequence
aaatgctaatccatggcatctataag

SEQ ID NO: 115654 - DNA, 26 bp, Artificial sequence
  SiRNA target sequence
aatgctaatccatggcatctataaga

SEQ ID NO: 115655 - DNA, 26 bp, Artificial sequence
  SiRNA target sequence
atgctaatccatggcatctataagat

SEQ ID NO: 115656 - DNA, 26 bp, Artificial sequence
  SiRNA target sequence
tgctaatccatggcatctataagatc

SEQ ID NO: 115657 - DNA, 26 bp, Artificial sequence
  SiRNA target sequence
gctaatccatggcatctataagatcc

SEQ ID NO: 115658 - DNA, 26 bp, Artificial sequence
  SiRNA target sequence
ctaatccatggcatctataagatcct

SEQ ID NO: 115659 - DNA, 26 bp, Artificial sequence
  SiRNA target sequence
taatccatggcatctataagatccta

SEQ ID NO: 115660 - DNA, 26 bp, Artificial sequence
  SiRNA target sequence
aatccatggcatctataagatcctat

SEQ ID NO: 115661 - DNA, 26 bp, Artificial sequence
  SiRNA target sequence
atccatggcatctataagatcctatg

SEQ ID NO: 115662 - DNA, 26 bp, Artificial sequence
  SiRNA target sequence
tccatggcatctataagatcctatga

SEQ ID NO: 115663 - DNA, 26 bp, Artificial sequence
  SiRNA target sequence
ccatggcatctataagatcctatgac

SEQ ID NO: 115664 - DNA, 26 bp, Artificial sequence
  SiRNA target sequence
catggcatctataagatcctatgact

SEQ ID NO: 115665 - DNA, 26 bp, Artificial sequence
  SiRNA target sequence
atggcatctataagatcctatgactt

SEQ ID NO: 115666 - DNA, 26 bp, Artificial sequence
  SiRNA target sequence
tggcatctataagatcctatgacttt

SEQ ID NO: 115667 - DNA, 26 bp, Artificial sequence
  SiRNA target sequence
ggcatctataagatcctatgacttta

SEQ ID NO: 115668 - DNA, 26 bp, Artificial sequence
  SiRNA target sequence
gcatctataagatcctatgactttat

SEQ ID NO: 115669 - DNA, 26 bp, Artificial sequence
  SiRNA target sequence
catctataagatcctatgactttatc

SEQ ID NO: 115670 - DNA, 26 bp, Artificial sequence
  SiRNA target sequence
atctataagatcctatgactttatca

SEQ ID NO: 115671 - DNA, 26 bp, Artificial sequence
  SiRNA target sequence
tctataagatcctatgactttatcat

SEQ ID NO: 115672 - DNA, 26 bp, Artificial sequence
  SiRNA target sequence
ctataagatcctatgactttatcatt

SEQ ID NO: 115673 - DNA, 26 bp, Artificial sequence
  SiRNA target sequence
tataagatcctatgactttatcattt

SEQ ID NO: 115674 - DNA, 26 bp, Artificial sequence
  SiRNA target sequence
ataagatcctatgactttatcatttt

SEQ ID NO: 115675 - DNA, 26 bp, Artificial sequence
  SiRNA target sequence
taagatcctatgactttatcattttt

SEQ ID NO: 115676 - DNA, 26 bp, Artificial sequence
  SiRNA target sequence
aagatcctatgactttatcattttta

SEQ ID NO: 115677 - DNA, 26 bp, Artificial sequence
  SiRNA target sequence
agatcctatgactttatcatttttat

SEQ ID NO: 115678 - DNA, 26 bp, Artificial sequence
  SiRNA target sequence
gatcctatgactttatcatttttatc

SEQ ID NO: 115679 - DNA, 26 bp, Artificial sequence
  SiRNA target sequence
atcctatgactttatcatttttatct

SEQ ID NO: 115680 - DNA, 26 bp, Artificial sequence
  SiRNA target sequence
tcctatgactttatcatttttatcta

SEQ ID NO: 115681 - DNA, 26 bp, Artificial sequence
  SiRNA target sequence
cctatgactttatcatttttatctag

SEQ ID NO: 115682 - DNA, 26 bp, Artificial sequence
  SiRNA target sequence
ctatgactttatcatttttatctagt

SEQ ID NO: 115683 - DNA, 26 bp, Artificial sequence
  SiRNA target sequence
tatgactttatcatttttatctagta

SEQ ID NO: 115684 - DNA, 26 bp, Artificial sequence
  SiRNA target sequence
atgactttatcatttttatctagtac

SEQ ID NO: 115685 - DNA, 26 bp, Artificial sequence
  SiRNA target sequence
tgactttatcatttttatctagtacc

SEQ ID NO: 115686 - DNA, 26 bp, Artificial sequence
  SiRNA target sequence
gactttatcatttttatctagtacct

SEQ ID NO: 115687 - DNA, 26 bp, Artificial sequence
  SiRNA target sequence
actttatcatttttatctagtacctt

SEQ ID NO: 115688 - DNA, 26 bp, Artificial sequence
  SiRNA target sequence
ctttatcatttttatctagtaccttt

SEQ ID NO: 115689 - DNA, 26 bp, Artificial sequence
  SiRNA target sequence
tttatcatttttatctagtacctttt

SEQ ID NO: 115690 - DNA, 26 bp, Artificial sequence
  SiRNA target sequence
ttatcatttttatctagtaccttttg

SEQ ID NO: 115691 - DNA, 26 bp, Artificial sequence
  SiRNA target sequence
tatcatttttatctagtaccttttgt

SEQ ID NO: 115692 - DNA, 26 bp, Artificial sequence
  SiRNA target sequence
atcatttttatctagtaccttttgta

SEQ ID NO: 115693 - DNA, 26 bp, Artificial sequence
  SiRNA target sequence
tcatttttatctagtaccttttgtaa

SEQ ID NO: 115694 - DNA, 26 bp, Artificial sequence
  SiRNA target sequence
catttttatctagtaccttttgtaaa

SEQ ID NO: 115695 - DNA, 26 bp, Artificial sequence
  SiRNA target sequence
atttttatctagtaccttttgtaaac

SEQ ID NO: 115696 - DNA, 26 bp, Artificial sequence
  SiRNA target sequence
tttttatctagtaccttttgtaaact

SEQ ID NO: 115697 - DNA, 26 bp, Artificial sequence
  SiRNA target sequence
ttttatctagtaccttttgtaaactc

SEQ ID NO: 115698 - DNA, 26 bp, Artificial sequence
  SiRNA target sequence
tttatctagtaccttttgtaaactca

SEQ ID NO: 115699 - DNA, 26 bp, Artificial sequence
  SiRNA target sequence
ttatctagtaccttttgtaaactcat

SEQ ID NO: 115700 - DNA, 26 bp, Artificial sequence
  SiRNA target sequence
tatctagtaccttttgtaaactcata

SEQ ID NO: 115701 - DNA, 26 bp, Artificial sequence
  SiRNA target sequence
atctagtaccttttgtaaactcatat

SEQ ID NO: 115702 - DNA, 26 bp, Artificial sequence
  SiRNA target sequence
tctagtaccttttgtaaactcatata

SEQ ID NO: 115703 - DNA, 26 bp, Artificial sequence
  SiRNA target sequence
ctagtaccttttgtaaactcatataa

SEQ ID NO: 115704 - DNA, 26 bp, Artificial sequence
  SiRNA target sequence
tagtaccttttgtaaactcatataaa

SEQ ID NO: 115705 - DNA, 26 bp, Artificial sequence
  SiRNA target sequence
agtaccttttgtaaactcatataaat

SEQ ID NO: 115706 - DNA, 26 bp, Artificial sequence
  SiRNA target sequence
gtaccttttgtaaactcatataaatg

SEQ ID NO: 115707 - DNA, 26 bp, Artificial sequence
  SiRNA target sequence
taccttttgtaaactcatataaatgt

SEQ ID NO: 115708 - DNA, 26 bp, Artificial sequence
  SiRNA target sequence
accttttgtaaactcatataaatgtt

SEQ ID NO: 115709 - DNA, 26 bp, Artificial sequence
  SiRNA target sequence
ccttttgtaaactcatataaatgttt

SEQ ID NO: 115710 - DNA, 26 bp, Artificial sequence
  SiRNA target sequence
cttttgtaaactcatataaatgtttt

SEQ ID NO: 115711 - DNA, 26 bp, Artificial sequence
  SiRNA target sequence
ttttgtaaactcatataaatgttttc

SEQ ID NO: 115712 - DNA, 26 bp, Artificial sequence
  SiRNA target sequence
tttgtaaactcatataaatgttttcc

SEQ ID NO: 115713 - DNA, 26 bp, Artificial sequence
  SiRNA target sequence
ttgtaaactcatataaatgttttcct

SEQ ID NO: 115714 - DNA, 26 bp, Artificial sequence
  SiRNA target sequence
tgtaaactcatataaatgttttcctg

SEQ ID NO: 115715 - DNA, 26 bp, Artificial sequence
  SiRNA target sequence
gtaaactcatataaatgttttcctgt

SEQ ID NO: 115716 - DNA, 26 bp, Artificial sequence
  SiRNA target sequence
taaactcatataaatgttttcctgtc

SEQ ID NO: 115717 - DNA, 26 bp, Artificial sequence
  SiRNA target sequence
aaactcatataaatgttttcctgtcc

SEQ ID NO: 115718 - DNA, 26 bp, Artificial sequence
  SiRNA target sequence
aactcatataaatgttttcctgtcct

SEQ ID NO: 115719 - DNA, 26 bp, Artificial sequence
  SiRNA target sequence
actcatataaatgttttcctgtccta

SEQ ID NO: 115720 - DNA, 26 bp, Artificial sequence
  SiRNA target sequence
ctcatataaatgttttcctgtcctat

SEQ ID NO: 115721 - DNA, 26 bp, Artificial sequence
  SiRNA target sequence
tcatataaatgttttcctgtcctatt

SEQ ID NO: 115722 - DNA, 26 bp, Artificial sequence
  SiRNA target sequence
catataaatgttttcctgtcctatta

SEQ ID NO: 115723 - DNA, 26 bp, Artificial sequence
  SiRNA target sequence
atataaatgttttcctgtcctattac

SEQ ID NO: 115724 - DNA, 26 bp, Artificial sequence
  SiRNA target sequence
tataaatgttttcctgtcctattact

SEQ ID NO: 115725 - DNA, 26 bp, Artificial sequence
  SiRNA target sequence
ataaatgttttcctgtcctattacta

SEQ ID NO: 115726 - DNA, 26 bp, Artificial sequence
  SiRNA target sequence
taaatgttttcctgtcctattactaa

SEQ ID NO: 115727 - DNA, 26 bp, Artificial sequence
  SiRNA target sequence
aaatgttttcctgtcctattactaaa

SEQ ID NO: 115728 - DNA, 26 bp, Artificial sequence
  SiRNA target sequence
aatgttttcctgtcctattactaaat

SEQ ID NO: 115729 - DNA, 26 bp, Artificial sequence
  SiRNA target sequence
atgttttcctgtcctattactaaatg

SEQ ID NO: 115730 - DNA, 26 bp, Artificial sequence
  SiRNA target sequence
tgttttcctgtcctattactaaatga

SEQ ID NO: 115731 - DNA, 26 bp, Artificial sequence
  SiRNA target sequence
gttttcctgtcctattactaaatgac

SEQ ID NO: 115732 - DNA, 26 bp, Artificial sequence
  SiRNA target sequence
ttttcctgtcctattactaaatgaca

SEQ ID NO: 115733 - DNA, 26 bp, Artificial sequence
  SiRNA target sequence
tttcctgtcctattactaaatgacag

SEQ ID NO: 115734 - DNA, 26 bp, Artificial sequence
  SiRNA target sequence
ttcctgtcctattactaaatgacaga

SEQ ID NO: 115735 - DNA, 26 bp, Artificial sequence
  SiRNA target sequence
tcctgtcctattactaaatgacagaa

SEQ ID NO: 115736 - DNA, 26 bp, Artificial sequence
  SiRNA target sequence
cctgtcctattactaaatgacagaag

SEQ ID NO: 115737 - DNA, 26 bp, Artificial sequence
  SiRNA target sequence
ctgtcctattactaaatgacagaagc

SEQ ID NO: 115738 - DNA, 26 bp, Artificial sequence
  SiRNA target sequence
tgtcctattactaaatgacagaagcc

SEQ ID NO: 115739 - DNA, 26 bp, Artificial sequence
  SiRNA target sequence
gtcctattactaaatgacagaagcct

SEQ ID NO: 115740 - DNA, 26 bp, Artificial sequence
  SiRNA target sequence
tcctattactaaatgacagaagcctc

SEQ ID NO: 115741 - DNA, 26 bp, Artificial sequence
  SiRNA target sequence
cctattactaaatgacagaagcctct

SEQ ID NO: 115742 - DNA, 26 bp, Artificial sequence
  SiRNA target sequence
ctattactaaatgacagaagcctctt

SEQ ID NO: 115743 - DNA, 26 bp, Artificial sequence
  SiRNA target sequence
tattactaaatgacagaagcctctta

SEQ ID NO: 115744 - DNA, 26 bp, Artificial sequence
  SiRNA target sequence
attactaaatgacagaagcctcttat

SEQ ID NO: 115745 - DNA, 26 bp, Artificial sequence
  SiRNA target sequence
ttactaaatgacagaagcctcttata

SEQ ID NO: 115746 - DNA, 26 bp, Artificial sequence
  SiRNA target sequence
tactaaatgacagaagcctcttatat

SEQ ID NO: 115747 - DNA, 26 bp, Artificial sequence
  SiRNA target sequence
actaaatgacagaagcctcttatatt

SEQ ID NO: 115748 - DNA, 26 bp, Artificial sequence
  SiRNA target sequence
ctaaatgacagaagcctcttatattt

SEQ ID NO: 115749 - DNA, 26 bp, Artificial sequence
  SiRNA target sequence
taaatgacagaagcctcttatatttc

SEQ ID NO: 115750 - DNA, 26 bp, Artificial sequence
  SiRNA target sequence
aaatgacagaagcctcttatatttcc

SEQ ID NO: 115751 - DNA, 26 bp, Artificial sequence
  SiRNA target sequence
aatgacagaagcctcttatatttcct

SEQ ID NO: 115752 - DNA, 26 bp, Artificial sequence
  SiRNA target sequence
atgacagaagcctcttatatttcctt

SEQ ID NO: 115753 - DNA, 26 bp, Artificial sequence
  SiRNA target sequence
tgacagaagcctcttatatttccttt

SEQ ID NO: 115754 - DNA, 26 bp, Artificial sequence
  SiRNA target sequence
gacagaagcctcttatatttcctttt

SEQ ID NO: 115755 - DNA, 26 bp, Artificial sequence
  SiRNA target sequence
acagaagcctcttatatttccttttt

SEQ ID NO: 115756 - DNA, 26 bp, Artificial sequence
  SiRNA target sequence
cagaagcctcttatatttcctttttt

SEQ ID NO: 115757 - DNA, 26 bp, Artificial sequence
  SiRNA target sequence
agaagcctcttatatttcctttttta

SEQ ID NO: 115758 - DNA, 26 bp, Artificial sequence
  SiRNA target sequence
gaagcctcttatatttccttttttat

SEQ ID NO: 115759 - DNA, 26 bp, Artificial sequence
  SiRNA target sequence
aagcctcttatatttccttttttata

SEQ ID NO: 115760 - DNA, 26 bp, Artificial sequence
  SiRNA target sequence
agcctcttatatttccttttttatac

SEQ ID NO: 115761 - DNA, 26 bp, Artificial sequence
  SiRNA target sequence
gcctcttatatttccttttttatact

SEQ ID NO: 115762 - DNA, 26 bp, Artificial sequence
  SiRNA target sequence
cctcttatatttccttttttatactt

SEQ ID NO: 115763 - DNA, 26 bp, Artificial sequence
  SiRNA target sequence
ctcttatatttccttttttatactta

SEQ ID NO: 115764 - DNA, 26 bp, Artificial sequence
  SiRNA target sequence
tcttatatttccttttttatacttag

SEQ ID NO: 115765 - DNA, 26 bp, Artificial sequence
  SiRNA target sequence
cttatatttccttttttatacttaga

SEQ ID NO: 115766 - DNA, 26 bp, Artificial sequence
  SiRNA target sequence
ttatatttccttttttatacttagag

SEQ ID NO: 115767 - DNA, 26 bp, Artificial sequence
  SiRNA target sequence
tatatttccttttttatacttagagt

SEQ ID NO: 115768 - DNA, 26 bp, Artificial sequence
  SiRNA target sequence
atatttccttttttatacttagagtt

SEQ ID NO: 115769 - DNA, 26 bp, Artificial sequence
  SiRNA target sequence
tatttccttttttatacttagagtta

SEQ ID NO: 115770 - DNA, 26 bp, Artificial sequence
  SiRNA target sequence
atttccttttttatacttagagttag

SEQ ID NO: 115771 - DNA, 26 bp, Artificial sequence
  SiRNA target sequence
tttccttttttatacttagagttagc

SEQ ID NO: 115772 - DNA, 26 bp, Artificial sequence
  SiRNA target sequence
ttccttttttatacttagagttagca

SEQ ID NO: 115773 - DNA, 26 bp, Artificial sequence
  SiRNA target sequence
tccttttttatacttagagttagcat

SEQ ID NO: 115774 - DNA, 26 bp, Artificial sequence
  SiRNA target sequence
ccttttttatacttagagttagcata

SEQ ID NO: 115775 - DNA, 26 bp, Artificial sequence
  SiRNA target sequence
cttttttatacttagagttagcatat

SEQ ID NO: 115776 - DNA, 26 bp, Artificial sequence
  SiRNA target sequence
ttttttatacttagagttagcatatt

SEQ ID NO: 115777 - DNA, 26 bp, Artificial sequence
  SiRNA target sequence
tttttatacttagagttagcatattc

SEQ ID NO: 115778 - DNA, 26 bp, Artificial sequence
  SiRNA target sequence
ttttatacttagagttagcatattct

SEQ ID NO: 115779 - DNA, 26 bp, Artificial sequence
  SiRNA target sequence
tttatacttagagttagcatattctt

SEQ ID NO: 115780 - DNA, 26 bp, Artificial sequence
  SiRNA target sequence
ttatacttagagttagcatattcttc

SEQ ID NO: 115781 - DNA, 26 bp, Artificial sequence
  SiRNA target sequence
tatacttagagttagcatattcttcg

SEQ ID NO: 115782 - DNA, 26 bp, Artificial sequence
  SiRNA target sequence
atacttagagttagcatattcttcga

SEQ ID NO: 115783 - DNA, 26 bp, Artificial sequence
  SiRNA target sequence
tacttagagttagcatattcttcgat

SEQ ID NO: 115784 - DNA, 26 bp, Artificial sequence
  SiRNA target sequence
acttagagttagcatattcttcgata

SEQ ID NO: 115785 - DNA, 26 bp, Artificial sequence
  SiRNA target sequence
cttagagttagcatattcttcgataa

SEQ ID NO: 115786 - DNA, 26 bp, Artificial sequence
  SiRNA target sequence
ttagagttagcatattcttcgataag

SEQ ID NO: 115787 - DNA, 26 bp, Artificial sequence
  SiRNA target sequence
tagagttagcatattcttcgataaga

SEQ ID NO: 115788 - DNA, 26 bp, Artificial sequence
  SiRNA target sequence
agagttagcatattcttcgataagac

SEQ ID NO: 115789 - DNA, 26 bp, Artificial sequence
  SiRNA target sequence
gagttagcatattcttcgataagacg

SEQ ID NO: 115790 - DNA, 26 bp, Artificial sequence
  SiRNA target sequence
agttagcatattcttcgataagacgt

SEQ ID NO: 115791 - DNA, 26 bp, Artificial sequence
  SiRNA target sequence
gttagcatattcttcgataagacgta

SEQ ID NO: 115792 - DNA, 26 bp, Artificial sequence
  SiRNA target sequence
ttagcatattcttcgataagacgtag

SEQ ID NO: 115793 - DNA, 26 bp, Artificial sequence
  SiRNA target sequence
tagcatattcttcgataagacgtaga

SEQ ID NO: 115794 - DNA, 26 bp, Artificial sequence
  SiRNA target sequence
agcatattcttcgataagacgtagaa

SEQ ID NO: 115795 - DNA, 26 bp, Artificial sequence
  SiRNA target sequence
gcatattcttcgataagacgtagaat

SEQ ID NO: 115796 - DNA, 26 bp, Artificial sequence
  SiRNA target sequence
catattcttcgataagacgtagaatt

SEQ ID NO: 115797 - DNA, 26 bp, Artificial sequence
  SiRNA target sequence
atattcttcgataagacgtagaatta

SEQ ID NO: 115798 - DNA, 26 bp, Artificial sequence
  SiRNA target sequence
tattcttcgataagacgtagaattaa

SEQ ID NO: 115799 - DNA, 26 bp, Artificial sequence
  SiRNA target sequence
attcttcgataagacgtagaattaac

SEQ ID NO: 115800 - DNA, 26 bp, Artificial sequence
  SiRNA target sequence
ttcttcgataagacgtagaattaaca

SEQ ID NO: 115801 - DNA, 26 bp, Artificial sequence
  SiRNA target sequence
tcttcgataagacgtagaattaacat

SEQ ID NO: 115802 - DNA, 26 bp, Artificial sequence
  SiRNA target sequence
cttcgataagacgtagaattaacata

SEQ ID NO: 115803 - DNA, 26 bp, Artificial sequence
  SiRNA target sequence
ttcgataagacgtagaattaacatat

SEQ ID NO: 115804 - DNA, 26 bp, Artificial sequence
  SiRNA target sequence
tcgataagacgtagaattaacatatt

SEQ ID NO: 115805 - DNA, 26 bp, Artificial sequence
  SiRNA target sequence
cgataagacgtagaattaacatattt

SEQ ID NO: 115806 - DNA, 26 bp, Artificial sequence
  SiRNA target sequence
gataagacgtagaattaacatatttc

SEQ ID NO: 115807 - DNA, 26 bp, Artificial sequence
  SiRNA target sequence
ataagacgtagaattaacatatttct

SEQ ID NO: 115808 - DNA, 26 bp, Artificial sequence
  SiRNA target sequence
taagacgtagaattaacatatttcta

SEQ ID NO: 115809 - DNA, 26 bp, Artificial sequence
  SiRNA target sequence
aagacgtagaattaacatatttctat

SEQ ID NO: 115810 - DNA, 26 bp, Artificial sequence
  SiRNA target sequence
agacgtagaattaacatatttctata

SEQ ID NO: 115811 - DNA, 26 bp, Artificial sequence
  SiRNA target sequence
gacgtagaattaacatatttctataa

SEQ ID NO: 115812 - DNA, 26 bp, Artificial sequence
  SiRNA target sequence
acgtagaattaacatatttctataaa

SEQ ID NO: 115813 - DNA, 26 bp, Artificial sequence
  SiRNA target sequence
cgtagaattaacatatttctataaac

SEQ ID NO: 115814 - DNA, 26 bp, Artificial sequence
  SiRNA target sequence
gtagaattaacatatttctataaaca

SEQ ID NO: 115815 - DNA, 26 bp, Artificial sequence
  SiRNA target sequence
tagaattaacatatttctataaacat

SEQ ID NO: 115816 - DNA, 26 bp, Artificial sequence
  SiRNA target sequence
agaattaacatatttctataaacatc

SEQ ID NO: 115817 - DNA, 26 bp, Artificial sequence
  SiRNA target sequence
gaattaacatatttctataaacatct

SEQ ID NO: 115818 - DNA, 26 bp, Artificial sequence
  SiRNA target sequence
aattaacatatttctataaacatctt

SEQ ID NO: 115819 - DNA, 26 bp, Artificial sequence
  SiRNA target sequence
attaacatatttctataaacatcttg

SEQ ID NO: 115820 - DNA, 26 bp, Artificial sequence
  SiRNA target sequence
ttaacatatttctataaacatcttgt

SEQ ID NO: 115821 - DNA, 26 bp, Artificial sequence
  SiRNA target sequence
taacatatttctataaacatcttgta

SEQ ID NO: 115822 - DNA, 26 bp, Artificial sequence
  SiRNA target sequence
aacatatttctataaacatcttgtac

SEQ ID NO: 115823 - DNA, 26 bp, Artificial sequence
  SiRNA target sequence
acatatttctataaacatcttgtaca

SEQ ID NO: 115824 - DNA, 26 bp, Artificial sequence
  SiRNA target sequence
catatttctataaacatcttgtacaa

SEQ ID NO: 115825 - DNA, 26 bp, Artificial sequence
  SiRNA target sequence
atatttctataaacatcttgtacaag

SEQ ID NO: 115826 - DNA, 26 bp, Artificial sequence
  SiRNA target sequence
tatttctataaacatcttgtacaagt

SEQ ID NO: 115827 - DNA, 26 bp, Artificial sequence
  SiRNA target sequence
atttctataaacatcttgtacaagtt

SEQ ID NO: 115828 - DNA, 26 bp, Artificial sequence
  SiRNA target sequence
tttctataaacatcttgtacaagttc

SEQ ID NO: 115829 - DNA, 26 bp, Artificial sequence
  SiRNA target sequence
ttctataaacatcttgtacaagttct

SEQ ID NO: 115830 - DNA, 26 bp, Artificial sequence
  SiRNA target sequence
tctataaacatcttgtacaagttctt

SEQ ID NO: 115831 - DNA, 26 bp, Artificial sequence
  SiRNA target sequence
ctataaacatcttgtacaagttcttt

SEQ ID NO: 115832 - DNA, 26 bp, Artificial sequence
  SiRNA target sequence
tataaacatcttgtacaagttctttg

SEQ ID NO: 115833 - DNA, 26 bp, Artificial sequence
  SiRNA target sequence
ataaacatcttgtacaagttctttgt

SEQ ID NO: 115834 - DNA, 26 bp, Artificial sequence
  SiRNA target sequence
taaacatcttgtacaagttctttgtt

SEQ ID NO: 115835 - DNA, 26 bp, Artificial sequence
  SiRNA target sequence
aaacatcttgtacaagttctttgttt

SEQ ID NO: 115836 - DNA, 26 bp, Artificial sequence
  SiRNA target sequence
aacatcttgtacaagttctttgttta

SEQ ID NO: 115837 - DNA, 26 bp, Artificial sequence
  SiRNA target sequence
acatcttgtacaagttctttgtttaa

SEQ ID NO: 115838 - DNA, 26 bp, Artificial sequence
  SiRNA target sequence
catcttgtacaagttctttgtttaaa

SEQ ID NO: 115839 - DNA, 26 bp, Artificial sequence
  SiRNA target sequence
atcttgtacaagttctttgtttaaag

SEQ ID NO: 115840 - DNA, 26 bp, Artificial sequence
  SiRNA target sequence
tcttgtacaagttctttgtttaaagt

SEQ ID NO: 115841 - DNA, 26 bp, Artificial sequence
  SiRNA target sequence
cttgtacaagttctttgtttaaagta

SEQ ID NO: 115842 - DNA, 26 bp, Artificial sequence
  SiRNA target sequence
ttgtacaagttctttgtttaaagtag

SEQ ID NO: 115843 - DNA, 26 bp, Artificial sequence
  SiRNA target sequence
tgtacaagttctttgtttaaagtagt

SEQ ID NO: 115844 - DNA, 26 bp, Artificial sequence
  SiRNA target sequence
gtacaagttctttgtttaaagtagtt

SEQ ID NO: 115845 - DNA, 26 bp, Artificial sequence
  SiRNA target sequence
tacaagttctttgtttaaagtagttt

SEQ ID NO: 115846 - DNA, 26 bp, Artificial sequence
  SiRNA target sequence
acaagttctttgtttaaagtagtttt

SEQ ID NO: 115847 - DNA, 26 bp, Artificial sequence
  SiRNA target sequence
caagttctttgtttaaagtagttttc

SEQ ID NO: 115848 - DNA, 26 bp, Artificial sequence
  SiRNA target sequence
aagttctttgtttaaagtagttttca

SEQ ID NO: 115849 - DNA, 26 bp, Artificial sequence
  SiRNA target sequence
agttctttgtttaaagtagttttcag

SEQ ID NO: 115850 - DNA, 26 bp, Artificial sequence
  SiRNA target sequence
gttctttgtttaaagtagttttcagt

SEQ ID NO: 115851 - DNA, 26 bp, Artificial sequence
  SiRNA target sequence
ttctttgtttaaagtagttttcagtt

SEQ ID NO: 115852 - DNA, 26 bp, Artificial sequence
  SiRNA target sequence
tctttgtttaaagtagttttcagttt

SEQ ID NO: 115853 - DNA, 26 bp, Artificial sequence
  SiRNA target sequence
ctttgtttaaagtagttttcagttta

SEQ ID NO: 115854 - DNA, 26 bp, Artificial sequence
  SiRNA target sequence
tttgtttaaagtagttttcagtttaa

SEQ ID NO: 115855 - DNA, 26 bp, Artificial sequence
  SiRNA target sequence
ttgtttaaagtagttttcagtttaac

SEQ ID NO: 115856 - DNA, 26 bp, Artificial sequence
  SiRNA target sequence
tgtttaaagtagttttcagtttaact

SEQ ID NO: 115857 - DNA, 26 bp, Artificial sequence
  SiRNA target sequence
gtttaaagtagttttcagtttaactg

SEQ ID NO: 115858 - DNA, 26 bp, Artificial sequence
  SiRNA target sequence
tttaaagtagttttcagtttaactgt

SEQ ID NO: 115859 - DNA, 26 bp, Artificial sequence
  SiRNA target sequence
ttaaagtagttttcagtttaactgta

SEQ ID NO: 115860 - DNA, 26 bp, Artificial sequence
  SiRNA target sequence
taaagtagttttcagtttaactgtat

SEQ ID NO: 115861 - DNA, 26 bp, Artificial sequence
  SiRNA target sequence
aaagtagttttcagtttaactgtatt

SEQ ID NO: 115862 - DNA, 26 bp, Artificial sequence
  SiRNA target sequence
aagtagttttcagtttaactgtattt

SEQ ID NO: 115863 - DNA, 26 bp, Artificial sequence
  SiRNA target sequence
agtagttttcagtttaactgtatttt

SEQ ID NO: 115864 - DNA, 26 bp, Artificial sequence
  SiRNA target sequence
gtagttttcagtttaactgtattttt

SEQ ID NO: 115865 - DNA, 26 bp, Artificial sequence
  SiRNA target sequence
tagttttcagtttaactgtattttta

SEQ ID NO: 115866 - DNA, 26 bp, Artificial sequence
  SiRNA target sequence
agttttcagtttaactgtatttttat

SEQ ID NO: 115867 - DNA, 26 bp, Artificial sequence
  SiRNA target sequence
gttttcagtttaactgtatttttatc

SEQ ID NO: 115868 - DNA, 26 bp, Artificial sequence
  SiRNA target sequence
ttttcagtttaactgtatttttatct

SEQ ID NO: 115869 - DNA, 26 bp, Artificial sequence
  SiRNA target sequence
tttcagtttaactgtatttttatcta

SEQ ID NO: 115870 - DNA, 26 bp, Artificial sequence
  SiRNA target sequence
ttcagtttaactgtatttttatctac

SEQ ID NO: 115871 - DNA, 26 bp, Artificial sequence
  SiRNA target sequence
tcagtttaactgtatttttatctacc

SEQ ID NO: 115872 - DNA, 26 bp, Artificial sequence
  SiRNA target sequence
cagtttaactgtatttttatctacca

SEQ ID NO: 115873 - DNA, 26 bp, Artificial sequence
  SiRNA target sequence
agtttaactgtatttttatctaccaa

SEQ ID NO: 115874 - DNA, 26 bp, Artificial sequence
  SiRNA target sequence
gtttaactgtatttttatctaccaaa

SEQ ID NO: 115875 - DNA, 26 bp, Artificial sequence
  SiRNA target sequence
tttaactgtatttttatctaccaaat

SEQ ID NO: 115876 - DNA, 26 bp, Artificial sequence
  SiRNA target sequence
ttaactgtatttttatctaccaaata

SEQ ID NO: 115877 - DNA, 26 bp, Artificial sequence
  SiRNA target sequence
taactgtatttttatctaccaaataa

SEQ ID NO: 115878 - DNA, 26 bp, Artificial sequence
  SiRNA target sequence
aactgtatttttatctaccaaataat

SEQ ID NO: 115879 - DNA, 26 bp, Artificial sequence
  SiRNA target sequence
actgtatttttatctaccaaataata

SEQ ID NO: 115880 - DNA, 26 bp, Artificial sequence
  SiRNA target sequence
ctgtatttttatctaccaaataataa

SEQ ID NO: 115881 - DNA, 26 bp, Artificial sequence
  SiRNA target sequence
tgtatttttatctaccaaataataat

SEQ ID NO: 115882 - DNA, 26 bp, Artificial sequence
  SiRNA target sequence
gtatttttatctaccaaataataatc

SEQ ID NO: 115883 - DNA, 26 bp, Artificial sequence
  SiRNA target sequence
tatttttatctaccaaataataatct

SEQ ID NO: 115884 - DNA, 26 bp, Artificial sequence
  SiRNA target sequence
atttttatctaccaaataataatcta

SEQ ID NO: 115885 - DNA, 26 bp, Artificial sequence
  SiRNA target sequence
tttttatctaccaaataataatctat

SEQ ID NO: 115886 - DNA, 26 bp, Artificial sequence
  SiRNA target sequence
ttttatctaccaaataataatctatc

SEQ ID NO: 115887 - DNA, 26 bp, Artificial sequence
  SiRNA target sequence
tttatctaccaaataataatctatca

SEQ ID NO: 115888 - DNA, 26 bp, Artificial sequence
  SiRNA target sequence
ttatctaccaaataataatctatcat

SEQ ID NO: 115889 - DNA, 27 bp, Artificial sequence
  SiRNA target sequence
ttattcagaataaacatcttttaaaag

SEQ ID NO: 115890 - DNA, 27 bp, Artificial sequence
  SiRNA target sequence
tattcagaataaacatcttttaaaagt

SEQ ID NO: 115891 - DNA, 27 bp, Artificial sequence
  SiRNA target sequence
attcagaataaacatcttttaaaagtt

SEQ ID NO: 115892 - DNA, 27 bp, Artificial sequence
  SiRNA target sequence
ttcagaataaacatcttttaaaagttc

SEQ ID NO: 115893 - DNA, 27 bp, Artificial sequence
  SiRNA target sequence
tcagaataaacatcttttaaaagttca

SEQ ID NO: 115894 - DNA, 27 bp, Artificial sequence
  SiRNA target sequence
cagaataaacatcttttaaaagttcat

SEQ ID NO: 115895 - DNA, 27 bp, Artificial sequence
  SiRNA target sequence
agaataaacatcttttaaaagttcatc

SEQ ID NO: 115896 - DNA, 27 bp, Artificial sequence
  SiRNA target sequence
gaataaacatcttttaaaagttcatcg

SEQ ID NO: 115897 - DNA, 27 bp, Artificial sequence
  SiRNA target sequence
aataaacatcttttaaaagttcatcga

SEQ ID NO: 115898 - DNA, 27 bp, Artificial sequence
  SiRNA target sequence
ataaacatcttttaaaagttcatcgat

SEQ ID NO: 115899 - DNA, 27 bp, Artificial sequence
  SiRNA target sequence
taaacatcttttaaaagttcatcgata

SEQ ID NO: 115900 - DNA, 27 bp, Artificial sequence
  SiRNA target sequence
aaacatcttttaaaagttcatcgatat

SEQ ID NO: 115901 - DNA, 27 bp, Artificial sequence
  SiRNA target sequence
aacatcttttaaaagttcatcgatatc

SEQ ID NO: 115902 - DNA, 27 bp, Artificial sequence
  SiRNA target sequence
acatcttttaaaagttcatcgatatcg

SEQ ID NO: 115903 - DNA, 27 bp, Artificial sequence
  SiRNA target sequence
catcttttaaaagttcatcgatatcgg

SEQ ID NO: 115904 - DNA, 27 bp, Artificial sequence
  SiRNA target sequence
atcttttaaaagttcatcgatatcggg

SEQ ID NO: 115905 - DNA, 27 bp, Artificial sequence
  SiRNA target sequence
tcttttaaaagttcatcgatatcgggt

SEQ ID NO: 115906 - DNA, 27 bp, Artificial sequence
  SiRNA target sequence
cttttaaaagttcatcgatatcgggtt

SEQ ID NO: 115907 - DNA, 27 bp, Artificial sequence
  SiRNA target sequence
ttttaaaagttcatcgatatcgggttc

SEQ ID NO: 115908 - DNA, 27 bp, Artificial sequence
  SiRNA target sequence
tttaaaagttcatcgatatcgggttct

SEQ ID NO: 115909 - DNA, 27 bp, Artificial sequence
  SiRNA target sequence
ttaaaagttcatcgatatcgggttctt

SEQ ID NO: 115910 - DNA, 27 bp, Artificial sequence
  SiRNA target sequence
taaaagttcatcgatatcgggttcttt

SEQ ID NO: 115911 - DNA, 27 bp, Artificial sequence
  SiRNA target sequence
aaaagttcatcgatatcgggttcttta

SEQ ID NO: 115912 - DNA, 27 bp, Artificial sequence
  SiRNA target sequence
aaagttcatcgatatcgggttctttag

SEQ ID NO: 115913 - DNA, 27 bp, Artificial sequence
  SiRNA target sequence
aagttcatcgatatcgggttctttaga

SEQ ID NO: 115914 - DNA, 27 bp, Artificial sequence
  SiRNA target sequence
agttcatcgatatcgggttctttagaa

SEQ ID NO: 115915 - DNA, 27 bp, Artificial sequence
  SiRNA target sequence
gttcatcgatatcgggttctttagaaa

SEQ ID NO: 115916 - DNA, 27 bp, Artificial sequence
  SiRNA target sequence
ttcatcgatatcgggttctttagaaaa

SEQ ID NO: 115917 - DNA, 27 bp, Artificial sequence
  SiRNA target sequence
tcatcgatatcgggttctttagaaaaa

SEQ ID NO: 115918 - DNA, 27 bp, Artificial sequence
  SiRNA target sequence
catcgatatcgggttctttagaaaaaa

SEQ ID NO: 115919 - DNA, 27 bp, Artificial sequence
  SiRNA target sequence
atcgatatcgggttctttagaaaaaat

SEQ ID NO: 115920 - DNA, 27 bp, Artificial sequence
  SiRNA target sequence
tcgatatcgggttctttagaaaaaata

SEQ ID NO: 115921 - DNA, 27 bp, Artificial sequence
  SiRNA target sequence
cgatatcgggttctttagaaaaaataa

SEQ ID NO: 115922 - DNA, 27 bp, Artificial sequence
  SiRNA target sequence
gatatcgggttctttagaaaaaataac

SEQ ID NO: 115923 - DNA, 27 bp, Artificial sequence
  SiRNA target sequence
atatcgggttctttagaaaaaataact

SEQ ID NO: 115924 - DNA, 27 bp, Artificial sequence
  SiRNA target sequence
tatcgggttctttagaaaaaataactt

SEQ ID NO: 115925 - DNA, 27 bp, Artificial sequence
  SiRNA target sequence
atcgggttctttagaaaaaataacttt

SEQ ID NO: 115926 - DNA, 27 bp, Artificial sequence
  SiRNA target sequence
tcgggttctttagaaaaaataactttt

SEQ ID NO: 115927 - DNA, 27 bp, Artificial sequence
  SiRNA target sequence
cgggttctttagaaaaaataacttttt

SEQ ID NO: 115928 - DNA, 27 bp, Artificial sequence
  SiRNA target sequence
gggttctttagaaaaaataactttttt

SEQ ID NO: 115929 - DNA, 27 bp, Artificial sequence
  SiRNA target sequence
ggttctttagaaaaaataactttttta

SEQ ID NO: 115930 - DNA, 27 bp, Artificial sequence
  SiRNA target sequence
gttctttagaaaaaataacttttttaa

SEQ ID NO: 115931 - DNA, 27 bp, Artificial sequence
  SiRNA target sequence
ttctttagaaaaaataacttttttaac

SEQ ID NO: 115932 - DNA, 27 bp, Artificial sequence
  SiRNA target sequence
tctttagaaaaaataacttttttaaca

SEQ ID NO: 115933 - DNA, 27 bp, Artificial sequence
  SiRNA target sequence
ctttagaaaaaataacttttttaacac

SEQ ID NO: 115934 - DNA, 27 bp, Artificial sequence
  SiRNA target sequence
tttagaaaaaataacttttttaacacc

SEQ ID NO: 115935 - DNA, 27 bp, Artificial sequence
  SiRNA target sequence
ttagaaaaaataacttttttaacacct

SEQ ID NO: 115936 - DNA, 27 bp, Artificial sequence
  SiRNA target sequence
tagaaaaaataacttttttaacacctt

SEQ ID NO: 115937 - DNA, 27 bp, Artificial sequence
  SiRNA target sequence
agaaaaaataacttttttaacaccttc

SEQ ID NO: 115938 - DNA, 27 bp, Artificial sequence
  SiRNA target sequence
gaaaaaataacttttttaacaccttct

SEQ ID NO: 115939 - DNA, 27 bp, Artificial sequence
  SiRNA target sequence
aaaaaataacttttttaacaccttctt

SEQ ID NO: 115940 - DNA, 27 bp, Artificial sequence
  SiRNA target sequence
aaaaataacttttttaacaccttcttc

SEQ ID NO: 115941 - DNA, 27 bp, Artificial sequence
  SiRNA target sequence
aaaataacttttttaacaccttcttca

SEQ ID NO: 115942 - DNA, 27 bp, Artificial sequence
  SiRNA target sequence
aaataacttttttaacaccttcttcaa

SEQ ID NO: 115943 - DNA, 27 bp, Artificial sequence
  SiRNA target sequence
aataacttttttaacaccttcttcaaa

SEQ ID NO: 115944 - DNA, 27 bp, Artificial sequence
  SiRNA target sequence
ataacttttttaacaccttcttcaaag

SEQ ID NO: 115945 - DNA, 27 bp, Artificial sequence
  SiRNA target sequence
taacttttttaacaccttcttcaaagc

SEQ ID NO: 115946 - DNA, 27 bp, Artificial sequence
  SiRNA target sequence
aacttttttaacaccttcttcaaagca

SEQ ID NO: 115947 - DNA, 27 bp, Artificial sequence
  SiRNA target sequence
acttttttaacaccttcttcaaagcag

SEQ ID NO: 115948 - DNA, 27 bp, Artificial sequence
  SiRNA target sequence
cttttttaacaccttcttcaaagcagg

SEQ ID NO: 115949 - DNA, 27 bp, Artificial sequence
  SiRNA target sequence
ttttttaacaccttcttcaaagcagga

SEQ ID NO: 115950 - DNA, 27 bp, Artificial sequence
  SiRNA target sequence
tttttaacaccttcttcaaagcaggaa

SEQ ID NO: 115951 - DNA, 27 bp, Artificial sequence
  SiRNA target sequence
ttttaacaccttcttcaaagcaggaaa

SEQ ID NO: 115952 - DNA, 27 bp, Artificial sequence
  SiRNA target sequence
tttaacaccttcttcaaagcaggaaat

SEQ ID NO: 115953 - DNA, 27 bp, Artificial sequence
  SiRNA target sequence
ttaacaccttcttcaaagcaggaaatt

SEQ ID NO: 115954 - DNA, 27 bp, Artificial sequence
  SiRNA target sequence
taacaccttcttcaaagcaggaaatta

SEQ ID NO: 115955 - DNA, 27 bp, Artificial sequence
  SiRNA target sequence
aacaccttcttcaaagcaggaaattac

SEQ ID NO: 115956 - DNA, 27 bp, Artificial sequence
  SiRNA target sequence
acaccttcttcaaagcaggaaattacc

SEQ ID NO: 115957 - DNA, 27 bp, Artificial sequence
  SiRNA target sequence
caccttcttcaaagcaggaaattacct

SEQ ID NO: 115958 - DNA, 27 bp, Artificial sequence
  SiRNA target sequence
accttcttcaaagcaggaaattacctc

SEQ ID NO: 115959 - DNA, 27 bp, Artificial sequence
  SiRNA target sequence
ccttcttcaaagcaggaaattacctca

SEQ ID NO: 115960 - DNA, 27 bp, Artificial sequence
  SiRNA target sequence
cttcttcaaagcaggaaattacctcat

SEQ ID NO: 115961 - DNA, 27 bp, Artificial sequence
  SiRNA target sequence
ttcttcaaagcaggaaattacctcatc

SEQ ID NO: 115962 - DNA, 27 bp, Artificial sequence
  SiRNA target sequence
tcttcaaagcaggaaattacctcatct

SEQ ID NO: 115963 - DNA, 27 bp, Artificial sequence
  SiRNA target sequence
cttcaaagcaggaaattacctcatctt

SEQ ID NO: 115964 - DNA, 27 bp, Artificial sequence
  SiRNA target sequence
ttcaaagcaggaaattacctcatcttc

SEQ ID NO: 115965 - DNA, 27 bp, Artificial sequence
  SiRNA target sequence
tcaaagcaggaaattacctcatcttcg

SEQ ID NO: 115966 - DNA, 27 bp, Artificial sequence
  SiRNA target sequence
caaagcaggaaattacctcatcttcga

SEQ ID NO: 115967 - DNA, 27 bp, Artificial sequence
  SiRNA target sequence
aaagcaggaaattacctcatcttcgat

SEQ ID NO: 115968 - DNA, 27 bp, Artificial sequence
  SiRNA target sequence
aagcaggaaattacctcatcttcgata

SEQ ID NO: 115969 - DNA, 27 bp, Artificial sequence
  SiRNA target sequence
agcaggaaattacctcatcttcgataa

SEQ ID NO: 115970 - DNA, 27 bp, Artificial sequence
  SiRNA target sequence
gcaggaaattacctcatcttcgataat

SEQ ID NO: 115971 - DNA, 27 bp, Artificial sequence
  SiRNA target sequence
caggaaattacctcatcttcgataatt

SEQ ID NO: 115972 - DNA, 27 bp, Artificial sequence
  SiRNA target sequence
aggaaattacctcatcttcgataattt

SEQ ID NO: 115973 - DNA, 27 bp, Artificial sequence
  SiRNA target sequence
ggaaattacctcatcttcgataatttt

SEQ ID NO: 115974 - DNA, 27 bp, Artificial sequence
  SiRNA target sequence
gaaattacctcatcttcgataattttt

SEQ ID NO: 115975 - DNA, 27 bp, Artificial sequence
  SiRNA target sequence
aaattacctcatcttcgataattttta

SEQ ID NO: 115976 - DNA, 27 bp, Artificial sequence
  SiRNA target sequence
aattacctcatcttcgataatttttac

SEQ ID NO: 115977 - DNA, 27 bp, Artificial sequence
  SiRNA target sequence
attacctcatcttcgataatttttact

SEQ ID NO: 115978 - DNA, 27 bp, Artificial sequence
  SiRNA target sequence
ttacctcatcttcgataatttttactt

SEQ ID NO: 115979 - DNA, 27 bp, Artificial sequence
  SiRNA target sequence
tacctcatcttcgataatttttacttc

SEQ ID NO: 115980 - DNA, 27 bp, Artificial sequence
  SiRNA target sequence
acctcatcttcgataatttttacttct

SEQ ID NO: 115981 - DNA, 27 bp, Artificial sequence
  SiRNA target sequence
cctcatcttcgataatttttacttctt

SEQ ID NO: 115982 - DNA, 27 bp, Artificial sequence
  SiRNA target sequence
ctcatcttcgataatttttacttcttc

SEQ ID NO: 115983 - DNA, 27 bp, Artificial sequence
  SiRNA target sequence
tcatcttcgataatttttacttcttca

SEQ ID NO: 115984 - DNA, 27 bp, Artificial sequence
  SiRNA target sequence
catcttcgataatttttacttcttcac

SEQ ID NO: 115985 - DNA, 27 bp, Artificial sequence
  SiRNA target sequence
atcttcgataatttttacttcttcaca

SEQ ID NO: 115986 - DNA, 27 bp, Artificial sequence
  SiRNA target sequence
tcttcgataatttttacttcttcacaa

SEQ ID NO: 115987 - DNA, 27 bp, Artificial sequence
  SiRNA target sequence
cttcgataatttttacttcttcacaag

SEQ ID NO: 115988 - DNA, 27 bp, Artificial sequence
  SiRNA target sequence
ttcgataatttttacttcttcacaagt

SEQ ID NO: 115989 - DNA, 27 bp, Artificial sequence
  SiRNA target sequence
tcgataatttttacttcttcacaagtc

SEQ ID NO: 115990 - DNA, 27 bp, Artificial sequence
  SiRNA target sequence
cgataatttttacttcttcacaagtcg

SEQ ID NO: 115991 - DNA, 27 bp, Artificial sequence
  SiRNA target sequence
gataatttttacttcttcacaagtcgc

SEQ ID NO: 115992 - DNA, 27 bp, Artificial sequence
  SiRNA target sequence
ataatttttacttcttcacaagtcgca

SEQ ID NO: 115993 - DNA, 27 bp, Artificial sequence
  SiRNA target sequence
taatttttacttcttcacaagtcgcaa

SEQ ID NO: 115994 - DNA, 27 bp, Artificial sequence
  SiRNA target sequence
aatttttacttcttcacaagtcgcaaa

SEQ ID NO: 115995 - DNA, 27 bp, Artificial sequence
  SiRNA target sequence
atttttacttcttcacaagtcgcaaat

SEQ ID NO: 115996 - DNA, 27 bp, Artificial sequence
  SiRNA target sequence
tttttacttcttcacaagtcgcaaatt

SEQ ID NO: 115997 - DNA, 27 bp, Artificial sequence
  SiRNA target sequence
ttttacttcttcacaagtcgcaaattt

SEQ ID NO: 115998 - DNA, 27 bp, Artificial sequence
  SiRNA target sequence
tttacttcttcacaagtcgcaaatttt

SEQ ID NO: 115999 - DNA, 27 bp, Artificial sequence
  SiRNA target sequence
ttacttcttcacaagtcgcaaattttt

SEQ ID NO: 116000 - DNA, 27 bp, Artificial sequence
  SiRNA target sequence
tacttcttcacaagtcgcaaatttttg

SEQ ID NO: 116001 - DNA, 27 bp, Artificial sequence
  SiRNA target sequence
acttcttcacaagtcgcaaatttttgt

SEQ ID NO: 116002 - DNA, 27 bp, Artificial sequence
  SiRNA target sequence
cttcttcacaagtcgcaaatttttgta

SEQ ID NO: 116003 - DNA, 27 bp, Artificial sequence
  SiRNA target sequence
ttcttcacaagtcgcaaatttttgtaa

SEQ ID NO: 116004 - DNA, 27 bp, Artificial sequence
  SiRNA target sequence
tcttcacaagtcgcaaatttttgtaag

SEQ ID NO: 116005 - DNA, 27 bp, Artificial sequence
  SiRNA target sequence
cttcacaagtcgcaaatttttgtaagt

SEQ ID NO: 116006 - DNA, 27 bp, Artificial sequence
  SiRNA target sequence
ttcacaagtcgcaaatttttgtaagtt

SEQ ID NO: 116007 - DNA, 27 bp, Artificial sequence
  SiRNA target sequence
tcacaagtcgcaaatttttgtaagtta

SEQ ID NO: 116008 - DNA, 27 bp, Artificial sequence
  SiRNA target sequence
cacaagtcgcaaatttttgtaagttat

SEQ ID NO: 116009 - DNA, 27 bp, Artificial sequence
  SiRNA target sequence
acaagtcgcaaatttttgtaagttatt

SEQ ID NO: 116010 - DNA, 27 bp, Artificial sequence
  SiRNA target sequence
caagtcgcaaatttttgtaagttattt

SEQ ID NO: 116011 - DNA, 27 bp, Artificial sequence
  SiRNA target sequence
aagtcgcaaatttttgtaagttatttt

SEQ ID NO: 116012 - DNA, 27 bp, Artificial sequence
  SiRNA target sequence
agtcgcaaatttttgtaagttattttt

SEQ ID NO: 116013 - DNA, 27 bp, Artificial sequence
  SiRNA target sequence
gtcgcaaatttttgtaagttatttttt

SEQ ID NO: 116014 - DNA, 27 bp, Artificial sequence
  SiRNA target sequence
tcgcaaatttttgtaagttattttttg

SEQ ID NO: 116015 - DNA, 27 bp, Artificial sequence
  SiRNA target sequence
cgcaaatttttgtaagttattttttgc

SEQ ID NO: 116016 - DNA, 27 bp, Artificial sequence
  SiRNA target sequence
gcaaatttttgtaagttattttttgct

SEQ ID NO: 116017 - DNA, 27 bp, Artificial sequence
  SiRNA target sequence
caaatttttgtaagttattttttgctt

SEQ ID NO: 116018 - DNA, 27 bp, Artificial sequence
  SiRNA target sequence
aaatttttgtaagttattttttgcttc

SEQ ID NO: 116019 - DNA, 27 bp, Artificial sequence
  SiRNA target sequence
aatttttgtaagttattttttgcttct

SEQ ID NO: 116020 - DNA, 27 bp, Artificial sequence
  SiRNA target sequence
atttttgtaagttattttttgcttctt

SEQ ID NO: 116021 - DNA, 27 bp, Artificial sequence
  SiRNA target sequence
tttttgtaagttattttttgcttcttt

SEQ ID NO: 116022 - DNA, 27 bp, Artificial sequence
  SiRNA target sequence
ttttgtaagttattttttgcttcttta

SEQ ID NO: 116023 - DNA, 27 bp, Artificial sequence
  SiRNA target sequence
tttgtaagttattttttgcttctttaa

SEQ ID NO: 116024 - DNA, 27 bp, Artificial sequence
  SiRNA target sequence
ttgtaagttattttttgcttctttaag

SEQ ID NO: 116025 - DNA, 27 bp, Artificial sequence
  SiRNA target sequence
tgtaagttattttttgcttctttaagg

SEQ ID NO: 116026 - DNA, 27 bp, Artificial sequence
  SiRNA target sequence
gtaagttattttttgcttctttaaggc

SEQ ID NO: 116027 - DNA, 27 bp, Artificial sequence
  SiRNA target sequence
taagttattttttgcttctttaaggca

SEQ ID NO: 116028 - DNA, 27 bp, Artificial sequence
  SiRNA target sequence
aagttattttttgcttctttaaggcaa

SEQ ID NO: 116029 - DNA, 27 bp, Artificial sequence
  SiRNA target sequence
agttattttttgcttctttaaggcaat

SEQ ID NO: 116030 - DNA, 27 bp, Artificial sequence
  SiRNA target sequence
gttattttttgcttctttaaggcaatc

SEQ ID NO: 116031 - DNA, 27 bp, Artificial sequence
  SiRNA target sequence
ttattttttgcttctttaaggcaatca

SEQ ID NO: 116032 - DNA, 27 bp, Artificial sequence
  SiRNA target sequence
tattttttgcttctttaaggcaatcat

SEQ ID NO: 116033 - DNA, 27 bp, Artificial sequence
  SiRNA target sequence
attttttgcttctttaaggcaatcatt

SEQ ID NO: 116034 - DNA, 27 bp, Artificial sequence
  SiRNA target sequence
ttttttgcttctttaaggcaatcatta

SEQ ID NO: 116035 - DNA, 27 bp, Artificial sequence
  SiRNA target sequence
tttttgcttctttaaggcaatcattat

SEQ ID NO: 116036 - DNA, 27 bp, Artificial sequence
  SiRNA target sequence
ttttgcttctttaaggcaatcattatt

SEQ ID NO: 116037 - DNA, 27 bp, Artificial sequence
  SiRNA target sequence
tttgcttctttaaggcaatcattattt

SEQ ID NO: 116038 - DNA, 27 bp, Artificial sequence
  SiRNA target sequence
ttgcttctttaaggcaatcattatttt

SEQ ID NO: 116039 - DNA, 27 bp, Artificial sequence
  SiRNA target sequence
tgcttctttaaggcaatcattattttt

SEQ ID NO: 116040 - DNA, 27 bp, Artificial sequence
  SiRNA target sequence
gcttctttaaggcaatcattatttttt

SEQ ID NO: 116041 - DNA, 27 bp, Artificial sequence
  SiRNA target sequence
cttctttaaggcaatcattattttttt

SEQ ID NO: 116042 - DNA, 27 bp, Artificial sequence
  SiRNA target sequence
ttctttaaggcaatcattatttttttt

SEQ ID NO: 116043 - DNA, 27 bp, Artificial sequence
  SiRNA target sequence
tctttaaggcaatcattattttttttt

SEQ ID NO: 116044 - DNA, 27 bp, Artificial sequence
  SiRNA target sequence
ctttaaggcaatcattatttttttttt

SEQ ID NO: 116045 - DNA, 27 bp, Artificial sequence
  SiRNA target sequence
tttaaggcaatcattattttttttttc

SEQ ID NO: 116046 - DNA, 27 bp, Artificial sequence
  SiRNA target sequence
ttaaggcaatcattattttttttttca

SEQ ID NO: 116047 - DNA, 27 bp, Artificial sequence
  SiRNA target sequence
taaggcaatcattattttttttttcat

SEQ ID NO: 116048 - DNA, 27 bp, Artificial sequence
  SiRNA target sequence
aaggcaatcattattttttttttcatt

SEQ ID NO: 116049 - DNA, 27 bp, Artificial sequence
  SiRNA target sequence
aggcaatcattattttttttttcatta

SEQ ID NO: 116050 - DNA, 27 bp, Artificial sequence
  SiRNA target sequence
ggcaatcattattttttttttcattaa

SEQ ID NO: 116051 - DNA, 27 bp, Artificial sequence
  SiRNA target sequence
gcaatcattattttttttttcattaat

SEQ ID NO: 116052 - DNA, 27 bp, Artificial sequence
  SiRNA target sequence
caatcattattttttttttcattaatt

SEQ ID NO: 116053 - DNA, 27 bp, Artificial sequence
  SiRNA target sequence
aatcattattttttttttcattaattt

SEQ ID NO: 116054 - DNA, 27 bp, Artificial sequence
  SiRNA target sequence
atcattattttttttttcattaatttc

SEQ ID NO: 116055 - DNA, 27 bp, Artificial sequence
  SiRNA target sequence
tcattattttttttttcattaatttcc

SEQ ID NO: 116056 - DNA, 27 bp, Artificial sequence
  SiRNA target sequence
cattattttttttttcattaatttcct

SEQ ID NO: 116057 - DNA, 27 bp, Artificial sequence
  SiRNA target sequence
attattttttttttcattaatttcctc

SEQ ID NO: 116058 - DNA, 27 bp, Artificial sequence
  SiRNA target sequence
ttattttttttttcattaatttcctcc

SEQ ID NO: 116059 - DNA, 27 bp, Artificial sequence
  SiRNA target sequence
tattttttttttcattaatttcctccg

SEQ ID NO: 116060 - DNA, 27 bp, Artificial sequence
  SiRNA target sequence
attttttttttcattaatttcctccgt

SEQ ID NO: 116061 - DNA, 27 bp, Artificial sequence
  SiRNA target sequence
ttttttttttcattaatttcctccgtg

SEQ ID NO: 116062 - DNA, 27 bp, Artificial sequence
  SiRNA target sequence
tttttttttcattaatttcctccgtgg

SEQ ID NO: 116063 - DNA, 27 bp, Artificial sequence
  SiRNA target sequence
ttttttttcattaatttcctccgtgga

SEQ ID NO: 116064 - DNA, 27 bp, Artificial sequence
  SiRNA target sequence
tttttttcattaatttcctccgtggat

SEQ ID NO: 116065 - DNA, 27 bp, Artificial sequence
  SiRNA target sequence
ttttttcattaatttcctccgtggatc

SEQ ID NO: 116066 - DNA, 27 bp, Artificial sequence
  SiRNA target sequence
tttttcattaatttcctccgtggatct

SEQ ID NO: 116067 - DNA, 27 bp, Artificial sequence
  SiRNA target sequence
ttttcattaatttcctccgtggatctg

SEQ ID NO: 116068 - DNA, 27 bp, Artificial sequence
  SiRNA target sequence
tttcattaatttcctccgtggatctgt

SEQ ID NO: 116069 - DNA, 27 bp, Artificial sequence
  SiRNA target sequence
ttcattaatttcctccgtggatctgta

SEQ ID NO: 116070 - DNA, 27 bp, Artificial sequence
  SiRNA target sequence
tcattaatttcctccgtggatctgtaa

SEQ ID NO: 116071 - DNA, 27 bp, Artificial sequence
  SiRNA target sequence
cattaatttcctccgtggatctgtaaa

SEQ ID NO: 116072 - DNA, 27 bp, Artificial sequence
  SiRNA target sequence
attaatttcctccgtggatctgtaaaa

SEQ ID NO: 116073 - DNA, 27 bp, Artificial sequence
  SiRNA target sequence
ttaatttcctccgtggatctgtaaaaa

SEQ ID NO: 116074 - DNA, 27 bp, Artificial sequence
  SiRNA target sequence
taatttcctccgtggatctgtaaaaat

SEQ ID NO: 116075 - DNA, 27 bp, Artificial sequence
  SiRNA target sequence
aatttcctccgtggatctgtaaaaatc

SEQ ID NO: 116076 - DNA, 27 bp, Artificial sequence
  SiRNA target sequence
atttcctccgtggatctgtaaaaatcg

SEQ ID NO: 116077 - DNA, 27 bp, Artificial sequence
  SiRNA target sequence
tttcctccgtggatctgtaaaaatcgt

SEQ ID NO: 116078 - DNA, 27 bp, Artificial sequence
  SiRNA target sequence
ttcctccgtggatctgtaaaaatcgtt

SEQ ID NO: 116079 - DNA, 27 bp, Artificial sequence
  SiRNA target sequence
tcctccgtggatctgtaaaaatcgtta

SEQ ID NO: 116080 - DNA, 27 bp, Artificial sequence
  SiRNA target sequence
cctccgtggatctgtaaaaatcgttaa

SEQ ID NO: 116081 - DNA, 27 bp, Artificial sequence
  SiRNA target sequence
ctccgtggatctgtaaaaatcgttaac

SEQ ID NO: 116082 - DNA, 27 bp, Artificial sequence
  SiRNA target sequence
tccgtggatctgtaaaaatcgttaaca

SEQ ID NO: 116083 - DNA, 27 bp, Artificial sequence
  SiRNA target sequence
ccgtggatctgtaaaaatcgttaacat

SEQ ID NO: 116084 - DNA, 27 bp, Artificial sequence
  SiRNA target sequence
cgtggatctgtaaaaatcgttaacatc

SEQ ID NO: 116085 - DNA, 27 bp, Artificial sequence
  SiRNA target sequence
gtggatctgtaaaaatcgttaacatct

SEQ ID NO: 116086 - DNA, 27 bp, Artificial sequence
  SiRNA target sequence
tggatctgtaaaaatcgttaacatcta

SEQ ID NO: 116087 - DNA, 27 bp, Artificial sequence
  SiRNA target sequence
ggatctgtaaaaatcgttaacatctaa

SEQ ID NO: 116088 - DNA, 27 bp, Artificial sequence
  SiRNA target sequence
gatctgtaaaaatcgttaacatctaaa

SEQ ID NO: 116089 - DNA, 27 bp, Artificial sequence
  SiRNA target sequence
atctgtaaaaatcgttaacatctaaac

SEQ ID NO: 116090 - DNA, 27 bp, Artificial sequence
  SiRNA target sequence
tctgtaaaaatcgttaacatctaaaca

SEQ ID NO: 116091 - DNA, 27 bp, Artificial sequence
  SiRNA target sequence
ctgtaaaaatcgttaacatctaaacag

SEQ ID NO: 116092 - DNA, 27 bp, Artificial sequence
  SiRNA target sequence
tgtaaaaatcgttaacatctaaacagg

SEQ ID NO: 116093 - DNA, 27 bp, Artificial sequence
  SiRNA target sequence
gtaaaaatcgttaacatctaaacagga

SEQ ID NO: 116094 - DNA, 27 bp, Artificial sequence
  SiRNA target sequence
taaaaatcgttaacatctaaacaggag

SEQ ID NO: 116095 - DNA, 27 bp, Artificial sequence
  SiRNA target sequence
aaaaatcgttaacatctaaacaggagt

SEQ ID NO: 116096 - DNA, 27 bp, Artificial sequence
  SiRNA target sequence
aaaatcgttaacatctaaacaggagtg

SEQ ID NO: 116097 - DNA, 27 bp, Artificial sequence
  SiRNA target sequence
aaatcgttaacatctaaacaggagtgc

SEQ ID NO: 116098 - DNA, 27 bp, Artificial sequence
  SiRNA target sequence
aatcgttaacatctaaacaggagtgcc

SEQ ID NO: 116099 - DNA, 27 bp, Artificial sequence
  SiRNA target sequence
atcgttaacatctaaacaggagtgccc

SEQ ID NO: 116100 - DNA, 27 bp, Artificial sequence
  SiRNA target sequence
tcgttaacatctaaacaggagtgccca

SEQ ID NO: 116101 - DNA, 27 bp, Artificial sequence
  SiRNA target sequence
cgttaacatctaaacaggagtgcccac

SEQ ID NO: 116102 - DNA, 27 bp, Artificial sequence
  SiRNA target sequence
gttaacatctaaacaggagtgcccaca

SEQ ID NO: 116103 - DNA, 27 bp, Artificial sequence
  SiRNA target sequence
ttaacatctaaacaggagtgcccacat

SEQ ID NO: 116104 - DNA, 27 bp, Artificial sequence
  SiRNA target sequence
taacatctaaacaggagtgcccacatg

SEQ ID NO: 116105 - DNA, 27 bp, Artificial sequence
  SiRNA target sequence
aacatctaaacaggagtgcccacatgt

SEQ ID NO: 116106 - DNA, 27 bp, Artificial sequence
  SiRNA target sequence
acatctaaacaggagtgcccacatgtc

SEQ ID NO: 116107 - DNA, 27 bp, Artificial sequence
  SiRNA target sequence
catctaaacaggagtgcccacatgtcc

SEQ ID NO: 116108 - DNA, 27 bp, Artificial sequence
  SiRNA target sequence
atctaaacaggagtgcccacatgtcct

SEQ ID NO: 116109 - DNA, 27 bp, Artificial sequence
  SiRNA target sequence
tctaaacaggagtgcccacatgtcctg

SEQ ID NO: 116110 - DNA, 27 bp, Artificial sequence
  SiRNA target sequence
ctaaacaggagtgcccacatgtcctgt

SEQ ID NO: 116111 - DNA, 27 bp, Artificial sequence
  SiRNA target sequence
taaacaggagtgcccacatgtcctgta

SEQ ID NO: 116112 - DNA, 27 bp, Artificial sequence
  SiRNA target sequence
aaacaggagtgcccacatgtcctgtac

SEQ ID NO: 116113 - DNA, 27 bp, Artificial sequence
  SiRNA target sequence
aacaggagtgcccacatgtcctgtacg

SEQ ID NO: 116114 - DNA, 27 bp, Artificial sequence
  SiRNA target sequence
acaggagtgcccacatgtcctgtacgt

SEQ ID NO: 116115 - DNA, 27 bp, Artificial sequence
  SiRNA target sequence
caggagtgcccacatgtcctgtacgta

SEQ ID NO: 116116 - DNA, 27 bp, Artificial sequence
  SiRNA target sequence
aggagtgcccacatgtcctgtacgtat

SEQ ID NO: 116117 - DNA, 27 bp, Artificial sequence
  SiRNA target sequence
ggagtgcccacatgtcctgtacgtatc

SEQ ID NO: 116118 - DNA, 27 bp, Artificial sequence
  SiRNA target sequence
gagtgcccacatgtcctgtacgtatca

SEQ ID NO: 116119 - DNA, 27 bp, Artificial sequence
  SiRNA target sequence
agtgcccacatgtcctgtacgtatcaa

SEQ ID NO: 116120 - DNA, 27 bp, Artificial sequence
  SiRNA target sequence
gtgcccacatgtcctgtacgtatcaat

SEQ ID NO: 116121 - DNA, 27 bp, Artificial sequence
  SiRNA target sequence
tgcccacatgtcctgtacgtatcaatt

SEQ ID NO: 116122 - DNA, 27 bp, Artificial sequence
  SiRNA target sequence
gcccacatgtcctgtacgtatcaattt

SEQ ID NO: 116123 - DNA, 27 bp, Artificial sequence
  SiRNA target sequence
cccacatgtcctgtacgtatcaatttg

SEQ ID NO: 116124 - DNA, 27 bp, Artificial sequence
  SiRNA target sequence
ccacatgtcctgtacgtatcaatttgc

SEQ ID NO: 116125 - DNA, 27 bp, Artificial sequence
  SiRNA target sequence
cacatgtcctgtacgtatcaatttgca

SEQ ID NO: 116126 - DNA, 27 bp, Artificial sequence
  SiRNA target sequence
acatgtcctgtacgtatcaatttgcaa

SEQ ID NO: 116127 - DNA, 27 bp, Artificial sequence
  SiRNA target sequence
catgtcctgtacgtatcaatttgcaag

SEQ ID NO: 116128 - DNA, 27 bp, Artificial sequence
  SiRNA target sequence
atgtcctgtacgtatcaatttgcaaga

SEQ ID NO: 116129 - DNA, 27 bp, Artificial sequence
  SiRNA target sequence
tgtcctgtacgtatcaatttgcaagat

SEQ ID NO: 116130 - DNA, 27 bp, Artificial sequence
  SiRNA target sequence
gtcctgtacgtatcaatttgcaagatg

SEQ ID NO: 116131 - DNA, 27 bp, Artificial sequence
  SiRNA target sequence
tcctgtacgtatcaatttgcaagatga

SEQ ID NO: 116132 - DNA, 27 bp, Artificial sequence
  SiRNA target sequence
cctgtacgtatcaatttgcaagatgat

SEQ ID NO: 116133 - DNA, 27 bp, Artificial sequence
  SiRNA target sequence
ctgtacgtatcaatttgcaagatgata

SEQ ID NO: 116134 - DNA, 27 bp, Artificial sequence
  SiRNA target sequence
tgtacgtatcaatttgcaagatgatag

SEQ ID NO: 116135 - DNA, 27 bp, Artificial sequence
  SiRNA target sequence
gtacgtatcaatttgcaagatgatagg

SEQ ID NO: 116136 - DNA, 27 bp, Artificial sequence
  SiRNA target sequence
tacgtatcaatttgcaagatgataggt

SEQ ID NO: 116137 - DNA, 27 bp, Artificial sequence
  SiRNA target sequence
acgtatcaatttgcaagatgataggtc

SEQ ID NO: 116138 - DNA, 27 bp, Artificial sequence
  SiRNA target sequence
cgtatcaatttgcaagatgataggtcc

SEQ ID NO: 116139 - DNA, 27 bp, Artificial sequence
  SiRNA target sequence
gtatcaatttgcaagatgataggtcct

SEQ ID NO: 116140 - DNA, 27 bp, Artificial sequence
  SiRNA target sequence
tatcaatttgcaagatgataggtcctt

SEQ ID NO: 116141 - DNA, 27 bp, Artificial sequence
  SiRNA target sequence
atcaatttgcaagatgataggtccttt

SEQ ID NO: 116142 - DNA, 27 bp, Artificial sequence
  SiRNA target sequence
tcaatttgcaagatgataggtcctttt

SEQ ID NO: 116143 - DNA, 27 bp, Artificial sequence
  SiRNA target sequence
caatttgcaagatgataggtccttttt

SEQ ID NO: 116144 - DNA, 27 bp, Artificial sequence
  SiRNA target sequence
aatttgcaagatgataggtcctttttc

SEQ ID NO: 116145 - DNA, 27 bp, Artificial sequence
  SiRNA target sequence
atttgcaagatgataggtcctttttct

SEQ ID NO: 116146 - DNA, 27 bp, Artificial sequence
  SiRNA target sequence
tttgcaagatgataggtcctttttcta

SEQ ID NO: 116147 - DNA, 27 bp, Artificial sequence
  SiRNA target sequence
ttgcaagatgataggtcctttttctat

SEQ ID NO: 116148 - DNA, 27 bp, Artificial sequence
  SiRNA target sequence
tgcaagatgataggtcctttttctatt

SEQ ID NO: 116149 - DNA, 27 bp, Artificial sequence
  SiRNA target sequence
gcaagatgataggtcctttttctattg

SEQ ID NO: 116150 - DNA, 27 bp, Artificial sequence
  SiRNA target sequence
caagatgataggtcctttttctattgc

SEQ ID NO: 116151 - DNA, 27 bp, Artificial sequence
  SiRNA target sequence
aagatgataggtcctttttctattgca

SEQ ID NO: 116152 - DNA, 27 bp, Artificial sequence
  SiRNA target sequence
agatgataggtcctttttctattgcat

SEQ ID NO: 116153 - DNA, 27 bp, Artificial sequence
  SiRNA target sequence
gatgataggtcctttttctattgcatg

SEQ ID NO: 116154 - DNA, 27 bp, Artificial sequence
  SiRNA target sequence
atgataggtcctttttctattgcatgt

SEQ ID NO: 116155 - DNA, 27 bp, Artificial sequence
  SiRNA target sequence
tgataggtcctttttctattgcatgtt

SEQ ID NO: 116156 - DNA, 27 bp, Artificial sequence
  SiRNA target sequence
gataggtcctttttctattgcatgttg

SEQ ID NO: 116157 - DNA, 27 bp, Artificial sequence
  SiRNA target sequence
ataggtcctttttctattgcatgttgt

SEQ ID NO: 116158 - DNA, 27 bp, Artificial sequence
  SiRNA target sequence
taggtcctttttctattgcatgttgtc

SEQ ID NO: 116159 - DNA, 27 bp, Artificial sequence
  SiRNA target sequence
aggtcctttttctattgcatgttgtct

SEQ ID NO: 116160 - DNA, 27 bp, Artificial sequence
  SiRNA target sequence
ggtcctttttctattgcatgttgtcta

SEQ ID NO: 116161 - DNA, 27 bp, Artificial sequence
  SiRNA target sequence
gtcctttttctattgcatgttgtctag

SEQ ID NO: 116162 - DNA, 27 bp, Artificial sequence
  SiRNA target sequence
tcctttttctattgcatgttgtctagc

SEQ ID NO: 116163 - DNA, 27 bp, Artificial sequence
  SiRNA target sequence
cctttttctattgcatgttgtctagca

SEQ ID NO: 116164 - DNA, 27 bp, Artificial sequence
  SiRNA target sequence
ctttttctattgcatgttgtctagcaa

SEQ ID NO: 116165 - DNA, 27 bp, Artificial sequence
  SiRNA target sequence
tttttctattgcatgttgtctagcaaa

SEQ ID NO: 116166 - DNA, 27 bp, Artificial sequence
  SiRNA target sequence
ttttctattgcatgttgtctagcaaat

SEQ ID NO: 116167 - DNA, 27 bp, Artificial sequence
  SiRNA target sequence
tttctattgcatgttgtctagcaaatg

SEQ ID NO: 116168 - DNA, 27 bp, Artificial sequence
  SiRNA target sequence
ttctattgcatgttgtctagcaaatgt

SEQ ID NO: 116169 - DNA, 27 bp, Artificial sequence
  SiRNA target sequence
tctattgcatgttgtctagcaaatgta

SEQ ID NO: 116170 - DNA, 27 bp, Artificial sequence
  SiRNA target sequence
ctattgcatgttgtctagcaaatgtaa

SEQ ID NO: 116171 - DNA, 27 bp, Artificial sequence
  SiRNA target sequence
tattgcatgttgtctagcaaatgtaaa

SEQ ID NO: 116172 - DNA, 27 bp, Artificial sequence
  SiRNA target sequence
attgcatgttgtctagcaaatgtaaat

SEQ ID NO: 116173 - DNA, 27 bp, Artificial sequence
  SiRNA target sequence
ttgcatgttgtctagcaaatgtaaata

SEQ ID NO: 116174 - DNA, 27 bp, Artificial sequence
  SiRNA target sequence
tgcatgttgtctagcaaatgtaaatac

SEQ ID NO: 116175 - DNA, 27 bp, Artificial sequence
  SiRNA target sequence
gcatgttgtctagcaaatgtaaataca

SEQ ID NO: 116176 - DNA, 27 bp, Artificial sequence
  SiRNA target sequence
catgttgtctagcaaatgtaaatacat

SEQ ID NO: 116177 - DNA, 27 bp, Artificial sequence
  SiRNA target sequence
atgttgtctagcaaatgtaaatacatc

SEQ ID NO: 116178 - DNA, 27 bp, Artificial sequence
  SiRNA target sequence
tgttgtctagcaaatgtaaatacatca

SEQ ID NO: 116179 - DNA, 27 bp, Artificial sequence
  SiRNA target sequence
gttgtctagcaaatgtaaatacatcaa

SEQ ID NO: 116180 - DNA, 27 bp, Artificial sequence
  SiRNA target sequence
ttgtctagcaaatgtaaatacatcaat

SEQ ID NO: 116181 - DNA, 27 bp, Artificial sequence
  SiRNA target sequence
tgtctagcaaatgtaaatacatcaatc

SEQ ID NO: 116182 - DNA, 27 bp, Artificial sequence
  SiRNA target sequence
gtctagcaaatgtaaatacatcaatca

SEQ ID NO: 116183 - DNA, 27 bp, Artificial sequence
  SiRNA target sequence
tctagcaaatgtaaatacatcaatcag

SEQ ID NO: 116184 - DNA, 27 bp, Artificial sequence
  SiRNA target sequence
ctagcaaatgtaaatacatcaatcagt

SEQ ID NO: 116185 - DNA, 27 bp, Artificial sequence
  SiRNA target sequence
tagcaaatgtaaatacatcaatcagtt

SEQ ID NO: 116186 - DNA, 27 bp, Artificial sequence
  SiRNA target sequence
agcaaatgtaaatacatcaatcagttg

SEQ ID NO: 116187 - DNA, 27 bp, Artificial sequence
  SiRNA target sequence
gcaaatgtaaatacatcaatcagttga

SEQ ID NO: 116188 - DNA, 27 bp, Artificial sequence
  SiRNA target sequence
caaatgtaaatacatcaatcagttgag

SEQ ID NO: 116189 - DNA, 27 bp, Artificial sequence
  SiRNA target sequence
aaatgtaaatacatcaatcagttgagt

SEQ ID NO: 116190 - DNA, 27 bp, Artificial sequence
  SiRNA target sequence
aatgtaaatacatcaatcagttgagtt

SEQ ID NO: 116191 - DNA, 27 bp, Artificial sequence
  SiRNA target sequence
atgtaaatacatcaatcagttgagtta

SEQ ID NO: 116192 - DNA, 27 bp, Artificial sequence
  SiRNA target sequence
tgtaaatacatcaatcagttgagttat

SEQ ID NO: 116193 - DNA, 27 bp, Artificial sequence
  SiRNA target sequence
gtaaatacatcaatcagttgagttatg

SEQ ID NO: 116194 - DNA, 27 bp, Artificial sequence
  SiRNA target sequence
taaatacatcaatcagttgagttatgt

SEQ ID NO: 116195 - DNA, 27 bp, Artificial sequence
  SiRNA target sequence
aaatacatcaatcagttgagttatgtt

SEQ ID NO: 116196 - DNA, 27 bp, Artificial sequence
  SiRNA target sequence
aatacatcaatcagttgagttatgttt

SEQ ID NO: 116197 - DNA, 27 bp, Artificial sequence
  SiRNA target sequence
atacatcaatcagttgagttatgtttt

SEQ ID NO: 116198 - DNA, 27 bp, Artificial sequence
  SiRNA target sequence
tacatcaatcagttgagttatgttttt

SEQ ID NO: 116199 - DNA, 27 bp, Artificial sequence
  SiRNA target sequence
acatcaatcagttgagttatgttttta

SEQ ID NO: 116200 - DNA, 27 bp, Artificial sequence
  SiRNA target sequence
catcaatcagttgagttatgtttttat

SEQ ID NO: 116201 - DNA, 27 bp, Artificial sequence
  SiRNA target sequence
atcaatcagttgagttatgtttttatc

SEQ ID NO: 116202 - DNA, 27 bp, Artificial sequence
  SiRNA target sequence
tcaatcagttgagttatgtttttatct

SEQ ID NO: 116203 - DNA, 27 bp, Artificial sequence
  SiRNA target sequence
caatcagttgagttatgtttttatctg

SEQ ID NO: 116204 - DNA, 27 bp, Artificial sequence
  SiRNA target sequence
aatcagttgagttatgtttttatctgt

SEQ ID NO: 116205 - DNA, 27 bp, Artificial sequence
  SiRNA target sequence
atcagttgagttatgtttttatctgta

SEQ ID NO: 116206 - DNA, 27 bp, Artificial sequence
  SiRNA target sequence
tcagttgagttatgtttttatctgtaa

SEQ ID NO: 116207 - DNA, 27 bp, Artificial sequence
  SiRNA target sequence
cagttgagttatgtttttatctgtaag

SEQ ID NO: 116208 - DNA, 27 bp, Artificial sequence
  SiRNA target sequence
agttgagttatgtttttatctgtaaga

SEQ ID NO: 116209 - DNA, 27 bp, Artificial sequence
  SiRNA target sequence
gttgagttatgtttttatctgtaagac

SEQ ID NO: 116210 - DNA, 27 bp, Artificial sequence
  SiRNA target sequence
ttgagttatgtttttatctgtaagacg

SEQ ID NO: 116211 - DNA, 27 bp, Artificial sequence
  SiRNA target sequence
tgagttatgtttttatctgtaagacgt

SEQ ID NO: 116212 - DNA, 27 bp, Artificial sequence
  SiRNA target sequence
gagttatgtttttatctgtaagacgta

SEQ ID NO: 116213 - DNA, 27 bp, Artificial sequence
  SiRNA target sequence
agttatgtttttatctgtaagacgtat

SEQ ID NO: 116214 - DNA, 27 bp, Artificial sequence
  SiRNA target sequence
gttatgtttttatctgtaagacgtata

SEQ ID NO: 116215 - DNA, 27 bp, Artificial sequence
  SiRNA target sequence
ttatgtttttatctgtaagacgtatac

SEQ ID NO: 116216 - DNA, 27 bp, Artificial sequence
  SiRNA target sequence
tatgtttttatctgtaagacgtatacc

SEQ ID NO: 116217 - DNA, 27 bp, Artificial sequence
  SiRNA target sequence
atgtttttatctgtaagacgtatacct

SEQ ID NO: 116218 - DNA, 27 bp, Artificial sequence
  SiRNA target sequence
tgtttttatctgtaagacgtatacctg

SEQ ID NO: 116219 - DNA, 27 bp, Artificial sequence
  SiRNA target sequence
gtttttatctgtaagacgtatacctgg

SEQ ID NO: 116220 - DNA, 27 bp, Artificial sequence
  SiRNA target sequence
tttttatctgtaagacgtatacctgga

SEQ ID NO: 116221 - DNA, 27 bp, Artificial sequence
  SiRNA target sequence
ttttatctgtaagacgtatacctggaa

SEQ ID NO: 116222 - DNA, 27 bp, Artificial sequence
  SiRNA target sequence
tttatctgtaagacgtatacctggaat

SEQ ID NO: 116223 - DNA, 27 bp, Artificial sequence
  SiRNA target sequence
ttatctgtaagacgtatacctggaata

SEQ ID NO: 116224 - DNA, 27 bp, Artificial sequence
  SiRNA target sequence
tatctgtaagacgtatacctggaatat

SEQ ID NO: 116225 - DNA, 27 bp, Artificial sequence
  SiRNA target sequence
atctgtaagacgtatacctggaatatt

SEQ ID NO: 116226 - DNA, 27 bp, Artificial sequence
  SiRNA target sequence
tctgtaagacgtatacctggaatatta

SEQ ID NO: 116227 - DNA, 27 bp, Artificial sequence
  SiRNA target sequence
ctgtaagacgtatacctggaatattat

SEQ ID NO: 116228 - DNA, 27 bp, Artificial sequence
  SiRNA target sequence
tgtaagacgtatacctggaatattata

SEQ ID NO: 116229 - DNA, 27 bp, Artificial sequence
  SiRNA target sequence
gtaagacgtatacctggaatattatat

SEQ ID NO: 116230 - DNA, 27 bp, Artificial sequence
  SiRNA target sequence
taagacgtatacctggaatattatatc

SEQ ID NO: 116231 - DNA, 27 bp, Artificial sequence
  SiRNA target sequence
aagacgtatacctggaatattatatcc

SEQ ID NO: 116232 - DNA, 27 bp, Artificial sequence
  SiRNA target sequence
agacgtatacctggaatattatatccc

SEQ ID NO: 116233 - DNA, 27 bp, Artificial sequence
  SiRNA target sequence
gacgtatacctggaatattatatcccc

SEQ ID NO: 116234 - DNA, 27 bp, Artificial sequence
  SiRNA target sequence
acgtatacctggaatattatatcccct

SEQ ID NO: 116235 - DNA, 27 bp, Artificial sequence
  SiRNA target sequence
cgtatacctggaatattatatcccctt

SEQ ID NO: 116236 - DNA, 27 bp, Artificial sequence
  SiRNA target sequence
gtatacctggaatattatatccccttt

SEQ ID NO: 116237 - DNA, 27 bp, Artificial sequence
  SiRNA target sequence
tatacctggaatattatatcccctttt

SEQ ID NO: 116238 - DNA, 27 bp, Artificial sequence
  SiRNA target sequence
atacctggaatattatatcccctttta

SEQ ID NO: 116239 - DNA, 27 bp, Artificial sequence
  SiRNA target sequence
tacctggaatattatatccccttttaa

SEQ ID NO: 116240 - DNA, 27 bp, Artificial sequence
  SiRNA target sequence
acctggaatattatatccccttttaaa

SEQ ID NO: 116241 - DNA, 27 bp, Artificial sequence
  SiRNA target sequence
cctggaatattatatccccttttaaaa

SEQ ID NO: 116242 - DNA, 27 bp, Artificial sequence
  SiRNA target sequence
ctggaatattatatccccttttaaaat

SEQ ID NO: 116243 - DNA, 27 bp, Artificial sequence
  SiRNA target sequence
tggaatattatatccccttttaaaata

SEQ ID NO: 116244 - DNA, 27 bp, Artificial sequence
  SiRNA target sequence
ggaatattatatccccttttaaaatat

SEQ ID NO: 116245 - DNA, 27 bp, Artificial sequence
  SiRNA target sequence
gaatattatatccccttttaaaatatt

SEQ ID NO: 116246 - DNA, 27 bp, Artificial sequence
  SiRNA target sequence
aatattatatccccttttaaaatattc

SEQ ID NO: 116247 - DNA, 27 bp, Artificial sequence
  SiRNA target sequence
atattatatccccttttaaaatattca

SEQ ID NO: 116248 - DNA, 27 bp, Artificial sequence
  SiRNA target sequence
tattatatccccttttaaaatattcag

SEQ ID NO: 116249 - DNA, 27 bp, Artificial sequence
  SiRNA target sequence
attatatccccttttaaaatattcagg

SEQ ID NO: 116250 - DNA, 27 bp, Artificial sequence
  SiRNA target sequence
ttatatccccttttaaaatattcagga

SEQ ID NO: 116251 - DNA, 27 bp, Artificial sequence
  SiRNA target sequence
tatatccccttttaaaatattcaggat

SEQ ID NO: 116252 - DNA, 27 bp, Artificial sequence
  SiRNA target sequence
atatccccttttaaaatattcaggata

SEQ ID NO: 116253 - DNA, 27 bp, Artificial sequence
  SiRNA target sequence
tatccccttttaaaatattcaggatat

SEQ ID NO: 116254 - DNA, 27 bp, Artificial sequence
  SiRNA target sequence
atccccttttaaaatattcaggatatg

SEQ ID NO: 116255 - DNA, 27 bp, Artificial sequence
  SiRNA target sequence
tccccttttaaaatattcaggatatgt

SEQ ID NO: 116256 - DNA, 27 bp, Artificial sequence
  SiRNA target sequence
ccccttttaaaatattcaggatatgta

SEQ ID NO: 116257 - DNA, 27 bp, Artificial sequence
  SiRNA target sequence
cccttttaaaatattcaggatatgtag

SEQ ID NO: 116258 - DNA, 27 bp, Artificial sequence
  SiRNA target sequence
ccttttaaaatattcaggatatgtagt

SEQ ID NO: 116259 - DNA, 27 bp, Artificial sequence
  SiRNA target sequence
cttttaaaatattcaggatatgtagtg

SEQ ID NO: 116260 - DNA, 27 bp, Artificial sequence
  SiRNA target sequence
ttttaaaatattcaggatatgtagtgg

SEQ ID NO: 116261 - DNA, 27 bp, Artificial sequence
  SiRNA target sequence
tttaaaatattcaggatatgtagtgga

SEQ ID NO: 116262 - DNA, 27 bp, Artificial sequence
  SiRNA target sequence
ttaaaatattcaggatatgtagtggaa

SEQ ID NO: 116263 - DNA, 27 bp, Artificial sequence
  SiRNA target sequence
taaaatattcaggatatgtagtggaat

SEQ ID NO: 116264 - DNA, 27 bp, Artificial sequence
  SiRNA target sequence
aaaatattcaggatatgtagtggaatt

SEQ ID NO: 116265 - DNA, 27 bp, Artificial sequence
  SiRNA target sequence
aaatattcaggatatgtagtggaatta

SEQ ID NO: 116266 - DNA, 27 bp, Artificial sequence
  SiRNA target sequence
aatattcaggatatgtagtggaattac

SEQ ID NO: 116267 - DNA, 27 bp, Artificial sequence
  SiRNA target sequence
atattcaggatatgtagtggaattact

SEQ ID NO: 116268 - DNA, 27 bp, Artificial sequence
  SiRNA target sequence
tattcaggatatgtagtggaattactt

SEQ ID NO: 116269 - DNA, 27 bp, Artificial sequence
  SiRNA target sequence
attcaggatatgtagtggaattacttt

SEQ ID NO: 116270 - DNA, 27 bp, Artificial sequence
  SiRNA target sequence
ttcaggatatgtagtggaattactttc

SEQ ID NO: 116271 - DNA, 27 bp, Artificial sequence
  SiRNA target sequence
tcaggatatgtagtggaattactttca

SEQ ID NO: 116272 - DNA, 27 bp, Artificial sequence
  SiRNA target sequence
caggatatgtagtggaattactttcag

SEQ ID NO: 116273 - DNA, 27 bp, Artificial sequence
  SiRNA target sequence
aggatatgtagtggaattactttcagg

SEQ ID NO: 116274 - DNA, 27 bp, Artificial sequence
  SiRNA target sequence
ggatatgtagtggaattactttcaggt

SEQ ID NO: 116275 - DNA, 27 bp, Artificial sequence
  SiRNA target sequence
gatatgtagtggaattactttcaggtg

SEQ ID NO: 116276 - DNA, 27 bp, Artificial sequence
  SiRNA target sequence
atatgtagtggaattactttcaggtgt

SEQ ID NO: 116277 - DNA, 27 bp, Artificial sequence
  SiRNA target sequence
tatgtagtggaattactttcaggtgtc

SEQ ID NO: 116278 - DNA, 27 bp, Artificial sequence
  SiRNA target sequence
atgtagtggaattactttcaggtgtcc

SEQ ID NO: 116279 - DNA, 27 bp, Artificial sequence
  SiRNA target sequence
tgtagtggaattactttcaggtgtcca

SEQ ID NO: 116280 - DNA, 27 bp, Artificial sequence
  SiRNA target sequence
gtagtggaattactttcaggtgtccac

SEQ ID NO: 116281 - DNA, 27 bp, Artificial sequence
  SiRNA target sequence
tagtggaattactttcaggtgtccaca

SEQ ID NO: 116282 - DNA, 27 bp, Artificial sequence
  SiRNA target sequence
agtggaattactttcaggtgtccacat

SEQ ID NO: 116283 - DNA, 27 bp, Artificial sequence
  SiRNA target sequence
gtggaattactttcaggtgtccacata

SEQ ID NO: 116284 - DNA, 27 bp, Artificial sequence
  SiRNA target sequence
tggaattactttcaggtgtccacatac

SEQ ID NO: 116285 - DNA, 27 bp, Artificial sequence
  SiRNA target sequence
ggaattactttcaggtgtccacatact

SEQ ID NO: 116286 - DNA, 27 bp, Artificial sequence
  SiRNA target sequence
gaattactttcaggtgtccacatacta

SEQ ID NO: 116287 - DNA, 27 bp, Artificial sequence
  SiRNA target sequence
aattactttcaggtgtccacatactat

SEQ ID NO: 116288 - DNA, 27 bp, Artificial sequence
  SiRNA target sequence
attactttcaggtgtccacatactata

SEQ ID NO: 116289 - DNA, 27 bp, Artificial sequence
  SiRNA target sequence
ttactttcaggtgtccacatactataa

SEQ ID NO: 116290 - DNA, 27 bp, Artificial sequence
  SiRNA target sequence
tactttcaggtgtccacatactataat

SEQ ID NO: 116291 - DNA, 27 bp, Artificial sequence
  SiRNA target sequence
actttcaggtgtccacatactataatg

SEQ ID NO: 116292 - DNA, 27 bp, Artificial sequence
  SiRNA target sequence
ctttcaggtgtccacatactataatga

SEQ ID NO: 116293 - DNA, 27 bp, Artificial sequence
  SiRNA target sequence
tttcaggtgtccacatactataatgat

SEQ ID NO: 116294 - DNA, 27 bp, Artificial sequence
  SiRNA target sequence
ttcaggtgtccacatactataatgatt

SEQ ID NO: 116295 - DNA, 27 bp, Artificial sequence
  SiRNA target sequence
tcaggtgtccacatactataatgatta

SEQ ID NO: 116296 - DNA, 27 bp, Artificial sequence
  SiRNA target sequence
caggtgtccacatactataatgattat

SEQ ID NO: 116297 - DNA, 27 bp, Artificial sequence
  SiRNA target sequence
aggtgtccacatactataatgattatt

SEQ ID NO: 116298 - DNA, 27 bp, Artificial sequence
  SiRNA target sequence
ggtgtccacatactataatgattattt

SEQ ID NO: 116299 - DNA, 27 bp, Artificial sequence
  SiRNA target sequence
gtgtccacatactataatgattatttt

SEQ ID NO: 116300 - DNA, 27 bp, Artificial sequence
  SiRNA target sequence
tgtccacatactataatgattattttc

SEQ ID NO: 116301 - DNA, 27 bp, Artificial sequence
  SiRNA target sequence
gtccacatactataatgattattttca

SEQ ID NO: 116302 - DNA, 27 bp, Artificial sequence
  SiRNA target sequence
tccacatactataatgattattttcac

SEQ ID NO: 116303 - DNA, 27 bp, Artificial sequence
  SiRNA target sequence
ccacatactataatgattattttcaca

SEQ ID NO: 116304 - DNA, 27 bp, Artificial sequence
  SiRNA target sequence
cacatactataatgattattttcacat

SEQ ID NO: 116305 - DNA, 27 bp, Artificial sequence
  SiRNA target sequence
acatactataatgattattttcacata

SEQ ID NO: 116306 - DNA, 27 bp, Artificial sequence
  SiRNA target sequence
catactataatgattattttcacatac

SEQ ID NO: 116307 - DNA, 27 bp, Artificial sequence
  SiRNA target sequence
atactataatgattattttcacataca

SEQ ID NO: 116308 - DNA, 27 bp, Artificial sequence
  SiRNA target sequence
tactataatgattattttcacatacat

SEQ ID NO: 116309 - DNA, 27 bp, Artificial sequence
  SiRNA target sequence
actataatgattattttcacatacata

SEQ ID NO: 116310 - DNA, 27 bp, Artificial sequence
  SiRNA target sequence
ctataatgattattttcacatacataa

SEQ ID NO: 116311 - DNA, 27 bp, Artificial sequence
  SiRNA target sequence
tataatgattattttcacatacataaa

SEQ ID NO: 116312 - DNA, 27 bp, Artificial sequence
  SiRNA target sequence
ataatgattattttcacatacataaac

SEQ ID NO: 116313 - DNA, 27 bp, Artificial sequence
  SiRNA target sequence
taatgattattttcacatacataaacc

SEQ ID NO: 116314 - DNA, 27 bp, Artificial sequence
  SiRNA target sequence
aatgattattttcacatacataaacca

SEQ ID NO: 116315 - DNA, 27 bp, Artificial sequence
  SiRNA target sequence
atgattattttcacatacataaaccac

SEQ ID NO: 116316 - DNA, 27 bp, Artificial sequence
  SiRNA target sequence
tgattattttcacatacataaaccaca

SEQ ID NO: 116317 - DNA, 27 bp, Artificial sequence
  SiRNA target sequence
gattattttcacatacataaaccacag

SEQ ID NO: 116318 - DNA, 27 bp, Artificial sequence
  SiRNA target sequence
attattttcacatacataaaccacagg

SEQ ID NO: 116319 - DNA, 27 bp, Artificial sequence
  SiRNA target sequence
ttattttcacatacataaaccacagga

SEQ ID NO: 116320 - DNA, 27 bp, Artificial sequence
  SiRNA target sequence
tattttcacatacataaaccacaggaa

SEQ ID NO: 116321 - DNA, 27 bp, Artificial sequence
  SiRNA target sequence
attttcacatacataaaccacaggaag

SEQ ID NO: 116322 - DNA, 27 bp, Artificial sequence
  SiRNA target sequence
ttttcacatacataaaccacaggaagt

SEQ ID NO: 116323 - DNA, 27 bp, Artificial sequence
  SiRNA target sequence
tttcacatacataaaccacaggaagtt

SEQ ID NO: 116324 - DNA, 27 bp, Artificial sequence
  SiRNA target sequence
ttcacatacataaaccacaggaagttt

SEQ ID NO: 116325 - DNA, 27 bp, Artificial sequence
  SiRNA target sequence
tcacatacataaaccacaggaagtttc

SEQ ID NO: 116326 - DNA, 27 bp, Artificial sequence
  SiRNA target sequence
cacatacataaaccacaggaagtttcc

SEQ ID NO: 116327 - DNA, 27 bp, Artificial sequence
  SiRNA target sequence
acatacataaaccacaggaagtttcca

SEQ ID NO: 116328 - DNA, 27 bp, Artificial sequence
  SiRNA target sequence
catacataaaccacaggaagtttccat

SEQ ID NO: 116329 - DNA, 27 bp, Artificial sequence
  SiRNA target sequence
atacataaaccacaggaagtttccata

SEQ ID NO: 116330 - DNA, 27 bp, Artificial sequence
  SiRNA target sequence
tacataaaccacaggaagtttccataa

SEQ ID NO: 116331 - DNA, 27 bp, Artificial sequence
  SiRNA target sequence
acataaaccacaggaagtttccataat

SEQ ID NO: 116332 - DNA, 27 bp, Artificial sequence
  SiRNA target sequence
cataaaccacaggaagtttccataatg

SEQ ID NO: 116333 - DNA, 27 bp, Artificial sequence
  SiRNA target sequence
ataaaccacaggaagtttccataatgc

SEQ ID NO: 116334 - DNA, 27 bp, Artificial sequence
  SiRNA target sequence
taaaccacaggaagtttccataatgca

SEQ ID NO: 116335 - DNA, 27 bp, Artificial sequence
  SiRNA target sequence
aaaccacaggaagtttccataatgcag

SEQ ID NO: 116336 - DNA, 27 bp, Artificial sequence
  SiRNA target sequence
aaccacaggaagtttccataatgcagc

SEQ ID NO: 116337 - DNA, 27 bp, Artificial sequence
  SiRNA target sequence
accacaggaagtttccataatgcagcc

SEQ ID NO: 116338 - DNA, 27 bp, Artificial sequence
  SiRNA target sequence
ccacaggaagtttccataatgcagcca

SEQ ID NO: 116339 - DNA, 27 bp, Artificial sequence
  SiRNA target sequence
cacaggaagtttccataatgcagccat

SEQ ID NO: 116340 - DNA, 27 bp, Artificial sequence
  SiRNA target sequence
acaggaagtttccataatgcagccata

SEQ ID NO: 116341 - DNA, 27 bp, Artificial sequence
  SiRNA target sequence
caggaagtttccataatgcagccatat

SEQ ID NO: 116342 - DNA, 27 bp, Artificial sequence
  SiRNA target sequence
aggaagtttccataatgcagccatatt

SEQ ID NO: 116343 - DNA, 27 bp, Artificial sequence
  SiRNA target sequence
ggaagtttccataatgcagccatattg

SEQ ID NO: 116344 - DNA, 27 bp, Artificial sequence
  SiRNA target sequence
gaagtttccataatgcagccatattga

SEQ ID NO: 116345 - DNA, 27 bp, Artificial sequence
  SiRNA target sequence
aagtttccataatgcagccatattgaa

SEQ ID NO: 116346 - DNA, 27 bp, Artificial sequence
  SiRNA target sequence
agtttccataatgcagccatattgaac

SEQ ID NO: 116347 - DNA, 27 bp, Artificial sequence
  SiRNA target sequence
gtttccataatgcagccatattgaacg

SEQ ID NO: 116348 - DNA, 27 bp, Artificial sequence
  SiRNA target sequence
tttccataatgcagccatattgaacga

SEQ ID NO: 116349 - DNA, 27 bp, Artificial sequence
  SiRNA target sequence
ttccataatgcagccatattgaacgac

SEQ ID NO: 116350 - DNA, 27 bp, Artificial sequence
  SiRNA target sequence
tccataatgcagccatattgaacgact

SEQ ID NO: 116351 - DNA, 27 bp, Artificial sequence
  SiRNA target sequence
ccataatgcagccatattgaacgactc

SEQ ID NO: 116352 - DNA, 27 bp, Artificial sequence
  SiRNA target sequence
cataatgcagccatattgaacgactcc

SEQ ID NO: 116353 - DNA, 27 bp, Artificial sequence
  SiRNA target sequence
ataatgcagccatattgaacgactccc

SEQ ID NO: 116354 - DNA, 27 bp, Artificial sequence
  SiRNA target sequence
taatgcagccatattgaacgactccca

SEQ ID NO: 116355 - DNA, 27 bp, Artificial sequence
  SiRNA target sequence
aatgcagccatattgaacgactcccag

SEQ ID NO: 116356 - DNA, 27 bp, Artificial sequence
  SiRNA target sequence
atgcagccatattgaacgactcccaga

SEQ ID NO: 116357 - DNA, 27 bp, Artificial sequence
  SiRNA target sequence
tgcagccatattgaacgactcccagac

SEQ ID NO: 116358 - DNA, 27 bp, Artificial sequence
  SiRNA target sequence
gcagccatattgaacgactcccagacc

SEQ ID NO: 116359 - DNA, 27 bp, Artificial sequence
  SiRNA target sequence
cagccatattgaacgactcccagacct

SEQ ID NO: 116360 - DNA, 27 bp, Artificial sequence
  SiRNA target sequence
agccatattgaacgactcccagacctg

SEQ ID NO: 116361 - DNA, 27 bp, Artificial sequence
  SiRNA target sequence
gccatattgaacgactcccagacctgt

SEQ ID NO: 116362 - DNA, 27 bp, Artificial sequence
  SiRNA target sequence
ccatattgaacgactcccagacctgtc

SEQ ID NO: 116363 - DNA, 27 bp, Artificial sequence
  SiRNA target sequence
catattgaacgactcccagacctgtcc

SEQ ID NO: 116364 - DNA, 27 bp, Artificial sequence
  SiRNA target sequence
atattgaacgactcccagacctgtccc

SEQ ID NO: 116365 - DNA, 27 bp, Artificial sequence
  SiRNA target sequence
tattgaacgactcccagacctgtccct

SEQ ID NO: 116366 - DNA, 27 bp, Artificial sequence
  SiRNA target sequence
attgaacgactcccagacctgtccctg

SEQ ID NO: 116367 - DNA, 27 bp, Artificial sequence
  SiRNA target sequence
ttgaacgactcccagacctgtccctga

SEQ ID NO: 116368 - DNA, 27 bp, Artificial sequence
  SiRNA target sequence
tgaacgactcccagacctgtccctgat

SEQ ID NO: 116369 - DNA, 27 bp, Artificial sequence
  SiRNA target sequence
gaacgactcccagacctgtccctgatt

SEQ ID NO: 116370 - DNA, 27 bp, Artificial sequence
  SiRNA target sequence
aacgactcccagacctgtccctgattt

SEQ ID NO: 116371 - DNA, 27 bp, Artificial sequence
  SiRNA target sequence
acgactcccagacctgtccctgatttg

SEQ ID NO: 116372 - DNA, 27 bp, Artificial sequence
  SiRNA target sequence
cgactcccagacctgtccctgatttgc

SEQ ID NO: 116373 - DNA, 27 bp, Artificial sequence
  SiRNA target sequence
gactcccagacctgtccctgatttgca

SEQ ID NO: 116374 - DNA, 27 bp, Artificial sequence
  SiRNA target sequence
actcccagacctgtccctgatttgcag

SEQ ID NO: 116375 - DNA, 27 bp, Artificial sequence
  SiRNA target sequence
ctcccagacctgtccctgatttgcagc

SEQ ID NO: 116376 - DNA, 27 bp, Artificial sequence
  SiRNA target sequence
tcccagacctgtccctgatttgcagca

SEQ ID NO: 116377 - DNA, 27 bp, Artificial sequence
  SiRNA target sequence
cccagacctgtccctgatttgcagcac

SEQ ID NO: 116378 - DNA, 27 bp, Artificial sequence
  SiRNA target sequence
ccagacctgtccctgatttgcagcacc

SEQ ID NO: 116379 - DNA, 27 bp, Artificial sequence
  SiRNA target sequence
cagacctgtccctgatttgcagcacca

SEQ ID NO: 116380 - DNA, 27 bp, Artificial sequence
  SiRNA target sequence
agacctgtccctgatttgcagcaccat

SEQ ID NO: 116381 - DNA, 27 bp, Artificial sequence
  SiRNA target sequence
gacctgtccctgatttgcagcaccatc

SEQ ID NO: 116382 - DNA, 27 bp, Artificial sequence
  SiRNA target sequence
acctgtccctgatttgcagcaccatcc

SEQ ID NO: 116383 - DNA, 27 bp, Artificial sequence
  SiRNA target sequence
cctgtccctgatttgcagcaccatccc

SEQ ID NO: 116384 - DNA, 27 bp, Artificial sequence
  SiRNA target sequence
ctgtccctgatttgcagcaccatcccc

SEQ ID NO: 116385 - DNA, 27 bp, Artificial sequence
  SiRNA target sequence
tgtccctgatttgcagcaccatccccg

SEQ ID NO: 116386 - DNA, 27 bp, Artificial sequence
  SiRNA target sequence
gtccctgatttgcagcaccatccccga

SEQ ID NO: 116387 - DNA, 27 bp, Artificial sequence
  SiRNA target sequence
tccctgatttgcagcaccatccccgaa

SEQ ID NO: 116388 - DNA, 27 bp, Artificial sequence
  SiRNA target sequence
ccctgatttgcagcaccatccccgaaa

SEQ ID NO: 116389 - DNA, 27 bp, Artificial sequence
  SiRNA target sequence
cctgatttgcagcaccatccccgaaaa

SEQ ID NO: 116390 - DNA, 27 bp, Artificial sequence
  SiRNA target sequence
ctgatttgcagcaccatccccgaaaaa

SEQ ID NO: 116391 - DNA, 27 bp, Artificial sequence
  SiRNA target sequence
tgatttgcagcaccatccccgaaaaat

SEQ ID NO: 116392 - DNA, 27 bp, Artificial sequence
  SiRNA target sequence
gatttgcagcaccatccccgaaaaata

SEQ ID NO: 116393 - DNA, 27 bp, Artificial sequence
  SiRNA target sequence
atttgcagcaccatccccgaaaaatac

SEQ ID NO: 116394 - DNA, 27 bp, Artificial sequence
  SiRNA target sequence
tttgcagcaccatccccgaaaaataca

SEQ ID NO: 116395 - DNA, 27 bp, Artificial sequence
  SiRNA target sequence
ttgcagcaccatccccgaaaaatacaa

SEQ ID NO: 116396 - DNA, 27 bp, Artificial sequence
  SiRNA target sequence
tgcagcaccatccccgaaaaatacaaa

SEQ ID NO: 116397 - DNA, 27 bp, Artificial sequence
  SiRNA target sequence
gcagcaccatccccgaaaaatacaaat

SEQ ID NO: 116398 - DNA, 27 bp, Artificial sequence
  SiRNA target sequence
cagcaccatccccgaaaaatacaaatg

SEQ ID NO: 116399 - DNA, 27 bp, Artificial sequence
  SiRNA target sequence
agcaccatccccgaaaaatacaaatgc

SEQ ID NO: 116400 - DNA, 27 bp, Artificial sequence
  SiRNA target sequence
gcaccatccccgaaaaatacaaatgct

SEQ ID NO: 116401 - DNA, 27 bp, Artificial sequence
  SiRNA target sequence
caccatccccgaaaaatacaaatgcta

SEQ ID NO: 116402 - DNA, 27 bp, Artificial sequence
  SiRNA target sequence
accatccccgaaaaatacaaatgctac

SEQ ID NO: 116403 - DNA, 27 bp, Artificial sequence
  SiRNA target sequence
ccatccccgaaaaatacaaatgctaca

SEQ ID NO: 116404 - DNA, 27 bp, Artificial sequence
  SiRNA target sequence
catccccgaaaaatacaaatgctacat

SEQ ID NO: 116405 - DNA, 27 bp, Artificial sequence
  SiRNA target sequence
atccccgaaaaatacaaatgctacatt

SEQ ID NO: 116406 - DNA, 27 bp, Artificial sequence
  SiRNA target sequence
tccccgaaaaatacaaatgctacattt

SEQ ID NO: 116407 - DNA, 27 bp, Artificial sequence
  SiRNA target sequence
ccccgaaaaatacaaatgctacatttt

SEQ ID NO: 116408 - DNA, 27 bp, Artificial sequence
  SiRNA target sequence
cccgaaaaatacaaatgctacattttt

SEQ ID NO: 116409 - DNA, 27 bp, Artificial sequence
  SiRNA target sequence
ccgaaaaatacaaatgctacatttttt

SEQ ID NO: 116410 - DNA, 27 bp, Artificial sequence
  SiRNA target sequence
cgaaaaatacaaatgctacatttttta

SEQ ID NO: 116411 - DNA, 27 bp, Artificial sequence
  SiRNA target sequence
gaaaaatacaaatgctacattttttac

SEQ ID NO: 116412 - DNA, 27 bp, Artificial sequence
  SiRNA target sequence
aaaaatacaaatgctacattttttact

SEQ ID NO: 116413 - DNA, 27 bp, Artificial sequence
  SiRNA target sequence
aaaatacaaatgctacattttttactt

SEQ ID NO: 116414 - DNA, 27 bp, Artificial sequence
  SiRNA target sequence
aaatacaaatgctacattttttacttt

SEQ ID NO: 116415 - DNA, 27 bp, Artificial sequence
  SiRNA target sequence
aatacaaatgctacattttttactttt

SEQ ID NO: 116416 - DNA, 27 bp, Artificial sequence
  SiRNA target sequence
atacaaatgctacattttttacttttt

SEQ ID NO: 116417 - DNA, 27 bp, Artificial sequence
  SiRNA target sequence
tacaaatgctacattttttactttttt

SEQ ID NO: 116418 - DNA, 27 bp, Artificial sequence
  SiRNA target sequence
acaaatgctacattttttactttttta

SEQ ID NO: 116419 - DNA, 27 bp, Artificial sequence
  SiRNA target sequence
caaatgctacattttttacttttttat

SEQ ID NO: 116420 - DNA, 27 bp, Artificial sequence
  SiRNA target sequence
aaatgctacattttttacttttttata

SEQ ID NO: 116421 - DNA, 27 bp, Artificial sequence
  SiRNA target sequence
aatgctacattttttacttttttatat

SEQ ID NO: 116422 - DNA, 27 bp, Artificial sequence
  SiRNA target sequence
atgctacattttttacttttttatatt

SEQ ID NO: 116423 - DNA, 27 bp, Artificial sequence
  SiRNA target sequence
tgctacattttttacttttttatattg

SEQ ID NO: 116424 - DNA, 27 bp, Artificial sequence
  SiRNA target sequence
gctacattttttacttttttatattgt

SEQ ID NO: 116425 - DNA, 27 bp, Artificial sequence
  SiRNA target sequence
ctacattttttacttttttatattgta

SEQ ID NO: 116426 - DNA, 27 bp, Artificial sequence
  SiRNA target sequence
tacattttttacttttttatattgtaa

SEQ ID NO: 116427 - DNA, 27 bp, Artificial sequence
  SiRNA target sequence
acattttttacttttttatattgtaaa

SEQ ID NO: 116428 - DNA, 27 bp, Artificial sequence
  SiRNA target sequence
cattttttacttttttatattgtaaag

SEQ ID NO: 116429 - DNA, 27 bp, Artificial sequence
  SiRNA target sequence
attttttacttttttatattgtaaagc

SEQ ID NO: 116430 - DNA, 27 bp, Artificial sequence
  SiRNA target sequence
ttttttacttttttatattgtaaagca

SEQ ID NO: 116431 - DNA, 27 bp, Artificial sequence
  SiRNA target sequence
tttttacttttttatattgtaaagcaa

SEQ ID NO: 116432 - DNA, 27 bp, Artificial sequence
  SiRNA target sequence
ttttacttttttatattgtaaagcaaa

SEQ ID NO: 116433 - DNA, 27 bp, Artificial sequence
  SiRNA target sequence
tttacttttttatattgtaaagcaaat

SEQ ID NO: 116434 - DNA, 27 bp, Artificial sequence
  SiRNA target sequence
ttacttttttatattgtaaagcaaatc

SEQ ID NO: 116435 - DNA, 27 bp, Artificial sequence
  SiRNA target sequence
tacttttttatattgtaaagcaaatcc

SEQ ID NO: 116436 - DNA, 27 bp, Artificial sequence
  SiRNA target sequence
acttttttatattgtaaagcaaatccc

SEQ ID NO: 116437 - DNA, 27 bp, Artificial sequence
  SiRNA target sequence
cttttttatattgtaaagcaaatccca

SEQ ID NO: 116438 - DNA, 27 bp, Artificial sequence
  SiRNA target sequence
ttttttatattgtaaagcaaatcccaa

SEQ ID NO: 116439 - DNA, 27 bp, Artificial sequence
  SiRNA target sequence
tttttatattgtaaagcaaatcccaat

SEQ ID NO: 116440 - DNA, 27 bp, Artificial sequence
  SiRNA target sequence
ttttatattgtaaagcaaatcccaatc

SEQ ID NO: 116441 - DNA, 27 bp, Artificial sequence
  SiRNA target sequence
tttatattgtaaagcaaatcccaatcc

SEQ ID NO: 116442 - DNA, 27 bp, Artificial sequence
  SiRNA target sequence
ttatattgtaaagcaaatcccaatcct

SEQ ID NO: 116443 - DNA, 27 bp, Artificial sequence
  SiRNA target sequence
tatattgtaaagcaaatcccaatcctg

SEQ ID NO: 116444 - DNA, 27 bp, Artificial sequence
  SiRNA target sequence
atattgtaaagcaaatcccaatcctgt

SEQ ID NO: 116445 - DNA, 27 bp, Artificial sequence
  SiRNA target sequence
tattgtaaagcaaatcccaatcctgta

SEQ ID NO: 116446 - DNA, 27 bp, Artificial sequence
  SiRNA target sequence
attgtaaagcaaatcccaatcctgtac

SEQ ID NO: 116447 - DNA, 27 bp, Artificial sequence
  SiRNA target sequence
ttgtaaagcaaatcccaatcctgtacc

SEQ ID NO: 116448 - DNA, 27 bp, Artificial sequence
  SiRNA target sequence
tgtaaagcaaatcccaatcctgtacca

SEQ ID NO: 116449 - DNA, 27 bp, Artificial sequence
  SiRNA target sequence
gtaaagcaaatcccaatcctgtaccaa

SEQ ID NO: 116450 - DNA, 27 bp, Artificial sequence
  SiRNA target sequence
taaagcaaatcccaatcctgtaccaag

SEQ ID NO: 116451 - DNA, 27 bp, Artificial sequence
  SiRNA target sequence
aaagcaaatcccaatcctgtaccaagc

SEQ ID NO: 116452 - DNA, 27 bp, Artificial sequence
  SiRNA target sequence
aagcaaatcccaatcctgtaccaagcg

SEQ ID NO: 116453 - DNA, 27 bp, Artificial sequence
  SiRNA target sequence
agcaaatcccaatcctgtaccaagcga

SEQ ID NO: 116454 - DNA, 27 bp, Artificial sequence
  SiRNA target sequence
gcaaatcccaatcctgtaccaagcgat

SEQ ID NO: 116455 - DNA, 27 bp, Artificial sequence
  SiRNA target sequence
caaatcccaatcctgtaccaagcgata

SEQ ID NO: 116456 - DNA, 27 bp, Artificial sequence
  SiRNA target sequence
aaatcccaatcctgtaccaagcgatac

SEQ ID NO: 116457 - DNA, 27 bp, Artificial sequence
  SiRNA target sequence
aatcccaatcctgtaccaagcgatacc

SEQ ID NO: 116458 - DNA, 27 bp, Artificial sequence
  SiRNA target sequence
atcccaatcctgtaccaagcgatacct

SEQ ID NO: 116459 - DNA, 27 bp, Artificial sequence
  SiRNA target sequence
tcccaatcctgtaccaagcgatacctg

SEQ ID NO: 116460 - DNA, 27 bp, Artificial sequence
  SiRNA target sequence
cccaatcctgtaccaagcgatacctgc

SEQ ID NO: 116461 - DNA, 27 bp, Artificial sequence
  SiRNA target sequence
ccaatcctgtaccaagcgatacctgcg

SEQ ID NO: 116462 - DNA, 27 bp, Artificial sequence
  SiRNA target sequence
caatcctgtaccaagcgatacctgcgc

SEQ ID NO: 116463 - DNA, 27 bp, Artificial sequence
  SiRNA target sequence
aatcctgtaccaagcgatacctgcgca

SEQ ID NO: 116464 - DNA, 27 bp, Artificial sequence
  SiRNA target sequence
atcctgtaccaagcgatacctgcgcac

SEQ ID NO: 116465 - DNA, 27 bp, Artificial sequence
  SiRNA target sequence
tcctgtaccaagcgatacctgcgcacc

SEQ ID NO: 116466 - DNA, 27 bp, Artificial sequence
  SiRNA target sequence
cctgtaccaagcgatacctgcgcacct

SEQ ID NO: 116467 - DNA, 27 bp, Artificial sequence
  SiRNA target sequence
ctgtaccaagcgatacctgcgcaccta

SEQ ID NO: 116468 - DNA, 27 bp, Artificial sequence
  SiRNA target sequence
tgtaccaagcgatacctgcgcacctac

SEQ ID NO: 116469 - DNA, 27 bp, Artificial sequence
  SiRNA target sequence
gtaccaagcgatacctgcgcacctact

SEQ ID NO: 116470 - DNA, 27 bp, Artificial sequence
  SiRNA target sequence
taccaagcgatacctgcgcacctacta

SEQ ID NO: 116471 - DNA, 27 bp, Artificial sequence
  SiRNA target sequence
accaagcgatacctgcgcacctactat

SEQ ID NO: 116472 - DNA, 27 bp, Artificial sequence
  SiRNA target sequence
ccaagcgatacctgcgcacctactata

SEQ ID NO: 116473 - DNA, 27 bp, Artificial sequence
  SiRNA target sequence
caagcgatacctgcgcacctactatac

SEQ ID NO: 116474 - DNA, 27 bp, Artificial sequence
  SiRNA target sequence
aagcgatacctgcgcacctactatacc

SEQ ID NO: 116475 - DNA, 27 bp, Artificial sequence
  SiRNA target sequence
agcgatacctgcgcacctactataccg

SEQ ID NO: 116476 - DNA, 27 bp, Artificial sequence
  SiRNA target sequence
gcgatacctgcgcacctactataccgt

SEQ ID NO: 116477 - DNA, 27 bp, Artificial sequence
  SiRNA target sequence
cgatacctgcgcacctactataccgtg

SEQ ID NO: 116478 - DNA, 27 bp, Artificial sequence
  SiRNA target sequence
gatacctgcgcacctactataccgtgt

SEQ ID NO: 116479 - DNA, 27 bp, Artificial sequence
  SiRNA target sequence
atacctgcgcacctactataccgtgtc

SEQ ID NO: 116480 - DNA, 27 bp, Artificial sequence
  SiRNA target sequence
tacctgcgcacctactataccgtgtcc

SEQ ID NO: 116481 - DNA, 27 bp, Artificial sequence
  SiRNA target sequence
acctgcgcacctactataccgtgtccc

SEQ ID NO: 116482 - DNA, 27 bp, Artificial sequence
  SiRNA target sequence
cctgcgcacctactataccgtgtcccc

SEQ ID NO: 116483 - DNA, 27 bp, Artificial sequence
  SiRNA target sequence
ctgcgcacctactataccgtgtccccc

SEQ ID NO: 116484 - DNA, 27 bp, Artificial sequence
  SiRNA target sequence
tgcgcacctactataccgtgtccccca

SEQ ID NO: 116485 - DNA, 27 bp, Artificial sequence
  SiRNA target sequence
gcgcacctactataccgtgtcccccat

SEQ ID NO: 116486 - DNA, 27 bp, Artificial sequence
  SiRNA target sequence
cgcacctactataccgtgtcccccata

SEQ ID NO: 116487 - DNA, 27 bp, Artificial sequence
  SiRNA target sequence
gcacctactataccgtgtcccccataa

SEQ ID NO: 116488 - DNA, 27 bp, Artificial sequence
  SiRNA target sequence
cacctactataccgtgtcccccataaa

SEQ ID NO: 116489 - DNA, 27 bp, Artificial sequence
  SiRNA target sequence
acctactataccgtgtcccccataaaa

SEQ ID NO: 116490 - DNA, 27 bp, Artificial sequence
  SiRNA target sequence
cctactataccgtgtcccccataaaat

SEQ ID NO: 116491 - DNA, 27 bp, Artificial sequence
  SiRNA target sequence
ctactataccgtgtcccccataaaatt

SEQ ID NO: 116492 - DNA, 27 bp, Artificial sequence
  SiRNA target sequence
tactataccgtgtcccccataaaattg

SEQ ID NO: 116493 - DNA, 27 bp, Artificial sequence
  SiRNA target sequence
actataccgtgtcccccataaaattgg

SEQ ID NO: 116494 - DNA, 27 bp, Artificial sequence
  SiRNA target sequence
ctataccgtgtcccccataaaattggt

SEQ ID NO: 116495 - DNA, 27 bp, Artificial sequence
  SiRNA target sequence
tataccgtgtcccccataaaattggtc

SEQ ID NO: 116496 - DNA, 27 bp, Artificial sequence
  SiRNA target sequence
ataccgtgtcccccataaaattggtca

SEQ ID NO: 116497 - DNA, 27 bp, Artificial sequence
  SiRNA target sequence
taccgtgtcccccataaaattggtcat

SEQ ID NO: 116498 - DNA, 27 bp, Artificial sequence
  SiRNA target sequence
accgtgtcccccataaaattggtcatt

SEQ ID NO: 116499 - DNA, 27 bp, Artificial sequence
  SiRNA target sequence
ccgtgtcccccataaaattggtcatta

SEQ ID NO: 116500 - DNA, 27 bp, Artificial sequence
  SiRNA target sequence
cgtgtcccccataaaattggtcattat

SEQ ID NO: 116501 - DNA, 27 bp, Artificial sequence
  SiRNA target sequence
gtgtcccccataaaattggtcattata

SEQ ID NO: 116502 - DNA, 27 bp, Artificial sequence
  SiRNA target sequence
tgtcccccataaaattggtcattatac

SEQ ID NO: 116503 - DNA, 27 bp, Artificial sequence
  SiRNA target sequence
gtcccccataaaattggtcattataca

SEQ ID NO: 116504 - DNA, 27 bp, Artificial sequence
  SiRNA target sequence
tcccccataaaattggtcattatacaa

SEQ ID NO: 116505 - DNA, 27 bp, Artificial sequence
  SiRNA target sequence
cccccataaaattggtcattatacaaa

SEQ ID NO: 116506 - DNA, 27 bp, Artificial sequence
  SiRNA target sequence
ccccataaaattggtcattatacaaat

SEQ ID NO: 116507 - DNA, 27 bp, Artificial sequence
  SiRNA target sequence
cccataaaattggtcattatacaaatg

SEQ ID NO: 116508 - DNA, 27 bp, Artificial sequence
  SiRNA target sequence
ccataaaattggtcattatacaaatgc

SEQ ID NO: 116509 - DNA, 27 bp, Artificial sequence
  SiRNA target sequence
cataaaattggtcattatacaaatgca

SEQ ID NO: 116510 - DNA, 27 bp, Artificial sequence
  SiRNA target sequence
ataaaattggtcattatacaaatgcat

SEQ ID NO: 116511 - DNA, 27 bp, Artificial sequence
  SiRNA target sequence
taaaattggtcattatacaaatgcatc

SEQ ID NO: 116512 - DNA, 27 bp, Artificial sequence
  SiRNA target sequence
aaaattggtcattatacaaatgcatcg

SEQ ID NO: 116513 - DNA, 27 bp, Artificial sequence
  SiRNA target sequence
aaattggtcattatacaaatgcatcga

SEQ ID NO: 116514 - DNA, 27 bp, Artificial sequence
  SiRNA target sequence
aattggtcattatacaaatgcatcgat

SEQ ID NO: 116515 - DNA, 27 bp, Artificial sequence
  SiRNA target sequence
attggtcattatacaaatgcatcgatc

SEQ ID NO: 116516 - DNA, 27 bp, Artificial sequence
  SiRNA target sequence
ttggtcattatacaaatgcatcgatcc

SEQ ID NO: 116517 - DNA, 27 bp, Artificial sequence
  SiRNA target sequence
tggtcattatacaaatgcatcgatcct

SEQ ID NO: 116518 - DNA, 27 bp, Artificial sequence
  SiRNA target sequence
ggtcattatacaaatgcatcgatcctc

SEQ ID NO: 116519 - DNA, 27 bp, Artificial sequence
  SiRNA target sequence
gtcattatacaaatgcatcgatcctcc

SEQ ID NO: 116520 - DNA, 27 bp, Artificial sequence
  SiRNA target sequence
tcattatacaaatgcatcgatcctcct

SEQ ID NO: 116521 - DNA, 27 bp, Artificial sequence
  SiRNA target sequence
cattatacaaatgcatcgatcctcctt

SEQ ID NO: 116522 - DNA, 27 bp, Artificial sequence
  SiRNA target sequence
attatacaaatgcatcgatcctccttt

SEQ ID NO: 116523 - DNA, 27 bp, Artificial sequence
  SiRNA target sequence
ttatacaaatgcatcgatcctcctttt

SEQ ID NO: 116524 - DNA, 27 bp, Artificial sequence
  SiRNA target sequence
tatacaaatgcatcgatcctccttttc

SEQ ID NO: 116525 - DNA, 27 bp, Artificial sequence
  SiRNA target sequence
atacaaatgcatcgatcctccttttcc

SEQ ID NO: 116526 - DNA, 27 bp, Artificial sequence
  SiRNA target sequence
tacaaatgcatcgatcctccttttcct

SEQ ID NO: 116527 - DNA, 27 bp, Artificial sequence
  SiRNA target sequence
acaaatgcatcgatcctccttttcctt

SEQ ID NO: 116528 - DNA, 27 bp, Artificial sequence
  SiRNA target sequence
caaatgcatcgatcctccttttccttt

SEQ ID NO: 116529 - DNA, 27 bp, Artificial sequence
  SiRNA target sequence
aaatgcatcgatcctccttttcctttg

SEQ ID NO: 116530 - DNA, 27 bp, Artificial sequence
  SiRNA target sequence
aatgcatcgatcctccttttcctttgc

SEQ ID NO: 116531 - DNA, 27 bp, Artificial sequence
  SiRNA target sequence
atgcatcgatcctccttttcctttgca

SEQ ID NO: 116532 - DNA, 27 bp, Artificial sequence
  SiRNA target sequence
tgcatcgatcctccttttcctttgcaa

SEQ ID NO: 116533 - DNA, 27 bp, Artificial sequence
  SiRNA target sequence
gcatcgatcctccttttcctttgcaat

SEQ ID NO: 116534 - DNA, 27 bp, Artificial sequence
  SiRNA target sequence
catcgatcctccttttcctttgcaatt

SEQ ID NO: 116535 - DNA, 27 bp, Artificial sequence
  SiRNA target sequence
atcgatcctccttttcctttgcaatta

SEQ ID NO: 116536 - DNA, 27 bp, Artificial sequence
  SiRNA target sequence
tcgatcctccttttcctttgcaattac

SEQ ID NO: 116537 - DNA, 27 bp, Artificial sequence
  SiRNA target sequence
cgatcctccttttcctttgcaattacc

SEQ ID NO: 116538 - DNA, 27 bp, Artificial sequence
  SiRNA target sequence
gatcctccttttcctttgcaattacca

SEQ ID NO: 116539 - DNA, 27 bp, Artificial sequence
  SiRNA target sequence
atcctccttttcctttgcaattaccaa

SEQ ID NO: 116540 - DNA, 27 bp, Artificial sequence
  SiRNA target sequence
tcctccttttcctttgcaattaccaat

SEQ ID NO: 116541 - DNA, 27 bp, Artificial sequence
  SiRNA target sequence
cctccttttcctttgcaattaccaata

SEQ ID NO: 116542 - DNA, 27 bp, Artificial sequence
  SiRNA target sequence
ctccttttcctttgcaattaccaatag

SEQ ID NO: 116543 - DNA, 27 bp, Artificial sequence
  SiRNA target sequence
tccttttcctttgcaattaccaatagc

SEQ ID NO: 116544 - DNA, 27 bp, Artificial sequence
  SiRNA target sequence
ccttttcctttgcaattaccaatagcc

SEQ ID NO: 116545 - DNA, 27 bp, Artificial sequence
  SiRNA target sequence
cttttcctttgcaattaccaatagcct

SEQ ID NO: 116546 - DNA, 27 bp, Artificial sequence
  SiRNA target sequence
ttttcctttgcaattaccaatagcctt

SEQ ID NO: 116547 - DNA, 27 bp, Artificial sequence
  SiRNA target sequence
tttcctttgcaattaccaatagccttt

SEQ ID NO: 116548 - DNA, 27 bp, Artificial sequence
  SiRNA target sequence
ttcctttgcaattaccaatagcctttc

SEQ ID NO: 116549 - DNA, 27 bp, Artificial sequence
  SiRNA target sequence
tcctttgcaattaccaatagcctttcc

SEQ ID NO: 116550 - DNA, 27 bp, Artificial sequence
  SiRNA target sequence
cctttgcaattaccaatagcctttcct

SEQ ID NO: 116551 - DNA, 27 bp, Artificial sequence
  SiRNA target sequence
ctttgcaattaccaatagcctttccta

SEQ ID NO: 116552 - DNA, 27 bp, Artificial sequence
  SiRNA target sequence
tttgcaattaccaatagcctttcctaa

SEQ ID NO: 116553 - DNA, 27 bp, Artificial sequence
  SiRNA target sequence
ttgcaattaccaatagcctttcctaat

SEQ ID NO: 116554 - DNA, 27 bp, Artificial sequence
  SiRNA target sequence
tgcaattaccaatagcctttcctaata

SEQ ID NO: 116555 - DNA, 27 bp, Artificial sequence
  SiRNA target sequence
gcaattaccaatagcctttcctaataa

SEQ ID NO: 116556 - DNA, 27 bp, Artificial sequence
  SiRNA target sequence
caattaccaatagcctttcctaataat

SEQ ID NO: 116557 - DNA, 27 bp, Artificial sequence
  SiRNA target sequence
aattaccaatagcctttcctaataatt

SEQ ID NO: 116558 - DNA, 27 bp, Artificial sequence
  SiRNA target sequence
attaccaatagcctttcctaataattc

SEQ ID NO: 116559 - DNA, 27 bp, Artificial sequence
  SiRNA target sequence
ttaccaatagcctttcctaataattcc

SEQ ID NO: 116560 - DNA, 27 bp, Artificial sequence
  SiRNA target sequence
taccaatagcctttcctaataattccc

SEQ ID NO: 116561 - DNA, 27 bp, Artificial sequence
  SiRNA target sequence
accaatagcctttcctaataattcccc

SEQ ID NO: 116562 - DNA, 27 bp, Artificial sequence
  SiRNA target sequence
ccaatagcctttcctaataattcccct

SEQ ID NO: 116563 - DNA, 27 bp, Artificial sequence
  SiRNA target sequence
caatagcctttcctaataattccccta

SEQ ID NO: 116564 - DNA, 27 bp, Artificial sequence
  SiRNA target sequence
aatagcctttcctaataattcccctat

SEQ ID NO: 116565 - DNA, 27 bp, Artificial sequence
  SiRNA target sequence
atagcctttcctaataattcccctata

SEQ ID NO: 116566 - DNA, 27 bp, Artificial sequence
  SiRNA target sequence
tagcctttcctaataattcccctataa

SEQ ID NO: 116567 - DNA, 27 bp, Artificial sequence
  SiRNA target sequence
agcctttcctaataattcccctataat

SEQ ID NO: 116568 - DNA, 27 bp, Artificial sequence
  SiRNA target sequence
gcctttcctaataattcccctataata

SEQ ID NO: 116569 - DNA, 27 bp, Artificial sequence
  SiRNA target sequence
cctttcctaataattcccctataatac

SEQ ID NO: 116570 - DNA, 27 bp, Artificial sequence
  SiRNA target sequence
ctttcctaataattcccctataatact

SEQ ID NO: 116571 - DNA, 27 bp, Artificial sequence
  SiRNA target sequence
tttcctaataattcccctataatactt

SEQ ID NO: 116572 - DNA, 27 bp, Artificial sequence
  SiRNA target sequence
ttcctaataattcccctataatacttt

SEQ ID NO: 116573 - DNA, 27 bp, Artificial sequence
  SiRNA target sequence
tcctaataattcccctataatactttc

SEQ ID NO: 116574 - DNA, 27 bp, Artificial sequence
  SiRNA target sequence
cctaataattcccctataatactttct

SEQ ID NO: 116575 - DNA, 27 bp, Artificial sequence
  SiRNA target sequence
ctaataattcccctataatactttcta

SEQ ID NO: 116576 - DNA, 27 bp, Artificial sequence
  SiRNA target sequence
taataattcccctataatactttctat

SEQ ID NO: 116577 - DNA, 27 bp, Artificial sequence
  SiRNA target sequence
aataattcccctataatactttctata

SEQ ID NO: 116578 - DNA, 27 bp, Artificial sequence
  SiRNA target sequence
ataattcccctataatactttctatac

SEQ ID NO: 116579 - DNA, 27 bp, Artificial sequence
  SiRNA target sequence
taattcccctataatactttctatact

SEQ ID NO: 116580 - DNA, 27 bp, Artificial sequence
  SiRNA target sequence
aattcccctataatactttctatactg

SEQ ID NO: 116581 - DNA, 27 bp, Artificial sequence
  SiRNA target sequence
attcccctataatactttctatactga

SEQ ID NO: 116582 - DNA, 27 bp, Artificial sequence
  SiRNA target sequence
ttcccctataatactttctatactgat

SEQ ID NO: 116583 - DNA, 27 bp, Artificial sequence
  SiRNA target sequence
tcccctataatactttctatactgatt

SEQ ID NO: 116584 - DNA, 27 bp, Artificial sequence
  SiRNA target sequence
cccctataatactttctatactgattc

SEQ ID NO: 116585 - DNA, 27 bp, Artificial sequence
  SiRNA target sequence
ccctataatactttctatactgattcc

SEQ ID NO: 116586 - DNA, 27 bp, Artificial sequence
  SiRNA target sequence
cctataatactttctatactgattcca

SEQ ID NO: 116587 - DNA, 27 bp, Artificial sequence
  SiRNA target sequence
ctataatactttctatactgattccac

SEQ ID NO: 116588 - DNA, 27 bp, Artificial sequence
  SiRNA target sequence
tataatactttctatactgattccaca

SEQ ID NO: 116589 - DNA, 27 bp, Artificial sequence
  SiRNA target sequence
ataatactttctatactgattccacaa

SEQ ID NO: 116590 - DNA, 27 bp, Artificial sequence
  SiRNA target sequence
taatactttctatactgattccacaaa

SEQ ID NO: 116591 - DNA, 27 bp, Artificial sequence
  SiRNA target sequence
aatactttctatactgattccacaaat

SEQ ID NO: 116592 - DNA, 27 bp, Artificial sequence
  SiRNA target sequence
atactttctatactgattccacaaata

SEQ ID NO: 116593 - DNA, 27 bp, Artificial sequence
  SiRNA target sequence
tactttctatactgattccacaaataa

SEQ ID NO: 116594 - DNA, 27 bp, Artificial sequence
  SiRNA target sequence
actttctatactgattccacaaataaa

SEQ ID NO: 116595 - DNA, 27 bp, Artificial sequence
  SiRNA target sequence
ctttctatactgattccacaaataaat

SEQ ID NO: 116596 - DNA, 27 bp, Artificial sequence
  SiRNA target sequence
tttctatactgattccacaaataaatg

SEQ ID NO: 116597 - DNA, 27 bp, Artificial sequence
  SiRNA target sequence
ttctatactgattccacaaataaatgc

SEQ ID NO: 116598 - DNA, 27 bp, Artificial sequence
  SiRNA target sequence
tctatactgattccacaaataaatgct

SEQ ID NO: 116599 - DNA, 27 bp, Artificial sequence
  SiRNA target sequence
ctatactgattccacaaataaatgcta

SEQ ID NO: 116600 - DNA, 27 bp, Artificial sequence
  SiRNA target sequence
tatactgattccacaaataaatgctaa

SEQ ID NO: 116601 - DNA, 27 bp, Artificial sequence
  SiRNA target sequence
atactgattccacaaataaatgctaat

SEQ ID NO: 116602 - DNA, 27 bp, Artificial sequence
  SiRNA target sequence
tactgattccacaaataaatgctaatc

SEQ ID NO: 116603 - DNA, 27 bp, Artificial sequence
  SiRNA target sequence
actgattccacaaataaatgctaatcc

SEQ ID NO: 116604 - DNA, 27 bp, Artificial sequence
  SiRNA target sequence
ctgattccacaaataaatgctaatcca

SEQ ID NO: 116605 - DNA, 27 bp, Artificial sequence
  SiRNA target sequence
tgattccacaaataaatgctaatccat

SEQ ID NO: 116606 - DNA, 27 bp, Artificial sequence
  SiRNA target sequence
gattccacaaataaatgctaatccatg

SEQ ID NO: 116607 - DNA, 27 bp, Artificial sequence
  SiRNA target sequence
attccacaaataaatgctaatccatgg

SEQ ID NO: 116608 - DNA, 27 bp, Artificial sequence
  SiRNA target sequence
ttccacaaataaatgctaatccatggc

SEQ ID NO: 116609 - DNA, 27 bp, Artificial sequence
  SiRNA target sequence
tccacaaataaatgctaatccatggca

SEQ ID NO: 116610 - DNA, 27 bp, Artificial sequence
  SiRNA target sequence
ccacaaataaatgctaatccatggcat

SEQ ID NO: 116611 - DNA, 27 bp, Artificial sequence
  SiRNA target sequence
cacaaataaatgctaatccatggcatc

SEQ ID NO: 116612 - DNA, 27 bp, Artificial sequence
  SiRNA target sequence
acaaataaatgctaatccatggcatct

SEQ ID NO: 116613 - DNA, 27 bp, Artificial sequence
  SiRNA target sequence
caaataaatgctaatccatggcatcta

SEQ ID NO: 116614 - DNA, 27 bp, Artificial sequence
  SiRNA target sequence
aaataaatgctaatccatggcatctat

SEQ ID NO: 116615 - DNA, 27 bp, Artificial sequence
  SiRNA target sequence
aataaatgctaatccatggcatctata

SEQ ID NO: 116616 - DNA, 27 bp, Artificial sequence
  SiRNA target sequence
ataaatgctaatccatggcatctataa

SEQ ID NO: 116617 - DNA, 27 bp, Artificial sequence
  SiRNA target sequence
taaatgctaatccatggcatctataag

SEQ ID NO: 116618 - DNA, 27 bp, Artificial sequence
  SiRNA target sequence
aaatgctaatccatggcatctataaga

SEQ ID NO: 116619 - DNA, 27 bp, Artificial sequence
  SiRNA target sequence
aatgctaatccatggcatctataagat

SEQ ID NO: 116620 - DNA, 27 bp, Artificial sequence
  SiRNA target sequence
atgctaatccatggcatctataagatc

SEQ ID NO: 116621 - DNA, 27 bp, Artificial sequence
  SiRNA target sequence
tgctaatccatggcatctataagatcc

SEQ ID NO: 116622 - DNA, 27 bp, Artificial sequence
  SiRNA target sequence
gctaatccatggcatctataagatcct

SEQ ID NO: 116623 - DNA, 27 bp, Artificial sequence
  SiRNA target sequence
ctaatccatggcatctataagatccta

SEQ ID NO: 116624 - DNA, 27 bp, Artificial sequence
  SiRNA target sequence
taatccatggcatctataagatcctat

SEQ ID NO: 116625 - DNA, 27 bp, Artificial sequence
  SiRNA target sequence
aatccatggcatctataagatcctatg

SEQ ID NO: 116626 - DNA, 27 bp, Artificial sequence
  SiRNA target sequence
atccatggcatctataagatcctatga

SEQ ID NO: 116627 - DNA, 27 bp, Artificial sequence
  SiRNA target sequence
tccatggcatctataagatcctatgac

SEQ ID NO: 116628 - DNA, 27 bp, Artificial sequence
  SiRNA target sequence
ccatggcatctataagatcctatgact

SEQ ID NO: 116629 - DNA, 27 bp, Artificial sequence
  SiRNA target sequence
catggcatctataagatcctatgactt

SEQ ID NO: 116630 - DNA, 27 bp, Artificial sequence
  SiRNA target sequence
atggcatctataagatcctatgacttt

SEQ ID NO: 116631 - DNA, 27 bp, Artificial sequence
  SiRNA target sequence
tggcatctataagatcctatgacttta

SEQ ID NO: 116632 - DNA, 27 bp, Artificial sequence
  SiRNA target sequence
ggcatctataagatcctatgactttat

SEQ ID NO: 116633 - DNA, 27 bp, Artificial sequence
  SiRNA target sequence
gcatctataagatcctatgactttatc

SEQ ID NO: 116634 - DNA, 27 bp, Artificial sequence
  SiRNA target sequence
catctataagatcctatgactttatca

SEQ ID NO: 116635 - DNA, 27 bp, Artificial sequence
  SiRNA target sequence
atctataagatcctatgactttatcat

SEQ ID NO: 116636 - DNA, 27 bp, Artificial sequence
  SiRNA target sequence
tctataagatcctatgactttatcatt

SEQ ID NO: 116637 - DNA, 27 bp, Artificial sequence
  SiRNA target sequence
ctataagatcctatgactttatcattt

SEQ ID NO: 116638 - DNA, 27 bp, Artificial sequence
  SiRNA target sequence
tataagatcctatgactttatcatttt

SEQ ID NO: 116639 - DNA, 27 bp, Artificial sequence
  SiRNA target sequence
ataagatcctatgactttatcattttt

SEQ ID NO: 116640 - DNA, 27 bp, Artificial sequence
  SiRNA target sequence
taagatcctatgactttatcattttta

SEQ ID NO: 116641 - DNA, 27 bp, Artificial sequence
  SiRNA target sequence
aagatcctatgactttatcatttttat

SEQ ID NO: 116642 - DNA, 27 bp, Artificial sequence
  SiRNA target sequence
agatcctatgactttatcatttttatc

SEQ ID NO: 116643 - DNA, 27 bp, Artificial sequence
  SiRNA target sequence
gatcctatgactttatcatttttatct

SEQ ID NO: 116644 - DNA, 27 bp, Artificial sequence
  SiRNA target sequence
atcctatgactttatcatttttatcta

SEQ ID NO: 116645 - DNA, 27 bp, Artificial sequence
  SiRNA target sequence
tcctatgactttatcatttttatctag

SEQ ID NO: 116646 - DNA, 27 bp, Artificial sequence
  SiRNA target sequence
cctatgactttatcatttttatctagt

SEQ ID NO: 116647 - DNA, 27 bp, Artificial sequence
  SiRNA target sequence
ctatgactttatcatttttatctagta

SEQ ID NO: 116648 - DNA, 27 bp, Artificial sequence
  SiRNA target sequence
tatgactttatcatttttatctagtac

SEQ ID NO: 116649 - DNA, 27 bp, Artificial sequence
  SiRNA target sequence
atgactttatcatttttatctagtacc

SEQ ID NO: 116650 - DNA, 27 bp, Artificial sequence
  SiRNA target sequence
tgactttatcatttttatctagtacct

SEQ ID NO: 116651 - DNA, 27 bp, Artificial sequence
  SiRNA target sequence
gactttatcatttttatctagtacctt

SEQ ID NO: 116652 - DNA, 27 bp, Artificial sequence
  SiRNA target sequence
actttatcatttttatctagtaccttt

SEQ ID NO: 116653 - DNA, 27 bp, Artificial sequence
  SiRNA target sequence
ctttatcatttttatctagtacctttt

SEQ ID NO: 116654 - DNA, 27 bp, Artificial sequence
  SiRNA target sequence
tttatcatttttatctagtaccttttg

SEQ ID NO: 116655 - DNA, 27 bp, Artificial sequence
  SiRNA target sequence
ttatcatttttatctagtaccttttgt

SEQ ID NO: 116656 - DNA, 27 bp, Artificial sequence
  SiRNA target sequence
tatcatttttatctagtaccttttgta

SEQ ID NO: 116657 - DNA, 27 bp, Artificial sequence
  SiRNA target sequence
atcatttttatctagtaccttttgtaa

SEQ ID NO: 116658 - DNA, 27 bp, Artificial sequence
  SiRNA target sequence
tcatttttatctagtaccttttgtaaa

SEQ ID NO: 116659 - DNA, 27 bp, Artificial sequence
  SiRNA target sequence
catttttatctagtaccttttgtaaac

SEQ ID NO: 116660 - DNA, 27 bp, Artificial sequence
  SiRNA target sequence
atttttatctagtaccttttgtaaact

SEQ ID NO: 116661 - DNA, 27 bp, Artificial sequence
  SiRNA target sequence
tttttatctagtaccttttgtaaactc

SEQ ID NO: 116662 - DNA, 27 bp, Artificial sequence
  SiRNA target sequence
ttttatctagtaccttttgtaaactca

SEQ ID NO: 116663 - DNA, 27 bp, Artificial sequence
  SiRNA target sequence
tttatctagtaccttttgtaaactcat

SEQ ID NO: 116664 - DNA, 27 bp, Artificial sequence
  SiRNA target sequence
ttatctagtaccttttgtaaactcata

SEQ ID NO: 116665 - DNA, 27 bp, Artificial sequence
  SiRNA target sequence
tatctagtaccttttgtaaactcatat

SEQ ID NO: 116666 - DNA, 27 bp, Artificial sequence
  SiRNA target sequence
atctagtaccttttgtaaactcatata

SEQ ID NO: 116667 - DNA, 27 bp, Artificial sequence
  SiRNA target sequence
tctagtaccttttgtaaactcatataa

SEQ ID NO: 116668 - DNA, 27 bp, Artificial sequence
  SiRNA target sequence
ctagtaccttttgtaaactcatataaa

SEQ ID NO: 116669 - DNA, 27 bp, Artificial sequence
  SiRNA target sequence
tagtaccttttgtaaactcatataaat

SEQ ID NO: 116670 - DNA, 27 bp, Artificial sequence
  SiRNA target sequence
agtaccttttgtaaactcatataaatg

SEQ ID NO: 116671 - DNA, 27 bp, Artificial sequence
  SiRNA target sequence
gtaccttttgtaaactcatataaatgt

SEQ ID NO: 116672 - DNA, 27 bp, Artificial sequence
  SiRNA target sequence
taccttttgtaaactcatataaatgtt

SEQ ID NO: 116673 - DNA, 27 bp, Artificial sequence
  SiRNA target sequence
accttttgtaaactcatataaatgttt

SEQ ID NO: 116674 - DNA, 27 bp, Artificial sequence
  SiRNA target sequence
ccttttgtaaactcatataaatgtttt

SEQ ID NO: 116675 - DNA, 27 bp, Artificial sequence
  SiRNA target sequence
cttttgtaaactcatataaatgttttc

SEQ ID NO: 116676 - DNA, 27 bp, Artificial sequence
  SiRNA target sequence
ttttgtaaactcatataaatgttttcc

SEQ ID NO: 116677 - DNA, 27 bp, Artificial sequence
  SiRNA target sequence
tttgtaaactcatataaatgttttcct

SEQ ID NO: 116678 - DNA, 27 bp, Artificial sequence
  SiRNA target sequence
ttgtaaactcatataaatgttttcctg

SEQ ID NO: 116679 - DNA, 27 bp, Artificial sequence
  SiRNA target sequence
tgtaaactcatataaatgttttcctgt

SEQ ID NO: 116680 - DNA, 27 bp, Artificial sequence
  SiRNA target sequence
gtaaactcatataaatgttttcctgtc

SEQ ID NO: 116681 - DNA, 27 bp, Artificial sequence
  SiRNA target sequence
taaactcatataaatgttttcctgtcc

SEQ ID NO: 116682 - DNA, 27 bp, Artificial sequence
  SiRNA target sequence
aaactcatataaatgttttcctgtcct

SEQ ID NO: 116683 - DNA, 27 bp, Artificial sequence
  SiRNA target sequence
aactcatataaatgttttcctgtccta

SEQ ID NO: 116684 - DNA, 27 bp, Artificial sequence
  SiRNA target sequence
actcatataaatgttttcctgtcctat

SEQ ID NO: 116685 - DNA, 27 bp, Artificial sequence
  SiRNA target sequence
ctcatataaatgttttcctgtcctatt

SEQ ID NO: 116686 - DNA, 27 bp, Artificial sequence
  SiRNA target sequence
tcatataaatgttttcctgtcctatta

SEQ ID NO: 116687 - DNA, 27 bp, Artificial sequence
  SiRNA target sequence
catataaatgttttcctgtcctattac

SEQ ID NO: 116688 - DNA, 27 bp, Artificial sequence
  SiRNA target sequence
atataaatgttttcctgtcctattact

SEQ ID NO: 116689 - DNA, 27 bp, Artificial sequence
  SiRNA target sequence
tataaatgttttcctgtcctattacta

SEQ ID NO: 116690 - DNA, 27 bp, Artificial sequence
  SiRNA target sequence
ataaatgttttcctgtcctattactaa

SEQ ID NO: 116691 - DNA, 27 bp, Artificial sequence
  SiRNA target sequence
taaatgttttcctgtcctattactaaa

SEQ ID NO: 116692 - DNA, 27 bp, Artificial sequence
  SiRNA target sequence
aaatgttttcctgtcctattactaaat

SEQ ID NO: 116693 - DNA, 27 bp, Artificial sequence
  SiRNA target sequence
aatgttttcctgtcctattactaaatg

SEQ ID NO: 116694 - DNA, 27 bp, Artificial sequence
  SiRNA target sequence
atgttttcctgtcctattactaaatga

SEQ ID NO: 116695 - DNA, 27 bp, Artificial sequence
  SiRNA target sequence
tgttttcctgtcctattactaaatgac

SEQ ID NO: 116696 - DNA, 27 bp, Artificial sequence
  SiRNA target sequence
gttttcctgtcctattactaaatgaca

SEQ ID NO: 116697 - DNA, 27 bp, Artificial sequence
  SiRNA target sequence
ttttcctgtcctattactaaatgacag

SEQ ID NO: 116698 - DNA, 27 bp, Artificial sequence
  SiRNA target sequence
tttcctgtcctattactaaatgacaga

SEQ ID NO: 116699 - DNA, 27 bp, Artificial sequence
  SiRNA target sequence
ttcctgtcctattactaaatgacagaa

SEQ ID NO: 116700 - DNA, 27 bp, Artificial sequence
  SiRNA target sequence
tcctgtcctattactaaatgacagaag

SEQ ID NO: 116701 - DNA, 27 bp, Artificial sequence
  SiRNA target sequence
cctgtcctattactaaatgacagaagc

SEQ ID NO: 116702 - DNA, 27 bp, Artificial sequence
  SiRNA target sequence
ctgtcctattactaaatgacagaagcc

SEQ ID NO: 116703 - DNA, 27 bp, Artificial sequence
  SiRNA target sequence
tgtcctattactaaatgacagaagcct

SEQ ID NO: 116704 - DNA, 27 bp, Artificial sequence
  SiRNA target sequence
gtcctattactaaatgacagaagcctc

SEQ ID NO: 116705 - DNA, 27 bp, Artificial sequence
  SiRNA target sequence
tcctattactaaatgacagaagcctct

SEQ ID NO: 116706 - DNA, 27 bp, Artificial sequence
  SiRNA target sequence
cctattactaaatgacagaagcctctt

SEQ ID NO: 116707 - DNA, 27 bp, Artificial sequence
  SiRNA target sequence
ctattactaaatgacagaagcctctta

SEQ ID NO: 116708 - DNA, 27 bp, Artificial sequence
  SiRNA target sequence
tattactaaatgacagaagcctcttat

SEQ ID NO: 116709 - DNA, 27 bp, Artificial sequence
  SiRNA target sequence
attactaaatgacagaagcctcttata

SEQ ID NO: 116710 - DNA, 27 bp, Artificial sequence
  SiRNA target sequence
ttactaaatgacagaagcctcttatat

SEQ ID NO: 116711 - DNA, 27 bp, Artificial sequence
  SiRNA target sequence
tactaaatgacagaagcctcttatatt

SEQ ID NO: 116712 - DNA, 27 bp, Artificial sequence
  SiRNA target sequence
actaaatgacagaagcctcttatattt

SEQ ID NO: 116713 - DNA, 27 bp, Artificial sequence
  SiRNA target sequence
ctaaatgacagaagcctcttatatttc

SEQ ID NO: 116714 - DNA, 27 bp, Artificial sequence
  SiRNA target sequence
taaatgacagaagcctcttatatttcc

SEQ ID NO: 116715 - DNA, 27 bp, Artificial sequence
  SiRNA target sequence
aaatgacagaagcctcttatatttcct

SEQ ID NO: 116716 - DNA, 27 bp, Artificial sequence
  SiRNA target sequence
aatgacagaagcctcttatatttcctt

SEQ ID NO: 116717 - DNA, 27 bp, Artificial sequence
  SiRNA target sequence
atgacagaagcctcttatatttccttt

SEQ ID NO: 116718 - DNA, 27 bp, Artificial sequence
  SiRNA target sequence
tgacagaagcctcttatatttcctttt

SEQ ID NO: 116719 - DNA, 27 bp, Artificial sequence
  SiRNA target sequence
gacagaagcctcttatatttccttttt

SEQ ID NO: 116720 - DNA, 27 bp, Artificial sequence
  SiRNA target sequence
acagaagcctcttatatttcctttttt

SEQ ID NO: 116721 - DNA, 27 bp, Artificial sequence
  SiRNA target sequence
cagaagcctcttatatttcctttttta

SEQ ID NO: 116722 - DNA, 27 bp, Artificial sequence
  SiRNA target sequence
agaagcctcttatatttccttttttat

SEQ ID NO: 116723 - DNA, 27 bp, Artificial sequence
  SiRNA target sequence
gaagcctcttatatttccttttttata

SEQ ID NO: 116724 - DNA, 27 bp, Artificial sequence
  SiRNA target sequence
aagcctcttatatttccttttttatac

SEQ ID NO: 116725 - DNA, 27 bp, Artificial sequence
  SiRNA target sequence
agcctcttatatttccttttttatact

SEQ ID NO: 116726 - DNA, 27 bp, Artificial sequence
  SiRNA target sequence
gcctcttatatttccttttttatactt

SEQ ID NO: 116727 - DNA, 27 bp, Artificial sequence
  SiRNA target sequence
cctcttatatttccttttttatactta

SEQ ID NO: 116728 - DNA, 27 bp, Artificial sequence
  SiRNA target sequence
ctcttatatttccttttttatacttag

SEQ ID NO: 116729 - DNA, 27 bp, Artificial sequence
  SiRNA target sequence
tcttatatttccttttttatacttaga

SEQ ID NO: 116730 - DNA, 27 bp, Artificial sequence
  SiRNA target sequence
cttatatttccttttttatacttagag

SEQ ID NO: 116731 - DNA, 27 bp, Artificial sequence
  SiRNA target sequence
ttatatttccttttttatacttagagt

SEQ ID NO: 116732 - DNA, 27 bp, Artificial sequence
  SiRNA target sequence
tatatttccttttttatacttagagtt

SEQ ID NO: 116733 - DNA, 27 bp, Artificial sequence
  SiRNA target sequence
atatttccttttttatacttagagtta

SEQ ID NO: 116734 - DNA, 27 bp, Artificial sequence
  SiRNA target sequence
tatttccttttttatacttagagttag

SEQ ID NO: 116735 - DNA, 27 bp, Artificial sequence
  SiRNA target sequence
atttccttttttatacttagagttagc

SEQ ID NO: 116736 - DNA, 27 bp, Artificial sequence
  SiRNA target sequence
tttccttttttatacttagagttagca

SEQ ID NO: 116737 - DNA, 27 bp, Artificial sequence
  SiRNA target sequence
ttccttttttatacttagagttagcat

SEQ ID NO: 116738 - DNA, 27 bp, Artificial sequence
  SiRNA target sequence
tccttttttatacttagagttagcata

SEQ ID NO: 116739 - DNA, 27 bp, Artificial sequence
  SiRNA target sequence
ccttttttatacttagagttagcatat

SEQ ID NO: 116740 - DNA, 27 bp, Artificial sequence
  SiRNA target sequence
cttttttatacttagagttagcatatt

SEQ ID NO: 116741 - DNA, 27 bp, Artificial sequence
  SiRNA target sequence
ttttttatacttagagttagcatattc

SEQ ID NO: 116742 - DNA, 27 bp, Artificial sequence
  SiRNA target sequence
tttttatacttagagttagcatattct

SEQ ID NO: 116743 - DNA, 27 bp, Artificial sequence
  SiRNA target sequence
ttttatacttagagttagcatattctt

SEQ ID NO: 116744 - DNA, 27 bp, Artificial sequence
  SiRNA target sequence
tttatacttagagttagcatattcttc

SEQ ID NO: 116745 - DNA, 27 bp, Artificial sequence
  SiRNA target sequence
ttatacttagagttagcatattcttcg

SEQ ID NO: 116746 - DNA, 27 bp, Artificial sequence
  SiRNA target sequence
tatacttagagttagcatattcttcga

SEQ ID NO: 116747 - DNA, 27 bp, Artificial sequence
  SiRNA target sequence
atacttagagttagcatattcttcgat

SEQ ID NO: 116748 - DNA, 27 bp, Artificial sequence
  SiRNA target sequence
tacttagagttagcatattcttcgata

SEQ ID NO: 116749 - DNA, 27 bp, Artificial sequence
  SiRNA target sequence
acttagagttagcatattcttcgataa

SEQ ID NO: 116750 - DNA, 27 bp, Artificial sequence
  SiRNA target sequence
cttagagttagcatattcttcgataag

SEQ ID NO: 116751 - DNA, 27 bp, Artificial sequence
  SiRNA target sequence
ttagagttagcatattcttcgataaga

SEQ ID NO: 116752 - DNA, 27 bp, Artificial sequence
  SiRNA target sequence
tagagttagcatattcttcgataagac

SEQ ID NO: 116753 - DNA, 27 bp, Artificial sequence
  SiRNA target sequence
agagttagcatattcttcgataagacg

SEQ ID NO: 116754 - DNA, 27 bp, Artificial sequence
  SiRNA target sequence
gagttagcatattcttcgataagacgt

SEQ ID NO: 116755 - DNA, 27 bp, Artificial sequence
  SiRNA target sequence
agttagcatattcttcgataagacgta

SEQ ID NO: 116756 - DNA, 27 bp, Artificial sequence
  SiRNA target sequence
gttagcatattcttcgataagacgtag

SEQ ID NO: 116757 - DNA, 27 bp, Artificial sequence
  SiRNA target sequence
ttagcatattcttcgataagacgtaga

SEQ ID NO: 116758 - DNA, 27 bp, Artificial sequence
  SiRNA target sequence
tagcatattcttcgataagacgtagaa

SEQ ID NO: 116759 - DNA, 27 bp, Artificial sequence
  SiRNA target sequence
agcatattcttcgataagacgtagaat

SEQ ID NO: 116760 - DNA, 27 bp, Artificial sequence
  SiRNA target sequence
gcatattcttcgataagacgtagaatt

SEQ ID NO: 116761 - DNA, 27 bp, Artificial sequence
  SiRNA target sequence
catattcttcgataagacgtagaatta

SEQ ID NO: 116762 - DNA, 27 bp, Artificial sequence
  SiRNA target sequence
atattcttcgataagacgtagaattaa

SEQ ID NO: 116763 - DNA, 27 bp, Artificial sequence
  SiRNA target sequence
tattcttcgataagacgtagaattaac

SEQ ID NO: 116764 - DNA, 27 bp, Artificial sequence
  SiRNA target sequence
attcttcgataagacgtagaattaaca

SEQ ID NO: 116765 - DNA, 27 bp, Artificial sequence
  SiRNA target sequence
ttcttcgataagacgtagaattaacat

SEQ ID NO: 116766 - DNA, 27 bp, Artificial sequence
  SiRNA target sequence
tcttcgataagacgtagaattaacata

SEQ ID NO: 116767 - DNA, 27 bp, Artificial sequence
  SiRNA target sequence
cttcgataagacgtagaattaacatat

SEQ ID NO: 116768 - DNA, 27 bp, Artificial sequence
  SiRNA target sequence
ttcgataagacgtagaattaacatatt

SEQ ID NO: 116769 - DNA, 27 bp, Artificial sequence
  SiRNA target sequence
tcgataagacgtagaattaacatattt

SEQ ID NO: 116770 - DNA, 27 bp, Artificial sequence
  SiRNA target sequence
cgataagacgtagaattaacatatttc

SEQ ID NO: 116771 - DNA, 27 bp, Artificial sequence
  SiRNA target sequence
gataagacgtagaattaacatatttct

SEQ ID NO: 116772 - DNA, 27 bp, Artificial sequence
  SiRNA target sequence
ataagacgtagaattaacatatttcta

SEQ ID NO: 116773 - DNA, 27 bp, Artificial sequence
  SiRNA target sequence
taagacgtagaattaacatatttctat

SEQ ID NO: 116774 - DNA, 27 bp, Artificial sequence
  SiRNA target sequence
aagacgtagaattaacatatttctata

SEQ ID NO: 116775 - DNA, 27 bp, Artificial sequence
  SiRNA target sequence
agacgtagaattaacatatttctataa

SEQ ID NO: 116776 - DNA, 27 bp, Artificial sequence
  SiRNA target sequence
gacgtagaattaacatatttctataaa

SEQ ID NO: 116777 - DNA, 27 bp, Artificial sequence
  SiRNA target sequence
acgtagaattaacatatttctataaac

SEQ ID NO: 116778 - DNA, 27 bp, Artificial sequence
  SiRNA target sequence
cgtagaattaacatatttctataaaca

SEQ ID NO: 116779 - DNA, 27 bp, Artificial sequence
  SiRNA target sequence
gtagaattaacatatttctataaacat

SEQ ID NO: 116780 - DNA, 27 bp, Artificial sequence
  SiRNA target sequence
tagaattaacatatttctataaacatc

SEQ ID NO: 116781 - DNA, 27 bp, Artificial sequence
  SiRNA target sequence
agaattaacatatttctataaacatct

SEQ ID NO: 116782 - DNA, 27 bp, Artificial sequence
  SiRNA target sequence
gaattaacatatttctataaacatctt

SEQ ID NO: 116783 - DNA, 27 bp, Artificial sequence
  SiRNA target sequence
aattaacatatttctataaacatcttg

SEQ ID NO: 116784 - DNA, 27 bp, Artificial sequence
  SiRNA target sequence
attaacatatttctataaacatcttgt

SEQ ID NO: 116785 - DNA, 27 bp, Artificial sequence
  SiRNA target sequence
ttaacatatttctataaacatcttgta

SEQ ID NO: 116786 - DNA, 27 bp, Artificial sequence
  SiRNA target sequence
taacatatttctataaacatcttgtac

SEQ ID NO: 116787 - DNA, 27 bp, Artificial sequence
  SiRNA target sequence
aacatatttctataaacatcttgtaca

SEQ ID NO: 116788 - DNA, 27 bp, Artificial sequence
  SiRNA target sequence
acatatttctataaacatcttgtacaa

SEQ ID NO: 116789 - DNA, 27 bp, Artificial sequence
  SiRNA target sequence
catatttctataaacatcttgtacaag

SEQ ID NO: 116790 - DNA, 27 bp, Artificial sequence
  SiRNA target sequence
atatttctataaacatcttgtacaagt

SEQ ID NO: 116791 - DNA, 27 bp, Artificial sequence
  SiRNA target sequence
tatttctataaacatcttgtacaagtt

SEQ ID NO: 116792 - DNA, 27 bp, Artificial sequence
  SiRNA target sequence
atttctataaacatcttgtacaagttc

SEQ ID NO: 116793 - DNA, 27 bp, Artificial sequence
  SiRNA target sequence
tttctataaacatcttgtacaagttct

SEQ ID NO: 116794 - DNA, 27 bp, Artificial sequence
  SiRNA target sequence
ttctataaacatcttgtacaagttctt

SEQ ID NO: 116795 - DNA, 27 bp, Artificial sequence
  SiRNA target sequence
tctataaacatcttgtacaagttcttt

SEQ ID NO: 116796 - DNA, 27 bp, Artificial sequence
  SiRNA target sequence
ctataaacatcttgtacaagttctttg

SEQ ID NO: 116797 - DNA, 27 bp, Artificial sequence
  SiRNA target sequence
tataaacatcttgtacaagttctttgt

SEQ ID NO: 116798 - DNA, 27 bp, Artificial sequence
  SiRNA target sequence
ataaacatcttgtacaagttctttgtt

SEQ ID NO: 116799 - DNA, 27 bp, Artificial sequence
  SiRNA target sequence
taaacatcttgtacaagttctttgttt

SEQ ID NO: 116800 - DNA, 27 bp, Artificial sequence
  SiRNA target sequence
aaacatcttgtacaagttctttgttta

SEQ ID NO: 116801 - DNA, 27 bp, Artificial sequence
  SiRNA target sequence
aacatcttgtacaagttctttgtttaa

SEQ ID NO: 116802 - DNA, 27 bp, Artificial sequence
  SiRNA target sequence
acatcttgtacaagttctttgtttaaa

SEQ ID NO: 116803 - DNA, 27 bp, Artificial sequence
  SiRNA target sequence
catcttgtacaagttctttgtttaaag

SEQ ID NO: 116804 - DNA, 27 bp, Artificial sequence
  SiRNA target sequence
atcttgtacaagttctttgtttaaagt

SEQ ID NO: 116805 - DNA, 27 bp, Artificial sequence
  SiRNA target sequence
tcttgtacaagttctttgtttaaagta

SEQ ID NO: 116806 - DNA, 27 bp, Artificial sequence
  SiRNA target sequence
cttgtacaagttctttgtttaaagtag

SEQ ID NO: 116807 - DNA, 27 bp, Artificial sequence
  SiRNA target sequence
ttgtacaagttctttgtttaaagtagt

SEQ ID NO: 116808 - DNA, 27 bp, Artificial sequence
  SiRNA target sequence
tgtacaagttctttgtttaaagtagtt

SEQ ID NO: 116809 - DNA, 27 bp, Artificial sequence
  SiRNA target sequence
gtacaagttctttgtttaaagtagttt

SEQ ID NO: 116810 - DNA, 27 bp, Artificial sequence
  SiRNA target sequence
tacaagttctttgtttaaagtagtttt

SEQ ID NO: 116811 - DNA, 27 bp, Artificial sequence
  SiRNA target sequence
acaagttctttgtttaaagtagttttc

SEQ ID NO: 116812 - DNA, 27 bp, Artificial sequence
  SiRNA target sequence
caagttctttgtttaaagtagttttca

SEQ ID NO: 116813 - DNA, 27 bp, Artificial sequence
  SiRNA target sequence
aagttctttgtttaaagtagttttcag

SEQ ID NO: 116814 - DNA, 27 bp, Artificial sequence
  SiRNA target sequence
agttctttgtttaaagtagttttcagt

SEQ ID NO: 116815 - DNA, 27 bp, Artificial sequence
  SiRNA target sequence
gttctttgtttaaagtagttttcagtt

SEQ ID NO: 116816 - DNA, 27 bp, Artificial sequence
  SiRNA target sequence
ttctttgtttaaagtagttttcagttt

SEQ ID NO: 116817 - DNA, 27 bp, Artificial sequence
  SiRNA target sequence
tctttgtttaaagtagttttcagttta

SEQ ID NO: 116818 - DNA, 27 bp, Artificial sequence
  SiRNA target sequence
ctttgtttaaagtagttttcagtttaa

SEQ ID NO: 116819 - DNA, 27 bp, Artificial sequence
  SiRNA target sequence
tttgtttaaagtagttttcagtttaac

SEQ ID NO: 116820 - DNA, 27 bp, Artificial sequence
  SiRNA target sequence
ttgtttaaagtagttttcagtttaact

SEQ ID NO: 116821 - DNA, 27 bp, Artificial sequence
  SiRNA target sequence
tgtttaaagtagttttcagtttaactg

SEQ ID NO: 116822 - DNA, 27 bp, Artificial sequence
  SiRNA target sequence
gtttaaagtagttttcagtttaactgt

SEQ ID NO: 116823 - DNA, 27 bp, Artificial sequence
  SiRNA target sequence
tttaaagtagttttcagtttaactgta

SEQ ID NO: 116824 - DNA, 27 bp, Artificial sequence
  SiRNA target sequence
ttaaagtagttttcagtttaactgtat

SEQ ID NO: 116825 - DNA, 27 bp, Artificial sequence
  SiRNA target sequence
taaagtagttttcagtttaactgtatt

SEQ ID NO: 116826 - DNA, 27 bp, Artificial sequence
  SiRNA target sequence
aaagtagttttcagtttaactgtattt

SEQ ID NO: 116827 - DNA, 27 bp, Artificial sequence
  SiRNA target sequence
aagtagttttcagtttaactgtatttt

SEQ ID NO: 116828 - DNA, 27 bp, Artificial sequence
  SiRNA target sequence
agtagttttcagtttaactgtattttt

SEQ ID NO: 116829 - DNA, 27 bp, Artificial sequence
  SiRNA target sequence
gtagttttcagtttaactgtattttta

SEQ ID NO: 116830 - DNA, 27 bp, Artificial sequence
  SiRNA target sequence
tagttttcagtttaactgtatttttat

SEQ ID NO: 116831 - DNA, 27 bp, Artificial sequence
  SiRNA target sequence
agttttcagtttaactgtatttttatc

SEQ ID NO: 116832 - DNA, 27 bp, Artificial sequence
  SiRNA target sequence
gttttcagtttaactgtatttttatct

SEQ ID NO: 116833 - DNA, 27 bp, Artificial sequence
  SiRNA target sequence
ttttcagtttaactgtatttttatcta

SEQ ID NO: 116834 - DNA, 27 bp, Artificial sequence
  SiRNA target sequence
tttcagtttaactgtatttttatctac

SEQ ID NO: 116835 - DNA, 27 bp, Artificial sequence
  SiRNA target sequence
ttcagtttaactgtatttttatctacc

SEQ ID NO: 116836 - DNA, 27 bp, Artificial sequence
  SiRNA target sequence
tcagtttaactgtatttttatctacca

SEQ ID NO: 116837 - DNA, 27 bp, Artificial sequence
  SiRNA target sequence
cagtttaactgtatttttatctaccaa

SEQ ID NO: 116838 - DNA, 27 bp, Artificial sequence
  SiRNA target sequence
agtttaactgtatttttatctaccaaa

SEQ ID NO: 116839 - DNA, 27 bp, Artificial sequence
  SiRNA target sequence
gtttaactgtatttttatctaccaaat

SEQ ID NO: 116840 - DNA, 27 bp, Artificial sequence
  SiRNA target sequence
tttaactgtatttttatctaccaaata

SEQ ID NO: 116841 - DNA, 27 bp, Artificial sequence
  SiRNA target sequence
ttaactgtatttttatctaccaaataa

SEQ ID NO: 116842 - DNA, 27 bp, Artificial sequence
  SiRNA target sequence
taactgtatttttatctaccaaataat

SEQ ID NO: 116843 - DNA, 27 bp, Artificial sequence
  SiRNA target sequence
aactgtatttttatctaccaaataata

SEQ ID NO: 116844 - DNA, 27 bp, Artificial sequence
  SiRNA target sequence
actgtatttttatctaccaaataataa

SEQ ID NO: 116845 - DNA, 27 bp, Artificial sequence
  SiRNA target sequence
ctgtatttttatctaccaaataataat

SEQ ID NO: 116846 - DNA, 27 bp, Artificial sequence
  SiRNA target sequence
tgtatttttatctaccaaataataatc

SEQ ID NO: 116847 - DNA, 27 bp, Artificial sequence
  SiRNA target sequence
gtatttttatctaccaaataataatct

SEQ ID NO: 116848 - DNA, 27 bp, Artificial sequence
  SiRNA target sequence
tatttttatctaccaaataataatcta

SEQ ID NO: 116849 - DNA, 27 bp, Artificial sequence
  SiRNA target sequence
atttttatctaccaaataataatctat

SEQ ID NO: 116850 - DNA, 27 bp, Artificial sequence
  SiRNA target sequence
tttttatctaccaaataataatctatc

SEQ ID NO: 116851 - DNA, 27 bp, Artificial sequence
  SiRNA target sequence
ttttatctaccaaataataatctatca

SEQ ID NO: 116852 - DNA, 27 bp, Artificial sequence
  SiRNA target sequence
tttatctaccaaataataatctatcat

SEQ ID NO: 116853 - DNA, 19 bp, Artificial sequence
  SiRNA target sequence
atgatagaaattcgcgatc

SEQ ID NO: 116854 - DNA, 19 bp, Artificial sequence
  SiRNA target sequence
tgatagaaattcgcgatct

SEQ ID NO: 116855 - DNA, 19 bp, Artificial sequence
  SiRNA target sequence
gatagaaattcgcgatctt

SEQ ID NO: 116856 - DNA, 19 bp, Artificial sequence
  SiRNA target sequence
atagaaattcgcgatctta

SEQ ID NO: 116857 - DNA, 19 bp, Artificial sequence
  SiRNA target sequence
tagaaattcgcgatcttat

SEQ ID NO: 116858 - DNA, 19 bp, Artificial sequence
  SiRNA target sequence
agaaattcgcgatcttata

SEQ ID NO: 116859 - DNA, 19 bp, Artificial sequence
  SiRNA target sequence
gaaattcgcgatcttataa

SEQ ID NO: 116860 - DNA, 19 bp, Artificial sequence
  SiRNA target sequence
aaattcgcgatcttataaa

SEQ ID NO: 116861 - DNA, 19 bp, Artificial sequence
  SiRNA target sequence
aattcgcgatcttataaat

SEQ ID NO: 116862 - DNA, 19 bp, Artificial sequence
  SiRNA target sequence
attcgcgatcttataaatc

SEQ ID NO: 116863 - DNA, 19 bp, Artificial sequence
  SiRNA target sequence
ttcgcgatcttataaatca

SEQ ID NO: 116864 - DNA, 19 bp, Artificial sequence
  SiRNA target sequence
tcgcgatcttataaatcaa

SEQ ID NO: 116865 - DNA, 19 bp, Artificial sequence
  SiRNA target sequence
cgcgatcttataaatcaag

SEQ ID NO: 116866 - DNA, 19 bp, Artificial sequence
  SiRNA target sequence
gcgatcttataaatcaagc

SEQ ID NO: 116867 - DNA, 19 bp, Artificial sequence
  SiRNA target sequence
cgatcttataaatcaagca

SEQ ID NO: 116868 - DNA, 19 bp, Artificial sequence
  SiRNA target sequence
gatcttataaatcaagcat

SEQ ID NO: 116869 - DNA, 19 bp, Artificial sequence
  SiRNA target sequence
atcttataaatcaagcatt

SEQ ID NO: 116870 - DNA, 19 bp, Artificial sequence
  SiRNA target sequence
tcttataaatcaagcattg

SEQ ID NO: 116871 - DNA, 19 bp, Artificial sequence
  SiRNA target sequence
cttataaatcaagcattgg

SEQ ID NO: 116872 - DNA, 19 bp, Artificial sequence
  SiRNA target sequence
ttataaatcaagcattgga

SEQ ID NO: 116873 - DNA, 19 bp, Artificial sequence
  SiRNA target sequence
tataaatcaagcattggat

SEQ ID NO: 116874 - DNA, 19 bp, Artificial sequence
  SiRNA target sequence
ataaatcaagcattggatg

SEQ ID NO: 116875 - DNA, 19 bp, Artificial sequence
  SiRNA target sequence
taaatcaagcattggatga

SEQ ID NO: 116876 - DNA, 19 bp, Artificial sequence
  SiRNA target sequence
aaatcaagcattggatgag

SEQ ID NO: 116877 - DNA, 19 bp, Artificial sequence
  SiRNA target sequence
aatcaagcattggatgagg

SEQ ID NO: 116878 - DNA, 19 bp, Artificial sequence
  SiRNA target sequence
atcaagcattggatgagga

SEQ ID NO: 116879 - DNA, 19 bp, Artificial sequence
  SiRNA target sequence
tcaagcattggatgaggaa

SEQ ID NO: 116880 - DNA, 19 bp, Artificial sequence
  SiRNA target sequence
caagcattggatgaggaaa

SEQ ID NO: 116881 - DNA, 19 bp, Artificial sequence
  SiRNA target sequence
aagcattggatgaggaaat

SEQ ID NO: 116882 - DNA, 19 bp, Artificial sequence
  SiRNA target sequence
agcattggatgaggaaatg

SEQ ID NO: 116883 - DNA, 19 bp, Artificial sequence
  SiRNA target sequence
gcattggatgaggaaatgg

SEQ ID NO: 116884 - DNA, 19 bp, Artificial sequence
  SiRNA target sequence
cattggatgaggaaatggg

SEQ ID NO: 116885 - DNA, 19 bp, Artificial sequence
  SiRNA target sequence
attggatgaggaaatggga

SEQ ID NO: 116886 - DNA, 19 bp, Artificial sequence
  SiRNA target sequence
ttggatgaggaaatgggaa

SEQ ID NO: 116887 - DNA, 19 bp, Artificial sequence
  SiRNA target sequence
tggatgaggaaatgggaat

SEQ ID NO: 116888 - DNA, 19 bp, Artificial sequence
  SiRNA target sequence
ggatgaggaaatgggaatg

SEQ ID NO: 116889 - DNA, 19 bp, Artificial sequence
  SiRNA target sequence
gatgaggaaatgggaatgg

SEQ ID NO: 116890 - DNA, 19 bp, Artificial sequence
  SiRNA target sequence
atgaggaaatgggaatgga

SEQ ID NO: 116891 - DNA, 19 bp, Artificial sequence
  SiRNA target sequence
tgaggaaatgggaatggat

SEQ ID NO: 116892 - DNA, 19 bp, Artificial sequence
  SiRNA target sequence
gaggaaatgggaatggatc

SEQ ID NO: 116893 - DNA, 19 bp, Artificial sequence
  SiRNA target sequence
aggaaatgggaatggatca

SEQ ID NO: 116894 - DNA, 19 bp, Artificial sequence
  SiRNA target sequence
ggaaatgggaatggatcat

SEQ ID NO: 116895 - DNA, 19 bp, Artificial sequence
  SiRNA target sequence
gaaatgggaatggatcata

SEQ ID NO: 116896 - DNA, 19 bp, Artificial sequence
  SiRNA target sequence
aaatgggaatggatcataa

SEQ ID NO: 116897 - DNA, 19 bp, Artificial sequence
  SiRNA target sequence
aatgggaatggatcataat

SEQ ID NO: 116898 - DNA, 19 bp, Artificial sequence
  SiRNA target sequence
atgggaatggatcataatg

SEQ ID NO: 116899 - DNA, 19 bp, Artificial sequence
  SiRNA target sequence
tgggaatggatcataatgt

SEQ ID NO: 116900 - DNA, 19 bp, Artificial sequence
  SiRNA target sequence
gggaatggatcataatgta

SEQ ID NO: 116901 - DNA, 19 bp, Artificial sequence
  SiRNA target sequence
ggaatggatcataatgtat

SEQ ID NO: 116902 - DNA, 19 bp, Artificial sequence
  SiRNA target sequence
gaatggatcataatgtata

SEQ ID NO: 116903 - DNA, 19 bp, Artificial sequence
  SiRNA target sequence
aatggatcataatgtatat

SEQ ID NO: 116904 - DNA, 19 bp, Artificial sequence
  SiRNA target sequence
atggatcataatgtatata

SEQ ID NO: 116905 - DNA, 19 bp, Artificial sequence
  SiRNA target sequence
tggatcataatgtatatat

SEQ ID NO: 116906 - DNA, 19 bp, Artificial sequence
  SiRNA target sequence
ggatcataatgtatatata

SEQ ID NO: 116907 - DNA, 19 bp, Artificial sequence
  SiRNA target sequence
gatcataatgtatatataa

SEQ ID NO: 116908 - DNA, 19 bp, Artificial sequence
  SiRNA target sequence
atcataatgtatatataat

SEQ ID NO: 116909 - DNA, 19 bp, Artificial sequence
  SiRNA target sequence
tcataatgtatatataata

SEQ ID NO: 116910 - DNA, 19 bp, Artificial sequence
  SiRNA target sequence
cataatgtatatataatag

SEQ ID NO: 116911 - DNA, 19 bp, Artificial sequence
  SiRNA target sequence
ataatgtatatataatagg

SEQ ID NO: 116912 - DNA, 19 bp, Artificial sequence
  SiRNA target sequence
taatgtatatataatagga

SEQ ID NO: 116913 - DNA, 19 bp, Artificial sequence
  SiRNA target sequence
aatgtatatataataggag

SEQ ID NO: 116914 - DNA, 19 bp, Artificial sequence
  SiRNA target sequence
atgtatatataataggaga

SEQ ID NO: 116915 - DNA, 19 bp, Artificial sequence
  SiRNA target sequence
tgtatatataataggagaa

SEQ ID NO: 116916 - DNA, 19 bp, Artificial sequence
  SiRNA target sequence
gtatatataataggagaag

SEQ ID NO: 116917 - DNA, 19 bp, Artificial sequence
  SiRNA target sequence
tatatataataggagaaga

SEQ ID NO: 116918 - DNA, 19 bp, Artificial sequence
  SiRNA target sequence
atatataataggagaagaa

SEQ ID NO: 116919 - DNA, 19 bp, Artificial sequence
  SiRNA target sequence
tatataataggagaagaag

SEQ ID NO: 116920 - DNA, 19 bp, Artificial sequence
  SiRNA target sequence
atataataggagaagaagt

SEQ ID NO: 116921 - DNA, 19 bp, Artificial sequence
  SiRNA target sequence
tataataggagaagaagta

SEQ ID NO: 116922 - DNA, 19 bp, Artificial sequence
  SiRNA target sequence
ataataggagaagaagtag

SEQ ID NO: 116923 - DNA, 19 bp, Artificial sequence
  SiRNA target sequence
taataggagaagaagtagg

SEQ ID NO: 116924 - DNA, 19 bp, Artificial sequence
  SiRNA target sequence
aataggagaagaagtaggc

SEQ ID NO: 116925 - DNA, 19 bp, Artificial sequence
  SiRNA target sequence
ataggagaagaagtaggca

SEQ ID NO: 116926 - DNA, 19 bp, Artificial sequence
  SiRNA target sequence
taggagaagaagtaggcat

SEQ ID NO: 116927 - DNA, 19 bp, Artificial sequence
  SiRNA target sequence
aggagaagaagtaggcatc

SEQ ID NO: 116928 - DNA, 19 bp, Artificial sequence
  SiRNA target sequence
ggagaagaagtaggcatct

SEQ ID NO: 116929 - DNA, 19 bp, Artificial sequence
  SiRNA target sequence
gagaagaagtaggcatctc

SEQ ID NO: 116930 - DNA, 19 bp, Artificial sequence
  SiRNA target sequence
agaagaagtaggcatctct

SEQ ID NO: 116931 - DNA, 19 bp, Artificial sequence
  SiRNA target sequence
gaagaagtaggcatctctg

SEQ ID NO: 116932 - DNA, 19 bp, Artificial sequence
  SiRNA target sequence
aagaagtaggcatctctgg

SEQ ID NO: 116933 - DNA, 19 bp, Artificial sequence
  SiRNA target sequence
agaagtaggcatctctggt

SEQ ID NO: 116934 - DNA, 19 bp, Artificial sequence
  SiRNA target sequence
gaagtaggcatctctggtg

SEQ ID NO: 116935 - DNA, 19 bp, Artificial sequence
  SiRNA target sequence
aagtaggcatctctggtgg

SEQ ID NO: 116936 - DNA, 19 bp, Artificial sequence
  SiRNA target sequence
agtaggcatctctggtggt

SEQ ID NO: 116937 - DNA, 19 bp, Artificial sequence
  SiRNA target sequence
gtaggcatctctggtggtc

SEQ ID NO: 116938 - DNA, 19 bp, Artificial sequence
  SiRNA target sequence
taggcatctctggtggtcc

SEQ ID NO: 116939 - DNA, 19 bp, Artificial sequence
  SiRNA target sequence
aggcatctctggtggtcct

SEQ ID NO: 116940 - DNA, 19 bp, Artificial sequence
  SiRNA target sequence
ggcatctctggtggtcctc

SEQ ID NO: 116941 - DNA, 19 bp, Artificial sequence
  SiRNA target sequence
gcatctctggtggtcctca

SEQ ID NO: 116942 - DNA, 19 bp, Artificial sequence
  SiRNA target sequence
catctctggtggtcctcac

SEQ ID NO: 116943 - DNA, 19 bp, Artificial sequence
  SiRNA target sequence
atctctggtggtcctcacg

SEQ ID NO: 116944 - DNA, 19 bp, Artificial sequence
  SiRNA target sequence
tctctggtggtcctcacgg

SEQ ID NO: 116945 - DNA, 19 bp, Artificial sequence
  SiRNA target sequence
ctctggtggtcctcacggt

SEQ ID NO: 116946 - DNA, 19 bp, Artificial sequence
  SiRNA target sequence
tctggtggtcctcacggtc

SEQ ID NO: 116947 - DNA, 19 bp, Artificial sequence
  SiRNA target sequence
ctggtggtcctcacggtct

SEQ ID NO: 116948 - DNA, 19 bp, Artificial sequence
  SiRNA target sequence
tggtggtcctcacggtctt

SEQ ID NO: 116949 - DNA, 19 bp, Artificial sequence
  SiRNA target sequence
ggtggtcctcacggtctta

SEQ ID NO: 116950 - DNA, 19 bp, Artificial sequence
  SiRNA target sequence
gtggtcctcacggtcttac

SEQ ID NO: 116951 - DNA, 19 bp, Artificial sequence
  SiRNA target sequence
tggtcctcacggtcttact

SEQ ID NO: 116952 - DNA, 19 bp, Artificial sequence
  SiRNA target sequence
ggtcctcacggtcttacta

SEQ ID NO: 116953 - DNA, 19 bp, Artificial sequence
  SiRNA target sequence
gtcctcacggtcttactaa

SEQ ID NO: 116954 - DNA, 19 bp, Artificial sequence
  SiRNA target sequence
tcctcacggtcttactaaa

SEQ ID NO: 116955 - DNA, 19 bp, Artificial sequence
  SiRNA target sequence
cctcacggtcttactaaaa

SEQ ID NO: 116956 - DNA, 19 bp, Artificial sequence
  SiRNA target sequence
ctcacggtcttactaaaaa

SEQ ID NO: 116957 - DNA, 19 bp, Artificial sequence
  SiRNA target sequence
tcacggtcttactaaaaat

SEQ ID NO: 116958 - DNA, 19 bp, Artificial sequence
  SiRNA target sequence
cacggtcttactaaaaatt

SEQ ID NO: 116959 - DNA, 19 bp, Artificial sequence
  SiRNA target sequence
acggtcttactaaaaattt

SEQ ID NO: 116960 - DNA, 19 bp, Artificial sequence
  SiRNA target sequence
cggtcttactaaaaatttg

SEQ ID NO: 116961 - DNA, 19 bp, Artificial sequence
  SiRNA target sequence
ggtcttactaaaaatttga

SEQ ID NO: 116962 - DNA, 19 bp, Artificial sequence
  SiRNA target sequence
gtcttactaaaaatttgat

SEQ ID NO: 116963 - DNA, 19 bp, Artificial sequence
  SiRNA target sequence
tcttactaaaaatttgatc

SEQ ID NO: 116964 - DNA, 19 bp, Artificial sequence
  SiRNA target sequence
cttactaaaaatttgatca

SEQ ID NO: 116965 - DNA, 19 bp, Artificial sequence
  SiRNA target sequence
ttactaaaaatttgatcaa

SEQ ID NO: 116966 - DNA, 19 bp, Artificial sequence
  SiRNA target sequence
tactaaaaatttgatcaaa

SEQ ID NO: 116967 - DNA, 19 bp, Artificial sequence
  SiRNA target sequence
actaaaaatttgatcaaaa

SEQ ID NO: 116968 - DNA, 19 bp, Artificial sequence
  SiRNA target sequence
ctaaaaatttgatcaaaaa

SEQ ID NO: 116969 - DNA, 19 bp, Artificial sequence
  SiRNA target sequence
taaaaatttgatcaaaaaa

SEQ ID NO: 116970 - DNA, 19 bp, Artificial sequence
  SiRNA target sequence
aaaaatttgatcaaaaaat

SEQ ID NO: 116971 - DNA, 19 bp, Artificial sequence
  SiRNA target sequence
aaaatttgatcaaaaaata

SEQ ID NO: 116972 - DNA, 19 bp, Artificial sequence
  SiRNA target sequence
aaatttgatcaaaaaatac

SEQ ID NO: 116973 - DNA, 19 bp, Artificial sequence
  SiRNA target sequence
aatttgatcaaaaaatacg

SEQ ID NO: 116974 - DNA, 19 bp, Artificial sequence
  SiRNA target sequence
atttgatcaaaaaatacgg

SEQ ID NO: 116975 - DNA, 19 bp, Artificial sequence
  SiRNA target sequence
tttgatcaaaaaatacggc

SEQ ID NO: 116976 - DNA, 19 bp, Artificial sequence
  SiRNA target sequence
ttgatcaaaaaatacggcg

SEQ ID NO: 116977 - DNA, 19 bp, Artificial sequence
  SiRNA target sequence
tgatcaaaaaatacggcga

SEQ ID NO: 116978 - DNA, 19 bp, Artificial sequence
  SiRNA target sequence
gatcaaaaaatacggcgat

SEQ ID NO: 116979 - DNA, 19 bp, Artificial sequence
  SiRNA target sequence
atcaaaaaatacggcgatc

SEQ ID NO: 116980 - DNA, 19 bp, Artificial sequence
  SiRNA target sequence
tcaaaaaatacggcgatca

SEQ ID NO: 116981 - DNA, 19 bp, Artificial sequence
  SiRNA target sequence
caaaaaatacggcgatcaa

SEQ ID NO: 116982 - DNA, 19 bp, Artificial sequence
  SiRNA target sequence
aaaaaatacggcgatcaaa

SEQ ID NO: 116983 - DNA, 19 bp, Artificial sequence
  SiRNA target sequence
aaaaatacggcgatcaaag

SEQ ID NO: 116984 - DNA, 19 bp, Artificial sequence
  SiRNA target sequence
aaaatacggcgatcaaaga

SEQ ID NO: 116985 - DNA, 19 bp, Artificial sequence
  SiRNA target sequence
aaatacggcgatcaaagag

SEQ ID NO: 116986 - DNA, 19 bp, Artificial sequence
  SiRNA target sequence
aatacggcgatcaaagagt

SEQ ID NO: 116987 - DNA, 19 bp, Artificial sequence
  SiRNA target sequence
atacggcgatcaaagagtg

SEQ ID NO: 116988 - DNA, 19 bp, Artificial sequence
  SiRNA target sequence
tacggcgatcaaagagtga

SEQ ID NO: 116989 - DNA, 19 bp, Artificial sequence
  SiRNA target sequence
acggcgatcaaagagtgaa

SEQ ID NO: 116990 - DNA, 19 bp, Artificial sequence
  SiRNA target sequence
cggcgatcaaagagtgaag

SEQ ID NO: 116991 - DNA, 19 bp, Artificial sequence
  SiRNA target sequence
ggcgatcaaagagtgaagg

SEQ ID NO: 116992 - DNA, 19 bp, Artificial sequence
  SiRNA target sequence
gcgatcaaagagtgaagga

SEQ ID NO: 116993 - DNA, 19 bp, Artificial sequence
  SiRNA target sequence
cgatcaaagagtgaaggat

SEQ ID NO: 116994 - DNA, 19 bp, Artificial sequence
  SiRNA target sequence
gatcaaagagtgaaggata

SEQ ID NO: 116995 - DNA, 19 bp, Artificial sequence
  SiRNA target sequence
atcaaagagtgaaggatac

SEQ ID NO: 116996 - DNA, 19 bp, Artificial sequence
  SiRNA target sequence
tcaaagagtgaaggatacc

SEQ ID NO: 116997 - DNA, 19 bp, Artificial sequence
  SiRNA target sequence
caaagagtgaaggataccc

SEQ ID NO: 116998 - DNA, 19 bp, Artificial sequence
  SiRNA target sequence
aaagagtgaaggatacccc

SEQ ID NO: 116999 - DNA, 19 bp, Artificial sequence
  SiRNA target sequence
aagagtgaaggatacccct

SEQ ID NO: 117000 - DNA, 19 bp, Artificial sequence
  SiRNA target sequence
agagtgaaggataccccta

SEQ ID NO: 117001 - DNA, 19 bp, Artificial sequence
  SiRNA target sequence
gagtgaaggatacccctat

SEQ ID NO: 117002 - DNA, 19 bp, Artificial sequence
  SiRNA target sequence
agtgaaggatacccctatt

SEQ ID NO: 117003 - DNA, 19 bp, Artificial sequence
  SiRNA target sequence
gtgaaggatacccctattt

SEQ ID NO: 117004 - DNA, 19 bp, Artificial sequence
  SiRNA target sequence
tgaaggatacccctatttc

SEQ ID NO: 117005 - DNA, 19 bp, Artificial sequence
  SiRNA target sequence
gaaggatacccctatttcg

SEQ ID NO: 117006 - DNA, 19 bp, Artificial sequence
  SiRNA target sequence
aaggatacccctatttcgg

SEQ ID NO: 117007 - DNA, 19 bp, Artificial sequence
  SiRNA target sequence
aggatacccctatttcgga

SEQ ID NO: 117008 - DNA, 19 bp, Artificial sequence
  SiRNA target sequence
ggatacccctatttcggaa

SEQ ID NO: 117009 - DNA, 19 bp, Artificial sequence
  SiRNA target sequence
gatacccctatttcggaaa

SEQ ID NO: 117010 - DNA, 19 bp, Artificial sequence
  SiRNA target sequence
atacccctatttcggaaat

SEQ ID NO: 117011 - DNA, 19 bp, Artificial sequence
  SiRNA target sequence
tacccctatttcggaaatg

SEQ ID NO: 117012 - DNA, 19 bp, Artificial sequence
  SiRNA target sequence
acccctatttcggaaatgg

SEQ ID NO: 117013 - DNA, 19 bp, Artificial sequence
  SiRNA target sequence
cccctatttcggaaatggg

SEQ ID NO: 117014 - DNA, 19 bp, Artificial sequence
  SiRNA target sequence
ccctatttcggaaatggga

SEQ ID NO: 117015 - DNA, 19 bp, Artificial sequence
  SiRNA target sequence
cctatttcggaaatgggat

SEQ ID NO: 117016 - DNA, 19 bp, Artificial sequence
  SiRNA target sequence
ctatttcggaaatgggatt

SEQ ID NO: 117017 - DNA, 19 bp, Artificial sequence
  SiRNA target sequence
tatttcggaaatgggattt

SEQ ID NO: 117018 - DNA, 19 bp, Artificial sequence
  SiRNA target sequence
atttcggaaatgggattta

SEQ ID NO: 117019 - DNA, 19 bp, Artificial sequence
  SiRNA target sequence
tttcggaaatgggatttac

SEQ ID NO: 117020 - DNA, 19 bp, Artificial sequence
  SiRNA target sequence
ttcggaaatgggatttaca

SEQ ID NO: 117021 - DNA, 19 bp, Artificial sequence
  SiRNA target sequence
tcggaaatgggatttacag

SEQ ID NO: 117022 - DNA, 19 bp, Artificial sequence
  SiRNA target sequence
cggaaatgggatttacagg

SEQ ID NO: 117023 - DNA, 19 bp, Artificial sequence
  SiRNA target sequence
ggaaatgggatttacaggt

SEQ ID NO: 117024 - DNA, 19 bp, Artificial sequence
  SiRNA target sequence
gaaatgggatttacaggtc

SEQ ID NO: 117025 - DNA, 19 bp, Artificial sequence
  SiRNA target sequence
aaatgggatttacaggtct

SEQ ID NO: 117026 - DNA, 19 bp, Artificial sequence
  SiRNA target sequence
aatgggatttacaggtctc

SEQ ID NO: 117027 - DNA, 19 bp, Artificial sequence
  SiRNA target sequence
atgggatttacaggtctcg

SEQ ID NO: 117028 - DNA, 19 bp, Artificial sequence
  SiRNA target sequence
tgggatttacaggtctcgc

SEQ ID NO: 117029 - DNA, 19 bp, Artificial sequence
  SiRNA target sequence
gggatttacaggtctcgct

SEQ ID NO: 117030 - DNA, 19 bp, Artificial sequence
  SiRNA target sequence
ggatttacaggtctcgctg

SEQ ID NO: 117031 - DNA, 19 bp, Artificial sequence
  SiRNA target sequence
gatttacaggtctcgctgt

SEQ ID NO: 117032 - DNA, 19 bp, Artificial sequence
  SiRNA target sequence
atttacaggtctcgctgtg

SEQ ID NO: 117033 - DNA, 19 bp, Artificial sequence
  SiRNA target sequence
tttacaggtctcgctgtgg

SEQ ID NO: 117034 - DNA, 19 bp, Artificial sequence
  SiRNA target sequence
ttacaggtctcgctgtggg

SEQ ID NO: 117035 - DNA, 19 bp, Artificial sequence
  SiRNA target sequence
tacaggtctcgctgtgggt

SEQ ID NO: 117036 - DNA, 19 bp, Artificial sequence
  SiRNA target sequence
acaggtctcgctgtgggtt

SEQ ID NO: 117037 - DNA, 19 bp, Artificial sequence
  SiRNA target sequence
caggtctcgctgtgggttc

SEQ ID NO: 117038 - DNA, 19 bp, Artificial sequence
  SiRNA target sequence
aggtctcgctgtgggttca

SEQ ID NO: 117039 - DNA, 19 bp, Artificial sequence
  SiRNA target sequence
ggtctcgctgtgggttcaa

SEQ ID NO: 117040 - DNA, 19 bp, Artificial sequence
  SiRNA target sequence
gtctcgctgtgggttcaag

SEQ ID NO: 117041 - DNA, 19 bp, Artificial sequence
  SiRNA target sequence
tctcgctgtgggttcaagc

SEQ ID NO: 117042 - DNA, 19 bp, Artificial sequence
  SiRNA target sequence
ctcgctgtgggttcaagct

SEQ ID NO: 117043 - DNA, 19 bp, Artificial sequence
  SiRNA target sequence
tcgctgtgggttcaagcta

SEQ ID NO: 117044 - DNA, 19 bp, Artificial sequence
  SiRNA target sequence
cgctgtgggttcaagctat

SEQ ID NO: 117045 - DNA, 19 bp, Artificial sequence
  SiRNA target sequence
gctgtgggttcaagctatt

SEQ ID NO: 117046 - DNA, 19 bp, Artificial sequence
  SiRNA target sequence
ctgtgggttcaagctattt

SEQ ID NO: 117047 - DNA, 19 bp, Artificial sequence
  SiRNA target sequence
tgtgggttcaagctattta

SEQ ID NO: 117048 - DNA, 19 bp, Artificial sequence
  SiRNA target sequence
gtgggttcaagctatttag

SEQ ID NO: 117049 - DNA, 19 bp, Artificial sequence
  SiRNA target sequence
tgggttcaagctatttagg

SEQ ID NO: 117050 - DNA, 19 bp, Artificial sequence
  SiRNA target sequence
gggttcaagctatttaggg

SEQ ID NO: 117051 - DNA, 19 bp, Artificial sequence
  SiRNA target sequence
ggttcaagctatttagggt

SEQ ID NO: 117052 - DNA, 19 bp, Artificial sequence
  SiRNA target sequence
gttcaagctatttagggtt

SEQ ID NO: 117053 - DNA, 19 bp, Artificial sequence
  SiRNA target sequence
ttcaagctatttagggtta

SEQ ID NO: 117054 - DNA, 19 bp, Artificial sequence
  SiRNA target sequence
tcaagctatttagggttaa

SEQ ID NO: 117055 - DNA, 19 bp, Artificial sequence
  SiRNA target sequence
caagctatttagggttaag

SEQ ID NO: 117056 - DNA, 19 bp, Artificial sequence
  SiRNA target sequence
aagctatttagggttaaga

SEQ ID NO: 117057 - DNA, 19 bp, Artificial sequence
  SiRNA target sequence
agctatttagggttaagac

SEQ ID NO: 117058 - DNA, 19 bp, Artificial sequence
  SiRNA target sequence
gctatttagggttaagacc

SEQ ID NO: 117059 - DNA, 19 bp, Artificial sequence
  SiRNA target sequence
ctatttagggttaagaccc

SEQ ID NO: 117060 - DNA, 19 bp, Artificial sequence
  SiRNA target sequence
tatttagggttaagacccg

SEQ ID NO: 117061 - DNA, 19 bp, Artificial sequence
  SiRNA target sequence
atttagggttaagacccgt

SEQ ID NO: 117062 - DNA, 19 bp, Artificial sequence
  SiRNA target sequence
tttagggttaagacccgta

SEQ ID NO: 117063 - DNA, 19 bp, Artificial sequence
  SiRNA target sequence
ttagggttaagacccgtag

SEQ ID NO: 117064 - DNA, 19 bp, Artificial sequence
  SiRNA target sequence
tagggttaagacccgtagt

SEQ ID NO: 117065 - DNA, 19 bp, Artificial sequence
  SiRNA target sequence
agggttaagacccgtagta

SEQ ID NO: 117066 - DNA, 19 bp, Artificial sequence
  SiRNA target sequence
gggttaagacccgtagtag

SEQ ID NO: 117067 - DNA, 19 bp, Artificial sequence
  SiRNA target sequence
ggttaagacccgtagtaga

SEQ ID NO: 117068 - DNA, 19 bp, Artificial sequence
  SiRNA target sequence
gttaagacccgtagtagat

SEQ ID NO: 117069 - DNA, 19 bp, Artificial sequence
  SiRNA target sequence
ttaagacccgtagtagatt

SEQ ID NO: 117070 - DNA, 19 bp, Artificial sequence
  SiRNA target sequence
taagacccgtagtagattt

SEQ ID NO: 117071 - DNA, 19 bp, Artificial sequence
  SiRNA target sequence
aagacccgtagtagatttt

SEQ ID NO: 117072 - DNA, 19 bp, Artificial sequence
  SiRNA target sequence
agacccgtagtagatttta

SEQ ID NO: 117073 - DNA, 19 bp, Artificial sequence
  SiRNA target sequence
gacccgtagtagattttat

SEQ ID NO: 117074 - DNA, 19 bp, Artificial sequence
  SiRNA target sequence
acccgtagtagattttatg

SEQ ID NO: 117075 - DNA, 19 bp, Artificial sequence
  SiRNA target sequence
cccgtagtagattttatga

SEQ ID NO: 117076 - DNA, 19 bp, Artificial sequence
  SiRNA target sequence
ccgtagtagattttatgac

SEQ ID NO: 117077 - DNA, 19 bp, Artificial sequence
  SiRNA target sequence
cgtagtagattttatgact

SEQ ID NO: 117078 - DNA, 19 bp, Artificial sequence
  SiRNA target sequence
gtagtagattttatgactt

SEQ ID NO: 117079 - DNA, 19 bp, Artificial sequence
  SiRNA target sequence
tagtagattttatgacttg

SEQ ID NO: 117080 - DNA, 19 bp, Artificial sequence
  SiRNA target sequence
agtagattttatgacttgg

SEQ ID NO: 117081 - DNA, 19 bp, Artificial sequence
  SiRNA target sequence
gtagattttatgacttgga

SEQ ID NO: 117082 - DNA, 19 bp, Artificial sequence
  SiRNA target sequence
tagattttatgacttggaa

SEQ ID NO: 117083 - DNA, 19 bp, Artificial sequence
  SiRNA target sequence
agattttatgacttggaat

SEQ ID NO: 117084 - DNA, 19 bp, Artificial sequence
  SiRNA target sequence
gattttatgacttggaatt

SEQ ID NO: 117085 - DNA, 19 bp, Artificial sequence
  SiRNA target sequence
attttatgacttggaattt

SEQ ID NO: 117086 - DNA, 19 bp, Artificial sequence
  SiRNA target sequence
ttttatgacttggaatttt

SEQ ID NO: 117087 - DNA, 19 bp, Artificial sequence
  SiRNA target sequence
tttatgacttggaattttg

SEQ ID NO: 117088 - DNA, 19 bp, Artificial sequence
  SiRNA target sequence
ttatgacttggaattttgc

SEQ ID NO: 117089 - DNA, 19 bp, Artificial sequence
  SiRNA target sequence
tatgacttggaattttgct

SEQ ID NO: 117090 - DNA, 19 bp, Artificial sequence
  SiRNA target sequence
atgacttggaattttgctt

SEQ ID NO: 117091 - DNA, 19 bp, Artificial sequence
  SiRNA target sequence
tgacttggaattttgcttt

SEQ ID NO: 117092 - DNA, 19 bp, Artificial sequence
  SiRNA target sequence
gacttggaattttgctttg

SEQ ID NO: 117093 - DNA, 19 bp, Artificial sequence
  SiRNA target sequence
acttggaattttgctttgc

SEQ ID NO: 117094 - DNA, 19 bp, Artificial sequence
  SiRNA target sequence
cttggaattttgctttgca

SEQ ID NO: 117095 - DNA, 19 bp, Artificial sequence
  SiRNA target sequence
ttggaattttgctttgcaa

SEQ ID NO: 117096 - DNA, 19 bp, Artificial sequence
  SiRNA target sequence
tggaattttgctttgcaat

SEQ ID NO: 117097 - DNA, 19 bp, Artificial sequence
  SiRNA target sequence
ggaattttgctttgcaatc

SEQ ID NO: 117098 - DNA, 19 bp, Artificial sequence
  SiRNA target sequence
gaattttgctttgcaatca

SEQ ID NO: 117099 - DNA, 19 bp, Artificial sequence
  SiRNA target sequence
aattttgctttgcaatcaa

SEQ ID NO: 117100 - DNA, 19 bp, Artificial sequence
  SiRNA target sequence
attttgctttgcaatcaat

SEQ ID NO: 117101 - DNA, 19 bp, Artificial sequence
  SiRNA target sequence
ttttgctttgcaatcaatt

SEQ ID NO: 117102 - DNA, 19 bp, Artificial sequence
  SiRNA target sequence
tttgctttgcaatcaattg

SEQ ID NO: 117103 - DNA, 19 bp, Artificial sequence
  SiRNA target sequence
ttgctttgcaatcaattga

SEQ ID NO: 117104 - DNA, 19 bp, Artificial sequence
  SiRNA target sequence
tgctttgcaatcaattgac

SEQ ID NO: 117105 - DNA, 19 bp, Artificial sequence
  SiRNA target sequence
gctttgcaatcaattgacc

SEQ ID NO: 117106 - DNA, 19 bp, Artificial sequence
  SiRNA target sequence
ctttgcaatcaattgacca

SEQ ID NO: 117107 - DNA, 19 bp, Artificial sequence
  SiRNA target sequence
tttgcaatcaattgaccat

SEQ ID NO: 117108 - DNA, 19 bp, Artificial sequence
  SiRNA target sequence
ttgcaatcaattgaccata

SEQ ID NO: 117109 - DNA, 19 bp, Artificial sequence
  SiRNA target sequence
tgcaatcaattgaccatat

SEQ ID NO: 117110 - DNA, 19 bp, Artificial sequence
  SiRNA target sequence
gcaatcaattgaccatatt

SEQ ID NO: 117111 - DNA, 19 bp, Artificial sequence
  SiRNA target sequence
caatcaattgaccatatta

SEQ ID NO: 117112 - DNA, 19 bp, Artificial sequence
  SiRNA target sequence
aatcaattgaccatattat

SEQ ID NO: 117113 - DNA, 19 bp, Artificial sequence
  SiRNA target sequence
atcaattgaccatattatt

SEQ ID NO: 117114 - DNA, 19 bp, Artificial sequence
  SiRNA target sequence
tcaattgaccatattatta

SEQ ID NO: 117115 - DNA, 19 bp, Artificial sequence
  SiRNA target sequence
caattgaccatattattaa

SEQ ID NO: 117116 - DNA, 19 bp, Artificial sequence
  SiRNA target sequence
aattgaccatattattaat

SEQ ID NO: 117117 - DNA, 19 bp, Artificial sequence
  SiRNA target sequence
attgaccatattattaatt

SEQ ID NO: 117118 - DNA, 19 bp, Artificial sequence
  SiRNA target sequence
ttgaccatattattaattc

SEQ ID NO: 117119 - DNA, 19 bp, Artificial sequence
  SiRNA target sequence
tgaccatattattaattct

SEQ ID NO: 117120 - DNA, 19 bp, Artificial sequence
  SiRNA target sequence
gaccatattattaattctt

SEQ ID NO: 117121 - DNA, 19 bp, Artificial sequence
  SiRNA target sequence
accatattattaattcttg

SEQ ID NO: 117122 - DNA, 19 bp, Artificial sequence
  SiRNA target sequence
ccatattattaattcttgt

SEQ ID NO: 117123 - DNA, 19 bp, Artificial sequence
  SiRNA target sequence
catattattaattcttgtg

SEQ ID NO: 117124 - DNA, 19 bp, Artificial sequence
  SiRNA target sequence
atattattaattcttgtgc

SEQ ID NO: 117125 - DNA, 19 bp, Artificial sequence
  SiRNA target sequence
tattattaattcttgtgcg

SEQ ID NO: 117126 - DNA, 19 bp, Artificial sequence
  SiRNA target sequence
attattaattcttgtgcga

SEQ ID NO: 117127 - DNA, 19 bp, Artificial sequence
  SiRNA target sequence
ttattaattcttgtgcgaa

SEQ ID NO: 117128 - DNA, 19 bp, Artificial sequence
  SiRNA target sequence
tattaattcttgtgcgaaa

SEQ ID NO: 117129 - DNA, 19 bp, Artificial sequence
  SiRNA target sequence
attaattcttgtgcgaaaa

SEQ ID NO: 117130 - DNA, 19 bp, Artificial sequence
  SiRNA target sequence
ttaattcttgtgcgaaaac

SEQ ID NO: 117131 - DNA, 19 bp, Artificial sequence
  SiRNA target sequence
taattcttgtgcgaaaacc

SEQ ID NO: 117132 - DNA, 19 bp, Artificial sequence
  SiRNA target sequence
aattcttgtgcgaaaacct

SEQ ID NO: 117133 - DNA, 19 bp, Artificial sequence
  SiRNA target sequence
attcttgtgcgaaaacctt

SEQ ID NO: 117134 - DNA, 19 bp, Artificial sequence
  SiRNA target sequence
ttcttgtgcgaaaaccttg

SEQ ID NO: 117135 - DNA, 19 bp, Artificial sequence
  SiRNA target sequence
tcttgtgcgaaaaccttgt

SEQ ID NO: 117136 - DNA, 19 bp, Artificial sequence
  SiRNA target sequence
cttgtgcgaaaaccttgta

SEQ ID NO: 117137 - DNA, 19 bp, Artificial sequence
  SiRNA target sequence
ttgtgcgaaaaccttgtat

SEQ ID NO: 117138 - DNA, 19 bp, Artificial sequence
  SiRNA target sequence
tgtgcgaaaaccttgtata

SEQ ID NO: 117139 - DNA, 19 bp, Artificial sequence
  SiRNA target sequence
gtgcgaaaaccttgtatat

SEQ ID NO: 117140 - DNA, 19 bp, Artificial sequence
  SiRNA target sequence
tgcgaaaaccttgtatatg

SEQ ID NO: 117141 - DNA, 19 bp, Artificial sequence
  SiRNA target sequence
gcgaaaaccttgtatatgt

SEQ ID NO: 117142 - DNA, 19 bp, Artificial sequence
  SiRNA target sequence
cgaaaaccttgtatatgtc

SEQ ID NO: 117143 - DNA, 19 bp, Artificial sequence
  SiRNA target sequence
gaaaaccttgtatatgtca

SEQ ID NO: 117144 - DNA, 19 bp, Artificial sequence
  SiRNA target sequence
aaaaccttgtatatgtcag

SEQ ID NO: 117145 - DNA, 19 bp, Artificial sequence
  SiRNA target sequence
aaaccttgtatatgtcagg

SEQ ID NO: 117146 - DNA, 19 bp, Artificial sequence
  SiRNA target sequence
aaccttgtatatgtcagga

SEQ ID NO: 117147 - DNA, 19 bp, Artificial sequence
  SiRNA target sequence
accttgtatatgtcaggag

SEQ ID NO: 117148 - DNA, 19 bp, Artificial sequence
  SiRNA target sequence
ccttgtatatgtcaggagg

SEQ ID NO: 117149 - DNA, 19 bp, Artificial sequence
  SiRNA target sequence
cttgtatatgtcaggagga

SEQ ID NO: 117150 - DNA, 19 bp, Artificial sequence
  SiRNA target sequence
ttgtatatgtcaggaggaa

SEQ ID NO: 117151 - DNA, 19 bp, Artificial sequence
  SiRNA target sequence
tgtatatgtcaggaggaag

SEQ ID NO: 117152 - DNA, 19 bp, Artificial sequence
  SiRNA target sequence
gtatatgtcaggaggaaga

SEQ ID NO: 117153 - DNA, 19 bp, Artificial sequence
  SiRNA target sequence
tatatgtcaggaggaagaa

SEQ ID NO: 117154 - DNA, 19 bp, Artificial sequence
  SiRNA target sequence
atatgtcaggaggaagaat

SEQ ID NO: 117155 - DNA, 19 bp, Artificial sequence
  SiRNA target sequence
tatgtcaggaggaagaata

SEQ ID NO: 117156 - DNA, 19 bp, Artificial sequence
  SiRNA target sequence
atgtcaggaggaagaatac

SEQ ID NO: 117157 - DNA, 19 bp, Artificial sequence
  SiRNA target sequence
tgtcaggaggaagaataca

SEQ ID NO: 117158 - DNA, 19 bp, Artificial sequence
  SiRNA target sequence
gtcaggaggaagaatacaa

SEQ ID NO: 117159 - DNA, 19 bp, Artificial sequence
  SiRNA target sequence
tcaggaggaagaatacaat

SEQ ID NO: 117160 - DNA, 19 bp, Artificial sequence
  SiRNA target sequence
caggaggaagaatacaatg

SEQ ID NO: 117161 - DNA, 19 bp, Artificial sequence
  SiRNA target sequence
aggaggaagaatacaatgt

SEQ ID NO: 117162 - DNA, 19 bp, Artificial sequence
  SiRNA target sequence
ggaggaagaatacaatgtc

SEQ ID NO: 117163 - DNA, 19 bp, Artificial sequence
  SiRNA target sequence
gaggaagaatacaatgtcc

SEQ ID NO: 117164 - DNA, 19 bp, Artificial sequence
  SiRNA target sequence
aggaagaatacaatgtcca

SEQ ID NO: 117165 - DNA, 19 bp, Artificial sequence
  SiRNA target sequence
ggaagaatacaatgtccaa

SEQ ID NO: 117166 - DNA, 19 bp, Artificial sequence
  SiRNA target sequence
gaagaatacaatgtccaat

SEQ ID NO: 117167 - DNA, 19 bp, Artificial sequence
  SiRNA target sequence
aagaatacaatgtccaatt

SEQ ID NO: 117168 - DNA, 19 bp, Artificial sequence
  SiRNA target sequence
agaatacaatgtccaattg

SEQ ID NO: 117169 - DNA, 19 bp, Artificial sequence
  SiRNA target sequence
gaatacaatgtccaattgt

SEQ ID NO: 117170 - DNA, 19 bp, Artificial sequence
  SiRNA target sequence
aatacaatgtccaattgtt

SEQ ID NO: 117171 - DNA, 19 bp, Artificial sequence
  SiRNA target sequence
atacaatgtccaattgttt

SEQ ID NO: 117172 - DNA, 19 bp, Artificial sequence
  SiRNA target sequence
tacaatgtccaattgtttt

SEQ ID NO: 117173 - DNA, 19 bp, Artificial sequence
  SiRNA target sequence
acaatgtccaattgttttt

SEQ ID NO: 117174 - DNA, 19 bp, Artificial sequence
  SiRNA target sequence
caatgtccaattgttttta

SEQ ID NO: 117175 - DNA, 19 bp, Artificial sequence
  SiRNA target sequence
aatgtccaattgtttttag

SEQ ID NO: 117176 - DNA, 19 bp, Artificial sequence
  SiRNA target sequence
atgtccaattgtttttagg

SEQ ID NO: 117177 - DNA, 19 bp, Artificial sequence
  SiRNA target sequence
tgtccaattgtttttaggg

SEQ ID NO: 117178 - DNA, 19 bp, Artificial sequence
  SiRNA target sequence
gtccaattgtttttagggg

SEQ ID NO: 117179 - DNA, 19 bp, Artificial sequence
  SiRNA target sequence
tccaattgtttttagggga

SEQ ID NO: 117180 - DNA, 19 bp, Artificial sequence
  SiRNA target sequence
ccaattgtttttaggggac

SEQ ID NO: 117181 - DNA, 19 bp, Artificial sequence
  SiRNA target sequence
caattgtttttaggggacc

SEQ ID NO: 117182 - DNA, 19 bp, Artificial sequence
  SiRNA target sequence
aattgtttttaggggacca

SEQ ID NO: 117183 - DNA, 19 bp, Artificial sequence
  SiRNA target sequence
attgtttttaggggaccaa

SEQ ID NO: 117184 - DNA, 19 bp, Artificial sequence
  SiRNA target sequence
ttgtttttaggggaccaaa

SEQ ID NO: 117185 - DNA, 19 bp, Artificial sequence
  SiRNA target sequence
tgtttttaggggaccaaat

SEQ ID NO: 117186 - DNA, 19 bp, Artificial sequence
  SiRNA target sequence
gtttttaggggaccaaatg

SEQ ID NO: 117187 - DNA, 19 bp, Artificial sequence
  SiRNA target sequence
tttttaggggaccaaatgg

SEQ ID NO: 117188 - DNA, 19 bp, Artificial sequence
  SiRNA target sequence
ttttaggggaccaaatgga

SEQ ID NO: 117189 - DNA, 19 bp, Artificial sequence
  SiRNA target sequence
tttaggggaccaaatggat

SEQ ID NO: 117190 - DNA, 19 bp, Artificial sequence
  SiRNA target sequence
ttaggggaccaaatggatt

SEQ ID NO: 117191 - DNA, 19 bp, Artificial sequence
  SiRNA target sequence
taggggaccaaatggattc

SEQ ID NO: 117192 - DNA, 19 bp, Artificial sequence
  SiRNA target sequence
aggggaccaaatggattca

SEQ ID NO: 117193 - DNA, 19 bp, Artificial sequence
  SiRNA target sequence
ggggaccaaatggattcaa

SEQ ID NO: 117194 - DNA, 19 bp, Artificial sequence
  SiRNA target sequence
gggaccaaatggattcaat

SEQ ID NO: 117195 - DNA, 19 bp, Artificial sequence
  SiRNA target sequence
ggaccaaatggattcaata

SEQ ID NO: 117196 - DNA, 19 bp, Artificial sequence
  SiRNA target sequence
gaccaaatggattcaataa

SEQ ID NO: 117197 - DNA, 19 bp, Artificial sequence
  SiRNA target sequence
accaaatggattcaataat

SEQ ID NO: 117198 - DNA, 19 bp, Artificial sequence
  SiRNA target sequence
ccaaatggattcaataatg

SEQ ID NO: 117199 - DNA, 19 bp, Artificial sequence
  SiRNA target sequence
caaatggattcaataatgg

SEQ ID NO: 117200 - DNA, 19 bp, Artificial sequence
  SiRNA target sequence
aaatggattcaataatggg

SEQ ID NO: 117201 - DNA, 19 bp, Artificial sequence
  SiRNA target sequence
aatggattcaataatgggt

SEQ ID NO: 117202 - DNA, 19 bp, Artificial sequence
  SiRNA target sequence
atggattcaataatgggta

SEQ ID NO: 117203 - DNA, 19 bp, Artificial sequence
  SiRNA target sequence
tggattcaataatgggtac

SEQ ID NO: 117204 - DNA, 19 bp, Artificial sequence
  SiRNA target sequence
ggattcaataatgggtacg

SEQ ID NO: 117205 - DNA, 19 bp, Artificial sequence
  SiRNA target sequence
gattcaataatgggtacgc

SEQ ID NO: 117206 - DNA, 19 bp, Artificial sequence
  SiRNA target sequence
attcaataatgggtacgct

SEQ ID NO: 117207 - DNA, 19 bp, Artificial sequence
  SiRNA target sequence
ttcaataatgggtacgctg

SEQ ID NO: 117208 - DNA, 19 bp, Artificial sequence
  SiRNA target sequence
tcaataatgggtacgctgc

SEQ ID NO: 117209 - DNA, 19 bp, Artificial sequence
  SiRNA target sequence
caataatgggtacgctgca

SEQ ID NO: 117210 - DNA, 19 bp, Artificial sequence
  SiRNA target sequence
aataatgggtacgctgcac

SEQ ID NO: 117211 - DNA, 19 bp, Artificial sequence
  SiRNA target sequence
ataatgggtacgctgcaca

SEQ ID NO: 117212 - DNA, 19 bp, Artificial sequence
  SiRNA target sequence
taatgggtacgctgcacag

SEQ ID NO: 117213 - DNA, 19 bp, Artificial sequence
  SiRNA target sequence
aatgggtacgctgcacagc

SEQ ID NO: 117214 - DNA, 19 bp, Artificial sequence
  SiRNA target sequence
atgggtacgctgcacagca

SEQ ID NO: 117215 - DNA, 19 bp, Artificial sequence
  SiRNA target sequence
tgggtacgctgcacagcac

SEQ ID NO: 117216 - DNA, 19 bp, Artificial sequence
  SiRNA target sequence
gggtacgctgcacagcaca

SEQ ID NO: 117217 - DNA, 19 bp, Artificial sequence
  SiRNA target sequence
ggtacgctgcacagcacac

SEQ ID NO: 117218 - DNA, 19 bp, Artificial sequence
  SiRNA target sequence
gtacgctgcacagcacaca

SEQ ID NO: 117219 - DNA, 19 bp, Artificial sequence
  SiRNA target sequence
tacgctgcacagcacacac

SEQ ID NO: 117220 - DNA, 19 bp, Artificial sequence
  SiRNA target sequence
acgctgcacagcacacaca

SEQ ID NO: 117221 - DNA, 19 bp, Artificial sequence
  SiRNA target sequence
cgctgcacagcacacacaa

SEQ ID NO: 117222 - DNA, 19 bp, Artificial sequence
  SiRNA target sequence
gctgcacagcacacacaag

SEQ ID NO: 117223 - DNA, 19 bp, Artificial sequence
  SiRNA target sequence
ctgcacagcacacacaaga

SEQ ID NO: 117224 - DNA, 19 bp, Artificial sequence
  SiRNA target sequence
tgcacagcacacacaagat

SEQ ID NO: 117225 - DNA, 19 bp, Artificial sequence
  SiRNA target sequence
gcacagcacacacaagatt

SEQ ID NO: 117226 - DNA, 19 bp, Artificial sequence
  SiRNA target sequence
cacagcacacacaagattt

SEQ ID NO: 117227 - DNA, 19 bp, Artificial sequence
  SiRNA target sequence
acagcacacacaagatttt

SEQ ID NO: 117228 - DNA, 19 bp, Artificial sequence
  SiRNA target sequence
cagcacacacaagattttg

SEQ ID NO: 117229 - DNA, 19 bp, Artificial sequence
  SiRNA target sequence
agcacacacaagattttgc

SEQ ID NO: 117230 - DNA, 19 bp, Artificial sequence
  SiRNA target sequence
gcacacacaagattttgca

SEQ ID NO: 117231 - DNA, 19 bp, Artificial sequence
  SiRNA target sequence
cacacacaagattttgcac

SEQ ID NO: 117232 - DNA, 19 bp, Artificial sequence
  SiRNA target sequence
acacacaagattttgcacc

SEQ ID NO: 117233 - DNA, 19 bp, Artificial sequence
  SiRNA target sequence
cacacaagattttgcacca

SEQ ID NO: 117234 - DNA, 19 bp, Artificial sequence
  SiRNA target sequence
acacaagattttgcaccaa

SEQ ID NO: 117235 - DNA, 19 bp, Artificial sequence
  SiRNA target sequence
cacaagattttgcaccaat

SEQ ID NO: 117236 - DNA, 19 bp, Artificial sequence
  SiRNA target sequence
acaagattttgcaccaata

SEQ ID NO: 117237 - DNA, 19 bp, Artificial sequence
  SiRNA target sequence
caagattttgcaccaatat

SEQ ID NO: 117238 - DNA, 19 bp, Artificial sequence
  SiRNA target sequence
aagattttgcaccaatata

SEQ ID NO: 117239 - DNA, 19 bp, Artificial sequence
  SiRNA target sequence
agattttgcaccaatatat

SEQ ID NO: 117240 - DNA, 19 bp, Artificial sequence
  SiRNA target sequence
gattttgcaccaatatatg

SEQ ID NO: 117241 - DNA, 19 bp, Artificial sequence
  SiRNA target sequence
attttgcaccaatatatgg

SEQ ID NO: 117242 - DNA, 19 bp, Artificial sequence
  SiRNA target sequence
ttttgcaccaatatatggt

SEQ ID NO: 117243 - DNA, 19 bp, Artificial sequence
  SiRNA target sequence
tttgcaccaatatatggtt

SEQ ID NO: 117244 - DNA, 19 bp, Artificial sequence
  SiRNA target sequence
ttgcaccaatatatggttc

SEQ ID NO: 117245 - DNA, 19 bp, Artificial sequence
  SiRNA target sequence
tgcaccaatatatggttct

SEQ ID NO: 117246 - DNA, 19 bp, Artificial sequence
  SiRNA target sequence
gcaccaatatatggttcta

SEQ ID NO: 117247 - DNA, 19 bp, Artificial sequence
  SiRNA target sequence
caccaatatatggttctat

SEQ ID NO: 117248 - DNA, 19 bp, Artificial sequence
  SiRNA target sequence
accaatatatggttctatt

SEQ ID NO: 117249 - DNA, 19 bp, Artificial sequence
  SiRNA target sequence
ccaatatatggttctattc

SEQ ID NO: 117250 - DNA, 19 bp, Artificial sequence
  SiRNA target sequence
caatatatggttctattcc

SEQ ID NO: 117251 - DNA, 19 bp, Artificial sequence
  SiRNA target sequence
aatatatggttctattcca

SEQ ID NO: 117252 - DNA, 19 bp, Artificial sequence
  SiRNA target sequence
atatatggttctattccag

SEQ ID NO: 117253 - DNA, 19 bp, Artificial sequence
  SiRNA target sequence
tatatggttctattccagg

SEQ ID NO: 117254 - DNA, 19 bp, Artificial sequence
  SiRNA target sequence
atatggttctattccaggc

SEQ ID NO: 117255 - DNA, 19 bp, Artificial sequence
  SiRNA target sequence
tatggttctattccaggcc

SEQ ID NO: 117256 - DNA, 19 bp, Artificial sequence
  SiRNA target sequence
atggttctattccaggcct

SEQ ID NO: 117257 - DNA, 19 bp, Artificial sequence
  SiRNA target sequence
tggttctattccaggcctt

SEQ ID NO: 117258 - DNA, 19 bp, Artificial sequence
  SiRNA target sequence
ggttctattccaggcctta

SEQ ID NO: 117259 - DNA, 19 bp, Artificial sequence
  SiRNA target sequence
gttctattccaggccttaa

SEQ ID NO: 117260 - DNA, 19 bp, Artificial sequence
  SiRNA target sequence
ttctattccaggccttaag

SEQ ID NO: 117261 - DNA, 19 bp, Artificial sequence
  SiRNA target sequence
tctattccaggccttaagg

SEQ ID NO: 117262 - DNA, 19 bp, Artificial sequence
  SiRNA target sequence
ctattccaggccttaaggt

SEQ ID NO: 117263 - DNA, 19 bp, Artificial sequence
  SiRNA target sequence
tattccaggccttaaggtg

SEQ ID NO: 117264 - DNA, 19 bp, Artificial sequence
  SiRNA target sequence
attccaggccttaaggtgg

SEQ ID NO: 117265 - DNA, 19 bp, Artificial sequence
  SiRNA target sequence
ttccaggccttaaggtggt

SEQ ID NO: 117266 - DNA, 19 bp, Artificial sequence
  SiRNA target sequence
tccaggccttaaggtggtt

SEQ ID NO: 117267 - DNA, 19 bp, Artificial sequence
  SiRNA target sequence
ccaggccttaaggtggttt

SEQ ID NO: 117268 - DNA, 19 bp, Artificial sequence
  SiRNA target sequence
caggccttaaggtggtttg

SEQ ID NO: 117269 - DNA, 19 bp, Artificial sequence
  SiRNA target sequence
aggccttaaggtggtttgt

SEQ ID NO: 117270 - DNA, 19 bp, Artificial sequence
  SiRNA target sequence
ggccttaaggtggtttgtc

SEQ ID NO: 117271 - DNA, 19 bp, Artificial sequence
  SiRNA target sequence
gccttaaggtggtttgtcc

SEQ ID NO: 117272 - DNA, 19 bp, Artificial sequence
  SiRNA target sequence
ccttaaggtggtttgtcct

SEQ ID NO: 117273 - DNA, 19 bp, Artificial sequence
  SiRNA target sequence
cttaaggtggtttgtcctt

SEQ ID NO: 117274 - DNA, 19 bp, Artificial sequence
  SiRNA target sequence
ttaaggtggtttgtcctta

SEQ ID NO: 117275 - DNA, 19 bp, Artificial sequence
  SiRNA target sequence
taaggtggtttgtccttat

SEQ ID NO: 117276 - DNA, 19 bp, Artificial sequence
  SiRNA target sequence
aaggtggtttgtccttata

SEQ ID NO: 117277 - DNA, 19 bp, Artificial sequence
  SiRNA target sequence
aggtggtttgtccttatac

SEQ ID NO: 117278 - DNA, 19 bp, Artificial sequence
  SiRNA target sequence
ggtggtttgtccttatacg

SEQ ID NO: 117279 - DNA, 19 bp, Artificial sequence
  SiRNA target sequence
gtggtttgtccttatacgg

SEQ ID NO: 117280 - DNA, 19 bp, Artificial sequence
  SiRNA target sequence
tggtttgtccttatacggg

SEQ ID NO: 117281 - DNA, 19 bp, Artificial sequence
  SiRNA target sequence
ggtttgtccttatacgggt

SEQ ID NO: 117282 - DNA, 19 bp, Artificial sequence
  SiRNA target sequence
gtttgtccttatacgggta

SEQ ID NO: 117283 - DNA, 19 bp, Artificial sequence
  SiRNA target sequence
tttgtccttatacgggtaa

SEQ ID NO: 117284 - DNA, 19 bp, Artificial sequence
  SiRNA target sequence
ttgtccttatacgggtaaa

SEQ ID NO: 117285 - DNA, 19 bp, Artificial sequence
  SiRNA target sequence
tgtccttatacgggtaaag

SEQ ID NO: 117286 - DNA, 19 bp, Artificial sequence
  SiRNA target sequence
gtccttatacgggtaaaga

SEQ ID NO: 117287 - DNA, 19 bp, Artificial sequence
  SiRNA target sequence
tccttatacgggtaaagac

SEQ ID NO: 117288 - DNA, 19 bp, Artificial sequence
  SiRNA target sequence
ccttatacgggtaaagacc

SEQ ID NO: 117289 - DNA, 19 bp, Artificial sequence
  SiRNA target sequence
cttatacgggtaaagacca

SEQ ID NO: 117290 - DNA, 19 bp, Artificial sequence
  SiRNA target sequence
ttatacgggtaaagaccat

SEQ ID NO: 117291 - DNA, 19 bp, Artificial sequence
  SiRNA target sequence
tatacgggtaaagaccata

SEQ ID NO: 117292 - DNA, 19 bp, Artificial sequence
  SiRNA target sequence
atacgggtaaagaccataa

SEQ ID NO: 117293 - DNA, 19 bp, Artificial sequence
  SiRNA target sequence
tacgggtaaagaccataaa

SEQ ID NO: 117294 - DNA, 19 bp, Artificial sequence
  SiRNA target sequence
acgggtaaagaccataaag

SEQ ID NO: 117295 - DNA, 19 bp, Artificial sequence
  SiRNA target sequence
cgggtaaagaccataaagg

SEQ ID NO: 117296 - DNA, 19 bp, Artificial sequence
  SiRNA target sequence
gggtaaagaccataaagga

SEQ ID NO: 117297 - DNA, 19 bp, Artificial sequence
  SiRNA target sequence
ggtaaagaccataaaggac

SEQ ID NO: 117298 - DNA, 19 bp, Artificial sequence
  SiRNA target sequence
gtaaagaccataaaggact

SEQ ID NO: 117299 - DNA, 19 bp, Artificial sequence
  SiRNA target sequence
taaagaccataaaggactt

SEQ ID NO: 117300 - DNA, 19 bp, Artificial sequence
  SiRNA target sequence
aaagaccataaaggacttt

SEQ ID NO: 117301 - DNA, 19 bp, Artificial sequence
  SiRNA target sequence
aagaccataaaggactttt

SEQ ID NO: 117302 - DNA, 19 bp, Artificial sequence
  SiRNA target sequence
agaccataaaggactttta

SEQ ID NO: 117303 - DNA, 19 bp, Artificial sequence
  SiRNA target sequence
gaccataaaggacttttaa

SEQ ID NO: 117304 - DNA, 19 bp, Artificial sequence
  SiRNA target sequence
accataaaggacttttaaa

SEQ ID NO: 117305 - DNA, 19 bp, Artificial sequence
  SiRNA target sequence
ccataaaggacttttaaaa

SEQ ID NO: 117306 - DNA, 19 bp, Artificial sequence
  SiRNA target sequence
cataaaggacttttaaaaa

SEQ ID NO: 117307 - DNA, 19 bp, Artificial sequence
  SiRNA target sequence
ataaaggacttttaaaaag

SEQ ID NO: 117308 - DNA, 19 bp, Artificial sequence
  SiRNA target sequence
taaaggacttttaaaaagc

SEQ ID NO: 117309 - DNA, 19 bp, Artificial sequence
  SiRNA target sequence
aaaggacttttaaaaagcg

SEQ ID NO: 117310 - DNA, 19 bp, Artificial sequence
  SiRNA target sequence
aaggacttttaaaaagcgc

SEQ ID NO: 117311 - DNA, 19 bp, Artificial sequence
  SiRNA target sequence
aggacttttaaaaagcgct

SEQ ID NO: 117312 - DNA, 19 bp, Artificial sequence
  SiRNA target sequence
ggacttttaaaaagcgcta

SEQ ID NO: 117313 - DNA, 19 bp, Artificial sequence
  SiRNA target sequence
gacttttaaaaagcgctat

SEQ ID NO: 117314 - DNA, 19 bp, Artificial sequence
  SiRNA target sequence
acttttaaaaagcgctatt

SEQ ID NO: 117315 - DNA, 19 bp, Artificial sequence
  SiRNA target sequence
cttttaaaaagcgctatta

SEQ ID NO: 117316 - DNA, 19 bp, Artificial sequence
  SiRNA target sequence
ttttaaaaagcgctattag

SEQ ID NO: 117317 - DNA, 19 bp, Artificial sequence
  SiRNA target sequence
tttaaaaagcgctattaga

SEQ ID NO: 117318 - DNA, 19 bp, Artificial sequence
  SiRNA target sequence
ttaaaaagcgctattagag

SEQ ID NO: 117319 - DNA, 19 bp, Artificial sequence
  SiRNA target sequence
taaaaagcgctattagaga

SEQ ID NO: 117320 - DNA, 19 bp, Artificial sequence
  SiRNA target sequence
aaaaagcgctattagagac

SEQ ID NO: 117321 - DNA, 19 bp, Artificial sequence
  SiRNA target sequence
aaaagcgctattagagaca

SEQ ID NO: 117322 - DNA, 19 bp, Artificial sequence
  SiRNA target sequence
aaagcgctattagagacaa

SEQ ID NO: 117323 - DNA, 19 bp, Artificial sequence
  SiRNA target sequence
aagcgctattagagacaat

SEQ ID NO: 117324 - DNA, 19 bp, Artificial sequence
  SiRNA target sequence
agcgctattagagacaata

SEQ ID NO: 117325 - DNA, 19 bp, Artificial sequence
  SiRNA target sequence
gcgctattagagacaataa

SEQ ID NO: 117326 - DNA, 19 bp, Artificial sequence
  SiRNA target sequence
cgctattagagacaataac

SEQ ID NO: 117327 - DNA, 19 bp, Artificial sequence
  SiRNA target sequence
gctattagagacaataacc

SEQ ID NO: 117328 - DNA, 19 bp, Artificial sequence
  SiRNA target sequence
ctattagagacaataaccc

SEQ ID NO: 117329 - DNA, 19 bp, Artificial sequence
  SiRNA target sequence
tattagagacaataacccg

SEQ ID NO: 117330 - DNA, 19 bp, Artificial sequence
  SiRNA target sequence
attagagacaataacccgg

SEQ ID NO: 117331 - DNA, 19 bp, Artificial sequence
  SiRNA target sequence
ttagagacaataacccggt

SEQ ID NO: 117332 - DNA, 19 bp, Artificial sequence
  SiRNA target sequence
tagagacaataacccggtt

SEQ ID NO: 117333 - DNA, 19 bp, Artificial sequence
  SiRNA target sequence
agagacaataacccggtta

SEQ ID NO: 117334 - DNA, 19 bp, Artificial sequence
  SiRNA target sequence
gagacaataacccggttat

SEQ ID NO: 117335 - DNA, 19 bp, Artificial sequence
  SiRNA target sequence
agacaataacccggttata

SEQ ID NO: 117336 - DNA, 19 bp, Artificial sequence
  SiRNA target sequence
gacaataacccggttatat

SEQ ID NO: 117337 - DNA, 19 bp, Artificial sequence
  SiRNA target sequence
acaataacccggttatatt

SEQ ID NO: 117338 - DNA, 19 bp, Artificial sequence
  SiRNA target sequence
caataacccggttatattt

SEQ ID NO: 117339 - DNA, 19 bp, Artificial sequence
  SiRNA target sequence
aataacccggttatatttc

SEQ ID NO: 117340 - DNA, 19 bp, Artificial sequence
  SiRNA target sequence
ataacccggttatatttct

SEQ ID NO: 117341 - DNA, 19 bp, Artificial sequence
  SiRNA target sequence
taacccggttatatttctt

SEQ ID NO: 117342 - DNA, 19 bp, Artificial sequence
  SiRNA target sequence
aacccggttatatttcttg

SEQ ID NO: 117343 - DNA, 19 bp, Artificial sequence
  SiRNA target sequence
acccggttatatttcttga

SEQ ID NO: 117344 - DNA, 19 bp, Artificial sequence
  SiRNA target sequence
cccggttatatttcttgag

SEQ ID NO: 117345 - DNA, 19 bp, Artificial sequence
  SiRNA target sequence
ccggttatatttcttgaga

SEQ ID NO: 117346 - DNA, 19 bp, Artificial sequence
  SiRNA target sequence
cggttatatttcttgagaa

SEQ ID NO: 117347 - DNA, 19 bp, Artificial sequence
  SiRNA target sequence
ggttatatttcttgagaat

SEQ ID NO: 117348 - DNA, 19 bp, Artificial sequence
  SiRNA target sequence
gttatatttcttgagaatg

SEQ ID NO: 117349 - DNA, 19 bp, Artificial sequence
  SiRNA target sequence
ttatatttcttgagaatga

SEQ ID NO: 117350 - DNA, 19 bp, Artificial sequence
  SiRNA target sequence
tatatttcttgagaatgaa

SEQ ID NO: 117351 - DNA, 19 bp, Artificial sequence
  SiRNA target sequence
atatttcttgagaatgaaa

SEQ ID NO: 117352 - DNA, 19 bp, Artificial sequence
  SiRNA target sequence
tatttcttgagaatgaaat

SEQ ID NO: 117353 - DNA, 19 bp, Artificial sequence
  SiRNA target sequence
atttcttgagaatgaaata

SEQ ID NO: 117354 - DNA, 19 bp, Artificial sequence
  SiRNA target sequence
tttcttgagaatgaaatat

SEQ ID NO: 117355 - DNA, 19 bp, Artificial sequence
  SiRNA target sequence
ttcttgagaatgaaatatt

SEQ ID NO: 117356 - DNA, 19 bp, Artificial sequence
  SiRNA target sequence
tcttgagaatgaaatatta

SEQ ID NO: 117357 - DNA, 19 bp, Artificial sequence
  SiRNA target sequence
cttgagaatgaaatattat

SEQ ID NO: 117358 - DNA, 19 bp, Artificial sequence
  SiRNA target sequence
ttgagaatgaaatattata

SEQ ID NO: 117359 - DNA, 19 bp, Artificial sequence
  SiRNA target sequence
tgagaatgaaatattatat

SEQ ID NO: 117360 - DNA, 19 bp, Artificial sequence
  SiRNA target sequence
gagaatgaaatattatata

SEQ ID NO: 117361 - DNA, 19 bp, Artificial sequence
  SiRNA target sequence
agaatgaaatattatataa

SEQ ID NO: 117362 - DNA, 19 bp, Artificial sequence
  SiRNA target sequence
gaatgaaatattatataaa

SEQ ID NO: 117363 - DNA, 19 bp, Artificial sequence
  SiRNA target sequence
aatgaaatattatataaag

SEQ ID NO: 117364 - DNA, 19 bp, Artificial sequence
  SiRNA target sequence
atgaaatattatataaaga

SEQ ID NO: 117365 - DNA, 19 bp, Artificial sequence
  SiRNA target sequence
tgaaatattatataaagat

SEQ ID NO: 117366 - DNA, 19 bp, Artificial sequence
  SiRNA target sequence
gaaatattatataaagata

SEQ ID NO: 117367 - DNA, 19 bp, Artificial sequence
  SiRNA target sequence
aaatattatataaagataa

SEQ ID NO: 117368 - DNA, 19 bp, Artificial sequence
  SiRNA target sequence
aatattatataaagataaa

SEQ ID NO: 117369 - DNA, 19 bp, Artificial sequence
  SiRNA target sequence
atattatataaagataaat

SEQ ID NO: 117370 - DNA, 19 bp, Artificial sequence
  SiRNA target sequence
tattatataaagataaata

SEQ ID NO: 117371 - DNA, 19 bp, Artificial sequence
  SiRNA target sequence
attatataaagataaatac

SEQ ID NO: 117372 - DNA, 19 bp, Artificial sequence
  SiRNA target sequence
ttatataaagataaatacc

SEQ ID NO: 117373 - DNA, 19 bp, Artificial sequence
  SiRNA target sequence
tatataaagataaatacct

SEQ ID NO: 117374 - DNA, 19 bp, Artificial sequence
  SiRNA target sequence
atataaagataaatacctt

SEQ ID NO: 117375 - DNA, 19 bp, Artificial sequence
  SiRNA target sequence
tataaagataaataccttg

SEQ ID NO: 117376 - DNA, 19 bp, Artificial sequence
  SiRNA target sequence
ataaagataaataccttga

SEQ ID NO: 117377 - DNA, 19 bp, Artificial sequence
  SiRNA target sequence
taaagataaataccttgaa

SEQ ID NO: 117378 - DNA, 19 bp, Artificial sequence
  SiRNA target sequence
aaagataaataccttgaag

SEQ ID NO: 117379 - DNA, 19 bp, Artificial sequence
  SiRNA target sequence
aagataaataccttgaagt

SEQ ID NO: 117380 - DNA, 19 bp, Artificial sequence
  SiRNA target sequence
agataaataccttgaagtg

SEQ ID NO: 117381 - DNA, 19 bp, Artificial sequence
  SiRNA target sequence
gataaataccttgaagtgt

SEQ ID NO: 117382 - DNA, 19 bp, Artificial sequence
  SiRNA target sequence
ataaataccttgaagtgtc

SEQ ID NO: 117383 - DNA, 19 bp, Artificial sequence
  SiRNA target sequence
taaataccttgaagtgtct

SEQ ID NO: 117384 - DNA, 19 bp, Artificial sequence
  SiRNA target sequence
aaataccttgaagtgtcta

SEQ ID NO: 117385 - DNA, 19 bp, Artificial sequence
  SiRNA target sequence
aataccttgaagtgtctaa

SEQ ID NO: 117386 - DNA, 19 bp, Artificial sequence
  SiRNA target sequence
ataccttgaagtgtctaat

SEQ ID NO: 117387 - DNA, 19 bp, Artificial sequence
  SiRNA target sequence
taccttgaagtgtctaata

SEQ ID NO: 117388 - DNA, 19 bp, Artificial sequence
  SiRNA target sequence
accttgaagtgtctaataa

SEQ ID NO: 117389 - DNA, 19 bp, Artificial sequence
  SiRNA target sequence
ccttgaagtgtctaataat

SEQ ID NO: 117390 - DNA, 19 bp, Artificial sequence
  SiRNA target sequence
cttgaagtgtctaataatt

SEQ ID NO: 117391 - DNA, 19 bp, Artificial sequence
  SiRNA target sequence
ttgaagtgtctaataatta

SEQ ID NO: 117392 - DNA, 19 bp, Artificial sequence
  SiRNA target sequence
tgaagtgtctaataattat

SEQ ID NO: 117393 - DNA, 19 bp, Artificial sequence
  SiRNA target sequence
gaagtgtctaataattata

SEQ ID NO: 117394 - DNA, 19 bp, Artificial sequence
  SiRNA target sequence
aagtgtctaataattatat

SEQ ID NO: 117395 - DNA, 19 bp, Artificial sequence
  SiRNA target sequence
agtgtctaataattatatt

SEQ ID NO: 117396 - DNA, 19 bp, Artificial sequence
  SiRNA target sequence
gtgtctaataattatattc

SEQ ID NO: 117397 - DNA, 19 bp, Artificial sequence
  SiRNA target sequence
tgtctaataattatattca

SEQ ID NO: 117398 - DNA, 19 bp, Artificial sequence
  SiRNA target sequence
gtctaataattatattcaa

SEQ ID NO: 117399 - DNA, 19 bp, Artificial sequence
  SiRNA target sequence
tctaataattatattcaac

SEQ ID NO: 117400 - DNA, 19 bp, Artificial sequence
  SiRNA target sequence
ctaataattatattcaacc

SEQ ID NO: 117401 - DNA, 19 bp, Artificial sequence
  SiRNA target sequence
taataattatattcaacca

SEQ ID NO: 117402 - DNA, 19 bp, Artificial sequence
  SiRNA target sequence
aataattatattcaaccac

SEQ ID NO: 117403 - DNA, 19 bp, Artificial sequence
  SiRNA target sequence
ataattatattcaaccact

SEQ ID NO: 117404 - DNA, 19 bp, Artificial sequence
  SiRNA target sequence
taattatattcaaccactt

SEQ ID NO: 117405 - DNA, 19 bp, Artificial sequence
  SiRNA target sequence
aattatattcaaccacttg

SEQ ID NO: 117406 - DNA, 19 bp, Artificial sequence
  SiRNA target sequence
attatattcaaccacttga

SEQ ID NO: 117407 - DNA, 19 bp, Artificial sequence
  SiRNA target sequence
ttatattcaaccacttgac

SEQ ID NO: 117408 - DNA, 19 bp, Artificial sequence
  SiRNA target sequence
tatattcaaccacttgaca

SEQ ID NO: 117409 - DNA, 19 bp, Artificial sequence
  SiRNA target sequence
atattcaaccacttgacaa

SEQ ID NO: 117410 - DNA, 19 bp, Artificial sequence
  SiRNA target sequence
tattcaaccacttgacaag

SEQ ID NO: 117411 - DNA, 19 bp, Artificial sequence
  SiRNA target sequence
attcaaccacttgacaagg

SEQ ID NO: 117412 - DNA, 19 bp, Artificial sequence
  SiRNA target sequence
ttcaaccacttgacaaggc

SEQ ID NO: 117413 - DNA, 19 bp, Artificial sequence
  SiRNA target sequence
tcaaccacttgacaaggca

SEQ ID NO: 117414 - DNA, 19 bp, Artificial sequence
  SiRNA target sequence
caaccacttgacaaggcag

SEQ ID NO: 117415 - DNA, 19 bp, Artificial sequence
  SiRNA target sequence
aaccacttgacaaggcagt

SEQ ID NO: 117416 - DNA, 19 bp, Artificial sequence
  SiRNA target sequence
accacttgacaaggcagta

SEQ ID NO: 117417 - DNA, 19 bp, Artificial sequence
  SiRNA target sequence
ccacttgacaaggcagtaa

SEQ ID NO: 117418 - DNA, 19 bp, Artificial sequence
  SiRNA target sequence
cacttgacaaggcagtaat

SEQ ID NO: 117419 - DNA, 19 bp, Artificial sequence
  SiRNA target sequence
acttgacaaggcagtaatt

SEQ ID NO: 117420 - DNA, 19 bp, Artificial sequence
  SiRNA target sequence
cttgacaaggcagtaattg

SEQ ID NO: 117421 - DNA, 19 bp, Artificial sequence
  SiRNA target sequence
ttgacaaggcagtaattga

SEQ ID NO: 117422 - DNA, 19 bp, Artificial sequence
  SiRNA target sequence
tgacaaggcagtaattgaa

SEQ ID NO: 117423 - DNA, 19 bp, Artificial sequence
  SiRNA target sequence
gacaaggcagtaattgaaa

SEQ ID NO: 117424 - DNA, 19 bp, Artificial sequence
  SiRNA target sequence
acaaggcagtaattgaaaa

SEQ ID NO: 117425 - DNA, 19 bp, Artificial sequence
  SiRNA target sequence
caaggcagtaattgaaaaa

SEQ ID NO: 117426 - DNA, 19 bp, Artificial sequence
  SiRNA target sequence
aaggcagtaattgaaaaaa

SEQ ID NO: 117427 - DNA, 19 bp, Artificial sequence
  SiRNA target sequence
aggcagtaattgaaaaaaa

SEQ ID NO: 117428 - DNA, 19 bp, Artificial sequence
  SiRNA target sequence
ggcagtaattgaaaaaaat

SEQ ID NO: 117429 - DNA, 19 bp, Artificial sequence
  SiRNA target sequence
gcagtaattgaaaaaaatg

SEQ ID NO: 117430 - DNA, 19 bp, Artificial sequence
  SiRNA target sequence
cagtaattgaaaaaaatgg

SEQ ID NO: 117431 - DNA, 19 bp, Artificial sequence
  SiRNA target sequence
agtaattgaaaaaaatggt

SEQ ID NO: 117432 - DNA, 19 bp, Artificial sequence
  SiRNA target sequence
gtaattgaaaaaaatggtg

SEQ ID NO: 117433 - DNA, 19 bp, Artificial sequence
  SiRNA target sequence
taattgaaaaaaatggtgt

SEQ ID NO: 117434 - DNA, 19 bp, Artificial sequence
  SiRNA target sequence
aattgaaaaaaatggtgtt

SEQ ID NO: 117435 - DNA, 19 bp, Artificial sequence
  SiRNA target sequence
attgaaaaaaatggtgttg

SEQ ID NO: 117436 - DNA, 19 bp, Artificial sequence
  SiRNA target sequence
ttgaaaaaaatggtgttga

SEQ ID NO: 117437 - DNA, 19 bp, Artificial sequence
  SiRNA target sequence
tgaaaaaaatggtgttgac

SEQ ID NO: 117438 - DNA, 19 bp, Artificial sequence
  SiRNA target sequence
gaaaaaaatggtgttgacg

SEQ ID NO: 117439 - DNA, 19 bp, Artificial sequence
  SiRNA target sequence
aaaaaaatggtgttgacgt

SEQ ID NO: 117440 - DNA, 19 bp, Artificial sequence
  SiRNA target sequence
aaaaaatggtgttgacgtt

SEQ ID NO: 117441 - DNA, 19 bp, Artificial sequence
  SiRNA target sequence
aaaaatggtgttgacgtta

SEQ ID NO: 117442 - DNA, 19 bp, Artificial sequence
  SiRNA target sequence
aaaatggtgttgacgttac

SEQ ID NO: 117443 - DNA, 19 bp, Artificial sequence
  SiRNA target sequence
aaatggtgttgacgttaca

SEQ ID NO: 117444 - DNA, 19 bp, Artificial sequence
  SiRNA target sequence
aatggtgttgacgttacag

SEQ ID NO: 117445 - DNA, 19 bp, Artificial sequence
  SiRNA target sequence
atggtgttgacgttacagt

SEQ ID NO: 117446 - DNA, 19 bp, Artificial sequence
  SiRNA target sequence
tggtgttgacgttacagtt

SEQ ID NO: 117447 - DNA, 19 bp, Artificial sequence
  SiRNA target sequence
ggtgttgacgttacagttt

SEQ ID NO: 117448 - DNA, 19 bp, Artificial sequence
  SiRNA target sequence
gtgttgacgttacagtttt

SEQ ID NO: 117449 - DNA, 19 bp, Artificial sequence
  SiRNA target sequence
tgttgacgttacagtttta

SEQ ID NO: 117450 - DNA, 19 bp, Artificial sequence
  SiRNA target sequence
gttgacgttacagttttag

SEQ ID NO: 117451 - DNA, 19 bp, Artificial sequence
  SiRNA target sequence
ttgacgttacagttttagg

SEQ ID NO: 117452 - DNA, 19 bp, Artificial sequence
  SiRNA target sequence
tgacgttacagttttagga

SEQ ID NO: 117453 - DNA, 19 bp, Artificial sequence
  SiRNA target sequence
gacgttacagttttaggaa

SEQ ID NO: 117454 - DNA, 19 bp, Artificial sequence
  SiRNA target sequence
acgttacagttttaggaat

SEQ ID NO: 117455 - DNA, 19 bp, Artificial sequence
  SiRNA target sequence
cgttacagttttaggaata

SEQ ID NO: 117456 - DNA, 19 bp, Artificial sequence
  SiRNA target sequence
gttacagttttaggaatat

SEQ ID NO: 117457 - DNA, 19 bp, Artificial sequence
  SiRNA target sequence
ttacagttttaggaatatc

SEQ ID NO: 117458 - DNA, 19 bp, Artificial sequence
  SiRNA target sequence
tacagttttaggaatatca

SEQ ID NO: 117459 - DNA, 19 bp, Artificial sequence
  SiRNA target sequence
acagttttaggaatatcaa

SEQ ID NO: 117460 - DNA, 19 bp, Artificial sequence
  SiRNA target sequence
cagttttaggaatatcaat

SEQ ID NO: 117461 - DNA, 19 bp, Artificial sequence
  SiRNA target sequence
agttttaggaatatcaata

SEQ ID NO: 117462 - DNA, 19 bp, Artificial sequence
  SiRNA target sequence
gttttaggaatatcaataa

SEQ ID NO: 117463 - DNA, 19 bp, Artificial sequence
  SiRNA target sequence
ttttaggaatatcaataag

SEQ ID NO: 117464 - DNA, 19 bp, Artificial sequence
  SiRNA target sequence
tttaggaatatcaataagt

SEQ ID NO: 117465 - DNA, 19 bp, Artificial sequence
  SiRNA target sequence
ttaggaatatcaataagtc

SEQ ID NO: 117466 - DNA, 19 bp, Artificial sequence
  SiRNA target sequence
taggaatatcaataagtct

SEQ ID NO: 117467 - DNA, 19 bp, Artificial sequence
  SiRNA target sequence
aggaatatcaataagtctt

SEQ ID NO: 117468 - DNA, 19 bp, Artificial sequence
  SiRNA target sequence
ggaatatcaataagtctta

SEQ ID NO: 117469 - DNA, 19 bp, Artificial sequence
  SiRNA target sequence
gaatatcaataagtcttaa

SEQ ID NO: 117470 - DNA, 19 bp, Artificial sequence
  SiRNA target sequence
aatatcaataagtcttaaa

SEQ ID NO: 117471 - DNA, 19 bp, Artificial sequence
  SiRNA target sequence
atatcaataagtcttaaag

SEQ ID NO: 117472 - DNA, 19 bp, Artificial sequence
  SiRNA target sequence
tatcaataagtcttaaaga

SEQ ID NO: 117473 - DNA, 19 bp, Artificial sequence
  SiRNA target sequence
atcaataagtcttaaagaa

SEQ ID NO: 117474 - DNA, 19 bp, Artificial sequence
  SiRNA target sequence
tcaataagtcttaaagaaa

SEQ ID NO: 117475 - DNA, 19 bp, Artificial sequence
  SiRNA target sequence
caataagtcttaaagaaat

SEQ ID NO: 117476 - DNA, 19 bp, Artificial sequence
  SiRNA target sequence
aataagtcttaaagaaatt

SEQ ID NO: 117477 - DNA, 19 bp, Artificial sequence
  SiRNA target sequence
ataagtcttaaagaaattt

SEQ ID NO: 117478 - DNA, 19 bp, Artificial sequence
  SiRNA target sequence
taagtcttaaagaaatttt

SEQ ID NO: 117479 - DNA, 19 bp, Artificial sequence
  SiRNA target sequence
aagtcttaaagaaattttt

SEQ ID NO: 117480 - DNA, 19 bp, Artificial sequence
  SiRNA target sequence
agtcttaaagaaattttta

SEQ ID NO: 117481 - DNA, 19 bp, Artificial sequence
  SiRNA target sequence
gtcttaaagaaatttttaa

SEQ ID NO: 117482 - DNA, 19 bp, Artificial sequence
  SiRNA target sequence
tcttaaagaaatttttaaa

SEQ ID NO: 117483 - DNA, 19 bp, Artificial sequence
  SiRNA target sequence
cttaaagaaatttttaaag

SEQ ID NO: 117484 - DNA, 19 bp, Artificial sequence
  SiRNA target sequence
ttaaagaaatttttaaagc

SEQ ID NO: 117485 - DNA, 19 bp, Artificial sequence
  SiRNA target sequence
taaagaaatttttaaagca

SEQ ID NO: 117486 - DNA, 19 bp, Artificial sequence
  SiRNA target sequence
aaagaaatttttaaagcag

SEQ ID NO: 117487 - DNA, 19 bp, Artificial sequence
  SiRNA target sequence
aagaaatttttaaagcaga

SEQ ID NO: 117488 - DNA, 19 bp, Artificial sequence
  SiRNA target sequence
agaaatttttaaagcagac

SEQ ID NO: 117489 - DNA, 19 bp, Artificial sequence
  SiRNA target sequence
gaaatttttaaagcagaca

SEQ ID NO: 117490 - DNA, 19 bp, Artificial sequence
  SiRNA target sequence
aaatttttaaagcagacag

SEQ ID NO: 117491 - DNA, 19 bp, Artificial sequence
  SiRNA target sequence
aatttttaaagcagacagt

SEQ ID NO: 117492 - DNA, 19 bp, Artificial sequence
  SiRNA target sequence
atttttaaagcagacagtt

SEQ ID NO: 117493 - DNA, 19 bp, Artificial sequence
  SiRNA target sequence
tttttaaagcagacagttt

SEQ ID NO: 117494 - DNA, 19 bp, Artificial sequence
  SiRNA target sequence
ttttaaagcagacagtttg

SEQ ID NO: 117495 - DNA, 19 bp, Artificial sequence
  SiRNA target sequence
tttaaagcagacagtttgt

SEQ ID NO: 117496 - DNA, 19 bp, Artificial sequence
  SiRNA target sequence
ttaaagcagacagtttgtt

SEQ ID NO: 117497 - DNA, 19 bp, Artificial sequence
  SiRNA target sequence
taaagcagacagtttgtta

SEQ ID NO: 117498 - DNA, 19 bp, Artificial sequence
  SiRNA target sequence
aaagcagacagtttgttag

SEQ ID NO: 117499 - DNA, 19 bp, Artificial sequence
  SiRNA target sequence
aagcagacagtttgttaga

SEQ ID NO: 117500 - DNA, 19 bp, Artificial sequence
  SiRNA target sequence
agcagacagtttgttagag

SEQ ID NO: 117501 - DNA, 19 bp, Artificial sequence
  SiRNA target sequence
gcagacagtttgttagaga

SEQ ID NO: 117502 - DNA, 19 bp, Artificial sequence
  SiRNA target sequence
cagacagtttgttagagaa

SEQ ID NO: 117503 - DNA, 19 bp, Artificial sequence
  SiRNA target sequence
agacagtttgttagagaaa

SEQ ID NO: 117504 - DNA, 19 bp, Artificial sequence
  SiRNA target sequence
gacagtttgttagagaaaa

SEQ ID NO: 117505 - DNA, 19 bp, Artificial sequence
  SiRNA target sequence
acagtttgttagagaaaaa

SEQ ID NO: 117506 - DNA, 19 bp, Artificial sequence
  SiRNA target sequence
cagtttgttagagaaaaaa

SEQ ID NO: 117507 - DNA, 19 bp, Artificial sequence
  SiRNA target sequence
agtttgttagagaaaaaaa

SEQ ID NO: 117508 - DNA, 19 bp, Artificial sequence
  SiRNA target sequence
gtttgttagagaaaaaaaa

SEQ ID NO: 117509 - DNA, 19 bp, Artificial sequence
  SiRNA target sequence
tttgttagagaaaaaaaat

SEQ ID NO: 117510 - DNA, 19 bp, Artificial sequence
  SiRNA target sequence
ttgttagagaaaaaaaata

SEQ ID NO: 117511 - DNA, 19 bp, Artificial sequence
  SiRNA target sequence
tgttagagaaaaaaaatat

SEQ ID NO: 117512 - DNA, 19 bp, Artificial sequence
  SiRNA target sequence
gttagagaaaaaaaatatc

SEQ ID NO: 117513 - DNA, 19 bp, Artificial sequence
  SiRNA target sequence
ttagagaaaaaaaatatcg

SEQ ID NO: 117514 - DNA, 19 bp, Artificial sequence
  SiRNA target sequence
tagagaaaaaaaatatcga

SEQ ID NO: 117515 - DNA, 19 bp, Artificial sequence
  SiRNA target sequence
agagaaaaaaaatatcgac

SEQ ID NO: 117516 - DNA, 19 bp, Artificial sequence
  SiRNA target sequence
gagaaaaaaaatatcgaca

SEQ ID NO: 117517 - DNA, 19 bp, Artificial sequence
  SiRNA target sequence
agaaaaaaaatatcgacat

SEQ ID NO: 117518 - DNA, 19 bp, Artificial sequence
  SiRNA target sequence
gaaaaaaaatatcgacatt

SEQ ID NO: 117519 - DNA, 19 bp, Artificial sequence
  SiRNA target sequence
aaaaaaaatatcgacattg

SEQ ID NO: 117520 - DNA, 19 bp, Artificial sequence
  SiRNA target sequence
aaaaaaatatcgacattga

SEQ ID NO: 117521 - DNA, 19 bp, Artificial sequence
  SiRNA target sequence
aaaaaatatcgacattgag

SEQ ID NO: 117522 - DNA, 19 bp, Artificial sequence
  SiRNA target sequence
aaaaatatcgacattgaga

SEQ ID NO: 117523 - DNA, 19 bp, Artificial sequence
  SiRNA target sequence
aaaatatcgacattgagat

SEQ ID NO: 117524 - DNA, 19 bp, Artificial sequence
  SiRNA target sequence
aaatatcgacattgagata

SEQ ID NO: 117525 - DNA, 19 bp, Artificial sequence
  SiRNA target sequence
aatatcgacattgagataa

SEQ ID NO: 117526 - DNA, 19 bp, Artificial sequence
  SiRNA target sequence
atatcgacattgagataat

SEQ ID NO: 117527 - DNA, 19 bp, Artificial sequence
  SiRNA target sequence
tatcgacattgagataatt

SEQ ID NO: 117528 - DNA, 19 bp, Artificial sequence
  SiRNA target sequence
atcgacattgagataatta

SEQ ID NO: 117529 - DNA, 19 bp, Artificial sequence
  SiRNA target sequence
tcgacattgagataattaa

SEQ ID NO: 117530 - DNA, 19 bp, Artificial sequence
  SiRNA target sequence
cgacattgagataattaat

SEQ ID NO: 117531 - DNA, 19 bp, Artificial sequence
  SiRNA target sequence
gacattgagataattaatc

SEQ ID NO: 117532 - DNA, 19 bp, Artificial sequence
  SiRNA target sequence
acattgagataattaatct

SEQ ID NO: 117533 - DNA, 19 bp, Artificial sequence
  SiRNA target sequence
cattgagataattaatctt

SEQ ID NO: 117534 - DNA, 19 bp, Artificial sequence
  SiRNA target sequence
attgagataattaatcttg

SEQ ID NO: 117535 - DNA, 19 bp, Artificial sequence
  SiRNA target sequence
ttgagataattaatcttgt

SEQ ID NO: 117536 - DNA, 19 bp, Artificial sequence
  SiRNA target sequence
tgagataattaatcttgtg

SEQ ID NO: 117537 - DNA, 19 bp, Artificial sequence
  SiRNA target sequence
gagataattaatcttgtgt

SEQ ID NO: 117538 - DNA, 19 bp, Artificial sequence
  SiRNA target sequence
agataattaatcttgtgtc

SEQ ID NO: 117539 - DNA, 19 bp, Artificial sequence
  SiRNA target sequence
gataattaatcttgtgtca

SEQ ID NO: 117540 - DNA, 19 bp, Artificial sequence
  SiRNA target sequence
ataattaatcttgtgtcaa

SEQ ID NO: 117541 - DNA, 19 bp, Artificial sequence
  SiRNA target sequence
taattaatcttgtgtcaat

SEQ ID NO: 117542 - DNA, 19 bp, Artificial sequence
  SiRNA target sequence
aattaatcttgtgtcaata

SEQ ID NO: 117543 - DNA, 19 bp, Artificial sequence
  SiRNA target sequence
attaatcttgtgtcaataa

SEQ ID NO: 117544 - DNA, 19 bp, Artificial sequence
  SiRNA target sequence
ttaatcttgtgtcaataaa

SEQ ID NO: 117545 - DNA, 19 bp, Artificial sequence
  SiRNA target sequence
taatcttgtgtcaataaaa

SEQ ID NO: 117546 - DNA, 19 bp, Artificial sequence
  SiRNA target sequence
aatcttgtgtcaataaaac

SEQ ID NO: 117547 - DNA, 19 bp, Artificial sequence
  SiRNA target sequence
atcttgtgtcaataaaacc

SEQ ID NO: 117548 - DNA, 19 bp, Artificial sequence
  SiRNA target sequence
tcttgtgtcaataaaacca

SEQ ID NO: 117549 - DNA, 19 bp, Artificial sequence
  SiRNA target sequence
cttgtgtcaataaaaccaa

SEQ ID NO: 117550 - DNA, 19 bp, Artificial sequence
  SiRNA target sequence
ttgtgtcaataaaaccaat

SEQ ID NO: 117551 - DNA, 19 bp, Artificial sequence
  SiRNA target sequence
tgtgtcaataaaaccaatt

SEQ ID NO: 117552 - DNA, 19 bp, Artificial sequence
  SiRNA target sequence
gtgtcaataaaaccaattg

SEQ ID NO: 117553 - DNA, 19 bp, Artificial sequence
  SiRNA target sequence
tgtcaataaaaccaattga

SEQ ID NO: 117554 - DNA, 19 bp, Artificial sequence
  SiRNA target sequence
gtcaataaaaccaattgat

SEQ ID NO: 117555 - DNA, 19 bp, Artificial sequence
  SiRNA target sequence
tcaataaaaccaattgatt

SEQ ID NO: 117556 - DNA, 19 bp, Artificial sequence
  SiRNA target sequence
caataaaaccaattgatta

SEQ ID NO: 117557 - DNA, 19 bp, Artificial sequence
  SiRNA target sequence
aataaaaccaattgattat

SEQ ID NO: 117558 - DNA, 19 bp, Artificial sequence
  SiRNA target sequence
ataaaaccaattgattatg

SEQ ID NO: 117559 - DNA, 19 bp, Artificial sequence
  SiRNA target sequence
taaaaccaattgattatgt

SEQ ID NO: 117560 - DNA, 19 bp, Artificial sequence
  SiRNA target sequence
aaaaccaattgattatgtt

SEQ ID NO: 117561 - DNA, 19 bp, Artificial sequence
  SiRNA target sequence
aaaccaattgattatgtta

SEQ ID NO: 117562 - DNA, 19 bp, Artificial sequence
  SiRNA target sequence
aaccaattgattatgttac

SEQ ID NO: 117563 - DNA, 19 bp, Artificial sequence
  SiRNA target sequence
accaattgattatgttact

SEQ ID NO: 117564 - DNA, 19 bp, Artificial sequence
  SiRNA target sequence
ccaattgattatgttacta

SEQ ID NO: 117565 - DNA, 19 bp, Artificial sequence
  SiRNA target sequence
caattgattatgttactat

SEQ ID NO: 117566 - DNA, 19 bp, Artificial sequence
  SiRNA target sequence
aattgattatgttactatt

SEQ ID NO: 117567 - DNA, 19 bp, Artificial sequence
  SiRNA target sequence
attgattatgttactattg

SEQ ID NO: 117568 - DNA, 19 bp, Artificial sequence
  SiRNA target sequence
ttgattatgttactattga

SEQ ID NO: 117569 - DNA, 19 bp, Artificial sequence
  SiRNA target sequence
tgattatgttactattgaa

SEQ ID NO: 117570 - DNA, 19 bp, Artificial sequence
  SiRNA target sequence
gattatgttactattgaaa

SEQ ID NO: 117571 - DNA, 19 bp, Artificial sequence
  SiRNA target sequence
attatgttactattgaaat

SEQ ID NO: 117572 - DNA, 19 bp, Artificial sequence
  SiRNA target sequence
ttatgttactattgaaata

SEQ ID NO: 117573 - DNA, 19 bp, Artificial sequence
  SiRNA target sequence
tatgttactattgaaatat

SEQ ID NO: 117574 - DNA, 19 bp, Artificial sequence
  SiRNA target sequence
atgttactattgaaatatc

SEQ ID NO: 117575 - DNA, 19 bp, Artificial sequence
  SiRNA target sequence
tgttactattgaaatatca

SEQ ID NO: 117576 - DNA, 19 bp, Artificial sequence
  SiRNA target sequence
gttactattgaaatatcag

SEQ ID NO: 117577 - DNA, 19 bp, Artificial sequence
  SiRNA target sequence
ttactattgaaatatcagt

SEQ ID NO: 117578 - DNA, 19 bp, Artificial sequence
  SiRNA target sequence
tactattgaaatatcagtc

SEQ ID NO: 117579 - DNA, 19 bp, Artificial sequence
  SiRNA target sequence
actattgaaatatcagtca

SEQ ID NO: 117580 - DNA, 19 bp, Artificial sequence
  SiRNA target sequence
ctattgaaatatcagtcaa

SEQ ID NO: 117581 - DNA, 19 bp, Artificial sequence
  SiRNA target sequence
tattgaaatatcagtcaaa

SEQ ID NO: 117582 - DNA, 19 bp, Artificial sequence
  SiRNA target sequence
attgaaatatcagtcaaaa

SEQ ID NO: 117583 - DNA, 19 bp, Artificial sequence
  SiRNA target sequence
ttgaaatatcagtcaaaaa

SEQ ID NO: 117584 - DNA, 19 bp, Artificial sequence
  SiRNA target sequence
tgaaatatcagtcaaaaaa

SEQ ID NO: 117585 - DNA, 19 bp, Artificial sequence
  SiRNA target sequence
gaaatatcagtcaaaaaaa

SEQ ID NO: 117586 - DNA, 19 bp, Artificial sequence
  SiRNA target sequence
aaatatcagtcaaaaaaac

SEQ ID NO: 117587 - DNA, 19 bp, Artificial sequence
  SiRNA target sequence
aatatcagtcaaaaaaaca

SEQ ID NO: 117588 - DNA, 19 bp, Artificial sequence
  SiRNA target sequence
atatcagtcaaaaaaacac

SEQ ID NO: 117589 - DNA, 19 bp, Artificial sequence
  SiRNA target sequence
tatcagtcaaaaaaacaca

SEQ ID NO: 117590 - DNA, 19 bp, Artificial sequence
  SiRNA target sequence
atcagtcaaaaaaacacaa

SEQ ID NO: 117591 - DNA, 19 bp, Artificial sequence
  SiRNA target sequence
tcagtcaaaaaaacacaaa

SEQ ID NO: 117592 - DNA, 19 bp, Artificial sequence
  SiRNA target sequence
cagtcaaaaaaacacaaaa

SEQ ID NO: 117593 - DNA, 19 bp, Artificial sequence
  SiRNA target sequence
agtcaaaaaaacacaaaag

SEQ ID NO: 117594 - DNA, 19 bp, Artificial sequence
  SiRNA target sequence
gtcaaaaaaacacaaaagt

SEQ ID NO: 117595 - DNA, 19 bp, Artificial sequence
  SiRNA target sequence
tcaaaaaaacacaaaagtt

SEQ ID NO: 117596 - DNA, 19 bp, Artificial sequence
  SiRNA target sequence
caaaaaaacacaaaagtta

SEQ ID NO: 117597 - DNA, 19 bp, Artificial sequence
  SiRNA target sequence
aaaaaaacacaaaagttag

SEQ ID NO: 117598 - DNA, 19 bp, Artificial sequence
  SiRNA target sequence
aaaaaacacaaaagttagt

SEQ ID NO: 117599 - DNA, 19 bp, Artificial sequence
  SiRNA target sequence
aaaaacacaaaagttagtg

SEQ ID NO: 117600 - DNA, 19 bp, Artificial sequence
  SiRNA target sequence
aaaacacaaaagttagtga

SEQ ID NO: 117601 - DNA, 19 bp, Artificial sequence
  SiRNA target sequence
aaacacaaaagttagtgat

SEQ ID NO: 117602 - DNA, 19 bp, Artificial sequence
  SiRNA target sequence
aacacaaaagttagtgata

SEQ ID NO: 117603 - DNA, 19 bp, Artificial sequence
  SiRNA target sequence
acacaaaagttagtgatag

SEQ ID NO: 117604 - DNA, 19 bp, Artificial sequence
  SiRNA target sequence
cacaaaagttagtgatagt

SEQ ID NO: 117605 - DNA, 19 bp, Artificial sequence
  SiRNA target sequence
acaaaagttagtgatagtt

SEQ ID NO: 117606 - DNA, 19 bp, Artificial sequence
  SiRNA target sequence
caaaagttagtgatagttg

SEQ ID NO: 117607 - DNA, 19 bp, Artificial sequence
  SiRNA target sequence
aaaagttagtgatagttga

SEQ ID NO: 117608 - DNA, 19 bp, Artificial sequence
  SiRNA target sequence
aaagttagtgatagttgat

SEQ ID NO: 117609 - DNA, 19 bp, Artificial sequence
  SiRNA target sequence
aagttagtgatagttgatt

SEQ ID NO: 117610 - DNA, 19 bp, Artificial sequence
  SiRNA target sequence
agttagtgatagttgattt

SEQ ID NO: 117611 - DNA, 19 bp, Artificial sequence
  SiRNA target sequence
gttagtgatagttgatttt

SEQ ID NO: 117612 - DNA, 19 bp, Artificial sequence
  SiRNA target sequence
ttagtgatagttgattttg

SEQ ID NO: 117613 - DNA, 19 bp, Artificial sequence
  SiRNA target sequence
tagtgatagttgattttgc

SEQ ID NO: 117614 - DNA, 19 bp, Artificial sequence
  SiRNA target sequence
agtgatagttgattttgca

SEQ ID NO: 117615 - DNA, 19 bp, Artificial sequence
  SiRNA target sequence
gtgatagttgattttgcat

SEQ ID NO: 117616 - DNA, 19 bp, Artificial sequence
  SiRNA target sequence
tgatagttgattttgcata

SEQ ID NO: 117617 - DNA, 19 bp, Artificial sequence
  SiRNA target sequence
gatagttgattttgcatat

SEQ ID NO: 117618 - DNA, 19 bp, Artificial sequence
  SiRNA target sequence
atagttgattttgcatatc

SEQ ID NO: 117619 - DNA, 19 bp, Artificial sequence
  SiRNA target sequence
tagttgattttgcatatcc

SEQ ID NO: 117620 - DNA, 19 bp, Artificial sequence
  SiRNA target sequence
agttgattttgcatatcct

SEQ ID NO: 117621 - DNA, 19 bp, Artificial sequence
  SiRNA target sequence
gttgattttgcatatccta

SEQ ID NO: 117622 - DNA, 19 bp, Artificial sequence
  SiRNA target sequence
ttgattttgcatatcctac

SEQ ID NO: 117623 - DNA, 19 bp, Artificial sequence
  SiRNA target sequence
tgattttgcatatcctact

SEQ ID NO: 117624 - DNA, 19 bp, Artificial sequence
  SiRNA target sequence
gattttgcatatcctactt

SEQ ID NO: 117625 - DNA, 19 bp, Artificial sequence
  SiRNA target sequence
attttgcatatcctacttt

SEQ ID NO: 117626 - DNA, 19 bp, Artificial sequence
  SiRNA target sequence
ttttgcatatcctactttc

SEQ ID NO: 117627 - DNA, 19 bp, Artificial sequence
  SiRNA target sequence
tttgcatatcctactttca

SEQ ID NO: 117628 - DNA, 19 bp, Artificial sequence
  SiRNA target sequence
ttgcatatcctactttcaa

SEQ ID NO: 117629 - DNA, 19 bp, Artificial sequence
  SiRNA target sequence
tgcatatcctactttcaat

SEQ ID NO: 117630 - DNA, 19 bp, Artificial sequence
  SiRNA target sequence
gcatatcctactttcaata

SEQ ID NO: 117631 - DNA, 19 bp, Artificial sequence
  SiRNA target sequence
catatcctactttcaatat

SEQ ID NO: 117632 - DNA, 19 bp, Artificial sequence
  SiRNA target sequence
atatcctactttcaatatt

SEQ ID NO: 117633 - DNA, 19 bp, Artificial sequence
  SiRNA target sequence
tatcctactttcaatattg

SEQ ID NO: 117634 - DNA, 19 bp, Artificial sequence
  SiRNA target sequence
atcctactttcaatattgc

SEQ ID NO: 117635 - DNA, 19 bp, Artificial sequence
  SiRNA target sequence
tcctactttcaatattgcg

SEQ ID NO: 117636 - DNA, 19 bp, Artificial sequence
  SiRNA target sequence
cctactttcaatattgcga

SEQ ID NO: 117637 - DNA, 19 bp, Artificial sequence
  SiRNA target sequence
ctactttcaatattgcgag

SEQ ID NO: 117638 - DNA, 19 bp, Artificial sequence
  SiRNA target sequence
tactttcaatattgcgagt

SEQ ID NO: 117639 - DNA, 19 bp, Artificial sequence
  SiRNA target sequence
actttcaatattgcgagtg

SEQ ID NO: 117640 - DNA, 19 bp, Artificial sequence
  SiRNA target sequence
ctttcaatattgcgagtga

SEQ ID NO: 117641 - DNA, 19 bp, Artificial sequence
  SiRNA target sequence
tttcaatattgcgagtgaa

SEQ ID NO: 117642 - DNA, 19 bp, Artificial sequence
  SiRNA target sequence
ttcaatattgcgagtgaaa

SEQ ID NO: 117643 - DNA, 19 bp, Artificial sequence
  SiRNA target sequence
tcaatattgcgagtgaaat

SEQ ID NO: 117644 - DNA, 19 bp, Artificial sequence
  SiRNA target sequence
caatattgcgagtgaaata

SEQ ID NO: 117645 - DNA, 19 bp, Artificial sequence
  SiRNA target sequence
aatattgcgagtgaaatag

SEQ ID NO: 117646 - DNA, 19 bp, Artificial sequence
  SiRNA target sequence
atattgcgagtgaaatagc

SEQ ID NO: 117647 - DNA, 19 bp, Artificial sequence
  SiRNA target sequence
tattgcgagtgaaatagct

SEQ ID NO: 117648 - DNA, 19 bp, Artificial sequence
  SiRNA target sequence
attgcgagtgaaatagctg

SEQ ID NO: 117649 - DNA, 19 bp, Artificial sequence
  SiRNA target sequence
ttgcgagtgaaatagctgc

SEQ ID NO: 117650 - DNA, 19 bp, Artificial sequence
  SiRNA target sequence
tgcgagtgaaatagctgcg

SEQ ID NO: 117651 - DNA, 19 bp, Artificial sequence
  SiRNA target sequence
gcgagtgaaatagctgcgc

SEQ ID NO: 117652 - DNA, 19 bp, Artificial sequence
  SiRNA target sequence
cgagtgaaatagctgcgca

SEQ ID NO: 117653 - DNA, 19 bp, Artificial sequence
  SiRNA target sequence
gagtgaaatagctgcgcac

SEQ ID NO: 117654 - DNA, 19 bp, Artificial sequence
  SiRNA target sequence
agtgaaatagctgcgcact

SEQ ID NO: 117655 - DNA, 19 bp, Artificial sequence
  SiRNA target sequence
gtgaaatagctgcgcactt

SEQ ID NO: 117656 - DNA, 19 bp, Artificial sequence
  SiRNA target sequence
tgaaatagctgcgcacttt

SEQ ID NO: 117657 - DNA, 19 bp, Artificial sequence
  SiRNA target sequence
gaaatagctgcgcactttt

SEQ ID NO: 117658 - DNA, 19 bp, Artificial sequence
  SiRNA target sequence
aaatagctgcgcactttta

SEQ ID NO: 117659 - DNA, 19 bp, Artificial sequence
  SiRNA target sequence
aatagctgcgcacttttac

SEQ ID NO: 117660 - DNA, 19 bp, Artificial sequence
  SiRNA target sequence
atagctgcgcacttttacg

SEQ ID NO: 117661 - DNA, 19 bp, Artificial sequence
  SiRNA target sequence
tagctgcgcacttttacga

SEQ ID NO: 117662 - DNA, 19 bp, Artificial sequence
  SiRNA target sequence
agctgcgcacttttacgaa

SEQ ID NO: 117663 - DNA, 19 bp, Artificial sequence
  SiRNA target sequence
gctgcgcacttttacgaaa

SEQ ID NO: 117664 - DNA, 19 bp, Artificial sequence
  SiRNA target sequence
ctgcgcacttttacgaaaa

SEQ ID NO: 117665 - DNA, 19 bp, Artificial sequence
  SiRNA target sequence
tgcgcacttttacgaaaaa

SEQ ID NO: 117666 - DNA, 19 bp, Artificial sequence
  SiRNA target sequence
gcgcacttttacgaaaaat

SEQ ID NO: 117667 - DNA, 19 bp, Artificial sequence
  SiRNA target sequence
cgcacttttacgaaaaatt

SEQ ID NO: 117668 - DNA, 19 bp, Artificial sequence
  SiRNA target sequence
gcacttttacgaaaaattt

SEQ ID NO: 117669 - DNA, 19 bp, Artificial sequence
  SiRNA target sequence
cacttttacgaaaaattta

SEQ ID NO: 117670 - DNA, 19 bp, Artificial sequence
  SiRNA target sequence
acttttacgaaaaatttaa

SEQ ID NO: 117671 - DNA, 19 bp, Artificial sequence
  SiRNA target sequence
cttttacgaaaaatttaaa

SEQ ID NO: 117672 - DNA, 19 bp, Artificial sequence
  SiRNA target sequence
ttttacgaaaaatttaaag

SEQ ID NO: 117673 - DNA, 19 bp, Artificial sequence
  SiRNA target sequence
tttacgaaaaatttaaaga

SEQ ID NO: 117674 - DNA, 19 bp, Artificial sequence
  SiRNA target sequence
ttacgaaaaatttaaagat

SEQ ID NO: 117675 - DNA, 19 bp, Artificial sequence
  SiRNA target sequence
tacgaaaaatttaaagata

SEQ ID NO: 117676 - DNA, 19 bp, Artificial sequence
  SiRNA target sequence
acgaaaaatttaaagatat

SEQ ID NO: 117677 - DNA, 19 bp, Artificial sequence
  SiRNA target sequence
cgaaaaatttaaagatata

SEQ ID NO: 117678 - DNA, 19 bp, Artificial sequence
  SiRNA target sequence
gaaaaatttaaagatataa

SEQ ID NO: 117679 - DNA, 19 bp, Artificial sequence
  SiRNA target sequence
aaaaatttaaagatataaa

SEQ ID NO: 117680 - DNA, 19 bp, Artificial sequence
  SiRNA target sequence
aaaatttaaagatataaaa

SEQ ID NO: 117681 - DNA, 19 bp, Artificial sequence
  SiRNA target sequence
aaatttaaagatataaaaa

SEQ ID NO: 117682 - DNA, 19 bp, Artificial sequence
  SiRNA target sequence
aatttaaagatataaaaat

SEQ ID NO: 117683 - DNA, 19 bp, Artificial sequence
  SiRNA target sequence
atttaaagatataaaaatt

SEQ ID NO: 117684 - DNA, 19 bp, Artificial sequence
  SiRNA target sequence
tttaaagatataaaaatta

SEQ ID NO: 117685 - DNA, 19 bp, Artificial sequence
  SiRNA target sequence
ttaaagatataaaaattat

SEQ ID NO: 117686 - DNA, 19 bp, Artificial sequence
  SiRNA target sequence
taaagatataaaaattatg

SEQ ID NO: 117687 - DNA, 19 bp, Artificial sequence
  SiRNA target sequence
aaagatataaaaattatgc

SEQ ID NO: 117688 - DNA, 19 bp, Artificial sequence
  SiRNA target sequence
aagatataaaaattatgcg

SEQ ID NO: 117689 - DNA, 19 bp, Artificial sequence
  SiRNA target sequence
agatataaaaattatgcgt

SEQ ID NO: 117690 - DNA, 19 bp, Artificial sequence
  SiRNA target sequence
gatataaaaattatgcgtg

SEQ ID NO: 117691 - DNA, 19 bp, Artificial sequence
  SiRNA target sequence
atataaaaattatgcgtgt

SEQ ID NO: 117692 - DNA, 19 bp, Artificial sequence
  SiRNA target sequence
tataaaaattatgcgtgtt

SEQ ID NO: 117693 - DNA, 19 bp, Artificial sequence
  SiRNA target sequence
ataaaaattatgcgtgttc

SEQ ID NO: 117694 - DNA, 19 bp, Artificial sequence
  SiRNA target sequence
taaaaattatgcgtgttct

SEQ ID NO: 117695 - DNA, 19 bp, Artificial sequence
  SiRNA target sequence
aaaaattatgcgtgttctt

SEQ ID NO: 117696 - DNA, 19 bp, Artificial sequence
  SiRNA target sequence
aaaattatgcgtgttcttg

SEQ ID NO: 117697 - DNA, 19 bp, Artificial sequence
  SiRNA target sequence
aaattatgcgtgttcttgc

SEQ ID NO: 117698 - DNA, 19 bp, Artificial sequence
  SiRNA target sequence
aattatgcgtgttcttgcg

SEQ ID NO: 117699 - DNA, 19 bp, Artificial sequence
  SiRNA target sequence
attatgcgtgttcttgcgc

SEQ ID NO: 117700 - DNA, 19 bp, Artificial sequence
  SiRNA target sequence
ttatgcgtgttcttgcgca

SEQ ID NO: 117701 - DNA, 19 bp, Artificial sequence
  SiRNA target sequence
tatgcgtgttcttgcgcaa

SEQ ID NO: 117702 - DNA, 19 bp, Artificial sequence
  SiRNA target sequence
atgcgtgttcttgcgcaag

SEQ ID NO: 117703 - DNA, 19 bp, Artificial sequence
  SiRNA target sequence
tgcgtgttcttgcgcaaga

SEQ ID NO: 117704 - DNA, 19 bp, Artificial sequence
  SiRNA target sequence
gcgtgttcttgcgcaagat

SEQ ID NO: 117705 - DNA, 19 bp, Artificial sequence
  SiRNA target sequence
cgtgttcttgcgcaagata

SEQ ID NO: 117706 - DNA, 19 bp, Artificial sequence
  SiRNA target sequence
gtgttcttgcgcaagatat

SEQ ID NO: 117707 - DNA, 19 bp, Artificial sequence
  SiRNA target sequence
tgttcttgcgcaagatatt

SEQ ID NO: 117708 - DNA, 19 bp, Artificial sequence
  SiRNA target sequence
gttcttgcgcaagatattc

SEQ ID NO: 117709 - DNA, 19 bp, Artificial sequence
  SiRNA target sequence
ttcttgcgcaagatattcc

SEQ ID NO: 117710 - DNA, 19 bp, Artificial sequence
  SiRNA target sequence
tcttgcgcaagatattcct

SEQ ID NO: 117711 - DNA, 19 bp, Artificial sequence
  SiRNA target sequence
cttgcgcaagatattccta

SEQ ID NO: 117712 - DNA, 19 bp, Artificial sequence
  SiRNA target sequence
ttgcgcaagatattcctac

SEQ ID NO: 117713 - DNA, 19 bp, Artificial sequence
  SiRNA target sequence
tgcgcaagatattcctaca

SEQ ID NO: 117714 - DNA, 19 bp, Artificial sequence
  SiRNA target sequence
gcgcaagatattcctacac

SEQ ID NO: 117715 - DNA, 19 bp, Artificial sequence
  SiRNA target sequence
cgcaagatattcctacacc

SEQ ID NO: 117716 - DNA, 19 bp, Artificial sequence
  SiRNA target sequence
gcaagatattcctacaccg

SEQ ID NO: 117717 - DNA, 19 bp, Artificial sequence
  SiRNA target sequence
caagatattcctacaccgt

SEQ ID NO: 117718 - DNA, 19 bp, Artificial sequence
  SiRNA target sequence
aagatattcctacaccgta

SEQ ID NO: 117719 - DNA, 19 bp, Artificial sequence
  SiRNA target sequence
agatattcctacaccgtat

SEQ ID NO: 117720 - DNA, 19 bp, Artificial sequence
  SiRNA target sequence
gatattcctacaccgtatg

SEQ ID NO: 117721 - DNA, 19 bp, Artificial sequence
  SiRNA target sequence
atattcctacaccgtatgc

SEQ ID NO: 117722 - DNA, 19 bp, Artificial sequence
  SiRNA target sequence
tattcctacaccgtatgca

SEQ ID NO: 117723 - DNA, 19 bp, Artificial sequence
  SiRNA target sequence
attcctacaccgtatgcac

SEQ ID NO: 117724 - DNA, 19 bp, Artificial sequence
  SiRNA target sequence
ttcctacaccgtatgcact

SEQ ID NO: 117725 - DNA, 19 bp, Artificial sequence
  SiRNA target sequence
tcctacaccgtatgcactt

SEQ ID NO: 117726 - DNA, 19 bp, Artificial sequence
  SiRNA target sequence
cctacaccgtatgcactta

SEQ ID NO: 117727 - DNA, 19 bp, Artificial sequence
  SiRNA target sequence
ctacaccgtatgcacttaa

SEQ ID NO: 117728 - DNA, 19 bp, Artificial sequence
  SiRNA target sequence
tacaccgtatgcacttaat

SEQ ID NO: 117729 - DNA, 19 bp, Artificial sequence
  SiRNA target sequence
acaccgtatgcacttaatc

SEQ ID NO: 117730 - DNA, 19 bp, Artificial sequence
  SiRNA target sequence
caccgtatgcacttaatct

SEQ ID NO: 117731 - DNA, 19 bp, Artificial sequence
  SiRNA target sequence
accgtatgcacttaatctt

SEQ ID NO: 117732 - DNA, 19 bp, Artificial sequence
  SiRNA target sequence
ccgtatgcacttaatcttg

SEQ ID NO: 117733 - DNA, 19 bp, Artificial sequence
  SiRNA target sequence
cgtatgcacttaatcttga

SEQ ID NO: 117734 - DNA, 19 bp, Artificial sequence
  SiRNA target sequence
gtatgcacttaatcttgaa

SEQ ID NO: 117735 - DNA, 19 bp, Artificial sequence
  SiRNA target sequence
tatgcacttaatcttgaaa

SEQ ID NO: 117736 - DNA, 19 bp, Artificial sequence
  SiRNA target sequence
atgcacttaatcttgaaaa

SEQ ID NO: 117737 - DNA, 19 bp, Artificial sequence
  SiRNA target sequence
tgcacttaatcttgaaaaa

SEQ ID NO: 117738 - DNA, 19 bp, Artificial sequence
  SiRNA target sequence
gcacttaatcttgaaaaaa

SEQ ID NO: 117739 - DNA, 19 bp, Artificial sequence
  SiRNA target sequence
cacttaatcttgaaaaaat

SEQ ID NO: 117740 - DNA, 19 bp, Artificial sequence
  SiRNA target sequence
acttaatcttgaaaaaatg

SEQ ID NO: 117741 - DNA, 19 bp, Artificial sequence
  SiRNA target sequence
cttaatcttgaaaaaatgt

SEQ ID NO: 117742 - DNA, 19 bp, Artificial sequence
  SiRNA target sequence
ttaatcttgaaaaaatgtc

SEQ ID NO: 117743 - DNA, 19 bp, Artificial sequence
  SiRNA target sequence
taatcttgaaaaaatgtct

SEQ ID NO: 117744 - DNA, 19 bp, Artificial sequence
  SiRNA target sequence
aatcttgaaaaaatgtctt

SEQ ID NO: 117745 - DNA, 19 bp, Artificial sequence
  SiRNA target sequence
atcttgaaaaaatgtctta

SEQ ID NO: 117746 - DNA, 19 bp, Artificial sequence
  SiRNA target sequence
tcttgaaaaaatgtcttat

SEQ ID NO: 117747 - DNA, 19 bp, Artificial sequence
  SiRNA target sequence
cttgaaaaaatgtcttatc

SEQ ID NO: 117748 - DNA, 19 bp, Artificial sequence
  SiRNA target sequence
ttgaaaaaatgtcttatcc

SEQ ID NO: 117749 - DNA, 19 bp, Artificial sequence
  SiRNA target sequence
tgaaaaaatgtcttatccg

SEQ ID NO: 117750 - DNA, 19 bp, Artificial sequence
  SiRNA target sequence
gaaaaaatgtcttatccga

SEQ ID NO: 117751 - DNA, 19 bp, Artificial sequence
  SiRNA target sequence
aaaaaatgtcttatccgac

SEQ ID NO: 117752 - DNA, 19 bp, Artificial sequence
  SiRNA target sequence
aaaaatgtcttatccgaca

SEQ ID NO: 117753 - DNA, 19 bp, Artificial sequence
  SiRNA target sequence
aaaatgtcttatccgacat

SEQ ID NO: 117754 - DNA, 19 bp, Artificial sequence
  SiRNA target sequence
aaatgtcttatccgacatg

SEQ ID NO: 117755 - DNA, 19 bp, Artificial sequence
  SiRNA target sequence
aatgtcttatccgacatgc

SEQ ID NO: 117756 - DNA, 19 bp, Artificial sequence
  SiRNA target sequence
atgtcttatccgacatgca

SEQ ID NO: 117757 - DNA, 19 bp, Artificial sequence
  SiRNA target sequence
tgtcttatccgacatgcaa

SEQ ID NO: 117758 - DNA, 19 bp, Artificial sequence
  SiRNA target sequence
gtcttatccgacatgcaat

SEQ ID NO: 117759 - DNA, 19 bp, Artificial sequence
  SiRNA target sequence
tcttatccgacatgcaatg

SEQ ID NO: 117760 - DNA, 19 bp, Artificial sequence
  SiRNA target sequence
cttatccgacatgcaatga

SEQ ID NO: 117761 - DNA, 19 bp, Artificial sequence
  SiRNA target sequence
ttatccgacatgcaatgat

SEQ ID NO: 117762 - DNA, 19 bp, Artificial sequence
  SiRNA target sequence
tatccgacatgcaatgata

SEQ ID NO: 117763 - DNA, 19 bp, Artificial sequence
  SiRNA target sequence
atccgacatgcaatgatat

SEQ ID NO: 117764 - DNA, 19 bp, Artificial sequence
  SiRNA target sequence
tccgacatgcaatgatatt

SEQ ID NO: 117765 - DNA, 19 bp, Artificial sequence
  SiRNA target sequence
ccgacatgcaatgatattg

SEQ ID NO: 117766 - DNA, 19 bp, Artificial sequence
  SiRNA target sequence
cgacatgcaatgatattgt

SEQ ID NO: 117767 - DNA, 19 bp, Artificial sequence
  SiRNA target sequence
gacatgcaatgatattgta

SEQ ID NO: 117768 - DNA, 19 bp, Artificial sequence
  SiRNA target sequence
acatgcaatgatattgtaa

SEQ ID NO: 117769 - DNA, 19 bp, Artificial sequence
  SiRNA target sequence
catgcaatgatattgtaaa

SEQ ID NO: 117770 - DNA, 19 bp, Artificial sequence
  SiRNA target sequence
atgcaatgatattgtaaat

SEQ ID NO: 117771 - DNA, 19 bp, Artificial sequence
  SiRNA target sequence
tgcaatgatattgtaaatg

SEQ ID NO: 117772 - DNA, 19 bp, Artificial sequence
  SiRNA target sequence
gcaatgatattgtaaatgc

SEQ ID NO: 117773 - DNA, 19 bp, Artificial sequence
  SiRNA target sequence
caatgatattgtaaatgct

SEQ ID NO: 117774 - DNA, 19 bp, Artificial sequence
  SiRNA target sequence
aatgatattgtaaatgctg

SEQ ID NO: 117775 - DNA, 19 bp, Artificial sequence
  SiRNA target sequence
atgatattgtaaatgctgt

SEQ ID NO: 117776 - DNA, 19 bp, Artificial sequence
  SiRNA target sequence
tgatattgtaaatgctgtt

SEQ ID NO: 117777 - DNA, 19 bp, Artificial sequence
  SiRNA target sequence
gatattgtaaatgctgtta

SEQ ID NO: 117778 - DNA, 19 bp, Artificial sequence
  SiRNA target sequence
atattgtaaatgctgttac

SEQ ID NO: 117779 - DNA, 19 bp, Artificial sequence
  SiRNA target sequence
tattgtaaatgctgttaca

SEQ ID NO: 117780 - DNA, 19 bp, Artificial sequence
  SiRNA target sequence
attgtaaatgctgttacaa

SEQ ID NO: 117781 - DNA, 19 bp, Artificial sequence
  SiRNA target sequence
ttgtaaatgctgttacaaa

SEQ ID NO: 117782 - DNA, 19 bp, Artificial sequence
  SiRNA target sequence
tgtaaatgctgttacaaaa

SEQ ID NO: 117783 - DNA, 19 bp, Artificial sequence
  SiRNA target sequence
gtaaatgctgttacaaaaa

SEQ ID NO: 117784 - DNA, 19 bp, Artificial sequence
  SiRNA target sequence
taaatgctgttacaaaaat

SEQ ID NO: 117785 - DNA, 19 bp, Artificial sequence
  SiRNA target sequence
aaatgctgttacaaaaata

SEQ ID NO: 117786 - DNA, 19 bp, Artificial sequence
  SiRNA target sequence
aatgctgttacaaaaataa

SEQ ID NO: 117787 - DNA, 19 bp, Artificial sequence
  SiRNA target sequence
atgctgttacaaaaataaa

SEQ ID NO: 117788 - DNA, 19 bp, Artificial sequence
  SiRNA target sequence
tgctgttacaaaaataaat

SEQ ID NO: 117789 - DNA, 19 bp, Artificial sequence
  SiRNA target sequence
gctgttacaaaaataaatt

SEQ ID NO: 117790 - DNA, 19 bp, Artificial sequence
  SiRNA target sequence
ctgttacaaaaataaattc

SEQ ID NO: 117791 - DNA, 19 bp, Artificial sequence
  SiRNA target sequence
tgttacaaaaataaattca

SEQ ID NO: 117792 - DNA, 19 bp, Artificial sequence
  SiRNA target sequence
gttacaaaaataaattcat

SEQ ID NO: 117793 - DNA, 19 bp, Artificial sequence
  SiRNA target sequence
ttacaaaaataaattcata

SEQ ID NO: 117794 - DNA, 19 bp, Artificial sequence
  SiRNA target sequence
tacaaaaataaattcatag

SEQ ID NO: 117795 - DNA, 20 bp, Artificial sequence
  SiRNA target sequence
atgatagaaattcgcgatct

SEQ ID NO: 117796 - DNA, 20 bp, Artificial sequence
  SiRNA target sequence
tgatagaaattcgcgatctt

SEQ ID NO: 117797 - DNA, 20 bp, Artificial sequence
  SiRNA target sequence
gatagaaattcgcgatctta

SEQ ID NO: 117798 - DNA, 20 bp, Artificial sequence
  SiRNA target sequence
atagaaattcgcgatcttat

SEQ ID NO: 117799 - DNA, 20 bp, Artificial sequence
  SiRNA target sequence
tagaaattcgcgatcttata

SEQ ID NO: 117800 - DNA, 20 bp, Artificial sequence
  SiRNA target sequence
agaaattcgcgatcttataa

SEQ ID NO: 117801 - DNA, 20 bp, Artificial sequence
  SiRNA target sequence
gaaattcgcgatcttataaa

SEQ ID NO: 117802 - DNA, 20 bp, Artificial sequence
  SiRNA target sequence
aaattcgcgatcttataaat

SEQ ID NO: 117803 - DNA, 20 bp, Artificial sequence
  SiRNA target sequence
aattcgcgatcttataaatc

SEQ ID NO: 117804 - DNA, 20 bp, Artificial sequence
  SiRNA target sequence
attcgcgatcttataaatca

SEQ ID NO: 117805 - DNA, 20 bp, Artificial sequence
  SiRNA target sequence
ttcgcgatcttataaatcaa

SEQ ID NO: 117806 - DNA, 20 bp, Artificial sequence
  SiRNA target sequence
tcgcgatcttataaatcaag

SEQ ID NO: 117807 - DNA, 20 bp, Artificial sequence
  SiRNA target sequence
cgcgatcttataaatcaagc

SEQ ID NO: 117808 - DNA, 20 bp, Artificial sequence
  SiRNA target sequence
gcgatcttataaatcaagca

SEQ ID NO: 117809 - DNA, 20 bp, Artificial sequence
  SiRNA target sequence
cgatcttataaatcaagcat

SEQ ID NO: 117810 - DNA, 20 bp, Artificial sequence
  SiRNA target sequence
gatcttataaatcaagcatt

SEQ ID NO: 117811 - DNA, 20 bp, Artificial sequence
  SiRNA target sequence
atcttataaatcaagcattg

SEQ ID NO: 117812 - DNA, 20 bp, Artificial sequence
  SiRNA target sequence
tcttataaatcaagcattgg

SEQ ID NO: 117813 - DNA, 20 bp, Artificial sequence
  SiRNA target sequence
cttataaatcaagcattgga

SEQ ID NO: 117814 - DNA, 20 bp, Artificial sequence
  SiRNA target sequence
ttataaatcaagcattggat

SEQ ID NO: 117815 - DNA, 20 bp, Artificial sequence
  SiRNA target sequence
tataaatcaagcattggatg

SEQ ID NO: 117816 - DNA, 20 bp, Artificial sequence
  SiRNA target sequence
ataaatcaagcattggatga

SEQ ID NO: 117817 - DNA, 20 bp, Artificial sequence
  SiRNA target sequence
taaatcaagcattggatgag

SEQ ID NO: 117818 - DNA, 20 bp, Artificial sequence
  SiRNA target sequence
aaatcaagcattggatgagg

SEQ ID NO: 117819 - DNA, 20 bp, Artificial sequence
  SiRNA target sequence
aatcaagcattggatgagga

SEQ ID NO: 117820 - DNA, 20 bp, Artificial sequence
  SiRNA target sequence
atcaagcattggatgaggaa

SEQ ID NO: 117821 - DNA, 20 bp, Artificial sequence
  SiRNA target sequence
tcaagcattggatgaggaaa

SEQ ID NO: 117822 - DNA, 20 bp, Artificial sequence
  SiRNA target sequence
caagcattggatgaggaaat

SEQ ID NO: 117823 - DNA, 20 bp, Artificial sequence
  SiRNA target sequence
aagcattggatgaggaaatg

SEQ ID NO: 117824 - DNA, 20 bp, Artificial sequence
  SiRNA target sequence
agcattggatgaggaaatgg

SEQ ID NO: 117825 - DNA, 20 bp, Artificial sequence
  SiRNA target sequence
gcattggatgaggaaatggg

SEQ ID NO: 117826 - DNA, 20 bp, Artificial sequence
  SiRNA target sequence
cattggatgaggaaatggga

SEQ ID NO: 117827 - DNA, 20 bp, Artificial sequence
  SiRNA target sequence
attggatgaggaaatgggaa

SEQ ID NO: 117828 - DNA, 20 bp, Artificial sequence
  SiRNA target sequence
ttggatgaggaaatgggaat

SEQ ID NO: 117829 - DNA, 20 bp, Artificial sequence
  SiRNA target sequence
tggatgaggaaatgggaatg

SEQ ID NO: 117830 - DNA, 20 bp, Artificial sequence
  SiRNA target sequence
ggatgaggaaatgggaatgg

SEQ ID NO: 117831 - DNA, 20 bp, Artificial sequence
  SiRNA target sequence
gatgaggaaatgggaatgga

SEQ ID NO: 117832 - DNA, 20 bp, Artificial sequence
  SiRNA target sequence
atgaggaaatgggaatggat

SEQ ID NO: 117833 - DNA, 20 bp, Artificial sequence
  SiRNA target sequence
tgaggaaatgggaatggatc

SEQ ID NO: 117834 - DNA, 20 bp, Artificial sequence
  SiRNA target sequence
gaggaaatgggaatggatca

SEQ ID NO: 117835 - DNA, 20 bp, Artificial sequence
  SiRNA target sequence
aggaaatgggaatggatcat

SEQ ID NO: 117836 - DNA, 20 bp, Artificial sequence
  SiRNA target sequence
ggaaatgggaatggatcata

SEQ ID NO: 117837 - DNA, 20 bp, Artificial sequence
  SiRNA target sequence
gaaatgggaatggatcataa

SEQ ID NO: 117838 - DNA, 20 bp, Artificial sequence
  SiRNA target sequence
aaatgggaatggatcataat

SEQ ID NO: 117839 - DNA, 20 bp, Artificial sequence
  SiRNA target sequence
aatgggaatggatcataatg

SEQ ID NO: 117840 - DNA, 20 bp, Artificial sequence
  SiRNA target sequence
atgggaatggatcataatgt

SEQ ID NO: 117841 - DNA, 20 bp, Artificial sequence
  SiRNA target sequence
tgggaatggatcataatgta

SEQ ID NO: 117842 - DNA, 20 bp, Artificial sequence
  SiRNA target sequence
gggaatggatcataatgtat

SEQ ID NO: 117843 - DNA, 20 bp, Artificial sequence
  SiRNA target sequence
ggaatggatcataatgtata

SEQ ID NO: 117844 - DNA, 20 bp, Artificial sequence
  SiRNA target sequence
gaatggatcataatgtatat

SEQ ID NO: 117845 - DNA, 20 bp, Artificial sequence
  SiRNA target sequence
aatggatcataatgtatata

SEQ ID NO: 117846 - DNA, 20 bp, Artificial sequence
  SiRNA target sequence
atggatcataatgtatatat

SEQ ID NO: 117847 - DNA, 20 bp, Artificial sequence
  SiRNA target sequence
tggatcataatgtatatata

SEQ ID NO: 117848 - DNA, 20 bp, Artificial sequence
  SiRNA target sequence
ggatcataatgtatatataa

SEQ ID NO: 117849 - DNA, 20 bp, Artificial sequence
  SiRNA target sequence
gatcataatgtatatataat

SEQ ID NO: 117850 - DNA, 20 bp, Artificial sequence
  SiRNA target sequence
atcataatgtatatataata

SEQ ID NO: 117851 - DNA, 20 bp, Artificial sequence
  SiRNA target sequence
tcataatgtatatataatag

SEQ ID NO: 117852 - DNA, 20 bp, Artificial sequence
  SiRNA target sequence
cataatgtatatataatagg

SEQ ID NO: 117853 - DNA, 20 bp, Artificial sequence
  SiRNA target sequence
ataatgtatatataatagga

SEQ ID NO: 117854 - DNA, 20 bp, Artificial sequence
  SiRNA target sequence
taatgtatatataataggag

SEQ ID NO: 117855 - DNA, 20 bp, Artificial sequence
  SiRNA target sequence
aatgtatatataataggaga

SEQ ID NO: 117856 - DNA, 20 bp, Artificial sequence
  SiRNA target sequence
atgtatatataataggagaa

SEQ ID NO: 117857 - DNA, 20 bp, Artificial sequence
  SiRNA target sequence
tgtatatataataggagaag

SEQ ID NO: 117858 - DNA, 20 bp, Artificial sequence
  SiRNA target sequence
gtatatataataggagaaga

SEQ ID NO: 117859 - DNA, 20 bp, Artificial sequence
  SiRNA target sequence
tatatataataggagaagaa

SEQ ID NO: 117860 - DNA, 20 bp, Artificial sequence
  SiRNA target sequence
atatataataggagaagaag

SEQ ID NO: 117861 - DNA, 20 bp, Artificial sequence
  SiRNA target sequence
tatataataggagaagaagt

SEQ ID NO: 117862 - DNA, 20 bp, Artificial sequence
  SiRNA target sequence
atataataggagaagaagta

SEQ ID NO: 117863 - DNA, 20 bp, Artificial sequence
  SiRNA target sequence
tataataggagaagaagtag

SEQ ID NO: 117864 - DNA, 20 bp, Artificial sequence
  SiRNA target sequence
ataataggagaagaagtagg

SEQ ID NO: 117865 - DNA, 20 bp, Artificial sequence
  SiRNA target sequence
taataggagaagaagtaggc

SEQ ID NO: 117866 - DNA, 20 bp, Artificial sequence
  SiRNA target sequence
aataggagaagaagtaggca

SEQ ID NO: 117867 - DNA, 20 bp, Artificial sequence
  SiRNA target sequence
ataggagaagaagtaggcat

SEQ ID NO: 117868 - DNA, 20 bp, Artificial sequence
  SiRNA target sequence
taggagaagaagtaggcatc

SEQ ID NO: 117869 - DNA, 20 bp, Artificial sequence
  SiRNA target sequence
aggagaagaagtaggcatct

SEQ ID NO: 117870 - DNA, 20 bp, Artificial sequence
  SiRNA target sequence
ggagaagaagtaggcatctc

SEQ ID NO: 117871 - DNA, 20 bp, Artificial sequence
  SiRNA target sequence
gagaagaagtaggcatctct

SEQ ID NO: 117872 - DNA, 20 bp, Artificial sequence
  SiRNA target sequence
agaagaagtaggcatctctg

SEQ ID NO: 117873 - DNA, 20 bp, Artificial sequence
  SiRNA target sequence
gaagaagtaggcatctctgg

SEQ ID NO: 117874 - DNA, 20 bp, Artificial sequence
  SiRNA target sequence
aagaagtaggcatctctggt

SEQ ID NO: 117875 - DNA, 20 bp, Artificial sequence
  SiRNA target sequence
agaagtaggcatctctggtg

SEQ ID NO: 117876 - DNA, 20 bp, Artificial sequence
  SiRNA target sequence
gaagtaggcatctctggtgg

SEQ ID NO: 117877 - DNA, 20 bp, Artificial sequence
  SiRNA target sequence
aagtaggcatctctggtggt

SEQ ID NO: 117878 - DNA, 20 bp, Artificial sequence
  SiRNA target sequence
agtaggcatctctggtggtc

SEQ ID NO: 117879 - DNA, 20 bp, Artificial sequence
  SiRNA target sequence
gtaggcatctctggtggtcc

SEQ ID NO: 117880 - DNA, 20 bp, Artificial sequence
  SiRNA target sequence
taggcatctctggtggtcct

SEQ ID NO: 117881 - DNA, 20 bp, Artificial sequence
  SiRNA target sequence
aggcatctctggtggtcctc

SEQ ID NO: 117882 - DNA, 20 bp, Artificial sequence
  SiRNA target sequence
ggcatctctggtggtcctca

SEQ ID NO: 117883 - DNA, 20 bp, Artificial sequence
  SiRNA target sequence
gcatctctggtggtcctcac

SEQ ID NO: 117884 - DNA, 20 bp, Artificial sequence
  SiRNA target sequence
catctctggtggtcctcacg

SEQ ID NO: 117885 - DNA, 20 bp, Artificial sequence
  SiRNA target sequence
atctctggtggtcctcacgg

SEQ ID NO: 117886 - DNA, 20 bp, Artificial sequence
  SiRNA target sequence
tctctggtggtcctcacggt

SEQ ID NO: 117887 - DNA, 20 bp, Artificial sequence
  SiRNA target sequence
ctctggtggtcctcacggtc

SEQ ID NO: 117888 - DNA, 20 bp, Artificial sequence
  SiRNA target sequence
tctggtggtcctcacggtct

SEQ ID NO: 117889 - DNA, 20 bp, Artificial sequence
  SiRNA target sequence
ctggtggtcctcacggtctt

SEQ ID NO: 117890 - DNA, 20 bp, Artificial sequence
  SiRNA target sequence
tggtggtcctcacggtctta

SEQ ID NO: 117891 - DNA, 20 bp, Artificial sequence
  SiRNA target sequence
ggtggtcctcacggtcttac

SEQ ID NO: 117892 - DNA, 20 bp, Artificial sequence
  SiRNA target sequence
gtggtcctcacggtcttact

SEQ ID NO: 117893 - DNA, 20 bp, Artificial sequence
  SiRNA target sequence
tggtcctcacggtcttacta

SEQ ID NO: 117894 - DNA, 20 bp, Artificial sequence
  SiRNA target sequence
ggtcctcacggtcttactaa

SEQ ID NO: 117895 - DNA, 20 bp, Artificial sequence
  SiRNA target sequence
gtcctcacggtcttactaaa

SEQ ID NO: 117896 - DNA, 20 bp, Artificial sequence
  SiRNA target sequence
tcctcacggtcttactaaaa

SEQ ID NO: 117897 - DNA, 20 bp, Artificial sequence
  SiRNA target sequence
cctcacggtcttactaaaaa

SEQ ID NO: 117898 - DNA, 20 bp, Artificial sequence
  SiRNA target sequence
ctcacggtcttactaaaaat

SEQ ID NO: 117899 - DNA, 20 bp, Artificial sequence
  SiRNA target sequence
tcacggtcttactaaaaatt

SEQ ID NO: 117900 - DNA, 20 bp, Artificial sequence
  SiRNA target sequence
cacggtcttactaaaaattt

SEQ ID NO: 117901 - DNA, 20 bp, Artificial sequence
  SiRNA target sequence
acggtcttactaaaaatttg

SEQ ID NO: 117902 - DNA, 20 bp, Artificial sequence
  SiRNA target sequence
cggtcttactaaaaatttga

SEQ ID NO: 117903 - DNA, 20 bp, Artificial sequence
  SiRNA target sequence
ggtcttactaaaaatttgat

SEQ ID NO: 117904 - DNA, 20 bp, Artificial sequence
  SiRNA target sequence
gtcttactaaaaatttgatc

SEQ ID NO: 117905 - DNA, 20 bp, Artificial sequence
  SiRNA target sequence
tcttactaaaaatttgatca

SEQ ID NO: 117906 - DNA, 20 bp, Artificial sequence
  SiRNA target sequence
cttactaaaaatttgatcaa

SEQ ID NO: 117907 - DNA, 20 bp, Artificial sequence
  SiRNA target sequence
ttactaaaaatttgatcaaa

SEQ ID NO: 117908 - DNA, 20 bp, Artificial sequence
  SiRNA target sequence
tactaaaaatttgatcaaaa

SEQ ID NO: 117909 - DNA, 20 bp, Artificial sequence
  SiRNA target sequence
actaaaaatttgatcaaaaa

SEQ ID NO: 117910 - DNA, 20 bp, Artificial sequence
  SiRNA target sequence
ctaaaaatttgatcaaaaaa

SEQ ID NO: 117911 - DNA, 20 bp, Artificial sequence
  SiRNA target sequence
taaaaatttgatcaaaaaat

SEQ ID NO: 117912 - DNA, 20 bp, Artificial sequence
  SiRNA target sequence
aaaaatttgatcaaaaaata

SEQ ID NO: 117913 - DNA, 20 bp, Artificial sequence
  SiRNA target sequence
aaaatttgatcaaaaaatac

SEQ ID NO: 117914 - DNA, 20 bp, Artificial sequence
  SiRNA target sequence
aaatttgatcaaaaaatacg

SEQ ID NO: 117915 - DNA, 20 bp, Artificial sequence
  SiRNA target sequence
aatttgatcaaaaaatacgg

SEQ ID NO: 117916 - DNA, 20 bp, Artificial sequence
  SiRNA target sequence
atttgatcaaaaaatacggc

SEQ ID NO: 117917 - DNA, 20 bp, Artificial sequence
  SiRNA target sequence
tttgatcaaaaaatacggcg

SEQ ID NO: 117918 - DNA, 20 bp, Artificial sequence
  SiRNA target sequence
ttgatcaaaaaatacggcga

SEQ ID NO: 117919 - DNA, 20 bp, Artificial sequence
  SiRNA target sequence
tgatcaaaaaatacggcgat

SEQ ID NO: 117920 - DNA, 20 bp, Artificial sequence
  SiRNA target sequence
gatcaaaaaatacggcgatc

SEQ ID NO: 117921 - DNA, 20 bp, Artificial sequence
  SiRNA target sequence
atcaaaaaatacggcgatca

SEQ ID NO: 117922 - DNA, 20 bp, Artificial sequence
  SiRNA target sequence
tcaaaaaatacggcgatcaa

SEQ ID NO: 117923 - DNA, 20 bp, Artificial sequence
  SiRNA target sequence
caaaaaatacggcgatcaaa

SEQ ID NO: 117924 - DNA, 20 bp, Artificial sequence
  SiRNA target sequence
aaaaaatacggcgatcaaag

SEQ ID NO: 117925 - DNA, 20 bp, Artificial sequence
  SiRNA target sequence
aaaaatacggcgatcaaaga

SEQ ID NO: 117926 - DNA, 20 bp, Artificial sequence
  SiRNA target sequence
aaaatacggcgatcaaagag

SEQ ID NO: 117927 - DNA, 20 bp, Artificial sequence
  SiRNA target sequence
aaatacggcgatcaaagagt

SEQ ID NO: 117928 - DNA, 20 bp, Artificial sequence
  SiRNA target sequence
aatacggcgatcaaagagtg

SEQ ID NO: 117929 - DNA, 20 bp, Artificial sequence
  SiRNA target sequence
atacggcgatcaaagagtga

SEQ ID NO: 117930 - DNA, 20 bp, Artificial sequence
  SiRNA target sequence
tacggcgatcaaagagtgaa

SEQ ID NO: 117931 - DNA, 20 bp, Artificial sequence
  SiRNA target sequence
acggcgatcaaagagtgaag

SEQ ID NO: 117932 - DNA, 20 bp, Artificial sequence
  SiRNA target sequence
cggcgatcaaagagtgaagg

SEQ ID NO: 117933 - DNA, 20 bp, Artificial sequence
  SiRNA target sequence
ggcgatcaaagagtgaagga

SEQ ID NO: 117934 - DNA, 20 bp, Artificial sequence
  SiRNA target sequence
gcgatcaaagagtgaaggat

SEQ ID NO: 117935 - DNA, 20 bp, Artificial sequence
  SiRNA target sequence
cgatcaaagagtgaaggata

SEQ ID NO: 117936 - DNA, 20 bp, Artificial sequence
  SiRNA target sequence
gatcaaagagtgaaggatac

SEQ ID NO: 117937 - DNA, 20 bp, Artificial sequence
  SiRNA target sequence
atcaaagagtgaaggatacc

SEQ ID NO: 117938 - DNA, 20 bp, Artificial sequence
  SiRNA target sequence
tcaaagagtgaaggataccc

SEQ ID NO: 117939 - DNA, 20 bp, Artificial sequence
  SiRNA target sequence
caaagagtgaaggatacccc

SEQ ID NO: 117940 - DNA, 20 bp, Artificial sequence
  SiRNA target sequence
aaagagtgaaggatacccct

SEQ ID NO: 117941 - DNA, 20 bp, Artificial sequence
  SiRNA target sequence
aagagtgaaggataccccta

SEQ ID NO: 117942 - DNA, 20 bp, Artificial sequence
  SiRNA target sequence
agagtgaaggatacccctat

SEQ ID NO: 117943 - DNA, 20 bp, Artificial sequence
  SiRNA target sequence
gagtgaaggatacccctatt

SEQ ID NO: 117944 - DNA, 20 bp, Artificial sequence
  SiRNA target sequence
agtgaaggatacccctattt

SEQ ID NO: 117945 - DNA, 20 bp, Artificial sequence
  SiRNA target sequence
gtgaaggatacccctatttc

SEQ ID NO: 117946 - DNA, 20 bp, Artificial sequence
  SiRNA target sequence
tgaaggatacccctatttcg

SEQ ID NO: 117947 - DNA, 20 bp, Artificial sequence
  SiRNA target sequence
gaaggatacccctatttcgg

SEQ ID NO: 117948 - DNA, 20 bp, Artificial sequence
  SiRNA target sequence
aaggatacccctatttcgga

SEQ ID NO: 117949 - DNA, 20 bp, Artificial sequence
  SiRNA target sequence
aggatacccctatttcggaa

SEQ ID NO: 117950 - DNA, 20 bp, Artificial sequence
  SiRNA target sequence
ggatacccctatttcggaaa

SEQ ID NO: 117951 - DNA, 20 bp, Artificial sequence
  SiRNA target sequence
gatacccctatttcggaaat

SEQ ID NO: 117952 - DNA, 20 bp, Artificial sequence
  SiRNA target sequence
atacccctatttcggaaatg

SEQ ID NO: 117953 - DNA, 20 bp, Artificial sequence
  SiRNA target sequence
tacccctatttcggaaatgg

SEQ ID NO: 117954 - DNA, 20 bp, Artificial sequence
  SiRNA target sequence
acccctatttcggaaatggg

SEQ ID NO: 117955 - DNA, 20 bp, Artificial sequence
  SiRNA target sequence
cccctatttcggaaatggga

SEQ ID NO: 117956 - DNA, 20 bp, Artificial sequence
  SiRNA target sequence
ccctatttcggaaatgggat

SEQ ID NO: 117957 - DNA, 20 bp, Artificial sequence
  SiRNA target sequence
cctatttcggaaatgggatt

SEQ ID NO: 117958 - DNA, 20 bp, Artificial sequence
  SiRNA target sequence
ctatttcggaaatgggattt

SEQ ID NO: 117959 - DNA, 20 bp, Artificial sequence
  SiRNA target sequence
tatttcggaaatgggattta

SEQ ID NO: 117960 - DNA, 20 bp, Artificial sequence
  SiRNA target sequence
atttcggaaatgggatttac

SEQ ID NO: 117961 - DNA, 20 bp, Artificial sequence
  SiRNA target sequence
tttcggaaatgggatttaca

SEQ ID NO: 117962 - DNA, 20 bp, Artificial sequence
  SiRNA target sequence
ttcggaaatgggatttacag

SEQ ID NO: 117963 - DNA, 20 bp, Artificial sequence
  SiRNA target sequence
tcggaaatgggatttacagg

SEQ ID NO: 117964 - DNA, 20 bp, Artificial sequence
  SiRNA target sequence
cggaaatgggatttacaggt

SEQ ID NO: 117965 - DNA, 20 bp, Artificial sequence
  SiRNA target sequence
ggaaatgggatttacaggtc

SEQ ID NO: 117966 - DNA, 20 bp, Artificial sequence
  SiRNA target sequence
gaaatgggatttacaggtct

SEQ ID NO: 117967 - DNA, 20 bp, Artificial sequence
  SiRNA target sequence
aaatgggatttacaggtctc

SEQ ID NO: 117968 - DNA, 20 bp, Artificial sequence
  SiRNA target sequence
aatgggatttacaggtctcg

SEQ ID NO: 117969 - DNA, 20 bp, Artificial sequence
  SiRNA target sequence
atgggatttacaggtctcgc

SEQ ID NO: 117970 - DNA, 20 bp, Artificial sequence
  SiRNA target sequence
tgggatttacaggtctcgct

SEQ ID NO: 117971 - DNA, 20 bp, Artificial sequence
  SiRNA target sequence
gggatttacaggtctcgctg

SEQ ID NO: 117972 - DNA, 20 bp, Artificial sequence
  SiRNA target sequence
ggatttacaggtctcgctgt

SEQ ID NO: 117973 - DNA, 20 bp, Artificial sequence
  SiRNA target sequence
gatttacaggtctcgctgtg

SEQ ID NO: 117974 - DNA, 20 bp, Artificial sequence
  SiRNA target sequence
atttacaggtctcgctgtgg

SEQ ID NO: 117975 - DNA, 20 bp, Artificial sequence
  SiRNA target sequence
tttacaggtctcgctgtggg

SEQ ID NO: 117976 - DNA, 20 bp, Artificial sequence
  SiRNA target sequence
ttacaggtctcgctgtgggt

SEQ ID NO: 117977 - DNA, 20 bp, Artificial sequence
  SiRNA target sequence
tacaggtctcgctgtgggtt

SEQ ID NO: 117978 - DNA, 20 bp, Artificial sequence
  SiRNA target sequence
acaggtctcgctgtgggttc

SEQ ID NO: 117979 - DNA, 20 bp, Artificial sequence
  SiRNA target sequence
caggtctcgctgtgggttca

SEQ ID NO: 117980 - DNA, 20 bp, Artificial sequence
  SiRNA target sequence
aggtctcgctgtgggttcaa

SEQ ID NO: 117981 - DNA, 20 bp, Artificial sequence
  SiRNA target sequence
ggtctcgctgtgggttcaag

SEQ ID NO: 117982 - DNA, 20 bp, Artificial sequence
  SiRNA target sequence
gtctcgctgtgggttcaagc

SEQ ID NO: 117983 - DNA, 20 bp, Artificial sequence
  SiRNA target sequence
tctcgctgtgggttcaagct

SEQ ID NO: 117984 - DNA, 20 bp, Artificial sequence
  SiRNA target sequence
ctcgctgtgggttcaagcta

SEQ ID NO: 117985 - DNA, 20 bp, Artificial sequence
  SiRNA target sequence
tcgctgtgggttcaagctat

SEQ ID NO: 117986 - DNA, 20 bp, Artificial sequence
  SiRNA target sequence
cgctgtgggttcaagctatt

SEQ ID NO: 117987 - DNA, 20 bp, Artificial sequence
  SiRNA target sequence
gctgtgggttcaagctattt

SEQ ID NO: 117988 - DNA, 20 bp, Artificial sequence
  SiRNA target sequence
ctgtgggttcaagctattta

SEQ ID NO: 117989 - DNA, 20 bp, Artificial sequence
  SiRNA target sequence
tgtgggttcaagctatttag

SEQ ID NO: 117990 - DNA, 20 bp, Artificial sequence
  SiRNA target sequence
gtgggttcaagctatttagg

SEQ ID NO: 117991 - DNA, 20 bp, Artificial sequence
  SiRNA target sequence
tgggttcaagctatttaggg

SEQ ID NO: 117992 - DNA, 20 bp, Artificial sequence
  SiRNA target sequence
gggttcaagctatttagggt

SEQ ID NO: 117993 - DNA, 20 bp, Artificial sequence
  SiRNA target sequence
ggttcaagctatttagggtt

SEQ ID NO: 117994 - DNA, 20 bp, Artificial sequence
  SiRNA target sequence
gttcaagctatttagggtta

SEQ ID NO: 117995 - DNA, 20 bp, Artificial sequence
  SiRNA target sequence
ttcaagctatttagggttaa

SEQ ID NO: 117996 - DNA, 20 bp, Artificial sequence
  SiRNA target sequence
tcaagctatttagggttaag

SEQ ID NO: 117997 - DNA, 20 bp, Artificial sequence
  SiRNA target sequence
caagctatttagggttaaga

SEQ ID NO: 117998 - DNA, 20 bp, Artificial sequence
  SiRNA target sequence
aagctatttagggttaagac

SEQ ID NO: 117999 - DNA, 20 bp, Artificial sequence
  SiRNA target sequence
agctatttagggttaagacc

SEQ ID NO: 118000 - DNA, 20 bp, Artificial sequence
  SiRNA target sequence
gctatttagggttaagaccc

SEQ ID NO: 118001 - DNA, 20 bp, Artificial sequence
  SiRNA target sequence
ctatttagggttaagacccg

SEQ ID NO: 118002 - DNA, 20 bp, Artificial sequence
  SiRNA target sequence
tatttagggttaagacccgt

SEQ ID NO: 118003 - DNA, 20 bp, Artificial sequence
  SiRNA target sequence
atttagggttaagacccgta

SEQ ID NO: 118004 - DNA, 20 bp, Artificial sequence
  SiRNA target sequence
tttagggttaagacccgtag

SEQ ID NO: 118005 - DNA, 20 bp, Artificial sequence
  SiRNA target sequence
ttagggttaagacccgtagt

SEQ ID NO: 118006 - DNA, 20 bp, Artificial sequence
  SiRNA target sequence
tagggttaagacccgtagta

SEQ ID NO: 118007 - DNA, 20 bp, Artificial sequence
  SiRNA target sequence
agggttaagacccgtagtag

SEQ ID NO: 118008 - DNA, 20 bp, Artificial sequence
  SiRNA target sequence
gggttaagacccgtagtaga

SEQ ID NO: 118009 - DNA, 20 bp, Artificial sequence
  SiRNA target sequence
ggttaagacccgtagtagat

SEQ ID NO: 118010 - DNA, 20 bp, Artificial sequence
  SiRNA target sequence
gttaagacccgtagtagatt

SEQ ID NO: 118011 - DNA, 20 bp, Artificial sequence
  SiRNA target sequence
ttaagacccgtagtagattt

SEQ ID NO: 118012 - DNA, 20 bp, Artificial sequence
  SiRNA target sequence
taagacccgtagtagatttt

SEQ ID NO: 118013 - DNA, 20 bp, Artificial sequence
  SiRNA target sequence
aagacccgtagtagatttta

SEQ ID NO: 118014 - DNA, 20 bp, Artificial sequence
  SiRNA target sequence
agacccgtagtagattttat

SEQ ID NO: 118015 - DNA, 20 bp, Artificial sequence
  SiRNA target sequence
gacccgtagtagattttatg

SEQ ID NO: 118016 - DNA, 20 bp, Artificial sequence
  SiRNA target sequence
acccgtagtagattttatga

SEQ ID NO: 118017 - DNA, 20 bp, Artificial sequence
  SiRNA target sequence
cccgtagtagattttatgac

SEQ ID NO: 118018 - DNA, 20 bp, Artificial sequence
  SiRNA target sequence
ccgtagtagattttatgact

SEQ ID NO: 118019 - DNA, 20 bp, Artificial sequence
  SiRNA target sequence
cgtagtagattttatgactt

SEQ ID NO: 118020 - DNA, 20 bp, Artificial sequence
  SiRNA target sequence
gtagtagattttatgacttg

SEQ ID NO: 118021 - DNA, 20 bp, Artificial sequence
  SiRNA target sequence
tagtagattttatgacttgg

SEQ ID NO: 118022 - DNA, 20 bp, Artificial sequence
  SiRNA target sequence
agtagattttatgacttgga

SEQ ID NO: 118023 - DNA, 20 bp, Artificial sequence
  SiRNA target sequence
gtagattttatgacttggaa

SEQ ID NO: 118024 - DNA, 20 bp, Artificial sequence
  SiRNA target sequence
tagattttatgacttggaat

SEQ ID NO: 118025 - DNA, 20 bp, Artificial sequence
  SiRNA target sequence
agattttatgacttggaatt

SEQ ID NO: 118026 - DNA, 20 bp, Artificial sequence
  SiRNA target sequence
gattttatgacttggaattt

SEQ ID NO: 118027 - DNA, 20 bp, Artificial sequence
  SiRNA target sequence
attttatgacttggaatttt

SEQ ID NO: 118028 - DNA, 20 bp, Artificial sequence
  SiRNA target sequence
ttttatgacttggaattttg

SEQ ID NO: 118029 - DNA, 20 bp, Artificial sequence
  SiRNA target sequence
tttatgacttggaattttgc

SEQ ID NO: 118030 - DNA, 20 bp, Artificial sequence
  SiRNA target sequence
ttatgacttggaattttgct

SEQ ID NO: 118031 - DNA, 20 bp, Artificial sequence
  SiRNA target sequence
tatgacttggaattttgctt

SEQ ID NO: 118032 - DNA, 20 bp, Artificial sequence
  SiRNA target sequence
atgacttggaattttgcttt

SEQ ID NO: 118033 - DNA, 20 bp, Artificial sequence
  SiRNA target sequence
tgacttggaattttgctttg

SEQ ID NO: 118034 - DNA, 20 bp, Artificial sequence
  SiRNA target sequence
gacttggaattttgctttgc

SEQ ID NO: 118035 - DNA, 20 bp, Artificial sequence
  SiRNA target sequence
acttggaattttgctttgca

SEQ ID NO: 118036 - DNA, 20 bp, Artificial sequence
  SiRNA target sequence
cttggaattttgctttgcaa

SEQ ID NO: 118037 - DNA, 20 bp, Artificial sequence
  SiRNA target sequence
ttggaattttgctttgcaat

SEQ ID NO: 118038 - DNA, 20 bp, Artificial sequence
  SiRNA target sequence
tggaattttgctttgcaatc

SEQ ID NO: 118039 - DNA, 20 bp, Artificial sequence
  SiRNA target sequence
ggaattttgctttgcaatca

SEQ ID NO: 118040 - DNA, 20 bp, Artificial sequence
  SiRNA target sequence
gaattttgctttgcaatcaa

SEQ ID NO: 118041 - DNA, 20 bp, Artificial sequence
  SiRNA target sequence
aattttgctttgcaatcaat

SEQ ID NO: 118042 - DNA, 20 bp, Artificial sequence
  SiRNA target sequence
attttgctttgcaatcaatt

SEQ ID NO: 118043 - DNA, 20 bp, Artificial sequence
  SiRNA target sequence
ttttgctttgcaatcaattg

SEQ ID NO: 118044 - DNA, 20 bp, Artificial sequence
  SiRNA target sequence
tttgctttgcaatcaattga

SEQ ID NO: 118045 - DNA, 20 bp, Artificial sequence
  SiRNA target sequence
ttgctttgcaatcaattgac

SEQ ID NO: 118046 - DNA, 20 bp, Artificial sequence
  SiRNA target sequence
tgctttgcaatcaattgacc

SEQ ID NO: 118047 - DNA, 20 bp, Artificial sequence
  SiRNA target sequence
gctttgcaatcaattgacca

SEQ ID NO: 118048 - DNA, 20 bp, Artificial sequence
  SiRNA target sequence
ctttgcaatcaattgaccat

SEQ ID NO: 118049 - DNA, 20 bp, Artificial sequence
  SiRNA target sequence
tttgcaatcaattgaccata

SEQ ID NO: 118050 - DNA, 20 bp, Artificial sequence
  SiRNA target sequence
ttgcaatcaattgaccatat

SEQ ID NO: 118051 - DNA, 20 bp, Artificial sequence
  SiRNA target sequence
tgcaatcaattgaccatatt

SEQ ID NO: 118052 - DNA, 20 bp, Artificial sequence
  SiRNA target sequence
gcaatcaattgaccatatta

SEQ ID NO: 118053 - DNA, 20 bp, Artificial sequence
  SiRNA target sequence
caatcaattgaccatattat

SEQ ID NO: 118054 - DNA, 20 bp, Artificial sequence
  SiRNA target sequence
aatcaattgaccatattatt

SEQ ID NO: 118055 - DNA, 20 bp, Artificial sequence
  SiRNA target sequence
atcaattgaccatattatta

SEQ ID NO: 118056 - DNA, 20 bp, Artificial sequence
  SiRNA target sequence
tcaattgaccatattattaa

SEQ ID NO: 118057 - DNA, 20 bp, Artificial sequence
  SiRNA target sequence
caattgaccatattattaat

SEQ ID NO: 118058 - DNA, 20 bp, Artificial sequence
  SiRNA target sequence
aattgaccatattattaatt

SEQ ID NO: 118059 - DNA, 20 bp, Artificial sequence
  SiRNA target sequence
attgaccatattattaattc

SEQ ID NO: 118060 - DNA, 20 bp, Artificial sequence
  SiRNA target sequence
ttgaccatattattaattct

SEQ ID NO: 118061 - DNA, 20 bp, Artificial sequence
  SiRNA target sequence
tgaccatattattaattctt

SEQ ID NO: 118062 - DNA, 20 bp, Artificial sequence
  SiRNA target sequence
gaccatattattaattcttg

SEQ ID NO: 118063 - DNA, 20 bp, Artificial sequence
  SiRNA target sequence
accatattattaattcttgt

SEQ ID NO: 118064 - DNA, 20 bp, Artificial sequence
  SiRNA target sequence
ccatattattaattcttgtg

SEQ ID NO: 118065 - DNA, 20 bp, Artificial sequence
  SiRNA target sequence
catattattaattcttgtgc

SEQ ID NO: 118066 - DNA, 20 bp, Artificial sequence
  SiRNA target sequence
atattattaattcttgtgcg

SEQ ID NO: 118067 - DNA, 20 bp, Artificial sequence
  SiRNA target sequence
tattattaattcttgtgcga

SEQ ID NO: 118068 - DNA, 20 bp, Artificial sequence
  SiRNA target sequence
attattaattcttgtgcgaa

SEQ ID NO: 118069 - DNA, 20 bp, Artificial sequence
  SiRNA target sequence
ttattaattcttgtgcgaaa

SEQ ID NO: 118070 - DNA, 20 bp, Artificial sequence
  SiRNA target sequence
tattaattcttgtgcgaaaa

SEQ ID NO: 118071 - DNA, 20 bp, Artificial sequence
  SiRNA target sequence
attaattcttgtgcgaaaac

SEQ ID NO: 118072 - DNA, 20 bp, Artificial sequence
  SiRNA target sequence
ttaattcttgtgcgaaaacc

SEQ ID NO: 118073 - DNA, 20 bp, Artificial sequence
  SiRNA target sequence
taattcttgtgcgaaaacct

SEQ ID NO: 118074 - DNA, 20 bp, Artificial sequence
  SiRNA target sequence
aattcttgtgcgaaaacctt

SEQ ID NO: 118075 - DNA, 20 bp, Artificial sequence
  SiRNA target sequence
attcttgtgcgaaaaccttg

SEQ ID NO: 118076 - DNA, 20 bp, Artificial sequence
  SiRNA target sequence
ttcttgtgcgaaaaccttgt

SEQ ID NO: 118077 - DNA, 20 bp, Artificial sequence
  SiRNA target sequence
tcttgtgcgaaaaccttgta

SEQ ID NO: 118078 - DNA, 20 bp, Artificial sequence
  SiRNA target sequence
cttgtgcgaaaaccttgtat

SEQ ID NO: 118079 - DNA, 20 bp, Artificial sequence
  SiRNA target sequence
ttgtgcgaaaaccttgtata

SEQ ID NO: 118080 - DNA, 20 bp, Artificial sequence
  SiRNA target sequence
tgtgcgaaaaccttgtatat

SEQ ID NO: 118081 - DNA, 20 bp, Artificial sequence
  SiRNA target sequence
gtgcgaaaaccttgtatatg

SEQ ID NO: 118082 - DNA, 20 bp, Artificial sequence
  SiRNA target sequence
tgcgaaaaccttgtatatgt

SEQ ID NO: 118083 - DNA, 20 bp, Artificial sequence
  SiRNA target sequence
gcgaaaaccttgtatatgtc

SEQ ID NO: 118084 - DNA, 20 bp, Artificial sequence
  SiRNA target sequence
cgaaaaccttgtatatgtca

SEQ ID NO: 118085 - DNA, 20 bp, Artificial sequence
  SiRNA target sequence
gaaaaccttgtatatgtcag

SEQ ID NO: 118086 - DNA, 20 bp, Artificial sequence
  SiRNA target sequence
aaaaccttgtatatgtcagg

SEQ ID NO: 118087 - DNA, 20 bp, Artificial sequence
  SiRNA target sequence
aaaccttgtatatgtcagga

SEQ ID NO: 118088 - DNA, 20 bp, Artificial sequence
  SiRNA target sequence
aaccttgtatatgtcaggag

SEQ ID NO: 118089 - DNA, 20 bp, Artificial sequence
  SiRNA target sequence
accttgtatatgtcaggagg

SEQ ID NO: 118090 - DNA, 20 bp, Artificial sequence
  SiRNA target sequence
ccttgtatatgtcaggagga

SEQ ID NO: 118091 - DNA, 20 bp, Artificial sequence
  SiRNA target sequence
cttgtatatgtcaggaggaa

SEQ ID NO: 118092 - DNA, 20 bp, Artificial sequence
  SiRNA target sequence
ttgtatatgtcaggaggaag

SEQ ID NO: 118093 - DNA, 20 bp, Artificial sequence
  SiRNA target sequence
tgtatatgtcaggaggaaga

SEQ ID NO: 118094 - DNA, 20 bp, Artificial sequence
  SiRNA target sequence
gtatatgtcaggaggaagaa

SEQ ID NO: 118095 - DNA, 20 bp, Artificial sequence
  SiRNA target sequence
tatatgtcaggaggaagaat

SEQ ID NO: 118096 - DNA, 20 bp, Artificial sequence
  SiRNA target sequence
atatgtcaggaggaagaata

SEQ ID NO: 118097 - DNA, 20 bp, Artificial sequence
  SiRNA target sequence
tatgtcaggaggaagaatac

SEQ ID NO: 118098 - DNA, 20 bp, Artificial sequence
  SiRNA target sequence
atgtcaggaggaagaataca

SEQ ID NO: 118099 - DNA, 20 bp, Artificial sequence
  SiRNA target sequence
tgtcaggaggaagaatacaa

SEQ ID NO: 118100 - DNA, 20 bp, Artificial sequence
  SiRNA target sequence
gtcaggaggaagaatacaat

SEQ ID NO: 118101 - DNA, 20 bp, Artificial sequence
  SiRNA target sequence
tcaggaggaagaatacaatg

SEQ ID NO: 118102 - DNA, 20 bp, Artificial sequence
  SiRNA target sequence
caggaggaagaatacaatgt

SEQ ID NO: 118103 - DNA, 20 bp, Artificial sequence
  SiRNA target sequence
aggaggaagaatacaatgtc

SEQ ID NO: 118104 - DNA, 20 bp, Artificial sequence
  SiRNA target sequence
ggaggaagaatacaatgtcc

SEQ ID NO: 118105 - DNA, 20 bp, Artificial sequence
  SiRNA target sequence
gaggaagaatacaatgtcca

SEQ ID NO: 118106 - DNA, 20 bp, Artificial sequence
  SiRNA target sequence
aggaagaatacaatgtccaa

SEQ ID NO: 118107 - DNA, 20 bp, Artificial sequence
  SiRNA target sequence
ggaagaatacaatgtccaat

SEQ ID NO: 118108 - DNA, 20 bp, Artificial sequence
  SiRNA target sequence
gaagaatacaatgtccaatt

SEQ ID NO: 118109 - DNA, 20 bp, Artificial sequence
  SiRNA target sequence
aagaatacaatgtccaattg

SEQ ID NO: 118110 - DNA, 20 bp, Artificial sequence
  SiRNA target sequence
agaatacaatgtccaattgt

SEQ ID NO: 118111 - DNA, 20 bp, Artificial sequence
  SiRNA target sequence
gaatacaatgtccaattgtt

SEQ ID NO: 118112 - DNA, 20 bp, Artificial sequence
  SiRNA target sequence
aatacaatgtccaattgttt

SEQ ID NO: 118113 - DNA, 20 bp, Artificial sequence
  SiRNA target sequence
atacaatgtccaattgtttt

SEQ ID NO: 118114 - DNA, 20 bp, Artificial sequence
  SiRNA target sequence
tacaatgtccaattgttttt

SEQ ID NO: 118115 - DNA, 20 bp, Artificial sequence
  SiRNA target sequence
acaatgtccaattgttttta

SEQ ID NO: 118116 - DNA, 20 bp, Artificial sequence
  SiRNA target sequence
caatgtccaattgtttttag

SEQ ID NO: 118117 - DNA, 20 bp, Artificial sequence
  SiRNA target sequence
aatgtccaattgtttttagg

SEQ ID NO: 118118 - DNA, 20 bp, Artificial sequence
  SiRNA target sequence
atgtccaattgtttttaggg

SEQ ID NO: 118119 - DNA, 20 bp, Artificial sequence
  SiRNA target sequence
tgtccaattgtttttagggg

SEQ ID NO: 118120 - DNA, 20 bp, Artificial sequence
  SiRNA target sequence
gtccaattgtttttagggga

SEQ ID NO: 118121 - DNA, 20 bp, Artificial sequence
  SiRNA target sequence
tccaattgtttttaggggac

SEQ ID NO: 118122 - DNA, 20 bp, Artificial sequence
  SiRNA target sequence
ccaattgtttttaggggacc

SEQ ID NO: 118123 - DNA, 20 bp, Artificial sequence
  SiRNA target sequence
caattgtttttaggggacca

SEQ ID NO: 118124 - DNA, 20 bp, Artificial sequence
  SiRNA target sequence
aattgtttttaggggaccaa

SEQ ID NO: 118125 - DNA, 20 bp, Artificial sequence
  SiRNA target sequence
attgtttttaggggaccaaa

SEQ ID NO: 118126 - DNA, 20 bp, Artificial sequence
  SiRNA target sequence
ttgtttttaggggaccaaat

SEQ ID NO: 118127 - DNA, 20 bp, Artificial sequence
  SiRNA target sequence
tgtttttaggggaccaaatg

SEQ ID NO: 118128 - DNA, 20 bp, Artificial sequence
  SiRNA target sequence
gtttttaggggaccaaatgg

SEQ ID NO: 118129 - DNA, 20 bp, Artificial sequence
  SiRNA target sequence
tttttaggggaccaaatgga

SEQ ID NO: 118130 - DNA, 20 bp, Artificial sequence
  SiRNA target sequence
ttttaggggaccaaatggat

SEQ ID NO: 118131 - DNA, 20 bp, Artificial sequence
  SiRNA target sequence
tttaggggaccaaatggatt

SEQ ID NO: 118132 - DNA, 20 bp, Artificial sequence
  SiRNA target sequence
ttaggggaccaaatggattc

SEQ ID NO: 118133 - DNA, 20 bp, Artificial sequence
  SiRNA target sequence
taggggaccaaatggattca

SEQ ID NO: 118134 - DNA, 20 bp, Artificial sequence
  SiRNA target sequence
aggggaccaaatggattcaa

SEQ ID NO: 118135 - DNA, 20 bp, Artificial sequence
  SiRNA target sequence
ggggaccaaatggattcaat

SEQ ID NO: 118136 - DNA, 20 bp, Artificial sequence
  SiRNA target sequence
gggaccaaatggattcaata

SEQ ID NO: 118137 - DNA, 20 bp, Artificial sequence
  SiRNA target sequence
ggaccaaatggattcaataa

SEQ ID NO: 118138 - DNA, 20 bp, Artificial sequence
  SiRNA target sequence
gaccaaatggattcaataat

SEQ ID NO: 118139 - DNA, 20 bp, Artificial sequence
  SiRNA target sequence
accaaatggattcaataatg

SEQ ID NO: 118140 - DNA, 20 bp, Artificial sequence
  SiRNA target sequence
ccaaatggattcaataatgg

SEQ ID NO: 118141 - DNA, 20 bp, Artificial sequence
  SiRNA target sequence
caaatggattcaataatggg

SEQ ID NO: 118142 - DNA, 20 bp, Artificial sequence
  SiRNA target sequence
aaatggattcaataatgggt

SEQ ID NO: 118143 - DNA, 20 bp, Artificial sequence
  SiRNA target sequence
aatggattcaataatgggta

SEQ ID NO: 118144 - DNA, 20 bp, Artificial sequence
  SiRNA target sequence
atggattcaataatgggtac

SEQ ID NO: 118145 - DNA, 20 bp, Artificial sequence
  SiRNA target sequence
tggattcaataatgggtacg

SEQ ID NO: 118146 - DNA, 20 bp, Artificial sequence
  SiRNA target sequence
ggattcaataatgggtacgc

SEQ ID NO: 118147 - DNA, 20 bp, Artificial sequence
  SiRNA target sequence
gattcaataatgggtacgct

SEQ ID NO: 118148 - DNA, 20 bp, Artificial sequence
  SiRNA target sequence
attcaataatgggtacgctg

SEQ ID NO: 118149 - DNA, 20 bp, Artificial sequence
  SiRNA target sequence
ttcaataatgggtacgctgc

SEQ ID NO: 118150 - DNA, 20 bp, Artificial sequence
  SiRNA target sequence
tcaataatgggtacgctgca

SEQ ID NO: 118151 - DNA, 20 bp, Artificial sequence
  SiRNA target sequence
caataatgggtacgctgcac

SEQ ID NO: 118152 - DNA, 20 bp, Artificial sequence
  SiRNA target sequence
aataatgggtacgctgcaca

SEQ ID NO: 118153 - DNA, 20 bp, Artificial sequence
  SiRNA target sequence
ataatgggtacgctgcacag

SEQ ID NO: 118154 - DNA, 20 bp, Artificial sequence
  SiRNA target sequence
taatgggtacgctgcacagc

SEQ ID NO: 118155 - DNA, 20 bp, Artificial sequence
  SiRNA target sequence
aatgggtacgctgcacagca

SEQ ID NO: 118156 - DNA, 20 bp, Artificial sequence
  SiRNA target sequence
atgggtacgctgcacagcac

SEQ ID NO: 118157 - DNA, 20 bp, Artificial sequence
  SiRNA target sequence
tgggtacgctgcacagcaca

SEQ ID NO: 118158 - DNA, 20 bp, Artificial sequence
  SiRNA target sequence
gggtacgctgcacagcacac

SEQ ID NO: 118159 - DNA, 20 bp, Artificial sequence
  SiRNA target sequence
ggtacgctgcacagcacaca

SEQ ID NO: 118160 - DNA, 20 bp, Artificial sequence
  SiRNA target sequence
gtacgctgcacagcacacac

SEQ ID NO: 118161 - DNA, 20 bp, Artificial sequence
  SiRNA target sequence
tacgctgcacagcacacaca

SEQ ID NO: 118162 - DNA, 20 bp, Artificial sequence
  SiRNA target sequence
acgctgcacagcacacacaa

SEQ ID NO: 118163 - DNA, 20 bp, Artificial sequence
  SiRNA target sequence
cgctgcacagcacacacaag

SEQ ID NO: 118164 - DNA, 20 bp, Artificial sequence
  SiRNA target sequence
gctgcacagcacacacaaga

SEQ ID NO: 118165 - DNA, 20 bp, Artificial sequence
  SiRNA target sequence
ctgcacagcacacacaagat

SEQ ID NO: 118166 - DNA, 20 bp, Artificial sequence
  SiRNA target sequence
tgcacagcacacacaagatt

SEQ ID NO: 118167 - DNA, 20 bp, Artificial sequence
  SiRNA target sequence
gcacagcacacacaagattt

SEQ ID NO: 118168 - DNA, 20 bp, Artificial sequence
  SiRNA target sequence
cacagcacacacaagatttt

SEQ ID NO: 118169 - DNA, 20 bp, Artificial sequence
  SiRNA target sequence
acagcacacacaagattttg

SEQ ID NO: 118170 - DNA, 20 bp, Artificial sequence
  SiRNA target sequence
cagcacacacaagattttgc

SEQ ID NO: 118171 - DNA, 20 bp, Artificial sequence
  SiRNA target sequence
agcacacacaagattttgca

SEQ ID NO: 118172 - DNA, 20 bp, Artificial sequence
  SiRNA target sequence
gcacacacaagattttgcac

SEQ ID NO: 118173 - DNA, 20 bp, Artificial sequence
  SiRNA target sequence
cacacacaagattttgcacc

SEQ ID NO: 118174 - DNA, 20 bp, Artificial sequence
  SiRNA target sequence
acacacaagattttgcacca

SEQ ID NO: 118175 - DNA, 20 bp, Artificial sequence
  SiRNA target sequence
cacacaagattttgcaccaa

SEQ ID NO: 118176 - DNA, 20 bp, Artificial sequence
  SiRNA target sequence
acacaagattttgcaccaat

SEQ ID NO: 118177 - DNA, 20 bp, Artificial sequence
  SiRNA target sequence
cacaagattttgcaccaata

SEQ ID NO: 118178 - DNA, 20 bp, Artificial sequence
  SiRNA target sequence
acaagattttgcaccaatat

SEQ ID NO: 118179 - DNA, 20 bp, Artificial sequence
  SiRNA target sequence
caagattttgcaccaatata

SEQ ID NO: 118180 - DNA, 20 bp, Artificial sequence
  SiRNA target sequence
aagattttgcaccaatatat

SEQ ID NO: 118181 - DNA, 20 bp, Artificial sequence
  SiRNA target sequence
agattttgcaccaatatatg

SEQ ID NO: 118182 - DNA, 20 bp, Artificial sequence
  SiRNA target sequence
gattttgcaccaatatatgg

SEQ ID NO: 118183 - DNA, 20 bp, Artificial sequence
  SiRNA target sequence
attttgcaccaatatatggt

SEQ ID NO: 118184 - DNA, 20 bp, Artificial sequence
  SiRNA target sequence
ttttgcaccaatatatggtt

SEQ ID NO: 118185 - DNA, 20 bp, Artificial sequence
  SiRNA target sequence
tttgcaccaatatatggttc

SEQ ID NO: 118186 - DNA, 20 bp, Artificial sequence
  SiRNA target sequence
ttgcaccaatatatggttct

SEQ ID NO: 118187 - DNA, 20 bp, Artificial sequence
  SiRNA target sequence
tgcaccaatatatggttcta

SEQ ID NO: 118188 - DNA, 20 bp, Artificial sequence
  SiRNA target sequence
gcaccaatatatggttctat

SEQ ID NO: 118189 - DNA, 20 bp, Artificial sequence
  SiRNA target sequence
caccaatatatggttctatt

SEQ ID NO: 118190 - DNA, 20 bp, Artificial sequence
  SiRNA target sequence
accaatatatggttctattc

SEQ ID NO: 118191 - DNA, 20 bp, Artificial sequence
  SiRNA target sequence
ccaatatatggttctattcc

SEQ ID NO: 118192 - DNA, 20 bp, Artificial sequence
  SiRNA target sequence
caatatatggttctattcca

SEQ ID NO: 118193 - DNA, 20 bp, Artificial sequence
  SiRNA target sequence
aatatatggttctattccag

SEQ ID NO: 118194 - DNA, 20 bp, Artificial sequence
  SiRNA target sequence
atatatggttctattccagg

SEQ ID NO: 118195 - DNA, 20 bp, Artificial sequence
  SiRNA target sequence
tatatggttctattccaggc

SEQ ID NO: 118196 - DNA, 20 bp, Artificial sequence
  SiRNA target sequence
atatggttctattccaggcc

SEQ ID NO: 118197 - DNA, 20 bp, Artificial sequence
  SiRNA target sequence
tatggttctattccaggcct

SEQ ID NO: 118198 - DNA, 20 bp, Artificial sequence
  SiRNA target sequence
atggttctattccaggcctt

SEQ ID NO: 118199 - DNA, 20 bp, Artificial sequence
  SiRNA target sequence
tggttctattccaggcctta

SEQ ID NO: 118200 - DNA, 20 bp, Artificial sequence
  SiRNA target sequence
ggttctattccaggccttaa

SEQ ID NO: 118201 - DNA, 20 bp, Artificial sequence
  SiRNA target sequence
gttctattccaggccttaag

SEQ ID NO: 118202 - DNA, 20 bp, Artificial sequence
  SiRNA target sequence
ttctattccaggccttaagg

SEQ ID NO: 118203 - DNA, 20 bp, Artificial sequence
  SiRNA target sequence
tctattccaggccttaaggt

SEQ ID NO: 118204 - DNA, 20 bp, Artificial sequence
  SiRNA target sequence
ctattccaggccttaaggtg

SEQ ID NO: 118205 - DNA, 20 bp, Artificial sequence
  SiRNA target sequence
tattccaggccttaaggtgg

SEQ ID NO: 118206 - DNA, 20 bp, Artificial sequence
  SiRNA target sequence
attccaggccttaaggtggt

SEQ ID NO: 118207 - DNA, 20 bp, Artificial sequence
  SiRNA target sequence
ttccaggccttaaggtggtt

SEQ ID NO: 118208 - DNA, 20 bp, Artificial sequence
  SiRNA target sequence
tccaggccttaaggtggttt

SEQ ID NO: 118209 - DNA, 20 bp, Artificial sequence
  SiRNA target sequence
ccaggccttaaggtggtttg

SEQ ID NO: 118210 - DNA, 20 bp, Artificial sequence
  SiRNA target sequence
caggccttaaggtggtttgt

SEQ ID NO: 118211 - DNA, 20 bp, Artificial sequence
  SiRNA target sequence
aggccttaaggtggtttgtc

SEQ ID NO: 118212 - DNA, 20 bp, Artificial sequence
  SiRNA target sequence
ggccttaaggtggtttgtcc

SEQ ID NO: 118213 - DNA, 20 bp, Artificial sequence
  SiRNA target sequence
gccttaaggtggtttgtcct

SEQ ID NO: 118214 - DNA, 20 bp, Artificial sequence
  SiRNA target sequence
ccttaaggtggtttgtcctt

SEQ ID NO: 118215 - DNA, 20 bp, Artificial sequence
  SiRNA target sequence
cttaaggtggtttgtcctta

SEQ ID NO: 118216 - DNA, 20 bp, Artificial sequence
  SiRNA target sequence
ttaaggtggtttgtccttat

SEQ ID NO: 118217 - DNA, 20 bp, Artificial sequence
  SiRNA target sequence
taaggtggtttgtccttata

SEQ ID NO: 118218 - DNA, 20 bp, Artificial sequence
  SiRNA target sequence
aaggtggtttgtccttatac

SEQ ID NO: 118219 - DNA, 20 bp, Artificial sequence
  SiRNA target sequence
aggtggtttgtccttatacg

SEQ ID NO: 118220 - DNA, 20 bp, Artificial sequence
  SiRNA target sequence
ggtggtttgtccttatacgg

SEQ ID NO: 118221 - DNA, 20 bp, Artificial sequence
  SiRNA target sequence
gtggtttgtccttatacggg

SEQ ID NO: 118222 - DNA, 20 bp, Artificial sequence
  SiRNA target sequence
tggtttgtccttatacgggt

SEQ ID NO: 118223 - DNA, 20 bp, Artificial sequence
  SiRNA target sequence
ggtttgtccttatacgggta

SEQ ID NO: 118224 - DNA, 20 bp, Artificial sequence
  SiRNA target sequence
gtttgtccttatacgggtaa

SEQ ID NO: 118225 - DNA, 20 bp, Artificial sequence
  SiRNA target sequence
tttgtccttatacgggtaaa

SEQ ID NO: 118226 - DNA, 20 bp, Artificial sequence
  SiRNA target sequence
ttgtccttatacgggtaaag

SEQ ID NO: 118227 - DNA, 20 bp, Artificial sequence
  SiRNA target sequence
tgtccttatacgggtaaaga

SEQ ID NO: 118228 - DNA, 20 bp, Artificial sequence
  SiRNA target sequence
gtccttatacgggtaaagac

SEQ ID NO: 118229 - DNA, 20 bp, Artificial sequence
  SiRNA target sequence
tccttatacgggtaaagacc

SEQ ID NO: 118230 - DNA, 20 bp, Artificial sequence
  SiRNA target sequence
ccttatacgggtaaagacca

SEQ ID NO: 118231 - DNA, 20 bp, Artificial sequence
  SiRNA target sequence
cttatacgggtaaagaccat

SEQ ID NO: 118232 - DNA, 20 bp, Artificial sequence
  SiRNA target sequence
ttatacgggtaaagaccata

SEQ ID NO: 118233 - DNA, 20 bp, Artificial sequence
  SiRNA target sequence
tatacgggtaaagaccataa

SEQ ID NO: 118234 - DNA, 20 bp, Artificial sequence
  SiRNA target sequence
atacgggtaaagaccataaa

SEQ ID NO: 118235 - DNA, 20 bp, Artificial sequence
  SiRNA target sequence
tacgggtaaagaccataaag

SEQ ID NO: 118236 - DNA, 20 bp, Artificial sequence
  SiRNA target sequence
acgggtaaagaccataaagg

SEQ ID NO: 118237 - DNA, 20 bp, Artificial sequence
  SiRNA target sequence
cgggtaaagaccataaagga

SEQ ID NO: 118238 - DNA, 20 bp, Artificial sequence
  SiRNA target sequence
gggtaaagaccataaaggac

SEQ ID NO: 118239 - DNA, 20 bp, Artificial sequence
  SiRNA target sequence
ggtaaagaccataaaggact

SEQ ID NO: 118240 - DNA, 20 bp, Artificial sequence
  SiRNA target sequence
gtaaagaccataaaggactt

SEQ ID NO: 118241 - DNA, 20 bp, Artificial sequence
  SiRNA target sequence
taaagaccataaaggacttt

SEQ ID NO: 118242 - DNA, 20 bp, Artificial sequence
  SiRNA target sequence
aaagaccataaaggactttt

SEQ ID NO: 118243 - DNA, 20 bp, Artificial sequence
  SiRNA target sequence
aagaccataaaggactttta

SEQ ID NO: 118244 - DNA, 20 bp, Artificial sequence
  SiRNA target sequence
agaccataaaggacttttaa

SEQ ID NO: 118245 - DNA, 20 bp, Artificial sequence
  SiRNA target sequence
gaccataaaggacttttaaa

SEQ ID NO: 118246 - DNA, 20 bp, Artificial sequence
  SiRNA target sequence
accataaaggacttttaaaa

SEQ ID NO: 118247 - DNA, 20 bp, Artificial sequence
  SiRNA target sequence
ccataaaggacttttaaaaa

SEQ ID NO: 118248 - DNA, 20 bp, Artificial sequence
  SiRNA target sequence
cataaaggacttttaaaaag

SEQ ID NO: 118249 - DNA, 20 bp, Artificial sequence
  SiRNA target sequence
ataaaggacttttaaaaagc

SEQ ID NO: 118250 - DNA, 20 bp, Artificial sequence
  SiRNA target sequence
taaaggacttttaaaaagcg

SEQ ID NO: 118251 - DNA, 20 bp, Artificial sequence
  SiRNA target sequence
aaaggacttttaaaaagcgc

SEQ ID NO: 118252 - DNA, 20 bp, Artificial sequence
  SiRNA target sequence
aaggacttttaaaaagcgct

SEQ ID NO: 118253 - DNA, 20 bp, Artificial sequence
  SiRNA target sequence
aggacttttaaaaagcgcta

SEQ ID NO: 118254 - DNA, 20 bp, Artificial sequence
  SiRNA target sequence
ggacttttaaaaagcgctat

SEQ ID NO: 118255 - DNA, 20 bp, Artificial sequence
  SiRNA target sequence
gacttttaaaaagcgctatt

SEQ ID NO: 118256 - DNA, 20 bp, Artificial sequence
  SiRNA target sequence
acttttaaaaagcgctatta

SEQ ID NO: 118257 - DNA, 20 bp, Artificial sequence
  SiRNA target sequence
cttttaaaaagcgctattag

SEQ ID NO: 118258 - DNA, 20 bp, Artificial sequence
  SiRNA target sequence
ttttaaaaagcgctattaga

SEQ ID NO: 118259 - DNA, 20 bp, Artificial sequence
  SiRNA target sequence
tttaaaaagcgctattagag

SEQ ID NO: 118260 - DNA, 20 bp, Artificial sequence
  SiRNA target sequence
ttaaaaagcgctattagaga

SEQ ID NO: 118261 - DNA, 20 bp, Artificial sequence
  SiRNA target sequence
taaaaagcgctattagagac

SEQ ID NO: 118262 - DNA, 20 bp, Artificial sequence
  SiRNA target sequence
aaaaagcgctattagagaca

SEQ ID NO: 118263 - DNA, 20 bp, Artificial sequence
  SiRNA target sequence
aaaagcgctattagagacaa

SEQ ID NO: 118264 - DNA, 20 bp, Artificial sequence
  SiRNA target sequence
aaagcgctattagagacaat

SEQ ID NO: 118265 - DNA, 20 bp, Artificial sequence
  SiRNA target sequence
aagcgctattagagacaata

SEQ ID NO: 118266 - DNA, 20 bp, Artificial sequence
  SiRNA target sequence
agcgctattagagacaataa

SEQ ID NO: 118267 - DNA, 20 bp, Artificial sequence
  SiRNA target sequence
gcgctattagagacaataac

SEQ ID NO: 118268 - DNA, 20 bp, Artificial sequence
  SiRNA target sequence
cgctattagagacaataacc

SEQ ID NO: 118269 - DNA, 20 bp, Artificial sequence
  SiRNA target sequence
gctattagagacaataaccc

SEQ ID NO: 118270 - DNA, 20 bp, Artificial sequence
  SiRNA target sequence
ctattagagacaataacccg

SEQ ID NO: 118271 - DNA, 20 bp, Artificial sequence
  SiRNA target sequence
tattagagacaataacccgg

SEQ ID NO: 118272 - DNA, 20 bp, Artificial sequence
  SiRNA target sequence
attagagacaataacccggt

SEQ ID NO: 118273 - DNA, 20 bp, Artificial sequence
  SiRNA target sequence
ttagagacaataacccggtt

SEQ ID NO: 118274 - DNA, 20 bp, Artificial sequence
  SiRNA target sequence
tagagacaataacccggtta

SEQ ID NO: 118275 - DNA, 20 bp, Artificial sequence
  SiRNA target sequence
agagacaataacccggttat

SEQ ID NO: 118276 - DNA, 20 bp, Artificial sequence
  SiRNA target sequence
gagacaataacccggttata

SEQ ID NO: 118277 - DNA, 20 bp, Artificial sequence
  SiRNA target sequence
agacaataacccggttatat

SEQ ID NO: 118278 - DNA, 20 bp, Artificial sequence
  SiRNA target sequence
gacaataacccggttatatt

SEQ ID NO: 118279 - DNA, 20 bp, Artificial sequence
  SiRNA target sequence
acaataacccggttatattt

SEQ ID NO: 118280 - DNA, 20 bp, Artificial sequence
  SiRNA target sequence
caataacccggttatatttc

SEQ ID NO: 118281 - DNA, 20 bp, Artificial sequence
  SiRNA target sequence
aataacccggttatatttct

SEQ ID NO: 118282 - DNA, 20 bp, Artificial sequence
  SiRNA target sequence
ataacccggttatatttctt

SEQ ID NO: 118283 - DNA, 20 bp, Artificial sequence
  SiRNA target sequence
taacccggttatatttcttg

SEQ ID NO: 118284 - DNA, 20 bp, Artificial sequence
  SiRNA target sequence
aacccggttatatttcttga

SEQ ID NO: 118285 - DNA, 20 bp, Artificial sequence
  SiRNA target sequence
acccggttatatttcttgag

SEQ ID NO: 118286 - DNA, 20 bp, Artificial sequence
  SiRNA target sequence
cccggttatatttcttgaga

SEQ ID NO: 118287 - DNA, 20 bp, Artificial sequence
  SiRNA target sequence
ccggttatatttcttgagaa

SEQ ID NO: 118288 - DNA, 20 bp, Artificial sequence
  SiRNA target sequence
cggttatatttcttgagaat

SEQ ID NO: 118289 - DNA, 20 bp, Artificial sequence
  SiRNA target sequence
ggttatatttcttgagaatg

SEQ ID NO: 118290 - DNA, 20 bp, Artificial sequence
  SiRNA target sequence
gttatatttcttgagaatga

SEQ ID NO: 118291 - DNA, 20 bp, Artificial sequence
  SiRNA target sequence
ttatatttcttgagaatgaa

SEQ ID NO: 118292 - DNA, 20 bp, Artificial sequence
  SiRNA target sequence
tatatttcttgagaatgaaa

SEQ ID NO: 118293 - DNA, 20 bp, Artificial sequence
  SiRNA target sequence
atatttcttgagaatgaaat

SEQ ID NO: 118294 - DNA, 20 bp, Artificial sequence
  SiRNA target sequence
tatttcttgagaatgaaata

SEQ ID NO: 118295 - DNA, 20 bp, Artificial sequence
  SiRNA target sequence
atttcttgagaatgaaatat

SEQ ID NO: 118296 - DNA, 20 bp, Artificial sequence
  SiRNA target sequence
tttcttgagaatgaaatatt

SEQ ID NO: 118297 - DNA, 20 bp, Artificial sequence
  SiRNA target sequence
ttcttgagaatgaaatatta

SEQ ID NO: 118298 - DNA, 20 bp, Artificial sequence
  SiRNA target sequence
tcttgagaatgaaatattat

SEQ ID NO: 118299 - DNA, 20 bp, Artificial sequence
  SiRNA target sequence
cttgagaatgaaatattata

SEQ ID NO: 118300 - DNA, 20 bp, Artificial sequence
  SiRNA target sequence
ttgagaatgaaatattatat

SEQ ID NO: 118301 - DNA, 20 bp, Artificial sequence
  SiRNA target sequence
tgagaatgaaatattatata

SEQ ID NO: 118302 - DNA, 20 bp, Artificial sequence
  SiRNA target sequence
gagaatgaaatattatataa

SEQ ID NO: 118303 - DNA, 20 bp, Artificial sequence
  SiRNA target sequence
agaatgaaatattatataaa

SEQ ID NO: 118304 - DNA, 20 bp, Artificial sequence
  SiRNA target sequence
gaatgaaatattatataaag

SEQ ID NO: 118305 - DNA, 20 bp, Artificial sequence
  SiRNA target sequence
aatgaaatattatataaaga

SEQ ID NO: 118306 - DNA, 20 bp, Artificial sequence
  SiRNA target sequence
atgaaatattatataaagat

SEQ ID NO: 118307 - DNA, 20 bp, Artificial sequence
  SiRNA target sequence
tgaaatattatataaagata

SEQ ID NO: 118308 - DNA, 20 bp, Artificial sequence
  SiRNA target sequence
gaaatattatataaagataa

SEQ ID NO: 118309 - DNA, 20 bp, Artificial sequence
  SiRNA target sequence
aaatattatataaagataaa

SEQ ID NO: 118310 - DNA, 20 bp, Artificial sequence
  SiRNA target sequence
aatattatataaagataaat

SEQ ID NO: 118311 - DNA, 20 bp, Artificial sequence
  SiRNA target sequence
atattatataaagataaata

SEQ ID NO: 118312 - DNA, 20 bp, Artificial sequence
  SiRNA target sequence
tattatataaagataaatac

SEQ ID NO: 118313 - DNA, 20 bp, Artificial sequence
  SiRNA target sequence
attatataaagataaatacc

SEQ ID NO: 118314 - DNA, 20 bp, Artificial sequence
  SiRNA target sequence
ttatataaagataaatacct

SEQ ID NO: 118315 - DNA, 20 bp, Artificial sequence
  SiRNA target sequence
tatataaagataaatacctt

SEQ ID NO: 118316 - DNA, 20 bp, Artificial sequence
  SiRNA target sequence
atataaagataaataccttg

SEQ ID NO: 118317 - DNA, 20 bp, Artificial sequence
  SiRNA target sequence
tataaagataaataccttga

SEQ ID NO: 118318 - DNA, 20 bp, Artificial sequence
  SiRNA target sequence
ataaagataaataccttgaa

SEQ ID NO: 118319 - DNA, 20 bp, Artificial sequence
  SiRNA target sequence
taaagataaataccttgaag

SEQ ID NO: 118320 - DNA, 20 bp, Artificial sequence
  SiRNA target sequence
aaagataaataccttgaagt

SEQ ID NO: 118321 - DNA, 20 bp, Artificial sequence
  SiRNA target sequence
aagataaataccttgaagtg

SEQ ID NO: 118322 - DNA, 20 bp, Artificial sequence
  SiRNA target sequence
agataaataccttgaagtgt

SEQ ID NO: 118323 - DNA, 20 bp, Artificial sequence
  SiRNA target sequence
gataaataccttgaagtgtc

SEQ ID NO: 118324 - DNA, 20 bp, Artificial sequence
  SiRNA target sequence
ataaataccttgaagtgtct

SEQ ID NO: 118325 - DNA, 20 bp, Artificial sequence
  SiRNA target sequence
taaataccttgaagtgtcta

SEQ ID NO: 118326 - DNA, 20 bp, Artificial sequence
  SiRNA target sequence
aaataccttgaagtgtctaa

SEQ ID NO: 118327 - DNA, 20 bp, Artificial sequence
  SiRNA target sequence
aataccttgaagtgtctaat

SEQ ID NO: 118328 - DNA, 20 bp, Artificial sequence
  SiRNA target sequence
ataccttgaagtgtctaata

SEQ ID NO: 118329 - DNA, 20 bp, Artificial sequence
  SiRNA target sequence
taccttgaagtgtctaataa

SEQ ID NO: 118330 - DNA, 20 bp, Artificial sequence
  SiRNA target sequence
accttgaagtgtctaataat

SEQ ID NO: 118331 - DNA, 20 bp, Artificial sequence
  SiRNA target sequence
ccttgaagtgtctaataatt

SEQ ID NO: 118332 - DNA, 20 bp, Artificial sequence
  SiRNA target sequence
cttgaagtgtctaataatta

SEQ ID NO: 118333 - DNA, 20 bp, Artificial sequence
  SiRNA target sequence
ttgaagtgtctaataattat

SEQ ID NO: 118334 - DNA, 20 bp, Artificial sequence
  SiRNA target sequence
tgaagtgtctaataattata

SEQ ID NO: 118335 - DNA, 20 bp, Artificial sequence
  SiRNA target sequence
gaagtgtctaataattatat

SEQ ID NO: 118336 - DNA, 20 bp, Artificial sequence
  SiRNA target sequence
aagtgtctaataattatatt

SEQ ID NO: 118337 - DNA, 20 bp, Artificial sequence
  SiRNA target sequence
agtgtctaataattatattc

SEQ ID NO: 118338 - DNA, 20 bp, Artificial sequence
  SiRNA target sequence
gtgtctaataattatattca

SEQ ID NO: 118339 - DNA, 20 bp, Artificial sequence
  SiRNA target sequence
tgtctaataattatattcaa

SEQ ID NO: 118340 - DNA, 20 bp, Artificial sequence
  SiRNA target sequence
gtctaataattatattcaac

SEQ ID NO: 118341 - DNA, 20 bp, Artificial sequence
  SiRNA target sequence
tctaataattatattcaacc

SEQ ID NO: 118342 - DNA, 20 bp, Artificial sequence
  SiRNA target sequence
ctaataattatattcaacca

SEQ ID NO: 118343 - DNA, 20 bp, Artificial sequence
  SiRNA target sequence
taataattatattcaaccac

SEQ ID NO: 118344 - DNA, 20 bp, Artificial sequence
  SiRNA target sequence
aataattatattcaaccact

SEQ ID NO: 118345 - DNA, 20 bp, Artificial sequence
  SiRNA target sequence
ataattatattcaaccactt

SEQ ID NO: 118346 - DNA, 20 bp, Artificial sequence
  SiRNA target sequence
taattatattcaaccacttg

SEQ ID NO: 118347 - DNA, 20 bp, Artificial sequence
  SiRNA target sequence
aattatattcaaccacttga

SEQ ID NO: 118348 - DNA, 20 bp, Artificial sequence
  SiRNA target sequence
attatattcaaccacttgac

SEQ ID NO: 118349 - DNA, 20 bp, Artificial sequence
  SiRNA target sequence
ttatattcaaccacttgaca

SEQ ID NO: 118350 - DNA, 20 bp, Artificial sequence
  SiRNA target sequence
tatattcaaccacttgacaa

SEQ ID NO: 118351 - DNA, 20 bp, Artificial sequence
  SiRNA target sequence
atattcaaccacttgacaag

SEQ ID NO: 118352 - DNA, 20 bp, Artificial sequence
  SiRNA target sequence
tattcaaccacttgacaagg

SEQ ID NO: 118353 - DNA, 20 bp, Artificial sequence
  SiRNA target sequence
attcaaccacttgacaaggc

SEQ ID NO: 118354 - DNA, 20 bp, Artificial sequence
  SiRNA target sequence
ttcaaccacttgacaaggca

SEQ ID NO: 118355 - DNA, 20 bp, Artificial sequence
  SiRNA target sequence
tcaaccacttgacaaggcag

SEQ ID NO: 118356 - DNA, 20 bp, Artificial sequence
  SiRNA target sequence
caaccacttgacaaggcagt

SEQ ID NO: 118357 - DNA, 20 bp, Artificial sequence
  SiRNA target sequence
aaccacttgacaaggcagta

SEQ ID NO: 118358 - DNA, 20 bp, Artificial sequence
  SiRNA target sequence
accacttgacaaggcagtaa

SEQ ID NO: 118359 - DNA, 20 bp, Artificial sequence
  SiRNA target sequence
ccacttgacaaggcagtaat

SEQ ID NO: 118360 - DNA, 20 bp, Artificial sequence
  SiRNA target sequence
cacttgacaaggcagtaatt

SEQ ID NO: 118361 - DNA, 20 bp, Artificial sequence
  SiRNA target sequence
acttgacaaggcagtaattg

SEQ ID NO: 118362 - DNA, 20 bp, Artificial sequence
  SiRNA target sequence
cttgacaaggcagtaattga

SEQ ID NO: 118363 - DNA, 20 bp, Artificial sequence
  SiRNA target sequence
ttgacaaggcagtaattgaa

SEQ ID NO: 118364 - DNA, 20 bp, Artificial sequence
  SiRNA target sequence
tgacaaggcagtaattgaaa

SEQ ID NO: 118365 - DNA, 20 bp, Artificial sequence
  SiRNA target sequence
gacaaggcagtaattgaaaa

SEQ ID NO: 118366 - DNA, 20 bp, Artificial sequence
  SiRNA target sequence
acaaggcagtaattgaaaaa

SEQ ID NO: 118367 - DNA, 20 bp, Artificial sequence
  SiRNA target sequence
caaggcagtaattgaaaaaa

SEQ ID NO: 118368 - DNA, 20 bp, Artificial sequence
  SiRNA target sequence
aaggcagtaattgaaaaaaa

SEQ ID NO: 118369 - DNA, 20 bp, Artificial sequence
  SiRNA target sequence
aggcagtaattgaaaaaaat

SEQ ID NO: 118370 - DNA, 20 bp, Artificial sequence
  SiRNA target sequence
ggcagtaattgaaaaaaatg

SEQ ID NO: 118371 - DNA, 20 bp, Artificial sequence
  SiRNA target sequence
gcagtaattgaaaaaaatgg

SEQ ID NO: 118372 - DNA, 20 bp, Artificial sequence
  SiRNA target sequence
cagtaattgaaaaaaatggt

SEQ ID NO: 118373 - DNA, 20 bp, Artificial sequence
  SiRNA target sequence
agtaattgaaaaaaatggtg

SEQ ID NO: 118374 - DNA, 20 bp, Artificial sequence
  SiRNA target sequence
gtaattgaaaaaaatggtgt

SEQ ID NO: 118375 - DNA, 20 bp, Artificial sequence
  SiRNA target sequence
taattgaaaaaaatggtgtt

SEQ ID NO: 118376 - DNA, 20 bp, Artificial sequence
  SiRNA target sequence
aattgaaaaaaatggtgttg

SEQ ID NO: 118377 - DNA, 20 bp, Artificial sequence
  SiRNA target sequence
attgaaaaaaatggtgttga

SEQ ID NO: 118378 - DNA, 20 bp, Artificial sequence
  SiRNA target sequence
ttgaaaaaaatggtgttgac

SEQ ID NO: 118379 - DNA, 20 bp, Artificial sequence
  SiRNA target sequence
tgaaaaaaatggtgttgacg

SEQ ID NO: 118380 - DNA, 20 bp, Artificial sequence
  SiRNA target sequence
gaaaaaaatggtgttgacgt

SEQ ID NO: 118381 - DNA, 20 bp, Artificial sequence
  SiRNA target sequence
aaaaaaatggtgttgacgtt

SEQ ID NO: 118382 - DNA, 20 bp, Artificial sequence
  SiRNA target sequence
aaaaaatggtgttgacgtta

SEQ ID NO: 118383 - DNA, 20 bp, Artificial sequence
  SiRNA target sequence
aaaaatggtgttgacgttac

SEQ ID NO: 118384 - DNA, 20 bp, Artificial sequence
  SiRNA target sequence
aaaatggtgttgacgttaca

SEQ ID NO: 118385 - DNA, 20 bp, Artificial sequence
  SiRNA target sequence
aaatggtgttgacgttacag

SEQ ID NO: 118386 - DNA, 20 bp, Artificial sequence
  SiRNA target sequence
aatggtgttgacgttacagt

SEQ ID NO: 118387 - DNA, 20 bp, Artificial sequence
  SiRNA target sequence
atggtgttgacgttacagtt

SEQ ID NO: 118388 - DNA, 20 bp, Artificial sequence
  SiRNA target sequence
tggtgttgacgttacagttt

SEQ ID NO: 118389 - DNA, 20 bp, Artificial sequence
  SiRNA target sequence
ggtgttgacgttacagtttt

SEQ ID NO: 118390 - DNA, 20 bp, Artificial sequence
  SiRNA target sequence
gtgttgacgttacagtttta

SEQ ID NO: 118391 - DNA, 20 bp, Artificial sequence
  SiRNA target sequence
tgttgacgttacagttttag

SEQ ID NO: 118392 - DNA, 20 bp, Artificial sequence
  SiRNA target sequence
gttgacgttacagttttagg

SEQ ID NO: 118393 - DNA, 20 bp, Artificial sequence
  SiRNA target sequence
ttgacgttacagttttagga

SEQ ID NO: 118394 - DNA, 20 bp, Artificial sequence
  SiRNA target sequence
tgacgttacagttttaggaa

SEQ ID NO: 118395 - DNA, 20 bp, Artificial sequence
  SiRNA target sequence
gacgttacagttttaggaat

SEQ ID NO: 118396 - DNA, 20 bp, Artificial sequence
  SiRNA target sequence
acgttacagttttaggaata

SEQ ID NO: 118397 - DNA, 20 bp, Artificial sequence
  SiRNA target sequence
cgttacagttttaggaatat

SEQ ID NO: 118398 - DNA, 20 bp, Artificial sequence
  SiRNA target sequence
gttacagttttaggaatatc

SEQ ID NO: 118399 - DNA, 20 bp, Artificial sequence
  SiRNA target sequence
ttacagttttaggaatatca

SEQ ID NO: 118400 - DNA, 20 bp, Artificial sequence
  SiRNA target sequence
tacagttttaggaatatcaa

SEQ ID NO: 118401 - DNA, 20 bp, Artificial sequence
  SiRNA target sequence
acagttttaggaatatcaat

SEQ ID NO: 118402 - DNA, 20 bp, Artificial sequence
  SiRNA target sequence
cagttttaggaatatcaata

SEQ ID NO: 118403 - DNA, 20 bp, Artificial sequence
  SiRNA target sequence
agttttaggaatatcaataa

SEQ ID NO: 118404 - DNA, 20 bp, Artificial sequence
  SiRNA target sequence
gttttaggaatatcaataag

SEQ ID NO: 118405 - DNA, 20 bp, Artificial sequence
  SiRNA target sequence
ttttaggaatatcaataagt

SEQ ID NO: 118406 - DNA, 20 bp, Artificial sequence
  SiRNA target sequence
tttaggaatatcaataagtc

SEQ ID NO: 118407 - DNA, 20 bp, Artificial sequence
  SiRNA target sequence
ttaggaatatcaataagtct

SEQ ID NO: 118408 - DNA, 20 bp, Artificial sequence
  SiRNA target sequence
taggaatatcaataagtctt

SEQ ID NO: 118409 - DNA, 20 bp, Artificial sequence
  SiRNA target sequence
aggaatatcaataagtctta

SEQ ID NO: 118410 - DNA, 20 bp, Artificial sequence
  SiRNA target sequence
ggaatatcaataagtcttaa

SEQ ID NO: 118411 - DNA, 20 bp, Artificial sequence
  SiRNA target sequence
gaatatcaataagtcttaaa

SEQ ID NO: 118412 - DNA, 20 bp, Artificial sequence
  SiRNA target sequence
aatatcaataagtcttaaag

SEQ ID NO: 118413 - DNA, 20 bp, Artificial sequence
  SiRNA target sequence
atatcaataagtcttaaaga

SEQ ID NO: 118414 - DNA, 20 bp, Artificial sequence
  SiRNA target sequence
tatcaataagtcttaaagaa

SEQ ID NO: 118415 - DNA, 20 bp, Artificial sequence
  SiRNA target sequence
atcaataagtcttaaagaaa

SEQ ID NO: 118416 - DNA, 20 bp, Artificial sequence
  SiRNA target sequence
tcaataagtcttaaagaaat

SEQ ID NO: 118417 - DNA, 20 bp, Artificial sequence
  SiRNA target sequence
caataagtcttaaagaaatt

SEQ ID NO: 118418 - DNA, 20 bp, Artificial sequence
  SiRNA target sequence
aataagtcttaaagaaattt

SEQ ID NO: 118419 - DNA, 20 bp, Artificial sequence
  SiRNA target sequence
ataagtcttaaagaaatttt

SEQ ID NO: 118420 - DNA, 20 bp, Artificial sequence
  SiRNA target sequence
taagtcttaaagaaattttt

SEQ ID NO: 118421 - DNA, 20 bp, Artificial sequence
  SiRNA target sequence
aagtcttaaagaaattttta

SEQ ID NO: 118422 - DNA, 20 bp, Artificial sequence
  SiRNA target sequence
agtcttaaagaaatttttaa

SEQ ID NO: 118423 - DNA, 20 bp, Artificial sequence
  SiRNA target sequence
gtcttaaagaaatttttaaa

SEQ ID NO: 118424 - DNA, 20 bp, Artificial sequence
  SiRNA target sequence
tcttaaagaaatttttaaag

SEQ ID NO: 118425 - DNA, 20 bp, Artificial sequence
  SiRNA target sequence
cttaaagaaatttttaaagc

SEQ ID NO: 118426 - DNA, 20 bp, Artificial sequence
  SiRNA target sequence
ttaaagaaatttttaaagca

SEQ ID NO: 118427 - DNA, 20 bp, Artificial sequence
  SiRNA target sequence
taaagaaatttttaaagcag

SEQ ID NO: 118428 - DNA, 20 bp, Artificial sequence
  SiRNA target sequence
aaagaaatttttaaagcaga

SEQ ID NO: 118429 - DNA, 20 bp, Artificial sequence
  SiRNA target sequence
aagaaatttttaaagcagac

SEQ ID NO: 118430 - DNA, 20 bp, Artificial sequence
  SiRNA target sequence
agaaatttttaaagcagaca

SEQ ID NO: 118431 - DNA, 20 bp, Artificial sequence
  SiRNA target sequence
gaaatttttaaagcagacag

SEQ ID NO: 118432 - DNA, 20 bp, Artificial sequence
  SiRNA target sequence
aaatttttaaagcagacagt

SEQ ID NO: 118433 - DNA, 20 bp, Artificial sequence
  SiRNA target sequence
aatttttaaagcagacagtt

SEQ ID NO: 118434 - DNA, 20 bp, Artificial sequence
  SiRNA target sequence
atttttaaagcagacagttt

SEQ ID NO: 118435 - DNA, 20 bp, Artificial sequence
  SiRNA target sequence
tttttaaagcagacagtttg

SEQ ID NO: 118436 - DNA, 20 bp, Artificial sequence
  SiRNA target sequence
ttttaaagcagacagtttgt

SEQ ID NO: 118437 - DNA, 20 bp, Artificial sequence
  SiRNA target sequence
tttaaagcagacagtttgtt

SEQ ID NO: 118438 - DNA, 20 bp, Artificial sequence
  SiRNA target sequence
ttaaagcagacagtttgtta

SEQ ID NO: 118439 - DNA, 20 bp, Artificial sequence
  SiRNA target sequence
taaagcagacagtttgttag

SEQ ID NO: 118440 - DNA, 20 bp, Artificial sequence
  SiRNA target sequence
aaagcagacagtttgttaga

SEQ ID NO: 118441 - DNA, 20 bp, Artificial sequence
  SiRNA target sequence
aagcagacagtttgttagag

SEQ ID NO: 118442 - DNA, 20 bp, Artificial sequence
  SiRNA target sequence
agcagacagtttgttagaga

SEQ ID NO: 118443 - DNA, 20 bp, Artificial sequence
  SiRNA target sequence
gcagacagtttgttagagaa

SEQ ID NO: 118444 - DNA, 20 bp, Artificial sequence
  SiRNA target sequence
cagacagtttgttagagaaa

SEQ ID NO: 118445 - DNA, 20 bp, Artificial sequence
  SiRNA target sequence
agacagtttgttagagaaaa

SEQ ID NO: 118446 - DNA, 20 bp, Artificial sequence
  SiRNA target sequence
gacagtttgttagagaaaaa

SEQ ID NO: 118447 - DNA, 20 bp, Artificial sequence
  SiRNA target sequence
acagtttgttagagaaaaaa

SEQ ID NO: 118448 - DNA, 20 bp, Artificial sequence
  SiRNA target sequence
cagtttgttagagaaaaaaa

SEQ ID NO: 118449 - DNA, 20 bp, Artificial sequence
  SiRNA target sequence
agtttgttagagaaaaaaaa

SEQ ID NO: 118450 - DNA, 20 bp, Artificial sequence
  SiRNA target sequence
gtttgttagagaaaaaaaat

SEQ ID NO: 118451 - DNA, 20 bp, Artificial sequence
  SiRNA target sequence
tttgttagagaaaaaaaata

SEQ ID NO: 118452 - DNA, 20 bp, Artificial sequence
  SiRNA target sequence
ttgttagagaaaaaaaatat

SEQ ID NO: 118453 - DNA, 20 bp, Artificial sequence
  SiRNA target sequence
tgttagagaaaaaaaatatc

SEQ ID NO: 118454 - DNA, 20 bp, Artificial sequence
  SiRNA target sequence
gttagagaaaaaaaatatcg

SEQ ID NO: 118455 - DNA, 20 bp, Artificial sequence
  SiRNA target sequence
ttagagaaaaaaaatatcga

SEQ ID NO: 118456 - DNA, 20 bp, Artificial sequence
  SiRNA target sequence
tagagaaaaaaaatatcgac

SEQ ID NO: 118457 - DNA, 20 bp, Artificial sequence
  SiRNA target sequence
agagaaaaaaaatatcgaca

SEQ ID NO: 118458 - DNA, 20 bp, Artificial sequence
  SiRNA target sequence
gagaaaaaaaatatcgacat

SEQ ID NO: 118459 - DNA, 20 bp, Artificial sequence
  SiRNA target sequence
agaaaaaaaatatcgacatt

SEQ ID NO: 118460 - DNA, 20 bp, Artificial sequence
  SiRNA target sequence
gaaaaaaaatatcgacattg

SEQ ID NO: 118461 - DNA, 20 bp, Artificial sequence
  SiRNA target sequence
aaaaaaaatatcgacattga

SEQ ID NO: 118462 - DNA, 20 bp, Artificial sequence
  SiRNA target sequence
aaaaaaatatcgacattgag

SEQ ID NO: 118463 - DNA, 20 bp, Artificial sequence
  SiRNA target sequence
aaaaaatatcgacattgaga

SEQ ID NO: 118464 - DNA, 20 bp, Artificial sequence
  SiRNA target sequence
aaaaatatcgacattgagat

SEQ ID NO: 118465 - DNA, 20 bp, Artificial sequence
  SiRNA target sequence
aaaatatcgacattgagata

SEQ ID NO: 118466 - DNA, 20 bp, Artificial sequence
  SiRNA target sequence
aaatatcgacattgagataa

SEQ ID NO: 118467 - DNA, 20 bp, Artificial sequence
  SiRNA target sequence
aatatcgacattgagataat

SEQ ID NO: 118468 - DNA, 20 bp, Artificial sequence
  SiRNA target sequence
atatcgacattgagataatt

SEQ ID NO: 118469 - DNA, 20 bp, Artificial sequence
  SiRNA target sequence
tatcgacattgagataatta

SEQ ID NO: 118470 - DNA, 20 bp, Artificial sequence
  SiRNA target sequence
atcgacattgagataattaa

SEQ ID NO: 118471 - DNA, 20 bp, Artificial sequence
  SiRNA target sequence
tcgacattgagataattaat

SEQ ID NO: 118472 - DNA, 20 bp, Artificial sequence
  SiRNA target sequence
cgacattgagataattaatc

SEQ ID NO: 118473 - DNA, 20 bp, Artificial sequence
  SiRNA target sequence
gacattgagataattaatct

SEQ ID NO: 118474 - DNA, 20 bp, Artificial sequence
  SiRNA target sequence
acattgagataattaatctt

SEQ ID NO: 118475 - DNA, 20 bp, Artificial sequence
  SiRNA target sequence
cattgagataattaatcttg

SEQ ID NO: 118476 - DNA, 20 bp, Artificial sequence
  SiRNA target sequence
attgagataattaatcttgt

SEQ ID NO: 118477 - DNA, 20 bp, Artificial sequence
  SiRNA target sequence
ttgagataattaatcttgtg

SEQ ID NO: 118478 - DNA, 20 bp, Artificial sequence
  SiRNA target sequence
tgagataattaatcttgtgt

SEQ ID NO: 118479 - DNA, 20 bp, Artificial sequence
  SiRNA target sequence
gagataattaatcttgtgtc

SEQ ID NO: 118480 - DNA, 20 bp, Artificial sequence
  SiRNA target sequence
agataattaatcttgtgtca

SEQ ID NO: 118481 - DNA, 20 bp, Artificial sequence
  SiRNA target sequence
gataattaatcttgtgtcaa

SEQ ID NO: 118482 - DNA, 20 bp, Artificial sequence
  SiRNA target sequence
ataattaatcttgtgtcaat

SEQ ID NO: 118483 - DNA, 20 bp, Artificial sequence
  SiRNA target sequence
taattaatcttgtgtcaata

SEQ ID NO: 118484 - DNA, 20 bp, Artificial sequence
  SiRNA target sequence
aattaatcttgtgtcaataa

SEQ ID NO: 118485 - DNA, 20 bp, Artificial sequence
  SiRNA target sequence
attaatcttgtgtcaataaa

SEQ ID NO: 118486 - DNA, 20 bp, Artificial sequence
  SiRNA target sequence
ttaatcttgtgtcaataaaa

SEQ ID NO: 118487 - DNA, 20 bp, Artificial sequence
  SiRNA target sequence
taatcttgtgtcaataaaac

SEQ ID NO: 118488 - DNA, 20 bp, Artificial sequence
  SiRNA target sequence
aatcttgtgtcaataaaacc

SEQ ID NO: 118489 - DNA, 20 bp, Artificial sequence
  SiRNA target sequence
atcttgtgtcaataaaacca

SEQ ID NO: 118490 - DNA, 20 bp, Artificial sequence
  SiRNA target sequence
tcttgtgtcaataaaaccaa

SEQ ID NO: 118491 - DNA, 20 bp, Artificial sequence
  SiRNA target sequence
cttgtgtcaataaaaccaat

SEQ ID NO: 118492 - DNA, 20 bp, Artificial sequence
  SiRNA target sequence
ttgtgtcaataaaaccaatt

SEQ ID NO: 118493 - DNA, 20 bp, Artificial sequence
  SiRNA target sequence
tgtgtcaataaaaccaattg

SEQ ID NO: 118494 - DNA, 20 bp, Artificial sequence
  SiRNA target sequence
gtgtcaataaaaccaattga

SEQ ID NO: 118495 - DNA, 20 bp, Artificial sequence
  SiRNA target sequence
tgtcaataaaaccaattgat

SEQ ID NO: 118496 - DNA, 20 bp, Artificial sequence
  SiRNA target sequence
gtcaataaaaccaattgatt

SEQ ID NO: 118497 - DNA, 20 bp, Artificial sequence
  SiRNA target sequence
tcaataaaaccaattgatta

SEQ ID NO: 118498 - DNA, 20 bp, Artificial sequence
  SiRNA target sequence
caataaaaccaattgattat

SEQ ID NO: 118499 - DNA, 20 bp, Artificial sequence
  SiRNA target sequence
aataaaaccaattgattatg

SEQ ID NO: 118500 - DNA, 20 bp, Artificial sequence
  SiRNA target sequence
ataaaaccaattgattatgt

SEQ ID NO: 118501 - DNA, 20 bp, Artificial sequence
  SiRNA target sequence
taaaaccaattgattatgtt

SEQ ID NO: 118502 - DNA, 20 bp, Artificial sequence
  SiRNA target sequence
aaaaccaattgattatgtta

SEQ ID NO: 118503 - DNA, 20 bp, Artificial sequence
  SiRNA target sequence
aaaccaattgattatgttac

SEQ ID NO: 118504 - DNA, 20 bp, Artificial sequence
  SiRNA target sequence
aaccaattgattatgttact

SEQ ID NO: 118505 - DNA, 20 bp, Artificial sequence
  SiRNA target sequence
accaattgattatgttacta

SEQ ID NO: 118506 - DNA, 20 bp, Artificial sequence
  SiRNA target sequence
ccaattgattatgttactat

SEQ ID NO: 118507 - DNA, 20 bp, Artificial sequence
  SiRNA target sequence
caattgattatgttactatt

SEQ ID NO: 118508 - DNA, 20 bp, Artificial sequence
  SiRNA target sequence
aattgattatgttactattg

SEQ ID NO: 118509 - DNA, 20 bp, Artificial sequence
  SiRNA target sequence
attgattatgttactattga

SEQ ID NO: 118510 - DNA, 20 bp, Artificial sequence
  SiRNA target sequence
ttgattatgttactattgaa

SEQ ID NO: 118511 - DNA, 20 bp, Artificial sequence
  SiRNA target sequence
tgattatgttactattgaaa

SEQ ID NO: 118512 - DNA, 20 bp, Artificial sequence
  SiRNA target sequence
gattatgttactattgaaat

SEQ ID NO: 118513 - DNA, 20 bp, Artificial sequence
  SiRNA target sequence
attatgttactattgaaata

SEQ ID NO: 118514 - DNA, 20 bp, Artificial sequence
  SiRNA target sequence
ttatgttactattgaaatat

SEQ ID NO: 118515 - DNA, 20 bp, Artificial sequence
  SiRNA target sequence
tatgttactattgaaatatc

SEQ ID NO: 118516 - DNA, 20 bp, Artificial sequence
  SiRNA target sequence
atgttactattgaaatatca

SEQ ID NO: 118517 - DNA, 20 bp, Artificial sequence
  SiRNA target sequence
tgttactattgaaatatcag

SEQ ID NO: 118518 - DNA, 20 bp, Artificial sequence
  SiRNA target sequence
gttactattgaaatatcagt

SEQ ID NO: 118519 - DNA, 20 bp, Artificial sequence
  SiRNA target sequence
ttactattgaaatatcagtc

SEQ ID NO: 118520 - DNA, 20 bp, Artificial sequence
  SiRNA target sequence
tactattgaaatatcagtca

SEQ ID NO: 118521 - DNA, 20 bp, Artificial sequence
  SiRNA target sequence
actattgaaatatcagtcaa

SEQ ID NO: 118522 - DNA, 20 bp, Artificial sequence
  SiRNA target sequence
ctattgaaatatcagtcaaa

SEQ ID NO: 118523 - DNA, 20 bp, Artificial sequence
  SiRNA target sequence
tattgaaatatcagtcaaaa

SEQ ID NO: 118524 - DNA, 20 bp, Artificial sequence
  SiRNA target sequence
attgaaatatcagtcaaaaa

SEQ ID NO: 118525 - DNA, 20 bp, Artificial sequence
  SiRNA target sequence
ttgaaatatcagtcaaaaaa

SEQ ID NO: 118526 - DNA, 20 bp, Artificial sequence
  SiRNA target sequence
tgaaatatcagtcaaaaaaa

SEQ ID NO: 118527 - DNA, 20 bp, Artificial sequence
  SiRNA target sequence
gaaatatcagtcaaaaaaac

SEQ ID NO: 118528 - DNA, 20 bp, Artificial sequence
  SiRNA target sequence
aaatatcagtcaaaaaaaca

SEQ ID NO: 118529 - DNA, 20 bp, Artificial sequence
  SiRNA target sequence
aatatcagtcaaaaaaacac

SEQ ID NO: 118530 - DNA, 20 bp, Artificial sequence
  SiRNA target sequence
atatcagtcaaaaaaacaca

SEQ ID NO: 118531 - DNA, 20 bp, Artificial sequence
  SiRNA target sequence
tatcagtcaaaaaaacacaa

SEQ ID NO: 118532 - DNA, 20 bp, Artificial sequence
  SiRNA target sequence
atcagtcaaaaaaacacaaa

SEQ ID NO: 118533 - DNA, 20 bp, Artificial sequence
  SiRNA target sequence
tcagtcaaaaaaacacaaaa

SEQ ID NO: 118534 - DNA, 20 bp, Artificial sequence
  SiRNA target sequence
cagtcaaaaaaacacaaaag

SEQ ID NO: 118535 - DNA, 20 bp, Artificial sequence
  SiRNA target sequence
agtcaaaaaaacacaaaagt

SEQ ID NO: 118536 - DNA, 20 bp, Artificial sequence
  SiRNA target sequence
gtcaaaaaaacacaaaagtt

SEQ ID NO: 118537 - DNA, 20 bp, Artificial sequence
  SiRNA target sequence
tcaaaaaaacacaaaagtta

SEQ ID NO: 118538 - DNA, 20 bp, Artificial sequence
  SiRNA target sequence
caaaaaaacacaaaagttag

SEQ ID NO: 118539 - DNA, 20 bp, Artificial sequence
  SiRNA target sequence
aaaaaaacacaaaagttagt

SEQ ID NO: 118540 - DNA, 20 bp, Artificial sequence
  SiRNA target sequence
aaaaaacacaaaagttagtg

SEQ ID NO: 118541 - DNA, 20 bp, Artificial sequence
  SiRNA target sequence
aaaaacacaaaagttagtga

SEQ ID NO: 118542 - DNA, 20 bp, Artificial sequence
  SiRNA target sequence
aaaacacaaaagttagtgat

SEQ ID NO: 118543 - DNA, 20 bp, Artificial sequence
  SiRNA target sequence
aaacacaaaagttagtgata

SEQ ID NO: 118544 - DNA, 20 bp, Artificial sequence
  SiRNA target sequence
aacacaaaagttagtgatag

SEQ ID NO: 118545 - DNA, 20 bp, Artificial sequence
  SiRNA target sequence
acacaaaagttagtgatagt

SEQ ID NO: 118546 - DNA, 20 bp, Artificial sequence
  SiRNA target sequence
cacaaaagttagtgatagtt

SEQ ID NO: 118547 - DNA, 20 bp, Artificial sequence
  SiRNA target sequence
acaaaagttagtgatagttg

SEQ ID NO: 118548 - DNA, 20 bp, Artificial sequence
  SiRNA target sequence
caaaagttagtgatagttga

SEQ ID NO: 118549 - DNA, 20 bp, Artificial sequence
  SiRNA target sequence
aaaagttagtgatagttgat

SEQ ID NO: 118550 - DNA, 20 bp, Artificial sequence
  SiRNA target sequence
aaagttagtgatagttgatt

SEQ ID NO: 118551 - DNA, 20 bp, Artificial sequence
  SiRNA target sequence
aagttagtgatagttgattt

SEQ ID NO: 118552 - DNA, 20 bp, Artificial sequence
  SiRNA target sequence
agttagtgatagttgatttt

SEQ ID NO: 118553 - DNA, 20 bp, Artificial sequence
  SiRNA target sequence
gttagtgatagttgattttg

SEQ ID NO: 118554 - DNA, 20 bp, Artificial sequence
  SiRNA target sequence
ttagtgatagttgattttgc

SEQ ID NO: 118555 - DNA, 20 bp, Artificial sequence
  SiRNA target sequence
tagtgatagttgattttgca

SEQ ID NO: 118556 - DNA, 20 bp, Artificial sequence
  SiRNA target sequence
agtgatagttgattttgcat

SEQ ID NO: 118557 - DNA, 20 bp, Artificial sequence
  SiRNA target sequence
gtgatagttgattttgcata

SEQ ID NO: 118558 - DNA, 20 bp, Artificial sequence
  SiRNA target sequence
tgatagttgattttgcatat

SEQ ID NO: 118559 - DNA, 20 bp, Artificial sequence
  SiRNA target sequence
gatagttgattttgcatatc

SEQ ID NO: 118560 - DNA, 20 bp, Artificial sequence
  SiRNA target sequence
atagttgattttgcatatcc

SEQ ID NO: 118561 - DNA, 20 bp, Artificial sequence
  SiRNA target sequence
tagttgattttgcatatcct

SEQ ID NO: 118562 - DNA, 20 bp, Artificial sequence
  SiRNA target sequence
agttgattttgcatatccta

SEQ ID NO: 118563 - DNA, 20 bp, Artificial sequence
  SiRNA target sequence
gttgattttgcatatcctac

SEQ ID NO: 118564 - DNA, 20 bp, Artificial sequence
  SiRNA target sequence
ttgattttgcatatcctact

SEQ ID NO: 118565 - DNA, 20 bp, Artificial sequence
  SiRNA target sequence
tgattttgcatatcctactt

SEQ ID NO: 118566 - DNA, 20 bp, Artificial sequence
  SiRNA target sequence
gattttgcatatcctacttt

SEQ ID NO: 118567 - DNA, 20 bp, Artificial sequence
  SiRNA target sequence
attttgcatatcctactttc

SEQ ID NO: 118568 - DNA, 20 bp, Artificial sequence
  SiRNA target sequence
ttttgcatatcctactttca

SEQ ID NO: 118569 - DNA, 20 bp, Artificial sequence
  SiRNA target sequence
tttgcatatcctactttcaa

SEQ ID NO: 118570 - DNA, 20 bp, Artificial sequence
  SiRNA target sequence
ttgcatatcctactttcaat

SEQ ID NO: 118571 - DNA, 20 bp, Artificial sequence
  SiRNA target sequence
tgcatatcctactttcaata

SEQ ID NO: 118572 - DNA, 20 bp, Artificial sequence
  SiRNA target sequence
gcatatcctactttcaatat

SEQ ID NO: 118573 - DNA, 20 bp, Artificial sequence
  SiRNA target sequence
catatcctactttcaatatt

SEQ ID NO: 118574 - DNA, 20 bp, Artificial sequence
  SiRNA target sequence
atatcctactttcaatattg

SEQ ID NO: 118575 - DNA, 20 bp, Artificial sequence
  SiRNA target sequence
tatcctactttcaatattgc

SEQ ID NO: 118576 - DNA, 20 bp, Artificial sequence
  SiRNA target sequence
atcctactttcaatattgcg

SEQ ID NO: 118577 - DNA, 20 bp, Artificial sequence
  SiRNA target sequence
tcctactttcaatattgcga

SEQ ID NO: 118578 - DNA, 20 bp, Artificial sequence
  SiRNA target sequence
cctactttcaatattgcgag

SEQ ID NO: 118579 - DNA, 20 bp, Artificial sequence
  SiRNA target sequence
ctactttcaatattgcgagt

SEQ ID NO: 118580 - DNA, 20 bp, Artificial sequence
  SiRNA target sequence
tactttcaatattgcgagtg

SEQ ID NO: 118581 - DNA, 20 bp, Artificial sequence
  SiRNA target sequence
actttcaatattgcgagtga

SEQ ID NO: 118582 - DNA, 20 bp, Artificial sequence
  SiRNA target sequence
ctttcaatattgcgagtgaa

SEQ ID NO: 118583 - DNA, 20 bp, Artificial sequence
  SiRNA target sequence
tttcaatattgcgagtgaaa

SEQ ID NO: 118584 - DNA, 20 bp, Artificial sequence
  SiRNA target sequence
ttcaatattgcgagtgaaat

SEQ ID NO: 118585 - DNA, 20 bp, Artificial sequence
  SiRNA target sequence
tcaatattgcgagtgaaata

SEQ ID NO: 118586 - DNA, 20 bp, Artificial sequence
  SiRNA target sequence
caatattgcgagtgaaatag

SEQ ID NO: 118587 - DNA, 20 bp, Artificial sequence
  SiRNA target sequence
aatattgcgagtgaaatagc

SEQ ID NO: 118588 - DNA, 20 bp, Artificial sequence
  SiRNA target sequence
atattgcgagtgaaatagct

SEQ ID NO: 118589 - DNA, 20 bp, Artificial sequence
  SiRNA target sequence
tattgcgagtgaaatagctg

SEQ ID NO: 118590 - DNA, 20 bp, Artificial sequence
  SiRNA target sequence
attgcgagtgaaatagctgc

SEQ ID NO: 118591 - DNA, 20 bp, Artificial sequence
  SiRNA target sequence
ttgcgagtgaaatagctgcg

SEQ ID NO: 118592 - DNA, 20 bp, Artificial sequence
  SiRNA target sequence
tgcgagtgaaatagctgcgc

SEQ ID NO: 118593 - DNA, 20 bp, Artificial sequence
  SiRNA target sequence
gcgagtgaaatagctgcgca

SEQ ID NO: 118594 - DNA, 20 bp, Artificial sequence
  SiRNA target sequence
cgagtgaaatagctgcgcac

SEQ ID NO: 118595 - DNA, 20 bp, Artificial sequence
  SiRNA target sequence
gagtgaaatagctgcgcact

SEQ ID NO: 118596 - DNA, 20 bp, Artificial sequence
  SiRNA target sequence
agtgaaatagctgcgcactt

SEQ ID NO: 118597 - DNA, 20 bp, Artificial sequence
  SiRNA target sequence
gtgaaatagctgcgcacttt

SEQ ID NO: 118598 - DNA, 20 bp, Artificial sequence
  SiRNA target sequence
tgaaatagctgcgcactttt

SEQ ID NO: 118599 - DNA, 20 bp, Artificial sequence
  SiRNA target sequence
gaaatagctgcgcactttta

SEQ ID NO: 118600 - DNA, 20 bp, Artificial sequence
  SiRNA target sequence
aaatagctgcgcacttttac

SEQ ID NO: 118601 - DNA, 20 bp, Artificial sequence
  SiRNA target sequence
aatagctgcgcacttttacg

SEQ ID NO: 118602 - DNA, 20 bp, Artificial sequence
  SiRNA target sequence
atagctgcgcacttttacga

SEQ ID NO: 118603 - DNA, 20 bp, Artificial sequence
  SiRNA target sequence
tagctgcgcacttttacgaa

SEQ ID NO: 118604 - DNA, 20 bp, Artificial sequence
  SiRNA target sequence
agctgcgcacttttacgaaa

SEQ ID NO: 118605 - DNA, 20 bp, Artificial sequence
  SiRNA target sequence
gctgcgcacttttacgaaaa

SEQ ID NO: 118606 - DNA, 20 bp, Artificial sequence
  SiRNA target sequence
ctgcgcacttttacgaaaaa

SEQ ID NO: 118607 - DNA, 20 bp, Artificial sequence
  SiRNA target sequence
tgcgcacttttacgaaaaat

SEQ ID NO: 118608 - DNA, 20 bp, Artificial sequence
  SiRNA target sequence
gcgcacttttacgaaaaatt

SEQ ID NO: 118609 - DNA, 20 bp, Artificial sequence
  SiRNA target sequence
cgcacttttacgaaaaattt

SEQ ID NO: 118610 - DNA, 20 bp, Artificial sequence
  SiRNA target sequence
gcacttttacgaaaaattta

SEQ ID NO: 118611 - DNA, 20 bp, Artificial sequence
  SiRNA target sequence
cacttttacgaaaaatttaa

SEQ ID NO: 118612 - DNA, 20 bp, Artificial sequence
  SiRNA target sequence
acttttacgaaaaatttaaa

SEQ ID NO: 118613 - DNA, 20 bp, Artificial sequence
  SiRNA target sequence
cttttacgaaaaatttaaag

SEQ ID NO: 118614 - DNA, 20 bp, Artificial sequence
  SiRNA target sequence
ttttacgaaaaatttaaaga

SEQ ID NO: 118615 - DNA, 20 bp, Artificial sequence
  SiRNA target sequence
tttacgaaaaatttaaagat

SEQ ID NO: 118616 - DNA, 20 bp, Artificial sequence
  SiRNA target sequence
ttacgaaaaatttaaagata

SEQ ID NO: 118617 - DNA, 20 bp, Artificial sequence
  SiRNA target sequence
tacgaaaaatttaaagatat

SEQ ID NO: 118618 - DNA, 20 bp, Artificial sequence
  SiRNA target sequence
acgaaaaatttaaagatata

SEQ ID NO: 118619 - DNA, 20 bp, Artificial sequence
  SiRNA target sequence
cgaaaaatttaaagatataa

SEQ ID NO: 118620 - DNA, 20 bp, Artificial sequence
  SiRNA target sequence
gaaaaatttaaagatataaa

SEQ ID NO: 118621 - DNA, 20 bp, Artificial sequence
  SiRNA target sequence
aaaaatttaaagatataaaa

SEQ ID NO: 118622 - DNA, 20 bp, Artificial sequence
  SiRNA target sequence
aaaatttaaagatataaaaa

SEQ ID NO: 118623 - DNA, 20 bp, Artificial sequence
  SiRNA target sequence
aaatttaaagatataaaaat

SEQ ID NO: 118624 - DNA, 20 bp, Artificial sequence
  SiRNA target sequence
aatttaaagatataaaaatt

SEQ ID NO: 118625 - DNA, 20 bp, Artificial sequence
  SiRNA target sequence
atttaaagatataaaaatta

SEQ ID NO: 118626 - DNA, 20 bp, Artificial sequence
  SiRNA target sequence
tttaaagatataaaaattat

SEQ ID NO: 118627 - DNA, 20 bp, Artificial sequence
  SiRNA target sequence
ttaaagatataaaaattatg

SEQ ID NO: 118628 - DNA, 20 bp, Artificial sequence
  SiRNA target sequence
taaagatataaaaattatgc

SEQ ID NO: 118629 - DNA, 20 bp, Artificial sequence
  SiRNA target sequence
aaagatataaaaattatgcg

SEQ ID NO: 118630 - DNA, 20 bp, Artificial sequence
  SiRNA target sequence
aagatataaaaattatgcgt

SEQ ID NO: 118631 - DNA, 20 bp, Artificial sequence
  SiRNA target sequence
agatataaaaattatgcgtg

SEQ ID NO: 118632 - DNA, 20 bp, Artificial sequence
  SiRNA target sequence
gatataaaaattatgcgtgt

SEQ ID NO: 118633 - DNA, 20 bp, Artificial sequence
  SiRNA target sequence
atataaaaattatgcgtgtt

SEQ ID NO: 118634 - DNA, 20 bp, Artificial sequence
  SiRNA target sequence
tataaaaattatgcgtgttc

SEQ ID NO: 118635 - DNA, 20 bp, Artificial sequence
  SiRNA target sequence
ataaaaattatgcgtgttct

SEQ ID NO: 118636 - DNA, 20 bp, Artificial sequence
  SiRNA target sequence
taaaaattatgcgtgttctt

SEQ ID NO: 118637 - DNA, 20 bp, Artificial sequence
  SiRNA target sequence
aaaaattatgcgtgttcttg

SEQ ID NO: 118638 - DNA, 20 bp, Artificial sequence
  SiRNA target sequence
aaaattatgcgtgttcttgc

SEQ ID NO: 118639 - DNA, 20 bp, Artificial sequence
  SiRNA target sequence
aaattatgcgtgttcttgcg

SEQ ID NO: 118640 - DNA, 20 bp, Artificial sequence
  SiRNA target sequence
aattatgcgtgttcttgcgc

SEQ ID NO: 118641 - DNA, 20 bp, Artificial sequence
  SiRNA target sequence
attatgcgtgttcttgcgca

SEQ ID NO: 118642 - DNA, 20 bp, Artificial sequence
  SiRNA target sequence
ttatgcgtgttcttgcgcaa

SEQ ID NO: 118643 - DNA, 20 bp, Artificial sequence
  SiRNA target sequence
tatgcgtgttcttgcgcaag

SEQ ID NO: 118644 - DNA, 20 bp, Artificial sequence
  SiRNA target sequence
atgcgtgttcttgcgcaaga

SEQ ID NO: 118645 - DNA, 20 bp, Artificial sequence
  SiRNA target sequence
tgcgtgttcttgcgcaagat

SEQ ID NO: 118646 - DNA, 20 bp, Artificial sequence
  SiRNA target sequence
gcgtgttcttgcgcaagata

SEQ ID NO: 118647 - DNA, 20 bp, Artificial sequence
  SiRNA target sequence
cgtgttcttgcgcaagatat

SEQ ID NO: 118648 - DNA, 20 bp, Artificial sequence
  SiRNA target sequence
gtgttcttgcgcaagatatt

SEQ ID NO: 118649 - DNA, 20 bp, Artificial sequence
  SiRNA target sequence
tgttcttgcgcaagatattc

SEQ ID NO: 118650 - DNA, 20 bp, Artificial sequence
  SiRNA target sequence
gttcttgcgcaagatattcc

SEQ ID NO: 118651 - DNA, 20 bp, Artificial sequence
  SiRNA target sequence
ttcttgcgcaagatattcct

SEQ ID NO: 118652 - DNA, 20 bp, Artificial sequence
  SiRNA target sequence
tcttgcgcaagatattccta

SEQ ID NO: 118653 - DNA, 20 bp, Artificial sequence
  SiRNA target sequence
cttgcgcaagatattcctac

SEQ ID NO: 118654 - DNA, 20 bp, Artificial sequence
  SiRNA target sequence
ttgcgcaagatattcctaca

SEQ ID NO: 118655 - DNA, 20 bp, Artificial sequence
  SiRNA target sequence
tgcgcaagatattcctacac

SEQ ID NO: 118656 - DNA, 20 bp, Artificial sequence
  SiRNA target sequence
gcgcaagatattcctacacc

SEQ ID NO: 118657 - DNA, 20 bp, Artificial sequence
  SiRNA target sequence
cgcaagatattcctacaccg

SEQ ID NO: 118658 - DNA, 20 bp, Artificial sequence
  SiRNA target sequence
gcaagatattcctacaccgt

SEQ ID NO: 118659 - DNA, 20 bp, Artificial sequence
  SiRNA target sequence
caagatattcctacaccgta

SEQ ID NO: 118660 - DNA, 20 bp, Artificial sequence
  SiRNA target sequence
aagatattcctacaccgtat

SEQ ID NO: 118661 - DNA, 20 bp, Artificial sequence
  SiRNA target sequence
agatattcctacaccgtatg

SEQ ID NO: 118662 - DNA, 20 bp, Artificial sequence
  SiRNA target sequence
gatattcctacaccgtatgc

SEQ ID NO: 118663 - DNA, 20 bp, Artificial sequence
  SiRNA target sequence
atattcctacaccgtatgca

SEQ ID NO: 118664 - DNA, 20 bp, Artificial sequence
  SiRNA target sequence
tattcctacaccgtatgcac

SEQ ID NO: 118665 - DNA, 20 bp, Artificial sequence
  SiRNA target sequence
attcctacaccgtatgcact

SEQ ID NO: 118666 - DNA, 20 bp, Artificial sequence
  SiRNA target sequence
ttcctacaccgtatgcactt

SEQ ID NO: 118667 - DNA, 20 bp, Artificial sequence
  SiRNA target sequence
tcctacaccgtatgcactta

SEQ ID NO: 118668 - DNA, 20 bp, Artificial sequence
  SiRNA target sequence
cctacaccgtatgcacttaa

SEQ ID NO: 118669 - DNA, 20 bp, Artificial sequence
  SiRNA target sequence
ctacaccgtatgcacttaat

SEQ ID NO: 118670 - DNA, 20 bp, Artificial sequence
  SiRNA target sequence
tacaccgtatgcacttaatc

SEQ ID NO: 118671 - DNA, 20 bp, Artificial sequence
  SiRNA target sequence
acaccgtatgcacttaatct

SEQ ID NO: 118672 - DNA, 20 bp, Artificial sequence
  SiRNA target sequence
caccgtatgcacttaatctt

SEQ ID NO: 118673 - DNA, 20 bp, Artificial sequence
  SiRNA target sequence
accgtatgcacttaatcttg

SEQ ID NO: 118674 - DNA, 20 bp, Artificial sequence
  SiRNA target sequence
ccgtatgcacttaatcttga

SEQ ID NO: 118675 - DNA, 20 bp, Artificial sequence
  SiRNA target sequence
cgtatgcacttaatcttgaa

SEQ ID NO: 118676 - DNA, 20 bp, Artificial sequence
  SiRNA target sequence
gtatgcacttaatcttgaaa

SEQ ID NO: 118677 - DNA, 20 bp, Artificial sequence
  SiRNA target sequence
tatgcacttaatcttgaaaa

SEQ ID NO: 118678 - DNA, 20 bp, Artificial sequence
  SiRNA target sequence
atgcacttaatcttgaaaaa

SEQ ID NO: 118679 - DNA, 20 bp, Artificial sequence
  SiRNA target sequence
tgcacttaatcttgaaaaaa

SEQ ID NO: 118680 - DNA, 20 bp, Artificial sequence
  SiRNA target sequence
gcacttaatcttgaaaaaat

SEQ ID NO: 118681 - DNA, 20 bp, Artificial sequence
  SiRNA target sequence
cacttaatcttgaaaaaatg

SEQ ID NO: 118682 - DNA, 20 bp, Artificial sequence
  SiRNA target sequence
acttaatcttgaaaaaatgt

SEQ ID NO: 118683 - DNA, 20 bp, Artificial sequence
  SiRNA target sequence
cttaatcttgaaaaaatgtc

SEQ ID NO: 118684 - DNA, 20 bp, Artificial sequence
  SiRNA target sequence
ttaatcttgaaaaaatgtct

SEQ ID NO: 118685 - DNA, 20 bp, Artificial sequence
  SiRNA target sequence
taatcttgaaaaaatgtctt

SEQ ID NO: 118686 - DNA, 20 bp, Artificial sequence
  SiRNA target sequence
aatcttgaaaaaatgtctta

SEQ ID NO: 118687 - DNA, 20 bp, Artificial sequence
  SiRNA target sequence
atcttgaaaaaatgtcttat

SEQ ID NO: 118688 - DNA, 20 bp, Artificial sequence
  SiRNA target sequence
tcttgaaaaaatgtcttatc

SEQ ID NO: 118689 - DNA, 20 bp, Artificial sequence
  SiRNA target sequence
cttgaaaaaatgtcttatcc

SEQ ID NO: 118690 - DNA, 20 bp, Artificial sequence
  SiRNA target sequence
ttgaaaaaatgtcttatccg

SEQ ID NO: 118691 - DNA, 20 bp, Artificial sequence
  SiRNA target sequence
tgaaaaaatgtcttatccga

SEQ ID NO: 118692 - DNA, 20 bp, Artificial sequence
  SiRNA target sequence
gaaaaaatgtcttatccgac

SEQ ID NO: 118693 - DNA, 20 bp, Artificial sequence
  SiRNA target sequence
aaaaaatgtcttatccgaca

SEQ ID NO: 118694 - DNA, 20 bp, Artificial sequence
  SiRNA target sequence
aaaaatgtcttatccgacat

SEQ ID NO: 118695 - DNA, 20 bp, Artificial sequence
  SiRNA target sequence
aaaatgtcttatccgacatg

SEQ ID NO: 118696 - DNA, 20 bp, Artificial sequence
  SiRNA target sequence
aaatgtcttatccgacatgc

SEQ ID NO: 118697 - DNA, 20 bp, Artificial sequence
  SiRNA target sequence
aatgtcttatccgacatgca

SEQ ID NO: 118698 - DNA, 20 bp, Artificial sequence
  SiRNA target sequence
atgtcttatccgacatgcaa

SEQ ID NO: 118699 - DNA, 20 bp, Artificial sequence
  SiRNA target sequence
tgtcttatccgacatgcaat

SEQ ID NO: 118700 - DNA, 20 bp, Artificial sequence
  SiRNA target sequence
gtcttatccgacatgcaatg

SEQ ID NO: 118701 - DNA, 20 bp, Artificial sequence
  SiRNA target sequence
tcttatccgacatgcaatga

SEQ ID NO: 118702 - DNA, 20 bp, Artificial sequence
  SiRNA target sequence
cttatccgacatgcaatgat

SEQ ID NO: 118703 - DNA, 20 bp, Artificial sequence
  SiRNA target sequence
ttatccgacatgcaatgata

SEQ ID NO: 118704 - DNA, 20 bp, Artificial sequence
  SiRNA target sequence
tatccgacatgcaatgatat

SEQ ID NO: 118705 - DNA, 20 bp, Artificial sequence
  SiRNA target sequence
atccgacatgcaatgatatt

SEQ ID NO: 118706 - DNA, 20 bp, Artificial sequence
  SiRNA target sequence
tccgacatgcaatgatattg

SEQ ID NO: 118707 - DNA, 20 bp, Artificial sequence
  SiRNA target sequence
ccgacatgcaatgatattgt

SEQ ID NO: 118708 - DNA, 20 bp, Artificial sequence
  SiRNA target sequence
cgacatgcaatgatattgta

SEQ ID NO: 118709 - DNA, 20 bp, Artificial sequence
  SiRNA target sequence
gacatgcaatgatattgtaa

SEQ ID NO: 118710 - DNA, 20 bp, Artificial sequence
  SiRNA target sequence
acatgcaatgatattgtaaa

SEQ ID NO: 118711 - DNA, 20 bp, Artificial sequence
  SiRNA target sequence
catgcaatgatattgtaaat

SEQ ID NO: 118712 - DNA, 20 bp, Artificial sequence
  SiRNA target sequence
atgcaatgatattgtaaatg

SEQ ID NO: 118713 - DNA, 20 bp, Artificial sequence
  SiRNA target sequence
tgcaatgatattgtaaatgc

SEQ ID NO: 118714 - DNA, 20 bp, Artificial sequence
  SiRNA target sequence
gcaatgatattgtaaatgct

SEQ ID NO: 118715 - DNA, 20 bp, Artificial sequence
  SiRNA target sequence
caatgatattgtaaatgctg

SEQ ID NO: 118716 - DNA, 20 bp, Artificial sequence
  SiRNA target sequence
aatgatattgtaaatgctgt

SEQ ID NO: 118717 - DNA, 20 bp, Artificial sequence
  SiRNA target sequence
atgatattgtaaatgctgtt

SEQ ID NO: 118718 - DNA, 20 bp, Artificial sequence
  SiRNA target sequence
tgatattgtaaatgctgtta

SEQ ID NO: 118719 - DNA, 20 bp, Artificial sequence
  SiRNA target sequence
gatattgtaaatgctgttac

SEQ ID NO: 118720 - DNA, 20 bp, Artificial sequence
  SiRNA target sequence
atattgtaaatgctgttaca

SEQ ID NO: 118721 - DNA, 20 bp, Artificial sequence
  SiRNA target sequence
tattgtaaatgctgttacaa

SEQ ID NO: 118722 - DNA, 20 bp, Artificial sequence
  SiRNA target sequence
attgtaaatgctgttacaaa

SEQ ID NO: 118723 - DNA, 20 bp, Artificial sequence
  SiRNA target sequence
ttgtaaatgctgttacaaaa

SEQ ID NO: 118724 - DNA, 20 bp, Artificial sequence
  SiRNA target sequence
tgtaaatgctgttacaaaaa

SEQ ID NO: 118725 - DNA, 20 bp, Artificial sequence
  SiRNA target sequence
gtaaatgctgttacaaaaat

SEQ ID NO: 118726 - DNA, 20 bp, Artificial sequence
  SiRNA target sequence
taaatgctgttacaaaaata

SEQ ID NO: 118727 - DNA, 20 bp, Artificial sequence
  SiRNA target sequence
aaatgctgttacaaaaataa

SEQ ID NO: 118728 - DNA, 20 bp, Artificial sequence
  SiRNA target sequence
aatgctgttacaaaaataaa

SEQ ID NO: 118729 - DNA, 20 bp, Artificial sequence
  SiRNA target sequence
atgctgttacaaaaataaat

SEQ ID NO: 118730 - DNA, 20 bp, Artificial sequence
  SiRNA target sequence
tgctgttacaaaaataaatt

SEQ ID NO: 118731 - DNA, 20 bp, Artificial sequence
  SiRNA target sequence
gctgttacaaaaataaattc

SEQ ID NO: 118732 - DNA, 20 bp, Artificial sequence
  SiRNA target sequence
ctgttacaaaaataaattca

SEQ ID NO: 118733 - DNA, 20 bp, Artificial sequence
  SiRNA target sequence
tgttacaaaaataaattcat

SEQ ID NO: 118734 - DNA, 20 bp, Artificial sequence
  SiRNA target sequence
gttacaaaaataaattcata

SEQ ID NO: 118735 - DNA, 20 bp, Artificial sequence
  SiRNA target sequence
ttacaaaaataaattcatag

SEQ ID NO: 118736 - DNA, 21 bp, Artificial sequence
  SiRNA target sequence
atgatagaaattcgcgatctt

SEQ ID NO: 118737 - DNA, 21 bp, Artificial sequence
  SiRNA target sequence
tgatagaaattcgcgatctta

SEQ ID NO: 118738 - DNA, 21 bp, Artificial sequence
  SiRNA target sequence
gatagaaattcgcgatcttat

SEQ ID NO: 118739 - DNA, 21 bp, Artificial sequence
  SiRNA target sequence
atagaaattcgcgatcttata

SEQ ID NO: 118740 - DNA, 21 bp, Artificial sequence
  SiRNA target sequence
tagaaattcgcgatcttataa

SEQ ID NO: 118741 - DNA, 21 bp, Artificial sequence
  SiRNA target sequence
agaaattcgcgatcttataaa

SEQ ID NO: 118742 - DNA, 21 bp, Artificial sequence
  SiRNA target sequence
gaaattcgcgatcttataaat

SEQ ID NO: 118743 - DNA, 21 bp, Artificial sequence
  SiRNA target sequence
aaattcgcgatcttataaatc

SEQ ID NO: 118744 - DNA, 21 bp, Artificial sequence
  SiRNA target sequence
aattcgcgatcttataaatca

SEQ ID NO: 118745 - DNA, 21 bp, Artificial sequence
  SiRNA target sequence
attcgcgatcttataaatcaa

SEQ ID NO: 118746 - DNA, 21 bp, Artificial sequence
  SiRNA target sequence
ttcgcgatcttataaatcaag

SEQ ID NO: 118747 - DNA, 21 bp, Artificial sequence
  SiRNA target sequence
tcgcgatcttataaatcaagc

SEQ ID NO: 118748 - DNA, 21 bp, Artificial sequence
  SiRNA target sequence
cgcgatcttataaatcaagca

SEQ ID NO: 118749 - DNA, 21 bp, Artificial sequence
  SiRNA target sequence
gcgatcttataaatcaagcat

SEQ ID NO: 118750 - DNA, 21 bp, Artificial sequence
  SiRNA target sequence
cgatcttataaatcaagcatt

SEQ ID NO: 118751 - DNA, 21 bp, Artificial sequence
  SiRNA target sequence
gatcttataaatcaagcattg

SEQ ID NO: 118752 - DNA, 21 bp, Artificial sequence
  SiRNA target sequence
atcttataaatcaagcattgg

SEQ ID NO: 118753 - DNA, 21 bp, Artificial sequence
  SiRNA target sequence
tcttataaatcaagcattgga

SEQ ID NO: 118754 - DNA, 21 bp, Artificial sequence
  SiRNA target sequence
cttataaatcaagcattggat

SEQ ID NO: 118755 - DNA, 21 bp, Artificial sequence
  SiRNA target sequence
ttataaatcaagcattggatg

SEQ ID NO: 118756 - DNA, 21 bp, Artificial sequence
  SiRNA target sequence
tataaatcaagcattggatga

SEQ ID NO: 118757 - DNA, 21 bp, Artificial sequence
  SiRNA target sequence
ataaatcaagcattggatgag

SEQ ID NO: 118758 - DNA, 21 bp, Artificial sequence
  SiRNA target sequence
taaatcaagcattggatgagg

SEQ ID NO: 118759 - DNA, 21 bp, Artificial sequence
  SiRNA target sequence
aaatcaagcattggatgagga

SEQ ID NO: 118760 - DNA, 21 bp, Artificial sequence
  SiRNA target sequence
aatcaagcattggatgaggaa

SEQ ID NO: 118761 - DNA, 21 bp, Artificial sequence
  SiRNA target sequence
atcaagcattggatgaggaaa

SEQ ID NO: 118762 - DNA, 21 bp, Artificial sequence
  SiRNA target sequence
tcaagcattggatgaggaaat

SEQ ID NO: 118763 - DNA, 21 bp, Artificial sequence
  SiRNA target sequence
caagcattggatgaggaaatg

SEQ ID NO: 118764 - DNA, 21 bp, Artificial sequence
  SiRNA target sequence
aagcattggatgaggaaatgg

SEQ ID NO: 118765 - DNA, 21 bp, Artificial sequence
  SiRNA target sequence
agcattggatgaggaaatggg

SEQ ID NO: 118766 - DNA, 21 bp, Artificial sequence
  SiRNA target sequence
gcattggatgaggaaatggga

SEQ ID NO: 118767 - DNA, 21 bp, Artificial sequence
  SiRNA target sequence
cattggatgaggaaatgggaa

SEQ ID NO: 118768 - DNA, 21 bp, Artificial sequence
  SiRNA target sequence
attggatgaggaaatgggaat

SEQ ID NO: 118769 - DNA, 21 bp, Artificial sequence
  SiRNA target sequence
ttggatgaggaaatgggaatg

SEQ ID NO: 118770 - DNA, 21 bp, Artificial sequence
  SiRNA target sequence
tggatgaggaaatgggaatgg

SEQ ID NO: 118771 - DNA, 21 bp, Artificial sequence
  SiRNA target sequence
ggatgaggaaatgggaatgga

SEQ ID NO: 118772 - DNA, 21 bp, Artificial sequence
  SiRNA target sequence
gatgaggaaatgggaatggat

SEQ ID NO: 118773 - DNA, 21 bp, Artificial sequence
  SiRNA target sequence
atgaggaaatgggaatggatc

SEQ ID NO: 118774 - DNA, 21 bp, Artificial sequence
  SiRNA target sequence
tgaggaaatgggaatggatca

SEQ ID NO: 118775 - DNA, 21 bp, Artificial sequence
  SiRNA target sequence
gaggaaatgggaatggatcat

SEQ ID NO: 118776 - DNA, 21 bp, Artificial sequence
  SiRNA target sequence
aggaaatgggaatggatcata

SEQ ID NO: 118777 - DNA, 21 bp, Artificial sequence
  SiRNA target sequence
ggaaatgggaatggatcataa

SEQ ID NO: 118778 - DNA, 21 bp, Artificial sequence
  SiRNA target sequence
gaaatgggaatggatcataat

SEQ ID NO: 118779 - DNA, 21 bp, Artificial sequence
  SiRNA target sequence
aaatgggaatggatcataatg

SEQ ID NO: 118780 - DNA, 21 bp, Artificial sequence
  SiRNA target sequence
aatgggaatggatcataatgt

SEQ ID NO: 118781 - DNA, 21 bp, Artificial sequence
  SiRNA target sequence
atgggaatggatcataatgta

SEQ ID NO: 118782 - DNA, 21 bp, Artificial sequence
  SiRNA target sequence
tgggaatggatcataatgtat

SEQ ID NO: 118783 - DNA, 21 bp, Artificial sequence
  SiRNA target sequence
gggaatggatcataatgtata

SEQ ID NO: 118784 - DNA, 21 bp, Artificial sequence
  SiRNA target sequence
ggaatggatcataatgtatat

SEQ ID NO: 118785 - DNA, 21 bp, Artificial sequence
  SiRNA target sequence
gaatggatcataatgtatata

SEQ ID NO: 118786 - DNA, 21 bp, Artificial sequence
  SiRNA target sequence
aatggatcataatgtatatat

SEQ ID NO: 118787 - DNA, 21 bp, Artificial sequence
  SiRNA target sequence
atggatcataatgtatatata

SEQ ID NO: 118788 - DNA, 21 bp, Artificial sequence
  SiRNA target sequence
tggatcataatgtatatataa

SEQ ID NO: 118789 - DNA, 21 bp, Artificial sequence
  SiRNA target sequence
ggatcataatgtatatataat

SEQ ID NO: 118790 - DNA, 21 bp, Artificial sequence
  SiRNA target sequence
gatcataatgtatatataata

SEQ ID NO: 118791 - DNA, 21 bp, Artificial sequence
  SiRNA target sequence
atcataatgtatatataatag

SEQ ID NO: 118792 - DNA, 21 bp, Artificial sequence
  SiRNA target sequence
tcataatgtatatataatagg

SEQ ID NO: 118793 - DNA, 21 bp, Artificial sequence
  SiRNA target sequence
cataatgtatatataatagga

SEQ ID NO: 118794 - DNA, 21 bp, Artificial sequence
  SiRNA target sequence
ataatgtatatataataggag

SEQ ID NO: 118795 - DNA, 21 bp, Artificial sequence
  SiRNA target sequence
taatgtatatataataggaga

SEQ ID NO: 118796 - DNA, 21 bp, Artificial sequence
  SiRNA target sequence
aatgtatatataataggagaa

SEQ ID NO: 118797 - DNA, 21 bp, Artificial sequence
  SiRNA target sequence
atgtatatataataggagaag

SEQ ID NO: 118798 - DNA, 21 bp, Artificial sequence
  SiRNA target sequence
tgtatatataataggagaaga

SEQ ID NO: 118799 - DNA, 21 bp, Artificial sequence
  SiRNA target sequence
gtatatataataggagaagaa

SEQ ID NO: 118800 - DNA, 21 bp, Artificial sequence
  SiRNA target sequence
tatatataataggagaagaag

SEQ ID NO: 118801 - DNA, 21 bp, Artificial sequence
  SiRNA target sequence
atatataataggagaagaagt

SEQ ID NO: 118802 - DNA, 21 bp, Artificial sequence
  SiRNA target sequence
tatataataggagaagaagta

SEQ ID NO: 118803 - DNA, 21 bp, Artificial sequence
  SiRNA target sequence
atataataggagaagaagtag

SEQ ID NO: 118804 - DNA, 21 bp, Artificial sequence
  SiRNA target sequence
tataataggagaagaagtagg

SEQ ID NO: 118805 - DNA, 21 bp, Artificial sequence
  SiRNA target sequence
ataataggagaagaagtaggc

SEQ ID NO: 118806 - DNA, 21 bp, Artificial sequence
  SiRNA target sequence
taataggagaagaagtaggca

SEQ ID NO: 118807 - DNA, 21 bp, Artificial sequence
  SiRNA target sequence
aataggagaagaagtaggcat

SEQ ID NO: 118808 - DNA, 21 bp, Artificial sequence
  SiRNA target sequence
ataggagaagaagtaggcatc

SEQ ID NO: 118809 - DNA, 21 bp, Artificial sequence
  SiRNA target sequence
taggagaagaagtaggcatct

SEQ ID NO: 118810 - DNA, 21 bp, Artificial sequence
  SiRNA target sequence
aggagaagaagtaggcatctc

SEQ ID NO: 118811 - DNA, 21 bp, Artificial sequence
  SiRNA target sequence
ggagaagaagtaggcatctct

SEQ ID NO: 118812 - DNA, 21 bp, Artificial sequence
  SiRNA target sequence
gagaagaagtaggcatctctg

SEQ ID NO: 118813 - DNA, 21 bp, Artificial sequence
  SiRNA target sequence
agaagaagtaggcatctctgg

SEQ ID NO: 118814 - DNA, 21 bp, Artificial sequence
  SiRNA target sequence
gaagaagtaggcatctctggt

SEQ ID NO: 118815 - DNA, 21 bp, Artificial sequence
  SiRNA target sequence
aagaagtaggcatctctggtg

SEQ ID NO: 118816 - DNA, 21 bp, Artificial sequence
  SiRNA target sequence
agaagtaggcatctctggtgg

SEQ ID NO: 118817 - DNA, 21 bp, Artificial sequence
  SiRNA target sequence
gaagtaggcatctctggtggt

SEQ ID NO: 118818 - DNA, 21 bp, Artificial sequence
  SiRNA target sequence
aagtaggcatctctggtggtc

SEQ ID NO: 118819 - DNA, 21 bp, Artificial sequence
  SiRNA target sequence
agtaggcatctctggtggtcc

SEQ ID NO: 118820 - DNA, 21 bp, Artificial sequence
  SiRNA target sequence
gtaggcatctctggtggtcct

SEQ ID NO: 118821 - DNA, 21 bp, Artificial sequence
  SiRNA target sequence
taggcatctctggtggtcctc

SEQ ID NO: 118822 - DNA, 21 bp, Artificial sequence
  SiRNA target sequence
aggcatctctggtggtcctca

SEQ ID NO: 118823 - DNA, 21 bp, Artificial sequence
  SiRNA target sequence
ggcatctctggtggtcctcac

SEQ ID NO: 118824 - DNA, 21 bp, Artificial sequence
  SiRNA target sequence
gcatctctggtggtcctcacg

SEQ ID NO: 118825 - DNA, 21 bp, Artificial sequence
  SiRNA target sequence
catctctggtggtcctcacgg

SEQ ID NO: 118826 - DNA, 21 bp, Artificial sequence
  SiRNA target sequence
atctctggtggtcctcacggt

SEQ ID NO: 118827 - DNA, 21 bp, Artificial sequence
  SiRNA target sequence
tctctggtggtcctcacggtc

SEQ ID NO: 118828 - DNA, 21 bp, Artificial sequence
  SiRNA target sequence
ctctggtggtcctcacggtct

SEQ ID NO: 118829 - DNA, 21 bp, Artificial sequence
  SiRNA target sequence
tctggtggtcctcacggtctt

SEQ ID NO: 118830 - DNA, 21 bp, Artificial sequence
  SiRNA target sequence
ctggtggtcctcacggtctta

SEQ ID NO: 118831 - DNA, 21 bp, Artificial sequence
  SiRNA target sequence
tggtggtcctcacggtcttac

SEQ ID NO: 118832 - DNA, 21 bp, Artificial sequence
  SiRNA target sequence
ggtggtcctcacggtcttact

SEQ ID NO: 118833 - DNA, 21 bp, Artificial sequence
  SiRNA target sequence
gtggtcctcacggtcttacta

SEQ ID NO: 118834 - DNA, 21 bp, Artificial sequence
  SiRNA target sequence
tggtcctcacggtcttactaa

SEQ ID NO: 118835 - DNA, 21 bp, Artificial sequence
  SiRNA target sequence
ggtcctcacggtcttactaaa

SEQ ID NO: 118836 - DNA, 21 bp, Artificial sequence
  SiRNA target sequence
gtcctcacggtcttactaaaa

SEQ ID NO: 118837 - DNA, 21 bp, Artificial sequence
  SiRNA target sequence
tcctcacggtcttactaaaaa

SEQ ID NO: 118838 - DNA, 21 bp, Artificial sequence
  SiRNA target sequence
cctcacggtcttactaaaaat

SEQ ID NO: 118839 - DNA, 21 bp, Artificial sequence
  SiRNA target sequence
ctcacggtcttactaaaaatt

SEQ ID NO: 118840 - DNA, 21 bp, Artificial sequence
  SiRNA target sequence
tcacggtcttactaaaaattt

SEQ ID NO: 118841 - DNA, 21 bp, Artificial sequence
  SiRNA target sequence
cacggtcttactaaaaatttg

SEQ ID NO: 118842 - DNA, 21 bp, Artificial sequence
  SiRNA target sequence
acggtcttactaaaaatttga

SEQ ID NO: 118843 - DNA, 21 bp, Artificial sequence
  SiRNA target sequence
cggtcttactaaaaatttgat

SEQ ID NO: 118844 - DNA, 21 bp, Artificial sequence
  SiRNA target sequence
ggtcttactaaaaatttgatc

SEQ ID NO: 118845 - DNA, 21 bp, Artificial sequence
  SiRNA target sequence
gtcttactaaaaatttgatca

SEQ ID NO: 118846 - DNA, 21 bp, Artificial sequence
  SiRNA target sequence
tcttactaaaaatttgatcaa

SEQ ID NO: 118847 - DNA, 21 bp, Artificial sequence
  SiRNA target sequence
cttactaaaaatttgatcaaa

SEQ ID NO: 118848 - DNA, 21 bp, Artificial sequence
  SiRNA target sequence
ttactaaaaatttgatcaaaa

SEQ ID NO: 118849 - DNA, 21 bp, Artificial sequence
  SiRNA target sequence
tactaaaaatttgatcaaaaa

SEQ ID NO: 118850 - DNA, 21 bp, Artificial sequence
  SiRNA target sequence
actaaaaatttgatcaaaaaa

SEQ ID NO: 118851 - DNA, 21 bp, Artificial sequence
  SiRNA target sequence
ctaaaaatttgatcaaaaaat

SEQ ID NO: 118852 - DNA, 21 bp, Artificial sequence
  SiRNA target sequence
taaaaatttgatcaaaaaata

SEQ ID NO: 118853 - DNA, 21 bp, Artificial sequence
  SiRNA target sequence
aaaaatttgatcaaaaaatac

SEQ ID NO: 118854 - DNA, 21 bp, Artificial sequence
  SiRNA target sequence
aaaatttgatcaaaaaatacg

SEQ ID NO: 118855 - DNA, 21 bp, Artificial sequence
  SiRNA target sequence
aaatttgatcaaaaaatacgg

SEQ ID NO: 118856 - DNA, 21 bp, Artificial sequence
  SiRNA target sequence
aatttgatcaaaaaatacggc

SEQ ID NO: 118857 - DNA, 21 bp, Artificial sequence
  SiRNA target sequence
atttgatcaaaaaatacggcg

SEQ ID NO: 118858 - DNA, 21 bp, Artificial sequence
  SiRNA target sequence
tttgatcaaaaaatacggcga

SEQ ID NO: 118859 - DNA, 21 bp, Artificial sequence
  SiRNA target sequence
ttgatcaaaaaatacggcgat

SEQ ID NO: 118860 - DNA, 21 bp, Artificial sequence
  SiRNA target sequence
tgatcaaaaaatacggcgatc

SEQ ID NO: 118861 - DNA, 21 bp, Artificial sequence
  SiRNA target sequence
gatcaaaaaatacggcgatca

SEQ ID NO: 118862 - DNA, 21 bp, Artificial sequence
  SiRNA target sequence
atcaaaaaatacggcgatcaa

SEQ ID NO: 118863 - DNA, 21 bp, Artificial sequence
  SiRNA target sequence
tcaaaaaatacggcgatcaaa

SEQ ID NO: 118864 - DNA, 21 bp, Artificial sequence
  SiRNA target sequence
caaaaaatacggcgatcaaag

SEQ ID NO: 118865 - DNA, 21 bp, Artificial sequence
  SiRNA target sequence
aaaaaatacggcgatcaaaga

SEQ ID NO: 118866 - DNA, 21 bp, Artificial sequence
  SiRNA target sequence
aaaaatacggcgatcaaagag

SEQ ID NO: 118867 - DNA, 21 bp, Artificial sequence
  SiRNA target sequence
aaaatacggcgatcaaagagt

SEQ ID NO: 118868 - DNA, 21 bp, Artificial sequence
  SiRNA target sequence
aaatacggcgatcaaagagtg

SEQ ID NO: 118869 - DNA, 21 bp, Artificial sequence
  SiRNA target sequence
aatacggcgatcaaagagtga

SEQ ID NO: 118870 - DNA, 21 bp, Artificial sequence
  SiRNA target sequence
atacggcgatcaaagagtgaa

SEQ ID NO: 118871 - DNA, 21 bp, Artificial sequence
  SiRNA target sequence
tacggcgatcaaagagtgaag

SEQ ID NO: 118872 - DNA, 21 bp, Artificial sequence
  SiRNA target sequence
acggcgatcaaagagtgaagg

SEQ ID NO: 118873 - DNA, 21 bp, Artificial sequence
  SiRNA target sequence
cggcgatcaaagagtgaagga

SEQ ID NO: 118874 - DNA, 21 bp, Artificial sequence
  SiRNA target sequence
ggcgatcaaagagtgaaggat

SEQ ID NO: 118875 - DNA, 21 bp, Artificial sequence
  SiRNA target sequence
gcgatcaaagagtgaaggata

SEQ ID NO: 118876 - DNA, 21 bp, Artificial sequence
  SiRNA target sequence
cgatcaaagagtgaaggatac

SEQ ID NO: 118877 - DNA, 21 bp, Artificial sequence
  SiRNA target sequence
gatcaaagagtgaaggatacc

SEQ ID NO: 118878 - DNA, 21 bp, Artificial sequence
  SiRNA target sequence
atcaaagagtgaaggataccc

SEQ ID NO: 118879 - DNA, 21 bp, Artificial sequence
  SiRNA target sequence
tcaaagagtgaaggatacccc

SEQ ID NO: 118880 - DNA, 21 bp, Artificial sequence
  SiRNA target sequence
caaagagtgaaggatacccct

SEQ ID NO: 118881 - DNA, 21 bp, Artificial sequence
  SiRNA target sequence
aaagagtgaaggataccccta

SEQ ID NO: 118882 - DNA, 21 bp, Artificial sequence
  SiRNA target sequence
aagagtgaaggatacccctat

SEQ ID NO: 118883 - DNA, 21 bp, Artificial sequence
  SiRNA target sequence
agagtgaaggatacccctatt

SEQ ID NO: 118884 - DNA, 21 bp, Artificial sequence
  SiRNA target sequence
gagtgaaggatacccctattt

SEQ ID NO: 118885 - DNA, 21 bp, Artificial sequence
  SiRNA target sequence
agtgaaggatacccctatttc

SEQ ID NO: 118886 - DNA, 21 bp, Artificial sequence
  SiRNA target sequence
gtgaaggatacccctatttcg

SEQ ID NO: 118887 - DNA, 21 bp, Artificial sequence
  SiRNA target sequence
tgaaggatacccctatttcgg

SEQ ID NO: 118888 - DNA, 21 bp, Artificial sequence
  SiRNA target sequence
gaaggatacccctatttcgga

SEQ ID NO: 118889 - DNA, 21 bp, Artificial sequence
  SiRNA target sequence
aaggatacccctatttcggaa

SEQ ID NO: 118890 - DNA, 21 bp, Artificial sequence
  SiRNA target sequence
aggatacccctatttcggaaa

SEQ ID NO: 118891 - DNA, 21 bp, Artificial sequence
  SiRNA target sequence
ggatacccctatttcggaaat

SEQ ID NO: 118892 - DNA, 21 bp, Artificial sequence
  SiRNA target sequence
gatacccctatttcggaaatg

SEQ ID NO: 118893 - DNA, 21 bp, Artificial sequence
  SiRNA target sequence
atacccctatttcggaaatgg

SEQ ID NO: 118894 - DNA, 21 bp, Artificial sequence
  SiRNA target sequence
tacccctatttcggaaatggg

SEQ ID NO: 118895 - DNA, 21 bp, Artificial sequence
  SiRNA target sequence
acccctatttcggaaatggga

SEQ ID NO: 118896 - DNA, 21 bp, Artificial sequence
  SiRNA target sequence
cccctatttcggaaatgggat

SEQ ID NO: 118897 - DNA, 21 bp, Artificial sequence
  SiRNA target sequence
ccctatttcggaaatgggatt

SEQ ID NO: 118898 - DNA, 21 bp, Artificial sequence
  SiRNA target sequence
cctatttcggaaatgggattt

SEQ ID NO: 118899 - DNA, 21 bp, Artificial sequence
  SiRNA target sequence
ctatttcggaaatgggattta

SEQ ID NO: 118900 - DNA, 21 bp, Artificial sequence
  SiRNA target sequence
tatttcggaaatgggatttac

SEQ ID NO: 118901 - DNA, 21 bp, Artificial sequence
  SiRNA target sequence
atttcggaaatgggatttaca

SEQ ID NO: 118902 - DNA, 21 bp, Artificial sequence
  SiRNA target sequence
tttcggaaatgggatttacag

SEQ ID NO: 118903 - DNA, 21 bp, Artificial sequence
  SiRNA target sequence
ttcggaaatgggatttacagg

SEQ ID NO: 118904 - DNA, 21 bp, Artificial sequence
  SiRNA target sequence
tcggaaatgggatttacaggt

SEQ ID NO: 118905 - DNA, 21 bp, Artificial sequence
  SiRNA target sequence
cggaaatgggatttacaggtc

SEQ ID NO: 118906 - DNA, 21 bp, Artificial sequence
  SiRNA target sequence
ggaaatgggatttacaggtct

SEQ ID NO: 118907 - DNA, 21 bp, Artificial sequence
  SiRNA target sequence
gaaatgggatttacaggtctc

SEQ ID NO: 118908 - DNA, 21 bp, Artificial sequence
  SiRNA target sequence
aaatgggatttacaggtctcg

SEQ ID NO: 118909 - DNA, 21 bp, Artificial sequence
  SiRNA target sequence
aatgggatttacaggtctcgc

SEQ ID NO: 118910 - DNA, 21 bp, Artificial sequence
  SiRNA target sequence
atgggatttacaggtctcgct

SEQ ID NO: 118911 - DNA, 21 bp, Artificial sequence
  SiRNA target sequence
tgggatttacaggtctcgctg

SEQ ID NO: 118912 - DNA, 21 bp, Artificial sequence
  SiRNA target sequence
gggatttacaggtctcgctgt

SEQ ID NO: 118913 - DNA, 21 bp, Artificial sequence
  SiRNA target sequence
ggatttacaggtctcgctgtg

SEQ ID NO: 118914 - DNA, 21 bp, Artificial sequence
  SiRNA target sequence
gatttacaggtctcgctgtgg

SEQ ID NO: 118915 - DNA, 21 bp, Artificial sequence
  SiRNA target sequence
atttacaggtctcgctgtggg

SEQ ID NO: 118916 - DNA, 21 bp, Artificial sequence
  SiRNA target sequence
tttacaggtctcgctgtgggt

SEQ ID NO: 118917 - DNA, 21 bp, Artificial sequence
  SiRNA target sequence
ttacaggtctcgctgtgggtt

SEQ ID NO: 118918 - DNA, 21 bp, Artificial sequence
  SiRNA target sequence
tacaggtctcgctgtgggttc

SEQ ID NO: 118919 - DNA, 21 bp, Artificial sequence
  SiRNA target sequence
acaggtctcgctgtgggttca

SEQ ID NO: 118920 - DNA, 21 bp, Artificial sequence
  SiRNA target sequence
caggtctcgctgtgggttcaa

SEQ ID NO: 118921 - DNA, 21 bp, Artificial sequence
  SiRNA target sequence
aggtctcgctgtgggttcaag

SEQ ID NO: 118922 - DNA, 21 bp, Artificial sequence
  SiRNA target sequence
ggtctcgctgtgggttcaagc

SEQ ID NO: 118923 - DNA, 21 bp, Artificial sequence
  SiRNA target sequence
gtctcgctgtgggttcaagct

SEQ ID NO: 118924 - DNA, 21 bp, Artificial sequence
  SiRNA target sequence
tctcgctgtgggttcaagcta

SEQ ID NO: 118925 - DNA, 21 bp, Artificial sequence
  SiRNA target sequence
ctcgctgtgggttcaagctat

SEQ ID NO: 118926 - DNA, 21 bp, Artificial sequence
  SiRNA target sequence
tcgctgtgggttcaagctatt

SEQ ID NO: 118927 - DNA, 21 bp, Artificial sequence
  SiRNA target sequence
cgctgtgggttcaagctattt

SEQ ID NO: 118928 - DNA, 21 bp, Artificial sequence
  SiRNA target sequence
gctgtgggttcaagctattta

SEQ ID NO: 118929 - DNA, 21 bp, Artificial sequence
  SiRNA target sequence
ctgtgggttcaagctatttag

SEQ ID NO: 118930 - DNA, 21 bp, Artificial sequence
  SiRNA target sequence
tgtgggttcaagctatttagg

SEQ ID NO: 118931 - DNA, 21 bp, Artificial sequence
  SiRNA target sequence
gtgggttcaagctatttaggg

SEQ ID NO: 118932 - DNA, 21 bp, Artificial sequence
  SiRNA target sequence
tgggttcaagctatttagggt

SEQ ID NO: 118933 - DNA, 21 bp, Artificial sequence
  SiRNA target sequence
gggttcaagctatttagggtt

SEQ ID NO: 118934 - DNA, 21 bp, Artificial sequence
  SiRNA target sequence
ggttcaagctatttagggtta

SEQ ID NO: 118935 - DNA, 21 bp, Artificial sequence
  SiRNA target sequence
gttcaagctatttagggttaa

SEQ ID NO: 118936 - DNA, 21 bp, Artificial sequence
  SiRNA target sequence
ttcaagctatttagggttaag

SEQ ID NO: 118937 - DNA, 21 bp, Artificial sequence
  SiRNA target sequence
tcaagctatttagggttaaga

SEQ ID NO: 118938 - DNA, 21 bp, Artificial sequence
  SiRNA target sequence
caagctatttagggttaagac

SEQ ID NO: 118939 - DNA, 21 bp, Artificial sequence
  SiRNA target sequence
aagctatttagggttaagacc

SEQ ID NO: 118940 - DNA, 21 bp, Artificial sequence
  SiRNA target sequence
agctatttagggttaagaccc

SEQ ID NO: 118941 - DNA, 21 bp, Artificial sequence
  SiRNA target sequence
gctatttagggttaagacccg

SEQ ID NO: 118942 - DNA, 21 bp, Artificial sequence
  SiRNA target sequence
ctatttagggttaagacccgt

SEQ ID NO: 118943 - DNA, 21 bp, Artificial sequence
  SiRNA target sequence
tatttagggttaagacccgta

SEQ ID NO: 118944 - DNA, 21 bp, Artificial sequence
  SiRNA target sequence
atttagggttaagacccgtag

SEQ ID NO: 118945 - DNA, 21 bp, Artificial sequence
  SiRNA target sequence
tttagggttaagacccgtagt

SEQ ID NO: 118946 - DNA, 21 bp, Artificial sequence
  SiRNA target sequence
ttagggttaagacccgtagta

SEQ ID NO: 118947 - DNA, 21 bp, Artificial sequence
  SiRNA target sequence
tagggttaagacccgtagtag

SEQ ID NO: 118948 - DNA, 21 bp, Artificial sequence
  SiRNA target sequence
agggttaagacccgtagtaga

SEQ ID NO: 118949 - DNA, 21 bp, Artificial sequence
  SiRNA target sequence
gggttaagacccgtagtagat

SEQ ID NO: 118950 - DNA, 21 bp, Artificial sequence
  SiRNA target sequence
ggttaagacccgtagtagatt

SEQ ID NO: 118951 - DNA, 21 bp, Artificial sequence
  SiRNA target sequence
gttaagacccgtagtagattt

SEQ ID NO: 118952 - DNA, 21 bp, Artificial sequence
  SiRNA target sequence
ttaagacccgtagtagatttt

SEQ ID NO: 118953 - DNA, 21 bp, Artificial sequence
  SiRNA target sequence
taagacccgtagtagatttta

SEQ ID NO: 118954 - DNA, 21 bp, Artificial sequence
  SiRNA target sequence
aagacccgtagtagattttat

SEQ ID NO: 118955 - DNA, 21 bp, Artificial sequence
  SiRNA target sequence
agacccgtagtagattttatg

SEQ ID NO: 118956 - DNA, 21 bp, Artificial sequence
  SiRNA target sequence
gacccgtagtagattttatga

SEQ ID NO: 118957 - DNA, 21 bp, Artificial sequence
  SiRNA target sequence
acccgtagtagattttatgac

SEQ ID NO: 118958 - DNA, 21 bp, Artificial sequence
  SiRNA target sequence
cccgtagtagattttatgact

SEQ ID NO: 118959 - DNA, 21 bp, Artificial sequence
  SiRNA target sequence
ccgtagtagattttatgactt

SEQ ID NO: 118960 - DNA, 21 bp, Artificial sequence
  SiRNA target sequence
cgtagtagattttatgacttg

SEQ ID NO: 118961 - DNA, 21 bp, Artificial sequence
  SiRNA target sequence
gtagtagattttatgacttgg

SEQ ID NO: 118962 - DNA, 21 bp, Artificial sequence
  SiRNA target sequence
tagtagattttatgacttgga

SEQ ID NO: 118963 - DNA, 21 bp, Artificial sequence
  SiRNA target sequence
agtagattttatgacttggaa

SEQ ID NO: 118964 - DNA, 21 bp, Artificial sequence
  SiRNA target sequence
gtagattttatgacttggaat

SEQ ID NO: 118965 - DNA, 21 bp, Artificial sequence
  SiRNA target sequence
tagattttatgacttggaatt

SEQ ID NO: 118966 - DNA, 21 bp, Artificial sequence
  SiRNA target sequence
agattttatgacttggaattt

SEQ ID NO: 118967 - DNA, 21 bp, Artificial sequence
  SiRNA target sequence
gattttatgacttggaatttt

SEQ ID NO: 118968 - DNA, 21 bp, Artificial sequence
  SiRNA target sequence
attttatgacttggaattttg

SEQ ID NO: 118969 - DNA, 21 bp, Artificial sequence
  SiRNA target sequence
ttttatgacttggaattttgc

SEQ ID NO: 118970 - DNA, 21 bp, Artificial sequence
  SiRNA target sequence
tttatgacttggaattttgct

SEQ ID NO: 118971 - DNA, 21 bp, Artificial sequence
  SiRNA target sequence
ttatgacttggaattttgctt

SEQ ID NO: 118972 - DNA, 21 bp, Artificial sequence
  SiRNA target sequence
tatgacttggaattttgcttt

SEQ ID NO: 118973 - DNA, 21 bp, Artificial sequence
  SiRNA target sequence
atgacttggaattttgctttg

SEQ ID NO: 118974 - DNA, 21 bp, Artificial sequence
  SiRNA target sequence
tgacttggaattttgctttgc

SEQ ID NO: 118975 - DNA, 21 bp, Artificial sequence
  SiRNA target sequence
gacttggaattttgctttgca

SEQ ID NO: 118976 - DNA, 21 bp, Artificial sequence
  SiRNA target sequence
acttggaattttgctttgcaa

SEQ ID NO: 118977 - DNA, 21 bp, Artificial sequence
  SiRNA target sequence
cttggaattttgctttgcaat

SEQ ID NO: 118978 - DNA, 21 bp, Artificial sequence
  SiRNA target sequence
ttggaattttgctttgcaatc

SEQ ID NO: 118979 - DNA, 21 bp, Artificial sequence
  SiRNA target sequence
tggaattttgctttgcaatca

SEQ ID NO: 118980 - DNA, 21 bp, Artificial sequence
  SiRNA target sequence
ggaattttgctttgcaatcaa

SEQ ID NO: 118981 - DNA, 21 bp, Artificial sequence
  SiRNA target sequence
gaattttgctttgcaatcaat

SEQ ID NO: 118982 - DNA, 21 bp, Artificial sequence
  SiRNA target sequence
aattttgctttgcaatcaatt

SEQ ID NO: 118983 - DNA, 21 bp, Artificial sequence
  SiRNA target sequence
attttgctttgcaatcaattg

SEQ ID NO: 118984 - DNA, 21 bp, Artificial sequence
  SiRNA target sequence
ttttgctttgcaatcaattga

SEQ ID NO: 118985 - DNA, 21 bp, Artificial sequence
  SiRNA target sequence
tttgctttgcaatcaattgac

SEQ ID NO: 118986 - DNA, 21 bp, Artificial sequence
  SiRNA target sequence
ttgctttgcaatcaattgacc

SEQ ID NO: 118987 - DNA, 21 bp, Artificial sequence
  SiRNA target sequence
tgctttgcaatcaattgacca

SEQ ID NO: 118988 - DNA, 21 bp, Artificial sequence
  SiRNA target sequence
gctttgcaatcaattgaccat

SEQ ID NO: 118989 - DNA, 21 bp, Artificial sequence
  SiRNA target sequence
ctttgcaatcaattgaccata

SEQ ID NO: 118990 - DNA, 21 bp, Artificial sequence
  SiRNA target sequence
tttgcaatcaattgaccatat

SEQ ID NO: 118991 - DNA, 21 bp, Artificial sequence
  SiRNA target sequence
ttgcaatcaattgaccatatt

SEQ ID NO: 118992 - DNA, 21 bp, Artificial sequence
  SiRNA target sequence
tgcaatcaattgaccatatta

SEQ ID NO: 118993 - DNA, 21 bp, Artificial sequence
  SiRNA target sequence
gcaatcaattgaccatattat

SEQ ID NO: 118994 - DNA, 21 bp, Artificial sequence
  SiRNA target sequence
caatcaattgaccatattatt

SEQ ID NO: 118995 - DNA, 21 bp, Artificial sequence
  SiRNA target sequence
aatcaattgaccatattatta

SEQ ID NO: 118996 - DNA, 21 bp, Artificial sequence
  SiRNA target sequence
atcaattgaccatattattaa

SEQ ID NO: 118997 - DNA, 21 bp, Artificial sequence
  SiRNA target sequence
tcaattgaccatattattaat

SEQ ID NO: 118998 - DNA, 21 bp, Artificial sequence
  SiRNA target sequence
caattgaccatattattaatt

SEQ ID NO: 118999 - DNA, 21 bp, Artificial sequence
  SiRNA target sequence
aattgaccatattattaattc

SEQ ID NO: 119000 - DNA, 21 bp, Artificial sequence
  SiRNA target sequence
attgaccatattattaattct

SEQ ID NO: 119001 - DNA, 21 bp, Artificial sequence
  SiRNA target sequence
ttgaccatattattaattctt

SEQ ID NO: 119002 - DNA, 21 bp, Artificial sequence
  SiRNA target sequence
tgaccatattattaattcttg

SEQ ID NO: 119003 - DNA, 21 bp, Artificial sequence
  SiRNA target sequence
gaccatattattaattcttgt

SEQ ID NO: 119004 - DNA, 21 bp, Artificial sequence
  SiRNA target sequence
accatattattaattcttgtg

SEQ ID NO: 119005 - DNA, 21 bp, Artificial sequence
  SiRNA target sequence
ccatattattaattcttgtgc

SEQ ID NO: 119006 - DNA, 21 bp, Artificial sequence
  SiRNA target sequence
catattattaattcttgtgcg

SEQ ID NO: 119007 - DNA, 21 bp, Artificial sequence
  SiRNA target sequence
atattattaattcttgtgcga

SEQ ID NO: 119008 - DNA, 21 bp, Artificial sequence
  SiRNA target sequence
tattattaattcttgtgcgaa

SEQ ID NO: 119009 - DNA, 21 bp, Artificial sequence
  SiRNA target sequence
attattaattcttgtgcgaaa

SEQ ID NO: 119010 - DNA, 21 bp, Artificial sequence
  SiRNA target sequence
ttattaattcttgtgcgaaaa

SEQ ID NO: 119011 - DNA, 21 bp, Artificial sequence
  SiRNA target sequence
tattaattcttgtgcgaaaac

SEQ ID NO: 119012 - DNA, 21 bp, Artificial sequence
  SiRNA target sequence
attaattcttgtgcgaaaacc

SEQ ID NO: 119013 - DNA, 21 bp, Artificial sequence
  SiRNA target sequence
ttaattcttgtgcgaaaacct

SEQ ID NO: 119014 - DNA, 21 bp, Artificial sequence
  SiRNA target sequence
taattcttgtgcgaaaacctt

SEQ ID NO: 119015 - DNA, 21 bp, Artificial sequence
  SiRNA target sequence
aattcttgtgcgaaaaccttg

SEQ ID NO: 119016 - DNA, 21 bp, Artificial sequence
  SiRNA target sequence
attcttgtgcgaaaaccttgt

SEQ ID NO: 119017 - DNA, 21 bp, Artificial sequence
  SiRNA target sequence
ttcttgtgcgaaaaccttgta

SEQ ID NO: 119018 - DNA, 21 bp, Artificial sequence
  SiRNA target sequence
tcttgtgcgaaaaccttgtat

SEQ ID NO: 119019 - DNA, 21 bp, Artificial sequence
  SiRNA target sequence
cttgtgcgaaaaccttgtata

SEQ ID NO: 119020 - DNA, 21 bp, Artificial sequence
  SiRNA target sequence
ttgtgcgaaaaccttgtatat

SEQ ID NO: 119021 - DNA, 21 bp, Artificial sequence
  SiRNA target sequence
tgtgcgaaaaccttgtatatg

SEQ ID NO: 119022 - DNA, 21 bp, Artificial sequence
  SiRNA target sequence
gtgcgaaaaccttgtatatgt

SEQ ID NO: 119023 - DNA, 21 bp, Artificial sequence
  SiRNA target sequence
tgcgaaaaccttgtatatgtc

SEQ ID NO: 119024 - DNA, 21 bp, Artificial sequence
  SiRNA target sequence
gcgaaaaccttgtatatgtca

SEQ ID NO: 119025 - DNA, 21 bp, Artificial sequence
  SiRNA target sequence
cgaaaaccttgtatatgtcag

SEQ ID NO: 119026 - DNA, 21 bp, Artificial sequence
  SiRNA target sequence
gaaaaccttgtatatgtcagg

SEQ ID NO: 119027 - DNA, 21 bp, Artificial sequence
  SiRNA target sequence
aaaaccttgtatatgtcagga

SEQ ID NO: 119028 - DNA, 21 bp, Artificial sequence
  SiRNA target sequence
aaaccttgtatatgtcaggag

SEQ ID NO: 119029 - DNA, 21 bp, Artificial sequence
  SiRNA target sequence
aaccttgtatatgtcaggagg

SEQ ID NO: 119030 - DNA, 21 bp, Artificial sequence
  SiRNA target sequence
accttgtatatgtcaggagga

SEQ ID NO: 119031 - DNA, 21 bp, Artificial sequence
  SiRNA target sequence
ccttgtatatgtcaggaggaa

SEQ ID NO: 119032 - DNA, 21 bp, Artificial sequence
  SiRNA target sequence
cttgtatatgtcaggaggaag

SEQ ID NO: 119033 - DNA, 21 bp, Artificial sequence
  SiRNA target sequence
ttgtatatgtcaggaggaaga

SEQ ID NO: 119034 - DNA, 21 bp, Artificial sequence
  SiRNA target sequence
tgtatatgtcaggaggaagaa

SEQ ID NO: 119035 - DNA, 21 bp, Artificial sequence
  SiRNA target sequence
gtatatgtcaggaggaagaat

SEQ ID NO: 119036 - DNA, 21 bp, Artificial sequence
  SiRNA target sequence
tatatgtcaggaggaagaata

SEQ ID NO: 119037 - DNA, 21 bp, Artificial sequence
  SiRNA target sequence
atatgtcaggaggaagaatac

SEQ ID NO: 119038 - DNA, 21 bp, Artificial sequence
  SiRNA target sequence
tatgtcaggaggaagaataca

SEQ ID NO: 119039 - DNA, 21 bp, Artificial sequence
  SiRNA target sequence
atgtcaggaggaagaatacaa

SEQ ID NO: 119040 - DNA, 21 bp, Artificial sequence
  SiRNA target sequence
tgtcaggaggaagaatacaat

SEQ ID NO: 119041 - DNA, 21 bp, Artificial sequence
  SiRNA target sequence
gtcaggaggaagaatacaatg

SEQ ID NO: 119042 - DNA, 21 bp, Artificial sequence
  SiRNA target sequence
tcaggaggaagaatacaatgt

SEQ ID NO: 119043 - DNA, 21 bp, Artificial sequence
  SiRNA target sequence
caggaggaagaatacaatgtc

SEQ ID NO: 119044 - DNA, 21 bp, Artificial sequence
  SiRNA target sequence
aggaggaagaatacaatgtcc

SEQ ID NO: 119045 - DNA, 21 bp, Artificial sequence
  SiRNA target sequence
ggaggaagaatacaatgtcca

SEQ ID NO: 119046 - DNA, 21 bp, Artificial sequence
  SiRNA target sequence
gaggaagaatacaatgtccaa

SEQ ID NO: 119047 - DNA, 21 bp, Artificial sequence
  SiRNA target sequence
aggaagaatacaatgtccaat

SEQ ID NO: 119048 - DNA, 21 bp, Artificial sequence
  SiRNA target sequence
ggaagaatacaatgtccaatt

SEQ ID NO: 119049 - DNA, 21 bp, Artificial sequence
  SiRNA target sequence
gaagaatacaatgtccaattg

SEQ ID NO: 119050 - DNA, 21 bp, Artificial sequence
  SiRNA target sequence
aagaatacaatgtccaattgt

SEQ ID NO: 119051 - DNA, 21 bp, Artificial sequence
  SiRNA target sequence
agaatacaatgtccaattgtt

SEQ ID NO: 119052 - DNA, 21 bp, Artificial sequence
  SiRNA target sequence
gaatacaatgtccaattgttt

SEQ ID NO: 119053 - DNA, 21 bp, Artificial sequence
  SiRNA target sequence
aatacaatgtccaattgtttt

SEQ ID NO: 119054 - DNA, 21 bp, Artificial sequence
  SiRNA target sequence
atacaatgtccaattgttttt

SEQ ID NO: 119055 - DNA, 21 bp, Artificial sequence
  SiRNA target sequence
tacaatgtccaattgttttta

SEQ ID NO: 119056 - DNA, 21 bp, Artificial sequence
  SiRNA target sequence
acaatgtccaattgtttttag

SEQ ID NO: 119057 - DNA, 21 bp, Artificial sequence
  SiRNA target sequence
caatgtccaattgtttttagg

SEQ ID NO: 119058 - DNA, 21 bp, Artificial sequence
  SiRNA target sequence
aatgtccaattgtttttaggg

SEQ ID NO: 119059 - DNA, 21 bp, Artificial sequence
  SiRNA target sequence
atgtccaattgtttttagggg

SEQ ID NO: 119060 - DNA, 21 bp, Artificial sequence
  SiRNA target sequence
tgtccaattgtttttagggga

SEQ ID NO: 119061 - DNA, 21 bp, Artificial sequence
  SiRNA target sequence
gtccaattgtttttaggggac

SEQ ID NO: 119062 - DNA, 21 bp, Artificial sequence
  SiRNA target sequence
tccaattgtttttaggggacc

SEQ ID NO: 119063 - DNA, 21 bp, Artificial sequence
  SiRNA target sequence
ccaattgtttttaggggacca

SEQ ID NO: 119064 - DNA, 21 bp, Artificial sequence
  SiRNA target sequence
caattgtttttaggggaccaa

SEQ ID NO: 119065 - DNA, 21 bp, Artificial sequence
  SiRNA target sequence
aattgtttttaggggaccaaa

SEQ ID NO: 119066 - DNA, 21 bp, Artificial sequence
  SiRNA target sequence
attgtttttaggggaccaaat

SEQ ID NO: 119067 - DNA, 21 bp, Artificial sequence
  SiRNA target sequence
ttgtttttaggggaccaaatg

SEQ ID NO: 119068 - DNA, 21 bp, Artificial sequence
  SiRNA target sequence
tgtttttaggggaccaaatgg

SEQ ID NO: 119069 - DNA, 21 bp, Artificial sequence
  SiRNA target sequence
gtttttaggggaccaaatgga

SEQ ID NO: 119070 - DNA, 21 bp, Artificial sequence
  SiRNA target sequence
tttttaggggaccaaatggat

SEQ ID NO: 119071 - DNA, 21 bp, Artificial sequence
  SiRNA target sequence
ttttaggggaccaaatggatt

SEQ ID NO: 119072 - DNA, 21 bp, Artificial sequence
  SiRNA target sequence
tttaggggaccaaatggattc

SEQ ID NO: 119073 - DNA, 21 bp, Artificial sequence
  SiRNA target sequence
ttaggggaccaaatggattca

SEQ ID NO: 119074 - DNA, 21 bp, Artificial sequence
  SiRNA target sequence
taggggaccaaatggattcaa

SEQ ID NO: 119075 - DNA, 21 bp, Artificial sequence
  SiRNA target sequence
aggggaccaaatggattcaat

SEQ ID NO: 119076 - DNA, 21 bp, Artificial sequence
  SiRNA target sequence
ggggaccaaatggattcaata

SEQ ID NO: 119077 - DNA, 21 bp, Artificial sequence
  SiRNA target sequence
gggaccaaatggattcaataa

SEQ ID NO: 119078 - DNA, 21 bp, Artificial sequence
  SiRNA target sequence
ggaccaaatggattcaataat

SEQ ID NO: 119079 - DNA, 21 bp, Artificial sequence
  SiRNA target sequence
gaccaaatggattcaataatg

SEQ ID NO: 119080 - DNA, 21 bp, Artificial sequence
  SiRNA target sequence
accaaatggattcaataatgg

SEQ ID NO: 119081 - DNA, 21 bp, Artificial sequence
  SiRNA target sequence
ccaaatggattcaataatggg

SEQ ID NO: 119082 - DNA, 21 bp, Artificial sequence
  SiRNA target sequence
caaatggattcaataatgggt

SEQ ID NO: 119083 - DNA, 21 bp, Artificial sequence
  SiRNA target sequence
aaatggattcaataatgggta

SEQ ID NO: 119084 - DNA, 21 bp, Artificial sequence
  SiRNA target sequence
aatggattcaataatgggtac

SEQ ID NO: 119085 - DNA, 21 bp, Artificial sequence
  SiRNA target sequence
atggattcaataatgggtacg

SEQ ID NO: 119086 - DNA, 21 bp, Artificial sequence
  SiRNA target sequence
tggattcaataatgggtacgc

SEQ ID NO: 119087 - DNA, 21 bp, Artificial sequence
  SiRNA target sequence
ggattcaataatgggtacgct

SEQ ID NO: 119088 - DNA, 21 bp, Artificial sequence
  SiRNA target sequence
gattcaataatgggtacgctg

SEQ ID NO: 119089 - DNA, 21 bp, Artificial sequence
  SiRNA target sequence
attcaataatgggtacgctgc

SEQ ID NO: 119090 - DNA, 21 bp, Artificial sequence
  SiRNA target sequence
ttcaataatgggtacgctgca

SEQ ID NO: 119091 - DNA, 21 bp, Artificial sequence
  SiRNA target sequence
tcaataatgggtacgctgcac

SEQ ID NO: 119092 - DNA, 21 bp, Artificial sequence
  SiRNA target sequence
caataatgggtacgctgcaca

SEQ ID NO: 119093 - DNA, 21 bp, Artificial sequence
  SiRNA target sequence
aataatgggtacgctgcacag

SEQ ID NO: 119094 - DNA, 21 bp, Artificial sequence
  SiRNA target sequence
ataatgggtacgctgcacagc

SEQ ID NO: 119095 - DNA, 21 bp, Artificial sequence
  SiRNA target sequence
taatgggtacgctgcacagca

SEQ ID NO: 119096 - DNA, 21 bp, Artificial sequence
  SiRNA target sequence
aatgggtacgctgcacagcac

SEQ ID NO: 119097 - DNA, 21 bp, Artificial sequence
  SiRNA target sequence
atgggtacgctgcacagcaca

SEQ ID NO: 119098 - DNA, 21 bp, Artificial sequence
  SiRNA target sequence
tgggtacgctgcacagcacac

SEQ ID NO: 119099 - DNA, 21 bp, Artificial sequence
  SiRNA target sequence
gggtacgctgcacagcacaca

SEQ ID NO: 119100 - DNA, 21 bp, Artificial sequence
  SiRNA target sequence
ggtacgctgcacagcacacac

SEQ ID NO: 119101 - DNA, 21 bp, Artificial sequence
  SiRNA target sequence
gtacgctgcacagcacacaca

SEQ ID NO: 119102 - DNA, 21 bp, Artificial sequence
  SiRNA target sequence
tacgctgcacagcacacacaa

SEQ ID NO: 119103 - DNA, 21 bp, Artificial sequence
  SiRNA target sequence
acgctgcacagcacacacaag

SEQ ID NO: 119104 - DNA, 21 bp, Artificial sequence
  SiRNA target sequence
cgctgcacagcacacacaaga

SEQ ID NO: 119105 - DNA, 21 bp, Artificial sequence
  SiRNA target sequence
gctgcacagcacacacaagat

SEQ ID NO: 119106 - DNA, 21 bp, Artificial sequence
  SiRNA target sequence
ctgcacagcacacacaagatt

SEQ ID NO: 119107 - DNA, 21 bp, Artificial sequence
  SiRNA target sequence
tgcacagcacacacaagattt

SEQ ID NO: 119108 - DNA, 21 bp, Artificial sequence
  SiRNA target sequence
gcacagcacacacaagatttt

SEQ ID NO: 119109 - DNA, 21 bp, Artificial sequence
  SiRNA target sequence
cacagcacacacaagattttg

SEQ ID NO: 119110 - DNA, 21 bp, Artificial sequence
  SiRNA target sequence
acagcacacacaagattttgc

SEQ ID NO: 119111 - DNA, 21 bp, Artificial sequence
  SiRNA target sequence
cagcacacacaagattttgca

SEQ ID NO: 119112 - DNA, 21 bp, Artificial sequence
  SiRNA target sequence
agcacacacaagattttgcac

SEQ ID NO: 119113 - DNA, 21 bp, Artificial sequence
  SiRNA target sequence
gcacacacaagattttgcacc

SEQ ID NO: 119114 - DNA, 21 bp, Artificial sequence
  SiRNA target sequence
cacacacaagattttgcacca

SEQ ID NO: 119115 - DNA, 21 bp, Artificial sequence
  SiRNA target sequence
acacacaagattttgcaccaa

SEQ ID NO: 119116 - DNA, 21 bp, Artificial sequence
  SiRNA target sequence
cacacaagattttgcaccaat

SEQ ID NO: 119117 - DNA, 21 bp, Artificial sequence
  SiRNA target sequence
acacaagattttgcaccaata

SEQ ID NO: 119118 - DNA, 21 bp, Artificial sequence
  SiRNA target sequence
cacaagattttgcaccaatat

SEQ ID NO: 119119 - DNA, 21 bp, Artificial sequence
  SiRNA target sequence
acaagattttgcaccaatata

SEQ ID NO: 119120 - DNA, 21 bp, Artificial sequence
  SiRNA target sequence
caagattttgcaccaatatat

SEQ ID NO: 119121 - DNA, 21 bp, Artificial sequence
  SiRNA target sequence
aagattttgcaccaatatatg

SEQ ID NO: 119122 - DNA, 21 bp, Artificial sequence
  SiRNA target sequence
agattttgcaccaatatatgg

SEQ ID NO: 119123 - DNA, 21 bp, Artificial sequence
  SiRNA target sequence
gattttgcaccaatatatggt

SEQ ID NO: 119124 - DNA, 21 bp, Artificial sequence
  SiRNA target sequence
attttgcaccaatatatggtt

SEQ ID NO: 119125 - DNA, 21 bp, Artificial sequence
  SiRNA target sequence
ttttgcaccaatatatggttc

SEQ ID NO: 119126 - DNA, 21 bp, Artificial sequence
  SiRNA target sequence
tttgcaccaatatatggttct

SEQ ID NO: 119127 - DNA, 21 bp, Artificial sequence
  SiRNA target sequence
ttgcaccaatatatggttcta

SEQ ID NO: 119128 - DNA, 21 bp, Artificial sequence
  SiRNA target sequence
tgcaccaatatatggttctat

SEQ ID NO: 119129 - DNA, 21 bp, Artificial sequence
  SiRNA target sequence
gcaccaatatatggttctatt

SEQ ID NO: 119130 - DNA, 21 bp, Artificial sequence
  SiRNA target sequence
caccaatatatggttctattc

SEQ ID NO: 119131 - DNA, 21 bp, Artificial sequence
  SiRNA target sequence
accaatatatggttctattcc

SEQ ID NO: 119132 - DNA, 21 bp, Artificial sequence
  SiRNA target sequence
ccaatatatggttctattcca

SEQ ID NO: 119133 - DNA, 21 bp, Artificial sequence
  SiRNA target sequence
caatatatggttctattccag

SEQ ID NO: 119134 - DNA, 21 bp, Artificial sequence
  SiRNA target sequence
aatatatggttctattccagg

SEQ ID NO: 119135 - DNA, 21 bp, Artificial sequence
  SiRNA target sequence
atatatggttctattccaggc

SEQ ID NO: 119136 - DNA, 21 bp, Artificial sequence
  SiRNA target sequence
tatatggttctattccaggcc

SEQ ID NO: 119137 - DNA, 21 bp, Artificial sequence
  SiRNA target sequence
atatggttctattccaggcct

SEQ ID NO: 119138 - DNA, 21 bp, Artificial sequence
  SiRNA target sequence
tatggttctattccaggcctt

SEQ ID NO: 119139 - DNA, 21 bp, Artificial sequence
  SiRNA target sequence
atggttctattccaggcctta

SEQ ID NO: 119140 - DNA, 21 bp, Artificial sequence
  SiRNA target sequence
tggttctattccaggccttaa

SEQ ID NO: 119141 - DNA, 21 bp, Artificial sequence
  SiRNA target sequence
ggttctattccaggccttaag

SEQ ID NO: 119142 - DNA, 21 bp, Artificial sequence
  SiRNA target sequence
gttctattccaggccttaagg

SEQ ID NO: 119143 - DNA, 21 bp, Artificial sequence
  SiRNA target sequence
ttctattccaggccttaaggt

SEQ ID NO: 119144 - DNA, 21 bp, Artificial sequence
  SiRNA target sequence
tctattccaggccttaaggtg

SEQ ID NO: 119145 - DNA, 21 bp, Artificial sequence
  SiRNA target sequence
ctattccaggccttaaggtgg

SEQ ID NO: 119146 - DNA, 21 bp, Artificial sequence
  SiRNA target sequence
tattccaggccttaaggtggt

SEQ ID NO: 119147 - DNA, 21 bp, Artificial sequence
  SiRNA target sequence
attccaggccttaaggtggtt

SEQ ID NO: 119148 - DNA, 21 bp, Artificial sequence
  SiRNA target sequence
ttccaggccttaaggtggttt

SEQ ID NO: 119149 - DNA, 21 bp, Artificial sequence
  SiRNA target sequence
tccaggccttaaggtggtttg

SEQ ID NO: 119150 - DNA, 21 bp, Artificial sequence
  SiRNA target sequence
ccaggccttaaggtggtttgt

SEQ ID NO: 119151 - DNA, 21 bp, Artificial sequence
  SiRNA target sequence
caggccttaaggtggtttgtc

SEQ ID NO: 119152 - DNA, 21 bp, Artificial sequence
  SiRNA target sequence
aggccttaaggtggtttgtcc

SEQ ID NO: 119153 - DNA, 21 bp, Artificial sequence
  SiRNA target sequence
ggccttaaggtggtttgtcct

SEQ ID NO: 119154 - DNA, 21 bp, Artificial sequence
  SiRNA target sequence
gccttaaggtggtttgtcctt

SEQ ID NO: 119155 - DNA, 21 bp, Artificial sequence
  SiRNA target sequence
ccttaaggtggtttgtcctta

SEQ ID NO: 119156 - DNA, 21 bp, Artificial sequence
  SiRNA target sequence
cttaaggtggtttgtccttat

SEQ ID NO: 119157 - DNA, 21 bp, Artificial sequence
  SiRNA target sequence
ttaaggtggtttgtccttata

SEQ ID NO: 119158 - DNA, 21 bp, Artificial sequence
  SiRNA target sequence
taaggtggtttgtccttatac

SEQ ID NO: 119159 - DNA, 21 bp, Artificial sequence
  SiRNA target sequence
aaggtggtttgtccttatacg

SEQ ID NO: 119160 - DNA, 21 bp, Artificial sequence
  SiRNA target sequence
aggtggtttgtccttatacgg

SEQ ID NO: 119161 - DNA, 21 bp, Artificial sequence
  SiRNA target sequence
ggtggtttgtccttatacggg

SEQ ID NO: 119162 - DNA, 21 bp, Artificial sequence
  SiRNA target sequence
gtggtttgtccttatacgggt

SEQ ID NO: 119163 - DNA, 21 bp, Artificial sequence
  SiRNA target sequence
tggtttgtccttatacgggta

SEQ ID NO: 119164 - DNA, 21 bp, Artificial sequence
  SiRNA target sequence
ggtttgtccttatacgggtaa

SEQ ID NO: 119165 - DNA, 21 bp, Artificial sequence
  SiRNA target sequence
gtttgtccttatacgggtaaa

SEQ ID NO: 119166 - DNA, 21 bp, Artificial sequence
  SiRNA target sequence
tttgtccttatacgggtaaag

SEQ ID NO: 119167 - DNA, 21 bp, Artificial sequence
  SiRNA target sequence
ttgtccttatacgggtaaaga

SEQ ID NO: 119168 - DNA, 21 bp, Artificial sequence
  SiRNA target sequence
tgtccttatacgggtaaagac

SEQ ID NO: 119169 - DNA, 21 bp, Artificial sequence
  SiRNA target sequence
gtccttatacgggtaaagacc

SEQ ID NO: 119170 - DNA, 21 bp, Artificial sequence
  SiRNA target sequence
tccttatacgggtaaagacca

SEQ ID NO: 119171 - DNA, 21 bp, Artificial sequence
  SiRNA target sequence
ccttatacgggtaaagaccat

SEQ ID NO: 119172 - DNA, 21 bp, Artificial sequence
  SiRNA target sequence
cttatacgggtaaagaccata

SEQ ID NO: 119173 - DNA, 21 bp, Artificial sequence
  SiRNA target sequence
ttatacgggtaaagaccataa

SEQ ID NO: 119174 - DNA, 21 bp, Artificial sequence
  SiRNA target sequence
tatacgggtaaagaccataaa

SEQ ID NO: 119175 - DNA, 21 bp, Artificial sequence
  SiRNA target sequence
atacgggtaaagaccataaag

SEQ ID NO: 119176 - DNA, 21 bp, Artificial sequence
  SiRNA target sequence
tacgggtaaagaccataaagg

SEQ ID NO: 119177 - DNA, 21 bp, Artificial sequence
  SiRNA target sequence
acgggtaaagaccataaagga

SEQ ID NO: 119178 - DNA, 21 bp, Artificial sequence
  SiRNA target sequence
cgggtaaagaccataaaggac

SEQ ID NO: 119179 - DNA, 21 bp, Artificial sequence
  SiRNA target sequence
gggtaaagaccataaaggact

SEQ ID NO: 119180 - DNA, 21 bp, Artificial sequence
  SiRNA target sequence
ggtaaagaccataaaggactt

SEQ ID NO: 119181 - DNA, 21 bp, Artificial sequence
  SiRNA target sequence
gtaaagaccataaaggacttt

SEQ ID NO: 119182 - DNA, 21 bp, Artificial sequence
  SiRNA target sequence
taaagaccataaaggactttt

SEQ ID NO: 119183 - DNA, 21 bp, Artificial sequence
  SiRNA target sequence
aaagaccataaaggactttta

SEQ ID NO: 119184 - DNA, 21 bp, Artificial sequence
  SiRNA target sequence
aagaccataaaggacttttaa

SEQ ID NO: 119185 - DNA, 21 bp, Artificial sequence
  SiRNA target sequence
agaccataaaggacttttaaa

SEQ ID NO: 119186 - DNA, 21 bp, Artificial sequence
  SiRNA target sequence
gaccataaaggacttttaaaa

SEQ ID NO: 119187 - DNA, 21 bp, Artificial sequence
  SiRNA target sequence
accataaaggacttttaaaaa

SEQ ID NO: 119188 - DNA, 21 bp, Artificial sequence
  SiRNA target sequence
ccataaaggacttttaaaaag

SEQ ID NO: 119189 - DNA, 21 bp, Artificial sequence
  SiRNA target sequence
cataaaggacttttaaaaagc

SEQ ID NO: 119190 - DNA, 21 bp, Artificial sequence
  SiRNA target sequence
ataaaggacttttaaaaagcg

SEQ ID NO: 119191 - DNA, 21 bp, Artificial sequence
  SiRNA target sequence
taaaggacttttaaaaagcgc

SEQ ID NO: 119192 - DNA, 21 bp, Artificial sequence
  SiRNA target sequence
aaaggacttttaaaaagcgct

SEQ ID NO: 119193 - DNA, 21 bp, Artificial sequence
  SiRNA target sequence
aaggacttttaaaaagcgcta

SEQ ID NO: 119194 - DNA, 21 bp, Artificial sequence
  SiRNA target sequence
aggacttttaaaaagcgctat

SEQ ID NO: 119195 - DNA, 21 bp, Artificial sequence
  SiRNA target sequence
ggacttttaaaaagcgctatt

SEQ ID NO: 119196 - DNA, 21 bp, Artificial sequence
  SiRNA target sequence
gacttttaaaaagcgctatta

SEQ ID NO: 119197 - DNA, 21 bp, Artificial sequence
  SiRNA target sequence
acttttaaaaagcgctattag

SEQ ID NO: 119198 - DNA, 21 bp, Artificial sequence
  SiRNA target sequence
cttttaaaaagcgctattaga

SEQ ID NO: 119199 - DNA, 21 bp, Artificial sequence
  SiRNA target sequence
ttttaaaaagcgctattagag

SEQ ID NO: 119200 - DNA, 21 bp, Artificial sequence
  SiRNA target sequence
tttaaaaagcgctattagaga

SEQ ID NO: 119201 - DNA, 21 bp, Artificial sequence
  SiRNA target sequence
ttaaaaagcgctattagagac

SEQ ID NO: 119202 - DNA, 21 bp, Artificial sequence
  SiRNA target sequence
taaaaagcgctattagagaca

SEQ ID NO: 119203 - DNA, 21 bp, Artificial sequence
  SiRNA target sequence
aaaaagcgctattagagacaa

SEQ ID NO: 119204 - DNA, 21 bp, Artificial sequence
  SiRNA target sequence
aaaagcgctattagagacaat

SEQ ID NO: 119205 - DNA, 21 bp, Artificial sequence
  SiRNA target sequence
aaagcgctattagagacaata

SEQ ID NO: 119206 - DNA, 21 bp, Artificial sequence
  SiRNA target sequence
aagcgctattagagacaataa

SEQ ID NO: 119207 - DNA, 21 bp, Artificial sequence
  SiRNA target sequence
agcgctattagagacaataac

SEQ ID NO: 119208 - DNA, 21 bp, Artificial sequence
  SiRNA target sequence
gcgctattagagacaataacc

SEQ ID NO: 119209 - DNA, 21 bp, Artificial sequence
  SiRNA target sequence
cgctattagagacaataaccc

SEQ ID NO: 119210 - DNA, 21 bp, Artificial sequence
  SiRNA target sequence
gctattagagacaataacccg

SEQ ID NO: 119211 - DNA, 21 bp, Artificial sequence
  SiRNA target sequence
ctattagagacaataacccgg

SEQ ID NO: 119212 - DNA, 21 bp, Artificial sequence
  SiRNA target sequence
tattagagacaataacccggt

SEQ ID NO: 119213 - DNA, 21 bp, Artificial sequence
  SiRNA target sequence
attagagacaataacccggtt

SEQ ID NO: 119214 - DNA, 21 bp, Artificial sequence
  SiRNA target sequence
ttagagacaataacccggtta

SEQ ID NO: 119215 - DNA, 21 bp, Artificial sequence
  SiRNA target sequence
tagagacaataacccggttat

SEQ ID NO: 119216 - DNA, 21 bp, Artificial sequence
  SiRNA target sequence
agagacaataacccggttata

SEQ ID NO: 119217 - DNA, 21 bp, Artificial sequence
  SiRNA target sequence
gagacaataacccggttatat

SEQ ID NO: 119218 - DNA, 21 bp, Artificial sequence
  SiRNA target sequence
agacaataacccggttatatt

SEQ ID NO: 119219 - DNA, 21 bp, Artificial sequence
  SiRNA target sequence
gacaataacccggttatattt

SEQ ID NO: 119220 - DNA, 21 bp, Artificial sequence
  SiRNA target sequence
acaataacccggttatatttc

SEQ ID NO: 119221 - DNA, 21 bp, Artificial sequence
  SiRNA target sequence
caataacccggttatatttct

SEQ ID NO: 119222 - DNA, 21 bp, Artificial sequence
  SiRNA target sequence
aataacccggttatatttctt

SEQ ID NO: 119223 - DNA, 21 bp, Artificial sequence
  SiRNA target sequence
ataacccggttatatttcttg

SEQ ID NO: 119224 - DNA, 21 bp, Artificial sequence
  SiRNA target sequence
taacccggttatatttcttga

SEQ ID NO: 119225 - DNA, 21 bp, Artificial sequence
  SiRNA target sequence
aacccggttatatttcttgag

SEQ ID NO: 119226 - DNA, 21 bp, Artificial sequence
  SiRNA target sequence
acccggttatatttcttgaga

SEQ ID NO: 119227 - DNA, 21 bp, Artificial sequence
  SiRNA target sequence
cccggttatatttcttgagaa

SEQ ID NO: 119228 - DNA, 21 bp, Artificial sequence
  SiRNA target sequence
ccggttatatttcttgagaat

SEQ ID NO: 119229 - DNA, 21 bp, Artificial sequence
  SiRNA target sequence
cggttatatttcttgagaatg

SEQ ID NO: 119230 - DNA, 21 bp, Artificial sequence
  SiRNA target sequence
ggttatatttcttgagaatga

SEQ ID NO: 119231 - DNA, 21 bp, Artificial sequence
  SiRNA target sequence
gttatatttcttgagaatgaa

SEQ ID NO: 119232 - DNA, 21 bp, Artificial sequence
  SiRNA target sequence
ttatatttcttgagaatgaaa

SEQ ID NO: 119233 - DNA, 21 bp, Artificial sequence
  SiRNA target sequence
tatatttcttgagaatgaaat

SEQ ID NO: 119234 - DNA, 21 bp, Artificial sequence
  SiRNA target sequence
atatttcttgagaatgaaata

SEQ ID NO: 119235 - DNA, 21 bp, Artificial sequence
  SiRNA target sequence
tatttcttgagaatgaaatat

SEQ ID NO: 119236 - DNA, 21 bp, Artificial sequence
  SiRNA target sequence
atttcttgagaatgaaatatt

SEQ ID NO: 119237 - DNA, 21 bp, Artificial sequence
  SiRNA target sequence
tttcttgagaatgaaatatta

SEQ ID NO: 119238 - DNA, 21 bp, Artificial sequence
  SiRNA target sequence
ttcttgagaatgaaatattat

SEQ ID NO: 119239 - DNA, 21 bp, Artificial sequence
  SiRNA target sequence
tcttgagaatgaaatattata

SEQ ID NO: 119240 - DNA, 21 bp, Artificial sequence
  SiRNA target sequence
cttgagaatgaaatattatat

SEQ ID NO: 119241 - DNA, 21 bp, Artificial sequence
  SiRNA target sequence
ttgagaatgaaatattatata

SEQ ID NO: 119242 - DNA, 21 bp, Artificial sequence
  SiRNA target sequence
tgagaatgaaatattatataa

SEQ ID NO: 119243 - DNA, 21 bp, Artificial sequence
  SiRNA target sequence
gagaatgaaatattatataaa

SEQ ID NO: 119244 - DNA, 21 bp, Artificial sequence
  SiRNA target sequence
agaatgaaatattatataaag

SEQ ID NO: 119245 - DNA, 21 bp, Artificial sequence
  SiRNA target sequence
gaatgaaatattatataaaga

SEQ ID NO: 119246 - DNA, 21 bp, Artificial sequence
  SiRNA target sequence
aatgaaatattatataaagat

SEQ ID NO: 119247 - DNA, 21 bp, Artificial sequence
  SiRNA target sequence
atgaaatattatataaagata

SEQ ID NO: 119248 - DNA, 21 bp, Artificial sequence
  SiRNA target sequence
tgaaatattatataaagataa

SEQ ID NO: 119249 - DNA, 21 bp, Artificial sequence
  SiRNA target sequence
gaaatattatataaagataaa

SEQ ID NO: 119250 - DNA, 21 bp, Artificial sequence
  SiRNA target sequence
aaatattatataaagataaat

SEQ ID NO: 119251 - DNA, 21 bp, Artificial sequence
  SiRNA target sequence
aatattatataaagataaata

SEQ ID NO: 119252 - DNA, 21 bp, Artificial sequence
  SiRNA target sequence
atattatataaagataaatac

SEQ ID NO: 119253 - DNA, 21 bp, Artificial sequence
  SiRNA target sequence
tattatataaagataaatacc

SEQ ID NO: 119254 - DNA, 21 bp, Artificial sequence
  SiRNA target sequence
attatataaagataaatacct

SEQ ID NO: 119255 - DNA, 21 bp, Artificial sequence
  SiRNA target sequence
ttatataaagataaatacctt

SEQ ID NO: 119256 - DNA, 21 bp, Artificial sequence
  SiRNA target sequence
tatataaagataaataccttg

SEQ ID NO: 119257 - DNA, 21 bp, Artificial sequence
  SiRNA target sequence
atataaagataaataccttga

SEQ ID NO: 119258 - DNA, 21 bp, Artificial sequence
  SiRNA target sequence
tataaagataaataccttgaa

SEQ ID NO: 119259 - DNA, 21 bp, Artificial sequence
  SiRNA target sequence
ataaagataaataccttgaag

SEQ ID NO: 119260 - DNA, 21 bp, Artificial sequence
  SiRNA target sequence
taaagataaataccttgaagt

SEQ ID NO: 119261 - DNA, 21 bp, Artificial sequence
  SiRNA target sequence
aaagataaataccttgaagtg

SEQ ID NO: 119262 - DNA, 21 bp, Artificial sequence
  SiRNA target sequence
aagataaataccttgaagtgt

SEQ ID NO: 119263 - DNA, 21 bp, Artificial sequence
  SiRNA target sequence
agataaataccttgaagtgtc

SEQ ID NO: 119264 - DNA, 21 bp, Artificial sequence
  SiRNA target sequence
gataaataccttgaagtgtct

SEQ ID NO: 119265 - DNA, 21 bp, Artificial sequence
  SiRNA target sequence
ataaataccttgaagtgtcta

SEQ ID NO: 119266 - DNA, 21 bp, Artificial sequence
  SiRNA target sequence
taaataccttgaagtgtctaa

SEQ ID NO: 119267 - DNA, 21 bp, Artificial sequence
  SiRNA target sequence
aaataccttgaagtgtctaat

SEQ ID NO: 119268 - DNA, 21 bp, Artificial sequence
  SiRNA target sequence
aataccttgaagtgtctaata

SEQ ID NO: 119269 - DNA, 21 bp, Artificial sequence
  SiRNA target sequence
ataccttgaagtgtctaataa

SEQ ID NO: 119270 - DNA, 21 bp, Artificial sequence
  SiRNA target sequence
taccttgaagtgtctaataat

SEQ ID NO: 119271 - DNA, 21 bp, Artificial sequence
  SiRNA target sequence
accttgaagtgtctaataatt

SEQ ID NO: 119272 - DNA, 21 bp, Artificial sequence
  SiRNA target sequence
ccttgaagtgtctaataatta

SEQ ID NO: 119273 - DNA, 21 bp, Artificial sequence
  SiRNA target sequence
cttgaagtgtctaataattat

SEQ ID NO: 119274 - DNA, 21 bp, Artificial sequence
  SiRNA target sequence
ttgaagtgtctaataattata

SEQ ID NO: 119275 - DNA, 21 bp, Artificial sequence
  SiRNA target sequence
tgaagtgtctaataattatat

SEQ ID NO: 119276 - DNA, 21 bp, Artificial sequence
  SiRNA target sequence
gaagtgtctaataattatatt

SEQ ID NO: 119277 - DNA, 21 bp, Artificial sequence
  SiRNA target sequence
aagtgtctaataattatattc

SEQ ID NO: 119278 - DNA, 21 bp, Artificial sequence
  SiRNA target sequence
agtgtctaataattatattca

SEQ ID NO: 119279 - DNA, 21 bp, Artificial sequence
  SiRNA target sequence
gtgtctaataattatattcaa

SEQ ID NO: 119280 - DNA, 21 bp, Artificial sequence
  SiRNA target sequence
tgtctaataattatattcaac

SEQ ID NO: 119281 - DNA, 21 bp, Artificial sequence
  SiRNA target sequence
gtctaataattatattcaacc

SEQ ID NO: 119282 - DNA, 21 bp, Artificial sequence
  SiRNA target sequence
tctaataattatattcaacca

SEQ ID NO: 119283 - DNA, 21 bp, Artificial sequence
  SiRNA target sequence
ctaataattatattcaaccac

SEQ ID NO: 119284 - DNA, 21 bp, Artificial sequence
  SiRNA target sequence
taataattatattcaaccact

SEQ ID NO: 119285 - DNA, 21 bp, Artificial sequence
  SiRNA target sequence
aataattatattcaaccactt

SEQ ID NO: 119286 - DNA, 21 bp, Artificial sequence
  SiRNA target sequence
ataattatattcaaccacttg

SEQ ID NO: 119287 - DNA, 21 bp, Artificial sequence
  SiRNA target sequence
taattatattcaaccacttga

SEQ ID NO: 119288 - DNA, 21 bp, Artificial sequence
  SiRNA target sequence
aattatattcaaccacttgac

SEQ ID NO: 119289 - DNA, 21 bp, Artificial sequence
  SiRNA target sequence
attatattcaaccacttgaca

SEQ ID NO: 119290 - DNA, 21 bp, Artificial sequence
  SiRNA target sequence
ttatattcaaccacttgacaa

SEQ ID NO: 119291 - DNA, 21 bp, Artificial sequence
  SiRNA target sequence
tatattcaaccacttgacaag

SEQ ID NO: 119292 - DNA, 21 bp, Artificial sequence
  SiRNA target sequence
atattcaaccacttgacaagg

SEQ ID NO: 119293 - DNA, 21 bp, Artificial sequence
  SiRNA target sequence
tattcaaccacttgacaaggc

SEQ ID NO: 119294 - DNA, 21 bp, Artificial sequence
  SiRNA target sequence
attcaaccacttgacaaggca

SEQ ID NO: 119295 - DNA, 21 bp, Artificial sequence
  SiRNA target sequence
ttcaaccacttgacaaggcag

SEQ ID NO: 119296 - DNA, 21 bp, Artificial sequence
  SiRNA target sequence
tcaaccacttgacaaggcagt

SEQ ID NO: 119297 - DNA, 21 bp, Artificial sequence
  SiRNA target sequence
caaccacttgacaaggcagta

SEQ ID NO: 119298 - DNA, 21 bp, Artificial sequence
  SiRNA target sequence
aaccacttgacaaggcagtaa

SEQ ID NO: 119299 - DNA, 21 bp, Artificial sequence
  SiRNA target sequence
accacttgacaaggcagtaat

SEQ ID NO: 119300 - DNA, 21 bp, Artificial sequence
  SiRNA target sequence
ccacttgacaaggcagtaatt

SEQ ID NO: 119301 - DNA, 21 bp, Artificial sequence
  SiRNA target sequence
cacttgacaaggcagtaattg

SEQ ID NO: 119302 - DNA, 21 bp, Artificial sequence
  SiRNA target sequence
acttgacaaggcagtaattga

SEQ ID NO: 119303 - DNA, 21 bp, Artificial sequence
  SiRNA target sequence
cttgacaaggcagtaattgaa

SEQ ID NO: 119304 - DNA, 21 bp, Artificial sequence
  SiRNA target sequence
ttgacaaggcagtaattgaaa

SEQ ID NO: 119305 - DNA, 21 bp, Artificial sequence
  SiRNA target sequence
tgacaaggcagtaattgaaaa

SEQ ID NO: 119306 - DNA, 21 bp, Artificial sequence
  SiRNA target sequence
gacaaggcagtaattgaaaaa

SEQ ID NO: 119307 - DNA, 21 bp, Artificial sequence
  SiRNA target sequence
acaaggcagtaattgaaaaaa

SEQ ID NO: 119308 - DNA, 21 bp, Artificial sequence
  SiRNA target sequence
caaggcagtaattgaaaaaaa

SEQ ID NO: 119309 - DNA, 21 bp, Artificial sequence
  SiRNA target sequence
aaggcagtaattgaaaaaaat

SEQ ID NO: 119310 - DNA, 21 bp, Artificial sequence
  SiRNA target sequence
aggcagtaattgaaaaaaatg

SEQ ID NO: 119311 - DNA, 21 bp, Artificial sequence
  SiRNA target sequence
ggcagtaattgaaaaaaatgg

SEQ ID NO: 119312 - DNA, 21 bp, Artificial sequence
  SiRNA target sequence
gcagtaattgaaaaaaatggt

SEQ ID NO: 119313 - DNA, 21 bp, Artificial sequence
  SiRNA target sequence
cagtaattgaaaaaaatggtg

SEQ ID NO: 119314 - DNA, 21 bp, Artificial sequence
  SiRNA target sequence
agtaattgaaaaaaatggtgt

SEQ ID NO: 119315 - DNA, 21 bp, Artificial sequence
  SiRNA target sequence
gtaattgaaaaaaatggtgtt

SEQ ID NO: 119316 - DNA, 21 bp, Artificial sequence
  SiRNA target sequence
taattgaaaaaaatggtgttg

SEQ ID NO: 119317 - DNA, 21 bp, Artificial sequence
  SiRNA target sequence
aattgaaaaaaatggtgttga

SEQ ID NO: 119318 - DNA, 21 bp, Artificial sequence
  SiRNA target sequence
attgaaaaaaatggtgttgac

SEQ ID NO: 119319 - DNA, 21 bp, Artificial sequence
  SiRNA target sequence
ttgaaaaaaatggtgttgacg

SEQ ID NO: 119320 - DNA, 21 bp, Artificial sequence
  SiRNA target sequence
tgaaaaaaatggtgttgacgt

SEQ ID NO: 119321 - DNA, 21 bp, Artificial sequence
  SiRNA target sequence
gaaaaaaatggtgttgacgtt

SEQ ID NO: 119322 - DNA, 21 bp, Artificial sequence
  SiRNA target sequence
aaaaaaatggtgttgacgtta

SEQ ID NO: 119323 - DNA, 21 bp, Artificial sequence
  SiRNA target sequence
aaaaaatggtgttgacgttac

SEQ ID NO: 119324 - DNA, 21 bp, Artificial sequence
  SiRNA target sequence
aaaaatggtgttgacgttaca

SEQ ID NO: 119325 - DNA, 21 bp, Artificial sequence
  SiRNA target sequence
aaaatggtgttgacgttacag

SEQ ID NO: 119326 - DNA, 21 bp, Artificial sequence
  SiRNA target sequence
aaatggtgttgacgttacagt

SEQ ID NO: 119327 - DNA, 21 bp, Artificial sequence
  SiRNA target sequence
aatggtgttgacgttacagtt

SEQ ID NO: 119328 - DNA, 21 bp, Artificial sequence
  SiRNA target sequence
atggtgttgacgttacagttt

SEQ ID NO: 119329 - DNA, 21 bp, Artificial sequence
  SiRNA target sequence
tggtgttgacgttacagtttt

SEQ ID NO: 119330 - DNA, 21 bp, Artificial sequence
  SiRNA target sequence
ggtgttgacgttacagtttta

SEQ ID NO: 119331 - DNA, 21 bp, Artificial sequence
  SiRNA target sequence
gtgttgacgttacagttttag

SEQ ID NO: 119332 - DNA, 21 bp, Artificial sequence
  SiRNA target sequence
tgttgacgttacagttttagg

SEQ ID NO: 119333 - DNA, 21 bp, Artificial sequence
  SiRNA target sequence
gttgacgttacagttttagga

SEQ ID NO: 119334 - DNA, 21 bp, Artificial sequence
  SiRNA target sequence
ttgacgttacagttttaggaa

SEQ ID NO: 119335 - DNA, 21 bp, Artificial sequence
  SiRNA target sequence
tgacgttacagttttaggaat

SEQ ID NO: 119336 - DNA, 21 bp, Artificial sequence
  SiRNA target sequence
gacgttacagttttaggaata

SEQ ID NO: 119337 - DNA, 21 bp, Artificial sequence
  SiRNA target sequence
acgttacagttttaggaatat

SEQ ID NO: 119338 - DNA, 21 bp, Artificial sequence
  SiRNA target sequence
cgttacagttttaggaatatc

SEQ ID NO: 119339 - DNA, 21 bp, Artificial sequence
  SiRNA target sequence
gttacagttttaggaatatca

SEQ ID NO: 119340 - DNA, 21 bp, Artificial sequence
  SiRNA target sequence
ttacagttttaggaatatcaa

SEQ ID NO: 119341 - DNA, 21 bp, Artificial sequence
  SiRNA target sequence
tacagttttaggaatatcaat

SEQ ID NO: 119342 - DNA, 21 bp, Artificial sequence
  SiRNA target sequence
acagttttaggaatatcaata

SEQ ID NO: 119343 - DNA, 21 bp, Artificial sequence
  SiRNA target sequence
cagttttaggaatatcaataa

SEQ ID NO: 119344 - DNA, 21 bp, Artificial sequence
  SiRNA target sequence
agttttaggaatatcaataag

SEQ ID NO: 119345 - DNA, 21 bp, Artificial sequence
  SiRNA target sequence
gttttaggaatatcaataagt

SEQ ID NO: 119346 - DNA, 21 bp, Artificial sequence
  SiRNA target sequence
ttttaggaatatcaataagtc

SEQ ID NO: 119347 - DNA, 21 bp, Artificial sequence
  SiRNA target sequence
tttaggaatatcaataagtct

SEQ ID NO: 119348 - DNA, 21 bp, Artificial sequence
  SiRNA target sequence
ttaggaatatcaataagtctt

SEQ ID NO: 119349 - DNA, 21 bp, Artificial sequence
  SiRNA target sequence
taggaatatcaataagtctta

SEQ ID NO: 119350 - DNA, 21 bp, Artificial sequence
  SiRNA target sequence
aggaatatcaataagtcttaa

SEQ ID NO: 119351 - DNA, 21 bp, Artificial sequence
  SiRNA target sequence
ggaatatcaataagtcttaaa

SEQ ID NO: 119352 - DNA, 21 bp, Artificial sequence
  SiRNA target sequence
gaatatcaataagtcttaaag

SEQ ID NO: 119353 - DNA, 21 bp, Artificial sequence
  SiRNA target sequence
aatatcaataagtcttaaaga

SEQ ID NO: 119354 - DNA, 21 bp, Artificial sequence
  SiRNA target sequence
atatcaataagtcttaaagaa

SEQ ID NO: 119355 - DNA, 21 bp, Artificial sequence
  SiRNA target sequence
tatcaataagtcttaaagaaa

SEQ ID NO: 119356 - DNA, 21 bp, Artificial sequence
  SiRNA target sequence
atcaataagtcttaaagaaat

SEQ ID NO: 119357 - DNA, 21 bp, Artificial sequence
  SiRNA target sequence
tcaataagtcttaaagaaatt

SEQ ID NO: 119358 - DNA, 21 bp, Artificial sequence
  SiRNA target sequence
caataagtcttaaagaaattt

SEQ ID NO: 119359 - DNA, 21 bp, Artificial sequence
  SiRNA target sequence
aataagtcttaaagaaatttt

SEQ ID NO: 119360 - DNA, 21 bp, Artificial sequence
  SiRNA target sequence
ataagtcttaaagaaattttt

SEQ ID NO: 119361 - DNA, 21 bp, Artificial sequence
  SiRNA target sequence
taagtcttaaagaaattttta

SEQ ID NO: 119362 - DNA, 21 bp, Artificial sequence
  SiRNA target sequence
aagtcttaaagaaatttttaa

SEQ ID NO: 119363 - DNA, 21 bp, Artificial sequence
  SiRNA target sequence
agtcttaaagaaatttttaaa

SEQ ID NO: 119364 - DNA, 21 bp, Artificial sequence
  SiRNA target sequence
gtcttaaagaaatttttaaag

SEQ ID NO: 119365 - DNA, 21 bp, Artificial sequence
  SiRNA target sequence
tcttaaagaaatttttaaagc

SEQ ID NO: 119366 - DNA, 21 bp, Artificial sequence
  SiRNA target sequence
cttaaagaaatttttaaagca

SEQ ID NO: 119367 - DNA, 21 bp, Artificial sequence
  SiRNA target sequence
ttaaagaaatttttaaagcag

SEQ ID NO: 119368 - DNA, 21 bp, Artificial sequence
  SiRNA target sequence
taaagaaatttttaaagcaga

SEQ ID NO: 119369 - DNA, 21 bp, Artificial sequence
  SiRNA target sequence
aaagaaatttttaaagcagac

SEQ ID NO: 119370 - DNA, 21 bp, Artificial sequence
  SiRNA target sequence
aagaaatttttaaagcagaca

SEQ ID NO: 119371 - DNA, 21 bp, Artificial sequence
  SiRNA target sequence
agaaatttttaaagcagacag

SEQ ID NO: 119372 - DNA, 21 bp, Artificial sequence
  SiRNA target sequence
gaaatttttaaagcagacagt

SEQ ID NO: 119373 - DNA, 21 bp, Artificial sequence
  SiRNA target sequence
aaatttttaaagcagacagtt

SEQ ID NO: 119374 - DNA, 21 bp, Artificial sequence
  SiRNA target sequence
aatttttaaagcagacagttt

SEQ ID NO: 119375 - DNA, 21 bp, Artificial sequence
  SiRNA target sequence
atttttaaagcagacagtttg

SEQ ID NO: 119376 - DNA, 21 bp, Artificial sequence
  SiRNA target sequence
tttttaaagcagacagtttgt

SEQ ID NO: 119377 - DNA, 21 bp, Artificial sequence
  SiRNA target sequence
ttttaaagcagacagtttgtt

SEQ ID NO: 119378 - DNA, 21 bp, Artificial sequence
  SiRNA target sequence
tttaaagcagacagtttgtta

SEQ ID NO: 119379 - DNA, 21 bp, Artificial sequence
  SiRNA target sequence
ttaaagcagacagtttgttag

SEQ ID NO: 119380 - DNA, 21 bp, Artificial sequence
  SiRNA target sequence
taaagcagacagtttgttaga

SEQ ID NO: 119381 - DNA, 21 bp, Artificial sequence
  SiRNA target sequence
aaagcagacagtttgttagag

SEQ ID NO: 119382 - DNA, 21 bp, Artificial sequence
  SiRNA target sequence
aagcagacagtttgttagaga

SEQ ID NO: 119383 - DNA, 21 bp, Artificial sequence
  SiRNA target sequence
agcagacagtttgttagagaa

SEQ ID NO: 119384 - DNA, 21 bp, Artificial sequence
  SiRNA target sequence
gcagacagtttgttagagaaa

SEQ ID NO: 119385 - DNA, 21 bp, Artificial sequence
  SiRNA target sequence
cagacagtttgttagagaaaa

SEQ ID NO: 119386 - DNA, 21 bp, Artificial sequence
  SiRNA target sequence
agacagtttgttagagaaaaa

SEQ ID NO: 119387 - DNA, 21 bp, Artificial sequence
  SiRNA target sequence
gacagtttgttagagaaaaaa

SEQ ID NO: 119388 - DNA, 21 bp, Artificial sequence
  SiRNA target sequence
acagtttgttagagaaaaaaa

SEQ ID NO: 119389 - DNA, 21 bp, Artificial sequence
  SiRNA target sequence
cagtttgttagagaaaaaaaa

SEQ ID NO: 119390 - DNA, 21 bp, Artificial sequence
  SiRNA target sequence
agtttgttagagaaaaaaaat

SEQ ID NO: 119391 - DNA, 21 bp, Artificial sequence
  SiRNA target sequence
gtttgttagagaaaaaaaata

SEQ ID NO: 119392 - DNA, 21 bp, Artificial sequence
  SiRNA target sequence
tttgttagagaaaaaaaatat

SEQ ID NO: 119393 - DNA, 21 bp, Artificial sequence
  SiRNA target sequence
ttgttagagaaaaaaaatatc

SEQ ID NO: 119394 - DNA, 21 bp, Artificial sequence
  SiRNA target sequence
tgttagagaaaaaaaatatcg

SEQ ID NO: 119395 - DNA, 21 bp, Artificial sequence
  SiRNA target sequence
gttagagaaaaaaaatatcga

SEQ ID NO: 119396 - DNA, 21 bp, Artificial sequence
  SiRNA target sequence
ttagagaaaaaaaatatcgac

SEQ ID NO: 119397 - DNA, 21 bp, Artificial sequence
  SiRNA target sequence
tagagaaaaaaaatatcgaca

SEQ ID NO: 119398 - DNA, 21 bp, Artificial sequence
  SiRNA target sequence
agagaaaaaaaatatcgacat

SEQ ID NO: 119399 - DNA, 21 bp, Artificial sequence
  SiRNA target sequence
gagaaaaaaaatatcgacatt

SEQ ID NO: 119400 - DNA, 21 bp, Artificial sequence
  SiRNA target sequence
agaaaaaaaatatcgacattg

SEQ ID NO: 119401 - DNA, 21 bp, Artificial sequence
  SiRNA target sequence
gaaaaaaaatatcgacattga

SEQ ID NO: 119402 - DNA, 21 bp, Artificial sequence
  SiRNA target sequence
aaaaaaaatatcgacattgag

SEQ ID NO: 119403 - DNA, 21 bp, Artificial sequence
  SiRNA target sequence
aaaaaaatatcgacattgaga

SEQ ID NO: 119404 - DNA, 21 bp, Artificial sequence
  SiRNA target sequence
aaaaaatatcgacattgagat

SEQ ID NO: 119405 - DNA, 21 bp, Artificial sequence
  SiRNA target sequence
aaaaatatcgacattgagata

SEQ ID NO: 119406 - DNA, 21 bp, Artificial sequence
  SiRNA target sequence
aaaatatcgacattgagataa

SEQ ID NO: 119407 - DNA, 21 bp, Artificial sequence
  SiRNA target sequence
aaatatcgacattgagataat

SEQ ID NO: 119408 - DNA, 21 bp, Artificial sequence
  SiRNA target sequence
aatatcgacattgagataatt

SEQ ID NO: 119409 - DNA, 21 bp, Artificial sequence
  SiRNA target sequence
atatcgacattgagataatta

SEQ ID NO: 119410 - DNA, 21 bp, Artificial sequence
  SiRNA target sequence
tatcgacattgagataattaa

SEQ ID NO: 119411 - DNA, 21 bp, Artificial sequence
  SiRNA target sequence
atcgacattgagataattaat

SEQ ID NO: 119412 - DNA, 21 bp, Artificial sequence
  SiRNA target sequence
tcgacattgagataattaatc

SEQ ID NO: 119413 - DNA, 21 bp, Artificial sequence
  SiRNA target sequence
cgacattgagataattaatct

SEQ ID NO: 119414 - DNA, 21 bp, Artificial sequence
  SiRNA target sequence
gacattgagataattaatctt

SEQ ID NO: 119415 - DNA, 21 bp, Artificial sequence
  SiRNA target sequence
acattgagataattaatcttg

SEQ ID NO: 119416 - DNA, 21 bp, Artificial sequence
  SiRNA target sequence
cattgagataattaatcttgt

SEQ ID NO: 119417 - DNA, 21 bp, Artificial sequence
  SiRNA target sequence
attgagataattaatcttgtg

SEQ ID NO: 119418 - DNA, 21 bp, Artificial sequence
  SiRNA target sequence
ttgagataattaatcttgtgt

SEQ ID NO: 119419 - DNA, 21 bp, Artificial sequence
  SiRNA target sequence
tgagataattaatcttgtgtc

SEQ ID NO: 119420 - DNA, 21 bp, Artificial sequence
  SiRNA target sequence
gagataattaatcttgtgtca

SEQ ID NO: 119421 - DNA, 21 bp, Artificial sequence
  SiRNA target sequence
agataattaatcttgtgtcaa

SEQ ID NO: 119422 - DNA, 21 bp, Artificial sequence
  SiRNA target sequence
gataattaatcttgtgtcaat

SEQ ID NO: 119423 - DNA, 21 bp, Artificial sequence
  SiRNA target sequence
ataattaatcttgtgtcaata

SEQ ID NO: 119424 - DNA, 21 bp, Artificial sequence
  SiRNA target sequence
taattaatcttgtgtcaataa

SEQ ID NO: 119425 - DNA, 21 bp, Artificial sequence
  SiRNA target sequence
aattaatcttgtgtcaataaa

SEQ ID NO: 119426 - DNA, 21 bp, Artificial sequence
  SiRNA target sequence
attaatcttgtgtcaataaaa

SEQ ID NO: 119427 - DNA, 21 bp, Artificial sequence
  SiRNA target sequence
ttaatcttgtgtcaataaaac

SEQ ID NO: 119428 - DNA, 21 bp, Artificial sequence
  SiRNA target sequence
taatcttgtgtcaataaaacc

SEQ ID NO: 119429 - DNA, 21 bp, Artificial sequence
  SiRNA target sequence
aatcttgtgtcaataaaacca

SEQ ID NO: 119430 - DNA, 21 bp, Artificial sequence
  SiRNA target sequence
atcttgtgtcaataaaaccaa

SEQ ID NO: 119431 - DNA, 21 bp, Artificial sequence
  SiRNA target sequence
tcttgtgtcaataaaaccaat

SEQ ID NO: 119432 - DNA, 21 bp, Artificial sequence
  SiRNA target sequence
cttgtgtcaataaaaccaatt

SEQ ID NO: 119433 - DNA, 21 bp, Artificial sequence
  SiRNA target sequence
ttgtgtcaataaaaccaattg

SEQ ID NO: 119434 - DNA, 21 bp, Artificial sequence
  SiRNA target sequence
tgtgtcaataaaaccaattga

SEQ ID NO: 119435 - DNA, 21 bp, Artificial sequence
  SiRNA target sequence
gtgtcaataaaaccaattgat

SEQ ID NO: 119436 - DNA, 21 bp, Artificial sequence
  SiRNA target sequence
tgtcaataaaaccaattgatt

SEQ ID NO: 119437 - DNA, 21 bp, Artificial sequence
  SiRNA target sequence
gtcaataaaaccaattgatta

SEQ ID NO: 119438 - DNA, 21 bp, Artificial sequence
  SiRNA target sequence
tcaataaaaccaattgattat

SEQ ID NO: 119439 - DNA, 21 bp, Artificial sequence
  SiRNA target sequence
caataaaaccaattgattatg

SEQ ID NO: 119440 - DNA, 21 bp, Artificial sequence
  SiRNA target sequence
aataaaaccaattgattatgt

SEQ ID NO: 119441 - DNA, 21 bp, Artificial sequence
  SiRNA target sequence
ataaaaccaattgattatgtt

SEQ ID NO: 119442 - DNA, 21 bp, Artificial sequence
  SiRNA target sequence
taaaaccaattgattatgtta

SEQ ID NO: 119443 - DNA, 21 bp, Artificial sequence
  SiRNA target sequence
aaaaccaattgattatgttac

SEQ ID NO: 119444 - DNA, 21 bp, Artificial sequence
  SiRNA target sequence
aaaccaattgattatgttact

SEQ ID NO: 119445 - DNA, 21 bp, Artificial sequence
  SiRNA target sequence
aaccaattgattatgttacta

SEQ ID NO: 119446 - DNA, 21 bp, Artificial sequence
  SiRNA target sequence
accaattgattatgttactat

SEQ ID NO: 119447 - DNA, 21 bp, Artificial sequence
  SiRNA target sequence
ccaattgattatgttactatt

SEQ ID NO: 119448 - DNA, 21 bp, Artificial sequence
  SiRNA target sequence
caattgattatgttactattg

SEQ ID NO: 119449 - DNA, 21 bp, Artificial sequence
  SiRNA target sequence
aattgattatgttactattga

SEQ ID NO: 119450 - DNA, 21 bp, Artificial sequence
  SiRNA target sequence
attgattatgttactattgaa

SEQ ID NO: 119451 - DNA, 21 bp, Artificial sequence
  SiRNA target sequence
ttgattatgttactattgaaa

SEQ ID NO: 119452 - DNA, 21 bp, Artificial sequence
  SiRNA target sequence
tgattatgttactattgaaat

SEQ ID NO: 119453 - DNA, 21 bp, Artificial sequence
  SiRNA target sequence
gattatgttactattgaaata

SEQ ID NO: 119454 - DNA, 21 bp, Artificial sequence
  SiRNA target sequence
attatgttactattgaaatat

SEQ ID NO: 119455 - DNA, 21 bp, Artificial sequence
  SiRNA target sequence
ttatgttactattgaaatatc

SEQ ID NO: 119456 - DNA, 21 bp, Artificial sequence
  SiRNA target sequence
tatgttactattgaaatatca

SEQ ID NO: 119457 - DNA, 21 bp, Artificial sequence
  SiRNA target sequence
atgttactattgaaatatcag

SEQ ID NO: 119458 - DNA, 21 bp, Artificial sequence
  SiRNA target sequence
tgttactattgaaatatcagt

SEQ ID NO: 119459 - DNA, 21 bp, Artificial sequence
  SiRNA target sequence
gttactattgaaatatcagtc

SEQ ID NO: 119460 - DNA, 21 bp, Artificial sequence
  SiRNA target sequence
ttactattgaaatatcagtca

SEQ ID NO: 119461 - DNA, 21 bp, Artificial sequence
  SiRNA target sequence
tactattgaaatatcagtcaa

SEQ ID NO: 119462 - DNA, 21 bp, Artificial sequence
  SiRNA target sequence
actattgaaatatcagtcaaa

SEQ ID NO: 119463 - DNA, 21 bp, Artificial sequence
  SiRNA target sequence
ctattgaaatatcagtcaaaa

SEQ ID NO: 119464 - DNA, 21 bp, Artificial sequence
  SiRNA target sequence
tattgaaatatcagtcaaaaa

SEQ ID NO: 119465 - DNA, 21 bp, Artificial sequence
  SiRNA target sequence
attgaaatatcagtcaaaaaa

SEQ ID NO: 119466 - DNA, 21 bp, Artificial sequence
  SiRNA target sequence
ttgaaatatcagtcaaaaaaa

SEQ ID NO: 119467 - DNA, 21 bp, Artificial sequence
  SiRNA target sequence
tgaaatatcagtcaaaaaaac

SEQ ID NO: 119468 - DNA, 21 bp, Artificial sequence
  SiRNA target sequence
gaaatatcagtcaaaaaaaca

SEQ ID NO: 119469 - DNA, 21 bp, Artificial sequence
  SiRNA target sequence
aaatatcagtcaaaaaaacac

SEQ ID NO: 119470 - DNA, 21 bp, Artificial sequence
  SiRNA target sequence
aatatcagtcaaaaaaacaca

SEQ ID NO: 119471 - DNA, 21 bp, Artificial sequence
  SiRNA target sequence
atatcagtcaaaaaaacacaa

SEQ ID NO: 119472 - DNA, 21 bp, Artificial sequence
  SiRNA target sequence
tatcagtcaaaaaaacacaaa

SEQ ID NO: 119473 - DNA, 21 bp, Artificial sequence
  SiRNA target sequence
atcagtcaaaaaaacacaaaa

SEQ ID NO: 119474 - DNA, 21 bp, Artificial sequence
  SiRNA target sequence
tcagtcaaaaaaacacaaaag

SEQ ID NO: 119475 - DNA, 21 bp, Artificial sequence
  SiRNA target sequence
cagtcaaaaaaacacaaaagt

SEQ ID NO: 119476 - DNA, 21 bp, Artificial sequence
  SiRNA target sequence
agtcaaaaaaacacaaaagtt

SEQ ID NO: 119477 - DNA, 21 bp, Artificial sequence
  SiRNA target sequence
gtcaaaaaaacacaaaagtta

SEQ ID NO: 119478 - DNA, 21 bp, Artificial sequence
  SiRNA target sequence
tcaaaaaaacacaaaagttag

SEQ ID NO: 119479 - DNA, 21 bp, Artificial sequence
  SiRNA target sequence
caaaaaaacacaaaagttagt

SEQ ID NO: 119480 - DNA, 21 bp, Artificial sequence
  SiRNA target sequence
aaaaaaacacaaaagttagtg

SEQ ID NO: 119481 - DNA, 21 bp, Artificial sequence
  SiRNA target sequence
aaaaaacacaaaagttagtga

SEQ ID NO: 119482 - DNA, 21 bp, Artificial sequence
  SiRNA target sequence
aaaaacacaaaagttagtgat

SEQ ID NO: 119483 - DNA, 21 bp, Artificial sequence
  SiRNA target sequence
aaaacacaaaagttagtgata

SEQ ID NO: 119484 - DNA, 21 bp, Artificial sequence
  SiRNA target sequence
aaacacaaaagttagtgatag

SEQ ID NO: 119485 - DNA, 21 bp, Artificial sequence
  SiRNA target sequence
aacacaaaagttagtgatagt

SEQ ID NO: 119486 - DNA, 21 bp, Artificial sequence
  SiRNA target sequence
acacaaaagttagtgatagtt

SEQ ID NO: 119487 - DNA, 21 bp, Artificial sequence
  SiRNA target sequence
cacaaaagttagtgatagttg

SEQ ID NO: 119488 - DNA, 21 bp, Artificial sequence
  SiRNA target sequence
acaaaagttagtgatagttga

SEQ ID NO: 119489 - DNA, 21 bp, Artificial sequence
  SiRNA target sequence
caaaagttagtgatagttgat

SEQ ID NO: 119490 - DNA, 21 bp, Artificial sequence
  SiRNA target sequence
aaaagttagtgatagttgatt

SEQ ID NO: 119491 - DNA, 21 bp, Artificial sequence
  SiRNA target sequence
aaagttagtgatagttgattt

SEQ ID NO: 119492 - DNA, 21 bp, Artificial sequence
  SiRNA target sequence
aagttagtgatagttgatttt

SEQ ID NO: 119493 - DNA, 21 bp, Artificial sequence
  SiRNA target sequence
agttagtgatagttgattttg

SEQ ID NO: 119494 - DNA, 21 bp, Artificial sequence
  SiRNA target sequence
gttagtgatagttgattttgc

SEQ ID NO: 119495 - DNA, 21 bp, Artificial sequence
  SiRNA target sequence
ttagtgatagttgattttgca

SEQ ID NO: 119496 - DNA, 21 bp, Artificial sequence
  SiRNA target sequence
tagtgatagttgattttgcat

SEQ ID NO: 119497 - DNA, 21 bp, Artificial sequence
  SiRNA target sequence
agtgatagttgattttgcata

SEQ ID NO: 119498 - DNA, 21 bp, Artificial sequence
  SiRNA target sequence
gtgatagttgattttgcatat

SEQ ID NO: 119499 - DNA, 21 bp, Artificial sequence
  SiRNA target sequence
tgatagttgattttgcatatc

SEQ ID NO: 119500 - DNA, 21 bp, Artificial sequence
  SiRNA target sequence
gatagttgattttgcatatcc

SEQ ID NO: 119501 - DNA, 21 bp, Artificial sequence
  SiRNA target sequence
atagttgattttgcatatcct

SEQ ID NO: 119502 - DNA, 21 bp, Artificial sequence
  SiRNA target sequence
tagttgattttgcatatccta

SEQ ID NO: 119503 - DNA, 21 bp, Artificial sequence
  SiRNA target sequence
agttgattttgcatatcctac

SEQ ID NO: 119504 - DNA, 21 bp, Artificial sequence
  SiRNA target sequence
gttgattttgcatatcctact

SEQ ID NO: 119505 - DNA, 21 bp, Artificial sequence
  SiRNA target sequence
ttgattttgcatatcctactt

SEQ ID NO: 119506 - DNA, 21 bp, Artificial sequence
  SiRNA target sequence
tgattttgcatatcctacttt

SEQ ID NO: 119507 - DNA, 21 bp, Artificial sequence
  SiRNA target sequence
gattttgcatatcctactttc

SEQ ID NO: 119508 - DNA, 21 bp, Artificial sequence
  SiRNA target sequence
attttgcatatcctactttca

SEQ ID NO: 119509 - DNA, 21 bp, Artificial sequence
  SiRNA target sequence
ttttgcatatcctactttcaa

SEQ ID NO: 119510 - DNA, 21 bp, Artificial sequence
  SiRNA target sequence
tttgcatatcctactttcaat

SEQ ID NO: 119511 - DNA, 21 bp, Artificial sequence
  SiRNA target sequence
ttgcatatcctactttcaata

SEQ ID NO: 119512 - DNA, 21 bp, Artificial sequence
  SiRNA target sequence
tgcatatcctactttcaatat

SEQ ID NO: 119513 - DNA, 21 bp, Artificial sequence
  SiRNA target sequence
gcatatcctactttcaatatt

SEQ ID NO: 119514 - DNA, 21 bp, Artificial sequence
  SiRNA target sequence
catatcctactttcaatattg

SEQ ID NO: 119515 - DNA, 21 bp, Artificial sequence
  SiRNA target sequence
atatcctactttcaatattgc

SEQ ID NO: 119516 - DNA, 21 bp, Artificial sequence
  SiRNA target sequence
tatcctactttcaatattgcg

SEQ ID NO: 119517 - DNA, 21 bp, Artificial sequence
  SiRNA target sequence
atcctactttcaatattgcga

SEQ ID NO: 119518 - DNA, 21 bp, Artificial sequence
  SiRNA target sequence
tcctactttcaatattgcgag

SEQ ID NO: 119519 - DNA, 21 bp, Artificial sequence
  SiRNA target sequence
cctactttcaatattgcgagt

SEQ ID NO: 119520 - DNA, 21 bp, Artificial sequence
  SiRNA target sequence
ctactttcaatattgcgagtg

SEQ ID NO: 119521 - DNA, 21 bp, Artificial sequence
  SiRNA target sequence
tactttcaatattgcgagtga

SEQ ID NO: 119522 - DNA, 21 bp, Artificial sequence
  SiRNA target sequence
actttcaatattgcgagtgaa

SEQ ID NO: 119523 - DNA, 21 bp, Artificial sequence
  SiRNA target sequence
ctttcaatattgcgagtgaaa

SEQ ID NO: 119524 - DNA, 21 bp, Artificial sequence
  SiRNA target sequence
tttcaatattgcgagtgaaat

SEQ ID NO: 119525 - DNA, 21 bp, Artificial sequence
  SiRNA target sequence
ttcaatattgcgagtgaaata

SEQ ID NO: 119526 - DNA, 21 bp, Artificial sequence
  SiRNA target sequence
tcaatattgcgagtgaaatag

SEQ ID NO: 119527 - DNA, 21 bp, Artificial sequence
  SiRNA target sequence
caatattgcgagtgaaatagc

SEQ ID NO: 119528 - DNA, 21 bp, Artificial sequence
  SiRNA target sequence
aatattgcgagtgaaatagct

SEQ ID NO: 119529 - DNA, 21 bp, Artificial sequence
  SiRNA target sequence
atattgcgagtgaaatagctg

SEQ ID NO: 119530 - DNA, 21 bp, Artificial sequence
  SiRNA target sequence
tattgcgagtgaaatagctgc

SEQ ID NO: 119531 - DNA, 21 bp, Artificial sequence
  SiRNA target sequence
attgcgagtgaaatagctgcg

SEQ ID NO: 119532 - DNA, 21 bp, Artificial sequence
  SiRNA target sequence
ttgcgagtgaaatagctgcgc

SEQ ID NO: 119533 - DNA, 21 bp, Artificial sequence
  SiRNA target sequence
tgcgagtgaaatagctgcgca

SEQ ID NO: 119534 - DNA, 21 bp, Artificial sequence
  SiRNA target sequence
gcgagtgaaatagctgcgcac

SEQ ID NO: 119535 - DNA, 21 bp, Artificial sequence
  SiRNA target sequence
cgagtgaaatagctgcgcact

SEQ ID NO: 119536 - DNA, 21 bp, Artificial sequence
  SiRNA target sequence
gagtgaaatagctgcgcactt

SEQ ID NO: 119537 - DNA, 21 bp, Artificial sequence
  SiRNA target sequence
agtgaaatagctgcgcacttt

SEQ ID NO: 119538 - DNA, 21 bp, Artificial sequence
  SiRNA target sequence
gtgaaatagctgcgcactttt

SEQ ID NO: 119539 - DNA, 21 bp, Artificial sequence
  SiRNA target sequence
tgaaatagctgcgcactttta

SEQ ID NO: 119540 - DNA, 21 bp, Artificial sequence
  SiRNA target sequence
gaaatagctgcgcacttttac

SEQ ID NO: 119541 - DNA, 21 bp, Artificial sequence
  SiRNA target sequence
aaatagctgcgcacttttacg

SEQ ID NO: 119542 - DNA, 21 bp, Artificial sequence
  SiRNA target sequence
aatagctgcgcacttttacga

SEQ ID NO: 119543 - DNA, 21 bp, Artificial sequence
  SiRNA target sequence
atagctgcgcacttttacgaa

SEQ ID NO: 119544 - DNA, 21 bp, Artificial sequence
  SiRNA target sequence
tagctgcgcacttttacgaaa

SEQ ID NO: 119545 - DNA, 21 bp, Artificial sequence
  SiRNA target sequence
agctgcgcacttttacgaaaa

SEQ ID NO: 119546 - DNA, 21 bp, Artificial sequence
  SiRNA target sequence
gctgcgcacttttacgaaaaa

SEQ ID NO: 119547 - DNA, 21 bp, Artificial sequence
  SiRNA target sequence
ctgcgcacttttacgaaaaat

SEQ ID NO: 119548 - DNA, 21 bp, Artificial sequence
  SiRNA target sequence
tgcgcacttttacgaaaaatt

SEQ ID NO: 119549 - DNA, 21 bp, Artificial sequence
  SiRNA target sequence
gcgcacttttacgaaaaattt

SEQ ID NO: 119550 - DNA, 21 bp, Artificial sequence
  SiRNA target sequence
cgcacttttacgaaaaattta

SEQ ID NO: 119551 - DNA, 21 bp, Artificial sequence
  SiRNA target sequence
gcacttttacgaaaaatttaa

SEQ ID NO: 119552 - DNA, 21 bp, Artificial sequence
  SiRNA target sequence
cacttttacgaaaaatttaaa

SEQ ID NO: 119553 - DNA, 21 bp, Artificial sequence
  SiRNA target sequence
acttttacgaaaaatttaaag

SEQ ID NO: 119554 - DNA, 21 bp, Artificial sequence
  SiRNA target sequence
cttttacgaaaaatttaaaga

SEQ ID NO: 119555 - DNA, 21 bp, Artificial sequence
  SiRNA target sequence
ttttacgaaaaatttaaagat

SEQ ID NO: 119556 - DNA, 21 bp, Artificial sequence
  SiRNA target sequence
tttacgaaaaatttaaagata

SEQ ID NO: 119557 - DNA, 21 bp, Artificial sequence
  SiRNA target sequence
ttacgaaaaatttaaagatat

SEQ ID NO: 119558 - DNA, 21 bp, Artificial sequence
  SiRNA target sequence
tacgaaaaatttaaagatata

SEQ ID NO: 119559 - DNA, 21 bp, Artificial sequence
  SiRNA target sequence
acgaaaaatttaaagatataa

SEQ ID NO: 119560 - DNA, 21 bp, Artificial sequence
  SiRNA target sequence
cgaaaaatttaaagatataaa

SEQ ID NO: 119561 - DNA, 21 bp, Artificial sequence
  SiRNA target sequence
gaaaaatttaaagatataaaa

SEQ ID NO: 119562 - DNA, 21 bp, Artificial sequence
  SiRNA target sequence
aaaaatttaaagatataaaaa

SEQ ID NO: 119563 - DNA, 21 bp, Artificial sequence
  SiRNA target sequence
aaaatttaaagatataaaaat

SEQ ID NO: 119564 - DNA, 21 bp, Artificial sequence
  SiRNA target sequence
aaatttaaagatataaaaatt

SEQ ID NO: 119565 - DNA, 21 bp, Artificial sequence
  SiRNA target sequence
aatttaaagatataaaaatta

SEQ ID NO: 119566 - DNA, 21 bp, Artificial sequence
  SiRNA target sequence
atttaaagatataaaaattat

SEQ ID NO: 119567 - DNA, 21 bp, Artificial sequence
  SiRNA target sequence
tttaaagatataaaaattatg

SEQ ID NO: 119568 - DNA, 21 bp, Artificial sequence
  SiRNA target sequence
ttaaagatataaaaattatgc

SEQ ID NO: 119569 - DNA, 21 bp, Artificial sequence
  SiRNA target sequence
taaagatataaaaattatgcg

SEQ ID NO: 119570 - DNA, 21 bp, Artificial sequence
  SiRNA target sequence
aaagatataaaaattatgcgt

SEQ ID NO: 119571 - DNA, 21 bp, Artificial sequence
  SiRNA target sequence
aagatataaaaattatgcgtg

SEQ ID NO: 119572 - DNA, 21 bp, Artificial sequence
  SiRNA target sequence
agatataaaaattatgcgtgt

SEQ ID NO: 119573 - DNA, 21 bp, Artificial sequence
  SiRNA target sequence
gatataaaaattatgcgtgtt

SEQ ID NO: 119574 - DNA, 21 bp, Artificial sequence
  SiRNA target sequence
atataaaaattatgcgtgttc

SEQ ID NO: 119575 - DNA, 21 bp, Artificial sequence
  SiRNA target sequence
tataaaaattatgcgtgttct

SEQ ID NO: 119576 - DNA, 21 bp, Artificial sequence
  SiRNA target sequence
ataaaaattatgcgtgttctt

SEQ ID NO: 119577 - DNA, 21 bp, Artificial sequence
  SiRNA target sequence
taaaaattatgcgtgttcttg

SEQ ID NO: 119578 - DNA, 21 bp, Artificial sequence
  SiRNA target sequence
aaaaattatgcgtgttcttgc

SEQ ID NO: 119579 - DNA, 21 bp, Artificial sequence
  SiRNA target sequence
aaaattatgcgtgttcttgcg

SEQ ID NO: 119580 - DNA, 21 bp, Artificial sequence
  SiRNA target sequence
aaattatgcgtgttcttgcgc

SEQ ID NO: 119581 - DNA, 21 bp, Artificial sequence
  SiRNA target sequence
aattatgcgtgttcttgcgca

SEQ ID NO: 119582 - DNA, 21 bp, Artificial sequence
  SiRNA target sequence
attatgcgtgttcttgcgcaa

SEQ ID NO: 119583 - DNA, 21 bp, Artificial sequence
  SiRNA target sequence
ttatgcgtgttcttgcgcaag

SEQ ID NO: 119584 - DNA, 21 bp, Artificial sequence
  SiRNA target sequence
tatgcgtgttcttgcgcaaga

SEQ ID NO: 119585 - DNA, 21 bp, Artificial sequence
  SiRNA target sequence
atgcgtgttcttgcgcaagat

SEQ ID NO: 119586 - DNA, 21 bp, Artificial sequence
  SiRNA target sequence
tgcgtgttcttgcgcaagata

SEQ ID NO: 119587 - DNA, 21 bp, Artificial sequence
  SiRNA target sequence
gcgtgttcttgcgcaagatat

SEQ ID NO: 119588 - DNA, 21 bp, Artificial sequence
  SiRNA target sequence
cgtgttcttgcgcaagatatt

SEQ ID NO: 119589 - DNA, 21 bp, Artificial sequence
  SiRNA target sequence
gtgttcttgcgcaagatattc

SEQ ID NO: 119590 - DNA, 21 bp, Artificial sequence
  SiRNA target sequence
tgttcttgcgcaagatattcc

SEQ ID NO: 119591 - DNA, 21 bp, Artificial sequence
  SiRNA target sequence
gttcttgcgcaagatattcct

SEQ ID NO: 119592 - DNA, 21 bp, Artificial sequence
  SiRNA target sequence
ttcttgcgcaagatattccta

SEQ ID NO: 119593 - DNA, 21 bp, Artificial sequence
  SiRNA target sequence
tcttgcgcaagatattcctac

SEQ ID NO: 119594 - DNA, 21 bp, Artificial sequence
  SiRNA target sequence
cttgcgcaagatattcctaca

SEQ ID NO: 119595 - DNA, 21 bp, Artificial sequence
  SiRNA target sequence
ttgcgcaagatattcctacac

SEQ ID NO: 119596 - DNA, 21 bp, Artificial sequence
  SiRNA target sequence
tgcgcaagatattcctacacc

SEQ ID NO: 119597 - DNA, 21 bp, Artificial sequence
  SiRNA target sequence
gcgcaagatattcctacaccg

SEQ ID NO: 119598 - DNA, 21 bp, Artificial sequence
  SiRNA target sequence
cgcaagatattcctacaccgt

SEQ ID NO: 119599 - DNA, 21 bp, Artificial sequence
  SiRNA target sequence
gcaagatattcctacaccgta

SEQ ID NO: 119600 - DNA, 21 bp, Artificial sequence
  SiRNA target sequence
caagatattcctacaccgtat

SEQ ID NO: 119601 - DNA, 21 bp, Artificial sequence
  SiRNA target sequence
aagatattcctacaccgtatg

SEQ ID NO: 119602 - DNA, 21 bp, Artificial sequence
  SiRNA target sequence
agatattcctacaccgtatgc

SEQ ID NO: 119603 - DNA, 21 bp, Artificial sequence
  SiRNA target sequence
gatattcctacaccgtatgca

SEQ ID NO: 119604 - DNA, 21 bp, Artificial sequence
  SiRNA target sequence
atattcctacaccgtatgcac

SEQ ID NO: 119605 - DNA, 21 bp, Artificial sequence
  SiRNA target sequence
tattcctacaccgtatgcact

SEQ ID NO: 119606 - DNA, 21 bp, Artificial sequence
  SiRNA target sequence
attcctacaccgtatgcactt

SEQ ID NO: 119607 - DNA, 21 bp, Artificial sequence
  SiRNA target sequence
ttcctacaccgtatgcactta

SEQ ID NO: 119608 - DNA, 21 bp, Artificial sequence
  SiRNA target sequence
tcctacaccgtatgcacttaa

SEQ ID NO: 119609 - DNA, 21 bp, Artificial sequence
  SiRNA target sequence
cctacaccgtatgcacttaat

SEQ ID NO: 119610 - DNA, 21 bp, Artificial sequence
  SiRNA target sequence
ctacaccgtatgcacttaatc

SEQ ID NO: 119611 - DNA, 21 bp, Artificial sequence
  SiRNA target sequence
tacaccgtatgcacttaatct

SEQ ID NO: 119612 - DNA, 21 bp, Artificial sequence
  SiRNA target sequence
acaccgtatgcacttaatctt

SEQ ID NO: 119613 - DNA, 21 bp, Artificial sequence
  SiRNA target sequence
caccgtatgcacttaatcttg

SEQ ID NO: 119614 - DNA, 21 bp, Artificial sequence
  SiRNA target sequence
accgtatgcacttaatcttga

SEQ ID NO: 119615 - DNA, 21 bp, Artificial sequence
  SiRNA target sequence
ccgtatgcacttaatcttgaa

SEQ ID NO: 119616 - DNA, 21 bp, Artificial sequence
  SiRNA target sequence
cgtatgcacttaatcttgaaa

SEQ ID NO: 119617 - DNA, 21 bp, Artificial sequence
  SiRNA target sequence
gtatgcacttaatcttgaaaa

SEQ ID NO: 119618 - DNA, 21 bp, Artificial sequence
  SiRNA target sequence
tatgcacttaatcttgaaaaa

SEQ ID NO: 119619 - DNA, 21 bp, Artificial sequence
  SiRNA target sequence
atgcacttaatcttgaaaaaa

SEQ ID NO: 119620 - DNA, 21 bp, Artificial sequence
  SiRNA target sequence
tgcacttaatcttgaaaaaat

SEQ ID NO: 119621 - DNA, 21 bp, Artificial sequence
  SiRNA target sequence
gcacttaatcttgaaaaaatg

SEQ ID NO: 119622 - DNA, 21 bp, Artificial sequence
  SiRNA target sequence
cacttaatcttgaaaaaatgt

SEQ ID NO: 119623 - DNA, 21 bp, Artificial sequence
  SiRNA target sequence
acttaatcttgaaaaaatgtc

SEQ ID NO: 119624 - DNA, 21 bp, Artificial sequence
  SiRNA target sequence
cttaatcttgaaaaaatgtct

SEQ ID NO: 119625 - DNA, 21 bp, Artificial sequence
  SiRNA target sequence
ttaatcttgaaaaaatgtctt

SEQ ID NO: 119626 - DNA, 21 bp, Artificial sequence
  SiRNA target sequence
taatcttgaaaaaatgtctta

SEQ ID NO: 119627 - DNA, 21 bp, Artificial sequence
  SiRNA target sequence
aatcttgaaaaaatgtcttat

SEQ ID NO: 119628 - DNA, 21 bp, Artificial sequence
  SiRNA target sequence
atcttgaaaaaatgtcttatc

SEQ ID NO: 119629 - DNA, 21 bp, Artificial sequence
  SiRNA target sequence
tcttgaaaaaatgtcttatcc

SEQ ID NO: 119630 - DNA, 21 bp, Artificial sequence
  SiRNA target sequence
cttgaaaaaatgtcttatccg

SEQ ID NO: 119631 - DNA, 21 bp, Artificial sequence
  SiRNA target sequence
ttgaaaaaatgtcttatccga

SEQ ID NO: 119632 - DNA, 21 bp, Artificial sequence
  SiRNA target sequence
tgaaaaaatgtcttatccgac

SEQ ID NO: 119633 - DNA, 21 bp, Artificial sequence
  SiRNA target sequence
gaaaaaatgtcttatccgaca

SEQ ID NO: 119634 - DNA, 21 bp, Artificial sequence
  SiRNA target sequence
aaaaaatgtcttatccgacat

SEQ ID NO: 119635 - DNA, 21 bp, Artificial sequence
  SiRNA target sequence
aaaaatgtcttatccgacatg

SEQ ID NO: 119636 - DNA, 21 bp, Artificial sequence
  SiRNA target sequence
aaaatgtcttatccgacatgc

SEQ ID NO: 119637 - DNA, 21 bp, Artificial sequence
  SiRNA target sequence
aaatgtcttatccgacatgca

SEQ ID NO: 119638 - DNA, 21 bp, Artificial sequence
  SiRNA target sequence
aatgtcttatccgacatgcaa

SEQ ID NO: 119639 - DNA, 21 bp, Artificial sequence
  SiRNA target sequence
atgtcttatccgacatgcaat

SEQ ID NO: 119640 - DNA, 21 bp, Artificial sequence
  SiRNA target sequence
tgtcttatccgacatgcaatg

SEQ ID NO: 119641 - DNA, 21 bp, Artificial sequence
  SiRNA target sequence
gtcttatccgacatgcaatga

SEQ ID NO: 119642 - DNA, 21 bp, Artificial sequence
  SiRNA target sequence
tcttatccgacatgcaatgat

SEQ ID NO: 119643 - DNA, 21 bp, Artificial sequence
  SiRNA target sequence
cttatccgacatgcaatgata

SEQ ID NO: 119644 - DNA, 21 bp, Artificial sequence
  SiRNA target sequence
ttatccgacatgcaatgatat

SEQ ID NO: 119645 - DNA, 21 bp, Artificial sequence
  SiRNA target sequence
tatccgacatgcaatgatatt

SEQ ID NO: 119646 - DNA, 21 bp, Artificial sequence
  SiRNA target sequence
atccgacatgcaatgatattg

SEQ ID NO: 119647 - DNA, 21 bp, Artificial sequence
  SiRNA target sequence
tccgacatgcaatgatattgt

SEQ ID NO: 119648 - DNA, 21 bp, Artificial sequence
  SiRNA target sequence
ccgacatgcaatgatattgta

SEQ ID NO: 119649 - DNA, 21 bp, Artificial sequence
  SiRNA target sequence
cgacatgcaatgatattgtaa

SEQ ID NO: 119650 - DNA, 21 bp, Artificial sequence
  SiRNA target sequence
gacatgcaatgatattgtaaa

SEQ ID NO: 119651 - DNA, 21 bp, Artificial sequence
  SiRNA target sequence
acatgcaatgatattgtaaat

SEQ ID NO: 119652 - DNA, 21 bp, Artificial sequence
  SiRNA target sequence
catgcaatgatattgtaaatg

SEQ ID NO: 119653 - DNA, 21 bp, Artificial sequence
  SiRNA target sequence
atgcaatgatattgtaaatgc

SEQ ID NO: 119654 - DNA, 21 bp, Artificial sequence
  SiRNA target sequence
tgcaatgatattgtaaatgct

SEQ ID NO: 119655 - DNA, 21 bp, Artificial sequence
  SiRNA target sequence
gcaatgatattgtaaatgctg

SEQ ID NO: 119656 - DNA, 21 bp, Artificial sequence
  SiRNA target sequence
caatgatattgtaaatgctgt

SEQ ID NO: 119657 - DNA, 21 bp, Artificial sequence
  SiRNA target sequence
aatgatattgtaaatgctgtt

SEQ ID NO: 119658 - DNA, 21 bp, Artificial sequence
  SiRNA target sequence
atgatattgtaaatgctgtta

SEQ ID NO: 119659 - DNA, 21 bp, Artificial sequence
  SiRNA target sequence
tgatattgtaaatgctgttac

SEQ ID NO: 119660 - DNA, 21 bp, Artificial sequence
  SiRNA target sequence
gatattgtaaatgctgttaca

SEQ ID NO: 119661 - DNA, 21 bp, Artificial sequence
  SiRNA target sequence
atattgtaaatgctgttacaa

SEQ ID NO: 119662 - DNA, 21 bp, Artificial sequence
  SiRNA target sequence
tattgtaaatgctgttacaaa

SEQ ID NO: 119663 - DNA, 21 bp, Artificial sequence
  SiRNA target sequence
attgtaaatgctgttacaaaa

SEQ ID NO: 119664 - DNA, 21 bp, Artificial sequence
  SiRNA target sequence
ttgtaaatgctgttacaaaaa

SEQ ID NO: 119665 - DNA, 21 bp, Artificial sequence
  SiRNA target sequence
tgtaaatgctgttacaaaaat

SEQ ID NO: 119666 - DNA, 21 bp, Artificial sequence
  SiRNA target sequence
gtaaatgctgttacaaaaata

SEQ ID NO: 119667 - DNA, 21 bp, Artificial sequence
  SiRNA target sequence
taaatgctgttacaaaaataa

SEQ ID NO: 119668 - DNA, 21 bp, Artificial sequence
  SiRNA target sequence
aaatgctgttacaaaaataaa

SEQ ID NO: 119669 - DNA, 21 bp, Artificial sequence
  SiRNA target sequence
aatgctgttacaaaaataaat

SEQ ID NO: 119670 - DNA, 21 bp, Artificial sequence
  SiRNA target sequence
atgctgttacaaaaataaatt

SEQ ID NO: 119671 - DNA, 21 bp, Artificial sequence
  SiRNA target sequence
tgctgttacaaaaataaattc

SEQ ID NO: 119672 - DNA, 21 bp, Artificial sequence
  SiRNA target sequence
gctgttacaaaaataaattca

SEQ ID NO: 119673 - DNA, 21 bp, Artificial sequence
  SiRNA target sequence
ctgttacaaaaataaattcat

SEQ ID NO: 119674 - DNA, 21 bp, Artificial sequence
  SiRNA target sequence
tgttacaaaaataaattcata

SEQ ID NO: 119675 - DNA, 21 bp, Artificial sequence
  SiRNA target sequence
gttacaaaaataaattcatag

SEQ ID NO: 119676 - DNA, 22 bp, Artificial sequence
  SiRNA target sequence
atgatagaaattcgcgatctta

SEQ ID NO: 119677 - DNA, 22 bp, Artificial sequence
  SiRNA target sequence
tgatagaaattcgcgatcttat

SEQ ID NO: 119678 - DNA, 22 bp, Artificial sequence
  SiRNA target sequence
gatagaaattcgcgatcttata

SEQ ID NO: 119679 - DNA, 22 bp, Artificial sequence
  SiRNA target sequence
atagaaattcgcgatcttataa

SEQ ID NO: 119680 - DNA, 22 bp, Artificial sequence
  SiRNA target sequence
tagaaattcgcgatcttataaa

SEQ ID NO: 119681 - DNA, 22 bp, Artificial sequence
  SiRNA target sequence
agaaattcgcgatcttataaat

SEQ ID NO: 119682 - DNA, 22 bp, Artificial sequence
  SiRNA target sequence
gaaattcgcgatcttataaatc

SEQ ID NO: 119683 - DNA, 22 bp, Artificial sequence
  SiRNA target sequence
aaattcgcgatcttataaatca

SEQ ID NO: 119684 - DNA, 22 bp, Artificial sequence
  SiRNA target sequence
aattcgcgatcttataaatcaa

SEQ ID NO: 119685 - DNA, 22 bp, Artificial sequence
  SiRNA target sequence
attcgcgatcttataaatcaag

SEQ ID NO: 119686 - DNA, 22 bp, Artificial sequence
  SiRNA target sequence
ttcgcgatcttataaatcaagc

SEQ ID NO: 119687 - DNA, 22 bp, Artificial sequence
  SiRNA target sequence
tcgcgatcttataaatcaagca

SEQ ID NO: 119688 - DNA, 22 bp, Artificial sequence
  SiRNA target sequence
cgcgatcttataaatcaagcat

SEQ ID NO: 119689 - DNA, 22 bp, Artificial sequence
  SiRNA target sequence
gcgatcttataaatcaagcatt

SEQ ID NO: 119690 - DNA, 22 bp, Artificial sequence
  SiRNA target sequence
cgatcttataaatcaagcattg

SEQ ID NO: 119691 - DNA, 22 bp, Artificial sequence
  SiRNA target sequence
gatcttataaatcaagcattgg

SEQ ID NO: 119692 - DNA, 22 bp, Artificial sequence
  SiRNA target sequence
atcttataaatcaagcattgga

SEQ ID NO: 119693 - DNA, 22 bp, Artificial sequence
  SiRNA target sequence
tcttataaatcaagcattggat

SEQ ID NO: 119694 - DNA, 22 bp, Artificial sequence
  SiRNA target sequence
cttataaatcaagcattggatg

SEQ ID NO: 119695 - DNA, 22 bp, Artificial sequence
  SiRNA target sequence
ttataaatcaagcattggatga

SEQ ID NO: 119696 - DNA, 22 bp, Artificial sequence
  SiRNA target sequence
tataaatcaagcattggatgag

SEQ ID NO: 119697 - DNA, 22 bp, Artificial sequence
  SiRNA target sequence
ataaatcaagcattggatgagg

SEQ ID NO: 119698 - DNA, 22 bp, Artificial sequence
  SiRNA target sequence
taaatcaagcattggatgagga

SEQ ID NO: 119699 - DNA, 22 bp, Artificial sequence
  SiRNA target sequence
aaatcaagcattggatgaggaa

SEQ ID NO: 119700 - DNA, 22 bp, Artificial sequence
  SiRNA target sequence
aatcaagcattggatgaggaaa

SEQ ID NO: 119701 - DNA, 22 bp, Artificial sequence
  SiRNA target sequence
atcaagcattggatgaggaaat

SEQ ID NO: 119702 - DNA, 22 bp, Artificial sequence
  SiRNA target sequence
tcaagcattggatgaggaaatg

SEQ ID NO: 119703 - DNA, 22 bp, Artificial sequence
  SiRNA target sequence
caagcattggatgaggaaatgg

SEQ ID NO: 119704 - DNA, 22 bp, Artificial sequence
  SiRNA target sequence
aagcattggatgaggaaatggg

SEQ ID NO: 119705 - DNA, 22 bp, Artificial sequence
  SiRNA target sequence
agcattggatgaggaaatggga

SEQ ID NO: 119706 - DNA, 22 bp, Artificial sequence
  SiRNA target sequence
gcattggatgaggaaatgggaa

SEQ ID NO: 119707 - DNA, 22 bp, Artificial sequence
  SiRNA target sequence
cattggatgaggaaatgggaat

SEQ ID NO: 119708 - DNA, 22 bp, Artificial sequence
  SiRNA target sequence
attggatgaggaaatgggaatg

SEQ ID NO: 119709 - DNA, 22 bp, Artificial sequence
  SiRNA target sequence
ttggatgaggaaatgggaatgg

SEQ ID NO: 119710 - DNA, 22 bp, Artificial sequence
  SiRNA target sequence
tggatgaggaaatgggaatgga

SEQ ID NO: 119711 - DNA, 22 bp, Artificial sequence
  SiRNA target sequence
ggatgaggaaatgggaatggat

SEQ ID NO: 119712 - DNA, 22 bp, Artificial sequence
  SiRNA target sequence
gatgaggaaatgggaatggatc

SEQ ID NO: 119713 - DNA, 22 bp, Artificial sequence
  SiRNA target sequence
atgaggaaatgggaatggatca

SEQ ID NO: 119714 - DNA, 22 bp, Artificial sequence
  SiRNA target sequence
tgaggaaatgggaatggatcat

SEQ ID NO: 119715 - DNA, 22 bp, Artificial sequence
  SiRNA target sequence
gaggaaatgggaatggatcata

SEQ ID NO: 119716 - DNA, 22 bp, Artificial sequence
  SiRNA target sequence
aggaaatgggaatggatcataa

SEQ ID NO: 119717 - DNA, 22 bp, Artificial sequence
  SiRNA target sequence
ggaaatgggaatggatcataat

SEQ ID NO: 119718 - DNA, 22 bp, Artificial sequence
  SiRNA target sequence
gaaatgggaatggatcataatg

SEQ ID NO: 119719 - DNA, 22 bp, Artificial sequence
  SiRNA target sequence
aaatgggaatggatcataatgt

SEQ ID NO: 119720 - DNA, 22 bp, Artificial sequence
  SiRNA target sequence
aatgggaatggatcataatgta

SEQ ID NO: 119721 - DNA, 22 bp, Artificial sequence
  SiRNA target sequence
atgggaatggatcataatgtat

SEQ ID NO: 119722 - DNA, 22 bp, Artificial sequence
  SiRNA target sequence
tgggaatggatcataatgtata

SEQ ID NO: 119723 - DNA, 22 bp, Artificial sequence
  SiRNA target sequence
gggaatggatcataatgtatat

SEQ ID NO: 119724 - DNA, 22 bp, Artificial sequence
  SiRNA target sequence
ggaatggatcataatgtatata

SEQ ID NO: 119725 - DNA, 22 bp, Artificial sequence
  SiRNA target sequence
gaatggatcataatgtatatat

SEQ ID NO: 119726 - DNA, 22 bp, Artificial sequence
  SiRNA target sequence
aatggatcataatgtatatata

SEQ ID NO: 119727 - DNA, 22 bp, Artificial sequence
  SiRNA target sequence
atggatcataatgtatatataa

SEQ ID NO: 119728 - DNA, 22 bp, Artificial sequence
  SiRNA target sequence
tggatcataatgtatatataat

SEQ ID NO: 119729 - DNA, 22 bp, Artificial sequence
  SiRNA target sequence
ggatcataatgtatatataata

SEQ ID NO: 119730 - DNA, 22 bp, Artificial sequence
  SiRNA target sequence
gatcataatgtatatataatag

SEQ ID NO: 119731 - DNA, 22 bp, Artificial sequence
  SiRNA target sequence
atcataatgtatatataatagg

SEQ ID NO: 119732 - DNA, 22 bp, Artificial sequence
  SiRNA target sequence
tcataatgtatatataatagga

SEQ ID NO: 119733 - DNA, 22 bp, Artificial sequence
  SiRNA target sequence
cataatgtatatataataggag

SEQ ID NO: 119734 - DNA, 22 bp, Artificial sequence
  SiRNA target sequence
ataatgtatatataataggaga

SEQ ID NO: 119735 - DNA, 22 bp, Artificial sequence
  SiRNA target sequence
taatgtatatataataggagaa

SEQ ID NO: 119736 - DNA, 22 bp, Artificial sequence
  SiRNA target sequence
aatgtatatataataggagaag

SEQ ID NO: 119737 - DNA, 22 bp, Artificial sequence
  SiRNA target sequence
atgtatatataataggagaaga

SEQ ID NO: 119738 - DNA, 22 bp, Artificial sequence
  SiRNA target sequence
tgtatatataataggagaagaa

SEQ ID NO: 119739 - DNA, 22 bp, Artificial sequence
  SiRNA target sequence
gtatatataataggagaagaag

SEQ ID NO: 119740 - DNA, 22 bp, Artificial sequence
  SiRNA target sequence
tatatataataggagaagaagt

SEQ ID NO: 119741 - DNA, 22 bp, Artificial sequence
  SiRNA target sequence
atatataataggagaagaagta

SEQ ID NO: 119742 - DNA, 22 bp, Artificial sequence
  SiRNA target sequence
tatataataggagaagaagtag

SEQ ID NO: 119743 - DNA, 22 bp, Artificial sequence
  SiRNA target sequence
atataataggagaagaagtagg

SEQ ID NO: 119744 - DNA, 22 bp, Artificial sequence
  SiRNA target sequence
tataataggagaagaagtaggc

SEQ ID NO: 119745 - DNA, 22 bp, Artificial sequence
  SiRNA target sequence
ataataggagaagaagtaggca

SEQ ID NO: 119746 - DNA, 22 bp, Artificial sequence
  SiRNA target sequence
taataggagaagaagtaggcat

SEQ ID NO: 119747 - DNA, 22 bp, Artificial sequence
  SiRNA target sequence
aataggagaagaagtaggcatc

SEQ ID NO: 119748 - DNA, 22 bp, Artificial sequence
  SiRNA target sequence
ataggagaagaagtaggcatct

SEQ ID NO: 119749 - DNA, 22 bp, Artificial sequence
  SiRNA target sequence
taggagaagaagtaggcatctc

SEQ ID NO: 119750 - DNA, 22 bp, Artificial sequence
  SiRNA target sequence
aggagaagaagtaggcatctct

SEQ ID NO: 119751 - DNA, 22 bp, Artificial sequence
  SiRNA target sequence
ggagaagaagtaggcatctctg

SEQ ID NO: 119752 - DNA, 22 bp, Artificial sequence
  SiRNA target sequence
gagaagaagtaggcatctctgg

SEQ ID NO: 119753 - DNA, 22 bp, Artificial sequence
  SiRNA target sequence
agaagaagtaggcatctctggt

SEQ ID NO: 119754 - DNA, 22 bp, Artificial sequence
  SiRNA target sequence
gaagaagtaggcatctctggtg

SEQ ID NO: 119755 - DNA, 22 bp, Artificial sequence
  SiRNA target sequence
aagaagtaggcatctctggtgg

SEQ ID NO: 119756 - DNA, 22 bp, Artificial sequence
  SiRNA target sequence
agaagtaggcatctctggtggt

SEQ ID NO: 119757 - DNA, 22 bp, Artificial sequence
  SiRNA target sequence
gaagtaggcatctctggtggtc

SEQ ID NO: 119758 - DNA, 22 bp, Artificial sequence
  SiRNA target sequence
aagtaggcatctctggtggtcc

SEQ ID NO: 119759 - DNA, 22 bp, Artificial sequence
  SiRNA target sequence
agtaggcatctctggtggtcct

SEQ ID NO: 119760 - DNA, 22 bp, Artificial sequence
  SiRNA target sequence
gtaggcatctctggtggtcctc

SEQ ID NO: 119761 - DNA, 22 bp, Artificial sequence
  SiRNA target sequence
taggcatctctggtggtcctca

SEQ ID NO: 119762 - DNA, 22 bp, Artificial sequence
  SiRNA target sequence
aggcatctctggtggtcctcac

SEQ ID NO: 119763 - DNA, 22 bp, Artificial sequence
  SiRNA target sequence
ggcatctctggtggtcctcacg

SEQ ID NO: 119764 - DNA, 22 bp, Artificial sequence
  SiRNA target sequence
gcatctctggtggtcctcacgg

SEQ ID NO: 119765 - DNA, 22 bp, Artificial sequence
  SiRNA target sequence
catctctggtggtcctcacggt

SEQ ID NO: 119766 - DNA, 22 bp, Artificial sequence
  SiRNA target sequence
atctctggtggtcctcacggtc

SEQ ID NO: 119767 - DNA, 22 bp, Artificial sequence
  SiRNA target sequence
tctctggtggtcctcacggtct

SEQ ID NO: 119768 - DNA, 22 bp, Artificial sequence
  SiRNA target sequence
ctctggtggtcctcacggtctt

SEQ ID NO: 119769 - DNA, 22 bp, Artificial sequence
  SiRNA target sequence
tctggtggtcctcacggtctta

SEQ ID NO: 119770 - DNA, 22 bp, Artificial sequence
  SiRNA target sequence
ctggtggtcctcacggtcttac

SEQ ID NO: 119771 - DNA, 22 bp, Artificial sequence
  SiRNA target sequence
tggtggtcctcacggtcttact

SEQ ID NO: 119772 - DNA, 22 bp, Artificial sequence
  SiRNA target sequence
ggtggtcctcacggtcttacta

SEQ ID NO: 119773 - DNA, 22 bp, Artificial sequence
  SiRNA target sequence
gtggtcctcacggtcttactaa

SEQ ID NO: 119774 - DNA, 22 bp, Artificial sequence
  SiRNA target sequence
tggtcctcacggtcttactaaa

SEQ ID NO: 119775 - DNA, 22 bp, Artificial sequence
  SiRNA target sequence
ggtcctcacggtcttactaaaa

SEQ ID NO: 119776 - DNA, 22 bp, Artificial sequence
  SiRNA target sequence
gtcctcacggtcttactaaaaa

SEQ ID NO: 119777 - DNA, 22 bp, Artificial sequence
  SiRNA target sequence
tcctcacggtcttactaaaaat

SEQ ID NO: 119778 - DNA, 22 bp, Artificial sequence
  SiRNA target sequence
cctcacggtcttactaaaaatt

SEQ ID NO: 119779 - DNA, 22 bp, Artificial sequence
  SiRNA target sequence
ctcacggtcttactaaaaattt

SEQ ID NO: 119780 - DNA, 22 bp, Artificial sequence
  SiRNA target sequence
tcacggtcttactaaaaatttg

SEQ ID NO: 119781 - DNA, 22 bp, Artificial sequence
  SiRNA target sequence
cacggtcttactaaaaatttga

SEQ ID NO: 119782 - DNA, 22 bp, Artificial sequence
  SiRNA target sequence
acggtcttactaaaaatttgat

SEQ ID NO: 119783 - DNA, 22 bp, Artificial sequence
  SiRNA target sequence
cggtcttactaaaaatttgatc

SEQ ID NO: 119784 - DNA, 22 bp, Artificial sequence
  SiRNA target sequence
ggtcttactaaaaatttgatca

SEQ ID NO: 119785 - DNA, 22 bp, Artificial sequence
  SiRNA target sequence
gtcttactaaaaatttgatcaa

SEQ ID NO: 119786 - DNA, 22 bp, Artificial sequence
  SiRNA target sequence
tcttactaaaaatttgatcaaa

SEQ ID NO: 119787 - DNA, 22 bp, Artificial sequence
  SiRNA target sequence
cttactaaaaatttgatcaaaa

SEQ ID NO: 119788 - DNA, 22 bp, Artificial sequence
  SiRNA target sequence
ttactaaaaatttgatcaaaaa

SEQ ID NO: 119789 - DNA, 22 bp, Artificial sequence
  SiRNA target sequence
tactaaaaatttgatcaaaaaa

SEQ ID NO: 119790 - DNA, 22 bp, Artificial sequence
  SiRNA target sequence
actaaaaatttgatcaaaaaat

SEQ ID NO: 119791 - DNA, 22 bp, Artificial sequence
  SiRNA target sequence
ctaaaaatttgatcaaaaaata

SEQ ID NO: 119792 - DNA, 22 bp, Artificial sequence
  SiRNA target sequence
taaaaatttgatcaaaaaatac

SEQ ID NO: 119793 - DNA, 22 bp, Artificial sequence
  SiRNA target sequence
aaaaatttgatcaaaaaatacg

SEQ ID NO: 119794 - DNA, 22 bp, Artificial sequence
  SiRNA target sequence
aaaatttgatcaaaaaatacgg

SEQ ID NO: 119795 - DNA, 22 bp, Artificial sequence
  SiRNA target sequence
aaatttgatcaaaaaatacggc

SEQ ID NO: 119796 - DNA, 22 bp, Artificial sequence
  SiRNA target sequence
aatttgatcaaaaaatacggcg

SEQ ID NO: 119797 - DNA, 22 bp, Artificial sequence
  SiRNA target sequence
atttgatcaaaaaatacggcga

SEQ ID NO: 119798 - DNA, 22 bp, Artificial sequence
  SiRNA target sequence
tttgatcaaaaaatacggcgat

SEQ ID NO: 119799 - DNA, 22 bp, Artificial sequence
  SiRNA target sequence
ttgatcaaaaaatacggcgatc

SEQ ID NO: 119800 - DNA, 22 bp, Artificial sequence
  SiRNA target sequence
tgatcaaaaaatacggcgatca

SEQ ID NO: 119801 - DNA, 22 bp, Artificial sequence
  SiRNA target sequence
gatcaaaaaatacggcgatcaa

SEQ ID NO: 119802 - DNA, 22 bp, Artificial sequence
  SiRNA target sequence
atcaaaaaatacggcgatcaaa

SEQ ID NO: 119803 - DNA, 22 bp, Artificial sequence
  SiRNA target sequence
tcaaaaaatacggcgatcaaag

SEQ ID NO: 119804 - DNA, 22 bp, Artificial sequence
  SiRNA target sequence
caaaaaatacggcgatcaaaga

SEQ ID NO: 119805 - DNA, 22 bp, Artificial sequence
  SiRNA target sequence
aaaaaatacggcgatcaaagag

SEQ ID NO: 119806 - DNA, 22 bp, Artificial sequence
  SiRNA target sequence
aaaaatacggcgatcaaagagt

SEQ ID NO: 119807 - DNA, 22 bp, Artificial sequence
  SiRNA target sequence
aaaatacggcgatcaaagagtg

SEQ ID NO: 119808 - DNA, 22 bp, Artificial sequence
  SiRNA target sequence
aaatacggcgatcaaagagtga

SEQ ID NO: 119809 - DNA, 22 bp, Artificial sequence
  SiRNA target sequence
aatacggcgatcaaagagtgaa

SEQ ID NO: 119810 - DNA, 22 bp, Artificial sequence
  SiRNA target sequence
atacggcgatcaaagagtgaag

SEQ ID NO: 119811 - DNA, 22 bp, Artificial sequence
  SiRNA target sequence
tacggcgatcaaagagtgaagg

SEQ ID NO: 119812 - DNA, 22 bp, Artificial sequence
  SiRNA target sequence
acggcgatcaaagagtgaagga

SEQ ID NO: 119813 - DNA, 22 bp, Artificial sequence
  SiRNA target sequence
cggcgatcaaagagtgaaggat

SEQ ID NO: 119814 - DNA, 22 bp, Artificial sequence
  SiRNA target sequence
ggcgatcaaagagtgaaggata

SEQ ID NO: 119815 - DNA, 22 bp, Artificial sequence
  SiRNA target sequence
gcgatcaaagagtgaaggatac

SEQ ID NO: 119816 - DNA, 22 bp, Artificial sequence
  SiRNA target sequence
cgatcaaagagtgaaggatacc

SEQ ID NO: 119817 - DNA, 22 bp, Artificial sequence
  SiRNA target sequence
gatcaaagagtgaaggataccc

SEQ ID NO: 119818 - DNA, 22 bp, Artificial sequence
  SiRNA target sequence
atcaaagagtgaaggatacccc

SEQ ID NO: 119819 - DNA, 22 bp, Artificial sequence
  SiRNA target sequence
tcaaagagtgaaggatacccct

SEQ ID NO: 119820 - DNA, 22 bp, Artificial sequence
  SiRNA target sequence
caaagagtgaaggataccccta

SEQ ID NO: 119821 - DNA, 22 bp, Artificial sequence
  SiRNA target sequence
aaagagtgaaggatacccctat

SEQ ID NO: 119822 - DNA, 22 bp, Artificial sequence
  SiRNA target sequence
aagagtgaaggatacccctatt

SEQ ID NO: 119823 - DNA, 22 bp, Artificial sequence
  SiRNA target sequence
agagtgaaggatacccctattt

SEQ ID NO: 119824 - DNA, 22 bp, Artificial sequence
  SiRNA target sequence
gagtgaaggatacccctatttc

SEQ ID NO: 119825 - DNA, 22 bp, Artificial sequence
  SiRNA target sequence
agtgaaggatacccctatttcg

SEQ ID NO: 119826 - DNA, 22 bp, Artificial sequence
  SiRNA target sequence
gtgaaggatacccctatttcgg

SEQ ID NO: 119827 - DNA, 22 bp, Artificial sequence
  SiRNA target sequence
tgaaggatacccctatttcgga

SEQ ID NO: 119828 - DNA, 22 bp, Artificial sequence
  SiRNA target sequence
gaaggatacccctatttcggaa

SEQ ID NO: 119829 - DNA, 22 bp, Artificial sequence
  SiRNA target sequence
aaggatacccctatttcggaaa

SEQ ID NO: 119830 - DNA, 22 bp, Artificial sequence
  SiRNA target sequence
aggatacccctatttcggaaat

SEQ ID NO: 119831 - DNA, 22 bp, Artificial sequence
  SiRNA target sequence
ggatacccctatttcggaaatg

SEQ ID NO: 119832 - DNA, 22 bp, Artificial sequence
  SiRNA target sequence
gatacccctatttcggaaatgg

SEQ ID NO: 119833 - DNA, 22 bp, Artificial sequence
  SiRNA target sequence
atacccctatttcggaaatggg

SEQ ID NO: 119834 - DNA, 22 bp, Artificial sequence
  SiRNA target sequence
tacccctatttcggaaatggga

SEQ ID NO: 119835 - DNA, 22 bp, Artificial sequence
  SiRNA target sequence
acccctatttcggaaatgggat

SEQ ID NO: 119836 - DNA, 22 bp, Artificial sequence
  SiRNA target sequence
cccctatttcggaaatgggatt

SEQ ID NO: 119837 - DNA, 22 bp, Artificial sequence
  SiRNA target sequence
ccctatttcggaaatgggattt

SEQ ID NO: 119838 - DNA, 22 bp, Artificial sequence
  SiRNA target sequence
cctatttcggaaatgggattta

SEQ ID NO: 119839 - DNA, 22 bp, Artificial sequence
  SiRNA target sequence
ctatttcggaaatgggatttac

SEQ ID NO: 119840 - DNA, 22 bp, Artificial sequence
  SiRNA target sequence
tatttcggaaatgggatttaca

SEQ ID NO: 119841 - DNA, 22 bp, Artificial sequence
  SiRNA target sequence
atttcggaaatgggatttacag

SEQ ID NO: 119842 - DNA, 22 bp, Artificial sequence
  SiRNA target sequence
tttcggaaatgggatttacagg

SEQ ID NO: 119843 - DNA, 22 bp, Artificial sequence
  SiRNA target sequence
ttcggaaatgggatttacaggt

SEQ ID NO: 119844 - DNA, 22 bp, Artificial sequence
  SiRNA target sequence
tcggaaatgggatttacaggtc

SEQ ID NO: 119845 - DNA, 22 bp, Artificial sequence
  SiRNA target sequence
cggaaatgggatttacaggtct

SEQ ID NO: 119846 - DNA, 22 bp, Artificial sequence
  SiRNA target sequence
ggaaatgggatttacaggtctc

SEQ ID NO: 119847 - DNA, 22 bp, Artificial sequence
  SiRNA target sequence
gaaatgggatttacaggtctcg

SEQ ID NO: 119848 - DNA, 22 bp, Artificial sequence
  SiRNA target sequence
aaatgggatttacaggtctcgc

SEQ ID NO: 119849 - DNA, 22 bp, Artificial sequence
  SiRNA target sequence
aatgggatttacaggtctcgct

SEQ ID NO: 119850 - DNA, 22 bp, Artificial sequence
  SiRNA target sequence
atgggatttacaggtctcgctg

SEQ ID NO: 119851 - DNA, 22 bp, Artificial sequence
  SiRNA target sequence
tgggatttacaggtctcgctgt

SEQ ID NO: 119852 - DNA, 22 bp, Artificial sequence
  SiRNA target sequence
gggatttacaggtctcgctgtg

SEQ ID NO: 119853 - DNA, 22 bp, Artificial sequence
  SiRNA target sequence
ggatttacaggtctcgctgtgg

SEQ ID NO: 119854 - DNA, 22 bp, Artificial sequence
  SiRNA target sequence
gatttacaggtctcgctgtggg

SEQ ID NO: 119855 - DNA, 22 bp, Artificial sequence
  SiRNA target sequence
atttacaggtctcgctgtgggt

SEQ ID NO: 119856 - DNA, 22 bp, Artificial sequence
  SiRNA target sequence
tttacaggtctcgctgtgggtt

SEQ ID NO: 119857 - DNA, 22 bp, Artificial sequence
  SiRNA target sequence
ttacaggtctcgctgtgggttc

SEQ ID NO: 119858 - DNA, 22 bp, Artificial sequence
  SiRNA target sequence
tacaggtctcgctgtgggttca

SEQ ID NO: 119859 - DNA, 22 bp, Artificial sequence
  SiRNA target sequence
acaggtctcgctgtgggttcaa

SEQ ID NO: 119860 - DNA, 22 bp, Artificial sequence
  SiRNA target sequence
caggtctcgctgtgggttcaag

SEQ ID NO: 119861 - DNA, 22 bp, Artificial sequence
  SiRNA target sequence
aggtctcgctgtgggttcaagc

SEQ ID NO: 119862 - DNA, 22 bp, Artificial sequence
  SiRNA target sequence
ggtctcgctgtgggttcaagct

SEQ ID NO: 119863 - DNA, 22 bp, Artificial sequence
  SiRNA target sequence
gtctcgctgtgggttcaagcta

SEQ ID NO: 119864 - DNA, 22 bp, Artificial sequence
  SiRNA target sequence
tctcgctgtgggttcaagctat

SEQ ID NO: 119865 - DNA, 22 bp, Artificial sequence
  SiRNA target sequence
ctcgctgtgggttcaagctatt

SEQ ID NO: 119866 - DNA, 22 bp, Artificial sequence
  SiRNA target sequence
tcgctgtgggttcaagctattt

SEQ ID NO: 119867 - DNA, 22 bp, Artificial sequence
  SiRNA target sequence
cgctgtgggttcaagctattta

SEQ ID NO: 119868 - DNA, 22 bp, Artificial sequence
  SiRNA target sequence
gctgtgggttcaagctatttag

SEQ ID NO: 119869 - DNA, 22 bp, Artificial sequence
  SiRNA target sequence
ctgtgggttcaagctatttagg

SEQ ID NO: 119870 - DNA, 22 bp, Artificial sequence
  SiRNA target sequence
tgtgggttcaagctatttaggg

SEQ ID NO: 119871 - DNA, 22 bp, Artificial sequence
  SiRNA target sequence
gtgggttcaagctatttagggt

SEQ ID NO: 119872 - DNA, 22 bp, Artificial sequence
  SiRNA target sequence
tgggttcaagctatttagggtt

SEQ ID NO: 119873 - DNA, 22 bp, Artificial sequence
  SiRNA target sequence
gggttcaagctatttagggtta

SEQ ID NO: 119874 - DNA, 22 bp, Artificial sequence
  SiRNA target sequence
ggttcaagctatttagggttaa

SEQ ID NO: 119875 - DNA, 22 bp, Artificial sequence
  SiRNA target sequence
gttcaagctatttagggttaag

SEQ ID NO: 119876 - DNA, 22 bp, Artificial sequence
  SiRNA target sequence
ttcaagctatttagggttaaga

SEQ ID NO: 119877 - DNA, 22 bp, Artificial sequence
  SiRNA target sequence
tcaagctatttagggttaagac

SEQ ID NO: 119878 - DNA, 22 bp, Artificial sequence
  SiRNA target sequence
caagctatttagggttaagacc

SEQ ID NO: 119879 - DNA, 22 bp, Artificial sequence
  SiRNA target sequence
aagctatttagggttaagaccc

SEQ ID NO: 119880 - DNA, 22 bp, Artificial sequence
  SiRNA target sequence
agctatttagggttaagacccg

SEQ ID NO: 119881 - DNA, 22 bp, Artificial sequence
  SiRNA target sequence
gctatttagggttaagacccgt

SEQ ID NO: 119882 - DNA, 22 bp, Artificial sequence
  SiRNA target sequence
ctatttagggttaagacccgta

SEQ ID NO: 119883 - DNA, 22 bp, Artificial sequence
  SiRNA target sequence
tatttagggttaagacccgtag

SEQ ID NO: 119884 - DNA, 22 bp, Artificial sequence
  SiRNA target sequence
atttagggttaagacccgtagt

SEQ ID NO: 119885 - DNA, 22 bp, Artificial sequence
  SiRNA target sequence
tttagggttaagacccgtagta

SEQ ID NO: 119886 - DNA, 22 bp, Artificial sequence
  SiRNA target sequence
ttagggttaagacccgtagtag

SEQ ID NO: 119887 - DNA, 22 bp, Artificial sequence
  SiRNA target sequence
tagggttaagacccgtagtaga

SEQ ID NO: 119888 - DNA, 22 bp, Artificial sequence
  SiRNA target sequence
agggttaagacccgtagtagat

SEQ ID NO: 119889 - DNA, 22 bp, Artificial sequence
  SiRNA target sequence
gggttaagacccgtagtagatt

SEQ ID NO: 119890 - DNA, 22 bp, Artificial sequence
  SiRNA target sequence
ggttaagacccgtagtagattt

SEQ ID NO: 119891 - DNA, 22 bp, Artificial sequence
  SiRNA target sequence
gttaagacccgtagtagatttt

SEQ ID NO: 119892 - DNA, 22 bp, Artificial sequence
  SiRNA target sequence
ttaagacccgtagtagatttta

SEQ ID NO: 119893 - DNA, 22 bp, Artificial sequence
  SiRNA target sequence
taagacccgtagtagattttat

SEQ ID NO: 119894 - DNA, 22 bp, Artificial sequence
  SiRNA target sequence
aagacccgtagtagattttatg

SEQ ID NO: 119895 - DNA, 22 bp, Artificial sequence
  SiRNA target sequence
agacccgtagtagattttatga

SEQ ID NO: 119896 - DNA, 22 bp, Artificial sequence
  SiRNA target sequence
gacccgtagtagattttatgac

SEQ ID NO: 119897 - DNA, 22 bp, Artificial sequence
  SiRNA target sequence
acccgtagtagattttatgact

SEQ ID NO: 119898 - DNA, 22 bp, Artificial sequence
  SiRNA target sequence
cccgtagtagattttatgactt

SEQ ID NO: 119899 - DNA, 22 bp, Artificial sequence
  SiRNA target sequence
ccgtagtagattttatgacttg

SEQ ID NO: 119900 - DNA, 22 bp, Artificial sequence
  SiRNA target sequence
cgtagtagattttatgacttgg

SEQ ID NO: 119901 - DNA, 22 bp, Artificial sequence
  SiRNA target sequence
gtagtagattttatgacttgga

SEQ ID NO: 119902 - DNA, 22 bp, Artificial sequence
  SiRNA target sequence
tagtagattttatgacttggaa

SEQ ID NO: 119903 - DNA, 22 bp, Artificial sequence
  SiRNA target sequence
agtagattttatgacttggaat

SEQ ID NO: 119904 - DNA, 22 bp, Artificial sequence
  SiRNA target sequence
gtagattttatgacttggaatt

SEQ ID NO: 119905 - DNA, 22 bp, Artificial sequence
  SiRNA target sequence
tagattttatgacttggaattt

SEQ ID NO: 119906 - DNA, 22 bp, Artificial sequence
  SiRNA target sequence
agattttatgacttggaatttt

SEQ ID NO: 119907 - DNA, 22 bp, Artificial sequence
  SiRNA target sequence
gattttatgacttggaattttg

SEQ ID NO: 119908 - DNA, 22 bp, Artificial sequence
  SiRNA target sequence
attttatgacttggaattttgc

SEQ ID NO: 119909 - DNA, 22 bp, Artificial sequence
  SiRNA target sequence
ttttatgacttggaattttgct

SEQ ID NO: 119910 - DNA, 22 bp, Artificial sequence
  SiRNA target sequence
tttatgacttggaattttgctt

SEQ ID NO: 119911 - DNA, 22 bp, Artificial sequence
  SiRNA target sequence
ttatgacttggaattttgcttt

SEQ ID NO: 119912 - DNA, 22 bp, Artificial sequence
  SiRNA target sequence
tatgacttggaattttgctttg

SEQ ID NO: 119913 - DNA, 22 bp, Artificial sequence
  SiRNA target sequence
atgacttggaattttgctttgc

SEQ ID NO: 119914 - DNA, 22 bp, Artificial sequence
  SiRNA target sequence
tgacttggaattttgctttgca

SEQ ID NO: 119915 - DNA, 22 bp, Artificial sequence
  SiRNA target sequence
gacttggaattttgctttgcaa

SEQ ID NO: 119916 - DNA, 22 bp, Artificial sequence
  SiRNA target sequence
acttggaattttgctttgcaat

SEQ ID NO: 119917 - DNA, 22 bp, Artificial sequence
  SiRNA target sequence
cttggaattttgctttgcaatc

SEQ ID NO: 119918 - DNA, 22 bp, Artificial sequence
  SiRNA target sequence
ttggaattttgctttgcaatca

SEQ ID NO: 119919 - DNA, 22 bp, Artificial sequence
  SiRNA target sequence
tggaattttgctttgcaatcaa

SEQ ID NO: 119920 - DNA, 22 bp, Artificial sequence
  SiRNA target sequence
ggaattttgctttgcaatcaat

SEQ ID NO: 119921 - DNA, 22 bp, Artificial sequence
  SiRNA target sequence
gaattttgctttgcaatcaatt

SEQ ID NO: 119922 - DNA, 22 bp, Artificial sequence
  SiRNA target sequence
aattttgctttgcaatcaattg

SEQ ID NO: 119923 - DNA, 22 bp, Artificial sequence
  SiRNA target sequence
attttgctttgcaatcaattga

SEQ ID NO: 119924 - DNA, 22 bp, Artificial sequence
  SiRNA target sequence
ttttgctttgcaatcaattgac

SEQ ID NO: 119925 - DNA, 22 bp, Artificial sequence
  SiRNA target sequence
tttgctttgcaatcaattgacc

SEQ ID NO: 119926 - DNA, 22 bp, Artificial sequence
  SiRNA target sequence
ttgctttgcaatcaattgacca

SEQ ID NO: 119927 - DNA, 22 bp, Artificial sequence
  SiRNA target sequence
tgctttgcaatcaattgaccat

SEQ ID NO: 119928 - DNA, 22 bp, Artificial sequence
  SiRNA target sequence
gctttgcaatcaattgaccata

SEQ ID NO: 119929 - DNA, 22 bp, Artificial sequence
  SiRNA target sequence
ctttgcaatcaattgaccatat

SEQ ID NO: 119930 - DNA, 22 bp, Artificial sequence
  SiRNA target sequence
tttgcaatcaattgaccatatt

SEQ ID NO: 119931 - DNA, 22 bp, Artificial sequence
  SiRNA target sequence
ttgcaatcaattgaccatatta

SEQ ID NO: 119932 - DNA, 22 bp, Artificial sequence
  SiRNA target sequence
tgcaatcaattgaccatattat

SEQ ID NO: 119933 - DNA, 22 bp, Artificial sequence
  SiRNA target sequence
gcaatcaattgaccatattatt

SEQ ID NO: 119934 - DNA, 22 bp, Artificial sequence
  SiRNA target sequence
caatcaattgaccatattatta

SEQ ID NO: 119935 - DNA, 22 bp, Artificial sequence
  SiRNA target sequence
aatcaattgaccatattattaa

SEQ ID NO: 119936 - DNA, 22 bp, Artificial sequence
  SiRNA target sequence
atcaattgaccatattattaat

SEQ ID NO: 119937 - DNA, 22 bp, Artificial sequence
  SiRNA target sequence
tcaattgaccatattattaatt

SEQ ID NO: 119938 - DNA, 22 bp, Artificial sequence
  SiRNA target sequence
caattgaccatattattaattc

SEQ ID NO: 119939 - DNA, 22 bp, Artificial sequence
  SiRNA target sequence
aattgaccatattattaattct

SEQ ID NO: 119940 - DNA, 22 bp, Artificial sequence
  SiRNA target sequence
attgaccatattattaattctt

SEQ ID NO: 119941 - DNA, 22 bp, Artificial sequence
  SiRNA target sequence
ttgaccatattattaattcttg

SEQ ID NO: 119942 - DNA, 22 bp, Artificial sequence
  SiRNA target sequence
tgaccatattattaattcttgt

SEQ ID NO: 119943 - DNA, 22 bp, Artificial sequence
  SiRNA target sequence
gaccatattattaattcttgtg

SEQ ID NO: 119944 - DNA, 22 bp, Artificial sequence
  SiRNA target sequence
accatattattaattcttgtgc

SEQ ID NO: 119945 - DNA, 22 bp, Artificial sequence
  SiRNA target sequence
ccatattattaattcttgtgcg

SEQ ID NO: 119946 - DNA, 22 bp, Artificial sequence
  SiRNA target sequence
catattattaattcttgtgcga

SEQ ID NO: 119947 - DNA, 22 bp, Artificial sequence
  SiRNA target sequence
atattattaattcttgtgcgaa

SEQ ID NO: 119948 - DNA, 22 bp, Artificial sequence
  SiRNA target sequence
tattattaattcttgtgcgaaa

SEQ ID NO: 119949 - DNA, 22 bp, Artificial sequence
  SiRNA target sequence
attattaattcttgtgcgaaaa

SEQ ID NO: 119950 - DNA, 22 bp, Artificial sequence
  SiRNA target sequence
ttattaattcttgtgcgaaaac

SEQ ID NO: 119951 - DNA, 22 bp, Artificial sequence
  SiRNA target sequence
tattaattcttgtgcgaaaacc

SEQ ID NO: 119952 - DNA, 22 bp, Artificial sequence
  SiRNA target sequence
attaattcttgtgcgaaaacct

SEQ ID NO: 119953 - DNA, 22 bp, Artificial sequence
  SiRNA target sequence
ttaattcttgtgcgaaaacctt

SEQ ID NO: 119954 - DNA, 22 bp, Artificial sequence
  SiRNA target sequence
taattcttgtgcgaaaaccttg

SEQ ID NO: 119955 - DNA, 22 bp, Artificial sequence
  SiRNA target sequence
aattcttgtgcgaaaaccttgt

SEQ ID NO: 119956 - DNA, 22 bp, Artificial sequence
  SiRNA target sequence
attcttgtgcgaaaaccttgta

SEQ ID NO: 119957 - DNA, 22 bp, Artificial sequence
  SiRNA target sequence
ttcttgtgcgaaaaccttgtat

SEQ ID NO: 119958 - DNA, 22 bp, Artificial sequence
  SiRNA target sequence
tcttgtgcgaaaaccttgtata

SEQ ID NO: 119959 - DNA, 22 bp, Artificial sequence
  SiRNA target sequence
cttgtgcgaaaaccttgtatat

SEQ ID NO: 119960 - DNA, 22 bp, Artificial sequence
  SiRNA target sequence
ttgtgcgaaaaccttgtatatg

SEQ ID NO: 119961 - DNA, 22 bp, Artificial sequence
  SiRNA target sequence
tgtgcgaaaaccttgtatatgt

SEQ ID NO: 119962 - DNA, 22 bp, Artificial sequence
  SiRNA target sequence
gtgcgaaaaccttgtatatgtc

SEQ ID NO: 119963 - DNA, 22 bp, Artificial sequence
  SiRNA target sequence
tgcgaaaaccttgtatatgtca

SEQ ID NO: 119964 - DNA, 22 bp, Artificial sequence
  SiRNA target sequence
gcgaaaaccttgtatatgtcag

SEQ ID NO: 119965 - DNA, 22 bp, Artificial sequence
  SiRNA target sequence
cgaaaaccttgtatatgtcagg

SEQ ID NO: 119966 - DNA, 22 bp, Artificial sequence
  SiRNA target sequence
gaaaaccttgtatatgtcagga

SEQ ID NO: 119967 - DNA, 22 bp, Artificial sequence
  SiRNA target sequence
aaaaccttgtatatgtcaggag

SEQ ID NO: 119968 - DNA, 22 bp, Artificial sequence
  SiRNA target sequence
aaaccttgtatatgtcaggagg

SEQ ID NO: 119969 - DNA, 22 bp, Artificial sequence
  SiRNA target sequence
aaccttgtatatgtcaggagga

SEQ ID NO: 119970 - DNA, 22 bp, Artificial sequence
  SiRNA target sequence
accttgtatatgtcaggaggaa

SEQ ID NO: 119971 - DNA, 22 bp, Artificial sequence
  SiRNA target sequence
ccttgtatatgtcaggaggaag

SEQ ID NO: 119972 - DNA, 22 bp, Artificial sequence
  SiRNA target sequence
cttgtatatgtcaggaggaaga

SEQ ID NO: 119973 - DNA, 22 bp, Artificial sequence
  SiRNA target sequence
ttgtatatgtcaggaggaagaa

SEQ ID NO: 119974 - DNA, 22 bp, Artificial sequence
  SiRNA target sequence
tgtatatgtcaggaggaagaat

SEQ ID NO: 119975 - DNA, 22 bp, Artificial sequence
  SiRNA target sequence
gtatatgtcaggaggaagaata

SEQ ID NO: 119976 - DNA, 22 bp, Artificial sequence
  SiRNA target sequence
tatatgtcaggaggaagaatac

SEQ ID NO: 119977 - DNA, 22 bp, Artificial sequence
  SiRNA target sequence
atatgtcaggaggaagaataca

SEQ ID NO: 119978 - DNA, 22 bp, Artificial sequence
  SiRNA target sequence
tatgtcaggaggaagaatacaa

SEQ ID NO: 119979 - DNA, 22 bp, Artificial sequence
  SiRNA target sequence
atgtcaggaggaagaatacaat

SEQ ID NO: 119980 - DNA, 22 bp, Artificial sequence
  SiRNA target sequence
tgtcaggaggaagaatacaatg

SEQ ID NO: 119981 - DNA, 22 bp, Artificial sequence
  SiRNA target sequence
gtcaggaggaagaatacaatgt

SEQ ID NO: 119982 - DNA, 22 bp, Artificial sequence
  SiRNA target sequence
tcaggaggaagaatacaatgtc

SEQ ID NO: 119983 - DNA, 22 bp, Artificial sequence
  SiRNA target sequence
caggaggaagaatacaatgtcc

SEQ ID NO: 119984 - DNA, 22 bp, Artificial sequence
  SiRNA target sequence
aggaggaagaatacaatgtcca

SEQ ID NO: 119985 - DNA, 22 bp, Artificial sequence
  SiRNA target sequence
ggaggaagaatacaatgtccaa

SEQ ID NO: 119986 - DNA, 22 bp, Artificial sequence
  SiRNA target sequence
gaggaagaatacaatgtccaat

SEQ ID NO: 119987 - DNA, 22 bp, Artificial sequence
  SiRNA target sequence
aggaagaatacaatgtccaatt

SEQ ID NO: 119988 - DNA, 22 bp, Artificial sequence
  SiRNA target sequence
ggaagaatacaatgtccaattg

SEQ ID NO: 119989 - DNA, 22 bp, Artificial sequence
  SiRNA target sequence
gaagaatacaatgtccaattgt

SEQ ID NO: 119990 - DNA, 22 bp, Artificial sequence
  SiRNA target sequence
aagaatacaatgtccaattgtt

SEQ ID NO: 119991 - DNA, 22 bp, Artificial sequence
  SiRNA target sequence
agaatacaatgtccaattgttt

SEQ ID NO: 119992 - DNA, 22 bp, Artificial sequence
  SiRNA target sequence
gaatacaatgtccaattgtttt

SEQ ID NO: 119993 - DNA, 22 bp, Artificial sequence
  SiRNA target sequence
aatacaatgtccaattgttttt

SEQ ID NO: 119994 - DNA, 22 bp, Artificial sequence
  SiRNA target sequence
atacaatgtccaattgttttta

SEQ ID NO: 119995 - DNA, 22 bp, Artificial sequence
  SiRNA target sequence
tacaatgtccaattgtttttag

SEQ ID NO: 119996 - DNA, 22 bp, Artificial sequence
  SiRNA target sequence
acaatgtccaattgtttttagg

SEQ ID NO: 119997 - DNA, 22 bp, Artificial sequence
  SiRNA target sequence
caatgtccaattgtttttaggg

SEQ ID NO: 119998 - DNA, 22 bp, Artificial sequence
  SiRNA target sequence
aatgtccaattgtttttagggg

SEQ ID NO: 119999 - DNA, 22 bp, Artificial sequence
  SiRNA target sequence
atgtccaattgtttttagggga

SEQ ID NO: 120000 - DNA, 22 bp, Artificial sequence
  SiRNA target sequence
tgtccaattgtttttaggggac

SEQ ID NO: 120001 - DNA, 22 bp, Artificial sequence
  SiRNA target sequence
gtccaattgtttttaggggacc

SEQ ID NO: 120002 - DNA, 22 bp, Artificial sequence
  SiRNA target sequence
tccaattgtttttaggggacca

SEQ ID NO: 120003 - DNA, 22 bp, Artificial sequence
  SiRNA target sequence
ccaattgtttttaggggaccaa

SEQ ID NO: 120004 - DNA, 22 bp, Artificial sequence
  SiRNA target sequence
caattgtttttaggggaccaaa

SEQ ID NO: 120005 - DNA, 22 bp, Artificial sequence
  SiRNA target sequence
aattgtttttaggggaccaaat

SEQ ID NO: 120006 - DNA, 22 bp, Artificial sequence
  SiRNA target sequence
attgtttttaggggaccaaatg

SEQ ID NO: 120007 - DNA, 22 bp, Artificial sequence
  SiRNA target sequence
ttgtttttaggggaccaaatgg

SEQ ID NO: 120008 - DNA, 22 bp, Artificial sequence
  SiRNA target sequence
tgtttttaggggaccaaatgga

SEQ ID NO: 120009 - DNA, 22 bp, Artificial sequence
  SiRNA target sequence
gtttttaggggaccaaatggat

SEQ ID NO: 120010 - DNA, 22 bp, Artificial sequence
  SiRNA target sequence
tttttaggggaccaaatggatt

SEQ ID NO: 120011 - DNA, 22 bp, Artificial sequence
  SiRNA target sequence
ttttaggggaccaaatggattc

SEQ ID NO: 120012 - DNA, 22 bp, Artificial sequence
  SiRNA target sequence
tttaggggaccaaatggattca

SEQ ID NO: 120013 - DNA, 22 bp, Artificial sequence
  SiRNA target sequence
ttaggggaccaaatggattcaa

SEQ ID NO: 120014 - DNA, 22 bp, Artificial sequence
  SiRNA target sequence
taggggaccaaatggattcaat

SEQ ID NO: 120015 - DNA, 22 bp, Artificial sequence
  SiRNA target sequence
aggggaccaaatggattcaata

SEQ ID NO: 120016 - DNA, 22 bp, Artificial sequence
  SiRNA target sequence
ggggaccaaatggattcaataa

SEQ ID NO: 120017 - DNA, 22 bp, Artificial sequence
  SiRNA target sequence
gggaccaaatggattcaataat

SEQ ID NO: 120018 - DNA, 22 bp, Artificial sequence
  SiRNA target sequence
ggaccaaatggattcaataatg

SEQ ID NO: 120019 - DNA, 22 bp, Artificial sequence
  SiRNA target sequence
gaccaaatggattcaataatgg

SEQ ID NO: 120020 - DNA, 22 bp, Artificial sequence
  SiRNA target sequence
accaaatggattcaataatggg

SEQ ID NO: 120021 - DNA, 22 bp, Artificial sequence
  SiRNA target sequence
ccaaatggattcaataatgggt

SEQ ID NO: 120022 - DNA, 22 bp, Artificial sequence
  SiRNA target sequence
caaatggattcaataatgggta

SEQ ID NO: 120023 - DNA, 22 bp, Artificial sequence
  SiRNA target sequence
aaatggattcaataatgggtac

SEQ ID NO: 120024 - DNA, 22 bp, Artificial sequence
  SiRNA target sequence
aatggattcaataatgggtacg

SEQ ID NO: 120025 - DNA, 22 bp, Artificial sequence
  SiRNA target sequence
atggattcaataatgggtacgc

SEQ ID NO: 120026 - DNA, 22 bp, Artificial sequence
  SiRNA target sequence
tggattcaataatgggtacgct

SEQ ID NO: 120027 - DNA, 22 bp, Artificial sequence
  SiRNA target sequence
ggattcaataatgggtacgctg

SEQ ID NO: 120028 - DNA, 22 bp, Artificial sequence
  SiRNA target sequence
gattcaataatgggtacgctgc

SEQ ID NO: 120029 - DNA, 22 bp, Artificial sequence
  SiRNA target sequence
attcaataatgggtacgctgca

SEQ ID NO: 120030 - DNA, 22 bp, Artificial sequence
  SiRNA target sequence
ttcaataatgggtacgctgcac

SEQ ID NO: 120031 - DNA, 22 bp, Artificial sequence
  SiRNA target sequence
tcaataatgggtacgctgcaca

SEQ ID NO: 120032 - DNA, 22 bp, Artificial sequence
  SiRNA target sequence
caataatgggtacgctgcacag

SEQ ID NO: 120033 - DNA, 22 bp, Artificial sequence
  SiRNA target sequence
aataatgggtacgctgcacagc

SEQ ID NO: 120034 - DNA, 22 bp, Artificial sequence
  SiRNA target sequence
ataatgggtacgctgcacagca

SEQ ID NO: 120035 - DNA, 22 bp, Artificial sequence
  SiRNA target sequence
taatgggtacgctgcacagcac

SEQ ID NO: 120036 - DNA, 22 bp, Artificial sequence
  SiRNA target sequence
aatgggtacgctgcacagcaca

SEQ ID NO: 120037 - DNA, 22 bp, Artificial sequence
  SiRNA target sequence
atgggtacgctgcacagcacac

SEQ ID NO: 120038 - DNA, 22 bp, Artificial sequence
  SiRNA target sequence
tgggtacgctgcacagcacaca

SEQ ID NO: 120039 - DNA, 22 bp, Artificial sequence
  SiRNA target sequence
gggtacgctgcacagcacacac

SEQ ID NO: 120040 - DNA, 22 bp, Artificial sequence
  SiRNA target sequence
ggtacgctgcacagcacacaca

SEQ ID NO: 120041 - DNA, 22 bp, Artificial sequence
  SiRNA target sequence
gtacgctgcacagcacacacaa

SEQ ID NO: 120042 - DNA, 22 bp, Artificial sequence
  SiRNA target sequence
tacgctgcacagcacacacaag

SEQ ID NO: 120043 - DNA, 22 bp, Artificial sequence
  SiRNA target sequence
acgctgcacagcacacacaaga

SEQ ID NO: 120044 - DNA, 22 bp, Artificial sequence
  SiRNA target sequence
cgctgcacagcacacacaagat

SEQ ID NO: 120045 - DNA, 22 bp, Artificial sequence
  SiRNA target sequence
gctgcacagcacacacaagatt

SEQ ID NO: 120046 - DNA, 22 bp, Artificial sequence
  SiRNA target sequence
ctgcacagcacacacaagattt

SEQ ID NO: 120047 - DNA, 22 bp, Artificial sequence
  SiRNA target sequence
tgcacagcacacacaagatttt

SEQ ID NO: 120048 - DNA, 22 bp, Artificial sequence
  SiRNA target sequence
gcacagcacacacaagattttg

SEQ ID NO: 120049 - DNA, 22 bp, Artificial sequence
  SiRNA target sequence
cacagcacacacaagattttgc

SEQ ID NO: 120050 - DNA, 22 bp, Artificial sequence
  SiRNA target sequence
acagcacacacaagattttgca

SEQ ID NO: 120051 - DNA, 22 bp, Artificial sequence
  SiRNA target sequence
cagcacacacaagattttgcac

SEQ ID NO: 120052 - DNA, 22 bp, Artificial sequence
  SiRNA target sequence
agcacacacaagattttgcacc

SEQ ID NO: 120053 - DNA, 22 bp, Artificial sequence
  SiRNA target sequence
gcacacacaagattttgcacca

SEQ ID NO: 120054 - DNA, 22 bp, Artificial sequence
  SiRNA target sequence
cacacacaagattttgcaccaa

SEQ ID NO: 120055 - DNA, 22 bp, Artificial sequence
  SiRNA target sequence
acacacaagattttgcaccaat

SEQ ID NO: 120056 - DNA, 22 bp, Artificial sequence
  SiRNA target sequence
cacacaagattttgcaccaata

SEQ ID NO: 120057 - DNA, 22 bp, Artificial sequence
  SiRNA target sequence
acacaagattttgcaccaatat

SEQ ID NO: 120058 - DNA, 22 bp, Artificial sequence
  SiRNA target sequence
cacaagattttgcaccaatata

SEQ ID NO: 120059 - DNA, 22 bp, Artificial sequence
  SiRNA target sequence
acaagattttgcaccaatatat

SEQ ID NO: 120060 - DNA, 22 bp, Artificial sequence
  SiRNA target sequence
caagattttgcaccaatatatg

SEQ ID NO: 120061 - DNA, 22 bp, Artificial sequence
  SiRNA target sequence
aagattttgcaccaatatatgg

SEQ ID NO: 120062 - DNA, 22 bp, Artificial sequence
  SiRNA target sequence
agattttgcaccaatatatggt

SEQ ID NO: 120063 - DNA, 22 bp, Artificial sequence
  SiRNA target sequence
gattttgcaccaatatatggtt

SEQ ID NO: 120064 - DNA, 22 bp, Artificial sequence
  SiRNA target sequence
attttgcaccaatatatggttc

SEQ ID NO: 120065 - DNA, 22 bp, Artificial sequence
  SiRNA target sequence
ttttgcaccaatatatggttct

SEQ ID NO: 120066 - DNA, 22 bp, Artificial sequence
  SiRNA target sequence
tttgcaccaatatatggttcta

SEQ ID NO: 120067 - DNA, 22 bp, Artificial sequence
  SiRNA target sequence
ttgcaccaatatatggttctat

SEQ ID NO: 120068 - DNA, 22 bp, Artificial sequence
  SiRNA target sequence
tgcaccaatatatggttctatt

SEQ ID NO: 120069 - DNA, 22 bp, Artificial sequence
  SiRNA target sequence
gcaccaatatatggttctattc

SEQ ID NO: 120070 - DNA, 22 bp, Artificial sequence
  SiRNA target sequence
caccaatatatggttctattcc

SEQ ID NO: 120071 - DNA, 22 bp, Artificial sequence
  SiRNA target sequence
accaatatatggttctattcca

SEQ ID NO: 120072 - DNA, 22 bp, Artificial sequence
  SiRNA target sequence
ccaatatatggttctattccag

SEQ ID NO: 120073 - DNA, 22 bp, Artificial sequence
  SiRNA target sequence
caatatatggttctattccagg

SEQ ID NO: 120074 - DNA, 22 bp, Artificial sequence
  SiRNA target sequence
aatatatggttctattccaggc

SEQ ID NO: 120075 - DNA, 22 bp, Artificial sequence
  SiRNA target sequence
atatatggttctattccaggcc

SEQ ID NO: 120076 - DNA, 22 bp, Artificial sequence
  SiRNA target sequence
tatatggttctattccaggcct

SEQ ID NO: 120077 - DNA, 22 bp, Artificial sequence
  SiRNA target sequence
atatggttctattccaggcctt

SEQ ID NO: 120078 - DNA, 22 bp, Artificial sequence
  SiRNA target sequence
tatggttctattccaggcctta

SEQ ID NO: 120079 - DNA, 22 bp, Artificial sequence
  SiRNA target sequence
atggttctattccaggccttaa

SEQ ID NO: 120080 - DNA, 22 bp, Artificial sequence
  SiRNA target sequence
tggttctattccaggccttaag

SEQ ID NO: 120081 - DNA, 22 bp, Artificial sequence
  SiRNA target sequence
ggttctattccaggccttaagg

SEQ ID NO: 120082 - DNA, 22 bp, Artificial sequence
  SiRNA target sequence
gttctattccaggccttaaggt

SEQ ID NO: 120083 - DNA, 22 bp, Artificial sequence
  SiRNA target sequence
ttctattccaggccttaaggtg

SEQ ID NO: 120084 - DNA, 22 bp, Artificial sequence
  SiRNA target sequence
tctattccaggccttaaggtgg

SEQ ID NO: 120085 - DNA, 22 bp, Artificial sequence
  SiRNA target sequence
ctattccaggccttaaggtggt

SEQ ID NO: 120086 - DNA, 22 bp, Artificial sequence
  SiRNA target sequence
tattccaggccttaaggtggtt

SEQ ID NO: 120087 - DNA, 22 bp, Artificial sequence
  SiRNA target sequence
attccaggccttaaggtggttt

SEQ ID NO: 120088 - DNA, 22 bp, Artificial sequence
  SiRNA target sequence
ttccaggccttaaggtggtttg

SEQ ID NO: 120089 - DNA, 22 bp, Artificial sequence
  SiRNA target sequence
tccaggccttaaggtggtttgt

SEQ ID NO: 120090 - DNA, 22 bp, Artificial sequence
  SiRNA target sequence
ccaggccttaaggtggtttgtc

SEQ ID NO: 120091 - DNA, 22 bp, Artificial sequence
  SiRNA target sequence
caggccttaaggtggtttgtcc

SEQ ID NO: 120092 - DNA, 22 bp, Artificial sequence
  SiRNA target sequence
aggccttaaggtggtttgtcct

SEQ ID NO: 120093 - DNA, 22 bp, Artificial sequence
  SiRNA target sequence
ggccttaaggtggtttgtcctt

SEQ ID NO: 120094 - DNA, 22 bp, Artificial sequence
  SiRNA target sequence
gccttaaggtggtttgtcctta

SEQ ID NO: 120095 - DNA, 22 bp, Artificial sequence
  SiRNA target sequence
ccttaaggtggtttgtccttat

SEQ ID NO: 120096 - DNA, 22 bp, Artificial sequence
  SiRNA target sequence
cttaaggtggtttgtccttata

SEQ ID NO: 120097 - DNA, 22 bp, Artificial sequence
  SiRNA target sequence
ttaaggtggtttgtccttatac

SEQ ID NO: 120098 - DNA, 22 bp, Artificial sequence
  SiRNA target sequence
taaggtggtttgtccttatacg

SEQ ID NO: 120099 - DNA, 22 bp, Artificial sequence
  SiRNA target sequence
aaggtggtttgtccttatacgg

SEQ ID NO: 120100 - DNA, 22 bp, Artificial sequence
  SiRNA target sequence
aggtggtttgtccttatacggg

SEQ ID NO: 120101 - DNA, 22 bp, Artificial sequence
  SiRNA target sequence
ggtggtttgtccttatacgggt

SEQ ID NO: 120102 - DNA, 22 bp, Artificial sequence
  SiRNA target sequence
gtggtttgtccttatacgggta

SEQ ID NO: 120103 - DNA, 22 bp, Artificial sequence
  SiRNA target sequence
tggtttgtccttatacgggtaa

SEQ ID NO: 120104 - DNA, 22 bp, Artificial sequence
  SiRNA target sequence
ggtttgtccttatacgggtaaa

SEQ ID NO: 120105 - DNA, 22 bp, Artificial sequence
  SiRNA target sequence
gtttgtccttatacgggtaaag

SEQ ID NO: 120106 - DNA, 22 bp, Artificial sequence
  SiRNA target sequence
tttgtccttatacgggtaaaga

SEQ ID NO: 120107 - DNA, 22 bp, Artificial sequence
  SiRNA target sequence
ttgtccttatacgggtaaagac

SEQ ID NO: 120108 - DNA, 22 bp, Artificial sequence
  SiRNA target sequence
tgtccttatacgggtaaagacc

SEQ ID NO: 120109 - DNA, 22 bp, Artificial sequence
  SiRNA target sequence
gtccttatacgggtaaagacca

SEQ ID NO: 120110 - DNA, 22 bp, Artificial sequence
  SiRNA target sequence
tccttatacgggtaaagaccat

SEQ ID NO: 120111 - DNA, 22 bp, Artificial sequence
  SiRNA target sequence
ccttatacgggtaaagaccata

SEQ ID NO: 120112 - DNA, 22 bp, Artificial sequence
  SiRNA target sequence
cttatacgggtaaagaccataa

SEQ ID NO: 120113 - DNA, 22 bp, Artificial sequence
  SiRNA target sequence
ttatacgggtaaagaccataaa

SEQ ID NO: 120114 - DNA, 22 bp, Artificial sequence
  SiRNA target sequence
tatacgggtaaagaccataaag

SEQ ID NO: 120115 - DNA, 22 bp, Artificial sequence
  SiRNA target sequence
atacgggtaaagaccataaagg

SEQ ID NO: 120116 - DNA, 22 bp, Artificial sequence
  SiRNA target sequence
tacgggtaaagaccataaagga

SEQ ID NO: 120117 - DNA, 22 bp, Artificial sequence
  SiRNA target sequence
acgggtaaagaccataaaggac

SEQ ID NO: 120118 - DNA, 22 bp, Artificial sequence
  SiRNA target sequence
cgggtaaagaccataaaggact

SEQ ID NO: 120119 - DNA, 22 bp, Artificial sequence
  SiRNA target sequence
gggtaaagaccataaaggactt

SEQ ID NO: 120120 - DNA, 22 bp, Artificial sequence
  SiRNA target sequence
ggtaaagaccataaaggacttt

SEQ ID NO: 120121 - DNA, 22 bp, Artificial sequence
  SiRNA target sequence
gtaaagaccataaaggactttt

SEQ ID NO: 120122 - DNA, 22 bp, Artificial sequence
  SiRNA target sequence
taaagaccataaaggactttta

SEQ ID NO: 120123 - DNA, 22 bp, Artificial sequence
  SiRNA target sequence
aaagaccataaaggacttttaa

SEQ ID NO: 120124 - DNA, 22 bp, Artificial sequence
  SiRNA target sequence
aagaccataaaggacttttaaa

SEQ ID NO: 120125 - DNA, 22 bp, Artificial sequence
  SiRNA target sequence
agaccataaaggacttttaaaa

SEQ ID NO: 120126 - DNA, 22 bp, Artificial sequence
  SiRNA target sequence
gaccataaaggacttttaaaaa

SEQ ID NO: 120127 - DNA, 22 bp, Artificial sequence
  SiRNA target sequence
accataaaggacttttaaaaag

SEQ ID NO: 120128 - DNA, 22 bp, Artificial sequence
  SiRNA target sequence
ccataaaggacttttaaaaagc

SEQ ID NO: 120129 - DNA, 22 bp, Artificial sequence
  SiRNA target sequence
cataaaggacttttaaaaagcg

SEQ ID NO: 120130 - DNA, 22 bp, Artificial sequence
  SiRNA target sequence
ataaaggacttttaaaaagcgc

SEQ ID NO: 120131 - DNA, 22 bp, Artificial sequence
  SiRNA target sequence
taaaggacttttaaaaagcgct

SEQ ID NO: 120132 - DNA, 22 bp, Artificial sequence
  SiRNA target sequence
aaaggacttttaaaaagcgcta

SEQ ID NO: 120133 - DNA, 22 bp, Artificial sequence
  SiRNA target sequence
aaggacttttaaaaagcgctat

SEQ ID NO: 120134 - DNA, 22 bp, Artificial sequence
  SiRNA target sequence
aggacttttaaaaagcgctatt

SEQ ID NO: 120135 - DNA, 22 bp, Artificial sequence
  SiRNA target sequence
ggacttttaaaaagcgctatta

SEQ ID NO: 120136 - DNA, 22 bp, Artificial sequence
  SiRNA target sequence
gacttttaaaaagcgctattag

SEQ ID NO: 120137 - DNA, 22 bp, Artificial sequence
  SiRNA target sequence
acttttaaaaagcgctattaga

SEQ ID NO: 120138 - DNA, 22 bp, Artificial sequence
  SiRNA target sequence
cttttaaaaagcgctattagag

SEQ ID NO: 120139 - DNA, 22 bp, Artificial sequence
  SiRNA target sequence
ttttaaaaagcgctattagaga

SEQ ID NO: 120140 - DNA, 22 bp, Artificial sequence
  SiRNA target sequence
tttaaaaagcgctattagagac

SEQ ID NO: 120141 - DNA, 22 bp, Artificial sequence
  SiRNA target sequence
ttaaaaagcgctattagagaca

SEQ ID NO: 120142 - DNA, 22 bp, Artificial sequence
  SiRNA target sequence
taaaaagcgctattagagacaa

SEQ ID NO: 120143 - DNA, 22 bp, Artificial sequence
  SiRNA target sequence
aaaaagcgctattagagacaat

SEQ ID NO: 120144 - DNA, 22 bp, Artificial sequence
  SiRNA target sequence
aaaagcgctattagagacaata

SEQ ID NO: 120145 - DNA, 22 bp, Artificial sequence
  SiRNA target sequence
aaagcgctattagagacaataa

SEQ ID NO: 120146 - DNA, 22 bp, Artificial sequence
  SiRNA target sequence
aagcgctattagagacaataac

SEQ ID NO: 120147 - DNA, 22 bp, Artificial sequence
  SiRNA target sequence
agcgctattagagacaataacc

SEQ ID NO: 120148 - DNA, 22 bp, Artificial sequence
  SiRNA target sequence
gcgctattagagacaataaccc

SEQ ID NO: 120149 - DNA, 22 bp, Artificial sequence
  SiRNA target sequence
cgctattagagacaataacccg

SEQ ID NO: 120150 - DNA, 22 bp, Artificial sequence
  SiRNA target sequence
gctattagagacaataacccgg

SEQ ID NO: 120151 - DNA, 22 bp, Artificial sequence
  SiRNA target sequence
ctattagagacaataacccggt

SEQ ID NO: 120152 - DNA, 22 bp, Artificial sequence
  SiRNA target sequence
tattagagacaataacccggtt

SEQ ID NO: 120153 - DNA, 22 bp, Artificial sequence
  SiRNA target sequence
attagagacaataacccggtta

SEQ ID NO: 120154 - DNA, 22 bp, Artificial sequence
  SiRNA target sequence
ttagagacaataacccggttat

SEQ ID NO: 120155 - DNA, 22 bp, Artificial sequence
  SiRNA target sequence
tagagacaataacccggttata

SEQ ID NO: 120156 - DNA, 22 bp, Artificial sequence
  SiRNA target sequence
agagacaataacccggttatat

SEQ ID NO: 120157 - DNA, 22 bp, Artificial sequence
  SiRNA target sequence
gagacaataacccggttatatt

SEQ ID NO: 120158 - DNA, 22 bp, Artificial sequence
  SiRNA target sequence
agacaataacccggttatattt

SEQ ID NO: 120159 - DNA, 22 bp, Artificial sequence
  SiRNA target sequence
gacaataacccggttatatttc

SEQ ID NO: 120160 - DNA, 22 bp, Artificial sequence
  SiRNA target sequence
acaataacccggttatatttct

SEQ ID NO: 120161 - DNA, 22 bp, Artificial sequence
  SiRNA target sequence
caataacccggttatatttctt

SEQ ID NO: 120162 - DNA, 22 bp, Artificial sequence
  SiRNA target sequence
aataacccggttatatttcttg

SEQ ID NO: 120163 - DNA, 22 bp, Artificial sequence
  SiRNA target sequence
ataacccggttatatttcttga

SEQ ID NO: 120164 - DNA, 22 bp, Artificial sequence
  SiRNA target sequence
taacccggttatatttcttgag

SEQ ID NO: 120165 - DNA, 22 bp, Artificial sequence
  SiRNA target sequence
aacccggttatatttcttgaga

SEQ ID NO: 120166 - DNA, 22 bp, Artificial sequence
  SiRNA target sequence
acccggttatatttcttgagaa

SEQ ID NO: 120167 - DNA, 22 bp, Artificial sequence
  SiRNA target sequence
cccggttatatttcttgagaat

SEQ ID NO: 120168 - DNA, 22 bp, Artificial sequence
  SiRNA target sequence
ccggttatatttcttgagaatg

SEQ ID NO: 120169 - DNA, 22 bp, Artificial sequence
  SiRNA target sequence
cggttatatttcttgagaatga

SEQ ID NO: 120170 - DNA, 22 bp, Artificial sequence
  SiRNA target sequence
ggttatatttcttgagaatgaa

SEQ ID NO: 120171 - DNA, 22 bp, Artificial sequence
  SiRNA target sequence
gttatatttcttgagaatgaaa

SEQ ID NO: 120172 - DNA, 22 bp, Artificial sequence
  SiRNA target sequence
ttatatttcttgagaatgaaat

SEQ ID NO: 120173 - DNA, 22 bp, Artificial sequence
  SiRNA target sequence
tatatttcttgagaatgaaata

SEQ ID NO: 120174 - DNA, 22 bp, Artificial sequence
  SiRNA target sequence
atatttcttgagaatgaaatat

SEQ ID NO: 120175 - DNA, 22 bp, Artificial sequence
  SiRNA target sequence
tatttcttgagaatgaaatatt

SEQ ID NO: 120176 - DNA, 22 bp, Artificial sequence
  SiRNA target sequence
atttcttgagaatgaaatatta

SEQ ID NO: 120177 - DNA, 22 bp, Artificial sequence
  SiRNA target sequence
tttcttgagaatgaaatattat

SEQ ID NO: 120178 - DNA, 22 bp, Artificial sequence
  SiRNA target sequence
ttcttgagaatgaaatattata

SEQ ID NO: 120179 - DNA, 22 bp, Artificial sequence
  SiRNA target sequence
tcttgagaatgaaatattatat

SEQ ID NO: 120180 - DNA, 22 bp, Artificial sequence
  SiRNA target sequence
cttgagaatgaaatattatata

SEQ ID NO: 120181 - DNA, 22 bp, Artificial sequence
  SiRNA target sequence
ttgagaatgaaatattatataa

SEQ ID NO: 120182 - DNA, 22 bp, Artificial sequence
  SiRNA target sequence
tgagaatgaaatattatataaa

SEQ ID NO: 120183 - DNA, 22 bp, Artificial sequence
  SiRNA target sequence
gagaatgaaatattatataaag

SEQ ID NO: 120184 - DNA, 22 bp, Artificial sequence
  SiRNA target sequence
agaatgaaatattatataaaga

SEQ ID NO: 120185 - DNA, 22 bp, Artificial sequence
  SiRNA target sequence
gaatgaaatattatataaagat

SEQ ID NO: 120186 - DNA, 22 bp, Artificial sequence
  SiRNA target sequence
aatgaaatattatataaagata

SEQ ID NO: 120187 - DNA, 22 bp, Artificial sequence
  SiRNA target sequence
atgaaatattatataaagataa

SEQ ID NO: 120188 - DNA, 22 bp, Artificial sequence
  SiRNA target sequence
tgaaatattatataaagataaa

SEQ ID NO: 120189 - DNA, 22 bp, Artificial sequence
  SiRNA target sequence
gaaatattatataaagataaat

SEQ ID NO: 120190 - DNA, 22 bp, Artificial sequence
  SiRNA target sequence
aaatattatataaagataaata

SEQ ID NO: 120191 - DNA, 22 bp, Artificial sequence
  SiRNA target sequence
aatattatataaagataaatac

SEQ ID NO: 120192 - DNA, 22 bp, Artificial sequence
  SiRNA target sequence
atattatataaagataaatacc

SEQ ID NO: 120193 - DNA, 22 bp, Artificial sequence
  SiRNA target sequence
tattatataaagataaatacct

SEQ ID NO: 120194 - DNA, 22 bp, Artificial sequence
  SiRNA target sequence
attatataaagataaatacctt

SEQ ID NO: 120195 - DNA, 22 bp, Artificial sequence
  SiRNA target sequence
ttatataaagataaataccttg

SEQ ID NO: 120196 - DNA, 22 bp, Artificial sequence
  SiRNA target sequence
tatataaagataaataccttga

SEQ ID NO: 120197 - DNA, 22 bp, Artificial sequence
  SiRNA target sequence
atataaagataaataccttgaa

SEQ ID NO: 120198 - DNA, 22 bp, Artificial sequence
  SiRNA target sequence
tataaagataaataccttgaag

SEQ ID NO: 120199 - DNA, 22 bp, Artificial sequence
  SiRNA target sequence
ataaagataaataccttgaagt

SEQ ID NO: 120200 - DNA, 22 bp, Artificial sequence
  SiRNA target sequence
taaagataaataccttgaagtg

SEQ ID NO: 120201 - DNA, 22 bp, Artificial sequence
  SiRNA target sequence
aaagataaataccttgaagtgt

SEQ ID NO: 120202 - DNA, 22 bp, Artificial sequence
  SiRNA target sequence
aagataaataccttgaagtgtc

SEQ ID NO: 120203 - DNA, 22 bp, Artificial sequence
  SiRNA target sequence
agataaataccttgaagtgtct

SEQ ID NO: 120204 - DNA, 22 bp, Artificial sequence
  SiRNA target sequence
gataaataccttgaagtgtcta

SEQ ID NO: 120205 - DNA, 22 bp, Artificial sequence
  SiRNA target sequence
ataaataccttgaagtgtctaa

SEQ ID NO: 120206 - DNA, 22 bp, Artificial sequence
  SiRNA target sequence
taaataccttgaagtgtctaat

SEQ ID NO: 120207 - DNA, 22 bp, Artificial sequence
  SiRNA target sequence
aaataccttgaagtgtctaata

SEQ ID NO: 120208 - DNA, 22 bp, Artificial sequence
  SiRNA target sequence
aataccttgaagtgtctaataa

SEQ ID NO: 120209 - DNA, 22 bp, Artificial sequence
  SiRNA target sequence
ataccttgaagtgtctaataat

SEQ ID NO: 120210 - DNA, 22 bp, Artificial sequence
  SiRNA target sequence
taccttgaagtgtctaataatt

SEQ ID NO: 120211 - DNA, 22 bp, Artificial sequence
  SiRNA target sequence
accttgaagtgtctaataatta

SEQ ID NO: 120212 - DNA, 22 bp, Artificial sequence
  SiRNA target sequence
ccttgaagtgtctaataattat

SEQ ID NO: 120213 - DNA, 22 bp, Artificial sequence
  SiRNA target sequence
cttgaagtgtctaataattata

SEQ ID NO: 120214 - DNA, 22 bp, Artificial sequence
  SiRNA target sequence
ttgaagtgtctaataattatat

SEQ ID NO: 120215 - DNA, 22 bp, Artificial sequence
  SiRNA target sequence
tgaagtgtctaataattatatt

SEQ ID NO: 120216 - DNA, 22 bp, Artificial sequence
  SiRNA target sequence
gaagtgtctaataattatattc

SEQ ID NO: 120217 - DNA, 22 bp, Artificial sequence
  SiRNA target sequence
aagtgtctaataattatattca

SEQ ID NO: 120218 - DNA, 22 bp, Artificial sequence
  SiRNA target sequence
agtgtctaataattatattcaa

SEQ ID NO: 120219 - DNA, 22 bp, Artificial sequence
  SiRNA target sequence
gtgtctaataattatattcaac

SEQ ID NO: 120220 - DNA, 22 bp, Artificial sequence
  SiRNA target sequence
tgtctaataattatattcaacc

SEQ ID NO: 120221 - DNA, 22 bp, Artificial sequence
  SiRNA target sequence
gtctaataattatattcaacca

SEQ ID NO: 120222 - DNA, 22 bp, Artificial sequence
  SiRNA target sequence
tctaataattatattcaaccac

SEQ ID NO: 120223 - DNA, 22 bp, Artificial sequence
  SiRNA target sequence
ctaataattatattcaaccact

SEQ ID NO: 120224 - DNA, 22 bp, Artificial sequence
  SiRNA target sequence
taataattatattcaaccactt

SEQ ID NO: 120225 - DNA, 22 bp, Artificial sequence
  SiRNA target sequence
aataattatattcaaccacttg

SEQ ID NO: 120226 - DNA, 22 bp, Artificial sequence
  SiRNA target sequence
ataattatattcaaccacttga

SEQ ID NO: 120227 - DNA, 22 bp, Artificial sequence
  SiRNA target sequence
taattatattcaaccacttgac

SEQ ID NO: 120228 - DNA, 22 bp, Artificial sequence
  SiRNA target sequence
aattatattcaaccacttgaca

SEQ ID NO: 120229 - DNA, 22 bp, Artificial sequence
  SiRNA target sequence
attatattcaaccacttgacaa

SEQ ID NO: 120230 - DNA, 22 bp, Artificial sequence
  SiRNA target sequence
ttatattcaaccacttgacaag

SEQ ID NO: 120231 - DNA, 22 bp, Artificial sequence
  SiRNA target sequence
tatattcaaccacttgacaagg

SEQ ID NO: 120232 - DNA, 22 bp, Artificial sequence
  SiRNA target sequence
atattcaaccacttgacaaggc

SEQ ID NO: 120233 - DNA, 22 bp, Artificial sequence
  SiRNA target sequence
tattcaaccacttgacaaggca

SEQ ID NO: 120234 - DNA, 22 bp, Artificial sequence
  SiRNA target sequence
attcaaccacttgacaaggcag

SEQ ID NO: 120235 - DNA, 22 bp, Artificial sequence
  SiRNA target sequence
ttcaaccacttgacaaggcagt

SEQ ID NO: 120236 - DNA, 22 bp, Artificial sequence
  SiRNA target sequence
tcaaccacttgacaaggcagta

SEQ ID NO: 120237 - DNA, 22 bp, Artificial sequence
  SiRNA target sequence
caaccacttgacaaggcagtaa

SEQ ID NO: 120238 - DNA, 22 bp, Artificial sequence
  SiRNA target sequence
aaccacttgacaaggcagtaat

SEQ ID NO: 120239 - DNA, 22 bp, Artificial sequence
  SiRNA target sequence
accacttgacaaggcagtaatt

SEQ ID NO: 120240 - DNA, 22 bp, Artificial sequence
  SiRNA target sequence
ccacttgacaaggcagtaattg

SEQ ID NO: 120241 - DNA, 22 bp, Artificial sequence
  SiRNA target sequence
cacttgacaaggcagtaattga

SEQ ID NO: 120242 - DNA, 22 bp, Artificial sequence
  SiRNA target sequence
acttgacaaggcagtaattgaa

SEQ ID NO: 120243 - DNA, 22 bp, Artificial sequence
  SiRNA target sequence
cttgacaaggcagtaattgaaa

SEQ ID NO: 120244 - DNA, 22 bp, Artificial sequence
  SiRNA target sequence
ttgacaaggcagtaattgaaaa

SEQ ID NO: 120245 - DNA, 22 bp, Artificial sequence
  SiRNA target sequence
tgacaaggcagtaattgaaaaa

SEQ ID NO: 120246 - DNA, 22 bp, Artificial sequence
  SiRNA target sequence
gacaaggcagtaattgaaaaaa

SEQ ID NO: 120247 - DNA, 22 bp, Artificial sequence
  SiRNA target sequence
acaaggcagtaattgaaaaaaa

SEQ ID NO: 120248 - DNA, 22 bp, Artificial sequence
  SiRNA target sequence
caaggcagtaattgaaaaaaat

SEQ ID NO: 120249 - DNA, 22 bp, Artificial sequence
  SiRNA target sequence
aaggcagtaattgaaaaaaatg

SEQ ID NO: 120250 - DNA, 22 bp, Artificial sequence
  SiRNA target sequence
aggcagtaattgaaaaaaatgg

SEQ ID NO: 120251 - DNA, 22 bp, Artificial sequence
  SiRNA target sequence
ggcagtaattgaaaaaaatggt

SEQ ID NO: 120252 - DNA, 22 bp, Artificial sequence
  SiRNA target sequence
gcagtaattgaaaaaaatggtg

SEQ ID NO: 120253 - DNA, 22 bp, Artificial sequence
  SiRNA target sequence
cagtaattgaaaaaaatggtgt

SEQ ID NO: 120254 - DNA, 22 bp, Artificial sequence
  SiRNA target sequence
agtaattgaaaaaaatggtgtt

SEQ ID NO: 120255 - DNA, 22 bp, Artificial sequence
  SiRNA target sequence
gtaattgaaaaaaatggtgttg

SEQ ID NO: 120256 - DNA, 22 bp, Artificial sequence
  SiRNA target sequence
taattgaaaaaaatggtgttga

SEQ ID NO: 120257 - DNA, 22 bp, Artificial sequence
  SiRNA target sequence
aattgaaaaaaatggtgttgac

SEQ ID NO: 120258 - DNA, 22 bp, Artificial sequence
  SiRNA target sequence
attgaaaaaaatggtgttgacg

SEQ ID NO: 120259 - DNA, 22 bp, Artificial sequence
  SiRNA target sequence
ttgaaaaaaatggtgttgacgt

SEQ ID NO: 120260 - DNA, 22 bp, Artificial sequence
  SiRNA target sequence
tgaaaaaaatggtgttgacgtt

SEQ ID NO: 120261 - DNA, 22 bp, Artificial sequence
  SiRNA target sequence
gaaaaaaatggtgttgacgtta

SEQ ID NO: 120262 - DNA, 22 bp, Artificial sequence
  SiRNA target sequence
aaaaaaatggtgttgacgttac

SEQ ID NO: 120263 - DNA, 22 bp, Artificial sequence
  SiRNA target sequence
aaaaaatggtgttgacgttaca

SEQ ID NO: 120264 - DNA, 22 bp, Artificial sequence
  SiRNA target sequence
aaaaatggtgttgacgttacag

SEQ ID NO: 120265 - DNA, 22 bp, Artificial sequence
  SiRNA target sequence
aaaatggtgttgacgttacagt

SEQ ID NO: 120266 - DNA, 22 bp, Artificial sequence
  SiRNA target sequence
aaatggtgttgacgttacagtt

SEQ ID NO: 120267 - DNA, 22 bp, Artificial sequence
  SiRNA target sequence
aatggtgttgacgttacagttt

SEQ ID NO: 120268 - DNA, 22 bp, Artificial sequence
  SiRNA target sequence
atggtgttgacgttacagtttt

SEQ ID NO: 120269 - DNA, 22 bp, Artificial sequence
  SiRNA target sequence
tggtgttgacgttacagtttta

SEQ ID NO: 120270 - DNA, 22 bp, Artificial sequence
  SiRNA target sequence
ggtgttgacgttacagttttag

SEQ ID NO: 120271 - DNA, 22 bp, Artificial sequence
  SiRNA target sequence
gtgttgacgttacagttttagg

SEQ ID NO: 120272 - DNA, 22 bp, Artificial sequence
  SiRNA target sequence
tgttgacgttacagttttagga

SEQ ID NO: 120273 - DNA, 22 bp, Artificial sequence
  SiRNA target sequence
gttgacgttacagttttaggaa

SEQ ID NO: 120274 - DNA, 22 bp, Artificial sequence
  SiRNA target sequence
ttgacgttacagttttaggaat

SEQ ID NO: 120275 - DNA, 22 bp, Artificial sequence
  SiRNA target sequence
tgacgttacagttttaggaata

SEQ ID NO: 120276 - DNA, 22 bp, Artificial sequence
  SiRNA target sequence
gacgttacagttttaggaatat

SEQ ID NO: 120277 - DNA, 22 bp, Artificial sequence
  SiRNA target sequence
acgttacagttttaggaatatc

SEQ ID NO: 120278 - DNA, 22 bp, Artificial sequence
  SiRNA target sequence
cgttacagttttaggaatatca

SEQ ID NO: 120279 - DNA, 22 bp, Artificial sequence
  SiRNA target sequence
gttacagttttaggaatatcaa

SEQ ID NO: 120280 - DNA, 22 bp, Artificial sequence
  SiRNA target sequence
ttacagttttaggaatatcaat

SEQ ID NO: 120281 - DNA, 22 bp, Artificial sequence
  SiRNA target sequence
tacagttttaggaatatcaata

SEQ ID NO: 120282 - DNA, 22 bp, Artificial sequence
  SiRNA target sequence
acagttttaggaatatcaataa

SEQ ID NO: 120283 - DNA, 22 bp, Artificial sequence
  SiRNA target sequence
cagttttaggaatatcaataag

SEQ ID NO: 120284 - DNA, 22 bp, Artificial sequence
  SiRNA target sequence
agttttaggaatatcaataagt

SEQ ID NO: 120285 - DNA, 22 bp, Artificial sequence
  SiRNA target sequence
gttttaggaatatcaataagtc

SEQ ID NO: 120286 - DNA, 22 bp, Artificial sequence
  SiRNA target sequence
ttttaggaatatcaataagtct

SEQ ID NO: 120287 - DNA, 22 bp, Artificial sequence
  SiRNA target sequence
tttaggaatatcaataagtctt

SEQ ID NO: 120288 - DNA, 22 bp, Artificial sequence
  SiRNA target sequence
ttaggaatatcaataagtctta

SEQ ID NO: 120289 - DNA, 22 bp, Artificial sequence
  SiRNA target sequence
taggaatatcaataagtcttaa

SEQ ID NO: 120290 - DNA, 22 bp, Artificial sequence
  SiRNA target sequence
aggaatatcaataagtcttaaa

SEQ ID NO: 120291 - DNA, 22 bp, Artificial sequence
  SiRNA target sequence
ggaatatcaataagtcttaaag

SEQ ID NO: 120292 - DNA, 22 bp, Artificial sequence
  SiRNA target sequence
gaatatcaataagtcttaaaga

SEQ ID NO: 120293 - DNA, 22 bp, Artificial sequence
  SiRNA target sequence
aatatcaataagtcttaaagaa

SEQ ID NO: 120294 - DNA, 22 bp, Artificial sequence
  SiRNA target sequence
atatcaataagtcttaaagaaa

SEQ ID NO: 120295 - DNA, 22 bp, Artificial sequence
  SiRNA target sequence
tatcaataagtcttaaagaaat

SEQ ID NO: 120296 - DNA, 22 bp, Artificial sequence
  SiRNA target sequence
atcaataagtcttaaagaaatt

SEQ ID NO: 120297 - DNA, 22 bp, Artificial sequence
  SiRNA target sequence
tcaataagtcttaaagaaattt

SEQ ID NO: 120298 - DNA, 22 bp, Artificial sequence
  SiRNA target sequence
caataagtcttaaagaaatttt

SEQ ID NO: 120299 - DNA, 22 bp, Artificial sequence
  SiRNA target sequence
aataagtcttaaagaaattttt

SEQ ID NO: 120300 - DNA, 22 bp, Artificial sequence
  SiRNA target sequence
ataagtcttaaagaaattttta

SEQ ID NO: 120301 - DNA, 22 bp, Artificial sequence
  SiRNA target sequence
taagtcttaaagaaatttttaa

SEQ ID NO: 120302 - DNA, 22 bp, Artificial sequence
  SiRNA target sequence
aagtcttaaagaaatttttaaa

SEQ ID NO: 120303 - DNA, 22 bp, Artificial sequence
  SiRNA target sequence
agtcttaaagaaatttttaaag

SEQ ID NO: 120304 - DNA, 22 bp, Artificial sequence
  SiRNA target sequence
gtcttaaagaaatttttaaagc

SEQ ID NO: 120305 - DNA, 22 bp, Artificial sequence
  SiRNA target sequence
tcttaaagaaatttttaaagca

SEQ ID NO: 120306 - DNA, 22 bp, Artificial sequence
  SiRNA target sequence
cttaaagaaatttttaaagcag

SEQ ID NO: 120307 - DNA, 22 bp, Artificial sequence
  SiRNA target sequence
ttaaagaaatttttaaagcaga

SEQ ID NO: 120308 - DNA, 22 bp, Artificial sequence
  SiRNA target sequence
taaagaaatttttaaagcagac

SEQ ID NO: 120309 - DNA, 22 bp, Artificial sequence
  SiRNA target sequence
aaagaaatttttaaagcagaca

SEQ ID NO: 120310 - DNA, 22 bp, Artificial sequence
  SiRNA target sequence
aagaaatttttaaagcagacag

SEQ ID NO: 120311 - DNA, 22 bp, Artificial sequence
  SiRNA target sequence
agaaatttttaaagcagacagt

SEQ ID NO: 120312 - DNA, 22 bp, Artificial sequence
  SiRNA target sequence
gaaatttttaaagcagacagtt

SEQ ID NO: 120313 - DNA, 22 bp, Artificial sequence
  SiRNA target sequence
aaatttttaaagcagacagttt

SEQ ID NO: 120314 - DNA, 22 bp, Artificial sequence
  SiRNA target sequence
aatttttaaagcagacagtttg

SEQ ID NO: 120315 - DNA, 22 bp, Artificial sequence
  SiRNA target sequence
atttttaaagcagacagtttgt

SEQ ID NO: 120316 - DNA, 22 bp, Artificial sequence
  SiRNA target sequence
tttttaaagcagacagtttgtt

SEQ ID NO: 120317 - DNA, 22 bp, Artificial sequence
  SiRNA target sequence
ttttaaagcagacagtttgtta

SEQ ID NO: 120318 - DNA, 22 bp, Artificial sequence
  SiRNA target sequence
tttaaagcagacagtttgttag

SEQ ID NO: 120319 - DNA, 22 bp, Artificial sequence
  SiRNA target sequence
ttaaagcagacagtttgttaga

SEQ ID NO: 120320 - DNA, 22 bp, Artificial sequence
  SiRNA target sequence
taaagcagacagtttgttagag

SEQ ID NO: 120321 - DNA, 22 bp, Artificial sequence
  SiRNA target sequence
aaagcagacagtttgttagaga

SEQ ID NO: 120322 - DNA, 22 bp, Artificial sequence
  SiRNA target sequence
aagcagacagtttgttagagaa

SEQ ID NO: 120323 - DNA, 22 bp, Artificial sequence
  SiRNA target sequence
agcagacagtttgttagagaaa

SEQ ID NO: 120324 - DNA, 22 bp, Artificial sequence
  SiRNA target sequence
gcagacagtttgttagagaaaa

SEQ ID NO: 120325 - DNA, 22 bp, Artificial sequence
  SiRNA target sequence
cagacagtttgttagagaaaaa

SEQ ID NO: 120326 - DNA, 22 bp, Artificial sequence
  SiRNA target sequence
agacagtttgttagagaaaaaa

SEQ ID NO: 120327 - DNA, 22 bp, Artificial sequence
  SiRNA target sequence
gacagtttgttagagaaaaaaa

SEQ ID NO: 120328 - DNA, 22 bp, Artificial sequence
  SiRNA target sequence
acagtttgttagagaaaaaaaa

SEQ ID NO: 120329 - DNA, 22 bp, Artificial sequence
  SiRNA target sequence
cagtttgttagagaaaaaaaat

SEQ ID NO: 120330 - DNA, 22 bp, Artificial sequence
  SiRNA target sequence
agtttgttagagaaaaaaaata

SEQ ID NO: 120331 - DNA, 22 bp, Artificial sequence
  SiRNA target sequence
gtttgttagagaaaaaaaatat

SEQ ID NO: 120332 - DNA, 22 bp, Artificial sequence
  SiRNA target sequence
tttgttagagaaaaaaaatatc

SEQ ID NO: 120333 - DNA, 22 bp, Artificial sequence
  SiRNA target sequence
ttgttagagaaaaaaaatatcg

SEQ ID NO: 120334 - DNA, 22 bp, Artificial sequence
  SiRNA target sequence
tgttagagaaaaaaaatatcga

SEQ ID NO: 120335 - DNA, 22 bp, Artificial sequence
  SiRNA target sequence
gttagagaaaaaaaatatcgac

SEQ ID NO: 120336 - DNA, 22 bp, Artificial sequence
  SiRNA target sequence
ttagagaaaaaaaatatcgaca

SEQ ID NO: 120337 - DNA, 22 bp, Artificial sequence
  SiRNA target sequence
tagagaaaaaaaatatcgacat

SEQ ID NO: 120338 - DNA, 22 bp, Artificial sequence
  SiRNA target sequence
agagaaaaaaaatatcgacatt

SEQ ID NO: 120339 - DNA, 22 bp, Artificial sequence
  SiRNA target sequence
gagaaaaaaaatatcgacattg

SEQ ID NO: 120340 - DNA, 22 bp, Artificial sequence
  SiRNA target sequence
agaaaaaaaatatcgacattga

SEQ ID NO: 120341 - DNA, 22 bp, Artificial sequence
  SiRNA target sequence
gaaaaaaaatatcgacattgag

SEQ ID NO: 120342 - DNA, 22 bp, Artificial sequence
  SiRNA target sequence
aaaaaaaatatcgacattgaga

SEQ ID NO: 120343 - DNA, 22 bp, Artificial sequence
  SiRNA target sequence
aaaaaaatatcgacattgagat

SEQ ID NO: 120344 - DNA, 22 bp, Artificial sequence
  SiRNA target sequence
aaaaaatatcgacattgagata

SEQ ID NO: 120345 - DNA, 22 bp, Artificial sequence
  SiRNA target sequence
aaaaatatcgacattgagataa

SEQ ID NO: 120346 - DNA, 22 bp, Artificial sequence
  SiRNA target sequence
aaaatatcgacattgagataat

SEQ ID NO: 120347 - DNA, 22 bp, Artificial sequence
  SiRNA target sequence
aaatatcgacattgagataatt

SEQ ID NO: 120348 - DNA, 22 bp, Artificial sequence
  SiRNA target sequence
aatatcgacattgagataatta

SEQ ID NO: 120349 - DNA, 22 bp, Artificial sequence
  SiRNA target sequence
atatcgacattgagataattaa

SEQ ID NO: 120350 - DNA, 22 bp, Artificial sequence
  SiRNA target sequence
tatcgacattgagataattaat

SEQ ID NO: 120351 - DNA, 22 bp, Artificial sequence
  SiRNA target sequence
atcgacattgagataattaatc

SEQ ID NO: 120352 - DNA, 22 bp, Artificial sequence
  SiRNA target sequence
tcgacattgagataattaatct

SEQ ID NO: 120353 - DNA, 22 bp, Artificial sequence
  SiRNA target sequence
cgacattgagataattaatctt

SEQ ID NO: 120354 - DNA, 22 bp, Artificial sequence
  SiRNA target sequence
gacattgagataattaatcttg

SEQ ID NO: 120355 - DNA, 22 bp, Artificial sequence
  SiRNA target sequence
acattgagataattaatcttgt

SEQ ID NO: 120356 - DNA, 22 bp, Artificial sequence
  SiRNA target sequence
cattgagataattaatcttgtg

SEQ ID NO: 120357 - DNA, 22 bp, Artificial sequence
  SiRNA target sequence
attgagataattaatcttgtgt

SEQ ID NO: 120358 - DNA, 22 bp, Artificial sequence
  SiRNA target sequence
ttgagataattaatcttgtgtc

SEQ ID NO: 120359 - DNA, 22 bp, Artificial sequence
  SiRNA target sequence
tgagataattaatcttgtgtca

SEQ ID NO: 120360 - DNA, 22 bp, Artificial sequence
  SiRNA target sequence
gagataattaatcttgtgtcaa

SEQ ID NO: 120361 - DNA, 22 bp, Artificial sequence
  SiRNA target sequence
agataattaatcttgtgtcaat

SEQ ID NO: 120362 - DNA, 22 bp, Artificial sequence
  SiRNA target sequence
gataattaatcttgtgtcaata

SEQ ID NO: 120363 - DNA, 22 bp, Artificial sequence
  SiRNA target sequence
ataattaatcttgtgtcaataa

SEQ ID NO: 120364 - DNA, 22 bp, Artificial sequence
  SiRNA target sequence
taattaatcttgtgtcaataaa

SEQ ID NO: 120365 - DNA, 22 bp, Artificial sequence
  SiRNA target sequence
aattaatcttgtgtcaataaaa

SEQ ID NO: 120366 - DNA, 22 bp, Artificial sequence
  SiRNA target sequence
attaatcttgtgtcaataaaac

SEQ ID NO: 120367 - DNA, 22 bp, Artificial sequence
  SiRNA target sequence
ttaatcttgtgtcaataaaacc

SEQ ID NO: 120368 - DNA, 22 bp, Artificial sequence
  SiRNA target sequence
taatcttgtgtcaataaaacca

SEQ ID NO: 120369 - DNA, 22 bp, Artificial sequence
  SiRNA target sequence
aatcttgtgtcaataaaaccaa

SEQ ID NO: 120370 - DNA, 22 bp, Artificial sequence
  SiRNA target sequence
atcttgtgtcaataaaaccaat

SEQ ID NO: 120371 - DNA, 22 bp, Artificial sequence
  SiRNA target sequence
tcttgtgtcaataaaaccaatt

SEQ ID NO: 120372 - DNA, 22 bp, Artificial sequence
  SiRNA target sequence
cttgtgtcaataaaaccaattg

SEQ ID NO: 120373 - DNA, 22 bp, Artificial sequence
  SiRNA target sequence
ttgtgtcaataaaaccaattga

SEQ ID NO: 120374 - DNA, 22 bp, Artificial sequence
  SiRNA target sequence
tgtgtcaataaaaccaattgat

SEQ ID NO: 120375 - DNA, 22 bp, Artificial sequence
  SiRNA target sequence
gtgtcaataaaaccaattgatt

SEQ ID NO: 120376 - DNA, 22 bp, Artificial sequence
  SiRNA target sequence
tgtcaataaaaccaattgatta

SEQ ID NO: 120377 - DNA, 22 bp, Artificial sequence
  SiRNA target sequence
gtcaataaaaccaattgattat

SEQ ID NO: 120378 - DNA, 22 bp, Artificial sequence
  SiRNA target sequence
tcaataaaaccaattgattatg

SEQ ID NO: 120379 - DNA, 22 bp, Artificial sequence
  SiRNA target sequence
caataaaaccaattgattatgt

SEQ ID NO: 120380 - DNA, 22 bp, Artificial sequence
  SiRNA target sequence
aataaaaccaattgattatgtt

SEQ ID NO: 120381 - DNA, 22 bp, Artificial sequence
  SiRNA target sequence
ataaaaccaattgattatgtta

SEQ ID NO: 120382 - DNA, 22 bp, Artificial sequence
  SiRNA target sequence
taaaaccaattgattatgttac

SEQ ID NO: 120383 - DNA, 22 bp, Artificial sequence
  SiRNA target sequence
aaaaccaattgattatgttact

SEQ ID NO: 120384 - DNA, 22 bp, Artificial sequence
  SiRNA target sequence
aaaccaattgattatgttacta

SEQ ID NO: 120385 - DNA, 22 bp, Artificial sequence
  SiRNA target sequence
aaccaattgattatgttactat

SEQ ID NO: 120386 - DNA, 22 bp, Artificial sequence
  SiRNA target sequence
accaattgattatgttactatt

SEQ ID NO: 120387 - DNA, 22 bp, Artificial sequence
  SiRNA target sequence
ccaattgattatgttactattg

SEQ ID NO: 120388 - DNA, 22 bp, Artificial sequence
  SiRNA target sequence
caattgattatgttactattga

SEQ ID NO: 120389 - DNA, 22 bp, Artificial sequence
  SiRNA target sequence
aattgattatgttactattgaa

SEQ ID NO: 120390 - DNA, 22 bp, Artificial sequence
  SiRNA target sequence
attgattatgttactattgaaa

SEQ ID NO: 120391 - DNA, 22 bp, Artificial sequence
  SiRNA target sequence
ttgattatgttactattgaaat

SEQ ID NO: 120392 - DNA, 22 bp, Artificial sequence
  SiRNA target sequence
tgattatgttactattgaaata

SEQ ID NO: 120393 - DNA, 22 bp, Artificial sequence
  SiRNA target sequence
gattatgttactattgaaatat

SEQ ID NO: 120394 - DNA, 22 bp, Artificial sequence
  SiRNA target sequence
attatgttactattgaaatatc

SEQ ID NO: 120395 - DNA, 22 bp, Artificial sequence
  SiRNA target sequence
ttatgttactattgaaatatca

SEQ ID NO: 120396 - DNA, 22 bp, Artificial sequence
  SiRNA target sequence
tatgttactattgaaatatcag

SEQ ID NO: 120397 - DNA, 22 bp, Artificial sequence
  SiRNA target sequence
atgttactattgaaatatcagt

SEQ ID NO: 120398 - DNA, 22 bp, Artificial sequence
  SiRNA target sequence
tgttactattgaaatatcagtc

SEQ ID NO: 120399 - DNA, 22 bp, Artificial sequence
  SiRNA target sequence
gttactattgaaatatcagtca

SEQ ID NO: 120400 - DNA, 22 bp, Artificial sequence
  SiRNA target sequence
ttactattgaaatatcagtcaa

SEQ ID NO: 120401 - DNA, 22 bp, Artificial sequence
  SiRNA target sequence
tactattgaaatatcagtcaaa

SEQ ID NO: 120402 - DNA, 22 bp, Artificial sequence
  SiRNA target sequence
actattgaaatatcagtcaaaa

SEQ ID NO: 120403 - DNA, 22 bp, Artificial sequence
  SiRNA target sequence
ctattgaaatatcagtcaaaaa

SEQ ID NO: 120404 - DNA, 22 bp, Artificial sequence
  SiRNA target sequence
tattgaaatatcagtcaaaaaa

SEQ ID NO: 120405 - DNA, 22 bp, Artificial sequence
  SiRNA target sequence
attgaaatatcagtcaaaaaaa

SEQ ID NO: 120406 - DNA, 22 bp, Artificial sequence
  SiRNA target sequence
ttgaaatatcagtcaaaaaaac

SEQ ID NO: 120407 - DNA, 22 bp, Artificial sequence
  SiRNA target sequence
tgaaatatcagtcaaaaaaaca

SEQ ID NO: 120408 - DNA, 22 bp, Artificial sequence
  SiRNA target sequence
gaaatatcagtcaaaaaaacac

SEQ ID NO: 120409 - DNA, 22 bp, Artificial sequence
  SiRNA target sequence
aaatatcagtcaaaaaaacaca

SEQ ID NO: 120410 - DNA, 22 bp, Artificial sequence
  SiRNA target sequence
aatatcagtcaaaaaaacacaa

SEQ ID NO: 120411 - DNA, 22 bp, Artificial sequence
  SiRNA target sequence
atatcagtcaaaaaaacacaaa

SEQ ID NO: 120412 - DNA, 22 bp, Artificial sequence
  SiRNA target sequence
tatcagtcaaaaaaacacaaaa

SEQ ID NO: 120413 - DNA, 22 bp, Artificial sequence
  SiRNA target sequence
atcagtcaaaaaaacacaaaag

SEQ ID NO: 120414 - DNA, 22 bp, Artificial sequence
  SiRNA target sequence
tcagtcaaaaaaacacaaaagt

SEQ ID NO: 120415 - DNA, 22 bp, Artificial sequence
  SiRNA target sequence
cagtcaaaaaaacacaaaagtt

SEQ ID NO: 120416 - DNA, 22 bp, Artificial sequence
  SiRNA target sequence
agtcaaaaaaacacaaaagtta

SEQ ID NO: 120417 - DNA, 22 bp, Artificial sequence
  SiRNA target sequence
gtcaaaaaaacacaaaagttag

SEQ ID NO: 120418 - DNA, 22 bp, Artificial sequence
  SiRNA target sequence
tcaaaaaaacacaaaagttagt

SEQ ID NO: 120419 - DNA, 22 bp, Artificial sequence
  SiRNA target sequence
caaaaaaacacaaaagttagtg

SEQ ID NO: 120420 - DNA, 22 bp, Artificial sequence
  SiRNA target sequence
aaaaaaacacaaaagttagtga

SEQ ID NO: 120421 - DNA, 22 bp, Artificial sequence
  SiRNA target sequence
aaaaaacacaaaagttagtgat

SEQ ID NO: 120422 - DNA, 22 bp, Artificial sequence
  SiRNA target sequence
aaaaacacaaaagttagtgata

SEQ ID NO: 120423 - DNA, 22 bp, Artificial sequence
  SiRNA target sequence
aaaacacaaaagttagtgatag

SEQ ID NO: 120424 - DNA, 22 bp, Artificial sequence
  SiRNA target sequence
aaacacaaaagttagtgatagt

SEQ ID NO: 120425 - DNA, 22 bp, Artificial sequence
  SiRNA target sequence
aacacaaaagttagtgatagtt

SEQ ID NO: 120426 - DNA, 22 bp, Artificial sequence
  SiRNA target sequence
acacaaaagttagtgatagttg

SEQ ID NO: 120427 - DNA, 22 bp, Artificial sequence
  SiRNA target sequence
cacaaaagttagtgatagttga

SEQ ID NO: 120428 - DNA, 22 bp, Artificial sequence
  SiRNA target sequence
acaaaagttagtgatagttgat

SEQ ID NO: 120429 - DNA, 22 bp, Artificial sequence
  SiRNA target sequence
caaaagttagtgatagttgatt

SEQ ID NO: 120430 - DNA, 22 bp, Artificial sequence
  SiRNA target sequence
aaaagttagtgatagttgattt

SEQ ID NO: 120431 - DNA, 22 bp, Artificial sequence
  SiRNA target sequence
aaagttagtgatagttgatttt

SEQ ID NO: 120432 - DNA, 22 bp, Artificial sequence
  SiRNA target sequence
aagttagtgatagttgattttg

SEQ ID NO: 120433 - DNA, 22 bp, Artificial sequence
  SiRNA target sequence
agttagtgatagttgattttgc

SEQ ID NO: 120434 - DNA, 22 bp, Artificial sequence
  SiRNA target sequence
gttagtgatagttgattttgca

SEQ ID NO: 120435 - DNA, 22 bp, Artificial sequence
  SiRNA target sequence
ttagtgatagttgattttgcat

SEQ ID NO: 120436 - DNA, 22 bp, Artificial sequence
  SiRNA target sequence
tagtgatagttgattttgcata

SEQ ID NO: 120437 - DNA, 22 bp, Artificial sequence
  SiRNA target sequence
agtgatagttgattttgcatat

SEQ ID NO: 120438 - DNA, 22 bp, Artificial sequence
  SiRNA target sequence
gtgatagttgattttgcatatc

SEQ ID NO: 120439 - DNA, 22 bp, Artificial sequence
  SiRNA target sequence
tgatagttgattttgcatatcc

SEQ ID NO: 120440 - DNA, 22 bp, Artificial sequence
  SiRNA target sequence
gatagttgattttgcatatcct

SEQ ID NO: 120441 - DNA, 22 bp, Artificial sequence
  SiRNA target sequence
atagttgattttgcatatccta

SEQ ID NO: 120442 - DNA, 22 bp, Artificial sequence
  SiRNA target sequence
tagttgattttgcatatcctac

SEQ ID NO: 120443 - DNA, 22 bp, Artificial sequence
  SiRNA target sequence
agttgattttgcatatcctact

SEQ ID NO: 120444 - DNA, 22 bp, Artificial sequence
  SiRNA target sequence
gttgattttgcatatcctactt

SEQ ID NO: 120445 - DNA, 22 bp, Artificial sequence
  SiRNA target sequence
ttgattttgcatatcctacttt

SEQ ID NO: 120446 - DNA, 22 bp, Artificial sequence
  SiRNA target sequence
tgattttgcatatcctactttc

SEQ ID NO: 120447 - DNA, 22 bp, Artificial sequence
  SiRNA target sequence
gattttgcatatcctactttca

SEQ ID NO: 120448 - DNA, 22 bp, Artificial sequence
  SiRNA target sequence
attttgcatatcctactttcaa

SEQ ID NO: 120449 - DNA, 22 bp, Artificial sequence
  SiRNA target sequence
ttttgcatatcctactttcaat

SEQ ID NO: 120450 - DNA, 22 bp, Artificial sequence
  SiRNA target sequence
tttgcatatcctactttcaata

SEQ ID NO: 120451 - DNA, 22 bp, Artificial sequence
  SiRNA target sequence
ttgcatatcctactttcaatat

SEQ ID NO: 120452 - DNA, 22 bp, Artificial sequence
  SiRNA target sequence
tgcatatcctactttcaatatt

SEQ ID NO: 120453 - DNA, 22 bp, Artificial sequence
  SiRNA target sequence
gcatatcctactttcaatattg

SEQ ID NO: 120454 - DNA, 22 bp, Artificial sequence
  SiRNA target sequence
catatcctactttcaatattgc

SEQ ID NO: 120455 - DNA, 22 bp, Artificial sequence
  SiRNA target sequence
atatcctactttcaatattgcg

SEQ ID NO: 120456 - DNA, 22 bp, Artificial sequence
  SiRNA target sequence
tatcctactttcaatattgcga

SEQ ID NO: 120457 - DNA, 22 bp, Artificial sequence
  SiRNA target sequence
atcctactttcaatattgcgag

SEQ ID NO: 120458 - DNA, 22 bp, Artificial sequence
  SiRNA target sequence
tcctactttcaatattgcgagt

SEQ ID NO: 120459 - DNA, 22 bp, Artificial sequence
  SiRNA target sequence
cctactttcaatattgcgagtg

SEQ ID NO: 120460 - DNA, 22 bp, Artificial sequence
  SiRNA target sequence
ctactttcaatattgcgagtga

SEQ ID NO: 120461 - DNA, 22 bp, Artificial sequence
  SiRNA target sequence
tactttcaatattgcgagtgaa

SEQ ID NO: 120462 - DNA, 22 bp, Artificial sequence
  SiRNA target sequence
actttcaatattgcgagtgaaa

SEQ ID NO: 120463 - DNA, 22 bp, Artificial sequence
  SiRNA target sequence
ctttcaatattgcgagtgaaat

SEQ ID NO: 120464 - DNA, 22 bp, Artificial sequence
  SiRNA target sequence
tttcaatattgcgagtgaaata

SEQ ID NO: 120465 - DNA, 22 bp, Artificial sequence
  SiRNA target sequence
ttcaatattgcgagtgaaatag

SEQ ID NO: 120466 - DNA, 22 bp, Artificial sequence
  SiRNA target sequence
tcaatattgcgagtgaaatagc

SEQ ID NO: 120467 - DNA, 22 bp, Artificial sequence
  SiRNA target sequence
caatattgcgagtgaaatagct

SEQ ID NO: 120468 - DNA, 22 bp, Artificial sequence
  SiRNA target sequence
aatattgcgagtgaaatagctg

SEQ ID NO: 120469 - DNA, 22 bp, Artificial sequence
  SiRNA target sequence
atattgcgagtgaaatagctgc

SEQ ID NO: 120470 - DNA, 22 bp, Artificial sequence
  SiRNA target sequence
tattgcgagtgaaatagctgcg

SEQ ID NO: 120471 - DNA, 22 bp, Artificial sequence
  SiRNA target sequence
attgcgagtgaaatagctgcgc

SEQ ID NO: 120472 - DNA, 22 bp, Artificial sequence
  SiRNA target sequence
ttgcgagtgaaatagctgcgca

SEQ ID NO: 120473 - DNA, 22 bp, Artificial sequence
  SiRNA target sequence
tgcgagtgaaatagctgcgcac

SEQ ID NO: 120474 - DNA, 22 bp, Artificial sequence
  SiRNA target sequence
gcgagtgaaatagctgcgcact

SEQ ID NO: 120475 - DNA, 22 bp, Artificial sequence
  SiRNA target sequence
cgagtgaaatagctgcgcactt

SEQ ID NO: 120476 - DNA, 22 bp, Artificial sequence
  SiRNA target sequence
gagtgaaatagctgcgcacttt

SEQ ID NO: 120477 - DNA, 22 bp, Artificial sequence
  SiRNA target sequence
agtgaaatagctgcgcactttt

SEQ ID NO: 120478 - DNA, 22 bp, Artificial sequence
  SiRNA target sequence
gtgaaatagctgcgcactttta

SEQ ID NO: 120479 - DNA, 22 bp, Artificial sequence
  SiRNA target sequence
tgaaatagctgcgcacttttac

SEQ ID NO: 120480 - DNA, 22 bp, Artificial sequence
  SiRNA target sequence
gaaatagctgcgcacttttacg

SEQ ID NO: 120481 - DNA, 22 bp, Artificial sequence
  SiRNA target sequence
aaatagctgcgcacttttacga

SEQ ID NO: 120482 - DNA, 22 bp, Artificial sequence
  SiRNA target sequence
aatagctgcgcacttttacgaa

SEQ ID NO: 120483 - DNA, 22 bp, Artificial sequence
  SiRNA target sequence
atagctgcgcacttttacgaaa

SEQ ID NO: 120484 - DNA, 22 bp, Artificial sequence
  SiRNA target sequence
tagctgcgcacttttacgaaaa

SEQ ID NO: 120485 - DNA, 22 bp, Artificial sequence
  SiRNA target sequence
agctgcgcacttttacgaaaaa

SEQ ID NO: 120486 - DNA, 22 bp, Artificial sequence
  SiRNA target sequence
gctgcgcacttttacgaaaaat

SEQ ID NO: 120487 - DNA, 22 bp, Artificial sequence
  SiRNA target sequence
ctgcgcacttttacgaaaaatt

SEQ ID NO: 120488 - DNA, 22 bp, Artificial sequence
  SiRNA target sequence
tgcgcacttttacgaaaaattt

SEQ ID NO: 120489 - DNA, 22 bp, Artificial sequence
  SiRNA target sequence
gcgcacttttacgaaaaattta

SEQ ID NO: 120490 - DNA, 22 bp, Artificial sequence
  SiRNA target sequence
cgcacttttacgaaaaatttaa

SEQ ID NO: 120491 - DNA, 22 bp, Artificial sequence
  SiRNA target sequence
gcacttttacgaaaaatttaaa

SEQ ID NO: 120492 - DNA, 22 bp, Artificial sequence
  SiRNA target sequence
cacttttacgaaaaatttaaag

SEQ ID NO: 120493 - DNA, 22 bp, Artificial sequence
  SiRNA target sequence
acttttacgaaaaatttaaaga

SEQ ID NO: 120494 - DNA, 22 bp, Artificial sequence
  SiRNA target sequence
cttttacgaaaaatttaaagat

SEQ ID NO: 120495 - DNA, 22 bp, Artificial sequence
  SiRNA target sequence
ttttacgaaaaatttaaagata

SEQ ID NO: 120496 - DNA, 22 bp, Artificial sequence
  SiRNA target sequence
tttacgaaaaatttaaagatat

SEQ ID NO: 120497 - DNA, 22 bp, Artificial sequence
  SiRNA target sequence
ttacgaaaaatttaaagatata

SEQ ID NO: 120498 - DNA, 22 bp, Artificial sequence
  SiRNA target sequence
tacgaaaaatttaaagatataa

SEQ ID NO: 120499 - DNA, 22 bp, Artificial sequence
  SiRNA target sequence
acgaaaaatttaaagatataaa

SEQ ID NO: 120500 - DNA, 22 bp, Artificial sequence
  SiRNA target sequence
cgaaaaatttaaagatataaaa

SEQ ID NO: 120501 - DNA, 22 bp, Artificial sequence
  SiRNA target sequence
gaaaaatttaaagatataaaaa

SEQ ID NO: 120502 - DNA, 22 bp, Artificial sequence
  SiRNA target sequence
aaaaatttaaagatataaaaat

SEQ ID NO: 120503 - DNA, 22 bp, Artificial sequence
  SiRNA target sequence
aaaatttaaagatataaaaatt

SEQ ID NO: 120504 - DNA, 22 bp, Artificial sequence
  SiRNA target sequence
aaatttaaagatataaaaatta

SEQ ID NO: 120505 - DNA, 22 bp, Artificial sequence
  SiRNA target sequence
aatttaaagatataaaaattat

SEQ ID NO: 120506 - DNA, 22 bp, Artificial sequence
  SiRNA target sequence
atttaaagatataaaaattatg

SEQ ID NO: 120507 - DNA, 22 bp, Artificial sequence
  SiRNA target sequence
tttaaagatataaaaattatgc

SEQ ID NO: 120508 - DNA, 22 bp, Artificial sequence
  SiRNA target sequence
ttaaagatataaaaattatgcg

SEQ ID NO: 120509 - DNA, 22 bp, Artificial sequence
  SiRNA target sequence
taaagatataaaaattatgcgt

SEQ ID NO: 120510 - DNA, 22 bp, Artificial sequence
  SiRNA target sequence
aaagatataaaaattatgcgtg

SEQ ID NO: 120511 - DNA, 22 bp, Artificial sequence
  SiRNA target sequence
aagatataaaaattatgcgtgt

SEQ ID NO: 120512 - DNA, 22 bp, Artificial sequence
  SiRNA target sequence
agatataaaaattatgcgtgtt

SEQ ID NO: 120513 - DNA, 22 bp, Artificial sequence
  SiRNA target sequence
gatataaaaattatgcgtgttc

SEQ ID NO: 120514 - DNA, 22 bp, Artificial sequence
  SiRNA target sequence
atataaaaattatgcgtgttct

SEQ ID NO: 120515 - DNA, 22 bp, Artificial sequence
  SiRNA target sequence
tataaaaattatgcgtgttctt

SEQ ID NO: 120516 - DNA, 22 bp, Artificial sequence
  SiRNA target sequence
ataaaaattatgcgtgttcttg

SEQ ID NO: 120517 - DNA, 22 bp, Artificial sequence
  SiRNA target sequence
taaaaattatgcgtgttcttgc

SEQ ID NO: 120518 - DNA, 22 bp, Artificial sequence
  SiRNA target sequence
aaaaattatgcgtgttcttgcg

SEQ ID NO: 120519 - DNA, 22 bp, Artificial sequence
  SiRNA target sequence
aaaattatgcgtgttcttgcgc

SEQ ID NO: 120520 - DNA, 22 bp, Artificial sequence
  SiRNA target sequence
aaattatgcgtgttcttgcgca

SEQ ID NO: 120521 - DNA, 22 bp, Artificial sequence
  SiRNA target sequence
aattatgcgtgttcttgcgcaa

SEQ ID NO: 120522 - DNA, 22 bp, Artificial sequence
  SiRNA target sequence
attatgcgtgttcttgcgcaag

SEQ ID NO: 120523 - DNA, 22 bp, Artificial sequence
  SiRNA target sequence
ttatgcgtgttcttgcgcaaga

SEQ ID NO: 120524 - DNA, 22 bp, Artificial sequence
  SiRNA target sequence
tatgcgtgttcttgcgcaagat

SEQ ID NO: 120525 - DNA, 22 bp, Artificial sequence
  SiRNA target sequence
atgcgtgttcttgcgcaagata

SEQ ID NO: 120526 - DNA, 22 bp, Artificial sequence
  SiRNA target sequence
tgcgtgttcttgcgcaagatat

SEQ ID NO: 120527 - DNA, 22 bp, Artificial sequence
  SiRNA target sequence
gcgtgttcttgcgcaagatatt

SEQ ID NO: 120528 - DNA, 22 bp, Artificial sequence
  SiRNA target sequence
cgtgttcttgcgcaagatattc

SEQ ID NO: 120529 - DNA, 22 bp, Artificial sequence
  SiRNA target sequence
gtgttcttgcgcaagatattcc

SEQ ID NO: 120530 - DNA, 22 bp, Artificial sequence
  SiRNA target sequence
tgttcttgcgcaagatattcct

SEQ ID NO: 120531 - DNA, 22 bp, Artificial sequence
  SiRNA target sequence
gttcttgcgcaagatattccta

SEQ ID NO: 120532 - DNA, 22 bp, Artificial sequence
  SiRNA target sequence
ttcttgcgcaagatattcctac

SEQ ID NO: 120533 - DNA, 22 bp, Artificial sequence
  SiRNA target sequence
tcttgcgcaagatattcctaca

SEQ ID NO: 120534 - DNA, 22 bp, Artificial sequence
  SiRNA target sequence
cttgcgcaagatattcctacac

SEQ ID NO: 120535 - DNA, 22 bp, Artificial sequence
  SiRNA target sequence
ttgcgcaagatattcctacacc

SEQ ID NO: 120536 - DNA, 22 bp, Artificial sequence
  SiRNA target sequence
tgcgcaagatattcctacaccg

SEQ ID NO: 120537 - DNA, 22 bp, Artificial sequence
  SiRNA target sequence
gcgcaagatattcctacaccgt

SEQ ID NO: 120538 - DNA, 22 bp, Artificial sequence
  SiRNA target sequence
cgcaagatattcctacaccgta

SEQ ID NO: 120539 - DNA, 22 bp, Artificial sequence
  SiRNA target sequence
gcaagatattcctacaccgtat

SEQ ID NO: 120540 - DNA, 22 bp, Artificial sequence
  SiRNA target sequence
caagatattcctacaccgtatg

SEQ ID NO: 120541 - DNA, 22 bp, Artificial sequence
  SiRNA target sequence
aagatattcctacaccgtatgc

SEQ ID NO: 120542 - DNA, 22 bp, Artificial sequence
  SiRNA target sequence
agatattcctacaccgtatgca

SEQ ID NO: 120543 - DNA, 22 bp, Artificial sequence
  SiRNA target sequence
gatattcctacaccgtatgcac

SEQ ID NO: 120544 - DNA, 22 bp, Artificial sequence
  SiRNA target sequence
atattcctacaccgtatgcact

SEQ ID NO: 120545 - DNA, 22 bp, Artificial sequence
  SiRNA target sequence
tattcctacaccgtatgcactt

SEQ ID NO: 120546 - DNA, 22 bp, Artificial sequence
  SiRNA target sequence
attcctacaccgtatgcactta

SEQ ID NO: 120547 - DNA, 22 bp, Artificial sequence
  SiRNA target sequence
ttcctacaccgtatgcacttaa

SEQ ID NO: 120548 - DNA, 22 bp, Artificial sequence
  SiRNA target sequence
tcctacaccgtatgcacttaat

SEQ ID NO: 120549 - DNA, 22 bp, Artificial sequence
  SiRNA target sequence
cctacaccgtatgcacttaatc

SEQ ID NO: 120550 - DNA, 22 bp, Artificial sequence
  SiRNA target sequence
ctacaccgtatgcacttaatct

SEQ ID NO: 120551 - DNA, 22 bp, Artificial sequence
  SiRNA target sequence
tacaccgtatgcacttaatctt

SEQ ID NO: 120552 - DNA, 22 bp, Artificial sequence
  SiRNA target sequence
acaccgtatgcacttaatcttg

SEQ ID NO: 120553 - DNA, 22 bp, Artificial sequence
  SiRNA target sequence
caccgtatgcacttaatcttga

SEQ ID NO: 120554 - DNA, 22 bp, Artificial sequence
  SiRNA target sequence
accgtatgcacttaatcttgaa

SEQ ID NO: 120555 - DNA, 22 bp, Artificial sequence
  SiRNA target sequence
ccgtatgcacttaatcttgaaa

SEQ ID NO: 120556 - DNA, 22 bp, Artificial sequence
  SiRNA target sequence
cgtatgcacttaatcttgaaaa

SEQ ID NO: 120557 - DNA, 22 bp, Artificial sequence
  SiRNA target sequence
gtatgcacttaatcttgaaaaa

SEQ ID NO: 120558 - DNA, 22 bp, Artificial sequence
  SiRNA target sequence
tatgcacttaatcttgaaaaaa

SEQ ID NO: 120559 - DNA, 22 bp, Artificial sequence
  SiRNA target sequence
atgcacttaatcttgaaaaaat

SEQ ID NO: 120560 - DNA, 22 bp, Artificial sequence
  SiRNA target sequence
tgcacttaatcttgaaaaaatg

SEQ ID NO: 120561 - DNA, 22 bp, Artificial sequence
  SiRNA target sequence
gcacttaatcttgaaaaaatgt

SEQ ID NO: 120562 - DNA, 22 bp, Artificial sequence
  SiRNA target sequence
cacttaatcttgaaaaaatgtc

SEQ ID NO: 120563 - DNA, 22 bp, Artificial sequence
  SiRNA target sequence
acttaatcttgaaaaaatgtct

SEQ ID NO: 120564 - DNA, 22 bp, Artificial sequence
  SiRNA target sequence
cttaatcttgaaaaaatgtctt

SEQ ID NO: 120565 - DNA, 22 bp, Artificial sequence
  SiRNA target sequence
ttaatcttgaaaaaatgtctta

SEQ ID NO: 120566 - DNA, 22 bp, Artificial sequence
  SiRNA target sequence
taatcttgaaaaaatgtcttat

SEQ ID NO: 120567 - DNA, 22 bp, Artificial sequence
  SiRNA target sequence
aatcttgaaaaaatgtcttatc

SEQ ID NO: 120568 - DNA, 22 bp, Artificial sequence
  SiRNA target sequence
atcttgaaaaaatgtcttatcc

SEQ ID NO: 120569 - DNA, 22 bp, Artificial sequence
  SiRNA target sequence
tcttgaaaaaatgtcttatccg

SEQ ID NO: 120570 - DNA, 22 bp, Artificial sequence
  SiRNA target sequence
cttgaaaaaatgtcttatccga

SEQ ID NO: 120571 - DNA, 22 bp, Artificial sequence
  SiRNA target sequence
ttgaaaaaatgtcttatccgac

SEQ ID NO: 120572 - DNA, 22 bp, Artificial sequence
  SiRNA target sequence
tgaaaaaatgtcttatccgaca

SEQ ID NO: 120573 - DNA, 22 bp, Artificial sequence
  SiRNA target sequence
gaaaaaatgtcttatccgacat

SEQ ID NO: 120574 - DNA, 22 bp, Artificial sequence
  SiRNA target sequence
aaaaaatgtcttatccgacatg

SEQ ID NO: 120575 - DNA, 22 bp, Artificial sequence
  SiRNA target sequence
aaaaatgtcttatccgacatgc

SEQ ID NO: 120576 - DNA, 22 bp, Artificial sequence
  SiRNA target sequence
aaaatgtcttatccgacatgca

SEQ ID NO: 120577 - DNA, 22 bp, Artificial sequence
  SiRNA target sequence
aaatgtcttatccgacatgcaa

SEQ ID NO: 120578 - DNA, 22 bp, Artificial sequence
  SiRNA target sequence
aatgtcttatccgacatgcaat

SEQ ID NO: 120579 - DNA, 22 bp, Artificial sequence
  SiRNA target sequence
atgtcttatccgacatgcaatg

SEQ ID NO: 120580 - DNA, 22 bp, Artificial sequence
  SiRNA target sequence
tgtcttatccgacatgcaatga

SEQ ID NO: 120581 - DNA, 22 bp, Artificial sequence
  SiRNA target sequence
gtcttatccgacatgcaatgat

SEQ ID NO: 120582 - DNA, 22 bp, Artificial sequence
  SiRNA target sequence
tcttatccgacatgcaatgata

SEQ ID NO: 120583 - DNA, 22 bp, Artificial sequence
  SiRNA target sequence
cttatccgacatgcaatgatat

SEQ ID NO: 120584 - DNA, 22 bp, Artificial sequence
  SiRNA target sequence
ttatccgacatgcaatgatatt

SEQ ID NO: 120585 - DNA, 22 bp, Artificial sequence
  SiRNA target sequence
tatccgacatgcaatgatattg

SEQ ID NO: 120586 - DNA, 22 bp, Artificial sequence
  SiRNA target sequence
atccgacatgcaatgatattgt

SEQ ID NO: 120587 - DNA, 22 bp, Artificial sequence
  SiRNA target sequence
tccgacatgcaatgatattgta

SEQ ID NO: 120588 - DNA, 22 bp, Artificial sequence
  SiRNA target sequence
ccgacatgcaatgatattgtaa

SEQ ID NO: 120589 - DNA, 22 bp, Artificial sequence
  SiRNA target sequence
cgacatgcaatgatattgtaaa

SEQ ID NO: 120590 - DNA, 22 bp, Artificial sequence
  SiRNA target sequence
gacatgcaatgatattgtaaat

SEQ ID NO: 120591 - DNA, 22 bp, Artificial sequence
  SiRNA target sequence
acatgcaatgatattgtaaatg

SEQ ID NO: 120592 - DNA, 22 bp, Artificial sequence
  SiRNA target sequence
catgcaatgatattgtaaatgc

SEQ ID NO: 120593 - DNA, 22 bp, Artificial sequence
  SiRNA target sequence
atgcaatgatattgtaaatgct

SEQ ID NO: 120594 - DNA, 22 bp, Artificial sequence
  SiRNA target sequence
tgcaatgatattgtaaatgctg

SEQ ID NO: 120595 - DNA, 22 bp, Artificial sequence
  SiRNA target sequence
gcaatgatattgtaaatgctgt

SEQ ID NO: 120596 - DNA, 22 bp, Artificial sequence
  SiRNA target sequence
caatgatattgtaaatgctgtt

SEQ ID NO: 120597 - DNA, 22 bp, Artificial sequence
  SiRNA target sequence
aatgatattgtaaatgctgtta

SEQ ID NO: 120598 - DNA, 22 bp, Artificial sequence
  SiRNA target sequence
atgatattgtaaatgctgttac

SEQ ID NO: 120599 - DNA, 22 bp, Artificial sequence
  SiRNA target sequence
tgatattgtaaatgctgttaca

SEQ ID NO: 120600 - DNA, 22 bp, Artificial sequence
  SiRNA target sequence
gatattgtaaatgctgttacaa

SEQ ID NO: 120601 - DNA, 22 bp, Artificial sequence
  SiRNA target sequence
atattgtaaatgctgttacaaa

SEQ ID NO: 120602 - DNA, 22 bp, Artificial sequence
  SiRNA target sequence
tattgtaaatgctgttacaaaa

SEQ ID NO: 120603 - DNA, 22 bp, Artificial sequence
  SiRNA target sequence
attgtaaatgctgttacaaaaa

SEQ ID NO: 120604 - DNA, 22 bp, Artificial sequence
  SiRNA target sequence
ttgtaaatgctgttacaaaaat

SEQ ID NO: 120605 - DNA, 22 bp, Artificial sequence
  SiRNA target sequence
tgtaaatgctgttacaaaaata

SEQ ID NO: 120606 - DNA, 22 bp, Artificial sequence
  SiRNA target sequence
gtaaatgctgttacaaaaataa

SEQ ID NO: 120607 - DNA, 22 bp, Artificial sequence
  SiRNA target sequence
taaatgctgttacaaaaataaa

SEQ ID NO: 120608 - DNA, 22 bp, Artificial sequence
  SiRNA target sequence
aaatgctgttacaaaaataaat

SEQ ID NO: 120609 - DNA, 22 bp, Artificial sequence
  SiRNA target sequence
aatgctgttacaaaaataaatt

SEQ ID NO: 120610 - DNA, 22 bp, Artificial sequence
  SiRNA target sequence
atgctgttacaaaaataaattc

SEQ ID NO: 120611 - DNA, 22 bp, Artificial sequence
  SiRNA target sequence
tgctgttacaaaaataaattca

SEQ ID NO: 120612 - DNA, 22 bp, Artificial sequence
  SiRNA target sequence
gctgttacaaaaataaattcat

SEQ ID NO: 120613 - DNA, 22 bp, Artificial sequence
  SiRNA target sequence
ctgttacaaaaataaattcata

SEQ ID NO: 120614 - DNA, 22 bp, Artificial sequence
  SiRNA target sequence
tgttacaaaaataaattcatag

SEQ ID NO: 120615 - DNA, 23 bp, Artificial sequence
  SiRNA target sequence
atgatagaaattcgcgatcttat

SEQ ID NO: 120616 - DNA, 23 bp, Artificial sequence
  SiRNA target sequence
tgatagaaattcgcgatcttata

SEQ ID NO: 120617 - DNA, 23 bp, Artificial sequence
  SiRNA target sequence
gatagaaattcgcgatcttataa

SEQ ID NO: 120618 - DNA, 23 bp, Artificial sequence
  SiRNA target sequence
atagaaattcgcgatcttataaa

SEQ ID NO: 120619 - DNA, 23 bp, Artificial sequence
  SiRNA target sequence
tagaaattcgcgatcttataaat

SEQ ID NO: 120620 - DNA, 23 bp, Artificial sequence
  SiRNA target sequence
agaaattcgcgatcttataaatc

SEQ ID NO: 120621 - DNA, 23 bp, Artificial sequence
  SiRNA target sequence
gaaattcgcgatcttataaatca

SEQ ID NO: 120622 - DNA, 23 bp, Artificial sequence
  SiRNA target sequence
aaattcgcgatcttataaatcaa

SEQ ID NO: 120623 - DNA, 23 bp, Artificial sequence
  SiRNA target sequence
aattcgcgatcttataaatcaag

SEQ ID NO: 120624 - DNA, 23 bp, Artificial sequence
  SiRNA target sequence
attcgcgatcttataaatcaagc

SEQ ID NO: 120625 - DNA, 23 bp, Artificial sequence
  SiRNA target sequence
ttcgcgatcttataaatcaagca

SEQ ID NO: 120626 - DNA, 23 bp, Artificial sequence
  SiRNA target sequence
tcgcgatcttataaatcaagcat

SEQ ID NO: 120627 - DNA, 23 bp, Artificial sequence
  SiRNA target sequence
cgcgatcttataaatcaagcatt

SEQ ID NO: 120628 - DNA, 23 bp, Artificial sequence
  SiRNA target sequence
gcgatcttataaatcaagcattg

SEQ ID NO: 120629 - DNA, 23 bp, Artificial sequence
  SiRNA target sequence
cgatcttataaatcaagcattgg

SEQ ID NO: 120630 - DNA, 23 bp, Artificial sequence
  SiRNA target sequence
gatcttataaatcaagcattgga

SEQ ID NO: 120631 - DNA, 23 bp, Artificial sequence
  SiRNA target sequence
atcttataaatcaagcattggat

SEQ ID NO: 120632 - DNA, 23 bp, Artificial sequence
  SiRNA target sequence
tcttataaatcaagcattggatg

SEQ ID NO: 120633 - DNA, 23 bp, Artificial sequence
  SiRNA target sequence
cttataaatcaagcattggatga

SEQ ID NO: 120634 - DNA, 23 bp, Artificial sequence
  SiRNA target sequence
ttataaatcaagcattggatgag

SEQ ID NO: 120635 - DNA, 23 bp, Artificial sequence
  SiRNA target sequence
tataaatcaagcattggatgagg

SEQ ID NO: 120636 - DNA, 23 bp, Artificial sequence
  SiRNA target sequence
ataaatcaagcattggatgagga

SEQ ID NO: 120637 - DNA, 23 bp, Artificial sequence
  SiRNA target sequence
taaatcaagcattggatgaggaa

SEQ ID NO: 120638 - DNA, 23 bp, Artificial sequence
  SiRNA target sequence
aaatcaagcattggatgaggaaa

SEQ ID NO: 120639 - DNA, 23 bp, Artificial sequence
  SiRNA target sequence
aatcaagcattggatgaggaaat

SEQ ID NO: 120640 - DNA, 23 bp, Artificial sequence
  SiRNA target sequence
atcaagcattggatgaggaaatg

SEQ ID NO: 120641 - DNA, 23 bp, Artificial sequence
  SiRNA target sequence
tcaagcattggatgaggaaatgg

SEQ ID NO: 120642 - DNA, 23 bp, Artificial sequence
  SiRNA target sequence
caagcattggatgaggaaatggg

SEQ ID NO: 120643 - DNA, 23 bp, Artificial sequence
  SiRNA target sequence
aagcattggatgaggaaatggga

SEQ ID NO: 120644 - DNA, 23 bp, Artificial sequence
  SiRNA target sequence
agcattggatgaggaaatgggaa

SEQ ID NO: 120645 - DNA, 23 bp, Artificial sequence
  SiRNA target sequence
gcattggatgaggaaatgggaat

SEQ ID NO: 120646 - DNA, 23 bp, Artificial sequence
  SiRNA target sequence
cattggatgaggaaatgggaatg

SEQ ID NO: 120647 - DNA, 23 bp, Artificial sequence
  SiRNA target sequence
attggatgaggaaatgggaatgg

SEQ ID NO: 120648 - DNA, 23 bp, Artificial sequence
  SiRNA target sequence
ttggatgaggaaatgggaatgga

SEQ ID NO: 120649 - DNA, 23 bp, Artificial sequence
  SiRNA target sequence
tggatgaggaaatgggaatggat

SEQ ID NO: 120650 - DNA, 23 bp, Artificial sequence
  SiRNA target sequence
ggatgaggaaatgggaatggatc

SEQ ID NO: 120651 - DNA, 23 bp, Artificial sequence
  SiRNA target sequence
gatgaggaaatgggaatggatca

SEQ ID NO: 120652 - DNA, 23 bp, Artificial sequence
  SiRNA target sequence
atgaggaaatgggaatggatcat

SEQ ID NO: 120653 - DNA, 23 bp, Artificial sequence
  SiRNA target sequence
tgaggaaatgggaatggatcata

SEQ ID NO: 120654 - DNA, 23 bp, Artificial sequence
  SiRNA target sequence
gaggaaatgggaatggatcataa

SEQ ID NO: 120655 - DNA, 23 bp, Artificial sequence
  SiRNA target sequence
aggaaatgggaatggatcataat

SEQ ID NO: 120656 - DNA, 23 bp, Artificial sequence
  SiRNA target sequence
ggaaatgggaatggatcataatg

SEQ ID NO: 120657 - DNA, 23 bp, Artificial sequence
  SiRNA target sequence
gaaatgggaatggatcataatgt

SEQ ID NO: 120658 - DNA, 23 bp, Artificial sequence
  SiRNA target sequence
aaatgggaatggatcataatgta

SEQ ID NO: 120659 - DNA, 23 bp, Artificial sequence
  SiRNA target sequence
aatgggaatggatcataatgtat

SEQ ID NO: 120660 - DNA, 23 bp, Artificial sequence
  SiRNA target sequence
atgggaatggatcataatgtata

SEQ ID NO: 120661 - DNA, 23 bp, Artificial sequence
  SiRNA target sequence
tgggaatggatcataatgtatat

SEQ ID NO: 120662 - DNA, 23 bp, Artificial sequence
  SiRNA target sequence
gggaatggatcataatgtatata

SEQ ID NO: 120663 - DNA, 23 bp, Artificial sequence
  SiRNA target sequence
ggaatggatcataatgtatatat

SEQ ID NO: 120664 - DNA, 23 bp, Artificial sequence
  SiRNA target sequence
gaatggatcataatgtatatata

SEQ ID NO: 120665 - DNA, 23 bp, Artificial sequence
  SiRNA target sequence
aatggatcataatgtatatataa

SEQ ID NO: 120666 - DNA, 23 bp, Artificial sequence
  SiRNA target sequence
atggatcataatgtatatataat

SEQ ID NO: 120667 - DNA, 23 bp, Artificial sequence
  SiRNA target sequence
tggatcataatgtatatataata

SEQ ID NO: 120668 - DNA, 23 bp, Artificial sequence
  SiRNA target sequence
ggatcataatgtatatataatag

SEQ ID NO: 120669 - DNA, 23 bp, Artificial sequence
  SiRNA target sequence
gatcataatgtatatataatagg

SEQ ID NO: 120670 - DNA, 23 bp, Artificial sequence
  SiRNA target sequence
atcataatgtatatataatagga

SEQ ID NO: 120671 - DNA, 23 bp, Artificial sequence
  SiRNA target sequence
tcataatgtatatataataggag

SEQ ID NO: 120672 - DNA, 23 bp, Artificial sequence
  SiRNA target sequence
cataatgtatatataataggaga

SEQ ID NO: 120673 - DNA, 23 bp, Artificial sequence
  SiRNA target sequence
ataatgtatatataataggagaa

SEQ ID NO: 120674 - DNA, 23 bp, Artificial sequence
  SiRNA target sequence
taatgtatatataataggagaag

SEQ ID NO: 120675 - DNA, 23 bp, Artificial sequence
  SiRNA target sequence
aatgtatatataataggagaaga

SEQ ID NO: 120676 - DNA, 23 bp, Artificial sequence
  SiRNA target sequence
atgtatatataataggagaagaa

SEQ ID NO: 120677 - DNA, 23 bp, Artificial sequence
  SiRNA target sequence
tgtatatataataggagaagaag

SEQ ID NO: 120678 - DNA, 23 bp, Artificial sequence
  SiRNA target sequence
gtatatataataggagaagaagt

SEQ ID NO: 120679 - DNA, 23 bp, Artificial sequence
  SiRNA target sequence
tatatataataggagaagaagta

SEQ ID NO: 120680 - DNA, 23 bp, Artificial sequence
  SiRNA target sequence
atatataataggagaagaagtag

SEQ ID NO: 120681 - DNA, 23 bp, Artificial sequence
  SiRNA target sequence
tatataataggagaagaagtagg

SEQ ID NO: 120682 - DNA, 23 bp, Artificial sequence
  SiRNA target sequence
atataataggagaagaagtaggc

SEQ ID NO: 120683 - DNA, 23 bp, Artificial sequence
  SiRNA target sequence
tataataggagaagaagtaggca

SEQ ID NO: 120684 - DNA, 23 bp, Artificial sequence
  SiRNA target sequence
ataataggagaagaagtaggcat

SEQ ID NO: 120685 - DNA, 23 bp, Artificial sequence
  SiRNA target sequence
taataggagaagaagtaggcatc

SEQ ID NO: 120686 - DNA, 23 bp, Artificial sequence
  SiRNA target sequence
aataggagaagaagtaggcatct

SEQ ID NO: 120687 - DNA, 23 bp, Artificial sequence
  SiRNA target sequence
ataggagaagaagtaggcatctc

SEQ ID NO: 120688 - DNA, 23 bp, Artificial sequence
  SiRNA target sequence
taggagaagaagtaggcatctct

SEQ ID NO: 120689 - DNA, 23 bp, Artificial sequence
  SiRNA target sequence
aggagaagaagtaggcatctctg

SEQ ID NO: 120690 - DNA, 23 bp, Artificial sequence
  SiRNA target sequence
ggagaagaagtaggcatctctgg

SEQ ID NO: 120691 - DNA, 23 bp, Artificial sequence
  SiRNA target sequence
gagaagaagtaggcatctctggt

SEQ ID NO: 120692 - DNA, 23 bp, Artificial sequence
  SiRNA target sequence
agaagaagtaggcatctctggtg

SEQ ID NO: 120693 - DNA, 23 bp, Artificial sequence
  SiRNA target sequence
gaagaagtaggcatctctggtgg

SEQ ID NO: 120694 - DNA, 23 bp, Artificial sequence
  SiRNA target sequence
aagaagtaggcatctctggtggt

SEQ ID NO: 120695 - DNA, 23 bp, Artificial sequence
  SiRNA target sequence
agaagtaggcatctctggtggtc

SEQ ID NO: 120696 - DNA, 23 bp, Artificial sequence
  SiRNA target sequence
gaagtaggcatctctggtggtcc

SEQ ID NO: 120697 - DNA, 23 bp, Artificial sequence
  SiRNA target sequence
aagtaggcatctctggtggtcct

SEQ ID NO: 120698 - DNA, 23 bp, Artificial sequence
  SiRNA target sequence
agtaggcatctctggtggtcctc

SEQ ID NO: 120699 - DNA, 23 bp, Artificial sequence
  SiRNA target sequence
gtaggcatctctggtggtcctca

SEQ ID NO: 120700 - DNA, 23 bp, Artificial sequence
  SiRNA target sequence
taggcatctctggtggtcctcac

SEQ ID NO: 120701 - DNA, 23 bp, Artificial sequence
  SiRNA target sequence
aggcatctctggtggtcctcacg

SEQ ID NO: 120702 - DNA, 23 bp, Artificial sequence
  SiRNA target sequence
ggcatctctggtggtcctcacgg

SEQ ID NO: 120703 - DNA, 23 bp, Artificial sequence
  SiRNA target sequence
gcatctctggtggtcctcacggt

SEQ ID NO: 120704 - DNA, 23 bp, Artificial sequence
  SiRNA target sequence
catctctggtggtcctcacggtc

SEQ ID NO: 120705 - DNA, 23 bp, Artificial sequence
  SiRNA target sequence
atctctggtggtcctcacggtct

SEQ ID NO: 120706 - DNA, 23 bp, Artificial sequence
  SiRNA target sequence
tctctggtggtcctcacggtctt

SEQ ID NO: 120707 - DNA, 23 bp, Artificial sequence
  SiRNA target sequence
ctctggtggtcctcacggtctta

SEQ ID NO: 120708 - DNA, 23 bp, Artificial sequence
  SiRNA target sequence
tctggtggtcctcacggtcttac

SEQ ID NO: 120709 - DNA, 23 bp, Artificial sequence
  SiRNA target sequence
ctggtggtcctcacggtcttact

SEQ ID NO: 120710 - DNA, 23 bp, Artificial sequence
  SiRNA target sequence
tggtggtcctcacggtcttacta

SEQ ID NO: 120711 - DNA, 23 bp, Artificial sequence
  SiRNA target sequence
ggtggtcctcacggtcttactaa

SEQ ID NO: 120712 - DNA, 23 bp, Artificial sequence
  SiRNA target sequence
gtggtcctcacggtcttactaaa

SEQ ID NO: 120713 - DNA, 23 bp, Artificial sequence
  SiRNA target sequence
tggtcctcacggtcttactaaaa

SEQ ID NO: 120714 - DNA, 23 bp, Artificial sequence
  SiRNA target sequence
ggtcctcacggtcttactaaaaa

SEQ ID NO: 120715 - DNA, 23 bp, Artificial sequence
  SiRNA target sequence
gtcctcacggtcttactaaaaat

SEQ ID NO: 120716 - DNA, 23 bp, Artificial sequence
  SiRNA target sequence
tcctcacggtcttactaaaaatt

SEQ ID NO: 120717 - DNA, 23 bp, Artificial sequence
  SiRNA target sequence
cctcacggtcttactaaaaattt

SEQ ID NO: 120718 - DNA, 23 bp, Artificial sequence
  SiRNA target sequence
ctcacggtcttactaaaaatttg

SEQ ID NO: 120719 - DNA, 23 bp, Artificial sequence
  SiRNA target sequence
tcacggtcttactaaaaatttga

SEQ ID NO: 120720 - DNA, 23 bp, Artificial sequence
  SiRNA target sequence
cacggtcttactaaaaatttgat

SEQ ID NO: 120721 - DNA, 23 bp, Artificial sequence
  SiRNA target sequence
acggtcttactaaaaatttgatc

SEQ ID NO: 120722 - DNA, 23 bp, Artificial sequence
  SiRNA target sequence
cggtcttactaaaaatttgatca

SEQ ID NO: 120723 - DNA, 23 bp, Artificial sequence
  SiRNA target sequence
ggtcttactaaaaatttgatcaa

SEQ ID NO: 120724 - DNA, 23 bp, Artificial sequence
  SiRNA target sequence
gtcttactaaaaatttgatcaaa

SEQ ID NO: 120725 - DNA, 23 bp, Artificial sequence
  SiRNA target sequence
tcttactaaaaatttgatcaaaa

SEQ ID NO: 120726 - DNA, 23 bp, Artificial sequence
  SiRNA target sequence
cttactaaaaatttgatcaaaaa

SEQ ID NO: 120727 - DNA, 23 bp, Artificial sequence
  SiRNA target sequence
ttactaaaaatttgatcaaaaaa

SEQ ID NO: 120728 - DNA, 23 bp, Artificial sequence
  SiRNA target sequence
tactaaaaatttgatcaaaaaat

SEQ ID NO: 120729 - DNA, 23 bp, Artificial sequence
  SiRNA target sequence
actaaaaatttgatcaaaaaata

SEQ ID NO: 120730 - DNA, 23 bp, Artificial sequence
  SiRNA target sequence
ctaaaaatttgatcaaaaaatac

SEQ ID NO: 120731 - DNA, 23 bp, Artificial sequence
  SiRNA target sequence
taaaaatttgatcaaaaaatacg

SEQ ID NO: 120732 - DNA, 23 bp, Artificial sequence
  SiRNA target sequence
aaaaatttgatcaaaaaatacgg

SEQ ID NO: 120733 - DNA, 23 bp, Artificial sequence
  SiRNA target sequence
aaaatttgatcaaaaaatacggc

SEQ ID NO: 120734 - DNA, 23 bp, Artificial sequence
  SiRNA target sequence
aaatttgatcaaaaaatacggcg

SEQ ID NO: 120735 - DNA, 23 bp, Artificial sequence
  SiRNA target sequence
aatttgatcaaaaaatacggcga

SEQ ID NO: 120736 - DNA, 23 bp, Artificial sequence
  SiRNA target sequence
atttgatcaaaaaatacggcgat

SEQ ID NO: 120737 - DNA, 23 bp, Artificial sequence
  SiRNA target sequence
tttgatcaaaaaatacggcgatc

SEQ ID NO: 120738 - DNA, 23 bp, Artificial sequence
  SiRNA target sequence
ttgatcaaaaaatacggcgatca

SEQ ID NO: 120739 - DNA, 23 bp, Artificial sequence
  SiRNA target sequence
tgatcaaaaaatacggcgatcaa

SEQ ID NO: 120740 - DNA, 23 bp, Artificial sequence
  SiRNA target sequence
gatcaaaaaatacggcgatcaaa

SEQ ID NO: 120741 - DNA, 23 bp, Artificial sequence
  SiRNA target sequence
atcaaaaaatacggcgatcaaag

SEQ ID NO: 120742 - DNA, 23 bp, Artificial sequence
  SiRNA target sequence
tcaaaaaatacggcgatcaaaga

SEQ ID NO: 120743 - DNA, 23 bp, Artificial sequence
  SiRNA target sequence
caaaaaatacggcgatcaaagag

SEQ ID NO: 120744 - DNA, 23 bp, Artificial sequence
  SiRNA target sequence
aaaaaatacggcgatcaaagagt

SEQ ID NO: 120745 - DNA, 23 bp, Artificial sequence
  SiRNA target sequence
aaaaatacggcgatcaaagagtg

SEQ ID NO: 120746 - DNA, 23 bp, Artificial sequence
  SiRNA target sequence
aaaatacggcgatcaaagagtga

SEQ ID NO: 120747 - DNA, 23 bp, Artificial sequence
  SiRNA target sequence
aaatacggcgatcaaagagtgaa

SEQ ID NO: 120748 - DNA, 23 bp, Artificial sequence
  SiRNA target sequence
aatacggcgatcaaagagtgaag

SEQ ID NO: 120749 - DNA, 23 bp, Artificial sequence
  SiRNA target sequence
atacggcgatcaaagagtgaagg

SEQ ID NO: 120750 - DNA, 23 bp, Artificial sequence
  SiRNA target sequence
tacggcgatcaaagagtgaagga

SEQ ID NO: 120751 - DNA, 23 bp, Artificial sequence
  SiRNA target sequence
acggcgatcaaagagtgaaggat

SEQ ID NO: 120752 - DNA, 23 bp, Artificial sequence
  SiRNA target sequence
cggcgatcaaagagtgaaggata

SEQ ID NO: 120753 - DNA, 23 bp, Artificial sequence
  SiRNA target sequence
ggcgatcaaagagtgaaggatac

SEQ ID NO: 120754 - DNA, 23 bp, Artificial sequence
  SiRNA target sequence
gcgatcaaagagtgaaggatacc

SEQ ID NO: 120755 - DNA, 23 bp, Artificial sequence
  SiRNA target sequence
cgatcaaagagtgaaggataccc

SEQ ID NO: 120756 - DNA, 23 bp, Artificial sequence
  SiRNA target sequence
gatcaaagagtgaaggatacccc

SEQ ID NO: 120757 - DNA, 23 bp, Artificial sequence
  SiRNA target sequence
atcaaagagtgaaggatacccct

SEQ ID NO: 120758 - DNA, 23 bp, Artificial sequence
  SiRNA target sequence
tcaaagagtgaaggataccccta

SEQ ID NO: 120759 - DNA, 23 bp, Artificial sequence
  SiRNA target sequence
caaagagtgaaggatacccctat

SEQ ID NO: 120760 - DNA, 23 bp, Artificial sequence
  SiRNA target sequence
aaagagtgaaggatacccctatt

SEQ ID NO: 120761 - DNA, 23 bp, Artificial sequence
  SiRNA target sequence
aagagtgaaggatacccctattt

SEQ ID NO: 120762 - DNA, 23 bp, Artificial sequence
  SiRNA target sequence
agagtgaaggatacccctatttc

SEQ ID NO: 120763 - DNA, 23 bp, Artificial sequence
  SiRNA target sequence
gagtgaaggatacccctatttcg

SEQ ID NO: 120764 - DNA, 23 bp, Artificial sequence
  SiRNA target sequence
agtgaaggatacccctatttcgg

SEQ ID NO: 120765 - DNA, 23 bp, Artificial sequence
  SiRNA target sequence
gtgaaggatacccctatttcgga

SEQ ID NO: 120766 - DNA, 23 bp, Artificial sequence
  SiRNA target sequence
tgaaggatacccctatttcggaa

SEQ ID NO: 120767 - DNA, 23 bp, Artificial sequence
  SiRNA target sequence
gaaggatacccctatttcggaaa

SEQ ID NO: 120768 - DNA, 23 bp, Artificial sequence
  SiRNA target sequence
aaggatacccctatttcggaaat

SEQ ID NO: 120769 - DNA, 23 bp, Artificial sequence
  SiRNA target sequence
aggatacccctatttcggaaatg

SEQ ID NO: 120770 - DNA, 23 bp, Artificial sequence
  SiRNA target sequence
ggatacccctatttcggaaatgg

SEQ ID NO: 120771 - DNA, 23 bp, Artificial sequence
  SiRNA target sequence
gatacccctatttcggaaatggg

SEQ ID NO: 120772 - DNA, 23 bp, Artificial sequence
  SiRNA target sequence
atacccctatttcggaaatggga

SEQ ID NO: 120773 - DNA, 23 bp, Artificial sequence
  SiRNA target sequence
tacccctatttcggaaatgggat

SEQ ID NO: 120774 - DNA, 23 bp, Artificial sequence
  SiRNA target sequence
acccctatttcggaaatgggatt

SEQ ID NO: 120775 - DNA, 23 bp, Artificial sequence
  SiRNA target sequence
cccctatttcggaaatgggattt

SEQ ID NO: 120776 - DNA, 23 bp, Artificial sequence
  SiRNA target sequence
ccctatttcggaaatgggattta

SEQ ID NO: 120777 - DNA, 23 bp, Artificial sequence
  SiRNA target sequence
cctatttcggaaatgggatttac

SEQ ID NO: 120778 - DNA, 23 bp, Artificial sequence
  SiRNA target sequence
ctatttcggaaatgggatttaca

SEQ ID NO: 120779 - DNA, 23 bp, Artificial sequence
  SiRNA target sequence
tatttcggaaatgggatttacag

SEQ ID NO: 120780 - DNA, 23 bp, Artificial sequence
  SiRNA target sequence
atttcggaaatgggatttacagg

SEQ ID NO: 120781 - DNA, 23 bp, Artificial sequence
  SiRNA target sequence
tttcggaaatgggatttacaggt

SEQ ID NO: 120782 - DNA, 23 bp, Artificial sequence
  SiRNA target sequence
ttcggaaatgggatttacaggtc

SEQ ID NO: 120783 - DNA, 23 bp, Artificial sequence
  SiRNA target sequence
tcggaaatgggatttacaggtct

SEQ ID NO: 120784 - DNA, 23 bp, Artificial sequence
  SiRNA target sequence
cggaaatgggatttacaggtctc

SEQ ID NO: 120785 - DNA, 23 bp, Artificial sequence
  SiRNA target sequence
ggaaatgggatttacaggtctcg

SEQ ID NO: 120786 - DNA, 23 bp, Artificial sequence
  SiRNA target sequence
gaaatgggatttacaggtctcgc

SEQ ID NO: 120787 - DNA, 23 bp, Artificial sequence
  SiRNA target sequence
aaatgggatttacaggtctcgct

SEQ ID NO: 120788 - DNA, 23 bp, Artificial sequence
  SiRNA target sequence
aatgggatttacaggtctcgctg

SEQ ID NO: 120789 - DNA, 23 bp, Artificial sequence
  SiRNA target sequence
atgggatttacaggtctcgctgt

SEQ ID NO: 120790 - DNA, 23 bp, Artificial sequence
  SiRNA target sequence
tgggatttacaggtctcgctgtg

SEQ ID NO: 120791 - DNA, 23 bp, Artificial sequence
  SiRNA target sequence
gggatttacaggtctcgctgtgg

SEQ ID NO: 120792 - DNA, 23 bp, Artificial sequence
  SiRNA target sequence
ggatttacaggtctcgctgtggg

SEQ ID NO: 120793 - DNA, 23 bp, Artificial sequence
  SiRNA target sequence
gatttacaggtctcgctgtgggt

SEQ ID NO: 120794 - DNA, 23 bp, Artificial sequence
  SiRNA target sequence
atttacaggtctcgctgtgggtt

SEQ ID NO: 120795 - DNA, 23 bp, Artificial sequence
  SiRNA target sequence
tttacaggtctcgctgtgggttc

SEQ ID NO: 120796 - DNA, 23 bp, Artificial sequence
  SiRNA target sequence
ttacaggtctcgctgtgggttca

SEQ ID NO: 120797 - DNA, 23 bp, Artificial sequence
  SiRNA target sequence
tacaggtctcgctgtgggttcaa

SEQ ID NO: 120798 - DNA, 23 bp, Artificial sequence
  SiRNA target sequence
acaggtctcgctgtgggttcaag

SEQ ID NO: 120799 - DNA, 23 bp, Artificial sequence
  SiRNA target sequence
caggtctcgctgtgggttcaagc

SEQ ID NO: 120800 - DNA, 23 bp, Artificial sequence
  SiRNA target sequence
aggtctcgctgtgggttcaagct

SEQ ID NO: 120801 - DNA, 23 bp, Artificial sequence
  SiRNA target sequence
ggtctcgctgtgggttcaagcta

SEQ ID NO: 120802 - DNA, 23 bp, Artificial sequence
  SiRNA target sequence
gtctcgctgtgggttcaagctat

SEQ ID NO: 120803 - DNA, 23 bp, Artificial sequence
  SiRNA target sequence
tctcgctgtgggttcaagctatt

SEQ ID NO: 120804 - DNA, 23 bp, Artificial sequence
  SiRNA target sequence
ctcgctgtgggttcaagctattt

SEQ ID NO: 120805 - DNA, 23 bp, Artificial sequence
  SiRNA target sequence
tcgctgtgggttcaagctattta

SEQ ID NO: 120806 - DNA, 23 bp, Artificial sequence
  SiRNA target sequence
cgctgtgggttcaagctatttag

SEQ ID NO: 120807 - DNA, 23 bp, Artificial sequence
  SiRNA target sequence
gctgtgggttcaagctatttagg

SEQ ID NO: 120808 - DNA, 23 bp, Artificial sequence
  SiRNA target sequence
ctgtgggttcaagctatttaggg

SEQ ID NO: 120809 - DNA, 23 bp, Artificial sequence
  SiRNA target sequence
tgtgggttcaagctatttagggt

SEQ ID NO: 120810 - DNA, 23 bp, Artificial sequence
  SiRNA target sequence
gtgggttcaagctatttagggtt

SEQ ID NO: 120811 - DNA, 23 bp, Artificial sequence
  SiRNA target sequence
tgggttcaagctatttagggtta

SEQ ID NO: 120812 - DNA, 23 bp, Artificial sequence
  SiRNA target sequence
gggttcaagctatttagggttaa

SEQ ID NO: 120813 - DNA, 23 bp, Artificial sequence
  SiRNA target sequence
ggttcaagctatttagggttaag

SEQ ID NO: 120814 - DNA, 23 bp, Artificial sequence
  SiRNA target sequence
gttcaagctatttagggttaaga

SEQ ID NO: 120815 - DNA, 23 bp, Artificial sequence
  SiRNA target sequence
ttcaagctatttagggttaagac

SEQ ID NO: 120816 - DNA, 23 bp, Artificial sequence
  SiRNA target sequence
tcaagctatttagggttaagacc

SEQ ID NO: 120817 - DNA, 23 bp, Artificial sequence
  SiRNA target sequence
caagctatttagggttaagaccc

SEQ ID NO: 120818 - DNA, 23 bp, Artificial sequence
  SiRNA target sequence
aagctatttagggttaagacccg

SEQ ID NO: 120819 - DNA, 23 bp, Artificial sequence
  SiRNA target sequence
agctatttagggttaagacccgt

SEQ ID NO: 120820 - DNA, 23 bp, Artificial sequence
  SiRNA target sequence
gctatttagggttaagacccgta

SEQ ID NO: 120821 - DNA, 23 bp, Artificial sequence
  SiRNA target sequence
ctatttagggttaagacccgtag

SEQ ID NO: 120822 - DNA, 23 bp, Artificial sequence
  SiRNA target sequence
tatttagggttaagacccgtagt

SEQ ID NO: 120823 - DNA, 23 bp, Artificial sequence
  SiRNA target sequence
atttagggttaagacccgtagta

SEQ ID NO: 120824 - DNA, 23 bp, Artificial sequence
  SiRNA target sequence
tttagggttaagacccgtagtag

SEQ ID NO: 120825 - DNA, 23 bp, Artificial sequence
  SiRNA target sequence
ttagggttaagacccgtagtaga

SEQ ID NO: 120826 - DNA, 23 bp, Artificial sequence
  SiRNA target sequence
tagggttaagacccgtagtagat

SEQ ID NO: 120827 - DNA, 23 bp, Artificial sequence
  SiRNA target sequence
agggttaagacccgtagtagatt

SEQ ID NO: 120828 - DNA, 23 bp, Artificial sequence
  SiRNA target sequence
gggttaagacccgtagtagattt

SEQ ID NO: 120829 - DNA, 23 bp, Artificial sequence
  SiRNA target sequence
ggttaagacccgtagtagatttt

SEQ ID NO: 120830 - DNA, 23 bp, Artificial sequence
  SiRNA target sequence
gttaagacccgtagtagatttta

SEQ ID NO: 120831 - DNA, 23 bp, Artificial sequence
  SiRNA target sequence
ttaagacccgtagtagattttat

SEQ ID NO: 120832 - DNA, 23 bp, Artificial sequence
  SiRNA target sequence
taagacccgtagtagattttatg

SEQ ID NO: 120833 - DNA, 23 bp, Artificial sequence
  SiRNA target sequence
aagacccgtagtagattttatga

SEQ ID NO: 120834 - DNA, 23 bp, Artificial sequence
  SiRNA target sequence
agacccgtagtagattttatgac

SEQ ID NO: 120835 - DNA, 23 bp, Artificial sequence
  SiRNA target sequence
gacccgtagtagattttatgact

SEQ ID NO: 120836 - DNA, 23 bp, Artificial sequence
  SiRNA target sequence
acccgtagtagattttatgactt

SEQ ID NO: 120837 - DNA, 23 bp, Artificial sequence
  SiRNA target sequence
cccgtagtagattttatgacttg

SEQ ID NO: 120838 - DNA, 23 bp, Artificial sequence
  SiRNA target sequence
ccgtagtagattttatgacttgg

SEQ ID NO: 120839 - DNA, 23 bp, Artificial sequence
  SiRNA target sequence
cgtagtagattttatgacttgga

SEQ ID NO: 120840 - DNA, 23 bp, Artificial sequence
  SiRNA target sequence
gtagtagattttatgacttggaa

SEQ ID NO: 120841 - DNA, 23 bp, Artificial sequence
  SiRNA target sequence
tagtagattttatgacttggaat

SEQ ID NO: 120842 - DNA, 23 bp, Artificial sequence
  SiRNA target sequence
agtagattttatgacttggaatt

SEQ ID NO: 120843 - DNA, 23 bp, Artificial sequence
  SiRNA target sequence
gtagattttatgacttggaattt

SEQ ID NO: 120844 - DNA, 23 bp, Artificial sequence
  SiRNA target sequence
tagattttatgacttggaatttt

SEQ ID NO: 120845 - DNA, 23 bp, Artificial sequence
  SiRNA target sequence
agattttatgacttggaattttg

SEQ ID NO: 120846 - DNA, 23 bp, Artificial sequence
  SiRNA target sequence
gattttatgacttggaattttgc

SEQ ID NO: 120847 - DNA, 23 bp, Artificial sequence
  SiRNA target sequence
attttatgacttggaattttgct

SEQ ID NO: 120848 - DNA, 23 bp, Artificial sequence
  SiRNA target sequence
ttttatgacttggaattttgctt

SEQ ID NO: 120849 - DNA, 23 bp, Artificial sequence
  SiRNA target sequence
tttatgacttggaattttgcttt

SEQ ID NO: 120850 - DNA, 23 bp, Artificial sequence
  SiRNA target sequence
ttatgacttggaattttgctttg

SEQ ID NO: 120851 - DNA, 23 bp, Artificial sequence
  SiRNA target sequence
tatgacttggaattttgctttgc

SEQ ID NO: 120852 - DNA, 23 bp, Artificial sequence
  SiRNA target sequence
atgacttggaattttgctttgca

SEQ ID NO: 120853 - DNA, 23 bp, Artificial sequence
  SiRNA target sequence
tgacttggaattttgctttgcaa

SEQ ID NO: 120854 - DNA, 23 bp, Artificial sequence
  SiRNA target sequence
gacttggaattttgctttgcaat

SEQ ID NO: 120855 - DNA, 23 bp, Artificial sequence
  SiRNA target sequence
acttggaattttgctttgcaatc

SEQ ID NO: 120856 - DNA, 23 bp, Artificial sequence
  SiRNA target sequence
cttggaattttgctttgcaatca

SEQ ID NO: 120857 - DNA, 23 bp, Artificial sequence
  SiRNA target sequence
ttggaattttgctttgcaatcaa

SEQ ID NO: 120858 - DNA, 23 bp, Artificial sequence
  SiRNA target sequence
tggaattttgctttgcaatcaat

SEQ ID NO: 120859 - DNA, 23 bp, Artificial sequence
  SiRNA target sequence
ggaattttgctttgcaatcaatt

SEQ ID NO: 120860 - DNA, 23 bp, Artificial sequence
  SiRNA target sequence
gaattttgctttgcaatcaattg

SEQ ID NO: 120861 - DNA, 23 bp, Artificial sequence
  SiRNA target sequence
aattttgctttgcaatcaattga

SEQ ID NO: 120862 - DNA, 23 bp, Artificial sequence
  SiRNA target sequence
attttgctttgcaatcaattgac

SEQ ID NO: 120863 - DNA, 23 bp, Artificial sequence
  SiRNA target sequence
ttttgctttgcaatcaattgacc

SEQ ID NO: 120864 - DNA, 23 bp, Artificial sequence
  SiRNA target sequence
tttgctttgcaatcaattgacca

SEQ ID NO: 120865 - DNA, 23 bp, Artificial sequence
  SiRNA target sequence
ttgctttgcaatcaattgaccat

SEQ ID NO: 120866 - DNA, 23 bp, Artificial sequence
  SiRNA target sequence
tgctttgcaatcaattgaccata

SEQ ID NO: 120867 - DNA, 23 bp, Artificial sequence
  SiRNA target sequence
gctttgcaatcaattgaccatat

SEQ ID NO: 120868 - DNA, 23 bp, Artificial sequence
  SiRNA target sequence
ctttgcaatcaattgaccatatt

SEQ ID NO: 120869 - DNA, 23 bp, Artificial sequence
  SiRNA target sequence
tttgcaatcaattgaccatatta

SEQ ID NO: 120870 - DNA, 23 bp, Artificial sequence
  SiRNA target sequence
ttgcaatcaattgaccatattat

SEQ ID NO: 120871 - DNA, 23 bp, Artificial sequence
  SiRNA target sequence
tgcaatcaattgaccatattatt

SEQ ID NO: 120872 - DNA, 23 bp, Artificial sequence
  SiRNA target sequence
gcaatcaattgaccatattatta

SEQ ID NO: 120873 - DNA, 23 bp, Artificial sequence
  SiRNA target sequence
caatcaattgaccatattattaa

SEQ ID NO: 120874 - DNA, 23 bp, Artificial sequence
  SiRNA target sequence
aatcaattgaccatattattaat

SEQ ID NO: 120875 - DNA, 23 bp, Artificial sequence
  SiRNA target sequence
atcaattgaccatattattaatt

SEQ ID NO: 120876 - DNA, 23 bp, Artificial sequence
  SiRNA target sequence
tcaattgaccatattattaattc

SEQ ID NO: 120877 - DNA, 23 bp, Artificial sequence
  SiRNA target sequence
caattgaccatattattaattct

SEQ ID NO: 120878 - DNA, 23 bp, Artificial sequence
  SiRNA target sequence
aattgaccatattattaattctt

SEQ ID NO: 120879 - DNA, 23 bp, Artificial sequence
  SiRNA target sequence
attgaccatattattaattcttg

SEQ ID NO: 120880 - DNA, 23 bp, Artificial sequence
  SiRNA target sequence
ttgaccatattattaattcttgt

SEQ ID NO: 120881 - DNA, 23 bp, Artificial sequence
  SiRNA target sequence
tgaccatattattaattcttgtg

SEQ ID NO: 120882 - DNA, 23 bp, Artificial sequence
  SiRNA target sequence
gaccatattattaattcttgtgc

SEQ ID NO: 120883 - DNA, 23 bp, Artificial sequence
  SiRNA target sequence
accatattattaattcttgtgcg

SEQ ID NO: 120884 - DNA, 23 bp, Artificial sequence
  SiRNA target sequence
ccatattattaattcttgtgcga

SEQ ID NO: 120885 - DNA, 23 bp, Artificial sequence
  SiRNA target sequence
catattattaattcttgtgcgaa

SEQ ID NO: 120886 - DNA, 23 bp, Artificial sequence
  SiRNA target sequence
atattattaattcttgtgcgaaa

SEQ ID NO: 120887 - DNA, 23 bp, Artificial sequence
  SiRNA target sequence
tattattaattcttgtgcgaaaa

SEQ ID NO: 120888 - DNA, 23 bp, Artificial sequence
  SiRNA target sequence
attattaattcttgtgcgaaaac

SEQ ID NO: 120889 - DNA, 23 bp, Artificial sequence
  SiRNA target sequence
ttattaattcttgtgcgaaaacc

SEQ ID NO: 120890 - DNA, 23 bp, Artificial sequence
  SiRNA target sequence
tattaattcttgtgcgaaaacct

SEQ ID NO: 120891 - DNA, 23 bp, Artificial sequence
  SiRNA target sequence
attaattcttgtgcgaaaacctt

SEQ ID NO: 120892 - DNA, 23 bp, Artificial sequence
  SiRNA target sequence
ttaattcttgtgcgaaaaccttg

SEQ ID NO: 120893 - DNA, 23 bp, Artificial sequence
  SiRNA target sequence
taattcttgtgcgaaaaccttgt

SEQ ID NO: 120894 - DNA, 23 bp, Artificial sequence
  SiRNA target sequence
aattcttgtgcgaaaaccttgta

SEQ ID NO: 120895 - DNA, 23 bp, Artificial sequence
  SiRNA target sequence
attcttgtgcgaaaaccttgtat

SEQ ID NO: 120896 - DNA, 23 bp, Artificial sequence
  SiRNA target sequence
ttcttgtgcgaaaaccttgtata

SEQ ID NO: 120897 - DNA, 23 bp, Artificial sequence
  SiRNA target sequence
tcttgtgcgaaaaccttgtatat

SEQ ID NO: 120898 - DNA, 23 bp, Artificial sequence
  SiRNA target sequence
cttgtgcgaaaaccttgtatatg

SEQ ID NO: 120899 - DNA, 23 bp, Artificial sequence
  SiRNA target sequence
ttgtgcgaaaaccttgtatatgt

SEQ ID NO: 120900 - DNA, 23 bp, Artificial sequence
  SiRNA target sequence
tgtgcgaaaaccttgtatatgtc

SEQ ID NO: 120901 - DNA, 23 bp, Artificial sequence
  SiRNA target sequence
gtgcgaaaaccttgtatatgtca

SEQ ID NO: 120902 - DNA, 23 bp, Artificial sequence
  SiRNA target sequence
tgcgaaaaccttgtatatgtcag

SEQ ID NO: 120903 - DNA, 23 bp, Artificial sequence
  SiRNA target sequence
gcgaaaaccttgtatatgtcagg

SEQ ID NO: 120904 - DNA, 23 bp, Artificial sequence
  SiRNA target sequence
cgaaaaccttgtatatgtcagga

SEQ ID NO: 120905 - DNA, 23 bp, Artificial sequence
  SiRNA target sequence
gaaaaccttgtatatgtcaggag

SEQ ID NO: 120906 - DNA, 23 bp, Artificial sequence
  SiRNA target sequence
aaaaccttgtatatgtcaggagg

SEQ ID NO: 120907 - DNA, 23 bp, Artificial sequence
  SiRNA target sequence
aaaccttgtatatgtcaggagga

SEQ ID NO: 120908 - DNA, 23 bp, Artificial sequence
  SiRNA target sequence
aaccttgtatatgtcaggaggaa

SEQ ID NO: 120909 - DNA, 23 bp, Artificial sequence
  SiRNA target sequence
accttgtatatgtcaggaggaag

SEQ ID NO: 120910 - DNA, 23 bp, Artificial sequence
  SiRNA target sequence
ccttgtatatgtcaggaggaaga

SEQ ID NO: 120911 - DNA, 23 bp, Artificial sequence
  SiRNA target sequence
cttgtatatgtcaggaggaagaa

SEQ ID NO: 120912 - DNA, 23 bp, Artificial sequence
  SiRNA target sequence
ttgtatatgtcaggaggaagaat

SEQ ID NO: 120913 - DNA, 23 bp, Artificial sequence
  SiRNA target sequence
tgtatatgtcaggaggaagaata

SEQ ID NO: 120914 - DNA, 23 bp, Artificial sequence
  SiRNA target sequence
gtatatgtcaggaggaagaatac

SEQ ID NO: 120915 - DNA, 23 bp, Artificial sequence
  SiRNA target sequence
tatatgtcaggaggaagaataca

SEQ ID NO: 120916 - DNA, 23 bp, Artificial sequence
  SiRNA target sequence
atatgtcaggaggaagaatacaa

SEQ ID NO: 120917 - DNA, 23 bp, Artificial sequence
  SiRNA target sequence
tatgtcaggaggaagaatacaat

SEQ ID NO: 120918 - DNA, 23 bp, Artificial sequence
  SiRNA target sequence
atgtcaggaggaagaatacaatg

SEQ ID NO: 120919 - DNA, 23 bp, Artificial sequence
  SiRNA target sequence
tgtcaggaggaagaatacaatgt

SEQ ID NO: 120920 - DNA, 23 bp, Artificial sequence
  SiRNA target sequence
gtcaggaggaagaatacaatgtc

SEQ ID NO: 120921 - DNA, 23 bp, Artificial sequence
  SiRNA target sequence
tcaggaggaagaatacaatgtcc

SEQ ID NO: 120922 - DNA, 23 bp, Artificial sequence
  SiRNA target sequence
caggaggaagaatacaatgtcca

SEQ ID NO: 120923 - DNA, 23 bp, Artificial sequence
  SiRNA target sequence
aggaggaagaatacaatgtccaa

SEQ ID NO: 120924 - DNA, 23 bp, Artificial sequence
  SiRNA target sequence
ggaggaagaatacaatgtccaat

SEQ ID NO: 120925 - DNA, 23 bp, Artificial sequence
  SiRNA target sequence
gaggaagaatacaatgtccaatt

SEQ ID NO: 120926 - DNA, 23 bp, Artificial sequence
  SiRNA target sequence
aggaagaatacaatgtccaattg

SEQ ID NO: 120927 - DNA, 23 bp, Artificial sequence
  SiRNA target sequence
ggaagaatacaatgtccaattgt

SEQ ID NO: 120928 - DNA, 23 bp, Artificial sequence
  SiRNA target sequence
gaagaatacaatgtccaattgtt

SEQ ID NO: 120929 - DNA, 23 bp, Artificial sequence
  SiRNA target sequence
aagaatacaatgtccaattgttt

SEQ ID NO: 120930 - DNA, 23 bp, Artificial sequence
  SiRNA target sequence
agaatacaatgtccaattgtttt

SEQ ID NO: 120931 - DNA, 23 bp, Artificial sequence
  SiRNA target sequence
gaatacaatgtccaattgttttt

SEQ ID NO: 120932 - DNA, 23 bp, Artificial sequence
  SiRNA target sequence
aatacaatgtccaattgttttta

SEQ ID NO: 120933 - DNA, 23 bp, Artificial sequence
  SiRNA target sequence
atacaatgtccaattgtttttag

SEQ ID NO: 120934 - DNA, 23 bp, Artificial sequence
  SiRNA target sequence
tacaatgtccaattgtttttagg

SEQ ID NO: 120935 - DNA, 23 bp, Artificial sequence
  SiRNA target sequence
acaatgtccaattgtttttaggg

SEQ ID NO: 120936 - DNA, 23 bp, Artificial sequence
  SiRNA target sequence
caatgtccaattgtttttagggg

SEQ ID NO: 120937 - DNA, 23 bp, Artificial sequence
  SiRNA target sequence
aatgtccaattgtttttagggga

SEQ ID NO: 120938 - DNA, 23 bp, Artificial sequence
  SiRNA target sequence
atgtccaattgtttttaggggac

SEQ ID NO: 120939 - DNA, 23 bp, Artificial sequence
  SiRNA target sequence
tgtccaattgtttttaggggacc

SEQ ID NO: 120940 - DNA, 23 bp, Artificial sequence
  SiRNA target sequence
gtccaattgtttttaggggacca

SEQ ID NO: 120941 - DNA, 23 bp, Artificial sequence
  SiRNA target sequence
tccaattgtttttaggggaccaa

SEQ ID NO: 120942 - DNA, 23 bp, Artificial sequence
  SiRNA target sequence
ccaattgtttttaggggaccaaa

SEQ ID NO: 120943 - DNA, 23 bp, Artificial sequence
  SiRNA target sequence
caattgtttttaggggaccaaat

SEQ ID NO: 120944 - DNA, 23 bp, Artificial sequence
  SiRNA target sequence
aattgtttttaggggaccaaatg

SEQ ID NO: 120945 - DNA, 23 bp, Artificial sequence
  SiRNA target sequence
attgtttttaggggaccaaatgg

SEQ ID NO: 120946 - DNA, 23 bp, Artificial sequence
  SiRNA target sequence
ttgtttttaggggaccaaatgga

SEQ ID NO: 120947 - DNA, 23 bp, Artificial sequence
  SiRNA target sequence
tgtttttaggggaccaaatggat

SEQ ID NO: 120948 - DNA, 23 bp, Artificial sequence
  SiRNA target sequence
gtttttaggggaccaaatggatt

SEQ ID NO: 120949 - DNA, 23 bp, Artificial sequence
  SiRNA target sequence
tttttaggggaccaaatggattc

SEQ ID NO: 120950 - DNA, 23 bp, Artificial sequence
  SiRNA target sequence
ttttaggggaccaaatggattca

SEQ ID NO: 120951 - DNA, 23 bp, Artificial sequence
  SiRNA target sequence
tttaggggaccaaatggattcaa

SEQ ID NO: 120952 - DNA, 23 bp, Artificial sequence
  SiRNA target sequence
ttaggggaccaaatggattcaat

SEQ ID NO: 120953 - DNA, 23 bp, Artificial sequence
  SiRNA target sequence
taggggaccaaatggattcaata

SEQ ID NO: 120954 - DNA, 23 bp, Artificial sequence
  SiRNA target sequence
aggggaccaaatggattcaataa

SEQ ID NO: 120955 - DNA, 23 bp, Artificial sequence
  SiRNA target sequence
ggggaccaaatggattcaataat

SEQ ID NO: 120956 - DNA, 23 bp, Artificial sequence
  SiRNA target sequence
gggaccaaatggattcaataatg

SEQ ID NO: 120957 - DNA, 23 bp, Artificial sequence
  SiRNA target sequence
ggaccaaatggattcaataatgg

SEQ ID NO: 120958 - DNA, 23 bp, Artificial sequence
  SiRNA target sequence
gaccaaatggattcaataatggg

SEQ ID NO: 120959 - DNA, 23 bp, Artificial sequence
  SiRNA target sequence
accaaatggattcaataatgggt

SEQ ID NO: 120960 - DNA, 23 bp, Artificial sequence
  SiRNA target sequence
ccaaatggattcaataatgggta

SEQ ID NO: 120961 - DNA, 23 bp, Artificial sequence
  SiRNA target sequence
caaatggattcaataatgggtac

SEQ ID NO: 120962 - DNA, 23 bp, Artificial sequence
  SiRNA target sequence
aaatggattcaataatgggtacg

SEQ ID NO: 120963 - DNA, 23 bp, Artificial sequence
  SiRNA target sequence
aatggattcaataatgggtacgc

SEQ ID NO: 120964 - DNA, 23 bp, Artificial sequence
  SiRNA target sequence
atggattcaataatgggtacgct

SEQ ID NO: 120965 - DNA, 23 bp, Artificial sequence
  SiRNA target sequence
tggattcaataatgggtacgctg

SEQ ID NO: 120966 - DNA, 23 bp, Artificial sequence
  SiRNA target sequence
ggattcaataatgggtacgctgc

SEQ ID NO: 120967 - DNA, 23 bp, Artificial sequence
  SiRNA target sequence
gattcaataatgggtacgctgca

SEQ ID NO: 120968 - DNA, 23 bp, Artificial sequence
  SiRNA target sequence
attcaataatgggtacgctgcac

SEQ ID NO: 120969 - DNA, 23 bp, Artificial sequence
  SiRNA target sequence
ttcaataatgggtacgctgcaca

SEQ ID NO: 120970 - DNA, 23 bp, Artificial sequence
  SiRNA target sequence
tcaataatgggtacgctgcacag

SEQ ID NO: 120971 - DNA, 23 bp, Artificial sequence
  SiRNA target sequence
caataatgggtacgctgcacagc

SEQ ID NO: 120972 - DNA, 23 bp, Artificial sequence
  SiRNA target sequence
aataatgggtacgctgcacagca

SEQ ID NO: 120973 - DNA, 23 bp, Artificial sequence
  SiRNA target sequence
ataatgggtacgctgcacagcac

SEQ ID NO: 120974 - DNA, 23 bp, Artificial sequence
  SiRNA target sequence
taatgggtacgctgcacagcaca

SEQ ID NO: 120975 - DNA, 23 bp, Artificial sequence
  SiRNA target sequence
aatgggtacgctgcacagcacac

SEQ ID NO: 120976 - DNA, 23 bp, Artificial sequence
  SiRNA target sequence
atgggtacgctgcacagcacaca

SEQ ID NO: 120977 - DNA, 23 bp, Artificial sequence
  SiRNA target sequence
tgggtacgctgcacagcacacac

SEQ ID NO: 120978 - DNA, 23 bp, Artificial sequence
  SiRNA target sequence
gggtacgctgcacagcacacaca

SEQ ID NO: 120979 - DNA, 23 bp, Artificial sequence
  SiRNA target sequence
ggtacgctgcacagcacacacaa

SEQ ID NO: 120980 - DNA, 23 bp, Artificial sequence
  SiRNA target sequence
gtacgctgcacagcacacacaag

SEQ ID NO: 120981 - DNA, 23 bp, Artificial sequence
  SiRNA target sequence
tacgctgcacagcacacacaaga

SEQ ID NO: 120982 - DNA, 23 bp, Artificial sequence
  SiRNA target sequence
acgctgcacagcacacacaagat

SEQ ID NO: 120983 - DNA, 23 bp, Artificial sequence
  SiRNA target sequence
cgctgcacagcacacacaagatt

SEQ ID NO: 120984 - DNA, 23 bp, Artificial sequence
  SiRNA target sequence
gctgcacagcacacacaagattt

SEQ ID NO: 120985 - DNA, 23 bp, Artificial sequence
  SiRNA target sequence
ctgcacagcacacacaagatttt

SEQ ID NO: 120986 - DNA, 23 bp, Artificial sequence
  SiRNA target sequence
tgcacagcacacacaagattttg

SEQ ID NO: 120987 - DNA, 23 bp, Artificial sequence
  SiRNA target sequence
gcacagcacacacaagattttgc

SEQ ID NO: 120988 - DNA, 23 bp, Artificial sequence
  SiRNA target sequence
cacagcacacacaagattttgca

SEQ ID NO: 120989 - DNA, 23 bp, Artificial sequence
  SiRNA target sequence
acagcacacacaagattttgcac

SEQ ID NO: 120990 - DNA, 23 bp, Artificial sequence
  SiRNA target sequence
cagcacacacaagattttgcacc

SEQ ID NO: 120991 - DNA, 23 bp, Artificial sequence
  SiRNA target sequence
agcacacacaagattttgcacca

SEQ ID NO: 120992 - DNA, 23 bp, Artificial sequence
  SiRNA target sequence
gcacacacaagattttgcaccaa

SEQ ID NO: 120993 - DNA, 23 bp, Artificial sequence
  SiRNA target sequence
cacacacaagattttgcaccaat

SEQ ID NO: 120994 - DNA, 23 bp, Artificial sequence
  SiRNA target sequence
acacacaagattttgcaccaata

SEQ ID NO: 120995 - DNA, 23 bp, Artificial sequence
  SiRNA target sequence
cacacaagattttgcaccaatat

SEQ ID NO: 120996 - DNA, 23 bp, Artificial sequence
  SiRNA target sequence
acacaagattttgcaccaatata

SEQ ID NO: 120997 - DNA, 23 bp, Artificial sequence
  SiRNA target sequence
cacaagattttgcaccaatatat

SEQ ID NO: 120998 - DNA, 23 bp, Artificial sequence
  SiRNA target sequence
acaagattttgcaccaatatatg

SEQ ID NO: 120999 - DNA, 23 bp, Artificial sequence
  SiRNA target sequence
caagattttgcaccaatatatgg

SEQ ID NO: 121000 - DNA, 23 bp, Artificial sequence
  SiRNA target sequence
aagattttgcaccaatatatggt

SEQ ID NO: 121001 - DNA, 23 bp, Artificial sequence
  SiRNA target sequence
agattttgcaccaatatatggtt

SEQ ID NO: 121002 - DNA, 23 bp, Artificial sequence
  SiRNA target sequence
gattttgcaccaatatatggttc

SEQ ID NO: 121003 - DNA, 23 bp, Artificial sequence
  SiRNA target sequence
attttgcaccaatatatggttct

SEQ ID NO: 121004 - DNA, 23 bp, Artificial sequence
  SiRNA target sequence
ttttgcaccaatatatggttcta

SEQ ID NO: 121005 - DNA, 23 bp, Artificial sequence
  SiRNA target sequence
tttgcaccaatatatggttctat

SEQ ID NO: 121006 - DNA, 23 bp, Artificial sequence
  SiRNA target sequence
ttgcaccaatatatggttctatt

SEQ ID NO: 121007 - DNA, 23 bp, Artificial sequence
  SiRNA target sequence
tgcaccaatatatggttctattc

SEQ ID NO: 121008 - DNA, 23 bp, Artificial sequence
  SiRNA target sequence
gcaccaatatatggttctattcc

SEQ ID NO: 121009 - DNA, 23 bp, Artificial sequence
  SiRNA target sequence
caccaatatatggttctattcca

SEQ ID NO: 121010 - DNA, 23 bp, Artificial sequence
  SiRNA target sequence
accaatatatggttctattccag

SEQ ID NO: 121011 - DNA, 23 bp, Artificial sequence
  SiRNA target sequence
ccaatatatggttctattccagg

SEQ ID NO: 121012 - DNA, 23 bp, Artificial sequence
  SiRNA target sequence
caatatatggttctattccaggc

SEQ ID NO: 121013 - DNA, 23 bp, Artificial sequence
  SiRNA target sequence
aatatatggttctattccaggcc

SEQ ID NO: 121014 - DNA, 23 bp, Artificial sequence
  SiRNA target sequence
atatatggttctattccaggcct

SEQ ID NO: 121015 - DNA, 23 bp, Artificial sequence
  SiRNA target sequence
tatatggttctattccaggcctt

SEQ ID NO: 121016 - DNA, 23 bp, Artificial sequence
  SiRNA target sequence
atatggttctattccaggcctta

SEQ ID NO: 121017 - DNA, 23 bp, Artificial sequence
  SiRNA target sequence
tatggttctattccaggccttaa

SEQ ID NO: 121018 - DNA, 23 bp, Artificial sequence
  SiRNA target sequence
atggttctattccaggccttaag

SEQ ID NO: 121019 - DNA, 23 bp, Artificial sequence
  SiRNA target sequence
tggttctattccaggccttaagg

SEQ ID NO: 121020 - DNA, 23 bp, Artificial sequence
  SiRNA target sequence
ggttctattccaggccttaaggt

SEQ ID NO: 121021 - DNA, 23 bp, Artificial sequence
  SiRNA target sequence
gttctattccaggccttaaggtg

SEQ ID NO: 121022 - DNA, 23 bp, Artificial sequence
  SiRNA target sequence
ttctattccaggccttaaggtgg

SEQ ID NO: 121023 - DNA, 23 bp, Artificial sequence
  SiRNA target sequence
tctattccaggccttaaggtggt

SEQ ID NO: 121024 - DNA, 23 bp, Artificial sequence
  SiRNA target sequence
ctattccaggccttaaggtggtt

SEQ ID NO: 121025 - DNA, 23 bp, Artificial sequence
  SiRNA target sequence
tattccaggccttaaggtggttt

SEQ ID NO: 121026 - DNA, 23 bp, Artificial sequence
  SiRNA target sequence
attccaggccttaaggtggtttg

SEQ ID NO: 121027 - DNA, 23 bp, Artificial sequence
  SiRNA target sequence
ttccaggccttaaggtggtttgt

SEQ ID NO: 121028 - DNA, 23 bp, Artificial sequence
  SiRNA target sequence
tccaggccttaaggtggtttgtc

SEQ ID NO: 121029 - DNA, 23 bp, Artificial sequence
  SiRNA target sequence
ccaggccttaaggtggtttgtcc

SEQ ID NO: 121030 - DNA, 23 bp, Artificial sequence
  SiRNA target sequence
caggccttaaggtggtttgtcct

SEQ ID NO: 121031 - DNA, 23 bp, Artificial sequence
  SiRNA target sequence
aggccttaaggtggtttgtcctt

SEQ ID NO: 121032 - DNA, 23 bp, Artificial sequence
  SiRNA target sequence
ggccttaaggtggtttgtcctta

SEQ ID NO: 121033 - DNA, 23 bp, Artificial sequence
  SiRNA target sequence
gccttaaggtggtttgtccttat

SEQ ID NO: 121034 - DNA, 23 bp, Artificial sequence
  SiRNA target sequence
ccttaaggtggtttgtccttata

SEQ ID NO: 121035 - DNA, 23 bp, Artificial sequence
  SiRNA target sequence
cttaaggtggtttgtccttatac

SEQ ID NO: 121036 - DNA, 23 bp, Artificial sequence
  SiRNA target sequence
ttaaggtggtttgtccttatacg

SEQ ID NO: 121037 - DNA, 23 bp, Artificial sequence
  SiRNA target sequence
taaggtggtttgtccttatacgg

SEQ ID NO: 121038 - DNA, 23 bp, Artificial sequence
  SiRNA target sequence
aaggtggtttgtccttatacggg

SEQ ID NO: 121039 - DNA, 23 bp, Artificial sequence
  SiRNA target sequence
aggtggtttgtccttatacgggt

SEQ ID NO: 121040 - DNA, 23 bp, Artificial sequence
  SiRNA target sequence
ggtggtttgtccttatacgggta

SEQ ID NO: 121041 - DNA, 23 bp, Artificial sequence
  SiRNA target sequence
gtggtttgtccttatacgggtaa

SEQ ID NO: 121042 - DNA, 23 bp, Artificial sequence
  SiRNA target sequence
tggtttgtccttatacgggtaaa

SEQ ID NO: 121043 - DNA, 23 bp, Artificial sequence
  SiRNA target sequence
ggtttgtccttatacgggtaaag

SEQ ID NO: 121044 - DNA, 23 bp, Artificial sequence
  SiRNA target sequence
gtttgtccttatacgggtaaaga

SEQ ID NO: 121045 - DNA, 23 bp, Artificial sequence
  SiRNA target sequence
tttgtccttatacgggtaaagac

SEQ ID NO: 121046 - DNA, 23 bp, Artificial sequence
  SiRNA target sequence
ttgtccttatacgggtaaagacc

SEQ ID NO: 121047 - DNA, 23 bp, Artificial sequence
  SiRNA target sequence
tgtccttatacgggtaaagacca

SEQ ID NO: 121048 - DNA, 23 bp, Artificial sequence
  SiRNA target sequence
gtccttatacgggtaaagaccat

SEQ ID NO: 121049 - DNA, 23 bp, Artificial sequence
  SiRNA target sequence
tccttatacgggtaaagaccata

SEQ ID NO: 121050 - DNA, 23 bp, Artificial sequence
  SiRNA target sequence
ccttatacgggtaaagaccataa

SEQ ID NO: 121051 - DNA, 23 bp, Artificial sequence
  SiRNA target sequence
cttatacgggtaaagaccataaa

SEQ ID NO: 121052 - DNA, 23 bp, Artificial sequence
  SiRNA target sequence
ttatacgggtaaagaccataaag

SEQ ID NO: 121053 - DNA, 23 bp, Artificial sequence
  SiRNA target sequence
tatacgggtaaagaccataaagg

SEQ ID NO: 121054 - DNA, 23 bp, Artificial sequence
  SiRNA target sequence
atacgggtaaagaccataaagga

SEQ ID NO: 121055 - DNA, 23 bp, Artificial sequence
  SiRNA target sequence
tacgggtaaagaccataaaggac

SEQ ID NO: 121056 - DNA, 23 bp, Artificial sequence
  SiRNA target sequence
acgggtaaagaccataaaggact

SEQ ID NO: 121057 - DNA, 23 bp, Artificial sequence
  SiRNA target sequence
cgggtaaagaccataaaggactt

SEQ ID NO: 121058 - DNA, 23 bp, Artificial sequence
  SiRNA target sequence
gggtaaagaccataaaggacttt

SEQ ID NO: 121059 - DNA, 23 bp, Artificial sequence
  SiRNA target sequence
ggtaaagaccataaaggactttt

SEQ ID NO: 121060 - DNA, 23 bp, Artificial sequence
  SiRNA target sequence
gtaaagaccataaaggactttta

SEQ ID NO: 121061 - DNA, 23 bp, Artificial sequence
  SiRNA target sequence
taaagaccataaaggacttttaa

SEQ ID NO: 121062 - DNA, 23 bp, Artificial sequence
  SiRNA target sequence
aaagaccataaaggacttttaaa

SEQ ID NO: 121063 - DNA, 23 bp, Artificial sequence
  SiRNA target sequence
aagaccataaaggacttttaaaa

SEQ ID NO: 121064 - DNA, 23 bp, Artificial sequence
  SiRNA target sequence
agaccataaaggacttttaaaaa

SEQ ID NO: 121065 - DNA, 23 bp, Artificial sequence
  SiRNA target sequence
gaccataaaggacttttaaaaag

SEQ ID NO: 121066 - DNA, 23 bp, Artificial sequence
  SiRNA target sequence
accataaaggacttttaaaaagc

SEQ ID NO: 121067 - DNA, 23 bp, Artificial sequence
  SiRNA target sequence
ccataaaggacttttaaaaagcg

SEQ ID NO: 121068 - DNA, 23 bp, Artificial sequence
  SiRNA target sequence
cataaaggacttttaaaaagcgc

SEQ ID NO: 121069 - DNA, 23 bp, Artificial sequence
  SiRNA target sequence
ataaaggacttttaaaaagcgct

SEQ ID NO: 121070 - DNA, 23 bp, Artificial sequence
  SiRNA target sequence
taaaggacttttaaaaagcgcta

SEQ ID NO: 121071 - DNA, 23 bp, Artificial sequence
  SiRNA target sequence
aaaggacttttaaaaagcgctat

SEQ ID NO: 121072 - DNA, 23 bp, Artificial sequence
  SiRNA target sequence
aaggacttttaaaaagcgctatt

SEQ ID NO: 121073 - DNA, 23 bp, Artificial sequence
  SiRNA target sequence
aggacttttaaaaagcgctatta

SEQ ID NO: 121074 - DNA, 23 bp, Artificial sequence
  SiRNA target sequence
ggacttttaaaaagcgctattag

SEQ ID NO: 121075 - DNA, 23 bp, Artificial sequence
  SiRNA target sequence
gacttttaaaaagcgctattaga

SEQ ID NO: 121076 - DNA, 23 bp, Artificial sequence
  SiRNA target sequence
acttttaaaaagcgctattagag

SEQ ID NO: 121077 - DNA, 23 bp, Artificial sequence
  SiRNA target sequence
cttttaaaaagcgctattagaga

SEQ ID NO: 121078 - DNA, 23 bp, Artificial sequence
  SiRNA target sequence
ttttaaaaagcgctattagagac

SEQ ID NO: 121079 - DNA, 23 bp, Artificial sequence
  SiRNA target sequence
tttaaaaagcgctattagagaca

SEQ ID NO: 121080 - DNA, 23 bp, Artificial sequence
  SiRNA target sequence
ttaaaaagcgctattagagacaa

SEQ ID NO: 121081 - DNA, 23 bp, Artificial sequence
  SiRNA target sequence
taaaaagcgctattagagacaat

SEQ ID NO: 121082 - DNA, 23 bp, Artificial sequence
  SiRNA target sequence
aaaaagcgctattagagacaata

SEQ ID NO: 121083 - DNA, 23 bp, Artificial sequence
  SiRNA target sequence
aaaagcgctattagagacaataa

SEQ ID NO: 121084 - DNA, 23 bp, Artificial sequence
  SiRNA target sequence
aaagcgctattagagacaataac

SEQ ID NO: 121085 - DNA, 23 bp, Artificial sequence
  SiRNA target sequence
aagcgctattagagacaataacc

SEQ ID NO: 121086 - DNA, 23 bp, Artificial sequence
  SiRNA target sequence
agcgctattagagacaataaccc

SEQ ID NO: 121087 - DNA, 23 bp, Artificial sequence
  SiRNA target sequence
gcgctattagagacaataacccg

SEQ ID NO: 121088 - DNA, 23 bp, Artificial sequence
  SiRNA target sequence
cgctattagagacaataacccgg

SEQ ID NO: 121089 - DNA, 23 bp, Artificial sequence
  SiRNA target sequence
gctattagagacaataacccggt

SEQ ID NO: 121090 - DNA, 23 bp, Artificial sequence
  SiRNA target sequence
ctattagagacaataacccggtt

SEQ ID NO: 121091 - DNA, 23 bp, Artificial sequence
  SiRNA target sequence
tattagagacaataacccggtta

SEQ ID NO: 121092 - DNA, 23 bp, Artificial sequence
  SiRNA target sequence
attagagacaataacccggttat

SEQ ID NO: 121093 - DNA, 23 bp, Artificial sequence
  SiRNA target sequence
ttagagacaataacccggttata

SEQ ID NO: 121094 - DNA, 23 bp, Artificial sequence
  SiRNA target sequence
tagagacaataacccggttatat

SEQ ID NO: 121095 - DNA, 23 bp, Artificial sequence
  SiRNA target sequence
agagacaataacccggttatatt

SEQ ID NO: 121096 - DNA, 23 bp, Artificial sequence
  SiRNA target sequence
gagacaataacccggttatattt

SEQ ID NO: 121097 - DNA, 23 bp, Artificial sequence
  SiRNA target sequence
agacaataacccggttatatttc

SEQ ID NO: 121098 - DNA, 23 bp, Artificial sequence
  SiRNA target sequence
gacaataacccggttatatttct

SEQ ID NO: 121099 - DNA, 23 bp, Artificial sequence
  SiRNA target sequence
acaataacccggttatatttctt

SEQ ID NO: 121100 - DNA, 23 bp, Artificial sequence
  SiRNA target sequence
caataacccggttatatttcttg

SEQ ID NO: 121101 - DNA, 23 bp, Artificial sequence
  SiRNA target sequence
aataacccggttatatttcttga

SEQ ID NO: 121102 - DNA, 23 bp, Artificial sequence
  SiRNA target sequence
ataacccggttatatttcttgag

SEQ ID NO: 121103 - DNA, 23 bp, Artificial sequence
  SiRNA target sequence
taacccggttatatttcttgaga

SEQ ID NO: 121104 - DNA, 23 bp, Artificial sequence
  SiRNA target sequence
aacccggttatatttcttgagaa

SEQ ID NO: 121105 - DNA, 23 bp, Artificial sequence
  SiRNA target sequence
acccggttatatttcttgagaat

SEQ ID NO: 121106 - DNA, 23 bp, Artificial sequence
  SiRNA target sequence
cccggttatatttcttgagaatg

SEQ ID NO: 121107 - DNA, 23 bp, Artificial sequence
  SiRNA target sequence
ccggttatatttcttgagaatga

SEQ ID NO: 121108 - DNA, 23 bp, Artificial sequence
  SiRNA target sequence
cggttatatttcttgagaatgaa

SEQ ID NO: 121109 - DNA, 23 bp, Artificial sequence
  SiRNA target sequence
ggttatatttcttgagaatgaaa

SEQ ID NO: 121110 - DNA, 23 bp, Artificial sequence
  SiRNA target sequence
gttatatttcttgagaatgaaat

SEQ ID NO: 121111 - DNA, 23 bp, Artificial sequence
  SiRNA target sequence
ttatatttcttgagaatgaaata

SEQ ID NO: 121112 - DNA, 23 bp, Artificial sequence
  SiRNA target sequence
tatatttcttgagaatgaaatat

SEQ ID NO: 121113 - DNA, 23 bp, Artificial sequence
  SiRNA target sequence
atatttcttgagaatgaaatatt

SEQ ID NO: 121114 - DNA, 23 bp, Artificial sequence
  SiRNA target sequence
tatttcttgagaatgaaatatta

SEQ ID NO: 121115 - DNA, 23 bp, Artificial sequence
  SiRNA target sequence
atttcttgagaatgaaatattat

SEQ ID NO: 121116 - DNA, 23 bp, Artificial sequence
  SiRNA target sequence
tttcttgagaatgaaatattata

SEQ ID NO: 121117 - DNA, 23 bp, Artificial sequence
  SiRNA target sequence
ttcttgagaatgaaatattatat

SEQ ID NO: 121118 - DNA, 23 bp, Artificial sequence
  SiRNA target sequence
tcttgagaatgaaatattatata

SEQ ID NO: 121119 - DNA, 23 bp, Artificial sequence
  SiRNA target sequence
cttgagaatgaaatattatataa

SEQ ID NO: 121120 - DNA, 23 bp, Artificial sequence
  SiRNA target sequence
ttgagaatgaaatattatataaa

SEQ ID NO: 121121 - DNA, 23 bp, Artificial sequence
  SiRNA target sequence
tgagaatgaaatattatataaag

SEQ ID NO: 121122 - DNA, 23 bp, Artificial sequence
  SiRNA target sequence
gagaatgaaatattatataaaga

SEQ ID NO: 121123 - DNA, 23 bp, Artificial sequence
  SiRNA target sequence
agaatgaaatattatataaagat

SEQ ID NO: 121124 - DNA, 23 bp, Artificial sequence
  SiRNA target sequence
gaatgaaatattatataaagata

SEQ ID NO: 121125 - DNA, 23 bp, Artificial sequence
  SiRNA target sequence
aatgaaatattatataaagataa

SEQ ID NO: 121126 - DNA, 23 bp, Artificial sequence
  SiRNA target sequence
atgaaatattatataaagataaa

SEQ ID NO: 121127 - DNA, 23 bp, Artificial sequence
  SiRNA target sequence
tgaaatattatataaagataaat

SEQ ID NO: 121128 - DNA, 23 bp, Artificial sequence
  SiRNA target sequence
gaaatattatataaagataaata

SEQ ID NO: 121129 - DNA, 23 bp, Artificial sequence
  SiRNA target sequence
aaatattatataaagataaatac

SEQ ID NO: 121130 - DNA, 23 bp, Artificial sequence
  SiRNA target sequence
aatattatataaagataaatacc

SEQ ID NO: 121131 - DNA, 23 bp, Artificial sequence
  SiRNA target sequence
atattatataaagataaatacct

SEQ ID NO: 121132 - DNA, 23 bp, Artificial sequence
  SiRNA target sequence
tattatataaagataaatacctt

SEQ ID NO: 121133 - DNA, 23 bp, Artificial sequence
  SiRNA target sequence
attatataaagataaataccttg

SEQ ID NO: 121134 - DNA, 23 bp, Artificial sequence
  SiRNA target sequence
ttatataaagataaataccttga

SEQ ID NO: 121135 - DNA, 23 bp, Artificial sequence
  SiRNA target sequence
tatataaagataaataccttgaa

SEQ ID NO: 121136 - DNA, 23 bp, Artificial sequence
  SiRNA target sequence
atataaagataaataccttgaag

SEQ ID NO: 121137 - DNA, 23 bp, Artificial sequence
  SiRNA target sequence
tataaagataaataccttgaagt

SEQ ID NO: 121138 - DNA, 23 bp, Artificial sequence
  SiRNA target sequence
ataaagataaataccttgaagtg

SEQ ID NO: 121139 - DNA, 23 bp, Artificial sequence
  SiRNA target sequence
taaagataaataccttgaagtgt

SEQ ID NO: 121140 - DNA, 23 bp, Artificial sequence
  SiRNA target sequence
aaagataaataccttgaagtgtc

SEQ ID NO: 121141 - DNA, 23 bp, Artificial sequence
  SiRNA target sequence
aagataaataccttgaagtgtct

SEQ ID NO: 121142 - DNA, 23 bp, Artificial sequence
  SiRNA target sequence
agataaataccttgaagtgtcta

SEQ ID NO: 121143 - DNA, 23 bp, Artificial sequence
  SiRNA target sequence
gataaataccttgaagtgtctaa

SEQ ID NO: 121144 - DNA, 23 bp, Artificial sequence
  SiRNA target sequence
ataaataccttgaagtgtctaat

SEQ ID NO: 121145 - DNA, 23 bp, Artificial sequence
  SiRNA target sequence
taaataccttgaagtgtctaata

SEQ ID NO: 121146 - DNA, 23 bp, Artificial sequence
  SiRNA target sequence
aaataccttgaagtgtctaataa

SEQ ID NO: 121147 - DNA, 23 bp, Artificial sequence
  SiRNA target sequence
aataccttgaagtgtctaataat

SEQ ID NO: 121148 - DNA, 23 bp, Artificial sequence
  SiRNA target sequence
ataccttgaagtgtctaataatt

SEQ ID NO: 121149 - DNA, 23 bp, Artificial sequence
  SiRNA target sequence
taccttgaagtgtctaataatta

SEQ ID NO: 121150 - DNA, 23 bp, Artificial sequence
  SiRNA target sequence
accttgaagtgtctaataattat

SEQ ID NO: 121151 - DNA, 23 bp, Artificial sequence
  SiRNA target sequence
ccttgaagtgtctaataattata

SEQ ID NO: 121152 - DNA, 23 bp, Artificial sequence
  SiRNA target sequence
cttgaagtgtctaataattatat

SEQ ID NO: 121153 - DNA, 23 bp, Artificial sequence
  SiRNA target sequence
ttgaagtgtctaataattatatt

SEQ ID NO: 121154 - DNA, 23 bp, Artificial sequence
  SiRNA target sequence
tgaagtgtctaataattatattc

SEQ ID NO: 121155 - DNA, 23 bp, Artificial sequence
  SiRNA target sequence
gaagtgtctaataattatattca

SEQ ID NO: 121156 - DNA, 23 bp, Artificial sequence
  SiRNA target sequence
aagtgtctaataattatattcaa

SEQ ID NO: 121157 - DNA, 23 bp, Artificial sequence
  SiRNA target sequence
agtgtctaataattatattcaac

SEQ ID NO: 121158 - DNA, 23 bp, Artificial sequence
  SiRNA target sequence
gtgtctaataattatattcaacc

SEQ ID NO: 121159 - DNA, 23 bp, Artificial sequence
  SiRNA target sequence
tgtctaataattatattcaacca

SEQ ID NO: 121160 - DNA, 23 bp, Artificial sequence
  SiRNA target sequence
gtctaataattatattcaaccac

SEQ ID NO: 121161 - DNA, 23 bp, Artificial sequence
  SiRNA target sequence
tctaataattatattcaaccact

SEQ ID NO: 121162 - DNA, 23 bp, Artificial sequence
  SiRNA target sequence
ctaataattatattcaaccactt

SEQ ID NO: 121163 - DNA, 23 bp, Artificial sequence
  SiRNA target sequence
taataattatattcaaccacttg

SEQ ID NO: 121164 - DNA, 23 bp, Artificial sequence
  SiRNA target sequence
aataattatattcaaccacttga

SEQ ID NO: 121165 - DNA, 23 bp, Artificial sequence
  SiRNA target sequence
ataattatattcaaccacttgac

SEQ ID NO: 121166 - DNA, 23 bp, Artificial sequence
  SiRNA target sequence
taattatattcaaccacttgaca

SEQ ID NO: 121167 - DNA, 23 bp, Artificial sequence
  SiRNA target sequence
aattatattcaaccacttgacaa

SEQ ID NO: 121168 - DNA, 23 bp, Artificial sequence
  SiRNA target sequence
attatattcaaccacttgacaag

SEQ ID NO: 121169 - DNA, 23 bp, Artificial sequence
  SiRNA target sequence
ttatattcaaccacttgacaagg

SEQ ID NO: 121170 - DNA, 23 bp, Artificial sequence
  SiRNA target sequence
tatattcaaccacttgacaaggc

SEQ ID NO: 121171 - DNA, 23 bp, Artificial sequence
  SiRNA target sequence
atattcaaccacttgacaaggca

SEQ ID NO: 121172 - DNA, 23 bp, Artificial sequence
  SiRNA target sequence
tattcaaccacttgacaaggcag

SEQ ID NO: 121173 - DNA, 23 bp, Artificial sequence
  SiRNA target sequence
attcaaccacttgacaaggcagt

SEQ ID NO: 121174 - DNA, 23 bp, Artificial sequence
  SiRNA target sequence
ttcaaccacttgacaaggcagta

SEQ ID NO: 121175 - DNA, 23 bp, Artificial sequence
  SiRNA target sequence
tcaaccacttgacaaggcagtaa

SEQ ID NO: 121176 - DNA, 23 bp, Artificial sequence
  SiRNA target sequence
caaccacttgacaaggcagtaat

SEQ ID NO: 121177 - DNA, 23 bp, Artificial sequence
  SiRNA target sequence
aaccacttgacaaggcagtaatt

SEQ ID NO: 121178 - DNA, 23 bp, Artificial sequence
  SiRNA target sequence
accacttgacaaggcagtaattg

SEQ ID NO: 121179 - DNA, 23 bp, Artificial sequence
  SiRNA target sequence
ccacttgacaaggcagtaattga

SEQ ID NO: 121180 - DNA, 23 bp, Artificial sequence
  SiRNA target sequence
cacttgacaaggcagtaattgaa

SEQ ID NO: 121181 - DNA, 23 bp, Artificial sequence
  SiRNA target sequence
acttgacaaggcagtaattgaaa

SEQ ID NO: 121182 - DNA, 23 bp, Artificial sequence
  SiRNA target sequence
cttgacaaggcagtaattgaaaa

SEQ ID NO: 121183 - DNA, 23 bp, Artificial sequence
  SiRNA target sequence
ttgacaaggcagtaattgaaaaa

SEQ ID NO: 121184 - DNA, 23 bp, Artificial sequence
  SiRNA target sequence
tgacaaggcagtaattgaaaaaa

SEQ ID NO: 121185 - DNA, 23 bp, Artificial sequence
  SiRNA target sequence
gacaaggcagtaattgaaaaaaa

SEQ ID NO: 121186 - DNA, 23 bp, Artificial sequence
  SiRNA target sequence
acaaggcagtaattgaaaaaaat

SEQ ID NO: 121187 - DNA, 23 bp, Artificial sequence
  SiRNA target sequence
caaggcagtaattgaaaaaaatg

SEQ ID NO: 121188 - DNA, 23 bp, Artificial sequence
  SiRNA target sequence
aaggcagtaattgaaaaaaatgg

SEQ ID NO: 121189 - DNA, 23 bp, Artificial sequence
  SiRNA target sequence
aggcagtaattgaaaaaaatggt

SEQ ID NO: 121190 - DNA, 23 bp, Artificial sequence
  SiRNA target sequence
ggcagtaattgaaaaaaatggtg

SEQ ID NO: 121191 - DNA, 23 bp, Artificial sequence
  SiRNA target sequence
gcagtaattgaaaaaaatggtgt

SEQ ID NO: 121192 - DNA, 23 bp, Artificial sequence
  SiRNA target sequence
cagtaattgaaaaaaatggtgtt

SEQ ID NO: 121193 - DNA, 23 bp, Artificial sequence
  SiRNA target sequence
agtaattgaaaaaaatggtgttg

SEQ ID NO: 121194 - DNA, 23 bp, Artificial sequence
  SiRNA target sequence
gtaattgaaaaaaatggtgttga

SEQ ID NO: 121195 - DNA, 23 bp, Artificial sequence
  SiRNA target sequence
taattgaaaaaaatggtgttgac

SEQ ID NO: 121196 - DNA, 23 bp, Artificial sequence
  SiRNA target sequence
aattgaaaaaaatggtgttgacg

SEQ ID NO: 121197 - DNA, 23 bp, Artificial sequence
  SiRNA target sequence
attgaaaaaaatggtgttgacgt

SEQ ID NO: 121198 - DNA, 23 bp, Artificial sequence
  SiRNA target sequence
ttgaaaaaaatggtgttgacgtt

SEQ ID NO: 121199 - DNA, 23 bp, Artificial sequence
  SiRNA target sequence
tgaaaaaaatggtgttgacgtta

SEQ ID NO: 121200 - DNA, 23 bp, Artificial sequence
  SiRNA target sequence
gaaaaaaatggtgttgacgttac

SEQ ID NO: 121201 - DNA, 23 bp, Artificial sequence
  SiRNA target sequence
aaaaaaatggtgttgacgttaca

SEQ ID NO: 121202 - DNA, 23 bp, Artificial sequence
  SiRNA target sequence
aaaaaatggtgttgacgttacag

SEQ ID NO: 121203 - DNA, 23 bp, Artificial sequence
  SiRNA target sequence
aaaaatggtgttgacgttacagt

SEQ ID NO: 121204 - DNA, 23 bp, Artificial sequence
  SiRNA target sequence
aaaatggtgttgacgttacagtt

SEQ ID NO: 121205 - DNA, 23 bp, Artificial sequence
  SiRNA target sequence
aaatggtgttgacgttacagttt

SEQ ID NO: 121206 - DNA, 23 bp, Artificial sequence
  SiRNA target sequence
aatggtgttgacgttacagtttt

SEQ ID NO: 121207 - DNA, 23 bp, Artificial sequence
  SiRNA target sequence
atggtgttgacgttacagtttta

SEQ ID NO: 121208 - DNA, 23 bp, Artificial sequence
  SiRNA target sequence
tggtgttgacgttacagttttag

SEQ ID NO: 121209 - DNA, 23 bp, Artificial sequence
  SiRNA target sequence
ggtgttgacgttacagttttagg

SEQ ID NO: 121210 - DNA, 23 bp, Artificial sequence
  SiRNA target sequence
gtgttgacgttacagttttagga

SEQ ID NO: 121211 - DNA, 23 bp, Artificial sequence
  SiRNA target sequence
tgttgacgttacagttttaggaa

SEQ ID NO: 121212 - DNA, 23 bp, Artificial sequence
  SiRNA target sequence
gttgacgttacagttttaggaat

SEQ ID NO: 121213 - DNA, 23 bp, Artificial sequence
  SiRNA target sequence
ttgacgttacagttttaggaata

SEQ ID NO: 121214 - DNA, 23 bp, Artificial sequence
  SiRNA target sequence
tgacgttacagttttaggaatat

SEQ ID NO: 121215 - DNA, 23 bp, Artificial sequence
  SiRNA target sequence
gacgttacagttttaggaatatc

SEQ ID NO: 121216 - DNA, 23 bp, Artificial sequence
  SiRNA target sequence
acgttacagttttaggaatatca

SEQ ID NO: 121217 - DNA, 23 bp, Artificial sequence
  SiRNA target sequence
cgttacagttttaggaatatcaa

SEQ ID NO: 121218 - DNA, 23 bp, Artificial sequence
  SiRNA target sequence
gttacagttttaggaatatcaat

SEQ ID NO: 121219 - DNA, 23 bp, Artificial sequence
  SiRNA target sequence
ttacagttttaggaatatcaata

SEQ ID NO: 121220 - DNA, 23 bp, Artificial sequence
  SiRNA target sequence
tacagttttaggaatatcaataa

SEQ ID NO: 121221 - DNA, 23 bp, Artificial sequence
  SiRNA target sequence
acagttttaggaatatcaataag

SEQ ID NO: 121222 - DNA, 23 bp, Artificial sequence
  SiRNA target sequence
cagttttaggaatatcaataagt

SEQ ID NO: 121223 - DNA, 23 bp, Artificial sequence
  SiRNA target sequence
agttttaggaatatcaataagtc

SEQ ID NO: 121224 - DNA, 23 bp, Artificial sequence
  SiRNA target sequence
gttttaggaatatcaataagtct

SEQ ID NO: 121225 - DNA, 23 bp, Artificial sequence
  SiRNA target sequence
ttttaggaatatcaataagtctt

SEQ ID NO: 121226 - DNA, 23 bp, Artificial sequence
  SiRNA target sequence
tttaggaatatcaataagtctta

SEQ ID NO: 121227 - DNA, 23 bp, Artificial sequence
  SiRNA target sequence
ttaggaatatcaataagtcttaa

SEQ ID NO: 121228 - DNA, 23 bp, Artificial sequence
  SiRNA target sequence
taggaatatcaataagtcttaaa

SEQ ID NO: 121229 - DNA, 23 bp, Artificial sequence
  SiRNA target sequence
aggaatatcaataagtcttaaag

SEQ ID NO: 121230 - DNA, 23 bp, Artificial sequence
  SiRNA target sequence
ggaatatcaataagtcttaaaga

SEQ ID NO: 121231 - DNA, 23 bp, Artificial sequence
  SiRNA target sequence
gaatatcaataagtcttaaagaa

SEQ ID NO: 121232 - DNA, 23 bp, Artificial sequence
  SiRNA target sequence
aatatcaataagtcttaaagaaa

SEQ ID NO: 121233 - DNA, 23 bp, Artificial sequence
  SiRNA target sequence
atatcaataagtcttaaagaaat

SEQ ID NO: 121234 - DNA, 23 bp, Artificial sequence
  SiRNA target sequence
tatcaataagtcttaaagaaatt

SEQ ID NO: 121235 - DNA, 23 bp, Artificial sequence
  SiRNA target sequence
atcaataagtcttaaagaaattt

SEQ ID NO: 121236 - DNA, 23 bp, Artificial sequence
  SiRNA target sequence
tcaataagtcttaaagaaatttt

SEQ ID NO: 121237 - DNA, 23 bp, Artificial sequence
  SiRNA target sequence
caataagtcttaaagaaattttt

SEQ ID NO: 121238 - DNA, 23 bp, Artificial sequence
  SiRNA target sequence
aataagtcttaaagaaattttta

SEQ ID NO: 121239 - DNA, 23 bp, Artificial sequence
  SiRNA target sequence
ataagtcttaaagaaatttttaa

SEQ ID NO: 121240 - DNA, 23 bp, Artificial sequence
  SiRNA target sequence
taagtcttaaagaaatttttaaa

SEQ ID NO: 121241 - DNA, 23 bp, Artificial sequence
  SiRNA target sequence
aagtcttaaagaaatttttaaag

SEQ ID NO: 121242 - DNA, 23 bp, Artificial sequence
  SiRNA target sequence
agtcttaaagaaatttttaaagc

SEQ ID NO: 121243 - DNA, 23 bp, Artificial sequence
  SiRNA target sequence
gtcttaaagaaatttttaaagca

SEQ ID NO: 121244 - DNA, 23 bp, Artificial sequence
  SiRNA target sequence
tcttaaagaaatttttaaagcag

SEQ ID NO: 121245 - DNA, 23 bp, Artificial sequence
  SiRNA target sequence
cttaaagaaatttttaaagcaga

SEQ ID NO: 121246 - DNA, 23 bp, Artificial sequence
  SiRNA target sequence
ttaaagaaatttttaaagcagac

SEQ ID NO: 121247 - DNA, 23 bp, Artificial sequence
  SiRNA target sequence
taaagaaatttttaaagcagaca

SEQ ID NO: 121248 - DNA, 23 bp, Artificial sequence
  SiRNA target sequence
aaagaaatttttaaagcagacag

SEQ ID NO: 121249 - DNA, 23 bp, Artificial sequence
  SiRNA target sequence
aagaaatttttaaagcagacagt

SEQ ID NO: 121250 - DNA, 23 bp, Artificial sequence
  SiRNA target sequence
agaaatttttaaagcagacagtt

SEQ ID NO: 121251 - DNA, 23 bp, Artificial sequence
  SiRNA target sequence
gaaatttttaaagcagacagttt

SEQ ID NO: 121252 - DNA, 23 bp, Artificial sequence
  SiRNA target sequence
aaatttttaaagcagacagtttg

SEQ ID NO: 121253 - DNA, 23 bp, Artificial sequence
  SiRNA target sequence
aatttttaaagcagacagtttgt

SEQ ID NO: 121254 - DNA, 23 bp, Artificial sequence
  SiRNA target sequence
atttttaaagcagacagtttgtt

SEQ ID NO: 121255 - DNA, 23 bp, Artificial sequence
  SiRNA target sequence
tttttaaagcagacagtttgtta

SEQ ID NO: 121256 - DNA, 23 bp, Artificial sequence
  SiRNA target sequence
ttttaaagcagacagtttgttag

SEQ ID NO: 121257 - DNA, 23 bp, Artificial sequence
  SiRNA target sequence
tttaaagcagacagtttgttaga

SEQ ID NO: 121258 - DNA, 23 bp, Artificial sequence
  SiRNA target sequence
ttaaagcagacagtttgttagag

SEQ ID NO: 121259 - DNA, 23 bp, Artificial sequence
  SiRNA target sequence
taaagcagacagtttgttagaga

SEQ ID NO: 121260 - DNA, 23 bp, Artificial sequence
  SiRNA target sequence
aaagcagacagtttgttagagaa

SEQ ID NO: 121261 - DNA, 23 bp, Artificial sequence
  SiRNA target sequence
aagcagacagtttgttagagaaa

SEQ ID NO: 121262 - DNA, 23 bp, Artificial sequence
  SiRNA target sequence
agcagacagtttgttagagaaaa

SEQ ID NO: 121263 - DNA, 23 bp, Artificial sequence
  SiRNA target sequence
gcagacagtttgttagagaaaaa

SEQ ID NO: 121264 - DNA, 23 bp, Artificial sequence
  SiRNA target sequence
cagacagtttgttagagaaaaaa

SEQ ID NO: 121265 - DNA, 23 bp, Artificial sequence
  SiRNA target sequence
agacagtttgttagagaaaaaaa

SEQ ID NO: 121266 - DNA, 23 bp, Artificial sequence
  SiRNA target sequence
gacagtttgttagagaaaaaaaa

SEQ ID NO: 121267 - DNA, 23 bp, Artificial sequence
  SiRNA target sequence
acagtttgttagagaaaaaaaat

SEQ ID NO: 121268 - DNA, 23 bp, Artificial sequence
  SiRNA target sequence
cagtttgttagagaaaaaaaata

SEQ ID NO: 121269 - DNA, 23 bp, Artificial sequence
  SiRNA target sequence
agtttgttagagaaaaaaaatat

SEQ ID NO: 121270 - DNA, 23 bp, Artificial sequence
  SiRNA target sequence
gtttgttagagaaaaaaaatatc

SEQ ID NO: 121271 - DNA, 23 bp, Artificial sequence
  SiRNA target sequence
tttgttagagaaaaaaaatatcg

SEQ ID NO: 121272 - DNA, 23 bp, Artificial sequence
  SiRNA target sequence
ttgttagagaaaaaaaatatcga

SEQ ID NO: 121273 - DNA, 23 bp, Artificial sequence
  SiRNA target sequence
tgttagagaaaaaaaatatcgac

SEQ ID NO: 121274 - DNA, 23 bp, Artificial sequence
  SiRNA target sequence
gttagagaaaaaaaatatcgaca

SEQ ID NO: 121275 - DNA, 23 bp, Artificial sequence
  SiRNA target sequence
ttagagaaaaaaaatatcgacat

SEQ ID NO: 121276 - DNA, 23 bp, Artificial sequence
  SiRNA target sequence
tagagaaaaaaaatatcgacatt

SEQ ID NO: 121277 - DNA, 23 bp, Artificial sequence
  SiRNA target sequence
agagaaaaaaaatatcgacattg

SEQ ID NO: 121278 - DNA, 23 bp, Artificial sequence
  SiRNA target sequence
gagaaaaaaaatatcgacattga

SEQ ID NO: 121279 - DNA, 23 bp, Artificial sequence
  SiRNA target sequence
agaaaaaaaatatcgacattgag

SEQ ID NO: 121280 - DNA, 23 bp, Artificial sequence
  SiRNA target sequence
gaaaaaaaatatcgacattgaga

SEQ ID NO: 121281 - DNA, 23 bp, Artificial sequence
  SiRNA target sequence
aaaaaaaatatcgacattgagat

SEQ ID NO: 121282 - DNA, 23 bp, Artificial sequence
  SiRNA target sequence
aaaaaaatatcgacattgagata

SEQ ID NO: 121283 - DNA, 23 bp, Artificial sequence
  SiRNA target sequence
aaaaaatatcgacattgagataa

SEQ ID NO: 121284 - DNA, 23 bp, Artificial sequence
  SiRNA target sequence
aaaaatatcgacattgagataat

SEQ ID NO: 121285 - DNA, 23 bp, Artificial sequence
  SiRNA target sequence
aaaatatcgacattgagataatt

SEQ ID NO: 121286 - DNA, 23 bp, Artificial sequence
  SiRNA target sequence
aaatatcgacattgagataatta

SEQ ID NO: 121287 - DNA, 23 bp, Artificial sequence
  SiRNA target sequence
aatatcgacattgagataattaa

SEQ ID NO: 121288 - DNA, 23 bp, Artificial sequence
  SiRNA target sequence
atatcgacattgagataattaat

SEQ ID NO: 121289 - DNA, 23 bp, Artificial sequence
  SiRNA target sequence
tatcgacattgagataattaatc

SEQ ID NO: 121290 - DNA, 23 bp, Artificial sequence
  SiRNA target sequence
atcgacattgagataattaatct

SEQ ID NO: 121291 - DNA, 23 bp, Artificial sequence
  SiRNA target sequence
tcgacattgagataattaatctt

SEQ ID NO: 121292 - DNA, 23 bp, Artificial sequence
  SiRNA target sequence
cgacattgagataattaatcttg

SEQ ID NO: 121293 - DNA, 23 bp, Artificial sequence
  SiRNA target sequence
gacattgagataattaatcttgt

SEQ ID NO: 121294 - DNA, 23 bp, Artificial sequence
  SiRNA target sequence
acattgagataattaatcttgtg

SEQ ID NO: 121295 - DNA, 23 bp, Artificial sequence
  SiRNA target sequence
cattgagataattaatcttgtgt

SEQ ID NO: 121296 - DNA, 23 bp, Artificial sequence
  SiRNA target sequence
attgagataattaatcttgtgtc

SEQ ID NO: 121297 - DNA, 23 bp, Artificial sequence
  SiRNA target sequence
ttgagataattaatcttgtgtca

SEQ ID NO: 121298 - DNA, 23 bp, Artificial sequence
  SiRNA target sequence
tgagataattaatcttgtgtcaa

SEQ ID NO: 121299 - DNA, 23 bp, Artificial sequence
  SiRNA target sequence
gagataattaatcttgtgtcaat

SEQ ID NO: 121300 - DNA, 23 bp, Artificial sequence
  SiRNA target sequence
agataattaatcttgtgtcaata

SEQ ID NO: 121301 - DNA, 23 bp, Artificial sequence
  SiRNA target sequence
gataattaatcttgtgtcaataa

SEQ ID NO: 121302 - DNA, 23 bp, Artificial sequence
  SiRNA target sequence
ataattaatcttgtgtcaataaa

SEQ ID NO: 121303 - DNA, 23 bp, Artificial sequence
  SiRNA target sequence
taattaatcttgtgtcaataaaa

SEQ ID NO: 121304 - DNA, 23 bp, Artificial sequence
  SiRNA target sequence
aattaatcttgtgtcaataaaac

SEQ ID NO: 121305 - DNA, 23 bp, Artificial sequence
  SiRNA target sequence
attaatcttgtgtcaataaaacc

SEQ ID NO: 121306 - DNA, 23 bp, Artificial sequence
  SiRNA target sequence
ttaatcttgtgtcaataaaacca

SEQ ID NO: 121307 - DNA, 23 bp, Artificial sequence
  SiRNA target sequence
taatcttgtgtcaataaaaccaa

SEQ ID NO: 121308 - DNA, 23 bp, Artificial sequence
  SiRNA target sequence
aatcttgtgtcaataaaaccaat

SEQ ID NO: 121309 - DNA, 23 bp, Artificial sequence
  SiRNA target sequence
atcttgtgtcaataaaaccaatt

SEQ ID NO: 121310 - DNA, 23 bp, Artificial sequence
  SiRNA target sequence
tcttgtgtcaataaaaccaattg

SEQ ID NO: 121311 - DNA, 23 bp, Artificial sequence
  SiRNA target sequence
cttgtgtcaataaaaccaattga

SEQ ID NO: 121312 - DNA, 23 bp, Artificial sequence
  SiRNA target sequence
ttgtgtcaataaaaccaattgat

SEQ ID NO: 121313 - DNA, 23 bp, Artificial sequence
  SiRNA target sequence
tgtgtcaataaaaccaattgatt

SEQ ID NO: 121314 - DNA, 23 bp, Artificial sequence
  SiRNA target sequence
gtgtcaataaaaccaattgatta

SEQ ID NO: 121315 - DNA, 23 bp, Artificial sequence
  SiRNA target sequence
tgtcaataaaaccaattgattat

SEQ ID NO: 121316 - DNA, 23 bp, Artificial sequence
  SiRNA target sequence
gtcaataaaaccaattgattatg

SEQ ID NO: 121317 - DNA, 23 bp, Artificial sequence
  SiRNA target sequence
tcaataaaaccaattgattatgt

SEQ ID NO: 121318 - DNA, 23 bp, Artificial sequence
  SiRNA target sequence
caataaaaccaattgattatgtt

SEQ ID NO: 121319 - DNA, 23 bp, Artificial sequence
  SiRNA target sequence
aataaaaccaattgattatgtta

SEQ ID NO: 121320 - DNA, 23 bp, Artificial sequence
  SiRNA target sequence
ataaaaccaattgattatgttac

SEQ ID NO: 121321 - DNA, 23 bp, Artificial sequence
  SiRNA target sequence
taaaaccaattgattatgttact

SEQ ID NO: 121322 - DNA, 23 bp, Artificial sequence
  SiRNA target sequence
aaaaccaattgattatgttacta

SEQ ID NO: 121323 - DNA, 23 bp, Artificial sequence
  SiRNA target sequence
aaaccaattgattatgttactat

SEQ ID NO: 121324 - DNA, 23 bp, Artificial sequence
  SiRNA target sequence
aaccaattgattatgttactatt

SEQ ID NO: 121325 - DNA, 23 bp, Artificial sequence
  SiRNA target sequence
accaattgattatgttactattg

SEQ ID NO: 121326 - DNA, 23 bp, Artificial sequence
  SiRNA target sequence
ccaattgattatgttactattga

SEQ ID NO: 121327 - DNA, 23 bp, Artificial sequence
  SiRNA target sequence
caattgattatgttactattgaa

SEQ ID NO: 121328 - DNA, 23 bp, Artificial sequence
  SiRNA target sequence
aattgattatgttactattgaaa

SEQ ID NO: 121329 - DNA, 23 bp, Artificial sequence
  SiRNA target sequence
attgattatgttactattgaaat

SEQ ID NO: 121330 - DNA, 23 bp, Artificial sequence
  SiRNA target sequence
ttgattatgttactattgaaata

SEQ ID NO: 121331 - DNA, 23 bp, Artificial sequence
  SiRNA target sequence
tgattatgttactattgaaatat

SEQ ID NO: 121332 - DNA, 23 bp, Artificial sequence
  SiRNA target sequence
gattatgttactattgaaatatc

SEQ ID NO: 121333 - DNA, 23 bp, Artificial sequence
  SiRNA target sequence
attatgttactattgaaatatca

SEQ ID NO: 121334 - DNA, 23 bp, Artificial sequence
  SiRNA target sequence
ttatgttactattgaaatatcag

SEQ ID NO: 121335 - DNA, 23 bp, Artificial sequence
  SiRNA target sequence
tatgttactattgaaatatcagt

SEQ ID NO: 121336 - DNA, 23 bp, Artificial sequence
  SiRNA target sequence
atgttactattgaaatatcagtc

SEQ ID NO: 121337 - DNA, 23 bp, Artificial sequence
  SiRNA target sequence
tgttactattgaaatatcagtca

SEQ ID NO: 121338 - DNA, 23 bp, Artificial sequence
  SiRNA target sequence
gttactattgaaatatcagtcaa

SEQ ID NO: 121339 - DNA, 23 bp, Artificial sequence
  SiRNA target sequence
ttactattgaaatatcagtcaaa

SEQ ID NO: 121340 - DNA, 23 bp, Artificial sequence
  SiRNA target sequence
tactattgaaatatcagtcaaaa

SEQ ID NO: 121341 - DNA, 23 bp, Artificial sequence
  SiRNA target sequence
actattgaaatatcagtcaaaaa

SEQ ID NO: 121342 - DNA, 23 bp, Artificial sequence
  SiRNA target sequence
ctattgaaatatcagtcaaaaaa

SEQ ID NO: 121343 - DNA, 23 bp, Artificial sequence
  SiRNA target sequence
tattgaaatatcagtcaaaaaaa

SEQ ID NO: 121344 - DNA, 23 bp, Artificial sequence
  SiRNA target sequence
attgaaatatcagtcaaaaaaac

SEQ ID NO: 121345 - DNA, 23 bp, Artificial sequence
  SiRNA target sequence
ttgaaatatcagtcaaaaaaaca

SEQ ID NO: 121346 - DNA, 23 bp, Artificial sequence
  SiRNA target sequence
tgaaatatcagtcaaaaaaacac

SEQ ID NO: 121347 - DNA, 23 bp, Artificial sequence
  SiRNA target sequence
gaaatatcagtcaaaaaaacaca

SEQ ID NO: 121348 - DNA, 23 bp, Artificial sequence
  SiRNA target sequence
aaatatcagtcaaaaaaacacaa

SEQ ID NO: 121349 - DNA, 23 bp, Artificial sequence
  SiRNA target sequence
aatatcagtcaaaaaaacacaaa

SEQ ID NO: 121350 - DNA, 23 bp, Artificial sequence
  SiRNA target sequence
atatcagtcaaaaaaacacaaaa

SEQ ID NO: 121351 - DNA, 23 bp, Artificial sequence
  SiRNA target sequence
tatcagtcaaaaaaacacaaaag

SEQ ID NO: 121352 - DNA, 23 bp, Artificial sequence
  SiRNA target sequence
atcagtcaaaaaaacacaaaagt

SEQ ID NO: 121353 - DNA, 23 bp, Artificial sequence
  SiRNA target sequence
tcagtcaaaaaaacacaaaagtt

SEQ ID NO: 121354 - DNA, 23 bp, Artificial sequence
  SiRNA target sequence
cagtcaaaaaaacacaaaagtta

SEQ ID NO: 121355 - DNA, 23 bp, Artificial sequence
  SiRNA target sequence
agtcaaaaaaacacaaaagttag

SEQ ID NO: 121356 - DNA, 23 bp, Artificial sequence
  SiRNA target sequence
gtcaaaaaaacacaaaagttagt

SEQ ID NO: 121357 - DNA, 23 bp, Artificial sequence
  SiRNA target sequence
tcaaaaaaacacaaaagttagtg

SEQ ID NO: 121358 - DNA, 23 bp, Artificial sequence
  SiRNA target sequence
caaaaaaacacaaaagttagtga

SEQ ID NO: 121359 - DNA, 23 bp, Artificial sequence
  SiRNA target sequence
aaaaaaacacaaaagttagtgat

SEQ ID NO: 121360 - DNA, 23 bp, Artificial sequence
  SiRNA target sequence
aaaaaacacaaaagttagtgata

SEQ ID NO: 121361 - DNA, 23 bp, Artificial sequence
  SiRNA target sequence
aaaaacacaaaagttagtgatag

SEQ ID NO: 121362 - DNA, 23 bp, Artificial sequence
  SiRNA target sequence
aaaacacaaaagttagtgatagt

SEQ ID NO: 121363 - DNA, 23 bp, Artificial sequence
  SiRNA target sequence
aaacacaaaagttagtgatagtt

SEQ ID NO: 121364 - DNA, 23 bp, Artificial sequence
  SiRNA target sequence
aacacaaaagttagtgatagttg

SEQ ID NO: 121365 - DNA, 23 bp, Artificial sequence
  SiRNA target sequence
acacaaaagttagtgatagttga

SEQ ID NO: 121366 - DNA, 23 bp, Artificial sequence
  SiRNA target sequence
cacaaaagttagtgatagttgat

SEQ ID NO: 121367 - DNA, 23 bp, Artificial sequence
  SiRNA target sequence
acaaaagttagtgatagttgatt

SEQ ID NO: 121368 - DNA, 23 bp, Artificial sequence
  SiRNA target sequence
caaaagttagtgatagttgattt

SEQ ID NO: 121369 - DNA, 23 bp, Artificial sequence
  SiRNA target sequence
aaaagttagtgatagttgatttt

SEQ ID NO: 121370 - DNA, 23 bp, Artificial sequence
  SiRNA target sequence
aaagttagtgatagttgattttg

SEQ ID NO: 121371 - DNA, 23 bp, Artificial sequence
  SiRNA target sequence
aagttagtgatagttgattttgc

SEQ ID NO: 121372 - DNA, 23 bp, Artificial sequence
  SiRNA target sequence
agttagtgatagttgattttgca

SEQ ID NO: 121373 - DNA, 23 bp, Artificial sequence
  SiRNA target sequence
gttagtgatagttgattttgcat

SEQ ID NO: 121374 - DNA, 23 bp, Artificial sequence
  SiRNA target sequence
ttagtgatagttgattttgcata

SEQ ID NO: 121375 - DNA, 23 bp, Artificial sequence
  SiRNA target sequence
tagtgatagttgattttgcatat

SEQ ID NO: 121376 - DNA, 23 bp, Artificial sequence
  SiRNA target sequence
agtgatagttgattttgcatatc

SEQ ID NO: 121377 - DNA, 23 bp, Artificial sequence
  SiRNA target sequence
gtgatagttgattttgcatatcc

SEQ ID NO: 121378 - DNA, 23 bp, Artificial sequence
  SiRNA target sequence
tgatagttgattttgcatatcct

SEQ ID NO: 121379 - DNA, 23 bp, Artificial sequence
  SiRNA target sequence
gatagttgattttgcatatccta

SEQ ID NO: 121380 - DNA, 23 bp, Artificial sequence
  SiRNA target sequence
atagttgattttgcatatcctac

SEQ ID NO: 121381 - DNA, 23 bp, Artificial sequence
  SiRNA target sequence
tagttgattttgcatatcctact

SEQ ID NO: 121382 - DNA, 23 bp, Artificial sequence
  SiRNA target sequence
agttgattttgcatatcctactt

SEQ ID NO: 121383 - DNA, 23 bp, Artificial sequence
  SiRNA target sequence
gttgattttgcatatcctacttt

SEQ ID NO: 121384 - DNA, 23 bp, Artificial sequence
  SiRNA target sequence
ttgattttgcatatcctactttc

SEQ ID NO: 121385 - DNA, 23 bp, Artificial sequence
  SiRNA target sequence
tgattttgcatatcctactttca

SEQ ID NO: 121386 - DNA, 23 bp, Artificial sequence
  SiRNA target sequence
gattttgcatatcctactttcaa

SEQ ID NO: 121387 - DNA, 23 bp, Artificial sequence
  SiRNA target sequence
attttgcatatcctactttcaat

SEQ ID NO: 121388 - DNA, 23 bp, Artificial sequence
  SiRNA target sequence
ttttgcatatcctactttcaata

SEQ ID NO: 121389 - DNA, 23 bp, Artificial sequence
  SiRNA target sequence
tttgcatatcctactttcaatat

SEQ ID NO: 121390 - DNA, 23 bp, Artificial sequence
  SiRNA target sequence
ttgcatatcctactttcaatatt

SEQ ID NO: 121391 - DNA, 23 bp, Artificial sequence
  SiRNA target sequence
tgcatatcctactttcaatattg

SEQ ID NO: 121392 - DNA, 23 bp, Artificial sequence
  SiRNA target sequence
gcatatcctactttcaatattgc

SEQ ID NO: 121393 - DNA, 23 bp, Artificial sequence
  SiRNA target sequence
catatcctactttcaatattgcg

SEQ ID NO: 121394 - DNA, 23 bp, Artificial sequence
  SiRNA target sequence
atatcctactttcaatattgcga

SEQ ID NO: 121395 - DNA, 23 bp, Artificial sequence
  SiRNA target sequence
tatcctactttcaatattgcgag

SEQ ID NO: 121396 - DNA, 23 bp, Artificial sequence
  SiRNA target sequence
atcctactttcaatattgcgagt

SEQ ID NO: 121397 - DNA, 23 bp, Artificial sequence
  SiRNA target sequence
tcctactttcaatattgcgagtg

SEQ ID NO: 121398 - DNA, 23 bp, Artificial sequence
  SiRNA target sequence
cctactttcaatattgcgagtga

SEQ ID NO: 121399 - DNA, 23 bp, Artificial sequence
  SiRNA target sequence
ctactttcaatattgcgagtgaa

SEQ ID NO: 121400 - DNA, 23 bp, Artificial sequence
  SiRNA target sequence
tactttcaatattgcgagtgaaa

SEQ ID NO: 121401 - DNA, 23 bp, Artificial sequence
  SiRNA target sequence
actttcaatattgcgagtgaaat

SEQ ID NO: 121402 - DNA, 23 bp, Artificial sequence
  SiRNA target sequence
ctttcaatattgcgagtgaaata

SEQ ID NO: 121403 - DNA, 23 bp, Artificial sequence
  SiRNA target sequence
tttcaatattgcgagtgaaatag

SEQ ID NO: 121404 - DNA, 23 bp, Artificial sequence
  SiRNA target sequence
ttcaatattgcgagtgaaatagc

SEQ ID NO: 121405 - DNA, 23 bp, Artificial sequence
  SiRNA target sequence
tcaatattgcgagtgaaatagct

SEQ ID NO: 121406 - DNA, 23 bp, Artificial sequence
  SiRNA target sequence
caatattgcgagtgaaatagctg

SEQ ID NO: 121407 - DNA, 23 bp, Artificial sequence
  SiRNA target sequence
aatattgcgagtgaaatagctgc

SEQ ID NO: 121408 - DNA, 23 bp, Artificial sequence
  SiRNA target sequence
atattgcgagtgaaatagctgcg

SEQ ID NO: 121409 - DNA, 23 bp, Artificial sequence
  SiRNA target sequence
tattgcgagtgaaatagctgcgc

SEQ ID NO: 121410 - DNA, 23 bp, Artificial sequence
  SiRNA target sequence
attgcgagtgaaatagctgcgca

SEQ ID NO: 121411 - DNA, 23 bp, Artificial sequence
  SiRNA target sequence
ttgcgagtgaaatagctgcgcac

SEQ ID NO: 121412 - DNA, 23 bp, Artificial sequence
  SiRNA target sequence
tgcgagtgaaatagctgcgcact

SEQ ID NO: 121413 - DNA, 23 bp, Artificial sequence
  SiRNA target sequence
gcgagtgaaatagctgcgcactt

SEQ ID NO: 121414 - DNA, 23 bp, Artificial sequence
  SiRNA target sequence
cgagtgaaatagctgcgcacttt

SEQ ID NO: 121415 - DNA, 23 bp, Artificial sequence
  SiRNA target sequence
gagtgaaatagctgcgcactttt

SEQ ID NO: 121416 - DNA, 23 bp, Artificial sequence
  SiRNA target sequence
agtgaaatagctgcgcactttta

SEQ ID NO: 121417 - DNA, 23 bp, Artificial sequence
  SiRNA target sequence
gtgaaatagctgcgcacttttac

SEQ ID NO: 121418 - DNA, 23 bp, Artificial sequence
  SiRNA target sequence
tgaaatagctgcgcacttttacg

SEQ ID NO: 121419 - DNA, 23 bp, Artificial sequence
  SiRNA target sequence
gaaatagctgcgcacttttacga

SEQ ID NO: 121420 - DNA, 23 bp, Artificial sequence
  SiRNA target sequence
aaatagctgcgcacttttacgaa

SEQ ID NO: 121421 - DNA, 23 bp, Artificial sequence
  SiRNA target sequence
aatagctgcgcacttttacgaaa

SEQ ID NO: 121422 - DNA, 23 bp, Artificial sequence
  SiRNA target sequence
atagctgcgcacttttacgaaaa

SEQ ID NO: 121423 - DNA, 23 bp, Artificial sequence
  SiRNA target sequence
tagctgcgcacttttacgaaaaa

SEQ ID NO: 121424 - DNA, 23 bp, Artificial sequence
  SiRNA target sequence
agctgcgcacttttacgaaaaat

SEQ ID NO: 121425 - DNA, 23 bp, Artificial sequence
  SiRNA target sequence
gctgcgcacttttacgaaaaatt

SEQ ID NO: 121426 - DNA, 23 bp, Artificial sequence
  SiRNA target sequence
ctgcgcacttttacgaaaaattt

SEQ ID NO: 121427 - DNA, 23 bp, Artificial sequence
  SiRNA target sequence
tgcgcacttttacgaaaaattta

SEQ ID NO: 121428 - DNA, 23 bp, Artificial sequence
  SiRNA target sequence
gcgcacttttacgaaaaatttaa

SEQ ID NO: 121429 - DNA, 23 bp, Artificial sequence
  SiRNA target sequence
cgcacttttacgaaaaatttaaa

SEQ ID NO: 121430 - DNA, 23 bp, Artificial sequence
  SiRNA target sequence
gcacttttacgaaaaatttaaag

SEQ ID NO: 121431 - DNA, 23 bp, Artificial sequence
  SiRNA target sequence
cacttttacgaaaaatttaaaga

SEQ ID NO: 121432 - DNA, 23 bp, Artificial sequence
  SiRNA target sequence
acttttacgaaaaatttaaagat

SEQ ID NO: 121433 - DNA, 23 bp, Artificial sequence
  SiRNA target sequence
cttttacgaaaaatttaaagata

SEQ ID NO: 121434 - DNA, 23 bp, Artificial sequence
  SiRNA target sequence
ttttacgaaaaatttaaagatat

SEQ ID NO: 121435 - DNA, 23 bp, Artificial sequence
  SiRNA target sequence
tttacgaaaaatttaaagatata

SEQ ID NO: 121436 - DNA, 23 bp, Artificial sequence
  SiRNA target sequence
ttacgaaaaatttaaagatataa

SEQ ID NO: 121437 - DNA, 23 bp, Artificial sequence
  SiRNA target sequence
tacgaaaaatttaaagatataaa

SEQ ID NO: 121438 - DNA, 23 bp, Artificial sequence
  SiRNA target sequence
acgaaaaatttaaagatataaaa

SEQ ID NO: 121439 - DNA, 23 bp, Artificial sequence
  SiRNA target sequence
cgaaaaatttaaagatataaaaa

SEQ ID NO: 121440 - DNA, 23 bp, Artificial sequence
  SiRNA target sequence
gaaaaatttaaagatataaaaat

SEQ ID NO: 121441 - DNA, 23 bp, Artificial sequence
  SiRNA target sequence
aaaaatttaaagatataaaaatt

SEQ ID NO: 121442 - DNA, 23 bp, Artificial sequence
  SiRNA target sequence
aaaatttaaagatataaaaatta

SEQ ID NO: 121443 - DNA, 23 bp, Artificial sequence
  SiRNA target sequence
aaatttaaagatataaaaattat

SEQ ID NO: 121444 - DNA, 23 bp, Artificial sequence
  SiRNA target sequence
aatttaaagatataaaaattatg

SEQ ID NO: 121445 - DNA, 23 bp, Artificial sequence
  SiRNA target sequence
atttaaagatataaaaattatgc

SEQ ID NO: 121446 - DNA, 23 bp, Artificial sequence
  SiRNA target sequence
tttaaagatataaaaattatgcg

SEQ ID NO: 121447 - DNA, 23 bp, Artificial sequence
  SiRNA target sequence
ttaaagatataaaaattatgcgt

SEQ ID NO: 121448 - DNA, 23 bp, Artificial sequence
  SiRNA target sequence
taaagatataaaaattatgcgtg

SEQ ID NO: 121449 - DNA, 23 bp, Artificial sequence
  SiRNA target sequence
aaagatataaaaattatgcgtgt

SEQ ID NO: 121450 - DNA, 23 bp, Artificial sequence
  SiRNA target sequence
aagatataaaaattatgcgtgtt

SEQ ID NO: 121451 - DNA, 23 bp, Artificial sequence
  SiRNA target sequence
agatataaaaattatgcgtgttc

SEQ ID NO: 121452 - DNA, 23 bp, Artificial sequence
  SiRNA target sequence
gatataaaaattatgcgtgttct

SEQ ID NO: 121453 - DNA, 23 bp, Artificial sequence
  SiRNA target sequence
atataaaaattatgcgtgttctt

SEQ ID NO: 121454 - DNA, 23 bp, Artificial sequence
  SiRNA target sequence
tataaaaattatgcgtgttcttg

SEQ ID NO: 121455 - DNA, 23 bp, Artificial sequence
  SiRNA target sequence
ataaaaattatgcgtgttcttgc

SEQ ID NO: 121456 - DNA, 23 bp, Artificial sequence
  SiRNA target sequence
taaaaattatgcgtgttcttgcg

SEQ ID NO: 121457 - DNA, 23 bp, Artificial sequence
  SiRNA target sequence
aaaaattatgcgtgttcttgcgc

SEQ ID NO: 121458 - DNA, 23 bp, Artificial sequence
  SiRNA target sequence
aaaattatgcgtgttcttgcgca

SEQ ID NO: 121459 - DNA, 23 bp, Artificial sequence
  SiRNA target sequence
aaattatgcgtgttcttgcgcaa

SEQ ID NO: 121460 - DNA, 23 bp, Artificial sequence
  SiRNA target sequence
aattatgcgtgttcttgcgcaag

SEQ ID NO: 121461 - DNA, 23 bp, Artificial sequence
  SiRNA target sequence
attatgcgtgttcttgcgcaaga

SEQ ID NO: 121462 - DNA, 23 bp, Artificial sequence
  SiRNA target sequence
ttatgcgtgttcttgcgcaagat

SEQ ID NO: 121463 - DNA, 23 bp, Artificial sequence
  SiRNA target sequence
tatgcgtgttcttgcgcaagata

SEQ ID NO: 121464 - DNA, 23 bp, Artificial sequence
  SiRNA target sequence
atgcgtgttcttgcgcaagatat

SEQ ID NO: 121465 - DNA, 23 bp, Artificial sequence
  SiRNA target sequence
tgcgtgttcttgcgcaagatatt

SEQ ID NO: 121466 - DNA, 23 bp, Artificial sequence
  SiRNA target sequence
gcgtgttcttgcgcaagatattc

SEQ ID NO: 121467 - DNA, 23 bp, Artificial sequence
  SiRNA target sequence
cgtgttcttgcgcaagatattcc

SEQ ID NO: 121468 - DNA, 23 bp, Artificial sequence
  SiRNA target sequence
gtgttcttgcgcaagatattcct

SEQ ID NO: 121469 - DNA, 23 bp, Artificial sequence
  SiRNA target sequence
tgttcttgcgcaagatattccta

SEQ ID NO: 121470 - DNA, 23 bp, Artificial sequence
  SiRNA target sequence
gttcttgcgcaagatattcctac

SEQ ID NO: 121471 - DNA, 23 bp, Artificial sequence
  SiRNA target sequence
ttcttgcgcaagatattcctaca

SEQ ID NO: 121472 - DNA, 23 bp, Artificial sequence
  SiRNA target sequence
tcttgcgcaagatattcctacac

SEQ ID NO: 121473 - DNA, 23 bp, Artificial sequence
  SiRNA target sequence
cttgcgcaagatattcctacacc

SEQ ID NO: 121474 - DNA, 23 bp, Artificial sequence
  SiRNA target sequence
ttgcgcaagatattcctacaccg

SEQ ID NO: 121475 - DNA, 23 bp, Artificial sequence
  SiRNA target sequence
tgcgcaagatattcctacaccgt

SEQ ID NO: 121476 - DNA, 23 bp, Artificial sequence
  SiRNA target sequence
gcgcaagatattcctacaccgta

SEQ ID NO: 121477 - DNA, 23 bp, Artificial sequence
  SiRNA target sequence
cgcaagatattcctacaccgtat

SEQ ID NO: 121478 - DNA, 23 bp, Artificial sequence
  SiRNA target sequence
gcaagatattcctacaccgtatg

SEQ ID NO: 121479 - DNA, 23 bp, Artificial sequence
  SiRNA target sequence
caagatattcctacaccgtatgc

SEQ ID NO: 121480 - DNA, 23 bp, Artificial sequence
  SiRNA target sequence
aagatattcctacaccgtatgca

SEQ ID NO: 121481 - DNA, 23 bp, Artificial sequence
  SiRNA target sequence
agatattcctacaccgtatgcac

SEQ ID NO: 121482 - DNA, 23 bp, Artificial sequence
  SiRNA target sequence
gatattcctacaccgtatgcact

SEQ ID NO: 121483 - DNA, 23 bp, Artificial sequence
  SiRNA target sequence
atattcctacaccgtatgcactt

SEQ ID NO: 121484 - DNA, 23 bp, Artificial sequence
  SiRNA target sequence
tattcctacaccgtatgcactta

SEQ ID NO: 121485 - DNA, 23 bp, Artificial sequence
  SiRNA target sequence
attcctacaccgtatgcacttaa

SEQ ID NO: 121486 - DNA, 23 bp, Artificial sequence
  SiRNA target sequence
ttcctacaccgtatgcacttaat

SEQ ID NO: 121487 - DNA, 23 bp, Artificial sequence
  SiRNA target sequence
tcctacaccgtatgcacttaatc

SEQ ID NO: 121488 - DNA, 23 bp, Artificial sequence
  SiRNA target sequence
cctacaccgtatgcacttaatct

SEQ ID NO: 121489 - DNA, 23 bp, Artificial sequence
  SiRNA target sequence
ctacaccgtatgcacttaatctt

SEQ ID NO: 121490 - DNA, 23 bp, Artificial sequence
  SiRNA target sequence
tacaccgtatgcacttaatcttg

SEQ ID NO: 121491 - DNA, 23 bp, Artificial sequence
  SiRNA target sequence
acaccgtatgcacttaatcttga

SEQ ID NO: 121492 - DNA, 23 bp, Artificial sequence
  SiRNA target sequence
caccgtatgcacttaatcttgaa

SEQ ID NO: 121493 - DNA, 23 bp, Artificial sequence
  SiRNA target sequence
accgtatgcacttaatcttgaaa

SEQ ID NO: 121494 - DNA, 23 bp, Artificial sequence
  SiRNA target sequence
ccgtatgcacttaatcttgaaaa

SEQ ID NO: 121495 - DNA, 23 bp, Artificial sequence
  SiRNA target sequence
cgtatgcacttaatcttgaaaaa

SEQ ID NO: 121496 - DNA, 23 bp, Artificial sequence
  SiRNA target sequence
gtatgcacttaatcttgaaaaaa

SEQ ID NO: 121497 - DNA, 23 bp, Artificial sequence
  SiRNA target sequence
tatgcacttaatcttgaaaaaat

SEQ ID NO: 121498 - DNA, 23 bp, Artificial sequence
  SiRNA target sequence
atgcacttaatcttgaaaaaatg

SEQ ID NO: 121499 - DNA, 23 bp, Artificial sequence
  SiRNA target sequence
tgcacttaatcttgaaaaaatgt

SEQ ID NO: 121500 - DNA, 23 bp, Artificial sequence
  SiRNA target sequence
gcacttaatcttgaaaaaatgtc

SEQ ID NO: 121501 - DNA, 23 bp, Artificial sequence
  SiRNA target sequence
cacttaatcttgaaaaaatgtct

SEQ ID NO: 121502 - DNA, 23 bp, Artificial sequence
  SiRNA target sequence
acttaatcttgaaaaaatgtctt

SEQ ID NO: 121503 - DNA, 23 bp, Artificial sequence
  SiRNA target sequence
cttaatcttgaaaaaatgtctta

SEQ ID NO: 121504 - DNA, 23 bp, Artificial sequence
  SiRNA target sequence
ttaatcttgaaaaaatgtcttat

SEQ ID NO: 121505 - DNA, 23 bp, Artificial sequence
  SiRNA target sequence
taatcttgaaaaaatgtcttatc

SEQ ID NO: 121506 - DNA, 23 bp, Artificial sequence
  SiRNA target sequence
aatcttgaaaaaatgtcttatcc

SEQ ID NO: 121507 - DNA, 23 bp, Artificial sequence
  SiRNA target sequence
atcttgaaaaaatgtcttatccg

SEQ ID NO: 121508 - DNA, 23 bp, Artificial sequence
  SiRNA target sequence
tcttgaaaaaatgtcttatccga

SEQ ID NO: 121509 - DNA, 23 bp, Artificial sequence
  SiRNA target sequence
cttgaaaaaatgtcttatccgac

SEQ ID NO: 121510 - DNA, 23 bp, Artificial sequence
  SiRNA target sequence
ttgaaaaaatgtcttatccgaca

SEQ ID NO: 121511 - DNA, 23 bp, Artificial sequence
  SiRNA target sequence
tgaaaaaatgtcttatccgacat

SEQ ID NO: 121512 - DNA, 23 bp, Artificial sequence
  SiRNA target sequence
gaaaaaatgtcttatccgacatg

SEQ ID NO: 121513 - DNA, 23 bp, Artificial sequence
  SiRNA target sequence
aaaaaatgtcttatccgacatgc

SEQ ID NO: 121514 - DNA, 23 bp, Artificial sequence
  SiRNA target sequence
aaaaatgtcttatccgacatgca

SEQ ID NO: 121515 - DNA, 23 bp, Artificial sequence
  SiRNA target sequence
aaaatgtcttatccgacatgcaa

SEQ ID NO: 121516 - DNA, 23 bp, Artificial sequence
  SiRNA target sequence
aaatgtcttatccgacatgcaat

SEQ ID NO: 121517 - DNA, 23 bp, Artificial sequence
  SiRNA target sequence
aatgtcttatccgacatgcaatg

SEQ ID NO: 121518 - DNA, 23 bp, Artificial sequence
  SiRNA target sequence
atgtcttatccgacatgcaatga

SEQ ID NO: 121519 - DNA, 23 bp, Artificial sequence
  SiRNA target sequence
tgtcttatccgacatgcaatgat

SEQ ID NO: 121520 - DNA, 23 bp, Artificial sequence
  SiRNA target sequence
gtcttatccgacatgcaatgata

SEQ ID NO: 121521 - DNA, 23 bp, Artificial sequence
  SiRNA target sequence
tcttatccgacatgcaatgatat

SEQ ID NO: 121522 - DNA, 23 bp, Artificial sequence
  SiRNA target sequence
cttatccgacatgcaatgatatt

SEQ ID NO: 121523 - DNA, 23 bp, Artificial sequence
  SiRNA target sequence
ttatccgacatgcaatgatattg

SEQ ID NO: 121524 - DNA, 23 bp, Artificial sequence
  SiRNA target sequence
tatccgacatgcaatgatattgt

SEQ ID NO: 121525 - DNA, 23 bp, Artificial sequence
  SiRNA target sequence
atccgacatgcaatgatattgta

SEQ ID NO: 121526 - DNA, 23 bp, Artificial sequence
  SiRNA target sequence
tccgacatgcaatgatattgtaa

SEQ ID NO: 121527 - DNA, 23 bp, Artificial sequence
  SiRNA target sequence
ccgacatgcaatgatattgtaaa

SEQ ID NO: 121528 - DNA, 23 bp, Artificial sequence
  SiRNA target sequence
cgacatgcaatgatattgtaaat

SEQ ID NO: 121529 - DNA, 23 bp, Artificial sequence
  SiRNA target sequence
gacatgcaatgatattgtaaatg

SEQ ID NO: 121530 - DNA, 23 bp, Artificial sequence
  SiRNA target sequence
acatgcaatgatattgtaaatgc

SEQ ID NO: 121531 - DNA, 23 bp, Artificial sequence
  SiRNA target sequence
catgcaatgatattgtaaatgct

SEQ ID NO: 121532 - DNA, 23 bp, Artificial sequence
  SiRNA target sequence
atgcaatgatattgtaaatgctg

SEQ ID NO: 121533 - DNA, 23 bp, Artificial sequence
  SiRNA target sequence
tgcaatgatattgtaaatgctgt

SEQ ID NO: 121534 - DNA, 23 bp, Artificial sequence
  SiRNA target sequence
gcaatgatattgtaaatgctgtt

SEQ ID NO: 121535 - DNA, 23 bp, Artificial sequence
  SiRNA target sequence
caatgatattgtaaatgctgtta

SEQ ID NO: 121536 - DNA, 23 bp, Artificial sequence
  SiRNA target sequence
aatgatattgtaaatgctgttac

SEQ ID NO: 121537 - DNA, 23 bp, Artificial sequence
  SiRNA target sequence
atgatattgtaaatgctgttaca

SEQ ID NO: 121538 - DNA, 23 bp, Artificial sequence
  SiRNA target sequence
tgatattgtaaatgctgttacaa

SEQ ID NO: 121539 - DNA, 23 bp, Artificial sequence
  SiRNA target sequence
gatattgtaaatgctgttacaaa

SEQ ID NO: 121540 - DNA, 23 bp, Artificial sequence
  SiRNA target sequence
atattgtaaatgctgttacaaaa

SEQ ID NO: 121541 - DNA, 23 bp, Artificial sequence
  SiRNA target sequence
tattgtaaatgctgttacaaaaa

SEQ ID NO: 121542 - DNA, 23 bp, Artificial sequence
  SiRNA target sequence
attgtaaatgctgttacaaaaat

SEQ ID NO: 121543 - DNA, 23 bp, Artificial sequence
  SiRNA target sequence
ttgtaaatgctgttacaaaaata

SEQ ID NO: 121544 - DNA, 23 bp, Artificial sequence
  SiRNA target sequence
tgtaaatgctgttacaaaaataa

SEQ ID NO: 121545 - DNA, 23 bp, Artificial sequence
  SiRNA target sequence
gtaaatgctgttacaaaaataaa

SEQ ID NO: 121546 - DNA, 23 bp, Artificial sequence
  SiRNA target sequence
taaatgctgttacaaaaataaat

SEQ ID NO: 121547 - DNA, 23 bp, Artificial sequence
  SiRNA target sequence
aaatgctgttacaaaaataaatt

SEQ ID NO: 121548 - DNA, 23 bp, Artificial sequence
  SiRNA target sequence
aatgctgttacaaaaataaattc

SEQ ID NO: 121549 - DNA, 23 bp, Artificial sequence
  SiRNA target sequence
atgctgttacaaaaataaattca

SEQ ID NO: 121550 - DNA, 23 bp, Artificial sequence
  SiRNA target sequence
tgctgttacaaaaataaattcat

SEQ ID NO: 121551 - DNA, 23 bp, Artificial sequence
  SiRNA target sequence
gctgttacaaaaataaattcata

SEQ ID NO: 121552 - DNA, 23 bp, Artificial sequence
  SiRNA target sequence
ctgttacaaaaataaattcatag

SEQ ID NO: 121553 - DNA, 24 bp, Artificial sequence
  SiRNA target sequence
atgatagaaattcgcgatcttata

SEQ ID NO: 121554 - DNA, 24 bp, Artificial sequence
  SiRNA target sequence
tgatagaaattcgcgatcttataa

SEQ ID NO: 121555 - DNA, 24 bp, Artificial sequence
  SiRNA target sequence
gatagaaattcgcgatcttataaa

SEQ ID NO: 121556 - DNA, 24 bp, Artificial sequence
  SiRNA target sequence
atagaaattcgcgatcttataaat

SEQ ID NO: 121557 - DNA, 24 bp, Artificial sequence
  SiRNA target sequence
tagaaattcgcgatcttataaatc

SEQ ID NO: 121558 - DNA, 24 bp, Artificial sequence
  SiRNA target sequence
agaaattcgcgatcttataaatca

SEQ ID NO: 121559 - DNA, 24 bp, Artificial sequence
  SiRNA target sequence
gaaattcgcgatcttataaatcaa

SEQ ID NO: 121560 - DNA, 24 bp, Artificial sequence
  SiRNA target sequence
aaattcgcgatcttataaatcaag

SEQ ID NO: 121561 - DNA, 24 bp, Artificial sequence
  SiRNA target sequence
aattcgcgatcttataaatcaagc

SEQ ID NO: 121562 - DNA, 24 bp, Artificial sequence
  SiRNA target sequence
attcgcgatcttataaatcaagca

SEQ ID NO: 121563 - DNA, 24 bp, Artificial sequence
  SiRNA target sequence
ttcgcgatcttataaatcaagcat

SEQ ID NO: 121564 - DNA, 24 bp, Artificial sequence
  SiRNA target sequence
tcgcgatcttataaatcaagcatt

SEQ ID NO: 121565 - DNA, 24 bp, Artificial sequence
  SiRNA target sequence
cgcgatcttataaatcaagcattg

SEQ ID NO: 121566 - DNA, 24 bp, Artificial sequence
  SiRNA target sequence
gcgatcttataaatcaagcattgg

SEQ ID NO: 121567 - DNA, 24 bp, Artificial sequence
  SiRNA target sequence
cgatcttataaatcaagcattgga

SEQ ID NO: 121568 - DNA, 24 bp, Artificial sequence
  SiRNA target sequence
gatcttataaatcaagcattggat

SEQ ID NO: 121569 - DNA, 24 bp, Artificial sequence
  SiRNA target sequence
atcttataaatcaagcattggatg

SEQ ID NO: 121570 - DNA, 24 bp, Artificial sequence
  SiRNA target sequence
tcttataaatcaagcattggatga

SEQ ID NO: 121571 - DNA, 24 bp, Artificial sequence
  SiRNA target sequence
cttataaatcaagcattggatgag

SEQ ID NO: 121572 - DNA, 24 bp, Artificial sequence
  SiRNA target sequence
ttataaatcaagcattggatgagg

SEQ ID NO: 121573 - DNA, 24 bp, Artificial sequence
  SiRNA target sequence
tataaatcaagcattggatgagga

SEQ ID NO: 121574 - DNA, 24 bp, Artificial sequence
  SiRNA target sequence
ataaatcaagcattggatgaggaa

SEQ ID NO: 121575 - DNA, 24 bp, Artificial sequence
  SiRNA target sequence
taaatcaagcattggatgaggaaa

SEQ ID NO: 121576 - DNA, 24 bp, Artificial sequence
  SiRNA target sequence
aaatcaagcattggatgaggaaat

SEQ ID NO: 121577 - DNA, 24 bp, Artificial sequence
  SiRNA target sequence
aatcaagcattggatgaggaaatg

SEQ ID NO: 121578 - DNA, 24 bp, Artificial sequence
  SiRNA target sequence
atcaagcattggatgaggaaatgg

SEQ ID NO: 121579 - DNA, 24 bp, Artificial sequence
  SiRNA target sequence
tcaagcattggatgaggaaatggg

SEQ ID NO: 121580 - DNA, 24 bp, Artificial sequence
  SiRNA target sequence
caagcattggatgaggaaatggga

SEQ ID NO: 121581 - DNA, 24 bp, Artificial sequence
  SiRNA target sequence
aagcattggatgaggaaatgggaa

SEQ ID NO: 121582 - DNA, 24 bp, Artificial sequence
  SiRNA target sequence
agcattggatgaggaaatgggaat

SEQ ID NO: 121583 - DNA, 24 bp, Artificial sequence
  SiRNA target sequence
gcattggatgaggaaatgggaatg

SEQ ID NO: 121584 - DNA, 24 bp, Artificial sequence
  SiRNA target sequence
cattggatgaggaaatgggaatgg

SEQ ID NO: 121585 - DNA, 24 bp, Artificial sequence
  SiRNA target sequence
attggatgaggaaatgggaatgga

SEQ ID NO: 121586 - DNA, 24 bp, Artificial sequence
  SiRNA target sequence
ttggatgaggaaatgggaatggat

SEQ ID NO: 121587 - DNA, 24 bp, Artificial sequence
  SiRNA target sequence
tggatgaggaaatgggaatggatc

SEQ ID NO: 121588 - DNA, 24 bp, Artificial sequence
  SiRNA target sequence
ggatgaggaaatgggaatggatca

SEQ ID NO: 121589 - DNA, 24 bp, Artificial sequence
  SiRNA target sequence
gatgaggaaatgggaatggatcat

SEQ ID NO: 121590 - DNA, 24 bp, Artificial sequence
  SiRNA target sequence
atgaggaaatgggaatggatcata

SEQ ID NO: 121591 - DNA, 24 bp, Artificial sequence
  SiRNA target sequence
tgaggaaatgggaatggatcataa

SEQ ID NO: 121592 - DNA, 24 bp, Artificial sequence
  SiRNA target sequence
gaggaaatgggaatggatcataat

SEQ ID NO: 121593 - DNA, 24 bp, Artificial sequence
  SiRNA target sequence
aggaaatgggaatggatcataatg

SEQ ID NO: 121594 - DNA, 24 bp, Artificial sequence
  SiRNA target sequence
ggaaatgggaatggatcataatgt

SEQ ID NO: 121595 - DNA, 24 bp, Artificial sequence
  SiRNA target sequence
gaaatgggaatggatcataatgta

SEQ ID NO: 121596 - DNA, 24 bp, Artificial sequence
  SiRNA target sequence
aaatgggaatggatcataatgtat

SEQ ID NO: 121597 - DNA, 24 bp, Artificial sequence
  SiRNA target sequence
aatgggaatggatcataatgtata

SEQ ID NO: 121598 - DNA, 24 bp, Artificial sequence
  SiRNA target sequence
atgggaatggatcataatgtatat

SEQ ID NO: 121599 - DNA, 24 bp, Artificial sequence
  SiRNA target sequence
tgggaatggatcataatgtatata

SEQ ID NO: 121600 - DNA, 24 bp, Artificial sequence
  SiRNA target sequence
gggaatggatcataatgtatatat

SEQ ID NO: 121601 - DNA, 24 bp, Artificial sequence
  SiRNA target sequence
ggaatggatcataatgtatatata

SEQ ID NO: 121602 - DNA, 24 bp, Artificial sequence
  SiRNA target sequence
gaatggatcataatgtatatataa

SEQ ID NO: 121603 - DNA, 24 bp, Artificial sequence
  SiRNA target sequence
aatggatcataatgtatatataat

SEQ ID NO: 121604 - DNA, 24 bp, Artificial sequence
  SiRNA target sequence
atggatcataatgtatatataata

SEQ ID NO: 121605 - DNA, 24 bp, Artificial sequence
  SiRNA target sequence
tggatcataatgtatatataatag

SEQ ID NO: 121606 - DNA, 24 bp, Artificial sequence
  SiRNA target sequence
ggatcataatgtatatataatagg

SEQ ID NO: 121607 - DNA, 24 bp, Artificial sequence
  SiRNA target sequence
gatcataatgtatatataatagga

SEQ ID NO: 121608 - DNA, 24 bp, Artificial sequence
  SiRNA target sequence
atcataatgtatatataataggag

SEQ ID NO: 121609 - DNA, 24 bp, Artificial sequence
  SiRNA target sequence
tcataatgtatatataataggaga

SEQ ID NO: 121610 - DNA, 24 bp, Artificial sequence
  SiRNA target sequence
cataatgtatatataataggagaa

SEQ ID NO: 121611 - DNA, 24 bp, Artificial sequence
  SiRNA target sequence
ataatgtatatataataggagaag

SEQ ID NO: 121612 - DNA, 24 bp, Artificial sequence
  SiRNA target sequence
taatgtatatataataggagaaga

SEQ ID NO: 121613 - DNA, 24 bp, Artificial sequence
  SiRNA target sequence
aatgtatatataataggagaagaa

SEQ ID NO: 121614 - DNA, 24 bp, Artificial sequence
  SiRNA target sequence
atgtatatataataggagaagaag

SEQ ID NO: 121615 - DNA, 24 bp, Artificial sequence
  SiRNA target sequence
tgtatatataataggagaagaagt

SEQ ID NO: 121616 - DNA, 24 bp, Artificial sequence
  SiRNA target sequence
gtatatataataggagaagaagta

SEQ ID NO: 121617 - DNA, 24 bp, Artificial sequence
  SiRNA target sequence
tatatataataggagaagaagtag

SEQ ID NO: 121618 - DNA, 24 bp, Artificial sequence
  SiRNA target sequence
atatataataggagaagaagtagg

SEQ ID NO: 121619 - DNA, 24 bp, Artificial sequence
  SiRNA target sequence
tatataataggagaagaagtaggc

SEQ ID NO: 121620 - DNA, 24 bp, Artificial sequence
  SiRNA target sequence
atataataggagaagaagtaggca

SEQ ID NO: 121621 - DNA, 24 bp, Artificial sequence
  SiRNA target sequence
tataataggagaagaagtaggcat

SEQ ID NO: 121622 - DNA, 24 bp, Artificial sequence
  SiRNA target sequence
ataataggagaagaagtaggcatc

SEQ ID NO: 121623 - DNA, 24 bp, Artificial sequence
  SiRNA target sequence
taataggagaagaagtaggcatct

SEQ ID NO: 121624 - DNA, 24 bp, Artificial sequence
  SiRNA target sequence
aataggagaagaagtaggcatctc

SEQ ID NO: 121625 - DNA, 24 bp, Artificial sequence
  SiRNA target sequence
ataggagaagaagtaggcatctct

SEQ ID NO: 121626 - DNA, 24 bp, Artificial sequence
  SiRNA target sequence
taggagaagaagtaggcatctctg

SEQ ID NO: 121627 - DNA, 24 bp, Artificial sequence
  SiRNA target sequence
aggagaagaagtaggcatctctgg

SEQ ID NO: 121628 - DNA, 24 bp, Artificial sequence
  SiRNA target sequence
ggagaagaagtaggcatctctggt

SEQ ID NO: 121629 - DNA, 24 bp, Artificial sequence
  SiRNA target sequence
gagaagaagtaggcatctctggtg

SEQ ID NO: 121630 - DNA, 24 bp, Artificial sequence
  SiRNA target sequence
agaagaagtaggcatctctggtgg

SEQ ID NO: 121631 - DNA, 24 bp, Artificial sequence
  SiRNA target sequence
gaagaagtaggcatctctggtggt

SEQ ID NO: 121632 - DNA, 24 bp, Artificial sequence
  SiRNA target sequence
aagaagtaggcatctctggtggtc

SEQ ID NO: 121633 - DNA, 24 bp, Artificial sequence
  SiRNA target sequence
agaagtaggcatctctggtggtcc

SEQ ID NO: 121634 - DNA, 24 bp, Artificial sequence
  SiRNA target sequence
gaagtaggcatctctggtggtcct

SEQ ID NO: 121635 - DNA, 24 bp, Artificial sequence
  SiRNA target sequence
aagtaggcatctctggtggtcctc

SEQ ID NO: 121636 - DNA, 24 bp, Artificial sequence
  SiRNA target sequence
agtaggcatctctggtggtcctca

SEQ ID NO: 121637 - DNA, 24 bp, Artificial sequence
  SiRNA target sequence
gtaggcatctctggtggtcctcac

SEQ ID NO: 121638 - DNA, 24 bp, Artificial sequence
  SiRNA target sequence
taggcatctctggtggtcctcacg

SEQ ID NO: 121639 - DNA, 24 bp, Artificial sequence
  SiRNA target sequence
aggcatctctggtggtcctcacgg

SEQ ID NO: 121640 - DNA, 24 bp, Artificial sequence
  SiRNA target sequence
ggcatctctggtggtcctcacggt

SEQ ID NO: 121641 - DNA, 24 bp, Artificial sequence
  SiRNA target sequence
gcatctctggtggtcctcacggtc

SEQ ID NO: 121642 - DNA, 24 bp, Artificial sequence
  SiRNA target sequence
catctctggtggtcctcacggtct

SEQ ID NO: 121643 - DNA, 24 bp, Artificial sequence
  SiRNA target sequence
atctctggtggtcctcacggtctt

SEQ ID NO: 121644 - DNA, 24 bp, Artificial sequence
  SiRNA target sequence
tctctggtggtcctcacggtctta

SEQ ID NO: 121645 - DNA, 24 bp, Artificial sequence
  SiRNA target sequence
ctctggtggtcctcacggtcttac

SEQ ID NO: 121646 - DNA, 24 bp, Artificial sequence
  SiRNA target sequence
tctggtggtcctcacggtcttact

SEQ ID NO: 121647 - DNA, 24 bp, Artificial sequence
  SiRNA target sequence
ctggtggtcctcacggtcttacta

SEQ ID NO: 121648 - DNA, 24 bp, Artificial sequence
  SiRNA target sequence
tggtggtcctcacggtcttactaa

SEQ ID NO: 121649 - DNA, 24 bp, Artificial sequence
  SiRNA target sequence
ggtggtcctcacggtcttactaaa

SEQ ID NO: 121650 - DNA, 24 bp, Artificial sequence
  SiRNA target sequence
gtggtcctcacggtcttactaaaa

SEQ ID NO: 121651 - DNA, 24 bp, Artificial sequence
  SiRNA target sequence
tggtcctcacggtcttactaaaaa

SEQ ID NO: 121652 - DNA, 24 bp, Artificial sequence
  SiRNA target sequence
ggtcctcacggtcttactaaaaat

SEQ ID NO: 121653 - DNA, 24 bp, Artificial sequence
  SiRNA target sequence
gtcctcacggtcttactaaaaatt

SEQ ID NO: 121654 - DNA, 24 bp, Artificial sequence
  SiRNA target sequence
tcctcacggtcttactaaaaattt

SEQ ID NO: 121655 - DNA, 24 bp, Artificial sequence
  SiRNA target sequence
cctcacggtcttactaaaaatttg

SEQ ID NO: 121656 - DNA, 24 bp, Artificial sequence
  SiRNA target sequence
ctcacggtcttactaaaaatttga

SEQ ID NO: 121657 - DNA, 24 bp, Artificial sequence
  SiRNA target sequence
tcacggtcttactaaaaatttgat

SEQ ID NO: 121658 - DNA, 24 bp, Artificial sequence
  SiRNA target sequence
cacggtcttactaaaaatttgatc

SEQ ID NO: 121659 - DNA, 24 bp, Artificial sequence
  SiRNA target sequence
acggtcttactaaaaatttgatca

SEQ ID NO: 121660 - DNA, 24 bp, Artificial sequence
  SiRNA target sequence
cggtcttactaaaaatttgatcaa

SEQ ID NO: 121661 - DNA, 24 bp, Artificial sequence
  SiRNA target sequence
ggtcttactaaaaatttgatcaaa

SEQ ID NO: 121662 - DNA, 24 bp, Artificial sequence
  SiRNA target sequence
gtcttactaaaaatttgatcaaaa

SEQ ID NO: 121663 - DNA, 24 bp, Artificial sequence
  SiRNA target sequence
tcttactaaaaatttgatcaaaaa

SEQ ID NO: 121664 - DNA, 24 bp, Artificial sequence
  SiRNA target sequence
cttactaaaaatttgatcaaaaaa

SEQ ID NO: 121665 - DNA, 24 bp, Artificial sequence
  SiRNA target sequence
ttactaaaaatttgatcaaaaaat

SEQ ID NO: 121666 - DNA, 24 bp, Artificial sequence
  SiRNA target sequence
tactaaaaatttgatcaaaaaata

SEQ ID NO: 121667 - DNA, 24 bp, Artificial sequence
  SiRNA target sequence
actaaaaatttgatcaaaaaatac

SEQ ID NO: 121668 - DNA, 24 bp, Artificial sequence
  SiRNA target sequence
ctaaaaatttgatcaaaaaatacg

SEQ ID NO: 121669 - DNA, 24 bp, Artificial sequence
  SiRNA target sequence
taaaaatttgatcaaaaaatacgg

SEQ ID NO: 121670 - DNA, 24 bp, Artificial sequence
  SiRNA target sequence
aaaaatttgatcaaaaaatacggc

SEQ ID NO: 121671 - DNA, 24 bp, Artificial sequence
  SiRNA target sequence
aaaatttgatcaaaaaatacggcg

SEQ ID NO: 121672 - DNA, 24 bp, Artificial sequence
  SiRNA target sequence
aaatttgatcaaaaaatacggcga

SEQ ID NO: 121673 - DNA, 24 bp, Artificial sequence
  SiRNA target sequence
aatttgatcaaaaaatacggcgat

SEQ ID NO: 121674 - DNA, 24 bp, Artificial sequence
  SiRNA target sequence
atttgatcaaaaaatacggcgatc

SEQ ID NO: 121675 - DNA, 24 bp, Artificial sequence
  SiRNA target sequence
tttgatcaaaaaatacggcgatca

SEQ ID NO: 121676 - DNA, 24 bp, Artificial sequence
  SiRNA target sequence
ttgatcaaaaaatacggcgatcaa

SEQ ID NO: 121677 - DNA, 24 bp, Artificial sequence
  SiRNA target sequence
tgatcaaaaaatacggcgatcaaa

SEQ ID NO: 121678 - DNA, 24 bp, Artificial sequence
  SiRNA target sequence
gatcaaaaaatacggcgatcaaag

SEQ ID NO: 121679 - DNA, 24 bp, Artificial sequence
  SiRNA target sequence
atcaaaaaatacggcgatcaaaga

SEQ ID NO: 121680 - DNA, 24 bp, Artificial sequence
  SiRNA target sequence
tcaaaaaatacggcgatcaaagag

SEQ ID NO: 121681 - DNA, 24 bp, Artificial sequence
  SiRNA target sequence
caaaaaatacggcgatcaaagagt

SEQ ID NO: 121682 - DNA, 24 bp, Artificial sequence
  SiRNA target sequence
aaaaaatacggcgatcaaagagtg

SEQ ID NO: 121683 - DNA, 24 bp, Artificial sequence
  SiRNA target sequence
aaaaatacggcgatcaaagagtga

SEQ ID NO: 121684 - DNA, 24 bp, Artificial sequence
  SiRNA target sequence
aaaatacggcgatcaaagagtgaa

SEQ ID NO: 121685 - DNA, 24 bp, Artificial sequence
  SiRNA target sequence
aaatacggcgatcaaagagtgaag

SEQ ID NO: 121686 - DNA, 24 bp, Artificial sequence
  SiRNA target sequence
aatacggcgatcaaagagtgaagg

SEQ ID NO: 121687 - DNA, 24 bp, Artificial sequence
  SiRNA target sequence
atacggcgatcaaagagtgaagga

SEQ ID NO: 121688 - DNA, 24 bp, Artificial sequence
  SiRNA target sequence
tacggcgatcaaagagtgaaggat

SEQ ID NO: 121689 - DNA, 24 bp, Artificial sequence
  SiRNA target sequence
acggcgatcaaagagtgaaggata

SEQ ID NO: 121690 - DNA, 24 bp, Artificial sequence
  SiRNA target sequence
cggcgatcaaagagtgaaggatac

SEQ ID NO: 121691 - DNA, 24 bp, Artificial sequence
  SiRNA target sequence
ggcgatcaaagagtgaaggatacc

SEQ ID NO: 121692 - DNA, 24 bp, Artificial sequence
  SiRNA target sequence
gcgatcaaagagtgaaggataccc

SEQ ID NO: 121693 - DNA, 24 bp, Artificial sequence
  SiRNA target sequence
cgatcaaagagtgaaggatacccc

SEQ ID NO: 121694 - DNA, 24 bp, Artificial sequence
  SiRNA target sequence
gatcaaagagtgaaggatacccct

SEQ ID NO: 121695 - DNA, 24 bp, Artificial sequence
  SiRNA target sequence
atcaaagagtgaaggataccccta

SEQ ID NO: 121696 - DNA, 24 bp, Artificial sequence
  SiRNA target sequence
tcaaagagtgaaggatacccctat

SEQ ID NO: 121697 - DNA, 24 bp, Artificial sequence
  SiRNA target sequence
caaagagtgaaggatacccctatt

SEQ ID NO: 121698 - DNA, 24 bp, Artificial sequence
  SiRNA target sequence
aaagagtgaaggatacccctattt

SEQ ID NO: 121699 - DNA, 24 bp, Artificial sequence
  SiRNA target sequence
aagagtgaaggatacccctatttc

SEQ ID NO: 121700 - DNA, 24 bp, Artificial sequence
  SiRNA target sequence
agagtgaaggatacccctatttcg

SEQ ID NO: 121701 - DNA, 24 bp, Artificial sequence
  SiRNA target sequence
gagtgaaggatacccctatttcgg

SEQ ID NO: 121702 - DNA, 24 bp, Artificial sequence
  SiRNA target sequence
agtgaaggatacccctatttcgga

SEQ ID NO: 121703 - DNA, 24 bp, Artificial sequence
  SiRNA target sequence
gtgaaggatacccctatttcggaa

SEQ ID NO: 121704 - DNA, 24 bp, Artificial sequence
  SiRNA target sequence
tgaaggatacccctatttcggaaa

SEQ ID NO: 121705 - DNA, 24 bp, Artificial sequence
  SiRNA target sequence
gaaggatacccctatttcggaaat

SEQ ID NO: 121706 - DNA, 24 bp, Artificial sequence
  SiRNA target sequence
aaggatacccctatttcggaaatg

SEQ ID NO: 121707 - DNA, 24 bp, Artificial sequence
  SiRNA target sequence
aggatacccctatttcggaaatgg

SEQ ID NO: 121708 - DNA, 24 bp, Artificial sequence
  SiRNA target sequence
ggatacccctatttcggaaatggg

SEQ ID NO: 121709 - DNA, 24 bp, Artificial sequence
  SiRNA target sequence
gatacccctatttcggaaatggga

SEQ ID NO: 121710 - DNA, 24 bp, Artificial sequence
  SiRNA target sequence
atacccctatttcggaaatgggat

SEQ ID NO: 121711 - DNA, 24 bp, Artificial sequence
  SiRNA target sequence
tacccctatttcggaaatgggatt

SEQ ID NO: 121712 - DNA, 24 bp, Artificial sequence
  SiRNA target sequence
acccctatttcggaaatgggattt

SEQ ID NO: 121713 - DNA, 24 bp, Artificial sequence
  SiRNA target sequence
cccctatttcggaaatgggattta

SEQ ID NO: 121714 - DNA, 24 bp, Artificial sequence
  SiRNA target sequence
ccctatttcggaaatgggatttac

SEQ ID NO: 121715 - DNA, 24 bp, Artificial sequence
  SiRNA target sequence
cctatttcggaaatgggatttaca

SEQ ID NO: 121716 - DNA, 24 bp, Artificial sequence
  SiRNA target sequence
ctatttcggaaatgggatttacag

SEQ ID NO: 121717 - DNA, 24 bp, Artificial sequence
  SiRNA target sequence
tatttcggaaatgggatttacagg

SEQ ID NO: 121718 - DNA, 24 bp, Artificial sequence
  SiRNA target sequence
atttcggaaatgggatttacaggt

SEQ ID NO: 121719 - DNA, 24 bp, Artificial sequence
  SiRNA target sequence
tttcggaaatgggatttacaggtc

SEQ ID NO: 121720 - DNA, 24 bp, Artificial sequence
  SiRNA target sequence
ttcggaaatgggatttacaggtct

SEQ ID NO: 121721 - DNA, 24 bp, Artificial sequence
  SiRNA target sequence
tcggaaatgggatttacaggtctc

SEQ ID NO: 121722 - DNA, 24 bp, Artificial sequence
  SiRNA target sequence
cggaaatgggatttacaggtctcg

SEQ ID NO: 121723 - DNA, 24 bp, Artificial sequence
  SiRNA target sequence
ggaaatgggatttacaggtctcgc

SEQ ID NO: 121724 - DNA, 24 bp, Artificial sequence
  SiRNA target sequence
gaaatgggatttacaggtctcgct

SEQ ID NO: 121725 - DNA, 24 bp, Artificial sequence
  SiRNA target sequence
aaatgggatttacaggtctcgctg

SEQ ID NO: 121726 - DNA, 24 bp, Artificial sequence
  SiRNA target sequence
aatgggatttacaggtctcgctgt

SEQ ID NO: 121727 - DNA, 24 bp, Artificial sequence
  SiRNA target sequence
atgggatttacaggtctcgctgtg

SEQ ID NO: 121728 - DNA, 24 bp, Artificial sequence
  SiRNA target sequence
tgggatttacaggtctcgctgtgg

SEQ ID NO: 121729 - DNA, 24 bp, Artificial sequence
  SiRNA target sequence
gggatttacaggtctcgctgtggg

SEQ ID NO: 121730 - DNA, 24 bp, Artificial sequence
  SiRNA target sequence
ggatttacaggtctcgctgtgggt

SEQ ID NO: 121731 - DNA, 24 bp, Artificial sequence
  SiRNA target sequence
gatttacaggtctcgctgtgggtt

SEQ ID NO: 121732 - DNA, 24 bp, Artificial sequence
  SiRNA target sequence
atttacaggtctcgctgtgggttc

SEQ ID NO: 121733 - DNA, 24 bp, Artificial sequence
  SiRNA target sequence
tttacaggtctcgctgtgggttca

SEQ ID NO: 121734 - DNA, 24 bp, Artificial sequence
  SiRNA target sequence
ttacaggtctcgctgtgggttcaa

SEQ ID NO: 121735 - DNA, 24 bp, Artificial sequence
  SiRNA target sequence
tacaggtctcgctgtgggttcaag

SEQ ID NO: 121736 - DNA, 24 bp, Artificial sequence
  SiRNA target sequence
acaggtctcgctgtgggttcaagc

SEQ ID NO: 121737 - DNA, 24 bp, Artificial sequence
  SiRNA target sequence
caggtctcgctgtgggttcaagct

SEQ ID NO: 121738 - DNA, 24 bp, Artificial sequence
  SiRNA target sequence
aggtctcgctgtgggttcaagcta

SEQ ID NO: 121739 - DNA, 24 bp, Artificial sequence
  SiRNA target sequence
ggtctcgctgtgggttcaagctat

SEQ ID NO: 121740 - DNA, 24 bp, Artificial sequence
  SiRNA target sequence
gtctcgctgtgggttcaagctatt

SEQ ID NO: 121741 - DNA, 24 bp, Artificial sequence
  SiRNA target sequence
tctcgctgtgggttcaagctattt

SEQ ID NO: 121742 - DNA, 24 bp, Artificial sequence
  SiRNA target sequence
ctcgctgtgggttcaagctattta

SEQ ID NO: 121743 - DNA, 24 bp, Artificial sequence
  SiRNA target sequence
tcgctgtgggttcaagctatttag

SEQ ID NO: 121744 - DNA, 24 bp, Artificial sequence
  SiRNA target sequence
cgctgtgggttcaagctatttagg

SEQ ID NO: 121745 - DNA, 24 bp, Artificial sequence
  SiRNA target sequence
gctgtgggttcaagctatttaggg

SEQ ID NO: 121746 - DNA, 24 bp, Artificial sequence
  SiRNA target sequence
ctgtgggttcaagctatttagggt

SEQ ID NO: 121747 - DNA, 24 bp, Artificial sequence
  SiRNA target sequence
tgtgggttcaagctatttagggtt

SEQ ID NO: 121748 - DNA, 24 bp, Artificial sequence
  SiRNA target sequence
gtgggttcaagctatttagggtta

SEQ ID NO: 121749 - DNA, 24 bp, Artificial sequence
  SiRNA target sequence
tgggttcaagctatttagggttaa

SEQ ID NO: 121750 - DNA, 24 bp, Artificial sequence
  SiRNA target sequence
gggttcaagctatttagggttaag

SEQ ID NO: 121751 - DNA, 24 bp, Artificial sequence
  SiRNA target sequence
ggttcaagctatttagggttaaga

SEQ ID NO: 121752 - DNA, 24 bp, Artificial sequence
  SiRNA target sequence
gttcaagctatttagggttaagac

SEQ ID NO: 121753 - DNA, 24 bp, Artificial sequence
  SiRNA target sequence
ttcaagctatttagggttaagacc

SEQ ID NO: 121754 - DNA, 24 bp, Artificial sequence
  SiRNA target sequence
tcaagctatttagggttaagaccc

SEQ ID NO: 121755 - DNA, 24 bp, Artificial sequence
  SiRNA target sequence
caagctatttagggttaagacccg

SEQ ID NO: 121756 - DNA, 24 bp, Artificial sequence
  SiRNA target sequence
aagctatttagggttaagacccgt

SEQ ID NO: 121757 - DNA, 24 bp, Artificial sequence
  SiRNA target sequence
agctatttagggttaagacccgta

SEQ ID NO: 121758 - DNA, 24 bp, Artificial sequence
  SiRNA target sequence
gctatttagggttaagacccgtag

SEQ ID NO: 121759 - DNA, 24 bp, Artificial sequence
  SiRNA target sequence
ctatttagggttaagacccgtagt

SEQ ID NO: 121760 - DNA, 24 bp, Artificial sequence
  SiRNA target sequence
tatttagggttaagacccgtagta

SEQ ID NO: 121761 - DNA, 24 bp, Artificial sequence
  SiRNA target sequence
atttagggttaagacccgtagtag

SEQ ID NO: 121762 - DNA, 24 bp, Artificial sequence
  SiRNA target sequence
tttagggttaagacccgtagtaga

SEQ ID NO: 121763 - DNA, 24 bp, Artificial sequence
  SiRNA target sequence
ttagggttaagacccgtagtagat

SEQ ID NO: 121764 - DNA, 24 bp, Artificial sequence
  SiRNA target sequence
tagggttaagacccgtagtagatt

SEQ ID NO: 121765 - DNA, 24 bp, Artificial sequence
  SiRNA target sequence
agggttaagacccgtagtagattt

SEQ ID NO: 121766 - DNA, 24 bp, Artificial sequence
  SiRNA target sequence
gggttaagacccgtagtagatttt

SEQ ID NO: 121767 - DNA, 24 bp, Artificial sequence
  SiRNA target sequence
ggttaagacccgtagtagatttta

SEQ ID NO: 121768 - DNA, 24 bp, Artificial sequence
  SiRNA target sequence
gttaagacccgtagtagattttat

SEQ ID NO: 121769 - DNA, 24 bp, Artificial sequence
  SiRNA target sequence
ttaagacccgtagtagattttatg

SEQ ID NO: 121770 - DNA, 24 bp, Artificial sequence
  SiRNA target sequence
taagacccgtagtagattttatga

SEQ ID NO: 121771 - DNA, 24 bp, Artificial sequence
  SiRNA target sequence
aagacccgtagtagattttatgac

SEQ ID NO: 121772 - DNA, 24 bp, Artificial sequence
  SiRNA target sequence
agacccgtagtagattttatgact

SEQ ID NO: 121773 - DNA, 24 bp, Artificial sequence
  SiRNA target sequence
gacccgtagtagattttatgactt

SEQ ID NO: 121774 - DNA, 24 bp, Artificial sequence
  SiRNA target sequence
acccgtagtagattttatgacttg

SEQ ID NO: 121775 - DNA, 24 bp, Artificial sequence
  SiRNA target sequence
cccgtagtagattttatgacttgg

SEQ ID NO: 121776 - DNA, 24 bp, Artificial sequence
  SiRNA target sequence
ccgtagtagattttatgacttgga

SEQ ID NO: 121777 - DNA, 24 bp, Artificial sequence
  SiRNA target sequence
cgtagtagattttatgacttggaa

SEQ ID NO: 121778 - DNA, 24 bp, Artificial sequence
  SiRNA target sequence
gtagtagattttatgacttggaat

SEQ ID NO: 121779 - DNA, 24 bp, Artificial sequence
  SiRNA target sequence
tagtagattttatgacttggaatt

SEQ ID NO: 121780 - DNA, 24 bp, Artificial sequence
  SiRNA target sequence
agtagattttatgacttggaattt

SEQ ID NO: 121781 - DNA, 24 bp, Artificial sequence
  SiRNA target sequence
gtagattttatgacttggaatttt

SEQ ID NO: 121782 - DNA, 24 bp, Artificial sequence
  SiRNA target sequence
tagattttatgacttggaattttg

SEQ ID NO: 121783 - DNA, 24 bp, Artificial sequence
  SiRNA target sequence
agattttatgacttggaattttgc

SEQ ID NO: 121784 - DNA, 24 bp, Artificial sequence
  SiRNA target sequence
gattttatgacttggaattttgct

SEQ ID NO: 121785 - DNA, 24 bp, Artificial sequence
  SiRNA target sequence
attttatgacttggaattttgctt

SEQ ID NO: 121786 - DNA, 24 bp, Artificial sequence
  SiRNA target sequence
ttttatgacttggaattttgcttt

SEQ ID NO: 121787 - DNA, 24 bp, Artificial sequence
  SiRNA target sequence
tttatgacttggaattttgctttg

SEQ ID NO: 121788 - DNA, 24 bp, Artificial sequence
  SiRNA target sequence
ttatgacttggaattttgctttgc

SEQ ID NO: 121789 - DNA, 24 bp, Artificial sequence
  SiRNA target sequence
tatgacttggaattttgctttgca

SEQ ID NO: 121790 - DNA, 24 bp, Artificial sequence
  SiRNA target sequence
atgacttggaattttgctttgcaa

SEQ ID NO: 121791 - DNA, 24 bp, Artificial sequence
  SiRNA target sequence
tgacttggaattttgctttgcaat

SEQ ID NO: 121792 - DNA, 24 bp, Artificial sequence
  SiRNA target sequence
gacttggaattttgctttgcaatc

SEQ ID NO: 121793 - DNA, 24 bp, Artificial sequence
  SiRNA target sequence
acttggaattttgctttgcaatca

SEQ ID NO: 121794 - DNA, 24 bp, Artificial sequence
  SiRNA target sequence
cttggaattttgctttgcaatcaa

SEQ ID NO: 121795 - DNA, 24 bp, Artificial sequence
  SiRNA target sequence
ttggaattttgctttgcaatcaat

SEQ ID NO: 121796 - DNA, 24 bp, Artificial sequence
  SiRNA target sequence
tggaattttgctttgcaatcaatt

SEQ ID NO: 121797 - DNA, 24 bp, Artificial sequence
  SiRNA target sequence
ggaattttgctttgcaatcaattg

SEQ ID NO: 121798 - DNA, 24 bp, Artificial sequence
  SiRNA target sequence
gaattttgctttgcaatcaattga

SEQ ID NO: 121799 - DNA, 24 bp, Artificial sequence
  SiRNA target sequence
aattttgctttgcaatcaattgac

SEQ ID NO: 121800 - DNA, 24 bp, Artificial sequence
  SiRNA target sequence
attttgctttgcaatcaattgacc

SEQ ID NO: 121801 - DNA, 24 bp, Artificial sequence
  SiRNA target sequence
ttttgctttgcaatcaattgacca

SEQ ID NO: 121802 - DNA, 24 bp, Artificial sequence
  SiRNA target sequence
tttgctttgcaatcaattgaccat

SEQ ID NO: 121803 - DNA, 24 bp, Artificial sequence
  SiRNA target sequence
ttgctttgcaatcaattgaccata

SEQ ID NO: 121804 - DNA, 24 bp, Artificial sequence
  SiRNA target sequence
tgctttgcaatcaattgaccatat

SEQ ID NO: 121805 - DNA, 24 bp, Artificial sequence
  SiRNA target sequence
gctttgcaatcaattgaccatatt

SEQ ID NO: 121806 - DNA, 24 bp, Artificial sequence
  SiRNA target sequence
ctttgcaatcaattgaccatatta

SEQ ID NO: 121807 - DNA, 24 bp, Artificial sequence
  SiRNA target sequence
tttgcaatcaattgaccatattat

SEQ ID NO: 121808 - DNA, 24 bp, Artificial sequence
  SiRNA target sequence
ttgcaatcaattgaccatattatt

SEQ ID NO: 121809 - DNA, 24 bp, Artificial sequence
  SiRNA target sequence
tgcaatcaattgaccatattatta

SEQ ID NO: 121810 - DNA, 24 bp, Artificial sequence
  SiRNA target sequence
gcaatcaattgaccatattattaa

SEQ ID NO: 121811 - DNA, 24 bp, Artificial sequence
  SiRNA target sequence
caatcaattgaccatattattaat

SEQ ID NO: 121812 - DNA, 24 bp, Artificial sequence
  SiRNA target sequence
aatcaattgaccatattattaatt

SEQ ID NO: 121813 - DNA, 24 bp, Artificial sequence
  SiRNA target sequence
atcaattgaccatattattaattc

SEQ ID NO: 121814 - DNA, 24 bp, Artificial sequence
  SiRNA target sequence
tcaattgaccatattattaattct

SEQ ID NO: 121815 - DNA, 24 bp, Artificial sequence
  SiRNA target sequence
caattgaccatattattaattctt

SEQ ID NO: 121816 - DNA, 24 bp, Artificial sequence
  SiRNA target sequence
aattgaccatattattaattcttg

SEQ ID NO: 121817 - DNA, 24 bp, Artificial sequence
  SiRNA target sequence
attgaccatattattaattcttgt

SEQ ID NO: 121818 - DNA, 24 bp, Artificial sequence
  SiRNA target sequence
ttgaccatattattaattcttgtg

SEQ ID NO: 121819 - DNA, 24 bp, Artificial sequence
  SiRNA target sequence
tgaccatattattaattcttgtgc

SEQ ID NO: 121820 - DNA, 24 bp, Artificial sequence
  SiRNA target sequence
gaccatattattaattcttgtgcg

SEQ ID NO: 121821 - DNA, 24 bp, Artificial sequence
  SiRNA target sequence
accatattattaattcttgtgcga

SEQ ID NO: 121822 - DNA, 24 bp, Artificial sequence
  SiRNA target sequence
ccatattattaattcttgtgcgaa

SEQ ID NO: 121823 - DNA, 24 bp, Artificial sequence
  SiRNA target sequence
catattattaattcttgtgcgaaa

SEQ ID NO: 121824 - DNA, 24 bp, Artificial sequence
  SiRNA target sequence
atattattaattcttgtgcgaaaa

SEQ ID NO: 121825 - DNA, 24 bp, Artificial sequence
  SiRNA target sequence
tattattaattcttgtgcgaaaac

SEQ ID NO: 121826 - DNA, 24 bp, Artificial sequence
  SiRNA target sequence
attattaattcttgtgcgaaaacc

SEQ ID NO: 121827 - DNA, 24 bp, Artificial sequence
  SiRNA target sequence
ttattaattcttgtgcgaaaacct

SEQ ID NO: 121828 - DNA, 24 bp, Artificial sequence
  SiRNA target sequence
tattaattcttgtgcgaaaacctt

SEQ ID NO: 121829 - DNA, 24 bp, Artificial sequence
  SiRNA target sequence
attaattcttgtgcgaaaaccttg

SEQ ID NO: 121830 - DNA, 24 bp, Artificial sequence
  SiRNA target sequence
ttaattcttgtgcgaaaaccttgt

SEQ ID NO: 121831 - DNA, 24 bp, Artificial sequence
  SiRNA target sequence
taattcttgtgcgaaaaccttgta

SEQ ID NO: 121832 - DNA, 24 bp, Artificial sequence
  SiRNA target sequence
aattcttgtgcgaaaaccttgtat

SEQ ID NO: 121833 - DNA, 24 bp, Artificial sequence
  SiRNA target sequence
attcttgtgcgaaaaccttgtata

SEQ ID NO: 121834 - DNA, 24 bp, Artificial sequence
  SiRNA target sequence
ttcttgtgcgaaaaccttgtatat

SEQ ID NO: 121835 - DNA, 24 bp, Artificial sequence
  SiRNA target sequence
tcttgtgcgaaaaccttgtatatg

SEQ ID NO: 121836 - DNA, 24 bp, Artificial sequence
  SiRNA target sequence
cttgtgcgaaaaccttgtatatgt

SEQ ID NO: 121837 - DNA, 24 bp, Artificial sequence
  SiRNA target sequence
ttgtgcgaaaaccttgtatatgtc

SEQ ID NO: 121838 - DNA, 24 bp, Artificial sequence
  SiRNA target sequence
tgtgcgaaaaccttgtatatgtca

SEQ ID NO: 121839 - DNA, 24 bp, Artificial sequence
  SiRNA target sequence
gtgcgaaaaccttgtatatgtcag

SEQ ID NO: 121840 - DNA, 24 bp, Artificial sequence
  SiRNA target sequence
tgcgaaaaccttgtatatgtcagg

SEQ ID NO: 121841 - DNA, 24 bp, Artificial sequence
  SiRNA target sequence
gcgaaaaccttgtatatgtcagga

SEQ ID NO: 121842 - DNA, 24 bp, Artificial sequence
  SiRNA target sequence
cgaaaaccttgtatatgtcaggag

SEQ ID NO: 121843 - DNA, 24 bp, Artificial sequence
  SiRNA target sequence
gaaaaccttgtatatgtcaggagg

SEQ ID NO: 121844 - DNA, 24 bp, Artificial sequence
  SiRNA target sequence
aaaaccttgtatatgtcaggagga

SEQ ID NO: 121845 - DNA, 24 bp, Artificial sequence
  SiRNA target sequence
aaaccttgtatatgtcaggaggaa

SEQ ID NO: 121846 - DNA, 24 bp, Artificial sequence
  SiRNA target sequence
aaccttgtatatgtcaggaggaag

SEQ ID NO: 121847 - DNA, 24 bp, Artificial sequence
  SiRNA target sequence
accttgtatatgtcaggaggaaga

SEQ ID NO: 121848 - DNA, 24 bp, Artificial sequence
  SiRNA target sequence
ccttgtatatgtcaggaggaagaa

SEQ ID NO: 121849 - DNA, 24 bp, Artificial sequence
  SiRNA target sequence
cttgtatatgtcaggaggaagaat

SEQ ID NO: 121850 - DNA, 24 bp, Artificial sequence
  SiRNA target sequence
ttgtatatgtcaggaggaagaata

SEQ ID NO: 121851 - DNA, 24 bp, Artificial sequence
  SiRNA target sequence
tgtatatgtcaggaggaagaatac

SEQ ID NO: 121852 - DNA, 24 bp, Artificial sequence
  SiRNA target sequence
gtatatgtcaggaggaagaataca

SEQ ID NO: 121853 - DNA, 24 bp, Artificial sequence
  SiRNA target sequence
tatatgtcaggaggaagaatacaa

SEQ ID NO: 121854 - DNA, 24 bp, Artificial sequence
  SiRNA target sequence
atatgtcaggaggaagaatacaat

SEQ ID NO: 121855 - DNA, 24 bp, Artificial sequence
  SiRNA target sequence
tatgtcaggaggaagaatacaatg

SEQ ID NO: 121856 - DNA, 24 bp, Artificial sequence
  SiRNA target sequence
atgtcaggaggaagaatacaatgt

SEQ ID NO: 121857 - DNA, 24 bp, Artificial sequence
  SiRNA target sequence
tgtcaggaggaagaatacaatgtc

SEQ ID NO: 121858 - DNA, 24 bp, Artificial sequence
  SiRNA target sequence
gtcaggaggaagaatacaatgtcc

SEQ ID NO: 121859 - DNA, 24 bp, Artificial sequence
  SiRNA target sequence
tcaggaggaagaatacaatgtcca

SEQ ID NO: 121860 - DNA, 24 bp, Artificial sequence
  SiRNA target sequence
caggaggaagaatacaatgtccaa

SEQ ID NO: 121861 - DNA, 24 bp, Artificial sequence
  SiRNA target sequence
aggaggaagaatacaatgtccaat

SEQ ID NO: 121862 - DNA, 24 bp, Artificial sequence
  SiRNA target sequence
ggaggaagaatacaatgtccaatt

SEQ ID NO: 121863 - DNA, 24 bp, Artificial sequence
  SiRNA target sequence
gaggaagaatacaatgtccaattg

SEQ ID NO: 121864 - DNA, 24 bp, Artificial sequence
  SiRNA target sequence
aggaagaatacaatgtccaattgt

SEQ ID NO: 121865 - DNA, 24 bp, Artificial sequence
  SiRNA target sequence
ggaagaatacaatgtccaattgtt

SEQ ID NO: 121866 - DNA, 24 bp, Artificial sequence
  SiRNA target sequence
gaagaatacaatgtccaattgttt

SEQ ID NO: 121867 - DNA, 24 bp, Artificial sequence
  SiRNA target sequence
aagaatacaatgtccaattgtttt

SEQ ID NO: 121868 - DNA, 24 bp, Artificial sequence
  SiRNA target sequence
agaatacaatgtccaattgttttt

SEQ ID NO: 121869 - DNA, 24 bp, Artificial sequence
  SiRNA target sequence
gaatacaatgtccaattgttttta

SEQ ID NO: 121870 - DNA, 24 bp, Artificial sequence
  SiRNA target sequence
aatacaatgtccaattgtttttag

SEQ ID NO: 121871 - DNA, 24 bp, Artificial sequence
  SiRNA target sequence
atacaatgtccaattgtttttagg

SEQ ID NO: 121872 - DNA, 24 bp, Artificial sequence
  SiRNA target sequence
tacaatgtccaattgtttttaggg

SEQ ID NO: 121873 - DNA, 24 bp, Artificial sequence
  SiRNA target sequence
acaatgtccaattgtttttagggg

SEQ ID NO: 121874 - DNA, 24 bp, Artificial sequence
  SiRNA target sequence
caatgtccaattgtttttagggga

SEQ ID NO: 121875 - DNA, 24 bp, Artificial sequence
  SiRNA target sequence
aatgtccaattgtttttaggggac

SEQ ID NO: 121876 - DNA, 24 bp, Artificial sequence
  SiRNA target sequence
atgtccaattgtttttaggggacc

SEQ ID NO: 121877 - DNA, 24 bp, Artificial sequence
  SiRNA target sequence
tgtccaattgtttttaggggacca

SEQ ID NO: 121878 - DNA, 24 bp, Artificial sequence
  SiRNA target sequence
gtccaattgtttttaggggaccaa

SEQ ID NO: 121879 - DNA, 24 bp, Artificial sequence
  SiRNA target sequence
tccaattgtttttaggggaccaaa

SEQ ID NO: 121880 - DNA, 24 bp, Artificial sequence
  SiRNA target sequence
ccaattgtttttaggggaccaaat

SEQ ID NO: 121881 - DNA, 24 bp, Artificial sequence
  SiRNA target sequence
caattgtttttaggggaccaaatg

SEQ ID NO: 121882 - DNA, 24 bp, Artificial sequence
  SiRNA target sequence
aattgtttttaggggaccaaatgg

SEQ ID NO: 121883 - DNA, 24 bp, Artificial sequence
  SiRNA target sequence
attgtttttaggggaccaaatgga

SEQ ID NO: 121884 - DNA, 24 bp, Artificial sequence
  SiRNA target sequence
ttgtttttaggggaccaaatggat

SEQ ID NO: 121885 - DNA, 24 bp, Artificial sequence
  SiRNA target sequence
tgtttttaggggaccaaatggatt

SEQ ID NO: 121886 - DNA, 24 bp, Artificial sequence
  SiRNA target sequence
gtttttaggggaccaaatggattc

SEQ ID NO: 121887 - DNA, 24 bp, Artificial sequence
  SiRNA target sequence
tttttaggggaccaaatggattca

SEQ ID NO: 121888 - DNA, 24 bp, Artificial sequence
  SiRNA target sequence
ttttaggggaccaaatggattcaa

SEQ ID NO: 121889 - DNA, 24 bp, Artificial sequence
  SiRNA target sequence
tttaggggaccaaatggattcaat

SEQ ID NO: 121890 - DNA, 24 bp, Artificial sequence
  SiRNA target sequence
ttaggggaccaaatggattcaata

SEQ ID NO: 121891 - DNA, 24 bp, Artificial sequence
  SiRNA target sequence
taggggaccaaatggattcaataa

SEQ ID NO: 121892 - DNA, 24 bp, Artificial sequence
  SiRNA target sequence
aggggaccaaatggattcaataat

SEQ ID NO: 121893 - DNA, 24 bp, Artificial sequence
  SiRNA target sequence
ggggaccaaatggattcaataatg

SEQ ID NO: 121894 - DNA, 24 bp, Artificial sequence
  SiRNA target sequence
gggaccaaatggattcaataatgg

SEQ ID NO: 121895 - DNA, 24 bp, Artificial sequence
  SiRNA target sequence
ggaccaaatggattcaataatggg

SEQ ID NO: 121896 - DNA, 24 bp, Artificial sequence
  SiRNA target sequence
gaccaaatggattcaataatgggt

SEQ ID NO: 121897 - DNA, 24 bp, Artificial sequence
  SiRNA target sequence
accaaatggattcaataatgggta

SEQ ID NO: 121898 - DNA, 24 bp, Artificial sequence
  SiRNA target sequence
ccaaatggattcaataatgggtac

SEQ ID NO: 121899 - DNA, 24 bp, Artificial sequence
  SiRNA target sequence
caaatggattcaataatgggtacg

SEQ ID NO: 121900 - DNA, 24 bp, Artificial sequence
  SiRNA target sequence
aaatggattcaataatgggtacgc

SEQ ID NO: 121901 - DNA, 24 bp, Artificial sequence
  SiRNA target sequence
aatggattcaataatgggtacgct

SEQ ID NO: 121902 - DNA, 24 bp, Artificial sequence
  SiRNA target sequence
atggattcaataatgggtacgctg

SEQ ID NO: 121903 - DNA, 24 bp, Artificial sequence
  SiRNA target sequence
tggattcaataatgggtacgctgc

SEQ ID NO: 121904 - DNA, 24 bp, Artificial sequence
  SiRNA target sequence
ggattcaataatgggtacgctgca

SEQ ID NO: 121905 - DNA, 24 bp, Artificial sequence
  SiRNA target sequence
gattcaataatgggtacgctgcac

SEQ ID NO: 121906 - DNA, 24 bp, Artificial sequence
  SiRNA target sequence
attcaataatgggtacgctgcaca

SEQ ID NO: 121907 - DNA, 24 bp, Artificial sequence
  SiRNA target sequence
ttcaataatgggtacgctgcacag

SEQ ID NO: 121908 - DNA, 24 bp, Artificial sequence
  SiRNA target sequence
tcaataatgggtacgctgcacagc

SEQ ID NO: 121909 - DNA, 24 bp, Artificial sequence
  SiRNA target sequence
caataatgggtacgctgcacagca

SEQ ID NO: 121910 - DNA, 24 bp, Artificial sequence
  SiRNA target sequence
aataatgggtacgctgcacagcac

SEQ ID NO: 121911 - DNA, 24 bp, Artificial sequence
  SiRNA target sequence
ataatgggtacgctgcacagcaca

SEQ ID NO: 121912 - DNA, 24 bp, Artificial sequence
  SiRNA target sequence
taatgggtacgctgcacagcacac

SEQ ID NO: 121913 - DNA, 24 bp, Artificial sequence
  SiRNA target sequence
aatgggtacgctgcacagcacaca

SEQ ID NO: 121914 - DNA, 24 bp, Artificial sequence
  SiRNA target sequence
atgggtacgctgcacagcacacac

SEQ ID NO: 121915 - DNA, 24 bp, Artificial sequence
  SiRNA target sequence
tgggtacgctgcacagcacacaca

SEQ ID NO: 121916 - DNA, 24 bp, Artificial sequence
  SiRNA target sequence
gggtacgctgcacagcacacacaa

SEQ ID NO: 121917 - DNA, 24 bp, Artificial sequence
  SiRNA target sequence
ggtacgctgcacagcacacacaag

SEQ ID NO: 121918 - DNA, 24 bp, Artificial sequence
  SiRNA target sequence
gtacgctgcacagcacacacaaga

SEQ ID NO: 121919 - DNA, 24 bp, Artificial sequence
  SiRNA target sequence
tacgctgcacagcacacacaagat

SEQ ID NO: 121920 - DNA, 24 bp, Artificial sequence
  SiRNA target sequence
acgctgcacagcacacacaagatt

SEQ ID NO: 121921 - DNA, 24 bp, Artificial sequence
  SiRNA target sequence
cgctgcacagcacacacaagattt

SEQ ID NO: 121922 - DNA, 24 bp, Artificial sequence
  SiRNA target sequence
gctgcacagcacacacaagatttt

SEQ ID NO: 121923 - DNA, 24 bp, Artificial sequence
  SiRNA target sequence
ctgcacagcacacacaagattttg

SEQ ID NO: 121924 - DNA, 24 bp, Artificial sequence
  SiRNA target sequence
tgcacagcacacacaagattttgc

SEQ ID NO: 121925 - DNA, 24 bp, Artificial sequence
  SiRNA target sequence
gcacagcacacacaagattttgca

SEQ ID NO: 121926 - DNA, 24 bp, Artificial sequence
  SiRNA target sequence
cacagcacacacaagattttgcac

SEQ ID NO: 121927 - DNA, 24 bp, Artificial sequence
  SiRNA target sequence
acagcacacacaagattttgcacc

SEQ ID NO: 121928 - DNA, 24 bp, Artificial sequence
  SiRNA target sequence
cagcacacacaagattttgcacca

SEQ ID NO: 121929 - DNA, 24 bp, Artificial sequence
  SiRNA target sequence
agcacacacaagattttgcaccaa

SEQ ID NO: 121930 - DNA, 24 bp, Artificial sequence
  SiRNA target sequence
gcacacacaagattttgcaccaat

SEQ ID NO: 121931 - DNA, 24 bp, Artificial sequence
  SiRNA target sequence
cacacacaagattttgcaccaata

SEQ ID NO: 121932 - DNA, 24 bp, Artificial sequence
  SiRNA target sequence
acacacaagattttgcaccaatat

SEQ ID NO: 121933 - DNA, 24 bp, Artificial sequence
  SiRNA target sequence
cacacaagattttgcaccaatata

SEQ ID NO: 121934 - DNA, 24 bp, Artificial sequence
  SiRNA target sequence
acacaagattttgcaccaatatat

SEQ ID NO: 121935 - DNA, 24 bp, Artificial sequence
  SiRNA target sequence
cacaagattttgcaccaatatatg

SEQ ID NO: 121936 - DNA, 24 bp, Artificial sequence
  SiRNA target sequence
acaagattttgcaccaatatatgg

SEQ ID NO: 121937 - DNA, 24 bp, Artificial sequence
  SiRNA target sequence
caagattttgcaccaatatatggt

SEQ ID NO: 121938 - DNA, 24 bp, Artificial sequence
  SiRNA target sequence
aagattttgcaccaatatatggtt

SEQ ID NO: 121939 - DNA, 24 bp, Artificial sequence
  SiRNA target sequence
agattttgcaccaatatatggttc

SEQ ID NO: 121940 - DNA, 24 bp, Artificial sequence
  SiRNA target sequence
gattttgcaccaatatatggttct

SEQ ID NO: 121941 - DNA, 24 bp, Artificial sequence
  SiRNA target sequence
attttgcaccaatatatggttcta

SEQ ID NO: 121942 - DNA, 24 bp, Artificial sequence
  SiRNA target sequence
ttttgcaccaatatatggttctat

SEQ ID NO: 121943 - DNA, 24 bp, Artificial sequence
  SiRNA target sequence
tttgcaccaatatatggttctatt

SEQ ID NO: 121944 - DNA, 24 bp, Artificial sequence
  SiRNA target sequence
ttgcaccaatatatggttctattc

SEQ ID NO: 121945 - DNA, 24 bp, Artificial sequence
  SiRNA target sequence
tgcaccaatatatggttctattcc

SEQ ID NO: 121946 - DNA, 24 bp, Artificial sequence
  SiRNA target sequence
gcaccaatatatggttctattcca

SEQ ID NO: 121947 - DNA, 24 bp, Artificial sequence
  SiRNA target sequence
caccaatatatggttctattccag

SEQ ID NO: 121948 - DNA, 24 bp, Artificial sequence
  SiRNA target sequence
accaatatatggttctattccagg

SEQ ID NO: 121949 - DNA, 24 bp, Artificial sequence
  SiRNA target sequence
ccaatatatggttctattccaggc

SEQ ID NO: 121950 - DNA, 24 bp, Artificial sequence
  SiRNA target sequence
caatatatggttctattccaggcc

SEQ ID NO: 121951 - DNA, 24 bp, Artificial sequence
  SiRNA target sequence
aatatatggttctattccaggcct

SEQ ID NO: 121952 - DNA, 24 bp, Artificial sequence
  SiRNA target sequence
atatatggttctattccaggcctt

SEQ ID NO: 121953 - DNA, 24 bp, Artificial sequence
  SiRNA target sequence
tatatggttctattccaggcctta

SEQ ID NO: 121954 - DNA, 24 bp, Artificial sequence
  SiRNA target sequence
atatggttctattccaggccttaa

SEQ ID NO: 121955 - DNA, 24 bp, Artificial sequence
  SiRNA target sequence
tatggttctattccaggccttaag

SEQ ID NO: 121956 - DNA, 24 bp, Artificial sequence
  SiRNA target sequence
atggttctattccaggccttaagg

SEQ ID NO: 121957 - DNA, 24 bp, Artificial sequence
  SiRNA target sequence
tggttctattccaggccttaaggt

SEQ ID NO: 121958 - DNA, 24 bp, Artificial sequence
  SiRNA target sequence
ggttctattccaggccttaaggtg

SEQ ID NO: 121959 - DNA, 24 bp, Artificial sequence
  SiRNA target sequence
gttctattccaggccttaaggtgg

SEQ ID NO: 121960 - DNA, 24 bp, Artificial sequence
  SiRNA target sequence
ttctattccaggccttaaggtggt

SEQ ID NO: 121961 - DNA, 24 bp, Artificial sequence
  SiRNA target sequence
tctattccaggccttaaggtggtt

SEQ ID NO: 121962 - DNA, 24 bp, Artificial sequence
  SiRNA target sequence
ctattccaggccttaaggtggttt

SEQ ID NO: 121963 - DNA, 24 bp, Artificial sequence
  SiRNA target sequence
tattccaggccttaaggtggtttg

SEQ ID NO: 121964 - DNA, 24 bp, Artificial sequence
  SiRNA target sequence
attccaggccttaaggtggtttgt

SEQ ID NO: 121965 - DNA, 24 bp, Artificial sequence
  SiRNA target sequence
ttccaggccttaaggtggtttgtc

SEQ ID NO: 121966 - DNA, 24 bp, Artificial sequence
  SiRNA target sequence
tccaggccttaaggtggtttgtcc

SEQ ID NO: 121967 - DNA, 24 bp, Artificial sequence
  SiRNA target sequence
ccaggccttaaggtggtttgtcct

SEQ ID NO: 121968 - DNA, 24 bp, Artificial sequence
  SiRNA target sequence
caggccttaaggtggtttgtcctt

SEQ ID NO: 121969 - DNA, 24 bp, Artificial sequence
  SiRNA target sequence
aggccttaaggtggtttgtcctta

SEQ ID NO: 121970 - DNA, 24 bp, Artificial sequence
  SiRNA target sequence
ggccttaaggtggtttgtccttat

SEQ ID NO: 121971 - DNA, 24 bp, Artificial sequence
  SiRNA target sequence
gccttaaggtggtttgtccttata

SEQ ID NO: 121972 - DNA, 24 bp, Artificial sequence
  SiRNA target sequence
ccttaaggtggtttgtccttatac

SEQ ID NO: 121973 - DNA, 24 bp, Artificial sequence
  SiRNA target sequence
cttaaggtggtttgtccttatacg

SEQ ID NO: 121974 - DNA, 24 bp, Artificial sequence
  SiRNA target sequence
ttaaggtggtttgtccttatacgg

SEQ ID NO: 121975 - DNA, 24 bp, Artificial sequence
  SiRNA target sequence
taaggtggtttgtccttatacggg

SEQ ID NO: 121976 - DNA, 24 bp, Artificial sequence
  SiRNA target sequence
aaggtggtttgtccttatacgggt

SEQ ID NO: 121977 - DNA, 24 bp, Artificial sequence
  SiRNA target sequence
aggtggtttgtccttatacgggta

SEQ ID NO: 121978 - DNA, 24 bp, Artificial sequence
  SiRNA target sequence
ggtggtttgtccttatacgggtaa

SEQ ID NO: 121979 - DNA, 24 bp, Artificial sequence
  SiRNA target sequence
gtggtttgtccttatacgggtaaa

SEQ ID NO: 121980 - DNA, 24 bp, Artificial sequence
  SiRNA target sequence
tggtttgtccttatacgggtaaag

SEQ ID NO: 121981 - DNA, 24 bp, Artificial sequence
  SiRNA target sequence
ggtttgtccttatacgggtaaaga

SEQ ID NO: 121982 - DNA, 24 bp, Artificial sequence
  SiRNA target sequence
gtttgtccttatacgggtaaagac

SEQ ID NO: 121983 - DNA, 24 bp, Artificial sequence
  SiRNA target sequence
tttgtccttatacgggtaaagacc

SEQ ID NO: 121984 - DNA, 24 bp, Artificial sequence
  SiRNA target sequence
ttgtccttatacgggtaaagacca

SEQ ID NO: 121985 - DNA, 24 bp, Artificial sequence
  SiRNA target sequence
tgtccttatacgggtaaagaccat

SEQ ID NO: 121986 - DNA, 24 bp, Artificial sequence
  SiRNA target sequence
gtccttatacgggtaaagaccata

SEQ ID NO: 121987 - DNA, 24 bp, Artificial sequence
  SiRNA target sequence
tccttatacgggtaaagaccataa

SEQ ID NO: 121988 - DNA, 24 bp, Artificial sequence
  SiRNA target sequence
ccttatacgggtaaagaccataaa

SEQ ID NO: 121989 - DNA, 24 bp, Artificial sequence
  SiRNA target sequence
cttatacgggtaaagaccataaag

SEQ ID NO: 121990 - DNA, 24 bp, Artificial sequence
  SiRNA target sequence
ttatacgggtaaagaccataaagg

SEQ ID NO: 121991 - DNA, 24 bp, Artificial sequence
  SiRNA target sequence
tatacgggtaaagaccataaagga

SEQ ID NO: 121992 - DNA, 24 bp, Artificial sequence
  SiRNA target sequence
atacgggtaaagaccataaaggac

SEQ ID NO: 121993 - DNA, 24 bp, Artificial sequence
  SiRNA target sequence
tacgggtaaagaccataaaggact

SEQ ID NO: 121994 - DNA, 24 bp, Artificial sequence
  SiRNA target sequence
acgggtaaagaccataaaggactt

SEQ ID NO: 121995 - DNA, 24 bp, Artificial sequence
  SiRNA target sequence
cgggtaaagaccataaaggacttt

SEQ ID NO: 121996 - DNA, 24 bp, Artificial sequence
  SiRNA target sequence
gggtaaagaccataaaggactttt

SEQ ID NO: 121997 - DNA, 24 bp, Artificial sequence
  SiRNA target sequence
ggtaaagaccataaaggactttta

SEQ ID NO: 121998 - DNA, 24 bp, Artificial sequence
  SiRNA target sequence
gtaaagaccataaaggacttttaa

SEQ ID NO: 121999 - DNA, 24 bp, Artificial sequence
  SiRNA target sequence
taaagaccataaaggacttttaaa

SEQ ID NO: 122000 - DNA, 24 bp, Artificial sequence
  SiRNA target sequence
aaagaccataaaggacttttaaaa

SEQ ID NO: 122001 - DNA, 24 bp, Artificial sequence
  SiRNA target sequence
aagaccataaaggacttttaaaaa

SEQ ID NO: 122002 - DNA, 24 bp, Artificial sequence
  SiRNA target sequence
agaccataaaggacttttaaaaag

SEQ ID NO: 122003 - DNA, 24 bp, Artificial sequence
  SiRNA target sequence
gaccataaaggacttttaaaaagc

SEQ ID NO: 122004 - DNA, 24 bp, Artificial sequence
  SiRNA target sequence
accataaaggacttttaaaaagcg

SEQ ID NO: 122005 - DNA, 24 bp, Artificial sequence
  SiRNA target sequence
ccataaaggacttttaaaaagcgc

SEQ ID NO: 122006 - DNA, 24 bp, Artificial sequence
  SiRNA target sequence
cataaaggacttttaaaaagcgct

SEQ ID NO: 122007 - DNA, 24 bp, Artificial sequence
  SiRNA target sequence
ataaaggacttttaaaaagcgcta

SEQ ID NO: 122008 - DNA, 24 bp, Artificial sequence
  SiRNA target sequence
taaaggacttttaaaaagcgctat

SEQ ID NO: 122009 - DNA, 24 bp, Artificial sequence
  SiRNA target sequence
aaaggacttttaaaaagcgctatt

SEQ ID NO: 122010 - DNA, 24 bp, Artificial sequence
  SiRNA target sequence
aaggacttttaaaaagcgctatta

SEQ ID NO: 122011 - DNA, 24 bp, Artificial sequence
  SiRNA target sequence
aggacttttaaaaagcgctattag

SEQ ID NO: 122012 - DNA, 24 bp, Artificial sequence
  SiRNA target sequence
ggacttttaaaaagcgctattaga

SEQ ID NO: 122013 - DNA, 24 bp, Artificial sequence
  SiRNA target sequence
gacttttaaaaagcgctattagag

SEQ ID NO: 122014 - DNA, 24 bp, Artificial sequence
  SiRNA target sequence
acttttaaaaagcgctattagaga

SEQ ID NO: 122015 - DNA, 24 bp, Artificial sequence
  SiRNA target sequence
cttttaaaaagcgctattagagac

SEQ ID NO: 122016 - DNA, 24 bp, Artificial sequence
  SiRNA target sequence
ttttaaaaagcgctattagagaca

SEQ ID NO: 122017 - DNA, 24 bp, Artificial sequence
  SiRNA target sequence
tttaaaaagcgctattagagacaa

SEQ ID NO: 122018 - DNA, 24 bp, Artificial sequence
  SiRNA target sequence
ttaaaaagcgctattagagacaat

SEQ ID NO: 122019 - DNA, 24 bp, Artificial sequence
  SiRNA target sequence
taaaaagcgctattagagacaata

SEQ ID NO: 122020 - DNA, 24 bp, Artificial sequence
  SiRNA target sequence
aaaaagcgctattagagacaataa

SEQ ID NO: 122021 - DNA, 24 bp, Artificial sequence
  SiRNA target sequence
aaaagcgctattagagacaataac

SEQ ID NO: 122022 - DNA, 24 bp, Artificial sequence
  SiRNA target sequence
aaagcgctattagagacaataacc

SEQ ID NO: 122023 - DNA, 24 bp, Artificial sequence
  SiRNA target sequence
aagcgctattagagacaataaccc

SEQ ID NO: 122024 - DNA, 24 bp, Artificial sequence
  SiRNA target sequence
agcgctattagagacaataacccg

SEQ ID NO: 122025 - DNA, 24 bp, Artificial sequence
  SiRNA target sequence
gcgctattagagacaataacccgg

SEQ ID NO: 122026 - DNA, 24 bp, Artificial sequence
  SiRNA target sequence
cgctattagagacaataacccggt

SEQ ID NO: 122027 - DNA, 24 bp, Artificial sequence
  SiRNA target sequence
gctattagagacaataacccggtt

SEQ ID NO: 122028 - DNA, 24 bp, Artificial sequence
  SiRNA target sequence
ctattagagacaataacccggtta

SEQ ID NO: 122029 - DNA, 24 bp, Artificial sequence
  SiRNA target sequence
tattagagacaataacccggttat

SEQ ID NO: 122030 - DNA, 24 bp, Artificial sequence
  SiRNA target sequence
attagagacaataacccggttata

SEQ ID NO: 122031 - DNA, 24 bp, Artificial sequence
  SiRNA target sequence
ttagagacaataacccggttatat

SEQ ID NO: 122032 - DNA, 24 bp, Artificial sequence
  SiRNA target sequence
tagagacaataacccggttatatt

SEQ ID NO: 122033 - DNA, 24 bp, Artificial sequence
  SiRNA target sequence
agagacaataacccggttatattt

SEQ ID NO: 122034 - DNA, 24 bp, Artificial sequence
  SiRNA target sequence
gagacaataacccggttatatttc

SEQ ID NO: 122035 - DNA, 24 bp, Artificial sequence
  SiRNA target sequence
agacaataacccggttatatttct

SEQ ID NO: 122036 - DNA, 24 bp, Artificial sequence
  SiRNA target sequence
gacaataacccggttatatttctt

SEQ ID NO: 122037 - DNA, 24 bp, Artificial sequence
  SiRNA target sequence
acaataacccggttatatttcttg

SEQ ID NO: 122038 - DNA, 24 bp, Artificial sequence
  SiRNA target sequence
caataacccggttatatttcttga

SEQ ID NO: 122039 - DNA, 24 bp, Artificial sequence
  SiRNA target sequence
aataacccggttatatttcttgag

SEQ ID NO: 122040 - DNA, 24 bp, Artificial sequence
  SiRNA target sequence
ataacccggttatatttcttgaga

SEQ ID NO: 122041 - DNA, 24 bp, Artificial sequence
  SiRNA target sequence
taacccggttatatttcttgagaa

SEQ ID NO: 122042 - DNA, 24 bp, Artificial sequence
  SiRNA target sequence
aacccggttatatttcttgagaat

SEQ ID NO: 122043 - DNA, 24 bp, Artificial sequence
  SiRNA target sequence
acccggttatatttcttgagaatg

SEQ ID NO: 122044 - DNA, 24 bp, Artificial sequence
  SiRNA target sequence
cccggttatatttcttgagaatga

SEQ ID NO: 122045 - DNA, 24 bp, Artificial sequence
  SiRNA target sequence
ccggttatatttcttgagaatgaa

SEQ ID NO: 122046 - DNA, 24 bp, Artificial sequence
  SiRNA target sequence
cggttatatttcttgagaatgaaa

SEQ ID NO: 122047 - DNA, 24 bp, Artificial sequence
  SiRNA target sequence
ggttatatttcttgagaatgaaat

SEQ ID NO: 122048 - DNA, 24 bp, Artificial sequence
  SiRNA target sequence
gttatatttcttgagaatgaaata

SEQ ID NO: 122049 - DNA, 24 bp, Artificial sequence
  SiRNA target sequence
ttatatttcttgagaatgaaatat

SEQ ID NO: 122050 - DNA, 24 bp, Artificial sequence
  SiRNA target sequence
tatatttcttgagaatgaaatatt

SEQ ID NO: 122051 - DNA, 24 bp, Artificial sequence
  SiRNA target sequence
atatttcttgagaatgaaatatta

SEQ ID NO: 122052 - DNA, 24 bp, Artificial sequence
  SiRNA target sequence
tatttcttgagaatgaaatattat

SEQ ID NO: 122053 - DNA, 24 bp, Artificial sequence
  SiRNA target sequence
atttcttgagaatgaaatattata

SEQ ID NO: 122054 - DNA, 24 bp, Artificial sequence
  SiRNA target sequence
tttcttgagaatgaaatattatat

SEQ ID NO: 122055 - DNA, 24 bp, Artificial sequence
  SiRNA target sequence
ttcttgagaatgaaatattatata

SEQ ID NO: 122056 - DNA, 24 bp, Artificial sequence
  SiRNA target sequence
tcttgagaatgaaatattatataa

SEQ ID NO: 122057 - DNA, 24 bp, Artificial sequence
  SiRNA target sequence
cttgagaatgaaatattatataaa

SEQ ID NO: 122058 - DNA, 24 bp, Artificial sequence
  SiRNA target sequence
ttgagaatgaaatattatataaag

SEQ ID NO: 122059 - DNA, 24 bp, Artificial sequence
  SiRNA target sequence
tgagaatgaaatattatataaaga

SEQ ID NO: 122060 - DNA, 24 bp, Artificial sequence
  SiRNA target sequence
gagaatgaaatattatataaagat

SEQ ID NO: 122061 - DNA, 24 bp, Artificial sequence
  SiRNA target sequence
agaatgaaatattatataaagata

SEQ ID NO: 122062 - DNA, 24 bp, Artificial sequence
  SiRNA target sequence
gaatgaaatattatataaagataa

SEQ ID NO: 122063 - DNA, 24 bp, Artificial sequence
  SiRNA target sequence
aatgaaatattatataaagataaa

SEQ ID NO: 122064 - DNA, 24 bp, Artificial sequence
  SiRNA target sequence
atgaaatattatataaagataaat

SEQ ID NO: 122065 - DNA, 24 bp, Artificial sequence
  SiRNA target sequence
tgaaatattatataaagataaata

SEQ ID NO: 122066 - DNA, 24 bp, Artificial sequence
  SiRNA target sequence
gaaatattatataaagataaatac

SEQ ID NO: 122067 - DNA, 24 bp, Artificial sequence
  SiRNA target sequence
aaatattatataaagataaatacc

SEQ ID NO: 122068 - DNA, 24 bp, Artificial sequence
  SiRNA target sequence
aatattatataaagataaatacct

SEQ ID NO: 122069 - DNA, 24 bp, Artificial sequence
  SiRNA target sequence
atattatataaagataaatacctt

SEQ ID NO: 122070 - DNA, 24 bp, Artificial sequence
  SiRNA target sequence
tattatataaagataaataccttg

SEQ ID NO: 122071 - DNA, 24 bp, Artificial sequence
  SiRNA target sequence
attatataaagataaataccttga

SEQ ID NO: 122072 - DNA, 24 bp, Artificial sequence
  SiRNA target sequence
ttatataaagataaataccttgaa

SEQ ID NO: 122073 - DNA, 24 bp, Artificial sequence
  SiRNA target sequence
tatataaagataaataccttgaag

SEQ ID NO: 122074 - DNA, 24 bp, Artificial sequence
  SiRNA target sequence
atataaagataaataccttgaagt

SEQ ID NO: 122075 - DNA, 24 bp, Artificial sequence
  SiRNA target sequence
tataaagataaataccttgaagtg

SEQ ID NO: 122076 - DNA, 24 bp, Artificial sequence
  SiRNA target sequence
ataaagataaataccttgaagtgt

SEQ ID NO: 122077 - DNA, 24 bp, Artificial sequence
  SiRNA target sequence
taaagataaataccttgaagtgtc

SEQ ID NO: 122078 - DNA, 24 bp, Artificial sequence
  SiRNA target sequence
aaagataaataccttgaagtgtct

SEQ ID NO: 122079 - DNA, 24 bp, Artificial sequence
  SiRNA target sequence
aagataaataccttgaagtgtcta

SEQ ID NO: 122080 - DNA, 24 bp, Artificial sequence
  SiRNA target sequence
agataaataccttgaagtgtctaa

SEQ ID NO: 122081 - DNA, 24 bp, Artificial sequence
  SiRNA target sequence
gataaataccttgaagtgtctaat

SEQ ID NO: 122082 - DNA, 24 bp, Artificial sequence
  SiRNA target sequence
ataaataccttgaagtgtctaata

SEQ ID NO: 122083 - DNA, 24 bp, Artificial sequence
  SiRNA target sequence
taaataccttgaagtgtctaataa

SEQ ID NO: 122084 - DNA, 24 bp, Artificial sequence
  SiRNA target sequence
aaataccttgaagtgtctaataat

SEQ ID NO: 122085 - DNA, 24 bp, Artificial sequence
  SiRNA target sequence
aataccttgaagtgtctaataatt

SEQ ID NO: 122086 - DNA, 24 bp, Artificial sequence
  SiRNA target sequence
ataccttgaagtgtctaataatta

SEQ ID NO: 122087 - DNA, 24 bp, Artificial sequence
  SiRNA target sequence
taccttgaagtgtctaataattat

SEQ ID NO: 122088 - DNA, 24 bp, Artificial sequence
  SiRNA target sequence
accttgaagtgtctaataattata

SEQ ID NO: 122089 - DNA, 24 bp, Artificial sequence
  SiRNA target sequence
ccttgaagtgtctaataattatat

SEQ ID NO: 122090 - DNA, 24 bp, Artificial sequence
  SiRNA target sequence
cttgaagtgtctaataattatatt

SEQ ID NO: 122091 - DNA, 24 bp, Artificial sequence
  SiRNA target sequence
ttgaagtgtctaataattatattc

SEQ ID NO: 122092 - DNA, 24 bp, Artificial sequence
  SiRNA target sequence
tgaagtgtctaataattatattca

SEQ ID NO: 122093 - DNA, 24 bp, Artificial sequence
  SiRNA target sequence
gaagtgtctaataattatattcaa

SEQ ID NO: 122094 - DNA, 24 bp, Artificial sequence
  SiRNA target sequence
aagtgtctaataattatattcaac

SEQ ID NO: 122095 - DNA, 24 bp, Artificial sequence
  SiRNA target sequence
agtgtctaataattatattcaacc

SEQ ID NO: 122096 - DNA, 24 bp, Artificial sequence
  SiRNA target sequence
gtgtctaataattatattcaacca

SEQ ID NO: 122097 - DNA, 24 bp, Artificial sequence
  SiRNA target sequence
tgtctaataattatattcaaccac

SEQ ID NO: 122098 - DNA, 24 bp, Artificial sequence
  SiRNA target sequence
gtctaataattatattcaaccact

SEQ ID NO: 122099 - DNA, 24 bp, Artificial sequence
  SiRNA target sequence
tctaataattatattcaaccactt

SEQ ID NO: 122100 - DNA, 24 bp, Artificial sequence
  SiRNA target sequence
ctaataattatattcaaccacttg

SEQ ID NO: 122101 - DNA, 24 bp, Artificial sequence
  SiRNA target sequence
taataattatattcaaccacttga

SEQ ID NO: 122102 - DNA, 24 bp, Artificial sequence
  SiRNA target sequence
aataattatattcaaccacttgac

SEQ ID NO: 122103 - DNA, 24 bp, Artificial sequence
  SiRNA target sequence
ataattatattcaaccacttgaca

SEQ ID NO: 122104 - DNA, 24 bp, Artificial sequence
  SiRNA target sequence
taattatattcaaccacttgacaa

SEQ ID NO: 122105 - DNA, 24 bp, Artificial sequence
  SiRNA target sequence
aattatattcaaccacttgacaag

SEQ ID NO: 122106 - DNA, 24 bp, Artificial sequence
  SiRNA target sequence
attatattcaaccacttgacaagg

SEQ ID NO: 122107 - DNA, 24 bp, Artificial sequence
  SiRNA target sequence
ttatattcaaccacttgacaaggc

SEQ ID NO: 122108 - DNA, 24 bp, Artificial sequence
  SiRNA target sequence
tatattcaaccacttgacaaggca

SEQ ID NO: 122109 - DNA, 24 bp, Artificial sequence
  SiRNA target sequence
atattcaaccacttgacaaggcag

SEQ ID NO: 122110 - DNA, 24 bp, Artificial sequence
  SiRNA target sequence
tattcaaccacttgacaaggcagt

SEQ ID NO: 122111 - DNA, 24 bp, Artificial sequence
  SiRNA target sequence
attcaaccacttgacaaggcagta

SEQ ID NO: 122112 - DNA, 24 bp, Artificial sequence
  SiRNA target sequence
ttcaaccacttgacaaggcagtaa

SEQ ID NO: 122113 - DNA, 24 bp, Artificial sequence
  SiRNA target sequence
tcaaccacttgacaaggcagtaat

SEQ ID NO: 122114 - DNA, 24 bp, Artificial sequence
  SiRNA target sequence
caaccacttgacaaggcagtaatt

SEQ ID NO: 122115 - DNA, 24 bp, Artificial sequence
  SiRNA target sequence
aaccacttgacaaggcagtaattg

SEQ ID NO: 122116 - DNA, 24 bp, Artificial sequence
  SiRNA target sequence
accacttgacaaggcagtaattga

SEQ ID NO: 122117 - DNA, 24 bp, Artificial sequence
  SiRNA target sequence
ccacttgacaaggcagtaattgaa

SEQ ID NO: 122118 - DNA, 24 bp, Artificial sequence
  SiRNA target sequence
cacttgacaaggcagtaattgaaa

SEQ ID NO: 122119 - DNA, 24 bp, Artificial sequence
  SiRNA target sequence
acttgacaaggcagtaattgaaaa

SEQ ID NO: 122120 - DNA, 24 bp, Artificial sequence
  SiRNA target sequence
cttgacaaggcagtaattgaaaaa

SEQ ID NO: 122121 - DNA, 24 bp, Artificial sequence
  SiRNA target sequence
ttgacaaggcagtaattgaaaaaa

SEQ ID NO: 122122 - DNA, 24 bp, Artificial sequence
  SiRNA target sequence
tgacaaggcagtaattgaaaaaaa

SEQ ID NO: 122123 - DNA, 24 bp, Artificial sequence
  SiRNA target sequence
gacaaggcagtaattgaaaaaaat

SEQ ID NO: 122124 - DNA, 24 bp, Artificial sequence
  SiRNA target sequence
acaaggcagtaattgaaaaaaatg

SEQ ID NO: 122125 - DNA, 24 bp, Artificial sequence
  SiRNA target sequence
caaggcagtaattgaaaaaaatgg

SEQ ID NO: 122126 - DNA, 24 bp, Artificial sequence
  SiRNA target sequence
aaggcagtaattgaaaaaaatggt

SEQ ID NO: 122127 - DNA, 24 bp, Artificial sequence
  SiRNA target sequence
aggcagtaattgaaaaaaatggtg

SEQ ID NO: 122128 - DNA, 24 bp, Artificial sequence
  SiRNA target sequence
ggcagtaattgaaaaaaatggtgt

SEQ ID NO: 122129 - DNA, 24 bp, Artificial sequence
  SiRNA target sequence
gcagtaattgaaaaaaatggtgtt

SEQ ID NO: 122130 - DNA, 24 bp, Artificial sequence
  SiRNA target sequence
cagtaattgaaaaaaatggtgttg

SEQ ID NO: 122131 - DNA, 24 bp, Artificial sequence
  SiRNA target sequence
agtaattgaaaaaaatggtgttga

SEQ ID NO: 122132 - DNA, 24 bp, Artificial sequence
  SiRNA target sequence
gtaattgaaaaaaatggtgttgac

SEQ ID NO: 122133 - DNA, 24 bp, Artificial sequence
  SiRNA target sequence
taattgaaaaaaatggtgttgacg

SEQ ID NO: 122134 - DNA, 24 bp, Artificial sequence
  SiRNA target sequence
aattgaaaaaaatggtgttgacgt

SEQ ID NO: 122135 - DNA, 24 bp, Artificial sequence
  SiRNA target sequence
attgaaaaaaatggtgttgacgtt

SEQ ID NO: 122136 - DNA, 24 bp, Artificial sequence
  SiRNA target sequence
ttgaaaaaaatggtgttgacgtta

SEQ ID NO: 122137 - DNA, 24 bp, Artificial sequence
  SiRNA target sequence
tgaaaaaaatggtgttgacgttac

SEQ ID NO: 122138 - DNA, 24 bp, Artificial sequence
  SiRNA target sequence
gaaaaaaatggtgttgacgttaca

SEQ ID NO: 122139 - DNA, 24 bp, Artificial sequence
  SiRNA target sequence
aaaaaaatggtgttgacgttacag

SEQ ID NO: 122140 - DNA, 24 bp, Artificial sequence
  SiRNA target sequence
aaaaaatggtgttgacgttacagt

SEQ ID NO: 122141 - DNA, 24 bp, Artificial sequence
  SiRNA target sequence
aaaaatggtgttgacgttacagtt

SEQ ID NO: 122142 - DNA, 24 bp, Artificial sequence
  SiRNA target sequence
aaaatggtgttgacgttacagttt

SEQ ID NO: 122143 - DNA, 24 bp, Artificial sequence
  SiRNA target sequence
aaatggtgttgacgttacagtttt

SEQ ID NO: 122144 - DNA, 24 bp, Artificial sequence
  SiRNA target sequence
aatggtgttgacgttacagtttta

SEQ ID NO: 122145 - DNA, 24 bp, Artificial sequence
  SiRNA target sequence
atggtgttgacgttacagttttag

SEQ ID NO: 122146 - DNA, 24 bp, Artificial sequence
  SiRNA target sequence
tggtgttgacgttacagttttagg

SEQ ID NO: 122147 - DNA, 24 bp, Artificial sequence
  SiRNA target sequence
ggtgttgacgttacagttttagga

SEQ ID NO: 122148 - DNA, 24 bp, Artificial sequence
  SiRNA target sequence
gtgttgacgttacagttttaggaa

SEQ ID NO: 122149 - DNA, 24 bp, Artificial sequence
  SiRNA target sequence
tgttgacgttacagttttaggaat

SEQ ID NO: 122150 - DNA, 24 bp, Artificial sequence
  SiRNA target sequence
gttgacgttacagttttaggaata

SEQ ID NO: 122151 - DNA, 24 bp, Artificial sequence
  SiRNA target sequence
ttgacgttacagttttaggaatat

SEQ ID NO: 122152 - DNA, 24 bp, Artificial sequence
  SiRNA target sequence
tgacgttacagttttaggaatatc

SEQ ID NO: 122153 - DNA, 24 bp, Artificial sequence
  SiRNA target sequence
gacgttacagttttaggaatatca

SEQ ID NO: 122154 - DNA, 24 bp, Artificial sequence
  SiRNA target sequence
acgttacagttttaggaatatcaa

SEQ ID NO: 122155 - DNA, 24 bp, Artificial sequence
  SiRNA target sequence
cgttacagttttaggaatatcaat

SEQ ID NO: 122156 - DNA, 24 bp, Artificial sequence
  SiRNA target sequence
gttacagttttaggaatatcaata

SEQ ID NO: 122157 - DNA, 24 bp, Artificial sequence
  SiRNA target sequence
ttacagttttaggaatatcaataa

SEQ ID NO: 122158 - DNA, 24 bp, Artificial sequence
  SiRNA target sequence
tacagttttaggaatatcaataag

SEQ ID NO: 122159 - DNA, 24 bp, Artificial sequence
  SiRNA target sequence
acagttttaggaatatcaataagt

SEQ ID NO: 122160 - DNA, 24 bp, Artificial sequence
  SiRNA target sequence
cagttttaggaatatcaataagtc

SEQ ID NO: 122161 - DNA, 24 bp, Artificial sequence
  SiRNA target sequence
agttttaggaatatcaataagtct

SEQ ID NO: 122162 - DNA, 24 bp, Artificial sequence
  SiRNA target sequence
gttttaggaatatcaataagtctt

SEQ ID NO: 122163 - DNA, 24 bp, Artificial sequence
  SiRNA target sequence
ttttaggaatatcaataagtctta

SEQ ID NO: 122164 - DNA, 24 bp, Artificial sequence
  SiRNA target sequence
tttaggaatatcaataagtcttaa

SEQ ID NO: 122165 - DNA, 24 bp, Artificial sequence
  SiRNA target sequence
ttaggaatatcaataagtcttaaa

SEQ ID NO: 122166 - DNA, 24 bp, Artificial sequence
  SiRNA target sequence
taggaatatcaataagtcttaaag

SEQ ID NO: 122167 - DNA, 24 bp, Artificial sequence
  SiRNA target sequence
aggaatatcaataagtcttaaaga

SEQ ID NO: 122168 - DNA, 24 bp, Artificial sequence
  SiRNA target sequence
ggaatatcaataagtcttaaagaa

SEQ ID NO: 122169 - DNA, 24 bp, Artificial sequence
  SiRNA target sequence
gaatatcaataagtcttaaagaaa

SEQ ID NO: 122170 - DNA, 24 bp, Artificial sequence
  SiRNA target sequence
aatatcaataagtcttaaagaaat

SEQ ID NO: 122171 - DNA, 24 bp, Artificial sequence
  SiRNA target sequence
atatcaataagtcttaaagaaatt

SEQ ID NO: 122172 - DNA, 24 bp, Artificial sequence
  SiRNA target sequence
tatcaataagtcttaaagaaattt

SEQ ID NO: 122173 - DNA, 24 bp, Artificial sequence
  SiRNA target sequence
atcaataagtcttaaagaaatttt

SEQ ID NO: 122174 - DNA, 24 bp, Artificial sequence
  SiRNA target sequence
tcaataagtcttaaagaaattttt

SEQ ID NO: 122175 - DNA, 24 bp, Artificial sequence
  SiRNA target sequence
caataagtcttaaagaaattttta

SEQ ID NO: 122176 - DNA, 24 bp, Artificial sequence
  SiRNA target sequence
aataagtcttaaagaaatttttaa

SEQ ID NO: 122177 - DNA, 24 bp, Artificial sequence
  SiRNA target sequence
ataagtcttaaagaaatttttaaa

SEQ ID NO: 122178 - DNA, 24 bp, Artificial sequence
  SiRNA target sequence
taagtcttaaagaaatttttaaag

SEQ ID NO: 122179 - DNA, 24 bp, Artificial sequence
  SiRNA target sequence
aagtcttaaagaaatttttaaagc

SEQ ID NO: 122180 - DNA, 24 bp, Artificial sequence
  SiRNA target sequence
agtcttaaagaaatttttaaagca

SEQ ID NO: 122181 - DNA, 24 bp, Artificial sequence
  SiRNA target sequence
gtcttaaagaaatttttaaagcag

SEQ ID NO: 122182 - DNA, 24 bp, Artificial sequence
  SiRNA target sequence
tcttaaagaaatttttaaagcaga

SEQ ID NO: 122183 - DNA, 24 bp, Artificial sequence
  SiRNA target sequence
cttaaagaaatttttaaagcagac

SEQ ID NO: 122184 - DNA, 24 bp, Artificial sequence
  SiRNA target sequence
ttaaagaaatttttaaagcagaca

SEQ ID NO: 122185 - DNA, 24 bp, Artificial sequence
  SiRNA target sequence
taaagaaatttttaaagcagacag

SEQ ID NO: 122186 - DNA, 24 bp, Artificial sequence
  SiRNA target sequence
aaagaaatttttaaagcagacagt

SEQ ID NO: 122187 - DNA, 24 bp, Artificial sequence
  SiRNA target sequence
aagaaatttttaaagcagacagtt

SEQ ID NO: 122188 - DNA, 24 bp, Artificial sequence
  SiRNA target sequence
agaaatttttaaagcagacagttt

SEQ ID NO: 122189 - DNA, 24 bp, Artificial sequence
  SiRNA target sequence
gaaatttttaaagcagacagtttg

SEQ ID NO: 122190 - DNA, 24 bp, Artificial sequence
  SiRNA target sequence
aaatttttaaagcagacagtttgt

SEQ ID NO: 122191 - DNA, 24 bp, Artificial sequence
  SiRNA target sequence
aatttttaaagcagacagtttgtt

SEQ ID NO: 122192 - DNA, 24 bp, Artificial sequence
  SiRNA target sequence
atttttaaagcagacagtttgtta

SEQ ID NO: 122193 - DNA, 24 bp, Artificial sequence
  SiRNA target sequence
tttttaaagcagacagtttgttag

SEQ ID NO: 122194 - DNA, 24 bp, Artificial sequence
  SiRNA target sequence
ttttaaagcagacagtttgttaga

SEQ ID NO: 122195 - DNA, 24 bp, Artificial sequence
  SiRNA target sequence
tttaaagcagacagtttgttagag

SEQ ID NO: 122196 - DNA, 24 bp, Artificial sequence
  SiRNA target sequence
ttaaagcagacagtttgttagaga

SEQ ID NO: 122197 - DNA, 24 bp, Artificial sequence
  SiRNA target sequence
taaagcagacagtttgttagagaa

SEQ ID NO: 122198 - DNA, 24 bp, Artificial sequence
  SiRNA target sequence
aaagcagacagtttgttagagaaa

SEQ ID NO: 122199 - DNA, 24 bp, Artificial sequence
  SiRNA target sequence
aagcagacagtttgttagagaaaa

SEQ ID NO: 122200 - DNA, 24 bp, Artificial sequence
  SiRNA target sequence
agcagacagtttgttagagaaaaa

SEQ ID NO: 122201 - DNA, 24 bp, Artificial sequence
  SiRNA target sequence
gcagacagtttgttagagaaaaaa

SEQ ID NO: 122202 - DNA, 24 bp, Artificial sequence
  SiRNA target sequence
cagacagtttgttagagaaaaaaa

SEQ ID NO: 122203 - DNA, 24 bp, Artificial sequence
  SiRNA target sequence
agacagtttgttagagaaaaaaaa

SEQ ID NO: 122204 - DNA, 24 bp, Artificial sequence
  SiRNA target sequence
gacagtttgttagagaaaaaaaat

SEQ ID NO: 122205 - DNA, 24 bp, Artificial sequence
  SiRNA target sequence
acagtttgttagagaaaaaaaata

SEQ ID NO: 122206 - DNA, 24 bp, Artificial sequence
  SiRNA target sequence
cagtttgttagagaaaaaaaatat

SEQ ID NO: 122207 - DNA, 24 bp, Artificial sequence
  SiRNA target sequence
agtttgttagagaaaaaaaatatc

SEQ ID NO: 122208 - DNA, 24 bp, Artificial sequence
  SiRNA target sequence
gtttgttagagaaaaaaaatatcg

SEQ ID NO: 122209 - DNA, 24 bp, Artificial sequence
  SiRNA target sequence
tttgttagagaaaaaaaatatcga

SEQ ID NO: 122210 - DNA, 24 bp, Artificial sequence
  SiRNA target sequence
ttgttagagaaaaaaaatatcgac

SEQ ID NO: 122211 - DNA, 24 bp, Artificial sequence
  SiRNA target sequence
tgttagagaaaaaaaatatcgaca

SEQ ID NO: 122212 - DNA, 24 bp, Artificial sequence
  SiRNA target sequence
gttagagaaaaaaaatatcgacat

SEQ ID NO: 122213 - DNA, 24 bp, Artificial sequence
  SiRNA target sequence
ttagagaaaaaaaatatcgacatt

SEQ ID NO: 122214 - DNA, 24 bp, Artificial sequence
  SiRNA target sequence
tagagaaaaaaaatatcgacattg

SEQ ID NO: 122215 - DNA, 24 bp, Artificial sequence
  SiRNA target sequence
agagaaaaaaaatatcgacattga

SEQ ID NO: 122216 - DNA, 24 bp, Artificial sequence
  SiRNA target sequence
gagaaaaaaaatatcgacattgag

SEQ ID NO: 122217 - DNA, 24 bp, Artificial sequence
  SiRNA target sequence
agaaaaaaaatatcgacattgaga

SEQ ID NO: 122218 - DNA, 24 bp, Artificial sequence
  SiRNA target sequence
gaaaaaaaatatcgacattgagat

SEQ ID NO: 122219 - DNA, 24 bp, Artificial sequence
  SiRNA target sequence
aaaaaaaatatcgacattgagata

SEQ ID NO: 122220 - DNA, 24 bp, Artificial sequence
  SiRNA target sequence
aaaaaaatatcgacattgagataa

SEQ ID NO: 122221 - DNA, 24 bp, Artificial sequence
  SiRNA target sequence
aaaaaatatcgacattgagataat

SEQ ID NO: 122222 - DNA, 24 bp, Artificial sequence
  SiRNA target sequence
aaaaatatcgacattgagataatt

SEQ ID NO: 122223 - DNA, 24 bp, Artificial sequence
  SiRNA target sequence
aaaatatcgacattgagataatta

SEQ ID NO: 122224 - DNA, 24 bp, Artificial sequence
  SiRNA target sequence
aaatatcgacattgagataattaa

SEQ ID NO: 122225 - DNA, 24 bp, Artificial sequence
  SiRNA target sequence
aatatcgacattgagataattaat

SEQ ID NO: 122226 - DNA, 24 bp, Artificial sequence
  SiRNA target sequence
atatcgacattgagataattaatc

SEQ ID NO: 122227 - DNA, 24 bp, Artificial sequence
  SiRNA target sequence
tatcgacattgagataattaatct

SEQ ID NO: 122228 - DNA, 24 bp, Artificial sequence
  SiRNA target sequence
atcgacattgagataattaatctt

SEQ ID NO: 122229 - DNA, 24 bp, Artificial sequence
  SiRNA target sequence
tcgacattgagataattaatcttg

SEQ ID NO: 122230 - DNA, 24 bp, Artificial sequence
  SiRNA target sequence
cgacattgagataattaatcttgt

SEQ ID NO: 122231 - DNA, 24 bp, Artificial sequence
  SiRNA target sequence
gacattgagataattaatcttgtg

SEQ ID NO: 122232 - DNA, 24 bp, Artificial sequence
  SiRNA target sequence
acattgagataattaatcttgtgt

SEQ ID NO: 122233 - DNA, 24 bp, Artificial sequence
  SiRNA target sequence
cattgagataattaatcttgtgtc

SEQ ID NO: 122234 - DNA, 24 bp, Artificial sequence
  SiRNA target sequence
attgagataattaatcttgtgtca

SEQ ID NO: 122235 - DNA, 24 bp, Artificial sequence
  SiRNA target sequence
ttgagataattaatcttgtgtcaa

SEQ ID NO: 122236 - DNA, 24 bp, Artificial sequence
  SiRNA target sequence
tgagataattaatcttgtgtcaat

SEQ ID NO: 122237 - DNA, 24 bp, Artificial sequence
  SiRNA target sequence
gagataattaatcttgtgtcaata

SEQ ID NO: 122238 - DNA, 24 bp, Artificial sequence
  SiRNA target sequence
agataattaatcttgtgtcaataa

SEQ ID NO: 122239 - DNA, 24 bp, Artificial sequence
  SiRNA target sequence
gataattaatcttgtgtcaataaa

SEQ ID NO: 122240 - DNA, 24 bp, Artificial sequence
  SiRNA target sequence
ataattaatcttgtgtcaataaaa

SEQ ID NO: 122241 - DNA, 24 bp, Artificial sequence
  SiRNA target sequence
taattaatcttgtgtcaataaaac

SEQ ID NO: 122242 - DNA, 24 bp, Artificial sequence
  SiRNA target sequence
aattaatcttgtgtcaataaaacc

SEQ ID NO: 122243 - DNA, 24 bp, Artificial sequence
  SiRNA target sequence
attaatcttgtgtcaataaaacca

SEQ ID NO: 122244 - DNA, 24 bp, Artificial sequence
  SiRNA target sequence
ttaatcttgtgtcaataaaaccaa

SEQ ID NO: 122245 - DNA, 24 bp, Artificial sequence
  SiRNA target sequence
taatcttgtgtcaataaaaccaat

SEQ ID NO: 122246 - DNA, 24 bp, Artificial sequence
  SiRNA target sequence
aatcttgtgtcaataaaaccaatt

SEQ ID NO: 122247 - DNA, 24 bp, Artificial sequence
  SiRNA target sequence
atcttgtgtcaataaaaccaattg

SEQ ID NO: 122248 - DNA, 24 bp, Artificial sequence
  SiRNA target sequence
tcttgtgtcaataaaaccaattga

SEQ ID NO: 122249 - DNA, 24 bp, Artificial sequence
  SiRNA target sequence
cttgtgtcaataaaaccaattgat

SEQ ID NO: 122250 - DNA, 24 bp, Artificial sequence
  SiRNA target sequence
ttgtgtcaataaaaccaattgatt

SEQ ID NO: 122251 - DNA, 24 bp, Artificial sequence
  SiRNA target sequence
tgtgtcaataaaaccaattgatta

SEQ ID NO: 122252 - DNA, 24 bp, Artificial sequence
  SiRNA target sequence
gtgtcaataaaaccaattgattat

SEQ ID NO: 122253 - DNA, 24 bp, Artificial sequence
  SiRNA target sequence
tgtcaataaaaccaattgattatg

SEQ ID NO: 122254 - DNA, 24 bp, Artificial sequence
  SiRNA target sequence
gtcaataaaaccaattgattatgt

SEQ ID NO: 122255 - DNA, 24 bp, Artificial sequence
  SiRNA target sequence
tcaataaaaccaattgattatgtt

SEQ ID NO: 122256 - DNA, 24 bp, Artificial sequence
  SiRNA target sequence
caataaaaccaattgattatgtta

SEQ ID NO: 122257 - DNA, 24 bp, Artificial sequence
  SiRNA target sequence
aataaaaccaattgattatgttac

SEQ ID NO: 122258 - DNA, 24 bp, Artificial sequence
  SiRNA target sequence
ataaaaccaattgattatgttact

SEQ ID NO: 122259 - DNA, 24 bp, Artificial sequence
  SiRNA target sequence
taaaaccaattgattatgttacta

SEQ ID NO: 122260 - DNA, 24 bp, Artificial sequence
  SiRNA target sequence
aaaaccaattgattatgttactat

SEQ ID NO: 122261 - DNA, 24 bp, Artificial sequence
  SiRNA target sequence
aaaccaattgattatgttactatt

SEQ ID NO: 122262 - DNA, 24 bp, Artificial sequence
  SiRNA target sequence
aaccaattgattatgttactattg

SEQ ID NO: 122263 - DNA, 24 bp, Artificial sequence
  SiRNA target sequence
accaattgattatgttactattga

SEQ ID NO: 122264 - DNA, 24 bp, Artificial sequence
  SiRNA target sequence
ccaattgattatgttactattgaa

SEQ ID NO: 122265 - DNA, 24 bp, Artificial sequence
  SiRNA target sequence
caattgattatgttactattgaaa

SEQ ID NO: 122266 - DNA, 24 bp, Artificial sequence
  SiRNA target sequence
aattgattatgttactattgaaat

SEQ ID NO: 122267 - DNA, 24 bp, Artificial sequence
  SiRNA target sequence
attgattatgttactattgaaata

SEQ ID NO: 122268 - DNA, 24 bp, Artificial sequence
  SiRNA target sequence
ttgattatgttactattgaaatat

SEQ ID NO: 122269 - DNA, 24 bp, Artificial sequence
  SiRNA target sequence
tgattatgttactattgaaatatc

SEQ ID NO: 122270 - DNA, 24 bp, Artificial sequence
  SiRNA target sequence
gattatgttactattgaaatatca

SEQ ID NO: 122271 - DNA, 24 bp, Artificial sequence
  SiRNA target sequence
attatgttactattgaaatatcag

SEQ ID NO: 122272 - DNA, 24 bp, Artificial sequence
  SiRNA target sequence
ttatgttactattgaaatatcagt

SEQ ID NO: 122273 - DNA, 24 bp, Artificial sequence
  SiRNA target sequence
tatgttactattgaaatatcagtc

SEQ ID NO: 122274 - DNA, 24 bp, Artificial sequence
  SiRNA target sequence
atgttactattgaaatatcagtca

SEQ ID NO: 122275 - DNA, 24 bp, Artificial sequence
  SiRNA target sequence
tgttactattgaaatatcagtcaa

SEQ ID NO: 122276 - DNA, 24 bp, Artificial sequence
  SiRNA target sequence
gttactattgaaatatcagtcaaa

SEQ ID NO: 122277 - DNA, 24 bp, Artificial sequence
  SiRNA target sequence
ttactattgaaatatcagtcaaaa

SEQ ID NO: 122278 - DNA, 24 bp, Artificial sequence
  SiRNA target sequence
tactattgaaatatcagtcaaaaa

SEQ ID NO: 122279 - DNA, 24 bp, Artificial sequence
  SiRNA target sequence
actattgaaatatcagtcaaaaaa

SEQ ID NO: 122280 - DNA, 24 bp, Artificial sequence
  SiRNA target sequence
ctattgaaatatcagtcaaaaaaa

SEQ ID NO: 122281 - DNA, 24 bp, Artificial sequence
  SiRNA target sequence
tattgaaatatcagtcaaaaaaac

SEQ ID NO: 122282 - DNA, 24 bp, Artificial sequence
  SiRNA target sequence
attgaaatatcagtcaaaaaaaca

SEQ ID NO: 122283 - DNA, 24 bp, Artificial sequence
  SiRNA target sequence
ttgaaatatcagtcaaaaaaacac

SEQ ID NO: 122284 - DNA, 24 bp, Artificial sequence
  SiRNA target sequence
tgaaatatcagtcaaaaaaacaca

SEQ ID NO: 122285 - DNA, 24 bp, Artificial sequence
  SiRNA target sequence
gaaatatcagtcaaaaaaacacaa

SEQ ID NO: 122286 - DNA, 24 bp, Artificial sequence
  SiRNA target sequence
aaatatcagtcaaaaaaacacaaa

SEQ ID NO: 122287 - DNA, 24 bp, Artificial sequence
  SiRNA target sequence
aatatcagtcaaaaaaacacaaaa

SEQ ID NO: 122288 - DNA, 24 bp, Artificial sequence
  SiRNA target sequence
atatcagtcaaaaaaacacaaaag

SEQ ID NO: 122289 - DNA, 24 bp, Artificial sequence
  SiRNA target sequence
tatcagtcaaaaaaacacaaaagt

SEQ ID NO: 122290 - DNA, 24 bp, Artificial sequence
  SiRNA target sequence
atcagtcaaaaaaacacaaaagtt

SEQ ID NO: 122291 - DNA, 24 bp, Artificial sequence
  SiRNA target sequence
tcagtcaaaaaaacacaaaagtta

SEQ ID NO: 122292 - DNA, 24 bp, Artificial sequence
  SiRNA target sequence
cagtcaaaaaaacacaaaagttag

SEQ ID NO: 122293 - DNA, 24 bp, Artificial sequence
  SiRNA target sequence
agtcaaaaaaacacaaaagttagt

SEQ ID NO: 122294 - DNA, 24 bp, Artificial sequence
  SiRNA target sequence
gtcaaaaaaacacaaaagttagtg

SEQ ID NO: 122295 - DNA, 24 bp, Artificial sequence
  SiRNA target sequence
tcaaaaaaacacaaaagttagtga

SEQ ID NO: 122296 - DNA, 24 bp, Artificial sequence
  SiRNA target sequence
caaaaaaacacaaaagttagtgat

SEQ ID NO: 122297 - DNA, 24 bp, Artificial sequence
  SiRNA target sequence
aaaaaaacacaaaagttagtgata

SEQ ID NO: 122298 - DNA, 24 bp, Artificial sequence
  SiRNA target sequence
aaaaaacacaaaagttagtgatag

SEQ ID NO: 122299 - DNA, 24 bp, Artificial sequence
  SiRNA target sequence
aaaaacacaaaagttagtgatagt

SEQ ID NO: 122300 - DNA, 24 bp, Artificial sequence
  SiRNA target sequence
aaaacacaaaagttagtgatagtt

SEQ ID NO: 122301 - DNA, 24 bp, Artificial sequence
  SiRNA target sequence
aaacacaaaagttagtgatagttg

SEQ ID NO: 122302 - DNA, 24 bp, Artificial sequence
  SiRNA target sequence
aacacaaaagttagtgatagttga

SEQ ID NO: 122303 - DNA, 24 bp, Artificial sequence
  SiRNA target sequence
acacaaaagttagtgatagttgat

SEQ ID NO: 122304 - DNA, 24 bp, Artificial sequence
  SiRNA target sequence
cacaaaagttagtgatagttgatt

SEQ ID NO: 122305 - DNA, 24 bp, Artificial sequence
  SiRNA target sequence
acaaaagttagtgatagttgattt

SEQ ID NO: 122306 - DNA, 24 bp, Artificial sequence
  SiRNA target sequence
caaaagttagtgatagttgatttt

SEQ ID NO: 122307 - DNA, 24 bp, Artificial sequence
  SiRNA target sequence
aaaagttagtgatagttgattttg

SEQ ID NO: 122308 - DNA, 24 bp, Artificial sequence
  SiRNA target sequence
aaagttagtgatagttgattttgc

SEQ ID NO: 122309 - DNA, 24 bp, Artificial sequence
  SiRNA target sequence
aagttagtgatagttgattttgca

SEQ ID NO: 122310 - DNA, 24 bp, Artificial sequence
  SiRNA target sequence
agttagtgatagttgattttgcat

SEQ ID NO: 122311 - DNA, 24 bp, Artificial sequence
  SiRNA target sequence
gttagtgatagttgattttgcata

SEQ ID NO: 122312 - DNA, 24 bp, Artificial sequence
  SiRNA target sequence
ttagtgatagttgattttgcatat

SEQ ID NO: 122313 - DNA, 24 bp, Artificial sequence
  SiRNA target sequence
tagtgatagttgattttgcatatc

SEQ ID NO: 122314 - DNA, 24 bp, Artificial sequence
  SiRNA target sequence
agtgatagttgattttgcatatcc

SEQ ID NO: 122315 - DNA, 24 bp, Artificial sequence
  SiRNA target sequence
gtgatagttgattttgcatatcct

SEQ ID NO: 122316 - DNA, 24 bp, Artificial sequence
  SiRNA target sequence
tgatagttgattttgcatatccta

SEQ ID NO: 122317 - DNA, 24 bp, Artificial sequence
  SiRNA target sequence
gatagttgattttgcatatcctac

SEQ ID NO: 122318 - DNA, 24 bp, Artificial sequence
  SiRNA target sequence
atagttgattttgcatatcctact

SEQ ID NO: 122319 - DNA, 24 bp, Artificial sequence
  SiRNA target sequence
tagttgattttgcatatcctactt

SEQ ID NO: 122320 - DNA, 24 bp, Artificial sequence
  SiRNA target sequence
agttgattttgcatatcctacttt

SEQ ID NO: 122321 - DNA, 24 bp, Artificial sequence
  SiRNA target sequence
gttgattttgcatatcctactttc

SEQ ID NO: 122322 - DNA, 24 bp, Artificial sequence
  SiRNA target sequence
ttgattttgcatatcctactttca

SEQ ID NO: 122323 - DNA, 24 bp, Artificial sequence
  SiRNA target sequence
tgattttgcatatcctactttcaa

SEQ ID NO: 122324 - DNA, 24 bp, Artificial sequence
  SiRNA target sequence
gattttgcatatcctactttcaat

SEQ ID NO: 122325 - DNA, 24 bp, Artificial sequence
  SiRNA target sequence
attttgcatatcctactttcaata

SEQ ID NO: 122326 - DNA, 24 bp, Artificial sequence
  SiRNA target sequence
ttttgcatatcctactttcaatat

SEQ ID NO: 122327 - DNA, 24 bp, Artificial sequence
  SiRNA target sequence
tttgcatatcctactttcaatatt

SEQ ID NO: 122328 - DNA, 24 bp, Artificial sequence
  SiRNA target sequence
ttgcatatcctactttcaatattg

SEQ ID NO: 122329 - DNA, 24 bp, Artificial sequence
  SiRNA target sequence
tgcatatcctactttcaatattgc

SEQ ID NO: 122330 - DNA, 24 bp, Artificial sequence
  SiRNA target sequence
gcatatcctactttcaatattgcg

SEQ ID NO: 122331 - DNA, 24 bp, Artificial sequence
  SiRNA target sequence
catatcctactttcaatattgcga

SEQ ID NO: 122332 - DNA, 24 bp, Artificial sequence
  SiRNA target sequence
atatcctactttcaatattgcgag

SEQ ID NO: 122333 - DNA, 24 bp, Artificial sequence
  SiRNA target sequence
tatcctactttcaatattgcgagt

SEQ ID NO: 122334 - DNA, 24 bp, Artificial sequence
  SiRNA target sequence
atcctactttcaatattgcgagtg

SEQ ID NO: 122335 - DNA, 24 bp, Artificial sequence
  SiRNA target sequence
tcctactttcaatattgcgagtga

SEQ ID NO: 122336 - DNA, 24 bp, Artificial sequence
  SiRNA target sequence
cctactttcaatattgcgagtgaa

SEQ ID NO: 122337 - DNA, 24 bp, Artificial sequence
  SiRNA target sequence
ctactttcaatattgcgagtgaaa

SEQ ID NO: 122338 - DNA, 24 bp, Artificial sequence
  SiRNA target sequence
tactttcaatattgcgagtgaaat

SEQ ID NO: 122339 - DNA, 24 bp, Artificial sequence
  SiRNA target sequence
actttcaatattgcgagtgaaata

SEQ ID NO: 122340 - DNA, 24 bp, Artificial sequence
  SiRNA target sequence
ctttcaatattgcgagtgaaatag

SEQ ID NO: 122341 - DNA, 24 bp, Artificial sequence
  SiRNA target sequence
tttcaatattgcgagtgaaatagc

SEQ ID NO: 122342 - DNA, 24 bp, Artificial sequence
  SiRNA target sequence
ttcaatattgcgagtgaaatagct

SEQ ID NO: 122343 - DNA, 24 bp, Artificial sequence
  SiRNA target sequence
tcaatattgcgagtgaaatagctg

SEQ ID NO: 122344 - DNA, 24 bp, Artificial sequence
  SiRNA target sequence
caatattgcgagtgaaatagctgc

SEQ ID NO: 122345 - DNA, 24 bp, Artificial sequence
  SiRNA target sequence
aatattgcgagtgaaatagctgcg

SEQ ID NO: 122346 - DNA, 24 bp, Artificial sequence
  SiRNA target sequence
atattgcgagtgaaatagctgcgc

SEQ ID NO: 122347 - DNA, 24 bp, Artificial sequence
  SiRNA target sequence
tattgcgagtgaaatagctgcgca

SEQ ID NO: 122348 - DNA, 24 bp, Artificial sequence
  SiRNA target sequence
attgcgagtgaaatagctgcgcac

SEQ ID NO: 122349 - DNA, 24 bp, Artificial sequence
  SiRNA target sequence
ttgcgagtgaaatagctgcgcact

SEQ ID NO: 122350 - DNA, 24 bp, Artificial sequence
  SiRNA target sequence
tgcgagtgaaatagctgcgcactt

SEQ ID NO: 122351 - DNA, 24 bp, Artificial sequence
  SiRNA target sequence
gcgagtgaaatagctgcgcacttt

SEQ ID NO: 122352 - DNA, 24 bp, Artificial sequence
  SiRNA target sequence
cgagtgaaatagctgcgcactttt

SEQ ID NO: 122353 - DNA, 24 bp, Artificial sequence
  SiRNA target sequence
gagtgaaatagctgcgcactttta

SEQ ID NO: 122354 - DNA, 24 bp, Artificial sequence
  SiRNA target sequence
agtgaaatagctgcgcacttttac

SEQ ID NO: 122355 - DNA, 24 bp, Artificial sequence
  SiRNA target sequence
gtgaaatagctgcgcacttttacg

SEQ ID NO: 122356 - DNA, 24 bp, Artificial sequence
  SiRNA target sequence
tgaaatagctgcgcacttttacga

SEQ ID NO: 122357 - DNA, 24 bp, Artificial sequence
  SiRNA target sequence
gaaatagctgcgcacttttacgaa

SEQ ID NO: 122358 - DNA, 24 bp, Artificial sequence
  SiRNA target sequence
aaatagctgcgcacttttacgaaa

SEQ ID NO: 122359 - DNA, 24 bp, Artificial sequence
  SiRNA target sequence
aatagctgcgcacttttacgaaaa

SEQ ID NO: 122360 - DNA, 24 bp, Artificial sequence
  SiRNA target sequence
atagctgcgcacttttacgaaaaa

SEQ ID NO: 122361 - DNA, 24 bp, Artificial sequence
  SiRNA target sequence
tagctgcgcacttttacgaaaaat

SEQ ID NO: 122362 - DNA, 24 bp, Artificial sequence
  SiRNA target sequence
agctgcgcacttttacgaaaaatt

SEQ ID NO: 122363 - DNA, 24 bp, Artificial sequence
  SiRNA target sequence
gctgcgcacttttacgaaaaattt

SEQ ID NO: 122364 - DNA, 24 bp, Artificial sequence
  SiRNA target sequence
ctgcgcacttttacgaaaaattta

SEQ ID NO: 122365 - DNA, 24 bp, Artificial sequence
  SiRNA target sequence
tgcgcacttttacgaaaaatttaa

SEQ ID NO: 122366 - DNA, 24 bp, Artificial sequence
  SiRNA target sequence
gcgcacttttacgaaaaatttaaa

SEQ ID NO: 122367 - DNA, 24 bp, Artificial sequence
  SiRNA target sequence
cgcacttttacgaaaaatttaaag

SEQ ID NO: 122368 - DNA, 24 bp, Artificial sequence
  SiRNA target sequence
gcacttttacgaaaaatttaaaga

SEQ ID NO: 122369 - DNA, 24 bp, Artificial sequence
  SiRNA target sequence
cacttttacgaaaaatttaaagat

SEQ ID NO: 122370 - DNA, 24 bp, Artificial sequence
  SiRNA target sequence
acttttacgaaaaatttaaagata

SEQ ID NO: 122371 - DNA, 24 bp, Artificial sequence
  SiRNA target sequence
cttttacgaaaaatttaaagatat

SEQ ID NO: 122372 - DNA, 24 bp, Artificial sequence
  SiRNA target sequence
ttttacgaaaaatttaaagatata

SEQ ID NO: 122373 - DNA, 24 bp, Artificial sequence
  SiRNA target sequence
tttacgaaaaatttaaagatataa

SEQ ID NO: 122374 - DNA, 24 bp, Artificial sequence
  SiRNA target sequence
ttacgaaaaatttaaagatataaa

SEQ ID NO: 122375 - DNA, 24 bp, Artificial sequence
  SiRNA target sequence
tacgaaaaatttaaagatataaaa

SEQ ID NO: 122376 - DNA, 24 bp, Artificial sequence
  SiRNA target sequence
acgaaaaatttaaagatataaaaa

SEQ ID NO: 122377 - DNA, 24 bp, Artificial sequence
  SiRNA target sequence
cgaaaaatttaaagatataaaaat

SEQ ID NO: 122378 - DNA, 24 bp, Artificial sequence
  SiRNA target sequence
gaaaaatttaaagatataaaaatt

SEQ ID NO: 122379 - DNA, 24 bp, Artificial sequence
  SiRNA target sequence
aaaaatttaaagatataaaaatta

SEQ ID NO: 122380 - DNA, 24 bp, Artificial sequence
  SiRNA target sequence
aaaatttaaagatataaaaattat

SEQ ID NO: 122381 - DNA, 24 bp, Artificial sequence
  SiRNA target sequence
aaatttaaagatataaaaattatg

SEQ ID NO: 122382 - DNA, 24 bp, Artificial sequence
  SiRNA target sequence
aatttaaagatataaaaattatgc

SEQ ID NO: 122383 - DNA, 24 bp, Artificial sequence
  SiRNA target sequence
atttaaagatataaaaattatgcg

SEQ ID NO: 122384 - DNA, 24 bp, Artificial sequence
  SiRNA target sequence
tttaaagatataaaaattatgcgt

SEQ ID NO: 122385 - DNA, 24 bp, Artificial sequence
  SiRNA target sequence
ttaaagatataaaaattatgcgtg

SEQ ID NO: 122386 - DNA, 24 bp, Artificial sequence
  SiRNA target sequence
taaagatataaaaattatgcgtgt

SEQ ID NO: 122387 - DNA, 24 bp, Artificial sequence
  SiRNA target sequence
aaagatataaaaattatgcgtgtt

SEQ ID NO: 122388 - DNA, 24 bp, Artificial sequence
  SiRNA target sequence
aagatataaaaattatgcgtgttc

SEQ ID NO: 122389 - DNA, 24 bp, Artificial sequence
  SiRNA target sequence
agatataaaaattatgcgtgttct

SEQ ID NO: 122390 - DNA, 24 bp, Artificial sequence
  SiRNA target sequence
gatataaaaattatgcgtgttctt

SEQ ID NO: 122391 - DNA, 24 bp, Artificial sequence
  SiRNA target sequence
atataaaaattatgcgtgttcttg

SEQ ID NO: 122392 - DNA, 24 bp, Artificial sequence
  SiRNA target sequence
tataaaaattatgcgtgttcttgc

SEQ ID NO: 122393 - DNA, 24 bp, Artificial sequence
  SiRNA target sequence
ataaaaattatgcgtgttcttgcg

SEQ ID NO: 122394 - DNA, 24 bp, Artificial sequence
  SiRNA target sequence
taaaaattatgcgtgttcttgcgc

SEQ ID NO: 122395 - DNA, 24 bp, Artificial sequence
  SiRNA target sequence
aaaaattatgcgtgttcttgcgca

SEQ ID NO: 122396 - DNA, 24 bp, Artificial sequence
  SiRNA target sequence
aaaattatgcgtgttcttgcgcaa

SEQ ID NO: 122397 - DNA, 24 bp, Artificial sequence
  SiRNA target sequence
aaattatgcgtgttcttgcgcaag

SEQ ID NO: 122398 - DNA, 24 bp, Artificial sequence
  SiRNA target sequence
aattatgcgtgttcttgcgcaaga

SEQ ID NO: 122399 - DNA, 24 bp, Artificial sequence
  SiRNA target sequence
attatgcgtgttcttgcgcaagat

SEQ ID NO: 122400 - DNA, 24 bp, Artificial sequence
  SiRNA target sequence
ttatgcgtgttcttgcgcaagata

SEQ ID NO: 122401 - DNA, 24 bp, Artificial sequence
  SiRNA target sequence
tatgcgtgttcttgcgcaagatat

SEQ ID NO: 122402 - DNA, 24 bp, Artificial sequence
  SiRNA target sequence
atgcgtgttcttgcgcaagatatt

SEQ ID NO: 122403 - DNA, 24 bp, Artificial sequence
  SiRNA target sequence
tgcgtgttcttgcgcaagatattc

SEQ ID NO: 122404 - DNA, 24 bp, Artificial sequence
  SiRNA target sequence
gcgtgttcttgcgcaagatattcc

SEQ ID NO: 122405 - DNA, 24 bp, Artificial sequence
  SiRNA target sequence
cgtgttcttgcgcaagatattcct

SEQ ID NO: 122406 - DNA, 24 bp, Artificial sequence
  SiRNA target sequence
gtgttcttgcgcaagatattccta

SEQ ID NO: 122407 - DNA, 24 bp, Artificial sequence
  SiRNA target sequence
tgttcttgcgcaagatattcctac

SEQ ID NO: 122408 - DNA, 24 bp, Artificial sequence
  SiRNA target sequence
gttcttgcgcaagatattcctaca

SEQ ID NO: 122409 - DNA, 24 bp, Artificial sequence
  SiRNA target sequence
ttcttgcgcaagatattcctacac

SEQ ID NO: 122410 - DNA, 24 bp, Artificial sequence
  SiRNA target sequence
tcttgcgcaagatattcctacacc

SEQ ID NO: 122411 - DNA, 24 bp, Artificial sequence
  SiRNA target sequence
cttgcgcaagatattcctacaccg

SEQ ID NO: 122412 - DNA, 24 bp, Artificial sequence
  SiRNA target sequence
ttgcgcaagatattcctacaccgt

SEQ ID NO: 122413 - DNA, 24 bp, Artificial sequence
  SiRNA target sequence
tgcgcaagatattcctacaccgta

SEQ ID NO: 122414 - DNA, 24 bp, Artificial sequence
  SiRNA target sequence
gcgcaagatattcctacaccgtat

SEQ ID NO: 122415 - DNA, 24 bp, Artificial sequence
  SiRNA target sequence
cgcaagatattcctacaccgtatg

SEQ ID NO: 122416 - DNA, 24 bp, Artificial sequence
  SiRNA target sequence
gcaagatattcctacaccgtatgc

SEQ ID NO: 122417 - DNA, 24 bp, Artificial sequence
  SiRNA target sequence
caagatattcctacaccgtatgca

SEQ ID NO: 122418 - DNA, 24 bp, Artificial sequence
  SiRNA target sequence
aagatattcctacaccgtatgcac

SEQ ID NO: 122419 - DNA, 24 bp, Artificial sequence
  SiRNA target sequence
agatattcctacaccgtatgcact

SEQ ID NO: 122420 - DNA, 24 bp, Artificial sequence
  SiRNA target sequence
gatattcctacaccgtatgcactt

SEQ ID NO: 122421 - DNA, 24 bp, Artificial sequence
  SiRNA target sequence
atattcctacaccgtatgcactta

SEQ ID NO: 122422 - DNA, 24 bp, Artificial sequence
  SiRNA target sequence
tattcctacaccgtatgcacttaa

SEQ ID NO: 122423 - DNA, 24 bp, Artificial sequence
  SiRNA target sequence
attcctacaccgtatgcacttaat

SEQ ID NO: 122424 - DNA, 24 bp, Artificial sequence
  SiRNA target sequence
ttcctacaccgtatgcacttaatc

SEQ ID NO: 122425 - DNA, 24 bp, Artificial sequence
  SiRNA target sequence
tcctacaccgtatgcacttaatct

SEQ ID NO: 122426 - DNA, 24 bp, Artificial sequence
  SiRNA target sequence
cctacaccgtatgcacttaatctt

SEQ ID NO: 122427 - DNA, 24 bp, Artificial sequence
  SiRNA target sequence
ctacaccgtatgcacttaatcttg

SEQ ID NO: 122428 - DNA, 24 bp, Artificial sequence
  SiRNA target sequence
tacaccgtatgcacttaatcttga

SEQ ID NO: 122429 - DNA, 24 bp, Artificial sequence
  SiRNA target sequence
acaccgtatgcacttaatcttgaa

SEQ ID NO: 122430 - DNA, 24 bp, Artificial sequence
  SiRNA target sequence
caccgtatgcacttaatcttgaaa

SEQ ID NO: 122431 - DNA, 24 bp, Artificial sequence
  SiRNA target sequence
accgtatgcacttaatcttgaaaa

SEQ ID NO: 122432 - DNA, 24 bp, Artificial sequence
  SiRNA target sequence
ccgtatgcacttaatcttgaaaaa

SEQ ID NO: 122433 - DNA, 24 bp, Artificial sequence
  SiRNA target sequence
cgtatgcacttaatcttgaaaaaa

SEQ ID NO: 122434 - DNA, 24 bp, Artificial sequence
  SiRNA target sequence
gtatgcacttaatcttgaaaaaat

SEQ ID NO: 122435 - DNA, 24 bp, Artificial sequence
  SiRNA target sequence
tatgcacttaatcttgaaaaaatg

SEQ ID NO: 122436 - DNA, 24 bp, Artificial sequence
  SiRNA target sequence
atgcacttaatcttgaaaaaatgt

SEQ ID NO: 122437 - DNA, 24 bp, Artificial sequence
  SiRNA target sequence
tgcacttaatcttgaaaaaatgtc

SEQ ID NO: 122438 - DNA, 24 bp, Artificial sequence
  SiRNA target sequence
gcacttaatcttgaaaaaatgtct

SEQ ID NO: 122439 - DNA, 24 bp, Artificial sequence
  SiRNA target sequence
cacttaatcttgaaaaaatgtctt

SEQ ID NO: 122440 - DNA, 24 bp, Artificial sequence
  SiRNA target sequence
acttaatcttgaaaaaatgtctta

SEQ ID NO: 122441 - DNA, 24 bp, Artificial sequence
  SiRNA target sequence
cttaatcttgaaaaaatgtcttat

SEQ ID NO: 122442 - DNA, 24 bp, Artificial sequence
  SiRNA target sequence
ttaatcttgaaaaaatgtcttatc

SEQ ID NO: 122443 - DNA, 24 bp, Artificial sequence
  SiRNA target sequence
taatcttgaaaaaatgtcttatcc

SEQ ID NO: 122444 - DNA, 24 bp, Artificial sequence
  SiRNA target sequence
aatcttgaaaaaatgtcttatccg

SEQ ID NO: 122445 - DNA, 24 bp, Artificial sequence
  SiRNA target sequence
atcttgaaaaaatgtcttatccga

SEQ ID NO: 122446 - DNA, 24 bp, Artificial sequence
  SiRNA target sequence
tcttgaaaaaatgtcttatccgac

SEQ ID NO: 122447 - DNA, 24 bp, Artificial sequence
  SiRNA target sequence
cttgaaaaaatgtcttatccgaca

SEQ ID NO: 122448 - DNA, 24 bp, Artificial sequence
  SiRNA target sequence
ttgaaaaaatgtcttatccgacat

SEQ ID NO: 122449 - DNA, 24 bp, Artificial sequence
  SiRNA target sequence
tgaaaaaatgtcttatccgacatg

SEQ ID NO: 122450 - DNA, 24 bp, Artificial sequence
  SiRNA target sequence
gaaaaaatgtcttatccgacatgc

SEQ ID NO: 122451 - DNA, 24 bp, Artificial sequence
  SiRNA target sequence
aaaaaatgtcttatccgacatgca

SEQ ID NO: 122452 - DNA, 24 bp, Artificial sequence
  SiRNA target sequence
aaaaatgtcttatccgacatgcaa

SEQ ID NO: 122453 - DNA, 24 bp, Artificial sequence
  SiRNA target sequence
aaaatgtcttatccgacatgcaat

SEQ ID NO: 122454 - DNA, 24 bp, Artificial sequence
  SiRNA target sequence
aaatgtcttatccgacatgcaatg

SEQ ID NO: 122455 - DNA, 24 bp, Artificial sequence
  SiRNA target sequence
aatgtcttatccgacatgcaatga

SEQ ID NO: 122456 - DNA, 24 bp, Artificial sequence
  SiRNA target sequence
atgtcttatccgacatgcaatgat

SEQ ID NO: 122457 - DNA, 24 bp, Artificial sequence
  SiRNA target sequence
tgtcttatccgacatgcaatgata

SEQ ID NO: 122458 - DNA, 24 bp, Artificial sequence
  SiRNA target sequence
gtcttatccgacatgcaatgatat

SEQ ID NO: 122459 - DNA, 24 bp, Artificial sequence
  SiRNA target sequence
tcttatccgacatgcaatgatatt

SEQ ID NO: 122460 - DNA, 24 bp, Artificial sequence
  SiRNA target sequence
cttatccgacatgcaatgatattg

SEQ ID NO: 122461 - DNA, 24 bp, Artificial sequence
  SiRNA target sequence
ttatccgacatgcaatgatattgt

SEQ ID NO: 122462 - DNA, 24 bp, Artificial sequence
  SiRNA target sequence
tatccgacatgcaatgatattgta

SEQ ID NO: 122463 - DNA, 24 bp, Artificial sequence
  SiRNA target sequence
atccgacatgcaatgatattgtaa

SEQ ID NO: 122464 - DNA, 24 bp, Artificial sequence
  SiRNA target sequence
tccgacatgcaatgatattgtaaa

SEQ ID NO: 122465 - DNA, 24 bp, Artificial sequence
  SiRNA target sequence
ccgacatgcaatgatattgtaaat

SEQ ID NO: 122466 - DNA, 24 bp, Artificial sequence
  SiRNA target sequence
cgacatgcaatgatattgtaaatg

SEQ ID NO: 122467 - DNA, 24 bp, Artificial sequence
  SiRNA target sequence
gacatgcaatgatattgtaaatgc

SEQ ID NO: 122468 - DNA, 24 bp, Artificial sequence
  SiRNA target sequence
acatgcaatgatattgtaaatgct

SEQ ID NO: 122469 - DNA, 24 bp, Artificial sequence
  SiRNA target sequence
catgcaatgatattgtaaatgctg

SEQ ID NO: 122470 - DNA, 24 bp, Artificial sequence
  SiRNA target sequence
atgcaatgatattgtaaatgctgt

SEQ ID NO: 122471 - DNA, 24 bp, Artificial sequence
  SiRNA target sequence
tgcaatgatattgtaaatgctgtt

SEQ ID NO: 122472 - DNA, 24 bp, Artificial sequence
  SiRNA target sequence
gcaatgatattgtaaatgctgtta

SEQ ID NO: 122473 - DNA, 24 bp, Artificial sequence
  SiRNA target sequence
caatgatattgtaaatgctgttac

SEQ ID NO: 122474 - DNA, 24 bp, Artificial sequence
  SiRNA target sequence
aatgatattgtaaatgctgttaca

SEQ ID NO: 122475 - DNA, 24 bp, Artificial sequence
  SiRNA target sequence
atgatattgtaaatgctgttacaa

SEQ ID NO: 122476 - DNA, 24 bp, Artificial sequence
  SiRNA target sequence
tgatattgtaaatgctgttacaaa

SEQ ID NO: 122477 - DNA, 24 bp, Artificial sequence
  SiRNA target sequence
gatattgtaaatgctgttacaaaa

SEQ ID NO: 122478 - DNA, 24 bp, Artificial sequence
  SiRNA target sequence
atattgtaaatgctgttacaaaaa

SEQ ID NO: 122479 - DNA, 24 bp, Artificial sequence
  SiRNA target sequence
tattgtaaatgctgttacaaaaat

SEQ ID NO: 122480 - DNA, 24 bp, Artificial sequence
  SiRNA target sequence
attgtaaatgctgttacaaaaata

SEQ ID NO: 122481 - DNA, 24 bp, Artificial sequence
  SiRNA target sequence
ttgtaaatgctgttacaaaaataa

SEQ ID NO: 122482 - DNA, 24 bp, Artificial sequence
  SiRNA target sequence
tgtaaatgctgttacaaaaataaa

SEQ ID NO: 122483 - DNA, 24 bp, Artificial sequence
  SiRNA target sequence
gtaaatgctgttacaaaaataaat

SEQ ID NO: 122484 - DNA, 24 bp, Artificial sequence
  SiRNA target sequence
taaatgctgttacaaaaataaatt

SEQ ID NO: 122485 - DNA, 24 bp, Artificial sequence
  SiRNA target sequence
aaatgctgttacaaaaataaattc

SEQ ID NO: 122486 - DNA, 24 bp, Artificial sequence
  SiRNA target sequence
aatgctgttacaaaaataaattca

SEQ ID NO: 122487 - DNA, 24 bp, Artificial sequence
  SiRNA target sequence
atgctgttacaaaaataaattcat

SEQ ID NO: 122488 - DNA, 24 bp, Artificial sequence
  SiRNA target sequence
tgctgttacaaaaataaattcata

SEQ ID NO: 122489 - DNA, 24 bp, Artificial sequence
  SiRNA target sequence
gctgttacaaaaataaattcatag

SEQ ID NO: 122490 - DNA, 25 bp, Artificial sequence
  SiRNA target sequence
atgatagaaattcgcgatcttataa

SEQ ID NO: 122491 - DNA, 25 bp, Artificial sequence
  SiRNA target sequence
tgatagaaattcgcgatcttataaa

SEQ ID NO: 122492 - DNA, 25 bp, Artificial sequence
  SiRNA target sequence
gatagaaattcgcgatcttataaat

SEQ ID NO: 122493 - DNA, 25 bp, Artificial sequence
  SiRNA target sequence
atagaaattcgcgatcttataaatc

SEQ ID NO: 122494 - DNA, 25 bp, Artificial sequence
  SiRNA target sequence
tagaaattcgcgatcttataaatca

SEQ ID NO: 122495 - DNA, 25 bp, Artificial sequence
  SiRNA target sequence
agaaattcgcgatcttataaatcaa

SEQ ID NO: 122496 - DNA, 25 bp, Artificial sequence
  SiRNA target sequence
gaaattcgcgatcttataaatcaag

SEQ ID NO: 122497 - DNA, 25 bp, Artificial sequence
  SiRNA target sequence
aaattcgcgatcttataaatcaagc

SEQ ID NO: 122498 - DNA, 25 bp, Artificial sequence
  SiRNA target sequence
aattcgcgatcttataaatcaagca

SEQ ID NO: 122499 - DNA, 25 bp, Artificial sequence
  SiRNA target sequence
attcgcgatcttataaatcaagcat

SEQ ID NO: 122500 - DNA, 25 bp, Artificial sequence
  SiRNA target sequence
ttcgcgatcttataaatcaagcatt

SEQ ID NO: 122501 - DNA, 25 bp, Artificial sequence
  SiRNA target sequence
tcgcgatcttataaatcaagcattg

SEQ ID NO: 122502 - DNA, 25 bp, Artificial sequence
  SiRNA target sequence
cgcgatcttataaatcaagcattgg

SEQ ID NO: 122503 - DNA, 25 bp, Artificial sequence
  SiRNA target sequence
gcgatcttataaatcaagcattgga

SEQ ID NO: 122504 - DNA, 25 bp, Artificial sequence
  SiRNA target sequence
cgatcttataaatcaagcattggat

SEQ ID NO: 122505 - DNA, 25 bp, Artificial sequence
  SiRNA target sequence
gatcttataaatcaagcattggatg

SEQ ID NO: 122506 - DNA, 25 bp, Artificial sequence
  SiRNA target sequence
atcttataaatcaagcattggatga

SEQ ID NO: 122507 - DNA, 25 bp, Artificial sequence
  SiRNA target sequence
tcttataaatcaagcattggatgag

SEQ ID NO: 122508 - DNA, 25 bp, Artificial sequence
  SiRNA target sequence
cttataaatcaagcattggatgagg

SEQ ID NO: 122509 - DNA, 25 bp, Artificial sequence
  SiRNA target sequence
ttataaatcaagcattggatgagga

SEQ ID NO: 122510 - DNA, 25 bp, Artificial sequence
  SiRNA target sequence
tataaatcaagcattggatgaggaa

SEQ ID NO: 122511 - DNA, 25 bp, Artificial sequence
  SiRNA target sequence
ataaatcaagcattggatgaggaaa

SEQ ID NO: 122512 - DNA, 25 bp, Artificial sequence
  SiRNA target sequence
taaatcaagcattggatgaggaaat

SEQ ID NO: 122513 - DNA, 25 bp, Artificial sequence
  SiRNA target sequence
aaatcaagcattggatgaggaaatg

SEQ ID NO: 122514 - DNA, 25 bp, Artificial sequence
  SiRNA target sequence
aatcaagcattggatgaggaaatgg

SEQ ID NO: 122515 - DNA, 25 bp, Artificial sequence
  SiRNA target sequence
atcaagcattggatgaggaaatggg

SEQ ID NO: 122516 - DNA, 25 bp, Artificial sequence
  SiRNA target sequence
tcaagcattggatgaggaaatggga

SEQ ID NO: 122517 - DNA, 25 bp, Artificial sequence
  SiRNA target sequence
caagcattggatgaggaaatgggaa

SEQ ID NO: 122518 - DNA, 25 bp, Artificial sequence
  SiRNA target sequence
aagcattggatgaggaaatgggaat

SEQ ID NO: 122519 - DNA, 25 bp, Artificial sequence
  SiRNA target sequence
agcattggatgaggaaatgggaatg

SEQ ID NO: 122520 - DNA, 25 bp, Artificial sequence
  SiRNA target sequence
gcattggatgaggaaatgggaatgg

SEQ ID NO: 122521 - DNA, 25 bp, Artificial sequence
  SiRNA target sequence
cattggatgaggaaatgggaatgga

SEQ ID NO: 122522 - DNA, 25 bp, Artificial sequence
  SiRNA target sequence
attggatgaggaaatgggaatggat

SEQ ID NO: 122523 - DNA, 25 bp, Artificial sequence
  SiRNA target sequence
ttggatgaggaaatgggaatggatc

SEQ ID NO: 122524 - DNA, 25 bp, Artificial sequence
  SiRNA target sequence
tggatgaggaaatgggaatggatca

SEQ ID NO: 122525 - DNA, 25 bp, Artificial sequence
  SiRNA target sequence
ggatgaggaaatgggaatggatcat

SEQ ID NO: 122526 - DNA, 25 bp, Artificial sequence
  SiRNA target sequence
gatgaggaaatgggaatggatcata

SEQ ID NO: 122527 - DNA, 25 bp, Artificial sequence
  SiRNA target sequence
atgaggaaatgggaatggatcataa

SEQ ID NO: 122528 - DNA, 25 bp, Artificial sequence
  SiRNA target sequence
tgaggaaatgggaatggatcataat

SEQ ID NO: 122529 - DNA, 25 bp, Artificial sequence
  SiRNA target sequence
gaggaaatgggaatggatcataatg

SEQ ID NO: 122530 - DNA, 25 bp, Artificial sequence
  SiRNA target sequence
aggaaatgggaatggatcataatgt

SEQ ID NO: 122531 - DNA, 25 bp, Artificial sequence
  SiRNA target sequence
ggaaatgggaatggatcataatgta

SEQ ID NO: 122532 - DNA, 25 bp, Artificial sequence
  SiRNA target sequence
gaaatgggaatggatcataatgtat

SEQ ID NO: 122533 - DNA, 25 bp, Artificial sequence
  SiRNA target sequence
aaatgggaatggatcataatgtata

SEQ ID NO: 122534 - DNA, 25 bp, Artificial sequence
  SiRNA target sequence
aatgggaatggatcataatgtatat

SEQ ID NO: 122535 - DNA, 25 bp, Artificial sequence
  SiRNA target sequence
atgggaatggatcataatgtatata

SEQ ID NO: 122536 - DNA, 25 bp, Artificial sequence
  SiRNA target sequence
tgggaatggatcataatgtatatat

SEQ ID NO: 122537 - DNA, 25 bp, Artificial sequence
  SiRNA target sequence
gggaatggatcataatgtatatata

SEQ ID NO: 122538 - DNA, 25 bp, Artificial sequence
  SiRNA target sequence
ggaatggatcataatgtatatataa

SEQ ID NO: 122539 - DNA, 25 bp, Artificial sequence
  SiRNA target sequence
gaatggatcataatgtatatataat

SEQ ID NO: 122540 - DNA, 25 bp, Artificial sequence
  SiRNA target sequence
aatggatcataatgtatatataata

SEQ ID NO: 122541 - DNA, 25 bp, Artificial sequence
  SiRNA target sequence
atggatcataatgtatatataatag

SEQ ID NO: 122542 - DNA, 25 bp, Artificial sequence
  SiRNA target sequence
tggatcataatgtatatataatagg

SEQ ID NO: 122543 - DNA, 25 bp, Artificial sequence
  SiRNA target sequence
ggatcataatgtatatataatagga

SEQ ID NO: 122544 - DNA, 25 bp, Artificial sequence
  SiRNA target sequence
gatcataatgtatatataataggag

SEQ ID NO: 122545 - DNA, 25 bp, Artificial sequence
  SiRNA target sequence
atcataatgtatatataataggaga

SEQ ID NO: 122546 - DNA, 25 bp, Artificial sequence
  SiRNA target sequence
tcataatgtatatataataggagaa

SEQ ID NO: 122547 - DNA, 25 bp, Artificial sequence
  SiRNA target sequence
cataatgtatatataataggagaag

SEQ ID NO: 122548 - DNA, 25 bp, Artificial sequence
  SiRNA target sequence
ataatgtatatataataggagaaga

SEQ ID NO: 122549 - DNA, 25 bp, Artificial sequence
  SiRNA target sequence
taatgtatatataataggagaagaa

SEQ ID NO: 122550 - DNA, 25 bp, Artificial sequence
  SiRNA target sequence
aatgtatatataataggagaagaag

SEQ ID NO: 122551 - DNA, 25 bp, Artificial sequence
  SiRNA target sequence
atgtatatataataggagaagaagt

SEQ ID NO: 122552 - DNA, 25 bp, Artificial sequence
  SiRNA target sequence
tgtatatataataggagaagaagta

SEQ ID NO: 122553 - DNA, 25 bp, Artificial sequence
  SiRNA target sequence
gtatatataataggagaagaagtag

SEQ ID NO: 122554 - DNA, 25 bp, Artificial sequence
  SiRNA target sequence
tatatataataggagaagaagtagg

SEQ ID NO: 122555 - DNA, 25 bp, Artificial sequence
  SiRNA target sequence
atatataataggagaagaagtaggc

SEQ ID NO: 122556 - DNA, 25 bp, Artificial sequence
  SiRNA target sequence
tatataataggagaagaagtaggca

SEQ ID NO: 122557 - DNA, 25 bp, Artificial sequence
  SiRNA target sequence
atataataggagaagaagtaggcat

SEQ ID NO: 122558 - DNA, 25 bp, Artificial sequence
  SiRNA target sequence
tataataggagaagaagtaggcatc

SEQ ID NO: 122559 - DNA, 25 bp, Artificial sequence
  SiRNA target sequence
ataataggagaagaagtaggcatct

SEQ ID NO: 122560 - DNA, 25 bp, Artificial sequence
  SiRNA target sequence
taataggagaagaagtaggcatctc

SEQ ID NO: 122561 - DNA, 25 bp, Artificial sequence
  SiRNA target sequence
aataggagaagaagtaggcatctct

SEQ ID NO: 122562 - DNA, 25 bp, Artificial sequence
  SiRNA target sequence
ataggagaagaagtaggcatctctg

SEQ ID NO: 122563 - DNA, 25 bp, Artificial sequence
  SiRNA target sequence
taggagaagaagtaggcatctctgg

SEQ ID NO: 122564 - DNA, 25 bp, Artificial sequence
  SiRNA target sequence
aggagaagaagtaggcatctctggt

SEQ ID NO: 122565 - DNA, 25 bp, Artificial sequence
  SiRNA target sequence
ggagaagaagtaggcatctctggtg

SEQ ID NO: 122566 - DNA, 25 bp, Artificial sequence
  SiRNA target sequence
gagaagaagtaggcatctctggtgg

SEQ ID NO: 122567 - DNA, 25 bp, Artificial sequence
  SiRNA target sequence
agaagaagtaggcatctctggtggt

SEQ ID NO: 122568 - DNA, 25 bp, Artificial sequence
  SiRNA target sequence
gaagaagtaggcatctctggtggtc

SEQ ID NO: 122569 - DNA, 25 bp, Artificial sequence
  SiRNA target sequence
aagaagtaggcatctctggtggtcc

SEQ ID NO: 122570 - DNA, 25 bp, Artificial sequence
  SiRNA target sequence
agaagtaggcatctctggtggtcct

SEQ ID NO: 122571 - DNA, 25 bp, Artificial sequence
  SiRNA target sequence
gaagtaggcatctctggtggtcctc

SEQ ID NO: 122572 - DNA, 25 bp, Artificial sequence
  SiRNA target sequence
aagtaggcatctctggtggtcctca

SEQ ID NO: 122573 - DNA, 25 bp, Artificial sequence
  SiRNA target sequence
agtaggcatctctggtggtcctcac

SEQ ID NO: 122574 - DNA, 25 bp, Artificial sequence
  SiRNA target sequence
gtaggcatctctggtggtcctcacg

SEQ ID NO: 122575 - DNA, 25 bp, Artificial sequence
  SiRNA target sequence
taggcatctctggtggtcctcacgg

SEQ ID NO: 122576 - DNA, 25 bp, Artificial sequence
  SiRNA target sequence
aggcatctctggtggtcctcacggt

SEQ ID NO: 122577 - DNA, 25 bp, Artificial sequence
  SiRNA target sequence
ggcatctctggtggtcctcacggtc

SEQ ID NO: 122578 - DNA, 25 bp, Artificial sequence
  SiRNA target sequence
gcatctctggtggtcctcacggtct

SEQ ID NO: 122579 - DNA, 25 bp, Artificial sequence
  SiRNA target sequence
catctctggtggtcctcacggtctt

SEQ ID NO: 122580 - DNA, 25 bp, Artificial sequence
  SiRNA target sequence
atctctggtggtcctcacggtctta

SEQ ID NO: 122581 - DNA, 25 bp, Artificial sequence
  SiRNA target sequence
tctctggtggtcctcacggtcttac

SEQ ID NO: 122582 - DNA, 25 bp, Artificial sequence
  SiRNA target sequence
ctctggtggtcctcacggtcttact

SEQ ID NO: 122583 - DNA, 25 bp, Artificial sequence
  SiRNA target sequence
tctggtggtcctcacggtcttacta

SEQ ID NO: 122584 - DNA, 25 bp, Artificial sequence
  SiRNA target sequence
ctggtggtcctcacggtcttactaa

SEQ ID NO: 122585 - DNA, 25 bp, Artificial sequence
  SiRNA target sequence
tggtggtcctcacggtcttactaaa

SEQ ID NO: 122586 - DNA, 25 bp, Artificial sequence
  SiRNA target sequence
ggtggtcctcacggtcttactaaaa

SEQ ID NO: 122587 - DNA, 25 bp, Artificial sequence
  SiRNA target sequence
gtggtcctcacggtcttactaaaaa

SEQ ID NO: 122588 - DNA, 25 bp, Artificial sequence
  SiRNA target sequence
tggtcctcacggtcttactaaaaat

SEQ ID NO: 122589 - DNA, 25 bp, Artificial sequence
  SiRNA target sequence
ggtcctcacggtcttactaaaaatt

SEQ ID NO: 122590 - DNA, 25 bp, Artificial sequence
  SiRNA target sequence
gtcctcacggtcttactaaaaattt

SEQ ID NO: 122591 - DNA, 25 bp, Artificial sequence
  SiRNA target sequence
tcctcacggtcttactaaaaatttg

SEQ ID NO: 122592 - DNA, 25 bp, Artificial sequence
  SiRNA target sequence
cctcacggtcttactaaaaatttga

SEQ ID NO: 122593 - DNA, 25 bp, Artificial sequence
  SiRNA target sequence
ctcacggtcttactaaaaatttgat

SEQ ID NO: 122594 - DNA, 25 bp, Artificial sequence
  SiRNA target sequence
tcacggtcttactaaaaatttgatc

SEQ ID NO: 122595 - DNA, 25 bp, Artificial sequence
  SiRNA target sequence
cacggtcttactaaaaatttgatca

SEQ ID NO: 122596 - DNA, 25 bp, Artificial sequence
  SiRNA target sequence
acggtcttactaaaaatttgatcaa

SEQ ID NO: 122597 - DNA, 25 bp, Artificial sequence
  SiRNA target sequence
cggtcttactaaaaatttgatcaaa

SEQ ID NO: 122598 - DNA, 25 bp, Artificial sequence
  SiRNA target sequence
ggtcttactaaaaatttgatcaaaa

SEQ ID NO: 122599 - DNA, 25 bp, Artificial sequence
  SiRNA target sequence
gtcttactaaaaatttgatcaaaaa

SEQ ID NO: 122600 - DNA, 25 bp, Artificial sequence
  SiRNA target sequence
tcttactaaaaatttgatcaaaaaa

SEQ ID NO: 122601 - DNA, 25 bp, Artificial sequence
  SiRNA target sequence
cttactaaaaatttgatcaaaaaat

SEQ ID NO: 122602 - DNA, 25 bp, Artificial sequence
  SiRNA target sequence
ttactaaaaatttgatcaaaaaata

SEQ ID NO: 122603 - DNA, 25 bp, Artificial sequence
  SiRNA target sequence
tactaaaaatttgatcaaaaaatac

SEQ ID NO: 122604 - DNA, 25 bp, Artificial sequence
  SiRNA target sequence
actaaaaatttgatcaaaaaatacg

SEQ ID NO: 122605 - DNA, 25 bp, Artificial sequence
  SiRNA target sequence
ctaaaaatttgatcaaaaaatacgg

SEQ ID NO: 122606 - DNA, 25 bp, Artificial sequence
  SiRNA target sequence
taaaaatttgatcaaaaaatacggc

SEQ ID NO: 122607 - DNA, 25 bp, Artificial sequence
  SiRNA target sequence
aaaaatttgatcaaaaaatacggcg

SEQ ID NO: 122608 - DNA, 25 bp, Artificial sequence
  SiRNA target sequence
aaaatttgatcaaaaaatacggcga

SEQ ID NO: 122609 - DNA, 25 bp, Artificial sequence
  SiRNA target sequence
aaatttgatcaaaaaatacggcgat

SEQ ID NO: 122610 - DNA, 25 bp, Artificial sequence
  SiRNA target sequence
aatttgatcaaaaaatacggcgatc

SEQ ID NO: 122611 - DNA, 25 bp, Artificial sequence
  SiRNA target sequence
atttgatcaaaaaatacggcgatca

SEQ ID NO: 122612 - DNA, 25 bp, Artificial sequence
  SiRNA target sequence
tttgatcaaaaaatacggcgatcaa

SEQ ID NO: 122613 - DNA, 25 bp, Artificial sequence
  SiRNA target sequence
ttgatcaaaaaatacggcgatcaaa

SEQ ID NO: 122614 - DNA, 25 bp, Artificial sequence
  SiRNA target sequence
tgatcaaaaaatacggcgatcaaag

SEQ ID NO: 122615 - DNA, 25 bp, Artificial sequence
  SiRNA target sequence
gatcaaaaaatacggcgatcaaaga

SEQ ID NO: 122616 - DNA, 25 bp, Artificial sequence
  SiRNA target sequence
atcaaaaaatacggcgatcaaagag

SEQ ID NO: 122617 - DNA, 25 bp, Artificial sequence
  SiRNA target sequence
tcaaaaaatacggcgatcaaagagt

SEQ ID NO: 122618 - DNA, 25 bp, Artificial sequence
  SiRNA target sequence
caaaaaatacggcgatcaaagagtg

SEQ ID NO: 122619 - DNA, 25 bp, Artificial sequence
  SiRNA target sequence
aaaaaatacggcgatcaaagagtga

SEQ ID NO: 122620 - DNA, 25 bp, Artificial sequence
  SiRNA target sequence
aaaaatacggcgatcaaagagtgaa

SEQ ID NO: 122621 - DNA, 25 bp, Artificial sequence
  SiRNA target sequence
aaaatacggcgatcaaagagtgaag

SEQ ID NO: 122622 - DNA, 25 bp, Artificial sequence
  SiRNA target sequence
aaatacggcgatcaaagagtgaagg

SEQ ID NO: 122623 - DNA, 25 bp, Artificial sequence
  SiRNA target sequence
aatacggcgatcaaagagtgaagga

SEQ ID NO: 122624 - DNA, 25 bp, Artificial sequence
  SiRNA target sequence
atacggcgatcaaagagtgaaggat

SEQ ID NO: 122625 - DNA, 25 bp, Artificial sequence
  SiRNA target sequence
tacggcgatcaaagagtgaaggata

SEQ ID NO: 122626 - DNA, 25 bp, Artificial sequence
  SiRNA target sequence
acggcgatcaaagagtgaaggatac

SEQ ID NO: 122627 - DNA, 25 bp, Artificial sequence
  SiRNA target sequence
cggcgatcaaagagtgaaggatacc

SEQ ID NO: 122628 - DNA, 25 bp, Artificial sequence
  SiRNA target sequence
ggcgatcaaagagtgaaggataccc

SEQ ID NO: 122629 - DNA, 25 bp, Artificial sequence
  SiRNA target sequence
gcgatcaaagagtgaaggatacccc

SEQ ID NO: 122630 - DNA, 25 bp, Artificial sequence
  SiRNA target sequence
cgatcaaagagtgaaggatacccct

SEQ ID NO: 122631 - DNA, 25 bp, Artificial sequence
  SiRNA target sequence
gatcaaagagtgaaggataccccta

SEQ ID NO: 122632 - DNA, 25 bp, Artificial sequence
  SiRNA target sequence
atcaaagagtgaaggatacccctat

SEQ ID NO: 122633 - DNA, 25 bp, Artificial sequence
  SiRNA target sequence
tcaaagagtgaaggatacccctatt

SEQ ID NO: 122634 - DNA, 25 bp, Artificial sequence
  SiRNA target sequence
caaagagtgaaggatacccctattt

SEQ ID NO: 122635 - DNA, 25 bp, Artificial sequence
  SiRNA target sequence
aaagagtgaaggatacccctatttc

SEQ ID NO: 122636 - DNA, 25 bp, Artificial sequence
  SiRNA target sequence
aagagtgaaggatacccctatttcg

SEQ ID NO: 122637 - DNA, 25 bp, Artificial sequence
  SiRNA target sequence
agagtgaaggatacccctatttcgg

SEQ ID NO: 122638 - DNA, 25 bp, Artificial sequence
  SiRNA target sequence
gagtgaaggatacccctatttcgga

SEQ ID NO: 122639 - DNA, 25 bp, Artificial sequence
  SiRNA target sequence
agtgaaggatacccctatttcggaa

SEQ ID NO: 122640 - DNA, 25 bp, Artificial sequence
  SiRNA target sequence
gtgaaggatacccctatttcggaaa

SEQ ID NO: 122641 - DNA, 25 bp, Artificial sequence
  SiRNA target sequence
tgaaggatacccctatttcggaaat

SEQ ID NO: 122642 - DNA, 25 bp, Artificial sequence
  SiRNA target sequence
gaaggatacccctatttcggaaatg

SEQ ID NO: 122643 - DNA, 25 bp, Artificial sequence
  SiRNA target sequence
aaggatacccctatttcggaaatgg

SEQ ID NO: 122644 - DNA, 25 bp, Artificial sequence
  SiRNA target sequence
aggatacccctatttcggaaatggg

SEQ ID NO: 122645 - DNA, 25 bp, Artificial sequence
  SiRNA target sequence
ggatacccctatttcggaaatggga

SEQ ID NO: 122646 - DNA, 25 bp, Artificial sequence
  SiRNA target sequence
gatacccctatttcggaaatgggat

SEQ ID NO: 122647 - DNA, 25 bp, Artificial sequence
  SiRNA target sequence
atacccctatttcggaaatgggatt

SEQ ID NO: 122648 - DNA, 25 bp, Artificial sequence
  SiRNA target sequence
tacccctatttcggaaatgggattt

SEQ ID NO: 122649 - DNA, 25 bp, Artificial sequence
  SiRNA target sequence
acccctatttcggaaatgggattta

SEQ ID NO: 122650 - DNA, 25 bp, Artificial sequence
  SiRNA target sequence
cccctatttcggaaatgggatttac

SEQ ID NO: 122651 - DNA, 25 bp, Artificial sequence
  SiRNA target sequence
ccctatttcggaaatgggatttaca

SEQ ID NO: 122652 - DNA, 25 bp, Artificial sequence
  SiRNA target sequence
cctatttcggaaatgggatttacag

SEQ ID NO: 122653 - DNA, 25 bp, Artificial sequence
  SiRNA target sequence
ctatttcggaaatgggatttacagg

SEQ ID NO: 122654 - DNA, 25 bp, Artificial sequence
  SiRNA target sequence
tatttcggaaatgggatttacaggt

SEQ ID NO: 122655 - DNA, 25 bp, Artificial sequence
  SiRNA target sequence
atttcggaaatgggatttacaggtc

SEQ ID NO: 122656 - DNA, 25 bp, Artificial sequence
  SiRNA target sequence
tttcggaaatgggatttacaggtct

SEQ ID NO: 122657 - DNA, 25 bp, Artificial sequence
  SiRNA target sequence
ttcggaaatgggatttacaggtctc

SEQ ID NO: 122658 - DNA, 25 bp, Artificial sequence
  SiRNA target sequence
tcggaaatgggatttacaggtctcg

SEQ ID NO: 122659 - DNA, 25 bp, Artificial sequence
  SiRNA target sequence
cggaaatgggatttacaggtctcgc

SEQ ID NO: 122660 - DNA, 25 bp, Artificial sequence
  SiRNA target sequence
ggaaatgggatttacaggtctcgct

SEQ ID NO: 122661 - DNA, 25 bp, Artificial sequence
  SiRNA target sequence
gaaatgggatttacaggtctcgctg

SEQ ID NO: 122662 - DNA, 25 bp, Artificial sequence
  SiRNA target sequence
aaatgggatttacaggtctcgctgt

SEQ ID NO: 122663 - DNA, 25 bp, Artificial sequence
  SiRNA target sequence
aatgggatttacaggtctcgctgtg

SEQ ID NO: 122664 - DNA, 25 bp, Artificial sequence
  SiRNA target sequence
atgggatttacaggtctcgctgtgg

SEQ ID NO: 122665 - DNA, 25 bp, Artificial sequence
  SiRNA target sequence
tgggatttacaggtctcgctgtggg

SEQ ID NO: 122666 - DNA, 25 bp, Artificial sequence
  SiRNA target sequence
gggatttacaggtctcgctgtgggt

SEQ ID NO: 122667 - DNA, 25 bp, Artificial sequence
  SiRNA target sequence
ggatttacaggtctcgctgtgggtt

SEQ ID NO: 122668 - DNA, 25 bp, Artificial sequence
  SiRNA target sequence
gatttacaggtctcgctgtgggttc

SEQ ID NO: 122669 - DNA, 25 bp, Artificial sequence
  SiRNA target sequence
atttacaggtctcgctgtgggttca

SEQ ID NO: 122670 - DNA, 25 bp, Artificial sequence
  SiRNA target sequence
tttacaggtctcgctgtgggttcaa

SEQ ID NO: 122671 - DNA, 25 bp, Artificial sequence
  SiRNA target sequence
ttacaggtctcgctgtgggttcaag

SEQ ID NO: 122672 - DNA, 25 bp, Artificial sequence
  SiRNA target sequence
tacaggtctcgctgtgggttcaagc

SEQ ID NO: 122673 - DNA, 25 bp, Artificial sequence
  SiRNA target sequence
acaggtctcgctgtgggttcaagct

SEQ ID NO: 122674 - DNA, 25 bp, Artificial sequence
  SiRNA target sequence
caggtctcgctgtgggttcaagcta

SEQ ID NO: 122675 - DNA, 25 bp, Artificial sequence
  SiRNA target sequence
aggtctcgctgtgggttcaagctat

SEQ ID NO: 122676 - DNA, 25 bp, Artificial sequence
  SiRNA target sequence
ggtctcgctgtgggttcaagctatt

SEQ ID NO: 122677 - DNA, 25 bp, Artificial sequence
  SiRNA target sequence
gtctcgctgtgggttcaagctattt

SEQ ID NO: 122678 - DNA, 25 bp, Artificial sequence
  SiRNA target sequence
tctcgctgtgggttcaagctattta

SEQ ID NO: 122679 - DNA, 25 bp, Artificial sequence
  SiRNA target sequence
ctcgctgtgggttcaagctatttag

SEQ ID NO: 122680 - DNA, 25 bp, Artificial sequence
  SiRNA target sequence
tcgctgtgggttcaagctatttagg

SEQ ID NO: 122681 - DNA, 25 bp, Artificial sequence
  SiRNA target sequence
cgctgtgggttcaagctatttaggg

SEQ ID NO: 122682 - DNA, 25 bp, Artificial sequence
  SiRNA target sequence
gctgtgggttcaagctatttagggt

SEQ ID NO: 122683 - DNA, 25 bp, Artificial sequence
  SiRNA target sequence
ctgtgggttcaagctatttagggtt

SEQ ID NO: 122684 - DNA, 25 bp, Artificial sequence
  SiRNA target sequence
tgtgggttcaagctatttagggtta

SEQ ID NO: 122685 - DNA, 25 bp, Artificial sequence
  SiRNA target sequence
gtgggttcaagctatttagggttaa

SEQ ID NO: 122686 - DNA, 25 bp, Artificial sequence
  SiRNA target sequence
tgggttcaagctatttagggttaag

SEQ ID NO: 122687 - DNA, 25 bp, Artificial sequence
  SiRNA target sequence
gggttcaagctatttagggttaaga

SEQ ID NO: 122688 - DNA, 25 bp, Artificial sequence
  SiRNA target sequence
ggttcaagctatttagggttaagac

SEQ ID NO: 122689 - DNA, 25 bp, Artificial sequence
  SiRNA target sequence
gttcaagctatttagggttaagacc

SEQ ID NO: 122690 - DNA, 25 bp, Artificial sequence
  SiRNA target sequence
ttcaagctatttagggttaagaccc

SEQ ID NO: 122691 - DNA, 25 bp, Artificial sequence
  SiRNA target sequence
tcaagctatttagggttaagacccg

SEQ ID NO: 122692 - DNA, 25 bp, Artificial sequence
  SiRNA target sequence
caagctatttagggttaagacccgt

SEQ ID NO: 122693 - DNA, 25 bp, Artificial sequence
  SiRNA target sequence
aagctatttagggttaagacccgta

SEQ ID NO: 122694 - DNA, 25 bp, Artificial sequence
  SiRNA target sequence
agctatttagggttaagacccgtag

SEQ ID NO: 122695 - DNA, 25 bp, Artificial sequence
  SiRNA target sequence
gctatttagggttaagacccgtagt

SEQ ID NO: 122696 - DNA, 25 bp, Artificial sequence
  SiRNA target sequence
ctatttagggttaagacccgtagta

SEQ ID NO: 122697 - DNA, 25 bp, Artificial sequence
  SiRNA target sequence
tatttagggttaagacccgtagtag

SEQ ID NO: 122698 - DNA, 25 bp, Artificial sequence
  SiRNA target sequence
atttagggttaagacccgtagtaga

SEQ ID NO: 122699 - DNA, 25 bp, Artificial sequence
  SiRNA target sequence
tttagggttaagacccgtagtagat

SEQ ID NO: 122700 - DNA, 25 bp, Artificial sequence
  SiRNA target sequence
ttagggttaagacccgtagtagatt

SEQ ID NO: 122701 - DNA, 25 bp, Artificial sequence
  SiRNA target sequence
tagggttaagacccgtagtagattt

SEQ ID NO: 122702 - DNA, 25 bp, Artificial sequence
  SiRNA target sequence
agggttaagacccgtagtagatttt

SEQ ID NO: 122703 - DNA, 25 bp, Artificial sequence
  SiRNA target sequence
gggttaagacccgtagtagatttta

SEQ ID NO: 122704 - DNA, 25 bp, Artificial sequence
  SiRNA target sequence
ggttaagacccgtagtagattttat

SEQ ID NO: 122705 - DNA, 25 bp, Artificial sequence
  SiRNA target sequence
gttaagacccgtagtagattttatg

SEQ ID NO: 122706 - DNA, 25 bp, Artificial sequence
  SiRNA target sequence
ttaagacccgtagtagattttatga

SEQ ID NO: 122707 - DNA, 25 bp, Artificial sequence
  SiRNA target sequence
taagacccgtagtagattttatgac

SEQ ID NO: 122708 - DNA, 25 bp, Artificial sequence
  SiRNA target sequence
aagacccgtagtagattttatgact

SEQ ID NO: 122709 - DNA, 25 bp, Artificial sequence
  SiRNA target sequence
agacccgtagtagattttatgactt

SEQ ID NO: 122710 - DNA, 25 bp, Artificial sequence
  SiRNA target sequence
gacccgtagtagattttatgacttg

SEQ ID NO: 122711 - DNA, 25 bp, Artificial sequence
  SiRNA target sequence
acccgtagtagattttatgacttgg

SEQ ID NO: 122712 - DNA, 25 bp, Artificial sequence
  SiRNA target sequence
cccgtagtagattttatgacttgga

SEQ ID NO: 122713 - DNA, 25 bp, Artificial sequence
  SiRNA target sequence
ccgtagtagattttatgacttggaa

SEQ ID NO: 122714 - DNA, 25 bp, Artificial sequence
  SiRNA target sequence
cgtagtagattttatgacttggaat

SEQ ID NO: 122715 - DNA, 25 bp, Artificial sequence
  SiRNA target sequence
gtagtagattttatgacttggaatt

SEQ ID NO: 122716 - DNA, 25 bp, Artificial sequence
  SiRNA target sequence
tagtagattttatgacttggaattt

SEQ ID NO: 122717 - DNA, 25 bp, Artificial sequence
  SiRNA target sequence
agtagattttatgacttggaatttt

SEQ ID NO: 122718 - DNA, 25 bp, Artificial sequence
  SiRNA target sequence
gtagattttatgacttggaattttg

SEQ ID NO: 122719 - DNA, 25 bp, Artificial sequence
  SiRNA target sequence
tagattttatgacttggaattttgc

SEQ ID NO: 122720 - DNA, 25 bp, Artificial sequence
  SiRNA target sequence
agattttatgacttggaattttgct

SEQ ID NO: 122721 - DNA, 25 bp, Artificial sequence
  SiRNA target sequence
gattttatgacttggaattttgctt

SEQ ID NO: 122722 - DNA, 25 bp, Artificial sequence
  SiRNA target sequence
attttatgacttggaattttgcttt

SEQ ID NO: 122723 - DNA, 25 bp, Artificial sequence
  SiRNA target sequence
ttttatgacttggaattttgctttg

SEQ ID NO: 122724 - DNA, 25 bp, Artificial sequence
  SiRNA target sequence
tttatgacttggaattttgctttgc

SEQ ID NO: 122725 - DNA, 25 bp, Artificial sequence
  SiRNA target sequence
ttatgacttggaattttgctttgca

SEQ ID NO: 122726 - DNA, 25 bp, Artificial sequence
  SiRNA target sequence
tatgacttggaattttgctttgcaa

SEQ ID NO: 122727 - DNA, 25 bp, Artificial sequence
  SiRNA target sequence
atgacttggaattttgctttgcaat

SEQ ID NO: 122728 - DNA, 25 bp, Artificial sequence
  SiRNA target sequence
tgacttggaattttgctttgcaatc

SEQ ID NO: 122729 - DNA, 25 bp, Artificial sequence
  SiRNA target sequence
gacttggaattttgctttgcaatca

SEQ ID NO: 122730 - DNA, 25 bp, Artificial sequence
  SiRNA target sequence
acttggaattttgctttgcaatcaa

SEQ ID NO: 122731 - DNA, 25 bp, Artificial sequence
  SiRNA target sequence
cttggaattttgctttgcaatcaat

SEQ ID NO: 122732 - DNA, 25 bp, Artificial sequence
  SiRNA target sequence
ttggaattttgctttgcaatcaatt

SEQ ID NO: 122733 - DNA, 25 bp, Artificial sequence
  SiRNA target sequence
tggaattttgctttgcaatcaattg

SEQ ID NO: 122734 - DNA, 25 bp, Artificial sequence
  SiRNA target sequence
ggaattttgctttgcaatcaattga

SEQ ID NO: 122735 - DNA, 25 bp, Artificial sequence
  SiRNA target sequence
gaattttgctttgcaatcaattgac

SEQ ID NO: 122736 - DNA, 25 bp, Artificial sequence
  SiRNA target sequence
aattttgctttgcaatcaattgacc

SEQ ID NO: 122737 - DNA, 25 bp, Artificial sequence
  SiRNA target sequence
attttgctttgcaatcaattgacca

SEQ ID NO: 122738 - DNA, 25 bp, Artificial sequence
  SiRNA target sequence
ttttgctttgcaatcaattgaccat

SEQ ID NO: 122739 - DNA, 25 bp, Artificial sequence
  SiRNA target sequence
tttgctttgcaatcaattgaccata

SEQ ID NO: 122740 - DNA, 25 bp, Artificial sequence
  SiRNA target sequence
ttgctttgcaatcaattgaccatat

SEQ ID NO: 122741 - DNA, 25 bp, Artificial sequence
  SiRNA target sequence
tgctttgcaatcaattgaccatatt

SEQ ID NO: 122742 - DNA, 25 bp, Artificial sequence
  SiRNA target sequence
gctttgcaatcaattgaccatatta

SEQ ID NO: 122743 - DNA, 25 bp, Artificial sequence
  SiRNA target sequence
ctttgcaatcaattgaccatattat

SEQ ID NO: 122744 - DNA, 25 bp, Artificial sequence
  SiRNA target sequence
tttgcaatcaattgaccatattatt

SEQ ID NO: 122745 - DNA, 25 bp, Artificial sequence
  SiRNA target sequence
ttgcaatcaattgaccatattatta

SEQ ID NO: 122746 - DNA, 25 bp, Artificial sequence
  SiRNA target sequence
tgcaatcaattgaccatattattaa

SEQ ID NO: 122747 - DNA, 25 bp, Artificial sequence
  SiRNA target sequence
gcaatcaattgaccatattattaat

SEQ ID NO: 122748 - DNA, 25 bp, Artificial sequence
  SiRNA target sequence
caatcaattgaccatattattaatt

SEQ ID NO: 122749 - DNA, 25 bp, Artificial sequence
  SiRNA target sequence
aatcaattgaccatattattaattc

SEQ ID NO: 122750 - DNA, 25 bp, Artificial sequence
  SiRNA target sequence
atcaattgaccatattattaattct

SEQ ID NO: 122751 - DNA, 25 bp, Artificial sequence
  SiRNA target sequence
tcaattgaccatattattaattctt

SEQ ID NO: 122752 - DNA, 25 bp, Artificial sequence
  SiRNA target sequence
caattgaccatattattaattcttg

SEQ ID NO: 122753 - DNA, 25 bp, Artificial sequence
  SiRNA target sequence
aattgaccatattattaattcttgt

SEQ ID NO: 122754 - DNA, 25 bp, Artificial sequence
  SiRNA target sequence
attgaccatattattaattcttgtg

SEQ ID NO: 122755 - DNA, 25 bp, Artificial sequence
  SiRNA target sequence
ttgaccatattattaattcttgtgc

SEQ ID NO: 122756 - DNA, 25 bp, Artificial sequence
  SiRNA target sequence
tgaccatattattaattcttgtgcg

SEQ ID NO: 122757 - DNA, 25 bp, Artificial sequence
  SiRNA target sequence
gaccatattattaattcttgtgcga

SEQ ID NO: 122758 - DNA, 25 bp, Artificial sequence
  SiRNA target sequence
accatattattaattcttgtgcgaa

SEQ ID NO: 122759 - DNA, 25 bp, Artificial sequence
  SiRNA target sequence
ccatattattaattcttgtgcgaaa

SEQ ID NO: 122760 - DNA, 25 bp, Artificial sequence
  SiRNA target sequence
catattattaattcttgtgcgaaaa

SEQ ID NO: 122761 - DNA, 25 bp, Artificial sequence
  SiRNA target sequence
atattattaattcttgtgcgaaaac

SEQ ID NO: 122762 - DNA, 25 bp, Artificial sequence
  SiRNA target sequence
tattattaattcttgtgcgaaaacc

SEQ ID NO: 122763 - DNA, 25 bp, Artificial sequence
  SiRNA target sequence
attattaattcttgtgcgaaaacct

SEQ ID NO: 122764 - DNA, 25 bp, Artificial sequence
  SiRNA target sequence
ttattaattcttgtgcgaaaacctt

SEQ ID NO: 122765 - DNA, 25 bp, Artificial sequence
  SiRNA target sequence
tattaattcttgtgcgaaaaccttg

SEQ ID NO: 122766 - DNA, 25 bp, Artificial sequence
  SiRNA target sequence
attaattcttgtgcgaaaaccttgt

SEQ ID NO: 122767 - DNA, 25 bp, Artificial sequence
  SiRNA target sequence
ttaattcttgtgcgaaaaccttgta

SEQ ID NO: 122768 - DNA, 25 bp, Artificial sequence
  SiRNA target sequence
taattcttgtgcgaaaaccttgtat

SEQ ID NO: 122769 - DNA, 25 bp, Artificial sequence
  SiRNA target sequence
aattcttgtgcgaaaaccttgtata

SEQ ID NO: 122770 - DNA, 25 bp, Artificial sequence
  SiRNA target sequence
attcttgtgcgaaaaccttgtatat

SEQ ID NO: 122771 - DNA, 25 bp, Artificial sequence
  SiRNA target sequence
ttcttgtgcgaaaaccttgtatatg

SEQ ID NO: 122772 - DNA, 25 bp, Artificial sequence
  SiRNA target sequence
tcttgtgcgaaaaccttgtatatgt

SEQ ID NO: 122773 - DNA, 25 bp, Artificial sequence
  SiRNA target sequence
cttgtgcgaaaaccttgtatatgtc

SEQ ID NO: 122774 - DNA, 25 bp, Artificial sequence
  SiRNA target sequence
ttgtgcgaaaaccttgtatatgtca

SEQ ID NO: 122775 - DNA, 25 bp, Artificial sequence
  SiRNA target sequence
tgtgcgaaaaccttgtatatgtcag

SEQ ID NO: 122776 - DNA, 25 bp, Artificial sequence
  SiRNA target sequence
gtgcgaaaaccttgtatatgtcagg

SEQ ID NO: 122777 - DNA, 25 bp, Artificial sequence
  SiRNA target sequence
tgcgaaaaccttgtatatgtcagga

SEQ ID NO: 122778 - DNA, 25 bp, Artificial sequence
  SiRNA target sequence
gcgaaaaccttgtatatgtcaggag

SEQ ID NO: 122779 - DNA, 25 bp, Artificial sequence
  SiRNA target sequence
cgaaaaccttgtatatgtcaggagg

SEQ ID NO: 122780 - DNA, 25 bp, Artificial sequence
  SiRNA target sequence
gaaaaccttgtatatgtcaggagga

SEQ ID NO: 122781 - DNA, 25 bp, Artificial sequence
  SiRNA target sequence
aaaaccttgtatatgtcaggaggaa

SEQ ID NO: 122782 - DNA, 25 bp, Artificial sequence
  SiRNA target sequence
aaaccttgtatatgtcaggaggaag

SEQ ID NO: 122783 - DNA, 25 bp, Artificial sequence
  SiRNA target sequence
aaccttgtatatgtcaggaggaaga

SEQ ID NO: 122784 - DNA, 25 bp, Artificial sequence
  SiRNA target sequence
accttgtatatgtcaggaggaagaa

SEQ ID NO: 122785 - DNA, 25 bp, Artificial sequence
  SiRNA target sequence
ccttgtatatgtcaggaggaagaat

SEQ ID NO: 122786 - DNA, 25 bp, Artificial sequence
  SiRNA target sequence
cttgtatatgtcaggaggaagaata

SEQ ID NO: 122787 - DNA, 25 bp, Artificial sequence
  SiRNA target sequence
ttgtatatgtcaggaggaagaatac

SEQ ID NO: 122788 - DNA, 25 bp, Artificial sequence
  SiRNA target sequence
tgtatatgtcaggaggaagaataca

SEQ ID NO: 122789 - DNA, 25 bp, Artificial sequence
  SiRNA target sequence
gtatatgtcaggaggaagaatacaa

SEQ ID NO: 122790 - DNA, 25 bp, Artificial sequence
  SiRNA target sequence
tatatgtcaggaggaagaatacaat

SEQ ID NO: 122791 - DNA, 25 bp, Artificial sequence
  SiRNA target sequence
atatgtcaggaggaagaatacaatg

SEQ ID NO: 122792 - DNA, 25 bp, Artificial sequence
  SiRNA target sequence
tatgtcaggaggaagaatacaatgt

SEQ ID NO: 122793 - DNA, 25 bp, Artificial sequence
  SiRNA target sequence
atgtcaggaggaagaatacaatgtc

SEQ ID NO: 122794 - DNA, 25 bp, Artificial sequence
  SiRNA target sequence
tgtcaggaggaagaatacaatgtcc

SEQ ID NO: 122795 - DNA, 25 bp, Artificial sequence
  SiRNA target sequence
gtcaggaggaagaatacaatgtcca

SEQ ID NO: 122796 - DNA, 25 bp, Artificial sequence
  SiRNA target sequence
tcaggaggaagaatacaatgtccaa

SEQ ID NO: 122797 - DNA, 25 bp, Artificial sequence
  SiRNA target sequence
caggaggaagaatacaatgtccaat

SEQ ID NO: 122798 - DNA, 25 bp, Artificial sequence
  SiRNA target sequence
aggaggaagaatacaatgtccaatt

SEQ ID NO: 122799 - DNA, 25 bp, Artificial sequence
  SiRNA target sequence
ggaggaagaatacaatgtccaattg

SEQ ID NO: 122800 - DNA, 25 bp, Artificial sequence
  SiRNA target sequence
gaggaagaatacaatgtccaattgt

SEQ ID NO: 122801 - DNA, 25 bp, Artificial sequence
  SiRNA target sequence
aggaagaatacaatgtccaattgtt

SEQ ID NO: 122802 - DNA, 25 bp, Artificial sequence
  SiRNA target sequence
ggaagaatacaatgtccaattgttt

SEQ ID NO: 122803 - DNA, 25 bp, Artificial sequence
  SiRNA target sequence
gaagaatacaatgtccaattgtttt

SEQ ID NO: 122804 - DNA, 25 bp, Artificial sequence
  SiRNA target sequence
aagaatacaatgtccaattgttttt

SEQ ID NO: 122805 - DNA, 25 bp, Artificial sequence
  SiRNA target sequence
agaatacaatgtccaattgttttta

SEQ ID NO: 122806 - DNA, 25 bp, Artificial sequence
  SiRNA target sequence
gaatacaatgtccaattgtttttag

SEQ ID NO: 122807 - DNA, 25 bp, Artificial sequence
  SiRNA target sequence
aatacaatgtccaattgtttttagg

SEQ ID NO: 122808 - DNA, 25 bp, Artificial sequence
  SiRNA target sequence
atacaatgtccaattgtttttaggg

SEQ ID NO: 122809 - DNA, 25 bp, Artificial sequence
  SiRNA target sequence
tacaatgtccaattgtttttagggg

SEQ ID NO: 122810 - DNA, 25 bp, Artificial sequence
  SiRNA target sequence
acaatgtccaattgtttttagggga

SEQ ID NO: 122811 - DNA, 25 bp, Artificial sequence
  SiRNA target sequence
caatgtccaattgtttttaggggac

SEQ ID NO: 122812 - DNA, 25 bp, Artificial sequence
  SiRNA target sequence
aatgtccaattgtttttaggggacc

SEQ ID NO: 122813 - DNA, 25 bp, Artificial sequence
  SiRNA target sequence
atgtccaattgtttttaggggacca

SEQ ID NO: 122814 - DNA, 25 bp, Artificial sequence
  SiRNA target sequence
tgtccaattgtttttaggggaccaa

SEQ ID NO: 122815 - DNA, 25 bp, Artificial sequence
  SiRNA target sequence
gtccaattgtttttaggggaccaaa

SEQ ID NO: 122816 - DNA, 25 bp, Artificial sequence
  SiRNA target sequence
tccaattgtttttaggggaccaaat

SEQ ID NO: 122817 - DNA, 25 bp, Artificial sequence
  SiRNA target sequence
ccaattgtttttaggggaccaaatg

SEQ ID NO: 122818 - DNA, 25 bp, Artificial sequence
  SiRNA target sequence
caattgtttttaggggaccaaatgg

SEQ ID NO: 122819 - DNA, 25 bp, Artificial sequence
  SiRNA target sequence
aattgtttttaggggaccaaatgga

SEQ ID NO: 122820 - DNA, 25 bp, Artificial sequence
  SiRNA target sequence
attgtttttaggggaccaaatggat

SEQ ID NO: 122821 - DNA, 25 bp, Artificial sequence
  SiRNA target sequence
ttgtttttaggggaccaaatggatt

SEQ ID NO: 122822 - DNA, 25 bp, Artificial sequence
  SiRNA target sequence
tgtttttaggggaccaaatggattc

SEQ ID NO: 122823 - DNA, 25 bp, Artificial sequence
  SiRNA target sequence
gtttttaggggaccaaatggattca

SEQ ID NO: 122824 - DNA, 25 bp, Artificial sequence
  SiRNA target sequence
tttttaggggaccaaatggattcaa

SEQ ID NO: 122825 - DNA, 25 bp, Artificial sequence
  SiRNA target sequence
ttttaggggaccaaatggattcaat

SEQ ID NO: 122826 - DNA, 25 bp, Artificial sequence
  SiRNA target sequence
tttaggggaccaaatggattcaata

SEQ ID NO: 122827 - DNA, 25 bp, Artificial sequence
  SiRNA target sequence
ttaggggaccaaatggattcaataa

SEQ ID NO: 122828 - DNA, 25 bp, Artificial sequence
  SiRNA target sequence
taggggaccaaatggattcaataat

SEQ ID NO: 122829 - DNA, 25 bp, Artificial sequence
  SiRNA target sequence
aggggaccaaatggattcaataatg

SEQ ID NO: 122830 - DNA, 25 bp, Artificial sequence
  SiRNA target sequence
ggggaccaaatggattcaataatgg

SEQ ID NO: 122831 - DNA, 25 bp, Artificial sequence
  SiRNA target sequence
gggaccaaatggattcaataatggg

SEQ ID NO: 122832 - DNA, 25 bp, Artificial sequence
  SiRNA target sequence
ggaccaaatggattcaataatgggt

SEQ ID NO: 122833 - DNA, 25 bp, Artificial sequence
  SiRNA target sequence
gaccaaatggattcaataatgggta

SEQ ID NO: 122834 - DNA, 25 bp, Artificial sequence
  SiRNA target sequence
accaaatggattcaataatgggtac

SEQ ID NO: 122835 - DNA, 25 bp, Artificial sequence
  SiRNA target sequence
ccaaatggattcaataatgggtacg

SEQ ID NO: 122836 - DNA, 25 bp, Artificial sequence
  SiRNA target sequence
caaatggattcaataatgggtacgc

SEQ ID NO: 122837 - DNA, 25 bp, Artificial sequence
  SiRNA target sequence
aaatggattcaataatgggtacgct

SEQ ID NO: 122838 - DNA, 25 bp, Artificial sequence
  SiRNA target sequence
aatggattcaataatgggtacgctg

SEQ ID NO: 122839 - DNA, 25 bp, Artificial sequence
  SiRNA target sequence
atggattcaataatgggtacgctgc

SEQ ID NO: 122840 - DNA, 25 bp, Artificial sequence
  SiRNA target sequence
tggattcaataatgggtacgctgca

SEQ ID NO: 122841 - DNA, 25 bp, Artificial sequence
  SiRNA target sequence
ggattcaataatgggtacgctgcac

SEQ ID NO: 122842 - DNA, 25 bp, Artificial sequence
  SiRNA target sequence
gattcaataatgggtacgctgcaca

SEQ ID NO: 122843 - DNA, 25 bp, Artificial sequence
  SiRNA target sequence
attcaataatgggtacgctgcacag

SEQ ID NO: 122844 - DNA, 25 bp, Artificial sequence
  SiRNA target sequence
ttcaataatgggtacgctgcacagc

SEQ ID NO: 122845 - DNA, 25 bp, Artificial sequence
  SiRNA target sequence
tcaataatgggtacgctgcacagca

SEQ ID NO: 122846 - DNA, 25 bp, Artificial sequence
  SiRNA target sequence
caataatgggtacgctgcacagcac

SEQ ID NO: 122847 - DNA, 25 bp, Artificial sequence
  SiRNA target sequence
aataatgggtacgctgcacagcaca

SEQ ID NO: 122848 - DNA, 25 bp, Artificial sequence
  SiRNA target sequence
ataatgggtacgctgcacagcacac

SEQ ID NO: 122849 - DNA, 25 bp, Artificial sequence
  SiRNA target sequence
taatgggtacgctgcacagcacaca

SEQ ID NO: 122850 - DNA, 25 bp, Artificial sequence
  SiRNA target sequence
aatgggtacgctgcacagcacacac

SEQ ID NO: 122851 - DNA, 25 bp, Artificial sequence
  SiRNA target sequence
atgggtacgctgcacagcacacaca

SEQ ID NO: 122852 - DNA, 25 bp, Artificial sequence
  SiRNA target sequence
tgggtacgctgcacagcacacacaa

SEQ ID NO: 122853 - DNA, 25 bp, Artificial sequence
  SiRNA target sequence
gggtacgctgcacagcacacacaag

SEQ ID NO: 122854 - DNA, 25 bp, Artificial sequence
  SiRNA target sequence
ggtacgctgcacagcacacacaaga

SEQ ID NO: 122855 - DNA, 25 bp, Artificial sequence
  SiRNA target sequence
gtacgctgcacagcacacacaagat

SEQ ID NO: 122856 - DNA, 25 bp, Artificial sequence
  SiRNA target sequence
tacgctgcacagcacacacaagatt

SEQ ID NO: 122857 - DNA, 25 bp, Artificial sequence
  SiRNA target sequence
acgctgcacagcacacacaagattt

SEQ ID NO: 122858 - DNA, 25 bp, Artificial sequence
  SiRNA target sequence
cgctgcacagcacacacaagatttt

SEQ ID NO: 122859 - DNA, 25 bp, Artificial sequence
  SiRNA target sequence
gctgcacagcacacacaagattttg

SEQ ID NO: 122860 - DNA, 25 bp, Artificial sequence
  SiRNA target sequence
ctgcacagcacacacaagattttgc

SEQ ID NO: 122861 - DNA, 25 bp, Artificial sequence
  SiRNA target sequence
tgcacagcacacacaagattttgca

SEQ ID NO: 122862 - DNA, 25 bp, Artificial sequence
  SiRNA target sequence
gcacagcacacacaagattttgcac

SEQ ID NO: 122863 - DNA, 25 bp, Artificial sequence
  SiRNA target sequence
cacagcacacacaagattttgcacc

SEQ ID NO: 122864 - DNA, 25 bp, Artificial sequence
  SiRNA target sequence
acagcacacacaagattttgcacca

SEQ ID NO: 122865 - DNA, 25 bp, Artificial sequence
  SiRNA target sequence
cagcacacacaagattttgcaccaa

SEQ ID NO: 122866 - DNA, 25 bp, Artificial sequence
  SiRNA target sequence
agcacacacaagattttgcaccaat

SEQ ID NO: 122867 - DNA, 25 bp, Artificial sequence
  SiRNA target sequence
gcacacacaagattttgcaccaata

SEQ ID NO: 122868 - DNA, 25 bp, Artificial sequence
  SiRNA target sequence
cacacacaagattttgcaccaatat

SEQ ID NO: 122869 - DNA, 25 bp, Artificial sequence
  SiRNA target sequence
acacacaagattttgcaccaatata

SEQ ID NO: 122870 - DNA, 25 bp, Artificial sequence
  SiRNA target sequence
cacacaagattttgcaccaatatat

SEQ ID NO: 122871 - DNA, 25 bp, Artificial sequence
  SiRNA target sequence
acacaagattttgcaccaatatatg

SEQ ID NO: 122872 - DNA, 25 bp, Artificial sequence
  SiRNA target sequence
cacaagattttgcaccaatatatgg

SEQ ID NO: 122873 - DNA, 25 bp, Artificial sequence
  SiRNA target sequence
acaagattttgcaccaatatatggt

SEQ ID NO: 122874 - DNA, 25 bp, Artificial sequence
  SiRNA target sequence
caagattttgcaccaatatatggtt

SEQ ID NO: 122875 - DNA, 25 bp, Artificial sequence
  SiRNA target sequence
aagattttgcaccaatatatggttc

SEQ ID NO: 122876 - DNA, 25 bp, Artificial sequence
  SiRNA target sequence
agattttgcaccaatatatggttct

SEQ ID NO: 122877 - DNA, 25 bp, Artificial sequence
  SiRNA target sequence
gattttgcaccaatatatggttcta

SEQ ID NO: 122878 - DNA, 25 bp, Artificial sequence
  SiRNA target sequence
attttgcaccaatatatggttctat

SEQ ID NO: 122879 - DNA, 25 bp, Artificial sequence
  SiRNA target sequence
ttttgcaccaatatatggttctatt

SEQ ID NO: 122880 - DNA, 25 bp, Artificial sequence
  SiRNA target sequence
tttgcaccaatatatggttctattc

SEQ ID NO: 122881 - DNA, 25 bp, Artificial sequence
  SiRNA target sequence
ttgcaccaatatatggttctattcc

SEQ ID NO: 122882 - DNA, 25 bp, Artificial sequence
  SiRNA target sequence
tgcaccaatatatggttctattcca

SEQ ID NO: 122883 - DNA, 25 bp, Artificial sequence
  SiRNA target sequence
gcaccaatatatggttctattccag

SEQ ID NO: 122884 - DNA, 25 bp, Artificial sequence
  SiRNA target sequence
caccaatatatggttctattccagg

SEQ ID NO: 122885 - DNA, 25 bp, Artificial sequence
  SiRNA target sequence
accaatatatggttctattccaggc

SEQ ID NO: 122886 - DNA, 25 bp, Artificial sequence
  SiRNA target sequence
ccaatatatggttctattccaggcc

SEQ ID NO: 122887 - DNA, 25 bp, Artificial sequence
  SiRNA target sequence
caatatatggttctattccaggcct

SEQ ID NO: 122888 - DNA, 25 bp, Artificial sequence
  SiRNA target sequence
aatatatggttctattccaggcctt

SEQ ID NO: 122889 - DNA, 25 bp, Artificial sequence
  SiRNA target sequence
atatatggttctattccaggcctta

SEQ ID NO: 122890 - DNA, 25 bp, Artificial sequence
  SiRNA target sequence
tatatggttctattccaggccttaa

SEQ ID NO: 122891 - DNA, 25 bp, Artificial sequence
  SiRNA target sequence
atatggttctattccaggccttaag

SEQ ID NO: 122892 - DNA, 25 bp, Artificial sequence
  SiRNA target sequence
tatggttctattccaggccttaagg

SEQ ID NO: 122893 - DNA, 25 bp, Artificial sequence
  SiRNA target sequence
atggttctattccaggccttaaggt

SEQ ID NO: 122894 - DNA, 25 bp, Artificial sequence
  SiRNA target sequence
tggttctattccaggccttaaggtg

SEQ ID NO: 122895 - DNA, 25 bp, Artificial sequence
  SiRNA target sequence
ggttctattccaggccttaaggtgg

SEQ ID NO: 122896 - DNA, 25 bp, Artificial sequence
  SiRNA target sequence
gttctattccaggccttaaggtggt

SEQ ID NO: 122897 - DNA, 25 bp, Artificial sequence
  SiRNA target sequence
ttctattccaggccttaaggtggtt

SEQ ID NO: 122898 - DNA, 25 bp, Artificial sequence
  SiRNA target sequence
tctattccaggccttaaggtggttt

SEQ ID NO: 122899 - DNA, 25 bp, Artificial sequence
  SiRNA target sequence
ctattccaggccttaaggtggtttg

SEQ ID NO: 122900 - DNA, 25 bp, Artificial sequence
  SiRNA target sequence
tattccaggccttaaggtggtttgt

SEQ ID NO: 122901 - DNA, 25 bp, Artificial sequence
  SiRNA target sequence
attccaggccttaaggtggtttgtc

SEQ ID NO: 122902 - DNA, 25 bp, Artificial sequence
  SiRNA target sequence
ttccaggccttaaggtggtttgtcc

SEQ ID NO: 122903 - DNA, 25 bp, Artificial sequence
  SiRNA target sequence
tccaggccttaaggtggtttgtcct

SEQ ID NO: 122904 - DNA, 25 bp, Artificial sequence
  SiRNA target sequence
ccaggccttaaggtggtttgtcctt

SEQ ID NO: 122905 - DNA, 25 bp, Artificial sequence
  SiRNA target sequence
caggccttaaggtggtttgtcctta

SEQ ID NO: 122906 - DNA, 25 bp, Artificial sequence
  SiRNA target sequence
aggccttaaggtggtttgtccttat

SEQ ID NO: 122907 - DNA, 25 bp, Artificial sequence
  SiRNA target sequence
ggccttaaggtggtttgtccttata

SEQ ID NO: 122908 - DNA, 25 bp, Artificial sequence
  SiRNA target sequence
gccttaaggtggtttgtccttatac

SEQ ID NO: 122909 - DNA, 25 bp, Artificial sequence
  SiRNA target sequence
ccttaaggtggtttgtccttatacg

SEQ ID NO: 122910 - DNA, 25 bp, Artificial sequence
  SiRNA target sequence
cttaaggtggtttgtccttatacgg

SEQ ID NO: 122911 - DNA, 25 bp, Artificial sequence
  SiRNA target sequence
ttaaggtggtttgtccttatacggg

SEQ ID NO: 122912 - DNA, 25 bp, Artificial sequence
  SiRNA target sequence
taaggtggtttgtccttatacgggt

SEQ ID NO: 122913 - DNA, 25 bp, Artificial sequence
  SiRNA target sequence
aaggtggtttgtccttatacgggta

SEQ ID NO: 122914 - DNA, 25 bp, Artificial sequence
  SiRNA target sequence
aggtggtttgtccttatacgggtaa

SEQ ID NO: 122915 - DNA, 25 bp, Artificial sequence
  SiRNA target sequence
ggtggtttgtccttatacgggtaaa

SEQ ID NO: 122916 - DNA, 25 bp, Artificial sequence
  SiRNA target sequence
gtggtttgtccttatacgggtaaag

SEQ ID NO: 122917 - DNA, 25 bp, Artificial sequence
  SiRNA target sequence
tggtttgtccttatacgggtaaaga

SEQ ID NO: 122918 - DNA, 25 bp, Artificial sequence
  SiRNA target sequence
ggtttgtccttatacgggtaaagac

SEQ ID NO: 122919 - DNA, 25 bp, Artificial sequence
  SiRNA target sequence
gtttgtccttatacgggtaaagacc

SEQ ID NO: 122920 - DNA, 25 bp, Artificial sequence
  SiRNA target sequence
tttgtccttatacgggtaaagacca

SEQ ID NO: 122921 - DNA, 25 bp, Artificial sequence
  SiRNA target sequence
ttgtccttatacgggtaaagaccat

SEQ ID NO: 122922 - DNA, 25 bp, Artificial sequence
  SiRNA target sequence
tgtccttatacgggtaaagaccata

SEQ ID NO: 122923 - DNA, 25 bp, Artificial sequence
  SiRNA target sequence
gtccttatacgggtaaagaccataa

SEQ ID NO: 122924 - DNA, 25 bp, Artificial sequence
  SiRNA target sequence
tccttatacgggtaaagaccataaa

SEQ ID NO: 122925 - DNA, 25 bp, Artificial sequence
  SiRNA target sequence
ccttatacgggtaaagaccataaag

SEQ ID NO: 122926 - DNA, 25 bp, Artificial sequence
  SiRNA target sequence
cttatacgggtaaagaccataaagg

SEQ ID NO: 122927 - DNA, 25 bp, Artificial sequence
  SiRNA target sequence
ttatacgggtaaagaccataaagga

SEQ ID NO: 122928 - DNA, 25 bp, Artificial sequence
  SiRNA target sequence
tatacgggtaaagaccataaaggac

SEQ ID NO: 122929 - DNA, 25 bp, Artificial sequence
  SiRNA target sequence
atacgggtaaagaccataaaggact

SEQ ID NO: 122930 - DNA, 25 bp, Artificial sequence
  SiRNA target sequence
tacgggtaaagaccataaaggactt

SEQ ID NO: 122931 - DNA, 25 bp, Artificial sequence
  SiRNA target sequence
acgggtaaagaccataaaggacttt

SEQ ID NO: 122932 - DNA, 25 bp, Artificial sequence
  SiRNA target sequence
cgggtaaagaccataaaggactttt

SEQ ID NO: 122933 - DNA, 25 bp, Artificial sequence
  SiRNA target sequence
gggtaaagaccataaaggactttta

SEQ ID NO: 122934 - DNA, 25 bp, Artificial sequence
  SiRNA target sequence
ggtaaagaccataaaggacttttaa

SEQ ID NO: 122935 - DNA, 25 bp, Artificial sequence
  SiRNA target sequence
gtaaagaccataaaggacttttaaa

SEQ ID NO: 122936 - DNA, 25 bp, Artificial sequence
  SiRNA target sequence
taaagaccataaaggacttttaaaa

SEQ ID NO: 122937 - DNA, 25 bp, Artificial sequence
  SiRNA target sequence
aaagaccataaaggacttttaaaaa

SEQ ID NO: 122938 - DNA, 25 bp, Artificial sequence
  SiRNA target sequence
aagaccataaaggacttttaaaaag

SEQ ID NO: 122939 - DNA, 25 bp, Artificial sequence
  SiRNA target sequence
agaccataaaggacttttaaaaagc

SEQ ID NO: 122940 - DNA, 25 bp, Artificial sequence
  SiRNA target sequence
gaccataaaggacttttaaaaagcg

SEQ ID NO: 122941 - DNA, 25 bp, Artificial sequence
  SiRNA target sequence
accataaaggacttttaaaaagcgc

SEQ ID NO: 122942 - DNA, 25 bp, Artificial sequence
  SiRNA target sequence
ccataaaggacttttaaaaagcgct

SEQ ID NO: 122943 - DNA, 25 bp, Artificial sequence
  SiRNA target sequence
cataaaggacttttaaaaagcgcta

SEQ ID NO: 122944 - DNA, 25 bp, Artificial sequence
  SiRNA target sequence
ataaaggacttttaaaaagcgctat

SEQ ID NO: 122945 - DNA, 25 bp, Artificial sequence
  SiRNA target sequence
taaaggacttttaaaaagcgctatt

SEQ ID NO: 122946 - DNA, 25 bp, Artificial sequence
  SiRNA target sequence
aaaggacttttaaaaagcgctatta

SEQ ID NO: 122947 - DNA, 25 bp, Artificial sequence
  SiRNA target sequence
aaggacttttaaaaagcgctattag

SEQ ID NO: 122948 - DNA, 25 bp, Artificial sequence
  SiRNA target sequence
aggacttttaaaaagcgctattaga

SEQ ID NO: 122949 - DNA, 25 bp, Artificial sequence
  SiRNA target sequence
ggacttttaaaaagcgctattagag

SEQ ID NO: 122950 - DNA, 25 bp, Artificial sequence
  SiRNA target sequence
gacttttaaaaagcgctattagaga

SEQ ID NO: 122951 - DNA, 25 bp, Artificial sequence
  SiRNA target sequence
acttttaaaaagcgctattagagac

SEQ ID NO: 122952 - DNA, 25 bp, Artificial sequence
  SiRNA target sequence
cttttaaaaagcgctattagagaca

SEQ ID NO: 122953 - DNA, 25 bp, Artificial sequence
  SiRNA target sequence
ttttaaaaagcgctattagagacaa

SEQ ID NO: 122954 - DNA, 25 bp, Artificial sequence
  SiRNA target sequence
tttaaaaagcgctattagagacaat

SEQ ID NO: 122955 - DNA, 25 bp, Artificial sequence
  SiRNA target sequence
ttaaaaagcgctattagagacaata

SEQ ID NO: 122956 - DNA, 25 bp, Artificial sequence
  SiRNA target sequence
taaaaagcgctattagagacaataa

SEQ ID NO: 122957 - DNA, 25 bp, Artificial sequence
  SiRNA target sequence
aaaaagcgctattagagacaataac

SEQ ID NO: 122958 - DNA, 25 bp, Artificial sequence
  SiRNA target sequence
aaaagcgctattagagacaataacc

SEQ ID NO: 122959 - DNA, 25 bp, Artificial sequence
  SiRNA target sequence
aaagcgctattagagacaataaccc

SEQ ID NO: 122960 - DNA, 25 bp, Artificial sequence
  SiRNA target sequence
aagcgctattagagacaataacccg

SEQ ID NO: 122961 - DNA, 25 bp, Artificial sequence
  SiRNA target sequence
agcgctattagagacaataacccgg

SEQ ID NO: 122962 - DNA, 25 bp, Artificial sequence
  SiRNA target sequence
gcgctattagagacaataacccggt

SEQ ID NO: 122963 - DNA, 25 bp, Artificial sequence
  SiRNA target sequence
cgctattagagacaataacccggtt

SEQ ID NO: 122964 - DNA, 25 bp, Artificial sequence
  SiRNA target sequence
gctattagagacaataacccggtta

SEQ ID NO: 122965 - DNA, 25 bp, Artificial sequence
  SiRNA target sequence
ctattagagacaataacccggttat

SEQ ID NO: 122966 - DNA, 25 bp, Artificial sequence
  SiRNA target sequence
tattagagacaataacccggttata

SEQ ID NO: 122967 - DNA, 25 bp, Artificial sequence
  SiRNA target sequence
attagagacaataacccggttatat

SEQ ID NO: 122968 - DNA, 25 bp, Artificial sequence
  SiRNA target sequence
ttagagacaataacccggttatatt

SEQ ID NO: 122969 - DNA, 25 bp, Artificial sequence
  SiRNA target sequence
tagagacaataacccggttatattt

SEQ ID NO: 122970 - DNA, 25 bp, Artificial sequence
  SiRNA target sequence
agagacaataacccggttatatttc

SEQ ID NO: 122971 - DNA, 25 bp, Artificial sequence
  SiRNA target sequence
gagacaataacccggttatatttct

SEQ ID NO: 122972 - DNA, 25 bp, Artificial sequence
  SiRNA target sequence
agacaataacccggttatatttctt

SEQ ID NO: 122973 - DNA, 25 bp, Artificial sequence
  SiRNA target sequence
gacaataacccggttatatttcttg

SEQ ID NO: 122974 - DNA, 25 bp, Artificial sequence
  SiRNA target sequence
acaataacccggttatatttcttga

SEQ ID NO: 122975 - DNA, 25 bp, Artificial sequence
  SiRNA target sequence
caataacccggttatatttcttgag

SEQ ID NO: 122976 - DNA, 25 bp, Artificial sequence
  SiRNA target sequence
aataacccggttatatttcttgaga

SEQ ID NO: 122977 - DNA, 25 bp, Artificial sequence
  SiRNA target sequence
ataacccggttatatttcttgagaa

SEQ ID NO: 122978 - DNA, 25 bp, Artificial sequence
  SiRNA target sequence
taacccggttatatttcttgagaat

SEQ ID NO: 122979 - DNA, 25 bp, Artificial sequence
  SiRNA target sequence
aacccggttatatttcttgagaatg

SEQ ID NO: 122980 - DNA, 25 bp, Artificial sequence
  SiRNA target sequence
acccggttatatttcttgagaatga

SEQ ID NO: 122981 - DNA, 25 bp, Artificial sequence
  SiRNA target sequence
cccggttatatttcttgagaatgaa

SEQ ID NO: 122982 - DNA, 25 bp, Artificial sequence
  SiRNA target sequence
ccggttatatttcttgagaatgaaa

SEQ ID NO: 122983 - DNA, 25 bp, Artificial sequence
  SiRNA target sequence
cggttatatttcttgagaatgaaat

SEQ ID NO: 122984 - DNA, 25 bp, Artificial sequence
  SiRNA target sequence
ggttatatttcttgagaatgaaata

SEQ ID NO: 122985 - DNA, 25 bp, Artificial sequence
  SiRNA target sequence
gttatatttcttgagaatgaaatat

SEQ ID NO: 122986 - DNA, 25 bp, Artificial sequence
  SiRNA target sequence
ttatatttcttgagaatgaaatatt

SEQ ID NO: 122987 - DNA, 25 bp, Artificial sequence
  SiRNA target sequence
tatatttcttgagaatgaaatatta

SEQ ID NO: 122988 - DNA, 25 bp, Artificial sequence
  SiRNA target sequence
atatttcttgagaatgaaatattat

SEQ ID NO: 122989 - DNA, 25 bp, Artificial sequence
  SiRNA target sequence
tatttcttgagaatgaaatattata

SEQ ID NO: 122990 - DNA, 25 bp, Artificial sequence
  SiRNA target sequence
atttcttgagaatgaaatattatat

SEQ ID NO: 122991 - DNA, 25 bp, Artificial sequence
  SiRNA target sequence
tttcttgagaatgaaatattatata

SEQ ID NO: 122992 - DNA, 25 bp, Artificial sequence
  SiRNA target sequence
ttcttgagaatgaaatattatataa

SEQ ID NO: 122993 - DNA, 25 bp, Artificial sequence
  SiRNA target sequence
tcttgagaatgaaatattatataaa

SEQ ID NO: 122994 - DNA, 25 bp, Artificial sequence
  SiRNA target sequence
cttgagaatgaaatattatataaag

SEQ ID NO: 122995 - DNA, 25 bp, Artificial sequence
  SiRNA target sequence
ttgagaatgaaatattatataaaga

SEQ ID NO: 122996 - DNA, 25 bp, Artificial sequence
  SiRNA target sequence
tgagaatgaaatattatataaagat

SEQ ID NO: 122997 - DNA, 25 bp, Artificial sequence
  SiRNA target sequence
gagaatgaaatattatataaagata

SEQ ID NO: 122998 - DNA, 25 bp, Artificial sequence
  SiRNA target sequence
agaatgaaatattatataaagataa

SEQ ID NO: 122999 - DNA, 25 bp, Artificial sequence
  SiRNA target sequence
gaatgaaatattatataaagataaa

SEQ ID NO: 123000 - DNA, 25 bp, Artificial sequence
  SiRNA target sequence
aatgaaatattatataaagataaat

SEQ ID NO: 123001 - DNA, 25 bp, Artificial sequence
  SiRNA target sequence
atgaaatattatataaagataaata

SEQ ID NO: 123002 - DNA, 25 bp, Artificial sequence
  SiRNA target sequence
tgaaatattatataaagataaatac

SEQ ID NO: 123003 - DNA, 25 bp, Artificial sequence
  SiRNA target sequence
gaaatattatataaagataaatacc

SEQ ID NO: 123004 - DNA, 25 bp, Artificial sequence
  SiRNA target sequence
aaatattatataaagataaatacct

SEQ ID NO: 123005 - DNA, 25 bp, Artificial sequence
  SiRNA target sequence
aatattatataaagataaatacctt

SEQ ID NO: 123006 - DNA, 25 bp, Artificial sequence
  SiRNA target sequence
atattatataaagataaataccttg

SEQ ID NO: 123007 - DNA, 25 bp, Artificial sequence
  SiRNA target sequence
tattatataaagataaataccttga

SEQ ID NO: 123008 - DNA, 25 bp, Artificial sequence
  SiRNA target sequence
attatataaagataaataccttgaa

SEQ ID NO: 123009 - DNA, 25 bp, Artificial sequence
  SiRNA target sequence
ttatataaagataaataccttgaag

SEQ ID NO: 123010 - DNA, 25 bp, Artificial sequence
  SiRNA target sequence
tatataaagataaataccttgaagt

SEQ ID NO: 123011 - DNA, 25 bp, Artificial sequence
  SiRNA target sequence
atataaagataaataccttgaagtg

SEQ ID NO: 123012 - DNA, 25 bp, Artificial sequence
  SiRNA target sequence
tataaagataaataccttgaagtgt

SEQ ID NO: 123013 - DNA, 25 bp, Artificial sequence
  SiRNA target sequence
ataaagataaataccttgaagtgtc

SEQ ID NO: 123014 - DNA, 25 bp, Artificial sequence
  SiRNA target sequence
taaagataaataccttgaagtgtct

SEQ ID NO: 123015 - DNA, 25 bp, Artificial sequence
  SiRNA target sequence
aaagataaataccttgaagtgtcta

SEQ ID NO: 123016 - DNA, 25 bp, Artificial sequence
  SiRNA target sequence
aagataaataccttgaagtgtctaa

SEQ ID NO: 123017 - DNA, 25 bp, Artificial sequence
  SiRNA target sequence
agataaataccttgaagtgtctaat

SEQ ID NO: 123018 - DNA, 25 bp, Artificial sequence
  SiRNA target sequence
gataaataccttgaagtgtctaata

SEQ ID NO: 123019 - DNA, 25 bp, Artificial sequence
  SiRNA target sequence
ataaataccttgaagtgtctaataa

SEQ ID NO: 123020 - DNA, 25 bp, Artificial sequence
  SiRNA target sequence
taaataccttgaagtgtctaataat

SEQ ID NO: 123021 - DNA, 25 bp, Artificial sequence
  SiRNA target sequence
aaataccttgaagtgtctaataatt

SEQ ID NO: 123022 - DNA, 25 bp, Artificial sequence
  SiRNA target sequence
aataccttgaagtgtctaataatta

SEQ ID NO: 123023 - DNA, 25 bp, Artificial sequence
  SiRNA target sequence
ataccttgaagtgtctaataattat

SEQ ID NO: 123024 - DNA, 25 bp, Artificial sequence
  SiRNA target sequence
taccttgaagtgtctaataattata

SEQ ID NO: 123025 - DNA, 25 bp, Artificial sequence
  SiRNA target sequence
accttgaagtgtctaataattatat

SEQ ID NO: 123026 - DNA, 25 bp, Artificial sequence
  SiRNA target sequence
ccttgaagtgtctaataattatatt

SEQ ID NO: 123027 - DNA, 25 bp, Artificial sequence
  SiRNA target sequence
cttgaagtgtctaataattatattc

SEQ ID NO: 123028 - DNA, 25 bp, Artificial sequence
  SiRNA target sequence
ttgaagtgtctaataattatattca

SEQ ID NO: 123029 - DNA, 25 bp, Artificial sequence
  SiRNA target sequence
tgaagtgtctaataattatattcaa

SEQ ID NO: 123030 - DNA, 25 bp, Artificial sequence
  SiRNA target sequence
gaagtgtctaataattatattcaac

SEQ ID NO: 123031 - DNA, 25 bp, Artificial sequence
  SiRNA target sequence
aagtgtctaataattatattcaacc

SEQ ID NO: 123032 - DNA, 25 bp, Artificial sequence
  SiRNA target sequence
agtgtctaataattatattcaacca

SEQ ID NO: 123033 - DNA, 25 bp, Artificial sequence
  SiRNA target sequence
gtgtctaataattatattcaaccac

SEQ ID NO: 123034 - DNA, 25 bp, Artificial sequence
  SiRNA target sequence
tgtctaataattatattcaaccact

SEQ ID NO: 123035 - DNA, 25 bp, Artificial sequence
  SiRNA target sequence
gtctaataattatattcaaccactt

SEQ ID NO: 123036 - DNA, 25 bp, Artificial sequence
  SiRNA target sequence
tctaataattatattcaaccacttg

SEQ ID NO: 123037 - DNA, 25 bp, Artificial sequence
  SiRNA target sequence
ctaataattatattcaaccacttga

SEQ ID NO: 123038 - DNA, 25 bp, Artificial sequence
  SiRNA target sequence
taataattatattcaaccacttgac

SEQ ID NO: 123039 - DNA, 25 bp, Artificial sequence
  SiRNA target sequence
aataattatattcaaccacttgaca

SEQ ID NO: 123040 - DNA, 25 bp, Artificial sequence
  SiRNA target sequence
ataattatattcaaccacttgacaa

SEQ ID NO: 123041 - DNA, 25 bp, Artificial sequence
  SiRNA target sequence
taattatattcaaccacttgacaag

SEQ ID NO: 123042 - DNA, 25 bp, Artificial sequence
  SiRNA target sequence
aattatattcaaccacttgacaagg

SEQ ID NO: 123043 - DNA, 25 bp, Artificial sequence
  SiRNA target sequence
attatattcaaccacttgacaaggc

SEQ ID NO: 123044 - DNA, 25 bp, Artificial sequence
  SiRNA target sequence
ttatattcaaccacttgacaaggca

SEQ ID NO: 123045 - DNA, 25 bp, Artificial sequence
  SiRNA target sequence
tatattcaaccacttgacaaggcag

SEQ ID NO: 123046 - DNA, 25 bp, Artificial sequence
  SiRNA target sequence
atattcaaccacttgacaaggcagt

SEQ ID NO: 123047 - DNA, 25 bp, Artificial sequence
  SiRNA target sequence
tattcaaccacttgacaaggcagta

SEQ ID NO: 123048 - DNA, 25 bp, Artificial sequence
  SiRNA target sequence
attcaaccacttgacaaggcagtaa

SEQ ID NO: 123049 - DNA, 25 bp, Artificial sequence
  SiRNA target sequence
ttcaaccacttgacaaggcagtaat

SEQ ID NO: 123050 - DNA, 25 bp, Artificial sequence
  SiRNA target sequence
tcaaccacttgacaaggcagtaatt

SEQ ID NO: 123051 - DNA, 25 bp, Artificial sequence
  SiRNA target sequence
caaccacttgacaaggcagtaattg

SEQ ID NO: 123052 - DNA, 25 bp, Artificial sequence
  SiRNA target sequence
aaccacttgacaaggcagtaattga

SEQ ID NO: 123053 - DNA, 25 bp, Artificial sequence
  SiRNA target sequence
accacttgacaaggcagtaattgaa

SEQ ID NO: 123054 - DNA, 25 bp, Artificial sequence
  SiRNA target sequence
ccacttgacaaggcagtaattgaaa

SEQ ID NO: 123055 - DNA, 25 bp, Artificial sequence
  SiRNA target sequence
cacttgacaaggcagtaattgaaaa

SEQ ID NO: 123056 - DNA, 25 bp, Artificial sequence
  SiRNA target sequence
acttgacaaggcagtaattgaaaaa

SEQ ID NO: 123057 - DNA, 25 bp, Artificial sequence
  SiRNA target sequence
cttgacaaggcagtaattgaaaaaa

SEQ ID NO: 123058 - DNA, 25 bp, Artificial sequence
  SiRNA target sequence
ttgacaaggcagtaattgaaaaaaa

SEQ ID NO: 123059 - DNA, 25 bp, Artificial sequence
  SiRNA target sequence
tgacaaggcagtaattgaaaaaaat

SEQ ID NO: 123060 - DNA, 25 bp, Artificial sequence
  SiRNA target sequence
gacaaggcagtaattgaaaaaaatg

SEQ ID NO: 123061 - DNA, 25 bp, Artificial sequence
  SiRNA target sequence
acaaggcagtaattgaaaaaaatgg

SEQ ID NO: 123062 - DNA, 25 bp, Artificial sequence
  SiRNA target sequence
caaggcagtaattgaaaaaaatggt

SEQ ID NO: 123063 - DNA, 25 bp, Artificial sequence
  SiRNA target sequence
aaggcagtaattgaaaaaaatggtg

SEQ ID NO: 123064 - DNA, 25 bp, Artificial sequence
  SiRNA target sequence
aggcagtaattgaaaaaaatggtgt

SEQ ID NO: 123065 - DNA, 25 bp, Artificial sequence
  SiRNA target sequence
ggcagtaattgaaaaaaatggtgtt

SEQ ID NO: 123066 - DNA, 25 bp, Artificial sequence
  SiRNA target sequence
gcagtaattgaaaaaaatggtgttg

SEQ ID NO: 123067 - DNA, 25 bp, Artificial sequence
  SiRNA target sequence
cagtaattgaaaaaaatggtgttga

SEQ ID NO: 123068 - DNA, 25 bp, Artificial sequence
  SiRNA target sequence
agtaattgaaaaaaatggtgttgac

SEQ ID NO: 123069 - DNA, 25 bp, Artificial sequence
  SiRNA target sequence
gtaattgaaaaaaatggtgttgacg

SEQ ID NO: 123070 - DNA, 25 bp, Artificial sequence
  SiRNA target sequence
taattgaaaaaaatggtgttgacgt

SEQ ID NO: 123071 - DNA, 25 bp, Artificial sequence
  SiRNA target sequence
aattgaaaaaaatggtgttgacgtt

SEQ ID NO: 123072 - DNA, 25 bp, Artificial sequence
  SiRNA target sequence
attgaaaaaaatggtgttgacgtta

SEQ ID NO: 123073 - DNA, 25 bp, Artificial sequence
  SiRNA target sequence
ttgaaaaaaatggtgttgacgttac

SEQ ID NO: 123074 - DNA, 25 bp, Artificial sequence
  SiRNA target sequence
tgaaaaaaatggtgttgacgttaca

SEQ ID NO: 123075 - DNA, 25 bp, Artificial sequence
  SiRNA target sequence
gaaaaaaatggtgttgacgttacag

SEQ ID NO: 123076 - DNA, 25 bp, Artificial sequence
  SiRNA target sequence
aaaaaaatggtgttgacgttacagt

SEQ ID NO: 123077 - DNA, 25 bp, Artificial sequence
  SiRNA target sequence
aaaaaatggtgttgacgttacagtt

SEQ ID NO: 123078 - DNA, 25 bp, Artificial sequence
  SiRNA target sequence
aaaaatggtgttgacgttacagttt

SEQ ID NO: 123079 - DNA, 25 bp, Artificial sequence
  SiRNA target sequence
aaaatggtgttgacgttacagtttt

SEQ ID NO: 123080 - DNA, 25 bp, Artificial sequence
  SiRNA target sequence
aaatggtgttgacgttacagtttta

SEQ ID NO: 123081 - DNA, 25 bp, Artificial sequence
  SiRNA target sequence
aatggtgttgacgttacagttttag

SEQ ID NO: 123082 - DNA, 25 bp, Artificial sequence
  SiRNA target sequence
atggtgttgacgttacagttttagg

SEQ ID NO: 123083 - DNA, 25 bp, Artificial sequence
  SiRNA target sequence
tggtgttgacgttacagttttagga

SEQ ID NO: 123084 - DNA, 25 bp, Artificial sequence
  SiRNA target sequence
ggtgttgacgttacagttttaggaa

SEQ ID NO: 123085 - DNA, 25 bp, Artificial sequence
  SiRNA target sequence
gtgttgacgttacagttttaggaat

SEQ ID NO: 123086 - DNA, 25 bp, Artificial sequence
  SiRNA target sequence
tgttgacgttacagttttaggaata

SEQ ID NO: 123087 - DNA, 25 bp, Artificial sequence
  SiRNA target sequence
gttgacgttacagttttaggaatat

SEQ ID NO: 123088 - DNA, 25 bp, Artificial sequence
  SiRNA target sequence
ttgacgttacagttttaggaatatc

SEQ ID NO: 123089 - DNA, 25 bp, Artificial sequence
  SiRNA target sequence
tgacgttacagttttaggaatatca

SEQ ID NO: 123090 - DNA, 25 bp, Artificial sequence
  SiRNA target sequence
gacgttacagttttaggaatatcaa

SEQ ID NO: 123091 - DNA, 25 bp, Artificial sequence
  SiRNA target sequence
acgttacagttttaggaatatcaat

SEQ ID NO: 123092 - DNA, 25 bp, Artificial sequence
  SiRNA target sequence
cgttacagttttaggaatatcaata

SEQ ID NO: 123093 - DNA, 25 bp, Artificial sequence
  SiRNA target sequence
gttacagttttaggaatatcaataa

SEQ ID NO: 123094 - DNA, 25 bp, Artificial sequence
  SiRNA target sequence
ttacagttttaggaatatcaataag

SEQ ID NO: 123095 - DNA, 25 bp, Artificial sequence
  SiRNA target sequence
tacagttttaggaatatcaataagt

SEQ ID NO: 123096 - DNA, 25 bp, Artificial sequence
  SiRNA target sequence
acagttttaggaatatcaataagtc

SEQ ID NO: 123097 - DNA, 25 bp, Artificial sequence
  SiRNA target sequence
cagttttaggaatatcaataagtct

SEQ ID NO: 123098 - DNA, 25 bp, Artificial sequence
  SiRNA target sequence
agttttaggaatatcaataagtctt

SEQ ID NO: 123099 - DNA, 25 bp, Artificial sequence
  SiRNA target sequence
gttttaggaatatcaataagtctta

SEQ ID NO: 123100 - DNA, 25 bp, Artificial sequence
  SiRNA target sequence
ttttaggaatatcaataagtcttaa

SEQ ID NO: 123101 - DNA, 25 bp, Artificial sequence
  SiRNA target sequence
tttaggaatatcaataagtcttaaa

SEQ ID NO: 123102 - DNA, 25 bp, Artificial sequence
  SiRNA target sequence
ttaggaatatcaataagtcttaaag

SEQ ID NO: 123103 - DNA, 25 bp, Artificial sequence
  SiRNA target sequence
taggaatatcaataagtcttaaaga

SEQ ID NO: 123104 - DNA, 25 bp, Artificial sequence
  SiRNA target sequence
aggaatatcaataagtcttaaagaa

SEQ ID NO: 123105 - DNA, 25 bp, Artificial sequence
  SiRNA target sequence
ggaatatcaataagtcttaaagaaa

SEQ ID NO: 123106 - DNA, 25 bp, Artificial sequence
  SiRNA target sequence
gaatatcaataagtcttaaagaaat

SEQ ID NO: 123107 - DNA, 25 bp, Artificial sequence
  SiRNA target sequence
aatatcaataagtcttaaagaaatt

SEQ ID NO: 123108 - DNA, 25 bp, Artificial sequence
  SiRNA target sequence
atatcaataagtcttaaagaaattt

SEQ ID NO: 123109 - DNA, 25 bp, Artificial sequence
  SiRNA target sequence
tatcaataagtcttaaagaaatttt

SEQ ID NO: 123110 - DNA, 25 bp, Artificial sequence
  SiRNA target sequence
atcaataagtcttaaagaaattttt

SEQ ID NO: 123111 - DNA, 25 bp, Artificial sequence
  SiRNA target sequence
tcaataagtcttaaagaaattttta

SEQ ID NO: 123112 - DNA, 25 bp, Artificial sequence
  SiRNA target sequence
caataagtcttaaagaaatttttaa

SEQ ID NO: 123113 - DNA, 25 bp, Artificial sequence
  SiRNA target sequence
aataagtcttaaagaaatttttaaa

SEQ ID NO: 123114 - DNA, 25 bp, Artificial sequence
  SiRNA target sequence
ataagtcttaaagaaatttttaaag

SEQ ID NO: 123115 - DNA, 25 bp, Artificial sequence
  SiRNA target sequence
taagtcttaaagaaatttttaaagc

SEQ ID NO: 123116 - DNA, 25 bp, Artificial sequence
  SiRNA target sequence
aagtcttaaagaaatttttaaagca

SEQ ID NO: 123117 - DNA, 25 bp, Artificial sequence
  SiRNA target sequence
agtcttaaagaaatttttaaagcag

SEQ ID NO: 123118 - DNA, 25 bp, Artificial sequence
  SiRNA target sequence
gtcttaaagaaatttttaaagcaga

SEQ ID NO: 123119 - DNA, 25 bp, Artificial sequence
  SiRNA target sequence
tcttaaagaaatttttaaagcagac

SEQ ID NO: 123120 - DNA, 25 bp, Artificial sequence
  SiRNA target sequence
cttaaagaaatttttaaagcagaca

SEQ ID NO: 123121 - DNA, 25 bp, Artificial sequence
  SiRNA target sequence
ttaaagaaatttttaaagcagacag

SEQ ID NO: 123122 - DNA, 25 bp, Artificial sequence
  SiRNA target sequence
taaagaaatttttaaagcagacagt

SEQ ID NO: 123123 - DNA, 25 bp, Artificial sequence
  SiRNA target sequence
aaagaaatttttaaagcagacagtt

SEQ ID NO: 123124 - DNA, 25 bp, Artificial sequence
  SiRNA target sequence
aagaaatttttaaagcagacagttt

SEQ ID NO: 123125 - DNA, 25 bp, Artificial sequence
  SiRNA target sequence
agaaatttttaaagcagacagtttg

SEQ ID NO: 123126 - DNA, 25 bp, Artificial sequence
  SiRNA target sequence
gaaatttttaaagcagacagtttgt

SEQ ID NO: 123127 - DNA, 25 bp, Artificial sequence
  SiRNA target sequence
aaatttttaaagcagacagtttgtt

SEQ ID NO: 123128 - DNA, 25 bp, Artificial sequence
  SiRNA target sequence
aatttttaaagcagacagtttgtta

SEQ ID NO: 123129 - DNA, 25 bp, Artificial sequence
  SiRNA target sequence
atttttaaagcagacagtttgttag

SEQ ID NO: 123130 - DNA, 25 bp, Artificial sequence
  SiRNA target sequence
tttttaaagcagacagtttgttaga

SEQ ID NO: 123131 - DNA, 25 bp, Artificial sequence
  SiRNA target sequence
ttttaaagcagacagtttgttagag

SEQ ID NO: 123132 - DNA, 25 bp, Artificial sequence
  SiRNA target sequence
tttaaagcagacagtttgttagaga

SEQ ID NO: 123133 - DNA, 25 bp, Artificial sequence
  SiRNA target sequence
ttaaagcagacagtttgttagagaa

SEQ ID NO: 123134 - DNA, 25 bp, Artificial sequence
  SiRNA target sequence
taaagcagacagtttgttagagaaa

SEQ ID NO: 123135 - DNA, 25 bp, Artificial sequence
  SiRNA target sequence
aaagcagacagtttgttagagaaaa

SEQ ID NO: 123136 - DNA, 25 bp, Artificial sequence
  SiRNA target sequence
aagcagacagtttgttagagaaaaa

SEQ ID NO: 123137 - DNA, 25 bp, Artificial sequence
  SiRNA target sequence
agcagacagtttgttagagaaaaaa

SEQ ID NO: 123138 - DNA, 25 bp, Artificial sequence
  SiRNA target sequence
gcagacagtttgttagagaaaaaaa

SEQ ID NO: 123139 - DNA, 25 bp, Artificial sequence
  SiRNA target sequence
cagacagtttgttagagaaaaaaaa

SEQ ID NO: 123140 - DNA, 25 bp, Artificial sequence
  SiRNA target sequence
agacagtttgttagagaaaaaaaat

SEQ ID NO: 123141 - DNA, 25 bp, Artificial sequence
  SiRNA target sequence
gacagtttgttagagaaaaaaaata

SEQ ID NO: 123142 - DNA, 25 bp, Artificial sequence
  SiRNA target sequence
acagtttgttagagaaaaaaaatat

SEQ ID NO: 123143 - DNA, 25 bp, Artificial sequence
  SiRNA target sequence
cagtttgttagagaaaaaaaatatc

SEQ ID NO: 123144 - DNA, 25 bp, Artificial sequence
  SiRNA target sequence
agtttgttagagaaaaaaaatatcg

SEQ ID NO: 123145 - DNA, 25 bp, Artificial sequence
  SiRNA target sequence
gtttgttagagaaaaaaaatatcga

SEQ ID NO: 123146 - DNA, 25 bp, Artificial sequence
  SiRNA target sequence
tttgttagagaaaaaaaatatcgac

SEQ ID NO: 123147 - DNA, 25 bp, Artificial sequence
  SiRNA target sequence
ttgttagagaaaaaaaatatcgaca

SEQ ID NO: 123148 - DNA, 25 bp, Artificial sequence
  SiRNA target sequence
tgttagagaaaaaaaatatcgacat

SEQ ID NO: 123149 - DNA, 25 bp, Artificial sequence
  SiRNA target sequence
gttagagaaaaaaaatatcgacatt

SEQ ID NO: 123150 - DNA, 25 bp, Artificial sequence
  SiRNA target sequence
ttagagaaaaaaaatatcgacattg

SEQ ID NO: 123151 - DNA, 25 bp, Artificial sequence
  SiRNA target sequence
tagagaaaaaaaatatcgacattga

SEQ ID NO: 123152 - DNA, 25 bp, Artificial sequence
  SiRNA target sequence
agagaaaaaaaatatcgacattgag

SEQ ID NO: 123153 - DNA, 25 bp, Artificial sequence
  SiRNA target sequence
gagaaaaaaaatatcgacattgaga

SEQ ID NO: 123154 - DNA, 25 bp, Artificial sequence
  SiRNA target sequence
agaaaaaaaatatcgacattgagat

SEQ ID NO: 123155 - DNA, 25 bp, Artificial sequence
  SiRNA target sequence
gaaaaaaaatatcgacattgagata

SEQ ID NO: 123156 - DNA, 25 bp, Artificial sequence
  SiRNA target sequence
aaaaaaaatatcgacattgagataa

SEQ ID NO: 123157 - DNA, 25 bp, Artificial sequence
  SiRNA target sequence
aaaaaaatatcgacattgagataat

SEQ ID NO: 123158 - DNA, 25 bp, Artificial sequence
  SiRNA target sequence
aaaaaatatcgacattgagataatt

SEQ ID NO: 123159 - DNA, 25 bp, Artificial sequence
  SiRNA target sequence
aaaaatatcgacattgagataatta

SEQ ID NO: 123160 - DNA, 25 bp, Artificial sequence
  SiRNA target sequence
aaaatatcgacattgagataattaa

SEQ ID NO: 123161 - DNA, 25 bp, Artificial sequence
  SiRNA target sequence
aaatatcgacattgagataattaat

SEQ ID NO: 123162 - DNA, 25 bp, Artificial sequence
  SiRNA target sequence
aatatcgacattgagataattaatc

SEQ ID NO: 123163 - DNA, 25 bp, Artificial sequence
  SiRNA target sequence
atatcgacattgagataattaatct

SEQ ID NO: 123164 - DNA, 25 bp, Artificial sequence
  SiRNA target sequence
tatcgacattgagataattaatctt

SEQ ID NO: 123165 - DNA, 25 bp, Artificial sequence
  SiRNA target sequence
atcgacattgagataattaatcttg

SEQ ID NO: 123166 - DNA, 25 bp, Artificial sequence
  SiRNA target sequence
tcgacattgagataattaatcttgt

SEQ ID NO: 123167 - DNA, 25 bp, Artificial sequence
  SiRNA target sequence
cgacattgagataattaatcttgtg

SEQ ID NO: 123168 - DNA, 25 bp, Artificial sequence
  SiRNA target sequence
gacattgagataattaatcttgtgt

SEQ ID NO: 123169 - DNA, 25 bp, Artificial sequence
  SiRNA target sequence
acattgagataattaatcttgtgtc

SEQ ID NO: 123170 - DNA, 25 bp, Artificial sequence
  SiRNA target sequence
cattgagataattaatcttgtgtca

SEQ ID NO: 123171 - DNA, 25 bp, Artificial sequence
  SiRNA target sequence
attgagataattaatcttgtgtcaa

SEQ ID NO: 123172 - DNA, 25 bp, Artificial sequence
  SiRNA target sequence
ttgagataattaatcttgtgtcaat

SEQ ID NO: 123173 - DNA, 25 bp, Artificial sequence
  SiRNA target sequence
tgagataattaatcttgtgtcaata

SEQ ID NO: 123174 - DNA, 25 bp, Artificial sequence
  SiRNA target sequence
gagataattaatcttgtgtcaataa

SEQ ID NO: 123175 - DNA, 25 bp, Artificial sequence
  SiRNA target sequence
agataattaatcttgtgtcaataaa

SEQ ID NO: 123176 - DNA, 25 bp, Artificial sequence
  SiRNA target sequence
gataattaatcttgtgtcaataaaa

SEQ ID NO: 123177 - DNA, 25 bp, Artificial sequence
  SiRNA target sequence
ataattaatcttgtgtcaataaaac

SEQ ID NO: 123178 - DNA, 25 bp, Artificial sequence
  SiRNA target sequence
taattaatcttgtgtcaataaaacc

SEQ ID NO: 123179 - DNA, 25 bp, Artificial sequence
  SiRNA target sequence
aattaatcttgtgtcaataaaacca

SEQ ID NO: 123180 - DNA, 25 bp, Artificial sequence
  SiRNA target sequence
attaatcttgtgtcaataaaaccaa

SEQ ID NO: 123181 - DNA, 25 bp, Artificial sequence
  SiRNA target sequence
ttaatcttgtgtcaataaaaccaat

SEQ ID NO: 123182 - DNA, 25 bp, Artificial sequence
  SiRNA target sequence
taatcttgtgtcaataaaaccaatt

SEQ ID NO: 123183 - DNA, 25 bp, Artificial sequence
  SiRNA target sequence
aatcttgtgtcaataaaaccaattg

SEQ ID NO: 123184 - DNA, 25 bp, Artificial sequence
  SiRNA target sequence
atcttgtgtcaataaaaccaattga

SEQ ID NO: 123185 - DNA, 25 bp, Artificial sequence
  SiRNA target sequence
tcttgtgtcaataaaaccaattgat

SEQ ID NO: 123186 - DNA, 25 bp, Artificial sequence
  SiRNA target sequence
cttgtgtcaataaaaccaattgatt

SEQ ID NO: 123187 - DNA, 25 bp, Artificial sequence
  SiRNA target sequence
ttgtgtcaataaaaccaattgatta

SEQ ID NO: 123188 - DNA, 25 bp, Artificial sequence
  SiRNA target sequence
tgtgtcaataaaaccaattgattat

SEQ ID NO: 123189 - DNA, 25 bp, Artificial sequence
  SiRNA target sequence
gtgtcaataaaaccaattgattatg

SEQ ID NO: 123190 - DNA, 25 bp, Artificial sequence
  SiRNA target sequence
tgtcaataaaaccaattgattatgt

SEQ ID NO: 123191 - DNA, 25 bp, Artificial sequence
  SiRNA target sequence
gtcaataaaaccaattgattatgtt

SEQ ID NO: 123192 - DNA, 25 bp, Artificial sequence
  SiRNA target sequence
tcaataaaaccaattgattatgtta

SEQ ID NO: 123193 - DNA, 25 bp, Artificial sequence
  SiRNA target sequence
caataaaaccaattgattatgttac

SEQ ID NO: 123194 - DNA, 25 bp, Artificial sequence
  SiRNA target sequence
aataaaaccaattgattatgttact

SEQ ID NO: 123195 - DNA, 25 bp, Artificial sequence
  SiRNA target sequence
ataaaaccaattgattatgttacta

SEQ ID NO: 123196 - DNA, 25 bp, Artificial sequence
  SiRNA target sequence
taaaaccaattgattatgttactat

SEQ ID NO: 123197 - DNA, 25 bp, Artificial sequence
  SiRNA target sequence
aaaaccaattgattatgttactatt

SEQ ID NO: 123198 - DNA, 25 bp, Artificial sequence
  SiRNA target sequence
aaaccaattgattatgttactattg

SEQ ID NO: 123199 - DNA, 25 bp, Artificial sequence
  SiRNA target sequence
aaccaattgattatgttactattga

SEQ ID NO: 123200 - DNA, 25 bp, Artificial sequence
  SiRNA target sequence
accaattgattatgttactattgaa

SEQ ID NO: 123201 - DNA, 25 bp, Artificial sequence
  SiRNA target sequence
ccaattgattatgttactattgaaa

SEQ ID NO: 123202 - DNA, 25 bp, Artificial sequence
  SiRNA target sequence
caattgattatgttactattgaaat

SEQ ID NO: 123203 - DNA, 25 bp, Artificial sequence
  SiRNA target sequence
aattgattatgttactattgaaata

SEQ ID NO: 123204 - DNA, 25 bp, Artificial sequence
  SiRNA target sequence
attgattatgttactattgaaatat

SEQ ID NO: 123205 - DNA, 25 bp, Artificial sequence
  SiRNA target sequence
ttgattatgttactattgaaatatc

SEQ ID NO: 123206 - DNA, 25 bp, Artificial sequence
  SiRNA target sequence
tgattatgttactattgaaatatca

SEQ ID NO: 123207 - DNA, 25 bp, Artificial sequence
  SiRNA target sequence
gattatgttactattgaaatatcag

SEQ ID NO: 123208 - DNA, 25 bp, Artificial sequence
  SiRNA target sequence
attatgttactattgaaatatcagt

SEQ ID NO: 123209 - DNA, 25 bp, Artificial sequence
  SiRNA target sequence
ttatgttactattgaaatatcagtc

SEQ ID NO: 123210 - DNA, 25 bp, Artificial sequence
  SiRNA target sequence
tatgttactattgaaatatcagtca

SEQ ID NO: 123211 - DNA, 25 bp, Artificial sequence
  SiRNA target sequence
atgttactattgaaatatcagtcaa

SEQ ID NO: 123212 - DNA, 25 bp, Artificial sequence
  SiRNA target sequence
tgttactattgaaatatcagtcaaa

SEQ ID NO: 123213 - DNA, 25 bp, Artificial sequence
  SiRNA target sequence
gttactattgaaatatcagtcaaaa

SEQ ID NO: 123214 - DNA, 25 bp, Artificial sequence
  SiRNA target sequence
ttactattgaaatatcagtcaaaaa

SEQ ID NO: 123215 - DNA, 25 bp, Artificial sequence
  SiRNA target sequence
tactattgaaatatcagtcaaaaaa

SEQ ID NO: 123216 - DNA, 25 bp, Artificial sequence
  SiRNA target sequence
actattgaaatatcagtcaaaaaaa

SEQ ID NO: 123217 - DNA, 25 bp, Artificial sequence
  SiRNA target sequence
ctattgaaatatcagtcaaaaaaac

SEQ ID NO: 123218 - DNA, 25 bp, Artificial sequence
  SiRNA target sequence
tattgaaatatcagtcaaaaaaaca

SEQ ID NO: 123219 - DNA, 25 bp, Artificial sequence
  SiRNA target sequence
attgaaatatcagtcaaaaaaacac

SEQ ID NO: 123220 - DNA, 25 bp, Artificial sequence
  SiRNA target sequence
ttgaaatatcagtcaaaaaaacaca

SEQ ID NO: 123221 - DNA, 25 bp, Artificial sequence
  SiRNA target sequence
tgaaatatcagtcaaaaaaacacaa

SEQ ID NO: 123222 - DNA, 25 bp, Artificial sequence
  SiRNA target sequence
gaaatatcagtcaaaaaaacacaaa

SEQ ID NO: 123223 - DNA, 25 bp, Artificial sequence
  SiRNA target sequence
aaatatcagtcaaaaaaacacaaaa

SEQ ID NO: 123224 - DNA, 25 bp, Artificial sequence
  SiRNA target sequence
aatatcagtcaaaaaaacacaaaag

SEQ ID NO: 123225 - DNA, 25 bp, Artificial sequence
  SiRNA target sequence
atatcagtcaaaaaaacacaaaagt

SEQ ID NO: 123226 - DNA, 25 bp, Artificial sequence
  SiRNA target sequence
tatcagtcaaaaaaacacaaaagtt

SEQ ID NO: 123227 - DNA, 25 bp, Artificial sequence
  SiRNA target sequence
atcagtcaaaaaaacacaaaagtta

SEQ ID NO: 123228 - DNA, 25 bp, Artificial sequence
  SiRNA target sequence
tcagtcaaaaaaacacaaaagttag

SEQ ID NO: 123229 - DNA, 25 bp, Artificial sequence
  SiRNA target sequence
cagtcaaaaaaacacaaaagttagt

SEQ ID NO: 123230 - DNA, 25 bp, Artificial sequence
  SiRNA target sequence
agtcaaaaaaacacaaaagttagtg

SEQ ID NO: 123231 - DNA, 25 bp, Artificial sequence
  SiRNA target sequence
gtcaaaaaaacacaaaagttagtga

SEQ ID NO: 123232 - DNA, 25 bp, Artificial sequence
  SiRNA target sequence
tcaaaaaaacacaaaagttagtgat

SEQ ID NO: 123233 - DNA, 25 bp, Artificial sequence
  SiRNA target sequence
caaaaaaacacaaaagttagtgata

SEQ ID NO: 123234 - DNA, 25 bp, Artificial sequence
  SiRNA target sequence
aaaaaaacacaaaagttagtgatag

SEQ ID NO: 123235 - DNA, 25 bp, Artificial sequence
  SiRNA target sequence
aaaaaacacaaaagttagtgatagt

SEQ ID NO: 123236 - DNA, 25 bp, Artificial sequence
  SiRNA target sequence
aaaaacacaaaagttagtgatagtt

SEQ ID NO: 123237 - DNA, 25 bp, Artificial sequence
  SiRNA target sequence
aaaacacaaaagttagtgatagttg

SEQ ID NO: 123238 - DNA, 25 bp, Artificial sequence
  SiRNA target sequence
aaacacaaaagttagtgatagttga

SEQ ID NO: 123239 - DNA, 25 bp, Artificial sequence
  SiRNA target sequence
aacacaaaagttagtgatagttgat

SEQ ID NO: 123240 - DNA, 25 bp, Artificial sequence
  SiRNA target sequence
acacaaaagttagtgatagttgatt

SEQ ID NO: 123241 - DNA, 25 bp, Artificial sequence
  SiRNA target sequence
cacaaaagttagtgatagttgattt

SEQ ID NO: 123242 - DNA, 25 bp, Artificial sequence
  SiRNA target sequence
acaaaagttagtgatagttgatttt

SEQ ID NO: 123243 - DNA, 25 bp, Artificial sequence
  SiRNA target sequence
caaaagttagtgatagttgattttg

SEQ ID NO: 123244 - DNA, 25 bp, Artificial sequence
  SiRNA target sequence
aaaagttagtgatagttgattttgc

SEQ ID NO: 123245 - DNA, 25 bp, Artificial sequence
  SiRNA target sequence
aaagttagtgatagttgattttgca

SEQ ID NO: 123246 - DNA, 25 bp, Artificial sequence
  SiRNA target sequence
aagttagtgatagttgattttgcat

SEQ ID NO: 123247 - DNA, 25 bp, Artificial sequence
  SiRNA target sequence
agttagtgatagttgattttgcata

SEQ ID NO: 123248 - DNA, 25 bp, Artificial sequence
  SiRNA target sequence
gttagtgatagttgattttgcatat

SEQ ID NO: 123249 - DNA, 25 bp, Artificial sequence
  SiRNA target sequence
ttagtgatagttgattttgcatatc

SEQ ID NO: 123250 - DNA, 25 bp, Artificial sequence
  SiRNA target sequence
tagtgatagttgattttgcatatcc

SEQ ID NO: 123251 - DNA, 25 bp, Artificial sequence
  SiRNA target sequence
agtgatagttgattttgcatatcct

SEQ ID NO: 123252 - DNA, 25 bp, Artificial sequence
  SiRNA target sequence
gtgatagttgattttgcatatccta

SEQ ID NO: 123253 - DNA, 25 bp, Artificial sequence
  SiRNA target sequence
tgatagttgattttgcatatcctac

SEQ ID NO: 123254 - DNA, 25 bp, Artificial sequence
  SiRNA target sequence
gatagttgattttgcatatcctact

SEQ ID NO: 123255 - DNA, 25 bp, Artificial sequence
  SiRNA target sequence
atagttgattttgcatatcctactt

SEQ ID NO: 123256 - DNA, 25 bp, Artificial sequence
  SiRNA target sequence
tagttgattttgcatatcctacttt

SEQ ID NO: 123257 - DNA, 25 bp, Artificial sequence
  SiRNA target sequence
agttgattttgcatatcctactttc

SEQ ID NO: 123258 - DNA, 25 bp, Artificial sequence
  SiRNA target sequence
gttgattttgcatatcctactttca

SEQ ID NO: 123259 - DNA, 25 bp, Artificial sequence
  SiRNA target sequence
ttgattttgcatatcctactttcaa

SEQ ID NO: 123260 - DNA, 25 bp, Artificial sequence
  SiRNA target sequence
tgattttgcatatcctactttcaat

SEQ ID NO: 123261 - DNA, 25 bp, Artificial sequence
  SiRNA target sequence
gattttgcatatcctactttcaata

SEQ ID NO: 123262 - DNA, 25 bp, Artificial sequence
  SiRNA target sequence
attttgcatatcctactttcaatat

SEQ ID NO: 123263 - DNA, 25 bp, Artificial sequence
  SiRNA target sequence
ttttgcatatcctactttcaatatt

SEQ ID NO: 123264 - DNA, 25 bp, Artificial sequence
  SiRNA target sequence
tttgcatatcctactttcaatattg

SEQ ID NO: 123265 - DNA, 25 bp, Artificial sequence
  SiRNA target sequence
ttgcatatcctactttcaatattgc

SEQ ID NO: 123266 - DNA, 25 bp, Artificial sequence
  SiRNA target sequence
tgcatatcctactttcaatattgcg

SEQ ID NO: 123267 - DNA, 25 bp, Artificial sequence
  SiRNA target sequence
gcatatcctactttcaatattgcga

SEQ ID NO: 123268 - DNA, 25 bp, Artificial sequence
  SiRNA target sequence
catatcctactttcaatattgcgag

SEQ ID NO: 123269 - DNA, 25 bp, Artificial sequence
  SiRNA target sequence
atatcctactttcaatattgcgagt

SEQ ID NO: 123270 - DNA, 25 bp, Artificial sequence
  SiRNA target sequence
tatcctactttcaatattgcgagtg

SEQ ID NO: 123271 - DNA, 25 bp, Artificial sequence
  SiRNA target sequence
atcctactttcaatattgcgagtga

SEQ ID NO: 123272 - DNA, 25 bp, Artificial sequence
  SiRNA target sequence
tcctactttcaatattgcgagtgaa

SEQ ID NO: 123273 - DNA, 25 bp, Artificial sequence
  SiRNA target sequence
cctactttcaatattgcgagtgaaa

SEQ ID NO: 123274 - DNA, 25 bp, Artificial sequence
  SiRNA target sequence
ctactttcaatattgcgagtgaaat

SEQ ID NO: 123275 - DNA, 25 bp, Artificial sequence
  SiRNA target sequence
tactttcaatattgcgagtgaaata

SEQ ID NO: 123276 - DNA, 25 bp, Artificial sequence
  SiRNA target sequence
actttcaatattgcgagtgaaatag

SEQ ID NO: 123277 - DNA, 25 bp, Artificial sequence
  SiRNA target sequence
ctttcaatattgcgagtgaaatagc

SEQ ID NO: 123278 - DNA, 25 bp, Artificial sequence
  SiRNA target sequence
tttcaatattgcgagtgaaatagct

SEQ ID NO: 123279 - DNA, 25 bp, Artificial sequence
  SiRNA target sequence
ttcaatattgcgagtgaaatagctg

SEQ ID NO: 123280 - DNA, 25 bp, Artificial sequence
  SiRNA target sequence
tcaatattgcgagtgaaatagctgc

SEQ ID NO: 123281 - DNA, 25 bp, Artificial sequence
  SiRNA target sequence
caatattgcgagtgaaatagctgcg

SEQ ID NO: 123282 - DNA, 25 bp, Artificial sequence
  SiRNA target sequence
aatattgcgagtgaaatagctgcgc

SEQ ID NO: 123283 - DNA, 25 bp, Artificial sequence
  SiRNA target sequence
atattgcgagtgaaatagctgcgca

SEQ ID NO: 123284 - DNA, 25 bp, Artificial sequence
  SiRNA target sequence
tattgcgagtgaaatagctgcgcac

SEQ ID NO: 123285 - DNA, 25 bp, Artificial sequence
  SiRNA target sequence
attgcgagtgaaatagctgcgcact

SEQ ID NO: 123286 - DNA, 25 bp, Artificial sequence
  SiRNA target sequence
ttgcgagtgaaatagctgcgcactt

SEQ ID NO: 123287 - DNA, 25 bp, Artificial sequence
  SiRNA target sequence
tgcgagtgaaatagctgcgcacttt

SEQ ID NO: 123288 - DNA, 25 bp, Artificial sequence
  SiRNA target sequence
gcgagtgaaatagctgcgcactttt

SEQ ID NO: 123289 - DNA, 25 bp, Artificial sequence
  SiRNA target sequence
cgagtgaaatagctgcgcactttta

SEQ ID NO: 123290 - DNA, 25 bp, Artificial sequence
  SiRNA target sequence
gagtgaaatagctgcgcacttttac

SEQ ID NO: 123291 - DNA, 25 bp, Artificial sequence
  SiRNA target sequence
agtgaaatagctgcgcacttttacg

SEQ ID NO: 123292 - DNA, 25 bp, Artificial sequence
  SiRNA target sequence
gtgaaatagctgcgcacttttacga

SEQ ID NO: 123293 - DNA, 25 bp, Artificial sequence
  SiRNA target sequence
tgaaatagctgcgcacttttacgaa

SEQ ID NO: 123294 - DNA, 25 bp, Artificial sequence
  SiRNA target sequence
gaaatagctgcgcacttttacgaaa

SEQ ID NO: 123295 - DNA, 25 bp, Artificial sequence
  SiRNA target sequence
aaatagctgcgcacttttacgaaaa

SEQ ID NO: 123296 - DNA, 25 bp, Artificial sequence
  SiRNA target sequence
aatagctgcgcacttttacgaaaaa

SEQ ID NO: 123297 - DNA, 25 bp, Artificial sequence
  SiRNA target sequence
atagctgcgcacttttacgaaaaat

SEQ ID NO: 123298 - DNA, 25 bp, Artificial sequence
  SiRNA target sequence
tagctgcgcacttttacgaaaaatt

SEQ ID NO: 123299 - DNA, 25 bp, Artificial sequence
  SiRNA target sequence
agctgcgcacttttacgaaaaattt

SEQ ID NO: 123300 - DNA, 25 bp, Artificial sequence
  SiRNA target sequence
gctgcgcacttttacgaaaaattta

SEQ ID NO: 123301 - DNA, 25 bp, Artificial sequence
  SiRNA target sequence
ctgcgcacttttacgaaaaatttaa

SEQ ID NO: 123302 - DNA, 25 bp, Artificial sequence
  SiRNA target sequence
tgcgcacttttacgaaaaatttaaa

SEQ ID NO: 123303 - DNA, 25 bp, Artificial sequence
  SiRNA target sequence
gcgcacttttacgaaaaatttaaag

SEQ ID NO: 123304 - DNA, 25 bp, Artificial sequence
  SiRNA target sequence
cgcacttttacgaaaaatttaaaga

SEQ ID NO: 123305 - DNA, 25 bp, Artificial sequence
  SiRNA target sequence
gcacttttacgaaaaatttaaagat

SEQ ID NO: 123306 - DNA, 25 bp, Artificial sequence
  SiRNA target sequence
cacttttacgaaaaatttaaagata

SEQ ID NO: 123307 - DNA, 25 bp, Artificial sequence
  SiRNA target sequence
acttttacgaaaaatttaaagatat

SEQ ID NO: 123308 - DNA, 25 bp, Artificial sequence
  SiRNA target sequence
cttttacgaaaaatttaaagatata

SEQ ID NO: 123309 - DNA, 25 bp, Artificial sequence
  SiRNA target sequence
ttttacgaaaaatttaaagatataa

SEQ ID NO: 123310 - DNA, 25 bp, Artificial sequence
  SiRNA target sequence
tttacgaaaaatttaaagatataaa

SEQ ID NO: 123311 - DNA, 25 bp, Artificial sequence
  SiRNA target sequence
ttacgaaaaatttaaagatataaaa

SEQ ID NO: 123312 - DNA, 25 bp, Artificial sequence
  SiRNA target sequence
tacgaaaaatttaaagatataaaaa

SEQ ID NO: 123313 - DNA, 25 bp, Artificial sequence
  SiRNA target sequence
acgaaaaatttaaagatataaaaat

SEQ ID NO: 123314 - DNA, 25 bp, Artificial sequence
  SiRNA target sequence
cgaaaaatttaaagatataaaaatt

SEQ ID NO: 123315 - DNA, 25 bp, Artificial sequence
  SiRNA target sequence
gaaaaatttaaagatataaaaatta

SEQ ID NO: 123316 - DNA, 25 bp, Artificial sequence
  SiRNA target sequence
aaaaatttaaagatataaaaattat

SEQ ID NO: 123317 - DNA, 25 bp, Artificial sequence
  SiRNA target sequence
aaaatttaaagatataaaaattatg

SEQ ID NO: 123318 - DNA, 25 bp, Artificial sequence
  SiRNA target sequence
aaatttaaagatataaaaattatgc

SEQ ID NO: 123319 - DNA, 25 bp, Artificial sequence
  SiRNA target sequence
aatttaaagatataaaaattatgcg

SEQ ID NO: 123320 - DNA, 25 bp, Artificial sequence
  SiRNA target sequence
atttaaagatataaaaattatgcgt

SEQ ID NO: 123321 - DNA, 25 bp, Artificial sequence
  SiRNA target sequence
tttaaagatataaaaattatgcgtg

SEQ ID NO: 123322 - DNA, 25 bp, Artificial sequence
  SiRNA target sequence
ttaaagatataaaaattatgcgtgt

SEQ ID NO: 123323 - DNA, 25 bp, Artificial sequence
  SiRNA target sequence
taaagatataaaaattatgcgtgtt

SEQ ID NO: 123324 - DNA, 25 bp, Artificial sequence
  SiRNA target sequence
aaagatataaaaattatgcgtgttc

SEQ ID NO: 123325 - DNA, 25 bp, Artificial sequence
  SiRNA target sequence
aagatataaaaattatgcgtgttct

SEQ ID NO: 123326 - DNA, 25 bp, Artificial sequence
  SiRNA target sequence
agatataaaaattatgcgtgttctt

SEQ ID NO: 123327 - DNA, 25 bp, Artificial sequence
  SiRNA target sequence
gatataaaaattatgcgtgttcttg

SEQ ID NO: 123328 - DNA, 25 bp, Artificial sequence
  SiRNA target sequence
atataaaaattatgcgtgttcttgc

SEQ ID NO: 123329 - DNA, 25 bp, Artificial sequence
  SiRNA target sequence
tataaaaattatgcgtgttcttgcg

SEQ ID NO: 123330 - DNA, 25 bp, Artificial sequence
  SiRNA target sequence
ataaaaattatgcgtgttcttgcgc

SEQ ID NO: 123331 - DNA, 25 bp, Artificial sequence
  SiRNA target sequence
taaaaattatgcgtgttcttgcgca

SEQ ID NO: 123332 - DNA, 25 bp, Artificial sequence
  SiRNA target sequence
aaaaattatgcgtgttcttgcgcaa

SEQ ID NO: 123333 - DNA, 25 bp, Artificial sequence
  SiRNA target sequence
aaaattatgcgtgttcttgcgcaag

SEQ ID NO: 123334 - DNA, 25 bp, Artificial sequence
  SiRNA target sequence
aaattatgcgtgttcttgcgcaaga

SEQ ID NO: 123335 - DNA, 25 bp, Artificial sequence
  SiRNA target sequence
aattatgcgtgttcttgcgcaagat

SEQ ID NO: 123336 - DNA, 25 bp, Artificial sequence
  SiRNA target sequence
attatgcgtgttcttgcgcaagata

SEQ ID NO: 123337 - DNA, 25 bp, Artificial sequence
  SiRNA target sequence
ttatgcgtgttcttgcgcaagatat

SEQ ID NO: 123338 - DNA, 25 bp, Artificial sequence
  SiRNA target sequence
tatgcgtgttcttgcgcaagatatt

SEQ ID NO: 123339 - DNA, 25 bp, Artificial sequence
  SiRNA target sequence
atgcgtgttcttgcgcaagatattc

SEQ ID NO: 123340 - DNA, 25 bp, Artificial sequence
  SiRNA target sequence
tgcgtgttcttgcgcaagatattcc

SEQ ID NO: 123341 - DNA, 25 bp, Artificial sequence
  SiRNA target sequence
gcgtgttcttgcgcaagatattcct

SEQ ID NO: 123342 - DNA, 25 bp, Artificial sequence
  SiRNA target sequence
cgtgttcttgcgcaagatattccta

SEQ ID NO: 123343 - DNA, 25 bp, Artificial sequence
  SiRNA target sequence
gtgttcttgcgcaagatattcctac

SEQ ID NO: 123344 - DNA, 25 bp, Artificial sequence
  SiRNA target sequence
tgttcttgcgcaagatattcctaca

SEQ ID NO: 123345 - DNA, 25 bp, Artificial sequence
  SiRNA target sequence
gttcttgcgcaagatattcctacac

SEQ ID NO: 123346 - DNA, 25 bp, Artificial sequence
  SiRNA target sequence
ttcttgcgcaagatattcctacacc

SEQ ID NO: 123347 - DNA, 25 bp, Artificial sequence
  SiRNA target sequence
tcttgcgcaagatattcctacaccg

SEQ ID NO: 123348 - DNA, 25 bp, Artificial sequence
  SiRNA target sequence
cttgcgcaagatattcctacaccgt

SEQ ID NO: 123349 - DNA, 25 bp, Artificial sequence
  SiRNA target sequence
ttgcgcaagatattcctacaccgta

SEQ ID NO: 123350 - DNA, 25 bp, Artificial sequence
  SiRNA target sequence
tgcgcaagatattcctacaccgtat

SEQ ID NO: 123351 - DNA, 25 bp, Artificial sequence
  SiRNA target sequence
gcgcaagatattcctacaccgtatg

SEQ ID NO: 123352 - DNA, 25 bp, Artificial sequence
  SiRNA target sequence
cgcaagatattcctacaccgtatgc

SEQ ID NO: 123353 - DNA, 25 bp, Artificial sequence
  SiRNA target sequence
gcaagatattcctacaccgtatgca

SEQ ID NO: 123354 - DNA, 25 bp, Artificial sequence
  SiRNA target sequence
caagatattcctacaccgtatgcac

SEQ ID NO: 123355 - DNA, 25 bp, Artificial sequence
  SiRNA target sequence
aagatattcctacaccgtatgcact

SEQ ID NO: 123356 - DNA, 25 bp, Artificial sequence
  SiRNA target sequence
agatattcctacaccgtatgcactt

SEQ ID NO: 123357 - DNA, 25 bp, Artificial sequence
  SiRNA target sequence
gatattcctacaccgtatgcactta

SEQ ID NO: 123358 - DNA, 25 bp, Artificial sequence
  SiRNA target sequence
atattcctacaccgtatgcacttaa

SEQ ID NO: 123359 - DNA, 25 bp, Artificial sequence
  SiRNA target sequence
tattcctacaccgtatgcacttaat

SEQ ID NO: 123360 - DNA, 25 bp, Artificial sequence
  SiRNA target sequence
attcctacaccgtatgcacttaatc

SEQ ID NO: 123361 - DNA, 25 bp, Artificial sequence
  SiRNA target sequence
ttcctacaccgtatgcacttaatct

SEQ ID NO: 123362 - DNA, 25 bp, Artificial sequence
  SiRNA target sequence
tcctacaccgtatgcacttaatctt

SEQ ID NO: 123363 - DNA, 25 bp, Artificial sequence
  SiRNA target sequence
cctacaccgtatgcacttaatcttg

SEQ ID NO: 123364 - DNA, 25 bp, Artificial sequence
  SiRNA target sequence
ctacaccgtatgcacttaatcttga

SEQ ID NO: 123365 - DNA, 25 bp, Artificial sequence
  SiRNA target sequence
tacaccgtatgcacttaatcttgaa

SEQ ID NO: 123366 - DNA, 25 bp, Artificial sequence
  SiRNA target sequence
acaccgtatgcacttaatcttgaaa

SEQ ID NO: 123367 - DNA, 25 bp, Artificial sequence
  SiRNA target sequence
caccgtatgcacttaatcttgaaaa

SEQ ID NO: 123368 - DNA, 25 bp, Artificial sequence
  SiRNA target sequence
accgtatgcacttaatcttgaaaaa

SEQ ID NO: 123369 - DNA, 25 bp, Artificial sequence
  SiRNA target sequence
ccgtatgcacttaatcttgaaaaaa

SEQ ID NO: 123370 - DNA, 25 bp, Artificial sequence
  SiRNA target sequence
cgtatgcacttaatcttgaaaaaat

SEQ ID NO: 123371 - DNA, 25 bp, Artificial sequence
  SiRNA target sequence
gtatgcacttaatcttgaaaaaatg

SEQ ID NO: 123372 - DNA, 25 bp, Artificial sequence
  SiRNA target sequence
tatgcacttaatcttgaaaaaatgt

SEQ ID NO: 123373 - DNA, 25 bp, Artificial sequence
  SiRNA target sequence
atgcacttaatcttgaaaaaatgtc

SEQ ID NO: 123374 - DNA, 25 bp, Artificial sequence
  SiRNA target sequence
tgcacttaatcttgaaaaaatgtct

SEQ ID NO: 123375 - DNA, 25 bp, Artificial sequence
  SiRNA target sequence
gcacttaatcttgaaaaaatgtctt

SEQ ID NO: 123376 - DNA, 25 bp, Artificial sequence
  SiRNA target sequence
cacttaatcttgaaaaaatgtctta

SEQ ID NO: 123377 - DNA, 25 bp, Artificial sequence
  SiRNA target sequence
acttaatcttgaaaaaatgtcttat

SEQ ID NO: 123378 - DNA, 25 bp, Artificial sequence
  SiRNA target sequence
cttaatcttgaaaaaatgtcttatc

SEQ ID NO: 123379 - DNA, 25 bp, Artificial sequence
  SiRNA target sequence
ttaatcttgaaaaaatgtcttatcc

SEQ ID NO: 123380 - DNA, 25 bp, Artificial sequence
  SiRNA target sequence
taatcttgaaaaaatgtcttatccg

SEQ ID NO: 123381 - DNA, 25 bp, Artificial sequence
  SiRNA target sequence
aatcttgaaaaaatgtcttatccga

SEQ ID NO: 123382 - DNA, 25 bp, Artificial sequence
  SiRNA target sequence
atcttgaaaaaatgtcttatccgac

SEQ ID NO: 123383 - DNA, 25 bp, Artificial sequence
  SiRNA target sequence
tcttgaaaaaatgtcttatccgaca

SEQ ID NO: 123384 - DNA, 25 bp, Artificial sequence
  SiRNA target sequence
cttgaaaaaatgtcttatccgacat

SEQ ID NO: 123385 - DNA, 25 bp, Artificial sequence
  SiRNA target sequence
ttgaaaaaatgtcttatccgacatg

SEQ ID NO: 123386 - DNA, 25 bp, Artificial sequence
  SiRNA target sequence
tgaaaaaatgtcttatccgacatgc

SEQ ID NO: 123387 - DNA, 25 bp, Artificial sequence
  SiRNA target sequence
gaaaaaatgtcttatccgacatgca

SEQ ID NO: 123388 - DNA, 25 bp, Artificial sequence
  SiRNA target sequence
aaaaaatgtcttatccgacatgcaa

SEQ ID NO: 123389 - DNA, 25 bp, Artificial sequence
  SiRNA target sequence
aaaaatgtcttatccgacatgcaat

SEQ ID NO: 123390 - DNA, 25 bp, Artificial sequence
  SiRNA target sequence
aaaatgtcttatccgacatgcaatg

SEQ ID NO: 123391 - DNA, 25 bp, Artificial sequence
  SiRNA target sequence
aaatgtcttatccgacatgcaatga

SEQ ID NO: 123392 - DNA, 25 bp, Artificial sequence
  SiRNA target sequence
aatgtcttatccgacatgcaatgat

SEQ ID NO: 123393 - DNA, 25 bp, Artificial sequence
  SiRNA target sequence
atgtcttatccgacatgcaatgata

SEQ ID NO: 123394 - DNA, 25 bp, Artificial sequence
  SiRNA target sequence
tgtcttatccgacatgcaatgatat

SEQ ID NO: 123395 - DNA, 25 bp, Artificial sequence
  SiRNA target sequence
gtcttatccgacatgcaatgatatt

SEQ ID NO: 123396 - DNA, 25 bp, Artificial sequence
  SiRNA target sequence
tcttatccgacatgcaatgatattg

SEQ ID NO: 123397 - DNA, 25 bp, Artificial sequence
  SiRNA target sequence
cttatccgacatgcaatgatattgt

SEQ ID NO: 123398 - DNA, 25 bp, Artificial sequence
  SiRNA target sequence
ttatccgacatgcaatgatattgta

SEQ ID NO: 123399 - DNA, 25 bp, Artificial sequence
  SiRNA target sequence
tatccgacatgcaatgatattgtaa

SEQ ID NO: 123400 - DNA, 25 bp, Artificial sequence
  SiRNA target sequence
atccgacatgcaatgatattgtaaa

SEQ ID NO: 123401 - DNA, 25 bp, Artificial sequence
  SiRNA target sequence
tccgacatgcaatgatattgtaaat

SEQ ID NO: 123402 - DNA, 25 bp, Artificial sequence
  SiRNA target sequence
ccgacatgcaatgatattgtaaatg

SEQ ID NO: 123403 - DNA, 25 bp, Artificial sequence
  SiRNA target sequence
cgacatgcaatgatattgtaaatgc

SEQ ID NO: 123404 - DNA, 25 bp, Artificial sequence
  SiRNA target sequence
gacatgcaatgatattgtaaatgct

SEQ ID NO: 123405 - DNA, 25 bp, Artificial sequence
  SiRNA target sequence
acatgcaatgatattgtaaatgctg

SEQ ID NO: 123406 - DNA, 25 bp, Artificial sequence
  SiRNA target sequence
catgcaatgatattgtaaatgctgt

SEQ ID NO: 123407 - DNA, 25 bp, Artificial sequence
  SiRNA target sequence
atgcaatgatattgtaaatgctgtt

SEQ ID NO: 123408 - DNA, 25 bp, Artificial sequence
  SiRNA target sequence
tgcaatgatattgtaaatgctgtta

SEQ ID NO: 123409 - DNA, 25 bp, Artificial sequence
  SiRNA target sequence
gcaatgatattgtaaatgctgttac

SEQ ID NO: 123410 - DNA, 25 bp, Artificial sequence
  SiRNA target sequence
caatgatattgtaaatgctgttaca

SEQ ID NO: 123411 - DNA, 25 bp, Artificial sequence
  SiRNA target sequence
aatgatattgtaaatgctgttacaa

SEQ ID NO: 123412 - DNA, 25 bp, Artificial sequence
  SiRNA target sequence
atgatattgtaaatgctgttacaaa

SEQ ID NO: 123413 - DNA, 25 bp, Artificial sequence
  SiRNA target sequence
tgatattgtaaatgctgttacaaaa

SEQ ID NO: 123414 - DNA, 25 bp, Artificial sequence
  SiRNA target sequence
gatattgtaaatgctgttacaaaaa

SEQ ID NO: 123415 - DNA, 25 bp, Artificial sequence
  SiRNA target sequence
atattgtaaatgctgttacaaaaat

SEQ ID NO: 123416 - DNA, 25 bp, Artificial sequence
  SiRNA target sequence
tattgtaaatgctgttacaaaaata

SEQ ID NO: 123417 - DNA, 25 bp, Artificial sequence
  SiRNA target sequence
attgtaaatgctgttacaaaaataa

SEQ ID NO: 123418 - DNA, 25 bp, Artificial sequence
  SiRNA target sequence
ttgtaaatgctgttacaaaaataaa

SEQ ID NO: 123419 - DNA, 25 bp, Artificial sequence
  SiRNA target sequence
tgtaaatgctgttacaaaaataaat

SEQ ID NO: 123420 - DNA, 25 bp, Artificial sequence
  SiRNA target sequence
gtaaatgctgttacaaaaataaatt

SEQ ID NO: 123421 - DNA, 25 bp, Artificial sequence
  SiRNA target sequence
taaatgctgttacaaaaataaattc

SEQ ID NO: 123422 - DNA, 25 bp, Artificial sequence
  SiRNA target sequence
aaatgctgttacaaaaataaattca

SEQ ID NO: 123423 - DNA, 25 bp, Artificial sequence
  SiRNA target sequence
aatgctgttacaaaaataaattcat

SEQ ID NO: 123424 - DNA, 25 bp, Artificial sequence
  SiRNA target sequence
atgctgttacaaaaataaattcata

SEQ ID NO: 123425 - DNA, 25 bp, Artificial sequence
  SiRNA target sequence
tgctgttacaaaaataaattcatag

SEQ ID NO: 123426 - DNA, 26 bp, Artificial sequence
  SiRNA target sequence
atgatagaaattcgcgatcttataaa

SEQ ID NO: 123427 - DNA, 26 bp, Artificial sequence
  SiRNA target sequence
tgatagaaattcgcgatcttataaat

SEQ ID NO: 123428 - DNA, 26 bp, Artificial sequence
  SiRNA target sequence
gatagaaattcgcgatcttataaatc

SEQ ID NO: 123429 - DNA, 26 bp, Artificial sequence
  SiRNA target sequence
atagaaattcgcgatcttataaatca

SEQ ID NO: 123430 - DNA, 26 bp, Artificial sequence
  SiRNA target sequence
tagaaattcgcgatcttataaatcaa

SEQ ID NO: 123431 - DNA, 26 bp, Artificial sequence
  SiRNA target sequence
agaaattcgcgatcttataaatcaag

SEQ ID NO: 123432 - DNA, 26 bp, Artificial sequence
  SiRNA target sequence
gaaattcgcgatcttataaatcaagc

SEQ ID NO: 123433 - DNA, 26 bp, Artificial sequence
  SiRNA target sequence
aaattcgcgatcttataaatcaagca

SEQ ID NO: 123434 - DNA, 26 bp, Artificial sequence
  SiRNA target sequence
aattcgcgatcttataaatcaagcat

SEQ ID NO: 123435 - DNA, 26 bp, Artificial sequence
  SiRNA target sequence
attcgcgatcttataaatcaagcatt

SEQ ID NO: 123436 - DNA, 26 bp, Artificial sequence
  SiRNA target sequence
ttcgcgatcttataaatcaagcattg

SEQ ID NO: 123437 - DNA, 26 bp, Artificial sequence
  SiRNA target sequence
tcgcgatcttataaatcaagcattgg

SEQ ID NO: 123438 - DNA, 26 bp, Artificial sequence
  SiRNA target sequence
cgcgatcttataaatcaagcattgga

SEQ ID NO: 123439 - DNA, 26 bp, Artificial sequence
  SiRNA target sequence
gcgatcttataaatcaagcattggat

SEQ ID NO: 123440 - DNA, 26 bp, Artificial sequence
  SiRNA target sequence
cgatcttataaatcaagcattggatg

SEQ ID NO: 123441 - DNA, 26 bp, Artificial sequence
  SiRNA target sequence
gatcttataaatcaagcattggatga

SEQ ID NO: 123442 - DNA, 26 bp, Artificial sequence
  SiRNA target sequence
atcttataaatcaagcattggatgag

SEQ ID NO: 123443 - DNA, 26 bp, Artificial sequence
  SiRNA target sequence
tcttataaatcaagcattggatgagg

SEQ ID NO: 123444 - DNA, 26 bp, Artificial sequence
  SiRNA target sequence
cttataaatcaagcattggatgagga

SEQ ID NO: 123445 - DNA, 26 bp, Artificial sequence
  SiRNA target sequence
ttataaatcaagcattggatgaggaa

SEQ ID NO: 123446 - DNA, 26 bp, Artificial sequence
  SiRNA target sequence
tataaatcaagcattggatgaggaaa

SEQ ID NO: 123447 - DNA, 26 bp, Artificial sequence
  SiRNA target sequence
ataaatcaagcattggatgaggaaat

SEQ ID NO: 123448 - DNA, 26 bp, Artificial sequence
  SiRNA target sequence
taaatcaagcattggatgaggaaatg

SEQ ID NO: 123449 - DNA, 26 bp, Artificial sequence
  SiRNA target sequence
aaatcaagcattggatgaggaaatgg

SEQ ID NO: 123450 - DNA, 26 bp, Artificial sequence
  SiRNA target sequence
aatcaagcattggatgaggaaatggg

SEQ ID NO: 123451 - DNA, 26 bp, Artificial sequence
  SiRNA target sequence
atcaagcattggatgaggaaatggga

SEQ ID NO: 123452 - DNA, 26 bp, Artificial sequence
  SiRNA target sequence
tcaagcattggatgaggaaatgggaa

SEQ ID NO: 123453 - DNA, 26 bp, Artificial sequence
  SiRNA target sequence
caagcattggatgaggaaatgggaat

SEQ ID NO: 123454 - DNA, 26 bp, Artificial sequence
  SiRNA target sequence
aagcattggatgaggaaatgggaatg

SEQ ID NO: 123455 - DNA, 26 bp, Artificial sequence
  SiRNA target sequence
agcattggatgaggaaatgggaatgg

SEQ ID NO: 123456 - DNA, 26 bp, Artificial sequence
  SiRNA target sequence
gcattggatgaggaaatgggaatgga

SEQ ID NO: 123457 - DNA, 26 bp, Artificial sequence
  SiRNA target sequence
cattggatgaggaaatgggaatggat

SEQ ID NO: 123458 - DNA, 26 bp, Artificial sequence
  SiRNA target sequence
attggatgaggaaatgggaatggatc

SEQ ID NO: 123459 - DNA, 26 bp, Artificial sequence
  SiRNA target sequence
ttggatgaggaaatgggaatggatca

SEQ ID NO: 123460 - DNA, 26 bp, Artificial sequence
  SiRNA target sequence
tggatgaggaaatgggaatggatcat

SEQ ID NO: 123461 - DNA, 26 bp, Artificial sequence
  SiRNA target sequence
ggatgaggaaatgggaatggatcata

SEQ ID NO: 123462 - DNA, 26 bp, Artificial sequence
  SiRNA target sequence
gatgaggaaatgggaatggatcataa

SEQ ID NO: 123463 - DNA, 26 bp, Artificial sequence
  SiRNA target sequence
atgaggaaatgggaatggatcataat

SEQ ID NO: 123464 - DNA, 26 bp, Artificial sequence
  SiRNA target sequence
tgaggaaatgggaatggatcataatg

SEQ ID NO: 123465 - DNA, 26 bp, Artificial sequence
  SiRNA target sequence
gaggaaatgggaatggatcataatgt

SEQ ID NO: 123466 - DNA, 26 bp, Artificial sequence
  SiRNA target sequence
aggaaatgggaatggatcataatgta

SEQ ID NO: 123467 - DNA, 26 bp, Artificial sequence
  SiRNA target sequence
ggaaatgggaatggatcataatgtat

SEQ ID NO: 123468 - DNA, 26 bp, Artificial sequence
  SiRNA target sequence
gaaatgggaatggatcataatgtata

SEQ ID NO: 123469 - DNA, 26 bp, Artificial sequence
  SiRNA target sequence
aaatgggaatggatcataatgtatat

SEQ ID NO: 123470 - DNA, 26 bp, Artificial sequence
  SiRNA target sequence
aatgggaatggatcataatgtatata

SEQ ID NO: 123471 - DNA, 26 bp, Artificial sequence
  SiRNA target sequence
atgggaatggatcataatgtatatat

SEQ ID NO: 123472 - DNA, 26 bp, Artificial sequence
  SiRNA target sequence
tgggaatggatcataatgtatatata

SEQ ID NO: 123473 - DNA, 26 bp, Artificial sequence
  SiRNA target sequence
gggaatggatcataatgtatatataa

SEQ ID NO: 123474 - DNA, 26 bp, Artificial sequence
  SiRNA target sequence
ggaatggatcataatgtatatataat

SEQ ID NO: 123475 - DNA, 26 bp, Artificial sequence
  SiRNA target sequence
gaatggatcataatgtatatataata

SEQ ID NO: 123476 - DNA, 26 bp, Artificial sequence
  SiRNA target sequence
aatggatcataatgtatatataatag

SEQ ID NO: 123477 - DNA, 26 bp, Artificial sequence
  SiRNA target sequence
atggatcataatgtatatataatagg

SEQ ID NO: 123478 - DNA, 26 bp, Artificial sequence
  SiRNA target sequence
tggatcataatgtatatataatagga

SEQ ID NO: 123479 - DNA, 26 bp, Artificial sequence
  SiRNA target sequence
ggatcataatgtatatataataggag

SEQ ID NO: 123480 - DNA, 26 bp, Artificial sequence
  SiRNA target sequence
gatcataatgtatatataataggaga

SEQ ID NO: 123481 - DNA, 26 bp, Artificial sequence
  SiRNA target sequence
atcataatgtatatataataggagaa

SEQ ID NO: 123482 - DNA, 26 bp, Artificial sequence
  SiRNA target sequence
tcataatgtatatataataggagaag

SEQ ID NO: 123483 - DNA, 26 bp, Artificial sequence
  SiRNA target sequence
cataatgtatatataataggagaaga

SEQ ID NO: 123484 - DNA, 26 bp, Artificial sequence
  SiRNA target sequence
ataatgtatatataataggagaagaa

SEQ ID NO: 123485 - DNA, 26 bp, Artificial sequence
  SiRNA target sequence
taatgtatatataataggagaagaag

SEQ ID NO: 123486 - DNA, 26 bp, Artificial sequence
  SiRNA target sequence
aatgtatatataataggagaagaagt

SEQ ID NO: 123487 - DNA, 26 bp, Artificial sequence
  SiRNA target sequence
atgtatatataataggagaagaagta

SEQ ID NO: 123488 - DNA, 26 bp, Artificial sequence
  SiRNA target sequence
tgtatatataataggagaagaagtag

SEQ ID NO: 123489 - DNA, 26 bp, Artificial sequence
  SiRNA target sequence
gtatatataataggagaagaagtagg

SEQ ID NO: 123490 - DNA, 26 bp, Artificial sequence
  SiRNA target sequence
tatatataataggagaagaagtaggc

SEQ ID NO: 123491 - DNA, 26 bp, Artificial sequence
  SiRNA target sequence
atatataataggagaagaagtaggca

SEQ ID NO: 123492 - DNA, 26 bp, Artificial sequence
  SiRNA target sequence
tatataataggagaagaagtaggcat

SEQ ID NO: 123493 - DNA, 26 bp, Artificial sequence
  SiRNA target sequence
atataataggagaagaagtaggcatc

SEQ ID NO: 123494 - DNA, 26 bp, Artificial sequence
  SiRNA target sequence
tataataggagaagaagtaggcatct

SEQ ID NO: 123495 - DNA, 26 bp, Artificial sequence
  SiRNA target sequence
ataataggagaagaagtaggcatctc

SEQ ID NO: 123496 - DNA, 26 bp, Artificial sequence
  SiRNA target sequence
taataggagaagaagtaggcatctct

SEQ ID NO: 123497 - DNA, 26 bp, Artificial sequence
  SiRNA target sequence
aataggagaagaagtaggcatctctg

SEQ ID NO: 123498 - DNA, 26 bp, Artificial sequence
  SiRNA target sequence
ataggagaagaagtaggcatctctgg

SEQ ID NO: 123499 - DNA, 26 bp, Artificial sequence
  SiRNA target sequence
taggagaagaagtaggcatctctggt

SEQ ID NO: 123500 - DNA, 26 bp, Artificial sequence
  SiRNA target sequence
aggagaagaagtaggcatctctggtg

SEQ ID NO: 123501 - DNA, 26 bp, Artificial sequence
  SiRNA target sequence
ggagaagaagtaggcatctctggtgg

SEQ ID NO: 123502 - DNA, 26 bp, Artificial sequence
  SiRNA target sequence
gagaagaagtaggcatctctggtggt

SEQ ID NO: 123503 - DNA, 26 bp, Artificial sequence
  SiRNA target sequence
agaagaagtaggcatctctggtggtc

SEQ ID NO: 123504 - DNA, 26 bp, Artificial sequence
  SiRNA target sequence
gaagaagtaggcatctctggtggtcc

SEQ ID NO: 123505 - DNA, 26 bp, Artificial sequence
  SiRNA target sequence
aagaagtaggcatctctggtggtcct

SEQ ID NO: 123506 - DNA, 26 bp, Artificial sequence
  SiRNA target sequence
agaagtaggcatctctggtggtcctc

SEQ ID NO: 123507 - DNA, 26 bp, Artificial sequence
  SiRNA target sequence
gaagtaggcatctctggtggtcctca

SEQ ID NO: 123508 - DNA, 26 bp, Artificial sequence
  SiRNA target sequence
aagtaggcatctctggtggtcctcac

SEQ ID NO: 123509 - DNA, 26 bp, Artificial sequence
  SiRNA target sequence
agtaggcatctctggtggtcctcacg

SEQ ID NO: 123510 - DNA, 26 bp, Artificial sequence
  SiRNA target sequence
gtaggcatctctggtggtcctcacgg

SEQ ID NO: 123511 - DNA, 26 bp, Artificial sequence
  SiRNA target sequence
taggcatctctggtggtcctcacggt

SEQ ID NO: 123512 - DNA, 26 bp, Artificial sequence
  SiRNA target sequence
aggcatctctggtggtcctcacggtc

SEQ ID NO: 123513 - DNA, 26 bp, Artificial sequence
  SiRNA target sequence
ggcatctctggtggtcctcacggtct

SEQ ID NO: 123514 - DNA, 26 bp, Artificial sequence
  SiRNA target sequence
gcatctctggtggtcctcacggtctt

SEQ ID NO: 123515 - DNA, 26 bp, Artificial sequence
  SiRNA target sequence
catctctggtggtcctcacggtctta

SEQ ID NO: 123516 - DNA, 26 bp, Artificial sequence
  SiRNA target sequence
atctctggtggtcctcacggtcttac

SEQ ID NO: 123517 - DNA, 26 bp, Artificial sequence
  SiRNA target sequence
tctctggtggtcctcacggtcttact

SEQ ID NO: 123518 - DNA, 26 bp, Artificial sequence
  SiRNA target sequence
ctctggtggtcctcacggtcttacta

SEQ ID NO: 123519 - DNA, 26 bp, Artificial sequence
  SiRNA target sequence
tctggtggtcctcacggtcttactaa

SEQ ID NO: 123520 - DNA, 26 bp, Artificial sequence
  SiRNA target sequence
ctggtggtcctcacggtcttactaaa

SEQ ID NO: 123521 - DNA, 26 bp, Artificial sequence
  SiRNA target sequence
tggtggtcctcacggtcttactaaaa

SEQ ID NO: 123522 - DNA, 26 bp, Artificial sequence
  SiRNA target sequence
ggtggtcctcacggtcttactaaaaa

SEQ ID NO: 123523 - DNA, 26 bp, Artificial sequence
  SiRNA target sequence
gtggtcctcacggtcttactaaaaat

SEQ ID NO: 123524 - DNA, 26 bp, Artificial sequence
  SiRNA target sequence
tggtcctcacggtcttactaaaaatt

SEQ ID NO: 123525 - DNA, 26 bp, Artificial sequence
  SiRNA target sequence
ggtcctcacggtcttactaaaaattt

SEQ ID NO: 123526 - DNA, 26 bp, Artificial sequence
  SiRNA target sequence
gtcctcacggtcttactaaaaatttg

SEQ ID NO: 123527 - DNA, 26 bp, Artificial sequence
  SiRNA target sequence
tcctcacggtcttactaaaaatttga

SEQ ID NO: 123528 - DNA, 26 bp, Artificial sequence
  SiRNA target sequence
cctcacggtcttactaaaaatttgat

SEQ ID NO: 123529 - DNA, 26 bp, Artificial sequence
  SiRNA target sequence
ctcacggtcttactaaaaatttgatc

SEQ ID NO: 123530 - DNA, 26 bp, Artificial sequence
  SiRNA target sequence
tcacggtcttactaaaaatttgatca

SEQ ID NO: 123531 - DNA, 26 bp, Artificial sequence
  SiRNA target sequence
cacggtcttactaaaaatttgatcaa

SEQ ID NO: 123532 - DNA, 26 bp, Artificial sequence
  SiRNA target sequence
acggtcttactaaaaatttgatcaaa

SEQ ID NO: 123533 - DNA, 26 bp, Artificial sequence
  SiRNA target sequence
cggtcttactaaaaatttgatcaaaa

SEQ ID NO: 123534 - DNA, 26 bp, Artificial sequence
  SiRNA target sequence
ggtcttactaaaaatttgatcaaaaa

SEQ ID NO: 123535 - DNA, 26 bp, Artificial sequence
  SiRNA target sequence
gtcttactaaaaatttgatcaaaaaa

SEQ ID NO: 123536 - DNA, 26 bp, Artificial sequence
  SiRNA target sequence
tcttactaaaaatttgatcaaaaaat

SEQ ID NO: 123537 - DNA, 26 bp, Artificial sequence
  SiRNA target sequence
cttactaaaaatttgatcaaaaaata

SEQ ID NO: 123538 - DNA, 26 bp, Artificial sequence
  SiRNA target sequence
ttactaaaaatttgatcaaaaaatac

SEQ ID NO: 123539 - DNA, 26 bp, Artificial sequence
  SiRNA target sequence
tactaaaaatttgatcaaaaaatacg

SEQ ID NO: 123540 - DNA, 26 bp, Artificial sequence
  SiRNA target sequence
actaaaaatttgatcaaaaaatacgg

SEQ ID NO: 123541 - DNA, 26 bp, Artificial sequence
  SiRNA target sequence
ctaaaaatttgatcaaaaaatacggc

SEQ ID NO: 123542 - DNA, 26 bp, Artificial sequence
  SiRNA target sequence
taaaaatttgatcaaaaaatacggcg

SEQ ID NO: 123543 - DNA, 26 bp, Artificial sequence
  SiRNA target sequence
aaaaatttgatcaaaaaatacggcga

SEQ ID NO: 123544 - DNA, 26 bp, Artificial sequence
  SiRNA target sequence
aaaatttgatcaaaaaatacggcgat

SEQ ID NO: 123545 - DNA, 26 bp, Artificial sequence
  SiRNA target sequence
aaatttgatcaaaaaatacggcgatc

SEQ ID NO: 123546 - DNA, 26 bp, Artificial sequence
  SiRNA target sequence
aatttgatcaaaaaatacggcgatca

SEQ ID NO: 123547 - DNA, 26 bp, Artificial sequence
  SiRNA target sequence
atttgatcaaaaaatacggcgatcaa

SEQ ID NO: 123548 - DNA, 26 bp, Artificial sequence
  SiRNA target sequence
tttgatcaaaaaatacggcgatcaaa

SEQ ID NO: 123549 - DNA, 26 bp, Artificial sequence
  SiRNA target sequence
ttgatcaaaaaatacggcgatcaaag

SEQ ID NO: 123550 - DNA, 26 bp, Artificial sequence
  SiRNA target sequence
tgatcaaaaaatacggcgatcaaaga

SEQ ID NO: 123551 - DNA, 26 bp, Artificial sequence
  SiRNA target sequence
gatcaaaaaatacggcgatcaaagag

SEQ ID NO: 123552 - DNA, 26 bp, Artificial sequence
  SiRNA target sequence
atcaaaaaatacggcgatcaaagagt

SEQ ID NO: 123553 - DNA, 26 bp, Artificial sequence
  SiRNA target sequence
tcaaaaaatacggcgatcaaagagtg

SEQ ID NO: 123554 - DNA, 26 bp, Artificial sequence
  SiRNA target sequence
caaaaaatacggcgatcaaagagtga

SEQ ID NO: 123555 - DNA, 26 bp, Artificial sequence
  SiRNA target sequence
aaaaaatacggcgatcaaagagtgaa

SEQ ID NO: 123556 - DNA, 26 bp, Artificial sequence
  SiRNA target sequence
aaaaatacggcgatcaaagagtgaag

SEQ ID NO: 123557 - DNA, 26 bp, Artificial sequence
  SiRNA target sequence
aaaatacggcgatcaaagagtgaagg

SEQ ID NO: 123558 - DNA, 26 bp, Artificial sequence
  SiRNA target sequence
aaatacggcgatcaaagagtgaagga

SEQ ID NO: 123559 - DNA, 26 bp, Artificial sequence
  SiRNA target sequence
aatacggcgatcaaagagtgaaggat

SEQ ID NO: 123560 - DNA, 26 bp, Artificial sequence
  SiRNA target sequence
atacggcgatcaaagagtgaaggata

SEQ ID NO: 123561 - DNA, 26 bp, Artificial sequence
  SiRNA target sequence
tacggcgatcaaagagtgaaggatac

SEQ ID NO: 123562 - DNA, 26 bp, Artificial sequence
  SiRNA target sequence
acggcgatcaaagagtgaaggatacc

SEQ ID NO: 123563 - DNA, 26 bp, Artificial sequence
  SiRNA target sequence
cggcgatcaaagagtgaaggataccc

SEQ ID NO: 123564 - DNA, 26 bp, Artificial sequence
  SiRNA target sequence
ggcgatcaaagagtgaaggatacccc

SEQ ID NO: 123565 - DNA, 26 bp, Artificial sequence
  SiRNA target sequence
gcgatcaaagagtgaaggatacccct

SEQ ID NO: 123566 - DNA, 26 bp, Artificial sequence
  SiRNA target sequence
cgatcaaagagtgaaggataccccta

SEQ ID NO: 123567 - DNA, 26 bp, Artificial sequence
  SiRNA target sequence
gatcaaagagtgaaggatacccctat

SEQ ID NO: 123568 - DNA, 26 bp, Artificial sequence
  SiRNA target sequence
atcaaagagtgaaggatacccctatt

SEQ ID NO: 123569 - DNA, 26 bp, Artificial sequence
  SiRNA target sequence
tcaaagagtgaaggatacccctattt

SEQ ID NO: 123570 - DNA, 26 bp, Artificial sequence
  SiRNA target sequence
caaagagtgaaggatacccctatttc

SEQ ID NO: 123571 - DNA, 26 bp, Artificial sequence
  SiRNA target sequence
aaagagtgaaggatacccctatttcg

SEQ ID NO: 123572 - DNA, 26 bp, Artificial sequence
  SiRNA target sequence
aagagtgaaggatacccctatttcgg

SEQ ID NO: 123573 - DNA, 26 bp, Artificial sequence
  SiRNA target sequence
agagtgaaggatacccctatttcgga

SEQ ID NO: 123574 - DNA, 26 bp, Artificial sequence
  SiRNA target sequence
gagtgaaggatacccctatttcggaa

SEQ ID NO: 123575 - DNA, 26 bp, Artificial sequence
  SiRNA target sequence
agtgaaggatacccctatttcggaaa

SEQ ID NO: 123576 - DNA, 26 bp, Artificial sequence
  SiRNA target sequence
gtgaaggatacccctatttcggaaat

SEQ ID NO: 123577 - DNA, 26 bp, Artificial sequence
  SiRNA target sequence
tgaaggatacccctatttcggaaatg

SEQ ID NO: 123578 - DNA, 26 bp, Artificial sequence
  SiRNA target sequence
gaaggatacccctatttcggaaatgg

SEQ ID NO: 123579 - DNA, 26 bp, Artificial sequence
  SiRNA target sequence
aaggatacccctatttcggaaatggg

SEQ ID NO: 123580 - DNA, 26 bp, Artificial sequence
  SiRNA target sequence
aggatacccctatttcggaaatggga

SEQ ID NO: 123581 - DNA, 26 bp, Artificial sequence
  SiRNA target sequence
ggatacccctatttcggaaatgggat

SEQ ID NO: 123582 - DNA, 26 bp, Artificial sequence
  SiRNA target sequence
gatacccctatttcggaaatgggatt

SEQ ID NO: 123583 - DNA, 26 bp, Artificial sequence
  SiRNA target sequence
atacccctatttcggaaatgggattt

SEQ ID NO: 123584 - DNA, 26 bp, Artificial sequence
  SiRNA target sequence
tacccctatttcggaaatgggattta

SEQ ID NO: 123585 - DNA, 26 bp, Artificial sequence
  SiRNA target sequence
acccctatttcggaaatgggatttac

SEQ ID NO: 123586 - DNA, 26 bp, Artificial sequence
  SiRNA target sequence
cccctatttcggaaatgggatttaca

SEQ ID NO: 123587 - DNA, 26 bp, Artificial sequence
  SiRNA target sequence
ccctatttcggaaatgggatttacag

SEQ ID NO: 123588 - DNA, 26 bp, Artificial sequence
  SiRNA target sequence
cctatttcggaaatgggatttacagg

SEQ ID NO: 123589 - DNA, 26 bp, Artificial sequence
  SiRNA target sequence
ctatttcggaaatgggatttacaggt

SEQ ID NO: 123590 - DNA, 26 bp, Artificial sequence
  SiRNA target sequence
tatttcggaaatgggatttacaggtc

SEQ ID NO: 123591 - DNA, 26 bp, Artificial sequence
  SiRNA target sequence
atttcggaaatgggatttacaggtct

SEQ ID NO: 123592 - DNA, 26 bp, Artificial sequence
  SiRNA target sequence
tttcggaaatgggatttacaggtctc

SEQ ID NO: 123593 - DNA, 26 bp, Artificial sequence
  SiRNA target sequence
ttcggaaatgggatttacaggtctcg

SEQ ID NO: 123594 - DNA, 26 bp, Artificial sequence
  SiRNA target sequence
tcggaaatgggatttacaggtctcgc

SEQ ID NO: 123595 - DNA, 26 bp, Artificial sequence
  SiRNA target sequence
cggaaatgggatttacaggtctcgct

SEQ ID NO: 123596 - DNA, 26 bp, Artificial sequence
  SiRNA target sequence
ggaaatgggatttacaggtctcgctg

SEQ ID NO: 123597 - DNA, 26 bp, Artificial sequence
  SiRNA target sequence
gaaatgggatttacaggtctcgctgt

SEQ ID NO: 123598 - DNA, 26 bp, Artificial sequence
  SiRNA target sequence
aaatgggatttacaggtctcgctgtg

SEQ ID NO: 123599 - DNA, 26 bp, Artificial sequence
  SiRNA target sequence
aatgggatttacaggtctcgctgtgg

SEQ ID NO: 123600 - DNA, 26 bp, Artificial sequence
  SiRNA target sequence
atgggatttacaggtctcgctgtggg

SEQ ID NO: 123601 - DNA, 26 bp, Artificial sequence
  SiRNA target sequence
tgggatttacaggtctcgctgtgggt

SEQ ID NO: 123602 - DNA, 26 bp, Artificial sequence
  SiRNA target sequence
gggatttacaggtctcgctgtgggtt

SEQ ID NO: 123603 - DNA, 26 bp, Artificial sequence
  SiRNA target sequence
ggatttacaggtctcgctgtgggttc

SEQ ID NO: 123604 - DNA, 26 bp, Artificial sequence
  SiRNA target sequence
gatttacaggtctcgctgtgggttca

SEQ ID NO: 123605 - DNA, 26 bp, Artificial sequence
  SiRNA target sequence
atttacaggtctcgctgtgggttcaa

SEQ ID NO: 123606 - DNA, 26 bp, Artificial sequence
  SiRNA target sequence
tttacaggtctcgctgtgggttcaag

SEQ ID NO: 123607 - DNA, 26 bp, Artificial sequence
  SiRNA target sequence
ttacaggtctcgctgtgggttcaagc

SEQ ID NO: 123608 - DNA, 26 bp, Artificial sequence
  SiRNA target sequence
tacaggtctcgctgtgggttcaagct

SEQ ID NO: 123609 - DNA, 26 bp, Artificial sequence
  SiRNA target sequence
acaggtctcgctgtgggttcaagcta

SEQ ID NO: 123610 - DNA, 26 bp, Artificial sequence
  SiRNA target sequence
caggtctcgctgtgggttcaagctat

SEQ ID NO: 123611 - DNA, 26 bp, Artificial sequence
  SiRNA target sequence
aggtctcgctgtgggttcaagctatt

SEQ ID NO: 123612 - DNA, 26 bp, Artificial sequence
  SiRNA target sequence
ggtctcgctgtgggttcaagctattt

SEQ ID NO: 123613 - DNA, 26 bp, Artificial sequence
  SiRNA target sequence
gtctcgctgtgggttcaagctattta

SEQ ID NO: 123614 - DNA, 26 bp, Artificial sequence
  SiRNA target sequence
tctcgctgtgggttcaagctatttag

SEQ ID NO: 123615 - DNA, 26 bp, Artificial sequence
  SiRNA target sequence
ctcgctgtgggttcaagctatttagg

SEQ ID NO: 123616 - DNA, 26 bp, Artificial sequence
  SiRNA target sequence
tcgctgtgggttcaagctatttaggg

SEQ ID NO: 123617 - DNA, 26 bp, Artificial sequence
  SiRNA target sequence
cgctgtgggttcaagctatttagggt

SEQ ID NO: 123618 - DNA, 26 bp, Artificial sequence
  SiRNA target sequence
gctgtgggttcaagctatttagggtt

SEQ ID NO: 123619 - DNA, 26 bp, Artificial sequence
  SiRNA target sequence
ctgtgggttcaagctatttagggtta

SEQ ID NO: 123620 - DNA, 26 bp, Artificial sequence
  SiRNA target sequence
tgtgggttcaagctatttagggttaa

SEQ ID NO: 123621 - DNA, 26 bp, Artificial sequence
  SiRNA target sequence
gtgggttcaagctatttagggttaag

SEQ ID NO: 123622 - DNA, 26 bp, Artificial sequence
  SiRNA target sequence
tgggttcaagctatttagggttaaga

SEQ ID NO: 123623 - DNA, 26 bp, Artificial sequence
  SiRNA target sequence
gggttcaagctatttagggttaagac

SEQ ID NO: 123624 - DNA, 26 bp, Artificial sequence
  SiRNA target sequence
ggttcaagctatttagggttaagacc

SEQ ID NO: 123625 - DNA, 26 bp, Artificial sequence
  SiRNA target sequence
gttcaagctatttagggttaagaccc

SEQ ID NO: 123626 - DNA, 26 bp, Artificial sequence
  SiRNA target sequence
ttcaagctatttagggttaagacccg

SEQ ID NO: 123627 - DNA, 26 bp, Artificial sequence
  SiRNA target sequence
tcaagctatttagggttaagacccgt

SEQ ID NO: 123628 - DNA, 26 bp, Artificial sequence
  SiRNA target sequence
caagctatttagggttaagacccgta

SEQ ID NO: 123629 - DNA, 26 bp, Artificial sequence
  SiRNA target sequence
aagctatttagggttaagacccgtag

SEQ ID NO: 123630 - DNA, 26 bp, Artificial sequence
  SiRNA target sequence
agctatttagggttaagacccgtagt

SEQ ID NO: 123631 - DNA, 26 bp, Artificial sequence
  SiRNA target sequence
gctatttagggttaagacccgtagta

SEQ ID NO: 123632 - DNA, 26 bp, Artificial sequence
  SiRNA target sequence
ctatttagggttaagacccgtagtag

SEQ ID NO: 123633 - DNA, 26 bp, Artificial sequence
  SiRNA target sequence
tatttagggttaagacccgtagtaga

SEQ ID NO: 123634 - DNA, 26 bp, Artificial sequence
  SiRNA target sequence
atttagggttaagacccgtagtagat

SEQ ID NO: 123635 - DNA, 26 bp, Artificial sequence
  SiRNA target sequence
tttagggttaagacccgtagtagatt

SEQ ID NO: 123636 - DNA, 26 bp, Artificial sequence
  SiRNA target sequence
ttagggttaagacccgtagtagattt

SEQ ID NO: 123637 - DNA, 26 bp, Artificial sequence
  SiRNA target sequence
tagggttaagacccgtagtagatttt

SEQ ID NO: 123638 - DNA, 26 bp, Artificial sequence
  SiRNA target sequence
agggttaagacccgtagtagatttta

SEQ ID NO: 123639 - DNA, 26 bp, Artificial sequence
  SiRNA target sequence
gggttaagacccgtagtagattttat

SEQ ID NO: 123640 - DNA, 26 bp, Artificial sequence
  SiRNA target sequence
ggttaagacccgtagtagattttatg

SEQ ID NO: 123641 - DNA, 26 bp, Artificial sequence
  SiRNA target sequence
gttaagacccgtagtagattttatga

SEQ ID NO: 123642 - DNA, 26 bp, Artificial sequence
  SiRNA target sequence
ttaagacccgtagtagattttatgac

SEQ ID NO: 123643 - DNA, 26 bp, Artificial sequence
  SiRNA target sequence
taagacccgtagtagattttatgact

SEQ ID NO: 123644 - DNA, 26 bp, Artificial sequence
  SiRNA target sequence
aagacccgtagtagattttatgactt

SEQ ID NO: 123645 - DNA, 26 bp, Artificial sequence
  SiRNA target sequence
agacccgtagtagattttatgacttg

SEQ ID NO: 123646 - DNA, 26 bp, Artificial sequence
  SiRNA target sequence
gacccgtagtagattttatgacttgg

SEQ ID NO: 123647 - DNA, 26 bp, Artificial sequence
  SiRNA target sequence
acccgtagtagattttatgacttgga

SEQ ID NO: 123648 - DNA, 26 bp, Artificial sequence
  SiRNA target sequence
cccgtagtagattttatgacttggaa

SEQ ID NO: 123649 - DNA, 26 bp, Artificial sequence
  SiRNA target sequence
ccgtagtagattttatgacttggaat

SEQ ID NO: 123650 - DNA, 26 bp, Artificial sequence
  SiRNA target sequence
cgtagtagattttatgacttggaatt

SEQ ID NO: 123651 - DNA, 26 bp, Artificial sequence
  SiRNA target sequence
gtagtagattttatgacttggaattt

SEQ ID NO: 123652 - DNA, 26 bp, Artificial sequence
  SiRNA target sequence
tagtagattttatgacttggaatttt

SEQ ID NO: 123653 - DNA, 26 bp, Artificial sequence
  SiRNA target sequence
agtagattttatgacttggaattttg

SEQ ID NO: 123654 - DNA, 26 bp, Artificial sequence
  SiRNA target sequence
gtagattttatgacttggaattttgc

SEQ ID NO: 123655 - DNA, 26 bp, Artificial sequence
  SiRNA target sequence
tagattttatgacttggaattttgct

SEQ ID NO: 123656 - DNA, 26 bp, Artificial sequence
  SiRNA target sequence
agattttatgacttggaattttgctt

SEQ ID NO: 123657 - DNA, 26 bp, Artificial sequence
  SiRNA target sequence
gattttatgacttggaattttgcttt

SEQ ID NO: 123658 - DNA, 26 bp, Artificial sequence
  SiRNA target sequence
attttatgacttggaattttgctttg

SEQ ID NO: 123659 - DNA, 26 bp, Artificial sequence
  SiRNA target sequence
ttttatgacttggaattttgctttgc

SEQ ID NO: 123660 - DNA, 26 bp, Artificial sequence
  SiRNA target sequence
tttatgacttggaattttgctttgca

SEQ ID NO: 123661 - DNA, 26 bp, Artificial sequence
  SiRNA target sequence
ttatgacttggaattttgctttgcaa

SEQ ID NO: 123662 - DNA, 26 bp, Artificial sequence
  SiRNA target sequence
tatgacttggaattttgctttgcaat

SEQ ID NO: 123663 - DNA, 26 bp, Artificial sequence
  SiRNA target sequence
atgacttggaattttgctttgcaatc

SEQ ID NO: 123664 - DNA, 26 bp, Artificial sequence
  SiRNA target sequence
tgacttggaattttgctttgcaatca

SEQ ID NO: 123665 - DNA, 26 bp, Artificial sequence
  SiRNA target sequence
gacttggaattttgctttgcaatcaa

SEQ ID NO: 123666 - DNA, 26 bp, Artificial sequence
  SiRNA target sequence
acttggaattttgctttgcaatcaat

SEQ ID NO: 123667 - DNA, 26 bp, Artificial sequence
  SiRNA target sequence
cttggaattttgctttgcaatcaatt

SEQ ID NO: 123668 - DNA, 26 bp, Artificial sequence
  SiRNA target sequence
ttggaattttgctttgcaatcaattg

SEQ ID NO: 123669 - DNA, 26 bp, Artificial sequence
  SiRNA target sequence
tggaattttgctttgcaatcaattga

SEQ ID NO: 123670 - DNA, 26 bp, Artificial sequence
  SiRNA target sequence
ggaattttgctttgcaatcaattgac

SEQ ID NO: 123671 - DNA, 26 bp, Artificial sequence
  SiRNA target sequence
gaattttgctttgcaatcaattgacc

SEQ ID NO: 123672 - DNA, 26 bp, Artificial sequence
  SiRNA target sequence
aattttgctttgcaatcaattgacca

SEQ ID NO: 123673 - DNA, 26 bp, Artificial sequence
  SiRNA target sequence
attttgctttgcaatcaattgaccat

SEQ ID NO: 123674 - DNA, 26 bp, Artificial sequence
  SiRNA target sequence
ttttgctttgcaatcaattgaccata

SEQ ID NO: 123675 - DNA, 26 bp, Artificial sequence
  SiRNA target sequence
tttgctttgcaatcaattgaccatat

SEQ ID NO: 123676 - DNA, 26 bp, Artificial sequence
  SiRNA target sequence
ttgctttgcaatcaattgaccatatt

SEQ ID NO: 123677 - DNA, 26 bp, Artificial sequence
  SiRNA target sequence
tgctttgcaatcaattgaccatatta

SEQ ID NO: 123678 - DNA, 26 bp, Artificial sequence
  SiRNA target sequence
gctttgcaatcaattgaccatattat

SEQ ID NO: 123679 - DNA, 26 bp, Artificial sequence
  SiRNA target sequence
ctttgcaatcaattgaccatattatt

SEQ ID NO: 123680 - DNA, 26 bp, Artificial sequence
  SiRNA target sequence
tttgcaatcaattgaccatattatta

SEQ ID NO: 123681 - DNA, 26 bp, Artificial sequence
  SiRNA target sequence
ttgcaatcaattgaccatattattaa

SEQ ID NO: 123682 - DNA, 26 bp, Artificial sequence
  SiRNA target sequence
tgcaatcaattgaccatattattaat

SEQ ID NO: 123683 - DNA, 26 bp, Artificial sequence
  SiRNA target sequence
gcaatcaattgaccatattattaatt

SEQ ID NO: 123684 - DNA, 26 bp, Artificial sequence
  SiRNA target sequence
caatcaattgaccatattattaattc

SEQ ID NO: 123685 - DNA, 26 bp, Artificial sequence
  SiRNA target sequence
aatcaattgaccatattattaattct

SEQ ID NO: 123686 - DNA, 26 bp, Artificial sequence
  SiRNA target sequence
atcaattgaccatattattaattctt

SEQ ID NO: 123687 - DNA, 26 bp, Artificial sequence
  SiRNA target sequence
tcaattgaccatattattaattcttg

SEQ ID NO: 123688 - DNA, 26 bp, Artificial sequence
  SiRNA target sequence
caattgaccatattattaattcttgt

SEQ ID NO: 123689 - DNA, 26 bp, Artificial sequence
  SiRNA target sequence
aattgaccatattattaattcttgtg

SEQ ID NO: 123690 - DNA, 26 bp, Artificial sequence
  SiRNA target sequence
attgaccatattattaattcttgtgc

SEQ ID NO: 123691 - DNA, 26 bp, Artificial sequence
  SiRNA target sequence
ttgaccatattattaattcttgtgcg

SEQ ID NO: 123692 - DNA, 26 bp, Artificial sequence
  SiRNA target sequence
tgaccatattattaattcttgtgcga

SEQ ID NO: 123693 - DNA, 26 bp, Artificial sequence
  SiRNA target sequence
gaccatattattaattcttgtgcgaa

SEQ ID NO: 123694 - DNA, 26 bp, Artificial sequence
  SiRNA target sequence
accatattattaattcttgtgcgaaa

SEQ ID NO: 123695 - DNA, 26 bp, Artificial sequence
  SiRNA target sequence
ccatattattaattcttgtgcgaaaa

SEQ ID NO: 123696 - DNA, 26 bp, Artificial sequence
  SiRNA target sequence
catattattaattcttgtgcgaaaac

SEQ ID NO: 123697 - DNA, 26 bp, Artificial sequence
  SiRNA target sequence
atattattaattcttgtgcgaaaacc

SEQ ID NO: 123698 - DNA, 26 bp, Artificial sequence
  SiRNA target sequence
tattattaattcttgtgcgaaaacct

SEQ ID NO: 123699 - DNA, 26 bp, Artificial sequence
  SiRNA target sequence
attattaattcttgtgcgaaaacctt

SEQ ID NO: 123700 - DNA, 26 bp, Artificial sequence
  SiRNA target sequence
ttattaattcttgtgcgaaaaccttg

SEQ ID NO: 123701 - DNA, 26 bp, Artificial sequence
  SiRNA target sequence
tattaattcttgtgcgaaaaccttgt

SEQ ID NO: 123702 - DNA, 26 bp, Artificial sequence
  SiRNA target sequence
attaattcttgtgcgaaaaccttgta

SEQ ID NO: 123703 - DNA, 26 bp, Artificial sequence
  SiRNA target sequence
ttaattcttgtgcgaaaaccttgtat

SEQ ID NO: 123704 - DNA, 26 bp, Artificial sequence
  SiRNA target sequence
taattcttgtgcgaaaaccttgtata

SEQ ID NO: 123705 - DNA, 26 bp, Artificial sequence
  SiRNA target sequence
aattcttgtgcgaaaaccttgtatat

SEQ ID NO: 123706 - DNA, 26 bp, Artificial sequence
  SiRNA target sequence
attcttgtgcgaaaaccttgtatatg

SEQ ID NO: 123707 - DNA, 26 bp, Artificial sequence
  SiRNA target sequence
ttcttgtgcgaaaaccttgtatatgt

SEQ ID NO: 123708 - DNA, 26 bp, Artificial sequence
  SiRNA target sequence
tcttgtgcgaaaaccttgtatatgtc

SEQ ID NO: 123709 - DNA, 26 bp, Artificial sequence
  SiRNA target sequence
cttgtgcgaaaaccttgtatatgtca

SEQ ID NO: 123710 - DNA, 26 bp, Artificial sequence
  SiRNA target sequence
ttgtgcgaaaaccttgtatatgtcag

SEQ ID NO: 123711 - DNA, 26 bp, Artificial sequence
  SiRNA target sequence
tgtgcgaaaaccttgtatatgtcagg

SEQ ID NO: 123712 - DNA, 26 bp, Artificial sequence
  SiRNA target sequence
gtgcgaaaaccttgtatatgtcagga

SEQ ID NO: 123713 - DNA, 26 bp, Artificial sequence
  SiRNA target sequence
tgcgaaaaccttgtatatgtcaggag

SEQ ID NO: 123714 - DNA, 26 bp, Artificial sequence
  SiRNA target sequence
gcgaaaaccttgtatatgtcaggagg

SEQ ID NO: 123715 - DNA, 26 bp, Artificial sequence
  SiRNA target sequence
cgaaaaccttgtatatgtcaggagga

SEQ ID NO: 123716 - DNA, 26 bp, Artificial sequence
  SiRNA target sequence
gaaaaccttgtatatgtcaggaggaa

SEQ ID NO: 123717 - DNA, 26 bp, Artificial sequence
  SiRNA target sequence
aaaaccttgtatatgtcaggaggaag

SEQ ID NO: 123718 - DNA, 26 bp, Artificial sequence
  SiRNA target sequence
aaaccttgtatatgtcaggaggaaga

SEQ ID NO: 123719 - DNA, 26 bp, Artificial sequence
  SiRNA target sequence
aaccttgtatatgtcaggaggaagaa

SEQ ID NO: 123720 - DNA, 26 bp, Artificial sequence
  SiRNA target sequence
accttgtatatgtcaggaggaagaat

SEQ ID NO: 123721 - DNA, 26 bp, Artificial sequence
  SiRNA target sequence
ccttgtatatgtcaggaggaagaata

SEQ ID NO: 123722 - DNA, 26 bp, Artificial sequence
  SiRNA target sequence
cttgtatatgtcaggaggaagaatac

SEQ ID NO: 123723 - DNA, 26 bp, Artificial sequence
  SiRNA target sequence
ttgtatatgtcaggaggaagaataca

SEQ ID NO: 123724 - DNA, 26 bp, Artificial sequence
  SiRNA target sequence
tgtatatgtcaggaggaagaatacaa

SEQ ID NO: 123725 - DNA, 26 bp, Artificial sequence
  SiRNA target sequence
gtatatgtcaggaggaagaatacaat

SEQ ID NO: 123726 - DNA, 26 bp, Artificial sequence
  SiRNA target sequence
tatatgtcaggaggaagaatacaatg

SEQ ID NO: 123727 - DNA, 26 bp, Artificial sequence
  SiRNA target sequence
atatgtcaggaggaagaatacaatgt

SEQ ID NO: 123728 - DNA, 26 bp, Artificial sequence
  SiRNA target sequence
tatgtcaggaggaagaatacaatgtc

SEQ ID NO: 123729 - DNA, 26 bp, Artificial sequence
  SiRNA target sequence
atgtcaggaggaagaatacaatgtcc

SEQ ID NO: 123730 - DNA, 26 bp, Artificial sequence
  SiRNA target sequence
tgtcaggaggaagaatacaatgtcca

SEQ ID NO: 123731 - DNA, 26 bp, Artificial sequence
  SiRNA target sequence
gtcaggaggaagaatacaatgtccaa

SEQ ID NO: 123732 - DNA, 26 bp, Artificial sequence
  SiRNA target sequence
tcaggaggaagaatacaatgtccaat

SEQ ID NO: 123733 - DNA, 26 bp, Artificial sequence
  SiRNA target sequence
caggaggaagaatacaatgtccaatt

SEQ ID NO: 123734 - DNA, 26 bp, Artificial sequence
  SiRNA target sequence
aggaggaagaatacaatgtccaattg

SEQ ID NO: 123735 - DNA, 26 bp, Artificial sequence
  SiRNA target sequence
ggaggaagaatacaatgtccaattgt

SEQ ID NO: 123736 - DNA, 26 bp, Artificial sequence
  SiRNA target sequence
gaggaagaatacaatgtccaattgtt

SEQ ID NO: 123737 - DNA, 26 bp, Artificial sequence
  SiRNA target sequence
aggaagaatacaatgtccaattgttt

SEQ ID NO: 123738 - DNA, 26 bp, Artificial sequence
  SiRNA target sequence
ggaagaatacaatgtccaattgtttt

SEQ ID NO: 123739 - DNA, 26 bp, Artificial sequence
  SiRNA target sequence
gaagaatacaatgtccaattgttttt

SEQ ID NO: 123740 - DNA, 26 bp, Artificial sequence
  SiRNA target sequence
aagaatacaatgtccaattgttttta

SEQ ID NO: 123741 - DNA, 26 bp, Artificial sequence
  SiRNA target sequence
agaatacaatgtccaattgtttttag

SEQ ID NO: 123742 - DNA, 26 bp, Artificial sequence
  SiRNA target sequence
gaatacaatgtccaattgtttttagg

SEQ ID NO: 123743 - DNA, 26 bp, Artificial sequence
  SiRNA target sequence
aatacaatgtccaattgtttttaggg

SEQ ID NO: 123744 - DNA, 26 bp, Artificial sequence
  SiRNA target sequence
atacaatgtccaattgtttttagggg

SEQ ID NO: 123745 - DNA, 26 bp, Artificial sequence
  SiRNA target sequence
tacaatgtccaattgtttttagggga

SEQ ID NO: 123746 - DNA, 26 bp, Artificial sequence
  SiRNA target sequence
acaatgtccaattgtttttaggggac

SEQ ID NO: 123747 - DNA, 26 bp, Artificial sequence
  SiRNA target sequence
caatgtccaattgtttttaggggacc

SEQ ID NO: 123748 - DNA, 26 bp, Artificial sequence
  SiRNA target sequence
aatgtccaattgtttttaggggacca

SEQ ID NO: 123749 - DNA, 26 bp, Artificial sequence
  SiRNA target sequence
atgtccaattgtttttaggggaccaa

SEQ ID NO: 123750 - DNA, 26 bp, Artificial sequence
  SiRNA target sequence
tgtccaattgtttttaggggaccaaa

SEQ ID NO: 123751 - DNA, 26 bp, Artificial sequence
  SiRNA target sequence
gtccaattgtttttaggggaccaaat

SEQ ID NO: 123752 - DNA, 26 bp, Artificial sequence
  SiRNA target sequence
tccaattgtttttaggggaccaaatg

SEQ ID NO: 123753 - DNA, 26 bp, Artificial sequence
  SiRNA target sequence
ccaattgtttttaggggaccaaatgg

SEQ ID NO: 123754 - DNA, 26 bp, Artificial sequence
  SiRNA target sequence
caattgtttttaggggaccaaatgga

SEQ ID NO: 123755 - DNA, 26 bp, Artificial sequence
  SiRNA target sequence
aattgtttttaggggaccaaatggat

SEQ ID NO: 123756 - DNA, 26 bp, Artificial sequence
  SiRNA target sequence
attgtttttaggggaccaaatggatt

SEQ ID NO: 123757 - DNA, 26 bp, Artificial sequence
  SiRNA target sequence
ttgtttttaggggaccaaatggattc

SEQ ID NO: 123758 - DNA, 26 bp, Artificial sequence
  SiRNA target sequence
tgtttttaggggaccaaatggattca

SEQ ID NO: 123759 - DNA, 26 bp, Artificial sequence
  SiRNA target sequence
gtttttaggggaccaaatggattcaa

SEQ ID NO: 123760 - DNA, 26 bp, Artificial sequence
  SiRNA target sequence
tttttaggggaccaaatggattcaat

SEQ ID NO: 123761 - DNA, 26 bp, Artificial sequence
  SiRNA target sequence
ttttaggggaccaaatggattcaata

SEQ ID NO: 123762 - DNA, 26 bp, Artificial sequence
  SiRNA target sequence
tttaggggaccaaatggattcaataa

SEQ ID NO: 123763 - DNA, 26 bp, Artificial sequence
  SiRNA target sequence
ttaggggaccaaatggattcaataat

SEQ ID NO: 123764 - DNA, 26 bp, Artificial sequence
  SiRNA target sequence
taggggaccaaatggattcaataatg

SEQ ID NO: 123765 - DNA, 26 bp, Artificial sequence
  SiRNA target sequence
aggggaccaaatggattcaataatgg

SEQ ID NO: 123766 - DNA, 26 bp, Artificial sequence
  SiRNA target sequence
ggggaccaaatggattcaataatggg

SEQ ID NO: 123767 - DNA, 26 bp, Artificial sequence
  SiRNA target sequence
gggaccaaatggattcaataatgggt

SEQ ID NO: 123768 - DNA, 26 bp, Artificial sequence
  SiRNA target sequence
ggaccaaatggattcaataatgggta

SEQ ID NO: 123769 - DNA, 26 bp, Artificial sequence
  SiRNA target sequence
gaccaaatggattcaataatgggtac

SEQ ID NO: 123770 - DNA, 26 bp, Artificial sequence
  SiRNA target sequence
accaaatggattcaataatgggtacg

SEQ ID NO: 123771 - DNA, 26 bp, Artificial sequence
  SiRNA target sequence
ccaaatggattcaataatgggtacgc

SEQ ID NO: 123772 - DNA, 26 bp, Artificial sequence
  SiRNA target sequence
caaatggattcaataatgggtacgct

SEQ ID NO: 123773 - DNA, 26 bp, Artificial sequence
  SiRNA target sequence
aaatggattcaataatgggtacgctg

SEQ ID NO: 123774 - DNA, 26 bp, Artificial sequence
  SiRNA target sequence
aatggattcaataatgggtacgctgc

SEQ ID NO: 123775 - DNA, 26 bp, Artificial sequence
  SiRNA target sequence
atggattcaataatgggtacgctgca

SEQ ID NO: 123776 - DNA, 26 bp, Artificial sequence
  SiRNA target sequence
tggattcaataatgggtacgctgcac

SEQ ID NO: 123777 - DNA, 26 bp, Artificial sequence
  SiRNA target sequence
ggattcaataatgggtacgctgcaca

SEQ ID NO: 123778 - DNA, 26 bp, Artificial sequence
  SiRNA target sequence
gattcaataatgggtacgctgcacag

SEQ ID NO: 123779 - DNA, 26 bp, Artificial sequence
  SiRNA target sequence
attcaataatgggtacgctgcacagc

SEQ ID NO: 123780 - DNA, 26 bp, Artificial sequence
  SiRNA target sequence
ttcaataatgggtacgctgcacagca

SEQ ID NO: 123781 - DNA, 26 bp, Artificial sequence
  SiRNA target sequence
tcaataatgggtacgctgcacagcac

SEQ ID NO: 123782 - DNA, 26 bp, Artificial sequence
  SiRNA target sequence
caataatgggtacgctgcacagcaca

SEQ ID NO: 123783 - DNA, 26 bp, Artificial sequence
  SiRNA target sequence
aataatgggtacgctgcacagcacac

SEQ ID NO: 123784 - DNA, 26 bp, Artificial sequence
  SiRNA target sequence
ataatgggtacgctgcacagcacaca

SEQ ID NO: 123785 - DNA, 26 bp, Artificial sequence
  SiRNA target sequence
taatgggtacgctgcacagcacacac

SEQ ID NO: 123786 - DNA, 26 bp, Artificial sequence
  SiRNA target sequence
aatgggtacgctgcacagcacacaca

SEQ ID NO: 123787 - DNA, 26 bp, Artificial sequence
  SiRNA target sequence
atgggtacgctgcacagcacacacaa

SEQ ID NO: 123788 - DNA, 26 bp, Artificial sequence
  SiRNA target sequence
tgggtacgctgcacagcacacacaag

SEQ ID NO: 123789 - DNA, 26 bp, Artificial sequence
  SiRNA target sequence
gggtacgctgcacagcacacacaaga

SEQ ID NO: 123790 - DNA, 26 bp, Artificial sequence
  SiRNA target sequence
ggtacgctgcacagcacacacaagat

SEQ ID NO: 123791 - DNA, 26 bp, Artificial sequence
  SiRNA target sequence
gtacgctgcacagcacacacaagatt

SEQ ID NO: 123792 - DNA, 26 bp, Artificial sequence
  SiRNA target sequence
tacgctgcacagcacacacaagattt

SEQ ID NO: 123793 - DNA, 26 bp, Artificial sequence
  SiRNA target sequence
acgctgcacagcacacacaagatttt

SEQ ID NO: 123794 - DNA, 26 bp, Artificial sequence
  SiRNA target sequence
cgctgcacagcacacacaagattttg

SEQ ID NO: 123795 - DNA, 26 bp, Artificial sequence
  SiRNA target sequence
gctgcacagcacacacaagattttgc

SEQ ID NO: 123796 - DNA, 26 bp, Artificial sequence
  SiRNA target sequence
ctgcacagcacacacaagattttgca

SEQ ID NO: 123797 - DNA, 26 bp, Artificial sequence
  SiRNA target sequence
tgcacagcacacacaagattttgcac

SEQ ID NO: 123798 - DNA, 26 bp, Artificial sequence
  SiRNA target sequence
gcacagcacacacaagattttgcacc

SEQ ID NO: 123799 - DNA, 26 bp, Artificial sequence
  SiRNA target sequence
cacagcacacacaagattttgcacca

SEQ ID NO: 123800 - DNA, 26 bp, Artificial sequence
  SiRNA target sequence
acagcacacacaagattttgcaccaa

SEQ ID NO: 123801 - DNA, 26 bp, Artificial sequence
  SiRNA target sequence
cagcacacacaagattttgcaccaat

SEQ ID NO: 123802 - DNA, 26 bp, Artificial sequence
  SiRNA target sequence
agcacacacaagattttgcaccaata

SEQ ID NO: 123803 - DNA, 26 bp, Artificial sequence
  SiRNA target sequence
gcacacacaagattttgcaccaatat

SEQ ID NO: 123804 - DNA, 26 bp, Artificial sequence
  SiRNA target sequence
cacacacaagattttgcaccaatata

SEQ ID NO: 123805 - DNA, 26 bp, Artificial sequence
  SiRNA target sequence
acacacaagattttgcaccaatatat

SEQ ID NO: 123806 - DNA, 26 bp, Artificial sequence
  SiRNA target sequence
cacacaagattttgcaccaatatatg

SEQ ID NO: 123807 - DNA, 26 bp, Artificial sequence
  SiRNA target sequence
acacaagattttgcaccaatatatgg

SEQ ID NO: 123808 - DNA, 26 bp, Artificial sequence
  SiRNA target sequence
cacaagattttgcaccaatatatggt

SEQ ID NO: 123809 - DNA, 26 bp, Artificial sequence
  SiRNA target sequence
acaagattttgcaccaatatatggtt

SEQ ID NO: 123810 - DNA, 26 bp, Artificial sequence
  SiRNA target sequence
caagattttgcaccaatatatggttc

SEQ ID NO: 123811 - DNA, 26 bp, Artificial sequence
  SiRNA target sequence
aagattttgcaccaatatatggttct

SEQ ID NO: 123812 - DNA, 26 bp, Artificial sequence
  SiRNA target sequence
agattttgcaccaatatatggttcta

SEQ ID NO: 123813 - DNA, 26 bp, Artificial sequence
  SiRNA target sequence
gattttgcaccaatatatggttctat

SEQ ID NO: 123814 - DNA, 26 bp, Artificial sequence
  SiRNA target sequence
attttgcaccaatatatggttctatt

SEQ ID NO: 123815 - DNA, 26 bp, Artificial sequence
  SiRNA target sequence
ttttgcaccaatatatggttctattc

SEQ ID NO: 123816 - DNA, 26 bp, Artificial sequence
  SiRNA target sequence
tttgcaccaatatatggttctattcc

SEQ ID NO: 123817 - DNA, 26 bp, Artificial sequence
  SiRNA target sequence
ttgcaccaatatatggttctattcca

SEQ ID NO: 123818 - DNA, 26 bp, Artificial sequence
  SiRNA target sequence
tgcaccaatatatggttctattccag

SEQ ID NO: 123819 - DNA, 26 bp, Artificial sequence
  SiRNA target sequence
gcaccaatatatggttctattccagg

SEQ ID NO: 123820 - DNA, 26 bp, Artificial sequence
  SiRNA target sequence
caccaatatatggttctattccaggc

SEQ ID NO: 123821 - DNA, 26 bp, Artificial sequence
  SiRNA target sequence
accaatatatggttctattccaggcc

SEQ ID NO: 123822 - DNA, 26 bp, Artificial sequence
  SiRNA target sequence
ccaatatatggttctattccaggcct

SEQ ID NO: 123823 - DNA, 26 bp, Artificial sequence
  SiRNA target sequence
caatatatggttctattccaggcctt

SEQ ID NO: 123824 - DNA, 26 bp, Artificial sequence
  SiRNA target sequence
aatatatggttctattccaggcctta

SEQ ID NO: 123825 - DNA, 26 bp, Artificial sequence
  SiRNA target sequence
atatatggttctattccaggccttaa

SEQ ID NO: 123826 - DNA, 26 bp, Artificial sequence
  SiRNA target sequence
tatatggttctattccaggccttaag

SEQ ID NO: 123827 - DNA, 26 bp, Artificial sequence
  SiRNA target sequence
atatggttctattccaggccttaagg

SEQ ID NO: 123828 - DNA, 26 bp, Artificial sequence
  SiRNA target sequence
tatggttctattccaggccttaaggt

SEQ ID NO: 123829 - DNA, 26 bp, Artificial sequence
  SiRNA target sequence
atggttctattccaggccttaaggtg

SEQ ID NO: 123830 - DNA, 26 bp, Artificial sequence
  SiRNA target sequence
tggttctattccaggccttaaggtgg

SEQ ID NO: 123831 - DNA, 26 bp, Artificial sequence
  SiRNA target sequence
ggttctattccaggccttaaggtggt

SEQ ID NO: 123832 - DNA, 26 bp, Artificial sequence
  SiRNA target sequence
gttctattccaggccttaaggtggtt

SEQ ID NO: 123833 - DNA, 26 bp, Artificial sequence
  SiRNA target sequence
ttctattccaggccttaaggtggttt

SEQ ID NO: 123834 - DNA, 26 bp, Artificial sequence
  SiRNA target sequence
tctattccaggccttaaggtggtttg

SEQ ID NO: 123835 - DNA, 26 bp, Artificial sequence
  SiRNA target sequence
ctattccaggccttaaggtggtttgt

SEQ ID NO: 123836 - DNA, 26 bp, Artificial sequence
  SiRNA target sequence
tattccaggccttaaggtggtttgtc

SEQ ID NO: 123837 - DNA, 26 bp, Artificial sequence
  SiRNA target sequence
attccaggccttaaggtggtttgtcc

SEQ ID NO: 123838 - DNA, 26 bp, Artificial sequence
  SiRNA target sequence
ttccaggccttaaggtggtttgtcct

SEQ ID NO: 123839 - DNA, 26 bp, Artificial sequence
  SiRNA target sequence
tccaggccttaaggtggtttgtcctt

SEQ ID NO: 123840 - DNA, 26 bp, Artificial sequence
  SiRNA target sequence
ccaggccttaaggtggtttgtcctta

SEQ ID NO: 123841 - DNA, 26 bp, Artificial sequence
  SiRNA target sequence
caggccttaaggtggtttgtccttat

SEQ ID NO: 123842 - DNA, 26 bp, Artificial sequence
  SiRNA target sequence
aggccttaaggtggtttgtccttata

SEQ ID NO: 123843 - DNA, 26 bp, Artificial sequence
  SiRNA target sequence
ggccttaaggtggtttgtccttatac

SEQ ID NO: 123844 - DNA, 26 bp, Artificial sequence
  SiRNA target sequence
gccttaaggtggtttgtccttatacg

SEQ ID NO: 123845 - DNA, 26 bp, Artificial sequence
  SiRNA target sequence
ccttaaggtggtttgtccttatacgg

SEQ ID NO: 123846 - DNA, 26 bp, Artificial sequence
  SiRNA target sequence
cttaaggtggtttgtccttatacggg

SEQ ID NO: 123847 - DNA, 26 bp, Artificial sequence
  SiRNA target sequence
ttaaggtggtttgtccttatacgggt

SEQ ID NO: 123848 - DNA, 26 bp, Artificial sequence
  SiRNA target sequence
taaggtggtttgtccttatacgggta

SEQ ID NO: 123849 - DNA, 26 bp, Artificial sequence
  SiRNA target sequence
aaggtggtttgtccttatacgggtaa

SEQ ID NO: 123850 - DNA, 26 bp, Artificial sequence
  SiRNA target sequence
aggtggtttgtccttatacgggtaaa

SEQ ID NO: 123851 - DNA, 26 bp, Artificial sequence
  SiRNA target sequence
ggtggtttgtccttatacgggtaaag

SEQ ID NO: 123852 - DNA, 26 bp, Artificial sequence
  SiRNA target sequence
gtggtttgtccttatacgggtaaaga

SEQ ID NO: 123853 - DNA, 26 bp, Artificial sequence
  SiRNA target sequence
tggtttgtccttatacgggtaaagac

SEQ ID NO: 123854 - DNA, 26 bp, Artificial sequence
  SiRNA target sequence
ggtttgtccttatacgggtaaagacc

SEQ ID NO: 123855 - DNA, 26 bp, Artificial sequence
  SiRNA target sequence
gtttgtccttatacgggtaaagacca

SEQ ID NO: 123856 - DNA, 26 bp, Artificial sequence
  SiRNA target sequence
tttgtccttatacgggtaaagaccat

SEQ ID NO: 123857 - DNA, 26 bp, Artificial sequence
  SiRNA target sequence
ttgtccttatacgggtaaagaccata

SEQ ID NO: 123858 - DNA, 26 bp, Artificial sequence
  SiRNA target sequence
tgtccttatacgggtaaagaccataa

SEQ ID NO: 123859 - DNA, 26 bp, Artificial sequence
  SiRNA target sequence
gtccttatacgggtaaagaccataaa

SEQ ID NO: 123860 - DNA, 26 bp, Artificial sequence
  SiRNA target sequence
tccttatacgggtaaagaccataaag

SEQ ID NO: 123861 - DNA, 26 bp, Artificial sequence
  SiRNA target sequence
ccttatacgggtaaagaccataaagg

SEQ ID NO: 123862 - DNA, 26 bp, Artificial sequence
  SiRNA target sequence
cttatacgggtaaagaccataaagga

SEQ ID NO: 123863 - DNA, 26 bp, Artificial sequence
  SiRNA target sequence
ttatacgggtaaagaccataaaggac

SEQ ID NO: 123864 - DNA, 26 bp, Artificial sequence
  SiRNA target sequence
tatacgggtaaagaccataaaggact

SEQ ID NO: 123865 - DNA, 26 bp, Artificial sequence
  SiRNA target sequence
atacgggtaaagaccataaaggactt

SEQ ID NO: 123866 - DNA, 26 bp, Artificial sequence
  SiRNA target sequence
tacgggtaaagaccataaaggacttt

SEQ ID NO: 123867 - DNA, 26 bp, Artificial sequence
  SiRNA target sequence
acgggtaaagaccataaaggactttt

SEQ ID NO: 123868 - DNA, 26 bp, Artificial sequence
  SiRNA target sequence
cgggtaaagaccataaaggactttta

SEQ ID NO: 123869 - DNA, 26 bp, Artificial sequence
  SiRNA target sequence
gggtaaagaccataaaggacttttaa

SEQ ID NO: 123870 - DNA, 26 bp, Artificial sequence
  SiRNA target sequence
ggtaaagaccataaaggacttttaaa

SEQ ID NO: 123871 - DNA, 26 bp, Artificial sequence
  SiRNA target sequence
gtaaagaccataaaggacttttaaaa

SEQ ID NO: 123872 - DNA, 26 bp, Artificial sequence
  SiRNA target sequence
taaagaccataaaggacttttaaaaa

SEQ ID NO: 123873 - DNA, 26 bp, Artificial sequence
  SiRNA target sequence
aaagaccataaaggacttttaaaaag

SEQ ID NO: 123874 - DNA, 26 bp, Artificial sequence
  SiRNA target sequence
aagaccataaaggacttttaaaaagc

SEQ ID NO: 123875 - DNA, 26 bp, Artificial sequence
  SiRNA target sequence
agaccataaaggacttttaaaaagcg

SEQ ID NO: 123876 - DNA, 26 bp, Artificial sequence
  SiRNA target sequence
gaccataaaggacttttaaaaagcgc

SEQ ID NO: 123877 - DNA, 26 bp, Artificial sequence
  SiRNA target sequence
accataaaggacttttaaaaagcgct

SEQ ID NO: 123878 - DNA, 26 bp, Artificial sequence
  SiRNA target sequence
ccataaaggacttttaaaaagcgcta

SEQ ID NO: 123879 - DNA, 26 bp, Artificial sequence
  SiRNA target sequence
cataaaggacttttaaaaagcgctat

SEQ ID NO: 123880 - DNA, 26 bp, Artificial sequence
  SiRNA target sequence
ataaaggacttttaaaaagcgctatt

SEQ ID NO: 123881 - DNA, 26 bp, Artificial sequence
  SiRNA target sequence
taaaggacttttaaaaagcgctatta

SEQ ID NO: 123882 - DNA, 26 bp, Artificial sequence
  SiRNA target sequence
aaaggacttttaaaaagcgctattag

SEQ ID NO: 123883 - DNA, 26 bp, Artificial sequence
  SiRNA target sequence
aaggacttttaaaaagcgctattaga

SEQ ID NO: 123884 - DNA, 26 bp, Artificial sequence
  SiRNA target sequence
aggacttttaaaaagcgctattagag

SEQ ID NO: 123885 - DNA, 26 bp, Artificial sequence
  SiRNA target sequence
ggacttttaaaaagcgctattagaga

SEQ ID NO: 123886 - DNA, 26 bp, Artificial sequence
  SiRNA target sequence
gacttttaaaaagcgctattagagac

SEQ ID NO: 123887 - DNA, 26 bp, Artificial sequence
  SiRNA target sequence
acttttaaaaagcgctattagagaca

SEQ ID NO: 123888 - DNA, 26 bp, Artificial sequence
  SiRNA target sequence
cttttaaaaagcgctattagagacaa

SEQ ID NO: 123889 - DNA, 26 bp, Artificial sequence
  SiRNA target sequence
ttttaaaaagcgctattagagacaat

SEQ ID NO: 123890 - DNA, 26 bp, Artificial sequence
  SiRNA target sequence
tttaaaaagcgctattagagacaata

SEQ ID NO: 123891 - DNA, 26 bp, Artificial sequence
  SiRNA target sequence
ttaaaaagcgctattagagacaataa

SEQ ID NO: 123892 - DNA, 26 bp, Artificial sequence
  SiRNA target sequence
taaaaagcgctattagagacaataac

SEQ ID NO: 123893 - DNA, 26 bp, Artificial sequence
  SiRNA target sequence
aaaaagcgctattagagacaataacc

SEQ ID NO: 123894 - DNA, 26 bp, Artificial sequence
  SiRNA target sequence
aaaagcgctattagagacaataaccc

SEQ ID NO: 123895 - DNA, 26 bp, Artificial sequence
  SiRNA target sequence
aaagcgctattagagacaataacccg

SEQ ID NO: 123896 - DNA, 26 bp, Artificial sequence
  SiRNA target sequence
aagcgctattagagacaataacccgg

SEQ ID NO: 123897 - DNA, 26 bp, Artificial sequence
  SiRNA target sequence
agcgctattagagacaataacccggt

SEQ ID NO: 123898 - DNA, 26 bp, Artificial sequence
  SiRNA target sequence
gcgctattagagacaataacccggtt

SEQ ID NO: 123899 - DNA, 26 bp, Artificial sequence
  SiRNA target sequence
cgctattagagacaataacccggtta

SEQ ID NO: 123900 - DNA, 26 bp, Artificial sequence
  SiRNA target sequence
gctattagagacaataacccggttat

SEQ ID NO: 123901 - DNA, 26 bp, Artificial sequence
  SiRNA target sequence
ctattagagacaataacccggttata

SEQ ID NO: 123902 - DNA, 26 bp, Artificial sequence
  SiRNA target sequence
tattagagacaataacccggttatat

SEQ ID NO: 123903 - DNA, 26 bp, Artificial sequence
  SiRNA target sequence
attagagacaataacccggttatatt

SEQ ID NO: 123904 - DNA, 26 bp, Artificial sequence
  SiRNA target sequence
ttagagacaataacccggttatattt

SEQ ID NO: 123905 - DNA, 26 bp, Artificial sequence
  SiRNA target sequence
tagagacaataacccggttatatttc

SEQ ID NO: 123906 - DNA, 26 bp, Artificial sequence
  SiRNA target sequence
agagacaataacccggttatatttct

SEQ ID NO: 123907 - DNA, 26 bp, Artificial sequence
  SiRNA target sequence
gagacaataacccggttatatttctt

SEQ ID NO: 123908 - DNA, 26 bp, Artificial sequence
  SiRNA target sequence
agacaataacccggttatatttcttg

SEQ ID NO: 123909 - DNA, 26 bp, Artificial sequence
  SiRNA target sequence
gacaataacccggttatatttcttga

SEQ ID NO: 123910 - DNA, 26 bp, Artificial sequence
  SiRNA target sequence
acaataacccggttatatttcttgag

SEQ ID NO: 123911 - DNA, 26 bp, Artificial sequence
  SiRNA target sequence
caataacccggttatatttcttgaga

SEQ ID NO: 123912 - DNA, 26 bp, Artificial sequence
  SiRNA target sequence
aataacccggttatatttcttgagaa

SEQ ID NO: 123913 - DNA, 26 bp, Artificial sequence
  SiRNA target sequence
ataacccggttatatttcttgagaat

SEQ ID NO: 123914 - DNA, 26 bp, Artificial sequence
  SiRNA target sequence
taacccggttatatttcttgagaatg

SEQ ID NO: 123915 - DNA, 26 bp, Artificial sequence
  SiRNA target sequence
aacccggttatatttcttgagaatga

SEQ ID NO: 123916 - DNA, 26 bp, Artificial sequence
  SiRNA target sequence
acccggttatatttcttgagaatgaa

SEQ ID NO: 123917 - DNA, 26 bp, Artificial sequence
  SiRNA target sequence
cccggttatatttcttgagaatgaaa

SEQ ID NO: 123918 - DNA, 26 bp, Artificial sequence
  SiRNA target sequence
ccggttatatttcttgagaatgaaat

SEQ ID NO: 123919 - DNA, 26 bp, Artificial sequence
  SiRNA target sequence
cggttatatttcttgagaatgaaata

SEQ ID NO: 123920 - DNA, 26 bp, Artificial sequence
  SiRNA target sequence
ggttatatttcttgagaatgaaatat

SEQ ID NO: 123921 - DNA, 26 bp, Artificial sequence
  SiRNA target sequence
gttatatttcttgagaatgaaatatt

SEQ ID NO: 123922 - DNA, 26 bp, Artificial sequence
  SiRNA target sequence
ttatatttcttgagaatgaaatatta

SEQ ID NO: 123923 - DNA, 26 bp, Artificial sequence
  SiRNA target sequence
tatatttcttgagaatgaaatattat

SEQ ID NO: 123924 - DNA, 26 bp, Artificial sequence
  SiRNA target sequence
atatttcttgagaatgaaatattata

SEQ ID NO: 123925 - DNA, 26 bp, Artificial sequence
  SiRNA target sequence
tatttcttgagaatgaaatattatat

SEQ ID NO: 123926 - DNA, 26 bp, Artificial sequence
  SiRNA target sequence
atttcttgagaatgaaatattatata

SEQ ID NO: 123927 - DNA, 26 bp, Artificial sequence
  SiRNA target sequence
tttcttgagaatgaaatattatataa

SEQ ID NO: 123928 - DNA, 26 bp, Artificial sequence
  SiRNA target sequence
ttcttgagaatgaaatattatataaa

SEQ ID NO: 123929 - DNA, 26 bp, Artificial sequence
  SiRNA target sequence
tcttgagaatgaaatattatataaag

SEQ ID NO: 123930 - DNA, 26 bp, Artificial sequence
  SiRNA target sequence
cttgagaatgaaatattatataaaga

SEQ ID NO: 123931 - DNA, 26 bp, Artificial sequence
  SiRNA target sequence
ttgagaatgaaatattatataaagat

SEQ ID NO: 123932 - DNA, 26 bp, Artificial sequence
  SiRNA target sequence
tgagaatgaaatattatataaagata

SEQ ID NO: 123933 - DNA, 26 bp, Artificial sequence
  SiRNA target sequence
gagaatgaaatattatataaagataa

SEQ ID NO: 123934 - DNA, 26 bp, Artificial sequence
  SiRNA target sequence
agaatgaaatattatataaagataaa

SEQ ID NO: 123935 - DNA, 26 bp, Artificial sequence
  SiRNA target sequence
gaatgaaatattatataaagataaat

SEQ ID NO: 123936 - DNA, 26 bp, Artificial sequence
  SiRNA target sequence
aatgaaatattatataaagataaata

SEQ ID NO: 123937 - DNA, 26 bp, Artificial sequence
  SiRNA target sequence
atgaaatattatataaagataaatac

SEQ ID NO: 123938 - DNA, 26 bp, Artificial sequence
  SiRNA target sequence
tgaaatattatataaagataaatacc

SEQ ID NO: 123939 - DNA, 26 bp, Artificial sequence
  SiRNA target sequence
gaaatattatataaagataaatacct

SEQ ID NO: 123940 - DNA, 26 bp, Artificial sequence
  SiRNA target sequence
aaatattatataaagataaatacctt

SEQ ID NO: 123941 - DNA, 26 bp, Artificial sequence
  SiRNA target sequence
aatattatataaagataaataccttg

SEQ ID NO: 123942 - DNA, 26 bp, Artificial sequence
  SiRNA target sequence
atattatataaagataaataccttga

SEQ ID NO: 123943 - DNA, 26 bp, Artificial sequence
  SiRNA target sequence
tattatataaagataaataccttgaa

SEQ ID NO: 123944 - DNA, 26 bp, Artificial sequence
  SiRNA target sequence
attatataaagataaataccttgaag

SEQ ID NO: 123945 - DNA, 26 bp, Artificial sequence
  SiRNA target sequence
ttatataaagataaataccttgaagt

SEQ ID NO: 123946 - DNA, 26 bp, Artificial sequence
  SiRNA target sequence
tatataaagataaataccttgaagtg

SEQ ID NO: 123947 - DNA, 26 bp, Artificial sequence
  SiRNA target sequence
atataaagataaataccttgaagtgt

SEQ ID NO: 123948 - DNA, 26 bp, Artificial sequence
  SiRNA target sequence
tataaagataaataccttgaagtgtc

SEQ ID NO: 123949 - DNA, 26 bp, Artificial sequence
  SiRNA target sequence
ataaagataaataccttgaagtgtct

SEQ ID NO: 123950 - DNA, 26 bp, Artificial sequence
  SiRNA target sequence
taaagataaataccttgaagtgtcta

SEQ ID NO: 123951 - DNA, 26 bp, Artificial sequence
  SiRNA target sequence
aaagataaataccttgaagtgtctaa

SEQ ID NO: 123952 - DNA, 26 bp, Artificial sequence
  SiRNA target sequence
aagataaataccttgaagtgtctaat

SEQ ID NO: 123953 - DNA, 26 bp, Artificial sequence
  SiRNA target sequence
agataaataccttgaagtgtctaata

SEQ ID NO: 123954 - DNA, 26 bp, Artificial sequence
  SiRNA target sequence
gataaataccttgaagtgtctaataa

SEQ ID NO: 123955 - DNA, 26 bp, Artificial sequence
  SiRNA target sequence
ataaataccttgaagtgtctaataat

SEQ ID NO: 123956 - DNA, 26 bp, Artificial sequence
  SiRNA target sequence
taaataccttgaagtgtctaataatt

SEQ ID NO: 123957 - DNA, 26 bp, Artificial sequence
  SiRNA target sequence
aaataccttgaagtgtctaataatta

SEQ ID NO: 123958 - DNA, 26 bp, Artificial sequence
  SiRNA target sequence
aataccttgaagtgtctaataattat

SEQ ID NO: 123959 - DNA, 26 bp, Artificial sequence
  SiRNA target sequence
ataccttgaagtgtctaataattata

SEQ ID NO: 123960 - DNA, 26 bp, Artificial sequence
  SiRNA target sequence
taccttgaagtgtctaataattatat

SEQ ID NO: 123961 - DNA, 26 bp, Artificial sequence
  SiRNA target sequence
accttgaagtgtctaataattatatt

SEQ ID NO: 123962 - DNA, 26 bp, Artificial sequence
  SiRNA target sequence
ccttgaagtgtctaataattatattc

SEQ ID NO: 123963 - DNA, 26 bp, Artificial sequence
  SiRNA target sequence
cttgaagtgtctaataattatattca

SEQ ID NO: 123964 - DNA, 26 bp, Artificial sequence
  SiRNA target sequence
ttgaagtgtctaataattatattcaa

SEQ ID NO: 123965 - DNA, 26 bp, Artificial sequence
  SiRNA target sequence
tgaagtgtctaataattatattcaac

SEQ ID NO: 123966 - DNA, 26 bp, Artificial sequence
  SiRNA target sequence
gaagtgtctaataattatattcaacc

SEQ ID NO: 123967 - DNA, 26 bp, Artificial sequence
  SiRNA target sequence
aagtgtctaataattatattcaacca

SEQ ID NO: 123968 - DNA, 26 bp, Artificial sequence
  SiRNA target sequence
agtgtctaataattatattcaaccac

SEQ ID NO: 123969 - DNA, 26 bp, Artificial sequence
  SiRNA target sequence
gtgtctaataattatattcaaccact

SEQ ID NO: 123970 - DNA, 26 bp, Artificial sequence
  SiRNA target sequence
tgtctaataattatattcaaccactt

SEQ ID NO: 123971 - DNA, 26 bp, Artificial sequence
  SiRNA target sequence
gtctaataattatattcaaccacttg

SEQ ID NO: 123972 - DNA, 26 bp, Artificial sequence
  SiRNA target sequence
tctaataattatattcaaccacttga

SEQ ID NO: 123973 - DNA, 26 bp, Artificial sequence
  SiRNA target sequence
ctaataattatattcaaccacttgac

SEQ ID NO: 123974 - DNA, 26 bp, Artificial sequence
  SiRNA target sequence
taataattatattcaaccacttgaca

SEQ ID NO: 123975 - DNA, 26 bp, Artificial sequence
  SiRNA target sequence
aataattatattcaaccacttgacaa

SEQ ID NO: 123976 - DNA, 26 bp, Artificial sequence
  SiRNA target sequence
ataattatattcaaccacttgacaag

SEQ ID NO: 123977 - DNA, 26 bp, Artificial sequence
  SiRNA target sequence
taattatattcaaccacttgacaagg

SEQ ID NO: 123978 - DNA, 26 bp, Artificial sequence
  SiRNA target sequence
aattatattcaaccacttgacaaggc

SEQ ID NO: 123979 - DNA, 26 bp, Artificial sequence
  SiRNA target sequence
attatattcaaccacttgacaaggca

SEQ ID NO: 123980 - DNA, 26 bp, Artificial sequence
  SiRNA target sequence
ttatattcaaccacttgacaaggcag

SEQ ID NO: 123981 - DNA, 26 bp, Artificial sequence
  SiRNA target sequence
tatattcaaccacttgacaaggcagt

SEQ ID NO: 123982 - DNA, 26 bp, Artificial sequence
  SiRNA target sequence
atattcaaccacttgacaaggcagta

SEQ ID NO: 123983 - DNA, 26 bp, Artificial sequence
  SiRNA target sequence
tattcaaccacttgacaaggcagtaa

SEQ ID NO: 123984 - DNA, 26 bp, Artificial sequence
  SiRNA target sequence
attcaaccacttgacaaggcagtaat

SEQ ID NO: 123985 - DNA, 26 bp, Artificial sequence
  SiRNA target sequence
ttcaaccacttgacaaggcagtaatt

SEQ ID NO: 123986 - DNA, 26 bp, Artificial sequence
  SiRNA target sequence
tcaaccacttgacaaggcagtaattg

SEQ ID NO: 123987 - DNA, 26 bp, Artificial sequence
  SiRNA target sequence
caaccacttgacaaggcagtaattga

SEQ ID NO: 123988 - DNA, 26 bp, Artificial sequence
  SiRNA target sequence
aaccacttgacaaggcagtaattgaa

SEQ ID NO: 123989 - DNA, 26 bp, Artificial sequence
  SiRNA target sequence
accacttgacaaggcagtaattgaaa

SEQ ID NO: 123990 - DNA, 26 bp, Artificial sequence
  SiRNA target sequence
ccacttgacaaggcagtaattgaaaa

SEQ ID NO: 123991 - DNA, 26 bp, Artificial sequence
  SiRNA target sequence
cacttgacaaggcagtaattgaaaaa

SEQ ID NO: 123992 - DNA, 26 bp, Artificial sequence
  SiRNA target sequence
acttgacaaggcagtaattgaaaaaa

SEQ ID NO: 123993 - DNA, 26 bp, Artificial sequence
  SiRNA target sequence
cttgacaaggcagtaattgaaaaaaa

SEQ ID NO: 123994 - DNA, 26 bp, Artificial sequence
  SiRNA target sequence
ttgacaaggcagtaattgaaaaaaat

SEQ ID NO: 123995 - DNA, 26 bp, Artificial sequence
  SiRNA target sequence
tgacaaggcagtaattgaaaaaaatg

SEQ ID NO: 123996 - DNA, 26 bp, Artificial sequence
  SiRNA target sequence
gacaaggcagtaattgaaaaaaatgg

SEQ ID NO: 123997 - DNA, 26 bp, Artificial sequence
  SiRNA target sequence
acaaggcagtaattgaaaaaaatggt

SEQ ID NO: 123998 - DNA, 26 bp, Artificial sequence
  SiRNA target sequence
caaggcagtaattgaaaaaaatggtg

SEQ ID NO: 123999 - DNA, 26 bp, Artificial sequence
  SiRNA target sequence
aaggcagtaattgaaaaaaatggtgt

SEQ ID NO: 124000 - DNA, 26 bp, Artificial sequence
  SiRNA target sequence
aggcagtaattgaaaaaaatggtgtt

SEQ ID NO: 124001 - DNA, 26 bp, Artificial sequence
  SiRNA target sequence
ggcagtaattgaaaaaaatggtgttg

SEQ ID NO: 124002 - DNA, 26 bp, Artificial sequence
  SiRNA target sequence
gcagtaattgaaaaaaatggtgttga

SEQ ID NO: 124003 - DNA, 26 bp, Artificial sequence
  SiRNA target sequence
cagtaattgaaaaaaatggtgttgac

SEQ ID NO: 124004 - DNA, 26 bp, Artificial sequence
  SiRNA target sequence
agtaattgaaaaaaatggtgttgacg

SEQ ID NO: 124005 - DNA, 26 bp, Artificial sequence
  SiRNA target sequence
gtaattgaaaaaaatggtgttgacgt

SEQ ID NO: 124006 - DNA, 26 bp, Artificial sequence
  SiRNA target sequence
taattgaaaaaaatggtgttgacgtt

SEQ ID NO: 124007 - DNA, 26 bp, Artificial sequence
  SiRNA target sequence
aattgaaaaaaatggtgttgacgtta

SEQ ID NO: 124008 - DNA, 26 bp, Artificial sequence
  SiRNA target sequence
attgaaaaaaatggtgttgacgttac

SEQ ID NO: 124009 - DNA, 26 bp, Artificial sequence
  SiRNA target sequence
ttgaaaaaaatggtgttgacgttaca

SEQ ID NO: 124010 - DNA, 26 bp, Artificial sequence
  SiRNA target sequence
tgaaaaaaatggtgttgacgttacag

SEQ ID NO: 124011 - DNA, 26 bp, Artificial sequence
  SiRNA target sequence
gaaaaaaatggtgttgacgttacagt

SEQ ID NO: 124012 - DNA, 26 bp, Artificial sequence
  SiRNA target sequence
aaaaaaatggtgttgacgttacagtt

SEQ ID NO: 124013 - DNA, 26 bp, Artificial sequence
  SiRNA target sequence
aaaaaatggtgttgacgttacagttt

SEQ ID NO: 124014 - DNA, 26 bp, Artificial sequence
  SiRNA target sequence
aaaaatggtgttgacgttacagtttt

SEQ ID NO: 124015 - DNA, 26 bp, Artificial sequence
  SiRNA target sequence
aaaatggtgttgacgttacagtttta

SEQ ID NO: 124016 - DNA, 26 bp, Artificial sequence
  SiRNA target sequence
aaatggtgttgacgttacagttttag

SEQ ID NO: 124017 - DNA, 26 bp, Artificial sequence
  SiRNA target sequence
aatggtgttgacgttacagttttagg

SEQ ID NO: 124018 - DNA, 26 bp, Artificial sequence
  SiRNA target sequence
atggtgttgacgttacagttttagga

SEQ ID NO: 124019 - DNA, 26 bp, Artificial sequence
  SiRNA target sequence
tggtgttgacgttacagttttaggaa

SEQ ID NO: 124020 - DNA, 26 bp, Artificial sequence
  SiRNA target sequence
ggtgttgacgttacagttttaggaat

SEQ ID NO: 124021 - DNA, 26 bp, Artificial sequence
  SiRNA target sequence
gtgttgacgttacagttttaggaata

SEQ ID NO: 124022 - DNA, 26 bp, Artificial sequence
  SiRNA target sequence
tgttgacgttacagttttaggaatat

SEQ ID NO: 124023 - DNA, 26 bp, Artificial sequence
  SiRNA target sequence
gttgacgttacagttttaggaatatc

SEQ ID NO: 124024 - DNA, 26 bp, Artificial sequence
  SiRNA target sequence
ttgacgttacagttttaggaatatca

SEQ ID NO: 124025 - DNA, 26 bp, Artificial sequence
  SiRNA target sequence
tgacgttacagttttaggaatatcaa

SEQ ID NO: 124026 - DNA, 26 bp, Artificial sequence
  SiRNA target sequence
gacgttacagttttaggaatatcaat

SEQ ID NO: 124027 - DNA, 26 bp, Artificial sequence
  SiRNA target sequence
acgttacagttttaggaatatcaata

SEQ ID NO: 124028 - DNA, 26 bp, Artificial sequence
  SiRNA target sequence
cgttacagttttaggaatatcaataa

SEQ ID NO: 124029 - DNA, 26 bp, Artificial sequence
  SiRNA target sequence
gttacagttttaggaatatcaataag

SEQ ID NO: 124030 - DNA, 26 bp, Artificial sequence
  SiRNA target sequence
ttacagttttaggaatatcaataagt

SEQ ID NO: 124031 - DNA, 26 bp, Artificial sequence
  SiRNA target sequence
tacagttttaggaatatcaataagtc

SEQ ID NO: 124032 - DNA, 26 bp, Artificial sequence
  SiRNA target sequence
acagttttaggaatatcaataagtct

SEQ ID NO: 124033 - DNA, 26 bp, Artificial sequence
  SiRNA target sequence
cagttttaggaatatcaataagtctt

SEQ ID NO: 124034 - DNA, 26 bp, Artificial sequence
  SiRNA target sequence
agttttaggaatatcaataagtctta

SEQ ID NO: 124035 - DNA, 26 bp, Artificial sequence
  SiRNA target sequence
gttttaggaatatcaataagtcttaa

SEQ ID NO: 124036 - DNA, 26 bp, Artificial sequence
  SiRNA target sequence
ttttaggaatatcaataagtcttaaa

SEQ ID NO: 124037 - DNA, 26 bp, Artificial sequence
  SiRNA target sequence
tttaggaatatcaataagtcttaaag

SEQ ID NO: 124038 - DNA, 26 bp, Artificial sequence
  SiRNA target sequence
ttaggaatatcaataagtcttaaaga

SEQ ID NO: 124039 - DNA, 26 bp, Artificial sequence
  SiRNA target sequence
taggaatatcaataagtcttaaagaa

SEQ ID NO: 124040 - DNA, 26 bp, Artificial sequence
  SiRNA target sequence
aggaatatcaataagtcttaaagaaa

SEQ ID NO: 124041 - DNA, 26 bp, Artificial sequence
  SiRNA target sequence
ggaatatcaataagtcttaaagaaat

SEQ ID NO: 124042 - DNA, 26 bp, Artificial sequence
  SiRNA target sequence
gaatatcaataagtcttaaagaaatt

SEQ ID NO: 124043 - DNA, 26 bp, Artificial sequence
  SiRNA target sequence
aatatcaataagtcttaaagaaattt

SEQ ID NO: 124044 - DNA, 26 bp, Artificial sequence
  SiRNA target sequence
atatcaataagtcttaaagaaatttt

SEQ ID NO: 124045 - DNA, 26 bp, Artificial sequence
  SiRNA target sequence
tatcaataagtcttaaagaaattttt

SEQ ID NO: 124046 - DNA, 26 bp, Artificial sequence
  SiRNA target sequence
atcaataagtcttaaagaaattttta

SEQ ID NO: 124047 - DNA, 26 bp, Artificial sequence
  SiRNA target sequence
tcaataagtcttaaagaaatttttaa

SEQ ID NO: 124048 - DNA, 26 bp, Artificial sequence
  SiRNA target sequence
caataagtcttaaagaaatttttaaa

SEQ ID NO: 124049 - DNA, 26 bp, Artificial sequence
  SiRNA target sequence
aataagtcttaaagaaatttttaaag

SEQ ID NO: 124050 - DNA, 26 bp, Artificial sequence
  SiRNA target sequence
ataagtcttaaagaaatttttaaagc

SEQ ID NO: 124051 - DNA, 26 bp, Artificial sequence
  SiRNA target sequence
taagtcttaaagaaatttttaaagca

SEQ ID NO: 124052 - DNA, 26 bp, Artificial sequence
  SiRNA target sequence
aagtcttaaagaaatttttaaagcag

SEQ ID NO: 124053 - DNA, 26 bp, Artificial sequence
  SiRNA target sequence
agtcttaaagaaatttttaaagcaga

SEQ ID NO: 124054 - DNA, 26 bp, Artificial sequence
  SiRNA target sequence
gtcttaaagaaatttttaaagcagac

SEQ ID NO: 124055 - DNA, 26 bp, Artificial sequence
  SiRNA target sequence
tcttaaagaaatttttaaagcagaca

SEQ ID NO: 124056 - DNA, 26 bp, Artificial sequence
  SiRNA target sequence
cttaaagaaatttttaaagcagacag

SEQ ID NO: 124057 - DNA, 26 bp, Artificial sequence
  SiRNA target sequence
ttaaagaaatttttaaagcagacagt

SEQ ID NO: 124058 - DNA, 26 bp, Artificial sequence
  SiRNA target sequence
taaagaaatttttaaagcagacagtt

SEQ ID NO: 124059 - DNA, 26 bp, Artificial sequence
  SiRNA target sequence
aaagaaatttttaaagcagacagttt

SEQ ID NO: 124060 - DNA, 26 bp, Artificial sequence
  SiRNA target sequence
aagaaatttttaaagcagacagtttg

SEQ ID NO: 124061 - DNA, 26 bp, Artificial sequence
  SiRNA target sequence
agaaatttttaaagcagacagtttgt

SEQ ID NO: 124062 - DNA, 26 bp, Artificial sequence
  SiRNA target sequence
gaaatttttaaagcagacagtttgtt

SEQ ID NO: 124063 - DNA, 26 bp, Artificial sequence
  SiRNA target sequence
aaatttttaaagcagacagtttgtta

SEQ ID NO: 124064 - DNA, 26 bp, Artificial sequence
  SiRNA target sequence
aatttttaaagcagacagtttgttag

SEQ ID NO: 124065 - DNA, 26 bp, Artificial sequence
  SiRNA target sequence
atttttaaagcagacagtttgttaga

SEQ ID NO: 124066 - DNA, 26 bp, Artificial sequence
  SiRNA target sequence
tttttaaagcagacagtttgttagag

SEQ ID NO: 124067 - DNA, 26 bp, Artificial sequence
  SiRNA target sequence
ttttaaagcagacagtttgttagaga

SEQ ID NO: 124068 - DNA, 26 bp, Artificial sequence
  SiRNA target sequence
tttaaagcagacagtttgttagagaa

SEQ ID NO: 124069 - DNA, 26 bp, Artificial sequence
  SiRNA target sequence
ttaaagcagacagtttgttagagaaa

SEQ ID NO: 124070 - DNA, 26 bp, Artificial sequence
  SiRNA target sequence
taaagcagacagtttgttagagaaaa

SEQ ID NO: 124071 - DNA, 26 bp, Artificial sequence
  SiRNA target sequence
aaagcagacagtttgttagagaaaaa

SEQ ID NO: 124072 - DNA, 26 bp, Artificial sequence
  SiRNA target sequence
aagcagacagtttgttagagaaaaaa

SEQ ID NO: 124073 - DNA, 26 bp, Artificial sequence
  SiRNA target sequence
agcagacagtttgttagagaaaaaaa

SEQ ID NO: 124074 - DNA, 26 bp, Artificial sequence
  SiRNA target sequence
gcagacagtttgttagagaaaaaaaa

SEQ ID NO: 124075 - DNA, 26 bp, Artificial sequence
  SiRNA target sequence
cagacagtttgttagagaaaaaaaat

SEQ ID NO: 124076 - DNA, 26 bp, Artificial sequence
  SiRNA target sequence
agacagtttgttagagaaaaaaaata

SEQ ID NO: 124077 - DNA, 26 bp, Artificial sequence
  SiRNA target sequence
gacagtttgttagagaaaaaaaatat

SEQ ID NO: 124078 - DNA, 26 bp, Artificial sequence
  SiRNA target sequence
acagtttgttagagaaaaaaaatatc

SEQ ID NO: 124079 - DNA, 26 bp, Artificial sequence
  SiRNA target sequence
cagtttgttagagaaaaaaaatatcg

SEQ ID NO: 124080 - DNA, 26 bp, Artificial sequence
  SiRNA target sequence
agtttgttagagaaaaaaaatatcga

SEQ ID NO: 124081 - DNA, 26 bp, Artificial sequence
  SiRNA target sequence
gtttgttagagaaaaaaaatatcgac

SEQ ID NO: 124082 - DNA, 26 bp, Artificial sequence
  SiRNA target sequence
tttgttagagaaaaaaaatatcgaca

SEQ ID NO: 124083 - DNA, 26 bp, Artificial sequence
  SiRNA target sequence
ttgttagagaaaaaaaatatcgacat

SEQ ID NO: 124084 - DNA, 26 bp, Artificial sequence
  SiRNA target sequence
tgttagagaaaaaaaatatcgacatt

SEQ ID NO: 124085 - DNA, 26 bp, Artificial sequence
  SiRNA target sequence
gttagagaaaaaaaatatcgacattg

SEQ ID NO: 124086 - DNA, 26 bp, Artificial sequence
  SiRNA target sequence
ttagagaaaaaaaatatcgacattga

SEQ ID NO: 124087 - DNA, 26 bp, Artificial sequence
  SiRNA target sequence
tagagaaaaaaaatatcgacattgag

SEQ ID NO: 124088 - DNA, 26 bp, Artificial sequence
  SiRNA target sequence
agagaaaaaaaatatcgacattgaga

SEQ ID NO: 124089 - DNA, 26 bp, Artificial sequence
  SiRNA target sequence
gagaaaaaaaatatcgacattgagat

SEQ ID NO: 124090 - DNA, 26 bp, Artificial sequence
  SiRNA target sequence
agaaaaaaaatatcgacattgagata

SEQ ID NO: 124091 - DNA, 26 bp, Artificial sequence
  SiRNA target sequence
gaaaaaaaatatcgacattgagataa

SEQ ID NO: 124092 - DNA, 26 bp, Artificial sequence
  SiRNA target sequence
aaaaaaaatatcgacattgagataat

SEQ ID NO: 124093 - DNA, 26 bp, Artificial sequence
  SiRNA target sequence
aaaaaaatatcgacattgagataatt

SEQ ID NO: 124094 - DNA, 26 bp, Artificial sequence
  SiRNA target sequence
aaaaaatatcgacattgagataatta

SEQ ID NO: 124095 - DNA, 26 bp, Artificial sequence
  SiRNA target sequence
aaaaatatcgacattgagataattaa

SEQ ID NO: 124096 - DNA, 26 bp, Artificial sequence
  SiRNA target sequence
aaaatatcgacattgagataattaat

SEQ ID NO: 124097 - DNA, 26 bp, Artificial sequence
  SiRNA target sequence
aaatatcgacattgagataattaatc

SEQ ID NO: 124098 - DNA, 26 bp, Artificial sequence
  SiRNA target sequence
aatatcgacattgagataattaatct

SEQ ID NO: 124099 - DNA, 26 bp, Artificial sequence
  SiRNA target sequence
atatcgacattgagataattaatctt

SEQ ID NO: 124100 - DNA, 26 bp, Artificial sequence
  SiRNA target sequence
tatcgacattgagataattaatcttg

SEQ ID NO: 124101 - DNA, 26 bp, Artificial sequence
  SiRNA target sequence
atcgacattgagataattaatcttgt

SEQ ID NO: 124102 - DNA, 26 bp, Artificial sequence
  SiRNA target sequence
tcgacattgagataattaatcttgtg

SEQ ID NO: 124103 - DNA, 26 bp, Artificial sequence
  SiRNA target sequence
cgacattgagataattaatcttgtgt

SEQ ID NO: 124104 - DNA, 26 bp, Artificial sequence
  SiRNA target sequence
gacattgagataattaatcttgtgtc

SEQ ID NO: 124105 - DNA, 26 bp, Artificial sequence
  SiRNA target sequence
acattgagataattaatcttgtgtca

SEQ ID NO: 124106 - DNA, 26 bp, Artificial sequence
  SiRNA target sequence
cattgagataattaatcttgtgtcaa

SEQ ID NO: 124107 - DNA, 26 bp, Artificial sequence
  SiRNA target sequence
attgagataattaatcttgtgtcaat

SEQ ID NO: 124108 - DNA, 26 bp, Artificial sequence
  SiRNA target sequence
ttgagataattaatcttgtgtcaata

SEQ ID NO: 124109 - DNA, 26 bp, Artificial sequence
  SiRNA target sequence
tgagataattaatcttgtgtcaataa

SEQ ID NO: 124110 - DNA, 26 bp, Artificial sequence
  SiRNA target sequence
gagataattaatcttgtgtcaataaa

SEQ ID NO: 124111 - DNA, 26 bp, Artificial sequence
  SiRNA target sequence
agataattaatcttgtgtcaataaaa

SEQ ID NO: 124112 - DNA, 26 bp, Artificial sequence
  SiRNA target sequence
gataattaatcttgtgtcaataaaac

SEQ ID NO: 124113 - DNA, 26 bp, Artificial sequence
  SiRNA target sequence
ataattaatcttgtgtcaataaaacc

SEQ ID NO: 124114 - DNA, 26 bp, Artificial sequence
  SiRNA target sequence
taattaatcttgtgtcaataaaacca

SEQ ID NO: 124115 - DNA, 26 bp, Artificial sequence
  SiRNA target sequence
aattaatcttgtgtcaataaaaccaa

SEQ ID NO: 124116 - DNA, 26 bp, Artificial sequence
  SiRNA target sequence
attaatcttgtgtcaataaaaccaat

SEQ ID NO: 124117 - DNA, 26 bp, Artificial sequence
  SiRNA target sequence
ttaatcttgtgtcaataaaaccaatt

SEQ ID NO: 124118 - DNA, 26 bp, Artificial sequence
  SiRNA target sequence
taatcttgtgtcaataaaaccaattg

SEQ ID NO: 124119 - DNA, 26 bp, Artificial sequence
  SiRNA target sequence
aatcttgtgtcaataaaaccaattga

SEQ ID NO: 124120 - DNA, 26 bp, Artificial sequence
  SiRNA target sequence
atcttgtgtcaataaaaccaattgat

SEQ ID NO: 124121 - DNA, 26 bp, Artificial sequence
  SiRNA target sequence
tcttgtgtcaataaaaccaattgatt

SEQ ID NO: 124122 - DNA, 26 bp, Artificial sequence
  SiRNA target sequence
cttgtgtcaataaaaccaattgatta

SEQ ID NO: 124123 - DNA, 26 bp, Artificial sequence
  SiRNA target sequence
ttgtgtcaataaaaccaattgattat

SEQ ID NO: 124124 - DNA, 26 bp, Artificial sequence
  SiRNA target sequence
tgtgtcaataaaaccaattgattatg

SEQ ID NO: 124125 - DNA, 26 bp, Artificial sequence
  SiRNA target sequence
gtgtcaataaaaccaattgattatgt

SEQ ID NO: 124126 - DNA, 26 bp, Artificial sequence
  SiRNA target sequence
tgtcaataaaaccaattgattatgtt

SEQ ID NO: 124127 - DNA, 26 bp, Artificial sequence
  SiRNA target sequence
gtcaataaaaccaattgattatgtta

SEQ ID NO: 124128 - DNA, 26 bp, Artificial sequence
  SiRNA target sequence
tcaataaaaccaattgattatgttac

SEQ ID NO: 124129 - DNA, 26 bp, Artificial sequence
  SiRNA target sequence
caataaaaccaattgattatgttact

SEQ ID NO: 124130 - DNA, 26 bp, Artificial sequence
  SiRNA target sequence
aataaaaccaattgattatgttacta

SEQ ID NO: 124131 - DNA, 26 bp, Artificial sequence
  SiRNA target sequence
ataaaaccaattgattatgttactat

SEQ ID NO: 124132 - DNA, 26 bp, Artificial sequence
  SiRNA target sequence
taaaaccaattgattatgttactatt

SEQ ID NO: 124133 - DNA, 26 bp, Artificial sequence
  SiRNA target sequence
aaaaccaattgattatgttactattg

SEQ ID NO: 124134 - DNA, 26 bp, Artificial sequence
  SiRNA target sequence
aaaccaattgattatgttactattga

SEQ ID NO: 124135 - DNA, 26 bp, Artificial sequence
  SiRNA target sequence
aaccaattgattatgttactattgaa

SEQ ID NO: 124136 - DNA, 26 bp, Artificial sequence
  SiRNA target sequence
accaattgattatgttactattgaaa

SEQ ID NO: 124137 - DNA, 26 bp, Artificial sequence
  SiRNA target sequence
ccaattgattatgttactattgaaat

SEQ ID NO: 124138 - DNA, 26 bp, Artificial sequence
  SiRNA target sequence
caattgattatgttactattgaaata

SEQ ID NO: 124139 - DNA, 26 bp, Artificial sequence
  SiRNA target sequence
aattgattatgttactattgaaatat

SEQ ID NO: 124140 - DNA, 26 bp, Artificial sequence
  SiRNA target sequence
attgattatgttactattgaaatatc

SEQ ID NO: 124141 - DNA, 26 bp, Artificial sequence
  SiRNA target sequence
ttgattatgttactattgaaatatca

SEQ ID NO: 124142 - DNA, 26 bp, Artificial sequence
  SiRNA target sequence
tgattatgttactattgaaatatcag

SEQ ID NO: 124143 - DNA, 26 bp, Artificial sequence
  SiRNA target sequence
gattatgttactattgaaatatcagt

SEQ ID NO: 124144 - DNA, 26 bp, Artificial sequence
  SiRNA target sequence
attatgttactattgaaatatcagtc

SEQ ID NO: 124145 - DNA, 26 bp, Artificial sequence
  SiRNA target sequence
ttatgttactattgaaatatcagtca

SEQ ID NO: 124146 - DNA, 26 bp, Artificial sequence
  SiRNA target sequence
tatgttactattgaaatatcagtcaa

SEQ ID NO: 124147 - DNA, 26 bp, Artificial sequence
  SiRNA target sequence
atgttactattgaaatatcagtcaaa

SEQ ID NO: 124148 - DNA, 26 bp, Artificial sequence
  SiRNA target sequence
tgttactattgaaatatcagtcaaaa

SEQ ID NO: 124149 - DNA, 26 bp, Artificial sequence
  SiRNA target sequence
gttactattgaaatatcagtcaaaaa

SEQ ID NO: 124150 - DNA, 26 bp, Artificial sequence
  SiRNA target sequence
ttactattgaaatatcagtcaaaaaa

SEQ ID NO: 124151 - DNA, 26 bp, Artificial sequence
  SiRNA target sequence
tactattgaaatatcagtcaaaaaaa

SEQ ID NO: 124152 - DNA, 26 bp, Artificial sequence
  SiRNA target sequence
actattgaaatatcagtcaaaaaaac

SEQ ID NO: 124153 - DNA, 26 bp, Artificial sequence
  SiRNA target sequence
ctattgaaatatcagtcaaaaaaaca

SEQ ID NO: 124154 - DNA, 26 bp, Artificial sequence
  SiRNA target sequence
tattgaaatatcagtcaaaaaaacac

SEQ ID NO: 124155 - DNA, 26 bp, Artificial sequence
  SiRNA target sequence
attgaaatatcagtcaaaaaaacaca

SEQ ID NO: 124156 - DNA, 26 bp, Artificial sequence
  SiRNA target sequence
ttgaaatatcagtcaaaaaaacacaa

SEQ ID NO: 124157 - DNA, 26 bp, Artificial sequence
  SiRNA target sequence
tgaaatatcagtcaaaaaaacacaaa

SEQ ID NO: 124158 - DNA, 26 bp, Artificial sequence
  SiRNA target sequence
gaaatatcagtcaaaaaaacacaaaa

SEQ ID NO: 124159 - DNA, 26 bp, Artificial sequence
  SiRNA target sequence
aaatatcagtcaaaaaaacacaaaag

SEQ ID NO: 124160 - DNA, 26 bp, Artificial sequence
  SiRNA target sequence
aatatcagtcaaaaaaacacaaaagt

SEQ ID NO: 124161 - DNA, 26 bp, Artificial sequence
  SiRNA target sequence
atatcagtcaaaaaaacacaaaagtt

SEQ ID NO: 124162 - DNA, 26 bp, Artificial sequence
  SiRNA target sequence
tatcagtcaaaaaaacacaaaagtta

SEQ ID NO: 124163 - DNA, 26 bp, Artificial sequence
  SiRNA target sequence
atcagtcaaaaaaacacaaaagttag

SEQ ID NO: 124164 - DNA, 26 bp, Artificial sequence
  SiRNA target sequence
tcagtcaaaaaaacacaaaagttagt

SEQ ID NO: 124165 - DNA, 26 bp, Artificial sequence
  SiRNA target sequence
cagtcaaaaaaacacaaaagttagtg

SEQ ID NO: 124166 - DNA, 26 bp, Artificial sequence
  SiRNA target sequence
agtcaaaaaaacacaaaagttagtga

SEQ ID NO: 124167 - DNA, 26 bp, Artificial sequence
  SiRNA target sequence
gtcaaaaaaacacaaaagttagtgat

SEQ ID NO: 124168 - DNA, 26 bp, Artificial sequence
  SiRNA target sequence
tcaaaaaaacacaaaagttagtgata

SEQ ID NO: 124169 - DNA, 26 bp, Artificial sequence
  SiRNA target sequence
caaaaaaacacaaaagttagtgatag

SEQ ID NO: 124170 - DNA, 26 bp, Artificial sequence
  SiRNA target sequence
aaaaaaacacaaaagttagtgatagt

SEQ ID NO: 124171 - DNA, 26 bp, Artificial sequence
  SiRNA target sequence
aaaaaacacaaaagttagtgatagtt

SEQ ID NO: 124172 - DNA, 26 bp, Artificial sequence
  SiRNA target sequence
aaaaacacaaaagttagtgatagttg

SEQ ID NO: 124173 - DNA, 26 bp, Artificial sequence
  SiRNA target sequence
aaaacacaaaagttagtgatagttga

SEQ ID NO: 124174 - DNA, 26 bp, Artificial sequence
  SiRNA target sequence
aaacacaaaagttagtgatagttgat

SEQ ID NO: 124175 - DNA, 26 bp, Artificial sequence
  SiRNA target sequence
aacacaaaagttagtgatagttgatt

SEQ ID NO: 124176 - DNA, 26 bp, Artificial sequence
  SiRNA target sequence
acacaaaagttagtgatagttgattt

SEQ ID NO: 124177 - DNA, 26 bp, Artificial sequence
  SiRNA target sequence
cacaaaagttagtgatagttgatttt

SEQ ID NO: 124178 - DNA, 26 bp, Artificial sequence
  SiRNA target sequence
acaaaagttagtgatagttgattttg

SEQ ID NO: 124179 - DNA, 26 bp, Artificial sequence
  SiRNA target sequence
caaaagttagtgatagttgattttgc

SEQ ID NO: 124180 - DNA, 26 bp, Artificial sequence
  SiRNA target sequence
aaaagttagtgatagttgattttgca

SEQ ID NO: 124181 - DNA, 26 bp, Artificial sequence
  SiRNA target sequence
aaagttagtgatagttgattttgcat

SEQ ID NO: 124182 - DNA, 26 bp, Artificial sequence
  SiRNA target sequence
aagttagtgatagttgattttgcata

SEQ ID NO: 124183 - DNA, 26 bp, Artificial sequence
  SiRNA target sequence
agttagtgatagttgattttgcatat

SEQ ID NO: 124184 - DNA, 26 bp, Artificial sequence
  SiRNA target sequence
gttagtgatagttgattttgcatatc

SEQ ID NO: 124185 - DNA, 26 bp, Artificial sequence
  SiRNA target sequence
ttagtgatagttgattttgcatatcc

SEQ ID NO: 124186 - DNA, 26 bp, Artificial sequence
  SiRNA target sequence
tagtgatagttgattttgcatatcct

SEQ ID NO: 124187 - DNA, 26 bp, Artificial sequence
  SiRNA target sequence
agtgatagttgattttgcatatccta

SEQ ID NO: 124188 - DNA, 26 bp, Artificial sequence
  SiRNA target sequence
gtgatagttgattttgcatatcctac

SEQ ID NO: 124189 - DNA, 26 bp, Artificial sequence
  SiRNA target sequence
tgatagttgattttgcatatcctact

SEQ ID NO: 124190 - DNA, 26 bp, Artificial sequence
  SiRNA target sequence
gatagttgattttgcatatcctactt

SEQ ID NO: 124191 - DNA, 26 bp, Artificial sequence
  SiRNA target sequence
atagttgattttgcatatcctacttt

SEQ ID NO: 124192 - DNA, 26 bp, Artificial sequence
  SiRNA target sequence
tagttgattttgcatatcctactttc

SEQ ID NO: 124193 - DNA, 26 bp, Artificial sequence
  SiRNA target sequence
agttgattttgcatatcctactttca

SEQ ID NO: 124194 - DNA, 26 bp, Artificial sequence
  SiRNA target sequence
gttgattttgcatatcctactttcaa

SEQ ID NO: 124195 - DNA, 26 bp, Artificial sequence
  SiRNA target sequence
ttgattttgcatatcctactttcaat

SEQ ID NO: 124196 - DNA, 26 bp, Artificial sequence
  SiRNA target sequence
tgattttgcatatcctactttcaata

SEQ ID NO: 124197 - DNA, 26 bp, Artificial sequence
  SiRNA target sequence
gattttgcatatcctactttcaatat

SEQ ID NO: 124198 - DNA, 26 bp, Artificial sequence
  SiRNA target sequence
attttgcatatcctactttcaatatt

SEQ ID NO: 124199 - DNA, 26 bp, Artificial sequence
  SiRNA target sequence
ttttgcatatcctactttcaatattg

SEQ ID NO: 124200 - DNA, 26 bp, Artificial sequence
  SiRNA target sequence
tttgcatatcctactttcaatattgc

SEQ ID NO: 124201 - DNA, 26 bp, Artificial sequence
  SiRNA target sequence
ttgcatatcctactttcaatattgcg

SEQ ID NO: 124202 - DNA, 26 bp, Artificial sequence
  SiRNA target sequence
tgcatatcctactttcaatattgcga

SEQ ID NO: 124203 - DNA, 26 bp, Artificial sequence
  SiRNA target sequence
gcatatcctactttcaatattgcgag

SEQ ID NO: 124204 - DNA, 26 bp, Artificial sequence
  SiRNA target sequence
catatcctactttcaatattgcgagt

SEQ ID NO: 124205 - DNA, 26 bp, Artificial sequence
  SiRNA target sequence
atatcctactttcaatattgcgagtg

SEQ ID NO: 124206 - DNA, 26 bp, Artificial sequence
  SiRNA target sequence
tatcctactttcaatattgcgagtga

SEQ ID NO: 124207 - DNA, 26 bp, Artificial sequence
  SiRNA target sequence
atcctactttcaatattgcgagtgaa

SEQ ID NO: 124208 - DNA, 26 bp, Artificial sequence
  SiRNA target sequence
tcctactttcaatattgcgagtgaaa

SEQ ID NO: 124209 - DNA, 26 bp, Artificial sequence
  SiRNA target sequence
cctactttcaatattgcgagtgaaat

SEQ ID NO: 124210 - DNA, 26 bp, Artificial sequence
  SiRNA target sequence
ctactttcaatattgcgagtgaaata

SEQ ID NO: 124211 - DNA, 26 bp, Artificial sequence
  SiRNA target sequence
tactttcaatattgcgagtgaaatag

SEQ ID NO: 124212 - DNA, 26 bp, Artificial sequence
  SiRNA target sequence
actttcaatattgcgagtgaaatagc

SEQ ID NO: 124213 - DNA, 26 bp, Artificial sequence
  SiRNA target sequence
ctttcaatattgcgagtgaaatagct

SEQ ID NO: 124214 - DNA, 26 bp, Artificial sequence
  SiRNA target sequence
tttcaatattgcgagtgaaatagctg

SEQ ID NO: 124215 - DNA, 26 bp, Artificial sequence
  SiRNA target sequence
ttcaatattgcgagtgaaatagctgc

SEQ ID NO: 124216 - DNA, 26 bp, Artificial sequence
  SiRNA target sequence
tcaatattgcgagtgaaatagctgcg

SEQ ID NO: 124217 - DNA, 26 bp, Artificial sequence
  SiRNA target sequence
caatattgcgagtgaaatagctgcgc

SEQ ID NO: 124218 - DNA, 26 bp, Artificial sequence
  SiRNA target sequence
aatattgcgagtgaaatagctgcgca

SEQ ID NO: 124219 - DNA, 26 bp, Artificial sequence
  SiRNA target sequence
atattgcgagtgaaatagctgcgcac

SEQ ID NO: 124220 - DNA, 26 bp, Artificial sequence
  SiRNA target sequence
tattgcgagtgaaatagctgcgcact

SEQ ID NO: 124221 - DNA, 26 bp, Artificial sequence
  SiRNA target sequence
attgcgagtgaaatagctgcgcactt

SEQ ID NO: 124222 - DNA, 26 bp, Artificial sequence
  SiRNA target sequence
ttgcgagtgaaatagctgcgcacttt

SEQ ID NO: 124223 - DNA, 26 bp, Artificial sequence
  SiRNA target sequence
tgcgagtgaaatagctgcgcactttt

SEQ ID NO: 124224 - DNA, 26 bp, Artificial sequence
  SiRNA target sequence
gcgagtgaaatagctgcgcactttta

SEQ ID NO: 124225 - DNA, 26 bp, Artificial sequence
  SiRNA target sequence
cgagtgaaatagctgcgcacttttac

SEQ ID NO: 124226 - DNA, 26 bp, Artificial sequence
  SiRNA target sequence
gagtgaaatagctgcgcacttttacg

SEQ ID NO: 124227 - DNA, 26 bp, Artificial sequence
  SiRNA target sequence
agtgaaatagctgcgcacttttacga

SEQ ID NO: 124228 - DNA, 26 bp, Artificial sequence
  SiRNA target sequence
gtgaaatagctgcgcacttttacgaa

SEQ ID NO: 124229 - DNA, 26 bp, Artificial sequence
  SiRNA target sequence
tgaaatagctgcgcacttttacgaaa

SEQ ID NO: 124230 - DNA, 26 bp, Artificial sequence
  SiRNA target sequence
gaaatagctgcgcacttttacgaaaa

SEQ ID NO: 124231 - DNA, 26 bp, Artificial sequence
  SiRNA target sequence
aaatagctgcgcacttttacgaaaaa

SEQ ID NO: 124232 - DNA, 26 bp, Artificial sequence
  SiRNA target sequence
aatagctgcgcacttttacgaaaaat

SEQ ID NO: 124233 - DNA, 26 bp, Artificial sequence
  SiRNA target sequence
atagctgcgcacttttacgaaaaatt

SEQ ID NO: 124234 - DNA, 26 bp, Artificial sequence
  SiRNA target sequence
tagctgcgcacttttacgaaaaattt

SEQ ID NO: 124235 - DNA, 26 bp, Artificial sequence
  SiRNA target sequence
agctgcgcacttttacgaaaaattta

SEQ ID NO: 124236 - DNA, 26 bp, Artificial sequence
  SiRNA target sequence
gctgcgcacttttacgaaaaatttaa

SEQ ID NO: 124237 - DNA, 26 bp, Artificial sequence
  SiRNA target sequence
ctgcgcacttttacgaaaaatttaaa

SEQ ID NO: 124238 - DNA, 26 bp, Artificial sequence
  SiRNA target sequence
tgcgcacttttacgaaaaatttaaag

SEQ ID NO: 124239 - DNA, 26 bp, Artificial sequence
  SiRNA target sequence
gcgcacttttacgaaaaatttaaaga

SEQ ID NO: 124240 - DNA, 26 bp, Artificial sequence
  SiRNA target sequence
cgcacttttacgaaaaatttaaagat

SEQ ID NO: 124241 - DNA, 26 bp, Artificial sequence
  SiRNA target sequence
gcacttttacgaaaaatttaaagata

SEQ ID NO: 124242 - DNA, 26 bp, Artificial sequence
  SiRNA target sequence
cacttttacgaaaaatttaaagatat

SEQ ID NO: 124243 - DNA, 26 bp, Artificial sequence
  SiRNA target sequence
acttttacgaaaaatttaaagatata

SEQ ID NO: 124244 - DNA, 26 bp, Artificial sequence
  SiRNA target sequence
cttttacgaaaaatttaaagatataa

SEQ ID NO: 124245 - DNA, 26 bp, Artificial sequence
  SiRNA target sequence
ttttacgaaaaatttaaagatataaa

SEQ ID NO: 124246 - DNA, 26 bp, Artificial sequence
  SiRNA target sequence
tttacgaaaaatttaaagatataaaa

SEQ ID NO: 124247 - DNA, 26 bp, Artificial sequence
  SiRNA target sequence
ttacgaaaaatttaaagatataaaaa

SEQ ID NO: 124248 - DNA, 26 bp, Artificial sequence
  SiRNA target sequence
tacgaaaaatttaaagatataaaaat

SEQ ID NO: 124249 - DNA, 26 bp, Artificial sequence
  SiRNA target sequence
acgaaaaatttaaagatataaaaatt

SEQ ID NO: 124250 - DNA, 26 bp, Artificial sequence
  SiRNA target sequence
cgaaaaatttaaagatataaaaatta

SEQ ID NO: 124251 - DNA, 26 bp, Artificial sequence
  SiRNA target sequence
gaaaaatttaaagatataaaaattat

SEQ ID NO: 124252 - DNA, 26 bp, Artificial sequence
  SiRNA target sequence
aaaaatttaaagatataaaaattatg

SEQ ID NO: 124253 - DNA, 26 bp, Artificial sequence
  SiRNA target sequence
aaaatttaaagatataaaaattatgc

SEQ ID NO: 124254 - DNA, 26 bp, Artificial sequence
  SiRNA target sequence
aaatttaaagatataaaaattatgcg

SEQ ID NO: 124255 - DNA, 26 bp, Artificial sequence
  SiRNA target sequence
aatttaaagatataaaaattatgcgt

SEQ ID NO: 124256 - DNA, 26 bp, Artificial sequence
  SiRNA target sequence
atttaaagatataaaaattatgcgtg

SEQ ID NO: 124257 - DNA, 26 bp, Artificial sequence
  SiRNA target sequence
tttaaagatataaaaattatgcgtgt

SEQ ID NO: 124258 - DNA, 26 bp, Artificial sequence
  SiRNA target sequence
ttaaagatataaaaattatgcgtgtt

SEQ ID NO: 124259 - DNA, 26 bp, Artificial sequence
  SiRNA target sequence
taaagatataaaaattatgcgtgttc

SEQ ID NO: 124260 - DNA, 26 bp, Artificial sequence
  SiRNA target sequence
aaagatataaaaattatgcgtgttct

SEQ ID NO: 124261 - DNA, 26 bp, Artificial sequence
  SiRNA target sequence
aagatataaaaattatgcgtgttctt

SEQ ID NO: 124262 - DNA, 26 bp, Artificial sequence
  SiRNA target sequence
agatataaaaattatgcgtgttcttg

SEQ ID NO: 124263 - DNA, 26 bp, Artificial sequence
  SiRNA target sequence
gatataaaaattatgcgtgttcttgc

SEQ ID NO: 124264 - DNA, 26 bp, Artificial sequence
  SiRNA target sequence
atataaaaattatgcgtgttcttgcg

SEQ ID NO: 124265 - DNA, 26 bp, Artificial sequence
  SiRNA target sequence
tataaaaattatgcgtgttcttgcgc

SEQ ID NO: 124266 - DNA, 26 bp, Artificial sequence
  SiRNA target sequence
ataaaaattatgcgtgttcttgcgca

SEQ ID NO: 124267 - DNA, 26 bp, Artificial sequence
  SiRNA target sequence
taaaaattatgcgtgttcttgcgcaa

SEQ ID NO: 124268 - DNA, 26 bp, Artificial sequence
  SiRNA target sequence
aaaaattatgcgtgttcttgcgcaag

SEQ ID NO: 124269 - DNA, 26 bp, Artificial sequence
  SiRNA target sequence
aaaattatgcgtgttcttgcgcaaga

SEQ ID NO: 124270 - DNA, 26 bp, Artificial sequence
  SiRNA target sequence
aaattatgcgtgttcttgcgcaagat

SEQ ID NO: 124271 - DNA, 26 bp, Artificial sequence
  SiRNA target sequence
aattatgcgtgttcttgcgcaagata

SEQ ID NO: 124272 - DNA, 26 bp, Artificial sequence
  SiRNA target sequence
attatgcgtgttcttgcgcaagatat

SEQ ID NO: 124273 - DNA, 26 bp, Artificial sequence
  SiRNA target sequence
ttatgcgtgttcttgcgcaagatatt

SEQ ID NO: 124274 - DNA, 26 bp, Artificial sequence
  SiRNA target sequence
tatgcgtgttcttgcgcaagatattc

SEQ ID NO: 124275 - DNA, 26 bp, Artificial sequence
  SiRNA target sequence
atgcgtgttcttgcgcaagatattcc

SEQ ID NO: 124276 - DNA, 26 bp, Artificial sequence
  SiRNA target sequence
tgcgtgttcttgcgcaagatattcct

SEQ ID NO: 124277 - DNA, 26 bp, Artificial sequence
  SiRNA target sequence
gcgtgttcttgcgcaagatattccta

SEQ ID NO: 124278 - DNA, 26 bp, Artificial sequence
  SiRNA target sequence
cgtgttcttgcgcaagatattcctac

SEQ ID NO: 124279 - DNA, 26 bp, Artificial sequence
  SiRNA target sequence
gtgttcttgcgcaagatattcctaca

SEQ ID NO: 124280 - DNA, 26 bp, Artificial sequence
  SiRNA target sequence
tgttcttgcgcaagatattcctacac

SEQ ID NO: 124281 - DNA, 26 bp, Artificial sequence
  SiRNA target sequence
gttcttgcgcaagatattcctacacc

SEQ ID NO: 124282 - DNA, 26 bp, Artificial sequence
  SiRNA target sequence
ttcttgcgcaagatattcctacaccg

SEQ ID NO: 124283 - DNA, 26 bp, Artificial sequence
  SiRNA target sequence
tcttgcgcaagatattcctacaccgt

SEQ ID NO: 124284 - DNA, 26 bp, Artificial sequence
  SiRNA target sequence
cttgcgcaagatattcctacaccgta

SEQ ID NO: 124285 - DNA, 26 bp, Artificial sequence
  SiRNA target sequence
ttgcgcaagatattcctacaccgtat

SEQ ID NO: 124286 - DNA, 26 bp, Artificial sequence
  SiRNA target sequence
tgcgcaagatattcctacaccgtatg

SEQ ID NO: 124287 - DNA, 26 bp, Artificial sequence
  SiRNA target sequence
gcgcaagatattcctacaccgtatgc

SEQ ID NO: 124288 - DNA, 26 bp, Artificial sequence
  SiRNA target sequence
cgcaagatattcctacaccgtatgca

SEQ ID NO: 124289 - DNA, 26 bp, Artificial sequence
  SiRNA target sequence
gcaagatattcctacaccgtatgcac

SEQ ID NO: 124290 - DNA, 26 bp, Artificial sequence
  SiRNA target sequence
caagatattcctacaccgtatgcact

SEQ ID NO: 124291 - DNA, 26 bp, Artificial sequence
  SiRNA target sequence
aagatattcctacaccgtatgcactt

SEQ ID NO: 124292 - DNA, 26 bp, Artificial sequence
  SiRNA target sequence
agatattcctacaccgtatgcactta

SEQ ID NO: 124293 - DNA, 26 bp, Artificial sequence
  SiRNA target sequence
gatattcctacaccgtatgcacttaa

SEQ ID NO: 124294 - DNA, 26 bp, Artificial sequence
  SiRNA target sequence
atattcctacaccgtatgcacttaat

SEQ ID NO: 124295 - DNA, 26 bp, Artificial sequence
  SiRNA target sequence
tattcctacaccgtatgcacttaatc

SEQ ID NO: 124296 - DNA, 26 bp, Artificial sequence
  SiRNA target sequence
attcctacaccgtatgcacttaatct

SEQ ID NO: 124297 - DNA, 26 bp, Artificial sequence
  SiRNA target sequence
ttcctacaccgtatgcacttaatctt

SEQ ID NO: 124298 - DNA, 26 bp, Artificial sequence
  SiRNA target sequence
tcctacaccgtatgcacttaatcttg

SEQ ID NO: 124299 - DNA, 26 bp, Artificial sequence
  SiRNA target sequence
cctacaccgtatgcacttaatcttga

SEQ ID NO: 124300 - DNA, 26 bp, Artificial sequence
  SiRNA target sequence
ctacaccgtatgcacttaatcttgaa

SEQ ID NO: 124301 - DNA, 26 bp, Artificial sequence
  SiRNA target sequence
tacaccgtatgcacttaatcttgaaa

SEQ ID NO: 124302 - DNA, 26 bp, Artificial sequence
  SiRNA target sequence
acaccgtatgcacttaatcttgaaaa

SEQ ID NO: 124303 - DNA, 26 bp, Artificial sequence
  SiRNA target sequence
caccgtatgcacttaatcttgaaaaa

SEQ ID NO: 124304 - DNA, 26 bp, Artificial sequence
  SiRNA target sequence
accgtatgcacttaatcttgaaaaaa

SEQ ID NO: 124305 - DNA, 26 bp, Artificial sequence
  SiRNA target sequence
ccgtatgcacttaatcttgaaaaaat

SEQ ID NO: 124306 - DNA, 26 bp, Artificial sequence
  SiRNA target sequence
cgtatgcacttaatcttgaaaaaatg

SEQ ID NO: 124307 - DNA, 26 bp, Artificial sequence
  SiRNA target sequence
gtatgcacttaatcttgaaaaaatgt

SEQ ID NO: 124308 - DNA, 26 bp, Artificial sequence
  SiRNA target sequence
tatgcacttaatcttgaaaaaatgtc

SEQ ID NO: 124309 - DNA, 26 bp, Artificial sequence
  SiRNA target sequence
atgcacttaatcttgaaaaaatgtct

SEQ ID NO: 124310 - DNA, 26 bp, Artificial sequence
  SiRNA target sequence
tgcacttaatcttgaaaaaatgtctt

SEQ ID NO: 124311 - DNA, 26 bp, Artificial sequence
  SiRNA target sequence
gcacttaatcttgaaaaaatgtctta

SEQ ID NO: 124312 - DNA, 26 bp, Artificial sequence
  SiRNA target sequence
cacttaatcttgaaaaaatgtcttat

SEQ ID NO: 124313 - DNA, 26 bp, Artificial sequence
  SiRNA target sequence
acttaatcttgaaaaaatgtcttatc

SEQ ID NO: 124314 - DNA, 26 bp, Artificial sequence
  SiRNA target sequence
cttaatcttgaaaaaatgtcttatcc

SEQ ID NO: 124315 - DNA, 26 bp, Artificial sequence
  SiRNA target sequence
ttaatcttgaaaaaatgtcttatccg

SEQ ID NO: 124316 - DNA, 26 bp, Artificial sequence
  SiRNA target sequence
taatcttgaaaaaatgtcttatccga

SEQ ID NO: 124317 - DNA, 26 bp, Artificial sequence
  SiRNA target sequence
aatcttgaaaaaatgtcttatccgac

SEQ ID NO: 124318 - DNA, 26 bp, Artificial sequence
  SiRNA target sequence
atcttgaaaaaatgtcttatccgaca

SEQ ID NO: 124319 - DNA, 26 bp, Artificial sequence
  SiRNA target sequence
tcttgaaaaaatgtcttatccgacat

SEQ ID NO: 124320 - DNA, 26 bp, Artificial sequence
  SiRNA target sequence
cttgaaaaaatgtcttatccgacatg

SEQ ID NO: 124321 - DNA, 26 bp, Artificial sequence
  SiRNA target sequence
ttgaaaaaatgtcttatccgacatgc

SEQ ID NO: 124322 - DNA, 26 bp, Artificial sequence
  SiRNA target sequence
tgaaaaaatgtcttatccgacatgca

SEQ ID NO: 124323 - DNA, 26 bp, Artificial sequence
  SiRNA target sequence
gaaaaaatgtcttatccgacatgcaa

SEQ ID NO: 124324 - DNA, 26 bp, Artificial sequence
  SiRNA target sequence
aaaaaatgtcttatccgacatgcaat

SEQ ID NO: 124325 - DNA, 26 bp, Artificial sequence
  SiRNA target sequence
aaaaatgtcttatccgacatgcaatg

SEQ ID NO: 124326 - DNA, 26 bp, Artificial sequence
  SiRNA target sequence
aaaatgtcttatccgacatgcaatga

SEQ ID NO: 124327 - DNA, 26 bp, Artificial sequence
  SiRNA target sequence
aaatgtcttatccgacatgcaatgat

SEQ ID NO: 124328 - DNA, 26 bp, Artificial sequence
  SiRNA target sequence
aatgtcttatccgacatgcaatgata

SEQ ID NO: 124329 - DNA, 26 bp, Artificial sequence
  SiRNA target sequence
atgtcttatccgacatgcaatgatat

SEQ ID NO: 124330 - DNA, 26 bp, Artificial sequence
  SiRNA target sequence
tgtcttatccgacatgcaatgatatt

SEQ ID NO: 124331 - DNA, 26 bp, Artificial sequence
  SiRNA target sequence
gtcttatccgacatgcaatgatattg

SEQ ID NO: 124332 - DNA, 26 bp, Artificial sequence
  SiRNA target sequence
tcttatccgacatgcaatgatattgt

SEQ ID NO: 124333 - DNA, 26 bp, Artificial sequence
  SiRNA target sequence
cttatccgacatgcaatgatattgta

SEQ ID NO: 124334 - DNA, 26 bp, Artificial sequence
  SiRNA target sequence
ttatccgacatgcaatgatattgtaa

SEQ ID NO: 124335 - DNA, 26 bp, Artificial sequence
  SiRNA target sequence
tatccgacatgcaatgatattgtaaa

SEQ ID NO: 124336 - DNA, 26 bp, Artificial sequence
  SiRNA target sequence
atccgacatgcaatgatattgtaaat

SEQ ID NO: 124337 - DNA, 26 bp, Artificial sequence
  SiRNA target sequence
tccgacatgcaatgatattgtaaatg

SEQ ID NO: 124338 - DNA, 26 bp, Artificial sequence
  SiRNA target sequence
ccgacatgcaatgatattgtaaatgc

SEQ ID NO: 124339 - DNA, 26 bp, Artificial sequence
  SiRNA target sequence
cgacatgcaatgatattgtaaatgct

SEQ ID NO: 124340 - DNA, 26 bp, Artificial sequence
  SiRNA target sequence
gacatgcaatgatattgtaaatgctg

SEQ ID NO: 124341 - DNA, 26 bp, Artificial sequence
  SiRNA target sequence
acatgcaatgatattgtaaatgctgt

SEQ ID NO: 124342 - DNA, 26 bp, Artificial sequence
  SiRNA target sequence
catgcaatgatattgtaaatgctgtt

SEQ ID NO: 124343 - DNA, 26 bp, Artificial sequence
  SiRNA target sequence
atgcaatgatattgtaaatgctgtta

SEQ ID NO: 124344 - DNA, 26 bp, Artificial sequence
  SiRNA target sequence
tgcaatgatattgtaaatgctgttac

SEQ ID NO: 124345 - DNA, 26 bp, Artificial sequence
  SiRNA target sequence
gcaatgatattgtaaatgctgttaca

SEQ ID NO: 124346 - DNA, 26 bp, Artificial sequence
  SiRNA target sequence
caatgatattgtaaatgctgttacaa

SEQ ID NO: 124347 - DNA, 26 bp, Artificial sequence
  SiRNA target sequence
aatgatattgtaaatgctgttacaaa

SEQ ID NO: 124348 - DNA, 26 bp, Artificial sequence
  SiRNA target sequence
atgatattgtaaatgctgttacaaaa

SEQ ID NO: 124349 - DNA, 26 bp, Artificial sequence
  SiRNA target sequence
tgatattgtaaatgctgttacaaaaa

SEQ ID NO: 124350 - DNA, 26 bp, Artificial sequence
  SiRNA target sequence
gatattgtaaatgctgttacaaaaat

SEQ ID NO: 124351 - DNA, 26 bp, Artificial sequence
  SiRNA target sequence
atattgtaaatgctgttacaaaaata

SEQ ID NO: 124352 - DNA, 26 bp, Artificial sequence
  SiRNA target sequence
tattgtaaatgctgttacaaaaataa

SEQ ID NO: 124353 - DNA, 26 bp, Artificial sequence
  SiRNA target sequence
attgtaaatgctgttacaaaaataaa

SEQ ID NO: 124354 - DNA, 26 bp, Artificial sequence
  SiRNA target sequence
ttgtaaatgctgttacaaaaataaat

SEQ ID NO: 124355 - DNA, 26 bp, Artificial sequence
  SiRNA target sequence
tgtaaatgctgttacaaaaataaatt

SEQ ID NO: 124356 - DNA, 26 bp, Artificial sequence
  SiRNA target sequence
gtaaatgctgttacaaaaataaattc

SEQ ID NO: 124357 - DNA, 26 bp, Artificial sequence
  SiRNA target sequence
taaatgctgttacaaaaataaattca

SEQ ID NO: 124358 - DNA, 26 bp, Artificial sequence
  SiRNA target sequence
aaatgctgttacaaaaataaattcat

SEQ ID NO: 124359 - DNA, 26 bp, Artificial sequence
  SiRNA target sequence
aatgctgttacaaaaataaattcata

SEQ ID NO: 124360 - DNA, 26 bp, Artificial sequence
  SiRNA target sequence
atgctgttacaaaaataaattcatag

SEQ ID NO: 124361 - DNA, 27 bp, Artificial sequence
  SiRNA target sequence
atgatagaaattcgcgatcttataaat

SEQ ID NO: 124362 - DNA, 27 bp, Artificial sequence
  SiRNA target sequence
tgatagaaattcgcgatcttataaatc

SEQ ID NO: 124363 - DNA, 27 bp, Artificial sequence
  SiRNA target sequence
gatagaaattcgcgatcttataaatca

SEQ ID NO: 124364 - DNA, 27 bp, Artificial sequence
  SiRNA target sequence
atagaaattcgcgatcttataaatcaa

SEQ ID NO: 124365 - DNA, 27 bp, Artificial sequence
  SiRNA target sequence
tagaaattcgcgatcttataaatcaag

SEQ ID NO: 124366 - DNA, 27 bp, Artificial sequence
  SiRNA target sequence
agaaattcgcgatcttataaatcaagc

SEQ ID NO: 124367 - DNA, 27 bp, Artificial sequence
  SiRNA target sequence
gaaattcgcgatcttataaatcaagca

SEQ ID NO: 124368 - DNA, 27 bp, Artificial sequence
  SiRNA target sequence
aaattcgcgatcttataaatcaagcat

SEQ ID NO: 124369 - DNA, 27 bp, Artificial sequence
  SiRNA target sequence
aattcgcgatcttataaatcaagcatt

SEQ ID NO: 124370 - DNA, 27 bp, Artificial sequence
  SiRNA target sequence
attcgcgatcttataaatcaagcattg

SEQ ID NO: 124371 - DNA, 27 bp, Artificial sequence
  SiRNA target sequence
ttcgcgatcttataaatcaagcattgg

SEQ ID NO: 124372 - DNA, 27 bp, Artificial sequence
  SiRNA target sequence
tcgcgatcttataaatcaagcattgga

SEQ ID NO: 124373 - DNA, 27 bp, Artificial sequence
  SiRNA target sequence
cgcgatcttataaatcaagcattggat

SEQ ID NO: 124374 - DNA, 27 bp, Artificial sequence
  SiRNA target sequence
gcgatcttataaatcaagcattggatg

SEQ ID NO: 124375 - DNA, 27 bp, Artificial sequence
  SiRNA target sequence
cgatcttataaatcaagcattggatga

SEQ ID NO: 124376 - DNA, 27 bp, Artificial sequence
  SiRNA target sequence
gatcttataaatcaagcattggatgag

SEQ ID NO: 124377 - DNA, 27 bp, Artificial sequence
  SiRNA target sequence
atcttataaatcaagcattggatgagg

SEQ ID NO: 124378 - DNA, 27 bp, Artificial sequence
  SiRNA target sequence
tcttataaatcaagcattggatgagga

SEQ ID NO: 124379 - DNA, 27 bp, Artificial sequence
  SiRNA target sequence
cttataaatcaagcattggatgaggaa

SEQ ID NO: 124380 - DNA, 27 bp, Artificial sequence
  SiRNA target sequence
ttataaatcaagcattggatgaggaaa

SEQ ID NO: 124381 - DNA, 27 bp, Artificial sequence
  SiRNA target sequence
tataaatcaagcattggatgaggaaat

SEQ ID NO: 124382 - DNA, 27 bp, Artificial sequence
  SiRNA target sequence
ataaatcaagcattggatgaggaaatg

SEQ ID NO: 124383 - DNA, 27 bp, Artificial sequence
  SiRNA target sequence
taaatcaagcattggatgaggaaatgg

SEQ ID NO: 124384 - DNA, 27 bp, Artificial sequence
  SiRNA target sequence
aaatcaagcattggatgaggaaatggg

SEQ ID NO: 124385 - DNA, 27 bp, Artificial sequence
  SiRNA target sequence
aatcaagcattggatgaggaaatggga

SEQ ID NO: 124386 - DNA, 27 bp, Artificial sequence
  SiRNA target sequence
atcaagcattggatgaggaaatgggaa

SEQ ID NO: 124387 - DNA, 27 bp, Artificial sequence
  SiRNA target sequence
tcaagcattggatgaggaaatgggaat

SEQ ID NO: 124388 - DNA, 27 bp, Artificial sequence
  SiRNA target sequence
caagcattggatgaggaaatgggaatg

SEQ ID NO: 124389 - DNA, 27 bp, Artificial sequence
  SiRNA target sequence
aagcattggatgaggaaatgggaatgg

SEQ ID NO: 124390 - DNA, 27 bp, Artificial sequence
  SiRNA target sequence
agcattggatgaggaaatgggaatgga

SEQ ID NO: 124391 - DNA, 27 bp, Artificial sequence
  SiRNA target sequence
gcattggatgaggaaatgggaatggat

SEQ ID NO: 124392 - DNA, 27 bp, Artificial sequence
  SiRNA target sequence
cattggatgaggaaatgggaatggatc

SEQ ID NO: 124393 - DNA, 27 bp, Artificial sequence
  SiRNA target sequence
attggatgaggaaatgggaatggatca

SEQ ID NO: 124394 - DNA, 27 bp, Artificial sequence
  SiRNA target sequence
ttggatgaggaaatgggaatggatcat

SEQ ID NO: 124395 - DNA, 27 bp, Artificial sequence
  SiRNA target sequence
tggatgaggaaatgggaatggatcata

SEQ ID NO: 124396 - DNA, 27 bp, Artificial sequence
  SiRNA target sequence
ggatgaggaaatgggaatggatcataa

SEQ ID NO: 124397 - DNA, 27 bp, Artificial sequence
  SiRNA target sequence
gatgaggaaatgggaatggatcataat

SEQ ID NO: 124398 - DNA, 27 bp, Artificial sequence
  SiRNA target sequence
atgaggaaatgggaatggatcataatg

SEQ ID NO: 124399 - DNA, 27 bp, Artificial sequence
  SiRNA target sequence
tgaggaaatgggaatggatcataatgt

SEQ ID NO: 124400 - DNA, 27 bp, Artificial sequence
  SiRNA target sequence
gaggaaatgggaatggatcataatgta

SEQ ID NO: 124401 - DNA, 27 bp, Artificial sequence
  SiRNA target sequence
aggaaatgggaatggatcataatgtat

SEQ ID NO: 124402 - DNA, 27 bp, Artificial sequence
  SiRNA target sequence
ggaaatgggaatggatcataatgtata

SEQ ID NO: 124403 - DNA, 27 bp, Artificial sequence
  SiRNA target sequence
gaaatgggaatggatcataatgtatat

SEQ ID NO: 124404 - DNA, 27 bp, Artificial sequence
  SiRNA target sequence
aaatgggaatggatcataatgtatata

SEQ ID NO: 124405 - DNA, 27 bp, Artificial sequence
  SiRNA target sequence
aatgggaatggatcataatgtatatat

SEQ ID NO: 124406 - DNA, 27 bp, Artificial sequence
  SiRNA target sequence
atgggaatggatcataatgtatatata

SEQ ID NO: 124407 - DNA, 27 bp, Artificial sequence
  SiRNA target sequence
tgggaatggatcataatgtatatataa

SEQ ID NO: 124408 - DNA, 27 bp, Artificial sequence
  SiRNA target sequence
gggaatggatcataatgtatatataat

SEQ ID NO: 124409 - DNA, 27 bp, Artificial sequence
  SiRNA target sequence
ggaatggatcataatgtatatataata

SEQ ID NO: 124410 - DNA, 27 bp, Artificial sequence
  SiRNA target sequence
gaatggatcataatgtatatataatag

SEQ ID NO: 124411 - DNA, 27 bp, Artificial sequence
  SiRNA target sequence
aatggatcataatgtatatataatagg

SEQ ID NO: 124412 - DNA, 27 bp, Artificial sequence
  SiRNA target sequence
atggatcataatgtatatataatagga

SEQ ID NO: 124413 - DNA, 27 bp, Artificial sequence
  SiRNA target sequence
tggatcataatgtatatataataggag

SEQ ID NO: 124414 - DNA, 27 bp, Artificial sequence
  SiRNA target sequence
ggatcataatgtatatataataggaga

SEQ ID NO: 124415 - DNA, 27 bp, Artificial sequence
  SiRNA target sequence
gatcataatgtatatataataggagaa

SEQ ID NO: 124416 - DNA, 27 bp, Artificial sequence
  SiRNA target sequence
atcataatgtatatataataggagaag

SEQ ID NO: 124417 - DNA, 27 bp, Artificial sequence
  SiRNA target sequence
tcataatgtatatataataggagaaga

SEQ ID NO: 124418 - DNA, 27 bp, Artificial sequence
  SiRNA target sequence
cataatgtatatataataggagaagaa

SEQ ID NO: 124419 - DNA, 27 bp, Artificial sequence
  SiRNA target sequence
ataatgtatatataataggagaagaag

SEQ ID NO: 124420 - DNA, 27 bp, Artificial sequence
  SiRNA target sequence
taatgtatatataataggagaagaagt

SEQ ID NO: 124421 - DNA, 27 bp, Artificial sequence
  SiRNA target sequence
aatgtatatataataggagaagaagta

SEQ ID NO: 124422 - DNA, 27 bp, Artificial sequence
  SiRNA target sequence
atgtatatataataggagaagaagtag

SEQ ID NO: 124423 - DNA, 27 bp, Artificial sequence
  SiRNA target sequence
tgtatatataataggagaagaagtagg

SEQ ID NO: 124424 - DNA, 27 bp, Artificial sequence
  SiRNA target sequence
gtatatataataggagaagaagtaggc

SEQ ID NO: 124425 - DNA, 27 bp, Artificial sequence
  SiRNA target sequence
tatatataataggagaagaagtaggca

SEQ ID NO: 124426 - DNA, 27 bp, Artificial sequence
  SiRNA target sequence
atatataataggagaagaagtaggcat

SEQ ID NO: 124427 - DNA, 27 bp, Artificial sequence
  SiRNA target sequence
tatataataggagaagaagtaggcatc

SEQ ID NO: 124428 - DNA, 27 bp, Artificial sequence
  SiRNA target sequence
atataataggagaagaagtaggcatct

SEQ ID NO: 124429 - DNA, 27 bp, Artificial sequence
  SiRNA target sequence
tataataggagaagaagtaggcatctc

SEQ ID NO: 124430 - DNA, 27 bp, Artificial sequence
  SiRNA target sequence
ataataggagaagaagtaggcatctct

SEQ ID NO: 124431 - DNA, 27 bp, Artificial sequence
  SiRNA target sequence
taataggagaagaagtaggcatctctg

SEQ ID NO: 124432 - DNA, 27 bp, Artificial sequence
  SiRNA target sequence
aataggagaagaagtaggcatctctgg

SEQ ID NO: 124433 - DNA, 27 bp, Artificial sequence
  SiRNA target sequence
ataggagaagaagtaggcatctctggt

SEQ ID NO: 124434 - DNA, 27 bp, Artificial sequence
  SiRNA target sequence
taggagaagaagtaggcatctctggtg

SEQ ID NO: 124435 - DNA, 27 bp, Artificial sequence
  SiRNA target sequence
aggagaagaagtaggcatctctggtgg

SEQ ID NO: 124436 - DNA, 27 bp, Artificial sequence
  SiRNA target sequence
ggagaagaagtaggcatctctggtggt

SEQ ID NO: 124437 - DNA, 27 bp, Artificial sequence
  SiRNA target sequence
gagaagaagtaggcatctctggtggtc

SEQ ID NO: 124438 - DNA, 27 bp, Artificial sequence
  SiRNA target sequence
agaagaagtaggcatctctggtggtcc

SEQ ID NO: 124439 - DNA, 27 bp, Artificial sequence
  SiRNA target sequence
gaagaagtaggcatctctggtggtcct

SEQ ID NO: 124440 - DNA, 27 bp, Artificial sequence
  SiRNA target sequence
aagaagtaggcatctctggtggtcctc

SEQ ID NO: 124441 - DNA, 27 bp, Artificial sequence
  SiRNA target sequence
agaagtaggcatctctggtggtcctca

SEQ ID NO: 124442 - DNA, 27 bp, Artificial sequence
  SiRNA target sequence
gaagtaggcatctctggtggtcctcac

SEQ ID NO: 124443 - DNA, 27 bp, Artificial sequence
  SiRNA target sequence
aagtaggcatctctggtggtcctcacg

SEQ ID NO: 124444 - DNA, 27 bp, Artificial sequence
  SiRNA target sequence
agtaggcatctctggtggtcctcacgg

SEQ ID NO: 124445 - DNA, 27 bp, Artificial sequence
  SiRNA target sequence
gtaggcatctctggtggtcctcacggt

SEQ ID NO: 124446 - DNA, 27 bp, Artificial sequence
  SiRNA target sequence
taggcatctctggtggtcctcacggtc

SEQ ID NO: 124447 - DNA, 27 bp, Artificial sequence
  SiRNA target sequence
aggcatctctggtggtcctcacggtct

SEQ ID NO: 124448 - DNA, 27 bp, Artificial sequence
  SiRNA target sequence
ggcatctctggtggtcctcacggtctt

SEQ ID NO: 124449 - DNA, 27 bp, Artificial sequence
  SiRNA target sequence
gcatctctggtggtcctcacggtctta

SEQ ID NO: 124450 - DNA, 27 bp, Artificial sequence
  SiRNA target sequence
catctctggtggtcctcacggtcttac

SEQ ID NO: 124451 - DNA, 27 bp, Artificial sequence
  SiRNA target sequence
atctctggtggtcctcacggtcttact

SEQ ID NO: 124452 - DNA, 27 bp, Artificial sequence
  SiRNA target sequence
tctctggtggtcctcacggtcttacta

SEQ ID NO: 124453 - DNA, 27 bp, Artificial sequence
  SiRNA target sequence
ctctggtggtcctcacggtcttactaa

SEQ ID NO: 124454 - DNA, 27 bp, Artificial sequence
  SiRNA target sequence
tctggtggtcctcacggtcttactaaa

SEQ ID NO: 124455 - DNA, 27 bp, Artificial sequence
  SiRNA target sequence
ctggtggtcctcacggtcttactaaaa

SEQ ID NO: 124456 - DNA, 27 bp, Artificial sequence
  SiRNA target sequence
tggtggtcctcacggtcttactaaaaa

SEQ ID NO: 124457 - DNA, 27 bp, Artificial sequence
  SiRNA target sequence
ggtggtcctcacggtcttactaaaaat

SEQ ID NO: 124458 - DNA, 27 bp, Artificial sequence
  SiRNA target sequence
gtggtcctcacggtcttactaaaaatt

SEQ ID NO: 124459 - DNA, 27 bp, Artificial sequence
  SiRNA target sequence
tggtcctcacggtcttactaaaaattt

SEQ ID NO: 124460 - DNA, 27 bp, Artificial sequence
  SiRNA target sequence
ggtcctcacggtcttactaaaaatttg

SEQ ID NO: 124461 - DNA, 27 bp, Artificial sequence
  SiRNA target sequence
gtcctcacggtcttactaaaaatttga

SEQ ID NO: 124462 - DNA, 27 bp, Artificial sequence
  SiRNA target sequence
tcctcacggtcttactaaaaatttgat

SEQ ID NO: 124463 - DNA, 27 bp, Artificial sequence
  SiRNA target sequence
cctcacggtcttactaaaaatttgatc

SEQ ID NO: 124464 - DNA, 27 bp, Artificial sequence
  SiRNA target sequence
ctcacggtcttactaaaaatttgatca

SEQ ID NO: 124465 - DNA, 27 bp, Artificial sequence
  SiRNA target sequence
tcacggtcttactaaaaatttgatcaa

SEQ ID NO: 124466 - DNA, 27 bp, Artificial sequence
  SiRNA target sequence
cacggtcttactaaaaatttgatcaaa

SEQ ID NO: 124467 - DNA, 27 bp, Artificial sequence
  SiRNA target sequence
acggtcttactaaaaatttgatcaaaa

SEQ ID NO: 124468 - DNA, 27 bp, Artificial sequence
  SiRNA target sequence
cggtcttactaaaaatttgatcaaaaa

SEQ ID NO: 124469 - DNA, 27 bp, Artificial sequence
  SiRNA target sequence
ggtcttactaaaaatttgatcaaaaaa

SEQ ID NO: 124470 - DNA, 27 bp, Artificial sequence
  SiRNA target sequence
gtcttactaaaaatttgatcaaaaaat

SEQ ID NO: 124471 - DNA, 27 bp, Artificial sequence
  SiRNA target sequence
tcttactaaaaatttgatcaaaaaata

SEQ ID NO: 124472 - DNA, 27 bp, Artificial sequence
  SiRNA target sequence
cttactaaaaatttgatcaaaaaatac

SEQ ID NO: 124473 - DNA, 27 bp, Artificial sequence
  SiRNA target sequence
ttactaaaaatttgatcaaaaaatacg

SEQ ID NO: 124474 - DNA, 27 bp, Artificial sequence
  SiRNA target sequence
tactaaaaatttgatcaaaaaatacgg

SEQ ID NO: 124475 - DNA, 27 bp, Artificial sequence
  SiRNA target sequence
actaaaaatttgatcaaaaaatacggc

SEQ ID NO: 124476 - DNA, 27 bp, Artificial sequence
  SiRNA target sequence
ctaaaaatttgatcaaaaaatacggcg

SEQ ID NO: 124477 - DNA, 27 bp, Artificial sequence
  SiRNA target sequence
taaaaatttgatcaaaaaatacggcga

SEQ ID NO: 124478 - DNA, 27 bp, Artificial sequence
  SiRNA target sequence
aaaaatttgatcaaaaaatacggcgat

SEQ ID NO: 124479 - DNA, 27 bp, Artificial sequence
  SiRNA target sequence
aaaatttgatcaaaaaatacggcgatc

SEQ ID NO: 124480 - DNA, 27 bp, Artificial sequence
  SiRNA target sequence
aaatttgatcaaaaaatacggcgatca

SEQ ID NO: 124481 - DNA, 27 bp, Artificial sequence
  SiRNA target sequence
aatttgatcaaaaaatacggcgatcaa

SEQ ID NO: 124482 - DNA, 27 bp, Artificial sequence
  SiRNA target sequence
atttgatcaaaaaatacggcgatcaaa

SEQ ID NO: 124483 - DNA, 27 bp, Artificial sequence
  SiRNA target sequence
tttgatcaaaaaatacggcgatcaaag

SEQ ID NO: 124484 - DNA, 27 bp, Artificial sequence
  SiRNA target sequence
ttgatcaaaaaatacggcgatcaaaga

SEQ ID NO: 124485 - DNA, 27 bp, Artificial sequence
  SiRNA target sequence
tgatcaaaaaatacggcgatcaaagag

SEQ ID NO: 124486 - DNA, 27 bp, Artificial sequence
  SiRNA target sequence
gatcaaaaaatacggcgatcaaagagt

SEQ ID NO: 124487 - DNA, 27 bp, Artificial sequence
  SiRNA target sequence
atcaaaaaatacggcgatcaaagagtg

SEQ ID NO: 124488 - DNA, 27 bp, Artificial sequence
  SiRNA target sequence
tcaaaaaatacggcgatcaaagagtga

SEQ ID NO: 124489 - DNA, 27 bp, Artificial sequence
  SiRNA target sequence
caaaaaatacggcgatcaaagagtgaa

SEQ ID NO: 124490 - DNA, 27 bp, Artificial sequence
  SiRNA target sequence
aaaaaatacggcgatcaaagagtgaag

SEQ ID NO: 124491 - DNA, 27 bp, Artificial sequence
  SiRNA target sequence
aaaaatacggcgatcaaagagtgaagg

SEQ ID NO: 124492 - DNA, 27 bp, Artificial sequence
  SiRNA target sequence
aaaatacggcgatcaaagagtgaagga

SEQ ID NO: 124493 - DNA, 27 bp, Artificial sequence
  SiRNA target sequence
aaatacggcgatcaaagagtgaaggat

SEQ ID NO: 124494 - DNA, 27 bp, Artificial sequence
  SiRNA target sequence
aatacggcgatcaaagagtgaaggata

SEQ ID NO: 124495 - DNA, 27 bp, Artificial sequence
  SiRNA target sequence
atacggcgatcaaagagtgaaggatac

SEQ ID NO: 124496 - DNA, 27 bp, Artificial sequence
  SiRNA target sequence
tacggcgatcaaagagtgaaggatacc

SEQ ID NO: 124497 - DNA, 27 bp, Artificial sequence
  SiRNA target sequence
acggcgatcaaagagtgaaggataccc

SEQ ID NO: 124498 - DNA, 27 bp, Artificial sequence
  SiRNA target sequence
cggcgatcaaagagtgaaggatacccc

SEQ ID NO: 124499 - DNA, 27 bp, Artificial sequence
  SiRNA target sequence
ggcgatcaaagagtgaaggatacccct

SEQ ID NO: 124500 - DNA, 27 bp, Artificial sequence
  SiRNA target sequence
gcgatcaaagagtgaaggataccccta

SEQ ID NO: 124501 - DNA, 27 bp, Artificial sequence
  SiRNA target sequence
cgatcaaagagtgaaggatacccctat

SEQ ID NO: 124502 - DNA, 27 bp, Artificial sequence
  SiRNA target sequence
gatcaaagagtgaaggatacccctatt

SEQ ID NO: 124503 - DNA, 27 bp, Artificial sequence
  SiRNA target sequence
atcaaagagtgaaggatacccctattt

SEQ ID NO: 124504 - DNA, 27 bp, Artificial sequence
  SiRNA target sequence
tcaaagagtgaaggatacccctatttc

SEQ ID NO: 124505 - DNA, 27 bp, Artificial sequence
  SiRNA target sequence
caaagagtgaaggatacccctatttcg

SEQ ID NO: 124506 - DNA, 27 bp, Artificial sequence
  SiRNA target sequence
aaagagtgaaggatacccctatttcgg

SEQ ID NO: 124507 - DNA, 27 bp, Artificial sequence
  SiRNA target sequence
aagagtgaaggatacccctatttcgga

SEQ ID NO: 124508 - DNA, 27 bp, Artificial sequence
  SiRNA target sequence
agagtgaaggatacccctatttcggaa

SEQ ID NO: 124509 - DNA, 27 bp, Artificial sequence
  SiRNA target sequence
gagtgaaggatacccctatttcggaaa

SEQ ID NO: 124510 - DNA, 27 bp, Artificial sequence
  SiRNA target sequence
agtgaaggatacccctatttcggaaat

SEQ ID NO: 124511 - DNA, 27 bp, Artificial sequence
  SiRNA target sequence
gtgaaggatacccctatttcggaaatg

SEQ ID NO: 124512 - DNA, 27 bp, Artificial sequence
  SiRNA target sequence
tgaaggatacccctatttcggaaatgg

SEQ ID NO: 124513 - DNA, 27 bp, Artificial sequence
  SiRNA target sequence
gaaggatacccctatttcggaaatggg

SEQ ID NO: 124514 - DNA, 27 bp, Artificial sequence
  SiRNA target sequence
aaggatacccctatttcggaaatggga

SEQ ID NO: 124515 - DNA, 27 bp, Artificial sequence
  SiRNA target sequence
aggatacccctatttcggaaatgggat

SEQ ID NO: 124516 - DNA, 27 bp, Artificial sequence
  SiRNA target sequence
ggatacccctatttcggaaatgggatt

SEQ ID NO: 124517 - DNA, 27 bp, Artificial sequence
  SiRNA target sequence
gatacccctatttcggaaatgggattt

SEQ ID NO: 124518 - DNA, 27 bp, Artificial sequence
  SiRNA target sequence
atacccctatttcggaaatgggattta

SEQ ID NO: 124519 - DNA, 27 bp, Artificial sequence
  SiRNA target sequence
tacccctatttcggaaatgggatttac

SEQ ID NO: 124520 - DNA, 27 bp, Artificial sequence
  SiRNA target sequence
acccctatttcggaaatgggatttaca

SEQ ID NO: 124521 - DNA, 27 bp, Artificial sequence
  SiRNA target sequence
cccctatttcggaaatgggatttacag

SEQ ID NO: 124522 - DNA, 27 bp, Artificial sequence
  SiRNA target sequence
ccctatttcggaaatgggatttacagg

SEQ ID NO: 124523 - DNA, 27 bp, Artificial sequence
  SiRNA target sequence
cctatttcggaaatgggatttacaggt

SEQ ID NO: 124524 - DNA, 27 bp, Artificial sequence
  SiRNA target sequence
ctatttcggaaatgggatttacaggtc

SEQ ID NO: 124525 - DNA, 27 bp, Artificial sequence
  SiRNA target sequence
tatttcggaaatgggatttacaggtct

SEQ ID NO: 124526 - DNA, 27 bp, Artificial sequence
  SiRNA target sequence
atttcggaaatgggatttacaggtctc

SEQ ID NO: 124527 - DNA, 27 bp, Artificial sequence
  SiRNA target sequence
tttcggaaatgggatttacaggtctcg

SEQ ID NO: 124528 - DNA, 27 bp, Artificial sequence
  SiRNA target sequence
ttcggaaatgggatttacaggtctcgc

SEQ ID NO: 124529 - DNA, 27 bp, Artificial sequence
  SiRNA target sequence
tcggaaatgggatttacaggtctcgct

SEQ ID NO: 124530 - DNA, 27 bp, Artificial sequence
  SiRNA target sequence
cggaaatgggatttacaggtctcgctg

SEQ ID NO: 124531 - DNA, 27 bp, Artificial sequence
  SiRNA target sequence
ggaaatgggatttacaggtctcgctgt

SEQ ID NO: 124532 - DNA, 27 bp, Artificial sequence
  SiRNA target sequence
gaaatgggatttacaggtctcgctgtg

SEQ ID NO: 124533 - DNA, 27 bp, Artificial sequence
  SiRNA target sequence
aaatgggatttacaggtctcgctgtgg

SEQ ID NO: 124534 - DNA, 27 bp, Artificial sequence
  SiRNA target sequence
aatgggatttacaggtctcgctgtggg

SEQ ID NO: 124535 - DNA, 27 bp, Artificial sequence
  SiRNA target sequence
atgggatttacaggtctcgctgtgggt

SEQ ID NO: 124536 - DNA, 27 bp, Artificial sequence
  SiRNA target sequence
tgggatttacaggtctcgctgtgggtt

SEQ ID NO: 124537 - DNA, 27 bp, Artificial sequence
  SiRNA target sequence
gggatttacaggtctcgctgtgggttc

SEQ ID NO: 124538 - DNA, 27 bp, Artificial sequence
  SiRNA target sequence
ggatttacaggtctcgctgtgggttca

SEQ ID NO: 124539 - DNA, 27 bp, Artificial sequence
  SiRNA target sequence
gatttacaggtctcgctgtgggttcaa

SEQ ID NO: 124540 - DNA, 27 bp, Artificial sequence
  SiRNA target sequence
atttacaggtctcgctgtgggttcaag

SEQ ID NO: 124541 - DNA, 27 bp, Artificial sequence
  SiRNA target sequence
tttacaggtctcgctgtgggttcaagc

SEQ ID NO: 124542 - DNA, 27 bp, Artificial sequence
  SiRNA target sequence
ttacaggtctcgctgtgggttcaagct

SEQ ID NO: 124543 - DNA, 27 bp, Artificial sequence
  SiRNA target sequence
tacaggtctcgctgtgggttcaagcta

SEQ ID NO: 124544 - DNA, 27 bp, Artificial sequence
  SiRNA target sequence
acaggtctcgctgtgggttcaagctat

SEQ ID NO: 124545 - DNA, 27 bp, Artificial sequence
  SiRNA target sequence
caggtctcgctgtgggttcaagctatt

SEQ ID NO: 124546 - DNA, 27 bp, Artificial sequence
  SiRNA target sequence
aggtctcgctgtgggttcaagctattt

SEQ ID NO: 124547 - DNA, 27 bp, Artificial sequence
  SiRNA target sequence
ggtctcgctgtgggttcaagctattta

SEQ ID NO: 124548 - DNA, 27 bp, Artificial sequence
  SiRNA target sequence
gtctcgctgtgggttcaagctatttag

SEQ ID NO: 124549 - DNA, 27 bp, Artificial sequence
  SiRNA target sequence
tctcgctgtgggttcaagctatttagg

SEQ ID NO: 124550 - DNA, 27 bp, Artificial sequence
  SiRNA target sequence
ctcgctgtgggttcaagctatttaggg

SEQ ID NO: 124551 - DNA, 27 bp, Artificial sequence
  SiRNA target sequence
tcgctgtgggttcaagctatttagggt

SEQ ID NO: 124552 - DNA, 27 bp, Artificial sequence
  SiRNA target sequence
cgctgtgggttcaagctatttagggtt

SEQ ID NO: 124553 - DNA, 27 bp, Artificial sequence
  SiRNA target sequence
gctgtgggttcaagctatttagggtta

SEQ ID NO: 124554 - DNA, 27 bp, Artificial sequence
  SiRNA target sequence
ctgtgggttcaagctatttagggttaa

SEQ ID NO: 124555 - DNA, 27 bp, Artificial sequence
  SiRNA target sequence
tgtgggttcaagctatttagggttaag

SEQ ID NO: 124556 - DNA, 27 bp, Artificial sequence
  SiRNA target sequence
gtgggttcaagctatttagggttaaga

SEQ ID NO: 124557 - DNA, 27 bp, Artificial sequence
  SiRNA target sequence
tgggttcaagctatttagggttaagac

SEQ ID NO: 124558 - DNA, 27 bp, Artificial sequence
  SiRNA target sequence
gggttcaagctatttagggttaagacc

SEQ ID NO: 124559 - DNA, 27 bp, Artificial sequence
  SiRNA target sequence
ggttcaagctatttagggttaagaccc

SEQ ID NO: 124560 - DNA, 27 bp, Artificial sequence
  SiRNA target sequence
gttcaagctatttagggttaagacccg

SEQ ID NO: 124561 - DNA, 27 bp, Artificial sequence
  SiRNA target sequence
ttcaagctatttagggttaagacccgt

SEQ ID NO: 124562 - DNA, 27 bp, Artificial sequence
  SiRNA target sequence
tcaagctatttagggttaagacccgta

SEQ ID NO: 124563 - DNA, 27 bp, Artificial sequence
  SiRNA target sequence
caagctatttagggttaagacccgtag

SEQ ID NO: 124564 - DNA, 27 bp, Artificial sequence
  SiRNA target sequence
aagctatttagggttaagacccgtagt

SEQ ID NO: 124565 - DNA, 27 bp, Artificial sequence
  SiRNA target sequence
agctatttagggttaagacccgtagta

SEQ ID NO: 124566 - DNA, 27 bp, Artificial sequence
  SiRNA target sequence
gctatttagggttaagacccgtagtag

SEQ ID NO: 124567 - DNA, 27 bp, Artificial sequence
  SiRNA target sequence
ctatttagggttaagacccgtagtaga

SEQ ID NO: 124568 - DNA, 27 bp, Artificial sequence
  SiRNA target sequence
tatttagggttaagacccgtagtagat

SEQ ID NO: 124569 - DNA, 27 bp, Artificial sequence
  SiRNA target sequence
atttagggttaagacccgtagtagatt

SEQ ID NO: 124570 - DNA, 27 bp, Artificial sequence
  SiRNA target sequence
tttagggttaagacccgtagtagattt

SEQ ID NO: 124571 - DNA, 27 bp, Artificial sequence
  SiRNA target sequence
ttagggttaagacccgtagtagatttt

SEQ ID NO: 124572 - DNA, 27 bp, Artificial sequence
  SiRNA target sequence
tagggttaagacccgtagtagatttta

SEQ ID NO: 124573 - DNA, 27 bp, Artificial sequence
  SiRNA target sequence
agggttaagacccgtagtagattttat

SEQ ID NO: 124574 - DNA, 27 bp, Artificial sequence
  SiRNA target sequence
gggttaagacccgtagtagattttatg

SEQ ID NO: 124575 - DNA, 27 bp, Artificial sequence
  SiRNA target sequence
ggttaagacccgtagtagattttatga

SEQ ID NO: 124576 - DNA, 27 bp, Artificial sequence
  SiRNA target sequence
gttaagacccgtagtagattttatgac

SEQ ID NO: 124577 - DNA, 27 bp, Artificial sequence
  SiRNA target sequence
ttaagacccgtagtagattttatgact

SEQ ID NO: 124578 - DNA, 27 bp, Artificial sequence
  SiRNA target sequence
taagacccgtagtagattttatgactt

SEQ ID NO: 124579 - DNA, 27 bp, Artificial sequence
  SiRNA target sequence
aagacccgtagtagattttatgacttg

SEQ ID NO: 124580 - DNA, 27 bp, Artificial sequence
  SiRNA target sequence
agacccgtagtagattttatgacttgg

SEQ ID NO: 124581 - DNA, 27 bp, Artificial sequence
  SiRNA target sequence
gacccgtagtagattttatgacttgga

SEQ ID NO: 124582 - DNA, 27 bp, Artificial sequence
  SiRNA target sequence
acccgtagtagattttatgacttggaa

SEQ ID NO: 124583 - DNA, 27 bp, Artificial sequence
  SiRNA target sequence
cccgtagtagattttatgacttggaat

SEQ ID NO: 124584 - DNA, 27 bp, Artificial sequence
  SiRNA target sequence
ccgtagtagattttatgacttggaatt

SEQ ID NO: 124585 - DNA, 27 bp, Artificial sequence
  SiRNA target sequence
cgtagtagattttatgacttggaattt

SEQ ID NO: 124586 - DNA, 27 bp, Artificial sequence
  SiRNA target sequence
gtagtagattttatgacttggaatttt

SEQ ID NO: 124587 - DNA, 27 bp, Artificial sequence
  SiRNA target sequence
tagtagattttatgacttggaattttg

SEQ ID NO: 124588 - DNA, 27 bp, Artificial sequence
  SiRNA target sequence
agtagattttatgacttggaattttgc

SEQ ID NO: 124589 - DNA, 27 bp, Artificial sequence
  SiRNA target sequence
gtagattttatgacttggaattttgct

SEQ ID NO: 124590 - DNA, 27 bp, Artificial sequence
  SiRNA target sequence
tagattttatgacttggaattttgctt

SEQ ID NO: 124591 - DNA, 27 bp, Artificial sequence
  SiRNA target sequence
agattttatgacttggaattttgcttt

SEQ ID NO: 124592 - DNA, 27 bp, Artificial sequence
  SiRNA target sequence
gattttatgacttggaattttgctttg

SEQ ID NO: 124593 - DNA, 27 bp, Artificial sequence
  SiRNA target sequence
attttatgacttggaattttgctttgc

SEQ ID NO: 124594 - DNA, 27 bp, Artificial sequence
  SiRNA target sequence
ttttatgacttggaattttgctttgca

SEQ ID NO: 124595 - DNA, 27 bp, Artificial sequence
  SiRNA target sequence
tttatgacttggaattttgctttgcaa

SEQ ID NO: 124596 - DNA, 27 bp, Artificial sequence
  SiRNA target sequence
ttatgacttggaattttgctttgcaat

SEQ ID NO: 124597 - DNA, 27 bp, Artificial sequence
  SiRNA target sequence
tatgacttggaattttgctttgcaatc

SEQ ID NO: 124598 - DNA, 27 bp, Artificial sequence
  SiRNA target sequence
atgacttggaattttgctttgcaatca

SEQ ID NO: 124599 - DNA, 27 bp, Artificial sequence
  SiRNA target sequence
tgacttggaattttgctttgcaatcaa

SEQ ID NO: 124600 - DNA, 27 bp, Artificial sequence
  SiRNA target sequence
gacttggaattttgctttgcaatcaat

SEQ ID NO: 124601 - DNA, 27 bp, Artificial sequence
  SiRNA target sequence
acttggaattttgctttgcaatcaatt

SEQ ID NO: 124602 - DNA, 27 bp, Artificial sequence
  SiRNA target sequence
cttggaattttgctttgcaatcaattg

SEQ ID NO: 124603 - DNA, 27 bp, Artificial sequence
  SiRNA target sequence
ttggaattttgctttgcaatcaattga

SEQ ID NO: 124604 - DNA, 27 bp, Artificial sequence
  SiRNA target sequence
tggaattttgctttgcaatcaattgac

SEQ ID NO: 124605 - DNA, 27 bp, Artificial sequence
  SiRNA target sequence
ggaattttgctttgcaatcaattgacc

SEQ ID NO: 124606 - DNA, 27 bp, Artificial sequence
  SiRNA target sequence
gaattttgctttgcaatcaattgacca

SEQ ID NO: 124607 - DNA, 27 bp, Artificial sequence
  SiRNA target sequence
aattttgctttgcaatcaattgaccat

SEQ ID NO: 124608 - DNA, 27 bp, Artificial sequence
  SiRNA target sequence
attttgctttgcaatcaattgaccata

SEQ ID NO: 124609 - DNA, 27 bp, Artificial sequence
  SiRNA target sequence
ttttgctttgcaatcaattgaccatat

SEQ ID NO: 124610 - DNA, 27 bp, Artificial sequence
  SiRNA target sequence
tttgctttgcaatcaattgaccatatt

SEQ ID NO: 124611 - DNA, 27 bp, Artificial sequence
  SiRNA target sequence
ttgctttgcaatcaattgaccatatta

SEQ ID NO: 124612 - DNA, 27 bp, Artificial sequence
  SiRNA target sequence
tgctttgcaatcaattgaccatattat

SEQ ID NO: 124613 - DNA, 27 bp, Artificial sequence
  SiRNA target sequence
gctttgcaatcaattgaccatattatt

SEQ ID NO: 124614 - DNA, 27 bp, Artificial sequence
  SiRNA target sequence
ctttgcaatcaattgaccatattatta

SEQ ID NO: 124615 - DNA, 27 bp, Artificial sequence
  SiRNA target sequence
tttgcaatcaattgaccatattattaa

SEQ ID NO: 124616 - DNA, 27 bp, Artificial sequence
  SiRNA target sequence
ttgcaatcaattgaccatattattaat

SEQ ID NO: 124617 - DNA, 27 bp, Artificial sequence
  SiRNA target sequence
tgcaatcaattgaccatattattaatt

SEQ ID NO: 124618 - DNA, 27 bp, Artificial sequence
  SiRNA target sequence
gcaatcaattgaccatattattaattc

SEQ ID NO: 124619 - DNA, 27 bp, Artificial sequence
  SiRNA target sequence
caatcaattgaccatattattaattct

SEQ ID NO: 124620 - DNA, 27 bp, Artificial sequence
  SiRNA target sequence
aatcaattgaccatattattaattctt

SEQ ID NO: 124621 - DNA, 27 bp, Artificial sequence
  SiRNA target sequence
atcaattgaccatattattaattcttg

SEQ ID NO: 124622 - DNA, 27 bp, Artificial sequence
  SiRNA target sequence
tcaattgaccatattattaattcttgt

SEQ ID NO: 124623 - DNA, 27 bp, Artificial sequence
  SiRNA target sequence
caattgaccatattattaattcttgtg

SEQ ID NO: 124624 - DNA, 27 bp, Artificial sequence
  SiRNA target sequence
aattgaccatattattaattcttgtgc

SEQ ID NO: 124625 - DNA, 27 bp, Artificial sequence
  SiRNA target sequence
attgaccatattattaattcttgtgcg

SEQ ID NO: 124626 - DNA, 27 bp, Artificial sequence
  SiRNA target sequence
ttgaccatattattaattcttgtgcga

SEQ ID NO: 124627 - DNA, 27 bp, Artificial sequence
  SiRNA target sequence
tgaccatattattaattcttgtgcgaa

SEQ ID NO: 124628 - DNA, 27 bp, Artificial sequence
  SiRNA target sequence
gaccatattattaattcttgtgcgaaa

SEQ ID NO: 124629 - DNA, 27 bp, Artificial sequence
  SiRNA target sequence
accatattattaattcttgtgcgaaaa

SEQ ID NO: 124630 - DNA, 27 bp, Artificial sequence
  SiRNA target sequence
ccatattattaattcttgtgcgaaaac

SEQ ID NO: 124631 - DNA, 27 bp, Artificial sequence
  SiRNA target sequence
catattattaattcttgtgcgaaaacc

SEQ ID NO: 124632 - DNA, 27 bp, Artificial sequence
  SiRNA target sequence
atattattaattcttgtgcgaaaacct

SEQ ID NO: 124633 - DNA, 27 bp, Artificial sequence
  SiRNA target sequence
tattattaattcttgtgcgaaaacctt

SEQ ID NO: 124634 - DNA, 27 bp, Artificial sequence
  SiRNA target sequence
attattaattcttgtgcgaaaaccttg

SEQ ID NO: 124635 - DNA, 27 bp, Artificial sequence
  SiRNA target sequence
ttattaattcttgtgcgaaaaccttgt

SEQ ID NO: 124636 - DNA, 27 bp, Artificial sequence
  SiRNA target sequence
tattaattcttgtgcgaaaaccttgta

SEQ ID NO: 124637 - DNA, 27 bp, Artificial sequence
  SiRNA target sequence
attaattcttgtgcgaaaaccttgtat

SEQ ID NO: 124638 - DNA, 27 bp, Artificial sequence
  SiRNA target sequence
ttaattcttgtgcgaaaaccttgtata

SEQ ID NO: 124639 - DNA, 27 bp, Artificial sequence
  SiRNA target sequence
taattcttgtgcgaaaaccttgtatat

SEQ ID NO: 124640 - DNA, 27 bp, Artificial sequence
  SiRNA target sequence
aattcttgtgcgaaaaccttgtatatg

SEQ ID NO: 124641 - DNA, 27 bp, Artificial sequence
  SiRNA target sequence
attcttgtgcgaaaaccttgtatatgt

SEQ ID NO: 124642 - DNA, 27 bp, Artificial sequence
  SiRNA target sequence
ttcttgtgcgaaaaccttgtatatgtc

SEQ ID NO: 124643 - DNA, 27 bp, Artificial sequence
  SiRNA target sequence
tcttgtgcgaaaaccttgtatatgtca

SEQ ID NO: 124644 - DNA, 27 bp, Artificial sequence
  SiRNA target sequence
cttgtgcgaaaaccttgtatatgtcag

SEQ ID NO: 124645 - DNA, 27 bp, Artificial sequence
  SiRNA target sequence
ttgtgcgaaaaccttgtatatgtcagg

SEQ ID NO: 124646 - DNA, 27 bp, Artificial sequence
  SiRNA target sequence
tgtgcgaaaaccttgtatatgtcagga

SEQ ID NO: 124647 - DNA, 27 bp, Artificial sequence
  SiRNA target sequence
gtgcgaaaaccttgtatatgtcaggag

SEQ ID NO: 124648 - DNA, 27 bp, Artificial sequence
  SiRNA target sequence
tgcgaaaaccttgtatatgtcaggagg

SEQ ID NO: 124649 - DNA, 27 bp, Artificial sequence
  SiRNA target sequence
gcgaaaaccttgtatatgtcaggagga

SEQ ID NO: 124650 - DNA, 27 bp, Artificial sequence
  SiRNA target sequence
cgaaaaccttgtatatgtcaggaggaa

SEQ ID NO: 124651 - DNA, 27 bp, Artificial sequence
  SiRNA target sequence
gaaaaccttgtatatgtcaggaggaag

SEQ ID NO: 124652 - DNA, 27 bp, Artificial sequence
  SiRNA target sequence
aaaaccttgtatatgtcaggaggaaga

SEQ ID NO: 124653 - DNA, 27 bp, Artificial sequence
  SiRNA target sequence
aaaccttgtatatgtcaggaggaagaa

SEQ ID NO: 124654 - DNA, 27 bp, Artificial sequence
  SiRNA target sequence
aaccttgtatatgtcaggaggaagaat

SEQ ID NO: 124655 - DNA, 27 bp, Artificial sequence
  SiRNA target sequence
accttgtatatgtcaggaggaagaata

SEQ ID NO: 124656 - DNA, 27 bp, Artificial sequence
  SiRNA target sequence
ccttgtatatgtcaggaggaagaatac

SEQ ID NO: 124657 - DNA, 27 bp, Artificial sequence
  SiRNA target sequence
cttgtatatgtcaggaggaagaataca

SEQ ID NO: 124658 - DNA, 27 bp, Artificial sequence
  SiRNA target sequence
ttgtatatgtcaggaggaagaatacaa

SEQ ID NO: 124659 - DNA, 27 bp, Artificial sequence
  SiRNA target sequence
tgtatatgtcaggaggaagaatacaat

SEQ ID NO: 124660 - DNA, 27 bp, Artificial sequence
  SiRNA target sequence
gtatatgtcaggaggaagaatacaatg

SEQ ID NO: 124661 - DNA, 27 bp, Artificial sequence
  SiRNA target sequence
tatatgtcaggaggaagaatacaatgt

SEQ ID NO: 124662 - DNA, 27 bp, Artificial sequence
  SiRNA target sequence
atatgtcaggaggaagaatacaatgtc

SEQ ID NO: 124663 - DNA, 27 bp, Artificial sequence
  SiRNA target sequence
tatgtcaggaggaagaatacaatgtcc

SEQ ID NO: 124664 - DNA, 27 bp, Artificial sequence
  SiRNA target sequence
atgtcaggaggaagaatacaatgtcca

SEQ ID NO: 124665 - DNA, 27 bp, Artificial sequence
  SiRNA target sequence
tgtcaggaggaagaatacaatgtccaa

SEQ ID NO: 124666 - DNA, 27 bp, Artificial sequence
  SiRNA target sequence
gtcaggaggaagaatacaatgtccaat

SEQ ID NO: 124667 - DNA, 27 bp, Artificial sequence
  SiRNA target sequence
tcaggaggaagaatacaatgtccaatt

SEQ ID NO: 124668 - DNA, 27 bp, Artificial sequence
  SiRNA target sequence
caggaggaagaatacaatgtccaattg

SEQ ID NO: 124669 - DNA, 27 bp, Artificial sequence
  SiRNA target sequence
aggaggaagaatacaatgtccaattgt

SEQ ID NO: 124670 - DNA, 27 bp, Artificial sequence
  SiRNA target sequence
ggaggaagaatacaatgtccaattgtt

SEQ ID NO: 124671 - DNA, 27 bp, Artificial sequence
  SiRNA target sequence
gaggaagaatacaatgtccaattgttt

SEQ ID NO: 124672 - DNA, 27 bp, Artificial sequence
  SiRNA target sequence
aggaagaatacaatgtccaattgtttt

SEQ ID NO: 124673 - DNA, 27 bp, Artificial sequence
  SiRNA target sequence
ggaagaatacaatgtccaattgttttt

SEQ ID NO: 124674 - DNA, 27 bp, Artificial sequence
  SiRNA target sequence
gaagaatacaatgtccaattgttttta

SEQ ID NO: 124675 - DNA, 27 bp, Artificial sequence
  SiRNA target sequence
aagaatacaatgtccaattgtttttag

SEQ ID NO: 124676 - DNA, 27 bp, Artificial sequence
  SiRNA target sequence
agaatacaatgtccaattgtttttagg

SEQ ID NO: 124677 - DNA, 27 bp, Artificial sequence
  SiRNA target sequence
gaatacaatgtccaattgtttttaggg

SEQ ID NO: 124678 - DNA, 27 bp, Artificial sequence
  SiRNA target sequence
aatacaatgtccaattgtttttagggg

SEQ ID NO: 124679 - DNA, 27 bp, Artificial sequence
  SiRNA target sequence
atacaatgtccaattgtttttagggga

SEQ ID NO: 124680 - DNA, 27 bp, Artificial sequence
  SiRNA target sequence
tacaatgtccaattgtttttaggggac

SEQ ID NO: 124681 - DNA, 27 bp, Artificial sequence
  SiRNA target sequence
acaatgtccaattgtttttaggggacc

SEQ ID NO: 124682 - DNA, 27 bp, Artificial sequence
  SiRNA target sequence
caatgtccaattgtttttaggggacca

SEQ ID NO: 124683 - DNA, 27 bp, Artificial sequence
  SiRNA target sequence
aatgtccaattgtttttaggggaccaa

SEQ ID NO: 124684 - DNA, 27 bp, Artificial sequence
  SiRNA target sequence
atgtccaattgtttttaggggaccaaa

SEQ ID NO: 124685 - DNA, 27 bp, Artificial sequence
  SiRNA target sequence
tgtccaattgtttttaggggaccaaat

SEQ ID NO: 124686 - DNA, 27 bp, Artificial sequence
  SiRNA target sequence
gtccaattgtttttaggggaccaaatg

SEQ ID NO: 124687 - DNA, 27 bp, Artificial sequence
  SiRNA target sequence
tccaattgtttttaggggaccaaatgg

SEQ ID NO: 124688 - DNA, 27 bp, Artificial sequence
  SiRNA target sequence
ccaattgtttttaggggaccaaatgga

SEQ ID NO: 124689 - DNA, 27 bp, Artificial sequence
  SiRNA target sequence
caattgtttttaggggaccaaatggat

SEQ ID NO: 124690 - DNA, 27 bp, Artificial sequence
  SiRNA target sequence
aattgtttttaggggaccaaatggatt

SEQ ID NO: 124691 - DNA, 27 bp, Artificial sequence
  SiRNA target sequence
attgtttttaggggaccaaatggattc

SEQ ID NO: 124692 - DNA, 27 bp, Artificial sequence
  SiRNA target sequence
ttgtttttaggggaccaaatggattca

SEQ ID NO: 124693 - DNA, 27 bp, Artificial sequence
  SiRNA target sequence
tgtttttaggggaccaaatggattcaa

SEQ ID NO: 124694 - DNA, 27 bp, Artificial sequence
  SiRNA target sequence
gtttttaggggaccaaatggattcaat

SEQ ID NO: 124695 - DNA, 27 bp, Artificial sequence
  SiRNA target sequence
tttttaggggaccaaatggattcaata

SEQ ID NO: 124696 - DNA, 27 bp, Artificial sequence
  SiRNA target sequence
ttttaggggaccaaatggattcaataa

SEQ ID NO: 124697 - DNA, 27 bp, Artificial sequence
  SiRNA target sequence
tttaggggaccaaatggattcaataat

SEQ ID NO: 124698 - DNA, 27 bp, Artificial sequence
  SiRNA target sequence
ttaggggaccaaatggattcaataatg

SEQ ID NO: 124699 - DNA, 27 bp, Artificial sequence
  SiRNA target sequence
taggggaccaaatggattcaataatgg

SEQ ID NO: 124700 - DNA, 27 bp, Artificial sequence
  SiRNA target sequence
aggggaccaaatggattcaataatggg

SEQ ID NO: 124701 - DNA, 27 bp, Artificial sequence
  SiRNA target sequence
ggggaccaaatggattcaataatgggt

SEQ ID NO: 124702 - DNA, 27 bp, Artificial sequence
  SiRNA target sequence
gggaccaaatggattcaataatgggta

SEQ ID NO: 124703 - DNA, 27 bp, Artificial sequence
  SiRNA target sequence
ggaccaaatggattcaataatgggtac

SEQ ID NO: 124704 - DNA, 27 bp, Artificial sequence
  SiRNA target sequence
gaccaaatggattcaataatgggtacg

SEQ ID NO: 124705 - DNA, 27 bp, Artificial sequence
  SiRNA target sequence
accaaatggattcaataatgggtacgc

SEQ ID NO: 124706 - DNA, 27 bp, Artificial sequence
  SiRNA target sequence
ccaaatggattcaataatgggtacgct

SEQ ID NO: 124707 - DNA, 27 bp, Artificial sequence
  SiRNA target sequence
caaatggattcaataatgggtacgctg

SEQ ID NO: 124708 - DNA, 27 bp, Artificial sequence
  SiRNA target sequence
aaatggattcaataatgggtacgctgc

SEQ ID NO: 124709 - DNA, 27 bp, Artificial sequence
  SiRNA target sequence
aatggattcaataatgggtacgctgca

SEQ ID NO: 124710 - DNA, 27 bp, Artificial sequence
  SiRNA target sequence
atggattcaataatgggtacgctgcac

SEQ ID NO: 124711 - DNA, 27 bp, Artificial sequence
  SiRNA target sequence
tggattcaataatgggtacgctgcaca

SEQ ID NO: 124712 - DNA, 27 bp, Artificial sequence
  SiRNA target sequence
ggattcaataatgggtacgctgcacag

SEQ ID NO: 124713 - DNA, 27 bp, Artificial sequence
  SiRNA target sequence
gattcaataatgggtacgctgcacagc

SEQ ID NO: 124714 - DNA, 27 bp, Artificial sequence
  SiRNA target sequence
attcaataatgggtacgctgcacagca

SEQ ID NO: 124715 - DNA, 27 bp, Artificial sequence
  SiRNA target sequence
ttcaataatgggtacgctgcacagcac

SEQ ID NO: 124716 - DNA, 27 bp, Artificial sequence
  SiRNA target sequence
tcaataatgggtacgctgcacagcaca

SEQ ID NO: 124717 - DNA, 27 bp, Artificial sequence
  SiRNA target sequence
caataatgggtacgctgcacagcacac

SEQ ID NO: 124718 - DNA, 27 bp, Artificial sequence
  SiRNA target sequence
aataatgggtacgctgcacagcacaca

SEQ ID NO: 124719 - DNA, 27 bp, Artificial sequence
  SiRNA target sequence
ataatgggtacgctgcacagcacacac

SEQ ID NO: 124720 - DNA, 27 bp, Artificial sequence
  SiRNA target sequence
taatgggtacgctgcacagcacacaca

SEQ ID NO: 124721 - DNA, 27 bp, Artificial sequence
  SiRNA target sequence
aatgggtacgctgcacagcacacacaa

SEQ ID NO: 124722 - DNA, 27 bp, Artificial sequence
  SiRNA target sequence
atgggtacgctgcacagcacacacaag

SEQ ID NO: 124723 - DNA, 27 bp, Artificial sequence
  SiRNA target sequence
tgggtacgctgcacagcacacacaaga

SEQ ID NO: 124724 - DNA, 27 bp, Artificial sequence
  SiRNA target sequence
gggtacgctgcacagcacacacaagat

SEQ ID NO: 124725 - DNA, 27 bp, Artificial sequence
  SiRNA target sequence
ggtacgctgcacagcacacacaagatt

SEQ ID NO: 124726 - DNA, 27 bp, Artificial sequence
  SiRNA target sequence
gtacgctgcacagcacacacaagattt

SEQ ID NO: 124727 - DNA, 27 bp, Artificial sequence
  SiRNA target sequence
tacgctgcacagcacacacaagatttt

SEQ ID NO: 124728 - DNA, 27 bp, Artificial sequence
  SiRNA target sequence
acgctgcacagcacacacaagattttg

SEQ ID NO: 124729 - DNA, 27 bp, Artificial sequence
  SiRNA target sequence
cgctgcacagcacacacaagattttgc

SEQ ID NO: 124730 - DNA, 27 bp, Artificial sequence
  SiRNA target sequence
gctgcacagcacacacaagattttgca

SEQ ID NO: 124731 - DNA, 27 bp, Artificial sequence
  SiRNA target sequence
ctgcacagcacacacaagattttgcac

SEQ ID NO: 124732 - DNA, 27 bp, Artificial sequence
  SiRNA target sequence
tgcacagcacacacaagattttgcacc

SEQ ID NO: 124733 - DNA, 27 bp, Artificial sequence
  SiRNA target sequence
gcacagcacacacaagattttgcacca

SEQ ID NO: 124734 - DNA, 27 bp, Artificial sequence
  SiRNA target sequence
cacagcacacacaagattttgcaccaa

SEQ ID NO: 124735 - DNA, 27 bp, Artificial sequence
  SiRNA target sequence
acagcacacacaagattttgcaccaat

SEQ ID NO: 124736 - DNA, 27 bp, Artificial sequence
  SiRNA target sequence
cagcacacacaagattttgcaccaata

SEQ ID NO: 124737 - DNA, 27 bp, Artificial sequence
  SiRNA target sequence
agcacacacaagattttgcaccaatat

SEQ ID NO: 124738 - DNA, 27 bp, Artificial sequence
  SiRNA target sequence
gcacacacaagattttgcaccaatata

SEQ ID NO: 124739 - DNA, 27 bp, Artificial sequence
  SiRNA target sequence
cacacacaagattttgcaccaatatat

SEQ ID NO: 124740 - DNA, 27 bp, Artificial sequence
  SiRNA target sequence
acacacaagattttgcaccaatatatg

SEQ ID NO: 124741 - DNA, 27 bp, Artificial sequence
  SiRNA target sequence
cacacaagattttgcaccaatatatgg

SEQ ID NO: 124742 - DNA, 27 bp, Artificial sequence
  SiRNA target sequence
acacaagattttgcaccaatatatggt

SEQ ID NO: 124743 - DNA, 27 bp, Artificial sequence
  SiRNA target sequence
cacaagattttgcaccaatatatggtt

SEQ ID NO: 124744 - DNA, 27 bp, Artificial sequence
  SiRNA target sequence
acaagattttgcaccaatatatggttc

SEQ ID NO: 124745 - DNA, 27 bp, Artificial sequence
  SiRNA target sequence
caagattttgcaccaatatatggttct

SEQ ID NO: 124746 - DNA, 27 bp, Artificial sequence
  SiRNA target sequence
aagattttgcaccaatatatggttcta

SEQ ID NO: 124747 - DNA, 27 bp, Artificial sequence
  SiRNA target sequence
agattttgcaccaatatatggttctat

SEQ ID NO: 124748 - DNA, 27 bp, Artificial sequence
  SiRNA target sequence
gattttgcaccaatatatggttctatt

SEQ ID NO: 124749 - DNA, 27 bp, Artificial sequence
  SiRNA target sequence
attttgcaccaatatatggttctattc

SEQ ID NO: 124750 - DNA, 27 bp, Artificial sequence
  SiRNA target sequence
ttttgcaccaatatatggttctattcc

SEQ ID NO: 124751 - DNA, 27 bp, Artificial sequence
  SiRNA target sequence
tttgcaccaatatatggttctattcca

SEQ ID NO: 124752 - DNA, 27 bp, Artificial sequence
  SiRNA target sequence
ttgcaccaatatatggttctattccag

SEQ ID NO: 124753 - DNA, 27 bp, Artificial sequence
  SiRNA target sequence
tgcaccaatatatggttctattccagg

SEQ ID NO: 124754 - DNA, 27 bp, Artificial sequence
  SiRNA target sequence
gcaccaatatatggttctattccaggc

SEQ ID NO: 124755 - DNA, 27 bp, Artificial sequence
  SiRNA target sequence
caccaatatatggttctattccaggcc

SEQ ID NO: 124756 - DNA, 27 bp, Artificial sequence
  SiRNA target sequence
accaatatatggttctattccaggcct

SEQ ID NO: 124757 - DNA, 27 bp, Artificial sequence
  SiRNA target sequence
ccaatatatggttctattccaggcctt

SEQ ID NO: 124758 - DNA, 27 bp, Artificial sequence
  SiRNA target sequence
caatatatggttctattccaggcctta

SEQ ID NO: 124759 - DNA, 27 bp, Artificial sequence
  SiRNA target sequence
aatatatggttctattccaggccttaa

SEQ ID NO: 124760 - DNA, 27 bp, Artificial sequence
  SiRNA target sequence
atatatggttctattccaggccttaag

SEQ ID NO: 124761 - DNA, 27 bp, Artificial sequence
  SiRNA target sequence
tatatggttctattccaggccttaagg

SEQ ID NO: 124762 - DNA, 27 bp, Artificial sequence
  SiRNA target sequence
atatggttctattccaggccttaaggt

SEQ ID NO: 124763 - DNA, 27 bp, Artificial sequence
  SiRNA target sequence
tatggttctattccaggccttaaggtg

SEQ ID NO: 124764 - DNA, 27 bp, Artificial sequence
  SiRNA target sequence
atggttctattccaggccttaaggtgg

SEQ ID NO: 124765 - DNA, 27 bp, Artificial sequence
  SiRNA target sequence
tggttctattccaggccttaaggtggt

SEQ ID NO: 124766 - DNA, 27 bp, Artificial sequence
  SiRNA target sequence
ggttctattccaggccttaaggtggtt

SEQ ID NO: 124767 - DNA, 27 bp, Artificial sequence
  SiRNA target sequence
gttctattccaggccttaaggtggttt

SEQ ID NO: 124768 - DNA, 27 bp, Artificial sequence
  SiRNA target sequence
ttctattccaggccttaaggtggtttg

SEQ ID NO: 124769 - DNA, 27 bp, Artificial sequence
  SiRNA target sequence
tctattccaggccttaaggtggtttgt

SEQ ID NO: 124770 - DNA, 27 bp, Artificial sequence
  SiRNA target sequence
ctattccaggccttaaggtggtttgtc

SEQ ID NO: 124771 - DNA, 27 bp, Artificial sequence
  SiRNA target sequence
tattccaggccttaaggtggtttgtcc

SEQ ID NO: 124772 - DNA, 27 bp, Artificial sequence
  SiRNA target sequence
attccaggccttaaggtggtttgtcct

SEQ ID NO: 124773 - DNA, 27 bp, Artificial sequence
  SiRNA target sequence
ttccaggccttaaggtggtttgtcctt

SEQ ID NO: 124774 - DNA, 27 bp, Artificial sequence
  SiRNA target sequence
tccaggccttaaggtggtttgtcctta

SEQ ID NO: 124775 - DNA, 27 bp, Artificial sequence
  SiRNA target sequence
ccaggccttaaggtggtttgtccttat

SEQ ID NO: 124776 - DNA, 27 bp, Artificial sequence
  SiRNA target sequence
caggccttaaggtggtttgtccttata

SEQ ID NO: 124777 - DNA, 27 bp, Artificial sequence
  SiRNA target sequence
aggccttaaggtggtttgtccttatac

SEQ ID NO: 124778 - DNA, 27 bp, Artificial sequence
  SiRNA target sequence
ggccttaaggtggtttgtccttatacg

SEQ ID NO: 124779 - DNA, 27 bp, Artificial sequence
  SiRNA target sequence
gccttaaggtggtttgtccttatacgg

SEQ ID NO: 124780 - DNA, 27 bp, Artificial sequence
  SiRNA target sequence
ccttaaggtggtttgtccttatacggg

SEQ ID NO: 124781 - DNA, 27 bp, Artificial sequence
  SiRNA target sequence
cttaaggtggtttgtccttatacgggt

SEQ ID NO: 124782 - DNA, 27 bp, Artificial sequence
  SiRNA target sequence
ttaaggtggtttgtccttatacgggta

SEQ ID NO: 124783 - DNA, 27 bp, Artificial sequence
  SiRNA target sequence
taaggtggtttgtccttatacgggtaa

SEQ ID NO: 124784 - DNA, 27 bp, Artificial sequence
  SiRNA target sequence
aaggtggtttgtccttatacgggtaaa

SEQ ID NO: 124785 - DNA, 27 bp, Artificial sequence
  SiRNA target sequence
aggtggtttgtccttatacgggtaaag

SEQ ID NO: 124786 - DNA, 27 bp, Artificial sequence
  SiRNA target sequence
ggtggtttgtccttatacgggtaaaga

SEQ ID NO: 124787 - DNA, 27 bp, Artificial sequence
  SiRNA target sequence
gtggtttgtccttatacgggtaaagac

SEQ ID NO: 124788 - DNA, 27 bp, Artificial sequence
  SiRNA target sequence
tggtttgtccttatacgggtaaagacc

SEQ ID NO: 124789 - DNA, 27 bp, Artificial sequence
  SiRNA target sequence
ggtttgtccttatacgggtaaagacca

SEQ ID NO: 124790 - DNA, 27 bp, Artificial sequence
  SiRNA target sequence
gtttgtccttatacgggtaaagaccat

SEQ ID NO: 124791 - DNA, 27 bp, Artificial sequence
  SiRNA target sequence
tttgtccttatacgggtaaagaccata

SEQ ID NO: 124792 - DNA, 27 bp, Artificial sequence
  SiRNA target sequence
ttgtccttatacgggtaaagaccataa

SEQ ID NO: 124793 - DNA, 27 bp, Artificial sequence
  SiRNA target sequence
tgtccttatacgggtaaagaccataaa

SEQ ID NO: 124794 - DNA, 27 bp, Artificial sequence
  SiRNA target sequence
gtccttatacgggtaaagaccataaag

SEQ ID NO: 124795 - DNA, 27 bp, Artificial sequence
  SiRNA target sequence
tccttatacgggtaaagaccataaagg

SEQ ID NO: 124796 - DNA, 27 bp, Artificial sequence
  SiRNA target sequence
ccttatacgggtaaagaccataaagga

SEQ ID NO: 124797 - DNA, 27 bp, Artificial sequence
  SiRNA target sequence
cttatacgggtaaagaccataaaggac

SEQ ID NO: 124798 - DNA, 27 bp, Artificial sequence
  SiRNA target sequence
ttatacgggtaaagaccataaaggact

SEQ ID NO: 124799 - DNA, 27 bp, Artificial sequence
  SiRNA target sequence
tatacgggtaaagaccataaaggactt

SEQ ID NO: 124800 - DNA, 27 bp, Artificial sequence
  SiRNA target sequence
atacgggtaaagaccataaaggacttt

SEQ ID NO: 124801 - DNA, 27 bp, Artificial sequence
  SiRNA target sequence
tacgggtaaagaccataaaggactttt

SEQ ID NO: 124802 - DNA, 27 bp, Artificial sequence
  SiRNA target sequence
acgggtaaagaccataaaggactttta

SEQ ID NO: 124803 - DNA, 27 bp, Artificial sequence
  SiRNA target sequence
cgggtaaagaccataaaggacttttaa

SEQ ID NO: 124804 - DNA, 27 bp, Artificial sequence
  SiRNA target sequence
gggtaaagaccataaaggacttttaaa

SEQ ID NO: 124805 - DNA, 27 bp, Artificial sequence
  SiRNA target sequence
ggtaaagaccataaaggacttttaaaa

SEQ ID NO: 124806 - DNA, 27 bp, Artificial sequence
  SiRNA target sequence
gtaaagaccataaaggacttttaaaaa

SEQ ID NO: 124807 - DNA, 27 bp, Artificial sequence
  SiRNA target sequence
taaagaccataaaggacttttaaaaag

SEQ ID NO: 124808 - DNA, 27 bp, Artificial sequence
  SiRNA target sequence
aaagaccataaaggacttttaaaaagc

SEQ ID NO: 124809 - DNA, 27 bp, Artificial sequence
  SiRNA target sequence
aagaccataaaggacttttaaaaagcg

SEQ ID NO: 124810 - DNA, 27 bp, Artificial sequence
  SiRNA target sequence
agaccataaaggacttttaaaaagcgc

SEQ ID NO: 124811 - DNA, 27 bp, Artificial sequence
  SiRNA target sequence
gaccataaaggacttttaaaaagcgct

SEQ ID NO: 124812 - DNA, 27 bp, Artificial sequence
  SiRNA target sequence
accataaaggacttttaaaaagcgcta

SEQ ID NO: 124813 - DNA, 27 bp, Artificial sequence
  SiRNA target sequence
ccataaaggacttttaaaaagcgctat

SEQ ID NO: 124814 - DNA, 27 bp, Artificial sequence
  SiRNA target sequence
cataaaggacttttaaaaagcgctatt

SEQ ID NO: 124815 - DNA, 27 bp, Artificial sequence
  SiRNA target sequence
ataaaggacttttaaaaagcgctatta

SEQ ID NO: 124816 - DNA, 27 bp, Artificial sequence
  SiRNA target sequence
taaaggacttttaaaaagcgctattag

SEQ ID NO: 124817 - DNA, 27 bp, Artificial sequence
  SiRNA target sequence
aaaggacttttaaaaagcgctattaga

SEQ ID NO: 124818 - DNA, 27 bp, Artificial sequence
  SiRNA target sequence
aaggacttttaaaaagcgctattagag

SEQ ID NO: 124819 - DNA, 27 bp, Artificial sequence
  SiRNA target sequence
aggacttttaaaaagcgctattagaga

SEQ ID NO: 124820 - DNA, 27 bp, Artificial sequence
  SiRNA target sequence
ggacttttaaaaagcgctattagagac

SEQ ID NO: 124821 - DNA, 27 bp, Artificial sequence
  SiRNA target sequence
gacttttaaaaagcgctattagagaca

SEQ ID NO: 124822 - DNA, 27 bp, Artificial sequence
  SiRNA target sequence
acttttaaaaagcgctattagagacaa

SEQ ID NO: 124823 - DNA, 27 bp, Artificial sequence
  SiRNA target sequence
cttttaaaaagcgctattagagacaat

SEQ ID NO: 124824 - DNA, 27 bp, Artificial sequence
  SiRNA target sequence
ttttaaaaagcgctattagagacaata

SEQ ID NO: 124825 - DNA, 27 bp, Artificial sequence
  SiRNA target sequence
tttaaaaagcgctattagagacaataa

SEQ ID NO: 124826 - DNA, 27 bp, Artificial sequence
  SiRNA target sequence
ttaaaaagcgctattagagacaataac

SEQ ID NO: 124827 - DNA, 27 bp, Artificial sequence
  SiRNA target sequence
taaaaagcgctattagagacaataacc

SEQ ID NO: 124828 - DNA, 27 bp, Artificial sequence
  SiRNA target sequence
aaaaagcgctattagagacaataaccc

SEQ ID NO: 124829 - DNA, 27 bp, Artificial sequence
  SiRNA target sequence
aaaagcgctattagagacaataacccg

SEQ ID NO: 124830 - DNA, 27 bp, Artificial sequence
  SiRNA target sequence
aaagcgctattagagacaataacccgg

SEQ ID NO: 124831 - DNA, 27 bp, Artificial sequence
  SiRNA target sequence
aagcgctattagagacaataacccggt

SEQ ID NO: 124832 - DNA, 27 bp, Artificial sequence
  SiRNA target sequence
agcgctattagagacaataacccggtt

SEQ ID NO: 124833 - DNA, 27 bp, Artificial sequence
  SiRNA target sequence
gcgctattagagacaataacccggtta

SEQ ID NO: 124834 - DNA, 27 bp, Artificial sequence
  SiRNA target sequence
cgctattagagacaataacccggttat

SEQ ID NO: 124835 - DNA, 27 bp, Artificial sequence
  SiRNA target sequence
gctattagagacaataacccggttata

SEQ ID NO: 124836 - DNA, 27 bp, Artificial sequence
  SiRNA target sequence
ctattagagacaataacccggttatat

SEQ ID NO: 124837 - DNA, 27 bp, Artificial sequence
  SiRNA target sequence
tattagagacaataacccggttatatt

SEQ ID NO: 124838 - DNA, 27 bp, Artificial sequence
  SiRNA target sequence
attagagacaataacccggttatattt

SEQ ID NO: 124839 - DNA, 27 bp, Artificial sequence
  SiRNA target sequence
ttagagacaataacccggttatatttc

SEQ ID NO: 124840 - DNA, 27 bp, Artificial sequence
  SiRNA target sequence
tagagacaataacccggttatatttct

SEQ ID NO: 124841 - DNA, 27 bp, Artificial sequence
  SiRNA target sequence
agagacaataacccggttatatttctt

SEQ ID NO: 124842 - DNA, 27 bp, Artificial sequence
  SiRNA target sequence
gagacaataacccggttatatttcttg

SEQ ID NO: 124843 - DNA, 27 bp, Artificial sequence
  SiRNA target sequence
agacaataacccggttatatttcttga

SEQ ID NO: 124844 - DNA, 27 bp, Artificial sequence
  SiRNA target sequence
gacaataacccggttatatttcttgag

SEQ ID NO: 124845 - DNA, 27 bp, Artificial sequence
  SiRNA target sequence
acaataacccggttatatttcttgaga

SEQ ID NO: 124846 - DNA, 27 bp, Artificial sequence
  SiRNA target sequence
caataacccggttatatttcttgagaa

SEQ ID NO: 124847 - DNA, 27 bp, Artificial sequence
  SiRNA target sequence
aataacccggttatatttcttgagaat

SEQ ID NO: 124848 - DNA, 27 bp, Artificial sequence
  SiRNA target sequence
ataacccggttatatttcttgagaatg

SEQ ID NO: 124849 - DNA, 27 bp, Artificial sequence
  SiRNA target sequence
taacccggttatatttcttgagaatga

SEQ ID NO: 124850 - DNA, 27 bp, Artificial sequence
  SiRNA target sequence
aacccggttatatttcttgagaatgaa

SEQ ID NO: 124851 - DNA, 27 bp, Artificial sequence
  SiRNA target sequence
acccggttatatttcttgagaatgaaa

SEQ ID NO: 124852 - DNA, 27 bp, Artificial sequence
  SiRNA target sequence
cccggttatatttcttgagaatgaaat

SEQ ID NO: 124853 - DNA, 27 bp, Artificial sequence
  SiRNA target sequence
ccggttatatttcttgagaatgaaata

SEQ ID NO: 124854 - DNA, 27 bp, Artificial sequence
  SiRNA target sequence
cggttatatttcttgagaatgaaatat

SEQ ID NO: 124855 - DNA, 27 bp, Artificial sequence
  SiRNA target sequence
ggttatatttcttgagaatgaaatatt

SEQ ID NO: 124856 - DNA, 27 bp, Artificial sequence
  SiRNA target sequence
gttatatttcttgagaatgaaatatta

SEQ ID NO: 124857 - DNA, 27 bp, Artificial sequence
  SiRNA target sequence
ttatatttcttgagaatgaaatattat

SEQ ID NO: 124858 - DNA, 27 bp, Artificial sequence
  SiRNA target sequence
tatatttcttgagaatgaaatattata

SEQ ID NO: 124859 - DNA, 27 bp, Artificial sequence
  SiRNA target sequence
atatttcttgagaatgaaatattatat

SEQ ID NO: 124860 - DNA, 27 bp, Artificial sequence
  SiRNA target sequence
tatttcttgagaatgaaatattatata

SEQ ID NO: 124861 - DNA, 27 bp, Artificial sequence
  SiRNA target sequence
atttcttgagaatgaaatattatataa

SEQ ID NO: 124862 - DNA, 27 bp, Artificial sequence
  SiRNA target sequence
tttcttgagaatgaaatattatataaa

SEQ ID NO: 124863 - DNA, 27 bp, Artificial sequence
  SiRNA target sequence
ttcttgagaatgaaatattatataaag

SEQ ID NO: 124864 - DNA, 27 bp, Artificial sequence
  SiRNA target sequence
tcttgagaatgaaatattatataaaga

SEQ ID NO: 124865 - DNA, 27 bp, Artificial sequence
  SiRNA target sequence
cttgagaatgaaatattatataaagat

SEQ ID NO: 124866 - DNA, 27 bp, Artificial sequence
  SiRNA target sequence
ttgagaatgaaatattatataaagata

SEQ ID NO: 124867 - DNA, 27 bp, Artificial sequence
  SiRNA target sequence
tgagaatgaaatattatataaagataa

SEQ ID NO: 124868 - DNA, 27 bp, Artificial sequence
  SiRNA target sequence
gagaatgaaatattatataaagataaa

SEQ ID NO: 124869 - DNA, 27 bp, Artificial sequence
  SiRNA target sequence
agaatgaaatattatataaagataaat

SEQ ID NO: 124870 - DNA, 27 bp, Artificial sequence
  SiRNA target sequence
gaatgaaatattatataaagataaata

SEQ ID NO: 124871 - DNA, 27 bp, Artificial sequence
  SiRNA target sequence
aatgaaatattatataaagataaatac

SEQ ID NO: 124872 - DNA, 27 bp, Artificial sequence
  SiRNA target sequence
atgaaatattatataaagataaatacc

SEQ ID NO: 124873 - DNA, 27 bp, Artificial sequence
  SiRNA target sequence
tgaaatattatataaagataaatacct

SEQ ID NO: 124874 - DNA, 27 bp, Artificial sequence
  SiRNA target sequence
gaaatattatataaagataaatacctt

SEQ ID NO: 124875 - DNA, 27 bp, Artificial sequence
  SiRNA target sequence
aaatattatataaagataaataccttg

SEQ ID NO: 124876 - DNA, 27 bp, Artificial sequence
  SiRNA target sequence
aatattatataaagataaataccttga

SEQ ID NO: 124877 - DNA, 27 bp, Artificial sequence
  SiRNA target sequence
atattatataaagataaataccttgaa

SEQ ID NO: 124878 - DNA, 27 bp, Artificial sequence
  SiRNA target sequence
tattatataaagataaataccttgaag

SEQ ID NO: 124879 - DNA, 27 bp, Artificial sequence
  SiRNA target sequence
attatataaagataaataccttgaagt

SEQ ID NO: 124880 - DNA, 27 bp, Artificial sequence
  SiRNA target sequence
ttatataaagataaataccttgaagtg

SEQ ID NO: 124881 - DNA, 27 bp, Artificial sequence
  SiRNA target sequence
tatataaagataaataccttgaagtgt

SEQ ID NO: 124882 - DNA, 27 bp, Artificial sequence
  SiRNA target sequence
atataaagataaataccttgaagtgtc

SEQ ID NO: 124883 - DNA, 27 bp, Artificial sequence
  SiRNA target sequence
tataaagataaataccttgaagtgtct

SEQ ID NO: 124884 - DNA, 27 bp, Artificial sequence
  SiRNA target sequence
ataaagataaataccttgaagtgtcta

SEQ ID NO: 124885 - DNA, 27 bp, Artificial sequence
  SiRNA target sequence
taaagataaataccttgaagtgtctaa

SEQ ID NO: 124886 - DNA, 27 bp, Artificial sequence
  SiRNA target sequence
aaagataaataccttgaagtgtctaat

SEQ ID NO: 124887 - DNA, 27 bp, Artificial sequence
  SiRNA target sequence
aagataaataccttgaagtgtctaata

SEQ ID NO: 124888 - DNA, 27 bp, Artificial sequence
  SiRNA target sequence
agataaataccttgaagtgtctaataa

SEQ ID NO: 124889 - DNA, 27 bp, Artificial sequence
  SiRNA target sequence
gataaataccttgaagtgtctaataat

SEQ ID NO: 124890 - DNA, 27 bp, Artificial sequence
  SiRNA target sequence
ataaataccttgaagtgtctaataatt

SEQ ID NO: 124891 - DNA, 27 bp, Artificial sequence
  SiRNA target sequence
taaataccttgaagtgtctaataatta

SEQ ID NO: 124892 - DNA, 27 bp, Artificial sequence
  SiRNA target sequence
aaataccttgaagtgtctaataattat

SEQ ID NO: 124893 - DNA, 27 bp, Artificial sequence
  SiRNA target sequence
aataccttgaagtgtctaataattata

SEQ ID NO: 124894 - DNA, 27 bp, Artificial sequence
  SiRNA target sequence
ataccttgaagtgtctaataattatat

SEQ ID NO: 124895 - DNA, 27 bp, Artificial sequence
  SiRNA target sequence
taccttgaagtgtctaataattatatt

SEQ ID NO: 124896 - DNA, 27 bp, Artificial sequence
  SiRNA target sequence
accttgaagtgtctaataattatattc

SEQ ID NO: 124897 - DNA, 27 bp, Artificial sequence
  SiRNA target sequence
ccttgaagtgtctaataattatattca

SEQ ID NO: 124898 - DNA, 27 bp, Artificial sequence
  SiRNA target sequence
cttgaagtgtctaataattatattcaa

SEQ ID NO: 124899 - DNA, 27 bp, Artificial sequence
  SiRNA target sequence
ttgaagtgtctaataattatattcaac

SEQ ID NO: 124900 - DNA, 27 bp, Artificial sequence
  SiRNA target sequence
tgaagtgtctaataattatattcaacc

SEQ ID NO: 124901 - DNA, 27 bp, Artificial sequence
  SiRNA target sequence
gaagtgtctaataattatattcaacca

SEQ ID NO: 124902 - DNA, 27 bp, Artificial sequence
  SiRNA target sequence
aagtgtctaataattatattcaaccac

SEQ ID NO: 124903 - DNA, 27 bp, Artificial sequence
  SiRNA target sequence
agtgtctaataattatattcaaccact

SEQ ID NO: 124904 - DNA, 27 bp, Artificial sequence
  SiRNA target sequence
gtgtctaataattatattcaaccactt

SEQ ID NO: 124905 - DNA, 27 bp, Artificial sequence
  SiRNA target sequence
tgtctaataattatattcaaccacttg

SEQ ID NO: 124906 - DNA, 27 bp, Artificial sequence
  SiRNA target sequence
gtctaataattatattcaaccacttga

SEQ ID NO: 124907 - DNA, 27 bp, Artificial sequence
  SiRNA target sequence
tctaataattatattcaaccacttgac

SEQ ID NO: 124908 - DNA, 27 bp, Artificial sequence
  SiRNA target sequence
ctaataattatattcaaccacttgaca

SEQ ID NO: 124909 - DNA, 27 bp, Artificial sequence
  SiRNA target sequence
taataattatattcaaccacttgacaa

SEQ ID NO: 124910 - DNA, 27 bp, Artificial sequence
  SiRNA target sequence
aataattatattcaaccacttgacaag

SEQ ID NO: 124911 - DNA, 27 bp, Artificial sequence
  SiRNA target sequence
ataattatattcaaccacttgacaagg

SEQ ID NO: 124912 - DNA, 27 bp, Artificial sequence
  SiRNA target sequence
taattatattcaaccacttgacaaggc

SEQ ID NO: 124913 - DNA, 27 bp, Artificial sequence
  SiRNA target sequence
aattatattcaaccacttgacaaggca

SEQ ID NO: 124914 - DNA, 27 bp, Artificial sequence
  SiRNA target sequence
attatattcaaccacttgacaaggcag

SEQ ID NO: 124915 - DNA, 27 bp, Artificial sequence
  SiRNA target sequence
ttatattcaaccacttgacaaggcagt

SEQ ID NO: 124916 - DNA, 27 bp, Artificial sequence
  SiRNA target sequence
tatattcaaccacttgacaaggcagta

SEQ ID NO: 124917 - DNA, 27 bp, Artificial sequence
  SiRNA target sequence
atattcaaccacttgacaaggcagtaa

SEQ ID NO: 124918 - DNA, 27 bp, Artificial sequence
  SiRNA target sequence
tattcaaccacttgacaaggcagtaat

SEQ ID NO: 124919 - DNA, 27 bp, Artificial sequence
  SiRNA target sequence
attcaaccacttgacaaggcagtaatt

SEQ ID NO: 124920 - DNA, 27 bp, Artificial sequence
  SiRNA target sequence
ttcaaccacttgacaaggcagtaattg

SEQ ID NO: 124921 - DNA, 27 bp, Artificial sequence
  SiRNA target sequence
tcaaccacttgacaaggcagtaattga

SEQ ID NO: 124922 - DNA, 27 bp, Artificial sequence
  SiRNA target sequence
caaccacttgacaaggcagtaattgaa

SEQ ID NO: 124923 - DNA, 27 bp, Artificial sequence
  SiRNA target sequence
aaccacttgacaaggcagtaattgaaa

SEQ ID NO: 124924 - DNA, 27 bp, Artificial sequence
  SiRNA target sequence
accacttgacaaggcagtaattgaaaa

SEQ ID NO: 124925 - DNA, 27 bp, Artificial sequence
  SiRNA target sequence
ccacttgacaaggcagtaattgaaaaa

SEQ ID NO: 124926 - DNA, 27 bp, Artificial sequence
  SiRNA target sequence
cacttgacaaggcagtaattgaaaaaa

SEQ ID NO: 124927 - DNA, 27 bp, Artificial sequence
  SiRNA target sequence
acttgacaaggcagtaattgaaaaaaa

SEQ ID NO: 124928 - DNA, 27 bp, Artificial sequence
  SiRNA target sequence
cttgacaaggcagtaattgaaaaaaat

SEQ ID NO: 124929 - DNA, 27 bp, Artificial sequence
  SiRNA target sequence
ttgacaaggcagtaattgaaaaaaatg

SEQ ID NO: 124930 - DNA, 27 bp, Artificial sequence
  SiRNA target sequence
tgacaaggcagtaattgaaaaaaatgg

SEQ ID NO: 124931 - DNA, 27 bp, Artificial sequence
  SiRNA target sequence
gacaaggcagtaattgaaaaaaatggt

SEQ ID NO: 124932 - DNA, 27 bp, Artificial sequence
  SiRNA target sequence
acaaggcagtaattgaaaaaaatggtg

SEQ ID NO: 124933 - DNA, 27 bp, Artificial sequence
  SiRNA target sequence
caaggcagtaattgaaaaaaatggtgt

SEQ ID NO: 124934 - DNA, 27 bp, Artificial sequence
  SiRNA target sequence
aaggcagtaattgaaaaaaatggtgtt

SEQ ID NO: 124935 - DNA, 27 bp, Artificial sequence
  SiRNA target sequence
aggcagtaattgaaaaaaatggtgttg

SEQ ID NO: 124936 - DNA, 27 bp, Artificial sequence
  SiRNA target sequence
ggcagtaattgaaaaaaatggtgttga

SEQ ID NO: 124937 - DNA, 27 bp, Artificial sequence
  SiRNA target sequence
gcagtaattgaaaaaaatggtgttgac

SEQ ID NO: 124938 - DNA, 27 bp, Artificial sequence
  SiRNA target sequence
cagtaattgaaaaaaatggtgttgacg

SEQ ID NO: 124939 - DNA, 27 bp, Artificial sequence
  SiRNA target sequence
agtaattgaaaaaaatggtgttgacgt

SEQ ID NO: 124940 - DNA, 27 bp, Artificial sequence
  SiRNA target sequence
gtaattgaaaaaaatggtgttgacgtt

SEQ ID NO: 124941 - DNA, 27 bp, Artificial sequence
  SiRNA target sequence
taattgaaaaaaatggtgttgacgtta

SEQ ID NO: 124942 - DNA, 27 bp, Artificial sequence
  SiRNA target sequence
aattgaaaaaaatggtgttgacgttac

SEQ ID NO: 124943 - DNA, 27 bp, Artificial sequence
  SiRNA target sequence
attgaaaaaaatggtgttgacgttaca

SEQ ID NO: 124944 - DNA, 27 bp, Artificial sequence
  SiRNA target sequence
ttgaaaaaaatggtgttgacgttacag

SEQ ID NO: 124945 - DNA, 27 bp, Artificial sequence
  SiRNA target sequence
tgaaaaaaatggtgttgacgttacagt

SEQ ID NO: 124946 - DNA, 27 bp, Artificial sequence
  SiRNA target sequence
gaaaaaaatggtgttgacgttacagtt

SEQ ID NO: 124947 - DNA, 27 bp, Artificial sequence
  SiRNA target sequence
aaaaaaatggtgttgacgttacagttt

SEQ ID NO: 124948 - DNA, 27 bp, Artificial sequence
  SiRNA target sequence
aaaaaatggtgttgacgttacagtttt

SEQ ID NO: 124949 - DNA, 27 bp, Artificial sequence
  SiRNA target sequence
aaaaatggtgttgacgttacagtttta

SEQ ID NO: 124950 - DNA, 27 bp, Artificial sequence
  SiRNA target sequence
aaaatggtgttgacgttacagttttag

SEQ ID NO: 124951 - DNA, 27 bp, Artificial sequence
  SiRNA target sequence
aaatggtgttgacgttacagttttagg

SEQ ID NO: 124952 - DNA, 27 bp, Artificial sequence
  SiRNA target sequence
aatggtgttgacgttacagttttagga

SEQ ID NO: 124953 - DNA, 27 bp, Artificial sequence
  SiRNA target sequence
atggtgttgacgttacagttttaggaa

SEQ ID NO: 124954 - DNA, 27 bp, Artificial sequence
  SiRNA target sequence
tggtgttgacgttacagttttaggaat

SEQ ID NO: 124955 - DNA, 27 bp, Artificial sequence
  SiRNA target sequence
ggtgttgacgttacagttttaggaata

SEQ ID NO: 124956 - DNA, 27 bp, Artificial sequence
  SiRNA target sequence
gtgttgacgttacagttttaggaatat

SEQ ID NO: 124957 - DNA, 27 bp, Artificial sequence
  SiRNA target sequence
tgttgacgttacagttttaggaatatc

SEQ ID NO: 124958 - DNA, 27 bp, Artificial sequence
  SiRNA target sequence
gttgacgttacagttttaggaatatca

SEQ ID NO: 124959 - DNA, 27 bp, Artificial sequence
  SiRNA target sequence
ttgacgttacagttttaggaatatcaa

SEQ ID NO: 124960 - DNA, 27 bp, Artificial sequence
  SiRNA target sequence
tgacgttacagttttaggaatatcaat

SEQ ID NO: 124961 - DNA, 27 bp, Artificial sequence
  SiRNA target sequence
gacgttacagttttaggaatatcaata

SEQ ID NO: 124962 - DNA, 27 bp, Artificial sequence
  SiRNA target sequence
acgttacagttttaggaatatcaataa

SEQ ID NO: 124963 - DNA, 27 bp, Artificial sequence
  SiRNA target sequence
cgttacagttttaggaatatcaataag

SEQ ID NO: 124964 - DNA, 27 bp, Artificial sequence
  SiRNA target sequence
gttacagttttaggaatatcaataagt

SEQ ID NO: 124965 - DNA, 27 bp, Artificial sequence
  SiRNA target sequence
ttacagttttaggaatatcaataagtc

SEQ ID NO: 124966 - DNA, 27 bp, Artificial sequence
  SiRNA target sequence
tacagttttaggaatatcaataagtct

SEQ ID NO: 124967 - DNA, 27 bp, Artificial sequence
  SiRNA target sequence
acagttttaggaatatcaataagtctt

SEQ ID NO: 124968 - DNA, 27 bp, Artificial sequence
  SiRNA target sequence
cagttttaggaatatcaataagtctta

SEQ ID NO: 124969 - DNA, 27 bp, Artificial sequence
  SiRNA target sequence
agttttaggaatatcaataagtcttaa

SEQ ID NO: 124970 - DNA, 27 bp, Artificial sequence
  SiRNA target sequence
gttttaggaatatcaataagtcttaaa

SEQ ID NO: 124971 - DNA, 27 bp, Artificial sequence
  SiRNA target sequence
ttttaggaatatcaataagtcttaaag

SEQ ID NO: 124972 - DNA, 27 bp, Artificial sequence
  SiRNA target sequence
tttaggaatatcaataagtcttaaaga

SEQ ID NO: 124973 - DNA, 27 bp, Artificial sequence
  SiRNA target sequence
ttaggaatatcaataagtcttaaagaa

SEQ ID NO: 124974 - DNA, 27 bp, Artificial sequence
  SiRNA target sequence
taggaatatcaataagtcttaaagaaa

SEQ ID NO: 124975 - DNA, 27 bp, Artificial sequence
  SiRNA target sequence
aggaatatcaataagtcttaaagaaat

SEQ ID NO: 124976 - DNA, 27 bp, Artificial sequence
  SiRNA target sequence
ggaatatcaataagtcttaaagaaatt

SEQ ID NO: 124977 - DNA, 27 bp, Artificial sequence
  SiRNA target sequence
gaatatcaataagtcttaaagaaattt

SEQ ID NO: 124978 - DNA, 27 bp, Artificial sequence
  SiRNA target sequence
aatatcaataagtcttaaagaaatttt

SEQ ID NO: 124979 - DNA, 27 bp, Artificial sequence
  SiRNA target sequence
atatcaataagtcttaaagaaattttt

SEQ ID NO: 124980 - DNA, 27 bp, Artificial sequence
  SiRNA target sequence
tatcaataagtcttaaagaaattttta

SEQ ID NO: 124981 - DNA, 27 bp, Artificial sequence
  SiRNA target sequence
atcaataagtcttaaagaaatttttaa

SEQ ID NO: 124982 - DNA, 27 bp, Artificial sequence
  SiRNA target sequence
tcaataagtcttaaagaaatttttaaa

SEQ ID NO: 124983 - DNA, 27 bp, Artificial sequence
  SiRNA target sequence
caataagtcttaaagaaatttttaaag

SEQ ID NO: 124984 - DNA, 27 bp, Artificial sequence
  SiRNA target sequence
aataagtcttaaagaaatttttaaagc

SEQ ID NO: 124985 - DNA, 27 bp, Artificial sequence
  SiRNA target sequence
ataagtcttaaagaaatttttaaagca

SEQ ID NO: 124986 - DNA, 27 bp, Artificial sequence
  SiRNA target sequence
taagtcttaaagaaatttttaaagcag

SEQ ID NO: 124987 - DNA, 27 bp, Artificial sequence
  SiRNA target sequence
aagtcttaaagaaatttttaaagcaga

SEQ ID NO: 124988 - DNA, 27 bp, Artificial sequence
  SiRNA target sequence
agtcttaaagaaatttttaaagcagac

SEQ ID NO: 124989 - DNA, 27 bp, Artificial sequence
  SiRNA target sequence
gtcttaaagaaatttttaaagcagaca

SEQ ID NO: 124990 - DNA, 27 bp, Artificial sequence
  SiRNA target sequence
tcttaaagaaatttttaaagcagacag

SEQ ID NO: 124991 - DNA, 27 bp, Artificial sequence
  SiRNA target sequence
cttaaagaaatttttaaagcagacagt

SEQ ID NO: 124992 - DNA, 27 bp, Artificial sequence
  SiRNA target sequence
ttaaagaaatttttaaagcagacagtt

SEQ ID NO: 124993 - DNA, 27 bp, Artificial sequence
  SiRNA target sequence
taaagaaatttttaaagcagacagttt

SEQ ID NO: 124994 - DNA, 27 bp, Artificial sequence
  SiRNA target sequence
aaagaaatttttaaagcagacagtttg

SEQ ID NO: 124995 - DNA, 27 bp, Artificial sequence
  SiRNA target sequence
aagaaatttttaaagcagacagtttgt

SEQ ID NO: 124996 - DNA, 27 bp, Artificial sequence
  SiRNA target sequence
agaaatttttaaagcagacagtttgtt

SEQ ID NO: 124997 - DNA, 27 bp, Artificial sequence
  SiRNA target sequence
gaaatttttaaagcagacagtttgtta

SEQ ID NO: 124998 - DNA, 27 bp, Artificial sequence
  SiRNA target sequence
aaatttttaaagcagacagtttgttag

SEQ ID NO: 124999 - DNA, 27 bp, Artificial sequence
  SiRNA target sequence
aatttttaaagcagacagtttgttaga

SEQ ID NO: 125000 - DNA, 27 bp, Artificial sequence
  SiRNA target sequence
atttttaaagcagacagtttgttagag

SEQ ID NO: 125001 - DNA, 27 bp, Artificial sequence
  SiRNA target sequence
tttttaaagcagacagtttgttagaga

SEQ ID NO: 125002 - DNA, 27 bp, Artificial sequence
  SiRNA target sequence
ttttaaagcagacagtttgttagagaa

SEQ ID NO: 125003 - DNA, 27 bp, Artificial sequence
  SiRNA target sequence
tttaaagcagacagtttgttagagaaa

SEQ ID NO: 125004 - DNA, 27 bp, Artificial sequence
  SiRNA target sequence
ttaaagcagacagtttgttagagaaaa

SEQ ID NO: 125005 - DNA, 27 bp, Artificial sequence
  SiRNA target sequence
taaagcagacagtttgttagagaaaaa

SEQ ID NO: 125006 - DNA, 27 bp, Artificial sequence
  SiRNA target sequence
aaagcagacagtttgttagagaaaaaa

SEQ ID NO: 125007 - DNA, 27 bp, Artificial sequence
  SiRNA target sequence
aagcagacagtttgttagagaaaaaaa

SEQ ID NO: 125008 - DNA, 27 bp, Artificial sequence
  SiRNA target sequence
agcagacagtttgttagagaaaaaaaa

SEQ ID NO: 125009 - DNA, 27 bp, Artificial sequence
  SiRNA target sequence
gcagacagtttgttagagaaaaaaaat

SEQ ID NO: 125010 - DNA, 27 bp, Artificial sequence
  SiRNA target sequence
cagacagtttgttagagaaaaaaaata

SEQ ID NO: 125011 - DNA, 27 bp, Artificial sequence
  SiRNA target sequence
agacagtttgttagagaaaaaaaatat

SEQ ID NO: 125012 - DNA, 27 bp, Artificial sequence
  SiRNA target sequence
gacagtttgttagagaaaaaaaatatc

SEQ ID NO: 125013 - DNA, 27 bp, Artificial sequence
  SiRNA target sequence
acagtttgttagagaaaaaaaatatcg

SEQ ID NO: 125014 - DNA, 27 bp, Artificial sequence
  SiRNA target sequence
cagtttgttagagaaaaaaaatatcga

SEQ ID NO: 125015 - DNA, 27 bp, Artificial sequence
  SiRNA target sequence
agtttgttagagaaaaaaaatatcgac

SEQ ID NO: 125016 - DNA, 27 bp, Artificial sequence
  SiRNA target sequence
gtttgttagagaaaaaaaatatcgaca

SEQ ID NO: 125017 - DNA, 27 bp, Artificial sequence
  SiRNA target sequence
tttgttagagaaaaaaaatatcgacat

SEQ ID NO: 125018 - DNA, 27 bp, Artificial sequence
  SiRNA target sequence
ttgttagagaaaaaaaatatcgacatt

SEQ ID NO: 125019 - DNA, 27 bp, Artificial sequence
  SiRNA target sequence
tgttagagaaaaaaaatatcgacattg

SEQ ID NO: 125020 - DNA, 27 bp, Artificial sequence
  SiRNA target sequence
gttagagaaaaaaaatatcgacattga

SEQ ID NO: 125021 - DNA, 27 bp, Artificial sequence
  SiRNA target sequence
ttagagaaaaaaaatatcgacattgag

SEQ ID NO: 125022 - DNA, 27 bp, Artificial sequence
  SiRNA target sequence
tagagaaaaaaaatatcgacattgaga

SEQ ID NO: 125023 - DNA, 27 bp, Artificial sequence
  SiRNA target sequence
agagaaaaaaaatatcgacattgagat

SEQ ID NO: 125024 - DNA, 27 bp, Artificial sequence
  SiRNA target sequence
gagaaaaaaaatatcgacattgagata

SEQ ID NO: 125025 - DNA, 27 bp, Artificial sequence
  SiRNA target sequence
agaaaaaaaatatcgacattgagataa

SEQ ID NO: 125026 - DNA, 27 bp, Artificial sequence
  SiRNA target sequence
gaaaaaaaatatcgacattgagataat

SEQ ID NO: 125027 - DNA, 27 bp, Artificial sequence
  SiRNA target sequence
aaaaaaaatatcgacattgagataatt

SEQ ID NO: 125028 - DNA, 27 bp, Artificial sequence
  SiRNA target sequence
aaaaaaatatcgacattgagataatta

SEQ ID NO: 125029 - DNA, 27 bp, Artificial sequence
  SiRNA target sequence
aaaaaatatcgacattgagataattaa

SEQ ID NO: 125030 - DNA, 27 bp, Artificial sequence
  SiRNA target sequence
aaaaatatcgacattgagataattaat

SEQ ID NO: 125031 - DNA, 27 bp, Artificial sequence
  SiRNA target sequence
aaaatatcgacattgagataattaatc

SEQ ID NO: 125032 - DNA, 27 bp, Artificial sequence
  SiRNA target sequence
aaatatcgacattgagataattaatct

SEQ ID NO: 125033 - DNA, 27 bp, Artificial sequence
  SiRNA target sequence
aatatcgacattgagataattaatctt

SEQ ID NO: 125034 - DNA, 27 bp, Artificial sequence
  SiRNA target sequence
atatcgacattgagataattaatcttg

SEQ ID NO: 125035 - DNA, 27 bp, Artificial sequence
  SiRNA target sequence
tatcgacattgagataattaatcttgt

SEQ ID NO: 125036 - DNA, 27 bp, Artificial sequence
  SiRNA target sequence
atcgacattgagataattaatcttgtg

SEQ ID NO: 125037 - DNA, 27 bp, Artificial sequence
  SiRNA target sequence
tcgacattgagataattaatcttgtgt

SEQ ID NO: 125038 - DNA, 27 bp, Artificial sequence
  SiRNA target sequence
cgacattgagataattaatcttgtgtc

SEQ ID NO: 125039 - DNA, 27 bp, Artificial sequence
  SiRNA target sequence
gacattgagataattaatcttgtgtca

SEQ ID NO: 125040 - DNA, 27 bp, Artificial sequence
  SiRNA target sequence
acattgagataattaatcttgtgtcaa

SEQ ID NO: 125041 - DNA, 27 bp, Artificial sequence
  SiRNA target sequence
cattgagataattaatcttgtgtcaat

SEQ ID NO: 125042 - DNA, 27 bp, Artificial sequence
  SiRNA target sequence
attgagataattaatcttgtgtcaata

SEQ ID NO: 125043 - DNA, 27 bp, Artificial sequence
  SiRNA target sequence
ttgagataattaatcttgtgtcaataa

SEQ ID NO: 125044 - DNA, 27 bp, Artificial sequence
  SiRNA target sequence
tgagataattaatcttgtgtcaataaa

SEQ ID NO: 125045 - DNA, 27 bp, Artificial sequence
  SiRNA target sequence
gagataattaatcttgtgtcaataaaa

SEQ ID NO: 125046 - DNA, 27 bp, Artificial sequence
  SiRNA target sequence
agataattaatcttgtgtcaataaaac

SEQ ID NO: 125047 - DNA, 27 bp, Artificial sequence
  SiRNA target sequence
gataattaatcttgtgtcaataaaacc

SEQ ID NO: 125048 - DNA, 27 bp, Artificial sequence
  SiRNA target sequence
ataattaatcttgtgtcaataaaacca

SEQ ID NO: 125049 - DNA, 27 bp, Artificial sequence
  SiRNA target sequence
taattaatcttgtgtcaataaaaccaa

SEQ ID NO: 125050 - DNA, 27 bp, Artificial sequence
  SiRNA target sequence
aattaatcttgtgtcaataaaaccaat

SEQ ID NO: 125051 - DNA, 27 bp, Artificial sequence
  SiRNA target sequence
attaatcttgtgtcaataaaaccaatt

SEQ ID NO: 125052 - DNA, 27 bp, Artificial sequence
  SiRNA target sequence
ttaatcttgtgtcaataaaaccaattg

SEQ ID NO: 125053 - DNA, 27 bp, Artificial sequence
  SiRNA target sequence
taatcttgtgtcaataaaaccaattga

SEQ ID NO: 125054 - DNA, 27 bp, Artificial sequence
  SiRNA target sequence
aatcttgtgtcaataaaaccaattgat

SEQ ID NO: 125055 - DNA, 27 bp, Artificial sequence
  SiRNA target sequence
atcttgtgtcaataaaaccaattgatt

SEQ ID NO: 125056 - DNA, 27 bp, Artificial sequence
  SiRNA target sequence
tcttgtgtcaataaaaccaattgatta

SEQ ID NO: 125057 - DNA, 27 bp, Artificial sequence
  SiRNA target sequence
cttgtgtcaataaaaccaattgattat

SEQ ID NO: 125058 - DNA, 27 bp, Artificial sequence
  SiRNA target sequence
ttgtgtcaataaaaccaattgattatg

SEQ ID NO: 125059 - DNA, 27 bp, Artificial sequence
  SiRNA target sequence
tgtgtcaataaaaccaattgattatgt

SEQ ID NO: 125060 - DNA, 27 bp, Artificial sequence
  SiRNA target sequence
gtgtcaataaaaccaattgattatgtt

SEQ ID NO: 125061 - DNA, 27 bp, Artificial sequence
  SiRNA target sequence
tgtcaataaaaccaattgattatgtta

SEQ ID NO: 125062 - DNA, 27 bp, Artificial sequence
  SiRNA target sequence
gtcaataaaaccaattgattatgttac

SEQ ID NO: 125063 - DNA, 27 bp, Artificial sequence
  SiRNA target sequence
tcaataaaaccaattgattatgttact

SEQ ID NO: 125064 - DNA, 27 bp, Artificial sequence
  SiRNA target sequence
caataaaaccaattgattatgttacta

SEQ ID NO: 125065 - DNA, 27 bp, Artificial sequence
  SiRNA target sequence
aataaaaccaattgattatgttactat

SEQ ID NO: 125066 - DNA, 27 bp, Artificial sequence
  SiRNA target sequence
ataaaaccaattgattatgttactatt

SEQ ID NO: 125067 - DNA, 27 bp, Artificial sequence
  SiRNA target sequence
taaaaccaattgattatgttactattg

SEQ ID NO: 125068 - DNA, 27 bp, Artificial sequence
  SiRNA target sequence
aaaaccaattgattatgttactattga

SEQ ID NO: 125069 - DNA, 27 bp, Artificial sequence
  SiRNA target sequence
aaaccaattgattatgttactattgaa

SEQ ID NO: 125070 - DNA, 27 bp, Artificial sequence
  SiRNA target sequence
aaccaattgattatgttactattgaaa

SEQ ID NO: 125071 - DNA, 27 bp, Artificial sequence
  SiRNA target sequence
accaattgattatgttactattgaaat

SEQ ID NO: 125072 - DNA, 27 bp, Artificial sequence
  SiRNA target sequence
ccaattgattatgttactattgaaata

SEQ ID NO: 125073 - DNA, 27 bp, Artificial sequence
  SiRNA target sequence
caattgattatgttactattgaaatat

SEQ ID NO: 125074 - DNA, 27 bp, Artificial sequence
  SiRNA target sequence
aattgattatgttactattgaaatatc

SEQ ID NO: 125075 - DNA, 27 bp, Artificial sequence
  SiRNA target sequence
attgattatgttactattgaaatatca

SEQ ID NO: 125076 - DNA, 27 bp, Artificial sequence
  SiRNA target sequence
ttgattatgttactattgaaatatcag

SEQ ID NO: 125077 - DNA, 27 bp, Artificial sequence
  SiRNA target sequence
tgattatgttactattgaaatatcagt

SEQ ID NO: 125078 - DNA, 27 bp, Artificial sequence
  SiRNA target sequence
gattatgttactattgaaatatcagtc

SEQ ID NO: 125079 - DNA, 27 bp, Artificial sequence
  SiRNA target sequence
attatgttactattgaaatatcagtca

SEQ ID NO: 125080 - DNA, 27 bp, Artificial sequence
  SiRNA target sequence
ttatgttactattgaaatatcagtcaa

SEQ ID NO: 125081 - DNA, 27 bp, Artificial sequence
  SiRNA target sequence
tatgttactattgaaatatcagtcaaa

SEQ ID NO: 125082 - DNA, 27 bp, Artificial sequence
  SiRNA target sequence
atgttactattgaaatatcagtcaaaa

SEQ ID NO: 125083 - DNA, 27 bp, Artificial sequence
  SiRNA target sequence
tgttactattgaaatatcagtcaaaaa

SEQ ID NO: 125084 - DNA, 27 bp, Artificial sequence
  SiRNA target sequence
gttactattgaaatatcagtcaaaaaa

SEQ ID NO: 125085 - DNA, 27 bp, Artificial sequence
  SiRNA target sequence
ttactattgaaatatcagtcaaaaaaa

SEQ ID NO: 125086 - DNA, 27 bp, Artificial sequence
  SiRNA target sequence
tactattgaaatatcagtcaaaaaaac

SEQ ID NO: 125087 - DNA, 27 bp, Artificial sequence
  SiRNA target sequence
actattgaaatatcagtcaaaaaaaca

SEQ ID NO: 125088 - DNA, 27 bp, Artificial sequence
  SiRNA target sequence
ctattgaaatatcagtcaaaaaaacac

SEQ ID NO: 125089 - DNA, 27 bp, Artificial sequence
  SiRNA target sequence
tattgaaatatcagtcaaaaaaacaca

SEQ ID NO: 125090 - DNA, 27 bp, Artificial sequence
  SiRNA target sequence
attgaaatatcagtcaaaaaaacacaa

SEQ ID NO: 125091 - DNA, 27 bp, Artificial sequence
  SiRNA target sequence
ttgaaatatcagtcaaaaaaacacaaa

SEQ ID NO: 125092 - DNA, 27 bp, Artificial sequence
  SiRNA target sequence
tgaaatatcagtcaaaaaaacacaaaa

SEQ ID NO: 125093 - DNA, 27 bp, Artificial sequence
  SiRNA target sequence
gaaatatcagtcaaaaaaacacaaaag

SEQ ID NO: 125094 - DNA, 27 bp, Artificial sequence
  SiRNA target sequence
aaatatcagtcaaaaaaacacaaaagt

SEQ ID NO: 125095 - DNA, 27 bp, Artificial sequence
  SiRNA target sequence
aatatcagtcaaaaaaacacaaaagtt

SEQ ID NO: 125096 - DNA, 27 bp, Artificial sequence
  SiRNA target sequence
atatcagtcaaaaaaacacaaaagtta

SEQ ID NO: 125097 - DNA, 27 bp, Artificial sequence
  SiRNA target sequence
tatcagtcaaaaaaacacaaaagttag

SEQ ID NO: 125098 - DNA, 27 bp, Artificial sequence
  SiRNA target sequence
atcagtcaaaaaaacacaaaagttagt

SEQ ID NO: 125099 - DNA, 27 bp, Artificial sequence
  SiRNA target sequence
tcagtcaaaaaaacacaaaagttagtg

SEQ ID NO: 125100 - DNA, 27 bp, Artificial sequence
  SiRNA target sequence
cagtcaaaaaaacacaaaagttagtga

SEQ ID NO: 125101 - DNA, 27 bp, Artificial sequence
  SiRNA target sequence
agtcaaaaaaacacaaaagttagtgat

SEQ ID NO: 125102 - DNA, 27 bp, Artificial sequence
  SiRNA target sequence
gtcaaaaaaacacaaaagttagtgata

SEQ ID NO: 125103 - DNA, 27 bp, Artificial sequence
  SiRNA target sequence
tcaaaaaaacacaaaagttagtgatag

SEQ ID NO: 125104 - DNA, 27 bp, Artificial sequence
  SiRNA target sequence
caaaaaaacacaaaagttagtgatagt

SEQ ID NO: 125105 - DNA, 27 bp, Artificial sequence
  SiRNA target sequence
aaaaaaacacaaaagttagtgatagtt

SEQ ID NO: 125106 - DNA, 27 bp, Artificial sequence
  SiRNA target sequence
aaaaaacacaaaagttagtgatagttg

SEQ ID NO: 125107 - DNA, 27 bp, Artificial sequence
  SiRNA target sequence
aaaaacacaaaagttagtgatagttga

SEQ ID NO: 125108 - DNA, 27 bp, Artificial sequence
  SiRNA target sequence
aaaacacaaaagttagtgatagttgat

SEQ ID NO: 125109 - DNA, 27 bp, Artificial sequence
  SiRNA target sequence
aaacacaaaagttagtgatagttgatt

SEQ ID NO: 125110 - DNA, 27 bp, Artificial sequence
  SiRNA target sequence
aacacaaaagttagtgatagttgattt

SEQ ID NO: 125111 - DNA, 27 bp, Artificial sequence
  SiRNA target sequence
acacaaaagttagtgatagttgatttt

SEQ ID NO: 125112 - DNA, 27 bp, Artificial sequence
  SiRNA target sequence
cacaaaagttagtgatagttgattttg

SEQ ID NO: 125113 - DNA, 27 bp, Artificial sequence
  SiRNA target sequence
acaaaagttagtgatagttgattttgc

SEQ ID NO: 125114 - DNA, 27 bp, Artificial sequence
  SiRNA target sequence
caaaagttagtgatagttgattttgca

SEQ ID NO: 125115 - DNA, 27 bp, Artificial sequence
  SiRNA target sequence
aaaagttagtgatagttgattttgcat

SEQ ID NO: 125116 - DNA, 27 bp, Artificial sequence
  SiRNA target sequence
aaagttagtgatagttgattttgcata

SEQ ID NO: 125117 - DNA, 27 bp, Artificial sequence
  SiRNA target sequence
aagttagtgatagttgattttgcatat

SEQ ID NO: 125118 - DNA, 27 bp, Artificial sequence
  SiRNA target sequence
agttagtgatagttgattttgcatatc

SEQ ID NO: 125119 - DNA, 27 bp, Artificial sequence
  SiRNA target sequence
gttagtgatagttgattttgcatatcc

SEQ ID NO: 125120 - DNA, 27 bp, Artificial sequence
  SiRNA target sequence
ttagtgatagttgattttgcatatcct

SEQ ID NO: 125121 - DNA, 27 bp, Artificial sequence
  SiRNA target sequence
tagtgatagttgattttgcatatccta

SEQ ID NO: 125122 - DNA, 27 bp, Artificial sequence
  SiRNA target sequence
agtgatagttgattttgcatatcctac

SEQ ID NO: 125123 - DNA, 27 bp, Artificial sequence
  SiRNA target sequence
gtgatagttgattttgcatatcctact

SEQ ID NO: 125124 - DNA, 27 bp, Artificial sequence
  SiRNA target sequence
tgatagttgattttgcatatcctactt

SEQ ID NO: 125125 - DNA, 27 bp, Artificial sequence
  SiRNA target sequence
gatagttgattttgcatatcctacttt

SEQ ID NO: 125126 - DNA, 27 bp, Artificial sequence
  SiRNA target sequence
atagttgattttgcatatcctactttc

SEQ ID NO: 125127 - DNA, 27 bp, Artificial sequence
  SiRNA target sequence
tagttgattttgcatatcctactttca

SEQ ID NO: 125128 - DNA, 27 bp, Artificial sequence
  SiRNA target sequence
agttgattttgcatatcctactttcaa

SEQ ID NO: 125129 - DNA, 27 bp, Artificial sequence
  SiRNA target sequence
gttgattttgcatatcctactttcaat

SEQ ID NO: 125130 - DNA, 27 bp, Artificial sequence
  SiRNA target sequence
ttgattttgcatatcctactttcaata

SEQ ID NO: 125131 - DNA, 27 bp, Artificial sequence
  SiRNA target sequence
tgattttgcatatcctactttcaatat

SEQ ID NO: 125132 - DNA, 27 bp, Artificial sequence
  SiRNA target sequence
gattttgcatatcctactttcaatatt

SEQ ID NO: 125133 - DNA, 27 bp, Artificial sequence
  SiRNA target sequence
attttgcatatcctactttcaatattg

SEQ ID NO: 125134 - DNA, 27 bp, Artificial sequence
  SiRNA target sequence
ttttgcatatcctactttcaatattgc

SEQ ID NO: 125135 - DNA, 27 bp, Artificial sequence
  SiRNA target sequence
tttgcatatcctactttcaatattgcg

SEQ ID NO: 125136 - DNA, 27 bp, Artificial sequence
  SiRNA target sequence
ttgcatatcctactttcaatattgcga

SEQ ID NO: 125137 - DNA, 27 bp, Artificial sequence
  SiRNA target sequence
tgcatatcctactttcaatattgcgag

SEQ ID NO: 125138 - DNA, 27 bp, Artificial sequence
  SiRNA target sequence
gcatatcctactttcaatattgcgagt

SEQ ID NO: 125139 - DNA, 27 bp, Artificial sequence
  SiRNA target sequence
catatcctactttcaatattgcgagtg

SEQ ID NO: 125140 - DNA, 27 bp, Artificial sequence
  SiRNA target sequence
atatcctactttcaatattgcgagtga

SEQ ID NO: 125141 - DNA, 27 bp, Artificial sequence
  SiRNA target sequence
tatcctactttcaatattgcgagtgaa

SEQ ID NO: 125142 - DNA, 27 bp, Artificial sequence
  SiRNA target sequence
atcctactttcaatattgcgagtgaaa

SEQ ID NO: 125143 - DNA, 27 bp, Artificial sequence
  SiRNA target sequence
tcctactttcaatattgcgagtgaaat

SEQ ID NO: 125144 - DNA, 27 bp, Artificial sequence
  SiRNA target sequence
cctactttcaatattgcgagtgaaata

SEQ ID NO: 125145 - DNA, 27 bp, Artificial sequence
  SiRNA target sequence
ctactttcaatattgcgagtgaaatag

SEQ ID NO: 125146 - DNA, 27 bp, Artificial sequence
  SiRNA target sequence
tactttcaatattgcgagtgaaatagc

SEQ ID NO: 125147 - DNA, 27 bp, Artificial sequence
  SiRNA target sequence
actttcaatattgcgagtgaaatagct

SEQ ID NO: 125148 - DNA, 27 bp, Artificial sequence
  SiRNA target sequence
ctttcaatattgcgagtgaaatagctg

SEQ ID NO: 125149 - DNA, 27 bp, Artificial sequence
  SiRNA target sequence
tttcaatattgcgagtgaaatagctgc

SEQ ID NO: 125150 - DNA, 27 bp, Artificial sequence
  SiRNA target sequence
ttcaatattgcgagtgaaatagctgcg

SEQ ID NO: 125151 - DNA, 27 bp, Artificial sequence
  SiRNA target sequence
tcaatattgcgagtgaaatagctgcgc

SEQ ID NO: 125152 - DNA, 27 bp, Artificial sequence
  SiRNA target sequence
caatattgcgagtgaaatagctgcgca

SEQ ID NO: 125153 - DNA, 27 bp, Artificial sequence
  SiRNA target sequence
aatattgcgagtgaaatagctgcgcac

SEQ ID NO: 125154 - DNA, 27 bp, Artificial sequence
  SiRNA target sequence
atattgcgagtgaaatagctgcgcact

SEQ ID NO: 125155 - DNA, 27 bp, Artificial sequence
  SiRNA target sequence
tattgcgagtgaaatagctgcgcactt

SEQ ID NO: 125156 - DNA, 27 bp, Artificial sequence
  SiRNA target sequence
attgcgagtgaaatagctgcgcacttt

SEQ ID NO: 125157 - DNA, 27 bp, Artificial sequence
  SiRNA target sequence
ttgcgagtgaaatagctgcgcactttt

SEQ ID NO: 125158 - DNA, 27 bp, Artificial sequence
  SiRNA target sequence
tgcgagtgaaatagctgcgcactttta

SEQ ID NO: 125159 - DNA, 27 bp, Artificial sequence
  SiRNA target sequence
gcgagtgaaatagctgcgcacttttac

SEQ ID NO: 125160 - DNA, 27 bp, Artificial sequence
  SiRNA target sequence
cgagtgaaatagctgcgcacttttacg

SEQ ID NO: 125161 - DNA, 27 bp, Artificial sequence
  SiRNA target sequence
gagtgaaatagctgcgcacttttacga

SEQ ID NO: 125162 - DNA, 27 bp, Artificial sequence
  SiRNA target sequence
agtgaaatagctgcgcacttttacgaa

SEQ ID NO: 125163 - DNA, 27 bp, Artificial sequence
  SiRNA target sequence
gtgaaatagctgcgcacttttacgaaa

SEQ ID NO: 125164 - DNA, 27 bp, Artificial sequence
  SiRNA target sequence
tgaaatagctgcgcacttttacgaaaa

SEQ ID NO: 125165 - DNA, 27 bp, Artificial sequence
  SiRNA target sequence
gaaatagctgcgcacttttacgaaaaa

SEQ ID NO: 125166 - DNA, 27 bp, Artificial sequence
  SiRNA target sequence
aaatagctgcgcacttttacgaaaaat

SEQ ID NO: 125167 - DNA, 27 bp, Artificial sequence
  SiRNA target sequence
aatagctgcgcacttttacgaaaaatt

SEQ ID NO: 125168 - DNA, 27 bp, Artificial sequence
  SiRNA target sequence
atagctgcgcacttttacgaaaaattt

SEQ ID NO: 125169 - DNA, 27 bp, Artificial sequence
  SiRNA target sequence
tagctgcgcacttttacgaaaaattta

SEQ ID NO: 125170 - DNA, 27 bp, Artificial sequence
  SiRNA target sequence
agctgcgcacttttacgaaaaatttaa

SEQ ID NO: 125171 - DNA, 27 bp, Artificial sequence
  SiRNA target sequence
gctgcgcacttttacgaaaaatttaaa

SEQ ID NO: 125172 - DNA, 27 bp, Artificial sequence
  SiRNA target sequence
ctgcgcacttttacgaaaaatttaaag

SEQ ID NO: 125173 - DNA, 27 bp, Artificial sequence
  SiRNA target sequence
tgcgcacttttacgaaaaatttaaaga

SEQ ID NO: 125174 - DNA, 27 bp, Artificial sequence
  SiRNA target sequence
gcgcacttttacgaaaaatttaaagat

SEQ ID NO: 125175 - DNA, 27 bp, Artificial sequence
  SiRNA target sequence
cgcacttttacgaaaaatttaaagata

SEQ ID NO: 125176 - DNA, 27 bp, Artificial sequence
  SiRNA target sequence
gcacttttacgaaaaatttaaagatat

SEQ ID NO: 125177 - DNA, 27 bp, Artificial sequence
  SiRNA target sequence
cacttttacgaaaaatttaaagatata

SEQ ID NO: 125178 - DNA, 27 bp, Artificial sequence
  SiRNA target sequence
acttttacgaaaaatttaaagatataa

SEQ ID NO: 125179 - DNA, 27 bp, Artificial sequence
  SiRNA target sequence
cttttacgaaaaatttaaagatataaa

SEQ ID NO: 125180 - DNA, 27 bp, Artificial sequence
  SiRNA target sequence
ttttacgaaaaatttaaagatataaaa

SEQ ID NO: 125181 - DNA, 27 bp, Artificial sequence
  SiRNA target sequence
tttacgaaaaatttaaagatataaaaa

SEQ ID NO: 125182 - DNA, 27 bp, Artificial sequence
  SiRNA target sequence
ttacgaaaaatttaaagatataaaaat

SEQ ID NO: 125183 - DNA, 27 bp, Artificial sequence
  SiRNA target sequence
tacgaaaaatttaaagatataaaaatt

SEQ ID NO: 125184 - DNA, 27 bp, Artificial sequence
  SiRNA target sequence
acgaaaaatttaaagatataaaaatta

SEQ ID NO: 125185 - DNA, 27 bp, Artificial sequence
  SiRNA target sequence
cgaaaaatttaaagatataaaaattat

SEQ ID NO: 125186 - DNA, 27 bp, Artificial sequence
  SiRNA target sequence
gaaaaatttaaagatataaaaattatg

SEQ ID NO: 125187 - DNA, 27 bp, Artificial sequence
  SiRNA target sequence
aaaaatttaaagatataaaaattatgc

SEQ ID NO: 125188 - DNA, 27 bp, Artificial sequence
  SiRNA target sequence
aaaatttaaagatataaaaattatgcg

SEQ ID NO: 125189 - DNA, 27 bp, Artificial sequence
  SiRNA target sequence
aaatttaaagatataaaaattatgcgt

SEQ ID NO: 125190 - DNA, 27 bp, Artificial sequence
  SiRNA target sequence
aatttaaagatataaaaattatgcgtg

SEQ ID NO: 125191 - DNA, 27 bp, Artificial sequence
  SiRNA target sequence
atttaaagatataaaaattatgcgtgt

SEQ ID NO: 125192 - DNA, 27 bp, Artificial sequence
  SiRNA target sequence
tttaaagatataaaaattatgcgtgtt

SEQ ID NO: 125193 - DNA, 27 bp, Artificial sequence
  SiRNA target sequence
ttaaagatataaaaattatgcgtgttc

SEQ ID NO: 125194 - DNA, 27 bp, Artificial sequence
  SiRNA target sequence
taaagatataaaaattatgcgtgttct

SEQ ID NO: 125195 - DNA, 27 bp, Artificial sequence
  SiRNA target sequence
aaagatataaaaattatgcgtgttctt

SEQ ID NO: 125196 - DNA, 27 bp, Artificial sequence
  SiRNA target sequence
aagatataaaaattatgcgtgttcttg

SEQ ID NO: 125197 - DNA, 27 bp, Artificial sequence
  SiRNA target sequence
agatataaaaattatgcgtgttcttgc

SEQ ID NO: 125198 - DNA, 27 bp, Artificial sequence
  SiRNA target sequence
gatataaaaattatgcgtgttcttgcg

SEQ ID NO: 125199 - DNA, 27 bp, Artificial sequence
  SiRNA target sequence
atataaaaattatgcgtgttcttgcgc

SEQ ID NO: 125200 - DNA, 27 bp, Artificial sequence
  SiRNA target sequence
tataaaaattatgcgtgttcttgcgca

SEQ ID NO: 125201 - DNA, 27 bp, Artificial sequence
  SiRNA target sequence
ataaaaattatgcgtgttcttgcgcaa

SEQ ID NO: 125202 - DNA, 27 bp, Artificial sequence
  SiRNA target sequence
taaaaattatgcgtgttcttgcgcaag

SEQ ID NO: 125203 - DNA, 27 bp, Artificial sequence
  SiRNA target sequence
aaaaattatgcgtgttcttgcgcaaga

SEQ ID NO: 125204 - DNA, 27 bp, Artificial sequence
  SiRNA target sequence
aaaattatgcgtgttcttgcgcaagat

SEQ ID NO: 125205 - DNA, 27 bp, Artificial sequence
  SiRNA target sequence
aaattatgcgtgttcttgcgcaagata

SEQ ID NO: 125206 - DNA, 27 bp, Artificial sequence
  SiRNA target sequence
aattatgcgtgttcttgcgcaagatat

SEQ ID NO: 125207 - DNA, 27 bp, Artificial sequence
  SiRNA target sequence
attatgcgtgttcttgcgcaagatatt

SEQ ID NO: 125208 - DNA, 27 bp, Artificial sequence
  SiRNA target sequence
ttatgcgtgttcttgcgcaagatattc

SEQ ID NO: 125209 - DNA, 27 bp, Artificial sequence
  SiRNA target sequence
tatgcgtgttcttgcgcaagatattcc

SEQ ID NO: 125210 - DNA, 27 bp, Artificial sequence
  SiRNA target sequence
atgcgtgttcttgcgcaagatattcct

SEQ ID NO: 125211 - DNA, 27 bp, Artificial sequence
  SiRNA target sequence
tgcgtgttcttgcgcaagatattccta

SEQ ID NO: 125212 - DNA, 27 bp, Artificial sequence
  SiRNA target sequence
gcgtgttcttgcgcaagatattcctac

SEQ ID NO: 125213 - DNA, 27 bp, Artificial sequence
  SiRNA target sequence
cgtgttcttgcgcaagatattcctaca

SEQ ID NO: 125214 - DNA, 27 bp, Artificial sequence
  SiRNA target sequence
gtgttcttgcgcaagatattcctacac

SEQ ID NO: 125215 - DNA, 27 bp, Artificial sequence
  SiRNA target sequence
tgttcttgcgcaagatattcctacacc

SEQ ID NO: 125216 - DNA, 27 bp, Artificial sequence
  SiRNA target sequence
gttcttgcgcaagatattcctacaccg

SEQ ID NO: 125217 - DNA, 27 bp, Artificial sequence
  SiRNA target sequence
ttcttgcgcaagatattcctacaccgt

SEQ ID NO: 125218 - DNA, 27 bp, Artificial sequence
  SiRNA target sequence
tcttgcgcaagatattcctacaccgta

SEQ ID NO: 125219 - DNA, 27 bp, Artificial sequence
  SiRNA target sequence
cttgcgcaagatattcctacaccgtat

SEQ ID NO: 125220 - DNA, 27 bp, Artificial sequence
  SiRNA target sequence
ttgcgcaagatattcctacaccgtatg

SEQ ID NO: 125221 - DNA, 27 bp, Artificial sequence
  SiRNA target sequence
tgcgcaagatattcctacaccgtatgc

SEQ ID NO: 125222 - DNA, 27 bp, Artificial sequence
  SiRNA target sequence
gcgcaagatattcctacaccgtatgca

SEQ ID NO: 125223 - DNA, 27 bp, Artificial sequence
  SiRNA target sequence
cgcaagatattcctacaccgtatgcac

SEQ ID NO: 125224 - DNA, 27 bp, Artificial sequence
  SiRNA target sequence
gcaagatattcctacaccgtatgcact

SEQ ID NO: 125225 - DNA, 27 bp, Artificial sequence
  SiRNA target sequence
caagatattcctacaccgtatgcactt

SEQ ID NO: 125226 - DNA, 27 bp, Artificial sequence
  SiRNA target sequence
aagatattcctacaccgtatgcactta

SEQ ID NO: 125227 - DNA, 27 bp, Artificial sequence
  SiRNA target sequence
agatattcctacaccgtatgcacttaa

SEQ ID NO: 125228 - DNA, 27 bp, Artificial sequence
  SiRNA target sequence
gatattcctacaccgtatgcacttaat

SEQ ID NO: 125229 - DNA, 27 bp, Artificial sequence
  SiRNA target sequence
atattcctacaccgtatgcacttaatc

SEQ ID NO: 125230 - DNA, 27 bp, Artificial sequence
  SiRNA target sequence
tattcctacaccgtatgcacttaatct

SEQ ID NO: 125231 - DNA, 27 bp, Artificial sequence
  SiRNA target sequence
attcctacaccgtatgcacttaatctt

SEQ ID NO: 125232 - DNA, 27 bp, Artificial sequence
  SiRNA target sequence
ttcctacaccgtatgcacttaatcttg

SEQ ID NO: 125233 - DNA, 27 bp, Artificial sequence
  SiRNA target sequence
tcctacaccgtatgcacttaatcttga

SEQ ID NO: 125234 - DNA, 27 bp, Artificial sequence
  SiRNA target sequence
cctacaccgtatgcacttaatcttgaa

SEQ ID NO: 125235 - DNA, 27 bp, Artificial sequence
  SiRNA target sequence
ctacaccgtatgcacttaatcttgaaa

SEQ ID NO: 125236 - DNA, 27 bp, Artificial sequence
  SiRNA target sequence
tacaccgtatgcacttaatcttgaaaa

SEQ ID NO: 125237 - DNA, 27 bp, Artificial sequence
  SiRNA target sequence
acaccgtatgcacttaatcttgaaaaa

SEQ ID NO: 125238 - DNA, 27 bp, Artificial sequence
  SiRNA target sequence
caccgtatgcacttaatcttgaaaaaa

SEQ ID NO: 125239 - DNA, 27 bp, Artificial sequence
  SiRNA target sequence
accgtatgcacttaatcttgaaaaaat

SEQ ID NO: 125240 - DNA, 27 bp, Artificial sequence
  SiRNA target sequence
ccgtatgcacttaatcttgaaaaaatg

SEQ ID NO: 125241 - DNA, 27 bp, Artificial sequence
  SiRNA target sequence
cgtatgcacttaatcttgaaaaaatgt

SEQ ID NO: 125242 - DNA, 27 bp, Artificial sequence
  SiRNA target sequence
gtatgcacttaatcttgaaaaaatgtc

SEQ ID NO: 125243 - DNA, 27 bp, Artificial sequence
  SiRNA target sequence
tatgcacttaatcttgaaaaaatgtct

SEQ ID NO: 125244 - DNA, 27 bp, Artificial sequence
  SiRNA target sequence
atgcacttaatcttgaaaaaatgtctt

SEQ ID NO: 125245 - DNA, 27 bp, Artificial sequence
  SiRNA target sequence
tgcacttaatcttgaaaaaatgtctta

SEQ ID NO: 125246 - DNA, 27 bp, Artificial sequence
  SiRNA target sequence
gcacttaatcttgaaaaaatgtcttat

SEQ ID NO: 125247 - DNA, 27 bp, Artificial sequence
  SiRNA target sequence
cacttaatcttgaaaaaatgtcttatc

SEQ ID NO: 125248 - DNA, 27 bp, Artificial sequence
  SiRNA target sequence
acttaatcttgaaaaaatgtcttatcc

SEQ ID NO: 125249 - DNA, 27 bp, Artificial sequence
  SiRNA target sequence
cttaatcttgaaaaaatgtcttatccg

SEQ ID NO: 125250 - DNA, 27 bp, Artificial sequence
  SiRNA target sequence
ttaatcttgaaaaaatgtcttatccga

SEQ ID NO: 125251 - DNA, 27 bp, Artificial sequence
  SiRNA target sequence
taatcttgaaaaaatgtcttatccgac

SEQ ID NO: 125252 - DNA, 27 bp, Artificial sequence
  SiRNA target sequence
aatcttgaaaaaatgtcttatccgaca

SEQ ID NO: 125253 - DNA, 27 bp, Artificial sequence
  SiRNA target sequence
atcttgaaaaaatgtcttatccgacat

SEQ ID NO: 125254 - DNA, 27 bp, Artificial sequence
  SiRNA target sequence
tcttgaaaaaatgtcttatccgacatg

SEQ ID NO: 125255 - DNA, 27 bp, Artificial sequence
  SiRNA target sequence
cttgaaaaaatgtcttatccgacatgc

SEQ ID NO: 125256 - DNA, 27 bp, Artificial sequence
  SiRNA target sequence
ttgaaaaaatgtcttatccgacatgca

SEQ ID NO: 125257 - DNA, 27 bp, Artificial sequence
  SiRNA target sequence
tgaaaaaatgtcttatccgacatgcaa

SEQ ID NO: 125258 - DNA, 27 bp, Artificial sequence
  SiRNA target sequence
gaaaaaatgtcttatccgacatgcaat

SEQ ID NO: 125259 - DNA, 27 bp, Artificial sequence
  SiRNA target sequence
aaaaaatgtcttatccgacatgcaatg

SEQ ID NO: 125260 - DNA, 27 bp, Artificial sequence
  SiRNA target sequence
aaaaatgtcttatccgacatgcaatga

SEQ ID NO: 125261 - DNA, 27 bp, Artificial sequence
  SiRNA target sequence
aaaatgtcttatccgacatgcaatgat

SEQ ID NO: 125262 - DNA, 27 bp, Artificial sequence
  SiRNA target sequence
aaatgtcttatccgacatgcaatgata

SEQ ID NO: 125263 - DNA, 27 bp, Artificial sequence
  SiRNA target sequence
aatgtcttatccgacatgcaatgatat

SEQ ID NO: 125264 - DNA, 27 bp, Artificial sequence
  SiRNA target sequence
atgtcttatccgacatgcaatgatatt

SEQ ID NO: 125265 - DNA, 27 bp, Artificial sequence
  SiRNA target sequence
tgtcttatccgacatgcaatgatattg

SEQ ID NO: 125266 - DNA, 27 bp, Artificial sequence
  SiRNA target sequence
gtcttatccgacatgcaatgatattgt

SEQ ID NO: 125267 - DNA, 27 bp, Artificial sequence
  SiRNA target sequence
tcttatccgacatgcaatgatattgta

SEQ ID NO: 125268 - DNA, 27 bp, Artificial sequence
  SiRNA target sequence
cttatccgacatgcaatgatattgtaa

SEQ ID NO: 125269 - DNA, 27 bp, Artificial sequence
  SiRNA target sequence
ttatccgacatgcaatgatattgtaaa

SEQ ID NO: 125270 - DNA, 27 bp, Artificial sequence
  SiRNA target sequence
tatccgacatgcaatgatattgtaaat

SEQ ID NO: 125271 - DNA, 27 bp, Artificial sequence
  SiRNA target sequence
atccgacatgcaatgatattgtaaatg

SEQ ID NO: 125272 - DNA, 27 bp, Artificial sequence
  SiRNA target sequence
tccgacatgcaatgatattgtaaatgc

SEQ ID NO: 125273 - DNA, 27 bp, Artificial sequence
  SiRNA target sequence
ccgacatgcaatgatattgtaaatgct

SEQ ID NO: 125274 - DNA, 27 bp, Artificial sequence
  SiRNA target sequence
cgacatgcaatgatattgtaaatgctg

SEQ ID NO: 125275 - DNA, 27 bp, Artificial sequence
  SiRNA target sequence
gacatgcaatgatattgtaaatgctgt

SEQ ID NO: 125276 - DNA, 27 bp, Artificial sequence
  SiRNA target sequence
acatgcaatgatattgtaaatgctgtt

SEQ ID NO: 125277 - DNA, 27 bp, Artificial sequence
  SiRNA target sequence
catgcaatgatattgtaaatgctgtta

SEQ ID NO: 125278 - DNA, 27 bp, Artificial sequence
  SiRNA target sequence
atgcaatgatattgtaaatgctgttac

SEQ ID NO: 125279 - DNA, 27 bp, Artificial sequence
  SiRNA target sequence
tgcaatgatattgtaaatgctgttaca

SEQ ID NO: 125280 - DNA, 27 bp, Artificial sequence
  SiRNA target sequence
gcaatgatattgtaaatgctgttacaa

SEQ ID NO: 125281 - DNA, 27 bp, Artificial sequence
  SiRNA target sequence
caatgatattgtaaatgctgttacaaa

SEQ ID NO: 125282 - DNA, 27 bp, Artificial sequence
  SiRNA target sequence
aatgatattgtaaatgctgttacaaaa

SEQ ID NO: 125283 - DNA, 27 bp, Artificial sequence
  SiRNA target sequence
atgatattgtaaatgctgttacaaaaa

SEQ ID NO: 125284 - DNA, 27 bp, Artificial sequence
  SiRNA target sequence
tgatattgtaaatgctgttacaaaaat

SEQ ID NO: 125285 - DNA, 27 bp, Artificial sequence
  SiRNA target sequence
gatattgtaaatgctgttacaaaaata

SEQ ID NO: 125286 - DNA, 27 bp, Artificial sequence
  SiRNA target sequence
atattgtaaatgctgttacaaaaataa

SEQ ID NO: 125287 - DNA, 27 bp, Artificial sequence
  SiRNA target sequence
tattgtaaatgctgttacaaaaataaa

SEQ ID NO: 125288 - DNA, 27 bp, Artificial sequence
  SiRNA target sequence
attgtaaatgctgttacaaaaataaat

SEQ ID NO: 125289 - DNA, 27 bp, Artificial sequence
  SiRNA target sequence
ttgtaaatgctgttacaaaaataaatt

SEQ ID NO: 125290 - DNA, 27 bp, Artificial sequence
  SiRNA target sequence
tgtaaatgctgttacaaaaataaattc

SEQ ID NO: 125291 - DNA, 27 bp, Artificial sequence
  SiRNA target sequence
gtaaatgctgttacaaaaataaattca

SEQ ID NO: 125292 - DNA, 27 bp, Artificial sequence
  SiRNA target sequence
taaatgctgttacaaaaataaattcat

SEQ ID NO: 125293 - DNA, 27 bp, Artificial sequence
  SiRNA target sequence
aaatgctgttacaaaaataaattcata

SEQ ID NO: 125294 - DNA, 27 bp, Artificial sequence
  SiRNA target sequence
aatgctgttacaaaaataaattcatag

SEQ ID NO: 125295 - DNA, 19 bp, Artificial sequence
  SiRNA target sequence
atggtgtataaggttttat

SEQ ID NO: 125296 - DNA, 19 bp, Artificial sequence
  SiRNA target sequence
tggtgtataaggttttatt

SEQ ID NO: 125297 - DNA, 19 bp, Artificial sequence
  SiRNA target sequence
ggtgtataaggttttattt

SEQ ID NO: 125298 - DNA, 19 bp, Artificial sequence
  SiRNA target sequence
gtgtataaggttttattta

SEQ ID NO: 125299 - DNA, 19 bp, Artificial sequence
  SiRNA target sequence
tgtataaggttttatttac

SEQ ID NO: 125300 - DNA, 19 bp, Artificial sequence
  SiRNA target sequence
gtataaggttttatttaca

SEQ ID NO: 125301 - DNA, 19 bp, Artificial sequence
  SiRNA target sequence
tataaggttttatttacag

SEQ ID NO: 125302 - DNA, 19 bp, Artificial sequence
  SiRNA target sequence
ataaggttttatttacagt

SEQ ID NO: 125303 - DNA, 19 bp, Artificial sequence
  SiRNA target sequence
taaggttttatttacagta

SEQ ID NO: 125304 - DNA, 19 bp, Artificial sequence
  SiRNA target sequence
aaggttttatttacagtaa

SEQ ID NO: 125305 - DNA, 19 bp, Artificial sequence
  SiRNA target sequence
aggttttatttacagtaat

SEQ ID NO: 125306 - DNA, 19 bp, Artificial sequence
  SiRNA target sequence
ggttttatttacagtaata

SEQ ID NO: 125307 - DNA, 19 bp, Artificial sequence
  SiRNA target sequence
gttttatttacagtaatag

SEQ ID NO: 125308 - DNA, 19 bp, Artificial sequence
  SiRNA target sequence
ttttatttacagtaatagg

SEQ ID NO: 125309 - DNA, 19 bp, Artificial sequence
  SiRNA target sequence
tttatttacagtaatagga

SEQ ID NO: 125310 - DNA, 19 bp, Artificial sequence
  SiRNA target sequence
ttatttacagtaataggat

SEQ ID NO: 125311 - DNA, 19 bp, Artificial sequence
  SiRNA target sequence
tatttacagtaataggatt

SEQ ID NO: 125312 - DNA, 19 bp, Artificial sequence
  SiRNA target sequence
atttacagtaataggatta

SEQ ID NO: 125313 - DNA, 19 bp, Artificial sequence
  SiRNA target sequence
tttacagtaataggattaa

SEQ ID NO: 125314 - DNA, 19 bp, Artificial sequence
  SiRNA target sequence
ttacagtaataggattaat

SEQ ID NO: 125315 - DNA, 19 bp, Artificial sequence
  SiRNA target sequence
tacagtaataggattaata

SEQ ID NO: 125316 - DNA, 19 bp, Artificial sequence
  SiRNA target sequence
acagtaataggattaatat

SEQ ID NO: 125317 - DNA, 19 bp, Artificial sequence
  SiRNA target sequence
cagtaataggattaatatg

SEQ ID NO: 125318 - DNA, 19 bp, Artificial sequence
  SiRNA target sequence
agtaataggattaatatgt

SEQ ID NO: 125319 - DNA, 19 bp, Artificial sequence
  SiRNA target sequence
gtaataggattaatatgtg

SEQ ID NO: 125320 - DNA, 19 bp, Artificial sequence
  SiRNA target sequence
taataggattaatatgtgg

SEQ ID NO: 125321 - DNA, 19 bp, Artificial sequence
  SiRNA target sequence
aataggattaatatgtggt

SEQ ID NO: 125322 - DNA, 19 bp, Artificial sequence
  SiRNA target sequence
ataggattaatatgtggta

SEQ ID NO: 125323 - DNA, 19 bp, Artificial sequence
  SiRNA target sequence
taggattaatatgtggtat

SEQ ID NO: 125324 - DNA, 19 bp, Artificial sequence
  SiRNA target sequence
aggattaatatgtggtata

SEQ ID NO: 125325 - DNA, 19 bp, Artificial sequence
  SiRNA target sequence
ggattaatatgtggtatac

SEQ ID NO: 125326 - DNA, 19 bp, Artificial sequence
  SiRNA target sequence
gattaatatgtggtatact

SEQ ID NO: 125327 - DNA, 19 bp, Artificial sequence
  SiRNA target sequence
attaatatgtggtatactt

SEQ ID NO: 125328 - DNA, 19 bp, Artificial sequence
  SiRNA target sequence
ttaatatgtggtatactta

SEQ ID NO: 125329 - DNA, 19 bp, Artificial sequence
  SiRNA target sequence
taatatgtggtatacttac

SEQ ID NO: 125330 - DNA, 19 bp, Artificial sequence
  SiRNA target sequence
aatatgtggtatacttaca

SEQ ID NO: 125331 - DNA, 19 bp, Artificial sequence
  SiRNA target sequence
atatgtggtatacttacaa

SEQ ID NO: 125332 - DNA, 19 bp, Artificial sequence
  SiRNA target sequence
tatgtggtatacttacaat

SEQ ID NO: 125333 - DNA, 19 bp, Artificial sequence
  SiRNA target sequence
atgtggtatacttacaata

SEQ ID NO: 125334 - DNA, 19 bp, Artificial sequence
  SiRNA target sequence
tgtggtatacttacaataa

SEQ ID NO: 125335 - DNA, 19 bp, Artificial sequence
  SiRNA target sequence
gtggtatacttacaataat

SEQ ID NO: 125336 - DNA, 19 bp, Artificial sequence
  SiRNA target sequence
tggtatacttacaataatt

SEQ ID NO: 125337 - DNA, 19 bp, Artificial sequence
  SiRNA target sequence
ggtatacttacaataatta

SEQ ID NO: 125338 - DNA, 19 bp, Artificial sequence
  SiRNA target sequence
gtatacttacaataattaa

SEQ ID NO: 125339 - DNA, 19 bp, Artificial sequence
  SiRNA target sequence
tatacttacaataattaaa

SEQ ID NO: 125340 - DNA, 19 bp, Artificial sequence
  SiRNA target sequence
atacttacaataattaaac

SEQ ID NO: 125341 - DNA, 19 bp, Artificial sequence
  SiRNA target sequence
tacttacaataattaaacg

SEQ ID NO: 125342 - DNA, 19 bp, Artificial sequence
  SiRNA target sequence
acttacaataattaaacga

SEQ ID NO: 125343 - DNA, 19 bp, Artificial sequence
  SiRNA target sequence
cttacaataattaaacgat

SEQ ID NO: 125344 - DNA, 19 bp, Artificial sequence
  SiRNA target sequence
ttacaataattaaacgata

SEQ ID NO: 125345 - DNA, 19 bp, Artificial sequence
  SiRNA target sequence
tacaataattaaacgatac

SEQ ID NO: 125346 - DNA, 19 bp, Artificial sequence
  SiRNA target sequence
acaataattaaacgataca

SEQ ID NO: 125347 - DNA, 19 bp, Artificial sequence
  SiRNA target sequence
caataattaaacgatacaa

SEQ ID NO: 125348 - DNA, 19 bp, Artificial sequence
  SiRNA target sequence
aataattaaacgatacaag

SEQ ID NO: 125349 - DNA, 19 bp, Artificial sequence
  SiRNA target sequence
ataattaaacgatacaagt

SEQ ID NO: 125350 - DNA, 19 bp, Artificial sequence
  SiRNA target sequence
taattaaacgatacaagta

SEQ ID NO: 125351 - DNA, 19 bp, Artificial sequence
  SiRNA target sequence
aattaaacgatacaagtat

SEQ ID NO: 125352 - DNA, 19 bp, Artificial sequence
  SiRNA target sequence
attaaacgatacaagtatt

SEQ ID NO: 125353 - DNA, 19 bp, Artificial sequence
  SiRNA target sequence
ttaaacgatacaagtattt

SEQ ID NO: 125354 - DNA, 19 bp, Artificial sequence
  SiRNA target sequence
taaacgatacaagtatttt

SEQ ID NO: 125355 - DNA, 19 bp, Artificial sequence
  SiRNA target sequence
aaacgatacaagtatttta

SEQ ID NO: 125356 - DNA, 19 bp, Artificial sequence
  SiRNA target sequence
aacgatacaagtattttaa

SEQ ID NO: 125357 - DNA, 19 bp, Artificial sequence
  SiRNA target sequence
acgatacaagtattttaag

SEQ ID NO: 125358 - DNA, 19 bp, Artificial sequence
  SiRNA target sequence
cgatacaagtattttaaga

SEQ ID NO: 125359 - DNA, 19 bp, Artificial sequence
  SiRNA target sequence
gatacaagtattttaagat

SEQ ID NO: 125360 - DNA, 19 bp, Artificial sequence
  SiRNA target sequence
atacaagtattttaagata

SEQ ID NO: 125361 - DNA, 19 bp, Artificial sequence
  SiRNA target sequence
tacaagtattttaagataa

SEQ ID NO: 125362 - DNA, 19 bp, Artificial sequence
  SiRNA target sequence
acaagtattttaagataaa

SEQ ID NO: 125363 - DNA, 19 bp, Artificial sequence
  SiRNA target sequence
caagtattttaagataaaa

SEQ ID NO: 125364 - DNA, 19 bp, Artificial sequence
  SiRNA target sequence
aagtattttaagataaaaa

SEQ ID NO: 125365 - DNA, 19 bp, Artificial sequence
  SiRNA target sequence
agtattttaagataaaaaa

SEQ ID NO: 125366 - DNA, 19 bp, Artificial sequence
  SiRNA target sequence
gtattttaagataaaaaaa

SEQ ID NO: 125367 - DNA, 19 bp, Artificial sequence
  SiRNA target sequence
tattttaagataaaaaaat

SEQ ID NO: 125368 - DNA, 19 bp, Artificial sequence
  SiRNA target sequence
attttaagataaaaaaatt

SEQ ID NO: 125369 - DNA, 19 bp, Artificial sequence
  SiRNA target sequence
ttttaagataaaaaaattg

SEQ ID NO: 125370 - DNA, 19 bp, Artificial sequence
  SiRNA target sequence
tttaagataaaaaaattgg

SEQ ID NO: 125371 - DNA, 19 bp, Artificial sequence
  SiRNA target sequence
ttaagataaaaaaattggc

SEQ ID NO: 125372 - DNA, 19 bp, Artificial sequence
  SiRNA target sequence
taagataaaaaaattggcc

SEQ ID NO: 125373 - DNA, 19 bp, Artificial sequence
  SiRNA target sequence
aagataaaaaaattggcct

SEQ ID NO: 125374 - DNA, 19 bp, Artificial sequence
  SiRNA target sequence
agataaaaaaattggcctt

SEQ ID NO: 125375 - DNA, 19 bp, Artificial sequence
  SiRNA target sequence
gataaaaaaattggcctta

SEQ ID NO: 125376 - DNA, 19 bp, Artificial sequence
  SiRNA target sequence
ataaaaaaattggccttaa

SEQ ID NO: 125377 - DNA, 19 bp, Artificial sequence
  SiRNA target sequence
taaaaaaattggccttaac

SEQ ID NO: 125378 - DNA, 19 bp, Artificial sequence
  SiRNA target sequence
aaaaaaattggccttaact

SEQ ID NO: 125379 - DNA, 19 bp, Artificial sequence
  SiRNA target sequence
aaaaaattggccttaactt

SEQ ID NO: 125380 - DNA, 19 bp, Artificial sequence
  SiRNA target sequence
aaaaattggccttaactta

SEQ ID NO: 125381 - DNA, 19 bp, Artificial sequence
  SiRNA target sequence
aaaattggccttaacttac

SEQ ID NO: 125382 - DNA, 19 bp, Artificial sequence
  SiRNA target sequence
aaattggccttaacttact

SEQ ID NO: 125383 - DNA, 19 bp, Artificial sequence
  SiRNA target sequence
aattggccttaacttactt

SEQ ID NO: 125384 - DNA, 19 bp, Artificial sequence
  SiRNA target sequence
attggccttaacttacttc

SEQ ID NO: 125385 - DNA, 19 bp, Artificial sequence
  SiRNA target sequence
ttggccttaacttacttcg

SEQ ID NO: 125386 - DNA, 19 bp, Artificial sequence
  SiRNA target sequence
tggccttaacttacttcgg

SEQ ID NO: 125387 - DNA, 19 bp, Artificial sequence
  SiRNA target sequence
ggccttaacttacttcggg

SEQ ID NO: 125388 - DNA, 19 bp, Artificial sequence
  SiRNA target sequence
gccttaacttacttcggga

SEQ ID NO: 125389 - DNA, 19 bp, Artificial sequence
  SiRNA target sequence
ccttaacttacttcgggaa

SEQ ID NO: 125390 - DNA, 19 bp, Artificial sequence
  SiRNA target sequence
cttaacttacttcgggaaa

SEQ ID NO: 125391 - DNA, 19 bp, Artificial sequence
  SiRNA target sequence
ttaacttacttcgggaaac

SEQ ID NO: 125392 - DNA, 19 bp, Artificial sequence
  SiRNA target sequence
taacttacttcgggaaaca

SEQ ID NO: 125393 - DNA, 19 bp, Artificial sequence
  SiRNA target sequence
aacttacttcgggaaacaa

SEQ ID NO: 125394 - DNA, 19 bp, Artificial sequence
  SiRNA target sequence
acttacttcgggaaacaag

SEQ ID NO: 125395 - DNA, 19 bp, Artificial sequence
  SiRNA target sequence
cttacttcgggaaacaaga

SEQ ID NO: 125396 - DNA, 19 bp, Artificial sequence
  SiRNA target sequence
ttacttcgggaaacaagac

SEQ ID NO: 125397 - DNA, 19 bp, Artificial sequence
  SiRNA target sequence
tacttcgggaaacaagact

SEQ ID NO: 125398 - DNA, 19 bp, Artificial sequence
  SiRNA target sequence
acttcgggaaacaagactt

SEQ ID NO: 125399 - DNA, 19 bp, Artificial sequence
  SiRNA target sequence
cttcgggaaacaagacttg

SEQ ID NO: 125400 - DNA, 19 bp, Artificial sequence
  SiRNA target sequence
ttcgggaaacaagacttgc

SEQ ID NO: 125401 - DNA, 19 bp, Artificial sequence
  SiRNA target sequence
tcgggaaacaagacttgca

SEQ ID NO: 125402 - DNA, 19 bp, Artificial sequence
  SiRNA target sequence
cgggaaacaagacttgcaa

SEQ ID NO: 125403 - DNA, 19 bp, Artificial sequence
  SiRNA target sequence
gggaaacaagacttgcaat

SEQ ID NO: 125404 - DNA, 19 bp, Artificial sequence
  SiRNA target sequence
ggaaacaagacttgcaatg

SEQ ID NO: 125405 - DNA, 19 bp, Artificial sequence
  SiRNA target sequence
gaaacaagacttgcaatgg

SEQ ID NO: 125406 - DNA, 19 bp, Artificial sequence
  SiRNA target sequence
aaacaagacttgcaatgga

SEQ ID NO: 125407 - DNA, 19 bp, Artificial sequence
  SiRNA target sequence
aacaagacttgcaatggaa

SEQ ID NO: 125408 - DNA, 19 bp, Artificial sequence
  SiRNA target sequence
acaagacttgcaatggaaa

SEQ ID NO: 125409 - DNA, 19 bp, Artificial sequence
  SiRNA target sequence
caagacttgcaatggaaac

SEQ ID NO: 125410 - DNA, 19 bp, Artificial sequence
  SiRNA target sequence
aagacttgcaatggaaacc

SEQ ID NO: 125411 - DNA, 19 bp, Artificial sequence
  SiRNA target sequence
agacttgcaatggaaacct

SEQ ID NO: 125412 - DNA, 19 bp, Artificial sequence
  SiRNA target sequence
gacttgcaatggaaaccta

SEQ ID NO: 125413 - DNA, 19 bp, Artificial sequence
  SiRNA target sequence
acttgcaatggaaacctaa

SEQ ID NO: 125414 - DNA, 19 bp, Artificial sequence
  SiRNA target sequence
cttgcaatggaaacctaaa

SEQ ID NO: 125415 - DNA, 19 bp, Artificial sequence
  SiRNA target sequence
ttgcaatggaaacctaaaa

SEQ ID NO: 125416 - DNA, 19 bp, Artificial sequence
  SiRNA target sequence
tgcaatggaaacctaaaag

SEQ ID NO: 125417 - DNA, 19 bp, Artificial sequence
  SiRNA target sequence
gcaatggaaacctaaaagt

SEQ ID NO: 125418 - DNA, 19 bp, Artificial sequence
  SiRNA target sequence
caatggaaacctaaaagtc

SEQ ID NO: 125419 - DNA, 19 bp, Artificial sequence
  SiRNA target sequence
aatggaaacctaaaagtcg

SEQ ID NO: 125420 - DNA, 19 bp, Artificial sequence
  SiRNA target sequence
atggaaacctaaaagtcgg

SEQ ID NO: 125421 - DNA, 19 bp, Artificial sequence
  SiRNA target sequence
tggaaacctaaaagtcggt

SEQ ID NO: 125422 - DNA, 19 bp, Artificial sequence
  SiRNA target sequence
ggaaacctaaaagtcggtc

SEQ ID NO: 125423 - DNA, 19 bp, Artificial sequence
  SiRNA target sequence
gaaacctaaaagtcggtca

SEQ ID NO: 125424 - DNA, 19 bp, Artificial sequence
  SiRNA target sequence
aaacctaaaagtcggtcag

SEQ ID NO: 125425 - DNA, 19 bp, Artificial sequence
  SiRNA target sequence
aacctaaaagtcggtcaga

SEQ ID NO: 125426 - DNA, 19 bp, Artificial sequence
  SiRNA target sequence
acctaaaagtcggtcagaa

SEQ ID NO: 125427 - DNA, 19 bp, Artificial sequence
  SiRNA target sequence
cctaaaagtcggtcagaaa

SEQ ID NO: 125428 - DNA, 19 bp, Artificial sequence
  SiRNA target sequence
ctaaaagtcggtcagaaat

SEQ ID NO: 125429 - DNA, 19 bp, Artificial sequence
  SiRNA target sequence
taaaagtcggtcagaaatt

SEQ ID NO: 125430 - DNA, 19 bp, Artificial sequence
  SiRNA target sequence
aaaagtcggtcagaaatta

SEQ ID NO: 125431 - DNA, 19 bp, Artificial sequence
  SiRNA target sequence
aaagtcggtcagaaattat

SEQ ID NO: 125432 - DNA, 19 bp, Artificial sequence
  SiRNA target sequence
aagtcggtcagaaattatt

SEQ ID NO: 125433 - DNA, 19 bp, Artificial sequence
  SiRNA target sequence
agtcggtcagaaattatta

SEQ ID NO: 125434 - DNA, 19 bp, Artificial sequence
  SiRNA target sequence
gtcggtcagaaattattaa

SEQ ID NO: 125435 - DNA, 19 bp, Artificial sequence
  SiRNA target sequence
tcggtcagaaattattaac

SEQ ID NO: 125436 - DNA, 19 bp, Artificial sequence
  SiRNA target sequence
cggtcagaaattattaacg

SEQ ID NO: 125437 - DNA, 19 bp, Artificial sequence
  SiRNA target sequence
ggtcagaaattattaacga

SEQ ID NO: 125438 - DNA, 19 bp, Artificial sequence
  SiRNA target sequence
gtcagaaattattaacgat

SEQ ID NO: 125439 - DNA, 19 bp, Artificial sequence
  SiRNA target sequence
tcagaaattattaacgatt

SEQ ID NO: 125440 - DNA, 19 bp, Artificial sequence
  SiRNA target sequence
cagaaattattaacgattt

SEQ ID NO: 125441 - DNA, 19 bp, Artificial sequence
  SiRNA target sequence
agaaattattaacgattta

SEQ ID NO: 125442 - DNA, 19 bp, Artificial sequence
  SiRNA target sequence
gaaattattaacgatttaa

SEQ ID NO: 125443 - DNA, 19 bp, Artificial sequence
  SiRNA target sequence
aaattattaacgatttaaa

SEQ ID NO: 125444 - DNA, 19 bp, Artificial sequence
  SiRNA target sequence
aattattaacgatttaaaa

SEQ ID NO: 125445 - DNA, 19 bp, Artificial sequence
  SiRNA target sequence
attattaacgatttaaaaa

SEQ ID NO: 125446 - DNA, 19 bp, Artificial sequence
  SiRNA target sequence
ttattaacgatttaaaaaa

SEQ ID NO: 125447 - DNA, 19 bp, Artificial sequence
  SiRNA target sequence
tattaacgatttaaaaaat

SEQ ID NO: 125448 - DNA, 19 bp, Artificial sequence
  SiRNA target sequence
attaacgatttaaaaaata

SEQ ID NO: 125449 - DNA, 19 bp, Artificial sequence
  SiRNA target sequence
ttaacgatttaaaaaatac

SEQ ID NO: 125450 - DNA, 19 bp, Artificial sequence
  SiRNA target sequence
taacgatttaaaaaataca

SEQ ID NO: 125451 - DNA, 19 bp, Artificial sequence
  SiRNA target sequence
aacgatttaaaaaatacaa

SEQ ID NO: 125452 - DNA, 19 bp, Artificial sequence
  SiRNA target sequence
acgatttaaaaaatacaaa

SEQ ID NO: 125453 - DNA, 19 bp, Artificial sequence
  SiRNA target sequence
cgatttaaaaaatacaaac

SEQ ID NO: 125454 - DNA, 19 bp, Artificial sequence
  SiRNA target sequence
gatttaaaaaatacaaact

SEQ ID NO: 125455 - DNA, 19 bp, Artificial sequence
  SiRNA target sequence
atttaaaaaatacaaactt

SEQ ID NO: 125456 - DNA, 19 bp, Artificial sequence
  SiRNA target sequence
tttaaaaaatacaaacttt

SEQ ID NO: 125457 - DNA, 19 bp, Artificial sequence
  SiRNA target sequence
ttaaaaaatacaaactttg

SEQ ID NO: 125458 - DNA, 19 bp, Artificial sequence
  SiRNA target sequence
taaaaaatacaaactttga

SEQ ID NO: 125459 - DNA, 19 bp, Artificial sequence
  SiRNA target sequence
aaaaaatacaaactttgac

SEQ ID NO: 125460 - DNA, 19 bp, Artificial sequence
  SiRNA target sequence
aaaaatacaaactttgaca

SEQ ID NO: 125461 - DNA, 19 bp, Artificial sequence
  SiRNA target sequence
aaaatacaaactttgacat

SEQ ID NO: 125462 - DNA, 19 bp, Artificial sequence
  SiRNA target sequence
aaatacaaactttgacata

SEQ ID NO: 125463 - DNA, 19 bp, Artificial sequence
  SiRNA target sequence
aatacaaactttgacatat

SEQ ID NO: 125464 - DNA, 19 bp, Artificial sequence
  SiRNA target sequence
atacaaactttgacatatt

SEQ ID NO: 125465 - DNA, 19 bp, Artificial sequence
  SiRNA target sequence
tacaaactttgacatattg

SEQ ID NO: 125466 - DNA, 19 bp, Artificial sequence
  SiRNA target sequence
acaaactttgacatattga

SEQ ID NO: 125467 - DNA, 19 bp, Artificial sequence
  SiRNA target sequence
caaactttgacatattgat

SEQ ID NO: 125468 - DNA, 19 bp, Artificial sequence
  SiRNA target sequence
aaactttgacatattgatt

SEQ ID NO: 125469 - DNA, 19 bp, Artificial sequence
  SiRNA target sequence
aactttgacatattgatta

SEQ ID NO: 125470 - DNA, 19 bp, Artificial sequence
  SiRNA target sequence
actttgacatattgattat

SEQ ID NO: 125471 - DNA, 19 bp, Artificial sequence
  SiRNA target sequence
ctttgacatattgattatt

SEQ ID NO: 125472 - DNA, 19 bp, Artificial sequence
  SiRNA target sequence
tttgacatattgattattg

SEQ ID NO: 125473 - DNA, 19 bp, Artificial sequence
  SiRNA target sequence
ttgacatattgattattgg

SEQ ID NO: 125474 - DNA, 19 bp, Artificial sequence
  SiRNA target sequence
tgacatattgattattggt

SEQ ID NO: 125475 - DNA, 19 bp, Artificial sequence
  SiRNA target sequence
gacatattgattattggtg

SEQ ID NO: 125476 - DNA, 19 bp, Artificial sequence
  SiRNA target sequence
acatattgattattggtgg

SEQ ID NO: 125477 - DNA, 19 bp, Artificial sequence
  SiRNA target sequence
catattgattattggtggc

SEQ ID NO: 125478 - DNA, 19 bp, Artificial sequence
  SiRNA target sequence
atattgattattggtggcg

SEQ ID NO: 125479 - DNA, 19 bp, Artificial sequence
  SiRNA target sequence
tattgattattggtggcgg

SEQ ID NO: 125480 - DNA, 19 bp, Artificial sequence
  SiRNA target sequence
attgattattggtggcggt

SEQ ID NO: 125481 - DNA, 19 bp, Artificial sequence
  SiRNA target sequence
ttgattattggtggcggtt

SEQ ID NO: 125482 - DNA, 19 bp, Artificial sequence
  SiRNA target sequence
tgattattggtggcggttc

SEQ ID NO: 125483 - DNA, 19 bp, Artificial sequence
  SiRNA target sequence
gattattggtggcggttca

SEQ ID NO: 125484 - DNA, 19 bp, Artificial sequence
  SiRNA target sequence
attattggtggcggttcaa

SEQ ID NO: 125485 - DNA, 19 bp, Artificial sequence
  SiRNA target sequence
ttattggtggcggttcaac

SEQ ID NO: 125486 - DNA, 19 bp, Artificial sequence
  SiRNA target sequence
tattggtggcggttcaacg

SEQ ID NO: 125487 - DNA, 19 bp, Artificial sequence
  SiRNA target sequence
attggtggcggttcaacgg

SEQ ID NO: 125488 - DNA, 19 bp, Artificial sequence
  SiRNA target sequence
ttggtggcggttcaacggg

SEQ ID NO: 125489 - DNA, 19 bp, Artificial sequence
  SiRNA target sequence
tggtggcggttcaacggga

SEQ ID NO: 125490 - DNA, 19 bp, Artificial sequence
  SiRNA target sequence
ggtggcggttcaacgggaa

SEQ ID NO: 125491 - DNA, 19 bp, Artificial sequence
  SiRNA target sequence
gtggcggttcaacgggaat

SEQ ID NO: 125492 - DNA, 19 bp, Artificial sequence
  SiRNA target sequence
tggcggttcaacgggaatg

SEQ ID NO: 125493 - DNA, 19 bp, Artificial sequence
  SiRNA target sequence
ggcggttcaacgggaatgg

SEQ ID NO: 125494 - DNA, 19 bp, Artificial sequence
  SiRNA target sequence
gcggttcaacgggaatggg

SEQ ID NO: 125495 - DNA, 19 bp, Artificial sequence
  SiRNA target sequence
cggttcaacgggaatggga

SEQ ID NO: 125496 - DNA, 19 bp, Artificial sequence
  SiRNA target sequence
ggttcaacgggaatgggat

SEQ ID NO: 125497 - DNA, 19 bp, Artificial sequence
  SiRNA target sequence
gttcaacgggaatgggatg

SEQ ID NO: 125498 - DNA, 19 bp, Artificial sequence
  SiRNA target sequence
ttcaacgggaatgggatgt

SEQ ID NO: 125499 - DNA, 19 bp, Artificial sequence
  SiRNA target sequence
tcaacgggaatgggatgtg

SEQ ID NO: 125500 - DNA, 19 bp, Artificial sequence
  SiRNA target sequence
caacgggaatgggatgtgc

SEQ ID NO: 125501 - DNA, 19 bp, Artificial sequence
  SiRNA target sequence
aacgggaatgggatgtgca

SEQ ID NO: 125502 - DNA, 19 bp, Artificial sequence
  SiRNA target sequence
acgggaatgggatgtgcaa

SEQ ID NO: 125503 - DNA, 19 bp, Artificial sequence
  SiRNA target sequence
cgggaatgggatgtgcaat

SEQ ID NO: 125504 - DNA, 19 bp, Artificial sequence
  SiRNA target sequence
gggaatgggatgtgcaatc

SEQ ID NO: 125505 - DNA, 19 bp, Artificial sequence
  SiRNA target sequence
ggaatgggatgtgcaatcg

SEQ ID NO: 125506 - DNA, 19 bp, Artificial sequence
  SiRNA target sequence
gaatgggatgtgcaatcga

SEQ ID NO: 125507 - DNA, 19 bp, Artificial sequence
  SiRNA target sequence
aatgggatgtgcaatcgaa

SEQ ID NO: 125508 - DNA, 19 bp, Artificial sequence
  SiRNA target sequence
atgggatgtgcaatcgaag

SEQ ID NO: 125509 - DNA, 19 bp, Artificial sequence
  SiRNA target sequence
tgggatgtgcaatcgaagc

SEQ ID NO: 125510 - DNA, 19 bp, Artificial sequence
  SiRNA target sequence
gggatgtgcaatcgaagca

SEQ ID NO: 125511 - DNA, 19 bp, Artificial sequence
  SiRNA target sequence
ggatgtgcaatcgaagcag

SEQ ID NO: 125512 - DNA, 19 bp, Artificial sequence
  SiRNA target sequence
gatgtgcaatcgaagcagc

SEQ ID NO: 125513 - DNA, 19 bp, Artificial sequence
  SiRNA target sequence
atgtgcaatcgaagcagct

SEQ ID NO: 125514 - DNA, 19 bp, Artificial sequence
  SiRNA target sequence
tgtgcaatcgaagcagcta

SEQ ID NO: 125515 - DNA, 19 bp, Artificial sequence
  SiRNA target sequence
gtgcaatcgaagcagctac

SEQ ID NO: 125516 - DNA, 19 bp, Artificial sequence
  SiRNA target sequence
tgcaatcgaagcagctaca

SEQ ID NO: 125517 - DNA, 19 bp, Artificial sequence
  SiRNA target sequence
gcaatcgaagcagctacac

SEQ ID NO: 125518 - DNA, 19 bp, Artificial sequence
  SiRNA target sequence
caatcgaagcagctacacg

SEQ ID NO: 125519 - DNA, 19 bp, Artificial sequence
  SiRNA target sequence
aatcgaagcagctacacga

SEQ ID NO: 125520 - DNA, 19 bp, Artificial sequence
  SiRNA target sequence
atcgaagcagctacacgag

SEQ ID NO: 125521 - DNA, 19 bp, Artificial sequence
  SiRNA target sequence
tcgaagcagctacacgagg

SEQ ID NO: 125522 - DNA, 19 bp, Artificial sequence
  SiRNA target sequence
cgaagcagctacacgaggt

SEQ ID NO: 125523 - DNA, 19 bp, Artificial sequence
  SiRNA target sequence
gaagcagctacacgaggta

SEQ ID NO: 125524 - DNA, 19 bp, Artificial sequence
  SiRNA target sequence
aagcagctacacgaggtat

SEQ ID NO: 125525 - DNA, 19 bp, Artificial sequence
  SiRNA target sequence
agcagctacacgaggtata

SEQ ID NO: 125526 - DNA, 19 bp, Artificial sequence
  SiRNA target sequence
gcagctacacgaggtataa

SEQ ID NO: 125527 - DNA, 19 bp, Artificial sequence
  SiRNA target sequence
cagctacacgaggtataag

SEQ ID NO: 125528 - DNA, 19 bp, Artificial sequence
  SiRNA target sequence
agctacacgaggtataagt

SEQ ID NO: 125529 - DNA, 19 bp, Artificial sequence
  SiRNA target sequence
gctacacgaggtataagtg

SEQ ID NO: 125530 - DNA, 19 bp, Artificial sequence
  SiRNA target sequence
ctacacgaggtataagtgt

SEQ ID NO: 125531 - DNA, 19 bp, Artificial sequence
  SiRNA target sequence
tacacgaggtataagtgtt

SEQ ID NO: 125532 - DNA, 19 bp, Artificial sequence
  SiRNA target sequence
acacgaggtataagtgttg

SEQ ID NO: 125533 - DNA, 19 bp, Artificial sequence
  SiRNA target sequence
cacgaggtataagtgttgg

SEQ ID NO: 125534 - DNA, 19 bp, Artificial sequence
  SiRNA target sequence
acgaggtataagtgttggc

SEQ ID NO: 125535 - DNA, 19 bp, Artificial sequence
  SiRNA target sequence
cgaggtataagtgttggcc

SEQ ID NO: 125536 - DNA, 19 bp, Artificial sequence
  SiRNA target sequence
gaggtataagtgttggcct

SEQ ID NO: 125537 - DNA, 19 bp, Artificial sequence
  SiRNA target sequence
aggtataagtgttggcctg

SEQ ID NO: 125538 - DNA, 19 bp, Artificial sequence
  SiRNA target sequence
ggtataagtgttggcctga

SEQ ID NO: 125539 - DNA, 19 bp, Artificial sequence
  SiRNA target sequence
gtataagtgttggcctgat

SEQ ID NO: 125540 - DNA, 19 bp, Artificial sequence
  SiRNA target sequence
tataagtgttggcctgata

SEQ ID NO: 125541 - DNA, 19 bp, Artificial sequence
  SiRNA target sequence
ataagtgttggcctgatag

SEQ ID NO: 125542 - DNA, 19 bp, Artificial sequence
  SiRNA target sequence
taagtgttggcctgataga

SEQ ID NO: 125543 - DNA, 19 bp, Artificial sequence
  SiRNA target sequence
aagtgttggcctgatagaa

SEQ ID NO: 125544 - DNA, 19 bp, Artificial sequence
  SiRNA target sequence
agtgttggcctgatagaag

SEQ ID NO: 125545 - DNA, 19 bp, Artificial sequence
  SiRNA target sequence
gtgttggcctgatagaagc

SEQ ID NO: 125546 - DNA, 19 bp, Artificial sequence
  SiRNA target sequence
tgttggcctgatagaagca

SEQ ID NO: 125547 - DNA, 19 bp, Artificial sequence
  SiRNA target sequence
gttggcctgatagaagcac

SEQ ID NO: 125548 - DNA, 19 bp, Artificial sequence
  SiRNA target sequence
ttggcctgatagaagcaca

SEQ ID NO: 125549 - DNA, 19 bp, Artificial sequence
  SiRNA target sequence
tggcctgatagaagcacat

SEQ ID NO: 125550 - DNA, 19 bp, Artificial sequence
  SiRNA target sequence
ggcctgatagaagcacatg

SEQ ID NO: 125551 - DNA, 19 bp, Artificial sequence
  SiRNA target sequence
gcctgatagaagcacatga

SEQ ID NO: 125552 - DNA, 19 bp, Artificial sequence
  SiRNA target sequence
cctgatagaagcacatgat

SEQ ID NO: 125553 - DNA, 19 bp, Artificial sequence
  SiRNA target sequence
ctgatagaagcacatgatt

SEQ ID NO: 125554 - DNA, 19 bp, Artificial sequence
  SiRNA target sequence
tgatagaagcacatgattt

SEQ ID NO: 125555 - DNA, 19 bp, Artificial sequence
  SiRNA target sequence
gatagaagcacatgatttt

SEQ ID NO: 125556 - DNA, 19 bp, Artificial sequence
  SiRNA target sequence
atagaagcacatgattttg

SEQ ID NO: 125557 - DNA, 19 bp, Artificial sequence
  SiRNA target sequence
tagaagcacatgattttgg

SEQ ID NO: 125558 - DNA, 19 bp, Artificial sequence
  SiRNA target sequence
agaagcacatgattttggt

SEQ ID NO: 125559 - DNA, 19 bp, Artificial sequence
  SiRNA target sequence
gaagcacatgattttggtt

SEQ ID NO: 125560 - DNA, 19 bp, Artificial sequence
  SiRNA target sequence
aagcacatgattttggttc

SEQ ID NO: 125561 - DNA, 19 bp, Artificial sequence
  SiRNA target sequence
agcacatgattttggttcg

SEQ ID NO: 125562 - DNA, 19 bp, Artificial sequence
  SiRNA target sequence
gcacatgattttggttcgg

SEQ ID NO: 125563 - DNA, 19 bp, Artificial sequence
  SiRNA target sequence
cacatgattttggttcggg

SEQ ID NO: 125564 - DNA, 19 bp, Artificial sequence
  SiRNA target sequence
acatgattttggttcgggc

SEQ ID NO: 125565 - DNA, 19 bp, Artificial sequence
  SiRNA target sequence
catgattttggttcgggca

SEQ ID NO: 125566 - DNA, 19 bp, Artificial sequence
  SiRNA target sequence
atgattttggttcgggcac

SEQ ID NO: 125567 - DNA, 19 bp, Artificial sequence
  SiRNA target sequence
tgattttggttcgggcacg

SEQ ID NO: 125568 - DNA, 19 bp, Artificial sequence
  SiRNA target sequence
gattttggttcgggcacga

SEQ ID NO: 125569 - DNA, 19 bp, Artificial sequence
  SiRNA target sequence
attttggttcgggcacgag

SEQ ID NO: 125570 - DNA, 19 bp, Artificial sequence
  SiRNA target sequence
ttttggttcgggcacgagt

SEQ ID NO: 125571 - DNA, 19 bp, Artificial sequence
  SiRNA target sequence
tttggttcgggcacgagtt

SEQ ID NO: 125572 - DNA, 19 bp, Artificial sequence
  SiRNA target sequence
ttggttcgggcacgagttc

SEQ ID NO: 125573 - DNA, 19 bp, Artificial sequence
  SiRNA target sequence
tggttcgggcacgagttca

SEQ ID NO: 125574 - DNA, 19 bp, Artificial sequence
  SiRNA target sequence
ggttcgggcacgagttcaa

SEQ ID NO: 125575 - DNA, 19 bp, Artificial sequence
  SiRNA target sequence
gttcgggcacgagttcaaa

SEQ ID NO: 125576 - DNA, 19 bp, Artificial sequence
  SiRNA target sequence
ttcgggcacgagttcaaaa

SEQ ID NO: 125577 - DNA, 19 bp, Artificial sequence
  SiRNA target sequence
tcgggcacgagttcaaaat

SEQ ID NO: 125578 - DNA, 19 bp, Artificial sequence
  SiRNA target sequence
cgggcacgagttcaaaatc

SEQ ID NO: 125579 - DNA, 19 bp, Artificial sequence
  SiRNA target sequence
gggcacgagttcaaaatct

SEQ ID NO: 125580 - DNA, 19 bp, Artificial sequence
  SiRNA target sequence
ggcacgagttcaaaatcta

SEQ ID NO: 125581 - DNA, 19 bp, Artificial sequence
  SiRNA target sequence
gcacgagttcaaaatctac

SEQ ID NO: 125582 - DNA, 19 bp, Artificial sequence
  SiRNA target sequence
cacgagttcaaaatctaca

SEQ ID NO: 125583 - DNA, 19 bp, Artificial sequence
  SiRNA target sequence
acgagttcaaaatctacaa

SEQ ID NO: 125584 - DNA, 19 bp, Artificial sequence
  SiRNA target sequence
cgagttcaaaatctacaaa

SEQ ID NO: 125585 - DNA, 19 bp, Artificial sequence
  SiRNA target sequence
gagttcaaaatctacaaaa

SEQ ID NO: 125586 - DNA, 19 bp, Artificial sequence
  SiRNA target sequence
agttcaaaatctacaaaac

SEQ ID NO: 125587 - DNA, 19 bp, Artificial sequence
  SiRNA target sequence
gttcaaaatctacaaaact

SEQ ID NO: 125588 - DNA, 19 bp, Artificial sequence
  SiRNA target sequence
ttcaaaatctacaaaactt

SEQ ID NO: 125589 - DNA, 19 bp, Artificial sequence
  SiRNA target sequence
tcaaaatctacaaaacttt

SEQ ID NO: 125590 - DNA, 19 bp, Artificial sequence
  SiRNA target sequence
caaaatctacaaaactttt

SEQ ID NO: 125591 - DNA, 19 bp, Artificial sequence
  SiRNA target sequence
aaaatctacaaaacttttt

SEQ ID NO: 125592 - DNA, 19 bp, Artificial sequence
  SiRNA target sequence
aaatctacaaaactttttc

SEQ ID NO: 125593 - DNA, 19 bp, Artificial sequence
  SiRNA target sequence
aatctacaaaactttttca

SEQ ID NO: 125594 - DNA, 19 bp, Artificial sequence
  SiRNA target sequence
atctacaaaactttttcat

SEQ ID NO: 125595 - DNA, 19 bp, Artificial sequence
  SiRNA target sequence
tctacaaaactttttcatg

SEQ ID NO: 125596 - DNA, 19 bp, Artificial sequence
  SiRNA target sequence
ctacaaaactttttcatgg

SEQ ID NO: 125597 - DNA, 19 bp, Artificial sequence
  SiRNA target sequence
tacaaaactttttcatggc

SEQ ID NO: 125598 - DNA, 19 bp, Artificial sequence
  SiRNA target sequence
acaaaactttttcatggcg

SEQ ID NO: 125599 - DNA, 19 bp, Artificial sequence
  SiRNA target sequence
caaaactttttcatggcgg

SEQ ID NO: 125600 - DNA, 19 bp, Artificial sequence
  SiRNA target sequence
aaaactttttcatggcggt

SEQ ID NO: 125601 - DNA, 19 bp, Artificial sequence
  SiRNA target sequence
aaactttttcatggcggtg

SEQ ID NO: 125602 - DNA, 19 bp, Artificial sequence
  SiRNA target sequence
aactttttcatggcggtgt

SEQ ID NO: 125603 - DNA, 19 bp, Artificial sequence
  SiRNA target sequence
actttttcatggcggtgta

SEQ ID NO: 125604 - DNA, 19 bp, Artificial sequence
  SiRNA target sequence
ctttttcatggcggtgtac

SEQ ID NO: 125605 - DNA, 19 bp, Artificial sequence
  SiRNA target sequence
tttttcatggcggtgtacg

SEQ ID NO: 125606 - DNA, 19 bp, Artificial sequence
  SiRNA target sequence
ttttcatggcggtgtacgc

SEQ ID NO: 125607 - DNA, 19 bp, Artificial sequence
  SiRNA target sequence
tttcatggcggtgtacgct

SEQ ID NO: 125608 - DNA, 19 bp, Artificial sequence
  SiRNA target sequence
ttcatggcggtgtacgcta

SEQ ID NO: 125609 - DNA, 19 bp, Artificial sequence
  SiRNA target sequence
tcatggcggtgtacgctac

SEQ ID NO: 125610 - DNA, 19 bp, Artificial sequence
  SiRNA target sequence
catggcggtgtacgctacc

SEQ ID NO: 125611 - DNA, 19 bp, Artificial sequence
  SiRNA target sequence
atggcggtgtacgctacct

SEQ ID NO: 125612 - DNA, 19 bp, Artificial sequence
  SiRNA target sequence
tggcggtgtacgctacctt

SEQ ID NO: 125613 - DNA, 19 bp, Artificial sequence
  SiRNA target sequence
ggcggtgtacgctaccttg

SEQ ID NO: 125614 - DNA, 19 bp, Artificial sequence
  SiRNA target sequence
gcggtgtacgctaccttga

SEQ ID NO: 125615 - DNA, 19 bp, Artificial sequence
  SiRNA target sequence
cggtgtacgctaccttgaa

SEQ ID NO: 125616 - DNA, 19 bp, Artificial sequence
  SiRNA target sequence
ggtgtacgctaccttgaaa

SEQ ID NO: 125617 - DNA, 19 bp, Artificial sequence
  SiRNA target sequence
gtgtacgctaccttgaaaa

SEQ ID NO: 125618 - DNA, 19 bp, Artificial sequence
  SiRNA target sequence
tgtacgctaccttgaaaaa

SEQ ID NO: 125619 - DNA, 19 bp, Artificial sequence
  SiRNA target sequence
gtacgctaccttgaaaaag

SEQ ID NO: 125620 - DNA, 19 bp, Artificial sequence
  SiRNA target sequence
tacgctaccttgaaaaagc

SEQ ID NO: 125621 - DNA, 19 bp, Artificial sequence
  SiRNA target sequence
acgctaccttgaaaaagct

SEQ ID NO: 125622 - DNA, 19 bp, Artificial sequence
  SiRNA target sequence
cgctaccttgaaaaagctg

SEQ ID NO: 125623 - DNA, 19 bp, Artificial sequence
  SiRNA target sequence
gctaccttgaaaaagctgt

SEQ ID NO: 125624 - DNA, 19 bp, Artificial sequence
  SiRNA target sequence
ctaccttgaaaaagctgtt

SEQ ID NO: 125625 - DNA, 19 bp, Artificial sequence
  SiRNA target sequence
taccttgaaaaagctgtta

SEQ ID NO: 125626 - DNA, 19 bp, Artificial sequence
  SiRNA target sequence
accttgaaaaagctgttaa

SEQ ID NO: 125627 - DNA, 19 bp, Artificial sequence
  SiRNA target sequence
ccttgaaaaagctgttaat

SEQ ID NO: 125628 - DNA, 19 bp, Artificial sequence
  SiRNA target sequence
cttgaaaaagctgttaatg

SEQ ID NO: 125629 - DNA, 19 bp, Artificial sequence
  SiRNA target sequence
ttgaaaaagctgttaatga

SEQ ID NO: 125630 - DNA, 19 bp, Artificial sequence
  SiRNA target sequence
tgaaaaagctgttaatgat

SEQ ID NO: 125631 - DNA, 19 bp, Artificial sequence
  SiRNA target sequence
gaaaaagctgttaatgatt

SEQ ID NO: 125632 - DNA, 19 bp, Artificial sequence
  SiRNA target sequence
aaaaagctgttaatgattt

SEQ ID NO: 125633 - DNA, 19 bp, Artificial sequence
  SiRNA target sequence
aaaagctgttaatgattta

SEQ ID NO: 125634 - DNA, 19 bp, Artificial sequence
  SiRNA target sequence
aaagctgttaatgatttag

SEQ ID NO: 125635 - DNA, 19 bp, Artificial sequence
  SiRNA target sequence
aagctgttaatgatttaga

SEQ ID NO: 125636 - DNA, 19 bp, Artificial sequence
  SiRNA target sequence
agctgttaatgatttagat

SEQ ID NO: 125637 - DNA, 19 bp, Artificial sequence
  SiRNA target sequence
gctgttaatgatttagata

SEQ ID NO: 125638 - DNA, 19 bp, Artificial sequence
  SiRNA target sequence
ctgttaatgatttagatag

SEQ ID NO: 125639 - DNA, 19 bp, Artificial sequence
  SiRNA target sequence
tgttaatgatttagataga

SEQ ID NO: 125640 - DNA, 19 bp, Artificial sequence
  SiRNA target sequence
gttaatgatttagatagat

SEQ ID NO: 125641 - DNA, 19 bp, Artificial sequence
  SiRNA target sequence
ttaatgatttagatagatc

SEQ ID NO: 125642 - DNA, 19 bp, Artificial sequence
  SiRNA target sequence
taatgatttagatagatct

SEQ ID NO: 125643 - DNA, 19 bp, Artificial sequence
  SiRNA target sequence
aatgatttagatagatctc

SEQ ID NO: 125644 - DNA, 19 bp, Artificial sequence
  SiRNA target sequence
atgatttagatagatctca

SEQ ID NO: 125645 - DNA, 19 bp, Artificial sequence
  SiRNA target sequence
tgatttagatagatctcag

SEQ ID NO: 125646 - DNA, 19 bp, Artificial sequence
  SiRNA target sequence
gatttagatagatctcagt

SEQ ID NO: 125647 - DNA, 19 bp, Artificial sequence
  SiRNA target sequence
atttagatagatctcagtt

SEQ ID NO: 125648 - DNA, 19 bp, Artificial sequence
  SiRNA target sequence
tttagatagatctcagttt

SEQ ID NO: 125649 - DNA, 19 bp, Artificial sequence
  SiRNA target sequence
ttagatagatctcagtttg

SEQ ID NO: 125650 - DNA, 19 bp, Artificial sequence
  SiRNA target sequence
tagatagatctcagtttga

SEQ ID NO: 125651 - DNA, 19 bp, Artificial sequence
  SiRNA target sequence
agatagatctcagtttgac

SEQ ID NO: 125652 - DNA, 19 bp, Artificial sequence
  SiRNA target sequence
gatagatctcagtttgact

SEQ ID NO: 125653 - DNA, 19 bp, Artificial sequence
  SiRNA target sequence
atagatctcagtttgactt

SEQ ID NO: 125654 - DNA, 19 bp, Artificial sequence
  SiRNA target sequence
tagatctcagtttgacttg

SEQ ID NO: 125655 - DNA, 19 bp, Artificial sequence
  SiRNA target sequence
agatctcagtttgacttgg

SEQ ID NO: 125656 - DNA, 19 bp, Artificial sequence
  SiRNA target sequence
gatctcagtttgacttggt

SEQ ID NO: 125657 - DNA, 19 bp, Artificial sequence
  SiRNA target sequence
atctcagtttgacttggta

SEQ ID NO: 125658 - DNA, 19 bp, Artificial sequence
  SiRNA target sequence
tctcagtttgacttggtat

SEQ ID NO: 125659 - DNA, 19 bp, Artificial sequence
  SiRNA target sequence
ctcagtttgacttggtatc

SEQ ID NO: 125660 - DNA, 19 bp, Artificial sequence
  SiRNA target sequence
tcagtttgacttggtatct

SEQ ID NO: 125661 - DNA, 19 bp, Artificial sequence
  SiRNA target sequence
cagtttgacttggtatctg

SEQ ID NO: 125662 - DNA, 19 bp, Artificial sequence
  SiRNA target sequence
agtttgacttggtatctga

SEQ ID NO: 125663 - DNA, 19 bp, Artificial sequence
  SiRNA target sequence
gtttgacttggtatctgaa

SEQ ID NO: 125664 - DNA, 19 bp, Artificial sequence
  SiRNA target sequence
tttgacttggtatctgaag

SEQ ID NO: 125665 - DNA, 19 bp, Artificial sequence
  SiRNA target sequence
ttgacttggtatctgaagc

SEQ ID NO: 125666 - DNA, 19 bp, Artificial sequence
  SiRNA target sequence
tgacttggtatctgaagca

SEQ ID NO: 125667 - DNA, 19 bp, Artificial sequence
  SiRNA target sequence
gacttggtatctgaagcat

SEQ ID NO: 125668 - DNA, 19 bp, Artificial sequence
  SiRNA target sequence
acttggtatctgaagcatt

SEQ ID NO: 125669 - DNA, 19 bp, Artificial sequence
  SiRNA target sequence
cttggtatctgaagcatta

SEQ ID NO: 125670 - DNA, 19 bp, Artificial sequence
  SiRNA target sequence
ttggtatctgaagcattaa

SEQ ID NO: 125671 - DNA, 19 bp, Artificial sequence
  SiRNA target sequence
tggtatctgaagcattaag

SEQ ID NO: 125672 - DNA, 19 bp, Artificial sequence
  SiRNA target sequence
ggtatctgaagcattaagt

SEQ ID NO: 125673 - DNA, 19 bp, Artificial sequence
  SiRNA target sequence
gtatctgaagcattaagtg

SEQ ID NO: 125674 - DNA, 19 bp, Artificial sequence
  SiRNA target sequence
tatctgaagcattaagtga

SEQ ID NO: 125675 - DNA, 19 bp, Artificial sequence
  SiRNA target sequence
atctgaagcattaagtgaa

SEQ ID NO: 125676 - DNA, 19 bp, Artificial sequence
  SiRNA target sequence
tctgaagcattaagtgaac

SEQ ID NO: 125677 - DNA, 19 bp, Artificial sequence
  SiRNA target sequence
ctgaagcattaagtgaacg

SEQ ID NO: 125678 - DNA, 19 bp, Artificial sequence
  SiRNA target sequence
tgaagcattaagtgaacga

SEQ ID NO: 125679 - DNA, 19 bp, Artificial sequence
  SiRNA target sequence
gaagcattaagtgaacgaa

SEQ ID NO: 125680 - DNA, 19 bp, Artificial sequence
  SiRNA target sequence
aagcattaagtgaacgaaa

SEQ ID NO: 125681 - DNA, 19 bp, Artificial sequence
  SiRNA target sequence
agcattaagtgaacgaaaa

SEQ ID NO: 125682 - DNA, 19 bp, Artificial sequence
  SiRNA target sequence
gcattaagtgaacgaaaaa

SEQ ID NO: 125683 - DNA, 19 bp, Artificial sequence
  SiRNA target sequence
cattaagtgaacgaaaaat

SEQ ID NO: 125684 - DNA, 19 bp, Artificial sequence
  SiRNA target sequence
attaagtgaacgaaaaatt

SEQ ID NO: 125685 - DNA, 19 bp, Artificial sequence
  SiRNA target sequence
ttaagtgaacgaaaaattg

SEQ ID NO: 125686 - DNA, 19 bp, Artificial sequence
  SiRNA target sequence
taagtgaacgaaaaattgt

SEQ ID NO: 125687 - DNA, 19 bp, Artificial sequence
  SiRNA target sequence
aagtgaacgaaaaattgtt

SEQ ID NO: 125688 - DNA, 19 bp, Artificial sequence
  SiRNA target sequence
agtgaacgaaaaattgtta

SEQ ID NO: 125689 - DNA, 19 bp, Artificial sequence
  SiRNA target sequence
gtgaacgaaaaattgttat

SEQ ID NO: 125690 - DNA, 19 bp, Artificial sequence
  SiRNA target sequence
tgaacgaaaaattgttatg

SEQ ID NO: 125691 - DNA, 19 bp, Artificial sequence
  SiRNA target sequence
gaacgaaaaattgttatga

SEQ ID NO: 125692 - DNA, 19 bp, Artificial sequence
  SiRNA target sequence
aacgaaaaattgttatgaa

SEQ ID NO: 125693 - DNA, 19 bp, Artificial sequence
  SiRNA target sequence
acgaaaaattgttatgaat

SEQ ID NO: 125694 - DNA, 19 bp, Artificial sequence
  SiRNA target sequence
cgaaaaattgttatgaata

SEQ ID NO: 125695 - DNA, 19 bp, Artificial sequence
  SiRNA target sequence
gaaaaattgttatgaatat

SEQ ID NO: 125696 - DNA, 19 bp, Artificial sequence
  SiRNA target sequence
aaaaattgttatgaatatg

SEQ ID NO: 125697 - DNA, 19 bp, Artificial sequence
  SiRNA target sequence
aaaattgttatgaatatgt

SEQ ID NO: 125698 - DNA, 19 bp, Artificial sequence
  SiRNA target sequence
aaattgttatgaatatgtg

SEQ ID NO: 125699 - DNA, 19 bp, Artificial sequence
  SiRNA target sequence
aattgttatgaatatgtgt

SEQ ID NO: 125700 - DNA, 19 bp, Artificial sequence
  SiRNA target sequence
attgttatgaatatgtgtc

SEQ ID NO: 125701 - DNA, 19 bp, Artificial sequence
  SiRNA target sequence
ttgttatgaatatgtgtcc

SEQ ID NO: 125702 - DNA, 19 bp, Artificial sequence
  SiRNA target sequence
tgttatgaatatgtgtcct

SEQ ID NO: 125703 - DNA, 19 bp, Artificial sequence
  SiRNA target sequence
gttatgaatatgtgtcctt

SEQ ID NO: 125704 - DNA, 19 bp, Artificial sequence
  SiRNA target sequence
ttatgaatatgtgtccttt

SEQ ID NO: 125705 - DNA, 19 bp, Artificial sequence
  SiRNA target sequence
tatgaatatgtgtcctttt

SEQ ID NO: 125706 - DNA, 19 bp, Artificial sequence
  SiRNA target sequence
atgaatatgtgtccttttc

SEQ ID NO: 125707 - DNA, 19 bp, Artificial sequence
  SiRNA target sequence
tgaatatgtgtccttttct

SEQ ID NO: 125708 - DNA, 19 bp, Artificial sequence
  SiRNA target sequence
gaatatgtgtccttttcta

SEQ ID NO: 125709 - DNA, 19 bp, Artificial sequence
  SiRNA target sequence
aatatgtgtccttttctag

SEQ ID NO: 125710 - DNA, 19 bp, Artificial sequence
  SiRNA target sequence
atatgtgtccttttctagt

SEQ ID NO: 125711 - DNA, 19 bp, Artificial sequence
  SiRNA target sequence
tatgtgtccttttctagta

SEQ ID NO: 125712 - DNA, 19 bp, Artificial sequence
  SiRNA target sequence
atgtgtccttttctagtaa

SEQ ID NO: 125713 - DNA, 19 bp, Artificial sequence
  SiRNA target sequence
tgtgtccttttctagtaag

SEQ ID NO: 125714 - DNA, 19 bp, Artificial sequence
  SiRNA target sequence
gtgtccttttctagtaagg

SEQ ID NO: 125715 - DNA, 19 bp, Artificial sequence
  SiRNA target sequence
tgtccttttctagtaaggt

SEQ ID NO: 125716 - DNA, 19 bp, Artificial sequence
  SiRNA target sequence
gtccttttctagtaaggtc

SEQ ID NO: 125717 - DNA, 19 bp, Artificial sequence
  SiRNA target sequence
tccttttctagtaaggtcg

SEQ ID NO: 125718 - DNA, 19 bp, Artificial sequence
  SiRNA target sequence
ccttttctagtaaggtcga

SEQ ID NO: 125719 - DNA, 19 bp, Artificial sequence
  SiRNA target sequence
cttttctagtaaggtcgat

SEQ ID NO: 125720 - DNA, 19 bp, Artificial sequence
  SiRNA target sequence
ttttctagtaaggtcgatg

SEQ ID NO: 125721 - DNA, 19 bp, Artificial sequence
  SiRNA target sequence
tttctagtaaggtcgatgg

SEQ ID NO: 125722 - DNA, 19 bp, Artificial sequence
  SiRNA target sequence
ttctagtaaggtcgatgga

SEQ ID NO: 125723 - DNA, 19 bp, Artificial sequence
  SiRNA target sequence
tctagtaaggtcgatggaa

SEQ ID NO: 125724 - DNA, 19 bp, Artificial sequence
  SiRNA target sequence
ctagtaaggtcgatggaaa

SEQ ID NO: 125725 - DNA, 19 bp, Artificial sequence
  SiRNA target sequence
tagtaaggtcgatggaaat

SEQ ID NO: 125726 - DNA, 19 bp, Artificial sequence
  SiRNA target sequence
agtaaggtcgatggaaata

SEQ ID NO: 125727 - DNA, 19 bp, Artificial sequence
  SiRNA target sequence
gtaaggtcgatggaaatat

SEQ ID NO: 125728 - DNA, 19 bp, Artificial sequence
  SiRNA target sequence
taaggtcgatggaaatatt

SEQ ID NO: 125729 - DNA, 19 bp, Artificial sequence
  SiRNA target sequence
aaggtcgatggaaatatta

SEQ ID NO: 125730 - DNA, 19 bp, Artificial sequence
  SiRNA target sequence
aggtcgatggaaatattat

SEQ ID NO: 125731 - DNA, 19 bp, Artificial sequence
  SiRNA target sequence
ggtcgatggaaatattatt

SEQ ID NO: 125732 - DNA, 19 bp, Artificial sequence
  SiRNA target sequence
gtcgatggaaatattattt

SEQ ID NO: 125733 - DNA, 19 bp, Artificial sequence
  SiRNA target sequence
tcgatggaaatattatttc

SEQ ID NO: 125734 - DNA, 19 bp, Artificial sequence
  SiRNA target sequence
cgatggaaatattatttcc

SEQ ID NO: 125735 - DNA, 19 bp, Artificial sequence
  SiRNA target sequence
gatggaaatattatttccg

SEQ ID NO: 125736 - DNA, 19 bp, Artificial sequence
  SiRNA target sequence
atggaaatattatttccgg

SEQ ID NO: 125737 - DNA, 19 bp, Artificial sequence
  SiRNA target sequence
tggaaatattatttccggt

SEQ ID NO: 125738 - DNA, 19 bp, Artificial sequence
  SiRNA target sequence
ggaaatattatttccggtt

SEQ ID NO: 125739 - DNA, 19 bp, Artificial sequence
  SiRNA target sequence
gaaatattatttccggttt

SEQ ID NO: 125740 - DNA, 19 bp, Artificial sequence
  SiRNA target sequence
aaatattatttccggttta

SEQ ID NO: 125741 - DNA, 19 bp, Artificial sequence
  SiRNA target sequence
aatattatttccggtttat

SEQ ID NO: 125742 - DNA, 19 bp, Artificial sequence
  SiRNA target sequence
atattatttccggtttata

SEQ ID NO: 125743 - DNA, 19 bp, Artificial sequence
  SiRNA target sequence
tattatttccggtttataa

SEQ ID NO: 125744 - DNA, 19 bp, Artificial sequence
  SiRNA target sequence
attatttccggtttataaa

SEQ ID NO: 125745 - DNA, 19 bp, Artificial sequence
  SiRNA target sequence
ttatttccggtttataaaa

SEQ ID NO: 125746 - DNA, 19 bp, Artificial sequence
  SiRNA target sequence
tatttccggtttataaaag

SEQ ID NO: 125747 - DNA, 19 bp, Artificial sequence
  SiRNA target sequence
atttccggtttataaaagg

SEQ ID NO: 125748 - DNA, 19 bp, Artificial sequence
  SiRNA target sequence
tttccggtttataaaaggc

SEQ ID NO: 125749 - DNA, 19 bp, Artificial sequence
  SiRNA target sequence
ttccggtttataaaaggct

SEQ ID NO: 125750 - DNA, 19 bp, Artificial sequence
  SiRNA target sequence
tccggtttataaaaggctt

SEQ ID NO: 125751 - DNA, 19 bp, Artificial sequence
  SiRNA target sequence
ccggtttataaaaggcttt

SEQ ID NO: 125752 - DNA, 19 bp, Artificial sequence
  SiRNA target sequence
cggtttataaaaggctttt

SEQ ID NO: 125753 - DNA, 19 bp, Artificial sequence
  SiRNA target sequence
ggtttataaaaggctttta

SEQ ID NO: 125754 - DNA, 19 bp, Artificial sequence
  SiRNA target sequence
gtttataaaaggcttttaa

SEQ ID NO: 125755 - DNA, 19 bp, Artificial sequence
  SiRNA target sequence
tttataaaaggcttttaat

SEQ ID NO: 125756 - DNA, 19 bp, Artificial sequence
  SiRNA target sequence
ttataaaaggcttttaatt

SEQ ID NO: 125757 - DNA, 19 bp, Artificial sequence
  SiRNA target sequence
tataaaaggcttttaattc

SEQ ID NO: 125758 - DNA, 19 bp, Artificial sequence
  SiRNA target sequence
ataaaaggcttttaattcc

SEQ ID NO: 125759 - DNA, 19 bp, Artificial sequence
  SiRNA target sequence
taaaaggcttttaattcct

SEQ ID NO: 125760 - DNA, 19 bp, Artificial sequence
  SiRNA target sequence
aaaaggcttttaattcctt

SEQ ID NO: 125761 - DNA, 19 bp, Artificial sequence
  SiRNA target sequence
aaaggcttttaattcctta

SEQ ID NO: 125762 - DNA, 19 bp, Artificial sequence
  SiRNA target sequence
aaggcttttaattccttac

SEQ ID NO: 125763 - DNA, 19 bp, Artificial sequence
  SiRNA target sequence
aggcttttaattccttact

SEQ ID NO: 125764 - DNA, 19 bp, Artificial sequence
  SiRNA target sequence
ggcttttaattccttacta

SEQ ID NO: 125765 - DNA, 19 bp, Artificial sequence
  SiRNA target sequence
gcttttaattccttactac

SEQ ID NO: 125766 - DNA, 19 bp, Artificial sequence
  SiRNA target sequence
cttttaattccttactact

SEQ ID NO: 125767 - DNA, 19 bp, Artificial sequence
  SiRNA target sequence
ttttaattccttactacta

SEQ ID NO: 125768 - DNA, 19 bp, Artificial sequence
  SiRNA target sequence
tttaattccttactactat

SEQ ID NO: 125769 - DNA, 19 bp, Artificial sequence
  SiRNA target sequence
ttaattccttactactata

SEQ ID NO: 125770 - DNA, 19 bp, Artificial sequence
  SiRNA target sequence
taattccttactactatat

SEQ ID NO: 125771 - DNA, 19 bp, Artificial sequence
  SiRNA target sequence
aattccttactactatatt

SEQ ID NO: 125772 - DNA, 19 bp, Artificial sequence
  SiRNA target sequence
attccttactactatattg

SEQ ID NO: 125773 - DNA, 19 bp, Artificial sequence
  SiRNA target sequence
ttccttactactatattgg

SEQ ID NO: 125774 - DNA, 19 bp, Artificial sequence
  SiRNA target sequence
tccttactactatattggc

SEQ ID NO: 125775 - DNA, 19 bp, Artificial sequence
  SiRNA target sequence
ccttactactatattggcc

SEQ ID NO: 125776 - DNA, 19 bp, Artificial sequence
  SiRNA target sequence
cttactactatattggcct

SEQ ID NO: 125777 - DNA, 19 bp, Artificial sequence
  SiRNA target sequence
ttactactatattggcctt

SEQ ID NO: 125778 - DNA, 19 bp, Artificial sequence
  SiRNA target sequence
tactactatattggcctta

SEQ ID NO: 125779 - DNA, 19 bp, Artificial sequence
  SiRNA target sequence
actactatattggccttaa

SEQ ID NO: 125780 - DNA, 19 bp, Artificial sequence
  SiRNA target sequence
ctactatattggccttaaa

SEQ ID NO: 125781 - DNA, 19 bp, Artificial sequence
  SiRNA target sequence
tactatattggccttaaat

SEQ ID NO: 125782 - DNA, 19 bp, Artificial sequence
  SiRNA target sequence
actatattggccttaaatt

SEQ ID NO: 125783 - DNA, 19 bp, Artificial sequence
  SiRNA target sequence
ctatattggccttaaattt

SEQ ID NO: 125784 - DNA, 19 bp, Artificial sequence
  SiRNA target sequence
tatattggccttaaatttt

SEQ ID NO: 125785 - DNA, 19 bp, Artificial sequence
  SiRNA target sequence
atattggccttaaatttta

SEQ ID NO: 125786 - DNA, 19 bp, Artificial sequence
  SiRNA target sequence
tattggccttaaattttat

SEQ ID NO: 125787 - DNA, 19 bp, Artificial sequence
  SiRNA target sequence
attggccttaaattttatg

SEQ ID NO: 125788 - DNA, 19 bp, Artificial sequence
  SiRNA target sequence
ttggccttaaattttatga

SEQ ID NO: 125789 - DNA, 19 bp, Artificial sequence
  SiRNA target sequence
tggccttaaattttatgat

SEQ ID NO: 125790 - DNA, 19 bp, Artificial sequence
  SiRNA target sequence
ggccttaaattttatgatt

SEQ ID NO: 125791 - DNA, 19 bp, Artificial sequence
  SiRNA target sequence
gccttaaattttatgattg

SEQ ID NO: 125792 - DNA, 19 bp, Artificial sequence
  SiRNA target sequence
ccttaaattttatgattgg

SEQ ID NO: 125793 - DNA, 19 bp, Artificial sequence
  SiRNA target sequence
cttaaattttatgattgga

SEQ ID NO: 125794 - DNA, 19 bp, Artificial sequence
  SiRNA target sequence
ttaaattttatgattggat

SEQ ID NO: 125795 - DNA, 19 bp, Artificial sequence
  SiRNA target sequence
taaattttatgattggatt

SEQ ID NO: 125796 - DNA, 19 bp, Artificial sequence
  SiRNA target sequence
aaattttatgattggattt

SEQ ID NO: 125797 - DNA, 19 bp, Artificial sequence
  SiRNA target sequence
aattttatgattggatttc

SEQ ID NO: 125798 - DNA, 19 bp, Artificial sequence
  SiRNA target sequence
attttatgattggatttct

SEQ ID NO: 125799 - DNA, 19 bp, Artificial sequence
  SiRNA target sequence
ttttatgattggatttctg

SEQ ID NO: 125800 - DNA, 19 bp, Artificial sequence
  SiRNA target sequence
tttatgattggatttctgg

SEQ ID NO: 125801 - DNA, 19 bp, Artificial sequence
  SiRNA target sequence
ttatgattggatttctggg

SEQ ID NO: 125802 - DNA, 19 bp, Artificial sequence
  SiRNA target sequence
tatgattggatttctgggc

SEQ ID NO: 125803 - DNA, 19 bp, Artificial sequence
  SiRNA target sequence
atgattggatttctgggca

SEQ ID NO: 125804 - DNA, 19 bp, Artificial sequence
  SiRNA target sequence
tgattggatttctgggcaa

SEQ ID NO: 125805 - DNA, 19 bp, Artificial sequence
  SiRNA target sequence
gattggatttctgggcaac

SEQ ID NO: 125806 - DNA, 19 bp, Artificial sequence
  SiRNA target sequence
attggatttctgggcaacg

SEQ ID NO: 125807 - DNA, 19 bp, Artificial sequence
  SiRNA target sequence
ttggatttctgggcaacgg

SEQ ID NO: 125808 - DNA, 19 bp, Artificial sequence
  SiRNA target sequence
tggatttctgggcaacggt

SEQ ID NO: 125809 - DNA, 19 bp, Artificial sequence
  SiRNA target sequence
ggatttctgggcaacggtc

SEQ ID NO: 125810 - DNA, 19 bp, Artificial sequence
  SiRNA target sequence
gatttctgggcaacggtcc

SEQ ID NO: 125811 - DNA, 19 bp, Artificial sequence
  SiRNA target sequence
atttctgggcaacggtccc

SEQ ID NO: 125812 - DNA, 19 bp, Artificial sequence
  SiRNA target sequence
tttctgggcaacggtccct

SEQ ID NO: 125813 - DNA, 19 bp, Artificial sequence
  SiRNA target sequence
ttctgggcaacggtccctt

SEQ ID NO: 125814 - DNA, 19 bp, Artificial sequence
  SiRNA target sequence
tctgggcaacggtcccttg

SEQ ID NO: 125815 - DNA, 19 bp, Artificial sequence
  SiRNA target sequence
ctgggcaacggtcccttgg

SEQ ID NO: 125816 - DNA, 19 bp, Artificial sequence
  SiRNA target sequence
tgggcaacggtcccttggg

SEQ ID NO: 125817 - DNA, 19 bp, Artificial sequence
  SiRNA target sequence
gggcaacggtcccttgggc

SEQ ID NO: 125818 - DNA, 19 bp, Artificial sequence
  SiRNA target sequence
ggcaacggtcccttgggcg

SEQ ID NO: 125819 - DNA, 19 bp, Artificial sequence
  SiRNA target sequence
gcaacggtcccttgggcga

SEQ ID NO: 125820 - DNA, 19 bp, Artificial sequence
  SiRNA target sequence
caacggtcccttgggcgaa

SEQ ID NO: 125821 - DNA, 19 bp, Artificial sequence
  SiRNA target sequence
aacggtcccttgggcgaag

SEQ ID NO: 125822 - DNA, 19 bp, Artificial sequence
  SiRNA target sequence
acggtcccttgggcgaagt

SEQ ID NO: 125823 - DNA, 19 bp, Artificial sequence
  SiRNA target sequence
cggtcccttgggcgaagta

SEQ ID NO: 125824 - DNA, 19 bp, Artificial sequence
  SiRNA target sequence
ggtcccttgggcgaagtaa

SEQ ID NO: 125825 - DNA, 19 bp, Artificial sequence
  SiRNA target sequence
gtcccttgggcgaagtaaa

SEQ ID NO: 125826 - DNA, 19 bp, Artificial sequence
  SiRNA target sequence
tcccttgggcgaagtaaat

SEQ ID NO: 125827 - DNA, 19 bp, Artificial sequence
  SiRNA target sequence
cccttgggcgaagtaaatt

SEQ ID NO: 125828 - DNA, 19 bp, Artificial sequence
  SiRNA target sequence
ccttgggcgaagtaaattt

SEQ ID NO: 125829 - DNA, 19 bp, Artificial sequence
  SiRNA target sequence
cttgggcgaagtaaatttt

SEQ ID NO: 125830 - DNA, 19 bp, Artificial sequence
  SiRNA target sequence
ttgggcgaagtaaattttt

SEQ ID NO: 125831 - DNA, 19 bp, Artificial sequence
  SiRNA target sequence
tgggcgaagtaaatttttg

SEQ ID NO: 125832 - DNA, 19 bp, Artificial sequence
  SiRNA target sequence
gggcgaagtaaatttttgt

SEQ ID NO: 125833 - DNA, 19 bp, Artificial sequence
  SiRNA target sequence
ggcgaagtaaatttttgtc

SEQ ID NO: 125834 - DNA, 19 bp, Artificial sequence
  SiRNA target sequence
gcgaagtaaatttttgtcg

SEQ ID NO: 125835 - DNA, 19 bp, Artificial sequence
  SiRNA target sequence
cgaagtaaatttttgtcgc

SEQ ID NO: 125836 - DNA, 19 bp, Artificial sequence
  SiRNA target sequence
gaagtaaatttttgtcgcg

SEQ ID NO: 125837 - DNA, 19 bp, Artificial sequence
  SiRNA target sequence
aagtaaatttttgtcgcgg

SEQ ID NO: 125838 - DNA, 19 bp, Artificial sequence
  SiRNA target sequence
agtaaatttttgtcgcggc

SEQ ID NO: 125839 - DNA, 19 bp, Artificial sequence
  SiRNA target sequence
gtaaatttttgtcgcggca

SEQ ID NO: 125840 - DNA, 19 bp, Artificial sequence
  SiRNA target sequence
taaatttttgtcgcggcaa

SEQ ID NO: 125841 - DNA, 19 bp, Artificial sequence
  SiRNA target sequence
aaatttttgtcgcggcaac

SEQ ID NO: 125842 - DNA, 19 bp, Artificial sequence
  SiRNA target sequence
aatttttgtcgcggcaaca

SEQ ID NO: 125843 - DNA, 19 bp, Artificial sequence
  SiRNA target sequence
atttttgtcgcggcaacaa

SEQ ID NO: 125844 - DNA, 19 bp, Artificial sequence
  SiRNA target sequence
tttttgtcgcggcaacaaa

SEQ ID NO: 125845 - DNA, 19 bp, Artificial sequence
  SiRNA target sequence
ttttgtcgcggcaacaaac

SEQ ID NO: 125846 - DNA, 19 bp, Artificial sequence
  SiRNA target sequence
tttgtcgcggcaacaaact

SEQ ID NO: 125847 - DNA, 19 bp, Artificial sequence
  SiRNA target sequence
ttgtcgcggcaacaaacta

SEQ ID NO: 125848 - DNA, 19 bp, Artificial sequence
  SiRNA target sequence
tgtcgcggcaacaaactat

SEQ ID NO: 125849 - DNA, 19 bp, Artificial sequence
  SiRNA target sequence
gtcgcggcaacaaactatt

SEQ ID NO: 125850 - DNA, 19 bp, Artificial sequence
  SiRNA target sequence
tcgcggcaacaaactatta

SEQ ID NO: 125851 - DNA, 19 bp, Artificial sequence
  SiRNA target sequence
cgcggcaacaaactattac

SEQ ID NO: 125852 - DNA, 19 bp, Artificial sequence
  SiRNA target sequence
gcggcaacaaactattaca

SEQ ID NO: 125853 - DNA, 19 bp, Artificial sequence
  SiRNA target sequence
cggcaacaaactattacaa

SEQ ID NO: 125854 - DNA, 19 bp, Artificial sequence
  SiRNA target sequence
ggcaacaaactattacaaa

SEQ ID NO: 125855 - DNA, 19 bp, Artificial sequence
  SiRNA target sequence
gcaacaaactattacaaaa

SEQ ID NO: 125856 - DNA, 19 bp, Artificial sequence
  SiRNA target sequence
caacaaactattacaaaat

SEQ ID NO: 125857 - DNA, 19 bp, Artificial sequence
  SiRNA target sequence
aacaaactattacaaaatt

SEQ ID NO: 125858 - DNA, 19 bp, Artificial sequence
  SiRNA target sequence
acaaactattacaaaattt

SEQ ID NO: 125859 - DNA, 19 bp, Artificial sequence
  SiRNA target sequence
caaactattacaaaatttc

SEQ ID NO: 125860 - DNA, 19 bp, Artificial sequence
  SiRNA target sequence
aaactattacaaaatttcc

SEQ ID NO: 125861 - DNA, 19 bp, Artificial sequence
  SiRNA target sequence
aactattacaaaatttcct

SEQ ID NO: 125862 - DNA, 19 bp, Artificial sequence
  SiRNA target sequence
actattacaaaatttccta

SEQ ID NO: 125863 - DNA, 19 bp, Artificial sequence
  SiRNA target sequence
ctattacaaaatttcctaa

SEQ ID NO: 125864 - DNA, 19 bp, Artificial sequence
  SiRNA target sequence
tattacaaaatttcctaat

SEQ ID NO: 125865 - DNA, 19 bp, Artificial sequence
  SiRNA target sequence
attacaaaatttcctaatg

SEQ ID NO: 125866 - DNA, 19 bp, Artificial sequence
  SiRNA target sequence
ttacaaaatttcctaatgt

SEQ ID NO: 125867 - DNA, 19 bp, Artificial sequence
  SiRNA target sequence
tacaaaatttcctaatgtg

SEQ ID NO: 125868 - DNA, 19 bp, Artificial sequence
  SiRNA target sequence
acaaaatttcctaatgtga

SEQ ID NO: 125869 - DNA, 19 bp, Artificial sequence
  SiRNA target sequence
caaaatttcctaatgtgag

SEQ ID NO: 125870 - DNA, 19 bp, Artificial sequence
  SiRNA target sequence
aaaatttcctaatgtgaga

SEQ ID NO: 125871 - DNA, 19 bp, Artificial sequence
  SiRNA target sequence
aaatttcctaatgtgagaa

SEQ ID NO: 125872 - DNA, 19 bp, Artificial sequence
  SiRNA target sequence
aatttcctaatgtgagaaa

SEQ ID NO: 125873 - DNA, 19 bp, Artificial sequence
  SiRNA target sequence
atttcctaatgtgagaaaa

SEQ ID NO: 125874 - DNA, 19 bp, Artificial sequence
  SiRNA target sequence
tttcctaatgtgagaaaaa

SEQ ID NO: 125875 - DNA, 19 bp, Artificial sequence
  SiRNA target sequence
ttcctaatgtgagaaaaat

SEQ ID NO: 125876 - DNA, 19 bp, Artificial sequence
  SiRNA target sequence
tcctaatgtgagaaaaatc

SEQ ID NO: 125877 - DNA, 19 bp, Artificial sequence
  SiRNA target sequence
cctaatgtgagaaaaatcg

SEQ ID NO: 125878 - DNA, 19 bp, Artificial sequence
  SiRNA target sequence
ctaatgtgagaaaaatcga

SEQ ID NO: 125879 - DNA, 19 bp, Artificial sequence
  SiRNA target sequence
taatgtgagaaaaatcgac

SEQ ID NO: 125880 - DNA, 19 bp, Artificial sequence
  SiRNA target sequence
aatgtgagaaaaatcgacc

SEQ ID NO: 125881 - DNA, 19 bp, Artificial sequence
  SiRNA target sequence
atgtgagaaaaatcgacct

SEQ ID NO: 125882 - DNA, 19 bp, Artificial sequence
  SiRNA target sequence
tgtgagaaaaatcgacctt

SEQ ID NO: 125883 - DNA, 19 bp, Artificial sequence
  SiRNA target sequence
gtgagaaaaatcgaccttg

SEQ ID NO: 125884 - DNA, 19 bp, Artificial sequence
  SiRNA target sequence
tgagaaaaatcgaccttgt

SEQ ID NO: 125885 - DNA, 19 bp, Artificial sequence
  SiRNA target sequence
gagaaaaatcgaccttgta

SEQ ID NO: 125886 - DNA, 19 bp, Artificial sequence
  SiRNA target sequence
agaaaaatcgaccttgtag

SEQ ID NO: 125887 - DNA, 19 bp, Artificial sequence
  SiRNA target sequence
gaaaaatcgaccttgtagg

SEQ ID NO: 125888 - DNA, 19 bp, Artificial sequence
  SiRNA target sequence
aaaaatcgaccttgtagga

SEQ ID NO: 125889 - DNA, 19 bp, Artificial sequence
  SiRNA target sequence
aaaatcgaccttgtaggat

SEQ ID NO: 125890 - DNA, 19 bp, Artificial sequence
  SiRNA target sequence
aaatcgaccttgtaggatc

SEQ ID NO: 125891 - DNA, 19 bp, Artificial sequence
  SiRNA target sequence
aatcgaccttgtaggatcc

SEQ ID NO: 125892 - DNA, 19 bp, Artificial sequence
  SiRNA target sequence
atcgaccttgtaggatccg

SEQ ID NO: 125893 - DNA, 19 bp, Artificial sequence
  SiRNA target sequence
tcgaccttgtaggatccgt

SEQ ID NO: 125894 - DNA, 19 bp, Artificial sequence
  SiRNA target sequence
cgaccttgtaggatccgtt

SEQ ID NO: 125895 - DNA, 19 bp, Artificial sequence
  SiRNA target sequence
gaccttgtaggatccgttt

SEQ ID NO: 125896 - DNA, 19 bp, Artificial sequence
  SiRNA target sequence
accttgtaggatccgtttc

SEQ ID NO: 125897 - DNA, 19 bp, Artificial sequence
  SiRNA target sequence
ccttgtaggatccgtttcg

SEQ ID NO: 125898 - DNA, 19 bp, Artificial sequence
  SiRNA target sequence
cttgtaggatccgtttcgt

SEQ ID NO: 125899 - DNA, 19 bp, Artificial sequence
  SiRNA target sequence
ttgtaggatccgtttcgta

SEQ ID NO: 125900 - DNA, 19 bp, Artificial sequence
  SiRNA target sequence
tgtaggatccgtttcgtat

SEQ ID NO: 125901 - DNA, 19 bp, Artificial sequence
  SiRNA target sequence
gtaggatccgtttcgtatc

SEQ ID NO: 125902 - DNA, 19 bp, Artificial sequence
  SiRNA target sequence
taggatccgtttcgtatcg

SEQ ID NO: 125903 - DNA, 19 bp, Artificial sequence
  SiRNA target sequence
aggatccgtttcgtatcgt

SEQ ID NO: 125904 - DNA, 19 bp, Artificial sequence
  SiRNA target sequence
ggatccgtttcgtatcgtg

SEQ ID NO: 125905 - DNA, 19 bp, Artificial sequence
  SiRNA target sequence
gatccgtttcgtatcgtga

SEQ ID NO: 125906 - DNA, 19 bp, Artificial sequence
  SiRNA target sequence
atccgtttcgtatcgtgat

SEQ ID NO: 125907 - DNA, 19 bp, Artificial sequence
  SiRNA target sequence
tccgtttcgtatcgtgatg

SEQ ID NO: 125908 - DNA, 19 bp, Artificial sequence
  SiRNA target sequence
ccgtttcgtatcgtgatgg

SEQ ID NO: 125909 - DNA, 19 bp, Artificial sequence
  SiRNA target sequence
cgtttcgtatcgtgatggc

SEQ ID NO: 125910 - DNA, 19 bp, Artificial sequence
  SiRNA target sequence
gtttcgtatcgtgatggcc

SEQ ID NO: 125911 - DNA, 19 bp, Artificial sequence
  SiRNA target sequence
tttcgtatcgtgatggcca

SEQ ID NO: 125912 - DNA, 19 bp, Artificial sequence
  SiRNA target sequence
ttcgtatcgtgatggccaa

SEQ ID NO: 125913 - DNA, 19 bp, Artificial sequence
  SiRNA target sequence
tcgtatcgtgatggccaat

SEQ ID NO: 125914 - DNA, 19 bp, Artificial sequence
  SiRNA target sequence
cgtatcgtgatggccaatt

SEQ ID NO: 125915 - DNA, 19 bp, Artificial sequence
  SiRNA target sequence
gtatcgtgatggccaattt

SEQ ID NO: 125916 - DNA, 19 bp, Artificial sequence
  SiRNA target sequence
tatcgtgatggccaatttt

SEQ ID NO: 125917 - DNA, 19 bp, Artificial sequence
  SiRNA target sequence
atcgtgatggccaatttta

SEQ ID NO: 125918 - DNA, 19 bp, Artificial sequence
  SiRNA target sequence
tcgtgatggccaattttat

SEQ ID NO: 125919 - DNA, 19 bp, Artificial sequence
  SiRNA target sequence
cgtgatggccaattttatg

SEQ ID NO: 125920 - DNA, 19 bp, Artificial sequence
  SiRNA target sequence
gtgatggccaattttatga

SEQ ID NO: 125921 - DNA, 19 bp, Artificial sequence
  SiRNA target sequence
tgatggccaattttatgat

SEQ ID NO: 125922 - DNA, 19 bp, Artificial sequence
  SiRNA target sequence
gatggccaattttatgatg

SEQ ID NO: 125923 - DNA, 19 bp, Artificial sequence
  SiRNA target sequence
atggccaattttatgatgc

SEQ ID NO: 125924 - DNA, 19 bp, Artificial sequence
  SiRNA target sequence
tggccaattttatgatgct

SEQ ID NO: 125925 - DNA, 19 bp, Artificial sequence
  SiRNA target sequence
ggccaattttatgatgcta

SEQ ID NO: 125926 - DNA, 19 bp, Artificial sequence
  SiRNA target sequence
gccaattttatgatgctaa

SEQ ID NO: 125927 - DNA, 19 bp, Artificial sequence
  SiRNA target sequence
ccaattttatgatgctaaa

SEQ ID NO: 125928 - DNA, 19 bp, Artificial sequence
  SiRNA target sequence
caattttatgatgctaaat

SEQ ID NO: 125929 - DNA, 19 bp, Artificial sequence
  SiRNA target sequence
aattttatgatgctaaata

SEQ ID NO: 125930 - DNA, 19 bp, Artificial sequence
  SiRNA target sequence
attttatgatgctaaatac

SEQ ID NO: 125931 - DNA, 19 bp, Artificial sequence
  SiRNA target sequence
ttttatgatgctaaataca

SEQ ID NO: 125932 - DNA, 19 bp, Artificial sequence
  SiRNA target sequence
tttatgatgctaaatacaa

SEQ ID NO: 125933 - DNA, 19 bp, Artificial sequence
  SiRNA target sequence
ttatgatgctaaatacaat

SEQ ID NO: 125934 - DNA, 19 bp, Artificial sequence
  SiRNA target sequence
tatgatgctaaatacaatg

SEQ ID NO: 125935 - DNA, 19 bp, Artificial sequence
  SiRNA target sequence
atgatgctaaatacaatgt

SEQ ID NO: 125936 - DNA, 19 bp, Artificial sequence
  SiRNA target sequence
tgatgctaaatacaatgtt

SEQ ID NO: 125937 - DNA, 19 bp, Artificial sequence
  SiRNA target sequence
gatgctaaatacaatgttc

SEQ ID NO: 125938 - DNA, 19 bp, Artificial sequence
  SiRNA target sequence
atgctaaatacaatgttct

SEQ ID NO: 125939 - DNA, 19 bp, Artificial sequence
  SiRNA target sequence
tgctaaatacaatgttcta

SEQ ID NO: 125940 - DNA, 19 bp, Artificial sequence
  SiRNA target sequence
gctaaatacaatgttctat

SEQ ID NO: 125941 - DNA, 19 bp, Artificial sequence
  SiRNA target sequence
ctaaatacaatgttctatt

SEQ ID NO: 125942 - DNA, 19 bp, Artificial sequence
  SiRNA target sequence
taaatacaatgttctattg

SEQ ID NO: 125943 - DNA, 19 bp, Artificial sequence
  SiRNA target sequence
aaatacaatgttctattgg

SEQ ID NO: 125944 - DNA, 19 bp, Artificial sequence
  SiRNA target sequence
aatacaatgttctattggg

SEQ ID NO: 125945 - DNA, 19 bp, Artificial sequence
  SiRNA target sequence
atacaatgttctattgggt

SEQ ID NO: 125946 - DNA, 19 bp, Artificial sequence
  SiRNA target sequence
tacaatgttctattgggtg

SEQ ID NO: 125947 - DNA, 19 bp, Artificial sequence
  SiRNA target sequence
acaatgttctattgggtgt

SEQ ID NO: 125948 - DNA, 19 bp, Artificial sequence
  SiRNA target sequence
caatgttctattgggtgtc

SEQ ID NO: 125949 - DNA, 19 bp, Artificial sequence
  SiRNA target sequence
aatgttctattgggtgtca

SEQ ID NO: 125950 - DNA, 19 bp, Artificial sequence
  SiRNA target sequence
atgttctattgggtgtcac

SEQ ID NO: 125951 - DNA, 19 bp, Artificial sequence
  SiRNA target sequence
tgttctattgggtgtcaca

SEQ ID NO: 125952 - DNA, 19 bp, Artificial sequence
  SiRNA target sequence
gttctattgggtgtcacag

SEQ ID NO: 125953 - DNA, 19 bp, Artificial sequence
  SiRNA target sequence
ttctattgggtgtcacagc

SEQ ID NO: 125954 - DNA, 19 bp, Artificial sequence
  SiRNA target sequence
tctattgggtgtcacagct

SEQ ID NO: 125955 - DNA, 19 bp, Artificial sequence
  SiRNA target sequence
ctattgggtgtcacagcta

SEQ ID NO: 125956 - DNA, 19 bp, Artificial sequence
  SiRNA target sequence
tattgggtgtcacagctac

SEQ ID NO: 125957 - DNA, 19 bp, Artificial sequence
  SiRNA target sequence
attgggtgtcacagctacc

SEQ ID NO: 125958 - DNA, 19 bp, Artificial sequence
  SiRNA target sequence
ttgggtgtcacagctacct

SEQ ID NO: 125959 - DNA, 19 bp, Artificial sequence
  SiRNA target sequence
tgggtgtcacagctaccta

SEQ ID NO: 125960 - DNA, 19 bp, Artificial sequence
  SiRNA target sequence
gggtgtcacagctacctac

SEQ ID NO: 125961 - DNA, 19 bp, Artificial sequence
  SiRNA target sequence
ggtgtcacagctacctact

SEQ ID NO: 125962 - DNA, 19 bp, Artificial sequence
  SiRNA target sequence
gtgtcacagctacctacta

SEQ ID NO: 125963 - DNA, 19 bp, Artificial sequence
  SiRNA target sequence
tgtcacagctacctactat

SEQ ID NO: 125964 - DNA, 19 bp, Artificial sequence
  SiRNA target sequence
gtcacagctacctactatg

SEQ ID NO: 125965 - DNA, 19 bp, Artificial sequence
  SiRNA target sequence
tcacagctacctactatgg

SEQ ID NO: 125966 - DNA, 19 bp, Artificial sequence
  SiRNA target sequence
cacagctacctactatgga

SEQ ID NO: 125967 - DNA, 19 bp, Artificial sequence
  SiRNA target sequence
acagctacctactatggag

SEQ ID NO: 125968 - DNA, 19 bp, Artificial sequence
  SiRNA target sequence
cagctacctactatggagc

SEQ ID NO: 125969 - DNA, 19 bp, Artificial sequence
  SiRNA target sequence
agctacctactatggagct

SEQ ID NO: 125970 - DNA, 19 bp, Artificial sequence
  SiRNA target sequence
gctacctactatggagctg

SEQ ID NO: 125971 - DNA, 19 bp, Artificial sequence
  SiRNA target sequence
ctacctactatggagctgt

SEQ ID NO: 125972 - DNA, 19 bp, Artificial sequence
  SiRNA target sequence
tacctactatggagctgtt

SEQ ID NO: 125973 - DNA, 19 bp, Artificial sequence
  SiRNA target sequence
acctactatggagctgttg

SEQ ID NO: 125974 - DNA, 19 bp, Artificial sequence
  SiRNA target sequence
cctactatggagctgttgt

SEQ ID NO: 125975 - DNA, 19 bp, Artificial sequence
  SiRNA target sequence
ctactatggagctgttgta

SEQ ID NO: 125976 - DNA, 19 bp, Artificial sequence
  SiRNA target sequence
tactatggagctgttgtat

SEQ ID NO: 125977 - DNA, 19 bp, Artificial sequence
  SiRNA target sequence
actatggagctgttgtatt

SEQ ID NO: 125978 - DNA, 19 bp, Artificial sequence
  SiRNA target sequence
ctatggagctgttgtatta

SEQ ID NO: 125979 - DNA, 19 bp, Artificial sequence
  SiRNA target sequence
tatggagctgttgtattaa

SEQ ID NO: 125980 - DNA, 19 bp, Artificial sequence
  SiRNA target sequence
atggagctgttgtattaaa

SEQ ID NO: 125981 - DNA, 19 bp, Artificial sequence
  SiRNA target sequence
tggagctgttgtattaaat

SEQ ID NO: 125982 - DNA, 19 bp, Artificial sequence
  SiRNA target sequence
ggagctgttgtattaaatc

SEQ ID NO: 125983 - DNA, 19 bp, Artificial sequence
  SiRNA target sequence
gagctgttgtattaaatca

SEQ ID NO: 125984 - DNA, 19 bp, Artificial sequence
  SiRNA target sequence
agctgttgtattaaatcat

SEQ ID NO: 125985 - DNA, 19 bp, Artificial sequence
  SiRNA target sequence
gctgttgtattaaatcatg

SEQ ID NO: 125986 - DNA, 19 bp, Artificial sequence
  SiRNA target sequence
ctgttgtattaaatcatgc

SEQ ID NO: 125987 - DNA, 19 bp, Artificial sequence
  SiRNA target sequence
tgttgtattaaatcatgca

SEQ ID NO: 125988 - DNA, 19 bp, Artificial sequence
  SiRNA target sequence
gttgtattaaatcatgcaa

SEQ ID NO: 125989 - DNA, 19 bp, Artificial sequence
  SiRNA target sequence
ttgtattaaatcatgcaaa

SEQ ID NO: 125990 - DNA, 19 bp, Artificial sequence
  SiRNA target sequence
tgtattaaatcatgcaaaa

SEQ ID NO: 125991 - DNA, 19 bp, Artificial sequence
  SiRNA target sequence
gtattaaatcatgcaaaat

SEQ ID NO: 125992 - DNA, 19 bp, Artificial sequence
  SiRNA target sequence
tattaaatcatgcaaaatt

SEQ ID NO: 125993 - DNA, 19 bp, Artificial sequence
  SiRNA target sequence
attaaatcatgcaaaattc

SEQ ID NO: 125994 - DNA, 19 bp, Artificial sequence
  SiRNA target sequence
ttaaatcatgcaaaattct

SEQ ID NO: 125995 - DNA, 19 bp, Artificial sequence
  SiRNA target sequence
taaatcatgcaaaattctt

SEQ ID NO: 125996 - DNA, 19 bp, Artificial sequence
  SiRNA target sequence
aaatcatgcaaaattcttg

SEQ ID NO: 125997 - DNA, 19 bp, Artificial sequence
  SiRNA target sequence
aatcatgcaaaattcttgt

SEQ ID NO: 125998 - DNA, 19 bp, Artificial sequence
  SiRNA target sequence
atcatgcaaaattcttgtc

SEQ ID NO: 125999 - DNA, 19 bp, Artificial sequence
  SiRNA target sequence
tcatgcaaaattcttgtca

SEQ ID NO: 126000 - DNA, 19 bp, Artificial sequence
  SiRNA target sequence
catgcaaaattcttgtcag

SEQ ID NO: 126001 - DNA, 19 bp, Artificial sequence
  SiRNA target sequence
atgcaaaattcttgtcagt

SEQ ID NO: 126002 - DNA, 19 bp, Artificial sequence
  SiRNA target sequence
tgcaaaattcttgtcagta

SEQ ID NO: 126003 - DNA, 19 bp, Artificial sequence
  SiRNA target sequence
gcaaaattcttgtcagtaa

SEQ ID NO: 126004 - DNA, 19 bp, Artificial sequence
  SiRNA target sequence
caaaattcttgtcagtaac

SEQ ID NO: 126005 - DNA, 19 bp, Artificial sequence
  SiRNA target sequence
aaaattcttgtcagtaaca

SEQ ID NO: 126006 - DNA, 19 bp, Artificial sequence
  SiRNA target sequence
aaattcttgtcagtaacaa

SEQ ID NO: 126007 - DNA, 19 bp, Artificial sequence
  SiRNA target sequence
aattcttgtcagtaacaaa

SEQ ID NO: 126008 - DNA, 19 bp, Artificial sequence
  SiRNA target sequence
attcttgtcagtaacaaaa

SEQ ID NO: 126009 - DNA, 19 bp, Artificial sequence
  SiRNA target sequence
ttcttgtcagtaacaaaag

SEQ ID NO: 126010 - DNA, 19 bp, Artificial sequence
  SiRNA target sequence
tcttgtcagtaacaaaaga

SEQ ID NO: 126011 - DNA, 19 bp, Artificial sequence
  SiRNA target sequence
cttgtcagtaacaaaagat

SEQ ID NO: 126012 - DNA, 19 bp, Artificial sequence
  SiRNA target sequence
ttgtcagtaacaaaagatg

SEQ ID NO: 126013 - DNA, 19 bp, Artificial sequence
  SiRNA target sequence
tgtcagtaacaaaagatgg

SEQ ID NO: 126014 - DNA, 19 bp, Artificial sequence
  SiRNA target sequence
gtcagtaacaaaagatggc

SEQ ID NO: 126015 - DNA, 19 bp, Artificial sequence
  SiRNA target sequence
tcagtaacaaaagatggcg

SEQ ID NO: 126016 - DNA, 19 bp, Artificial sequence
  SiRNA target sequence
cagtaacaaaagatggcga

SEQ ID NO: 126017 - DNA, 19 bp, Artificial sequence
  SiRNA target sequence
agtaacaaaagatggcgat

SEQ ID NO: 126018 - DNA, 19 bp, Artificial sequence
  SiRNA target sequence
gtaacaaaagatggcgata

SEQ ID NO: 126019 - DNA, 19 bp, Artificial sequence
  SiRNA target sequence
taacaaaagatggcgataa

SEQ ID NO: 126020 - DNA, 19 bp, Artificial sequence
  SiRNA target sequence
aacaaaagatggcgataaa

SEQ ID NO: 126021 - DNA, 19 bp, Artificial sequence
  SiRNA target sequence
acaaaagatggcgataaaa

SEQ ID NO: 126022 - DNA, 19 bp, Artificial sequence
  SiRNA target sequence
caaaagatggcgataaaat

SEQ ID NO: 126023 - DNA, 19 bp, Artificial sequence
  SiRNA target sequence
aaaagatggcgataaaatt

SEQ ID NO: 126024 - DNA, 19 bp, Artificial sequence
  SiRNA target sequence
aaagatggcgataaaatta

SEQ ID NO: 126025 - DNA, 19 bp, Artificial sequence
  SiRNA target sequence
aagatggcgataaaattaa

SEQ ID NO: 126026 - DNA, 19 bp, Artificial sequence
  SiRNA target sequence
agatggcgataaaattaat

SEQ ID NO: 126027 - DNA, 19 bp, Artificial sequence
  SiRNA target sequence
gatggcgataaaattaatg

SEQ ID NO: 126028 - DNA, 19 bp, Artificial sequence
  SiRNA target sequence
atggcgataaaattaatgg

SEQ ID NO: 126029 - DNA, 19 bp, Artificial sequence
  SiRNA target sequence
tggcgataaaattaatgga

SEQ ID NO: 126030 - DNA, 19 bp, Artificial sequence
  SiRNA target sequence
ggcgataaaattaatggaa

SEQ ID NO: 126031 - DNA, 19 bp, Artificial sequence
  SiRNA target sequence
gcgataaaattaatggaat

SEQ ID NO: 126032 - DNA, 19 bp, Artificial sequence
  SiRNA target sequence
cgataaaattaatggaatt

SEQ ID NO: 126033 - DNA, 19 bp, Artificial sequence
  SiRNA target sequence
gataaaattaatggaatta

SEQ ID NO: 126034 - DNA, 19 bp, Artificial sequence
  SiRNA target sequence
ataaaattaatggaattaa

SEQ ID NO: 126035 - DNA, 19 bp, Artificial sequence
  SiRNA target sequence
taaaattaatggaattaaa

SEQ ID NO: 126036 - DNA, 19 bp, Artificial sequence
  SiRNA target sequence
aaaattaatggaattaaat

SEQ ID NO: 126037 - DNA, 19 bp, Artificial sequence
  SiRNA target sequence
aaattaatggaattaaatg

SEQ ID NO: 126038 - DNA, 19 bp, Artificial sequence
  SiRNA target sequence
aattaatggaattaaatgt

SEQ ID NO: 126039 - DNA, 19 bp, Artificial sequence
  SiRNA target sequence
attaatggaattaaatgtc

SEQ ID NO: 126040 - DNA, 19 bp, Artificial sequence
  SiRNA target sequence
ttaatggaattaaatgtca

SEQ ID NO: 126041 - DNA, 19 bp, Artificial sequence
  SiRNA target sequence
taatggaattaaatgtcaa

SEQ ID NO: 126042 - DNA, 19 bp, Artificial sequence
  SiRNA target sequence
aatggaattaaatgtcaag

SEQ ID NO: 126043 - DNA, 19 bp, Artificial sequence
  SiRNA target sequence
atggaattaaatgtcaaga

SEQ ID NO: 126044 - DNA, 19 bp, Artificial sequence
  SiRNA target sequence
tggaattaaatgtcaagat

SEQ ID NO: 126045 - DNA, 19 bp, Artificial sequence
  SiRNA target sequence
ggaattaaatgtcaagatt

SEQ ID NO: 126046 - DNA, 19 bp, Artificial sequence
  SiRNA target sequence
gaattaaatgtcaagattc

SEQ ID NO: 126047 - DNA, 19 bp, Artificial sequence
  SiRNA target sequence
aattaaatgtcaagattca

SEQ ID NO: 126048 - DNA, 19 bp, Artificial sequence
  SiRNA target sequence
attaaatgtcaagattcaa

SEQ ID NO: 126049 - DNA, 19 bp, Artificial sequence
  SiRNA target sequence
ttaaatgtcaagattcaat

SEQ ID NO: 126050 - DNA, 19 bp, Artificial sequence
  SiRNA target sequence
taaatgtcaagattcaata

SEQ ID NO: 126051 - DNA, 19 bp, Artificial sequence
  SiRNA target sequence
aaatgtcaagattcaataa

SEQ ID NO: 126052 - DNA, 19 bp, Artificial sequence
  SiRNA target sequence
aatgtcaagattcaataaa

SEQ ID NO: 126053 - DNA, 19 bp, Artificial sequence
  SiRNA target sequence
atgtcaagattcaataaat

SEQ ID NO: 126054 - DNA, 19 bp, Artificial sequence
  SiRNA target sequence
tgtcaagattcaataaata

SEQ ID NO: 126055 - DNA, 19 bp, Artificial sequence
  SiRNA target sequence
gtcaagattcaataaataa

SEQ ID NO: 126056 - DNA, 19 bp, Artificial sequence
  SiRNA target sequence
tcaagattcaataaataat

SEQ ID NO: 126057 - DNA, 19 bp, Artificial sequence
  SiRNA target sequence
caagattcaataaataatg

SEQ ID NO: 126058 - DNA, 19 bp, Artificial sequence
  SiRNA target sequence
aagattcaataaataatga

SEQ ID NO: 126059 - DNA, 19 bp, Artificial sequence
  SiRNA target sequence
agattcaataaataatgaa

SEQ ID NO: 126060 - DNA, 19 bp, Artificial sequence
  SiRNA target sequence
gattcaataaataatgaaa

SEQ ID NO: 126061 - DNA, 19 bp, Artificial sequence
  SiRNA target sequence
attcaataaataatgaaaa

SEQ ID NO: 126062 - DNA, 19 bp, Artificial sequence
  SiRNA target sequence
ttcaataaataatgaaaaa

SEQ ID NO: 126063 - DNA, 19 bp, Artificial sequence
  SiRNA target sequence
tcaataaataatgaaaaat

SEQ ID NO: 126064 - DNA, 19 bp, Artificial sequence
  SiRNA target sequence
caataaataatgaaaaatt

SEQ ID NO: 126065 - DNA, 19 bp, Artificial sequence
  SiRNA target sequence
aataaataatgaaaaattt

SEQ ID NO: 126066 - DNA, 19 bp, Artificial sequence
  SiRNA target sequence
ataaataatgaaaaatttt

SEQ ID NO: 126067 - DNA, 19 bp, Artificial sequence
  SiRNA target sequence
taaataatgaaaaattttt

SEQ ID NO: 126068 - DNA, 19 bp, Artificial sequence
  SiRNA target sequence
aaataatgaaaaattttta

SEQ ID NO: 126069 - DNA, 19 bp, Artificial sequence
  SiRNA target sequence
aataatgaaaaatttttaa

SEQ ID NO: 126070 - DNA, 19 bp, Artificial sequence
  SiRNA target sequence
ataatgaaaaatttttaat

SEQ ID NO: 126071 - DNA, 19 bp, Artificial sequence
  SiRNA target sequence
taatgaaaaatttttaatt

SEQ ID NO: 126072 - DNA, 19 bp, Artificial sequence
  SiRNA target sequence
aatgaaaaatttttaatta

SEQ ID NO: 126073 - DNA, 19 bp, Artificial sequence
  SiRNA target sequence
atgaaaaatttttaattag

SEQ ID NO: 126074 - DNA, 19 bp, Artificial sequence
  SiRNA target sequence
tgaaaaatttttaattagg

SEQ ID NO: 126075 - DNA, 19 bp, Artificial sequence
  SiRNA target sequence
gaaaaatttttaattaggt

SEQ ID NO: 126076 - DNA, 19 bp, Artificial sequence
  SiRNA target sequence
aaaaatttttaattaggtg

SEQ ID NO: 126077 - DNA, 19 bp, Artificial sequence
  SiRNA target sequence
aaaatttttaattaggtgt

SEQ ID NO: 126078 - DNA, 19 bp, Artificial sequence
  SiRNA target sequence
aaatttttaattaggtgta

SEQ ID NO: 126079 - DNA, 19 bp, Artificial sequence
  SiRNA target sequence
aatttttaattaggtgtaa

SEQ ID NO: 126080 - DNA, 19 bp, Artificial sequence
  SiRNA target sequence
atttttaattaggtgtaaa

SEQ ID NO: 126081 - DNA, 19 bp, Artificial sequence
  SiRNA target sequence
tttttaattaggtgtaaag

SEQ ID NO: 126082 - DNA, 19 bp, Artificial sequence
  SiRNA target sequence
ttttaattaggtgtaaagt

SEQ ID NO: 126083 - DNA, 19 bp, Artificial sequence
  SiRNA target sequence
tttaattaggtgtaaagtt

SEQ ID NO: 126084 - DNA, 19 bp, Artificial sequence
  SiRNA target sequence
ttaattaggtgtaaagttt

SEQ ID NO: 126085 - DNA, 19 bp, Artificial sequence
  SiRNA target sequence
taattaggtgtaaagtttt

SEQ ID NO: 126086 - DNA, 19 bp, Artificial sequence
  SiRNA target sequence
aattaggtgtaaagtttta

SEQ ID NO: 126087 - DNA, 19 bp, Artificial sequence
  SiRNA target sequence
attaggtgtaaagttttaa

SEQ ID NO: 126088 - DNA, 19 bp, Artificial sequence
  SiRNA target sequence
ttaggtgtaaagttttaat

SEQ ID NO: 126089 - DNA, 19 bp, Artificial sequence
  SiRNA target sequence
taggtgtaaagttttaata

SEQ ID NO: 126090 - DNA, 19 bp, Artificial sequence
  SiRNA target sequence
aggtgtaaagttttaataa

SEQ ID NO: 126091 - DNA, 19 bp, Artificial sequence
  SiRNA target sequence
ggtgtaaagttttaataaa

SEQ ID NO: 126092 - DNA, 19 bp, Artificial sequence
  SiRNA target sequence
gtgtaaagttttaataaat

SEQ ID NO: 126093 - DNA, 19 bp, Artificial sequence
  SiRNA target sequence
tgtaaagttttaataaata

SEQ ID NO: 126094 - DNA, 19 bp, Artificial sequence
  SiRNA target sequence
gtaaagttttaataaatac

SEQ ID NO: 126095 - DNA, 19 bp, Artificial sequence
  SiRNA target sequence
taaagttttaataaatact

SEQ ID NO: 126096 - DNA, 19 bp, Artificial sequence
  SiRNA target sequence
aaagttttaataaatactt

SEQ ID NO: 126097 - DNA, 19 bp, Artificial sequence
  SiRNA target sequence
aagttttaataaatacttc

SEQ ID NO: 126098 - DNA, 19 bp, Artificial sequence
  SiRNA target sequence
agttttaataaatacttct

SEQ ID NO: 126099 - DNA, 19 bp, Artificial sequence
  SiRNA target sequence
gttttaataaatacttctg

SEQ ID NO: 126100 - DNA, 19 bp, Artificial sequence
  SiRNA target sequence
ttttaataaatacttctgg

SEQ ID NO: 126101 - DNA, 19 bp, Artificial sequence
  SiRNA target sequence
tttaataaatacttctggc

SEQ ID NO: 126102 - DNA, 19 bp, Artificial sequence
  SiRNA target sequence
ttaataaatacttctggcc

SEQ ID NO: 126103 - DNA, 19 bp, Artificial sequence
  SiRNA target sequence
taataaatacttctggccc

SEQ ID NO: 126104 - DNA, 19 bp, Artificial sequence
  SiRNA target sequence
aataaatacttctggccct

SEQ ID NO: 126105 - DNA, 19 bp, Artificial sequence
  SiRNA target sequence
ataaatacttctggccctt

SEQ ID NO: 126106 - DNA, 19 bp, Artificial sequence
  SiRNA target sequence
taaatacttctggcccttt

SEQ ID NO: 126107 - DNA, 19 bp, Artificial sequence
  SiRNA target sequence
aaatacttctggccctttt

SEQ ID NO: 126108 - DNA, 19 bp, Artificial sequence
  SiRNA target sequence
aatacttctggcccttttg

SEQ ID NO: 126109 - DNA, 19 bp, Artificial sequence
  SiRNA target sequence
atacttctggcccttttgc

SEQ ID NO: 126110 - DNA, 19 bp, Artificial sequence
  SiRNA target sequence
tacttctggcccttttgct

SEQ ID NO: 126111 - DNA, 19 bp, Artificial sequence
  SiRNA target sequence
acttctggcccttttgctg

SEQ ID NO: 126112 - DNA, 19 bp, Artificial sequence
  SiRNA target sequence
cttctggcccttttgctga

SEQ ID NO: 126113 - DNA, 19 bp, Artificial sequence
  SiRNA target sequence
ttctggcccttttgctgac

SEQ ID NO: 126114 - DNA, 19 bp, Artificial sequence
  SiRNA target sequence
tctggcccttttgctgacg

SEQ ID NO: 126115 - DNA, 19 bp, Artificial sequence
  SiRNA target sequence
ctggcccttttgctgacga

SEQ ID NO: 126116 - DNA, 19 bp, Artificial sequence
  SiRNA target sequence
tggcccttttgctgacgag

SEQ ID NO: 126117 - DNA, 19 bp, Artificial sequence
  SiRNA target sequence
ggcccttttgctgacgagg

SEQ ID NO: 126118 - DNA, 19 bp, Artificial sequence
  SiRNA target sequence
gcccttttgctgacgaggt

SEQ ID NO: 126119 - DNA, 19 bp, Artificial sequence
  SiRNA target sequence
cccttttgctgacgaggtt

SEQ ID NO: 126120 - DNA, 19 bp, Artificial sequence
  SiRNA target sequence
ccttttgctgacgaggttc

SEQ ID NO: 126121 - DNA, 19 bp, Artificial sequence
  SiRNA target sequence
cttttgctgacgaggttcg

SEQ ID NO: 126122 - DNA, 19 bp, Artificial sequence
  SiRNA target sequence
ttttgctgacgaggttcga

SEQ ID NO: 126123 - DNA, 19 bp, Artificial sequence
  SiRNA target sequence
tttgctgacgaggttcgaa

SEQ ID NO: 126124 - DNA, 19 bp, Artificial sequence
  SiRNA target sequence
ttgctgacgaggttcgaaa

SEQ ID NO: 126125 - DNA, 19 bp, Artificial sequence
  SiRNA target sequence
tgctgacgaggttcgaaat

SEQ ID NO: 126126 - DNA, 19 bp, Artificial sequence
  SiRNA target sequence
gctgacgaggttcgaaata

SEQ ID NO: 126127 - DNA, 19 bp, Artificial sequence
  SiRNA target sequence
ctgacgaggttcgaaatac

SEQ ID NO: 126128 - DNA, 19 bp, Artificial sequence
  SiRNA target sequence
tgacgaggttcgaaataca

SEQ ID NO: 126129 - DNA, 19 bp, Artificial sequence
  SiRNA target sequence
gacgaggttcgaaatacat

SEQ ID NO: 126130 - DNA, 19 bp, Artificial sequence
  SiRNA target sequence
acgaggttcgaaatacatc

SEQ ID NO: 126131 - DNA, 19 bp, Artificial sequence
  SiRNA target sequence
cgaggttcgaaatacatca

SEQ ID NO: 126132 - DNA, 19 bp, Artificial sequence
  SiRNA target sequence
gaggttcgaaatacatcaa

SEQ ID NO: 126133 - DNA, 19 bp, Artificial sequence
  SiRNA target sequence
aggttcgaaatacatcaat

SEQ ID NO: 126134 - DNA, 19 bp, Artificial sequence
  SiRNA target sequence
ggttcgaaatacatcaatt

SEQ ID NO: 126135 - DNA, 19 bp, Artificial sequence
  SiRNA target sequence
gttcgaaatacatcaattg

SEQ ID NO: 126136 - DNA, 19 bp, Artificial sequence
  SiRNA target sequence
ttcgaaatacatcaattga

SEQ ID NO: 126137 - DNA, 19 bp, Artificial sequence
  SiRNA target sequence
tcgaaatacatcaattgaa

SEQ ID NO: 126138 - DNA, 19 bp, Artificial sequence
  SiRNA target sequence
cgaaatacatcaattgaaa

SEQ ID NO: 126139 - DNA, 19 bp, Artificial sequence
  SiRNA target sequence
gaaatacatcaattgaaaa

SEQ ID NO: 126140 - DNA, 19 bp, Artificial sequence
  SiRNA target sequence
aaatacatcaattgaaaac

SEQ ID NO: 126141 - DNA, 19 bp, Artificial sequence
  SiRNA target sequence
aatacatcaattgaaaact

SEQ ID NO: 126142 - DNA, 19 bp, Artificial sequence
  SiRNA target sequence
atacatcaattgaaaactg

SEQ ID NO: 126143 - DNA, 19 bp, Artificial sequence
  SiRNA target sequence
tacatcaattgaaaactgt

SEQ ID NO: 126144 - DNA, 19 bp, Artificial sequence
  SiRNA target sequence
acatcaattgaaaactgtc

SEQ ID NO: 126145 - DNA, 19 bp, Artificial sequence
  SiRNA target sequence
catcaattgaaaactgtca

SEQ ID NO: 126146 - DNA, 19 bp, Artificial sequence
  SiRNA target sequence
atcaattgaaaactgtcaa

SEQ ID NO: 126147 - DNA, 19 bp, Artificial sequence
  SiRNA target sequence
tcaattgaaaactgtcaac

SEQ ID NO: 126148 - DNA, 19 bp, Artificial sequence
  SiRNA target sequence
caattgaaaactgtcaacc

SEQ ID NO: 126149 - DNA, 19 bp, Artificial sequence
  SiRNA target sequence
aattgaaaactgtcaacca

SEQ ID NO: 126150 - DNA, 19 bp, Artificial sequence
  SiRNA target sequence
attgaaaactgtcaaccaa

SEQ ID NO: 126151 - DNA, 19 bp, Artificial sequence
  SiRNA target sequence
ttgaaaactgtcaaccaat

SEQ ID NO: 126152 - DNA, 19 bp, Artificial sequence
  SiRNA target sequence
tgaaaactgtcaaccaata

SEQ ID NO: 126153 - DNA, 19 bp, Artificial sequence
  SiRNA target sequence
gaaaactgtcaaccaatac

SEQ ID NO: 126154 - DNA, 19 bp, Artificial sequence
  SiRNA target sequence
aaaactgtcaaccaatact

SEQ ID NO: 126155 - DNA, 19 bp, Artificial sequence
  SiRNA target sequence
aaactgtcaaccaatactc

SEQ ID NO: 126156 - DNA, 19 bp, Artificial sequence
  SiRNA target sequence
aactgtcaaccaatactcc

SEQ ID NO: 126157 - DNA, 19 bp, Artificial sequence
  SiRNA target sequence
actgtcaaccaatactcca

SEQ ID NO: 126158 - DNA, 19 bp, Artificial sequence
  SiRNA target sequence
ctgtcaaccaatactccaa

SEQ ID NO: 126159 - DNA, 19 bp, Artificial sequence
  SiRNA target sequence
tgtcaaccaatactccaac

SEQ ID NO: 126160 - DNA, 19 bp, Artificial sequence
  SiRNA target sequence
gtcaaccaatactccaaca

SEQ ID NO: 126161 - DNA, 19 bp, Artificial sequence
  SiRNA target sequence
tcaaccaatactccaacat

SEQ ID NO: 126162 - DNA, 19 bp, Artificial sequence
  SiRNA target sequence
caaccaatactccaacata

SEQ ID NO: 126163 - DNA, 19 bp, Artificial sequence
  SiRNA target sequence
aaccaatactccaacatag

SEQ ID NO: 126164 - DNA, 19 bp, Artificial sequence
  SiRNA target sequence
accaatactccaacatagt

SEQ ID NO: 126165 - DNA, 19 bp, Artificial sequence
  SiRNA target sequence
ccaatactccaacatagtt

SEQ ID NO: 126166 - DNA, 19 bp, Artificial sequence
  SiRNA target sequence
caatactccaacatagtta

SEQ ID NO: 126167 - DNA, 19 bp, Artificial sequence
  SiRNA target sequence
aatactccaacatagttat

SEQ ID NO: 126168 - DNA, 19 bp, Artificial sequence
  SiRNA target sequence
atactccaacatagttatg

SEQ ID NO: 126169 - DNA, 19 bp, Artificial sequence
  SiRNA target sequence
tactccaacatagttatgg

SEQ ID NO: 126170 - DNA, 19 bp, Artificial sequence
  SiRNA target sequence
actccaacatagttatggt

SEQ ID NO: 126171 - DNA, 19 bp, Artificial sequence
  SiRNA target sequence
ctccaacatagttatggta

SEQ ID NO: 126172 - DNA, 19 bp, Artificial sequence
  SiRNA target sequence
tccaacatagttatggtac

SEQ ID NO: 126173 - DNA, 19 bp, Artificial sequence
  SiRNA target sequence
ccaacatagttatggtaca

SEQ ID NO: 126174 - DNA, 19 bp, Artificial sequence
  SiRNA target sequence
caacatagttatggtacac

SEQ ID NO: 126175 - DNA, 19 bp, Artificial sequence
  SiRNA target sequence
aacatagttatggtacaca

SEQ ID NO: 126176 - DNA, 19 bp, Artificial sequence
  SiRNA target sequence
acatagttatggtacacat

SEQ ID NO: 126177 - DNA, 19 bp, Artificial sequence
  SiRNA target sequence
catagttatggtacacata

SEQ ID NO: 126178 - DNA, 19 bp, Artificial sequence
  SiRNA target sequence
atagttatggtacacatat

SEQ ID NO: 126179 - DNA, 19 bp, Artificial sequence
  SiRNA target sequence
tagttatggtacacatatt

SEQ ID NO: 126180 - DNA, 19 bp, Artificial sequence
  SiRNA target sequence
agttatggtacacatattg

SEQ ID NO: 126181 - DNA, 19 bp, Artificial sequence
  SiRNA target sequence
gttatggtacacatattgt

SEQ ID NO: 126182 - DNA, 19 bp, Artificial sequence
  SiRNA target sequence
ttatggtacacatattgta

SEQ ID NO: 126183 - DNA, 19 bp, Artificial sequence
  SiRNA target sequence
tatggtacacatattgtag

SEQ ID NO: 126184 - DNA, 19 bp, Artificial sequence
  SiRNA target sequence
atggtacacatattgtagt

SEQ ID NO: 126185 - DNA, 19 bp, Artificial sequence
  SiRNA target sequence
tggtacacatattgtagtt

SEQ ID NO: 126186 - DNA, 19 bp, Artificial sequence
  SiRNA target sequence
ggtacacatattgtagttc

SEQ ID NO: 126187 - DNA, 19 bp, Artificial sequence
  SiRNA target sequence
gtacacatattgtagttcc

SEQ ID NO: 126188 - DNA, 19 bp, Artificial sequence
  SiRNA target sequence
tacacatattgtagttcct

SEQ ID NO: 126189 - DNA, 19 bp, Artificial sequence
  SiRNA target sequence
acacatattgtagttcctg

SEQ ID NO: 126190 - DNA, 19 bp, Artificial sequence
  SiRNA target sequence
cacatattgtagttcctgc

SEQ ID NO: 126191 - DNA, 19 bp, Artificial sequence
  SiRNA target sequence
acatattgtagttcctgcg

SEQ ID NO: 126192 - DNA, 19 bp, Artificial sequence
  SiRNA target sequence
catattgtagttcctgcga

SEQ ID NO: 126193 - DNA, 19 bp, Artificial sequence
  SiRNA target sequence
atattgtagttcctgcgat

SEQ ID NO: 126194 - DNA, 19 bp, Artificial sequence
  SiRNA target sequence
tattgtagttcctgcgata

SEQ ID NO: 126195 - DNA, 19 bp, Artificial sequence
  SiRNA target sequence
attgtagttcctgcgatat

SEQ ID NO: 126196 - DNA, 19 bp, Artificial sequence
  SiRNA target sequence
ttgtagttcctgcgatatt

SEQ ID NO: 126197 - DNA, 19 bp, Artificial sequence
  SiRNA target sequence
tgtagttcctgcgatattt

SEQ ID NO: 126198 - DNA, 19 bp, Artificial sequence
  SiRNA target sequence
gtagttcctgcgatatttt

SEQ ID NO: 126199 - DNA, 19 bp, Artificial sequence
  SiRNA target sequence
tagttcctgcgatattttc

SEQ ID NO: 126200 - DNA, 19 bp, Artificial sequence
  SiRNA target sequence
agttcctgcgatattttcg

SEQ ID NO: 126201 - DNA, 19 bp, Artificial sequence
  SiRNA target sequence
gttcctgcgatattttcgc

SEQ ID NO: 126202 - DNA, 19 bp, Artificial sequence
  SiRNA target sequence
ttcctgcgatattttcgcc

SEQ ID NO: 126203 - DNA, 19 bp, Artificial sequence
  SiRNA target sequence
tcctgcgatattttcgcct

SEQ ID NO: 126204 - DNA, 19 bp, Artificial sequence
  SiRNA target sequence
cctgcgatattttcgccta

SEQ ID NO: 126205 - DNA, 19 bp, Artificial sequence
  SiRNA target sequence
ctgcgatattttcgcctaa

SEQ ID NO: 126206 - DNA, 19 bp, Artificial sequence
  SiRNA target sequence
tgcgatattttcgcctaaa

SEQ ID NO: 126207 - DNA, 19 bp, Artificial sequence
  SiRNA target sequence
gcgatattttcgcctaaaa

SEQ ID NO: 126208 - DNA, 19 bp, Artificial sequence
  SiRNA target sequence
cgatattttcgcctaaaaa

SEQ ID NO: 126209 - DNA, 19 bp, Artificial sequence
  SiRNA target sequence
gatattttcgcctaaaaat

SEQ ID NO: 126210 - DNA, 19 bp, Artificial sequence
  SiRNA target sequence
atattttcgcctaaaaata

SEQ ID NO: 126211 - DNA, 19 bp, Artificial sequence
  SiRNA target sequence
tattttcgcctaaaaatat

SEQ ID NO: 126212 - DNA, 19 bp, Artificial sequence
  SiRNA target sequence
attttcgcctaaaaatatg

SEQ ID NO: 126213 - DNA, 19 bp, Artificial sequence
  SiRNA target sequence
ttttcgcctaaaaatatgg

SEQ ID NO: 126214 - DNA, 19 bp, Artificial sequence
  SiRNA target sequence
tttcgcctaaaaatatggg

SEQ ID NO: 126215 - DNA, 19 bp, Artificial sequence
  SiRNA target sequence
ttcgcctaaaaatatgggc

SEQ ID NO: 126216 - DNA, 19 bp, Artificial sequence
  SiRNA target sequence
tcgcctaaaaatatgggct

SEQ ID NO: 126217 - DNA, 19 bp, Artificial sequence
  SiRNA target sequence
cgcctaaaaatatgggctt

SEQ ID NO: 126218 - DNA, 19 bp, Artificial sequence
  SiRNA target sequence
gcctaaaaatatgggcttt

SEQ ID NO: 126219 - DNA, 19 bp, Artificial sequence
  SiRNA target sequence
cctaaaaatatgggctttg

SEQ ID NO: 126220 - DNA, 19 bp, Artificial sequence
  SiRNA target sequence
ctaaaaatatgggctttgt

SEQ ID NO: 126221 - DNA, 19 bp, Artificial sequence
  SiRNA target sequence
taaaaatatgggctttgtt

SEQ ID NO: 126222 - DNA, 19 bp, Artificial sequence
  SiRNA target sequence
aaaaatatgggctttgttg

SEQ ID NO: 126223 - DNA, 19 bp, Artificial sequence
  SiRNA target sequence
aaaatatgggctttgttga

SEQ ID NO: 126224 - DNA, 19 bp, Artificial sequence
  SiRNA target sequence
aaatatgggctttgttgat

SEQ ID NO: 126225 - DNA, 19 bp, Artificial sequence
  SiRNA target sequence
aatatgggctttgttgatc

SEQ ID NO: 126226 - DNA, 19 bp, Artificial sequence
  SiRNA target sequence
atatgggctttgttgatcc

SEQ ID NO: 126227 - DNA, 19 bp, Artificial sequence
  SiRNA target sequence
tatgggctttgttgatcca

SEQ ID NO: 126228 - DNA, 19 bp, Artificial sequence
  SiRNA target sequence
atgggctttgttgatccaa

SEQ ID NO: 126229 - DNA, 19 bp, Artificial sequence
  SiRNA target sequence
tgggctttgttgatccaag

SEQ ID NO: 126230 - DNA, 19 bp, Artificial sequence
  SiRNA target sequence
gggctttgttgatccaagc

SEQ ID NO: 126231 - DNA, 19 bp, Artificial sequence
  SiRNA target sequence
ggctttgttgatccaagca

SEQ ID NO: 126232 - DNA, 19 bp, Artificial sequence
  SiRNA target sequence
gctttgttgatccaagcac

SEQ ID NO: 126233 - DNA, 19 bp, Artificial sequence
  SiRNA target sequence
ctttgttgatccaagcacg

SEQ ID NO: 126234 - DNA, 19 bp, Artificial sequence
  SiRNA target sequence
tttgttgatccaagcacga

SEQ ID NO: 126235 - DNA, 19 bp, Artificial sequence
  SiRNA target sequence
ttgttgatccaagcacgag

SEQ ID NO: 126236 - DNA, 19 bp, Artificial sequence
  SiRNA target sequence
tgttgatccaagcacgagt

SEQ ID NO: 126237 - DNA, 19 bp, Artificial sequence
  SiRNA target sequence
gttgatccaagcacgagtg

SEQ ID NO: 126238 - DNA, 19 bp, Artificial sequence
  SiRNA target sequence
ttgatccaagcacgagtga

SEQ ID NO: 126239 - DNA, 19 bp, Artificial sequence
  SiRNA target sequence
tgatccaagcacgagtgat

SEQ ID NO: 126240 - DNA, 19 bp, Artificial sequence
  SiRNA target sequence
gatccaagcacgagtgatg

SEQ ID NO: 126241 - DNA, 19 bp, Artificial sequence
  SiRNA target sequence
atccaagcacgagtgatgg

SEQ ID NO: 126242 - DNA, 19 bp, Artificial sequence
  SiRNA target sequence
tccaagcacgagtgatgga

SEQ ID NO: 126243 - DNA, 19 bp, Artificial sequence
  SiRNA target sequence
ccaagcacgagtgatggaa

SEQ ID NO: 126244 - DNA, 19 bp, Artificial sequence
  SiRNA target sequence
caagcacgagtgatggaag

SEQ ID NO: 126245 - DNA, 19 bp, Artificial sequence
  SiRNA target sequence
aagcacgagtgatggaaga

SEQ ID NO: 126246 - DNA, 19 bp, Artificial sequence
  SiRNA target sequence
agcacgagtgatggaagaa

SEQ ID NO: 126247 - DNA, 19 bp, Artificial sequence
  SiRNA target sequence
gcacgagtgatggaagaat

SEQ ID NO: 126248 - DNA, 19 bp, Artificial sequence
  SiRNA target sequence
cacgagtgatggaagaatc

SEQ ID NO: 126249 - DNA, 19 bp, Artificial sequence
  SiRNA target sequence
acgagtgatggaagaatcg

SEQ ID NO: 126250 - DNA, 19 bp, Artificial sequence
  SiRNA target sequence
cgagtgatggaagaatcgc

SEQ ID NO: 126251 - DNA, 19 bp, Artificial sequence
  SiRNA target sequence
gagtgatggaagaatcgca

SEQ ID NO: 126252 - DNA, 19 bp, Artificial sequence
  SiRNA target sequence
agtgatggaagaatcgcat

SEQ ID NO: 126253 - DNA, 19 bp, Artificial sequence
  SiRNA target sequence
gtgatggaagaatcgcatt

SEQ ID NO: 126254 - DNA, 19 bp, Artificial sequence
  SiRNA target sequence
tgatggaagaatcgcattt

SEQ ID NO: 126255 - DNA, 19 bp, Artificial sequence
  SiRNA target sequence
gatggaagaatcgcatttt

SEQ ID NO: 126256 - DNA, 19 bp, Artificial sequence
  SiRNA target sequence
atggaagaatcgcattttt

SEQ ID NO: 126257 - DNA, 19 bp, Artificial sequence
  SiRNA target sequence
tggaagaatcgcatttttt

SEQ ID NO: 126258 - DNA, 19 bp, Artificial sequence
  SiRNA target sequence
ggaagaatcgcatttttta

SEQ ID NO: 126259 - DNA, 19 bp, Artificial sequence
  SiRNA target sequence
gaagaatcgcattttttat

SEQ ID NO: 126260 - DNA, 19 bp, Artificial sequence
  SiRNA target sequence
aagaatcgcattttttatg

SEQ ID NO: 126261 - DNA, 19 bp, Artificial sequence
  SiRNA target sequence
agaatcgcattttttatga

SEQ ID NO: 126262 - DNA, 19 bp, Artificial sequence
  SiRNA target sequence
gaatcgcattttttatgaa

SEQ ID NO: 126263 - DNA, 19 bp, Artificial sequence
  SiRNA target sequence
aatcgcattttttatgaat

SEQ ID NO: 126264 - DNA, 19 bp, Artificial sequence
  SiRNA target sequence
atcgcattttttatgaatt

SEQ ID NO: 126265 - DNA, 19 bp, Artificial sequence
  SiRNA target sequence
tcgcattttttatgaattt

SEQ ID NO: 126266 - DNA, 19 bp, Artificial sequence
  SiRNA target sequence
cgcattttttatgaatttt

SEQ ID NO: 126267 - DNA, 19 bp, Artificial sequence
  SiRNA target sequence
gcattttttatgaatttta

SEQ ID NO: 126268 - DNA, 19 bp, Artificial sequence
  SiRNA target sequence
cattttttatgaattttaa

SEQ ID NO: 126269 - DNA, 19 bp, Artificial sequence
  SiRNA target sequence
attttttatgaattttaaa

SEQ ID NO: 126270 - DNA, 19 bp, Artificial sequence
  SiRNA target sequence
ttttttatgaattttaaag

SEQ ID NO: 126271 - DNA, 19 bp, Artificial sequence
  SiRNA target sequence
tttttatgaattttaaagg

SEQ ID NO: 126272 - DNA, 19 bp, Artificial sequence
  SiRNA target sequence
ttttatgaattttaaaggt

SEQ ID NO: 126273 - DNA, 19 bp, Artificial sequence
  SiRNA target sequence
tttatgaattttaaaggta

SEQ ID NO: 126274 - DNA, 19 bp, Artificial sequence
  SiRNA target sequence
ttatgaattttaaaggtaa

SEQ ID NO: 126275 - DNA, 19 bp, Artificial sequence
  SiRNA target sequence
tatgaattttaaaggtaaa

SEQ ID NO: 126276 - DNA, 19 bp, Artificial sequence
  SiRNA target sequence
atgaattttaaaggtaaaa

SEQ ID NO: 126277 - DNA, 19 bp, Artificial sequence
  SiRNA target sequence
tgaattttaaaggtaaaac

SEQ ID NO: 126278 - DNA, 19 bp, Artificial sequence
  SiRNA target sequence
gaattttaaaggtaaaaca

SEQ ID NO: 126279 - DNA, 19 bp, Artificial sequence
  SiRNA target sequence
aattttaaaggtaaaacat

SEQ ID NO: 126280 - DNA, 19 bp, Artificial sequence
  SiRNA target sequence
attttaaaggtaaaacatt

SEQ ID NO: 126281 - DNA, 19 bp, Artificial sequence
  SiRNA target sequence
ttttaaaggtaaaacattg

SEQ ID NO: 126282 - DNA, 19 bp, Artificial sequence
  SiRNA target sequence
tttaaaggtaaaacattga

SEQ ID NO: 126283 - DNA, 19 bp, Artificial sequence
  SiRNA target sequence
ttaaaggtaaaacattgat

SEQ ID NO: 126284 - DNA, 19 bp, Artificial sequence
  SiRNA target sequence
taaaggtaaaacattgatt

SEQ ID NO: 126285 - DNA, 19 bp, Artificial sequence
  SiRNA target sequence
aaaggtaaaacattgattg

SEQ ID NO: 126286 - DNA, 19 bp, Artificial sequence
  SiRNA target sequence
aaggtaaaacattgattgg

SEQ ID NO: 126287 - DNA, 19 bp, Artificial sequence
  SiRNA target sequence
aggtaaaacattgattgga

SEQ ID NO: 126288 - DNA, 19 bp, Artificial sequence
  SiRNA target sequence
ggtaaaacattgattggag

SEQ ID NO: 126289 - DNA, 19 bp, Artificial sequence
  SiRNA target sequence
gtaaaacattgattggagg

SEQ ID NO: 126290 - DNA, 19 bp, Artificial sequence
  SiRNA target sequence
taaaacattgattggagga

SEQ ID NO: 126291 - DNA, 19 bp, Artificial sequence
  SiRNA target sequence
aaaacattgattggaggaa

SEQ ID NO: 126292 - DNA, 19 bp, Artificial sequence
  SiRNA target sequence
aaacattgattggaggaac

SEQ ID NO: 126293 - DNA, 19 bp, Artificial sequence
  SiRNA target sequence
aacattgattggaggaaca

SEQ ID NO: 126294 - DNA, 19 bp, Artificial sequence
  SiRNA target sequence
acattgattggaggaacag

SEQ ID NO: 126295 - DNA, 19 bp, Artificial sequence
  SiRNA target sequence
cattgattggaggaacaga

SEQ ID NO: 126296 - DNA, 19 bp, Artificial sequence
  SiRNA target sequence
attgattggaggaacagat

SEQ ID NO: 126297 - DNA, 19 bp, Artificial sequence
  SiRNA target sequence
ttgattggaggaacagatg

SEQ ID NO: 126298 - DNA, 19 bp, Artificial sequence
  SiRNA target sequence
tgattggaggaacagatgt

SEQ ID NO: 126299 - DNA, 19 bp, Artificial sequence
  SiRNA target sequence
gattggaggaacagatgtt

SEQ ID NO: 126300 - DNA, 19 bp, Artificial sequence
  SiRNA target sequence
attggaggaacagatgtta

SEQ ID NO: 126301 - DNA, 19 bp, Artificial sequence
  SiRNA target sequence
ttggaggaacagatgttaa

SEQ ID NO: 126302 - DNA, 19 bp, Artificial sequence
  SiRNA target sequence
tggaggaacagatgttaag

SEQ ID NO: 126303 - DNA, 19 bp, Artificial sequence
  SiRNA target sequence
ggaggaacagatgttaagt

SEQ ID NO: 126304 - DNA, 19 bp, Artificial sequence
  SiRNA target sequence
gaggaacagatgttaagtg

SEQ ID NO: 126305 - DNA, 19 bp, Artificial sequence
  SiRNA target sequence
aggaacagatgttaagtgt

SEQ ID NO: 126306 - DNA, 19 bp, Artificial sequence
  SiRNA target sequence
ggaacagatgttaagtgta

SEQ ID NO: 126307 - DNA, 19 bp, Artificial sequence
  SiRNA target sequence
gaacagatgttaagtgtaa

SEQ ID NO: 126308 - DNA, 19 bp, Artificial sequence
  SiRNA target sequence
aacagatgttaagtgtaaa

SEQ ID NO: 126309 - DNA, 19 bp, Artificial sequence
  SiRNA target sequence
acagatgttaagtgtaaag

SEQ ID NO: 126310 - DNA, 19 bp, Artificial sequence
  SiRNA target sequence
cagatgttaagtgtaaagt

SEQ ID NO: 126311 - DNA, 19 bp, Artificial sequence
  SiRNA target sequence
agatgttaagtgtaaagtt

SEQ ID NO: 126312 - DNA, 19 bp, Artificial sequence
  SiRNA target sequence
gatgttaagtgtaaagttg

SEQ ID NO: 126313 - DNA, 19 bp, Artificial sequence
  SiRNA target sequence
atgttaagtgtaaagttga

SEQ ID NO: 126314 - DNA, 19 bp, Artificial sequence
  SiRNA target sequence
tgttaagtgtaaagttgaa

SEQ ID NO: 126315 - DNA, 19 bp, Artificial sequence
  SiRNA target sequence
gttaagtgtaaagttgaag

SEQ ID NO: 126316 - DNA, 19 bp, Artificial sequence
  SiRNA target sequence
ttaagtgtaaagttgaaga

SEQ ID NO: 126317 - DNA, 19 bp, Artificial sequence
  SiRNA target sequence
taagtgtaaagttgaagat

SEQ ID NO: 126318 - DNA, 19 bp, Artificial sequence
  SiRNA target sequence
aagtgtaaagttgaagatt

SEQ ID NO: 126319 - DNA, 19 bp, Artificial sequence
  SiRNA target sequence
agtgtaaagttgaagattt

SEQ ID NO: 126320 - DNA, 19 bp, Artificial sequence
  SiRNA target sequence
gtgtaaagttgaagattta

SEQ ID NO: 126321 - DNA, 19 bp, Artificial sequence
  SiRNA target sequence
tgtaaagttgaagatttaa

SEQ ID NO: 126322 - DNA, 19 bp, Artificial sequence
  SiRNA target sequence
gtaaagttgaagatttaat

SEQ ID NO: 126323 - DNA, 19 bp, Artificial sequence
  SiRNA target sequence
taaagttgaagatttaata

SEQ ID NO: 126324 - DNA, 19 bp, Artificial sequence
  SiRNA target sequence
aaagttgaagatttaataa

SEQ ID NO: 126325 - DNA, 19 bp, Artificial sequence
  SiRNA target sequence
aagttgaagatttaataaa

SEQ ID NO: 126326 - DNA, 19 bp, Artificial sequence
  SiRNA target sequence
agttgaagatttaataaaa

SEQ ID NO: 126327 - DNA, 19 bp, Artificial sequence
  SiRNA target sequence
gttgaagatttaataaaac

SEQ ID NO: 126328 - DNA, 19 bp, Artificial sequence
  SiRNA target sequence
ttgaagatttaataaaacc

SEQ ID NO: 126329 - DNA, 19 bp, Artificial sequence
  SiRNA target sequence
tgaagatttaataaaaccg

SEQ ID NO: 126330 - DNA, 19 bp, Artificial sequence
  SiRNA target sequence
gaagatttaataaaaccga

SEQ ID NO: 126331 - DNA, 19 bp, Artificial sequence
  SiRNA target sequence
aagatttaataaaaccgac

SEQ ID NO: 126332 - DNA, 19 bp, Artificial sequence
  SiRNA target sequence
agatttaataaaaccgact

SEQ ID NO: 126333 - DNA, 19 bp, Artificial sequence
  SiRNA target sequence
gatttaataaaaccgactg

SEQ ID NO: 126334 - DNA, 19 bp, Artificial sequence
  SiRNA target sequence
atttaataaaaccgactga

SEQ ID NO: 126335 - DNA, 19 bp, Artificial sequence
  SiRNA target sequence
tttaataaaaccgactgaa

SEQ ID NO: 126336 - DNA, 19 bp, Artificial sequence
  SiRNA target sequence
ttaataaaaccgactgaag

SEQ ID NO: 126337 - DNA, 19 bp, Artificial sequence
  SiRNA target sequence
taataaaaccgactgaaga

SEQ ID NO: 126338 - DNA, 19 bp, Artificial sequence
  SiRNA target sequence
aataaaaccgactgaagaa

SEQ ID NO: 126339 - DNA, 19 bp, Artificial sequence
  SiRNA target sequence
ataaaaccgactgaagaag

SEQ ID NO: 126340 - DNA, 19 bp, Artificial sequence
  SiRNA target sequence
taaaaccgactgaagaaga

SEQ ID NO: 126341 - DNA, 19 bp, Artificial sequence
  SiRNA target sequence
aaaaccgactgaagaagat

SEQ ID NO: 126342 - DNA, 19 bp, Artificial sequence
  SiRNA target sequence
aaaccgactgaagaagatc

SEQ ID NO: 126343 - DNA, 19 bp, Artificial sequence
  SiRNA target sequence
aaccgactgaagaagatct

SEQ ID NO: 126344 - DNA, 19 bp, Artificial sequence
  SiRNA target sequence
accgactgaagaagatcta

SEQ ID NO: 126345 - DNA, 19 bp, Artificial sequence
  SiRNA target sequence
ccgactgaagaagatctaa

SEQ ID NO: 126346 - DNA, 19 bp, Artificial sequence
  SiRNA target sequence
cgactgaagaagatctaaa

SEQ ID NO: 126347 - DNA, 19 bp, Artificial sequence
  SiRNA target sequence
gactgaagaagatctaaac

SEQ ID NO: 126348 - DNA, 19 bp, Artificial sequence
  SiRNA target sequence
actgaagaagatctaaact

SEQ ID NO: 126349 - DNA, 19 bp, Artificial sequence
  SiRNA target sequence
ctgaagaagatctaaactt

SEQ ID NO: 126350 - DNA, 19 bp, Artificial sequence
  SiRNA target sequence
tgaagaagatctaaacttt

SEQ ID NO: 126351 - DNA, 19 bp, Artificial sequence
  SiRNA target sequence
gaagaagatctaaactttc

SEQ ID NO: 126352 - DNA, 19 bp, Artificial sequence
  SiRNA target sequence
aagaagatctaaactttct

SEQ ID NO: 126353 - DNA, 19 bp, Artificial sequence
  SiRNA target sequence
agaagatctaaactttctt

SEQ ID NO: 126354 - DNA, 19 bp, Artificial sequence
  SiRNA target sequence
gaagatctaaactttctta

SEQ ID NO: 126355 - DNA, 19 bp, Artificial sequence
  SiRNA target sequence
aagatctaaactttcttat

SEQ ID NO: 126356 - DNA, 19 bp, Artificial sequence
  SiRNA target sequence
agatctaaactttcttatt

SEQ ID NO: 126357 - DNA, 19 bp, Artificial sequence
  SiRNA target sequence
gatctaaactttcttattc

SEQ ID NO: 126358 - DNA, 19 bp, Artificial sequence
  SiRNA target sequence
atctaaactttcttattca

SEQ ID NO: 126359 - DNA, 19 bp, Artificial sequence
  SiRNA target sequence
tctaaactttcttattcac

SEQ ID NO: 126360 - DNA, 19 bp, Artificial sequence
  SiRNA target sequence
ctaaactttcttattcacg

SEQ ID NO: 126361 - DNA, 19 bp, Artificial sequence
  SiRNA target sequence
taaactttcttattcacga

SEQ ID NO: 126362 - DNA, 19 bp, Artificial sequence
  SiRNA target sequence
aaactttcttattcacgag

SEQ ID NO: 126363 - DNA, 19 bp, Artificial sequence
  SiRNA target sequence
aactttcttattcacgagg

SEQ ID NO: 126364 - DNA, 19 bp, Artificial sequence
  SiRNA target sequence
actttcttattcacgaggc

SEQ ID NO: 126365 - DNA, 19 bp, Artificial sequence
  SiRNA target sequence
ctttcttattcacgaggcc

SEQ ID NO: 126366 - DNA, 19 bp, Artificial sequence
  SiRNA target sequence
tttcttattcacgaggcca

SEQ ID NO: 126367 - DNA, 19 bp, Artificial sequence
  SiRNA target sequence
ttcttattcacgaggccaa

SEQ ID NO: 126368 - DNA, 19 bp, Artificial sequence
  SiRNA target sequence
tcttattcacgaggccaat

SEQ ID NO: 126369 - DNA, 19 bp, Artificial sequence
  SiRNA target sequence
cttattcacgaggccaatt

SEQ ID NO: 126370 - DNA, 19 bp, Artificial sequence
  SiRNA target sequence
ttattcacgaggccaatta

SEQ ID NO: 126371 - DNA, 19 bp, Artificial sequence
  SiRNA target sequence
tattcacgaggccaattat

SEQ ID NO: 126372 - DNA, 19 bp, Artificial sequence
  SiRNA target sequence
attcacgaggccaattatt

SEQ ID NO: 126373 - DNA, 19 bp, Artificial sequence
  SiRNA target sequence
ttcacgaggccaattattt

SEQ ID NO: 126374 - DNA, 19 bp, Artificial sequence
  SiRNA target sequence
tcacgaggccaattatttt

SEQ ID NO: 126375 - DNA, 19 bp, Artificial sequence
  SiRNA target sequence
cacgaggccaattatttta

SEQ ID NO: 126376 - DNA, 19 bp, Artificial sequence
  SiRNA target sequence
acgaggccaattattttac

SEQ ID NO: 126377 - DNA, 19 bp, Artificial sequence
  SiRNA target sequence
cgaggccaattattttaca

SEQ ID NO: 126378 - DNA, 19 bp, Artificial sequence
  SiRNA target sequence
gaggccaattattttacag

SEQ ID NO: 126379 - DNA, 19 bp, Artificial sequence
  SiRNA target sequence
aggccaattattttacaga

SEQ ID NO: 126380 - DNA, 19 bp, Artificial sequence
  SiRNA target sequence
ggccaattattttacagat

SEQ ID NO: 126381 - DNA, 19 bp, Artificial sequence
  SiRNA target sequence
gccaattattttacagatc

SEQ ID NO: 126382 - DNA, 19 bp, Artificial sequence
  SiRNA target sequence
ccaattattttacagatca

SEQ ID NO: 126383 - DNA, 19 bp, Artificial sequence
  SiRNA target sequence
caattattttacagatcac

SEQ ID NO: 126384 - DNA, 19 bp, Artificial sequence
  SiRNA target sequence
aattattttacagatcaca

SEQ ID NO: 126385 - DNA, 19 bp, Artificial sequence
  SiRNA target sequence
attattttacagatcacaa

SEQ ID NO: 126386 - DNA, 19 bp, Artificial sequence
  SiRNA target sequence
ttattttacagatcacaat

SEQ ID NO: 126387 - DNA, 19 bp, Artificial sequence
  SiRNA target sequence
tattttacagatcacaatt

SEQ ID NO: 126388 - DNA, 19 bp, Artificial sequence
  SiRNA target sequence
attttacagatcacaattt

SEQ ID NO: 126389 - DNA, 19 bp, Artificial sequence
  SiRNA target sequence
ttttacagatcacaattta

SEQ ID NO: 126390 - DNA, 19 bp, Artificial sequence
  SiRNA target sequence
tttacagatcacaatttaa

SEQ ID NO: 126391 - DNA, 19 bp, Artificial sequence
  SiRNA target sequence
ttacagatcacaatttaaa

SEQ ID NO: 126392 - DNA, 19 bp, Artificial sequence
  SiRNA target sequence
tacagatcacaatttaaaa

SEQ ID NO: 126393 - DNA, 19 bp, Artificial sequence
  SiRNA target sequence
acagatcacaatttaaaat

SEQ ID NO: 126394 - DNA, 19 bp, Artificial sequence
  SiRNA target sequence
cagatcacaatttaaaatt

SEQ ID NO: 126395 - DNA, 19 bp, Artificial sequence
  SiRNA target sequence
agatcacaatttaaaatta

SEQ ID NO: 126396 - DNA, 19 bp, Artificial sequence
  SiRNA target sequence
gatcacaatttaaaattaa

SEQ ID NO: 126397 - DNA, 19 bp, Artificial sequence
  SiRNA target sequence
atcacaatttaaaattaac

SEQ ID NO: 126398 - DNA, 19 bp, Artificial sequence
  SiRNA target sequence
tcacaatttaaaattaaca

SEQ ID NO: 126399 - DNA, 19 bp, Artificial sequence
  SiRNA target sequence
cacaatttaaaattaacaa

SEQ ID NO: 126400 - DNA, 19 bp, Artificial sequence
  SiRNA target sequence
acaatttaaaattaacaaa

SEQ ID NO: 126401 - DNA, 19 bp, Artificial sequence
  SiRNA target sequence
caatttaaaattaacaaaa

SEQ ID NO: 126402 - DNA, 19 bp, Artificial sequence
  SiRNA target sequence
aatttaaaattaacaaaaa

SEQ ID NO: 126403 - DNA, 19 bp, Artificial sequence
  SiRNA target sequence
atttaaaattaacaaaaaa

SEQ ID NO: 126404 - DNA, 19 bp, Artificial sequence
  SiRNA target sequence
tttaaaattaacaaaaaaa

SEQ ID NO: 126405 - DNA, 19 bp, Artificial sequence
  SiRNA target sequence
ttaaaattaacaaaaaaag

SEQ ID NO: 126406 - DNA, 19 bp, Artificial sequence
  SiRNA target sequence
taaaattaacaaaaaaaga

SEQ ID NO: 126407 - DNA, 19 bp, Artificial sequence
  SiRNA target sequence
aaaattaacaaaaaaagat

SEQ ID NO: 126408 - DNA, 19 bp, Artificial sequence
  SiRNA target sequence
aaattaacaaaaaaagatg

SEQ ID NO: 126409 - DNA, 19 bp, Artificial sequence
  SiRNA target sequence
aattaacaaaaaaagatgt

SEQ ID NO: 126410 - DNA, 19 bp, Artificial sequence
  SiRNA target sequence
attaacaaaaaaagatgtt

SEQ ID NO: 126411 - DNA, 19 bp, Artificial sequence
  SiRNA target sequence
ttaacaaaaaaagatgttt

SEQ ID NO: 126412 - DNA, 19 bp, Artificial sequence
  SiRNA target sequence
taacaaaaaaagatgtttt

SEQ ID NO: 126413 - DNA, 19 bp, Artificial sequence
  SiRNA target sequence
aacaaaaaaagatgttttg

SEQ ID NO: 126414 - DNA, 19 bp, Artificial sequence
  SiRNA target sequence
acaaaaaaagatgttttgt

SEQ ID NO: 126415 - DNA, 19 bp, Artificial sequence
  SiRNA target sequence
caaaaaaagatgttttgtc

SEQ ID NO: 126416 - DNA, 19 bp, Artificial sequence
  SiRNA target sequence
aaaaaaagatgttttgtct

SEQ ID NO: 126417 - DNA, 19 bp, Artificial sequence
  SiRNA target sequence
aaaaaagatgttttgtctg

SEQ ID NO: 126418 - DNA, 19 bp, Artificial sequence
  SiRNA target sequence
aaaaagatgttttgtctgt

SEQ ID NO: 126419 - DNA, 19 bp, Artificial sequence
  SiRNA target sequence
aaaagatgttttgtctgtt

SEQ ID NO: 126420 - DNA, 19 bp, Artificial sequence
  SiRNA target sequence
aaagatgttttgtctgttt

SEQ ID NO: 126421 - DNA, 19 bp, Artificial sequence
  SiRNA target sequence
aagatgttttgtctgtttg

SEQ ID NO: 126422 - DNA, 19 bp, Artificial sequence
  SiRNA target sequence
agatgttttgtctgtttgg

SEQ ID NO: 126423 - DNA, 19 bp, Artificial sequence
  SiRNA target sequence
gatgttttgtctgtttgga

SEQ ID NO: 126424 - DNA, 19 bp, Artificial sequence
  SiRNA target sequence
atgttttgtctgtttggac

SEQ ID NO: 126425 - DNA, 19 bp, Artificial sequence
  SiRNA target sequence
tgttttgtctgtttggaca

SEQ ID NO: 126426 - DNA, 19 bp, Artificial sequence
  SiRNA target sequence
gttttgtctgtttggacag

SEQ ID NO: 126427 - DNA, 19 bp, Artificial sequence
  SiRNA target sequence
ttttgtctgtttggacagg

SEQ ID NO: 126428 - DNA, 19 bp, Artificial sequence
  SiRNA target sequence
tttgtctgtttggacaggt

SEQ ID NO: 126429 - DNA, 19 bp, Artificial sequence
  SiRNA target sequence
ttgtctgtttggacaggta

SEQ ID NO: 126430 - DNA, 19 bp, Artificial sequence
  SiRNA target sequence
tgtctgtttggacaggtat

SEQ ID NO: 126431 - DNA, 19 bp, Artificial sequence
  SiRNA target sequence
gtctgtttggacaggtatt

SEQ ID NO: 126432 - DNA, 19 bp, Artificial sequence
  SiRNA target sequence
tctgtttggacaggtatta

SEQ ID NO: 126433 - DNA, 19 bp, Artificial sequence
  SiRNA target sequence
ctgtttggacaggtattag

SEQ ID NO: 126434 - DNA, 19 bp, Artificial sequence
  SiRNA target sequence
tgtttggacaggtattaga

SEQ ID NO: 126435 - DNA, 19 bp, Artificial sequence
  SiRNA target sequence
gtttggacaggtattagac

SEQ ID NO: 126436 - DNA, 19 bp, Artificial sequence
  SiRNA target sequence
tttggacaggtattagacc

SEQ ID NO: 126437 - DNA, 19 bp, Artificial sequence
  SiRNA target sequence
ttggacaggtattagaccg

SEQ ID NO: 126438 - DNA, 19 bp, Artificial sequence
  SiRNA target sequence
tggacaggtattagaccgt

SEQ ID NO: 126439 - DNA, 19 bp, Artificial sequence
  SiRNA target sequence
ggacaggtattagaccgtt

SEQ ID NO: 126440 - DNA, 19 bp, Artificial sequence
  SiRNA target sequence
gacaggtattagaccgtta

SEQ ID NO: 126441 - DNA, 19 bp, Artificial sequence
  SiRNA target sequence
acaggtattagaccgttag

SEQ ID NO: 126442 - DNA, 19 bp, Artificial sequence
  SiRNA target sequence
caggtattagaccgttagt

SEQ ID NO: 126443 - DNA, 19 bp, Artificial sequence
  SiRNA target sequence
aggtattagaccgttagtc

SEQ ID NO: 126444 - DNA, 19 bp, Artificial sequence
  SiRNA target sequence
ggtattagaccgttagtca

SEQ ID NO: 126445 - DNA, 19 bp, Artificial sequence
  SiRNA target sequence
gtattagaccgttagtcaa

SEQ ID NO: 126446 - DNA, 19 bp, Artificial sequence
  SiRNA target sequence
tattagaccgttagtcaag

SEQ ID NO: 126447 - DNA, 19 bp, Artificial sequence
  SiRNA target sequence
attagaccgttagtcaagg

SEQ ID NO: 126448 - DNA, 19 bp, Artificial sequence
  SiRNA target sequence
ttagaccgttagtcaagga

SEQ ID NO: 126449 - DNA, 19 bp, Artificial sequence
  SiRNA target sequence
tagaccgttagtcaaggat

SEQ ID NO: 126450 - DNA, 19 bp, Artificial sequence
  SiRNA target sequence
agaccgttagtcaaggatt

SEQ ID NO: 126451 - DNA, 19 bp, Artificial sequence
  SiRNA target sequence
gaccgttagtcaaggattt

SEQ ID NO: 126452 - DNA, 19 bp, Artificial sequence
  SiRNA target sequence
accgttagtcaaggattta

SEQ ID NO: 126453 - DNA, 19 bp, Artificial sequence
  SiRNA target sequence
ccgttagtcaaggatttat

SEQ ID NO: 126454 - DNA, 19 bp, Artificial sequence
  SiRNA target sequence
cgttagtcaaggatttatc

SEQ ID NO: 126455 - DNA, 19 bp, Artificial sequence
  SiRNA target sequence
gttagtcaaggatttatcg

SEQ ID NO: 126456 - DNA, 19 bp, Artificial sequence
  SiRNA target sequence
ttagtcaaggatttatcga

SEQ ID NO: 126457 - DNA, 19 bp, Artificial sequence
  SiRNA target sequence
tagtcaaggatttatcgaa

SEQ ID NO: 126458 - DNA, 19 bp, Artificial sequence
  SiRNA target sequence
agtcaaggatttatcgaaa

SEQ ID NO: 126459 - DNA, 19 bp, Artificial sequence
  SiRNA target sequence
gtcaaggatttatcgaaaa

SEQ ID NO: 126460 - DNA, 19 bp, Artificial sequence
  SiRNA target sequence
tcaaggatttatcgaaaag

SEQ ID NO: 126461 - DNA, 19 bp, Artificial sequence
  SiRNA target sequence
caaggatttatcgaaaagt

SEQ ID NO: 126462 - DNA, 19 bp, Artificial sequence
  SiRNA target sequence
aaggatttatcgaaaagtt

SEQ ID NO: 126463 - DNA, 19 bp, Artificial sequence
  SiRNA target sequence
aggatttatcgaaaagttc

SEQ ID NO: 126464 - DNA, 19 bp, Artificial sequence
  SiRNA target sequence
ggatttatcgaaaagttca

SEQ ID NO: 126465 - DNA, 19 bp, Artificial sequence
  SiRNA target sequence
gatttatcgaaaagttcaa

SEQ ID NO: 126466 - DNA, 19 bp, Artificial sequence
  SiRNA target sequence
atttatcgaaaagttcaac

SEQ ID NO: 126467 - DNA, 19 bp, Artificial sequence
  SiRNA target sequence
tttatcgaaaagttcaaca

SEQ ID NO: 126468 - DNA, 19 bp, Artificial sequence
  SiRNA target sequence
ttatcgaaaagttcaacag

SEQ ID NO: 126469 - DNA, 19 bp, Artificial sequence
  SiRNA target sequence
tatcgaaaagttcaacaga

SEQ ID NO: 126470 - DNA, 19 bp, Artificial sequence
  SiRNA target sequence
atcgaaaagttcaacagaa

SEQ ID NO: 126471 - DNA, 19 bp, Artificial sequence
  SiRNA target sequence
tcgaaaagttcaacagaaa

SEQ ID NO: 126472 - DNA, 19 bp, Artificial sequence
  SiRNA target sequence
cgaaaagttcaacagaaaa

SEQ ID NO: 126473 - DNA, 19 bp, Artificial sequence
  SiRNA target sequence
gaaaagttcaacagaaaag

SEQ ID NO: 126474 - DNA, 19 bp, Artificial sequence
  SiRNA target sequence
aaaagttcaacagaaaaga

SEQ ID NO: 126475 - DNA, 19 bp, Artificial sequence
  SiRNA target sequence
aaagttcaacagaaaagat

SEQ ID NO: 126476 - DNA, 19 bp, Artificial sequence
  SiRNA target sequence
aagttcaacagaaaagata

SEQ ID NO: 126477 - DNA, 19 bp, Artificial sequence
  SiRNA target sequence
agttcaacagaaaagatat

SEQ ID NO: 126478 - DNA, 19 bp, Artificial sequence
  SiRNA target sequence
gttcaacagaaaagatatg

SEQ ID NO: 126479 - DNA, 19 bp, Artificial sequence
  SiRNA target sequence
ttcaacagaaaagatatgt

SEQ ID NO: 126480 - DNA, 19 bp, Artificial sequence
  SiRNA target sequence
tcaacagaaaagatatgta

SEQ ID NO: 126481 - DNA, 19 bp, Artificial sequence
  SiRNA target sequence
caacagaaaagatatgtag

SEQ ID NO: 126482 - DNA, 19 bp, Artificial sequence
  SiRNA target sequence
aacagaaaagatatgtaga

SEQ ID NO: 126483 - DNA, 19 bp, Artificial sequence
  SiRNA target sequence
acagaaaagatatgtagaa

SEQ ID NO: 126484 - DNA, 19 bp, Artificial sequence
  SiRNA target sequence
cagaaaagatatgtagaaa

SEQ ID NO: 126485 - DNA, 19 bp, Artificial sequence
  SiRNA target sequence
agaaaagatatgtagaaaa

SEQ ID NO: 126486 - DNA, 19 bp, Artificial sequence
  SiRNA target sequence
gaaaagatatgtagaaaac

SEQ ID NO: 126487 - DNA, 19 bp, Artificial sequence
  SiRNA target sequence
aaaagatatgtagaaaaca

SEQ ID NO: 126488 - DNA, 19 bp, Artificial sequence
  SiRNA target sequence
aaagatatgtagaaaacat

SEQ ID NO: 126489 - DNA, 19 bp, Artificial sequence
  SiRNA target sequence
aagatatgtagaaaacata

SEQ ID NO: 126490 - DNA, 19 bp, Artificial sequence
  SiRNA target sequence
agatatgtagaaaacatac

SEQ ID NO: 126491 - DNA, 19 bp, Artificial sequence
  SiRNA target sequence
gatatgtagaaaacatact

SEQ ID NO: 126492 - DNA, 19 bp, Artificial sequence
  SiRNA target sequence
atatgtagaaaacatacta

SEQ ID NO: 126493 - DNA, 19 bp, Artificial sequence
  SiRNA target sequence
tatgtagaaaacatactat

SEQ ID NO: 126494 - DNA, 19 bp, Artificial sequence
  SiRNA target sequence
atgtagaaaacatactata

SEQ ID NO: 126495 - DNA, 19 bp, Artificial sequence
  SiRNA target sequence
tgtagaaaacatactataa

SEQ ID NO: 126496 - DNA, 19 bp, Artificial sequence
  SiRNA target sequence
gtagaaaacatactataag

SEQ ID NO: 126497 - DNA, 19 bp, Artificial sequence
  SiRNA target sequence
tagaaaacatactataaga

SEQ ID NO: 126498 - DNA, 19 bp, Artificial sequence
  SiRNA target sequence
agaaaacatactataagaa

SEQ ID NO: 126499 - DNA, 19 bp, Artificial sequence
  SiRNA target sequence
gaaaacatactataagaat

SEQ ID NO: 126500 - DNA, 19 bp, Artificial sequence
  SiRNA target sequence
aaaacatactataagaata

SEQ ID NO: 126501 - DNA, 19 bp, Artificial sequence
  SiRNA target sequence
aaacatactataagaatag

SEQ ID NO: 126502 - DNA, 19 bp, Artificial sequence
  SiRNA target sequence
aacatactataagaataga

SEQ ID NO: 126503 - DNA, 19 bp, Artificial sequence
  SiRNA target sequence
acatactataagaatagat

SEQ ID NO: 126504 - DNA, 19 bp, Artificial sequence
  SiRNA target sequence
catactataagaatagata

SEQ ID NO: 126505 - DNA, 19 bp, Artificial sequence
  SiRNA target sequence
atactataagaatagataa

SEQ ID NO: 126506 - DNA, 19 bp, Artificial sequence
  SiRNA target sequence
tactataagaatagataaa

SEQ ID NO: 126507 - DNA, 19 bp, Artificial sequence
  SiRNA target sequence
actataagaatagataaag

SEQ ID NO: 126508 - DNA, 19 bp, Artificial sequence
  SiRNA target sequence
ctataagaatagataaaga

SEQ ID NO: 126509 - DNA, 19 bp, Artificial sequence
  SiRNA target sequence
tataagaatagataaagac

SEQ ID NO: 126510 - DNA, 19 bp, Artificial sequence
  SiRNA target sequence
ataagaatagataaagaca

SEQ ID NO: 126511 - DNA, 19 bp, Artificial sequence
  SiRNA target sequence
taagaatagataaagacaa

SEQ ID NO: 126512 - DNA, 19 bp, Artificial sequence
  SiRNA target sequence
aagaatagataaagacaat

SEQ ID NO: 126513 - DNA, 19 bp, Artificial sequence
  SiRNA target sequence
agaatagataaagacaata

SEQ ID NO: 126514 - DNA, 19 bp, Artificial sequence
  SiRNA target sequence
gaatagataaagacaatat

SEQ ID NO: 126515 - DNA, 19 bp, Artificial sequence
  SiRNA target sequence
aatagataaagacaatatg

SEQ ID NO: 126516 - DNA, 19 bp, Artificial sequence
  SiRNA target sequence
atagataaagacaatatgg

SEQ ID NO: 126517 - DNA, 19 bp, Artificial sequence
  SiRNA target sequence
tagataaagacaatatggt

SEQ ID NO: 126518 - DNA, 19 bp, Artificial sequence
  SiRNA target sequence
agataaagacaatatggta

SEQ ID NO: 126519 - DNA, 19 bp, Artificial sequence
  SiRNA target sequence
gataaagacaatatggtaa

SEQ ID NO: 126520 - DNA, 19 bp, Artificial sequence
  SiRNA target sequence
ataaagacaatatggtaac

SEQ ID NO: 126521 - DNA, 19 bp, Artificial sequence
  SiRNA target sequence
taaagacaatatggtaact

SEQ ID NO: 126522 - DNA, 19 bp, Artificial sequence
  SiRNA target sequence
aaagacaatatggtaactg

SEQ ID NO: 126523 - DNA, 19 bp, Artificial sequence
  SiRNA target sequence
aagacaatatggtaactgt

SEQ ID NO: 126524 - DNA, 19 bp, Artificial sequence
  SiRNA target sequence
agacaatatggtaactgta

SEQ ID NO: 126525 - DNA, 19 bp, Artificial sequence
  SiRNA target sequence
gacaatatggtaactgtaa

SEQ ID NO: 126526 - DNA, 19 bp, Artificial sequence
  SiRNA target sequence
acaatatggtaactgtaac

SEQ ID NO: 126527 - DNA, 19 bp, Artificial sequence
  SiRNA target sequence
caatatggtaactgtaaca

SEQ ID NO: 126528 - DNA, 19 bp, Artificial sequence
  SiRNA target sequence
aatatggtaactgtaacag

SEQ ID NO: 126529 - DNA, 19 bp, Artificial sequence
  SiRNA target sequence
atatggtaactgtaacagg

SEQ ID NO: 126530 - DNA, 19 bp, Artificial sequence
  SiRNA target sequence
tatggtaactgtaacaggt

SEQ ID NO: 126531 - DNA, 19 bp, Artificial sequence
  SiRNA target sequence
atggtaactgtaacaggtg

SEQ ID NO: 126532 - DNA, 19 bp, Artificial sequence
  SiRNA target sequence
tggtaactgtaacaggtgg

SEQ ID NO: 126533 - DNA, 19 bp, Artificial sequence
  SiRNA target sequence
ggtaactgtaacaggtggt

SEQ ID NO: 126534 - DNA, 19 bp, Artificial sequence
  SiRNA target sequence
gtaactgtaacaggtggta

SEQ ID NO: 126535 - DNA, 19 bp, Artificial sequence
  SiRNA target sequence
taactgtaacaggtggtaa

SEQ ID NO: 126536 - DNA, 19 bp, Artificial sequence
  SiRNA target sequence
aactgtaacaggtggtaag

SEQ ID NO: 126537 - DNA, 19 bp, Artificial sequence
  SiRNA target sequence
actgtaacaggtggtaagt

SEQ ID NO: 126538 - DNA, 19 bp, Artificial sequence
  SiRNA target sequence
ctgtaacaggtggtaagtg

SEQ ID NO: 126539 - DNA, 19 bp, Artificial sequence
  SiRNA target sequence
tgtaacaggtggtaagtgg

SEQ ID NO: 126540 - DNA, 19 bp, Artificial sequence
  SiRNA target sequence
gtaacaggtggtaagtgga

SEQ ID NO: 126541 - DNA, 19 bp, Artificial sequence
  SiRNA target sequence
taacaggtggtaagtggac

SEQ ID NO: 126542 - DNA, 19 bp, Artificial sequence
  SiRNA target sequence
aacaggtggtaagtggaca

SEQ ID NO: 126543 - DNA, 19 bp, Artificial sequence
  SiRNA target sequence
acaggtggtaagtggacaa

SEQ ID NO: 126544 - DNA, 19 bp, Artificial sequence
  SiRNA target sequence
caggtggtaagtggacaat

SEQ ID NO: 126545 - DNA, 19 bp, Artificial sequence
  SiRNA target sequence
aggtggtaagtggacaatt

SEQ ID NO: 126546 - DNA, 19 bp, Artificial sequence
  SiRNA target sequence
ggtggtaagtggacaattt

SEQ ID NO: 126547 - DNA, 19 bp, Artificial sequence
  SiRNA target sequence
gtggtaagtggacaatttt

SEQ ID NO: 126548 - DNA, 19 bp, Artificial sequence
  SiRNA target sequence
tggtaagtggacaattttt

SEQ ID NO: 126549 - DNA, 19 bp, Artificial sequence
  SiRNA target sequence
ggtaagtggacaatttttc

SEQ ID NO: 126550 - DNA, 19 bp, Artificial sequence
  SiRNA target sequence
gtaagtggacaatttttcg

SEQ ID NO: 126551 - DNA, 19 bp, Artificial sequence
  SiRNA target sequence
taagtggacaatttttcga

SEQ ID NO: 126552 - DNA, 19 bp, Artificial sequence
  SiRNA target sequence
aagtggacaatttttcgac

SEQ ID NO: 126553 - DNA, 19 bp, Artificial sequence
  SiRNA target sequence
agtggacaatttttcgact

SEQ ID NO: 126554 - DNA, 19 bp, Artificial sequence
  SiRNA target sequence
gtggacaatttttcgactt

SEQ ID NO: 126555 - DNA, 19 bp, Artificial sequence
  SiRNA target sequence
tggacaatttttcgactta

SEQ ID NO: 126556 - DNA, 19 bp, Artificial sequence
  SiRNA target sequence
ggacaatttttcgacttat

SEQ ID NO: 126557 - DNA, 19 bp, Artificial sequence
  SiRNA target sequence
gacaatttttcgacttatg

SEQ ID NO: 126558 - DNA, 19 bp, Artificial sequence
  SiRNA target sequence
acaatttttcgacttatgg

SEQ ID NO: 126559 - DNA, 19 bp, Artificial sequence
  SiRNA target sequence
caatttttcgacttatggg

SEQ ID NO: 126560 - DNA, 19 bp, Artificial sequence
  SiRNA target sequence
aatttttcgacttatggga

SEQ ID NO: 126561 - DNA, 19 bp, Artificial sequence
  SiRNA target sequence
atttttcgacttatgggag

SEQ ID NO: 126562 - DNA, 19 bp, Artificial sequence
  SiRNA target sequence
tttttcgacttatgggaga

SEQ ID NO: 126563 - DNA, 19 bp, Artificial sequence
  SiRNA target sequence
ttttcgacttatgggagaa

SEQ ID NO: 126564 - DNA, 19 bp, Artificial sequence
  SiRNA target sequence
tttcgacttatgggagaac

SEQ ID NO: 126565 - DNA, 19 bp, Artificial sequence
  SiRNA target sequence
ttcgacttatgggagaaca

SEQ ID NO: 126566 - DNA, 19 bp, Artificial sequence
  SiRNA target sequence
tcgacttatgggagaacag

SEQ ID NO: 126567 - DNA, 19 bp, Artificial sequence
  SiRNA target sequence
cgacttatgggagaacaga

SEQ ID NO: 126568 - DNA, 19 bp, Artificial sequence
  SiRNA target sequence
gacttatgggagaacagac

SEQ ID NO: 126569 - DNA, 19 bp, Artificial sequence
  SiRNA target sequence
acttatgggagaacagaca

SEQ ID NO: 126570 - DNA, 19 bp, Artificial sequence
  SiRNA target sequence
cttatgggagaacagacaa

SEQ ID NO: 126571 - DNA, 19 bp, Artificial sequence
  SiRNA target sequence
ttatgggagaacagacaat

SEQ ID NO: 126572 - DNA, 19 bp, Artificial sequence
  SiRNA target sequence
tatgggagaacagacaata

SEQ ID NO: 126573 - DNA, 19 bp, Artificial sequence
  SiRNA target sequence
atgggagaacagacaataa

SEQ ID NO: 126574 - DNA, 19 bp, Artificial sequence
  SiRNA target sequence
tgggagaacagacaataaa

SEQ ID NO: 126575 - DNA, 19 bp, Artificial sequence
  SiRNA target sequence
gggagaacagacaataaat

SEQ ID NO: 126576 - DNA, 19 bp, Artificial sequence
  SiRNA target sequence
ggagaacagacaataaatc

SEQ ID NO: 126577 - DNA, 19 bp, Artificial sequence
  SiRNA target sequence
gagaacagacaataaatca

SEQ ID NO: 126578 - DNA, 19 bp, Artificial sequence
  SiRNA target sequence
agaacagacaataaatcaa

SEQ ID NO: 126579 - DNA, 19 bp, Artificial sequence
  SiRNA target sequence
gaacagacaataaatcaaa

SEQ ID NO: 126580 - DNA, 19 bp, Artificial sequence
  SiRNA target sequence
aacagacaataaatcaaat

SEQ ID NO: 126581 - DNA, 19 bp, Artificial sequence
  SiRNA target sequence
acagacaataaatcaaatt

SEQ ID NO: 126582 - DNA, 19 bp, Artificial sequence
  SiRNA target sequence
cagacaataaatcaaatta

SEQ ID NO: 126583 - DNA, 19 bp, Artificial sequence
  SiRNA target sequence
agacaataaatcaaattat

SEQ ID NO: 126584 - DNA, 19 bp, Artificial sequence
  SiRNA target sequence
gacaataaatcaaattata

SEQ ID NO: 126585 - DNA, 19 bp, Artificial sequence
  SiRNA target sequence
acaataaatcaaattataa

SEQ ID NO: 126586 - DNA, 19 bp, Artificial sequence
  SiRNA target sequence
caataaatcaaattataaa

SEQ ID NO: 126587 - DNA, 19 bp, Artificial sequence
  SiRNA target sequence
aataaatcaaattataaaa

SEQ ID NO: 126588 - DNA, 19 bp, Artificial sequence
  SiRNA target sequence
ataaatcaaattataaaag

SEQ ID NO: 126589 - DNA, 19 bp, Artificial sequence
  SiRNA target sequence
taaatcaaattataaaagt

SEQ ID NO: 126590 - DNA, 19 bp, Artificial sequence
  SiRNA target sequence
aaatcaaattataaaagtt

SEQ ID NO: 126591 - DNA, 19 bp, Artificial sequence
  SiRNA target sequence
aatcaaattataaaagttt

SEQ ID NO: 126592 - DNA, 19 bp, Artificial sequence
  SiRNA target sequence
atcaaattataaaagtttt

SEQ ID NO: 126593 - DNA, 19 bp, Artificial sequence
  SiRNA target sequence
tcaaattataaaagttttt

SEQ ID NO: 126594 - DNA, 19 bp, Artificial sequence
  SiRNA target sequence
caaattataaaagttttta

SEQ ID NO: 126595 - DNA, 19 bp, Artificial sequence
  SiRNA target sequence
aaattataaaagtttttaa

SEQ ID NO: 126596 - DNA, 19 bp, Artificial sequence
  SiRNA target sequence
aattataaaagtttttaat

SEQ ID NO: 126597 - DNA, 19 bp, Artificial sequence
  SiRNA target sequence
attataaaagtttttaata

SEQ ID NO: 126598 - DNA, 19 bp, Artificial sequence
  SiRNA target sequence
ttataaaagtttttaatat

SEQ ID NO: 126599 - DNA, 19 bp, Artificial sequence
  SiRNA target sequence
tataaaagtttttaatata

SEQ ID NO: 126600 - DNA, 19 bp, Artificial sequence
  SiRNA target sequence
ataaaagtttttaatataa

SEQ ID NO: 126601 - DNA, 19 bp, Artificial sequence
  SiRNA target sequence
taaaagtttttaatataaa

SEQ ID NO: 126602 - DNA, 19 bp, Artificial sequence
  SiRNA target sequence
aaaagtttttaatataaag

SEQ ID NO: 126603 - DNA, 19 bp, Artificial sequence
  SiRNA target sequence
aaagtttttaatataaagt

SEQ ID NO: 126604 - DNA, 19 bp, Artificial sequence
  SiRNA target sequence
aagtttttaatataaagtc

SEQ ID NO: 126605 - DNA, 19 bp, Artificial sequence
  SiRNA target sequence
agtttttaatataaagtct

SEQ ID NO: 126606 - DNA, 19 bp, Artificial sequence
  SiRNA target sequence
gtttttaatataaagtcta

SEQ ID NO: 126607 - DNA, 19 bp, Artificial sequence
  SiRNA target sequence
tttttaatataaagtctaa

SEQ ID NO: 126608 - DNA, 19 bp, Artificial sequence
  SiRNA target sequence
ttttaatataaagtctaat

SEQ ID NO: 126609 - DNA, 19 bp, Artificial sequence
  SiRNA target sequence
tttaatataaagtctaata

SEQ ID NO: 126610 - DNA, 19 bp, Artificial sequence
  SiRNA target sequence
ttaatataaagtctaataa

SEQ ID NO: 126611 - DNA, 19 bp, Artificial sequence
  SiRNA target sequence
taatataaagtctaataaa

SEQ ID NO: 126612 - DNA, 19 bp, Artificial sequence
  SiRNA target sequence
aatataaagtctaataaac

SEQ ID NO: 126613 - DNA, 19 bp, Artificial sequence
  SiRNA target sequence
atataaagtctaataaacc

SEQ ID NO: 126614 - DNA, 19 bp, Artificial sequence
  SiRNA target sequence
tataaagtctaataaacca

SEQ ID NO: 126615 - DNA, 19 bp, Artificial sequence
  SiRNA target sequence
ataaagtctaataaaccaa

SEQ ID NO: 126616 - DNA, 19 bp, Artificial sequence
  SiRNA target sequence
taaagtctaataaaccaag

SEQ ID NO: 126617 - DNA, 19 bp, Artificial sequence
  SiRNA target sequence
aaagtctaataaaccaagt

SEQ ID NO: 126618 - DNA, 19 bp, Artificial sequence
  SiRNA target sequence
aagtctaataaaccaagta

SEQ ID NO: 126619 - DNA, 19 bp, Artificial sequence
  SiRNA target sequence
agtctaataaaccaagtat

SEQ ID NO: 126620 - DNA, 19 bp, Artificial sequence
  SiRNA target sequence
gtctaataaaccaagtata

SEQ ID NO: 126621 - DNA, 19 bp, Artificial sequence
  SiRNA target sequence
tctaataaaccaagtataa

SEQ ID NO: 126622 - DNA, 19 bp, Artificial sequence
  SiRNA target sequence
ctaataaaccaagtataac

SEQ ID NO: 126623 - DNA, 19 bp, Artificial sequence
  SiRNA target sequence
taataaaccaagtataaca

SEQ ID NO: 126624 - DNA, 19 bp, Artificial sequence
  SiRNA target sequence
aataaaccaagtataacac

SEQ ID NO: 126625 - DNA, 19 bp, Artificial sequence
  SiRNA target sequence
ataaaccaagtataacaca

SEQ ID NO: 126626 - DNA, 19 bp, Artificial sequence
  SiRNA target sequence
taaaccaagtataacacaa

SEQ ID NO: 126627 - DNA, 19 bp, Artificial sequence
  SiRNA target sequence
aaaccaagtataacacaat

SEQ ID NO: 126628 - DNA, 19 bp, Artificial sequence
  SiRNA target sequence
aaccaagtataacacaata

SEQ ID NO: 126629 - DNA, 19 bp, Artificial sequence
  SiRNA target sequence
accaagtataacacaatat

SEQ ID NO: 126630 - DNA, 19 bp, Artificial sequence
  SiRNA target sequence
ccaagtataacacaatatc

SEQ ID NO: 126631 - DNA, 19 bp, Artificial sequence
  SiRNA target sequence
caagtataacacaatatct

SEQ ID NO: 126632 - DNA, 19 bp, Artificial sequence
  SiRNA target sequence
aagtataacacaatatctt

SEQ ID NO: 126633 - DNA, 19 bp, Artificial sequence
  SiRNA target sequence
agtataacacaatatcttc

SEQ ID NO: 126634 - DNA, 19 bp, Artificial sequence
  SiRNA target sequence
gtataacacaatatcttcc

SEQ ID NO: 126635 - DNA, 19 bp, Artificial sequence
  SiRNA target sequence
tataacacaatatcttcct

SEQ ID NO: 126636 - DNA, 19 bp, Artificial sequence
  SiRNA target sequence
ataacacaatatcttcctg

SEQ ID NO: 126637 - DNA, 19 bp, Artificial sequence
  SiRNA target sequence
taacacaatatcttcctgt

SEQ ID NO: 126638 - DNA, 19 bp, Artificial sequence
  SiRNA target sequence
aacacaatatcttcctgtt

SEQ ID NO: 126639 - DNA, 19 bp, Artificial sequence
  SiRNA target sequence
acacaatatcttcctgttt

SEQ ID NO: 126640 - DNA, 19 bp, Artificial sequence
  SiRNA target sequence
cacaatatcttcctgtttt

SEQ ID NO: 126641 - DNA, 19 bp, Artificial sequence
  SiRNA target sequence
acaatatcttcctgttttg

SEQ ID NO: 126642 - DNA, 19 bp, Artificial sequence
  SiRNA target sequence
caatatcttcctgttttgg

SEQ ID NO: 126643 - DNA, 19 bp, Artificial sequence
  SiRNA target sequence
aatatcttcctgttttggg

SEQ ID NO: 126644 - DNA, 19 bp, Artificial sequence
  SiRNA target sequence
atatcttcctgttttggga

SEQ ID NO: 126645 - DNA, 19 bp, Artificial sequence
  SiRNA target sequence
tatcttcctgttttgggat

SEQ ID NO: 126646 - DNA, 19 bp, Artificial sequence
  SiRNA target sequence
atcttcctgttttgggatc

SEQ ID NO: 126647 - DNA, 19 bp, Artificial sequence
  SiRNA target sequence
tcttcctgttttgggatca

SEQ ID NO: 126648 - DNA, 19 bp, Artificial sequence
  SiRNA target sequence
cttcctgttttgggatcac

SEQ ID NO: 126649 - DNA, 19 bp, Artificial sequence
  SiRNA target sequence
ttcctgttttgggatcaca

SEQ ID NO: 126650 - DNA, 19 bp, Artificial sequence
  SiRNA target sequence
tcctgttttgggatcacag

SEQ ID NO: 126651 - DNA, 19 bp, Artificial sequence
  SiRNA target sequence
cctgttttgggatcacagg

SEQ ID NO: 126652 - DNA, 19 bp, Artificial sequence
  SiRNA target sequence
ctgttttgggatcacaggg

SEQ ID NO: 126653 - DNA, 19 bp, Artificial sequence
  SiRNA target sequence
tgttttgggatcacaggga

SEQ ID NO: 126654 - DNA, 19 bp, Artificial sequence
  SiRNA target sequence
gttttgggatcacagggat

SEQ ID NO: 126655 - DNA, 19 bp, Artificial sequence
  SiRNA target sequence
ttttgggatcacagggata

SEQ ID NO: 126656 - DNA, 19 bp, Artificial sequence
  SiRNA target sequence
tttgggatcacagggatat

SEQ ID NO: 126657 - DNA, 19 bp, Artificial sequence
  SiRNA target sequence
ttgggatcacagggatata

SEQ ID NO: 126658 - DNA, 19 bp, Artificial sequence
  SiRNA target sequence
tgggatcacagggatatac

SEQ ID NO: 126659 - DNA, 19 bp, Artificial sequence
  SiRNA target sequence
gggatcacagggatatact

SEQ ID NO: 126660 - DNA, 19 bp, Artificial sequence
  SiRNA target sequence
ggatcacagggatatacta

SEQ ID NO: 126661 - DNA, 19 bp, Artificial sequence
  SiRNA target sequence
gatcacagggatatactaa

SEQ ID NO: 126662 - DNA, 19 bp, Artificial sequence
  SiRNA target sequence
atcacagggatatactaaa

SEQ ID NO: 126663 - DNA, 19 bp, Artificial sequence
  SiRNA target sequence
tcacagggatatactaaag

SEQ ID NO: 126664 - DNA, 19 bp, Artificial sequence
  SiRNA target sequence
cacagggatatactaaagc

SEQ ID NO: 126665 - DNA, 19 bp, Artificial sequence
  SiRNA target sequence
acagggatatactaaagct

SEQ ID NO: 126666 - DNA, 19 bp, Artificial sequence
  SiRNA target sequence
cagggatatactaaagcta

SEQ ID NO: 126667 - DNA, 19 bp, Artificial sequence
  SiRNA target sequence
agggatatactaaagctac

SEQ ID NO: 126668 - DNA, 19 bp, Artificial sequence
  SiRNA target sequence
gggatatactaaagctaca

SEQ ID NO: 126669 - DNA, 19 bp, Artificial sequence
  SiRNA target sequence
ggatatactaaagctacag

SEQ ID NO: 126670 - DNA, 19 bp, Artificial sequence
  SiRNA target sequence
gatatactaaagctacaga

SEQ ID NO: 126671 - DNA, 19 bp, Artificial sequence
  SiRNA target sequence
atatactaaagctacagaa

SEQ ID NO: 126672 - DNA, 19 bp, Artificial sequence
  SiRNA target sequence
tatactaaagctacagaat

SEQ ID NO: 126673 - DNA, 19 bp, Artificial sequence
  SiRNA target sequence
atactaaagctacagaatt

SEQ ID NO: 126674 - DNA, 19 bp, Artificial sequence
  SiRNA target sequence
tactaaagctacagaattt

SEQ ID NO: 126675 - DNA, 19 bp, Artificial sequence
  SiRNA target sequence
actaaagctacagaatttg

SEQ ID NO: 126676 - DNA, 19 bp, Artificial sequence
  SiRNA target sequence
ctaaagctacagaatttga

SEQ ID NO: 126677 - DNA, 19 bp, Artificial sequence
  SiRNA target sequence
taaagctacagaatttgat

SEQ ID NO: 126678 - DNA, 19 bp, Artificial sequence
  SiRNA target sequence
aaagctacagaatttgatt

SEQ ID NO: 126679 - DNA, 19 bp, Artificial sequence
  SiRNA target sequence
aagctacagaatttgattt

SEQ ID NO: 126680 - DNA, 19 bp, Artificial sequence
  SiRNA target sequence
agctacagaatttgatttg

SEQ ID NO: 126681 - DNA, 19 bp, Artificial sequence
  SiRNA target sequence
gctacagaatttgatttgg

SEQ ID NO: 126682 - DNA, 19 bp, Artificial sequence
  SiRNA target sequence
ctacagaatttgatttggc

SEQ ID NO: 126683 - DNA, 19 bp, Artificial sequence
  SiRNA target sequence
tacagaatttgatttggca

SEQ ID NO: 126684 - DNA, 19 bp, Artificial sequence
  SiRNA target sequence
acagaatttgatttggcac

SEQ ID NO: 126685 - DNA, 19 bp, Artificial sequence
  SiRNA target sequence
cagaatttgatttggcact

SEQ ID NO: 126686 - DNA, 19 bp, Artificial sequence
  SiRNA target sequence
agaatttgatttggcactt

SEQ ID NO: 126687 - DNA, 19 bp, Artificial sequence
  SiRNA target sequence
gaatttgatttggcactta

SEQ ID NO: 126688 - DNA, 19 bp, Artificial sequence
  SiRNA target sequence
aatttgatttggcacttac

SEQ ID NO: 126689 - DNA, 19 bp, Artificial sequence
  SiRNA target sequence
atttgatttggcacttact

SEQ ID NO: 126690 - DNA, 19 bp, Artificial sequence
  SiRNA target sequence
tttgatttggcacttactt

SEQ ID NO: 126691 - DNA, 19 bp, Artificial sequence
  SiRNA target sequence
ttgatttggcacttacttt

SEQ ID NO: 126692 - DNA, 19 bp, Artificial sequence
  SiRNA target sequence
tgatttggcacttacttta

SEQ ID NO: 126693 - DNA, 19 bp, Artificial sequence
  SiRNA target sequence
gatttggcacttactttaa

SEQ ID NO: 126694 - DNA, 19 bp, Artificial sequence
  SiRNA target sequence
atttggcacttactttaaa

SEQ ID NO: 126695 - DNA, 19 bp, Artificial sequence
  SiRNA target sequence
tttggcacttactttaaat

SEQ ID NO: 126696 - DNA, 19 bp, Artificial sequence
  SiRNA target sequence
ttggcacttactttaaata

SEQ ID NO: 126697 - DNA, 19 bp, Artificial sequence
  SiRNA target sequence
tggcacttactttaaatat

SEQ ID NO: 126698 - DNA, 19 bp, Artificial sequence
  SiRNA target sequence
ggcacttactttaaatatt

SEQ ID NO: 126699 - DNA, 19 bp, Artificial sequence
  SiRNA target sequence
gcacttactttaaatattc

SEQ ID NO: 126700 - DNA, 19 bp, Artificial sequence
  SiRNA target sequence
cacttactttaaatattcc

SEQ ID NO: 126701 - DNA, 19 bp, Artificial sequence
  SiRNA target sequence
acttactttaaatattcca

SEQ ID NO: 126702 - DNA, 19 bp, Artificial sequence
  SiRNA target sequence
cttactttaaatattccag

SEQ ID NO: 126703 - DNA, 19 bp, Artificial sequence
  SiRNA target sequence
ttactttaaatattccaga

SEQ ID NO: 126704 - DNA, 19 bp, Artificial sequence
  SiRNA target sequence
tactttaaatattccagaa

SEQ ID NO: 126705 - DNA, 19 bp, Artificial sequence
  SiRNA target sequence
actttaaatattccagaag

SEQ ID NO: 126706 - DNA, 19 bp, Artificial sequence
  SiRNA target sequence
ctttaaatattccagaaga

SEQ ID NO: 126707 - DNA, 19 bp, Artificial sequence
  SiRNA target sequence
tttaaatattccagaagat

SEQ ID NO: 126708 - DNA, 19 bp, Artificial sequence
  SiRNA target sequence
ttaaatattccagaagata

SEQ ID NO: 126709 - DNA, 19 bp, Artificial sequence
  SiRNA target sequence
taaatattccagaagatat

SEQ ID NO: 126710 - DNA, 19 bp, Artificial sequence
  SiRNA target sequence
aaatattccagaagatata

SEQ ID NO: 126711 - DNA, 19 bp, Artificial sequence
  SiRNA target sequence
aatattccagaagatatag

SEQ ID NO: 126712 - DNA, 19 bp, Artificial sequence
  SiRNA target sequence
atattccagaagatatagc

SEQ ID NO: 126713 - DNA, 19 bp, Artificial sequence
  SiRNA target sequence
tattccagaagatatagct

SEQ ID NO: 126714 - DNA, 19 bp, Artificial sequence
  SiRNA target sequence
attccagaagatatagcta

SEQ ID NO: 126715 - DNA, 19 bp, Artificial sequence
  SiRNA target sequence
ttccagaagatatagctaa

SEQ ID NO: 126716 - DNA, 19 bp, Artificial sequence
  SiRNA target sequence
tccagaagatatagctaag

SEQ ID NO: 126717 - DNA, 19 bp, Artificial sequence
  SiRNA target sequence
ccagaagatatagctaagc

SEQ ID NO: 126718 - DNA, 19 bp, Artificial sequence
  SiRNA target sequence
cagaagatatagctaagca

SEQ ID NO: 126719 - DNA, 19 bp, Artificial sequence
  SiRNA target sequence
agaagatatagctaagcat

SEQ ID NO: 126720 - DNA, 19 bp, Artificial sequence
  SiRNA target sequence
gaagatatagctaagcatt

SEQ ID NO: 126721 - DNA, 19 bp, Artificial sequence
  SiRNA target sequence
aagatatagctaagcattt

SEQ ID NO: 126722 - DNA, 19 bp, Artificial sequence
  SiRNA target sequence
agatatagctaagcattta

SEQ ID NO: 126723 - DNA, 19 bp, Artificial sequence
  SiRNA target sequence
gatatagctaagcatttag

SEQ ID NO: 126724 - DNA, 19 bp, Artificial sequence
  SiRNA target sequence
atatagctaagcatttagc

SEQ ID NO: 126725 - DNA, 19 bp, Artificial sequence
  SiRNA target sequence
tatagctaagcatttagct

SEQ ID NO: 126726 - DNA, 19 bp, Artificial sequence
  SiRNA target sequence
atagctaagcatttagcta

SEQ ID NO: 126727 - DNA, 19 bp, Artificial sequence
  SiRNA target sequence
tagctaagcatttagctac

SEQ ID NO: 126728 - DNA, 19 bp, Artificial sequence
  SiRNA target sequence
agctaagcatttagctaca

SEQ ID NO: 126729 - DNA, 19 bp, Artificial sequence
  SiRNA target sequence
gctaagcatttagctacaa

SEQ ID NO: 126730 - DNA, 19 bp, Artificial sequence
  SiRNA target sequence
ctaagcatttagctacaac

SEQ ID NO: 126731 - DNA, 19 bp, Artificial sequence
  SiRNA target sequence
taagcatttagctacaact

SEQ ID NO: 126732 - DNA, 19 bp, Artificial sequence
  SiRNA target sequence
aagcatttagctacaactt

SEQ ID NO: 126733 - DNA, 19 bp, Artificial sequence
  SiRNA target sequence
agcatttagctacaactta

SEQ ID NO: 126734 - DNA, 19 bp, Artificial sequence
  SiRNA target sequence
gcatttagctacaacttat

SEQ ID NO: 126735 - DNA, 19 bp, Artificial sequence
  SiRNA target sequence
catttagctacaacttatg

SEQ ID NO: 126736 - DNA, 19 bp, Artificial sequence
  SiRNA target sequence
atttagctacaacttatgg

SEQ ID NO: 126737 - DNA, 19 bp, Artificial sequence
  SiRNA target sequence
tttagctacaacttatggt

SEQ ID NO: 126738 - DNA, 19 bp, Artificial sequence
  SiRNA target sequence
ttagctacaacttatggta

SEQ ID NO: 126739 - DNA, 19 bp, Artificial sequence
  SiRNA target sequence
tagctacaacttatggtac

SEQ ID NO: 126740 - DNA, 19 bp, Artificial sequence
  SiRNA target sequence
agctacaacttatggtacc

SEQ ID NO: 126741 - DNA, 19 bp, Artificial sequence
  SiRNA target sequence
gctacaacttatggtacca

SEQ ID NO: 126742 - DNA, 19 bp, Artificial sequence
  SiRNA target sequence
ctacaacttatggtaccaa

SEQ ID NO: 126743 - DNA, 19 bp, Artificial sequence
  SiRNA target sequence
tacaacttatggtaccaaa

SEQ ID NO: 126744 - DNA, 19 bp, Artificial sequence
  SiRNA target sequence
acaacttatggtaccaaag

SEQ ID NO: 126745 - DNA, 19 bp, Artificial sequence
  SiRNA target sequence
caacttatggtaccaaagc

SEQ ID NO: 126746 - DNA, 19 bp, Artificial sequence
  SiRNA target sequence
aacttatggtaccaaagct

SEQ ID NO: 126747 - DNA, 19 bp, Artificial sequence
  SiRNA target sequence
acttatggtaccaaagctt

SEQ ID NO: 126748 - DNA, 19 bp, Artificial sequence
  SiRNA target sequence
cttatggtaccaaagctta

SEQ ID NO: 126749 - DNA, 19 bp, Artificial sequence
  SiRNA target sequence
ttatggtaccaaagcttac

SEQ ID NO: 126750 - DNA, 19 bp, Artificial sequence
  SiRNA target sequence
tatggtaccaaagcttaca

SEQ ID NO: 126751 - DNA, 19 bp, Artificial sequence
  SiRNA target sequence
atggtaccaaagcttacaa

SEQ ID NO: 126752 - DNA, 19 bp, Artificial sequence
  SiRNA target sequence
tggtaccaaagcttacaat

SEQ ID NO: 126753 - DNA, 19 bp, Artificial sequence
  SiRNA target sequence
ggtaccaaagcttacaatt

SEQ ID NO: 126754 - DNA, 19 bp, Artificial sequence
  SiRNA target sequence
gtaccaaagcttacaattt

SEQ ID NO: 126755 - DNA, 19 bp, Artificial sequence
  SiRNA target sequence
taccaaagcttacaatttc

SEQ ID NO: 126756 - DNA, 19 bp, Artificial sequence
  SiRNA target sequence
accaaagcttacaatttct

SEQ ID NO: 126757 - DNA, 19 bp, Artificial sequence
  SiRNA target sequence
ccaaagcttacaatttctc

SEQ ID NO: 126758 - DNA, 19 bp, Artificial sequence
  SiRNA target sequence
caaagcttacaatttctct

SEQ ID NO: 126759 - DNA, 19 bp, Artificial sequence
  SiRNA target sequence
aaagcttacaatttctctg

SEQ ID NO: 126760 - DNA, 19 bp, Artificial sequence
  SiRNA target sequence
aagcttacaatttctctga

SEQ ID NO: 126761 - DNA, 19 bp, Artificial sequence
  SiRNA target sequence
agcttacaatttctctgaa

SEQ ID NO: 126762 - DNA, 19 bp, Artificial sequence
  SiRNA target sequence
gcttacaatttctctgaat

SEQ ID NO: 126763 - DNA, 19 bp, Artificial sequence
  SiRNA target sequence
cttacaatttctctgaata

SEQ ID NO: 126764 - DNA, 19 bp, Artificial sequence
  SiRNA target sequence
ttacaatttctctgaatac

SEQ ID NO: 126765 - DNA, 19 bp, Artificial sequence
  SiRNA target sequence
tacaatttctctgaatact

SEQ ID NO: 126766 - DNA, 19 bp, Artificial sequence
  SiRNA target sequence
acaatttctctgaatactt

SEQ ID NO: 126767 - DNA, 19 bp, Artificial sequence
  SiRNA target sequence
caatttctctgaatacttt

SEQ ID NO: 126768 - DNA, 19 bp, Artificial sequence
  SiRNA target sequence
aatttctctgaatacttta

SEQ ID NO: 126769 - DNA, 19 bp, Artificial sequence
  SiRNA target sequence
atttctctgaatactttaa

SEQ ID NO: 126770 - DNA, 19 bp, Artificial sequence
  SiRNA target sequence
tttctctgaatactttaat

SEQ ID NO: 126771 - DNA, 19 bp, Artificial sequence
  SiRNA target sequence
ttctctgaatactttaatg

SEQ ID NO: 126772 - DNA, 19 bp, Artificial sequence
  SiRNA target sequence
tctctgaatactttaatgg

SEQ ID NO: 126773 - DNA, 19 bp, Artificial sequence
  SiRNA target sequence
ctctgaatactttaatggg

SEQ ID NO: 126774 - DNA, 19 bp, Artificial sequence
  SiRNA target sequence
tctgaatactttaatgggt

SEQ ID NO: 126775 - DNA, 19 bp, Artificial sequence
  SiRNA target sequence
ctgaatactttaatgggtc

SEQ ID NO: 126776 - DNA, 19 bp, Artificial sequence
  SiRNA target sequence
tgaatactttaatgggtca

SEQ ID NO: 126777 - DNA, 19 bp, Artificial sequence
  SiRNA target sequence
gaatactttaatgggtcat

SEQ ID NO: 126778 - DNA, 19 bp, Artificial sequence
  SiRNA target sequence
aatactttaatgggtcata

SEQ ID NO: 126779 - DNA, 19 bp, Artificial sequence
  SiRNA target sequence
atactttaatgggtcatac

SEQ ID NO: 126780 - DNA, 19 bp, Artificial sequence
  SiRNA target sequence
tactttaatgggtcataca

SEQ ID NO: 126781 - DNA, 19 bp, Artificial sequence
  SiRNA target sequence
actttaatgggtcatacac

SEQ ID NO: 126782 - DNA, 19 bp, Artificial sequence
  SiRNA target sequence
ctttaatgggtcatacacc

SEQ ID NO: 126783 - DNA, 19 bp, Artificial sequence
  SiRNA target sequence
tttaatgggtcatacacca

SEQ ID NO: 126784 - DNA, 19 bp, Artificial sequence
  SiRNA target sequence
ttaatgggtcatacaccag

SEQ ID NO: 126785 - DNA, 19 bp, Artificial sequence
  SiRNA target sequence
taatgggtcatacaccaga

SEQ ID NO: 126786 - DNA, 19 bp, Artificial sequence
  SiRNA target sequence
aatgggtcatacaccagac

SEQ ID NO: 126787 - DNA, 19 bp, Artificial sequence
  SiRNA target sequence
atgggtcatacaccagact

SEQ ID NO: 126788 - DNA, 19 bp, Artificial sequence
  SiRNA target sequence
tgggtcatacaccagactt

SEQ ID NO: 126789 - DNA, 19 bp, Artificial sequence
  SiRNA target sequence
gggtcatacaccagactta

SEQ ID NO: 126790 - DNA, 19 bp, Artificial sequence
  SiRNA target sequence
ggtcatacaccagacttac

SEQ ID NO: 126791 - DNA, 19 bp, Artificial sequence
  SiRNA target sequence
gtcatacaccagacttaca

SEQ ID NO: 126792 - DNA, 19 bp, Artificial sequence
  SiRNA target sequence
tcatacaccagacttacag

SEQ ID NO: 126793 - DNA, 19 bp, Artificial sequence
  SiRNA target sequence
catacaccagacttacaga

SEQ ID NO: 126794 - DNA, 19 bp, Artificial sequence
  SiRNA target sequence
atacaccagacttacagat

SEQ ID NO: 126795 - DNA, 19 bp, Artificial sequence
  SiRNA target sequence
tacaccagacttacagatg

SEQ ID NO: 126796 - DNA, 19 bp, Artificial sequence
  SiRNA target sequence
acaccagacttacagatgg

SEQ ID NO: 126797 - DNA, 19 bp, Artificial sequence
  SiRNA target sequence
caccagacttacagatggt

SEQ ID NO: 126798 - DNA, 19 bp, Artificial sequence
  SiRNA target sequence
accagacttacagatggtt

SEQ ID NO: 126799 - DNA, 19 bp, Artificial sequence
  SiRNA target sequence
ccagacttacagatggtta

SEQ ID NO: 126800 - DNA, 19 bp, Artificial sequence
  SiRNA target sequence
cagacttacagatggttat

SEQ ID NO: 126801 - DNA, 19 bp, Artificial sequence
  SiRNA target sequence
agacttacagatggttatc

SEQ ID NO: 126802 - DNA, 19 bp, Artificial sequence
  SiRNA target sequence
gacttacagatggttatcc

SEQ ID NO: 126803 - DNA, 19 bp, Artificial sequence
  SiRNA target sequence
acttacagatggttatcct

SEQ ID NO: 126804 - DNA, 19 bp, Artificial sequence
  SiRNA target sequence
cttacagatggttatcctt

SEQ ID NO: 126805 - DNA, 19 bp, Artificial sequence
  SiRNA target sequence
ttacagatggttatcctta

SEQ ID NO: 126806 - DNA, 19 bp, Artificial sequence
  SiRNA target sequence
tacagatggttatccttat

SEQ ID NO: 126807 - DNA, 19 bp, Artificial sequence
  SiRNA target sequence
acagatggttatccttata

SEQ ID NO: 126808 - DNA, 19 bp, Artificial sequence
  SiRNA target sequence
cagatggttatccttatac

SEQ ID NO: 126809 - DNA, 19 bp, Artificial sequence
  SiRNA target sequence
agatggttatccttataca

SEQ ID NO: 126810 - DNA, 19 bp, Artificial sequence
  SiRNA target sequence
gatggttatccttatacaa

SEQ ID NO: 126811 - DNA, 19 bp, Artificial sequence
  SiRNA target sequence
atggttatccttatacaaa

SEQ ID NO: 126812 - DNA, 19 bp, Artificial sequence
  SiRNA target sequence
tggttatccttatacaaaa

SEQ ID NO: 126813 - DNA, 19 bp, Artificial sequence
  SiRNA target sequence
ggttatccttatacaaaag

SEQ ID NO: 126814 - DNA, 19 bp, Artificial sequence
  SiRNA target sequence
gttatccttatacaaaaga

SEQ ID NO: 126815 - DNA, 19 bp, Artificial sequence
  SiRNA target sequence
ttatccttatacaaaagaa

SEQ ID NO: 126816 - DNA, 19 bp, Artificial sequence
  SiRNA target sequence
tatccttatacaaaagaag

SEQ ID NO: 126817 - DNA, 19 bp, Artificial sequence
  SiRNA target sequence
atccttatacaaaagaaga

SEQ ID NO: 126818 - DNA, 19 bp, Artificial sequence
  SiRNA target sequence
tccttatacaaaagaagaa

SEQ ID NO: 126819 - DNA, 19 bp, Artificial sequence
  SiRNA target sequence
ccttatacaaaagaagaaa

SEQ ID NO: 126820 - DNA, 19 bp, Artificial sequence
  SiRNA target sequence
cttatacaaaagaagaaat

SEQ ID NO: 126821 - DNA, 19 bp, Artificial sequence
  SiRNA target sequence
ttatacaaaagaagaaata

SEQ ID NO: 126822 - DNA, 19 bp, Artificial sequence
  SiRNA target sequence
tatacaaaagaagaaatag

SEQ ID NO: 126823 - DNA, 19 bp, Artificial sequence
  SiRNA target sequence
atacaaaagaagaaatagt

SEQ ID NO: 126824 - DNA, 19 bp, Artificial sequence
  SiRNA target sequence
tacaaaagaagaaatagta

SEQ ID NO: 126825 - DNA, 19 bp, Artificial sequence
  SiRNA target sequence
acaaaagaagaaatagtat

SEQ ID NO: 126826 - DNA, 19 bp, Artificial sequence
  SiRNA target sequence
caaaagaagaaatagtata

SEQ ID NO: 126827 - DNA, 19 bp, Artificial sequence
  SiRNA target sequence
aaaagaagaaatagtatat

SEQ ID NO: 126828 - DNA, 19 bp, Artificial sequence
  SiRNA target sequence
aaagaagaaatagtatatt

SEQ ID NO: 126829 - DNA, 19 bp, Artificial sequence
  SiRNA target sequence
aagaagaaatagtatattg

SEQ ID NO: 126830 - DNA, 19 bp, Artificial sequence
  SiRNA target sequence
agaagaaatagtatattgt

SEQ ID NO: 126831 - DNA, 19 bp, Artificial sequence
  SiRNA target sequence
gaagaaatagtatattgta

SEQ ID NO: 126832 - DNA, 19 bp, Artificial sequence
  SiRNA target sequence
aagaaatagtatattgtat

SEQ ID NO: 126833 - DNA, 19 bp, Artificial sequence
  SiRNA target sequence
agaaatagtatattgtatc

SEQ ID NO: 126834 - DNA, 19 bp, Artificial sequence
  SiRNA target sequence
gaaatagtatattgtatcg

SEQ ID NO: 126835 - DNA, 19 bp, Artificial sequence
  SiRNA target sequence
aaatagtatattgtatcga

SEQ ID NO: 126836 - DNA, 19 bp, Artificial sequence
  SiRNA target sequence
aatagtatattgtatcgaa

SEQ ID NO: 126837 - DNA, 19 bp, Artificial sequence
  SiRNA target sequence
atagtatattgtatcgaac

SEQ ID NO: 126838 - DNA, 19 bp, Artificial sequence
  SiRNA target sequence
tagtatattgtatcgaaca

SEQ ID NO: 126839 - DNA, 19 bp, Artificial sequence
  SiRNA target sequence
agtatattgtatcgaacat

SEQ ID NO: 126840 - DNA, 19 bp, Artificial sequence
  SiRNA target sequence
gtatattgtatcgaacatg

SEQ ID NO: 126841 - DNA, 19 bp, Artificial sequence
  SiRNA target sequence
tatattgtatcgaacatga

SEQ ID NO: 126842 - DNA, 19 bp, Artificial sequence
  SiRNA target sequence
atattgtatcgaacatgaa

SEQ ID NO: 126843 - DNA, 19 bp, Artificial sequence
  SiRNA target sequence
tattgtatcgaacatgaat

SEQ ID NO: 126844 - DNA, 19 bp, Artificial sequence
  SiRNA target sequence
attgtatcgaacatgaatt

SEQ ID NO: 126845 - DNA, 19 bp, Artificial sequence
  SiRNA target sequence
ttgtatcgaacatgaattg

SEQ ID NO: 126846 - DNA, 19 bp, Artificial sequence
  SiRNA target sequence
tgtatcgaacatgaattgg

SEQ ID NO: 126847 - DNA, 19 bp, Artificial sequence
  SiRNA target sequence
gtatcgaacatgaattggc

SEQ ID NO: 126848 - DNA, 19 bp, Artificial sequence
  SiRNA target sequence
tatcgaacatgaattggct

SEQ ID NO: 126849 - DNA, 19 bp, Artificial sequence
  SiRNA target sequence
atcgaacatgaattggctt

SEQ ID NO: 126850 - DNA, 19 bp, Artificial sequence
  SiRNA target sequence
tcgaacatgaattggctta

SEQ ID NO: 126851 - DNA, 19 bp, Artificial sequence
  SiRNA target sequence
cgaacatgaattggcttat

SEQ ID NO: 126852 - DNA, 19 bp, Artificial sequence
  SiRNA target sequence
gaacatgaattggcttatc

SEQ ID NO: 126853 - DNA, 19 bp, Artificial sequence
  SiRNA target sequence
aacatgaattggcttatcg

SEQ ID NO: 126854 - DNA, 19 bp, Artificial sequence
  SiRNA target sequence
acatgaattggcttatcgc

SEQ ID NO: 126855 - DNA, 19 bp, Artificial sequence
  SiRNA target sequence
catgaattggcttatcgca

SEQ ID NO: 126856 - DNA, 19 bp, Artificial sequence
  SiRNA target sequence
atgaattggcttatcgcat

SEQ ID NO: 126857 - DNA, 19 bp, Artificial sequence
  SiRNA target sequence
tgaattggcttatcgcatc

SEQ ID NO: 126858 - DNA, 19 bp, Artificial sequence
  SiRNA target sequence
gaattggcttatcgcatca

SEQ ID NO: 126859 - DNA, 19 bp, Artificial sequence
  SiRNA target sequence
aattggcttatcgcatcag

SEQ ID NO: 126860 - DNA, 19 bp, Artificial sequence
  SiRNA target sequence
attggcttatcgcatcagt

SEQ ID NO: 126861 - DNA, 19 bp, Artificial sequence
  SiRNA target sequence
ttggcttatcgcatcagtg

SEQ ID NO: 126862 - DNA, 19 bp, Artificial sequence
  SiRNA target sequence
tggcttatcgcatcagtga

SEQ ID NO: 126863 - DNA, 19 bp, Artificial sequence
  SiRNA target sequence
ggcttatcgcatcagtgat

SEQ ID NO: 126864 - DNA, 19 bp, Artificial sequence
  SiRNA target sequence
gcttatcgcatcagtgata

SEQ ID NO: 126865 - DNA, 19 bp, Artificial sequence
  SiRNA target sequence
cttatcgcatcagtgatat

SEQ ID NO: 126866 - DNA, 19 bp, Artificial sequence
  SiRNA target sequence
ttatcgcatcagtgatata

SEQ ID NO: 126867 - DNA, 19 bp, Artificial sequence
  SiRNA target sequence
tatcgcatcagtgatatat

SEQ ID NO: 126868 - DNA, 19 bp, Artificial sequence
  SiRNA target sequence
atcgcatcagtgatatatt

SEQ ID NO: 126869 - DNA, 19 bp, Artificial sequence
  SiRNA target sequence
tcgcatcagtgatatatta

SEQ ID NO: 126870 - DNA, 19 bp, Artificial sequence
  SiRNA target sequence
cgcatcagtgatatattat

SEQ ID NO: 126871 - DNA, 19 bp, Artificial sequence
  SiRNA target sequence
gcatcagtgatatattatt

SEQ ID NO: 126872 - DNA, 19 bp, Artificial sequence
  SiRNA target sequence
catcagtgatatattattt

SEQ ID NO: 126873 - DNA, 19 bp, Artificial sequence
  SiRNA target sequence
atcagtgatatattattta

SEQ ID NO: 126874 - DNA, 19 bp, Artificial sequence
  SiRNA target sequence
tcagtgatatattatttaa

SEQ ID NO: 126875 - DNA, 19 bp, Artificial sequence
  SiRNA target sequence
cagtgatatattatttaat

SEQ ID NO: 126876 - DNA, 19 bp, Artificial sequence
  SiRNA target sequence
agtgatatattatttaata

SEQ ID NO: 126877 - DNA, 19 bp, Artificial sequence
  SiRNA target sequence
gtgatatattatttaatag

SEQ ID NO: 126878 - DNA, 19 bp, Artificial sequence
  SiRNA target sequence
tgatatattatttaatagg

SEQ ID NO: 126879 - DNA, 19 bp, Artificial sequence
  SiRNA target sequence
gatatattatttaatagga

SEQ ID NO: 126880 - DNA, 19 bp, Artificial sequence
  SiRNA target sequence
atatattatttaataggat

SEQ ID NO: 126881 - DNA, 19 bp, Artificial sequence
  SiRNA target sequence
tatattatttaataggatg

SEQ ID NO: 126882 - DNA, 19 bp, Artificial sequence
  SiRNA target sequence
atattatttaataggatga

SEQ ID NO: 126883 - DNA, 19 bp, Artificial sequence
  SiRNA target sequence
tattatttaataggatgat

SEQ ID NO: 126884 - DNA, 19 bp, Artificial sequence
  SiRNA target sequence
attatttaataggatgatg

SEQ ID NO: 126885 - DNA, 19 bp, Artificial sequence
  SiRNA target sequence
ttatttaataggatgatga

SEQ ID NO: 126886 - DNA, 19 bp, Artificial sequence
  SiRNA target sequence
tatttaataggatgatgat

SEQ ID NO: 126887 - DNA, 19 bp, Artificial sequence
  SiRNA target sequence
atttaataggatgatgata

SEQ ID NO: 126888 - DNA, 19 bp, Artificial sequence
  SiRNA target sequence
tttaataggatgatgatag

SEQ ID NO: 126889 - DNA, 19 bp, Artificial sequence
  SiRNA target sequence
ttaataggatgatgatagg

SEQ ID NO: 126890 - DNA, 19 bp, Artificial sequence
  SiRNA target sequence
taataggatgatgatagga

SEQ ID NO: 126891 - DNA, 19 bp, Artificial sequence
  SiRNA target sequence
aataggatgatgataggat

SEQ ID NO: 126892 - DNA, 19 bp, Artificial sequence
  SiRNA target sequence
ataggatgatgataggata

SEQ ID NO: 126893 - DNA, 19 bp, Artificial sequence
  SiRNA target sequence
taggatgatgataggatac

SEQ ID NO: 126894 - DNA, 19 bp, Artificial sequence
  SiRNA target sequence
aggatgatgataggataca

SEQ ID NO: 126895 - DNA, 19 bp, Artificial sequence
  SiRNA target sequence
ggatgatgataggatacat

SEQ ID NO: 126896 - DNA, 19 bp, Artificial sequence
  SiRNA target sequence
gatgatgataggatacatt

SEQ ID NO: 126897 - DNA, 19 bp, Artificial sequence
  SiRNA target sequence
atgatgataggatacattg

SEQ ID NO: 126898 - DNA, 19 bp, Artificial sequence
  SiRNA target sequence
tgatgataggatacattga

SEQ ID NO: 126899 - DNA, 19 bp, Artificial sequence
  SiRNA target sequence
gatgataggatacattgac

SEQ ID NO: 126900 - DNA, 19 bp, Artificial sequence
  SiRNA target sequence
atgataggatacattgacg

SEQ ID NO: 126901 - DNA, 19 bp, Artificial sequence
  SiRNA target sequence
tgataggatacattgacgt

SEQ ID NO: 126902 - DNA, 19 bp, Artificial sequence
  SiRNA target sequence
gataggatacattgacgtc

SEQ ID NO: 126903 - DNA, 19 bp, Artificial sequence
  SiRNA target sequence
ataggatacattgacgtca

SEQ ID NO: 126904 - DNA, 19 bp, Artificial sequence
  SiRNA target sequence
taggatacattgacgtcag

SEQ ID NO: 126905 - DNA, 19 bp, Artificial sequence
  SiRNA target sequence
aggatacattgacgtcaga

SEQ ID NO: 126906 - DNA, 19 bp, Artificial sequence
  SiRNA target sequence
ggatacattgacgtcagaa

SEQ ID NO: 126907 - DNA, 19 bp, Artificial sequence
  SiRNA target sequence
gatacattgacgtcagaag

SEQ ID NO: 126908 - DNA, 19 bp, Artificial sequence
  SiRNA target sequence
atacattgacgtcagaaga

SEQ ID NO: 126909 - DNA, 19 bp, Artificial sequence
  SiRNA target sequence
tacattgacgtcagaagag

SEQ ID NO: 126910 - DNA, 19 bp, Artificial sequence
  SiRNA target sequence
acattgacgtcagaagagc

SEQ ID NO: 126911 - DNA, 19 bp, Artificial sequence
  SiRNA target sequence
cattgacgtcagaagagca

SEQ ID NO: 126912 - DNA, 19 bp, Artificial sequence
  SiRNA target sequence
attgacgtcagaagagcat

SEQ ID NO: 126913 - DNA, 19 bp, Artificial sequence
  SiRNA target sequence
ttgacgtcagaagagcatt

SEQ ID NO: 126914 - DNA, 19 bp, Artificial sequence
  SiRNA target sequence
tgacgtcagaagagcattt

SEQ ID NO: 126915 - DNA, 19 bp, Artificial sequence
  SiRNA target sequence
gacgtcagaagagcatttg

SEQ ID NO: 126916 - DNA, 19 bp, Artificial sequence
  SiRNA target sequence
acgtcagaagagcatttga

SEQ ID NO: 126917 - DNA, 19 bp, Artificial sequence
  SiRNA target sequence
cgtcagaagagcatttgat

SEQ ID NO: 126918 - DNA, 19 bp, Artificial sequence
  SiRNA target sequence
gtcagaagagcatttgatt

SEQ ID NO: 126919 - DNA, 19 bp, Artificial sequence
  SiRNA target sequence
tcagaagagcatttgattt

SEQ ID NO: 126920 - DNA, 19 bp, Artificial sequence
  SiRNA target sequence
cagaagagcatttgattta

SEQ ID NO: 126921 - DNA, 19 bp, Artificial sequence
  SiRNA target sequence
agaagagcatttgatttaa

SEQ ID NO: 126922 - DNA, 19 bp, Artificial sequence
  SiRNA target sequence
gaagagcatttgatttaat

SEQ ID NO: 126923 - DNA, 19 bp, Artificial sequence
  SiRNA target sequence
aagagcatttgatttaatt

SEQ ID NO: 126924 - DNA, 19 bp, Artificial sequence
  SiRNA target sequence
agagcatttgatttaattg

SEQ ID NO: 126925 - DNA, 19 bp, Artificial sequence
  SiRNA target sequence
gagcatttgatttaattgg

SEQ ID NO: 126926 - DNA, 19 bp, Artificial sequence
  SiRNA target sequence
agcatttgatttaattggt

SEQ ID NO: 126927 - DNA, 19 bp, Artificial sequence
  SiRNA target sequence
gcatttgatttaattggta

SEQ ID NO: 126928 - DNA, 19 bp, Artificial sequence
  SiRNA target sequence
catttgatttaattggtat

SEQ ID NO: 126929 - DNA, 19 bp, Artificial sequence
  SiRNA target sequence
atttgatttaattggtata

SEQ ID NO: 126930 - DNA, 19 bp, Artificial sequence
  SiRNA target sequence
tttgatttaattggtatag

SEQ ID NO: 126931 - DNA, 19 bp, Artificial sequence
  SiRNA target sequence
ttgatttaattggtatagt

SEQ ID NO: 126932 - DNA, 19 bp, Artificial sequence
  SiRNA target sequence
tgatttaattggtatagta

SEQ ID NO: 126933 - DNA, 19 bp, Artificial sequence
  SiRNA target sequence
gatttaattggtatagtag

SEQ ID NO: 126934 - DNA, 19 bp, Artificial sequence
  SiRNA target sequence
atttaattggtatagtagc

SEQ ID NO: 126935 - DNA, 19 bp, Artificial sequence
  SiRNA target sequence
tttaattggtatagtagct

SEQ ID NO: 126936 - DNA, 19 bp, Artificial sequence
  SiRNA target sequence
ttaattggtatagtagctg

SEQ ID NO: 126937 - DNA, 19 bp, Artificial sequence
  SiRNA target sequence
taattggtatagtagctga

SEQ ID NO: 126938 - DNA, 19 bp, Artificial sequence
  SiRNA target sequence
aattggtatagtagctgaa

SEQ ID NO: 126939 - DNA, 19 bp, Artificial sequence
  SiRNA target sequence
attggtatagtagctgaag

SEQ ID NO: 126940 - DNA, 19 bp, Artificial sequence
  SiRNA target sequence
ttggtatagtagctgaagt

SEQ ID NO: 126941 - DNA, 19 bp, Artificial sequence
  SiRNA target sequence
tggtatagtagctgaagta

SEQ ID NO: 126942 - DNA, 19 bp, Artificial sequence
  SiRNA target sequence
ggtatagtagctgaagtaa

SEQ ID NO: 126943 - DNA, 19 bp, Artificial sequence
  SiRNA target sequence
gtatagtagctgaagtaat

SEQ ID NO: 126944 - DNA, 19 bp, Artificial sequence
  SiRNA target sequence
tatagtagctgaagtaatg

SEQ ID NO: 126945 - DNA, 19 bp, Artificial sequence
  SiRNA target sequence
atagtagctgaagtaatga

SEQ ID NO: 126946 - DNA, 19 bp, Artificial sequence
  SiRNA target sequence
tagtagctgaagtaatgaa

SEQ ID NO: 126947 - DNA, 19 bp, Artificial sequence
  SiRNA target sequence
agtagctgaagtaatgaaa

SEQ ID NO: 126948 - DNA, 19 bp, Artificial sequence
  SiRNA target sequence
gtagctgaagtaatgaaag

SEQ ID NO: 126949 - DNA, 19 bp, Artificial sequence
  SiRNA target sequence
tagctgaagtaatgaaaga

SEQ ID NO: 126950 - DNA, 19 bp, Artificial sequence
  SiRNA target sequence
agctgaagtaatgaaagac

SEQ ID NO: 126951 - DNA, 19 bp, Artificial sequence
  SiRNA target sequence
gctgaagtaatgaaagact

SEQ ID NO: 126952 - DNA, 19 bp, Artificial sequence
  SiRNA target sequence
ctgaagtaatgaaagacta

SEQ ID NO: 126953 - DNA, 19 bp, Artificial sequence
  SiRNA target sequence
tgaagtaatgaaagactat

SEQ ID NO: 126954 - DNA, 19 bp, Artificial sequence
  SiRNA target sequence
gaagtaatgaaagactatt

SEQ ID NO: 126955 - DNA, 19 bp, Artificial sequence
  SiRNA target sequence
aagtaatgaaagactatta

SEQ ID NO: 126956 - DNA, 19 bp, Artificial sequence
  SiRNA target sequence
agtaatgaaagactattac

SEQ ID NO: 126957 - DNA, 19 bp, Artificial sequence
  SiRNA target sequence
gtaatgaaagactattacg

SEQ ID NO: 126958 - DNA, 19 bp, Artificial sequence
  SiRNA target sequence
taatgaaagactattacgg

SEQ ID NO: 126959 - DNA, 19 bp, Artificial sequence
  SiRNA target sequence
aatgaaagactattacgga

SEQ ID NO: 126960 - DNA, 19 bp, Artificial sequence
  SiRNA target sequence
atgaaagactattacggat

SEQ ID NO: 126961 - DNA, 19 bp, Artificial sequence
  SiRNA target sequence
tgaaagactattacggatg

SEQ ID NO: 126962 - DNA, 19 bp, Artificial sequence
  SiRNA target sequence
gaaagactattacggatgg

SEQ ID NO: 126963 - DNA, 19 bp, Artificial sequence
  SiRNA target sequence
aaagactattacggatggg

SEQ ID NO: 126964 - DNA, 19 bp, Artificial sequence
  SiRNA target sequence
aagactattacggatggga

SEQ ID NO: 126965 - DNA, 19 bp, Artificial sequence
  SiRNA target sequence
agactattacggatgggat

SEQ ID NO: 126966 - DNA, 19 bp, Artificial sequence
  SiRNA target sequence
gactattacggatgggatc

SEQ ID NO: 126967 - DNA, 19 bp, Artificial sequence
  SiRNA target sequence
actattacggatgggatca

SEQ ID NO: 126968 - DNA, 19 bp, Artificial sequence
  SiRNA target sequence
ctattacggatgggatcag

SEQ ID NO: 126969 - DNA, 19 bp, Artificial sequence
  SiRNA target sequence
tattacggatgggatcagc

SEQ ID NO: 126970 - DNA, 19 bp, Artificial sequence
  SiRNA target sequence
attacggatgggatcagca

SEQ ID NO: 126971 - DNA, 19 bp, Artificial sequence
  SiRNA target sequence
ttacggatgggatcagcaa

SEQ ID NO: 126972 - DNA, 19 bp, Artificial sequence
  SiRNA target sequence
tacggatgggatcagcaaa

SEQ ID NO: 126973 - DNA, 19 bp, Artificial sequence
  SiRNA target sequence
acggatgggatcagcaaag

SEQ ID NO: 126974 - DNA, 19 bp, Artificial sequence
  SiRNA target sequence
cggatgggatcagcaaaga

SEQ ID NO: 126975 - DNA, 19 bp, Artificial sequence
  SiRNA target sequence
ggatgggatcagcaaagat

SEQ ID NO: 126976 - DNA, 19 bp, Artificial sequence
  SiRNA target sequence
gatgggatcagcaaagata

SEQ ID NO: 126977 - DNA, 19 bp, Artificial sequence
  SiRNA target sequence
atgggatcagcaaagatat

SEQ ID NO: 126978 - DNA, 19 bp, Artificial sequence
  SiRNA target sequence
tgggatcagcaaagatata

SEQ ID NO: 126979 - DNA, 19 bp, Artificial sequence
  SiRNA target sequence
gggatcagcaaagatataa

SEQ ID NO: 126980 - DNA, 19 bp, Artificial sequence
  SiRNA target sequence
ggatcagcaaagatataat

SEQ ID NO: 126981 - DNA, 19 bp, Artificial sequence
  SiRNA target sequence
gatcagcaaagatataatg

SEQ ID NO: 126982 - DNA, 19 bp, Artificial sequence
  SiRNA target sequence
atcagcaaagatataatga

SEQ ID NO: 126983 - DNA, 19 bp, Artificial sequence
  SiRNA target sequence
tcagcaaagatataatgaa

SEQ ID NO: 126984 - DNA, 19 bp, Artificial sequence
  SiRNA target sequence
cagcaaagatataatgaag

SEQ ID NO: 126985 - DNA, 19 bp, Artificial sequence
  SiRNA target sequence
agcaaagatataatgaaga

SEQ ID NO: 126986 - DNA, 19 bp, Artificial sequence
  SiRNA target sequence
gcaaagatataatgaagaa

SEQ ID NO: 126987 - DNA, 19 bp, Artificial sequence
  SiRNA target sequence
caaagatataatgaagaaa

SEQ ID NO: 126988 - DNA, 19 bp, Artificial sequence
  SiRNA target sequence
aaagatataatgaagaaac

SEQ ID NO: 126989 - DNA, 19 bp, Artificial sequence
  SiRNA target sequence
aagatataatgaagaaaca

SEQ ID NO: 126990 - DNA, 19 bp, Artificial sequence
  SiRNA target sequence
agatataatgaagaaacaa

SEQ ID NO: 126991 - DNA, 19 bp, Artificial sequence
  SiRNA target sequence
gatataatgaagaaacaaa

SEQ ID NO: 126992 - DNA, 19 bp, Artificial sequence
  SiRNA target sequence
atataatgaagaaacaaaa

SEQ ID NO: 126993 - DNA, 19 bp, Artificial sequence
  SiRNA target sequence
tataatgaagaaacaaaat

SEQ ID NO: 126994 - DNA, 19 bp, Artificial sequence
  SiRNA target sequence
ataatgaagaaacaaaatt

SEQ ID NO: 126995 - DNA, 19 bp, Artificial sequence
  SiRNA target sequence
taatgaagaaacaaaatta

SEQ ID NO: 126996 - DNA, 19 bp, Artificial sequence
  SiRNA target sequence
aatgaagaaacaaaattat

SEQ ID NO: 126997 - DNA, 19 bp, Artificial sequence
  SiRNA target sequence
atgaagaaacaaaattatg

SEQ ID NO: 126998 - DNA, 19 bp, Artificial sequence
  SiRNA target sequence
tgaagaaacaaaattatgc

SEQ ID NO: 126999 - DNA, 19 bp, Artificial sequence
  SiRNA target sequence
gaagaaacaaaattatgca

SEQ ID NO: 127000 - DNA, 19 bp, Artificial sequence
  SiRNA target sequence
aagaaacaaaattatgcat

SEQ ID NO: 127001 - DNA, 19 bp, Artificial sequence
  SiRNA target sequence
agaaacaaaattatgcatg

SEQ ID NO: 127002 - DNA, 19 bp, Artificial sequence
  SiRNA target sequence
gaaacaaaattatgcatgg

SEQ ID NO: 127003 - DNA, 19 bp, Artificial sequence
  SiRNA target sequence
aaacaaaattatgcatgga

SEQ ID NO: 127004 - DNA, 19 bp, Artificial sequence
  SiRNA target sequence
aacaaaattatgcatggaa

SEQ ID NO: 127005 - DNA, 19 bp, Artificial sequence
  SiRNA target sequence
acaaaattatgcatggaaa

SEQ ID NO: 127006 - DNA, 19 bp, Artificial sequence
  SiRNA target sequence
caaaattatgcatggaaat

SEQ ID NO: 127007 - DNA, 19 bp, Artificial sequence
  SiRNA target sequence
aaaattatgcatggaaatg

SEQ ID NO: 127008 - DNA, 19 bp, Artificial sequence
  SiRNA target sequence
aaattatgcatggaaatga

SEQ ID NO: 127009 - DNA, 19 bp, Artificial sequence
  SiRNA target sequence
aattatgcatggaaatgat

SEQ ID NO: 127010 - DNA, 19 bp, Artificial sequence
  SiRNA target sequence
attatgcatggaaatgatg

SEQ ID NO: 127011 - DNA, 19 bp, Artificial sequence
  SiRNA target sequence
ttatgcatggaaatgatgg

SEQ ID NO: 127012 - DNA, 19 bp, Artificial sequence
  SiRNA target sequence
tatgcatggaaatgatgga

SEQ ID NO: 127013 - DNA, 19 bp, Artificial sequence
  SiRNA target sequence
atgcatggaaatgatggaa

SEQ ID NO: 127014 - DNA, 19 bp, Artificial sequence
  SiRNA target sequence
tgcatggaaatgatggaaa

SEQ ID NO: 127015 - DNA, 19 bp, Artificial sequence
  SiRNA target sequence
gcatggaaatgatggaaac

SEQ ID NO: 127016 - DNA, 19 bp, Artificial sequence
  SiRNA target sequence
catggaaatgatggaaact

SEQ ID NO: 127017 - DNA, 19 bp, Artificial sequence
  SiRNA target sequence
atggaaatgatggaaactt

SEQ ID NO: 127018 - DNA, 19 bp, Artificial sequence
  SiRNA target sequence
tggaaatgatggaaacttg

SEQ ID NO: 127019 - DNA, 19 bp, Artificial sequence
  SiRNA target sequence
ggaaatgatggaaacttgt

SEQ ID NO: 127020 - DNA, 19 bp, Artificial sequence
  SiRNA target sequence
gaaatgatggaaacttgtg

SEQ ID NO: 127021 - DNA, 19 bp, Artificial sequence
  SiRNA target sequence
aaatgatggaaacttgtgg

SEQ ID NO: 127022 - DNA, 19 bp, Artificial sequence
  SiRNA target sequence
aatgatggaaacttgtggt

SEQ ID NO: 127023 - DNA, 19 bp, Artificial sequence
  SiRNA target sequence
atgatggaaacttgtggtt

SEQ ID NO: 127024 - DNA, 19 bp, Artificial sequence
  SiRNA target sequence
tgatggaaacttgtggtta

SEQ ID NO: 127025 - DNA, 19 bp, Artificial sequence
  SiRNA target sequence
gatggaaacttgtggttat

SEQ ID NO: 127026 - DNA, 19 bp, Artificial sequence
  SiRNA target sequence
atggaaacttgtggttata

SEQ ID NO: 127027 - DNA, 19 bp, Artificial sequence
  SiRNA target sequence
tggaaacttgtggttatag

SEQ ID NO: 127028 - DNA, 19 bp, Artificial sequence
  SiRNA target sequence
ggaaacttgtggttatagt

SEQ ID NO: 127029 - DNA, 19 bp, Artificial sequence
  SiRNA target sequence
gaaacttgtggttatagtt

SEQ ID NO: 127030 - DNA, 19 bp, Artificial sequence
  SiRNA target sequence
aaacttgtggttatagttt

SEQ ID NO: 127031 - DNA, 19 bp, Artificial sequence
  SiRNA target sequence
aacttgtggttatagttta

SEQ ID NO: 127032 - DNA, 19 bp, Artificial sequence
  SiRNA target sequence
acttgtggttatagtttat

SEQ ID NO: 127033 - DNA, 19 bp, Artificial sequence
  SiRNA target sequence
cttgtggttatagtttatt

SEQ ID NO: 127034 - DNA, 19 bp, Artificial sequence
  SiRNA target sequence
ttgtggttatagtttatta

SEQ ID NO: 127035 - DNA, 19 bp, Artificial sequence
  SiRNA target sequence
tgtggttatagtttattaa

SEQ ID NO: 127036 - DNA, 19 bp, Artificial sequence
  SiRNA target sequence
gtggttatagtttattaaa

SEQ ID NO: 127037 - DNA, 19 bp, Artificial sequence
  SiRNA target sequence
tggttatagtttattaaaa

SEQ ID NO: 127038 - DNA, 19 bp, Artificial sequence
  SiRNA target sequence
ggttatagtttattaaaaa

SEQ ID NO: 127039 - DNA, 19 bp, Artificial sequence
  SiRNA target sequence
gttatagtttattaaaaaa

SEQ ID NO: 127040 - DNA, 19 bp, Artificial sequence
  SiRNA target sequence
ttatagtttattaaaaaat

SEQ ID NO: 127041 - DNA, 19 bp, Artificial sequence
  SiRNA target sequence
tatagtttattaaaaaatt

SEQ ID NO: 127042 - DNA, 19 bp, Artificial sequence
  SiRNA target sequence
atagtttattaaaaaatta

SEQ ID NO: 127043 - DNA, 19 bp, Artificial sequence
  SiRNA target sequence
tagtttattaaaaaattaa

SEQ ID NO: 127044 - DNA, 20 bp, Artificial sequence
  SiRNA target sequence
atggtgtataaggttttatt

SEQ ID NO: 127045 - DNA, 20 bp, Artificial sequence
  SiRNA target sequence
tggtgtataaggttttattt

SEQ ID NO: 127046 - DNA, 20 bp, Artificial sequence
  SiRNA target sequence
ggtgtataaggttttattta

SEQ ID NO: 127047 - DNA, 20 bp, Artificial sequence
  SiRNA target sequence
gtgtataaggttttatttac

SEQ ID NO: 127048 - DNA, 20 bp, Artificial sequence
  SiRNA target sequence
tgtataaggttttatttaca

SEQ ID NO: 127049 - DNA, 20 bp, Artificial sequence
  SiRNA target sequence
gtataaggttttatttacag

SEQ ID NO: 127050 - DNA, 20 bp, Artificial sequence
  SiRNA target sequence
tataaggttttatttacagt

SEQ ID NO: 127051 - DNA, 20 bp, Artificial sequence
  SiRNA target sequence
ataaggttttatttacagta

SEQ ID NO: 127052 - DNA, 20 bp, Artificial sequence
  SiRNA target sequence
taaggttttatttacagtaa

SEQ ID NO: 127053 - DNA, 20 bp, Artificial sequence
  SiRNA target sequence
aaggttttatttacagtaat

SEQ ID NO: 127054 - DNA, 20 bp, Artificial sequence
  SiRNA target sequence
aggttttatttacagtaata

SEQ ID NO: 127055 - DNA, 20 bp, Artificial sequence
  SiRNA target sequence
ggttttatttacagtaatag

SEQ ID NO: 127056 - DNA, 20 bp, Artificial sequence
  SiRNA target sequence
gttttatttacagtaatagg

SEQ ID NO: 127057 - DNA, 20 bp, Artificial sequence
  SiRNA target sequence
ttttatttacagtaatagga

SEQ ID NO: 127058 - DNA, 20 bp, Artificial sequence
  SiRNA target sequence
tttatttacagtaataggat

SEQ ID NO: 127059 - DNA, 20 bp, Artificial sequence
  SiRNA target sequence
ttatttacagtaataggatt

SEQ ID NO: 127060 - DNA, 20 bp, Artificial sequence
  SiRNA target sequence
tatttacagtaataggatta

SEQ ID NO: 127061 - DNA, 20 bp, Artificial sequence
  SiRNA target sequence
atttacagtaataggattaa

SEQ ID NO: 127062 - DNA, 20 bp, Artificial sequence
  SiRNA target sequence
tttacagtaataggattaat

SEQ ID NO: 127063 - DNA, 20 bp, Artificial sequence
  SiRNA target sequence
ttacagtaataggattaata

SEQ ID NO: 127064 - DNA, 20 bp, Artificial sequence
  SiRNA target sequence
tacagtaataggattaatat

SEQ ID NO: 127065 - DNA, 20 bp, Artificial sequence
  SiRNA target sequence
acagtaataggattaatatg

SEQ ID NO: 127066 - DNA, 20 bp, Artificial sequence
  SiRNA target sequence
cagtaataggattaatatgt

SEQ ID NO: 127067 - DNA, 20 bp, Artificial sequence
  SiRNA target sequence
agtaataggattaatatgtg

SEQ ID NO: 127068 - DNA, 20 bp, Artificial sequence
  SiRNA target sequence
gtaataggattaatatgtgg

SEQ ID NO: 127069 - DNA, 20 bp, Artificial sequence
  SiRNA target sequence
taataggattaatatgtggt

SEQ ID NO: 127070 - DNA, 20 bp, Artificial sequence
  SiRNA target sequence
aataggattaatatgtggta

SEQ ID NO: 127071 - DNA, 20 bp, Artificial sequence
  SiRNA target sequence
ataggattaatatgtggtat

SEQ ID NO: 127072 - DNA, 20 bp, Artificial sequence
  SiRNA target sequence
taggattaatatgtggtata

SEQ ID NO: 127073 - DNA, 20 bp, Artificial sequence
  SiRNA target sequence
aggattaatatgtggtatac

SEQ ID NO: 127074 - DNA, 20 bp, Artificial sequence
  SiRNA target sequence
ggattaatatgtggtatact

SEQ ID NO: 127075 - DNA, 20 bp, Artificial sequence
  SiRNA target sequence
gattaatatgtggtatactt

SEQ ID NO: 127076 - DNA, 20 bp, Artificial sequence
  SiRNA target sequence
attaatatgtggtatactta

SEQ ID NO: 127077 - DNA, 20 bp, Artificial sequence
  SiRNA target sequence
ttaatatgtggtatacttac

SEQ ID NO: 127078 - DNA, 20 bp, Artificial sequence
  SiRNA target sequence
taatatgtggtatacttaca

SEQ ID NO: 127079 - DNA, 20 bp, Artificial sequence
  SiRNA target sequence
aatatgtggtatacttacaa

SEQ ID NO: 127080 - DNA, 20 bp, Artificial sequence
  SiRNA target sequence
atatgtggtatacttacaat

SEQ ID NO: 127081 - DNA, 20 bp, Artificial sequence
  SiRNA target sequence
tatgtggtatacttacaata

SEQ ID NO: 127082 - DNA, 20 bp, Artificial sequence
  SiRNA target sequence
atgtggtatacttacaataa

SEQ ID NO: 127083 - DNA, 20 bp, Artificial sequence
  SiRNA target sequence
tgtggtatacttacaataat

SEQ ID NO: 127084 - DNA, 20 bp, Artificial sequence
  SiRNA target sequence
gtggtatacttacaataatt

SEQ ID NO: 127085 - DNA, 20 bp, Artificial sequence
  SiRNA target sequence
tggtatacttacaataatta

SEQ ID NO: 127086 - DNA, 20 bp, Artificial sequence
  SiRNA target sequence
ggtatacttacaataattaa

SEQ ID NO: 127087 - DNA, 20 bp, Artificial sequence
  SiRNA target sequence
gtatacttacaataattaaa

SEQ ID NO: 127088 - DNA, 20 bp, Artificial sequence
  SiRNA target sequence
tatacttacaataattaaac

SEQ ID NO: 127089 - DNA, 20 bp, Artificial sequence
  SiRNA target sequence
atacttacaataattaaacg

SEQ ID NO: 127090 - DNA, 20 bp, Artificial sequence
  SiRNA target sequence
tacttacaataattaaacga

SEQ ID NO: 127091 - DNA, 20 bp, Artificial sequence
  SiRNA target sequence
acttacaataattaaacgat

SEQ ID NO: 127092 - DNA, 20 bp, Artificial sequence
  SiRNA target sequence
cttacaataattaaacgata

SEQ ID NO: 127093 - DNA, 20 bp, Artificial sequence
  SiRNA target sequence
ttacaataattaaacgatac

SEQ ID NO: 127094 - DNA, 20 bp, Artificial sequence
  SiRNA target sequence
tacaataattaaacgataca

SEQ ID NO: 127095 - DNA, 20 bp, Artificial sequence
  SiRNA target sequence
acaataattaaacgatacaa

SEQ ID NO: 127096 - DNA, 20 bp, Artificial sequence
  SiRNA target sequence
caataattaaacgatacaag

SEQ ID NO: 127097 - DNA, 20 bp, Artificial sequence
  SiRNA target sequence
aataattaaacgatacaagt

SEQ ID NO: 127098 - DNA, 20 bp, Artificial sequence
  SiRNA target sequence
ataattaaacgatacaagta

SEQ ID NO: 127099 - DNA, 20 bp, Artificial sequence
  SiRNA target sequence
taattaaacgatacaagtat

SEQ ID NO: 127100 - DNA, 20 bp, Artificial sequence
  SiRNA target sequence
aattaaacgatacaagtatt

SEQ ID NO: 127101 - DNA, 20 bp, Artificial sequence
  SiRNA target sequence
attaaacgatacaagtattt

SEQ ID NO: 127102 - DNA, 20 bp, Artificial sequence
  SiRNA target sequence
ttaaacgatacaagtatttt

SEQ ID NO: 127103 - DNA, 20 bp, Artificial sequence
  SiRNA target sequence
taaacgatacaagtatttta

SEQ ID NO: 127104 - DNA, 20 bp, Artificial sequence
  SiRNA target sequence
aaacgatacaagtattttaa

SEQ ID NO: 127105 - DNA, 20 bp, Artificial sequence
  SiRNA target sequence
aacgatacaagtattttaag

SEQ ID NO: 127106 - DNA, 20 bp, Artificial sequence
  SiRNA target sequence
acgatacaagtattttaaga

SEQ ID NO: 127107 - DNA, 20 bp, Artificial sequence
  SiRNA target sequence
cgatacaagtattttaagat

SEQ ID NO: 127108 - DNA, 20 bp, Artificial sequence
  SiRNA target sequence
gatacaagtattttaagata

SEQ ID NO: 127109 - DNA, 20 bp, Artificial sequence
  SiRNA target sequence
atacaagtattttaagataa

SEQ ID NO: 127110 - DNA, 20 bp, Artificial sequence
  SiRNA target sequence
tacaagtattttaagataaa

SEQ ID NO: 127111 - DNA, 20 bp, Artificial sequence
  SiRNA target sequence
acaagtattttaagataaaa

SEQ ID NO: 127112 - DNA, 20 bp, Artificial sequence
  SiRNA target sequence
caagtattttaagataaaaa

SEQ ID NO: 127113 - DNA, 20 bp, Artificial sequence
  SiRNA target sequence
aagtattttaagataaaaaa

SEQ ID NO: 127114 - DNA, 20 bp, Artificial sequence
  SiRNA target sequence
agtattttaagataaaaaaa

SEQ ID NO: 127115 - DNA, 20 bp, Artificial sequence
  SiRNA target sequence
gtattttaagataaaaaaat

SEQ ID NO: 127116 - DNA, 20 bp, Artificial sequence
  SiRNA target sequence
tattttaagataaaaaaatt

SEQ ID NO: 127117 - DNA, 20 bp, Artificial sequence
  SiRNA target sequence
attttaagataaaaaaattg

SEQ ID NO: 127118 - DNA, 20 bp, Artificial sequence
  SiRNA target sequence
ttttaagataaaaaaattgg

SEQ ID NO: 127119 - DNA, 20 bp, Artificial sequence
  SiRNA target sequence
tttaagataaaaaaattggc

SEQ ID NO: 127120 - DNA, 20 bp, Artificial sequence
  SiRNA target sequence
ttaagataaaaaaattggcc

SEQ ID NO: 127121 - DNA, 20 bp, Artificial sequence
  SiRNA target sequence
taagataaaaaaattggcct

SEQ ID NO: 127122 - DNA, 20 bp, Artificial sequence
  SiRNA target sequence
aagataaaaaaattggcctt

SEQ ID NO: 127123 - DNA, 20 bp, Artificial sequence
  SiRNA target sequence
agataaaaaaattggcctta

SEQ ID NO: 127124 - DNA, 20 bp, Artificial sequence
  SiRNA target sequence
gataaaaaaattggccttaa

SEQ ID NO: 127125 - DNA, 20 bp, Artificial sequence
  SiRNA target sequence
ataaaaaaattggccttaac

SEQ ID NO: 127126 - DNA, 20 bp, Artificial sequence
  SiRNA target sequence
taaaaaaattggccttaact

SEQ ID NO: 127127 - DNA, 20 bp, Artificial sequence
  SiRNA target sequence
aaaaaaattggccttaactt

SEQ ID NO: 127128 - DNA, 20 bp, Artificial sequence
  SiRNA target sequence
aaaaaattggccttaactta

SEQ ID NO: 127129 - DNA, 20 bp, Artificial sequence
  SiRNA target sequence
aaaaattggccttaacttac

SEQ ID NO: 127130 - DNA, 20 bp, Artificial sequence
  SiRNA target sequence
aaaattggccttaacttact

SEQ ID NO: 127131 - DNA, 20 bp, Artificial sequence
  SiRNA target sequence
aaattggccttaacttactt

SEQ ID NO: 127132 - DNA, 20 bp, Artificial sequence
  SiRNA target sequence
aattggccttaacttacttc

SEQ ID NO: 127133 - DNA, 20 bp, Artificial sequence
  SiRNA target sequence
attggccttaacttacttcg

SEQ ID NO: 127134 - DNA, 20 bp, Artificial sequence
  SiRNA target sequence
ttggccttaacttacttcgg

SEQ ID NO: 127135 - DNA, 20 bp, Artificial sequence
  SiRNA target sequence
tggccttaacttacttcggg

SEQ ID NO: 127136 - DNA, 20 bp, Artificial sequence
  SiRNA target sequence
ggccttaacttacttcggga

SEQ ID NO: 127137 - DNA, 20 bp, Artificial sequence
  SiRNA target sequence
gccttaacttacttcgggaa

SEQ ID NO: 127138 - DNA, 20 bp, Artificial sequence
  SiRNA target sequence
ccttaacttacttcgggaaa

SEQ ID NO: 127139 - DNA, 20 bp, Artificial sequence
  SiRNA target sequence
cttaacttacttcgggaaac

SEQ ID NO: 127140 - DNA, 20 bp, Artificial sequence
  SiRNA target sequence
ttaacttacttcgggaaaca

SEQ ID NO: 127141 - DNA, 20 bp, Artificial sequence
  SiRNA target sequence
taacttacttcgggaaacaa

SEQ ID NO: 127142 - DNA, 20 bp, Artificial sequence
  SiRNA target sequence
aacttacttcgggaaacaag

SEQ ID NO: 127143 - DNA, 20 bp, Artificial sequence
  SiRNA target sequence
acttacttcgggaaacaaga

SEQ ID NO: 127144 - DNA, 20 bp, Artificial sequence
  SiRNA target sequence
cttacttcgggaaacaagac

SEQ ID NO: 127145 - DNA, 20 bp, Artificial sequence
  SiRNA target sequence
ttacttcgggaaacaagact

SEQ ID NO: 127146 - DNA, 20 bp, Artificial sequence
  SiRNA target sequence
tacttcgggaaacaagactt

SEQ ID NO: 127147 - DNA, 20 bp, Artificial sequence
  SiRNA target sequence
acttcgggaaacaagacttg

SEQ ID NO: 127148 - DNA, 20 bp, Artificial sequence
  SiRNA target sequence
cttcgggaaacaagacttgc

SEQ ID NO: 127149 - DNA, 20 bp, Artificial sequence
  SiRNA target sequence
ttcgggaaacaagacttgca

SEQ ID NO: 127150 - DNA, 20 bp, Artificial sequence
  SiRNA target sequence
tcgggaaacaagacttgcaa

SEQ ID NO: 127151 - DNA, 20 bp, Artificial sequence
  SiRNA target sequence
cgggaaacaagacttgcaat

SEQ ID NO: 127152 - DNA, 20 bp, Artificial sequence
  SiRNA target sequence
gggaaacaagacttgcaatg

SEQ ID NO: 127153 - DNA, 20 bp, Artificial sequence
  SiRNA target sequence
ggaaacaagacttgcaatgg

SEQ ID NO: 127154 - DNA, 20 bp, Artificial sequence
  SiRNA target sequence
gaaacaagacttgcaatgga

SEQ ID NO: 127155 - DNA, 20 bp, Artificial sequence
  SiRNA target sequence
aaacaagacttgcaatggaa

SEQ ID NO: 127156 - DNA, 20 bp, Artificial sequence
  SiRNA target sequence
aacaagacttgcaatggaaa

SEQ ID NO: 127157 - DNA, 20 bp, Artificial sequence
  SiRNA target sequence
acaagacttgcaatggaaac

SEQ ID NO: 127158 - DNA, 20 bp, Artificial sequence
  SiRNA target sequence
caagacttgcaatggaaacc

SEQ ID NO: 127159 - DNA, 20 bp, Artificial sequence
  SiRNA target sequence
aagacttgcaatggaaacct

SEQ ID NO: 127160 - DNA, 20 bp, Artificial sequence
  SiRNA target sequence
agacttgcaatggaaaccta

SEQ ID NO: 127161 - DNA, 20 bp, Artificial sequence
  SiRNA target sequence
gacttgcaatggaaacctaa

SEQ ID NO: 127162 - DNA, 20 bp, Artificial sequence
  SiRNA target sequence
acttgcaatggaaacctaaa

SEQ ID NO: 127163 - DNA, 20 bp, Artificial sequence
  SiRNA target sequence
cttgcaatggaaacctaaaa

SEQ ID NO: 127164 - DNA, 20 bp, Artificial sequence
  SiRNA target sequence
ttgcaatggaaacctaaaag

SEQ ID NO: 127165 - DNA, 20 bp, Artificial sequence
  SiRNA target sequence
tgcaatggaaacctaaaagt

SEQ ID NO: 127166 - DNA, 20 bp, Artificial sequence
  SiRNA target sequence
gcaatggaaacctaaaagtc

SEQ ID NO: 127167 - DNA, 20 bp, Artificial sequence
  SiRNA target sequence
caatggaaacctaaaagtcg

SEQ ID NO: 127168 - DNA, 20 bp, Artificial sequence
  SiRNA target sequence
aatggaaacctaaaagtcgg

SEQ ID NO: 127169 - DNA, 20 bp, Artificial sequence
  SiRNA target sequence
atggaaacctaaaagtcggt

SEQ ID NO: 127170 - DNA, 20 bp, Artificial sequence
  SiRNA target sequence
tggaaacctaaaagtcggtc

SEQ ID NO: 127171 - DNA, 20 bp, Artificial sequence
  SiRNA target sequence
ggaaacctaaaagtcggtca

SEQ ID NO: 127172 - DNA, 20 bp, Artificial sequence
  SiRNA target sequence
gaaacctaaaagtcggtcag

SEQ ID NO: 127173 - DNA, 20 bp, Artificial sequence
  SiRNA target sequence
aaacctaaaagtcggtcaga

SEQ ID NO: 127174 - DNA, 20 bp, Artificial sequence
  SiRNA target sequence
aacctaaaagtcggtcagaa

SEQ ID NO: 127175 - DNA, 20 bp, Artificial sequence
  SiRNA target sequence
acctaaaagtcggtcagaaa

SEQ ID NO: 127176 - DNA, 20 bp, Artificial sequence
  SiRNA target sequence
cctaaaagtcggtcagaaat

SEQ ID NO: 127177 - DNA, 20 bp, Artificial sequence
  SiRNA target sequence
ctaaaagtcggtcagaaatt

SEQ ID NO: 127178 - DNA, 20 bp, Artificial sequence
  SiRNA target sequence
taaaagtcggtcagaaatta

SEQ ID NO: 127179 - DNA, 20 bp, Artificial sequence
  SiRNA target sequence
aaaagtcggtcagaaattat

SEQ ID NO: 127180 - DNA, 20 bp, Artificial sequence
  SiRNA target sequence
aaagtcggtcagaaattatt

SEQ ID NO: 127181 - DNA, 20 bp, Artificial sequence
  SiRNA target sequence
aagtcggtcagaaattatta

SEQ ID NO: 127182 - DNA, 20 bp, Artificial sequence
  SiRNA target sequence
agtcggtcagaaattattaa

SEQ ID NO: 127183 - DNA, 20 bp, Artificial sequence
  SiRNA target sequence
gtcggtcagaaattattaac

SEQ ID NO: 127184 - DNA, 20 bp, Artificial sequence
  SiRNA target sequence
tcggtcagaaattattaacg

SEQ ID NO: 127185 - DNA, 20 bp, Artificial sequence
  SiRNA target sequence
cggtcagaaattattaacga

SEQ ID NO: 127186 - DNA, 20 bp, Artificial sequence
  SiRNA target sequence
ggtcagaaattattaacgat

SEQ ID NO: 127187 - DNA, 20 bp, Artificial sequence
  SiRNA target sequence
gtcagaaattattaacgatt

SEQ ID NO: 127188 - DNA, 20 bp, Artificial sequence
  SiRNA target sequence
tcagaaattattaacgattt

SEQ ID NO: 127189 - DNA, 20 bp, Artificial sequence
  SiRNA target sequence
cagaaattattaacgattta

SEQ ID NO: 127190 - DNA, 20 bp, Artificial sequence
  SiRNA target sequence
agaaattattaacgatttaa

SEQ ID NO: 127191 - DNA, 20 bp, Artificial sequence
  SiRNA target sequence
gaaattattaacgatttaaa

SEQ ID NO: 127192 - DNA, 20 bp, Artificial sequence
  SiRNA target sequence
aaattattaacgatttaaaa

SEQ ID NO: 127193 - DNA, 20 bp, Artificial sequence
  SiRNA target sequence
aattattaacgatttaaaaa

SEQ ID NO: 127194 - DNA, 20 bp, Artificial sequence
  SiRNA target sequence
attattaacgatttaaaaaa

SEQ ID NO: 127195 - DNA, 20 bp, Artificial sequence
  SiRNA target sequence
ttattaacgatttaaaaaat

SEQ ID NO: 127196 - DNA, 20 bp, Artificial sequence
  SiRNA target sequence
tattaacgatttaaaaaata

SEQ ID NO: 127197 - DNA, 20 bp, Artificial sequence
  SiRNA target sequence
attaacgatttaaaaaatac

SEQ ID NO: 127198 - DNA, 20 bp, Artificial sequence
  SiRNA target sequence
ttaacgatttaaaaaataca

SEQ ID NO: 127199 - DNA, 20 bp, Artificial sequence
  SiRNA target sequence
taacgatttaaaaaatacaa

SEQ ID NO: 127200 - DNA, 20 bp, Artificial sequence
  SiRNA target sequence
aacgatttaaaaaatacaaa

SEQ ID NO: 127201 - DNA, 20 bp, Artificial sequence
  SiRNA target sequence
acgatttaaaaaatacaaac

SEQ ID NO: 127202 - DNA, 20 bp, Artificial sequence
  SiRNA target sequence
cgatttaaaaaatacaaact

SEQ ID NO: 127203 - DNA, 20 bp, Artificial sequence
  SiRNA target sequence
gatttaaaaaatacaaactt

SEQ ID NO: 127204 - DNA, 20 bp, Artificial sequence
  SiRNA target sequence
atttaaaaaatacaaacttt

SEQ ID NO: 127205 - DNA, 20 bp, Artificial sequence
  SiRNA target sequence
tttaaaaaatacaaactttg

SEQ ID NO: 127206 - DNA, 20 bp, Artificial sequence
  SiRNA target sequence
ttaaaaaatacaaactttga

SEQ ID NO: 127207 - DNA, 20 bp, Artificial sequence
  SiRNA target sequence
taaaaaatacaaactttgac

SEQ ID NO: 127208 - DNA, 20 bp, Artificial sequence
  SiRNA target sequence
aaaaaatacaaactttgaca

SEQ ID NO: 127209 - DNA, 20 bp, Artificial sequence
  SiRNA target sequence
aaaaatacaaactttgacat

SEQ ID NO: 127210 - DNA, 20 bp, Artificial sequence
  SiRNA target sequence
aaaatacaaactttgacata

SEQ ID NO: 127211 - DNA, 20 bp, Artificial sequence
  SiRNA target sequence
aaatacaaactttgacatat

SEQ ID NO: 127212 - DNA, 20 bp, Artificial sequence
  SiRNA target sequence
aatacaaactttgacatatt

SEQ ID NO: 127213 - DNA, 20 bp, Artificial sequence
  SiRNA target sequence
atacaaactttgacatattg

SEQ ID NO: 127214 - DNA, 20 bp, Artificial sequence
  SiRNA target sequence
tacaaactttgacatattga

SEQ ID NO: 127215 - DNA, 20 bp, Artificial sequence
  SiRNA target sequence
acaaactttgacatattgat

SEQ ID NO: 127216 - DNA, 20 bp, Artificial sequence
  SiRNA target sequence
caaactttgacatattgatt

SEQ ID NO: 127217 - DNA, 20 bp, Artificial sequence
  SiRNA target sequence
aaactttgacatattgatta

SEQ ID NO: 127218 - DNA, 20 bp, Artificial sequence
  SiRNA target sequence
aactttgacatattgattat

SEQ ID NO: 127219 - DNA, 20 bp, Artificial sequence
  SiRNA target sequence
actttgacatattgattatt

SEQ ID NO: 127220 - DNA, 20 bp, Artificial sequence
  SiRNA target sequence
ctttgacatattgattattg

SEQ ID NO: 127221 - DNA, 20 bp, Artificial sequence
  SiRNA target sequence
tttgacatattgattattgg

SEQ ID NO: 127222 - DNA, 20 bp, Artificial sequence
  SiRNA target sequence
ttgacatattgattattggt

SEQ ID NO: 127223 - DNA, 20 bp, Artificial sequence
  SiRNA target sequence
tgacatattgattattggtg

SEQ ID NO: 127224 - DNA, 20 bp, Artificial sequence
  SiRNA target sequence
gacatattgattattggtgg

SEQ ID NO: 127225 - DNA, 20 bp, Artificial sequence
  SiRNA target sequence
acatattgattattggtggc

SEQ ID NO: 127226 - DNA, 20 bp, Artificial sequence
  SiRNA target sequence
catattgattattggtggcg

SEQ ID NO: 127227 - DNA, 20 bp, Artificial sequence
  SiRNA target sequence
atattgattattggtggcgg

SEQ ID NO: 127228 - DNA, 20 bp, Artificial sequence
  SiRNA target sequence
tattgattattggtggcggt

SEQ ID NO: 127229 - DNA, 20 bp, Artificial sequence
  SiRNA target sequence
attgattattggtggcggtt

SEQ ID NO: 127230 - DNA, 20 bp, Artificial sequence
  SiRNA target sequence
ttgattattggtggcggttc

SEQ ID NO: 127231 - DNA, 20 bp, Artificial sequence
  SiRNA target sequence
tgattattggtggcggttca

SEQ ID NO: 127232 - DNA, 20 bp, Artificial sequence
  SiRNA target sequence
gattattggtggcggttcaa

SEQ ID NO: 127233 - DNA, 20 bp, Artificial sequence
  SiRNA target sequence
attattggtggcggttcaac

SEQ ID NO: 127234 - DNA, 20 bp, Artificial sequence
  SiRNA target sequence
ttattggtggcggttcaacg

SEQ ID NO: 127235 - DNA, 20 bp, Artificial sequence
  SiRNA target sequence
tattggtggcggttcaacgg

SEQ ID NO: 127236 - DNA, 20 bp, Artificial sequence
  SiRNA target sequence
attggtggcggttcaacggg

SEQ ID NO: 127237 - DNA, 20 bp, Artificial sequence
  SiRNA target sequence
ttggtggcggttcaacggga

SEQ ID NO: 127238 - DNA, 20 bp, Artificial sequence
  SiRNA target sequence
tggtggcggttcaacgggaa

SEQ ID NO: 127239 - DNA, 20 bp, Artificial sequence
  SiRNA target sequence
ggtggcggttcaacgggaat

SEQ ID NO: 127240 - DNA, 20 bp, Artificial sequence
  SiRNA target sequence
gtggcggttcaacgggaatg

SEQ ID NO: 127241 - DNA, 20 bp, Artificial sequence
  SiRNA target sequence
tggcggttcaacgggaatgg

SEQ ID NO: 127242 - DNA, 20 bp, Artificial sequence
  SiRNA target sequence
ggcggttcaacgggaatggg

SEQ ID NO: 127243 - DNA, 20 bp, Artificial sequence
  SiRNA target sequence
gcggttcaacgggaatggga

SEQ ID NO: 127244 - DNA, 20 bp, Artificial sequence
  SiRNA target sequence
cggttcaacgggaatgggat

SEQ ID NO: 127245 - DNA, 20 bp, Artificial sequence
  SiRNA target sequence
ggttcaacgggaatgggatg

SEQ ID NO: 127246 - DNA, 20 bp, Artificial sequence
  SiRNA target sequence
gttcaacgggaatgggatgt

SEQ ID NO: 127247 - DNA, 20 bp, Artificial sequence
  SiRNA target sequence
ttcaacgggaatgggatgtg

SEQ ID NO: 127248 - DNA, 20 bp, Artificial sequence
  SiRNA target sequence
tcaacgggaatgggatgtgc

SEQ ID NO: 127249 - DNA, 20 bp, Artificial sequence
  SiRNA target sequence
caacgggaatgggatgtgca

SEQ ID NO: 127250 - DNA, 20 bp, Artificial sequence
  SiRNA target sequence
aacgggaatgggatgtgcaa

SEQ ID NO: 127251 - DNA, 20 bp, Artificial sequence
  SiRNA target sequence
acgggaatgggatgtgcaat

SEQ ID NO: 127252 - DNA, 20 bp, Artificial sequence
  SiRNA target sequence
cgggaatgggatgtgcaatc

SEQ ID NO: 127253 - DNA, 20 bp, Artificial sequence
  SiRNA target sequence
gggaatgggatgtgcaatcg

SEQ ID NO: 127254 - DNA, 20 bp, Artificial sequence
  SiRNA target sequence
ggaatgggatgtgcaatcga

SEQ ID NO: 127255 - DNA, 20 bp, Artificial sequence
  SiRNA target sequence
gaatgggatgtgcaatcgaa

SEQ ID NO: 127256 - DNA, 20 bp, Artificial sequence
  SiRNA target sequence
aatgggatgtgcaatcgaag

SEQ ID NO: 127257 - DNA, 20 bp, Artificial sequence
  SiRNA target sequence
atgggatgtgcaatcgaagc

SEQ ID NO: 127258 - DNA, 20 bp, Artificial sequence
  SiRNA target sequence
tgggatgtgcaatcgaagca

SEQ ID NO: 127259 - DNA, 20 bp, Artificial sequence
  SiRNA target sequence
gggatgtgcaatcgaagcag

SEQ ID NO: 127260 - DNA, 20 bp, Artificial sequence
  SiRNA target sequence
ggatgtgcaatcgaagcagc

SEQ ID NO: 127261 - DNA, 20 bp, Artificial sequence
  SiRNA target sequence
gatgtgcaatcgaagcagct

SEQ ID NO: 127262 - DNA, 20 bp, Artificial sequence
  SiRNA target sequence
atgtgcaatcgaagcagcta

SEQ ID NO: 127263 - DNA, 20 bp, Artificial sequence
  SiRNA target sequence
tgtgcaatcgaagcagctac

SEQ ID NO: 127264 - DNA, 20 bp, Artificial sequence
  SiRNA target sequence
gtgcaatcgaagcagctaca

SEQ ID NO: 127265 - DNA, 20 bp, Artificial sequence
  SiRNA target sequence
tgcaatcgaagcagctacac

SEQ ID NO: 127266 - DNA, 20 bp, Artificial sequence
  SiRNA target sequence
gcaatcgaagcagctacacg

SEQ ID NO: 127267 - DNA, 20 bp, Artificial sequence
  SiRNA target sequence
caatcgaagcagctacacga

SEQ ID NO: 127268 - DNA, 20 bp, Artificial sequence
  SiRNA target sequence
aatcgaagcagctacacgag

SEQ ID NO: 127269 - DNA, 20 bp, Artificial sequence
  SiRNA target sequence
atcgaagcagctacacgagg

SEQ ID NO: 127270 - DNA, 20 bp, Artificial sequence
  SiRNA target sequence
tcgaagcagctacacgaggt

SEQ ID NO: 127271 - DNA, 20 bp, Artificial sequence
  SiRNA target sequence
cgaagcagctacacgaggta

SEQ ID NO: 127272 - DNA, 20 bp, Artificial sequence
  SiRNA target sequence
gaagcagctacacgaggtat

SEQ ID NO: 127273 - DNA, 20 bp, Artificial sequence
  SiRNA target sequence
aagcagctacacgaggtata

SEQ ID NO: 127274 - DNA, 20 bp, Artificial sequence
  SiRNA target sequence
agcagctacacgaggtataa

SEQ ID NO: 127275 - DNA, 20 bp, Artificial sequence
  SiRNA target sequence
gcagctacacgaggtataag

SEQ ID NO: 127276 - DNA, 20 bp, Artificial sequence
  SiRNA target sequence
cagctacacgaggtataagt

SEQ ID NO: 127277 - DNA, 20 bp, Artificial sequence
  SiRNA target sequence
agctacacgaggtataagtg

SEQ ID NO: 127278 - DNA, 20 bp, Artificial sequence
  SiRNA target sequence
gctacacgaggtataagtgt

SEQ ID NO: 127279 - DNA, 20 bp, Artificial sequence
  SiRNA target sequence
ctacacgaggtataagtgtt

SEQ ID NO: 127280 - DNA, 20 bp, Artificial sequence
  SiRNA target sequence
tacacgaggtataagtgttg

SEQ ID NO: 127281 - DNA, 20 bp, Artificial sequence
  SiRNA target sequence
acacgaggtataagtgttgg

SEQ ID NO: 127282 - DNA, 20 bp, Artificial sequence
  SiRNA target sequence
cacgaggtataagtgttggc

SEQ ID NO: 127283 - DNA, 20 bp, Artificial sequence
  SiRNA target sequence
acgaggtataagtgttggcc

SEQ ID NO: 127284 - DNA, 20 bp, Artificial sequence
  SiRNA target sequence
cgaggtataagtgttggcct

SEQ ID NO: 127285 - DNA, 20 bp, Artificial sequence
  SiRNA target sequence
gaggtataagtgttggcctg

SEQ ID NO: 127286 - DNA, 20 bp, Artificial sequence
  SiRNA target sequence
aggtataagtgttggcctga

SEQ ID NO: 127287 - DNA, 20 bp, Artificial sequence
  SiRNA target sequence
ggtataagtgttggcctgat

SEQ ID NO: 127288 - DNA, 20 bp, Artificial sequence
  SiRNA target sequence
gtataagtgttggcctgata

SEQ ID NO: 127289 - DNA, 20 bp, Artificial sequence
  SiRNA target sequence
tataagtgttggcctgatag

SEQ ID NO: 127290 - DNA, 20 bp, Artificial sequence
  SiRNA target sequence
ataagtgttggcctgataga

SEQ ID NO: 127291 - DNA, 20 bp, Artificial sequence
  SiRNA target sequence
taagtgttggcctgatagaa

SEQ ID NO: 127292 - DNA, 20 bp, Artificial sequence
  SiRNA target sequence
aagtgttggcctgatagaag

SEQ ID NO: 127293 - DNA, 20 bp, Artificial sequence
  SiRNA target sequence
agtgttggcctgatagaagc

SEQ ID NO: 127294 - DNA, 20 bp, Artificial sequence
  SiRNA target sequence
gtgttggcctgatagaagca

SEQ ID NO: 127295 - DNA, 20 bp, Artificial sequence
  SiRNA target sequence
tgttggcctgatagaagcac

SEQ ID NO: 127296 - DNA, 20 bp, Artificial sequence
  SiRNA target sequence
gttggcctgatagaagcaca

SEQ ID NO: 127297 - DNA, 20 bp, Artificial sequence
  SiRNA target sequence
ttggcctgatagaagcacat

SEQ ID NO: 127298 - DNA, 20 bp, Artificial sequence
  SiRNA target sequence
tggcctgatagaagcacatg

SEQ ID NO: 127299 - DNA, 20 bp, Artificial sequence
  SiRNA target sequence
ggcctgatagaagcacatga

SEQ ID NO: 127300 - DNA, 20 bp, Artificial sequence
  SiRNA target sequence
gcctgatagaagcacatgat

SEQ ID NO: 127301 - DNA, 20 bp, Artificial sequence
  SiRNA target sequence
cctgatagaagcacatgatt

SEQ ID NO: 127302 - DNA, 20 bp, Artificial sequence
  SiRNA target sequence
ctgatagaagcacatgattt

SEQ ID NO: 127303 - DNA, 20 bp, Artificial sequence
  SiRNA target sequence
tgatagaagcacatgatttt

SEQ ID NO: 127304 - DNA, 20 bp, Artificial sequence
  SiRNA target sequence
gatagaagcacatgattttg

SEQ ID NO: 127305 - DNA, 20 bp, Artificial sequence
  SiRNA target sequence
atagaagcacatgattttgg

SEQ ID NO: 127306 - DNA, 20 bp, Artificial sequence
  SiRNA target sequence
tagaagcacatgattttggt

SEQ ID NO: 127307 - DNA, 20 bp, Artificial sequence
  SiRNA target sequence
agaagcacatgattttggtt

SEQ ID NO: 127308 - DNA, 20 bp, Artificial sequence
  SiRNA target sequence
gaagcacatgattttggttc

SEQ ID NO: 127309 - DNA, 20 bp, Artificial sequence
  SiRNA target sequence
aagcacatgattttggttcg

SEQ ID NO: 127310 - DNA, 20 bp, Artificial sequence
  SiRNA target sequence
agcacatgattttggttcgg

SEQ ID NO: 127311 - DNA, 20 bp, Artificial sequence
  SiRNA target sequence
gcacatgattttggttcggg

SEQ ID NO: 127312 - DNA, 20 bp, Artificial sequence
  SiRNA target sequence
cacatgattttggttcgggc

SEQ ID NO: 127313 - DNA, 20 bp, Artificial sequence
  SiRNA target sequence
acatgattttggttcgggca

SEQ ID NO: 127314 - DNA, 20 bp, Artificial sequence
  SiRNA target sequence
catgattttggttcgggcac

SEQ ID NO: 127315 - DNA, 20 bp, Artificial sequence
  SiRNA target sequence
atgattttggttcgggcacg

SEQ ID NO: 127316 - DNA, 20 bp, Artificial sequence
  SiRNA target sequence
tgattttggttcgggcacga

SEQ ID NO: 127317 - DNA, 20 bp, Artificial sequence
  SiRNA target sequence
gattttggttcgggcacgag

SEQ ID NO: 127318 - DNA, 20 bp, Artificial sequence
  SiRNA target sequence
attttggttcgggcacgagt

SEQ ID NO: 127319 - DNA, 20 bp, Artificial sequence
  SiRNA target sequence
ttttggttcgggcacgagtt

SEQ ID NO: 127320 - DNA, 20 bp, Artificial sequence
  SiRNA target sequence
tttggttcgggcacgagttc

SEQ ID NO: 127321 - DNA, 20 bp, Artificial sequence
  SiRNA target sequence
ttggttcgggcacgagttca

SEQ ID NO: 127322 - DNA, 20 bp, Artificial sequence
  SiRNA target sequence
tggttcgggcacgagttcaa

SEQ ID NO: 127323 - DNA, 20 bp, Artificial sequence
  SiRNA target sequence
ggttcgggcacgagttcaaa

SEQ ID NO: 127324 - DNA, 20 bp, Artificial sequence
  SiRNA target sequence
gttcgggcacgagttcaaaa

SEQ ID NO: 127325 - DNA, 20 bp, Artificial sequence
  SiRNA target sequence
ttcgggcacgagttcaaaat

SEQ ID NO: 127326 - DNA, 20 bp, Artificial sequence
  SiRNA target sequence
tcgggcacgagttcaaaatc

SEQ ID NO: 127327 - DNA, 20 bp, Artificial sequence
  SiRNA target sequence
cgggcacgagttcaaaatct

SEQ ID NO: 127328 - DNA, 20 bp, Artificial sequence
  SiRNA target sequence
gggcacgagttcaaaatcta

SEQ ID NO: 127329 - DNA, 20 bp, Artificial sequence
  SiRNA target sequence
ggcacgagttcaaaatctac

SEQ ID NO: 127330 - DNA, 20 bp, Artificial sequence
  SiRNA target sequence
gcacgagttcaaaatctaca

SEQ ID NO: 127331 - DNA, 20 bp, Artificial sequence
  SiRNA target sequence
cacgagttcaaaatctacaa

SEQ ID NO: 127332 - DNA, 20 bp, Artificial sequence
  SiRNA target sequence
acgagttcaaaatctacaaa

SEQ ID NO: 127333 - DNA, 20 bp, Artificial sequence
  SiRNA target sequence
cgagttcaaaatctacaaaa

SEQ ID NO: 127334 - DNA, 20 bp, Artificial sequence
  SiRNA target sequence
gagttcaaaatctacaaaac

SEQ ID NO: 127335 - DNA, 20 bp, Artificial sequence
  SiRNA target sequence
agttcaaaatctacaaaact

SEQ ID NO: 127336 - DNA, 20 bp, Artificial sequence
  SiRNA target sequence
gttcaaaatctacaaaactt

SEQ ID NO: 127337 - DNA, 20 bp, Artificial sequence
  SiRNA target sequence
ttcaaaatctacaaaacttt

SEQ ID NO: 127338 - DNA, 20 bp, Artificial sequence
  SiRNA target sequence
tcaaaatctacaaaactttt

SEQ ID NO: 127339 - DNA, 20 bp, Artificial sequence
  SiRNA target sequence
caaaatctacaaaacttttt

SEQ ID NO: 127340 - DNA, 20 bp, Artificial sequence
  SiRNA target sequence
aaaatctacaaaactttttc

SEQ ID NO: 127341 - DNA, 20 bp, Artificial sequence
  SiRNA target sequence
aaatctacaaaactttttca

SEQ ID NO: 127342 - DNA, 20 bp, Artificial sequence
  SiRNA target sequence
aatctacaaaactttttcat

SEQ ID NO: 127343 - DNA, 20 bp, Artificial sequence
  SiRNA target sequence
atctacaaaactttttcatg

SEQ ID NO: 127344 - DNA, 20 bp, Artificial sequence
  SiRNA target sequence
tctacaaaactttttcatgg

SEQ ID NO: 127345 - DNA, 20 bp, Artificial sequence
  SiRNA target sequence
ctacaaaactttttcatggc

SEQ ID NO: 127346 - DNA, 20 bp, Artificial sequence
  SiRNA target sequence
tacaaaactttttcatggcg

SEQ ID NO: 127347 - DNA, 20 bp, Artificial sequence
  SiRNA target sequence
acaaaactttttcatggcgg

SEQ ID NO: 127348 - DNA, 20 bp, Artificial sequence
  SiRNA target sequence
caaaactttttcatggcggt

SEQ ID NO: 127349 - DNA, 20 bp, Artificial sequence
  SiRNA target sequence
aaaactttttcatggcggtg

SEQ ID NO: 127350 - DNA, 20 bp, Artificial sequence
  SiRNA target sequence
aaactttttcatggcggtgt

SEQ ID NO: 127351 - DNA, 20 bp, Artificial sequence
  SiRNA target sequence
aactttttcatggcggtgta

SEQ ID NO: 127352 - DNA, 20 bp, Artificial sequence
  SiRNA target sequence
actttttcatggcggtgtac

SEQ ID NO: 127353 - DNA, 20 bp, Artificial sequence
  SiRNA target sequence
ctttttcatggcggtgtacg

SEQ ID NO: 127354 - DNA, 20 bp, Artificial sequence
  SiRNA target sequence
tttttcatggcggtgtacgc

SEQ ID NO: 127355 - DNA, 20 bp, Artificial sequence
  SiRNA target sequence
ttttcatggcggtgtacgct

SEQ ID NO: 127356 - DNA, 20 bp, Artificial sequence
  SiRNA target sequence
tttcatggcggtgtacgcta

SEQ ID NO: 127357 - DNA, 20 bp, Artificial sequence
  SiRNA target sequence
ttcatggcggtgtacgctac

SEQ ID NO: 127358 - DNA, 20 bp, Artificial sequence
  SiRNA target sequence
tcatggcggtgtacgctacc

SEQ ID NO: 127359 - DNA, 20 bp, Artificial sequence
  SiRNA target sequence
catggcggtgtacgctacct

SEQ ID NO: 127360 - DNA, 20 bp, Artificial sequence
  SiRNA target sequence
atggcggtgtacgctacctt

SEQ ID NO: 127361 - DNA, 20 bp, Artificial sequence
  SiRNA target sequence
tggcggtgtacgctaccttg

SEQ ID NO: 127362 - DNA, 20 bp, Artificial sequence
  SiRNA target sequence
ggcggtgtacgctaccttga

SEQ ID NO: 127363 - DNA, 20 bp, Artificial sequence
  SiRNA target sequence
gcggtgtacgctaccttgaa

SEQ ID NO: 127364 - DNA, 20 bp, Artificial sequence
  SiRNA target sequence
cggtgtacgctaccttgaaa

SEQ ID NO: 127365 - DNA, 20 bp, Artificial sequence
  SiRNA target sequence
ggtgtacgctaccttgaaaa

SEQ ID NO: 127366 - DNA, 20 bp, Artificial sequence
  SiRNA target sequence
gtgtacgctaccttgaaaaa

SEQ ID NO: 127367 - DNA, 20 bp, Artificial sequence
  SiRNA target sequence
tgtacgctaccttgaaaaag

SEQ ID NO: 127368 - DNA, 20 bp, Artificial sequence
  SiRNA target sequence
gtacgctaccttgaaaaagc

SEQ ID NO: 127369 - DNA, 20 bp, Artificial sequence
  SiRNA target sequence
tacgctaccttgaaaaagct

SEQ ID NO: 127370 - DNA, 20 bp, Artificial sequence
  SiRNA target sequence
acgctaccttgaaaaagctg

SEQ ID NO: 127371 - DNA, 20 bp, Artificial sequence
  SiRNA target sequence
cgctaccttgaaaaagctgt

SEQ ID NO: 127372 - DNA, 20 bp, Artificial sequence
  SiRNA target sequence
gctaccttgaaaaagctgtt

SEQ ID NO: 127373 - DNA, 20 bp, Artificial sequence
  SiRNA target sequence
ctaccttgaaaaagctgtta

SEQ ID NO: 127374 - DNA, 20 bp, Artificial sequence
  SiRNA target sequence
taccttgaaaaagctgttaa

SEQ ID NO: 127375 - DNA, 20 bp, Artificial sequence
  SiRNA target sequence
accttgaaaaagctgttaat

SEQ ID NO: 127376 - DNA, 20 bp, Artificial sequence
  SiRNA target sequence
ccttgaaaaagctgttaatg

SEQ ID NO: 127377 - DNA, 20 bp, Artificial sequence
  SiRNA target sequence
cttgaaaaagctgttaatga

SEQ ID NO: 127378 - DNA, 20 bp, Artificial sequence
  SiRNA target sequence
ttgaaaaagctgttaatgat

SEQ ID NO: 127379 - DNA, 20 bp, Artificial sequence
  SiRNA target sequence
tgaaaaagctgttaatgatt

SEQ ID NO: 127380 - DNA, 20 bp, Artificial sequence
  SiRNA target sequence
gaaaaagctgttaatgattt

SEQ ID NO: 127381 - DNA, 20 bp, Artificial sequence
  SiRNA target sequence
aaaaagctgttaatgattta

SEQ ID NO: 127382 - DNA, 20 bp, Artificial sequence
  SiRNA target sequence
aaaagctgttaatgatttag

SEQ ID NO: 127383 - DNA, 20 bp, Artificial sequence
  SiRNA target sequence
aaagctgttaatgatttaga

SEQ ID NO: 127384 - DNA, 20 bp, Artificial sequence
  SiRNA target sequence
aagctgttaatgatttagat

SEQ ID NO: 127385 - DNA, 20 bp, Artificial sequence
  SiRNA target sequence
agctgttaatgatttagata

SEQ ID NO: 127386 - DNA, 20 bp, Artificial sequence
  SiRNA target sequence
gctgttaatgatttagatag

SEQ ID NO: 127387 - DNA, 20 bp, Artificial sequence
  SiRNA target sequence
ctgttaatgatttagataga

SEQ ID NO: 127388 - DNA, 20 bp, Artificial sequence
  SiRNA target sequence
tgttaatgatttagatagat

SEQ ID NO: 127389 - DNA, 20 bp, Artificial sequence
  SiRNA target sequence
gttaatgatttagatagatc

SEQ ID NO: 127390 - DNA, 20 bp, Artificial sequence
  SiRNA target sequence
ttaatgatttagatagatct

SEQ ID NO: 127391 - DNA, 20 bp, Artificial sequence
  SiRNA target sequence
taatgatttagatagatctc

SEQ ID NO: 127392 - DNA, 20 bp, Artificial sequence
  SiRNA target sequence
aatgatttagatagatctca

SEQ ID NO: 127393 - DNA, 20 bp, Artificial sequence
  SiRNA target sequence
atgatttagatagatctcag

SEQ ID NO: 127394 - DNA, 20 bp, Artificial sequence
  SiRNA target sequence
tgatttagatagatctcagt

SEQ ID NO: 127395 - DNA, 20 bp, Artificial sequence
  SiRNA target sequence
gatttagatagatctcagtt

SEQ ID NO: 127396 - DNA, 20 bp, Artificial sequence
  SiRNA target sequence
atttagatagatctcagttt

SEQ ID NO: 127397 - DNA, 20 bp, Artificial sequence
  SiRNA target sequence
tttagatagatctcagtttg

SEQ ID NO: 127398 - DNA, 20 bp, Artificial sequence
  SiRNA target sequence
ttagatagatctcagtttga

SEQ ID NO: 127399 - DNA, 20 bp, Artificial sequence
  SiRNA target sequence
tagatagatctcagtttgac

SEQ ID NO: 127400 - DNA, 20 bp, Artificial sequence
  SiRNA target sequence
agatagatctcagtttgact

SEQ ID NO: 127401 - DNA, 20 bp, Artificial sequence
  SiRNA target sequence
gatagatctcagtttgactt

SEQ ID NO: 127402 - DNA, 20 bp, Artificial sequence
  SiRNA target sequence
atagatctcagtttgacttg

SEQ ID NO: 127403 - DNA, 20 bp, Artificial sequence
  SiRNA target sequence
tagatctcagtttgacttgg

SEQ ID NO: 127404 - DNA, 20 bp, Artificial sequence
  SiRNA target sequence
agatctcagtttgacttggt

SEQ ID NO: 127405 - DNA, 20 bp, Artificial sequence
  SiRNA target sequence
gatctcagtttgacttggta

SEQ ID NO: 127406 - DNA, 20 bp, Artificial sequence
  SiRNA target sequence
atctcagtttgacttggtat

SEQ ID NO: 127407 - DNA, 20 bp, Artificial sequence
  SiRNA target sequence
tctcagtttgacttggtatc

SEQ ID NO: 127408 - DNA, 20 bp, Artificial sequence
  SiRNA target sequence
ctcagtttgacttggtatct

SEQ ID NO: 127409 - DNA, 20 bp, Artificial sequence
  SiRNA target sequence
tcagtttgacttggtatctg

SEQ ID NO: 127410 - DNA, 20 bp, Artificial sequence
  SiRNA target sequence
cagtttgacttggtatctga

SEQ ID NO: 127411 - DNA, 20 bp, Artificial sequence
  SiRNA target sequence
agtttgacttggtatctgaa

SEQ ID NO: 127412 - DNA, 20 bp, Artificial sequence
  SiRNA target sequence
gtttgacttggtatctgaag

SEQ ID NO: 127413 - DNA, 20 bp, Artificial sequence
  SiRNA target sequence
tttgacttggtatctgaagc

SEQ ID NO: 127414 - DNA, 20 bp, Artificial sequence
  SiRNA target sequence
ttgacttggtatctgaagca

SEQ ID NO: 127415 - DNA, 20 bp, Artificial sequence
  SiRNA target sequence
tgacttggtatctgaagcat

SEQ ID NO: 127416 - DNA, 20 bp, Artificial sequence
  SiRNA target sequence
gacttggtatctgaagcatt

SEQ ID NO: 127417 - DNA, 20 bp, Artificial sequence
  SiRNA target sequence
acttggtatctgaagcatta

SEQ ID NO: 127418 - DNA, 20 bp, Artificial sequence
  SiRNA target sequence
cttggtatctgaagcattaa

SEQ ID NO: 127419 - DNA, 20 bp, Artificial sequence
  SiRNA target sequence
ttggtatctgaagcattaag

SEQ ID NO: 127420 - DNA, 20 bp, Artificial sequence
  SiRNA target sequence
tggtatctgaagcattaagt

SEQ ID NO: 127421 - DNA, 20 bp, Artificial sequence
  SiRNA target sequence
ggtatctgaagcattaagtg

SEQ ID NO: 127422 - DNA, 20 bp, Artificial sequence
  SiRNA target sequence
gtatctgaagcattaagtga

SEQ ID NO: 127423 - DNA, 20 bp, Artificial sequence
  SiRNA target sequence
tatctgaagcattaagtgaa

SEQ ID NO: 127424 - DNA, 20 bp, Artificial sequence
  SiRNA target sequence
atctgaagcattaagtgaac

SEQ ID NO: 127425 - DNA, 20 bp, Artificial sequence
  SiRNA target sequence
tctgaagcattaagtgaacg

SEQ ID NO: 127426 - DNA, 20 bp, Artificial sequence
  SiRNA target sequence
ctgaagcattaagtgaacga

SEQ ID NO: 127427 - DNA, 20 bp, Artificial sequence
  SiRNA target sequence
tgaagcattaagtgaacgaa

SEQ ID NO: 127428 - DNA, 20 bp, Artificial sequence
  SiRNA target sequence
gaagcattaagtgaacgaaa

SEQ ID NO: 127429 - DNA, 20 bp, Artificial sequence
  SiRNA target sequence
aagcattaagtgaacgaaaa

SEQ ID NO: 127430 - DNA, 20 bp, Artificial sequence
  SiRNA target sequence
agcattaagtgaacgaaaaa

SEQ ID NO: 127431 - DNA, 20 bp, Artificial sequence
  SiRNA target sequence
gcattaagtgaacgaaaaat

SEQ ID NO: 127432 - DNA, 20 bp, Artificial sequence
  SiRNA target sequence
cattaagtgaacgaaaaatt

SEQ ID NO: 127433 - DNA, 20 bp, Artificial sequence
  SiRNA target sequence
attaagtgaacgaaaaattg

SEQ ID NO: 127434 - DNA, 20 bp, Artificial sequence
  SiRNA target sequence
ttaagtgaacgaaaaattgt

SEQ ID NO: 127435 - DNA, 20 bp, Artificial sequence
  SiRNA target sequence
taagtgaacgaaaaattgtt

SEQ ID NO: 127436 - DNA, 20 bp, Artificial sequence
  SiRNA target sequence
aagtgaacgaaaaattgtta

SEQ ID NO: 127437 - DNA, 20 bp, Artificial sequence
  SiRNA target sequence
agtgaacgaaaaattgttat

SEQ ID NO: 127438 - DNA, 20 bp, Artificial sequence
  SiRNA target sequence
gtgaacgaaaaattgttatg

SEQ ID NO: 127439 - DNA, 20 bp, Artificial sequence
  SiRNA target sequence
tgaacgaaaaattgttatga

SEQ ID NO: 127440 - DNA, 20 bp, Artificial sequence
  SiRNA target sequence
gaacgaaaaattgttatgaa

SEQ ID NO: 127441 - DNA, 20 bp, Artificial sequence
  SiRNA target sequence
aacgaaaaattgttatgaat

SEQ ID NO: 127442 - DNA, 20 bp, Artificial sequence
  SiRNA target sequence
acgaaaaattgttatgaata

SEQ ID NO: 127443 - DNA, 20 bp, Artificial sequence
  SiRNA target sequence
cgaaaaattgttatgaatat

SEQ ID NO: 127444 - DNA, 20 bp, Artificial sequence
  SiRNA target sequence
gaaaaattgttatgaatatg

SEQ ID NO: 127445 - DNA, 20 bp, Artificial sequence
  SiRNA target sequence
aaaaattgttatgaatatgt

SEQ ID NO: 127446 - DNA, 20 bp, Artificial sequence
  SiRNA target sequence
aaaattgttatgaatatgtg

SEQ ID NO: 127447 - DNA, 20 bp, Artificial sequence
  SiRNA target sequence
aaattgttatgaatatgtgt

SEQ ID NO: 127448 - DNA, 20 bp, Artificial sequence
  SiRNA target sequence
aattgttatgaatatgtgtc

SEQ ID NO: 127449 - DNA, 20 bp, Artificial sequence
  SiRNA target sequence
attgttatgaatatgtgtcc

SEQ ID NO: 127450 - DNA, 20 bp, Artificial sequence
  SiRNA target sequence
ttgttatgaatatgtgtcct

SEQ ID NO: 127451 - DNA, 20 bp, Artificial sequence
  SiRNA target sequence
tgttatgaatatgtgtcctt

SEQ ID NO: 127452 - DNA, 20 bp, Artificial sequence
  SiRNA target sequence
gttatgaatatgtgtccttt

SEQ ID NO: 127453 - DNA, 20 bp, Artificial sequence
  SiRNA target sequence
ttatgaatatgtgtcctttt

SEQ ID NO: 127454 - DNA, 20 bp, Artificial sequence
  SiRNA target sequence
tatgaatatgtgtccttttc

SEQ ID NO: 127455 - DNA, 20 bp, Artificial sequence
  SiRNA target sequence
atgaatatgtgtccttttct

SEQ ID NO: 127456 - DNA, 20 bp, Artificial sequence
  SiRNA target sequence
tgaatatgtgtccttttcta

SEQ ID NO: 127457 - DNA, 20 bp, Artificial sequence
  SiRNA target sequence
gaatatgtgtccttttctag

SEQ ID NO: 127458 - DNA, 20 bp, Artificial sequence
  SiRNA target sequence
aatatgtgtccttttctagt

SEQ ID NO: 127459 - DNA, 20 bp, Artificial sequence
  SiRNA target sequence
atatgtgtccttttctagta

SEQ ID NO: 127460 - DNA, 20 bp, Artificial sequence
  SiRNA target sequence
tatgtgtccttttctagtaa

SEQ ID NO: 127461 - DNA, 20 bp, Artificial sequence
  SiRNA target sequence
atgtgtccttttctagtaag

SEQ ID NO: 127462 - DNA, 20 bp, Artificial sequence
  SiRNA target sequence
tgtgtccttttctagtaagg

SEQ ID NO: 127463 - DNA, 20 bp, Artificial sequence
  SiRNA target sequence
gtgtccttttctagtaaggt

SEQ ID NO: 127464 - DNA, 20 bp, Artificial sequence
  SiRNA target sequence
tgtccttttctagtaaggtc

SEQ ID NO: 127465 - DNA, 20 bp, Artificial sequence
  SiRNA target sequence
gtccttttctagtaaggtcg

SEQ ID NO: 127466 - DNA, 20 bp, Artificial sequence
  SiRNA target sequence
tccttttctagtaaggtcga

SEQ ID NO: 127467 - DNA, 20 bp, Artificial sequence
  SiRNA target sequence
ccttttctagtaaggtcgat

SEQ ID NO: 127468 - DNA, 20 bp, Artificial sequence
  SiRNA target sequence
cttttctagtaaggtcgatg

SEQ ID NO: 127469 - DNA, 20 bp, Artificial sequence
  SiRNA target sequence
ttttctagtaaggtcgatgg

SEQ ID NO: 127470 - DNA, 20 bp, Artificial sequence
  SiRNA target sequence
tttctagtaaggtcgatgga

SEQ ID NO: 127471 - DNA, 20 bp, Artificial sequence
  SiRNA target sequence
ttctagtaaggtcgatggaa

SEQ ID NO: 127472 - DNA, 20 bp, Artificial sequence
  SiRNA target sequence
tctagtaaggtcgatggaaa

SEQ ID NO: 127473 - DNA, 20 bp, Artificial sequence
  SiRNA target sequence
ctagtaaggtcgatggaaat

SEQ ID NO: 127474 - DNA, 20 bp, Artificial sequence
  SiRNA target sequence
tagtaaggtcgatggaaata

SEQ ID NO: 127475 - DNA, 20 bp, Artificial sequence
  SiRNA target sequence
agtaaggtcgatggaaatat

SEQ ID NO: 127476 - DNA, 20 bp, Artificial sequence
  SiRNA target sequence
gtaaggtcgatggaaatatt

SEQ ID NO: 127477 - DNA, 20 bp, Artificial sequence
  SiRNA target sequence
taaggtcgatggaaatatta

SEQ ID NO: 127478 - DNA, 20 bp, Artificial sequence
  SiRNA target sequence
aaggtcgatggaaatattat

SEQ ID NO: 127479 - DNA, 20 bp, Artificial sequence
  SiRNA target sequence
aggtcgatggaaatattatt

SEQ ID NO: 127480 - DNA, 20 bp, Artificial sequence
  SiRNA target sequence
ggtcgatggaaatattattt

SEQ ID NO: 127481 - DNA, 20 bp, Artificial sequence
  SiRNA target sequence
gtcgatggaaatattatttc

SEQ ID NO: 127482 - DNA, 20 bp, Artificial sequence
  SiRNA target sequence
tcgatggaaatattatttcc

SEQ ID NO: 127483 - DNA, 20 bp, Artificial sequence
  SiRNA target sequence
cgatggaaatattatttccg

SEQ ID NO: 127484 - DNA, 20 bp, Artificial sequence
  SiRNA target sequence
gatggaaatattatttccgg

SEQ ID NO: 127485 - DNA, 20 bp, Artificial sequence
  SiRNA target sequence
atggaaatattatttccggt

SEQ ID NO: 127486 - DNA, 20 bp, Artificial sequence
  SiRNA target sequence
tggaaatattatttccggtt

SEQ ID NO: 127487 - DNA, 20 bp, Artificial sequence
  SiRNA target sequence
ggaaatattatttccggttt

SEQ ID NO: 127488 - DNA, 20 bp, Artificial sequence
  SiRNA target sequence
gaaatattatttccggttta

SEQ ID NO: 127489 - DNA, 20 bp, Artificial sequence
  SiRNA target sequence
aaatattatttccggtttat

SEQ ID NO: 127490 - DNA, 20 bp, Artificial sequence
  SiRNA target sequence
aatattatttccggtttata

SEQ ID NO: 127491 - DNA, 20 bp, Artificial sequence
  SiRNA target sequence
atattatttccggtttataa

SEQ ID NO: 127492 - DNA, 20 bp, Artificial sequence
  SiRNA target sequence
tattatttccggtttataaa

SEQ ID NO: 127493 - DNA, 20 bp, Artificial sequence
  SiRNA target sequence
attatttccggtttataaaa

SEQ ID NO: 127494 - DNA, 20 bp, Artificial sequence
  SiRNA target sequence
ttatttccggtttataaaag

SEQ ID NO: 127495 - DNA, 20 bp, Artificial sequence
  SiRNA target sequence
tatttccggtttataaaagg

SEQ ID NO: 127496 - DNA, 20 bp, Artificial sequence
  SiRNA target sequence
atttccggtttataaaaggc

SEQ ID NO: 127497 - DNA, 20 bp, Artificial sequence
  SiRNA target sequence
tttccggtttataaaaggct

SEQ ID NO: 127498 - DNA, 20 bp, Artificial sequence
  SiRNA target sequence
ttccggtttataaaaggctt

SEQ ID NO: 127499 - DNA, 20 bp, Artificial sequence
  SiRNA target sequence
tccggtttataaaaggcttt

SEQ ID NO: 127500 - DNA, 20 bp, Artificial sequence
  SiRNA target sequence
ccggtttataaaaggctttt

SEQ ID NO: 127501 - DNA, 20 bp, Artificial sequence
  SiRNA target sequence
cggtttataaaaggctttta

SEQ ID NO: 127502 - DNA, 20 bp, Artificial sequence
  SiRNA target sequence
ggtttataaaaggcttttaa

SEQ ID NO: 127503 - DNA, 20 bp, Artificial sequence
  SiRNA target sequence
gtttataaaaggcttttaat

SEQ ID NO: 127504 - DNA, 20 bp, Artificial sequence
  SiRNA target sequence
tttataaaaggcttttaatt

SEQ ID NO: 127505 - DNA, 20 bp, Artificial sequence
  SiRNA target sequence
ttataaaaggcttttaattc

SEQ ID NO: 127506 - DNA, 20 bp, Artificial sequence
  SiRNA target sequence
tataaaaggcttttaattcc

SEQ ID NO: 127507 - DNA, 20 bp, Artificial sequence
  SiRNA target sequence
ataaaaggcttttaattcct

SEQ ID NO: 127508 - DNA, 20 bp, Artificial sequence
  SiRNA target sequence
taaaaggcttttaattcctt

SEQ ID NO: 127509 - DNA, 20 bp, Artificial sequence
  SiRNA target sequence
aaaaggcttttaattcctta

SEQ ID NO: 127510 - DNA, 20 bp, Artificial sequence
  SiRNA target sequence
aaaggcttttaattccttac

SEQ ID NO: 127511 - DNA, 20 bp, Artificial sequence
  SiRNA target sequence
aaggcttttaattccttact

SEQ ID NO: 127512 - DNA, 20 bp, Artificial sequence
  SiRNA target sequence
aggcttttaattccttacta

SEQ ID NO: 127513 - DNA, 20 bp, Artificial sequence
  SiRNA target sequence
ggcttttaattccttactac

SEQ ID NO: 127514 - DNA, 20 bp, Artificial sequence
  SiRNA target sequence
gcttttaattccttactact

SEQ ID NO: 127515 - DNA, 20 bp, Artificial sequence
  SiRNA target sequence
cttttaattccttactacta

SEQ ID NO: 127516 - DNA, 20 bp, Artificial sequence
  SiRNA target sequence
ttttaattccttactactat

SEQ ID NO: 127517 - DNA, 20 bp, Artificial sequence
  SiRNA target sequence
tttaattccttactactata

SEQ ID NO: 127518 - DNA, 20 bp, Artificial sequence
  SiRNA target sequence
ttaattccttactactatat

SEQ ID NO: 127519 - DNA, 20 bp, Artificial sequence
  SiRNA target sequence
taattccttactactatatt

SEQ ID NO: 127520 - DNA, 20 bp, Artificial sequence
  SiRNA target sequence
aattccttactactatattg

SEQ ID NO: 127521 - DNA, 20 bp, Artificial sequence
  SiRNA target sequence
attccttactactatattgg

SEQ ID NO: 127522 - DNA, 20 bp, Artificial sequence
  SiRNA target sequence
ttccttactactatattggc

SEQ ID NO: 127523 - DNA, 20 bp, Artificial sequence
  SiRNA target sequence
tccttactactatattggcc

SEQ ID NO: 127524 - DNA, 20 bp, Artificial sequence
  SiRNA target sequence
ccttactactatattggcct

SEQ ID NO: 127525 - DNA, 20 bp, Artificial sequence
  SiRNA target sequence
cttactactatattggcctt

SEQ ID NO: 127526 - DNA, 20 bp, Artificial sequence
  SiRNA target sequence
ttactactatattggcctta

SEQ ID NO: 127527 - DNA, 20 bp, Artificial sequence
  SiRNA target sequence
tactactatattggccttaa

SEQ ID NO: 127528 - DNA, 20 bp, Artificial sequence
  SiRNA target sequence
actactatattggccttaaa

SEQ ID NO: 127529 - DNA, 20 bp, Artificial sequence
  SiRNA target sequence
ctactatattggccttaaat

SEQ ID NO: 127530 - DNA, 20 bp, Artificial sequence
  SiRNA target sequence
tactatattggccttaaatt

SEQ ID NO: 127531 - DNA, 20 bp, Artificial sequence
  SiRNA target sequence
actatattggccttaaattt

SEQ ID NO: 127532 - DNA, 20 bp, Artificial sequence
  SiRNA target sequence
ctatattggccttaaatttt

SEQ ID NO: 127533 - DNA, 20 bp, Artificial sequence
  SiRNA target sequence
tatattggccttaaatttta

SEQ ID NO: 127534 - DNA, 20 bp, Artificial sequence
  SiRNA target sequence
atattggccttaaattttat

SEQ ID NO: 127535 - DNA, 20 bp, Artificial sequence
  SiRNA target sequence
tattggccttaaattttatg

SEQ ID NO: 127536 - DNA, 20 bp, Artificial sequence
  SiRNA target sequence
attggccttaaattttatga

SEQ ID NO: 127537 - DNA, 20 bp, Artificial sequence
  SiRNA target sequence
ttggccttaaattttatgat

SEQ ID NO: 127538 - DNA, 20 bp, Artificial sequence
  SiRNA target sequence
tggccttaaattttatgatt

SEQ ID NO: 127539 - DNA, 20 bp, Artificial sequence
  SiRNA target sequence
ggccttaaattttatgattg

SEQ ID NO: 127540 - DNA, 20 bp, Artificial sequence
  SiRNA target sequence
gccttaaattttatgattgg

SEQ ID NO: 127541 - DNA, 20 bp, Artificial sequence
  SiRNA target sequence
ccttaaattttatgattgga

SEQ ID NO: 127542 - DNA, 20 bp, Artificial sequence
  SiRNA target sequence
cttaaattttatgattggat

SEQ ID NO: 127543 - DNA, 20 bp, Artificial sequence
  SiRNA target sequence
ttaaattttatgattggatt

SEQ ID NO: 127544 - DNA, 20 bp, Artificial sequence
  SiRNA target sequence
taaattttatgattggattt

SEQ ID NO: 127545 - DNA, 20 bp, Artificial sequence
  SiRNA target sequence
aaattttatgattggatttc

SEQ ID NO: 127546 - DNA, 20 bp, Artificial sequence
  SiRNA target sequence
aattttatgattggatttct

SEQ ID NO: 127547 - DNA, 20 bp, Artificial sequence
  SiRNA target sequence
attttatgattggatttctg

SEQ ID NO: 127548 - DNA, 20 bp, Artificial sequence
  SiRNA target sequence
ttttatgattggatttctgg

SEQ ID NO: 127549 - DNA, 20 bp, Artificial sequence
  SiRNA target sequence
tttatgattggatttctggg

SEQ ID NO: 127550 - DNA, 20 bp, Artificial sequence
  SiRNA target sequence
ttatgattggatttctgggc

SEQ ID NO: 127551 - DNA, 20 bp, Artificial sequence
  SiRNA target sequence
tatgattggatttctgggca

SEQ ID NO: 127552 - DNA, 20 bp, Artificial sequence
  SiRNA target sequence
atgattggatttctgggcaa

SEQ ID NO: 127553 - DNA, 20 bp, Artificial sequence
  SiRNA target sequence
tgattggatttctgggcaac

SEQ ID NO: 127554 - DNA, 20 bp, Artificial sequence
  SiRNA target sequence
gattggatttctgggcaacg

SEQ ID NO: 127555 - DNA, 20 bp, Artificial sequence
  SiRNA target sequence
attggatttctgggcaacgg

SEQ ID NO: 127556 - DNA, 20 bp, Artificial sequence
  SiRNA target sequence
ttggatttctgggcaacggt

SEQ ID NO: 127557 - DNA, 20 bp, Artificial sequence
  SiRNA target sequence
tggatttctgggcaacggtc

SEQ ID NO: 127558 - DNA, 20 bp, Artificial sequence
  SiRNA target sequence
ggatttctgggcaacggtcc

SEQ ID NO: 127559 - DNA, 20 bp, Artificial sequence
  SiRNA target sequence
gatttctgggcaacggtccc

SEQ ID NO: 127560 - DNA, 20 bp, Artificial sequence
  SiRNA target sequence
atttctgggcaacggtccct

SEQ ID NO: 127561 - DNA, 20 bp, Artificial sequence
  SiRNA target sequence
tttctgggcaacggtccctt

SEQ ID NO: 127562 - DNA, 20 bp, Artificial sequence
  SiRNA target sequence
ttctgggcaacggtcccttg

SEQ ID NO: 127563 - DNA, 20 bp, Artificial sequence
  SiRNA target sequence
tctgggcaacggtcccttgg

SEQ ID NO: 127564 - DNA, 20 bp, Artificial sequence
  SiRNA target sequence
ctgggcaacggtcccttggg

SEQ ID NO: 127565 - DNA, 20 bp, Artificial sequence
  SiRNA target sequence
tgggcaacggtcccttgggc

SEQ ID NO: 127566 - DNA, 20 bp, Artificial sequence
  SiRNA target sequence
gggcaacggtcccttgggcg

SEQ ID NO: 127567 - DNA, 20 bp, Artificial sequence
  SiRNA target sequence
ggcaacggtcccttgggcga

SEQ ID NO: 127568 - DNA, 20 bp, Artificial sequence
  SiRNA target sequence
gcaacggtcccttgggcgaa

SEQ ID NO: 127569 - DNA, 20 bp, Artificial sequence
  SiRNA target sequence
caacggtcccttgggcgaag

SEQ ID NO: 127570 - DNA, 20 bp, Artificial sequence
  SiRNA target sequence
aacggtcccttgggcgaagt

SEQ ID NO: 127571 - DNA, 20 bp, Artificial sequence
  SiRNA target sequence
acggtcccttgggcgaagta

SEQ ID NO: 127572 - DNA, 20 bp, Artificial sequence
  SiRNA target sequence
cggtcccttgggcgaagtaa

SEQ ID NO: 127573 - DNA, 20 bp, Artificial sequence
  SiRNA target sequence
ggtcccttgggcgaagtaaa

SEQ ID NO: 127574 - DNA, 20 bp, Artificial sequence
  SiRNA target sequence
gtcccttgggcgaagtaaat

SEQ ID NO: 127575 - DNA, 20 bp, Artificial sequence
  SiRNA target sequence
tcccttgggcgaagtaaatt

SEQ ID NO: 127576 - DNA, 20 bp, Artificial sequence
  SiRNA target sequence
cccttgggcgaagtaaattt

SEQ ID NO: 127577 - DNA, 20 bp, Artificial sequence
  SiRNA target sequence
ccttgggcgaagtaaatttt

SEQ ID NO: 127578 - DNA, 20 bp, Artificial sequence
  SiRNA target sequence
cttgggcgaagtaaattttt

SEQ ID NO: 127579 - DNA, 20 bp, Artificial sequence
  SiRNA target sequence
ttgggcgaagtaaatttttg

SEQ ID NO: 127580 - DNA, 20 bp, Artificial sequence
  SiRNA target sequence
tgggcgaagtaaatttttgt

SEQ ID NO: 127581 - DNA, 20 bp, Artificial sequence
  SiRNA target sequence
gggcgaagtaaatttttgtc

SEQ ID NO: 127582 - DNA, 20 bp, Artificial sequence
  SiRNA target sequence
ggcgaagtaaatttttgtcg

SEQ ID NO: 127583 - DNA, 20 bp, Artificial sequence
  SiRNA target sequence
gcgaagtaaatttttgtcgc

SEQ ID NO: 127584 - DNA, 20 bp, Artificial sequence
  SiRNA target sequence
cgaagtaaatttttgtcgcg

SEQ ID NO: 127585 - DNA, 20 bp, Artificial sequence
  SiRNA target sequence
gaagtaaatttttgtcgcgg

SEQ ID NO: 127586 - DNA, 20 bp, Artificial sequence
  SiRNA target sequence
aagtaaatttttgtcgcggc

SEQ ID NO: 127587 - DNA, 20 bp, Artificial sequence
  SiRNA target sequence
agtaaatttttgtcgcggca

SEQ ID NO: 127588 - DNA, 20 bp, Artificial sequence
  SiRNA target sequence
gtaaatttttgtcgcggcaa

SEQ ID NO: 127589 - DNA, 20 bp, Artificial sequence
  SiRNA target sequence
taaatttttgtcgcggcaac

SEQ ID NO: 127590 - DNA, 20 bp, Artificial sequence
  SiRNA target sequence
aaatttttgtcgcggcaaca

SEQ ID NO: 127591 - DNA, 20 bp, Artificial sequence
  SiRNA target sequence
aatttttgtcgcggcaacaa

SEQ ID NO: 127592 - DNA, 20 bp, Artificial sequence
  SiRNA target sequence
atttttgtcgcggcaacaaa

SEQ ID NO: 127593 - DNA, 20 bp, Artificial sequence
  SiRNA target sequence
tttttgtcgcggcaacaaac

SEQ ID NO: 127594 - DNA, 20 bp, Artificial sequence
  SiRNA target sequence
ttttgtcgcggcaacaaact

SEQ ID NO: 127595 - DNA, 20 bp, Artificial sequence
  SiRNA target sequence
tttgtcgcggcaacaaacta

SEQ ID NO: 127596 - DNA, 20 bp, Artificial sequence
  SiRNA target sequence
ttgtcgcggcaacaaactat

SEQ ID NO: 127597 - DNA, 20 bp, Artificial sequence
  SiRNA target sequence
tgtcgcggcaacaaactatt

SEQ ID NO: 127598 - DNA, 20 bp, Artificial sequence
  SiRNA target sequence
gtcgcggcaacaaactatta

SEQ ID NO: 127599 - DNA, 20 bp, Artificial sequence
  SiRNA target sequence
tcgcggcaacaaactattac

SEQ ID NO: 127600 - DNA, 20 bp, Artificial sequence
  SiRNA target sequence
cgcggcaacaaactattaca

SEQ ID NO: 127601 - DNA, 20 bp, Artificial sequence
  SiRNA target sequence
gcggcaacaaactattacaa

SEQ ID NO: 127602 - DNA, 20 bp, Artificial sequence
  SiRNA target sequence
cggcaacaaactattacaaa

SEQ ID NO: 127603 - DNA, 20 bp, Artificial sequence
  SiRNA target sequence
ggcaacaaactattacaaaa

SEQ ID NO: 127604 - DNA, 20 bp, Artificial sequence
  SiRNA target sequence
gcaacaaactattacaaaat

SEQ ID NO: 127605 - DNA, 20 bp, Artificial sequence
  SiRNA target sequence
caacaaactattacaaaatt

SEQ ID NO: 127606 - DNA, 20 bp, Artificial sequence
  SiRNA target sequence
aacaaactattacaaaattt

SEQ ID NO: 127607 - DNA, 20 bp, Artificial sequence
  SiRNA target sequence
acaaactattacaaaatttc

SEQ ID NO: 127608 - DNA, 20 bp, Artificial sequence
  SiRNA target sequence
caaactattacaaaatttcc

SEQ ID NO: 127609 - DNA, 20 bp, Artificial sequence
  SiRNA target sequence
aaactattacaaaatttcct

SEQ ID NO: 127610 - DNA, 20 bp, Artificial sequence
  SiRNA target sequence
aactattacaaaatttccta

SEQ ID NO: 127611 - DNA, 20 bp, Artificial sequence
  SiRNA target sequence
actattacaaaatttcctaa

SEQ ID NO: 127612 - DNA, 20 bp, Artificial sequence
  SiRNA target sequence
ctattacaaaatttcctaat

SEQ ID NO: 127613 - DNA, 20 bp, Artificial sequence
  SiRNA target sequence
tattacaaaatttcctaatg

SEQ ID NO: 127614 - DNA, 20 bp, Artificial sequence
  SiRNA target sequence
attacaaaatttcctaatgt

SEQ ID NO: 127615 - DNA, 20 bp, Artificial sequence
  SiRNA target sequence
ttacaaaatttcctaatgtg

SEQ ID NO: 127616 - DNA, 20 bp, Artificial sequence
  SiRNA target sequence
tacaaaatttcctaatgtga

SEQ ID NO: 127617 - DNA, 20 bp, Artificial sequence
  SiRNA target sequence
acaaaatttcctaatgtgag

SEQ ID NO: 127618 - DNA, 20 bp, Artificial sequence
  SiRNA target sequence
caaaatttcctaatgtgaga

SEQ ID NO: 127619 - DNA, 20 bp, Artificial sequence
  SiRNA target sequence
aaaatttcctaatgtgagaa

SEQ ID NO: 127620 - DNA, 20 bp, Artificial sequence
  SiRNA target sequence
aaatttcctaatgtgagaaa

SEQ ID NO: 127621 - DNA, 20 bp, Artificial sequence
  SiRNA target sequence
aatttcctaatgtgagaaaa

SEQ ID NO: 127622 - DNA, 20 bp, Artificial sequence
  SiRNA target sequence
atttcctaatgtgagaaaaa

SEQ ID NO: 127623 - DNA, 20 bp, Artificial sequence
  SiRNA target sequence
tttcctaatgtgagaaaaat

SEQ ID NO: 127624 - DNA, 20 bp, Artificial sequence
  SiRNA target sequence
ttcctaatgtgagaaaaatc

SEQ ID NO: 127625 - DNA, 20 bp, Artificial sequence
  SiRNA target sequence
tcctaatgtgagaaaaatcg

SEQ ID NO: 127626 - DNA, 20 bp, Artificial sequence
  SiRNA target sequence
cctaatgtgagaaaaatcga

SEQ ID NO: 127627 - DNA, 20 bp, Artificial sequence
  SiRNA target sequence
ctaatgtgagaaaaatcgac

SEQ ID NO: 127628 - DNA, 20 bp, Artificial sequence
  SiRNA target sequence
taatgtgagaaaaatcgacc

SEQ ID NO: 127629 - DNA, 20 bp, Artificial sequence
  SiRNA target sequence
aatgtgagaaaaatcgacct

SEQ ID NO: 127630 - DNA, 20 bp, Artificial sequence
  SiRNA target sequence
atgtgagaaaaatcgacctt

SEQ ID NO: 127631 - DNA, 20 bp, Artificial sequence
  SiRNA target sequence
tgtgagaaaaatcgaccttg

SEQ ID NO: 127632 - DNA, 20 bp, Artificial sequence
  SiRNA target sequence
gtgagaaaaatcgaccttgt

SEQ ID NO: 127633 - DNA, 20 bp, Artificial sequence
  SiRNA target sequence
tgagaaaaatcgaccttgta

SEQ ID NO: 127634 - DNA, 20 bp, Artificial sequence
  SiRNA target sequence
gagaaaaatcgaccttgtag

SEQ ID NO: 127635 - DNA, 20 bp, Artificial sequence
  SiRNA target sequence
agaaaaatcgaccttgtagg

SEQ ID NO: 127636 - DNA, 20 bp, Artificial sequence
  SiRNA target sequence
gaaaaatcgaccttgtagga

SEQ ID NO: 127637 - DNA, 20 bp, Artificial sequence
  SiRNA target sequence
aaaaatcgaccttgtaggat

SEQ ID NO: 127638 - DNA, 20 bp, Artificial sequence
  SiRNA target sequence
aaaatcgaccttgtaggatc

SEQ ID NO: 127639 - DNA, 20 bp, Artificial sequence
  SiRNA target sequence
aaatcgaccttgtaggatcc

SEQ ID NO: 127640 - DNA, 20 bp, Artificial sequence
  SiRNA target sequence
aatcgaccttgtaggatccg

SEQ ID NO: 127641 - DNA, 20 bp, Artificial sequence
  SiRNA target sequence
atcgaccttgtaggatccgt

SEQ ID NO: 127642 - DNA, 20 bp, Artificial sequence
  SiRNA target sequence
tcgaccttgtaggatccgtt

SEQ ID NO: 127643 - DNA, 20 bp, Artificial sequence
  SiRNA target sequence
cgaccttgtaggatccgttt

SEQ ID NO: 127644 - DNA, 20 bp, Artificial sequence
  SiRNA target sequence
gaccttgtaggatccgtttc

SEQ ID NO: 127645 - DNA, 20 bp, Artificial sequence
  SiRNA target sequence
accttgtaggatccgtttcg

SEQ ID NO: 127646 - DNA, 20 bp, Artificial sequence
  SiRNA target sequence
ccttgtaggatccgtttcgt

SEQ ID NO: 127647 - DNA, 20 bp, Artificial sequence
  SiRNA target sequence
cttgtaggatccgtttcgta

SEQ ID NO: 127648 - DNA, 20 bp, Artificial sequence
  SiRNA target sequence
ttgtaggatccgtttcgtat

SEQ ID NO: 127649 - DNA, 20 bp, Artificial sequence
  SiRNA target sequence
tgtaggatccgtttcgtatc

SEQ ID NO: 127650 - DNA, 20 bp, Artificial sequence
  SiRNA target sequence
gtaggatccgtttcgtatcg

SEQ ID NO: 127651 - DNA, 20 bp, Artificial sequence
  SiRNA target sequence
taggatccgtttcgtatcgt

SEQ ID NO: 127652 - DNA, 20 bp, Artificial sequence
  SiRNA target sequence
aggatccgtttcgtatcgtg

SEQ ID NO: 127653 - DNA, 20 bp, Artificial sequence
  SiRNA target sequence
ggatccgtttcgtatcgtga

SEQ ID NO: 127654 - DNA, 20 bp, Artificial sequence
  SiRNA target sequence
gatccgtttcgtatcgtgat

SEQ ID NO: 127655 - DNA, 20 bp, Artificial sequence
  SiRNA target sequence
atccgtttcgtatcgtgatg

SEQ ID NO: 127656 - DNA, 20 bp, Artificial sequence
  SiRNA target sequence
tccgtttcgtatcgtgatgg

SEQ ID NO: 127657 - DNA, 20 bp, Artificial sequence
  SiRNA target sequence
ccgtttcgtatcgtgatggc

SEQ ID NO: 127658 - DNA, 20 bp, Artificial sequence
  SiRNA target sequence
cgtttcgtatcgtgatggcc

SEQ ID NO: 127659 - DNA, 20 bp, Artificial sequence
  SiRNA target sequence
gtttcgtatcgtgatggcca

SEQ ID NO: 127660 - DNA, 20 bp, Artificial sequence
  SiRNA target sequence
tttcgtatcgtgatggccaa

SEQ ID NO: 127661 - DNA, 20 bp, Artificial sequence
  SiRNA target sequence
ttcgtatcgtgatggccaat

SEQ ID NO: 127662 - DNA, 20 bp, Artificial sequence
  SiRNA target sequence
tcgtatcgtgatggccaatt

SEQ ID NO: 127663 - DNA, 20 bp, Artificial sequence
  SiRNA target sequence
cgtatcgtgatggccaattt

SEQ ID NO: 127664 - DNA, 20 bp, Artificial sequence
  SiRNA target sequence
gtatcgtgatggccaatttt

SEQ ID NO: 127665 - DNA, 20 bp, Artificial sequence
  SiRNA target sequence
tatcgtgatggccaatttta

SEQ ID NO: 127666 - DNA, 20 bp, Artificial sequence
  SiRNA target sequence
atcgtgatggccaattttat

SEQ ID NO: 127667 - DNA, 20 bp, Artificial sequence
  SiRNA target sequence
tcgtgatggccaattttatg

SEQ ID NO: 127668 - DNA, 20 bp, Artificial sequence
  SiRNA target sequence
cgtgatggccaattttatga

SEQ ID NO: 127669 - DNA, 20 bp, Artificial sequence
  SiRNA target sequence
gtgatggccaattttatgat

SEQ ID NO: 127670 - DNA, 20 bp, Artificial sequence
  SiRNA target sequence
tgatggccaattttatgatg

SEQ ID NO: 127671 - DNA, 20 bp, Artificial sequence
  SiRNA target sequence
gatggccaattttatgatgc

SEQ ID NO: 127672 - DNA, 20 bp, Artificial sequence
  SiRNA target sequence
atggccaattttatgatgct

SEQ ID NO: 127673 - DNA, 20 bp, Artificial sequence
  SiRNA target sequence
tggccaattttatgatgcta

SEQ ID NO: 127674 - DNA, 20 bp, Artificial sequence
  SiRNA target sequence
ggccaattttatgatgctaa

SEQ ID NO: 127675 - DNA, 20 bp, Artificial sequence
  SiRNA target sequence
gccaattttatgatgctaaa

SEQ ID NO: 127676 - DNA, 20 bp, Artificial sequence
  SiRNA target sequence
ccaattttatgatgctaaat

SEQ ID NO: 127677 - DNA, 20 bp, Artificial sequence
  SiRNA target sequence
caattttatgatgctaaata

SEQ ID NO: 127678 - DNA, 20 bp, Artificial sequence
  SiRNA target sequence
aattttatgatgctaaatac

SEQ ID NO: 127679 - DNA, 20 bp, Artificial sequence
  SiRNA target sequence
attttatgatgctaaataca

SEQ ID NO: 127680 - DNA, 20 bp, Artificial sequence
  SiRNA target sequence
ttttatgatgctaaatacaa

SEQ ID NO: 127681 - DNA, 20 bp, Artificial sequence
  SiRNA target sequence
tttatgatgctaaatacaat

SEQ ID NO: 127682 - DNA, 20 bp, Artificial sequence
  SiRNA target sequence
ttatgatgctaaatacaatg

SEQ ID NO: 127683 - DNA, 20 bp, Artificial sequence
  SiRNA target sequence
tatgatgctaaatacaatgt

SEQ ID NO: 127684 - DNA, 20 bp, Artificial sequence
  SiRNA target sequence
atgatgctaaatacaatgtt

SEQ ID NO: 127685 - DNA, 20 bp, Artificial sequence
  SiRNA target sequence
tgatgctaaatacaatgttc

SEQ ID NO: 127686 - DNA, 20 bp, Artificial sequence
  SiRNA target sequence
gatgctaaatacaatgttct

SEQ ID NO: 127687 - DNA, 20 bp, Artificial sequence
  SiRNA target sequence
atgctaaatacaatgttcta

SEQ ID NO: 127688 - DNA, 20 bp, Artificial sequence
  SiRNA target sequence
tgctaaatacaatgttctat

SEQ ID NO: 127689 - DNA, 20 bp, Artificial sequence
  SiRNA target sequence
gctaaatacaatgttctatt

SEQ ID NO: 127690 - DNA, 20 bp, Artificial sequence
  SiRNA target sequence
ctaaatacaatgttctattg

SEQ ID NO: 127691 - DNA, 20 bp, Artificial sequence
  SiRNA target sequence
taaatacaatgttctattgg

SEQ ID NO: 127692 - DNA, 20 bp, Artificial sequence
  SiRNA target sequence
aaatacaatgttctattggg

SEQ ID NO: 127693 - DNA, 20 bp, Artificial sequence
  SiRNA target sequence
aatacaatgttctattgggt

SEQ ID NO: 127694 - DNA, 20 bp, Artificial sequence
  SiRNA target sequence
atacaatgttctattgggtg

SEQ ID NO: 127695 - DNA, 20 bp, Artificial sequence
  SiRNA target sequence
tacaatgttctattgggtgt

SEQ ID NO: 127696 - DNA, 20 bp, Artificial sequence
  SiRNA target sequence
acaatgttctattgggtgtc

SEQ ID NO: 127697 - DNA, 20 bp, Artificial sequence
  SiRNA target sequence
caatgttctattgggtgtca

SEQ ID NO: 127698 - DNA, 20 bp, Artificial sequence
  SiRNA target sequence
aatgttctattgggtgtcac

SEQ ID NO: 127699 - DNA, 20 bp, Artificial sequence
  SiRNA target sequence
atgttctattgggtgtcaca

SEQ ID NO: 127700 - DNA, 20 bp, Artificial sequence
  SiRNA target sequence
tgttctattgggtgtcacag

SEQ ID NO: 127701 - DNA, 20 bp, Artificial sequence
  SiRNA target sequence
gttctattgggtgtcacagc

SEQ ID NO: 127702 - DNA, 20 bp, Artificial sequence
  SiRNA target sequence
ttctattgggtgtcacagct

SEQ ID NO: 127703 - DNA, 20 bp, Artificial sequence
  SiRNA target sequence
tctattgggtgtcacagcta

SEQ ID NO: 127704 - DNA, 20 bp, Artificial sequence
  SiRNA target sequence
ctattgggtgtcacagctac

SEQ ID NO: 127705 - DNA, 20 bp, Artificial sequence
  SiRNA target sequence
tattgggtgtcacagctacc

SEQ ID NO: 127706 - DNA, 20 bp, Artificial sequence
  SiRNA target sequence
attgggtgtcacagctacct

SEQ ID NO: 127707 - DNA, 20 bp, Artificial sequence
  SiRNA target sequence
ttgggtgtcacagctaccta

SEQ ID NO: 127708 - DNA, 20 bp, Artificial sequence
  SiRNA target sequence
tgggtgtcacagctacctac

SEQ ID NO: 127709 - DNA, 20 bp, Artificial sequence
  SiRNA target sequence
gggtgtcacagctacctact

SEQ ID NO: 127710 - DNA, 20 bp, Artificial sequence
  SiRNA target sequence
ggtgtcacagctacctacta

SEQ ID NO: 127711 - DNA, 20 bp, Artificial sequence
  SiRNA target sequence
gtgtcacagctacctactat

SEQ ID NO: 127712 - DNA, 20 bp, Artificial sequence
  SiRNA target sequence
tgtcacagctacctactatg

SEQ ID NO: 127713 - DNA, 20 bp, Artificial sequence
  SiRNA target sequence
gtcacagctacctactatgg

SEQ ID NO: 127714 - DNA, 20 bp, Artificial sequence
  SiRNA target sequence
tcacagctacctactatgga

SEQ ID NO: 127715 - DNA, 20 bp, Artificial sequence
  SiRNA target sequence
cacagctacctactatggag

SEQ ID NO: 127716 - DNA, 20 bp, Artificial sequence
  SiRNA target sequence
acagctacctactatggagc

SEQ ID NO: 127717 - DNA, 20 bp, Artificial sequence
  SiRNA target sequence
cagctacctactatggagct

SEQ ID NO: 127718 - DNA, 20 bp, Artificial sequence
  SiRNA target sequence
agctacctactatggagctg

SEQ ID NO: 127719 - DNA, 20 bp, Artificial sequence
  SiRNA target sequence
gctacctactatggagctgt

SEQ ID NO: 127720 - DNA, 20 bp, Artificial sequence
  SiRNA target sequence
ctacctactatggagctgtt

SEQ ID NO: 127721 - DNA, 20 bp, Artificial sequence
  SiRNA target sequence
tacctactatggagctgttg

SEQ ID NO: 127722 - DNA, 20 bp, Artificial sequence
  SiRNA target sequence
acctactatggagctgttgt

SEQ ID NO: 127723 - DNA, 20 bp, Artificial sequence
  SiRNA target sequence
cctactatggagctgttgta

SEQ ID NO: 127724 - DNA, 20 bp, Artificial sequence
  SiRNA target sequence
ctactatggagctgttgtat

SEQ ID NO: 127725 - DNA, 20 bp, Artificial sequence
  SiRNA target sequence
tactatggagctgttgtatt

SEQ ID NO: 127726 - DNA, 20 bp, Artificial sequence
  SiRNA target sequence
actatggagctgttgtatta

SEQ ID NO: 127727 - DNA, 20 bp, Artificial sequence
  SiRNA target sequence
ctatggagctgttgtattaa

SEQ ID NO: 127728 - DNA, 20 bp, Artificial sequence
  SiRNA target sequence
tatggagctgttgtattaaa

SEQ ID NO: 127729 - DNA, 20 bp, Artificial sequence
  SiRNA target sequence
atggagctgttgtattaaat

SEQ ID NO: 127730 - DNA, 20 bp, Artificial sequence
  SiRNA target sequence
tggagctgttgtattaaatc

SEQ ID NO: 127731 - DNA, 20 bp, Artificial sequence
  SiRNA target sequence
ggagctgttgtattaaatca

SEQ ID NO: 127732 - DNA, 20 bp, Artificial sequence
  SiRNA target sequence
gagctgttgtattaaatcat

SEQ ID NO: 127733 - DNA, 20 bp, Artificial sequence
  SiRNA target sequence
agctgttgtattaaatcatg

SEQ ID NO: 127734 - DNA, 20 bp, Artificial sequence
  SiRNA target sequence
gctgttgtattaaatcatgc

SEQ ID NO: 127735 - DNA, 20 bp, Artificial sequence
  SiRNA target sequence
ctgttgtattaaatcatgca

SEQ ID NO: 127736 - DNA, 20 bp, Artificial sequence
  SiRNA target sequence
tgttgtattaaatcatgcaa

SEQ ID NO: 127737 - DNA, 20 bp, Artificial sequence
  SiRNA target sequence
gttgtattaaatcatgcaaa

SEQ ID NO: 127738 - DNA, 20 bp, Artificial sequence
  SiRNA target sequence
ttgtattaaatcatgcaaaa

SEQ ID NO: 127739 - DNA, 20 bp, Artificial sequence
  SiRNA target sequence
tgtattaaatcatgcaaaat

SEQ ID NO: 127740 - DNA, 20 bp, Artificial sequence
  SiRNA target sequence
gtattaaatcatgcaaaatt

SEQ ID NO: 127741 - DNA, 20 bp, Artificial sequence
  SiRNA target sequence
tattaaatcatgcaaaattc

SEQ ID NO: 127742 - DNA, 20 bp, Artificial sequence
  SiRNA target sequence
attaaatcatgcaaaattct

SEQ ID NO: 127743 - DNA, 20 bp, Artificial sequence
  SiRNA target sequence
ttaaatcatgcaaaattctt

SEQ ID NO: 127744 - DNA, 20 bp, Artificial sequence
  SiRNA target sequence
taaatcatgcaaaattcttg

SEQ ID NO: 127745 - DNA, 20 bp, Artificial sequence
  SiRNA target sequence
aaatcatgcaaaattcttgt

SEQ ID NO: 127746 - DNA, 20 bp, Artificial sequence
  SiRNA target sequence
aatcatgcaaaattcttgtc

SEQ ID NO: 127747 - DNA, 20 bp, Artificial sequence
  SiRNA target sequence
atcatgcaaaattcttgtca

SEQ ID NO: 127748 - DNA, 20 bp, Artificial sequence
  SiRNA target sequence
tcatgcaaaattcttgtcag

SEQ ID NO: 127749 - DNA, 20 bp, Artificial sequence
  SiRNA target sequence
catgcaaaattcttgtcagt

SEQ ID NO: 127750 - DNA, 20 bp, Artificial sequence
  SiRNA target sequence
atgcaaaattcttgtcagta

SEQ ID NO: 127751 - DNA, 20 bp, Artificial sequence
  SiRNA target sequence
tgcaaaattcttgtcagtaa

SEQ ID NO: 127752 - DNA, 20 bp, Artificial sequence
  SiRNA target sequence
gcaaaattcttgtcagtaac

SEQ ID NO: 127753 - DNA, 20 bp, Artificial sequence
  SiRNA target sequence
caaaattcttgtcagtaaca

SEQ ID NO: 127754 - DNA, 20 bp, Artificial sequence
  SiRNA target sequence
aaaattcttgtcagtaacaa

SEQ ID NO: 127755 - DNA, 20 bp, Artificial sequence
  SiRNA target sequence
aaattcttgtcagtaacaaa

SEQ ID NO: 127756 - DNA, 20 bp, Artificial sequence
  SiRNA target sequence
aattcttgtcagtaacaaaa

SEQ ID NO: 127757 - DNA, 20 bp, Artificial sequence
  SiRNA target sequence
attcttgtcagtaacaaaag

SEQ ID NO: 127758 - DNA, 20 bp, Artificial sequence
  SiRNA target sequence
ttcttgtcagtaacaaaaga

SEQ ID NO: 127759 - DNA, 20 bp, Artificial sequence
  SiRNA target sequence
tcttgtcagtaacaaaagat

SEQ ID NO: 127760 - DNA, 20 bp, Artificial sequence
  SiRNA target sequence
cttgtcagtaacaaaagatg

SEQ ID NO: 127761 - DNA, 20 bp, Artificial sequence
  SiRNA target sequence
ttgtcagtaacaaaagatgg

SEQ ID NO: 127762 - DNA, 20 bp, Artificial sequence
  SiRNA target sequence
tgtcagtaacaaaagatggc

SEQ ID NO: 127763 - DNA, 20 bp, Artificial sequence
  SiRNA target sequence
gtcagtaacaaaagatggcg

SEQ ID NO: 127764 - DNA, 20 bp, Artificial sequence
  SiRNA target sequence
tcagtaacaaaagatggcga

SEQ ID NO: 127765 - DNA, 20 bp, Artificial sequence
  SiRNA target sequence
cagtaacaaaagatggcgat

SEQ ID NO: 127766 - DNA, 20 bp, Artificial sequence
  SiRNA target sequence
agtaacaaaagatggcgata

SEQ ID NO: 127767 - DNA, 20 bp, Artificial sequence
  SiRNA target sequence
gtaacaaaagatggcgataa

SEQ ID NO: 127768 - DNA, 20 bp, Artificial sequence
  SiRNA target sequence
taacaaaagatggcgataaa

SEQ ID NO: 127769 - DNA, 20 bp, Artificial sequence
  SiRNA target sequence
aacaaaagatggcgataaaa

SEQ ID NO: 127770 - DNA, 20 bp, Artificial sequence
  SiRNA target sequence
acaaaagatggcgataaaat

SEQ ID NO: 127771 - DNA, 20 bp, Artificial sequence
  SiRNA target sequence
caaaagatggcgataaaatt

SEQ ID NO: 127772 - DNA, 20 bp, Artificial sequence
  SiRNA target sequence
aaaagatggcgataaaatta

SEQ ID NO: 127773 - DNA, 20 bp, Artificial sequence
  SiRNA target sequence
aaagatggcgataaaattaa

SEQ ID NO: 127774 - DNA, 20 bp, Artificial sequence
  SiRNA target sequence
aagatggcgataaaattaat

SEQ ID NO: 127775 - DNA, 20 bp, Artificial sequence
  SiRNA target sequence
agatggcgataaaattaatg

SEQ ID NO: 127776 - DNA, 20 bp, Artificial sequence
  SiRNA target sequence
gatggcgataaaattaatgg

SEQ ID NO: 127777 - DNA, 20 bp, Artificial sequence
  SiRNA target sequence
atggcgataaaattaatgga

SEQ ID NO: 127778 - DNA, 20 bp, Artificial sequence
  SiRNA target sequence
tggcgataaaattaatggaa

SEQ ID NO: 127779 - DNA, 20 bp, Artificial sequence
  SiRNA target sequence
ggcgataaaattaatggaat

SEQ ID NO: 127780 - DNA, 20 bp, Artificial sequence
  SiRNA target sequence
gcgataaaattaatggaatt

SEQ ID NO: 127781 - DNA, 20 bp, Artificial sequence
  SiRNA target sequence
cgataaaattaatggaatta

SEQ ID NO: 127782 - DNA, 20 bp, Artificial sequence
  SiRNA target sequence
gataaaattaatggaattaa

SEQ ID NO: 127783 - DNA, 20 bp, Artificial sequence
  SiRNA target sequence
ataaaattaatggaattaaa

SEQ ID NO: 127784 - DNA, 20 bp, Artificial sequence
  SiRNA target sequence
taaaattaatggaattaaat

SEQ ID NO: 127785 - DNA, 20 bp, Artificial sequence
  SiRNA target sequence
aaaattaatggaattaaatg

SEQ ID NO: 127786 - DNA, 20 bp, Artificial sequence
  SiRNA target sequence
aaattaatggaattaaatgt

SEQ ID NO: 127787 - DNA, 20 bp, Artificial sequence
  SiRNA target sequence
aattaatggaattaaatgtc

SEQ ID NO: 127788 - DNA, 20 bp, Artificial sequence
  SiRNA target sequence
attaatggaattaaatgtca

SEQ ID NO: 127789 - DNA, 20 bp, Artificial sequence
  SiRNA target sequence
ttaatggaattaaatgtcaa

SEQ ID NO: 127790 - DNA, 20 bp, Artificial sequence
  SiRNA target sequence
taatggaattaaatgtcaag

SEQ ID NO: 127791 - DNA, 20 bp, Artificial sequence
  SiRNA target sequence
aatggaattaaatgtcaaga

SEQ ID NO: 127792 - DNA, 20 bp, Artificial sequence
  SiRNA target sequence
atggaattaaatgtcaagat

SEQ ID NO: 127793 - DNA, 20 bp, Artificial sequence
  SiRNA target sequence
tggaattaaatgtcaagatt

SEQ ID NO: 127794 - DNA, 20 bp, Artificial sequence
  SiRNA target sequence
ggaattaaatgtcaagattc

SEQ ID NO: 127795 - DNA, 20 bp, Artificial sequence
  SiRNA target sequence
gaattaaatgtcaagattca

SEQ ID NO: 127796 - DNA, 20 bp, Artificial sequence
  SiRNA target sequence
aattaaatgtcaagattcaa

SEQ ID NO: 127797 - DNA, 20 bp, Artificial sequence
  SiRNA target sequence
attaaatgtcaagattcaat

SEQ ID NO: 127798 - DNA, 20 bp, Artificial sequence
  SiRNA target sequence
ttaaatgtcaagattcaata

SEQ ID NO: 127799 - DNA, 20 bp, Artificial sequence
  SiRNA target sequence
taaatgtcaagattcaataa

SEQ ID NO: 127800 - DNA, 20 bp, Artificial sequence
  SiRNA target sequence
aaatgtcaagattcaataaa

SEQ ID NO: 127801 - DNA, 20 bp, Artificial sequence
  SiRNA target sequence
aatgtcaagattcaataaat

SEQ ID NO: 127802 - DNA, 20 bp, Artificial sequence
  SiRNA target sequence
atgtcaagattcaataaata

SEQ ID NO: 127803 - DNA, 20 bp, Artificial sequence
  SiRNA target sequence
tgtcaagattcaataaataa

SEQ ID NO: 127804 - DNA, 20 bp, Artificial sequence
  SiRNA target sequence
gtcaagattcaataaataat

SEQ ID NO: 127805 - DNA, 20 bp, Artificial sequence
  SiRNA target sequence
tcaagattcaataaataatg

SEQ ID NO: 127806 - DNA, 20 bp, Artificial sequence
  SiRNA target sequence
caagattcaataaataatga

SEQ ID NO: 127807 - DNA, 20 bp, Artificial sequence
  SiRNA target sequence
aagattcaataaataatgaa

SEQ ID NO: 127808 - DNA, 20 bp, Artificial sequence
  SiRNA target sequence
agattcaataaataatgaaa

SEQ ID NO: 127809 - DNA, 20 bp, Artificial sequence
  SiRNA target sequence
gattcaataaataatgaaaa

SEQ ID NO: 127810 - DNA, 20 bp, Artificial sequence
  SiRNA target sequence
attcaataaataatgaaaaa

SEQ ID NO: 127811 - DNA, 20 bp, Artificial sequence
  SiRNA target sequence
ttcaataaataatgaaaaat

SEQ ID NO: 127812 - DNA, 20 bp, Artificial sequence
  SiRNA target sequence
tcaataaataatgaaaaatt

SEQ ID NO: 127813 - DNA, 20 bp, Artificial sequence
  SiRNA target sequence
caataaataatgaaaaattt

SEQ ID NO: 127814 - DNA, 20 bp, Artificial sequence
  SiRNA target sequence
aataaataatgaaaaatttt

SEQ ID NO: 127815 - DNA, 20 bp, Artificial sequence
  SiRNA target sequence
ataaataatgaaaaattttt

SEQ ID NO: 127816 - DNA, 20 bp, Artificial sequence
  SiRNA target sequence
taaataatgaaaaattttta

SEQ ID NO: 127817 - DNA, 20 bp, Artificial sequence
  SiRNA target sequence
aaataatgaaaaatttttaa

SEQ ID NO: 127818 - DNA, 20 bp, Artificial sequence
  SiRNA target sequence
aataatgaaaaatttttaat

SEQ ID NO: 127819 - DNA, 20 bp, Artificial sequence
  SiRNA target sequence
ataatgaaaaatttttaatt

SEQ ID NO: 127820 - DNA, 20 bp, Artificial sequence
  SiRNA target sequence
taatgaaaaatttttaatta

SEQ ID NO: 127821 - DNA, 20 bp, Artificial sequence
  SiRNA target sequence
aatgaaaaatttttaattag

SEQ ID NO: 127822 - DNA, 20 bp, Artificial sequence
  SiRNA target sequence
atgaaaaatttttaattagg

SEQ ID NO: 127823 - DNA, 20 bp, Artificial sequence
  SiRNA target sequence
tgaaaaatttttaattaggt

SEQ ID NO: 127824 - DNA, 20 bp, Artificial sequence
  SiRNA target sequence
gaaaaatttttaattaggtg

SEQ ID NO: 127825 - DNA, 20 bp, Artificial sequence
  SiRNA target sequence
aaaaatttttaattaggtgt

SEQ ID NO: 127826 - DNA, 20 bp, Artificial sequence
  SiRNA target sequence
aaaatttttaattaggtgta

SEQ ID NO: 127827 - DNA, 20 bp, Artificial sequence
  SiRNA target sequence
aaatttttaattaggtgtaa

SEQ ID NO: 127828 - DNA, 20 bp, Artificial sequence
  SiRNA target sequence
aatttttaattaggtgtaaa

SEQ ID NO: 127829 - DNA, 20 bp, Artificial sequence
  SiRNA target sequence
atttttaattaggtgtaaag

SEQ ID NO: 127830 - DNA, 20 bp, Artificial sequence
  SiRNA target sequence
tttttaattaggtgtaaagt

SEQ ID NO: 127831 - DNA, 20 bp, Artificial sequence
  SiRNA target sequence
ttttaattaggtgtaaagtt

SEQ ID NO: 127832 - DNA, 20 bp, Artificial sequence
  SiRNA target sequence
tttaattaggtgtaaagttt

SEQ ID NO: 127833 - DNA, 20 bp, Artificial sequence
  SiRNA target sequence
ttaattaggtgtaaagtttt

SEQ ID NO: 127834 - DNA, 20 bp, Artificial sequence
  SiRNA target sequence
taattaggtgtaaagtttta

SEQ ID NO: 127835 - DNA, 20 bp, Artificial sequence
  SiRNA target sequence
aattaggtgtaaagttttaa

SEQ ID NO: 127836 - DNA, 20 bp, Artificial sequence
  SiRNA target sequence
attaggtgtaaagttttaat

SEQ ID NO: 127837 - DNA, 20 bp, Artificial sequence
  SiRNA target sequence
ttaggtgtaaagttttaata

SEQ ID NO: 127838 - DNA, 20 bp, Artificial sequence
  SiRNA target sequence
taggtgtaaagttttaataa

SEQ ID NO: 127839 - DNA, 20 bp, Artificial sequence
  SiRNA target sequence
aggtgtaaagttttaataaa

SEQ ID NO: 127840 - DNA, 20 bp, Artificial sequence
  SiRNA target sequence
ggtgtaaagttttaataaat

SEQ ID NO: 127841 - DNA, 20 bp, Artificial sequence
  SiRNA target sequence
gtgtaaagttttaataaata

SEQ ID NO: 127842 - DNA, 20 bp, Artificial sequence
  SiRNA target sequence
tgtaaagttttaataaatac

SEQ ID NO: 127843 - DNA, 20 bp, Artificial sequence
  SiRNA target sequence
gtaaagttttaataaatact

SEQ ID NO: 127844 - DNA, 20 bp, Artificial sequence
  SiRNA target sequence
taaagttttaataaatactt

SEQ ID NO: 127845 - DNA, 20 bp, Artificial sequence
  SiRNA target sequence
aaagttttaataaatacttc

SEQ ID NO: 127846 - DNA, 20 bp, Artificial sequence
  SiRNA target sequence
aagttttaataaatacttct

SEQ ID NO: 127847 - DNA, 20 bp, Artificial sequence
  SiRNA target sequence
agttttaataaatacttctg

SEQ ID NO: 127848 - DNA, 20 bp, Artificial sequence
  SiRNA target sequence
gttttaataaatacttctgg

SEQ ID NO: 127849 - DNA, 20 bp, Artificial sequence
  SiRNA target sequence
ttttaataaatacttctggc

SEQ ID NO: 127850 - DNA, 20 bp, Artificial sequence
  SiRNA target sequence
tttaataaatacttctggcc

SEQ ID NO: 127851 - DNA, 20 bp, Artificial sequence
  SiRNA target sequence
ttaataaatacttctggccc

SEQ ID NO: 127852 - DNA, 20 bp, Artificial sequence
  SiRNA target sequence
taataaatacttctggccct

SEQ ID NO: 127853 - DNA, 20 bp, Artificial sequence
  SiRNA target sequence
aataaatacttctggccctt

SEQ ID NO: 127854 - DNA, 20 bp, Artificial sequence
  SiRNA target sequence
ataaatacttctggcccttt

SEQ ID NO: 127855 - DNA, 20 bp, Artificial sequence
  SiRNA target sequence
taaatacttctggccctttt

SEQ ID NO: 127856 - DNA, 20 bp, Artificial sequence
  SiRNA target sequence
aaatacttctggcccttttg

SEQ ID NO: 127857 - DNA, 20 bp, Artificial sequence
  SiRNA target sequence
aatacttctggcccttttgc

SEQ ID NO: 127858 - DNA, 20 bp, Artificial sequence
  SiRNA target sequence
atacttctggcccttttgct

SEQ ID NO: 127859 - DNA, 20 bp, Artificial sequence
  SiRNA target sequence
tacttctggcccttttgctg

SEQ ID NO: 127860 - DNA, 20 bp, Artificial sequence
  SiRNA target sequence
acttctggcccttttgctga

SEQ ID NO: 127861 - DNA, 20 bp, Artificial sequence
  SiRNA target sequence
cttctggcccttttgctgac

SEQ ID NO: 127862 - DNA, 20 bp, Artificial sequence
  SiRNA target sequence
ttctggcccttttgctgacg

SEQ ID NO: 127863 - DNA, 20 bp, Artificial sequence
  SiRNA target sequence
tctggcccttttgctgacga

SEQ ID NO: 127864 - DNA, 20 bp, Artificial sequence
  SiRNA target sequence
ctggcccttttgctgacgag

SEQ ID NO: 127865 - DNA, 20 bp, Artificial sequence
  SiRNA target sequence
tggcccttttgctgacgagg

SEQ ID NO: 127866 - DNA, 20 bp, Artificial sequence
  SiRNA target sequence
ggcccttttgctgacgaggt

SEQ ID NO: 127867 - DNA, 20 bp, Artificial sequence
  SiRNA target sequence
gcccttttgctgacgaggtt

SEQ ID NO: 127868 - DNA, 20 bp, Artificial sequence
  SiRNA target sequence
cccttttgctgacgaggttc

SEQ ID NO: 127869 - DNA, 20 bp, Artificial sequence
  SiRNA target sequence
ccttttgctgacgaggttcg

SEQ ID NO: 127870 - DNA, 20 bp, Artificial sequence
  SiRNA target sequence
cttttgctgacgaggttcga

SEQ ID NO: 127871 - DNA, 20 bp, Artificial sequence
  SiRNA target sequence
ttttgctgacgaggttcgaa

SEQ ID NO: 127872 - DNA, 20 bp, Artificial sequence
  SiRNA target sequence
tttgctgacgaggttcgaaa

SEQ ID NO: 127873 - DNA, 20 bp, Artificial sequence
  SiRNA target sequence
ttgctgacgaggttcgaaat

SEQ ID NO: 127874 - DNA, 20 bp, Artificial sequence
  SiRNA target sequence
tgctgacgaggttcgaaata

SEQ ID NO: 127875 - DNA, 20 bp, Artificial sequence
  SiRNA target sequence
gctgacgaggttcgaaatac

SEQ ID NO: 127876 - DNA, 20 bp, Artificial sequence
  SiRNA target sequence
ctgacgaggttcgaaataca

SEQ ID NO: 127877 - DNA, 20 bp, Artificial sequence
  SiRNA target sequence
tgacgaggttcgaaatacat

SEQ ID NO: 127878 - DNA, 20 bp, Artificial sequence
  SiRNA target sequence
gacgaggttcgaaatacatc

SEQ ID NO: 127879 - DNA, 20 bp, Artificial sequence
  SiRNA target sequence
acgaggttcgaaatacatca

SEQ ID NO: 127880 - DNA, 20 bp, Artificial sequence
  SiRNA target sequence
cgaggttcgaaatacatcaa

SEQ ID NO: 127881 - DNA, 20 bp, Artificial sequence
  SiRNA target sequence
gaggttcgaaatacatcaat

SEQ ID NO: 127882 - DNA, 20 bp, Artificial sequence
  SiRNA target sequence
aggttcgaaatacatcaatt

SEQ ID NO: 127883 - DNA, 20 bp, Artificial sequence
  SiRNA target sequence
ggttcgaaatacatcaattg

SEQ ID NO: 127884 - DNA, 20 bp, Artificial sequence
  SiRNA target sequence
gttcgaaatacatcaattga

SEQ ID NO: 127885 - DNA, 20 bp, Artificial sequence
  SiRNA target sequence
ttcgaaatacatcaattgaa

SEQ ID NO: 127886 - DNA, 20 bp, Artificial sequence
  SiRNA target sequence
tcgaaatacatcaattgaaa

SEQ ID NO: 127887 - DNA, 20 bp, Artificial sequence
  SiRNA target sequence
cgaaatacatcaattgaaaa

SEQ ID NO: 127888 - DNA, 20 bp, Artificial sequence
  SiRNA target sequence
gaaatacatcaattgaaaac

SEQ ID NO: 127889 - DNA, 20 bp, Artificial sequence
  SiRNA target sequence
aaatacatcaattgaaaact

SEQ ID NO: 127890 - DNA, 20 bp, Artificial sequence
  SiRNA target sequence
aatacatcaattgaaaactg

SEQ ID NO: 127891 - DNA, 20 bp, Artificial sequence
  SiRNA target sequence
atacatcaattgaaaactgt

SEQ ID NO: 127892 - DNA, 20 bp, Artificial sequence
  SiRNA target sequence
tacatcaattgaaaactgtc

SEQ ID NO: 127893 - DNA, 20 bp, Artificial sequence
  SiRNA target sequence
acatcaattgaaaactgtca

SEQ ID NO: 127894 - DNA, 20 bp, Artificial sequence
  SiRNA target sequence
catcaattgaaaactgtcaa

SEQ ID NO: 127895 - DNA, 20 bp, Artificial sequence
  SiRNA target sequence
atcaattgaaaactgtcaac

SEQ ID NO: 127896 - DNA, 20 bp, Artificial sequence
  SiRNA target sequence
tcaattgaaaactgtcaacc

SEQ ID NO: 127897 - DNA, 20 bp, Artificial sequence
  SiRNA target sequence
caattgaaaactgtcaacca

SEQ ID NO: 127898 - DNA, 20 bp, Artificial sequence
  SiRNA target sequence
aattgaaaactgtcaaccaa

SEQ ID NO: 127899 - DNA, 20 bp, Artificial sequence
  SiRNA target sequence
attgaaaactgtcaaccaat

SEQ ID NO: 127900 - DNA, 20 bp, Artificial sequence
  SiRNA target sequence
ttgaaaactgtcaaccaata

SEQ ID NO: 127901 - DNA, 20 bp, Artificial sequence
  SiRNA target sequence
tgaaaactgtcaaccaatac

SEQ ID NO: 127902 - DNA, 20 bp, Artificial sequence
  SiRNA target sequence
gaaaactgtcaaccaatact

SEQ ID NO: 127903 - DNA, 20 bp, Artificial sequence
  SiRNA target sequence
aaaactgtcaaccaatactc

SEQ ID NO: 127904 - DNA, 20 bp, Artificial sequence
  SiRNA target sequence
aaactgtcaaccaatactcc

SEQ ID NO: 127905 - DNA, 20 bp, Artificial sequence
  SiRNA target sequence
aactgtcaaccaatactcca

SEQ ID NO: 127906 - DNA, 20 bp, Artificial sequence
  SiRNA target sequence
actgtcaaccaatactccaa

SEQ ID NO: 127907 - DNA, 20 bp, Artificial sequence
  SiRNA target sequence
ctgtcaaccaatactccaac

SEQ ID NO: 127908 - DNA, 20 bp, Artificial sequence
  SiRNA target sequence
tgtcaaccaatactccaaca

SEQ ID NO: 127909 - DNA, 20 bp, Artificial sequence
  SiRNA target sequence
gtcaaccaatactccaacat

SEQ ID NO: 127910 - DNA, 20 bp, Artificial sequence
  SiRNA target sequence
tcaaccaatactccaacata

SEQ ID NO: 127911 - DNA, 20 bp, Artificial sequence
  SiRNA target sequence
caaccaatactccaacatag

SEQ ID NO: 127912 - DNA, 20 bp, Artificial sequence
  SiRNA target sequence
aaccaatactccaacatagt

SEQ ID NO: 127913 - DNA, 20 bp, Artificial sequence
  SiRNA target sequence
accaatactccaacatagtt

SEQ ID NO: 127914 - DNA, 20 bp, Artificial sequence
  SiRNA target sequence
ccaatactccaacatagtta

SEQ ID NO: 127915 - DNA, 20 bp, Artificial sequence
  SiRNA target sequence
caatactccaacatagttat

SEQ ID NO: 127916 - DNA, 20 bp, Artificial sequence
  SiRNA target sequence
aatactccaacatagttatg

SEQ ID NO: 127917 - DNA, 20 bp, Artificial sequence
  SiRNA target sequence
atactccaacatagttatgg

SEQ ID NO: 127918 - DNA, 20 bp, Artificial sequence
  SiRNA target sequence
tactccaacatagttatggt

SEQ ID NO: 127919 - DNA, 20 bp, Artificial sequence
  SiRNA target sequence
actccaacatagttatggta

SEQ ID NO: 127920 - DNA, 20 bp, Artificial sequence
  SiRNA target sequence
ctccaacatagttatggtac

SEQ ID NO: 127921 - DNA, 20 bp, Artificial sequence
  SiRNA target sequence
tccaacatagttatggtaca

SEQ ID NO: 127922 - DNA, 20 bp, Artificial sequence
  SiRNA target sequence
ccaacatagttatggtacac

SEQ ID NO: 127923 - DNA, 20 bp, Artificial sequence
  SiRNA target sequence
caacatagttatggtacaca

SEQ ID NO: 127924 - DNA, 20 bp, Artificial sequence
  SiRNA target sequence
aacatagttatggtacacat

SEQ ID NO: 127925 - DNA, 20 bp, Artificial sequence
  SiRNA target sequence
acatagttatggtacacata

SEQ ID NO: 127926 - DNA, 20 bp, Artificial sequence
  SiRNA target sequence
catagttatggtacacatat

SEQ ID NO: 127927 - DNA, 20 bp, Artificial sequence
  SiRNA target sequence
atagttatggtacacatatt

SEQ ID NO: 127928 - DNA, 20 bp, Artificial sequence
  SiRNA target sequence
tagttatggtacacatattg

SEQ ID NO: 127929 - DNA, 20 bp, Artificial sequence
  SiRNA target sequence
agttatggtacacatattgt

SEQ ID NO: 127930 - DNA, 20 bp, Artificial sequence
  SiRNA target sequence
gttatggtacacatattgta

SEQ ID NO: 127931 - DNA, 20 bp, Artificial sequence
  SiRNA target sequence
ttatggtacacatattgtag

SEQ ID NO: 127932 - DNA, 20 bp, Artificial sequence
  SiRNA target sequence
tatggtacacatattgtagt

SEQ ID NO: 127933 - DNA, 20 bp, Artificial sequence
  SiRNA target sequence
atggtacacatattgtagtt

SEQ ID NO: 127934 - DNA, 20 bp, Artificial sequence
  SiRNA target sequence
tggtacacatattgtagttc

SEQ ID NO: 127935 - DNA, 20 bp, Artificial sequence
  SiRNA target sequence
ggtacacatattgtagttcc

SEQ ID NO: 127936 - DNA, 20 bp, Artificial sequence
  SiRNA target sequence
gtacacatattgtagttcct

SEQ ID NO: 127937 - DNA, 20 bp, Artificial sequence
  SiRNA target sequence
tacacatattgtagttcctg

SEQ ID NO: 127938 - DNA, 20 bp, Artificial sequence
  SiRNA target sequence
acacatattgtagttcctgc

SEQ ID NO: 127939 - DNA, 20 bp, Artificial sequence
  SiRNA target sequence
cacatattgtagttcctgcg

SEQ ID NO: 127940 - DNA, 20 bp, Artificial sequence
  SiRNA target sequence
acatattgtagttcctgcga

SEQ ID NO: 127941 - DNA, 20 bp, Artificial sequence
  SiRNA target sequence
catattgtagttcctgcgat

SEQ ID NO: 127942 - DNA, 20 bp, Artificial sequence
  SiRNA target sequence
atattgtagttcctgcgata

SEQ ID NO: 127943 - DNA, 20 bp, Artificial sequence
  SiRNA target sequence
tattgtagttcctgcgatat

SEQ ID NO: 127944 - DNA, 20 bp, Artificial sequence
  SiRNA target sequence
attgtagttcctgcgatatt

SEQ ID NO: 127945 - DNA, 20 bp, Artificial sequence
  SiRNA target sequence
ttgtagttcctgcgatattt

SEQ ID NO: 127946 - DNA, 20 bp, Artificial sequence
  SiRNA target sequence
tgtagttcctgcgatatttt

SEQ ID NO: 127947 - DNA, 20 bp, Artificial sequence
  SiRNA target sequence
gtagttcctgcgatattttc

SEQ ID NO: 127948 - DNA, 20 bp, Artificial sequence
  SiRNA target sequence
tagttcctgcgatattttcg

SEQ ID NO: 127949 - DNA, 20 bp, Artificial sequence
  SiRNA target sequence
agttcctgcgatattttcgc

SEQ ID NO: 127950 - DNA, 20 bp, Artificial sequence
  SiRNA target sequence
gttcctgcgatattttcgcc

SEQ ID NO: 127951 - DNA, 20 bp, Artificial sequence
  SiRNA target sequence
ttcctgcgatattttcgcct

SEQ ID NO: 127952 - DNA, 20 bp, Artificial sequence
  SiRNA target sequence
tcctgcgatattttcgccta

SEQ ID NO: 127953 - DNA, 20 bp, Artificial sequence
  SiRNA target sequence
cctgcgatattttcgcctaa

SEQ ID NO: 127954 - DNA, 20 bp, Artificial sequence
  SiRNA target sequence
ctgcgatattttcgcctaaa

SEQ ID NO: 127955 - DNA, 20 bp, Artificial sequence
  SiRNA target sequence
tgcgatattttcgcctaaaa

SEQ ID NO: 127956 - DNA, 20 bp, Artificial sequence
  SiRNA target sequence
gcgatattttcgcctaaaaa

SEQ ID NO: 127957 - DNA, 20 bp, Artificial sequence
  SiRNA target sequence
cgatattttcgcctaaaaat

SEQ ID NO: 127958 - DNA, 20 bp, Artificial sequence
  SiRNA target sequence
gatattttcgcctaaaaata

SEQ ID NO: 127959 - DNA, 20 bp, Artificial sequence
  SiRNA target sequence
atattttcgcctaaaaatat

SEQ ID NO: 127960 - DNA, 20 bp, Artificial sequence
  SiRNA target sequence
tattttcgcctaaaaatatg

SEQ ID NO: 127961 - DNA, 20 bp, Artificial sequence
  SiRNA target sequence
attttcgcctaaaaatatgg

SEQ ID NO: 127962 - DNA, 20 bp, Artificial sequence
  SiRNA target sequence
ttttcgcctaaaaatatggg

SEQ ID NO: 127963 - DNA, 20 bp, Artificial sequence
  SiRNA target sequence
tttcgcctaaaaatatgggc

SEQ ID NO: 127964 - DNA, 20 bp, Artificial sequence
  SiRNA target sequence
ttcgcctaaaaatatgggct

SEQ ID NO: 127965 - DNA, 20 bp, Artificial sequence
  SiRNA target sequence
tcgcctaaaaatatgggctt

SEQ ID NO: 127966 - DNA, 20 bp, Artificial sequence
  SiRNA target sequence
cgcctaaaaatatgggcttt

SEQ ID NO: 127967 - DNA, 20 bp, Artificial sequence
  SiRNA target sequence
gcctaaaaatatgggctttg

SEQ ID NO: 127968 - DNA, 20 bp, Artificial sequence
  SiRNA target sequence
cctaaaaatatgggctttgt

SEQ ID NO: 127969 - DNA, 20 bp, Artificial sequence
  SiRNA target sequence
ctaaaaatatgggctttgtt

SEQ ID NO: 127970 - DNA, 20 bp, Artificial sequence
  SiRNA target sequence
taaaaatatgggctttgttg

SEQ ID NO: 127971 - DNA, 20 bp, Artificial sequence
  SiRNA target sequence
aaaaatatgggctttgttga

SEQ ID NO: 127972 - DNA, 20 bp, Artificial sequence
  SiRNA target sequence
aaaatatgggctttgttgat

SEQ ID NO: 127973 - DNA, 20 bp, Artificial sequence
  SiRNA target sequence
aaatatgggctttgttgatc

SEQ ID NO: 127974 - DNA, 20 bp, Artificial sequence
  SiRNA target sequence
aatatgggctttgttgatcc

SEQ ID NO: 127975 - DNA, 20 bp, Artificial sequence
  SiRNA target sequence
atatgggctttgttgatcca

SEQ ID NO: 127976 - DNA, 20 bp, Artificial sequence
  SiRNA target sequence
tatgggctttgttgatccaa

SEQ ID NO: 127977 - DNA, 20 bp, Artificial sequence
  SiRNA target sequence
atgggctttgttgatccaag

SEQ ID NO: 127978 - DNA, 20 bp, Artificial sequence
  SiRNA target sequence
tgggctttgttgatccaagc

SEQ ID NO: 127979 - DNA, 20 bp, Artificial sequence
  SiRNA target sequence
gggctttgttgatccaagca

SEQ ID NO: 127980 - DNA, 20 bp, Artificial sequence
  SiRNA target sequence
ggctttgttgatccaagcac

SEQ ID NO: 127981 - DNA, 20 bp, Artificial sequence
  SiRNA target sequence
gctttgttgatccaagcacg

SEQ ID NO: 127982 - DNA, 20 bp, Artificial sequence
  SiRNA target sequence
ctttgttgatccaagcacga

SEQ ID NO: 127983 - DNA, 20 bp, Artificial sequence
  SiRNA target sequence
tttgttgatccaagcacgag

SEQ ID NO: 127984 - DNA, 20 bp, Artificial sequence
  SiRNA target sequence
ttgttgatccaagcacgagt

SEQ ID NO: 127985 - DNA, 20 bp, Artificial sequence
  SiRNA target sequence
tgttgatccaagcacgagtg

SEQ ID NO: 127986 - DNA, 20 bp, Artificial sequence
  SiRNA target sequence
gttgatccaagcacgagtga

SEQ ID NO: 127987 - DNA, 20 bp, Artificial sequence
  SiRNA target sequence
ttgatccaagcacgagtgat

SEQ ID NO: 127988 - DNA, 20 bp, Artificial sequence
  SiRNA target sequence
tgatccaagcacgagtgatg

SEQ ID NO: 127989 - DNA, 20 bp, Artificial sequence
  SiRNA target sequence
gatccaagcacgagtgatgg

SEQ ID NO: 127990 - DNA, 20 bp, Artificial sequence
  SiRNA target sequence
atccaagcacgagtgatgga

SEQ ID NO: 127991 - DNA, 20 bp, Artificial sequence
  SiRNA target sequence
tccaagcacgagtgatggaa

SEQ ID NO: 127992 - DNA, 20 bp, Artificial sequence
  SiRNA target sequence
ccaagcacgagtgatggaag

SEQ ID NO: 127993 - DNA, 20 bp, Artificial sequence
  SiRNA target sequence
caagcacgagtgatggaaga

SEQ ID NO: 127994 - DNA, 20 bp, Artificial sequence
  SiRNA target sequence
aagcacgagtgatggaagaa

SEQ ID NO: 127995 - DNA, 20 bp, Artificial sequence
  SiRNA target sequence
agcacgagtgatggaagaat

SEQ ID NO: 127996 - DNA, 20 bp, Artificial sequence
  SiRNA target sequence
gcacgagtgatggaagaatc

SEQ ID NO: 127997 - DNA, 20 bp, Artificial sequence
  SiRNA target sequence
cacgagtgatggaagaatcg

SEQ ID NO: 127998 - DNA, 20 bp, Artificial sequence
  SiRNA target sequence
acgagtgatggaagaatcgc

SEQ ID NO: 127999 - DNA, 20 bp, Artificial sequence
  SiRNA target sequence
cgagtgatggaagaatcgca

SEQ ID NO: 128000 - DNA, 20 bp, Artificial sequence
  SiRNA target sequence
gagtgatggaagaatcgcat

SEQ ID NO: 128001 - DNA, 20 bp, Artificial sequence
  SiRNA target sequence
agtgatggaagaatcgcatt

SEQ ID NO: 128002 - DNA, 20 bp, Artificial sequence
  SiRNA target sequence
gtgatggaagaatcgcattt

SEQ ID NO: 128003 - DNA, 20 bp, Artificial sequence
  SiRNA target sequence
tgatggaagaatcgcatttt

SEQ ID NO: 128004 - DNA, 20 bp, Artificial sequence
  SiRNA target sequence
gatggaagaatcgcattttt

SEQ ID NO: 128005 - DNA, 20 bp, Artificial sequence
  SiRNA target sequence
atggaagaatcgcatttttt

SEQ ID NO: 128006 - DNA, 20 bp, Artificial sequence
  SiRNA target sequence
tggaagaatcgcatttttta

SEQ ID NO: 128007 - DNA, 20 bp, Artificial sequence
  SiRNA target sequence
ggaagaatcgcattttttat

SEQ ID NO: 128008 - DNA, 20 bp, Artificial sequence
  SiRNA target sequence
gaagaatcgcattttttatg

SEQ ID NO: 128009 - DNA, 20 bp, Artificial sequence
  SiRNA target sequence
aagaatcgcattttttatga

SEQ ID NO: 128010 - DNA, 20 bp, Artificial sequence
  SiRNA target sequence
agaatcgcattttttatgaa

SEQ ID NO: 128011 - DNA, 20 bp, Artificial sequence
  SiRNA target sequence
gaatcgcattttttatgaat

SEQ ID NO: 128012 - DNA, 20 bp, Artificial sequence
  SiRNA target sequence
aatcgcattttttatgaatt

SEQ ID NO: 128013 - DNA, 20 bp, Artificial sequence
  SiRNA target sequence
atcgcattttttatgaattt

SEQ ID NO: 128014 - DNA, 20 bp, Artificial sequence
  SiRNA target sequence
tcgcattttttatgaatttt

SEQ ID NO: 128015 - DNA, 20 bp, Artificial sequence
  SiRNA target sequence
cgcattttttatgaatttta

SEQ ID NO: 128016 - DNA, 20 bp, Artificial sequence
  SiRNA target sequence
gcattttttatgaattttaa

SEQ ID NO: 128017 - DNA, 20 bp, Artificial sequence
  SiRNA target sequence
cattttttatgaattttaaa

SEQ ID NO: 128018 - DNA, 20 bp, Artificial sequence
  SiRNA target sequence
attttttatgaattttaaag

SEQ ID NO: 128019 - DNA, 20 bp, Artificial sequence
  SiRNA target sequence
ttttttatgaattttaaagg

SEQ ID NO: 128020 - DNA, 20 bp, Artificial sequence
  SiRNA target sequence
tttttatgaattttaaaggt

SEQ ID NO: 128021 - DNA, 20 bp, Artificial sequence
  SiRNA target sequence
ttttatgaattttaaaggta

SEQ ID NO: 128022 - DNA, 20 bp, Artificial sequence
  SiRNA target sequence
tttatgaattttaaaggtaa

SEQ ID NO: 128023 - DNA, 20 bp, Artificial sequence
  SiRNA target sequence
ttatgaattttaaaggtaaa

SEQ ID NO: 128024 - DNA, 20 bp, Artificial sequence
  SiRNA target sequence
tatgaattttaaaggtaaaa

SEQ ID NO: 128025 - DNA, 20 bp, Artificial sequence
  SiRNA target sequence
atgaattttaaaggtaaaac

SEQ ID NO: 128026 - DNA, 20 bp, Artificial sequence
  SiRNA target sequence
tgaattttaaaggtaaaaca

SEQ ID NO: 128027 - DNA, 20 bp, Artificial sequence
  SiRNA target sequence
gaattttaaaggtaaaacat

SEQ ID NO: 128028 - DNA, 20 bp, Artificial sequence
  SiRNA target sequence
aattttaaaggtaaaacatt

SEQ ID NO: 128029 - DNA, 20 bp, Artificial sequence
  SiRNA target sequence
attttaaaggtaaaacattg

SEQ ID NO: 128030 - DNA, 20 bp, Artificial sequence
  SiRNA target sequence
ttttaaaggtaaaacattga

SEQ ID NO: 128031 - DNA, 20 bp, Artificial sequence
  SiRNA target sequence
tttaaaggtaaaacattgat

SEQ ID NO: 128032 - DNA, 20 bp, Artificial sequence
  SiRNA target sequence
ttaaaggtaaaacattgatt

SEQ ID NO: 128033 - DNA, 20 bp, Artificial sequence
  SiRNA target sequence
taaaggtaaaacattgattg

SEQ ID NO: 128034 - DNA, 20 bp, Artificial sequence
  SiRNA target sequence
aaaggtaaaacattgattgg

SEQ ID NO: 128035 - DNA, 20 bp, Artificial sequence
  SiRNA target sequence
aaggtaaaacattgattgga

SEQ ID NO: 128036 - DNA, 20 bp, Artificial sequence
  SiRNA target sequence
aggtaaaacattgattggag

SEQ ID NO: 128037 - DNA, 20 bp, Artificial sequence
  SiRNA target sequence
ggtaaaacattgattggagg

SEQ ID NO: 128038 - DNA, 20 bp, Artificial sequence
  SiRNA target sequence
gtaaaacattgattggagga

SEQ ID NO: 128039 - DNA, 20 bp, Artificial sequence
  SiRNA target sequence
taaaacattgattggaggaa

SEQ ID NO: 128040 - DNA, 20 bp, Artificial sequence
  SiRNA target sequence
aaaacattgattggaggaac

SEQ ID NO: 128041 - DNA, 20 bp, Artificial sequence
  SiRNA target sequence
aaacattgattggaggaaca

SEQ ID NO: 128042 - DNA, 20 bp, Artificial sequence
  SiRNA target sequence
aacattgattggaggaacag

SEQ ID NO: 128043 - DNA, 20 bp, Artificial sequence
  SiRNA target sequence
acattgattggaggaacaga

SEQ ID NO: 128044 - DNA, 20 bp, Artificial sequence
  SiRNA target sequence
cattgattggaggaacagat

SEQ ID NO: 128045 - DNA, 20 bp, Artificial sequence
  SiRNA target sequence
attgattggaggaacagatg

SEQ ID NO: 128046 - DNA, 20 bp, Artificial sequence
  SiRNA target sequence
ttgattggaggaacagatgt

SEQ ID NO: 128047 - DNA, 20 bp, Artificial sequence
  SiRNA target sequence
tgattggaggaacagatgtt

SEQ ID NO: 128048 - DNA, 20 bp, Artificial sequence
  SiRNA target sequence
gattggaggaacagatgtta

SEQ ID NO: 128049 - DNA, 20 bp, Artificial sequence
  SiRNA target sequence
attggaggaacagatgttaa

SEQ ID NO: 128050 - DNA, 20 bp, Artificial sequence
  SiRNA target sequence
ttggaggaacagatgttaag

SEQ ID NO: 128051 - DNA, 20 bp, Artificial sequence
  SiRNA target sequence
tggaggaacagatgttaagt

SEQ ID NO: 128052 - DNA, 20 bp, Artificial sequence
  SiRNA target sequence
ggaggaacagatgttaagtg

SEQ ID NO: 128053 - DNA, 20 bp, Artificial sequence
  SiRNA target sequence
gaggaacagatgttaagtgt

SEQ ID NO: 128054 - DNA, 20 bp, Artificial sequence
  SiRNA target sequence
aggaacagatgttaagtgta

SEQ ID NO: 128055 - DNA, 20 bp, Artificial sequence
  SiRNA target sequence
ggaacagatgttaagtgtaa

SEQ ID NO: 128056 - DNA, 20 bp, Artificial sequence
  SiRNA target sequence
gaacagatgttaagtgtaaa

SEQ ID NO: 128057 - DNA, 20 bp, Artificial sequence
  SiRNA target sequence
aacagatgttaagtgtaaag

SEQ ID NO: 128058 - DNA, 20 bp, Artificial sequence
  SiRNA target sequence
acagatgttaagtgtaaagt

SEQ ID NO: 128059 - DNA, 20 bp, Artificial sequence
  SiRNA target sequence
cagatgttaagtgtaaagtt

SEQ ID NO: 128060 - DNA, 20 bp, Artificial sequence
  SiRNA target sequence
agatgttaagtgtaaagttg

SEQ ID NO: 128061 - DNA, 20 bp, Artificial sequence
  SiRNA target sequence
gatgttaagtgtaaagttga

SEQ ID NO: 128062 - DNA, 20 bp, Artificial sequence
  SiRNA target sequence
atgttaagtgtaaagttgaa

SEQ ID NO: 128063 - DNA, 20 bp, Artificial sequence
  SiRNA target sequence
tgttaagtgtaaagttgaag

SEQ ID NO: 128064 - DNA, 20 bp, Artificial sequence
  SiRNA target sequence
gttaagtgtaaagttgaaga

SEQ ID NO: 128065 - DNA, 20 bp, Artificial sequence
  SiRNA target sequence
ttaagtgtaaagttgaagat

SEQ ID NO: 128066 - DNA, 20 bp, Artificial sequence
  SiRNA target sequence
taagtgtaaagttgaagatt

SEQ ID NO: 128067 - DNA, 20 bp, Artificial sequence
  SiRNA target sequence
aagtgtaaagttgaagattt

SEQ ID NO: 128068 - DNA, 20 bp, Artificial sequence
  SiRNA target sequence
agtgtaaagttgaagattta

SEQ ID NO: 128069 - DNA, 20 bp, Artificial sequence
  SiRNA target sequence
gtgtaaagttgaagatttaa

SEQ ID NO: 128070 - DNA, 20 bp, Artificial sequence
  SiRNA target sequence
tgtaaagttgaagatttaat

SEQ ID NO: 128071 - DNA, 20 bp, Artificial sequence
  SiRNA target sequence
gtaaagttgaagatttaata

SEQ ID NO: 128072 - DNA, 20 bp, Artificial sequence
  SiRNA target sequence
taaagttgaagatttaataa

SEQ ID NO: 128073 - DNA, 20 bp, Artificial sequence
  SiRNA target sequence
aaagttgaagatttaataaa

SEQ ID NO: 128074 - DNA, 20 bp, Artificial sequence
  SiRNA target sequence
aagttgaagatttaataaaa

SEQ ID NO: 128075 - DNA, 20 bp, Artificial sequence
  SiRNA target sequence
agttgaagatttaataaaac

SEQ ID NO: 128076 - DNA, 20 bp, Artificial sequence
  SiRNA target sequence
gttgaagatttaataaaacc

SEQ ID NO: 128077 - DNA, 20 bp, Artificial sequence
  SiRNA target sequence
ttgaagatttaataaaaccg

SEQ ID NO: 128078 - DNA, 20 bp, Artificial sequence
  SiRNA target sequence
tgaagatttaataaaaccga

SEQ ID NO: 128079 - DNA, 20 bp, Artificial sequence
  SiRNA target sequence
gaagatttaataaaaccgac

SEQ ID NO: 128080 - DNA, 20 bp, Artificial sequence
  SiRNA target sequence
aagatttaataaaaccgact

SEQ ID NO: 128081 - DNA, 20 bp, Artificial sequence
  SiRNA target sequence
agatttaataaaaccgactg

SEQ ID NO: 128082 - DNA, 20 bp, Artificial sequence
  SiRNA target sequence
gatttaataaaaccgactga

SEQ ID NO: 128083 - DNA, 20 bp, Artificial sequence
  SiRNA target sequence
atttaataaaaccgactgaa

SEQ ID NO: 128084 - DNA, 20 bp, Artificial sequence
  SiRNA target sequence
tttaataaaaccgactgaag

SEQ ID NO: 128085 - DNA, 20 bp, Artificial sequence
  SiRNA target sequence
ttaataaaaccgactgaaga

SEQ ID NO: 128086 - DNA, 20 bp, Artificial sequence
  SiRNA target sequence
taataaaaccgactgaagaa

SEQ ID NO: 128087 - DNA, 20 bp, Artificial sequence
  SiRNA target sequence
aataaaaccgactgaagaag

SEQ ID NO: 128088 - DNA, 20 bp, Artificial sequence
  SiRNA target sequence
ataaaaccgactgaagaaga

SEQ ID NO: 128089 - DNA, 20 bp, Artificial sequence
  SiRNA target sequence
taaaaccgactgaagaagat

SEQ ID NO: 128090 - DNA, 20 bp, Artificial sequence
  SiRNA target sequence
aaaaccgactgaagaagatc

SEQ ID NO: 128091 - DNA, 20 bp, Artificial sequence
  SiRNA target sequence
aaaccgactgaagaagatct

SEQ ID NO: 128092 - DNA, 20 bp, Artificial sequence
  SiRNA target sequence
aaccgactgaagaagatcta

SEQ ID NO: 128093 - DNA, 20 bp, Artificial sequence
  SiRNA target sequence
accgactgaagaagatctaa

SEQ ID NO: 128094 - DNA, 20 bp, Artificial sequence
  SiRNA target sequence
ccgactgaagaagatctaaa

SEQ ID NO: 128095 - DNA, 20 bp, Artificial sequence
  SiRNA target sequence
cgactgaagaagatctaaac

SEQ ID NO: 128096 - DNA, 20 bp, Artificial sequence
  SiRNA target sequence
gactgaagaagatctaaact

SEQ ID NO: 128097 - DNA, 20 bp, Artificial sequence
  SiRNA target sequence
actgaagaagatctaaactt

SEQ ID NO: 128098 - DNA, 20 bp, Artificial sequence
  SiRNA target sequence
ctgaagaagatctaaacttt

SEQ ID NO: 128099 - DNA, 20 bp, Artificial sequence
  SiRNA target sequence
tgaagaagatctaaactttc

SEQ ID NO: 128100 - DNA, 20 bp, Artificial sequence
  SiRNA target sequence
gaagaagatctaaactttct

SEQ ID NO: 128101 - DNA, 20 bp, Artificial sequence
  SiRNA target sequence
aagaagatctaaactttctt

SEQ ID NO: 128102 - DNA, 20 bp, Artificial sequence
  SiRNA target sequence
agaagatctaaactttctta

SEQ ID NO: 128103 - DNA, 20 bp, Artificial sequence
  SiRNA target sequence
gaagatctaaactttcttat

SEQ ID NO: 128104 - DNA, 20 bp, Artificial sequence
  SiRNA target sequence
aagatctaaactttcttatt

SEQ ID NO: 128105 - DNA, 20 bp, Artificial sequence
  SiRNA target sequence
agatctaaactttcttattc

SEQ ID NO: 128106 - DNA, 20 bp, Artificial sequence
  SiRNA target sequence
gatctaaactttcttattca

SEQ ID NO: 128107 - DNA, 20 bp, Artificial sequence
  SiRNA target sequence
atctaaactttcttattcac

SEQ ID NO: 128108 - DNA, 20 bp, Artificial sequence
  SiRNA target sequence
tctaaactttcttattcacg

SEQ ID NO: 128109 - DNA, 20 bp, Artificial sequence
  SiRNA target sequence
ctaaactttcttattcacga

SEQ ID NO: 128110 - DNA, 20 bp, Artificial sequence
  SiRNA target sequence
taaactttcttattcacgag

SEQ ID NO: 128111 - DNA, 20 bp, Artificial sequence
  SiRNA target sequence
aaactttcttattcacgagg

SEQ ID NO: 128112 - DNA, 20 bp, Artificial sequence
  SiRNA target sequence
aactttcttattcacgaggc

SEQ ID NO: 128113 - DNA, 20 bp, Artificial sequence
  SiRNA target sequence
actttcttattcacgaggcc

SEQ ID NO: 128114 - DNA, 20 bp, Artificial sequence
  SiRNA target sequence
ctttcttattcacgaggcca

SEQ ID NO: 128115 - DNA, 20 bp, Artificial sequence
  SiRNA target sequence
tttcttattcacgaggccaa

SEQ ID NO: 128116 - DNA, 20 bp, Artificial sequence
  SiRNA target sequence
ttcttattcacgaggccaat

SEQ ID NO: 128117 - DNA, 20 bp, Artificial sequence
  SiRNA target sequence
tcttattcacgaggccaatt

SEQ ID NO: 128118 - DNA, 20 bp, Artificial sequence
  SiRNA target sequence
cttattcacgaggccaatta

SEQ ID NO: 128119 - DNA, 20 bp, Artificial sequence
  SiRNA target sequence
ttattcacgaggccaattat

SEQ ID NO: 128120 - DNA, 20 bp, Artificial sequence
  SiRNA target sequence
tattcacgaggccaattatt

SEQ ID NO: 128121 - DNA, 20 bp, Artificial sequence
  SiRNA target sequence
attcacgaggccaattattt

SEQ ID NO: 128122 - DNA, 20 bp, Artificial sequence
  SiRNA target sequence
ttcacgaggccaattatttt

SEQ ID NO: 128123 - DNA, 20 bp, Artificial sequence
  SiRNA target sequence
tcacgaggccaattatttta

SEQ ID NO: 128124 - DNA, 20 bp, Artificial sequence
  SiRNA target sequence
cacgaggccaattattttac

SEQ ID NO: 128125 - DNA, 20 bp, Artificial sequence
  SiRNA target sequence
acgaggccaattattttaca

SEQ ID NO: 128126 - DNA, 20 bp, Artificial sequence
  SiRNA target sequence
cgaggccaattattttacag

SEQ ID NO: 128127 - DNA, 20 bp, Artificial sequence
  SiRNA target sequence
gaggccaattattttacaga

SEQ ID NO: 128128 - DNA, 20 bp, Artificial sequence
  SiRNA target sequence
aggccaattattttacagat

SEQ ID NO: 128129 - DNA, 20 bp, Artificial sequence
  SiRNA target sequence
ggccaattattttacagatc

SEQ ID NO: 128130 - DNA, 20 bp, Artificial sequence
  SiRNA target sequence
gccaattattttacagatca

SEQ ID NO: 128131 - DNA, 20 bp, Artificial sequence
  SiRNA target sequence
ccaattattttacagatcac

SEQ ID NO: 128132 - DNA, 20 bp, Artificial sequence
  SiRNA target sequence
caattattttacagatcaca

SEQ ID NO: 128133 - DNA, 20 bp, Artificial sequence
  SiRNA target sequence
aattattttacagatcacaa

SEQ ID NO: 128134 - DNA, 20 bp, Artificial sequence
  SiRNA target sequence
attattttacagatcacaat

SEQ ID NO: 128135 - DNA, 20 bp, Artificial sequence
  SiRNA target sequence
ttattttacagatcacaatt

SEQ ID NO: 128136 - DNA, 20 bp, Artificial sequence
  SiRNA target sequence
tattttacagatcacaattt

SEQ ID NO: 128137 - DNA, 20 bp, Artificial sequence
  SiRNA target sequence
attttacagatcacaattta

SEQ ID NO: 128138 - DNA, 20 bp, Artificial sequence
  SiRNA target sequence
ttttacagatcacaatttaa

SEQ ID NO: 128139 - DNA, 20 bp, Artificial sequence
  SiRNA target sequence
tttacagatcacaatttaaa

SEQ ID NO: 128140 - DNA, 20 bp, Artificial sequence
  SiRNA target sequence
ttacagatcacaatttaaaa

SEQ ID NO: 128141 - DNA, 20 bp, Artificial sequence
  SiRNA target sequence
tacagatcacaatttaaaat

SEQ ID NO: 128142 - DNA, 20 bp, Artificial sequence
  SiRNA target sequence
acagatcacaatttaaaatt

SEQ ID NO: 128143 - DNA, 20 bp, Artificial sequence
  SiRNA target sequence
cagatcacaatttaaaatta

SEQ ID NO: 128144 - DNA, 20 bp, Artificial sequence
  SiRNA target sequence
agatcacaatttaaaattaa

SEQ ID NO: 128145 - DNA, 20 bp, Artificial sequence
  SiRNA target sequence
gatcacaatttaaaattaac

SEQ ID NO: 128146 - DNA, 20 bp, Artificial sequence
  SiRNA target sequence
atcacaatttaaaattaaca

SEQ ID NO: 128147 - DNA, 20 bp, Artificial sequence
  SiRNA target sequence
tcacaatttaaaattaacaa

SEQ ID NO: 128148 - DNA, 20 bp, Artificial sequence
  SiRNA target sequence
cacaatttaaaattaacaaa

SEQ ID NO: 128149 - DNA, 20 bp, Artificial sequence
  SiRNA target sequence
acaatttaaaattaacaaaa

SEQ ID NO: 128150 - DNA, 20 bp, Artificial sequence
  SiRNA target sequence
caatttaaaattaacaaaaa

SEQ ID NO: 128151 - DNA, 20 bp, Artificial sequence
  SiRNA target sequence
aatttaaaattaacaaaaaa

SEQ ID NO: 128152 - DNA, 20 bp, Artificial sequence
  SiRNA target sequence
atttaaaattaacaaaaaaa

SEQ ID NO: 128153 - DNA, 20 bp, Artificial sequence
  SiRNA target sequence
tttaaaattaacaaaaaaag

SEQ ID NO: 128154 - DNA, 20 bp, Artificial sequence
  SiRNA target sequence
ttaaaattaacaaaaaaaga

SEQ ID NO: 128155 - DNA, 20 bp, Artificial sequence
  SiRNA target sequence
taaaattaacaaaaaaagat

SEQ ID NO: 128156 - DNA, 20 bp, Artificial sequence
  SiRNA target sequence
aaaattaacaaaaaaagatg

SEQ ID NO: 128157 - DNA, 20 bp, Artificial sequence
  SiRNA target sequence
aaattaacaaaaaaagatgt

SEQ ID NO: 128158 - DNA, 20 bp, Artificial sequence
  SiRNA target sequence
aattaacaaaaaaagatgtt

SEQ ID NO: 128159 - DNA, 20 bp, Artificial sequence
  SiRNA target sequence
attaacaaaaaaagatgttt

SEQ ID NO: 128160 - DNA, 20 bp, Artificial sequence
  SiRNA target sequence
ttaacaaaaaaagatgtttt

SEQ ID NO: 128161 - DNA, 20 bp, Artificial sequence
  SiRNA target sequence
taacaaaaaaagatgttttg

SEQ ID NO: 128162 - DNA, 20 bp, Artificial sequence
  SiRNA target sequence
aacaaaaaaagatgttttgt

SEQ ID NO: 128163 - DNA, 20 bp, Artificial sequence
  SiRNA target sequence
acaaaaaaagatgttttgtc

SEQ ID NO: 128164 - DNA, 20 bp, Artificial sequence
  SiRNA target sequence
caaaaaaagatgttttgtct

SEQ ID NO: 128165 - DNA, 20 bp, Artificial sequence
  SiRNA target sequence
aaaaaaagatgttttgtctg

SEQ ID NO: 128166 - DNA, 20 bp, Artificial sequence
  SiRNA target sequence
aaaaaagatgttttgtctgt

SEQ ID NO: 128167 - DNA, 20 bp, Artificial sequence
  SiRNA target sequence
aaaaagatgttttgtctgtt

SEQ ID NO: 128168 - DNA, 20 bp, Artificial sequence
  SiRNA target sequence
aaaagatgttttgtctgttt

SEQ ID NO: 128169 - DNA, 20 bp, Artificial sequence
  SiRNA target sequence
aaagatgttttgtctgtttg

SEQ ID NO: 128170 - DNA, 20 bp, Artificial sequence
  SiRNA target sequence
aagatgttttgtctgtttgg

SEQ ID NO: 128171 - DNA, 20 bp, Artificial sequence
  SiRNA target sequence
agatgttttgtctgtttgga

SEQ ID NO: 128172 - DNA, 20 bp, Artificial sequence
  SiRNA target sequence
gatgttttgtctgtttggac

SEQ ID NO: 128173 - DNA, 20 bp, Artificial sequence
  SiRNA target sequence
atgttttgtctgtttggaca

SEQ ID NO: 128174 - DNA, 20 bp, Artificial sequence
  SiRNA target sequence
tgttttgtctgtttggacag

SEQ ID NO: 128175 - DNA, 20 bp, Artificial sequence
  SiRNA target sequence
gttttgtctgtttggacagg

SEQ ID NO: 128176 - DNA, 20 bp, Artificial sequence
  SiRNA target sequence
ttttgtctgtttggacaggt

SEQ ID NO: 128177 - DNA, 20 bp, Artificial sequence
  SiRNA target sequence
tttgtctgtttggacaggta

SEQ ID NO: 128178 - DNA, 20 bp, Artificial sequence
  SiRNA target sequence
ttgtctgtttggacaggtat

SEQ ID NO: 128179 - DNA, 20 bp, Artificial sequence
  SiRNA target sequence
tgtctgtttggacaggtatt

SEQ ID NO: 128180 - DNA, 20 bp, Artificial sequence
  SiRNA target sequence
gtctgtttggacaggtatta

SEQ ID NO: 128181 - DNA, 20 bp, Artificial sequence
  SiRNA target sequence
tctgtttggacaggtattag

SEQ ID NO: 128182 - DNA, 20 bp, Artificial sequence
  SiRNA target sequence
ctgtttggacaggtattaga

SEQ ID NO: 128183 - DNA, 20 bp, Artificial sequence
  SiRNA target sequence
tgtttggacaggtattagac

SEQ ID NO: 128184 - DNA, 20 bp, Artificial sequence
  SiRNA target sequence
gtttggacaggtattagacc

SEQ ID NO: 128185 - DNA, 20 bp, Artificial sequence
  SiRNA target sequence
tttggacaggtattagaccg

SEQ ID NO: 128186 - DNA, 20 bp, Artificial sequence
  SiRNA target sequence
ttggacaggtattagaccgt

SEQ ID NO: 128187 - DNA, 20 bp, Artificial sequence
  SiRNA target sequence
tggacaggtattagaccgtt

SEQ ID NO: 128188 - DNA, 20 bp, Artificial sequence
  SiRNA target sequence
ggacaggtattagaccgtta

SEQ ID NO: 128189 - DNA, 20 bp, Artificial sequence
  SiRNA target sequence
gacaggtattagaccgttag

SEQ ID NO: 128190 - DNA, 20 bp, Artificial sequence
  SiRNA target sequence
acaggtattagaccgttagt

SEQ ID NO: 128191 - DNA, 20 bp, Artificial sequence
  SiRNA target sequence
caggtattagaccgttagtc

SEQ ID NO: 128192 - DNA, 20 bp, Artificial sequence
  SiRNA target sequence
aggtattagaccgttagtca

SEQ ID NO: 128193 - DNA, 20 bp, Artificial sequence
  SiRNA target sequence
ggtattagaccgttagtcaa

SEQ ID NO: 128194 - DNA, 20 bp, Artificial sequence
  SiRNA target sequence
gtattagaccgttagtcaag

SEQ ID NO: 128195 - DNA, 20 bp, Artificial sequence
  SiRNA target sequence
tattagaccgttagtcaagg

SEQ ID NO: 128196 - DNA, 20 bp, Artificial sequence
  SiRNA target sequence
attagaccgttagtcaagga

SEQ ID NO: 128197 - DNA, 20 bp, Artificial sequence
  SiRNA target sequence
ttagaccgttagtcaaggat

SEQ ID NO: 128198 - DNA, 20 bp, Artificial sequence
  SiRNA target sequence
tagaccgttagtcaaggatt

SEQ ID NO: 128199 - DNA, 20 bp, Artificial sequence
  SiRNA target sequence
agaccgttagtcaaggattt

SEQ ID NO: 128200 - DNA, 20 bp, Artificial sequence
  SiRNA target sequence
gaccgttagtcaaggattta

SEQ ID NO: 128201 - DNA, 20 bp, Artificial sequence
  SiRNA target sequence
accgttagtcaaggatttat

SEQ ID NO: 128202 - DNA, 20 bp, Artificial sequence
  SiRNA target sequence
ccgttagtcaaggatttatc

SEQ ID NO: 128203 - DNA, 20 bp, Artificial sequence
  SiRNA target sequence
cgttagtcaaggatttatcg

SEQ ID NO: 128204 - DNA, 20 bp, Artificial sequence
  SiRNA target sequence
gttagtcaaggatttatcga

SEQ ID NO: 128205 - DNA, 20 bp, Artificial sequence
  SiRNA target sequence
ttagtcaaggatttatcgaa

SEQ ID NO: 128206 - DNA, 20 bp, Artificial sequence
  SiRNA target sequence
tagtcaaggatttatcgaaa

SEQ ID NO: 128207 - DNA, 20 bp, Artificial sequence
  SiRNA target sequence
agtcaaggatttatcgaaaa

SEQ ID NO: 128208 - DNA, 20 bp, Artificial sequence
  SiRNA target sequence
gtcaaggatttatcgaaaag

SEQ ID NO: 128209 - DNA, 20 bp, Artificial sequence
  SiRNA target sequence
tcaaggatttatcgaaaagt

SEQ ID NO: 128210 - DNA, 20 bp, Artificial sequence
  SiRNA target sequence
caaggatttatcgaaaagtt

SEQ ID NO: 128211 - DNA, 20 bp, Artificial sequence
  SiRNA target sequence
aaggatttatcgaaaagttc

SEQ ID NO: 128212 - DNA, 20 bp, Artificial sequence
  SiRNA target sequence
aggatttatcgaaaagttca

SEQ ID NO: 128213 - DNA, 20 bp, Artificial sequence
  SiRNA target sequence
ggatttatcgaaaagttcaa

SEQ ID NO: 128214 - DNA, 20 bp, Artificial sequence
  SiRNA target sequence
gatttatcgaaaagttcaac

SEQ ID NO: 128215 - DNA, 20 bp, Artificial sequence
  SiRNA target sequence
atttatcgaaaagttcaaca

SEQ ID NO: 128216 - DNA, 20 bp, Artificial sequence
  SiRNA target sequence
tttatcgaaaagttcaacag

SEQ ID NO: 128217 - DNA, 20 bp, Artificial sequence
  SiRNA target sequence
ttatcgaaaagttcaacaga

SEQ ID NO: 128218 - DNA, 20 bp, Artificial sequence
  SiRNA target sequence
tatcgaaaagttcaacagaa

SEQ ID NO: 128219 - DNA, 20 bp, Artificial sequence
  SiRNA target sequence
atcgaaaagttcaacagaaa

SEQ ID NO: 128220 - DNA, 20 bp, Artificial sequence
  SiRNA target sequence
tcgaaaagttcaacagaaaa

SEQ ID NO: 128221 - DNA, 20 bp, Artificial sequence
  SiRNA target sequence
cgaaaagttcaacagaaaag

SEQ ID NO: 128222 - DNA, 20 bp, Artificial sequence
  SiRNA target sequence
gaaaagttcaacagaaaaga

SEQ ID NO: 128223 - DNA, 20 bp, Artificial sequence
  SiRNA target sequence
aaaagttcaacagaaaagat

SEQ ID NO: 128224 - DNA, 20 bp, Artificial sequence
  SiRNA target sequence
aaagttcaacagaaaagata

SEQ ID NO: 128225 - DNA, 20 bp, Artificial sequence
  SiRNA target sequence
aagttcaacagaaaagatat

SEQ ID NO: 128226 - DNA, 20 bp, Artificial sequence
  SiRNA target sequence
agttcaacagaaaagatatg

SEQ ID NO: 128227 - DNA, 20 bp, Artificial sequence
  SiRNA target sequence
gttcaacagaaaagatatgt

SEQ ID NO: 128228 - DNA, 20 bp, Artificial sequence
  SiRNA target sequence
ttcaacagaaaagatatgta

SEQ ID NO: 128229 - DNA, 20 bp, Artificial sequence
  SiRNA target sequence
tcaacagaaaagatatgtag

SEQ ID NO: 128230 - DNA, 20 bp, Artificial sequence
  SiRNA target sequence
caacagaaaagatatgtaga

SEQ ID NO: 128231 - DNA, 20 bp, Artificial sequence
  SiRNA target sequence
aacagaaaagatatgtagaa

SEQ ID NO: 128232 - DNA, 20 bp, Artificial sequence
  SiRNA target sequence
acagaaaagatatgtagaaa

SEQ ID NO: 128233 - DNA, 20 bp, Artificial sequence
  SiRNA target sequence
cagaaaagatatgtagaaaa

SEQ ID NO: 128234 - DNA, 20 bp, Artificial sequence
  SiRNA target sequence
agaaaagatatgtagaaaac

SEQ ID NO: 128235 - DNA, 20 bp, Artificial sequence
  SiRNA target sequence
gaaaagatatgtagaaaaca

SEQ ID NO: 128236 - DNA, 20 bp, Artificial sequence
  SiRNA target sequence
aaaagatatgtagaaaacat

SEQ ID NO: 128237 - DNA, 20 bp, Artificial sequence
  SiRNA target sequence
aaagatatgtagaaaacata

SEQ ID NO: 128238 - DNA, 20 bp, Artificial sequence
  SiRNA target sequence
aagatatgtagaaaacatac

SEQ ID NO: 128239 - DNA, 20 bp, Artificial sequence
  SiRNA target sequence
agatatgtagaaaacatact

SEQ ID NO: 128240 - DNA, 20 bp, Artificial sequence
  SiRNA target sequence
gatatgtagaaaacatacta

SEQ ID NO: 128241 - DNA, 20 bp, Artificial sequence
  SiRNA target sequence
atatgtagaaaacatactat

SEQ ID NO: 128242 - DNA, 20 bp, Artificial sequence
  SiRNA target sequence
tatgtagaaaacatactata

SEQ ID NO: 128243 - DNA, 20 bp, Artificial sequence
  SiRNA target sequence
atgtagaaaacatactataa

SEQ ID NO: 128244 - DNA, 20 bp, Artificial sequence
  SiRNA target sequence
tgtagaaaacatactataag

SEQ ID NO: 128245 - DNA, 20 bp, Artificial sequence
  SiRNA target sequence
gtagaaaacatactataaga

SEQ ID NO: 128246 - DNA, 20 bp, Artificial sequence
  SiRNA target sequence
tagaaaacatactataagaa

SEQ ID NO: 128247 - DNA, 20 bp, Artificial sequence
  SiRNA target sequence
agaaaacatactataagaat

SEQ ID NO: 128248 - DNA, 20 bp, Artificial sequence
  SiRNA target sequence
gaaaacatactataagaata

SEQ ID NO: 128249 - DNA, 20 bp, Artificial sequence
  SiRNA target sequence
aaaacatactataagaatag

SEQ ID NO: 128250 - DNA, 20 bp, Artificial sequence
  SiRNA target sequence
aaacatactataagaataga

SEQ ID NO: 128251 - DNA, 20 bp, Artificial sequence
  SiRNA target sequence
aacatactataagaatagat

SEQ ID NO: 128252 - DNA, 20 bp, Artificial sequence
  SiRNA target sequence
acatactataagaatagata

SEQ ID NO: 128253 - DNA, 20 bp, Artificial sequence
  SiRNA target sequence
catactataagaatagataa

SEQ ID NO: 128254 - DNA, 20 bp, Artificial sequence
  SiRNA target sequence
atactataagaatagataaa

SEQ ID NO: 128255 - DNA, 20 bp, Artificial sequence
  SiRNA target sequence
tactataagaatagataaag

SEQ ID NO: 128256 - DNA, 20 bp, Artificial sequence
  SiRNA target sequence
actataagaatagataaaga

SEQ ID NO: 128257 - DNA, 20 bp, Artificial sequence
  SiRNA target sequence
ctataagaatagataaagac

SEQ ID NO: 128258 - DNA, 20 bp, Artificial sequence
  SiRNA target sequence
tataagaatagataaagaca

SEQ ID NO: 128259 - DNA, 20 bp, Artificial sequence
  SiRNA target sequence
ataagaatagataaagacaa

SEQ ID NO: 128260 - DNA, 20 bp, Artificial sequence
  SiRNA target sequence
taagaatagataaagacaat

SEQ ID NO: 128261 - DNA, 20 bp, Artificial sequence
  SiRNA target sequence
aagaatagataaagacaata

SEQ ID NO: 128262 - DNA, 20 bp, Artificial sequence
  SiRNA target sequence
agaatagataaagacaatat

SEQ ID NO: 128263 - DNA, 20 bp, Artificial sequence
  SiRNA target sequence
gaatagataaagacaatatg

SEQ ID NO: 128264 - DNA, 20 bp, Artificial sequence
  SiRNA target sequence
aatagataaagacaatatgg

SEQ ID NO: 128265 - DNA, 20 bp, Artificial sequence
  SiRNA target sequence
atagataaagacaatatggt

SEQ ID NO: 128266 - DNA, 20 bp, Artificial sequence
  SiRNA target sequence
tagataaagacaatatggta

SEQ ID NO: 128267 - DNA, 20 bp, Artificial sequence
  SiRNA target sequence
agataaagacaatatggtaa

SEQ ID NO: 128268 - DNA, 20 bp, Artificial sequence
  SiRNA target sequence
gataaagacaatatggtaac

SEQ ID NO: 128269 - DNA, 20 bp, Artificial sequence
  SiRNA target sequence
ataaagacaatatggtaact

SEQ ID NO: 128270 - DNA, 20 bp, Artificial sequence
  SiRNA target sequence
taaagacaatatggtaactg

SEQ ID NO: 128271 - DNA, 20 bp, Artificial sequence
  SiRNA target sequence
aaagacaatatggtaactgt

SEQ ID NO: 128272 - DNA, 20 bp, Artificial sequence
  SiRNA target sequence
aagacaatatggtaactgta

SEQ ID NO: 128273 - DNA, 20 bp, Artificial sequence
  SiRNA target sequence
agacaatatggtaactgtaa

SEQ ID NO: 128274 - DNA, 20 bp, Artificial sequence
  SiRNA target sequence
gacaatatggtaactgtaac

SEQ ID NO: 128275 - DNA, 20 bp, Artificial sequence
  SiRNA target sequence
acaatatggtaactgtaaca

SEQ ID NO: 128276 - DNA, 20 bp, Artificial sequence
  SiRNA target sequence
caatatggtaactgtaacag

SEQ ID NO: 128277 - DNA, 20 bp, Artificial sequence
  SiRNA target sequence
aatatggtaactgtaacagg

SEQ ID NO: 128278 - DNA, 20 bp, Artificial sequence
  SiRNA target sequence
atatggtaactgtaacaggt

SEQ ID NO: 128279 - DNA, 20 bp, Artificial sequence
  SiRNA target sequence
tatggtaactgtaacaggtg

SEQ ID NO: 128280 - DNA, 20 bp, Artificial sequence
  SiRNA target sequence
atggtaactgtaacaggtgg

SEQ ID NO: 128281 - DNA, 20 bp, Artificial sequence
  SiRNA target sequence
tggtaactgtaacaggtggt

SEQ ID NO: 128282 - DNA, 20 bp, Artificial sequence
  SiRNA target sequence
ggtaactgtaacaggtggta

SEQ ID NO: 128283 - DNA, 20 bp, Artificial sequence
  SiRNA target sequence
gtaactgtaacaggtggtaa

SEQ ID NO: 128284 - DNA, 20 bp, Artificial sequence
  SiRNA target sequence
taactgtaacaggtggtaag

SEQ ID NO: 128285 - DNA, 20 bp, Artificial sequence
  SiRNA target sequence
aactgtaacaggtggtaagt

SEQ ID NO: 128286 - DNA, 20 bp, Artificial sequence
  SiRNA target sequence
actgtaacaggtggtaagtg

SEQ ID NO: 128287 - DNA, 20 bp, Artificial sequence
  SiRNA target sequence
ctgtaacaggtggtaagtgg

SEQ ID NO: 128288 - DNA, 20 bp, Artificial sequence
  SiRNA target sequence
tgtaacaggtggtaagtgga

SEQ ID NO: 128289 - DNA, 20 bp, Artificial sequence
  SiRNA target sequence
gtaacaggtggtaagtggac

SEQ ID NO: 128290 - DNA, 20 bp, Artificial sequence
  SiRNA target sequence
taacaggtggtaagtggaca

SEQ ID NO: 128291 - DNA, 20 bp, Artificial sequence
  SiRNA target sequence
aacaggtggtaagtggacaa

SEQ ID NO: 128292 - DNA, 20 bp, Artificial sequence
  SiRNA target sequence
acaggtggtaagtggacaat

SEQ ID NO: 128293 - DNA, 20 bp, Artificial sequence
  SiRNA target sequence
caggtggtaagtggacaatt

SEQ ID NO: 128294 - DNA, 20 bp, Artificial sequence
  SiRNA target sequence
aggtggtaagtggacaattt

SEQ ID NO: 128295 - DNA, 20 bp, Artificial sequence
  SiRNA target sequence
ggtggtaagtggacaatttt

SEQ ID NO: 128296 - DNA, 20 bp, Artificial sequence
  SiRNA target sequence
gtggtaagtggacaattttt

SEQ ID NO: 128297 - DNA, 20 bp, Artificial sequence
  SiRNA target sequence
tggtaagtggacaatttttc

SEQ ID NO: 128298 - DNA, 20 bp, Artificial sequence
  SiRNA target sequence
ggtaagtggacaatttttcg

SEQ ID NO: 128299 - DNA, 20 bp, Artificial sequence
  SiRNA target sequence
gtaagtggacaatttttcga

SEQ ID NO: 128300 - DNA, 20 bp, Artificial sequence
  SiRNA target sequence
taagtggacaatttttcgac

SEQ ID NO: 128301 - DNA, 20 bp, Artificial sequence
  SiRNA target sequence
aagtggacaatttttcgact

SEQ ID NO: 128302 - DNA, 20 bp, Artificial sequence
  SiRNA target sequence
agtggacaatttttcgactt

SEQ ID NO: 128303 - DNA, 20 bp, Artificial sequence
  SiRNA target sequence
gtggacaatttttcgactta

SEQ ID NO: 128304 - DNA, 20 bp, Artificial sequence
  SiRNA target sequence
tggacaatttttcgacttat

SEQ ID NO: 128305 - DNA, 20 bp, Artificial sequence
  SiRNA target sequence
ggacaatttttcgacttatg

SEQ ID NO: 128306 - DNA, 20 bp, Artificial sequence
  SiRNA target sequence
gacaatttttcgacttatgg

SEQ ID NO: 128307 - DNA, 20 bp, Artificial sequence
  SiRNA target sequence
acaatttttcgacttatggg

SEQ ID NO: 128308 - DNA, 20 bp, Artificial sequence
  SiRNA target sequence
caatttttcgacttatggga

SEQ ID NO: 128309 - DNA, 20 bp, Artificial sequence
  SiRNA target sequence
aatttttcgacttatgggag

SEQ ID NO: 128310 - DNA, 20 bp, Artificial sequence
  SiRNA target sequence
atttttcgacttatgggaga

SEQ ID NO: 128311 - DNA, 20 bp, Artificial sequence
  SiRNA target sequence
tttttcgacttatgggagaa

SEQ ID NO: 128312 - DNA, 20 bp, Artificial sequence
  SiRNA target sequence
ttttcgacttatgggagaac

SEQ ID NO: 128313 - DNA, 20 bp, Artificial sequence
  SiRNA target sequence
tttcgacttatgggagaaca

SEQ ID NO: 128314 - DNA, 20 bp, Artificial sequence
  SiRNA target sequence
ttcgacttatgggagaacag

SEQ ID NO: 128315 - DNA, 20 bp, Artificial sequence
  SiRNA target sequence
tcgacttatgggagaacaga

SEQ ID NO: 128316 - DNA, 20 bp, Artificial sequence
  SiRNA target sequence
cgacttatgggagaacagac

SEQ ID NO: 128317 - DNA, 20 bp, Artificial sequence
  SiRNA target sequence
gacttatgggagaacagaca

SEQ ID NO: 128318 - DNA, 20 bp, Artificial sequence
  SiRNA target sequence
acttatgggagaacagacaa

SEQ ID NO: 128319 - DNA, 20 bp, Artificial sequence
  SiRNA target sequence
cttatgggagaacagacaat

SEQ ID NO: 128320 - DNA, 20 bp, Artificial sequence
  SiRNA target sequence
ttatgggagaacagacaata

SEQ ID NO: 128321 - DNA, 20 bp, Artificial sequence
  SiRNA target sequence
tatgggagaacagacaataa

SEQ ID NO: 128322 - DNA, 20 bp, Artificial sequence
  SiRNA target sequence
atgggagaacagacaataaa

SEQ ID NO: 128323 - DNA, 20 bp, Artificial sequence
  SiRNA target sequence
tgggagaacagacaataaat

SEQ ID NO: 128324 - DNA, 20 bp, Artificial sequence
  SiRNA target sequence
gggagaacagacaataaatc

SEQ ID NO: 128325 - DNA, 20 bp, Artificial sequence
  SiRNA target sequence
ggagaacagacaataaatca

SEQ ID NO: 128326 - DNA, 20 bp, Artificial sequence
  SiRNA target sequence
gagaacagacaataaatcaa

SEQ ID NO: 128327 - DNA, 20 bp, Artificial sequence
  SiRNA target sequence
agaacagacaataaatcaaa

SEQ ID NO: 128328 - DNA, 20 bp, Artificial sequence
  SiRNA target sequence
gaacagacaataaatcaaat

SEQ ID NO: 128329 - DNA, 20 bp, Artificial sequence
  SiRNA target sequence
aacagacaataaatcaaatt

SEQ ID NO: 128330 - DNA, 20 bp, Artificial sequence
  SiRNA target sequence
acagacaataaatcaaatta

SEQ ID NO: 128331 - DNA, 20 bp, Artificial sequence
  SiRNA target sequence
cagacaataaatcaaattat

SEQ ID NO: 128332 - DNA, 20 bp, Artificial sequence
  SiRNA target sequence
agacaataaatcaaattata

SEQ ID NO: 128333 - DNA, 20 bp, Artificial sequence
  SiRNA target sequence
gacaataaatcaaattataa

SEQ ID NO: 128334 - DNA, 20 bp, Artificial sequence
  SiRNA target sequence
acaataaatcaaattataaa

SEQ ID NO: 128335 - DNA, 20 bp, Artificial sequence
  SiRNA target sequence
caataaatcaaattataaaa

SEQ ID NO: 128336 - DNA, 20 bp, Artificial sequence
  SiRNA target sequence
aataaatcaaattataaaag

SEQ ID NO: 128337 - DNA, 20 bp, Artificial sequence
  SiRNA target sequence
ataaatcaaattataaaagt

SEQ ID NO: 128338 - DNA, 20 bp, Artificial sequence
  SiRNA target sequence
taaatcaaattataaaagtt

SEQ ID NO: 128339 - DNA, 20 bp, Artificial sequence
  SiRNA target sequence
aaatcaaattataaaagttt

SEQ ID NO: 128340 - DNA, 20 bp, Artificial sequence
  SiRNA target sequence
aatcaaattataaaagtttt

SEQ ID NO: 128341 - DNA, 20 bp, Artificial sequence
  SiRNA target sequence
atcaaattataaaagttttt

SEQ ID NO: 128342 - DNA, 20 bp, Artificial sequence
  SiRNA target sequence
tcaaattataaaagttttta

SEQ ID NO: 128343 - DNA, 20 bp, Artificial sequence
  SiRNA target sequence
caaattataaaagtttttaa

SEQ ID NO: 128344 - DNA, 20 bp, Artificial sequence
  SiRNA target sequence
aaattataaaagtttttaat

SEQ ID NO: 128345 - DNA, 20 bp, Artificial sequence
  SiRNA target sequence
aattataaaagtttttaata

SEQ ID NO: 128346 - DNA, 20 bp, Artificial sequence
  SiRNA target sequence
attataaaagtttttaatat

SEQ ID NO: 128347 - DNA, 20 bp, Artificial sequence
  SiRNA target sequence
ttataaaagtttttaatata

SEQ ID NO: 128348 - DNA, 20 bp, Artificial sequence
  SiRNA target sequence
tataaaagtttttaatataa

SEQ ID NO: 128349 - DNA, 20 bp, Artificial sequence
  SiRNA target sequence
ataaaagtttttaatataaa

SEQ ID NO: 128350 - DNA, 20 bp, Artificial sequence
  SiRNA target sequence
taaaagtttttaatataaag

SEQ ID NO: 128351 - DNA, 20 bp, Artificial sequence
  SiRNA target sequence
aaaagtttttaatataaagt

SEQ ID NO: 128352 - DNA, 20 bp, Artificial sequence
  SiRNA target sequence
aaagtttttaatataaagtc

SEQ ID NO: 128353 - DNA, 20 bp, Artificial sequence
  SiRNA target sequence
aagtttttaatataaagtct

SEQ ID NO: 128354 - DNA, 20 bp, Artificial sequence
  SiRNA target sequence
agtttttaatataaagtcta

SEQ ID NO: 128355 - DNA, 20 bp, Artificial sequence
  SiRNA target sequence
gtttttaatataaagtctaa

SEQ ID NO: 128356 - DNA, 20 bp, Artificial sequence
  SiRNA target sequence
tttttaatataaagtctaat

SEQ ID NO: 128357 - DNA, 20 bp, Artificial sequence
  SiRNA target sequence
ttttaatataaagtctaata

SEQ ID NO: 128358 - DNA, 20 bp, Artificial sequence
  SiRNA target sequence
tttaatataaagtctaataa

SEQ ID NO: 128359 - DNA, 20 bp, Artificial sequence
  SiRNA target sequence
ttaatataaagtctaataaa

SEQ ID NO: 128360 - DNA, 20 bp, Artificial sequence
  SiRNA target sequence
taatataaagtctaataaac

SEQ ID NO: 128361 - DNA, 20 bp, Artificial sequence
  SiRNA target sequence
aatataaagtctaataaacc

SEQ ID NO: 128362 - DNA, 20 bp, Artificial sequence
  SiRNA target sequence
atataaagtctaataaacca

SEQ ID NO: 128363 - DNA, 20 bp, Artificial sequence
  SiRNA target sequence
tataaagtctaataaaccaa

SEQ ID NO: 128364 - DNA, 20 bp, Artificial sequence
  SiRNA target sequence
ataaagtctaataaaccaag

SEQ ID NO: 128365 - DNA, 20 bp, Artificial sequence
  SiRNA target sequence
taaagtctaataaaccaagt

SEQ ID NO: 128366 - DNA, 20 bp, Artificial sequence
  SiRNA target sequence
aaagtctaataaaccaagta

SEQ ID NO: 128367 - DNA, 20 bp, Artificial sequence
  SiRNA target sequence
aagtctaataaaccaagtat

SEQ ID NO: 128368 - DNA, 20 bp, Artificial sequence
  SiRNA target sequence
agtctaataaaccaagtata

SEQ ID NO: 128369 - DNA, 20 bp, Artificial sequence
  SiRNA target sequence
gtctaataaaccaagtataa

SEQ ID NO: 128370 - DNA, 20 bp, Artificial sequence
  SiRNA target sequence
tctaataaaccaagtataac

SEQ ID NO: 128371 - DNA, 20 bp, Artificial sequence
  SiRNA target sequence
ctaataaaccaagtataaca

SEQ ID NO: 128372 - DNA, 20 bp, Artificial sequence
  SiRNA target sequence
taataaaccaagtataacac

SEQ ID NO: 128373 - DNA, 20 bp, Artificial sequence
  SiRNA target sequence
aataaaccaagtataacaca

SEQ ID NO: 128374 - DNA, 20 bp, Artificial sequence
  SiRNA target sequence
ataaaccaagtataacacaa

SEQ ID NO: 128375 - DNA, 20 bp, Artificial sequence
  SiRNA target sequence
taaaccaagtataacacaat

SEQ ID NO: 128376 - DNA, 20 bp, Artificial sequence
  SiRNA target sequence
aaaccaagtataacacaata

SEQ ID NO: 128377 - DNA, 20 bp, Artificial sequence
  SiRNA target sequence
aaccaagtataacacaatat

SEQ ID NO: 128378 - DNA, 20 bp, Artificial sequence
  SiRNA target sequence
accaagtataacacaatatc

SEQ ID NO: 128379 - DNA, 20 bp, Artificial sequence
  SiRNA target sequence
ccaagtataacacaatatct

SEQ ID NO: 128380 - DNA, 20 bp, Artificial sequence
  SiRNA target sequence
caagtataacacaatatctt

SEQ ID NO: 128381 - DNA, 20 bp, Artificial sequence
  SiRNA target sequence
aagtataacacaatatcttc

SEQ ID NO: 128382 - DNA, 20 bp, Artificial sequence
  SiRNA target sequence
agtataacacaatatcttcc

SEQ ID NO: 128383 - DNA, 20 bp, Artificial sequence
  SiRNA target sequence
gtataacacaatatcttcct

SEQ ID NO: 128384 - DNA, 20 bp, Artificial sequence
  SiRNA target sequence
tataacacaatatcttcctg

SEQ ID NO: 128385 - DNA, 20 bp, Artificial sequence
  SiRNA target sequence
ataacacaatatcttcctgt

SEQ ID NO: 128386 - DNA, 20 bp, Artificial sequence
  SiRNA target sequence
taacacaatatcttcctgtt

SEQ ID NO: 128387 - DNA, 20 bp, Artificial sequence
  SiRNA target sequence
aacacaatatcttcctgttt

SEQ ID NO: 128388 - DNA, 20 bp, Artificial sequence
  SiRNA target sequence
acacaatatcttcctgtttt

SEQ ID NO: 128389 - DNA, 20 bp, Artificial sequence
  SiRNA target sequence
cacaatatcttcctgttttg

SEQ ID NO: 128390 - DNA, 20 bp, Artificial sequence
  SiRNA target sequence
acaatatcttcctgttttgg

SEQ ID NO: 128391 - DNA, 20 bp, Artificial sequence
  SiRNA target sequence
caatatcttcctgttttggg

SEQ ID NO: 128392 - DNA, 20 bp, Artificial sequence
  SiRNA target sequence
aatatcttcctgttttggga

SEQ ID NO: 128393 - DNA, 20 bp, Artificial sequence
  SiRNA target sequence
atatcttcctgttttgggat

SEQ ID NO: 128394 - DNA, 20 bp, Artificial sequence
  SiRNA target sequence
tatcttcctgttttgggatc

SEQ ID NO: 128395 - DNA, 20 bp, Artificial sequence
  SiRNA target sequence
atcttcctgttttgggatca

SEQ ID NO: 128396 - DNA, 20 bp, Artificial sequence
  SiRNA target sequence
tcttcctgttttgggatcac

SEQ ID NO: 128397 - DNA, 20 bp, Artificial sequence
  SiRNA target sequence
cttcctgttttgggatcaca

SEQ ID NO: 128398 - DNA, 20 bp, Artificial sequence
  SiRNA target sequence
ttcctgttttgggatcacag

SEQ ID NO: 128399 - DNA, 20 bp, Artificial sequence
  SiRNA target sequence
tcctgttttgggatcacagg

SEQ ID NO: 128400 - DNA, 20 bp, Artificial sequence
  SiRNA target sequence
cctgttttgggatcacaggg

SEQ ID NO: 128401 - DNA, 20 bp, Artificial sequence
  SiRNA target sequence
ctgttttgggatcacaggga

SEQ ID NO: 128402 - DNA, 20 bp, Artificial sequence
  SiRNA target sequence
tgttttgggatcacagggat

SEQ ID NO: 128403 - DNA, 20 bp, Artificial sequence
  SiRNA target sequence
gttttgggatcacagggata

SEQ ID NO: 128404 - DNA, 20 bp, Artificial sequence
  SiRNA target sequence
ttttgggatcacagggatat

SEQ ID NO: 128405 - DNA, 20 bp, Artificial sequence
  SiRNA target sequence
tttgggatcacagggatata

SEQ ID NO: 128406 - DNA, 20 bp, Artificial sequence
  SiRNA target sequence
ttgggatcacagggatatac

SEQ ID NO: 128407 - DNA, 20 bp, Artificial sequence
  SiRNA target sequence
tgggatcacagggatatact

SEQ ID NO: 128408 - DNA, 20 bp, Artificial sequence
  SiRNA target sequence
gggatcacagggatatacta

SEQ ID NO: 128409 - DNA, 20 bp, Artificial sequence
  SiRNA target sequence
ggatcacagggatatactaa

SEQ ID NO: 128410 - DNA, 20 bp, Artificial sequence
  SiRNA target sequence
gatcacagggatatactaaa

SEQ ID NO: 128411 - DNA, 20 bp, Artificial sequence
  SiRNA target sequence
atcacagggatatactaaag

SEQ ID NO: 128412 - DNA, 20 bp, Artificial sequence
  SiRNA target sequence
tcacagggatatactaaagc

SEQ ID NO: 128413 - DNA, 20 bp, Artificial sequence
  SiRNA target sequence
cacagggatatactaaagct

SEQ ID NO: 128414 - DNA, 20 bp, Artificial sequence
  SiRNA target sequence
acagggatatactaaagcta

SEQ ID NO: 128415 - DNA, 20 bp, Artificial sequence
  SiRNA target sequence
cagggatatactaaagctac

SEQ ID NO: 128416 - DNA, 20 bp, Artificial sequence
  SiRNA target sequence
agggatatactaaagctaca

SEQ ID NO: 128417 - DNA, 20 bp, Artificial sequence
  SiRNA target sequence
gggatatactaaagctacag

SEQ ID NO: 128418 - DNA, 20 bp, Artificial sequence
  SiRNA target sequence
ggatatactaaagctacaga

SEQ ID NO: 128419 - DNA, 20 bp, Artificial sequence
  SiRNA target sequence
gatatactaaagctacagaa

SEQ ID NO: 128420 - DNA, 20 bp, Artificial sequence
  SiRNA target sequence
atatactaaagctacagaat

SEQ ID NO: 128421 - DNA, 20 bp, Artificial sequence
  SiRNA target sequence
tatactaaagctacagaatt

SEQ ID NO: 128422 - DNA, 20 bp, Artificial sequence
  SiRNA target sequence
atactaaagctacagaattt

SEQ ID NO: 128423 - DNA, 20 bp, Artificial sequence
  SiRNA target sequence
tactaaagctacagaatttg

SEQ ID NO: 128424 - DNA, 20 bp, Artificial sequence
  SiRNA target sequence
actaaagctacagaatttga

SEQ ID NO: 128425 - DNA, 20 bp, Artificial sequence
  SiRNA target sequence
ctaaagctacagaatttgat

SEQ ID NO: 128426 - DNA, 20 bp, Artificial sequence
  SiRNA target sequence
taaagctacagaatttgatt

SEQ ID NO: 128427 - DNA, 20 bp, Artificial sequence
  SiRNA target sequence
aaagctacagaatttgattt

SEQ ID NO: 128428 - DNA, 20 bp, Artificial sequence
  SiRNA target sequence
aagctacagaatttgatttg

SEQ ID NO: 128429 - DNA, 20 bp, Artificial sequence
  SiRNA target sequence
agctacagaatttgatttgg

SEQ ID NO: 128430 - DNA, 20 bp, Artificial sequence
  SiRNA target sequence
gctacagaatttgatttggc

SEQ ID NO: 128431 - DNA, 20 bp, Artificial sequence
  SiRNA target sequence
ctacagaatttgatttggca

SEQ ID NO: 128432 - DNA, 20 bp, Artificial sequence
  SiRNA target sequence
tacagaatttgatttggcac

SEQ ID NO: 128433 - DNA, 20 bp, Artificial sequence
  SiRNA target sequence
acagaatttgatttggcact

SEQ ID NO: 128434 - DNA, 20 bp, Artificial sequence
  SiRNA target sequence
cagaatttgatttggcactt

SEQ ID NO: 128435 - DNA, 20 bp, Artificial sequence
  SiRNA target sequence
agaatttgatttggcactta

SEQ ID NO: 128436 - DNA, 20 bp, Artificial sequence
  SiRNA target sequence
gaatttgatttggcacttac

SEQ ID NO: 128437 - DNA, 20 bp, Artificial sequence
  SiRNA target sequence
aatttgatttggcacttact

SEQ ID NO: 128438 - DNA, 20 bp, Artificial sequence
  SiRNA target sequence
atttgatttggcacttactt

SEQ ID NO: 128439 - DNA, 20 bp, Artificial sequence
  SiRNA target sequence
tttgatttggcacttacttt

SEQ ID NO: 128440 - DNA, 20 bp, Artificial sequence
  SiRNA target sequence
ttgatttggcacttacttta

SEQ ID NO: 128441 - DNA, 20 bp, Artificial sequence
  SiRNA target sequence
tgatttggcacttactttaa

SEQ ID NO: 128442 - DNA, 20 bp, Artificial sequence
  SiRNA target sequence
gatttggcacttactttaaa

SEQ ID NO: 128443 - DNA, 20 bp, Artificial sequence
  SiRNA target sequence
atttggcacttactttaaat

SEQ ID NO: 128444 - DNA, 20 bp, Artificial sequence
  SiRNA target sequence
tttggcacttactttaaata

SEQ ID NO: 128445 - DNA, 20 bp, Artificial sequence
  SiRNA target sequence
ttggcacttactttaaatat

SEQ ID NO: 128446 - DNA, 20 bp, Artificial sequence
  SiRNA target sequence
tggcacttactttaaatatt

SEQ ID NO: 128447 - DNA, 20 bp, Artificial sequence
  SiRNA target sequence
ggcacttactttaaatattc

SEQ ID NO: 128448 - DNA, 20 bp, Artificial sequence
  SiRNA target sequence
gcacttactttaaatattcc

SEQ ID NO: 128449 - DNA, 20 bp, Artificial sequence
  SiRNA target sequence
cacttactttaaatattcca

SEQ ID NO: 128450 - DNA, 20 bp, Artificial sequence
  SiRNA target sequence
acttactttaaatattccag

SEQ ID NO: 128451 - DNA, 20 bp, Artificial sequence
  SiRNA target sequence
cttactttaaatattccaga

SEQ ID NO: 128452 - DNA, 20 bp, Artificial sequence
  SiRNA target sequence
ttactttaaatattccagaa

SEQ ID NO: 128453 - DNA, 20 bp, Artificial sequence
  SiRNA target sequence
tactttaaatattccagaag

SEQ ID NO: 128454 - DNA, 20 bp, Artificial sequence
  SiRNA target sequence
actttaaatattccagaaga

SEQ ID NO: 128455 - DNA, 20 bp, Artificial sequence
  SiRNA target sequence
ctttaaatattccagaagat

SEQ ID NO: 128456 - DNA, 20 bp, Artificial sequence
  SiRNA target sequence
tttaaatattccagaagata

SEQ ID NO: 128457 - DNA, 20 bp, Artificial sequence
  SiRNA target sequence
ttaaatattccagaagatat

SEQ ID NO: 128458 - DNA, 20 bp, Artificial sequence
  SiRNA target sequence
taaatattccagaagatata

SEQ ID NO: 128459 - DNA, 20 bp, Artificial sequence
  SiRNA target sequence
aaatattccagaagatatag

SEQ ID NO: 128460 - DNA, 20 bp, Artificial sequence
  SiRNA target sequence
aatattccagaagatatagc

SEQ ID NO: 128461 - DNA, 20 bp, Artificial sequence
  SiRNA target sequence
atattccagaagatatagct

SEQ ID NO: 128462 - DNA, 20 bp, Artificial sequence
  SiRNA target sequence
tattccagaagatatagcta

SEQ ID NO: 128463 - DNA, 20 bp, Artificial sequence
  SiRNA target sequence
attccagaagatatagctaa

SEQ ID NO: 128464 - DNA, 20 bp, Artificial sequence
  SiRNA target sequence
ttccagaagatatagctaag

SEQ ID NO: 128465 - DNA, 20 bp, Artificial sequence
  SiRNA target sequence
tccagaagatatagctaagc

SEQ ID NO: 128466 - DNA, 20 bp, Artificial sequence
  SiRNA target sequence
ccagaagatatagctaagca

SEQ ID NO: 128467 - DNA, 20 bp, Artificial sequence
  SiRNA target sequence
cagaagatatagctaagcat

SEQ ID NO: 128468 - DNA, 20 bp, Artificial sequence
  SiRNA target sequence
agaagatatagctaagcatt

SEQ ID NO: 128469 - DNA, 20 bp, Artificial sequence
  SiRNA target sequence
gaagatatagctaagcattt

SEQ ID NO: 128470 - DNA, 20 bp, Artificial sequence
  SiRNA target sequence
aagatatagctaagcattta

SEQ ID NO: 128471 - DNA, 20 bp, Artificial sequence
  SiRNA target sequence
agatatagctaagcatttag

SEQ ID NO: 128472 - DNA, 20 bp, Artificial sequence
  SiRNA target sequence
gatatagctaagcatttagc

SEQ ID NO: 128473 - DNA, 20 bp, Artificial sequence
  SiRNA target sequence
atatagctaagcatttagct

SEQ ID NO: 128474 - DNA, 20 bp, Artificial sequence
  SiRNA target sequence
tatagctaagcatttagcta

SEQ ID NO: 128475 - DNA, 20 bp, Artificial sequence
  SiRNA target sequence
atagctaagcatttagctac

SEQ ID NO: 128476 - DNA, 20 bp, Artificial sequence
  SiRNA target sequence
tagctaagcatttagctaca

SEQ ID NO: 128477 - DNA, 20 bp, Artificial sequence
  SiRNA target sequence
agctaagcatttagctacaa

SEQ ID NO: 128478 - DNA, 20 bp, Artificial sequence
  SiRNA target sequence
gctaagcatttagctacaac

SEQ ID NO: 128479 - DNA, 20 bp, Artificial sequence
  SiRNA target sequence
ctaagcatttagctacaact

SEQ ID NO: 128480 - DNA, 20 bp, Artificial sequence
  SiRNA target sequence
taagcatttagctacaactt

SEQ ID NO: 128481 - DNA, 20 bp, Artificial sequence
  SiRNA target sequence
aagcatttagctacaactta

SEQ ID NO: 128482 - DNA, 20 bp, Artificial sequence
  SiRNA target sequence
agcatttagctacaacttat

SEQ ID NO: 128483 - DNA, 20 bp, Artificial sequence
  SiRNA target sequence
gcatttagctacaacttatg

SEQ ID NO: 128484 - DNA, 20 bp, Artificial sequence
  SiRNA target sequence
catttagctacaacttatgg

SEQ ID NO: 128485 - DNA, 20 bp, Artificial sequence
  SiRNA target sequence
atttagctacaacttatggt

SEQ ID NO: 128486 - DNA, 20 bp, Artificial sequence
  SiRNA target sequence
tttagctacaacttatggta

SEQ ID NO: 128487 - DNA, 20 bp, Artificial sequence
  SiRNA target sequence
ttagctacaacttatggtac

SEQ ID NO: 128488 - DNA, 20 bp, Artificial sequence
  SiRNA target sequence
tagctacaacttatggtacc

SEQ ID NO: 128489 - DNA, 20 bp, Artificial sequence
  SiRNA target sequence
agctacaacttatggtacca

SEQ ID NO: 128490 - DNA, 20 bp, Artificial sequence
  SiRNA target sequence
gctacaacttatggtaccaa

SEQ ID NO: 128491 - DNA, 20 bp, Artificial sequence
  SiRNA target sequence
ctacaacttatggtaccaaa

SEQ ID NO: 128492 - DNA, 20 bp, Artificial sequence
  SiRNA target sequence
tacaacttatggtaccaaag

SEQ ID NO: 128493 - DNA, 20 bp, Artificial sequence
  SiRNA target sequence
acaacttatggtaccaaagc

SEQ ID NO: 128494 - DNA, 20 bp, Artificial sequence
  SiRNA target sequence
caacttatggtaccaaagct

SEQ ID NO: 128495 - DNA, 20 bp, Artificial sequence
  SiRNA target sequence
aacttatggtaccaaagctt

SEQ ID NO: 128496 - DNA, 20 bp, Artificial sequence
  SiRNA target sequence
acttatggtaccaaagctta

SEQ ID NO: 128497 - DNA, 20 bp, Artificial sequence
  SiRNA target sequence
cttatggtaccaaagcttac

SEQ ID NO: 128498 - DNA, 20 bp, Artificial sequence
  SiRNA target sequence
ttatggtaccaaagcttaca

SEQ ID NO: 128499 - DNA, 20 bp, Artificial sequence
  SiRNA target sequence
tatggtaccaaagcttacaa

SEQ ID NO: 128500 - DNA, 20 bp, Artificial sequence
  SiRNA target sequence
atggtaccaaagcttacaat

SEQ ID NO: 128501 - DNA, 20 bp, Artificial sequence
  SiRNA target sequence
tggtaccaaagcttacaatt

SEQ ID NO: 128502 - DNA, 20 bp, Artificial sequence
  SiRNA target sequence
ggtaccaaagcttacaattt

SEQ ID NO: 128503 - DNA, 20 bp, Artificial sequence
  SiRNA target sequence
gtaccaaagcttacaatttc

SEQ ID NO: 128504 - DNA, 20 bp, Artificial sequence
  SiRNA target sequence
taccaaagcttacaatttct

SEQ ID NO: 128505 - DNA, 20 bp, Artificial sequence
  SiRNA target sequence
accaaagcttacaatttctc

SEQ ID NO: 128506 - DNA, 20 bp, Artificial sequence
  SiRNA target sequence
ccaaagcttacaatttctct

SEQ ID NO: 128507 - DNA, 20 bp, Artificial sequence
  SiRNA target sequence
caaagcttacaatttctctg

SEQ ID NO: 128508 - DNA, 20 bp, Artificial sequence
  SiRNA target sequence
aaagcttacaatttctctga

SEQ ID NO: 128509 - DNA, 20 bp, Artificial sequence
  SiRNA target sequence
aagcttacaatttctctgaa

SEQ ID NO: 128510 - DNA, 20 bp, Artificial sequence
  SiRNA target sequence
agcttacaatttctctgaat

SEQ ID NO: 128511 - DNA, 20 bp, Artificial sequence
  SiRNA target sequence
gcttacaatttctctgaata

SEQ ID NO: 128512 - DNA, 20 bp, Artificial sequence
  SiRNA target sequence
cttacaatttctctgaatac

SEQ ID NO: 128513 - DNA, 20 bp, Artificial sequence
  SiRNA target sequence
ttacaatttctctgaatact

SEQ ID NO: 128514 - DNA, 20 bp, Artificial sequence
  SiRNA target sequence
tacaatttctctgaatactt

SEQ ID NO: 128515 - DNA, 20 bp, Artificial sequence
  SiRNA target sequence
acaatttctctgaatacttt

SEQ ID NO: 128516 - DNA, 20 bp, Artificial sequence
  SiRNA target sequence
caatttctctgaatacttta

SEQ ID NO: 128517 - DNA, 20 bp, Artificial sequence
  SiRNA target sequence
aatttctctgaatactttaa

SEQ ID NO: 128518 - DNA, 20 bp, Artificial sequence
  SiRNA target sequence
atttctctgaatactttaat

SEQ ID NO: 128519 - DNA, 20 bp, Artificial sequence
  SiRNA target sequence
tttctctgaatactttaatg

SEQ ID NO: 128520 - DNA, 20 bp, Artificial sequence
  SiRNA target sequence
ttctctgaatactttaatgg

SEQ ID NO: 128521 - DNA, 20 bp, Artificial sequence
  SiRNA target sequence
tctctgaatactttaatggg

SEQ ID NO: 128522 - DNA, 20 bp, Artificial sequence
  SiRNA target sequence
ctctgaatactttaatgggt

SEQ ID NO: 128523 - DNA, 20 bp, Artificial sequence
  SiRNA target sequence
tctgaatactttaatgggtc

SEQ ID NO: 128524 - DNA, 20 bp, Artificial sequence
  SiRNA target sequence
ctgaatactttaatgggtca

SEQ ID NO: 128525 - DNA, 20 bp, Artificial sequence
  SiRNA target sequence
tgaatactttaatgggtcat

SEQ ID NO: 128526 - DNA, 20 bp, Artificial sequence
  SiRNA target sequence
gaatactttaatgggtcata

SEQ ID NO: 128527 - DNA, 20 bp, Artificial sequence
  SiRNA target sequence
aatactttaatgggtcatac

SEQ ID NO: 128528 - DNA, 20 bp, Artificial sequence
  SiRNA target sequence
atactttaatgggtcataca

SEQ ID NO: 128529 - DNA, 20 bp, Artificial sequence
  SiRNA target sequence
tactttaatgggtcatacac

SEQ ID NO: 128530 - DNA, 20 bp, Artificial sequence
  SiRNA target sequence
actttaatgggtcatacacc

SEQ ID NO: 128531 - DNA, 20 bp, Artificial sequence
  SiRNA target sequence
ctttaatgggtcatacacca

SEQ ID NO: 128532 - DNA, 20 bp, Artificial sequence
  SiRNA target sequence
tttaatgggtcatacaccag

SEQ ID NO: 128533 - DNA, 20 bp, Artificial sequence
  SiRNA target sequence
ttaatgggtcatacaccaga

SEQ ID NO: 128534 - DNA, 20 bp, Artificial sequence
  SiRNA target sequence
taatgggtcatacaccagac

SEQ ID NO: 128535 - DNA, 20 bp, Artificial sequence
  SiRNA target sequence
aatgggtcatacaccagact

SEQ ID NO: 128536 - DNA, 20 bp, Artificial sequence
  SiRNA target sequence
atgggtcatacaccagactt

SEQ ID NO: 128537 - DNA, 20 bp, Artificial sequence
  SiRNA target sequence
tgggtcatacaccagactta

SEQ ID NO: 128538 - DNA, 20 bp, Artificial sequence
  SiRNA target sequence
gggtcatacaccagacttac

SEQ ID NO: 128539 - DNA, 20 bp, Artificial sequence
  SiRNA target sequence
ggtcatacaccagacttaca

SEQ ID NO: 128540 - DNA, 20 bp, Artificial sequence
  SiRNA target sequence
gtcatacaccagacttacag

SEQ ID NO: 128541 - DNA, 20 bp, Artificial sequence
  SiRNA target sequence
tcatacaccagacttacaga

SEQ ID NO: 128542 - DNA, 20 bp, Artificial sequence
  SiRNA target sequence
catacaccagacttacagat

SEQ ID NO: 128543 - DNA, 20 bp, Artificial sequence
  SiRNA target sequence
atacaccagacttacagatg

SEQ ID NO: 128544 - DNA, 20 bp, Artificial sequence
  SiRNA target sequence
tacaccagacttacagatgg

SEQ ID NO: 128545 - DNA, 20 bp, Artificial sequence
  SiRNA target sequence
acaccagacttacagatggt

SEQ ID NO: 128546 - DNA, 20 bp, Artificial sequence
  SiRNA target sequence
caccagacttacagatggtt

SEQ ID NO: 128547 - DNA, 20 bp, Artificial sequence
  SiRNA target sequence
accagacttacagatggtta

SEQ ID NO: 128548 - DNA, 20 bp, Artificial sequence
  SiRNA target sequence
ccagacttacagatggttat

SEQ ID NO: 128549 - DNA, 20 bp, Artificial sequence
  SiRNA target sequence
cagacttacagatggttatc

SEQ ID NO: 128550 - DNA, 20 bp, Artificial sequence
  SiRNA target sequence
agacttacagatggttatcc

SEQ ID NO: 128551 - DNA, 20 bp, Artificial sequence
  SiRNA target sequence
gacttacagatggttatcct

SEQ ID NO: 128552 - DNA, 20 bp, Artificial sequence
  SiRNA target sequence
acttacagatggttatcctt

SEQ ID NO: 128553 - DNA, 20 bp, Artificial sequence
  SiRNA target sequence
cttacagatggttatcctta

SEQ ID NO: 128554 - DNA, 20 bp, Artificial sequence
  SiRNA target sequence
ttacagatggttatccttat

SEQ ID NO: 128555 - DNA, 20 bp, Artificial sequence
  SiRNA target sequence
tacagatggttatccttata

SEQ ID NO: 128556 - DNA, 20 bp, Artificial sequence
  SiRNA target sequence
acagatggttatccttatac

SEQ ID NO: 128557 - DNA, 20 bp, Artificial sequence
  SiRNA target sequence
cagatggttatccttataca

SEQ ID NO: 128558 - DNA, 20 bp, Artificial sequence
  SiRNA target sequence
agatggttatccttatacaa

SEQ ID NO: 128559 - DNA, 20 bp, Artificial sequence
  SiRNA target sequence
gatggttatccttatacaaa

SEQ ID NO: 128560 - DNA, 20 bp, Artificial sequence
  SiRNA target sequence
atggttatccttatacaaaa

SEQ ID NO: 128561 - DNA, 20 bp, Artificial sequence
  SiRNA target sequence
tggttatccttatacaaaag

SEQ ID NO: 128562 - DNA, 20 bp, Artificial sequence
  SiRNA target sequence
ggttatccttatacaaaaga

SEQ ID NO: 128563 - DNA, 20 bp, Artificial sequence
  SiRNA target sequence
gttatccttatacaaaagaa

SEQ ID NO: 128564 - DNA, 20 bp, Artificial sequence
  SiRNA target sequence
ttatccttatacaaaagaag

SEQ ID NO: 128565 - DNA, 20 bp, Artificial sequence
  SiRNA target sequence
tatccttatacaaaagaaga

SEQ ID NO: 128566 - DNA, 20 bp, Artificial sequence
  SiRNA target sequence
atccttatacaaaagaagaa

SEQ ID NO: 128567 - DNA, 20 bp, Artificial sequence
  SiRNA target sequence
tccttatacaaaagaagaaa

SEQ ID NO: 128568 - DNA, 20 bp, Artificial sequence
  SiRNA target sequence
ccttatacaaaagaagaaat

SEQ ID NO: 128569 - DNA, 20 bp, Artificial sequence
  SiRNA target sequence
cttatacaaaagaagaaata

SEQ ID NO: 128570 - DNA, 20 bp, Artificial sequence
  SiRNA target sequence
ttatacaaaagaagaaatag

SEQ ID NO: 128571 - DNA, 20 bp, Artificial sequence
  SiRNA target sequence
tatacaaaagaagaaatagt

SEQ ID NO: 128572 - DNA, 20 bp, Artificial sequence
  SiRNA target sequence
atacaaaagaagaaatagta

SEQ ID NO: 128573 - DNA, 20 bp, Artificial sequence
  SiRNA target sequence
tacaaaagaagaaatagtat

SEQ ID NO: 128574 - DNA, 20 bp, Artificial sequence
  SiRNA target sequence
acaaaagaagaaatagtata

SEQ ID NO: 128575 - DNA, 20 bp, Artificial sequence
  SiRNA target sequence
caaaagaagaaatagtatat

SEQ ID NO: 128576 - DNA, 20 bp, Artificial sequence
  SiRNA target sequence
aaaagaagaaatagtatatt

SEQ ID NO: 128577 - DNA, 20 bp, Artificial sequence
  SiRNA target sequence
aaagaagaaatagtatattg

SEQ ID NO: 128578 - DNA, 20 bp, Artificial sequence
  SiRNA target sequence
aagaagaaatagtatattgt

SEQ ID NO: 128579 - DNA, 20 bp, Artificial sequence
  SiRNA target sequence
agaagaaatagtatattgta

SEQ ID NO: 128580 - DNA, 20 bp, Artificial sequence
  SiRNA target sequence
gaagaaatagtatattgtat

SEQ ID NO: 128581 - DNA, 20 bp, Artificial sequence
  SiRNA target sequence
aagaaatagtatattgtatc

SEQ ID NO: 128582 - DNA, 20 bp, Artificial sequence
  SiRNA target sequence
agaaatagtatattgtatcg

SEQ ID NO: 128583 - DNA, 20 bp, Artificial sequence
  SiRNA target sequence
gaaatagtatattgtatcga

SEQ ID NO: 128584 - DNA, 20 bp, Artificial sequence
  SiRNA target sequence
aaatagtatattgtatcgaa

SEQ ID NO: 128585 - DNA, 20 bp, Artificial sequence
  SiRNA target sequence
aatagtatattgtatcgaac

SEQ ID NO: 128586 - DNA, 20 bp, Artificial sequence
  SiRNA target sequence
atagtatattgtatcgaaca

SEQ ID NO: 128587 - DNA, 20 bp, Artificial sequence
  SiRNA target sequence
tagtatattgtatcgaacat

SEQ ID NO: 128588 - DNA, 20 bp, Artificial sequence
  SiRNA target sequence
agtatattgtatcgaacatg

SEQ ID NO: 128589 - DNA, 20 bp, Artificial sequence
  SiRNA target sequence
gtatattgtatcgaacatga

SEQ ID NO: 128590 - DNA, 20 bp, Artificial sequence
  SiRNA target sequence
tatattgtatcgaacatgaa

SEQ ID NO: 128591 - DNA, 20 bp, Artificial sequence
  SiRNA target sequence
atattgtatcgaacatgaat

SEQ ID NO: 128592 - DNA, 20 bp, Artificial sequence
  SiRNA target sequence
tattgtatcgaacatgaatt

SEQ ID NO: 128593 - DNA, 20 bp, Artificial sequence
  SiRNA target sequence
attgtatcgaacatgaattg

SEQ ID NO: 128594 - DNA, 20 bp, Artificial sequence
  SiRNA target sequence
ttgtatcgaacatgaattgg

SEQ ID NO: 128595 - DNA, 20 bp, Artificial sequence
  SiRNA target sequence
tgtatcgaacatgaattggc

SEQ ID NO: 128596 - DNA, 20 bp, Artificial sequence
  SiRNA target sequence
gtatcgaacatgaattggct

SEQ ID NO: 128597 - DNA, 20 bp, Artificial sequence
  SiRNA target sequence
tatcgaacatgaattggctt

SEQ ID NO: 128598 - DNA, 20 bp, Artificial sequence
  SiRNA target sequence
atcgaacatgaattggctta

SEQ ID NO: 128599 - DNA, 20 bp, Artificial sequence
  SiRNA target sequence
tcgaacatgaattggcttat

SEQ ID NO: 128600 - DNA, 20 bp, Artificial sequence
  SiRNA target sequence
cgaacatgaattggcttatc

SEQ ID NO: 128601 - DNA, 20 bp, Artificial sequence
  SiRNA target sequence
gaacatgaattggcttatcg

SEQ ID NO: 128602 - DNA, 20 bp, Artificial sequence
  SiRNA target sequence
aacatgaattggcttatcgc

SEQ ID NO: 128603 - DNA, 20 bp, Artificial sequence
  SiRNA target sequence
acatgaattggcttatcgca

SEQ ID NO: 128604 - DNA, 20 bp, Artificial sequence
  SiRNA target sequence
catgaattggcttatcgcat

SEQ ID NO: 128605 - DNA, 20 bp, Artificial sequence
  SiRNA target sequence
atgaattggcttatcgcatc

SEQ ID NO: 128606 - DNA, 20 bp, Artificial sequence
  SiRNA target sequence
tgaattggcttatcgcatca

SEQ ID NO: 128607 - DNA, 20 bp, Artificial sequence
  SiRNA target sequence
gaattggcttatcgcatcag

SEQ ID NO: 128608 - DNA, 20 bp, Artificial sequence
  SiRNA target sequence
aattggcttatcgcatcagt

SEQ ID NO: 128609 - DNA, 20 bp, Artificial sequence
  SiRNA target sequence
attggcttatcgcatcagtg

SEQ ID NO: 128610 - DNA, 20 bp, Artificial sequence
  SiRNA target sequence
ttggcttatcgcatcagtga

SEQ ID NO: 128611 - DNA, 20 bp, Artificial sequence
  SiRNA target sequence
tggcttatcgcatcagtgat

SEQ ID NO: 128612 - DNA, 20 bp, Artificial sequence
  SiRNA target sequence
ggcttatcgcatcagtgata

SEQ ID NO: 128613 - DNA, 20 bp, Artificial sequence
  SiRNA target sequence
gcttatcgcatcagtgatat

SEQ ID NO: 128614 - DNA, 20 bp, Artificial sequence
  SiRNA target sequence
cttatcgcatcagtgatata

SEQ ID NO: 128615 - DNA, 20 bp, Artificial sequence
  SiRNA target sequence
ttatcgcatcagtgatatat

SEQ ID NO: 128616 - DNA, 20 bp, Artificial sequence
  SiRNA target sequence
tatcgcatcagtgatatatt

SEQ ID NO: 128617 - DNA, 20 bp, Artificial sequence
  SiRNA target sequence
atcgcatcagtgatatatta

SEQ ID NO: 128618 - DNA, 20 bp, Artificial sequence
  SiRNA target sequence
tcgcatcagtgatatattat

SEQ ID NO: 128619 - DNA, 20 bp, Artificial sequence
  SiRNA target sequence
cgcatcagtgatatattatt

SEQ ID NO: 128620 - DNA, 20 bp, Artificial sequence
  SiRNA target sequence
gcatcagtgatatattattt

SEQ ID NO: 128621 - DNA, 20 bp, Artificial sequence
  SiRNA target sequence
catcagtgatatattattta

SEQ ID NO: 128622 - DNA, 20 bp, Artificial sequence
  SiRNA target sequence
atcagtgatatattatttaa

SEQ ID NO: 128623 - DNA, 20 bp, Artificial sequence
  SiRNA target sequence
tcagtgatatattatttaat

SEQ ID NO: 128624 - DNA, 20 bp, Artificial sequence
  SiRNA target sequence
cagtgatatattatttaata

SEQ ID NO: 128625 - DNA, 20 bp, Artificial sequence
  SiRNA target sequence
agtgatatattatttaatag

SEQ ID NO: 128626 - DNA, 20 bp, Artificial sequence
  SiRNA target sequence
gtgatatattatttaatagg

SEQ ID NO: 128627 - DNA, 20 bp, Artificial sequence
  SiRNA target sequence
tgatatattatttaatagga

SEQ ID NO: 128628 - DNA, 20 bp, Artificial sequence
  SiRNA target sequence
gatatattatttaataggat

SEQ ID NO: 128629 - DNA, 20 bp, Artificial sequence
  SiRNA target sequence
atatattatttaataggatg

SEQ ID NO: 128630 - DNA, 20 bp, Artificial sequence
  SiRNA target sequence
tatattatttaataggatga

SEQ ID NO: 128631 - DNA, 20 bp, Artificial sequence
  SiRNA target sequence
atattatttaataggatgat

SEQ ID NO: 128632 - DNA, 20 bp, Artificial sequence
  SiRNA target sequence
tattatttaataggatgatg

SEQ ID NO: 128633 - DNA, 20 bp, Artificial sequence
  SiRNA target sequence
attatttaataggatgatga

SEQ ID NO: 128634 - DNA, 20 bp, Artificial sequence
  SiRNA target sequence
ttatttaataggatgatgat

SEQ ID NO: 128635 - DNA, 20 bp, Artificial sequence
  SiRNA target sequence
tatttaataggatgatgata

SEQ ID NO: 128636 - DNA, 20 bp, Artificial sequence
  SiRNA target sequence
atttaataggatgatgatag

SEQ ID NO: 128637 - DNA, 20 bp, Artificial sequence
  SiRNA target sequence
tttaataggatgatgatagg

SEQ ID NO: 128638 - DNA, 20 bp, Artificial sequence
  SiRNA target sequence
ttaataggatgatgatagga

SEQ ID NO: 128639 - DNA, 20 bp, Artificial sequence
  SiRNA target sequence
taataggatgatgataggat

SEQ ID NO: 128640 - DNA, 20 bp, Artificial sequence
  SiRNA target sequence
aataggatgatgataggata

SEQ ID NO: 128641 - DNA, 20 bp, Artificial sequence
  SiRNA target sequence
ataggatgatgataggatac

SEQ ID NO: 128642 - DNA, 20 bp, Artificial sequence
  SiRNA target sequence
taggatgatgataggataca

SEQ ID NO: 128643 - DNA, 20 bp, Artificial sequence
  SiRNA target sequence
aggatgatgataggatacat

SEQ ID NO: 128644 - DNA, 20 bp, Artificial sequence
  SiRNA target sequence
ggatgatgataggatacatt

SEQ ID NO: 128645 - DNA, 20 bp, Artificial sequence
  SiRNA target sequence
gatgatgataggatacattg

SEQ ID NO: 128646 - DNA, 20 bp, Artificial sequence
  SiRNA target sequence
atgatgataggatacattga

SEQ ID NO: 128647 - DNA, 20 bp, Artificial sequence
  SiRNA target sequence
tgatgataggatacattgac

SEQ ID NO: 128648 - DNA, 20 bp, Artificial sequence
  SiRNA target sequence
gatgataggatacattgacg

SEQ ID NO: 128649 - DNA, 20 bp, Artificial sequence
  SiRNA target sequence
atgataggatacattgacgt

SEQ ID NO: 128650 - DNA, 20 bp, Artificial sequence
  SiRNA target sequence
tgataggatacattgacgtc

SEQ ID NO: 128651 - DNA, 20 bp, Artificial sequence
  SiRNA target sequence
gataggatacattgacgtca

SEQ ID NO: 128652 - DNA, 20 bp, Artificial sequence
  SiRNA target sequence
ataggatacattgacgtcag

SEQ ID NO: 128653 - DNA, 20 bp, Artificial sequence
  SiRNA target sequence
taggatacattgacgtcaga

SEQ ID NO: 128654 - DNA, 20 bp, Artificial sequence
  SiRNA target sequence
aggatacattgacgtcagaa

SEQ ID NO: 128655 - DNA, 20 bp, Artificial sequence
  SiRNA target sequence
ggatacattgacgtcagaag

SEQ ID NO: 128656 - DNA, 20 bp, Artificial sequence
  SiRNA target sequence
gatacattgacgtcagaaga

SEQ ID NO: 128657 - DNA, 20 bp, Artificial sequence
  SiRNA target sequence
atacattgacgtcagaagag

SEQ ID NO: 128658 - DNA, 20 bp, Artificial sequence
  SiRNA target sequence
tacattgacgtcagaagagc

SEQ ID NO: 128659 - DNA, 20 bp, Artificial sequence
  SiRNA target sequence
acattgacgtcagaagagca

SEQ ID NO: 128660 - DNA, 20 bp, Artificial sequence
  SiRNA target sequence
cattgacgtcagaagagcat

SEQ ID NO: 128661 - DNA, 20 bp, Artificial sequence
  SiRNA target sequence
attgacgtcagaagagcatt

SEQ ID NO: 128662 - DNA, 20 bp, Artificial sequence
  SiRNA target sequence
ttgacgtcagaagagcattt

SEQ ID NO: 128663 - DNA, 20 bp, Artificial sequence
  SiRNA target sequence
tgacgtcagaagagcatttg

SEQ ID NO: 128664 - DNA, 20 bp, Artificial sequence
  SiRNA target sequence
gacgtcagaagagcatttga

SEQ ID NO: 128665 - DNA, 20 bp, Artificial sequence
  SiRNA target sequence
acgtcagaagagcatttgat

SEQ ID NO: 128666 - DNA, 20 bp, Artificial sequence
  SiRNA target sequence
cgtcagaagagcatttgatt

SEQ ID NO: 128667 - DNA, 20 bp, Artificial sequence
  SiRNA target sequence
gtcagaagagcatttgattt

SEQ ID NO: 128668 - DNA, 20 bp, Artificial sequence
  SiRNA target sequence
tcagaagagcatttgattta

SEQ ID NO: 128669 - DNA, 20 bp, Artificial sequence
  SiRNA target sequence
cagaagagcatttgatttaa

SEQ ID NO: 128670 - DNA, 20 bp, Artificial sequence
  SiRNA target sequence
agaagagcatttgatttaat

SEQ ID NO: 128671 - DNA, 20 bp, Artificial sequence
  SiRNA target sequence
gaagagcatttgatttaatt

SEQ ID NO: 128672 - DNA, 20 bp, Artificial sequence
  SiRNA target sequence
aagagcatttgatttaattg

SEQ ID NO: 128673 - DNA, 20 bp, Artificial sequence
  SiRNA target sequence
agagcatttgatttaattgg

SEQ ID NO: 128674 - DNA, 20 bp, Artificial sequence
  SiRNA target sequence
gagcatttgatttaattggt

SEQ ID NO: 128675 - DNA, 20 bp, Artificial sequence
  SiRNA target sequence
agcatttgatttaattggta

SEQ ID NO: 128676 - DNA, 20 bp, Artificial sequence
  SiRNA target sequence
gcatttgatttaattggtat

SEQ ID NO: 128677 - DNA, 20 bp, Artificial sequence
  SiRNA target sequence
catttgatttaattggtata

SEQ ID NO: 128678 - DNA, 20 bp, Artificial sequence
  SiRNA target sequence
atttgatttaattggtatag

SEQ ID NO: 128679 - DNA, 20 bp, Artificial sequence
  SiRNA target sequence
tttgatttaattggtatagt

SEQ ID NO: 128680 - DNA, 20 bp, Artificial sequence
  SiRNA target sequence
ttgatttaattggtatagta

SEQ ID NO: 128681 - DNA, 20 bp, Artificial sequence
  SiRNA target sequence
tgatttaattggtatagtag

SEQ ID NO: 128682 - DNA, 20 bp, Artificial sequence
  SiRNA target sequence
gatttaattggtatagtagc

SEQ ID NO: 128683 - DNA, 20 bp, Artificial sequence
  SiRNA target sequence
atttaattggtatagtagct

SEQ ID NO: 128684 - DNA, 20 bp, Artificial sequence
  SiRNA target sequence
tttaattggtatagtagctg

SEQ ID NO: 128685 - DNA, 20 bp, Artificial sequence
  SiRNA target sequence
ttaattggtatagtagctga

SEQ ID NO: 128686 - DNA, 20 bp, Artificial sequence
  SiRNA target sequence
taattggtatagtagctgaa

SEQ ID NO: 128687 - DNA, 20 bp, Artificial sequence
  SiRNA target sequence
aattggtatagtagctgaag

SEQ ID NO: 128688 - DNA, 20 bp, Artificial sequence
  SiRNA target sequence
attggtatagtagctgaagt

SEQ ID NO: 128689 - DNA, 20 bp, Artificial sequence
  SiRNA target sequence
ttggtatagtagctgaagta

SEQ ID NO: 128690 - DNA, 20 bp, Artificial sequence
  SiRNA target sequence
tggtatagtagctgaagtaa

SEQ ID NO: 128691 - DNA, 20 bp, Artificial sequence
  SiRNA target sequence
ggtatagtagctgaagtaat

SEQ ID NO: 128692 - DNA, 20 bp, Artificial sequence
  SiRNA target sequence
gtatagtagctgaagtaatg

SEQ ID NO: 128693 - DNA, 20 bp, Artificial sequence
  SiRNA target sequence
tatagtagctgaagtaatga

SEQ ID NO: 128694 - DNA, 20 bp, Artificial sequence
  SiRNA target sequence
atagtagctgaagtaatgaa

SEQ ID NO: 128695 - DNA, 20 bp, Artificial sequence
  SiRNA target sequence
tagtagctgaagtaatgaaa

SEQ ID NO: 128696 - DNA, 20 bp, Artificial sequence
  SiRNA target sequence
agtagctgaagtaatgaaag

SEQ ID NO: 128697 - DNA, 20 bp, Artificial sequence
  SiRNA target sequence
gtagctgaagtaatgaaaga

SEQ ID NO: 128698 - DNA, 20 bp, Artificial sequence
  SiRNA target sequence
tagctgaagtaatgaaagac

SEQ ID NO: 128699 - DNA, 20 bp, Artificial sequence
  SiRNA target sequence
agctgaagtaatgaaagact

SEQ ID NO: 128700 - DNA, 20 bp, Artificial sequence
  SiRNA target sequence
gctgaagtaatgaaagacta

SEQ ID NO: 128701 - DNA, 20 bp, Artificial sequence
  SiRNA target sequence
ctgaagtaatgaaagactat

SEQ ID NO: 128702 - DNA, 20 bp, Artificial sequence
  SiRNA target sequence
tgaagtaatgaaagactatt

SEQ ID NO: 128703 - DNA, 20 bp, Artificial sequence
  SiRNA target sequence
gaagtaatgaaagactatta

SEQ ID NO: 128704 - DNA, 20 bp, Artificial sequence
  SiRNA target sequence
aagtaatgaaagactattac

SEQ ID NO: 128705 - DNA, 20 bp, Artificial sequence
  SiRNA target sequence
agtaatgaaagactattacg

SEQ ID NO: 128706 - DNA, 20 bp, Artificial sequence
  SiRNA target sequence
gtaatgaaagactattacgg

SEQ ID NO: 128707 - DNA, 20 bp, Artificial sequence
  SiRNA target sequence
taatgaaagactattacgga

SEQ ID NO: 128708 - DNA, 20 bp, Artificial sequence
  SiRNA target sequence
aatgaaagactattacggat

SEQ ID NO: 128709 - DNA, 20 bp, Artificial sequence
  SiRNA target sequence
atgaaagactattacggatg

SEQ ID NO: 128710 - DNA, 20 bp, Artificial sequence
  SiRNA target sequence
tgaaagactattacggatgg

SEQ ID NO: 128711 - DNA, 20 bp, Artificial sequence
  SiRNA target sequence
gaaagactattacggatggg

SEQ ID NO: 128712 - DNA, 20 bp, Artificial sequence
  SiRNA target sequence
aaagactattacggatggga

SEQ ID NO: 128713 - DNA, 20 bp, Artificial sequence
  SiRNA target sequence
aagactattacggatgggat

SEQ ID NO: 128714 - DNA, 20 bp, Artificial sequence
  SiRNA target sequence
agactattacggatgggatc

SEQ ID NO: 128715 - DNA, 20 bp, Artificial sequence
  SiRNA target sequence
gactattacggatgggatca

SEQ ID NO: 128716 - DNA, 20 bp, Artificial sequence
  SiRNA target sequence
actattacggatgggatcag

SEQ ID NO: 128717 - DNA, 20 bp, Artificial sequence
  SiRNA target sequence
ctattacggatgggatcagc

SEQ ID NO: 128718 - DNA, 20 bp, Artificial sequence
  SiRNA target sequence
tattacggatgggatcagca

SEQ ID NO: 128719 - DNA, 20 bp, Artificial sequence
  SiRNA target sequence
attacggatgggatcagcaa

SEQ ID NO: 128720 - DNA, 20 bp, Artificial sequence
  SiRNA target sequence
ttacggatgggatcagcaaa

SEQ ID NO: 128721 - DNA, 20 bp, Artificial sequence
  SiRNA target sequence
tacggatgggatcagcaaag

SEQ ID NO: 128722 - DNA, 20 bp, Artificial sequence
  SiRNA target sequence
acggatgggatcagcaaaga

SEQ ID NO: 128723 - DNA, 20 bp, Artificial sequence
  SiRNA target sequence
cggatgggatcagcaaagat

SEQ ID NO: 128724 - DNA, 20 bp, Artificial sequence
  SiRNA target sequence
ggatgggatcagcaaagata

SEQ ID NO: 128725 - DNA, 20 bp, Artificial sequence
  SiRNA target sequence
gatgggatcagcaaagatat

SEQ ID NO: 128726 - DNA, 20 bp, Artificial sequence
  SiRNA target sequence
atgggatcagcaaagatata

SEQ ID NO: 128727 - DNA, 20 bp, Artificial sequence
  SiRNA target sequence
tgggatcagcaaagatataa

SEQ ID NO: 128728 - DNA, 20 bp, Artificial sequence
  SiRNA target sequence
gggatcagcaaagatataat

SEQ ID NO: 128729 - DNA, 20 bp, Artificial sequence
  SiRNA target sequence
ggatcagcaaagatataatg

SEQ ID NO: 128730 - DNA, 20 bp, Artificial sequence
  SiRNA target sequence
gatcagcaaagatataatga

SEQ ID NO: 128731 - DNA, 20 bp, Artificial sequence
  SiRNA target sequence
atcagcaaagatataatgaa

SEQ ID NO: 128732 - DNA, 20 bp, Artificial sequence
  SiRNA target sequence
tcagcaaagatataatgaag

SEQ ID NO: 128733 - DNA, 20 bp, Artificial sequence
  SiRNA target sequence
cagcaaagatataatgaaga

SEQ ID NO: 128734 - DNA, 20 bp, Artificial sequence
  SiRNA target sequence
agcaaagatataatgaagaa

SEQ ID NO: 128735 - DNA, 20 bp, Artificial sequence
  SiRNA target sequence
gcaaagatataatgaagaaa

SEQ ID NO: 128736 - DNA, 20 bp, Artificial sequence
  SiRNA target sequence
caaagatataatgaagaaac

SEQ ID NO: 128737 - DNA, 20 bp, Artificial sequence
  SiRNA target sequence
aaagatataatgaagaaaca

SEQ ID NO: 128738 - DNA, 20 bp, Artificial sequence
  SiRNA target sequence
aagatataatgaagaaacaa

SEQ ID NO: 128739 - DNA, 20 bp, Artificial sequence
  SiRNA target sequence
agatataatgaagaaacaaa

SEQ ID NO: 128740 - DNA, 20 bp, Artificial sequence
  SiRNA target sequence
gatataatgaagaaacaaaa

SEQ ID NO: 128741 - DNA, 20 bp, Artificial sequence
  SiRNA target sequence
atataatgaagaaacaaaat

SEQ ID NO: 128742 - DNA, 20 bp, Artificial sequence
  SiRNA target sequence
tataatgaagaaacaaaatt

SEQ ID NO: 128743 - DNA, 20 bp, Artificial sequence
  SiRNA target sequence
ataatgaagaaacaaaatta

SEQ ID NO: 128744 - DNA, 20 bp, Artificial sequence
  SiRNA target sequence
taatgaagaaacaaaattat

SEQ ID NO: 128745 - DNA, 20 bp, Artificial sequence
  SiRNA target sequence
aatgaagaaacaaaattatg

SEQ ID NO: 128746 - DNA, 20 bp, Artificial sequence
  SiRNA target sequence
atgaagaaacaaaattatgc

SEQ ID NO: 128747 - DNA, 20 bp, Artificial sequence
  SiRNA target sequence
tgaagaaacaaaattatgca

SEQ ID NO: 128748 - DNA, 20 bp, Artificial sequence
  SiRNA target sequence
gaagaaacaaaattatgcat

SEQ ID NO: 128749 - DNA, 20 bp, Artificial sequence
  SiRNA target sequence
aagaaacaaaattatgcatg

SEQ ID NO: 128750 - DNA, 20 bp, Artificial sequence
  SiRNA target sequence
agaaacaaaattatgcatgg

SEQ ID NO: 128751 - DNA, 20 bp, Artificial sequence
  SiRNA target sequence
gaaacaaaattatgcatgga

SEQ ID NO: 128752 - DNA, 20 bp, Artificial sequence
  SiRNA target sequence
aaacaaaattatgcatggaa

SEQ ID NO: 128753 - DNA, 20 bp, Artificial sequence
  SiRNA target sequence
aacaaaattatgcatggaaa

SEQ ID NO: 128754 - DNA, 20 bp, Artificial sequence
  SiRNA target sequence
acaaaattatgcatggaaat

SEQ ID NO: 128755 - DNA, 20 bp, Artificial sequence
  SiRNA target sequence
caaaattatgcatggaaatg

SEQ ID NO: 128756 - DNA, 20 bp, Artificial sequence
  SiRNA target sequence
aaaattatgcatggaaatga

SEQ ID NO: 128757 - DNA, 20 bp, Artificial sequence
  SiRNA target sequence
aaattatgcatggaaatgat

SEQ ID NO: 128758 - DNA, 20 bp, Artificial sequence
  SiRNA target sequence
aattatgcatggaaatgatg

SEQ ID NO: 128759 - DNA, 20 bp, Artificial sequence
  SiRNA target sequence
attatgcatggaaatgatgg

SEQ ID NO: 128760 - DNA, 20 bp, Artificial sequence
  SiRNA target sequence
ttatgcatggaaatgatgga

SEQ ID NO: 128761 - DNA, 20 bp, Artificial sequence
  SiRNA target sequence
tatgcatggaaatgatggaa

SEQ ID NO: 128762 - DNA, 20 bp, Artificial sequence
  SiRNA target sequence
atgcatggaaatgatggaaa

SEQ ID NO: 128763 - DNA, 20 bp, Artificial sequence
  SiRNA target sequence
tgcatggaaatgatggaaac

SEQ ID NO: 128764 - DNA, 20 bp, Artificial sequence
  SiRNA target sequence
gcatggaaatgatggaaact

SEQ ID NO: 128765 - DNA, 20 bp, Artificial sequence
  SiRNA target sequence
catggaaatgatggaaactt

SEQ ID NO: 128766 - DNA, 20 bp, Artificial sequence
  SiRNA target sequence
atggaaatgatggaaacttg

SEQ ID NO: 128767 - DNA, 20 bp, Artificial sequence
  SiRNA target sequence
tggaaatgatggaaacttgt

SEQ ID NO: 128768 - DNA, 20 bp, Artificial sequence
  SiRNA target sequence
ggaaatgatggaaacttgtg

SEQ ID NO: 128769 - DNA, 20 bp, Artificial sequence
  SiRNA target sequence
gaaatgatggaaacttgtgg

SEQ ID NO: 128770 - DNA, 20 bp, Artificial sequence
  SiRNA target sequence
aaatgatggaaacttgtggt

SEQ ID NO: 128771 - DNA, 20 bp, Artificial sequence
  SiRNA target sequence
aatgatggaaacttgtggtt

SEQ ID NO: 128772 - DNA, 20 bp, Artificial sequence
  SiRNA target sequence
atgatggaaacttgtggtta

SEQ ID NO: 128773 - DNA, 20 bp, Artificial sequence
  SiRNA target sequence
tgatggaaacttgtggttat

SEQ ID NO: 128774 - DNA, 20 bp, Artificial sequence
  SiRNA target sequence
gatggaaacttgtggttata

SEQ ID NO: 128775 - DNA, 20 bp, Artificial sequence
  SiRNA target sequence
atggaaacttgtggttatag

SEQ ID NO: 128776 - DNA, 20 bp, Artificial sequence
  SiRNA target sequence
tggaaacttgtggttatagt

SEQ ID NO: 128777 - DNA, 20 bp, Artificial sequence
  SiRNA target sequence
ggaaacttgtggttatagtt

SEQ ID NO: 128778 - DNA, 20 bp, Artificial sequence
  SiRNA target sequence
gaaacttgtggttatagttt

SEQ ID NO: 128779 - DNA, 20 bp, Artificial sequence
  SiRNA target sequence
aaacttgtggttatagttta

SEQ ID NO: 128780 - DNA, 20 bp, Artificial sequence
  SiRNA target sequence
aacttgtggttatagtttat

SEQ ID NO: 128781 - DNA, 20 bp, Artificial sequence
  SiRNA target sequence
acttgtggttatagtttatt

SEQ ID NO: 128782 - DNA, 20 bp, Artificial sequence
  SiRNA target sequence
cttgtggttatagtttatta

SEQ ID NO: 128783 - DNA, 20 bp, Artificial sequence
  SiRNA target sequence
ttgtggttatagtttattaa

SEQ ID NO: 128784 - DNA, 20 bp, Artificial sequence
  SiRNA target sequence
tgtggttatagtttattaaa

SEQ ID NO: 128785 - DNA, 20 bp, Artificial sequence
  SiRNA target sequence
gtggttatagtttattaaaa

SEQ ID NO: 128786 - DNA, 20 bp, Artificial sequence
  SiRNA target sequence
tggttatagtttattaaaaa

SEQ ID NO: 128787 - DNA, 20 bp, Artificial sequence
  SiRNA target sequence
ggttatagtttattaaaaaa

SEQ ID NO: 128788 - DNA, 20 bp, Artificial sequence
  SiRNA target sequence
gttatagtttattaaaaaat

SEQ ID NO: 128789 - DNA, 20 bp, Artificial sequence
  SiRNA target sequence
ttatagtttattaaaaaatt

SEQ ID NO: 128790 - DNA, 20 bp, Artificial sequence
  SiRNA target sequence
tatagtttattaaaaaatta

SEQ ID NO: 128791 - DNA, 20 bp, Artificial sequence
  SiRNA target sequence
atagtttattaaaaaattaa

SEQ ID NO: 128792 - DNA, 21 bp, Artificial sequence
  SiRNA target sequence
atggtgtataaggttttattt

SEQ ID NO: 128793 - DNA, 21 bp, Artificial sequence
  SiRNA target sequence
tggtgtataaggttttattta

SEQ ID NO: 128794 - DNA, 21 bp, Artificial sequence
  SiRNA target sequence
ggtgtataaggttttatttac

SEQ ID NO: 128795 - DNA, 21 bp, Artificial sequence
  SiRNA target sequence
gtgtataaggttttatttaca

SEQ ID NO: 128796 - DNA, 21 bp, Artificial sequence
  SiRNA target sequence
tgtataaggttttatttacag

SEQ ID NO: 128797 - DNA, 21 bp, Artificial sequence
  SiRNA target sequence
gtataaggttttatttacagt

SEQ ID NO: 128798 - DNA, 21 bp, Artificial sequence
  SiRNA target sequence
tataaggttttatttacagta

SEQ ID NO: 128799 - DNA, 21 bp, Artificial sequence
  SiRNA target sequence
ataaggttttatttacagtaa

SEQ ID NO: 128800 - DNA, 21 bp, Artificial sequence
  SiRNA target sequence
taaggttttatttacagtaat

SEQ ID NO: 128801 - DNA, 21 bp, Artificial sequence
  SiRNA target sequence
aaggttttatttacagtaata

SEQ ID NO: 128802 - DNA, 21 bp, Artificial sequence
  SiRNA target sequence
aggttttatttacagtaatag

SEQ ID NO: 128803 - DNA, 21 bp, Artificial sequence
  SiRNA target sequence
ggttttatttacagtaatagg

SEQ ID NO: 128804 - DNA, 21 bp, Artificial sequence
  SiRNA target sequence
gttttatttacagtaatagga

SEQ ID NO: 128805 - DNA, 21 bp, Artificial sequence
  SiRNA target sequence
ttttatttacagtaataggat

SEQ ID NO: 128806 - DNA, 21 bp, Artificial sequence
  SiRNA target sequence
tttatttacagtaataggatt

SEQ ID NO: 128807 - DNA, 21 bp, Artificial sequence
  SiRNA target sequence
ttatttacagtaataggatta

SEQ ID NO: 128808 - DNA, 21 bp, Artificial sequence
  SiRNA target sequence
tatttacagtaataggattaa

SEQ ID NO: 128809 - DNA, 21 bp, Artificial sequence
  SiRNA target sequence
atttacagtaataggattaat

SEQ ID NO: 128810 - DNA, 21 bp, Artificial sequence
  SiRNA target sequence
tttacagtaataggattaata

SEQ ID NO: 128811 - DNA, 21 bp, Artificial sequence
  SiRNA target sequence
ttacagtaataggattaatat

SEQ ID NO: 128812 - DNA, 21 bp, Artificial sequence
  SiRNA target sequence
tacagtaataggattaatatg

SEQ ID NO: 128813 - DNA, 21 bp, Artificial sequence
  SiRNA target sequence
acagtaataggattaatatgt

SEQ ID NO: 128814 - DNA, 21 bp, Artificial sequence
  SiRNA target sequence
cagtaataggattaatatgtg

SEQ ID NO: 128815 - DNA, 21 bp, Artificial sequence
  SiRNA target sequence
agtaataggattaatatgtgg

SEQ ID NO: 128816 - DNA, 21 bp, Artificial sequence
  SiRNA target sequence
gtaataggattaatatgtggt

SEQ ID NO: 128817 - DNA, 21 bp, Artificial sequence
  SiRNA target sequence
taataggattaatatgtggta

SEQ ID NO: 128818 - DNA, 21 bp, Artificial sequence
  SiRNA target sequence
aataggattaatatgtggtat

SEQ ID NO: 128819 - DNA, 21 bp, Artificial sequence
  SiRNA target sequence
ataggattaatatgtggtata

SEQ ID NO: 128820 - DNA, 21 bp, Artificial sequence
  SiRNA target sequence
taggattaatatgtggtatac

SEQ ID NO: 128821 - DNA, 21 bp, Artificial sequence
  SiRNA target sequence
aggattaatatgtggtatact

SEQ ID NO: 128822 - DNA, 21 bp, Artificial sequence
  SiRNA target sequence
ggattaatatgtggtatactt

SEQ ID NO: 128823 - DNA, 21 bp, Artificial sequence
  SiRNA target sequence
gattaatatgtggtatactta

SEQ ID NO: 128824 - DNA, 21 bp, Artificial sequence
  SiRNA target sequence
attaatatgtggtatacttac

SEQ ID NO: 128825 - DNA, 21 bp, Artificial sequence
  SiRNA target sequence
ttaatatgtggtatacttaca

SEQ ID NO: 128826 - DNA, 21 bp, Artificial sequence
  SiRNA target sequence
taatatgtggtatacttacaa

SEQ ID NO: 128827 - DNA, 21 bp, Artificial sequence
  SiRNA target sequence
aatatgtggtatacttacaat

SEQ ID NO: 128828 - DNA, 21 bp, Artificial sequence
  SiRNA target sequence
atatgtggtatacttacaata

SEQ ID NO: 128829 - DNA, 21 bp, Artificial sequence
  SiRNA target sequence
tatgtggtatacttacaataa

SEQ ID NO: 128830 - DNA, 21 bp, Artificial sequence
  SiRNA target sequence
atgtggtatacttacaataat

SEQ ID NO: 128831 - DNA, 21 bp, Artificial sequence
  SiRNA target sequence
tgtggtatacttacaataatt

SEQ ID NO: 128832 - DNA, 21 bp, Artificial sequence
  SiRNA target sequence
gtggtatacttacaataatta

SEQ ID NO: 128833 - DNA, 21 bp, Artificial sequence
  SiRNA target sequence
tggtatacttacaataattaa

SEQ ID NO: 128834 - DNA, 21 bp, Artificial sequence
  SiRNA target sequence
ggtatacttacaataattaaa

SEQ ID NO: 128835 - DNA, 21 bp, Artificial sequence
  SiRNA target sequence
gtatacttacaataattaaac

SEQ ID NO: 128836 - DNA, 21 bp, Artificial sequence
  SiRNA target sequence
tatacttacaataattaaacg

SEQ ID NO: 128837 - DNA, 21 bp, Artificial sequence
  SiRNA target sequence
atacttacaataattaaacga

SEQ ID NO: 128838 - DNA, 21 bp, Artificial sequence
  SiRNA target sequence
tacttacaataattaaacgat

SEQ ID NO: 128839 - DNA, 21 bp, Artificial sequence
  SiRNA target sequence
acttacaataattaaacgata

SEQ ID NO: 128840 - DNA, 21 bp, Artificial sequence
  SiRNA target sequence
cttacaataattaaacgatac

SEQ ID NO: 128841 - DNA, 21 bp, Artificial sequence
  SiRNA target sequence
ttacaataattaaacgataca

SEQ ID NO: 128842 - DNA, 21 bp, Artificial sequence
  SiRNA target sequence
tacaataattaaacgatacaa

SEQ ID NO: 128843 - DNA, 21 bp, Artificial sequence
  SiRNA target sequence
acaataattaaacgatacaag

SEQ ID NO: 128844 - DNA, 21 bp, Artificial sequence
  SiRNA target sequence
caataattaaacgatacaagt

SEQ ID NO: 128845 - DNA, 21 bp, Artificial sequence
  SiRNA target sequence
aataattaaacgatacaagta

SEQ ID NO: 128846 - DNA, 21 bp, Artificial sequence
  SiRNA target sequence
ataattaaacgatacaagtat

SEQ ID NO: 128847 - DNA, 21 bp, Artificial sequence
  SiRNA target sequence
taattaaacgatacaagtatt

SEQ ID NO: 128848 - DNA, 21 bp, Artificial sequence
  SiRNA target sequence
aattaaacgatacaagtattt

SEQ ID NO: 128849 - DNA, 21 bp, Artificial sequence
  SiRNA target sequence
attaaacgatacaagtatttt

SEQ ID NO: 128850 - DNA, 21 bp, Artificial sequence
  SiRNA target sequence
ttaaacgatacaagtatttta

SEQ ID NO: 128851 - DNA, 21 bp, Artificial sequence
  SiRNA target sequence
taaacgatacaagtattttaa

SEQ ID NO: 128852 - DNA, 21 bp, Artificial sequence
  SiRNA target sequence
aaacgatacaagtattttaag

SEQ ID NO: 128853 - DNA, 21 bp, Artificial sequence
  SiRNA target sequence
aacgatacaagtattttaaga

SEQ ID NO: 128854 - DNA, 21 bp, Artificial sequence
  SiRNA target sequence
acgatacaagtattttaagat

SEQ ID NO: 128855 - DNA, 21 bp, Artificial sequence
  SiRNA target sequence
cgatacaagtattttaagata

SEQ ID NO: 128856 - DNA, 21 bp, Artificial sequence
  SiRNA target sequence
gatacaagtattttaagataa

SEQ ID NO: 128857 - DNA, 21 bp, Artificial sequence
  SiRNA target sequence
atacaagtattttaagataaa

SEQ ID NO: 128858 - DNA, 21 bp, Artificial sequence
  SiRNA target sequence
tacaagtattttaagataaaa

SEQ ID NO: 128859 - DNA, 21 bp, Artificial sequence
  SiRNA target sequence
acaagtattttaagataaaaa

SEQ ID NO: 128860 - DNA, 21 bp, Artificial sequence
  SiRNA target sequence
caagtattttaagataaaaaa

SEQ ID NO: 128861 - DNA, 21 bp, Artificial sequence
  SiRNA target sequence
aagtattttaagataaaaaaa

SEQ ID NO: 128862 - DNA, 21 bp, Artificial sequence
  SiRNA target sequence
agtattttaagataaaaaaat

SEQ ID NO: 128863 - DNA, 21 bp, Artificial sequence
  SiRNA target sequence
gtattttaagataaaaaaatt

SEQ ID NO: 128864 - DNA, 21 bp, Artificial sequence
  SiRNA target sequence
tattttaagataaaaaaattg

SEQ ID NO: 128865 - DNA, 21 bp, Artificial sequence
  SiRNA target sequence
attttaagataaaaaaattgg

SEQ ID NO: 128866 - DNA, 21 bp, Artificial sequence
  SiRNA target sequence
ttttaagataaaaaaattggc

SEQ ID NO: 128867 - DNA, 21 bp, Artificial sequence
  SiRNA target sequence
tttaagataaaaaaattggcc

SEQ ID NO: 128868 - DNA, 21 bp, Artificial sequence
  SiRNA target sequence
ttaagataaaaaaattggcct

SEQ ID NO: 128869 - DNA, 21 bp, Artificial sequence
  SiRNA target sequence
taagataaaaaaattggcctt

SEQ ID NO: 128870 - DNA, 21 bp, Artificial sequence
  SiRNA target sequence
aagataaaaaaattggcctta

SEQ ID NO: 128871 - DNA, 21 bp, Artificial sequence
  SiRNA target sequence
agataaaaaaattggccttaa

SEQ ID NO: 128872 - DNA, 21 bp, Artificial sequence
  SiRNA target sequence
gataaaaaaattggccttaac

SEQ ID NO: 128873 - DNA, 21 bp, Artificial sequence
  SiRNA target sequence
ataaaaaaattggccttaact

SEQ ID NO: 128874 - DNA, 21 bp, Artificial sequence
  SiRNA target sequence
taaaaaaattggccttaactt

SEQ ID NO: 128875 - DNA, 21 bp, Artificial sequence
  SiRNA target sequence
aaaaaaattggccttaactta

SEQ ID NO: 128876 - DNA, 21 bp, Artificial sequence
  SiRNA target sequence
aaaaaattggccttaacttac

SEQ ID NO: 128877 - DNA, 21 bp, Artificial sequence
  SiRNA target sequence
aaaaattggccttaacttact

SEQ ID NO: 128878 - DNA, 21 bp, Artificial sequence
  SiRNA target sequence
aaaattggccttaacttactt

SEQ ID NO: 128879 - DNA, 21 bp, Artificial sequence
  SiRNA target sequence
aaattggccttaacttacttc

SEQ ID NO: 128880 - DNA, 21 bp, Artificial sequence
  SiRNA target sequence
aattggccttaacttacttcg

SEQ ID NO: 128881 - DNA, 21 bp, Artificial sequence
  SiRNA target sequence
attggccttaacttacttcgg

SEQ ID NO: 128882 - DNA, 21 bp, Artificial sequence
  SiRNA target sequence
ttggccttaacttacttcggg

SEQ ID NO: 128883 - DNA, 21 bp, Artificial sequence
  SiRNA target sequence
tggccttaacttacttcggga

SEQ ID NO: 128884 - DNA, 21 bp, Artificial sequence
  SiRNA target sequence
ggccttaacttacttcgggaa

SEQ ID NO: 128885 - DNA, 21 bp, Artificial sequence
  SiRNA target sequence
gccttaacttacttcgggaaa

SEQ ID NO: 128886 - DNA, 21 bp, Artificial sequence
  SiRNA target sequence
ccttaacttacttcgggaaac

SEQ ID NO: 128887 - DNA, 21 bp, Artificial sequence
  SiRNA target sequence
cttaacttacttcgggaaaca

SEQ ID NO: 128888 - DNA, 21 bp, Artificial sequence
  SiRNA target sequence
ttaacttacttcgggaaacaa

SEQ ID NO: 128889 - DNA, 21 bp, Artificial sequence
  SiRNA target sequence
taacttacttcgggaaacaag

SEQ ID NO: 128890 - DNA, 21 bp, Artificial sequence
  SiRNA target sequence
aacttacttcgggaaacaaga

SEQ ID NO: 128891 - DNA, 21 bp, Artificial sequence
  SiRNA target sequence
acttacttcgggaaacaagac

SEQ ID NO: 128892 - DNA, 21 bp, Artificial sequence
  SiRNA target sequence
cttacttcgggaaacaagact

SEQ ID NO: 128893 - DNA, 21 bp, Artificial sequence
  SiRNA target sequence
ttacttcgggaaacaagactt

SEQ ID NO: 128894 - DNA, 21 bp, Artificial sequence
  SiRNA target sequence
tacttcgggaaacaagacttg

SEQ ID NO: 128895 - DNA, 21 bp, Artificial sequence
  SiRNA target sequence
acttcgggaaacaagacttgc

SEQ ID NO: 128896 - DNA, 21 bp, Artificial sequence
  SiRNA target sequence
cttcgggaaacaagacttgca

SEQ ID NO: 128897 - DNA, 21 bp, Artificial sequence
  SiRNA target sequence
ttcgggaaacaagacttgcaa

SEQ ID NO: 128898 - DNA, 21 bp, Artificial sequence
  SiRNA target sequence
tcgggaaacaagacttgcaat

SEQ ID NO: 128899 - DNA, 21 bp, Artificial sequence
  SiRNA target sequence
cgggaaacaagacttgcaatg

SEQ ID NO: 128900 - DNA, 21 bp, Artificial sequence
  SiRNA target sequence
gggaaacaagacttgcaatgg

SEQ ID NO: 128901 - DNA, 21 bp, Artificial sequence
  SiRNA target sequence
ggaaacaagacttgcaatgga

SEQ ID NO: 128902 - DNA, 21 bp, Artificial sequence
  SiRNA target sequence
gaaacaagacttgcaatggaa

SEQ ID NO: 128903 - DNA, 21 bp, Artificial sequence
  SiRNA target sequence
aaacaagacttgcaatggaaa

SEQ ID NO: 128904 - DNA, 21 bp, Artificial sequence
  SiRNA target sequence
aacaagacttgcaatggaaac

SEQ ID NO: 128905 - DNA, 21 bp, Artificial sequence
  SiRNA target sequence
acaagacttgcaatggaaacc

SEQ ID NO: 128906 - DNA, 21 bp, Artificial sequence
  SiRNA target sequence
caagacttgcaatggaaacct

SEQ ID NO: 128907 - DNA, 21 bp, Artificial sequence
  SiRNA target sequence
aagacttgcaatggaaaccta

SEQ ID NO: 128908 - DNA, 21 bp, Artificial sequence
  SiRNA target sequence
agacttgcaatggaaacctaa

SEQ ID NO: 128909 - DNA, 21 bp, Artificial sequence
  SiRNA target sequence
gacttgcaatggaaacctaaa

SEQ ID NO: 128910 - DNA, 21 bp, Artificial sequence
  SiRNA target sequence
acttgcaatggaaacctaaaa

SEQ ID NO: 128911 - DNA, 21 bp, Artificial sequence
  SiRNA target sequence
cttgcaatggaaacctaaaag

SEQ ID NO: 128912 - DNA, 21 bp, Artificial sequence
  SiRNA target sequence
ttgcaatggaaacctaaaagt

SEQ ID NO: 128913 - DNA, 21 bp, Artificial sequence
  SiRNA target sequence
tgcaatggaaacctaaaagtc

SEQ ID NO: 128914 - DNA, 21 bp, Artificial sequence
  SiRNA target sequence
gcaatggaaacctaaaagtcg

SEQ ID NO: 128915 - DNA, 21 bp, Artificial sequence
  SiRNA target sequence
caatggaaacctaaaagtcgg

SEQ ID NO: 128916 - DNA, 21 bp, Artificial sequence
  SiRNA target sequence
aatggaaacctaaaagtcggt

SEQ ID NO: 128917 - DNA, 21 bp, Artificial sequence
  SiRNA target sequence
atggaaacctaaaagtcggtc

SEQ ID NO: 128918 - DNA, 21 bp, Artificial sequence
  SiRNA target sequence
tggaaacctaaaagtcggtca

SEQ ID NO: 128919 - DNA, 21 bp, Artificial sequence
  SiRNA target sequence
ggaaacctaaaagtcggtcag

SEQ ID NO: 128920 - DNA, 21 bp, Artificial sequence
  SiRNA target sequence
gaaacctaaaagtcggtcaga

SEQ ID NO: 128921 - DNA, 21 bp, Artificial sequence
  SiRNA target sequence
aaacctaaaagtcggtcagaa

SEQ ID NO: 128922 - DNA, 21 bp, Artificial sequence
  SiRNA target sequence
aacctaaaagtcggtcagaaa

SEQ ID NO: 128923 - DNA, 21 bp, Artificial sequence
  SiRNA target sequence
acctaaaagtcggtcagaaat

SEQ ID NO: 128924 - DNA, 21 bp, Artificial sequence
  SiRNA target sequence
cctaaaagtcggtcagaaatt

SEQ ID NO: 128925 - DNA, 21 bp, Artificial sequence
  SiRNA target sequence
ctaaaagtcggtcagaaatta

SEQ ID NO: 128926 - DNA, 21 bp, Artificial sequence
  SiRNA target sequence
taaaagtcggtcagaaattat

SEQ ID NO: 128927 - DNA, 21 bp, Artificial sequence
  SiRNA target sequence
aaaagtcggtcagaaattatt

SEQ ID NO: 128928 - DNA, 21 bp, Artificial sequence
  SiRNA target sequence
aaagtcggtcagaaattatta

SEQ ID NO: 128929 - DNA, 21 bp, Artificial sequence
  SiRNA target sequence
aagtcggtcagaaattattaa

SEQ ID NO: 128930 - DNA, 21 bp, Artificial sequence
  SiRNA target sequence
agtcggtcagaaattattaac

SEQ ID NO: 128931 - DNA, 21 bp, Artificial sequence
  SiRNA target sequence
gtcggtcagaaattattaacg

SEQ ID NO: 128932 - DNA, 21 bp, Artificial sequence
  SiRNA target sequence
tcggtcagaaattattaacga

SEQ ID NO: 128933 - DNA, 21 bp, Artificial sequence
  SiRNA target sequence
cggtcagaaattattaacgat

SEQ ID NO: 128934 - DNA, 21 bp, Artificial sequence
  SiRNA target sequence
ggtcagaaattattaacgatt

SEQ ID NO: 128935 - DNA, 21 bp, Artificial sequence
  SiRNA target sequence
gtcagaaattattaacgattt

SEQ ID NO: 128936 - DNA, 21 bp, Artificial sequence
  SiRNA target sequence
tcagaaattattaacgattta

SEQ ID NO: 128937 - DNA, 21 bp, Artificial sequence
  SiRNA target sequence
cagaaattattaacgatttaa

SEQ ID NO: 128938 - DNA, 21 bp, Artificial sequence
  SiRNA target sequence
agaaattattaacgatttaaa

SEQ ID NO: 128939 - DNA, 21 bp, Artificial sequence
  SiRNA target sequence
gaaattattaacgatttaaaa

SEQ ID NO: 128940 - DNA, 21 bp, Artificial sequence
  SiRNA target sequence
aaattattaacgatttaaaaa

SEQ ID NO: 128941 - DNA, 21 bp, Artificial sequence
  SiRNA target sequence
aattattaacgatttaaaaaa

SEQ ID NO: 128942 - DNA, 21 bp, Artificial sequence
  SiRNA target sequence
attattaacgatttaaaaaat

SEQ ID NO: 128943 - DNA, 21 bp, Artificial sequence
  SiRNA target sequence
ttattaacgatttaaaaaata

SEQ ID NO: 128944 - DNA, 21 bp, Artificial sequence
  SiRNA target sequence
tattaacgatttaaaaaatac

SEQ ID NO: 128945 - DNA, 21 bp, Artificial sequence
  SiRNA target sequence
attaacgatttaaaaaataca

SEQ ID NO: 128946 - DNA, 21 bp, Artificial sequence
  SiRNA target sequence
ttaacgatttaaaaaatacaa

SEQ ID NO: 128947 - DNA, 21 bp, Artificial sequence
  SiRNA target sequence
taacgatttaaaaaatacaaa

SEQ ID NO: 128948 - DNA, 21 bp, Artificial sequence
  SiRNA target sequence
aacgatttaaaaaatacaaac

SEQ ID NO: 128949 - DNA, 21 bp, Artificial sequence
  SiRNA target sequence
acgatttaaaaaatacaaact

SEQ ID NO: 128950 - DNA, 21 bp, Artificial sequence
  SiRNA target sequence
cgatttaaaaaatacaaactt

SEQ ID NO: 128951 - DNA, 21 bp, Artificial sequence
  SiRNA target sequence
gatttaaaaaatacaaacttt

SEQ ID NO: 128952 - DNA, 21 bp, Artificial sequence
  SiRNA target sequence
atttaaaaaatacaaactttg

SEQ ID NO: 128953 - DNA, 21 bp, Artificial sequence
  SiRNA target sequence
tttaaaaaatacaaactttga

SEQ ID NO: 128954 - DNA, 21 bp, Artificial sequence
  SiRNA target sequence
ttaaaaaatacaaactttgac

SEQ ID NO: 128955 - DNA, 21 bp, Artificial sequence
  SiRNA target sequence
taaaaaatacaaactttgaca

SEQ ID NO: 128956 - DNA, 21 bp, Artificial sequence
  SiRNA target sequence
aaaaaatacaaactttgacat

SEQ ID NO: 128957 - DNA, 21 bp, Artificial sequence
  SiRNA target sequence
aaaaatacaaactttgacata

SEQ ID NO: 128958 - DNA, 21 bp, Artificial sequence
  SiRNA target sequence
aaaatacaaactttgacatat

SEQ ID NO: 128959 - DNA, 21 bp, Artificial sequence
  SiRNA target sequence
aaatacaaactttgacatatt

SEQ ID NO: 128960 - DNA, 21 bp, Artificial sequence
  SiRNA target sequence
aatacaaactttgacatattg

SEQ ID NO: 128961 - DNA, 21 bp, Artificial sequence
  SiRNA target sequence
atacaaactttgacatattga

SEQ ID NO: 128962 - DNA, 21 bp, Artificial sequence
  SiRNA target sequence
tacaaactttgacatattgat

SEQ ID NO: 128963 - DNA, 21 bp, Artificial sequence
  SiRNA target sequence
acaaactttgacatattgatt

SEQ ID NO: 128964 - DNA, 21 bp, Artificial sequence
  SiRNA target sequence
caaactttgacatattgatta

SEQ ID NO: 128965 - DNA, 21 bp, Artificial sequence
  SiRNA target sequence
aaactttgacatattgattat

SEQ ID NO: 128966 - DNA, 21 bp, Artificial sequence
  SiRNA target sequence
aactttgacatattgattatt

SEQ ID NO: 128967 - DNA, 21 bp, Artificial sequence
  SiRNA target sequence
actttgacatattgattattg

SEQ ID NO: 128968 - DNA, 21 bp, Artificial sequence
  SiRNA target sequence
ctttgacatattgattattgg

SEQ ID NO: 128969 - DNA, 21 bp, Artificial sequence
  SiRNA target sequence
tttgacatattgattattggt

SEQ ID NO: 128970 - DNA, 21 bp, Artificial sequence
  SiRNA target sequence
ttgacatattgattattggtg

SEQ ID NO: 128971 - DNA, 21 bp, Artificial sequence
  SiRNA target sequence
tgacatattgattattggtgg

SEQ ID NO: 128972 - DNA, 21 bp, Artificial sequence
  SiRNA target sequence
gacatattgattattggtggc

SEQ ID NO: 128973 - DNA, 21 bp, Artificial sequence
  SiRNA target sequence
acatattgattattggtggcg

SEQ ID NO: 128974 - DNA, 21 bp, Artificial sequence
  SiRNA target sequence
catattgattattggtggcgg

SEQ ID NO: 128975 - DNA, 21 bp, Artificial sequence
  SiRNA target sequence
atattgattattggtggcggt

SEQ ID NO: 128976 - DNA, 21 bp, Artificial sequence
  SiRNA target sequence
tattgattattggtggcggtt

SEQ ID NO: 128977 - DNA, 21 bp, Artificial sequence
  SiRNA target sequence
attgattattggtggcggttc

SEQ ID NO: 128978 - DNA, 21 bp, Artificial sequence
  SiRNA target sequence
ttgattattggtggcggttca

SEQ ID NO: 128979 - DNA, 21 bp, Artificial sequence
  SiRNA target sequence
tgattattggtggcggttcaa

SEQ ID NO: 128980 - DNA, 21 bp, Artificial sequence
  SiRNA target sequence
gattattggtggcggttcaac

SEQ ID NO: 128981 - DNA, 21 bp, Artificial sequence
  SiRNA target sequence
attattggtggcggttcaacg

SEQ ID NO: 128982 - DNA, 21 bp, Artificial sequence
  SiRNA target sequence
ttattggtggcggttcaacgg

SEQ ID NO: 128983 - DNA, 21 bp, Artificial sequence
  SiRNA target sequence
tattggtggcggttcaacggg

SEQ ID NO: 128984 - DNA, 21 bp, Artificial sequence
  SiRNA target sequence
attggtggcggttcaacggga

SEQ ID NO: 128985 - DNA, 21 bp, Artificial sequence
  SiRNA target sequence
ttggtggcggttcaacgggaa

SEQ ID NO: 128986 - DNA, 21 bp, Artificial sequence
  SiRNA target sequence
tggtggcggttcaacgggaat

SEQ ID NO: 128987 - DNA, 21 bp, Artificial sequence
  SiRNA target sequence
ggtggcggttcaacgggaatg

SEQ ID NO: 128988 - DNA, 21 bp, Artificial sequence
  SiRNA target sequence
gtggcggttcaacgggaatgg

SEQ ID NO: 128989 - DNA, 21 bp, Artificial sequence
  SiRNA target sequence
tggcggttcaacgggaatggg

SEQ ID NO: 128990 - DNA, 21 bp, Artificial sequence
  SiRNA target sequence
ggcggttcaacgggaatggga

SEQ ID NO: 128991 - DNA, 21 bp, Artificial sequence
  SiRNA target sequence
gcggttcaacgggaatgggat

SEQ ID NO: 128992 - DNA, 21 bp, Artificial sequence
  SiRNA target sequence
cggttcaacgggaatgggatg

SEQ ID NO: 128993 - DNA, 21 bp, Artificial sequence
  SiRNA target sequence
ggttcaacgggaatgggatgt

SEQ ID NO: 128994 - DNA, 21 bp, Artificial sequence
  SiRNA target sequence
gttcaacgggaatgggatgtg

SEQ ID NO: 128995 - DNA, 21 bp, Artificial sequence
  SiRNA target sequence
ttcaacgggaatgggatgtgc

SEQ ID NO: 128996 - DNA, 21 bp, Artificial sequence
  SiRNA target sequence
tcaacgggaatgggatgtgca

SEQ ID NO: 128997 - DNA, 21 bp, Artificial sequence
  SiRNA target sequence
caacgggaatgggatgtgcaa

SEQ ID NO: 128998 - DNA, 21 bp, Artificial sequence
  SiRNA target sequence
aacgggaatgggatgtgcaat

SEQ ID NO: 128999 - DNA, 21 bp, Artificial sequence
  SiRNA target sequence
acgggaatgggatgtgcaatc

SEQ ID NO: 129000 - DNA, 21 bp, Artificial sequence
  SiRNA target sequence
cgggaatgggatgtgcaatcg

SEQ ID NO: 129001 - DNA, 21 bp, Artificial sequence
  SiRNA target sequence
gggaatgggatgtgcaatcga

SEQ ID NO: 129002 - DNA, 21 bp, Artificial sequence
  SiRNA target sequence
ggaatgggatgtgcaatcgaa

SEQ ID NO: 129003 - DNA, 21 bp, Artificial sequence
  SiRNA target sequence
gaatgggatgtgcaatcgaag

SEQ ID NO: 129004 - DNA, 21 bp, Artificial sequence
  SiRNA target sequence
aatgggatgtgcaatcgaagc

SEQ ID NO: 129005 - DNA, 21 bp, Artificial sequence
  SiRNA target sequence
atgggatgtgcaatcgaagca

SEQ ID NO: 129006 - DNA, 21 bp, Artificial sequence
  SiRNA target sequence
tgggatgtgcaatcgaagcag

SEQ ID NO: 129007 - DNA, 21 bp, Artificial sequence
  SiRNA target sequence
gggatgtgcaatcgaagcagc

SEQ ID NO: 129008 - DNA, 21 bp, Artificial sequence
  SiRNA target sequence
ggatgtgcaatcgaagcagct

SEQ ID NO: 129009 - DNA, 21 bp, Artificial sequence
  SiRNA target sequence
gatgtgcaatcgaagcagcta

SEQ ID NO: 129010 - DNA, 21 bp, Artificial sequence
  SiRNA target sequence
atgtgcaatcgaagcagctac

SEQ ID NO: 129011 - DNA, 21 bp, Artificial sequence
  SiRNA target sequence
tgtgcaatcgaagcagctaca

SEQ ID NO: 129012 - DNA, 21 bp, Artificial sequence
  SiRNA target sequence
gtgcaatcgaagcagctacac

SEQ ID NO: 129013 - DNA, 21 bp, Artificial sequence
  SiRNA target sequence
tgcaatcgaagcagctacacg

SEQ ID NO: 129014 - DNA, 21 bp, Artificial sequence
  SiRNA target sequence
gcaatcgaagcagctacacga

SEQ ID NO: 129015 - DNA, 21 bp, Artificial sequence
  SiRNA target sequence
caatcgaagcagctacacgag

SEQ ID NO: 129016 - DNA, 21 bp, Artificial sequence
  SiRNA target sequence
aatcgaagcagctacacgagg

SEQ ID NO: 129017 - DNA, 21 bp, Artificial sequence
  SiRNA target sequence
atcgaagcagctacacgaggt

SEQ ID NO: 129018 - DNA, 21 bp, Artificial sequence
  SiRNA target sequence
tcgaagcagctacacgaggta

SEQ ID NO: 129019 - DNA, 21 bp, Artificial sequence
  SiRNA target sequence
cgaagcagctacacgaggtat

SEQ ID NO: 129020 - DNA, 21 bp, Artificial sequence
  SiRNA target sequence
gaagcagctacacgaggtata

SEQ ID NO: 129021 - DNA, 21 bp, Artificial sequence
  SiRNA target sequence
aagcagctacacgaggtataa

SEQ ID NO: 129022 - DNA, 21 bp, Artificial sequence
  SiRNA target sequence
agcagctacacgaggtataag

SEQ ID NO: 129023 - DNA, 21 bp, Artificial sequence
  SiRNA target sequence
gcagctacacgaggtataagt

SEQ ID NO: 129024 - DNA, 21 bp, Artificial sequence
  SiRNA target sequence
cagctacacgaggtataagtg

SEQ ID NO: 129025 - DNA, 21 bp, Artificial sequence
  SiRNA target sequence
agctacacgaggtataagtgt

SEQ ID NO: 129026 - DNA, 21 bp, Artificial sequence
  SiRNA target sequence
gctacacgaggtataagtgtt

SEQ ID NO: 129027 - DNA, 21 bp, Artificial sequence
  SiRNA target sequence
ctacacgaggtataagtgttg

SEQ ID NO: 129028 - DNA, 21 bp, Artificial sequence
  SiRNA target sequence
tacacgaggtataagtgttgg

SEQ ID NO: 129029 - DNA, 21 bp, Artificial sequence
  SiRNA target sequence
acacgaggtataagtgttggc

SEQ ID NO: 129030 - DNA, 21 bp, Artificial sequence
  SiRNA target sequence
cacgaggtataagtgttggcc

SEQ ID NO: 129031 - DNA, 21 bp, Artificial sequence
  SiRNA target sequence
acgaggtataagtgttggcct

SEQ ID NO: 129032 - DNA, 21 bp, Artificial sequence
  SiRNA target sequence
cgaggtataagtgttggcctg

SEQ ID NO: 129033 - DNA, 21 bp, Artificial sequence
  SiRNA target sequence
gaggtataagtgttggcctga

SEQ ID NO: 129034 - DNA, 21 bp, Artificial sequence
  SiRNA target sequence
aggtataagtgttggcctgat

SEQ ID NO: 129035 - DNA, 21 bp, Artificial sequence
  SiRNA target sequence
ggtataagtgttggcctgata

SEQ ID NO: 129036 - DNA, 21 bp, Artificial sequence
  SiRNA target sequence
gtataagtgttggcctgatag

SEQ ID NO: 129037 - DNA, 21 bp, Artificial sequence
  SiRNA target sequence
tataagtgttggcctgataga

SEQ ID NO: 129038 - DNA, 21 bp, Artificial sequence
  SiRNA target sequence
ataagtgttggcctgatagaa

SEQ ID NO: 129039 - DNA, 21 bp, Artificial sequence
  SiRNA target sequence
taagtgttggcctgatagaag

SEQ ID NO: 129040 - DNA, 21 bp, Artificial sequence
  SiRNA target sequence
aagtgttggcctgatagaagc

SEQ ID NO: 129041 - DNA, 21 bp, Artificial sequence
  SiRNA target sequence
agtgttggcctgatagaagca

SEQ ID NO: 129042 - DNA, 21 bp, Artificial sequence
  SiRNA target sequence
gtgttggcctgatagaagcac

SEQ ID NO: 129043 - DNA, 21 bp, Artificial sequence
  SiRNA target sequence
tgttggcctgatagaagcaca

SEQ ID NO: 129044 - DNA, 21 bp, Artificial sequence
  SiRNA target sequence
gttggcctgatagaagcacat

SEQ ID NO: 129045 - DNA, 21 bp, Artificial sequence
  SiRNA target sequence
ttggcctgatagaagcacatg

SEQ ID NO: 129046 - DNA, 21 bp, Artificial sequence
  SiRNA target sequence
tggcctgatagaagcacatga

SEQ ID NO: 129047 - DNA, 21 bp, Artificial sequence
  SiRNA target sequence
ggcctgatagaagcacatgat

SEQ ID NO: 129048 - DNA, 21 bp, Artificial sequence
  SiRNA target sequence
gcctgatagaagcacatgatt

SEQ ID NO: 129049 - DNA, 21 bp, Artificial sequence
  SiRNA target sequence
cctgatagaagcacatgattt

SEQ ID NO: 129050 - DNA, 21 bp, Artificial sequence
  SiRNA target sequence
ctgatagaagcacatgatttt

SEQ ID NO: 129051 - DNA, 21 bp, Artificial sequence
  SiRNA target sequence
tgatagaagcacatgattttg

SEQ ID NO: 129052 - DNA, 21 bp, Artificial sequence
  SiRNA target sequence
gatagaagcacatgattttgg

SEQ ID NO: 129053 - DNA, 21 bp, Artificial sequence
  SiRNA target sequence
atagaagcacatgattttggt

SEQ ID NO: 129054 - DNA, 21 bp, Artificial sequence
  SiRNA target sequence
tagaagcacatgattttggtt

SEQ ID NO: 129055 - DNA, 21 bp, Artificial sequence
  SiRNA target sequence
agaagcacatgattttggttc

SEQ ID NO: 129056 - DNA, 21 bp, Artificial sequence
  SiRNA target sequence
gaagcacatgattttggttcg

SEQ ID NO: 129057 - DNA, 21 bp, Artificial sequence
  SiRNA target sequence
aagcacatgattttggttcgg

SEQ ID NO: 129058 - DNA, 21 bp, Artificial sequence
  SiRNA target sequence
agcacatgattttggttcggg

SEQ ID NO: 129059 - DNA, 21 bp, Artificial sequence
  SiRNA target sequence
gcacatgattttggttcgggc

SEQ ID NO: 129060 - DNA, 21 bp, Artificial sequence
  SiRNA target sequence
cacatgattttggttcgggca

SEQ ID NO: 129061 - DNA, 21 bp, Artificial sequence
  SiRNA target sequence
acatgattttggttcgggcac

SEQ ID NO: 129062 - DNA, 21 bp, Artificial sequence
  SiRNA target sequence
catgattttggttcgggcacg

SEQ ID NO: 129063 - DNA, 21 bp, Artificial sequence
  SiRNA target sequence
atgattttggttcgggcacga

SEQ ID NO: 129064 - DNA, 21 bp, Artificial sequence
  SiRNA target sequence
tgattttggttcgggcacgag

SEQ ID NO: 129065 - DNA, 21 bp, Artificial sequence
  SiRNA target sequence
gattttggttcgggcacgagt

SEQ ID NO: 129066 - DNA, 21 bp, Artificial sequence
  SiRNA target sequence
attttggttcgggcacgagtt

SEQ ID NO: 129067 - DNA, 21 bp, Artificial sequence
  SiRNA target sequence
ttttggttcgggcacgagttc

SEQ ID NO: 129068 - DNA, 21 bp, Artificial sequence
  SiRNA target sequence
tttggttcgggcacgagttca

SEQ ID NO: 129069 - DNA, 21 bp, Artificial sequence
  SiRNA target sequence
ttggttcgggcacgagttcaa

SEQ ID NO: 129070 - DNA, 21 bp, Artificial sequence
  SiRNA target sequence
tggttcgggcacgagttcaaa

SEQ ID NO: 129071 - DNA, 21 bp, Artificial sequence
  SiRNA target sequence
ggttcgggcacgagttcaaaa

SEQ ID NO: 129072 - DNA, 21 bp, Artificial sequence
  SiRNA target sequence
gttcgggcacgagttcaaaat

SEQ ID NO: 129073 - DNA, 21 bp, Artificial sequence
  SiRNA target sequence
ttcgggcacgagttcaaaatc

SEQ ID NO: 129074 - DNA, 21 bp, Artificial sequence
  SiRNA target sequence
tcgggcacgagttcaaaatct

SEQ ID NO: 129075 - DNA, 21 bp, Artificial sequence
  SiRNA target sequence
cgggcacgagttcaaaatcta

SEQ ID NO: 129076 - DNA, 21 bp, Artificial sequence
  SiRNA target sequence
gggcacgagttcaaaatctac

SEQ ID NO: 129077 - DNA, 21 bp, Artificial sequence
  SiRNA target sequence
ggcacgagttcaaaatctaca

SEQ ID NO: 129078 - DNA, 21 bp, Artificial sequence
  SiRNA target sequence
gcacgagttcaaaatctacaa

SEQ ID NO: 129079 - DNA, 21 bp, Artificial sequence
  SiRNA target sequence
cacgagttcaaaatctacaaa

SEQ ID NO: 129080 - DNA, 21 bp, Artificial sequence
  SiRNA target sequence
acgagttcaaaatctacaaaa

SEQ ID NO: 129081 - DNA, 21 bp, Artificial sequence
  SiRNA target sequence
cgagttcaaaatctacaaaac

SEQ ID NO: 129082 - DNA, 21 bp, Artificial sequence
  SiRNA target sequence
gagttcaaaatctacaaaact

SEQ ID NO: 129083 - DNA, 21 bp, Artificial sequence
  SiRNA target sequence
agttcaaaatctacaaaactt

SEQ ID NO: 129084 - DNA, 21 bp, Artificial sequence
  SiRNA target sequence
gttcaaaatctacaaaacttt

SEQ ID NO: 129085 - DNA, 21 bp, Artificial sequence
  SiRNA target sequence
ttcaaaatctacaaaactttt

SEQ ID NO: 129086 - DNA, 21 bp, Artificial sequence
  SiRNA target sequence
tcaaaatctacaaaacttttt

SEQ ID NO: 129087 - DNA, 21 bp, Artificial sequence
  SiRNA target sequence
caaaatctacaaaactttttc

SEQ ID NO: 129088 - DNA, 21 bp, Artificial sequence
  SiRNA target sequence
aaaatctacaaaactttttca

SEQ ID NO: 129089 - DNA, 21 bp, Artificial sequence
  SiRNA target sequence
aaatctacaaaactttttcat

SEQ ID NO: 129090 - DNA, 21 bp, Artificial sequence
  SiRNA target sequence
aatctacaaaactttttcatg

SEQ ID NO: 129091 - DNA, 21 bp, Artificial sequence
  SiRNA target sequence
atctacaaaactttttcatgg

SEQ ID NO: 129092 - DNA, 21 bp, Artificial sequence
  SiRNA target sequence
tctacaaaactttttcatggc

SEQ ID NO: 129093 - DNA, 21 bp, Artificial sequence
  SiRNA target sequence
ctacaaaactttttcatggcg

SEQ ID NO: 129094 - DNA, 21 bp, Artificial sequence
  SiRNA target sequence
tacaaaactttttcatggcgg

SEQ ID NO: 129095 - DNA, 21 bp, Artificial sequence
  SiRNA target sequence
acaaaactttttcatggcggt

SEQ ID NO: 129096 - DNA, 21 bp, Artificial sequence
  SiRNA target sequence
caaaactttttcatggcggtg

SEQ ID NO: 129097 - DNA, 21 bp, Artificial sequence
  SiRNA target sequence
aaaactttttcatggcggtgt

SEQ ID NO: 129098 - DNA, 21 bp, Artificial sequence
  SiRNA target sequence
aaactttttcatggcggtgta

SEQ ID NO: 129099 - DNA, 21 bp, Artificial sequence
  SiRNA target sequence
aactttttcatggcggtgtac

SEQ ID NO: 129100 - DNA, 21 bp, Artificial sequence
  SiRNA target sequence
actttttcatggcggtgtacg

SEQ ID NO: 129101 - DNA, 21 bp, Artificial sequence
  SiRNA target sequence
ctttttcatggcggtgtacgc

SEQ ID NO: 129102 - DNA, 21 bp, Artificial sequence
  SiRNA target sequence
tttttcatggcggtgtacgct

SEQ ID NO: 129103 - DNA, 21 bp, Artificial sequence
  SiRNA target sequence
ttttcatggcggtgtacgcta

SEQ ID NO: 129104 - DNA, 21 bp, Artificial sequence
  SiRNA target sequence
tttcatggcggtgtacgctac

SEQ ID NO: 129105 - DNA, 21 bp, Artificial sequence
  SiRNA target sequence
ttcatggcggtgtacgctacc

SEQ ID NO: 129106 - DNA, 21 bp, Artificial sequence
  SiRNA target sequence
tcatggcggtgtacgctacct

SEQ ID NO: 129107 - DNA, 21 bp, Artificial sequence
  SiRNA target sequence
catggcggtgtacgctacctt

SEQ ID NO: 129108 - DNA, 21 bp, Artificial sequence
  SiRNA target sequence
atggcggtgtacgctaccttg

SEQ ID NO: 129109 - DNA, 21 bp, Artificial sequence
  SiRNA target sequence
tggcggtgtacgctaccttga

SEQ ID NO: 129110 - DNA, 21 bp, Artificial sequence
  SiRNA target sequence
ggcggtgtacgctaccttgaa

SEQ ID NO: 129111 - DNA, 21 bp, Artificial sequence
  SiRNA target sequence
gcggtgtacgctaccttgaaa

SEQ ID NO: 129112 - DNA, 21 bp, Artificial sequence
  SiRNA target sequence
cggtgtacgctaccttgaaaa

SEQ ID NO: 129113 - DNA, 21 bp, Artificial sequence
  SiRNA target sequence
ggtgtacgctaccttgaaaaa

SEQ ID NO: 129114 - DNA, 21 bp, Artificial sequence
  SiRNA target sequence
gtgtacgctaccttgaaaaag

SEQ ID NO: 129115 - DNA, 21 bp, Artificial sequence
  SiRNA target sequence
tgtacgctaccttgaaaaagc

SEQ ID NO: 129116 - DNA, 21 bp, Artificial sequence
  SiRNA target sequence
gtacgctaccttgaaaaagct

SEQ ID NO: 129117 - DNA, 21 bp, Artificial sequence
  SiRNA target sequence
tacgctaccttgaaaaagctg

SEQ ID NO: 129118 - DNA, 21 bp, Artificial sequence
  SiRNA target sequence
acgctaccttgaaaaagctgt

SEQ ID NO: 129119 - DNA, 21 bp, Artificial sequence
  SiRNA target sequence
cgctaccttgaaaaagctgtt

SEQ ID NO: 129120 - DNA, 21 bp, Artificial sequence
  SiRNA target sequence
gctaccttgaaaaagctgtta

SEQ ID NO: 129121 - DNA, 21 bp, Artificial sequence
  SiRNA target sequence
ctaccttgaaaaagctgttaa

SEQ ID NO: 129122 - DNA, 21 bp, Artificial sequence
  SiRNA target sequence
taccttgaaaaagctgttaat

SEQ ID NO: 129123 - DNA, 21 bp, Artificial sequence
  SiRNA target sequence
accttgaaaaagctgttaatg

SEQ ID NO: 129124 - DNA, 21 bp, Artificial sequence
  SiRNA target sequence
ccttgaaaaagctgttaatga

SEQ ID NO: 129125 - DNA, 21 bp, Artificial sequence
  SiRNA target sequence
cttgaaaaagctgttaatgat

SEQ ID NO: 129126 - DNA, 21 bp, Artificial sequence
  SiRNA target sequence
ttgaaaaagctgttaatgatt

SEQ ID NO: 129127 - DNA, 21 bp, Artificial sequence
  SiRNA target sequence
tgaaaaagctgttaatgattt

SEQ ID NO: 129128 - DNA, 21 bp, Artificial sequence
  SiRNA target sequence
gaaaaagctgttaatgattta

SEQ ID NO: 129129 - DNA, 21 bp, Artificial sequence
  SiRNA target sequence
aaaaagctgttaatgatttag

SEQ ID NO: 129130 - DNA, 21 bp, Artificial sequence
  SiRNA target sequence
aaaagctgttaatgatttaga

SEQ ID NO: 129131 - DNA, 21 bp, Artificial sequence
  SiRNA target sequence
aaagctgttaatgatttagat

SEQ ID NO: 129132 - DNA, 21 bp, Artificial sequence
  SiRNA target sequence
aagctgttaatgatttagata

SEQ ID NO: 129133 - DNA, 21 bp, Artificial sequence
  SiRNA target sequence
agctgttaatgatttagatag

SEQ ID NO: 129134 - DNA, 21 bp, Artificial sequence
  SiRNA target sequence
gctgttaatgatttagataga

SEQ ID NO: 129135 - DNA, 21 bp, Artificial sequence
  SiRNA target sequence
ctgttaatgatttagatagat

SEQ ID NO: 129136 - DNA, 21 bp, Artificial sequence
  SiRNA target sequence
tgttaatgatttagatagatc

SEQ ID NO: 129137 - DNA, 21 bp, Artificial sequence
  SiRNA target sequence
gttaatgatttagatagatct

SEQ ID NO: 129138 - DNA, 21 bp, Artificial sequence
  SiRNA target sequence
ttaatgatttagatagatctc

SEQ ID NO: 129139 - DNA, 21 bp, Artificial sequence
  SiRNA target sequence
taatgatttagatagatctca

SEQ ID NO: 129140 - DNA, 21 bp, Artificial sequence
  SiRNA target sequence
aatgatttagatagatctcag

SEQ ID NO: 129141 - DNA, 21 bp, Artificial sequence
  SiRNA target sequence
atgatttagatagatctcagt

SEQ ID NO: 129142 - DNA, 21 bp, Artificial sequence
  SiRNA target sequence
tgatttagatagatctcagtt

SEQ ID NO: 129143 - DNA, 21 bp, Artificial sequence
  SiRNA target sequence
gatttagatagatctcagttt

SEQ ID NO: 129144 - DNA, 21 bp, Artificial sequence
  SiRNA target sequence
atttagatagatctcagtttg

SEQ ID NO: 129145 - DNA, 21 bp, Artificial sequence
  SiRNA target sequence
tttagatagatctcagtttga

SEQ ID NO: 129146 - DNA, 21 bp, Artificial sequence
  SiRNA target sequence
ttagatagatctcagtttgac

SEQ ID NO: 129147 - DNA, 21 bp, Artificial sequence
  SiRNA target sequence
tagatagatctcagtttgact

SEQ ID NO: 129148 - DNA, 21 bp, Artificial sequence
  SiRNA target sequence
agatagatctcagtttgactt

SEQ ID NO: 129149 - DNA, 21 bp, Artificial sequence
  SiRNA target sequence
gatagatctcagtttgacttg

SEQ ID NO: 129150 - DNA, 21 bp, Artificial sequence
  SiRNA target sequence
atagatctcagtttgacttgg

SEQ ID NO: 129151 - DNA, 21 bp, Artificial sequence
  SiRNA target sequence
tagatctcagtttgacttggt

SEQ ID NO: 129152 - DNA, 21 bp, Artificial sequence
  SiRNA target sequence
agatctcagtttgacttggta

SEQ ID NO: 129153 - DNA, 21 bp, Artificial sequence
  SiRNA target sequence
gatctcagtttgacttggtat

SEQ ID NO: 129154 - DNA, 21 bp, Artificial sequence
  SiRNA target sequence
atctcagtttgacttggtatc

SEQ ID NO: 129155 - DNA, 21 bp, Artificial sequence
  SiRNA target sequence
tctcagtttgacttggtatct

SEQ ID NO: 129156 - DNA, 21 bp, Artificial sequence
  SiRNA target sequence
ctcagtttgacttggtatctg

SEQ ID NO: 129157 - DNA, 21 bp, Artificial sequence
  SiRNA target sequence
tcagtttgacttggtatctga

SEQ ID NO: 129158 - DNA, 21 bp, Artificial sequence
  SiRNA target sequence
cagtttgacttggtatctgaa

SEQ ID NO: 129159 - DNA, 21 bp, Artificial sequence
  SiRNA target sequence
agtttgacttggtatctgaag

SEQ ID NO: 129160 - DNA, 21 bp, Artificial sequence
  SiRNA target sequence
gtttgacttggtatctgaagc

SEQ ID NO: 129161 - DNA, 21 bp, Artificial sequence
  SiRNA target sequence
tttgacttggtatctgaagca

SEQ ID NO: 129162 - DNA, 21 bp, Artificial sequence
  SiRNA target sequence
ttgacttggtatctgaagcat

SEQ ID NO: 129163 - DNA, 21 bp, Artificial sequence
  SiRNA target sequence
tgacttggtatctgaagcatt

SEQ ID NO: 129164 - DNA, 21 bp, Artificial sequence
  SiRNA target sequence
gacttggtatctgaagcatta

SEQ ID NO: 129165 - DNA, 21 bp, Artificial sequence
  SiRNA target sequence
acttggtatctgaagcattaa

SEQ ID NO: 129166 - DNA, 21 bp, Artificial sequence
  SiRNA target sequence
cttggtatctgaagcattaag

SEQ ID NO: 129167 - DNA, 21 bp, Artificial sequence
  SiRNA target sequence
ttggtatctgaagcattaagt

SEQ ID NO: 129168 - DNA, 21 bp, Artificial sequence
  SiRNA target sequence
tggtatctgaagcattaagtg

SEQ ID NO: 129169 - DNA, 21 bp, Artificial sequence
  SiRNA target sequence
ggtatctgaagcattaagtga

SEQ ID NO: 129170 - DNA, 21 bp, Artificial sequence
  SiRNA target sequence
gtatctgaagcattaagtgaa

SEQ ID NO: 129171 - DNA, 21 bp, Artificial sequence
  SiRNA target sequence
tatctgaagcattaagtgaac

SEQ ID NO: 129172 - DNA, 21 bp, Artificial sequence
  SiRNA target sequence
atctgaagcattaagtgaacg

SEQ ID NO: 129173 - DNA, 21 bp, Artificial sequence
  SiRNA target sequence
tctgaagcattaagtgaacga

SEQ ID NO: 129174 - DNA, 21 bp, Artificial sequence
  SiRNA target sequence
ctgaagcattaagtgaacgaa

SEQ ID NO: 129175 - DNA, 21 bp, Artificial sequence
  SiRNA target sequence
tgaagcattaagtgaacgaaa

SEQ ID NO: 129176 - DNA, 21 bp, Artificial sequence
  SiRNA target sequence
gaagcattaagtgaacgaaaa

SEQ ID NO: 129177 - DNA, 21 bp, Artificial sequence
  SiRNA target sequence
aagcattaagtgaacgaaaaa

SEQ ID NO: 129178 - DNA, 21 bp, Artificial sequence
  SiRNA target sequence
agcattaagtgaacgaaaaat

SEQ ID NO: 129179 - DNA, 21 bp, Artificial sequence
  SiRNA target sequence
gcattaagtgaacgaaaaatt

SEQ ID NO: 129180 - DNA, 21 bp, Artificial sequence
  SiRNA target sequence
cattaagtgaacgaaaaattg

SEQ ID NO: 129181 - DNA, 21 bp, Artificial sequence
  SiRNA target sequence
attaagtgaacgaaaaattgt

SEQ ID NO: 129182 - DNA, 21 bp, Artificial sequence
  SiRNA target sequence
ttaagtgaacgaaaaattgtt

SEQ ID NO: 129183 - DNA, 21 bp, Artificial sequence
  SiRNA target sequence
taagtgaacgaaaaattgtta

SEQ ID NO: 129184 - DNA, 21 bp, Artificial sequence
  SiRNA target sequence
aagtgaacgaaaaattgttat

SEQ ID NO: 129185 - DNA, 21 bp, Artificial sequence
  SiRNA target sequence
agtgaacgaaaaattgttatg

SEQ ID NO: 129186 - DNA, 21 bp, Artificial sequence
  SiRNA target sequence
gtgaacgaaaaattgttatga

SEQ ID NO: 129187 - DNA, 21 bp, Artificial sequence
  SiRNA target sequence
tgaacgaaaaattgttatgaa

SEQ ID NO: 129188 - DNA, 21 bp, Artificial sequence
  SiRNA target sequence
gaacgaaaaattgttatgaat

SEQ ID NO: 129189 - DNA, 21 bp, Artificial sequence
  SiRNA target sequence
aacgaaaaattgttatgaata

SEQ ID NO: 129190 - DNA, 21 bp, Artificial sequence
  SiRNA target sequence
acgaaaaattgttatgaatat

SEQ ID NO: 129191 - DNA, 21 bp, Artificial sequence
  SiRNA target sequence
cgaaaaattgttatgaatatg

SEQ ID NO: 129192 - DNA, 21 bp, Artificial sequence
  SiRNA target sequence
gaaaaattgttatgaatatgt

SEQ ID NO: 129193 - DNA, 21 bp, Artificial sequence
  SiRNA target sequence
aaaaattgttatgaatatgtg

SEQ ID NO: 129194 - DNA, 21 bp, Artificial sequence
  SiRNA target sequence
aaaattgttatgaatatgtgt

SEQ ID NO: 129195 - DNA, 21 bp, Artificial sequence
  SiRNA target sequence
aaattgttatgaatatgtgtc

SEQ ID NO: 129196 - DNA, 21 bp, Artificial sequence
  SiRNA target sequence
aattgttatgaatatgtgtcc

SEQ ID NO: 129197 - DNA, 21 bp, Artificial sequence
  SiRNA target sequence
attgttatgaatatgtgtcct

SEQ ID NO: 129198 - DNA, 21 bp, Artificial sequence
  SiRNA target sequence
ttgttatgaatatgtgtcctt

SEQ ID NO: 129199 - DNA, 21 bp, Artificial sequence
  SiRNA target sequence
tgttatgaatatgtgtccttt

SEQ ID NO: 129200 - DNA, 21 bp, Artificial sequence
  SiRNA target sequence
gttatgaatatgtgtcctttt

SEQ ID NO: 129201 - DNA, 21 bp, Artificial sequence
  SiRNA target sequence
ttatgaatatgtgtccttttc

SEQ ID NO: 129202 - DNA, 21 bp, Artificial sequence
  SiRNA target sequence
tatgaatatgtgtccttttct

SEQ ID NO: 129203 - DNA, 21 bp, Artificial sequence
  SiRNA target sequence
atgaatatgtgtccttttcta

SEQ ID NO: 129204 - DNA, 21 bp, Artificial sequence
  SiRNA target sequence
tgaatatgtgtccttttctag

SEQ ID NO: 129205 - DNA, 21 bp, Artificial sequence
  SiRNA target sequence
gaatatgtgtccttttctagt

SEQ ID NO: 129206 - DNA, 21 bp, Artificial sequence
  SiRNA target sequence
aatatgtgtccttttctagta

SEQ ID NO: 129207 - DNA, 21 bp, Artificial sequence
  SiRNA target sequence
atatgtgtccttttctagtaa

SEQ ID NO: 129208 - DNA, 21 bp, Artificial sequence
  SiRNA target sequence
tatgtgtccttttctagtaag

SEQ ID NO: 129209 - DNA, 21 bp, Artificial sequence
  SiRNA target sequence
atgtgtccttttctagtaagg

SEQ ID NO: 129210 - DNA, 21 bp, Artificial sequence
  SiRNA target sequence
tgtgtccttttctagtaaggt

SEQ ID NO: 129211 - DNA, 21 bp, Artificial sequence
  SiRNA target sequence
gtgtccttttctagtaaggtc

SEQ ID NO: 129212 - DNA, 21 bp, Artificial sequence
  SiRNA target sequence
tgtccttttctagtaaggtcg

SEQ ID NO: 129213 - DNA, 21 bp, Artificial sequence
  SiRNA target sequence
gtccttttctagtaaggtcga

SEQ ID NO: 129214 - DNA, 21 bp, Artificial sequence
  SiRNA target sequence
tccttttctagtaaggtcgat

SEQ ID NO: 129215 - DNA, 21 bp, Artificial sequence
  SiRNA target sequence
ccttttctagtaaggtcgatg

SEQ ID NO: 129216 - DNA, 21 bp, Artificial sequence
  SiRNA target sequence
cttttctagtaaggtcgatgg

SEQ ID NO: 129217 - DNA, 21 bp, Artificial sequence
  SiRNA target sequence
ttttctagtaaggtcgatgga

SEQ ID NO: 129218 - DNA, 21 bp, Artificial sequence
  SiRNA target sequence
tttctagtaaggtcgatggaa

SEQ ID NO: 129219 - DNA, 21 bp, Artificial sequence
  SiRNA target sequence
ttctagtaaggtcgatggaaa

SEQ ID NO: 129220 - DNA, 21 bp, Artificial sequence
  SiRNA target sequence
tctagtaaggtcgatggaaat

SEQ ID NO: 129221 - DNA, 21 bp, Artificial sequence
  SiRNA target sequence
ctagtaaggtcgatggaaata

SEQ ID NO: 129222 - DNA, 21 bp, Artificial sequence
  SiRNA target sequence
tagtaaggtcgatggaaatat

SEQ ID NO: 129223 - DNA, 21 bp, Artificial sequence
  SiRNA target sequence
agtaaggtcgatggaaatatt

SEQ ID NO: 129224 - DNA, 21 bp, Artificial sequence
  SiRNA target sequence
gtaaggtcgatggaaatatta

SEQ ID NO: 129225 - DNA, 21 bp, Artificial sequence
  SiRNA target sequence
taaggtcgatggaaatattat

SEQ ID NO: 129226 - DNA, 21 bp, Artificial sequence
  SiRNA target sequence
aaggtcgatggaaatattatt

SEQ ID NO: 129227 - DNA, 21 bp, Artificial sequence
  SiRNA target sequence
aggtcgatggaaatattattt

SEQ ID NO: 129228 - DNA, 21 bp, Artificial sequence
  SiRNA target sequence
ggtcgatggaaatattatttc

SEQ ID NO: 129229 - DNA, 21 bp, Artificial sequence
  SiRNA target sequence
gtcgatggaaatattatttcc

SEQ ID NO: 129230 - DNA, 21 bp, Artificial sequence
  SiRNA target sequence
tcgatggaaatattatttccg

SEQ ID NO: 129231 - DNA, 21 bp, Artificial sequence
  SiRNA target sequence
cgatggaaatattatttccgg

SEQ ID NO: 129232 - DNA, 21 bp, Artificial sequence
  SiRNA target sequence
gatggaaatattatttccggt

SEQ ID NO: 129233 - DNA, 21 bp, Artificial sequence
  SiRNA target sequence
atggaaatattatttccggtt

SEQ ID NO: 129234 - DNA, 21 bp, Artificial sequence
  SiRNA target sequence
tggaaatattatttccggttt

SEQ ID NO: 129235 - DNA, 21 bp, Artificial sequence
  SiRNA target sequence
ggaaatattatttccggttta

SEQ ID NO: 129236 - DNA, 21 bp, Artificial sequence
  SiRNA target sequence
gaaatattatttccggtttat

SEQ ID NO: 129237 - DNA, 21 bp, Artificial sequence
  SiRNA target sequence
aaatattatttccggtttata

SEQ ID NO: 129238 - DNA, 21 bp, Artificial sequence
  SiRNA target sequence
aatattatttccggtttataa

SEQ ID NO: 129239 - DNA, 21 bp, Artificial sequence
  SiRNA target sequence
atattatttccggtttataaa

SEQ ID NO: 129240 - DNA, 21 bp, Artificial sequence
  SiRNA target sequence
tattatttccggtttataaaa

SEQ ID NO: 129241 - DNA, 21 bp, Artificial sequence
  SiRNA target sequence
attatttccggtttataaaag

SEQ ID NO: 129242 - DNA, 21 bp, Artificial sequence
  SiRNA target sequence
ttatttccggtttataaaagg

SEQ ID NO: 129243 - DNA, 21 bp, Artificial sequence
  SiRNA target sequence
tatttccggtttataaaaggc

SEQ ID NO: 129244 - DNA, 21 bp, Artificial sequence
  SiRNA target sequence
atttccggtttataaaaggct

SEQ ID NO: 129245 - DNA, 21 bp, Artificial sequence
  SiRNA target sequence
tttccggtttataaaaggctt

SEQ ID NO: 129246 - DNA, 21 bp, Artificial sequence
  SiRNA target sequence
ttccggtttataaaaggcttt

SEQ ID NO: 129247 - DNA, 21 bp, Artificial sequence
  SiRNA target sequence
tccggtttataaaaggctttt

SEQ ID NO: 129248 - DNA, 21 bp, Artificial sequence
  SiRNA target sequence
ccggtttataaaaggctttta

SEQ ID NO: 129249 - DNA, 21 bp, Artificial sequence
  SiRNA target sequence
cggtttataaaaggcttttaa

SEQ ID NO: 129250 - DNA, 21 bp, Artificial sequence
  SiRNA target sequence
ggtttataaaaggcttttaat

SEQ ID NO: 129251 - DNA, 21 bp, Artificial sequence
  SiRNA target sequence
gtttataaaaggcttttaatt

SEQ ID NO: 129252 - DNA, 21 bp, Artificial sequence
  SiRNA target sequence
tttataaaaggcttttaattc

SEQ ID NO: 129253 - DNA, 21 bp, Artificial sequence
  SiRNA target sequence
ttataaaaggcttttaattcc

SEQ ID NO: 129254 - DNA, 21 bp, Artificial sequence
  SiRNA target sequence
tataaaaggcttttaattcct

SEQ ID NO: 129255 - DNA, 21 bp, Artificial sequence
  SiRNA target sequence
ataaaaggcttttaattcctt

SEQ ID NO: 129256 - DNA, 21 bp, Artificial sequence
  SiRNA target sequence
taaaaggcttttaattcctta

SEQ ID NO: 129257 - DNA, 21 bp, Artificial sequence
  SiRNA target sequence
aaaaggcttttaattccttac

SEQ ID NO: 129258 - DNA, 21 bp, Artificial sequence
  SiRNA target sequence
aaaggcttttaattccttact

SEQ ID NO: 129259 - DNA, 21 bp, Artificial sequence
  SiRNA target sequence
aaggcttttaattccttacta

SEQ ID NO: 129260 - DNA, 21 bp, Artificial sequence
  SiRNA target sequence
aggcttttaattccttactac

SEQ ID NO: 129261 - DNA, 21 bp, Artificial sequence
  SiRNA target sequence
ggcttttaattccttactact

SEQ ID NO: 129262 - DNA, 21 bp, Artificial sequence
  SiRNA target sequence
gcttttaattccttactacta

SEQ ID NO: 129263 - DNA, 21 bp, Artificial sequence
  SiRNA target sequence
cttttaattccttactactat

SEQ ID NO: 129264 - DNA, 21 bp, Artificial sequence
  SiRNA target sequence
ttttaattccttactactata

SEQ ID NO: 129265 - DNA, 21 bp, Artificial sequence
  SiRNA target sequence
tttaattccttactactatat

SEQ ID NO: 129266 - DNA, 21 bp, Artificial sequence
  SiRNA target sequence
ttaattccttactactatatt

SEQ ID NO: 129267 - DNA, 21 bp, Artificial sequence
  SiRNA target sequence
taattccttactactatattg

SEQ ID NO: 129268 - DNA, 21 bp, Artificial sequence
  SiRNA target sequence
aattccttactactatattgg

SEQ ID NO: 129269 - DNA, 21 bp, Artificial sequence
  SiRNA target sequence
attccttactactatattggc

SEQ ID NO: 129270 - DNA, 21 bp, Artificial sequence
  SiRNA target sequence
ttccttactactatattggcc

SEQ ID NO: 129271 - DNA, 21 bp, Artificial sequence
  SiRNA target sequence
tccttactactatattggcct

SEQ ID NO: 129272 - DNA, 21 bp, Artificial sequence
  SiRNA target sequence
ccttactactatattggcctt

SEQ ID NO: 129273 - DNA, 21 bp, Artificial sequence
  SiRNA target sequence
cttactactatattggcctta

SEQ ID NO: 129274 - DNA, 21 bp, Artificial sequence
  SiRNA target sequence
ttactactatattggccttaa

SEQ ID NO: 129275 - DNA, 21 bp, Artificial sequence
  SiRNA target sequence
tactactatattggccttaaa

SEQ ID NO: 129276 - DNA, 21 bp, Artificial sequence
  SiRNA target sequence
actactatattggccttaaat

SEQ ID NO: 129277 - DNA, 21 bp, Artificial sequence
  SiRNA target sequence
ctactatattggccttaaatt

SEQ ID NO: 129278 - DNA, 21 bp, Artificial sequence
  SiRNA target sequence
tactatattggccttaaattt

SEQ ID NO: 129279 - DNA, 21 bp, Artificial sequence
  SiRNA target sequence
actatattggccttaaatttt

SEQ ID NO: 129280 - DNA, 21 bp, Artificial sequence
  SiRNA target sequence
ctatattggccttaaatttta

SEQ ID NO: 129281 - DNA, 21 bp, Artificial sequence
  SiRNA target sequence
tatattggccttaaattttat

SEQ ID NO: 129282 - DNA, 21 bp, Artificial sequence
  SiRNA target sequence
atattggccttaaattttatg

SEQ ID NO: 129283 - DNA, 21 bp, Artificial sequence
  SiRNA target sequence
tattggccttaaattttatga

SEQ ID NO: 129284 - DNA, 21 bp, Artificial sequence
  SiRNA target sequence
attggccttaaattttatgat

SEQ ID NO: 129285 - DNA, 21 bp, Artificial sequence
  SiRNA target sequence
ttggccttaaattttatgatt

SEQ ID NO: 129286 - DNA, 21 bp, Artificial sequence
  SiRNA target sequence
tggccttaaattttatgattg

SEQ ID NO: 129287 - DNA, 21 bp, Artificial sequence
  SiRNA target sequence
ggccttaaattttatgattgg

SEQ ID NO: 129288 - DNA, 21 bp, Artificial sequence
  SiRNA target sequence
gccttaaattttatgattgga

SEQ ID NO: 129289 - DNA, 21 bp, Artificial sequence
  SiRNA target sequence
ccttaaattttatgattggat

SEQ ID NO: 129290 - DNA, 21 bp, Artificial sequence
  SiRNA target sequence
cttaaattttatgattggatt

SEQ ID NO: 129291 - DNA, 21 bp, Artificial sequence
  SiRNA target sequence
ttaaattttatgattggattt

SEQ ID NO: 129292 - DNA, 21 bp, Artificial sequence
  SiRNA target sequence
taaattttatgattggatttc

SEQ ID NO: 129293 - DNA, 21 bp, Artificial sequence
  SiRNA target sequence
aaattttatgattggatttct

SEQ ID NO: 129294 - DNA, 21 bp, Artificial sequence
  SiRNA target sequence
aattttatgattggatttctg

SEQ ID NO: 129295 - DNA, 21 bp, Artificial sequence
  SiRNA target sequence
attttatgattggatttctgg

SEQ ID NO: 129296 - DNA, 21 bp, Artificial sequence
  SiRNA target sequence
ttttatgattggatttctggg

SEQ ID NO: 129297 - DNA, 21 bp, Artificial sequence
  SiRNA target sequence
tttatgattggatttctgggc

SEQ ID NO: 129298 - DNA, 21 bp, Artificial sequence
  SiRNA target sequence
ttatgattggatttctgggca

SEQ ID NO: 129299 - DNA, 21 bp, Artificial sequence
  SiRNA target sequence
tatgattggatttctgggcaa

SEQ ID NO: 129300 - DNA, 21 bp, Artificial sequence
  SiRNA target sequence
atgattggatttctgggcaac

SEQ ID NO: 129301 - DNA, 21 bp, Artificial sequence
  SiRNA target sequence
tgattggatttctgggcaacg

SEQ ID NO: 129302 - DNA, 21 bp, Artificial sequence
  SiRNA target sequence
gattggatttctgggcaacgg

SEQ ID NO: 129303 - DNA, 21 bp, Artificial sequence
  SiRNA target sequence
attggatttctgggcaacggt

SEQ ID NO: 129304 - DNA, 21 bp, Artificial sequence
  SiRNA target sequence
ttggatttctgggcaacggtc

SEQ ID NO: 129305 - DNA, 21 bp, Artificial sequence
  SiRNA target sequence
tggatttctgggcaacggtcc

SEQ ID NO: 129306 - DNA, 21 bp, Artificial sequence
  SiRNA target sequence
ggatttctgggcaacggtccc

SEQ ID NO: 129307 - DNA, 21 bp, Artificial sequence
  SiRNA target sequence
gatttctgggcaacggtccct

SEQ ID NO: 129308 - DNA, 21 bp, Artificial sequence
  SiRNA target sequence
atttctgggcaacggtccctt

SEQ ID NO: 129309 - DNA, 21 bp, Artificial sequence
  SiRNA target sequence
tttctgggcaacggtcccttg

SEQ ID NO: 129310 - DNA, 21 bp, Artificial sequence
  SiRNA target sequence
ttctgggcaacggtcccttgg

SEQ ID NO: 129311 - DNA, 21 bp, Artificial sequence
  SiRNA target sequence
tctgggcaacggtcccttggg

SEQ ID NO: 129312 - DNA, 21 bp, Artificial sequence
  SiRNA target sequence
ctgggcaacggtcccttgggc

SEQ ID NO: 129313 - DNA, 21 bp, Artificial sequence
  SiRNA target sequence
tgggcaacggtcccttgggcg

SEQ ID NO: 129314 - DNA, 21 bp, Artificial sequence
  SiRNA target sequence
gggcaacggtcccttgggcga

SEQ ID NO: 129315 - DNA, 21 bp, Artificial sequence
  SiRNA target sequence
ggcaacggtcccttgggcgaa

SEQ ID NO: 129316 - DNA, 21 bp, Artificial sequence
  SiRNA target sequence
gcaacggtcccttgggcgaag

SEQ ID NO: 129317 - DNA, 21 bp, Artificial sequence
  SiRNA target sequence
caacggtcccttgggcgaagt

SEQ ID NO: 129318 - DNA, 21 bp, Artificial sequence
  SiRNA target sequence
aacggtcccttgggcgaagta

SEQ ID NO: 129319 - DNA, 21 bp, Artificial sequence
  SiRNA target sequence
acggtcccttgggcgaagtaa

SEQ ID NO: 129320 - DNA, 21 bp, Artificial sequence
  SiRNA target sequence
cggtcccttgggcgaagtaaa

SEQ ID NO: 129321 - DNA, 21 bp, Artificial sequence
  SiRNA target sequence
ggtcccttgggcgaagtaaat

SEQ ID NO: 129322 - DNA, 21 bp, Artificial sequence
  SiRNA target sequence
gtcccttgggcgaagtaaatt

SEQ ID NO: 129323 - DNA, 21 bp, Artificial sequence
  SiRNA target sequence
tcccttgggcgaagtaaattt

SEQ ID NO: 129324 - DNA, 21 bp, Artificial sequence
  SiRNA target sequence
cccttgggcgaagtaaatttt

SEQ ID NO: 129325 - DNA, 21 bp, Artificial sequence
  SiRNA target sequence
ccttgggcgaagtaaattttt

SEQ ID NO: 129326 - DNA, 21 bp, Artificial sequence
  SiRNA target sequence
cttgggcgaagtaaatttttg

SEQ ID NO: 129327 - DNA, 21 bp, Artificial sequence
  SiRNA target sequence
ttgggcgaagtaaatttttgt

SEQ ID NO: 129328 - DNA, 21 bp, Artificial sequence
  SiRNA target sequence
tgggcgaagtaaatttttgtc

SEQ ID NO: 129329 - DNA, 21 bp, Artificial sequence
  SiRNA target sequence
gggcgaagtaaatttttgtcg

SEQ ID NO: 129330 - DNA, 21 bp, Artificial sequence
  SiRNA target sequence
ggcgaagtaaatttttgtcgc

SEQ ID NO: 129331 - DNA, 21 bp, Artificial sequence
  SiRNA target sequence
gcgaagtaaatttttgtcgcg

SEQ ID NO: 129332 - DNA, 21 bp, Artificial sequence
  SiRNA target sequence
cgaagtaaatttttgtcgcgg

SEQ ID NO: 129333 - DNA, 21 bp, Artificial sequence
  SiRNA target sequence
gaagtaaatttttgtcgcggc

SEQ ID NO: 129334 - DNA, 21 bp, Artificial sequence
  SiRNA target sequence
aagtaaatttttgtcgcggca

SEQ ID NO: 129335 - DNA, 21 bp, Artificial sequence
  SiRNA target sequence
agtaaatttttgtcgcggcaa

SEQ ID NO: 129336 - DNA, 21 bp, Artificial sequence
  SiRNA target sequence
gtaaatttttgtcgcggcaac

SEQ ID NO: 129337 - DNA, 21 bp, Artificial sequence
  SiRNA target sequence
taaatttttgtcgcggcaaca

SEQ ID NO: 129338 - DNA, 21 bp, Artificial sequence
  SiRNA target sequence
aaatttttgtcgcggcaacaa

SEQ ID NO: 129339 - DNA, 21 bp, Artificial sequence
  SiRNA target sequence
aatttttgtcgcggcaacaaa

SEQ ID NO: 129340 - DNA, 21 bp, Artificial sequence
  SiRNA target sequence
atttttgtcgcggcaacaaac

SEQ ID NO: 129341 - DNA, 21 bp, Artificial sequence
  SiRNA target sequence
tttttgtcgcggcaacaaact

SEQ ID NO: 129342 - DNA, 21 bp, Artificial sequence
  SiRNA target sequence
ttttgtcgcggcaacaaacta

SEQ ID NO: 129343 - DNA, 21 bp, Artificial sequence
  SiRNA target sequence
tttgtcgcggcaacaaactat

SEQ ID NO: 129344 - DNA, 21 bp, Artificial sequence
  SiRNA target sequence
ttgtcgcggcaacaaactatt

SEQ ID NO: 129345 - DNA, 21 bp, Artificial sequence
  SiRNA target sequence
tgtcgcggcaacaaactatta

SEQ ID NO: 129346 - DNA, 21 bp, Artificial sequence
  SiRNA target sequence
gtcgcggcaacaaactattac

SEQ ID NO: 129347 - DNA, 21 bp, Artificial sequence
  SiRNA target sequence
tcgcggcaacaaactattaca

SEQ ID NO: 129348 - DNA, 21 bp, Artificial sequence
  SiRNA target sequence
cgcggcaacaaactattacaa

SEQ ID NO: 129349 - DNA, 21 bp, Artificial sequence
  SiRNA target sequence
gcggcaacaaactattacaaa

SEQ ID NO: 129350 - DNA, 21 bp, Artificial sequence
  SiRNA target sequence
cggcaacaaactattacaaaa

SEQ ID NO: 129351 - DNA, 21 bp, Artificial sequence
  SiRNA target sequence
ggcaacaaactattacaaaat

SEQ ID NO: 129352 - DNA, 21 bp, Artificial sequence
  SiRNA target sequence
gcaacaaactattacaaaatt

SEQ ID NO: 129353 - DNA, 21 bp, Artificial sequence
  SiRNA target sequence
caacaaactattacaaaattt

SEQ ID NO: 129354 - DNA, 21 bp, Artificial sequence
  SiRNA target sequence
aacaaactattacaaaatttc

SEQ ID NO: 129355 - DNA, 21 bp, Artificial sequence
  SiRNA target sequence
acaaactattacaaaatttcc

SEQ ID NO: 129356 - DNA, 21 bp, Artificial sequence
  SiRNA target sequence
caaactattacaaaatttcct

SEQ ID NO: 129357 - DNA, 21 bp, Artificial sequence
  SiRNA target sequence
aaactattacaaaatttccta

SEQ ID NO: 129358 - DNA, 21 bp, Artificial sequence
  SiRNA target sequence
aactattacaaaatttcctaa

SEQ ID NO: 129359 - DNA, 21 bp, Artificial sequence
  SiRNA target sequence
actattacaaaatttcctaat

SEQ ID NO: 129360 - DNA, 21 bp, Artificial sequence
  SiRNA target sequence
ctattacaaaatttcctaatg

SEQ ID NO: 129361 - DNA, 21 bp, Artificial sequence
  SiRNA target sequence
tattacaaaatttcctaatgt

SEQ ID NO: 129362 - DNA, 21 bp, Artificial sequence
  SiRNA target sequence
attacaaaatttcctaatgtg

SEQ ID NO: 129363 - DNA, 21 bp, Artificial sequence
  SiRNA target sequence
ttacaaaatttcctaatgtga

SEQ ID NO: 129364 - DNA, 21 bp, Artificial sequence
  SiRNA target sequence
tacaaaatttcctaatgtgag

SEQ ID NO: 129365 - DNA, 21 bp, Artificial sequence
  SiRNA target sequence
acaaaatttcctaatgtgaga

SEQ ID NO: 129366 - DNA, 21 bp, Artificial sequence
  SiRNA target sequence
caaaatttcctaatgtgagaa

SEQ ID NO: 129367 - DNA, 21 bp, Artificial sequence
  SiRNA target sequence
aaaatttcctaatgtgagaaa

SEQ ID NO: 129368 - DNA, 21 bp, Artificial sequence
  SiRNA target sequence
aaatttcctaatgtgagaaaa

SEQ ID NO: 129369 - DNA, 21 bp, Artificial sequence
  SiRNA target sequence
aatttcctaatgtgagaaaaa

SEQ ID NO: 129370 - DNA, 21 bp, Artificial sequence
  SiRNA target sequence
atttcctaatgtgagaaaaat

SEQ ID NO: 129371 - DNA, 21 bp, Artificial sequence
  SiRNA target sequence
tttcctaatgtgagaaaaatc

SEQ ID NO: 129372 - DNA, 21 bp, Artificial sequence
  SiRNA target sequence
ttcctaatgtgagaaaaatcg

SEQ ID NO: 129373 - DNA, 21 bp, Artificial sequence
  SiRNA target sequence
tcctaatgtgagaaaaatcga

SEQ ID NO: 129374 - DNA, 21 bp, Artificial sequence
  SiRNA target sequence
cctaatgtgagaaaaatcgac

SEQ ID NO: 129375 - DNA, 21 bp, Artificial sequence
  SiRNA target sequence
ctaatgtgagaaaaatcgacc

SEQ ID NO: 129376 - DNA, 21 bp, Artificial sequence
  SiRNA target sequence
taatgtgagaaaaatcgacct

SEQ ID NO: 129377 - DNA, 21 bp, Artificial sequence
  SiRNA target sequence
aatgtgagaaaaatcgacctt

SEQ ID NO: 129378 - DNA, 21 bp, Artificial sequence
  SiRNA target sequence
atgtgagaaaaatcgaccttg

SEQ ID NO: 129379 - DNA, 21 bp, Artificial sequence
  SiRNA target sequence
tgtgagaaaaatcgaccttgt

SEQ ID NO: 129380 - DNA, 21 bp, Artificial sequence
  SiRNA target sequence
gtgagaaaaatcgaccttgta

SEQ ID NO: 129381 - DNA, 21 bp, Artificial sequence
  SiRNA target sequence
tgagaaaaatcgaccttgtag

SEQ ID NO: 129382 - DNA, 21 bp, Artificial sequence
  SiRNA target sequence
gagaaaaatcgaccttgtagg

SEQ ID NO: 129383 - DNA, 21 bp, Artificial sequence
  SiRNA target sequence
agaaaaatcgaccttgtagga

SEQ ID NO: 129384 - DNA, 21 bp, Artificial sequence
  SiRNA target sequence
gaaaaatcgaccttgtaggat

SEQ ID NO: 129385 - DNA, 21 bp, Artificial sequence
  SiRNA target sequence
aaaaatcgaccttgtaggatc

SEQ ID NO: 129386 - DNA, 21 bp, Artificial sequence
  SiRNA target sequence
aaaatcgaccttgtaggatcc

SEQ ID NO: 129387 - DNA, 21 bp, Artificial sequence
  SiRNA target sequence
aaatcgaccttgtaggatccg

SEQ ID NO: 129388 - DNA, 21 bp, Artificial sequence
  SiRNA target sequence
aatcgaccttgtaggatccgt

SEQ ID NO: 129389 - DNA, 21 bp, Artificial sequence
  SiRNA target sequence
atcgaccttgtaggatccgtt

SEQ ID NO: 129390 - DNA, 21 bp, Artificial sequence
  SiRNA target sequence
tcgaccttgtaggatccgttt

SEQ ID NO: 129391 - DNA, 21 bp, Artificial sequence
  SiRNA target sequence
cgaccttgtaggatccgtttc

SEQ ID NO: 129392 - DNA, 21 bp, Artificial sequence
  SiRNA target sequence
gaccttgtaggatccgtttcg

SEQ ID NO: 129393 - DNA, 21 bp, Artificial sequence
  SiRNA target sequence
accttgtaggatccgtttcgt

SEQ ID NO: 129394 - DNA, 21 bp, Artificial sequence
  SiRNA target sequence
ccttgtaggatccgtttcgta

SEQ ID NO: 129395 - DNA, 21 bp, Artificial sequence
  SiRNA target sequence
cttgtaggatccgtttcgtat

SEQ ID NO: 129396 - DNA, 21 bp, Artificial sequence
  SiRNA target sequence
ttgtaggatccgtttcgtatc

SEQ ID NO: 129397 - DNA, 21 bp, Artificial sequence
  SiRNA target sequence
tgtaggatccgtttcgtatcg

SEQ ID NO: 129398 - DNA, 21 bp, Artificial sequence
  SiRNA target sequence
gtaggatccgtttcgtatcgt

SEQ ID NO: 129399 - DNA, 21 bp, Artificial sequence
  SiRNA target sequence
taggatccgtttcgtatcgtg

SEQ ID NO: 129400 - DNA, 21 bp, Artificial sequence
  SiRNA target sequence
aggatccgtttcgtatcgtga

SEQ ID NO: 129401 - DNA, 21 bp, Artificial sequence
  SiRNA target sequence
ggatccgtttcgtatcgtgat

SEQ ID NO: 129402 - DNA, 21 bp, Artificial sequence
  SiRNA target sequence
gatccgtttcgtatcgtgatg

SEQ ID NO: 129403 - DNA, 21 bp, Artificial sequence
  SiRNA target sequence
atccgtttcgtatcgtgatgg

SEQ ID NO: 129404 - DNA, 21 bp, Artificial sequence
  SiRNA target sequence
tccgtttcgtatcgtgatggc

SEQ ID NO: 129405 - DNA, 21 bp, Artificial sequence
  SiRNA target sequence
ccgtttcgtatcgtgatggcc

SEQ ID NO: 129406 - DNA, 21 bp, Artificial sequence
  SiRNA target sequence
cgtttcgtatcgtgatggcca

SEQ ID NO: 129407 - DNA, 21 bp, Artificial sequence
  SiRNA target sequence
gtttcgtatcgtgatggccaa

SEQ ID NO: 129408 - DNA, 21 bp, Artificial sequence
  SiRNA target sequence
tttcgtatcgtgatggccaat

SEQ ID NO: 129409 - DNA, 21 bp, Artificial sequence
  SiRNA target sequence
ttcgtatcgtgatggccaatt

SEQ ID NO: 129410 - DNA, 21 bp, Artificial sequence
  SiRNA target sequence
tcgtatcgtgatggccaattt

SEQ ID NO: 129411 - DNA, 21 bp, Artificial sequence
  SiRNA target sequence
cgtatcgtgatggccaatttt

SEQ ID NO: 129412 - DNA, 21 bp, Artificial sequence
  SiRNA target sequence
gtatcgtgatggccaatttta

SEQ ID NO: 129413 - DNA, 21 bp, Artificial sequence
  SiRNA target sequence
tatcgtgatggccaattttat

SEQ ID NO: 129414 - DNA, 21 bp, Artificial sequence
  SiRNA target sequence
atcgtgatggccaattttatg

SEQ ID NO: 129415 - DNA, 21 bp, Artificial sequence
  SiRNA target sequence
tcgtgatggccaattttatga

SEQ ID NO: 129416 - DNA, 21 bp, Artificial sequence
  SiRNA target sequence
cgtgatggccaattttatgat

SEQ ID NO: 129417 - DNA, 21 bp, Artificial sequence
  SiRNA target sequence
gtgatggccaattttatgatg

SEQ ID NO: 129418 - DNA, 21 bp, Artificial sequence
  SiRNA target sequence
tgatggccaattttatgatgc

SEQ ID NO: 129419 - DNA, 21 bp, Artificial sequence
  SiRNA target sequence
gatggccaattttatgatgct

SEQ ID NO: 129420 - DNA, 21 bp, Artificial sequence
  SiRNA target sequence
atggccaattttatgatgcta

SEQ ID NO: 129421 - DNA, 21 bp, Artificial sequence
  SiRNA target sequence
tggccaattttatgatgctaa

SEQ ID NO: 129422 - DNA, 21 bp, Artificial sequence
  SiRNA target sequence
ggccaattttatgatgctaaa

SEQ ID NO: 129423 - DNA, 21 bp, Artificial sequence
  SiRNA target sequence
gccaattttatgatgctaaat

SEQ ID NO: 129424 - DNA, 21 bp, Artificial sequence
  SiRNA target sequence
ccaattttatgatgctaaata

SEQ ID NO: 129425 - DNA, 21 bp, Artificial sequence
  SiRNA target sequence
caattttatgatgctaaatac

SEQ ID NO: 129426 - DNA, 21 bp, Artificial sequence
  SiRNA target sequence
aattttatgatgctaaataca

SEQ ID NO: 129427 - DNA, 21 bp, Artificial sequence
  SiRNA target sequence
attttatgatgctaaatacaa

SEQ ID NO: 129428 - DNA, 21 bp, Artificial sequence
  SiRNA target sequence
ttttatgatgctaaatacaat

SEQ ID NO: 129429 - DNA, 21 bp, Artificial sequence
  SiRNA target sequence
tttatgatgctaaatacaatg

SEQ ID NO: 129430 - DNA, 21 bp, Artificial sequence
  SiRNA target sequence
ttatgatgctaaatacaatgt

SEQ ID NO: 129431 - DNA, 21 bp, Artificial sequence
  SiRNA target sequence
tatgatgctaaatacaatgtt

SEQ ID NO: 129432 - DNA, 21 bp, Artificial sequence
  SiRNA target sequence
atgatgctaaatacaatgttc

SEQ ID NO: 129433 - DNA, 21 bp, Artificial sequence
  SiRNA target sequence
tgatgctaaatacaatgttct

SEQ ID NO: 129434 - DNA, 21 bp, Artificial sequence
  SiRNA target sequence
gatgctaaatacaatgttcta

SEQ ID NO: 129435 - DNA, 21 bp, Artificial sequence
  SiRNA target sequence
atgctaaatacaatgttctat

SEQ ID NO: 129436 - DNA, 21 bp, Artificial sequence
  SiRNA target sequence
tgctaaatacaatgttctatt

SEQ ID NO: 129437 - DNA, 21 bp, Artificial sequence
  SiRNA target sequence
gctaaatacaatgttctattg

SEQ ID NO: 129438 - DNA, 21 bp, Artificial sequence
  SiRNA target sequence
ctaaatacaatgttctattgg

SEQ ID NO: 129439 - DNA, 21 bp, Artificial sequence
  SiRNA target sequence
taaatacaatgttctattggg

SEQ ID NO: 129440 - DNA, 21 bp, Artificial sequence
  SiRNA target sequence
aaatacaatgttctattgggt

SEQ ID NO: 129441 - DNA, 21 bp, Artificial sequence
  SiRNA target sequence
aatacaatgttctattgggtg

SEQ ID NO: 129442 - DNA, 21 bp, Artificial sequence
  SiRNA target sequence
atacaatgttctattgggtgt

SEQ ID NO: 129443 - DNA, 21 bp, Artificial sequence
  SiRNA target sequence
tacaatgttctattgggtgtc

SEQ ID NO: 129444 - DNA, 21 bp, Artificial sequence
  SiRNA target sequence
acaatgttctattgggtgtca

SEQ ID NO: 129445 - DNA, 21 bp, Artificial sequence
  SiRNA target sequence
caatgttctattgggtgtcac

SEQ ID NO: 129446 - DNA, 21 bp, Artificial sequence
  SiRNA target sequence
aatgttctattgggtgtcaca

SEQ ID NO: 129447 - DNA, 21 bp, Artificial sequence
  SiRNA target sequence
atgttctattgggtgtcacag

SEQ ID NO: 129448 - DNA, 21 bp, Artificial sequence
  SiRNA target sequence
tgttctattgggtgtcacagc

SEQ ID NO: 129449 - DNA, 21 bp, Artificial sequence
  SiRNA target sequence
gttctattgggtgtcacagct

SEQ ID NO: 129450 - DNA, 21 bp, Artificial sequence
  SiRNA target sequence
ttctattgggtgtcacagcta

SEQ ID NO: 129451 - DNA, 21 bp, Artificial sequence
  SiRNA target sequence
tctattgggtgtcacagctac

SEQ ID NO: 129452 - DNA, 21 bp, Artificial sequence
  SiRNA target sequence
ctattgggtgtcacagctacc

SEQ ID NO: 129453 - DNA, 21 bp, Artificial sequence
  SiRNA target sequence
tattgggtgtcacagctacct

SEQ ID NO: 129454 - DNA, 21 bp, Artificial sequence
  SiRNA target sequence
attgggtgtcacagctaccta

SEQ ID NO: 129455 - DNA, 21 bp, Artificial sequence
  SiRNA target sequence
ttgggtgtcacagctacctac

SEQ ID NO: 129456 - DNA, 21 bp, Artificial sequence
  SiRNA target sequence
tgggtgtcacagctacctact

SEQ ID NO: 129457 - DNA, 21 bp, Artificial sequence
  SiRNA target sequence
gggtgtcacagctacctacta

SEQ ID NO: 129458 - DNA, 21 bp, Artificial sequence
  SiRNA target sequence
ggtgtcacagctacctactat

SEQ ID NO: 129459 - DNA, 21 bp, Artificial sequence
  SiRNA target sequence
gtgtcacagctacctactatg

SEQ ID NO: 129460 - DNA, 21 bp, Artificial sequence
  SiRNA target sequence
tgtcacagctacctactatgg

SEQ ID NO: 129461 - DNA, 21 bp, Artificial sequence
  SiRNA target sequence
gtcacagctacctactatgga

SEQ ID NO: 129462 - DNA, 21 bp, Artificial sequence
  SiRNA target sequence
tcacagctacctactatggag

SEQ ID NO: 129463 - DNA, 21 bp, Artificial sequence
  SiRNA target sequence
cacagctacctactatggagc

SEQ ID NO: 129464 - DNA, 21 bp, Artificial sequence
  SiRNA target sequence
acagctacctactatggagct

SEQ ID NO: 129465 - DNA, 21 bp, Artificial sequence
  SiRNA target sequence
cagctacctactatggagctg

SEQ ID NO: 129466 - DNA, 21 bp, Artificial sequence
  SiRNA target sequence
agctacctactatggagctgt

SEQ ID NO: 129467 - DNA, 21 bp, Artificial sequence
  SiRNA target sequence
gctacctactatggagctgtt

SEQ ID NO: 129468 - DNA, 21 bp, Artificial sequence
  SiRNA target sequence
ctacctactatggagctgttg

SEQ ID NO: 129469 - DNA, 21 bp, Artificial sequence
  SiRNA target sequence
tacctactatggagctgttgt

SEQ ID NO: 129470 - DNA, 21 bp, Artificial sequence
  SiRNA target sequence
acctactatggagctgttgta

SEQ ID NO: 129471 - DNA, 21 bp, Artificial sequence
  SiRNA target sequence
cctactatggagctgttgtat

SEQ ID NO: 129472 - DNA, 21 bp, Artificial sequence
  SiRNA target sequence
ctactatggagctgttgtatt

SEQ ID NO: 129473 - DNA, 21 bp, Artificial sequence
  SiRNA target sequence
tactatggagctgttgtatta

SEQ ID NO: 129474 - DNA, 21 bp, Artificial sequence
  SiRNA target sequence
actatggagctgttgtattaa

SEQ ID NO: 129475 - DNA, 21 bp, Artificial sequence
  SiRNA target sequence
ctatggagctgttgtattaaa

SEQ ID NO: 129476 - DNA, 21 bp, Artificial sequence
  SiRNA target sequence
tatggagctgttgtattaaat

SEQ ID NO: 129477 - DNA, 21 bp, Artificial sequence
  SiRNA target sequence
atggagctgttgtattaaatc

SEQ ID NO: 129478 - DNA, 21 bp, Artificial sequence
  SiRNA target sequence
tggagctgttgtattaaatca

SEQ ID NO: 129479 - DNA, 21 bp, Artificial sequence
  SiRNA target sequence
ggagctgttgtattaaatcat

SEQ ID NO: 129480 - DNA, 21 bp, Artificial sequence
  SiRNA target sequence
gagctgttgtattaaatcatg

SEQ ID NO: 129481 - DNA, 21 bp, Artificial sequence
  SiRNA target sequence
agctgttgtattaaatcatgc

SEQ ID NO: 129482 - DNA, 21 bp, Artificial sequence
  SiRNA target sequence
gctgttgtattaaatcatgca

SEQ ID NO: 129483 - DNA, 21 bp, Artificial sequence
  SiRNA target sequence
ctgttgtattaaatcatgcaa

SEQ ID NO: 129484 - DNA, 21 bp, Artificial sequence
  SiRNA target sequence
tgttgtattaaatcatgcaaa

SEQ ID NO: 129485 - DNA, 21 bp, Artificial sequence
  SiRNA target sequence
gttgtattaaatcatgcaaaa

SEQ ID NO: 129486 - DNA, 21 bp, Artificial sequence
  SiRNA target sequence
ttgtattaaatcatgcaaaat

SEQ ID NO: 129487 - DNA, 21 bp, Artificial sequence
  SiRNA target sequence
tgtattaaatcatgcaaaatt

SEQ ID NO: 129488 - DNA, 21 bp, Artificial sequence
  SiRNA target sequence
gtattaaatcatgcaaaattc

SEQ ID NO: 129489 - DNA, 21 bp, Artificial sequence
  SiRNA target sequence
tattaaatcatgcaaaattct

SEQ ID NO: 129490 - DNA, 21 bp, Artificial sequence
  SiRNA target sequence
attaaatcatgcaaaattctt

SEQ ID NO: 129491 - DNA, 21 bp, Artificial sequence
  SiRNA target sequence
ttaaatcatgcaaaattcttg

SEQ ID NO: 129492 - DNA, 21 bp, Artificial sequence
  SiRNA target sequence
taaatcatgcaaaattcttgt

SEQ ID NO: 129493 - DNA, 21 bp, Artificial sequence
  SiRNA target sequence
aaatcatgcaaaattcttgtc

SEQ ID NO: 129494 - DNA, 21 bp, Artificial sequence
  SiRNA target sequence
aatcatgcaaaattcttgtca

SEQ ID NO: 129495 - DNA, 21 bp, Artificial sequence
  SiRNA target sequence
atcatgcaaaattcttgtcag

SEQ ID NO: 129496 - DNA, 21 bp, Artificial sequence
  SiRNA target sequence
tcatgcaaaattcttgtcagt

SEQ ID NO: 129497 - DNA, 21 bp, Artificial sequence
  SiRNA target sequence
catgcaaaattcttgtcagta

SEQ ID NO: 129498 - DNA, 21 bp, Artificial sequence
  SiRNA target sequence
atgcaaaattcttgtcagtaa

SEQ ID NO: 129499 - DNA, 21 bp, Artificial sequence
  SiRNA target sequence
tgcaaaattcttgtcagtaac

SEQ ID NO: 129500 - DNA, 21 bp, Artificial sequence
  SiRNA target sequence
gcaaaattcttgtcagtaaca

SEQ ID NO: 129501 - DNA, 21 bp, Artificial sequence
  SiRNA target sequence
caaaattcttgtcagtaacaa

SEQ ID NO: 129502 - DNA, 21 bp, Artificial sequence
  SiRNA target sequence
aaaattcttgtcagtaacaaa

SEQ ID NO: 129503 - DNA, 21 bp, Artificial sequence
  SiRNA target sequence
aaattcttgtcagtaacaaaa

SEQ ID NO: 129504 - DNA, 21 bp, Artificial sequence
  SiRNA target sequence
aattcttgtcagtaacaaaag

SEQ ID NO: 129505 - DNA, 21 bp, Artificial sequence
  SiRNA target sequence
attcttgtcagtaacaaaaga

SEQ ID NO: 129506 - DNA, 21 bp, Artificial sequence
  SiRNA target sequence
ttcttgtcagtaacaaaagat

SEQ ID NO: 129507 - DNA, 21 bp, Artificial sequence
  SiRNA target sequence
tcttgtcagtaacaaaagatg

SEQ ID NO: 129508 - DNA, 21 bp, Artificial sequence
  SiRNA target sequence
cttgtcagtaacaaaagatgg

SEQ ID NO: 129509 - DNA, 21 bp, Artificial sequence
  SiRNA target sequence
ttgtcagtaacaaaagatggc

SEQ ID NO: 129510 - DNA, 21 bp, Artificial sequence
  SiRNA target sequence
tgtcagtaacaaaagatggcg

SEQ ID NO: 129511 - DNA, 21 bp, Artificial sequence
  SiRNA target sequence
gtcagtaacaaaagatggcga

SEQ ID NO: 129512 - DNA, 21 bp, Artificial sequence
  SiRNA target sequence
tcagtaacaaaagatggcgat

SEQ ID NO: 129513 - DNA, 21 bp, Artificial sequence
  SiRNA target sequence
cagtaacaaaagatggcgata

SEQ ID NO: 129514 - DNA, 21 bp, Artificial sequence
  SiRNA target sequence
agtaacaaaagatggcgataa

SEQ ID NO: 129515 - DNA, 21 bp, Artificial sequence
  SiRNA target sequence
gtaacaaaagatggcgataaa

SEQ ID NO: 129516 - DNA, 21 bp, Artificial sequence
  SiRNA target sequence
taacaaaagatggcgataaaa

SEQ ID NO: 129517 - DNA, 21 bp, Artificial sequence
  SiRNA target sequence
aacaaaagatggcgataaaat

SEQ ID NO: 129518 - DNA, 21 bp, Artificial sequence
  SiRNA target sequence
acaaaagatggcgataaaatt

SEQ ID NO: 129519 - DNA, 21 bp, Artificial sequence
  SiRNA target sequence
caaaagatggcgataaaatta

SEQ ID NO: 129520 - DNA, 21 bp, Artificial sequence
  SiRNA target sequence
aaaagatggcgataaaattaa

SEQ ID NO: 129521 - DNA, 21 bp, Artificial sequence
  SiRNA target sequence
aaagatggcgataaaattaat

SEQ ID NO: 129522 - DNA, 21 bp, Artificial sequence
  SiRNA target sequence
aagatggcgataaaattaatg

SEQ ID NO: 129523 - DNA, 21 bp, Artificial sequence
  SiRNA target sequence
agatggcgataaaattaatgg

SEQ ID NO: 129524 - DNA, 21 bp, Artificial sequence
  SiRNA target sequence
gatggcgataaaattaatgga

SEQ ID NO: 129525 - DNA, 21 bp, Artificial sequence
  SiRNA target sequence
atggcgataaaattaatggaa

SEQ ID NO: 129526 - DNA, 21 bp, Artificial sequence
  SiRNA target sequence
tggcgataaaattaatggaat

SEQ ID NO: 129527 - DNA, 21 bp, Artificial sequence
  SiRNA target sequence
ggcgataaaattaatggaatt

SEQ ID NO: 129528 - DNA, 21 bp, Artificial sequence
  SiRNA target sequence
gcgataaaattaatggaatta

SEQ ID NO: 129529 - DNA, 21 bp, Artificial sequence
  SiRNA target sequence
cgataaaattaatggaattaa

SEQ ID NO: 129530 - DNA, 21 bp, Artificial sequence
  SiRNA target sequence
gataaaattaatggaattaaa

SEQ ID NO: 129531 - DNA, 21 bp, Artificial sequence
  SiRNA target sequence
ataaaattaatggaattaaat

SEQ ID NO: 129532 - DNA, 21 bp, Artificial sequence
  SiRNA target sequence
taaaattaatggaattaaatg

SEQ ID NO: 129533 - DNA, 21 bp, Artificial sequence
  SiRNA target sequence
aaaattaatggaattaaatgt

SEQ ID NO: 129534 - DNA, 21 bp, Artificial sequence
  SiRNA target sequence
aaattaatggaattaaatgtc

SEQ ID NO: 129535 - DNA, 21 bp, Artificial sequence
  SiRNA target sequence
aattaatggaattaaatgtca

SEQ ID NO: 129536 - DNA, 21 bp, Artificial sequence
  SiRNA target sequence
attaatggaattaaatgtcaa

SEQ ID NO: 129537 - DNA, 21 bp, Artificial sequence
  SiRNA target sequence
ttaatggaattaaatgtcaag

SEQ ID NO: 129538 - DNA, 21 bp, Artificial sequence
  SiRNA target sequence
taatggaattaaatgtcaaga

SEQ ID NO: 129539 - DNA, 21 bp, Artificial sequence
  SiRNA target sequence
aatggaattaaatgtcaagat

SEQ ID NO: 129540 - DNA, 21 bp, Artificial sequence
  SiRNA target sequence
atggaattaaatgtcaagatt

SEQ ID NO: 129541 - DNA, 21 bp, Artificial sequence
  SiRNA target sequence
tggaattaaatgtcaagattc

SEQ ID NO: 129542 - DNA, 21 bp, Artificial sequence
  SiRNA target sequence
ggaattaaatgtcaagattca

SEQ ID NO: 129543 - DNA, 21 bp, Artificial sequence
  SiRNA target sequence
gaattaaatgtcaagattcaa

SEQ ID NO: 129544 - DNA, 21 bp, Artificial sequence
  SiRNA target sequence
aattaaatgtcaagattcaat

SEQ ID NO: 129545 - DNA, 21 bp, Artificial sequence
  SiRNA target sequence
attaaatgtcaagattcaata

SEQ ID NO: 129546 - DNA, 21 bp, Artificial sequence
  SiRNA target sequence
ttaaatgtcaagattcaataa

SEQ ID NO: 129547 - DNA, 21 bp, Artificial sequence
  SiRNA target sequence
taaatgtcaagattcaataaa

SEQ ID NO: 129548 - DNA, 21 bp, Artificial sequence
  SiRNA target sequence
aaatgtcaagattcaataaat

SEQ ID NO: 129549 - DNA, 21 bp, Artificial sequence
  SiRNA target sequence
aatgtcaagattcaataaata

SEQ ID NO: 129550 - DNA, 21 bp, Artificial sequence
  SiRNA target sequence
atgtcaagattcaataaataa

SEQ ID NO: 129551 - DNA, 21 bp, Artificial sequence
  SiRNA target sequence
tgtcaagattcaataaataat

SEQ ID NO: 129552 - DNA, 21 bp, Artificial sequence
  SiRNA target sequence
gtcaagattcaataaataatg

SEQ ID NO: 129553 - DNA, 21 bp, Artificial sequence
  SiRNA target sequence
tcaagattcaataaataatga

SEQ ID NO: 129554 - DNA, 21 bp, Artificial sequence
  SiRNA target sequence
caagattcaataaataatgaa

SEQ ID NO: 129555 - DNA, 21 bp, Artificial sequence
  SiRNA target sequence
aagattcaataaataatgaaa

SEQ ID NO: 129556 - DNA, 21 bp, Artificial sequence
  SiRNA target sequence
agattcaataaataatgaaaa

SEQ ID NO: 129557 - DNA, 21 bp, Artificial sequence
  SiRNA target sequence
gattcaataaataatgaaaaa

SEQ ID NO: 129558 - DNA, 21 bp, Artificial sequence
  SiRNA target sequence
attcaataaataatgaaaaat

SEQ ID NO: 129559 - DNA, 21 bp, Artificial sequence
  SiRNA target sequence
ttcaataaataatgaaaaatt

SEQ ID NO: 129560 - DNA, 21 bp, Artificial sequence
  SiRNA target sequence
tcaataaataatgaaaaattt

SEQ ID NO: 129561 - DNA, 21 bp, Artificial sequence
  SiRNA target sequence
caataaataatgaaaaatttt

SEQ ID NO: 129562 - DNA, 21 bp, Artificial sequence
  SiRNA target sequence
aataaataatgaaaaattttt

SEQ ID NO: 129563 - DNA, 21 bp, Artificial sequence
  SiRNA target sequence
ataaataatgaaaaattttta

SEQ ID NO: 129564 - DNA, 21 bp, Artificial sequence
  SiRNA target sequence
taaataatgaaaaatttttaa

SEQ ID NO: 129565 - DNA, 21 bp, Artificial sequence
  SiRNA target sequence
aaataatgaaaaatttttaat

SEQ ID NO: 129566 - DNA, 21 bp, Artificial sequence
  SiRNA target sequence
aataatgaaaaatttttaatt

SEQ ID NO: 129567 - DNA, 21 bp, Artificial sequence
  SiRNA target sequence
ataatgaaaaatttttaatta

SEQ ID NO: 129568 - DNA, 21 bp, Artificial sequence
  SiRNA target sequence
taatgaaaaatttttaattag

SEQ ID NO: 129569 - DNA, 21 bp, Artificial sequence
  SiRNA target sequence
aatgaaaaatttttaattagg

SEQ ID NO: 129570 - DNA, 21 bp, Artificial sequence
  SiRNA target sequence
atgaaaaatttttaattaggt

SEQ ID NO: 129571 - DNA, 21 bp, Artificial sequence
  SiRNA target sequence
tgaaaaatttttaattaggtg

SEQ ID NO: 129572 - DNA, 21 bp, Artificial sequence
  SiRNA target sequence
gaaaaatttttaattaggtgt

SEQ ID NO: 129573 - DNA, 21 bp, Artificial sequence
  SiRNA target sequence
aaaaatttttaattaggtgta

SEQ ID NO: 129574 - DNA, 21 bp, Artificial sequence
  SiRNA target sequence
aaaatttttaattaggtgtaa

SEQ ID NO: 129575 - DNA, 21 bp, Artificial sequence
  SiRNA target sequence
aaatttttaattaggtgtaaa

SEQ ID NO: 129576 - DNA, 21 bp, Artificial sequence
  SiRNA target sequence
aatttttaattaggtgtaaag

SEQ ID NO: 129577 - DNA, 21 bp, Artificial sequence
  SiRNA target sequence
atttttaattaggtgtaaagt

SEQ ID NO: 129578 - DNA, 21 bp, Artificial sequence
  SiRNA target sequence
tttttaattaggtgtaaagtt

SEQ ID NO: 129579 - DNA, 21 bp, Artificial sequence
  SiRNA target sequence
ttttaattaggtgtaaagttt

SEQ ID NO: 129580 - DNA, 21 bp, Artificial sequence
  SiRNA target sequence
tttaattaggtgtaaagtttt

SEQ ID NO: 129581 - DNA, 21 bp, Artificial sequence
  SiRNA target sequence
ttaattaggtgtaaagtttta

SEQ ID NO: 129582 - DNA, 21 bp, Artificial sequence
  SiRNA target sequence
taattaggtgtaaagttttaa

SEQ ID NO: 129583 - DNA, 21 bp, Artificial sequence
  SiRNA target sequence
aattaggtgtaaagttttaat

SEQ ID NO: 129584 - DNA, 21 bp, Artificial sequence
  SiRNA target sequence
attaggtgtaaagttttaata

SEQ ID NO: 129585 - DNA, 21 bp, Artificial sequence
  SiRNA target sequence
ttaggtgtaaagttttaataa

SEQ ID NO: 129586 - DNA, 21 bp, Artificial sequence
  SiRNA target sequence
taggtgtaaagttttaataaa

SEQ ID NO: 129587 - DNA, 21 bp, Artificial sequence
  SiRNA target sequence
aggtgtaaagttttaataaat

SEQ ID NO: 129588 - DNA, 21 bp, Artificial sequence
  SiRNA target sequence
ggtgtaaagttttaataaata

SEQ ID NO: 129589 - DNA, 21 bp, Artificial sequence
  SiRNA target sequence
gtgtaaagttttaataaatac

SEQ ID NO: 129590 - DNA, 21 bp, Artificial sequence
  SiRNA target sequence
tgtaaagttttaataaatact

SEQ ID NO: 129591 - DNA, 21 bp, Artificial sequence
  SiRNA target sequence
gtaaagttttaataaatactt

SEQ ID NO: 129592 - DNA, 21 bp, Artificial sequence
  SiRNA target sequence
taaagttttaataaatacttc

SEQ ID NO: 129593 - DNA, 21 bp, Artificial sequence
  SiRNA target sequence
aaagttttaataaatacttct

SEQ ID NO: 129594 - DNA, 21 bp, Artificial sequence
  SiRNA target sequence
aagttttaataaatacttctg

SEQ ID NO: 129595 - DNA, 21 bp, Artificial sequence
  SiRNA target sequence
agttttaataaatacttctgg

SEQ ID NO: 129596 - DNA, 21 bp, Artificial sequence
  SiRNA target sequence
gttttaataaatacttctggc

SEQ ID NO: 129597 - DNA, 21 bp, Artificial sequence
  SiRNA target sequence
ttttaataaatacttctggcc

SEQ ID NO: 129598 - DNA, 21 bp, Artificial sequence
  SiRNA target sequence
tttaataaatacttctggccc

SEQ ID NO: 129599 - DNA, 21 bp, Artificial sequence
  SiRNA target sequence
ttaataaatacttctggccct

SEQ ID NO: 129600 - DNA, 21 bp, Artificial sequence
  SiRNA target sequence
taataaatacttctggccctt

SEQ ID NO: 129601 - DNA, 21 bp, Artificial sequence
  SiRNA target sequence
aataaatacttctggcccttt

SEQ ID NO: 129602 - DNA, 21 bp, Artificial sequence
  SiRNA target sequence
ataaatacttctggccctttt

SEQ ID NO: 129603 - DNA, 21 bp, Artificial sequence
  SiRNA target sequence
taaatacttctggcccttttg

SEQ ID NO: 129604 - DNA, 21 bp, Artificial sequence
  SiRNA target sequence
aaatacttctggcccttttgc

SEQ ID NO: 129605 - DNA, 21 bp, Artificial sequence
  SiRNA target sequence
aatacttctggcccttttgct

SEQ ID NO: 129606 - DNA, 21 bp, Artificial sequence
  SiRNA target sequence
atacttctggcccttttgctg

SEQ ID NO: 129607 - DNA, 21 bp, Artificial sequence
  SiRNA target sequence
tacttctggcccttttgctga

SEQ ID NO: 129608 - DNA, 21 bp, Artificial sequence
  SiRNA target sequence
acttctggcccttttgctgac

SEQ ID NO: 129609 - DNA, 21 bp, Artificial sequence
  SiRNA target sequence
cttctggcccttttgctgacg

SEQ ID NO: 129610 - DNA, 21 bp, Artificial sequence
  SiRNA target sequence
ttctggcccttttgctgacga

SEQ ID NO: 129611 - DNA, 21 bp, Artificial sequence
  SiRNA target sequence
tctggcccttttgctgacgag

SEQ ID NO: 129612 - DNA, 21 bp, Artificial sequence
  SiRNA target sequence
ctggcccttttgctgacgagg

SEQ ID NO: 129613 - DNA, 21 bp, Artificial sequence
  SiRNA target sequence
tggcccttttgctgacgaggt

SEQ ID NO: 129614 - DNA, 21 bp, Artificial sequence
  SiRNA target sequence
ggcccttttgctgacgaggtt

SEQ ID NO: 129615 - DNA, 21 bp, Artificial sequence
  SiRNA target sequence
gcccttttgctgacgaggttc

SEQ ID NO: 129616 - DNA, 21 bp, Artificial sequence
  SiRNA target sequence
cccttttgctgacgaggttcg

SEQ ID NO: 129617 - DNA, 21 bp, Artificial sequence
  SiRNA target sequence
ccttttgctgacgaggttcga

SEQ ID NO: 129618 - DNA, 21 bp, Artificial sequence
  SiRNA target sequence
cttttgctgacgaggttcgaa

SEQ ID NO: 129619 - DNA, 21 bp, Artificial sequence
  SiRNA target sequence
ttttgctgacgaggttcgaaa

SEQ ID NO: 129620 - DNA, 21 bp, Artificial sequence
  SiRNA target sequence
tttgctgacgaggttcgaaat

SEQ ID NO: 129621 - DNA, 21 bp, Artificial sequence
  SiRNA target sequence
ttgctgacgaggttcgaaata

SEQ ID NO: 129622 - DNA, 21 bp, Artificial sequence
  SiRNA target sequence
tgctgacgaggttcgaaatac

SEQ ID NO: 129623 - DNA, 21 bp, Artificial sequence
  SiRNA target sequence
gctgacgaggttcgaaataca

SEQ ID NO: 129624 - DNA, 21 bp, Artificial sequence
  SiRNA target sequence
ctgacgaggttcgaaatacat

SEQ ID NO: 129625 - DNA, 21 bp, Artificial sequence
  SiRNA target sequence
tgacgaggttcgaaatacatc

SEQ ID NO: 129626 - DNA, 21 bp, Artificial sequence
  SiRNA target sequence
gacgaggttcgaaatacatca

SEQ ID NO: 129627 - DNA, 21 bp, Artificial sequence
  SiRNA target sequence
acgaggttcgaaatacatcaa

SEQ ID NO: 129628 - DNA, 21 bp, Artificial sequence
  SiRNA target sequence
cgaggttcgaaatacatcaat

SEQ ID NO: 129629 - DNA, 21 bp, Artificial sequence
  SiRNA target sequence
gaggttcgaaatacatcaatt

SEQ ID NO: 129630 - DNA, 21 bp, Artificial sequence
  SiRNA target sequence
aggttcgaaatacatcaattg

SEQ ID NO: 129631 - DNA, 21 bp, Artificial sequence
  SiRNA target sequence
ggttcgaaatacatcaattga

SEQ ID NO: 129632 - DNA, 21 bp, Artificial sequence
  SiRNA target sequence
gttcgaaatacatcaattgaa

SEQ ID NO: 129633 - DNA, 21 bp, Artificial sequence
  SiRNA target sequence
ttcgaaatacatcaattgaaa

SEQ ID NO: 129634 - DNA, 21 bp, Artificial sequence
  SiRNA target sequence
tcgaaatacatcaattgaaaa

SEQ ID NO: 129635 - DNA, 21 bp, Artificial sequence
  SiRNA target sequence
cgaaatacatcaattgaaaac

SEQ ID NO: 129636 - DNA, 21 bp, Artificial sequence
  SiRNA target sequence
gaaatacatcaattgaaaact

SEQ ID NO: 129637 - DNA, 21 bp, Artificial sequence
  SiRNA target sequence
aaatacatcaattgaaaactg

SEQ ID NO: 129638 - DNA, 21 bp, Artificial sequence
  SiRNA target sequence
aatacatcaattgaaaactgt

SEQ ID NO: 129639 - DNA, 21 bp, Artificial sequence
  SiRNA target sequence
atacatcaattgaaaactgtc

SEQ ID NO: 129640 - DNA, 21 bp, Artificial sequence
  SiRNA target sequence
tacatcaattgaaaactgtca

SEQ ID NO: 129641 - DNA, 21 bp, Artificial sequence
  SiRNA target sequence
acatcaattgaaaactgtcaa

SEQ ID NO: 129642 - DNA, 21 bp, Artificial sequence
  SiRNA target sequence
catcaattgaaaactgtcaac

SEQ ID NO: 129643 - DNA, 21 bp, Artificial sequence
  SiRNA target sequence
atcaattgaaaactgtcaacc

SEQ ID NO: 129644 - DNA, 21 bp, Artificial sequence
  SiRNA target sequence
tcaattgaaaactgtcaacca

SEQ ID NO: 129645 - DNA, 21 bp, Artificial sequence
  SiRNA target sequence
caattgaaaactgtcaaccaa

SEQ ID NO: 129646 - DNA, 21 bp, Artificial sequence
  SiRNA target sequence
aattgaaaactgtcaaccaat

SEQ ID NO: 129647 - DNA, 21 bp, Artificial sequence
  SiRNA target sequence
attgaaaactgtcaaccaata

SEQ ID NO: 129648 - DNA, 21 bp, Artificial sequence
  SiRNA target sequence
ttgaaaactgtcaaccaatac

SEQ ID NO: 129649 - DNA, 21 bp, Artificial sequence
  SiRNA target sequence
tgaaaactgtcaaccaatact

SEQ ID NO: 129650 - DNA, 21 bp, Artificial sequence
  SiRNA target sequence
gaaaactgtcaaccaatactc

SEQ ID NO: 129651 - DNA, 21 bp, Artificial sequence
  SiRNA target sequence
aaaactgtcaaccaatactcc

SEQ ID NO: 129652 - DNA, 21 bp, Artificial sequence
  SiRNA target sequence
aaactgtcaaccaatactcca

SEQ ID NO: 129653 - DNA, 21 bp, Artificial sequence
  SiRNA target sequence
aactgtcaaccaatactccaa

SEQ ID NO: 129654 - DNA, 21 bp, Artificial sequence
  SiRNA target sequence
actgtcaaccaatactccaac

SEQ ID NO: 129655 - DNA, 21 bp, Artificial sequence
  SiRNA target sequence
ctgtcaaccaatactccaaca

SEQ ID NO: 129656 - DNA, 21 bp, Artificial sequence
  SiRNA target sequence
tgtcaaccaatactccaacat

SEQ ID NO: 129657 - DNA, 21 bp, Artificial sequence
  SiRNA target sequence
gtcaaccaatactccaacata

SEQ ID NO: 129658 - DNA, 21 bp, Artificial sequence
  SiRNA target sequence
tcaaccaatactccaacatag

SEQ ID NO: 129659 - DNA, 21 bp, Artificial sequence
  SiRNA target sequence
caaccaatactccaacatagt

SEQ ID NO: 129660 - DNA, 21 bp, Artificial sequence
  SiRNA target sequence
aaccaatactccaacatagtt

SEQ ID NO: 129661 - DNA, 21 bp, Artificial sequence
  SiRNA target sequence
accaatactccaacatagtta

SEQ ID NO: 129662 - DNA, 21 bp, Artificial sequence
  SiRNA target sequence
ccaatactccaacatagttat

SEQ ID NO: 129663 - DNA, 21 bp, Artificial sequence
  SiRNA target sequence
caatactccaacatagttatg

SEQ ID NO: 129664 - DNA, 21 bp, Artificial sequence
  SiRNA target sequence
aatactccaacatagttatgg

SEQ ID NO: 129665 - DNA, 21 bp, Artificial sequence
  SiRNA target sequence
atactccaacatagttatggt

SEQ ID NO: 129666 - DNA, 21 bp, Artificial sequence
  SiRNA target sequence
tactccaacatagttatggta

SEQ ID NO: 129667 - DNA, 21 bp, Artificial sequence
  SiRNA target sequence
actccaacatagttatggtac

SEQ ID NO: 129668 - DNA, 21 bp, Artificial sequence
  SiRNA target sequence
ctccaacatagttatggtaca

SEQ ID NO: 129669 - DNA, 21 bp, Artificial sequence
  SiRNA target sequence
tccaacatagttatggtacac

SEQ ID NO: 129670 - DNA, 21 bp, Artificial sequence
  SiRNA target sequence
ccaacatagttatggtacaca

SEQ ID NO: 129671 - DNA, 21 bp, Artificial sequence
  SiRNA target sequence
caacatagttatggtacacat

SEQ ID NO: 129672 - DNA, 21 bp, Artificial sequence
  SiRNA target sequence
aacatagttatggtacacata

SEQ ID NO: 129673 - DNA, 21 bp, Artificial sequence
  SiRNA target sequence
acatagttatggtacacatat

SEQ ID NO: 129674 - DNA, 21 bp, Artificial sequence
  SiRNA target sequence
catagttatggtacacatatt

SEQ ID NO: 129675 - DNA, 21 bp, Artificial sequence
  SiRNA target sequence
atagttatggtacacatattg

SEQ ID NO: 129676 - DNA, 21 bp, Artificial sequence
  SiRNA target sequence
tagttatggtacacatattgt

SEQ ID NO: 129677 - DNA, 21 bp, Artificial sequence
  SiRNA target sequence
agttatggtacacatattgta

SEQ ID NO: 129678 - DNA, 21 bp, Artificial sequence
  SiRNA target sequence
gttatggtacacatattgtag

SEQ ID NO: 129679 - DNA, 21 bp, Artificial sequence
  SiRNA target sequence
ttatggtacacatattgtagt

SEQ ID NO: 129680 - DNA, 21 bp, Artificial sequence
  SiRNA target sequence
tatggtacacatattgtagtt

SEQ ID NO: 129681 - DNA, 21 bp, Artificial sequence
  SiRNA target sequence
atggtacacatattgtagttc

SEQ ID NO: 129682 - DNA, 21 bp, Artificial sequence
  SiRNA target sequence
tggtacacatattgtagttcc

SEQ ID NO: 129683 - DNA, 21 bp, Artificial sequence
  SiRNA target sequence
ggtacacatattgtagttcct

SEQ ID NO: 129684 - DNA, 21 bp, Artificial sequence
  SiRNA target sequence
gtacacatattgtagttcctg

SEQ ID NO: 129685 - DNA, 21 bp, Artificial sequence
  SiRNA target sequence
tacacatattgtagttcctgc

SEQ ID NO: 129686 - DNA, 21 bp, Artificial sequence
  SiRNA target sequence
acacatattgtagttcctgcg

SEQ ID NO: 129687 - DNA, 21 bp, Artificial sequence
  SiRNA target sequence
cacatattgtagttcctgcga

SEQ ID NO: 129688 - DNA, 21 bp, Artificial sequence
  SiRNA target sequence
acatattgtagttcctgcgat

SEQ ID NO: 129689 - DNA, 21 bp, Artificial sequence
  SiRNA target sequence
catattgtagttcctgcgata

SEQ ID NO: 129690 - DNA, 21 bp, Artificial sequence
  SiRNA target sequence
atattgtagttcctgcgatat

SEQ ID NO: 129691 - DNA, 21 bp, Artificial sequence
  SiRNA target sequence
tattgtagttcctgcgatatt

SEQ ID NO: 129692 - DNA, 21 bp, Artificial sequence
  SiRNA target sequence
attgtagttcctgcgatattt

SEQ ID NO: 129693 - DNA, 21 bp, Artificial sequence
  SiRNA target sequence
ttgtagttcctgcgatatttt

SEQ ID NO: 129694 - DNA, 21 bp, Artificial sequence
  SiRNA target sequence
tgtagttcctgcgatattttc

SEQ ID NO: 129695 - DNA, 21 bp, Artificial sequence
  SiRNA target sequence
gtagttcctgcgatattttcg

SEQ ID NO: 129696 - DNA, 21 bp, Artificial sequence
  SiRNA target sequence
tagttcctgcgatattttcgc

SEQ ID NO: 129697 - DNA, 21 bp, Artificial sequence
  SiRNA target sequence
agttcctgcgatattttcgcc

SEQ ID NO: 129698 - DNA, 21 bp, Artificial sequence
  SiRNA target sequence
gttcctgcgatattttcgcct

SEQ ID NO: 129699 - DNA, 21 bp, Artificial sequence
  SiRNA target sequence
ttcctgcgatattttcgccta

SEQ ID NO: 129700 - DNA, 21 bp, Artificial sequence
  SiRNA target sequence
tcctgcgatattttcgcctaa

SEQ ID NO: 129701 - DNA, 21 bp, Artificial sequence
  SiRNA target sequence
cctgcgatattttcgcctaaa

SEQ ID NO: 129702 - DNA, 21 bp, Artificial sequence
  SiRNA target sequence
ctgcgatattttcgcctaaaa

SEQ ID NO: 129703 - DNA, 21 bp, Artificial sequence
  SiRNA target sequence
tgcgatattttcgcctaaaaa

SEQ ID NO: 129704 - DNA, 21 bp, Artificial sequence
  SiRNA target sequence
gcgatattttcgcctaaaaat

SEQ ID NO: 129705 - DNA, 21 bp, Artificial sequence
  SiRNA target sequence
cgatattttcgcctaaaaata

SEQ ID NO: 129706 - DNA, 21 bp, Artificial sequence
  SiRNA target sequence
gatattttcgcctaaaaatat

SEQ ID NO: 129707 - DNA, 21 bp, Artificial sequence
  SiRNA target sequence
atattttcgcctaaaaatatg

SEQ ID NO: 129708 - DNA, 21 bp, Artificial sequence
  SiRNA target sequence
tattttcgcctaaaaatatgg

SEQ ID NO: 129709 - DNA, 21 bp, Artificial sequence
  SiRNA target sequence
attttcgcctaaaaatatggg

SEQ ID NO: 129710 - DNA, 21 bp, Artificial sequence
  SiRNA target sequence
ttttcgcctaaaaatatgggc

SEQ ID NO: 129711 - DNA, 21 bp, Artificial sequence
  SiRNA target sequence
tttcgcctaaaaatatgggct

SEQ ID NO: 129712 - DNA, 21 bp, Artificial sequence
  SiRNA target sequence
ttcgcctaaaaatatgggctt

SEQ ID NO: 129713 - DNA, 21 bp, Artificial sequence
  SiRNA target sequence
tcgcctaaaaatatgggcttt

SEQ ID NO: 129714 - DNA, 21 bp, Artificial sequence
  SiRNA target sequence
cgcctaaaaatatgggctttg

SEQ ID NO: 129715 - DNA, 21 bp, Artificial sequence
  SiRNA target sequence
gcctaaaaatatgggctttgt

SEQ ID NO: 129716 - DNA, 21 bp, Artificial sequence
  SiRNA target sequence
cctaaaaatatgggctttgtt

SEQ ID NO: 129717 - DNA, 21 bp, Artificial sequence
  SiRNA target sequence
ctaaaaatatgggctttgttg

SEQ ID NO: 129718 - DNA, 21 bp, Artificial sequence
  SiRNA target sequence
taaaaatatgggctttgttga

SEQ ID NO: 129719 - DNA, 21 bp, Artificial sequence
  SiRNA target sequence
aaaaatatgggctttgttgat

SEQ ID NO: 129720 - DNA, 21 bp, Artificial sequence
  SiRNA target sequence
aaaatatgggctttgttgatc

SEQ ID NO: 129721 - DNA, 21 bp, Artificial sequence
  SiRNA target sequence
aaatatgggctttgttgatcc

SEQ ID NO: 129722 - DNA, 21 bp, Artificial sequence
  SiRNA target sequence
aatatgggctttgttgatcca

SEQ ID NO: 129723 - DNA, 21 bp, Artificial sequence
  SiRNA target sequence
atatgggctttgttgatccaa

SEQ ID NO: 129724 - DNA, 21 bp, Artificial sequence
  SiRNA target sequence
tatgggctttgttgatccaag

SEQ ID NO: 129725 - DNA, 21 bp, Artificial sequence
  SiRNA target sequence
atgggctttgttgatccaagc

SEQ ID NO: 129726 - DNA, 21 bp, Artificial sequence
  SiRNA target sequence
tgggctttgttgatccaagca

SEQ ID NO: 129727 - DNA, 21 bp, Artificial sequence
  SiRNA target sequence
gggctttgttgatccaagcac

SEQ ID NO: 129728 - DNA, 21 bp, Artificial sequence
  SiRNA target sequence
ggctttgttgatccaagcacg

SEQ ID NO: 129729 - DNA, 21 bp, Artificial sequence
  SiRNA target sequence
gctttgttgatccaagcacga

SEQ ID NO: 129730 - DNA, 21 bp, Artificial sequence
  SiRNA target sequence
ctttgttgatccaagcacgag

SEQ ID NO: 129731 - DNA, 21 bp, Artificial sequence
  SiRNA target sequence
tttgttgatccaagcacgagt

SEQ ID NO: 129732 - DNA, 21 bp, Artificial sequence
  SiRNA target sequence
ttgttgatccaagcacgagtg

SEQ ID NO: 129733 - DNA, 21 bp, Artificial sequence
  SiRNA target sequence
tgttgatccaagcacgagtga

SEQ ID NO: 129734 - DNA, 21 bp, Artificial sequence
  SiRNA target sequence
gttgatccaagcacgagtgat

SEQ ID NO: 129735 - DNA, 21 bp, Artificial sequence
  SiRNA target sequence
ttgatccaagcacgagtgatg

SEQ ID NO: 129736 - DNA, 21 bp, Artificial sequence
  SiRNA target sequence
tgatccaagcacgagtgatgg

SEQ ID NO: 129737 - DNA, 21 bp, Artificial sequence
  SiRNA target sequence
gatccaagcacgagtgatgga

SEQ ID NO: 129738 - DNA, 21 bp, Artificial sequence
  SiRNA target sequence
atccaagcacgagtgatggaa

SEQ ID NO: 129739 - DNA, 21 bp, Artificial sequence
  SiRNA target sequence
tccaagcacgagtgatggaag

SEQ ID NO: 129740 - DNA, 21 bp, Artificial sequence
  SiRNA target sequence
ccaagcacgagtgatggaaga

SEQ ID NO: 129741 - DNA, 21 bp, Artificial sequence
  SiRNA target sequence
caagcacgagtgatggaagaa

SEQ ID NO: 129742 - DNA, 21 bp, Artificial sequence
  SiRNA target sequence
aagcacgagtgatggaagaat

SEQ ID NO: 129743 - DNA, 21 bp, Artificial sequence
  SiRNA target sequence
agcacgagtgatggaagaatc

SEQ ID NO: 129744 - DNA, 21 bp, Artificial sequence
  SiRNA target sequence
gcacgagtgatggaagaatcg

SEQ ID NO: 129745 - DNA, 21 bp, Artificial sequence
  SiRNA target sequence
cacgagtgatggaagaatcgc

SEQ ID NO: 129746 - DNA, 21 bp, Artificial sequence
  SiRNA target sequence
acgagtgatggaagaatcgca

SEQ ID NO: 129747 - DNA, 21 bp, Artificial sequence
  SiRNA target sequence
cgagtgatggaagaatcgcat

SEQ ID NO: 129748 - DNA, 21 bp, Artificial sequence
  SiRNA target sequence
gagtgatggaagaatcgcatt

SEQ ID NO: 129749 - DNA, 21 bp, Artificial sequence
  SiRNA target sequence
agtgatggaagaatcgcattt

SEQ ID NO: 129750 - DNA, 21 bp, Artificial sequence
  SiRNA target sequence
gtgatggaagaatcgcatttt

SEQ ID NO: 129751 - DNA, 21 bp, Artificial sequence
  SiRNA target sequence
tgatggaagaatcgcattttt

SEQ ID NO: 129752 - DNA, 21 bp, Artificial sequence
  SiRNA target sequence
gatggaagaatcgcatttttt

SEQ ID NO: 129753 - DNA, 21 bp, Artificial sequence
  SiRNA target sequence
atggaagaatcgcatttttta

SEQ ID NO: 129754 - DNA, 21 bp, Artificial sequence
  SiRNA target sequence
tggaagaatcgcattttttat

SEQ ID NO: 129755 - DNA, 21 bp, Artificial sequence
  SiRNA target sequence
ggaagaatcgcattttttatg

SEQ ID NO: 129756 - DNA, 21 bp, Artificial sequence
  SiRNA target sequence
gaagaatcgcattttttatga

SEQ ID NO: 129757 - DNA, 21 bp, Artificial sequence
  SiRNA target sequence
aagaatcgcattttttatgaa

SEQ ID NO: 129758 - DNA, 21 bp, Artificial sequence
  SiRNA target sequence
agaatcgcattttttatgaat

SEQ ID NO: 129759 - DNA, 21 bp, Artificial sequence
  SiRNA target sequence
gaatcgcattttttatgaatt

SEQ ID NO: 129760 - DNA, 21 bp, Artificial sequence
  SiRNA target sequence
aatcgcattttttatgaattt

SEQ ID NO: 129761 - DNA, 21 bp, Artificial sequence
  SiRNA target sequence
atcgcattttttatgaatttt

SEQ ID NO: 129762 - DNA, 21 bp, Artificial sequence
  SiRNA target sequence
tcgcattttttatgaatttta

SEQ ID NO: 129763 - DNA, 21 bp, Artificial sequence
  SiRNA target sequence
cgcattttttatgaattttaa

SEQ ID NO: 129764 - DNA, 21 bp, Artificial sequence
  SiRNA target sequence
gcattttttatgaattttaaa

SEQ ID NO: 129765 - DNA, 21 bp, Artificial sequence
  SiRNA target sequence
cattttttatgaattttaaag

SEQ ID NO: 129766 - DNA, 21 bp, Artificial sequence
  SiRNA target sequence
attttttatgaattttaaagg

SEQ ID NO: 129767 - DNA, 21 bp, Artificial sequence
  SiRNA target sequence
ttttttatgaattttaaaggt

SEQ ID NO: 129768 - DNA, 21 bp, Artificial sequence
  SiRNA target sequence
tttttatgaattttaaaggta

SEQ ID NO: 129769 - DNA, 21 bp, Artificial sequence
  SiRNA target sequence
ttttatgaattttaaaggtaa

SEQ ID NO: 129770 - DNA, 21 bp, Artificial sequence
  SiRNA target sequence
tttatgaattttaaaggtaaa

SEQ ID NO: 129771 - DNA, 21 bp, Artificial sequence
  SiRNA target sequence
ttatgaattttaaaggtaaaa

SEQ ID NO: 129772 - DNA, 21 bp, Artificial sequence
  SiRNA target sequence
tatgaattttaaaggtaaaac

SEQ ID NO: 129773 - DNA, 21 bp, Artificial sequence
  SiRNA target sequence
atgaattttaaaggtaaaaca

SEQ ID NO: 129774 - DNA, 21 bp, Artificial sequence
  SiRNA target sequence
tgaattttaaaggtaaaacat

SEQ ID NO: 129775 - DNA, 21 bp, Artificial sequence
  SiRNA target sequence
gaattttaaaggtaaaacatt

SEQ ID NO: 129776 - DNA, 21 bp, Artificial sequence
  SiRNA target sequence
aattttaaaggtaaaacattg

SEQ ID NO: 129777 - DNA, 21 bp, Artificial sequence
  SiRNA target sequence
attttaaaggtaaaacattga

SEQ ID NO: 129778 - DNA, 21 bp, Artificial sequence
  SiRNA target sequence
ttttaaaggtaaaacattgat

SEQ ID NO: 129779 - DNA, 21 bp, Artificial sequence
  SiRNA target sequence
tttaaaggtaaaacattgatt

SEQ ID NO: 129780 - DNA, 21 bp, Artificial sequence
  SiRNA target sequence
ttaaaggtaaaacattgattg

SEQ ID NO: 129781 - DNA, 21 bp, Artificial sequence
  SiRNA target sequence
taaaggtaaaacattgattgg

SEQ ID NO: 129782 - DNA, 21 bp, Artificial sequence
  SiRNA target sequence
aaaggtaaaacattgattgga

SEQ ID NO: 129783 - DNA, 21 bp, Artificial sequence
  SiRNA target sequence
aaggtaaaacattgattggag

SEQ ID NO: 129784 - DNA, 21 bp, Artificial sequence
  SiRNA target sequence
aggtaaaacattgattggagg

SEQ ID NO: 129785 - DNA, 21 bp, Artificial sequence
  SiRNA target sequence
ggtaaaacattgattggagga

SEQ ID NO: 129786 - DNA, 21 bp, Artificial sequence
  SiRNA target sequence
gtaaaacattgattggaggaa

SEQ ID NO: 129787 - DNA, 21 bp, Artificial sequence
  SiRNA target sequence
taaaacattgattggaggaac

SEQ ID NO: 129788 - DNA, 21 bp, Artificial sequence
  SiRNA target sequence
aaaacattgattggaggaaca

SEQ ID NO: 129789 - DNA, 21 bp, Artificial sequence
  SiRNA target sequence
aaacattgattggaggaacag

SEQ ID NO: 129790 - DNA, 21 bp, Artificial sequence
  SiRNA target sequence
aacattgattggaggaacaga

SEQ ID NO: 129791 - DNA, 21 bp, Artificial sequence
  SiRNA target sequence
acattgattggaggaacagat

SEQ ID NO: 129792 - DNA, 21 bp, Artificial sequence
  SiRNA target sequence
cattgattggaggaacagatg

SEQ ID NO: 129793 - DNA, 21 bp, Artificial sequence
  SiRNA target sequence
attgattggaggaacagatgt

SEQ ID NO: 129794 - DNA, 21 bp, Artificial sequence
  SiRNA target sequence
ttgattggaggaacagatgtt

SEQ ID NO: 129795 - DNA, 21 bp, Artificial sequence
  SiRNA target sequence
tgattggaggaacagatgtta

SEQ ID NO: 129796 - DNA, 21 bp, Artificial sequence
  SiRNA target sequence
gattggaggaacagatgttaa

SEQ ID NO: 129797 - DNA, 21 bp, Artificial sequence
  SiRNA target sequence
attggaggaacagatgttaag

SEQ ID NO: 129798 - DNA, 21 bp, Artificial sequence
  SiRNA target sequence
ttggaggaacagatgttaagt

SEQ ID NO: 129799 - DNA, 21 bp, Artificial sequence
  SiRNA target sequence
tggaggaacagatgttaagtg

SEQ ID NO: 129800 - DNA, 21 bp, Artificial sequence
  SiRNA target sequence
ggaggaacagatgttaagtgt

SEQ ID NO: 129801 - DNA, 21 bp, Artificial sequence
  SiRNA target sequence
gaggaacagatgttaagtgta

SEQ ID NO: 129802 - DNA, 21 bp, Artificial sequence
  SiRNA target sequence
aggaacagatgttaagtgtaa

SEQ ID NO: 129803 - DNA, 21 bp, Artificial sequence
  SiRNA target sequence
ggaacagatgttaagtgtaaa

SEQ ID NO: 129804 - DNA, 21 bp, Artificial sequence
  SiRNA target sequence
gaacagatgttaagtgtaaag

SEQ ID NO: 129805 - DNA, 21 bp, Artificial sequence
  SiRNA target sequence
aacagatgttaagtgtaaagt

SEQ ID NO: 129806 - DNA, 21 bp, Artificial sequence
  SiRNA target sequence
acagatgttaagtgtaaagtt

SEQ ID NO: 129807 - DNA, 21 bp, Artificial sequence
  SiRNA target sequence
cagatgttaagtgtaaagttg

SEQ ID NO: 129808 - DNA, 21 bp, Artificial sequence
  SiRNA target sequence
agatgttaagtgtaaagttga

SEQ ID NO: 129809 - DNA, 21 bp, Artificial sequence
  SiRNA target sequence
gatgttaagtgtaaagttgaa

SEQ ID NO: 129810 - DNA, 21 bp, Artificial sequence
  SiRNA target sequence
atgttaagtgtaaagttgaag

SEQ ID NO: 129811 - DNA, 21 bp, Artificial sequence
  SiRNA target sequence
tgttaagtgtaaagttgaaga

SEQ ID NO: 129812 - DNA, 21 bp, Artificial sequence
  SiRNA target sequence
gttaagtgtaaagttgaagat

SEQ ID NO: 129813 - DNA, 21 bp, Artificial sequence
  SiRNA target sequence
ttaagtgtaaagttgaagatt

SEQ ID NO: 129814 - DNA, 21 bp, Artificial sequence
  SiRNA target sequence
taagtgtaaagttgaagattt

SEQ ID NO: 129815 - DNA, 21 bp, Artificial sequence
  SiRNA target sequence
aagtgtaaagttgaagattta

SEQ ID NO: 129816 - DNA, 21 bp, Artificial sequence
  SiRNA target sequence
agtgtaaagttgaagatttaa

SEQ ID NO: 129817 - DNA, 21 bp, Artificial sequence
  SiRNA target sequence
gtgtaaagttgaagatttaat

SEQ ID NO: 129818 - DNA, 21 bp, Artificial sequence
  SiRNA target sequence
tgtaaagttgaagatttaata

SEQ ID NO: 129819 - DNA, 21 bp, Artificial sequence
  SiRNA target sequence
gtaaagttgaagatttaataa

SEQ ID NO: 129820 - DNA, 21 bp, Artificial sequence
  SiRNA target sequence
taaagttgaagatttaataaa

SEQ ID NO: 129821 - DNA, 21 bp, Artificial sequence
  SiRNA target sequence
aaagttgaagatttaataaaa

SEQ ID NO: 129822 - DNA, 21 bp, Artificial sequence
  SiRNA target sequence
aagttgaagatttaataaaac

SEQ ID NO: 129823 - DNA, 21 bp, Artificial sequence
  SiRNA target sequence
agttgaagatttaataaaacc

SEQ ID NO: 129824 - DNA, 21 bp, Artificial sequence
  SiRNA target sequence
gttgaagatttaataaaaccg

SEQ ID NO: 129825 - DNA, 21 bp, Artificial sequence
  SiRNA target sequence
ttgaagatttaataaaaccga

SEQ ID NO: 129826 - DNA, 21 bp, Artificial sequence
  SiRNA target sequence
tgaagatttaataaaaccgac

SEQ ID NO: 129827 - DNA, 21 bp, Artificial sequence
  SiRNA target sequence
gaagatttaataaaaccgact

SEQ ID NO: 129828 - DNA, 21 bp, Artificial sequence
  SiRNA target sequence
aagatttaataaaaccgactg

SEQ ID NO: 129829 - DNA, 21 bp, Artificial sequence
  SiRNA target sequence
agatttaataaaaccgactga

SEQ ID NO: 129830 - DNA, 21 bp, Artificial sequence
  SiRNA target sequence
gatttaataaaaccgactgaa

SEQ ID NO: 129831 - DNA, 21 bp, Artificial sequence
  SiRNA target sequence
atttaataaaaccgactgaag

SEQ ID NO: 129832 - DNA, 21 bp, Artificial sequence
  SiRNA target sequence
tttaataaaaccgactgaaga

SEQ ID NO: 129833 - DNA, 21 bp, Artificial sequence
  SiRNA target sequence
ttaataaaaccgactgaagaa

SEQ ID NO: 129834 - DNA, 21 bp, Artificial sequence
  SiRNA target sequence
taataaaaccgactgaagaag

SEQ ID NO: 129835 - DNA, 21 bp, Artificial sequence
  SiRNA target sequence
aataaaaccgactgaagaaga

SEQ ID NO: 129836 - DNA, 21 bp, Artificial sequence
  SiRNA target sequence
ataaaaccgactgaagaagat

SEQ ID NO: 129837 - DNA, 21 bp, Artificial sequence
  SiRNA target sequence
taaaaccgactgaagaagatc

SEQ ID NO: 129838 - DNA, 21 bp, Artificial sequence
  SiRNA target sequence
aaaaccgactgaagaagatct

SEQ ID NO: 129839 - DNA, 21 bp, Artificial sequence
  SiRNA target sequence
aaaccgactgaagaagatcta

SEQ ID NO: 129840 - DNA, 21 bp, Artificial sequence
  SiRNA target sequence
aaccgactgaagaagatctaa

SEQ ID NO: 129841 - DNA, 21 bp, Artificial sequence
  SiRNA target sequence
accgactgaagaagatctaaa

SEQ ID NO: 129842 - DNA, 21 bp, Artificial sequence
  SiRNA target sequence
ccgactgaagaagatctaaac

SEQ ID NO: 129843 - DNA, 21 bp, Artificial sequence
  SiRNA target sequence
cgactgaagaagatctaaact

SEQ ID NO: 129844 - DNA, 21 bp, Artificial sequence
  SiRNA target sequence
gactgaagaagatctaaactt

SEQ ID NO: 129845 - DNA, 21 bp, Artificial sequence
  SiRNA target sequence
actgaagaagatctaaacttt

SEQ ID NO: 129846 - DNA, 21 bp, Artificial sequence
  SiRNA target sequence
ctgaagaagatctaaactttc

SEQ ID NO: 129847 - DNA, 21 bp, Artificial sequence
  SiRNA target sequence
tgaagaagatctaaactttct

SEQ ID NO: 129848 - DNA, 21 bp, Artificial sequence
  SiRNA target sequence
gaagaagatctaaactttctt

SEQ ID NO: 129849 - DNA, 21 bp, Artificial sequence
  SiRNA target sequence
aagaagatctaaactttctta

SEQ ID NO: 129850 - DNA, 21 bp, Artificial sequence
  SiRNA target sequence
agaagatctaaactttcttat

SEQ ID NO: 129851 - DNA, 21 bp, Artificial sequence
  SiRNA target sequence
gaagatctaaactttcttatt

SEQ ID NO: 129852 - DNA, 21 bp, Artificial sequence
  SiRNA target sequence
aagatctaaactttcttattc

SEQ ID NO: 129853 - DNA, 21 bp, Artificial sequence
  SiRNA target sequence
agatctaaactttcttattca

SEQ ID NO: 129854 - DNA, 21 bp, Artificial sequence
  SiRNA target sequence
gatctaaactttcttattcac

SEQ ID NO: 129855 - DNA, 21 bp, Artificial sequence
  SiRNA target sequence
atctaaactttcttattcacg

SEQ ID NO: 129856 - DNA, 21 bp, Artificial sequence
  SiRNA target sequence
tctaaactttcttattcacga

SEQ ID NO: 129857 - DNA, 21 bp, Artificial sequence
  SiRNA target sequence
ctaaactttcttattcacgag

SEQ ID NO: 129858 - DNA, 21 bp, Artificial sequence
  SiRNA target sequence
taaactttcttattcacgagg

SEQ ID NO: 129859 - DNA, 21 bp, Artificial sequence
  SiRNA target sequence
aaactttcttattcacgaggc

SEQ ID NO: 129860 - DNA, 21 bp, Artificial sequence
  SiRNA target sequence
aactttcttattcacgaggcc

SEQ ID NO: 129861 - DNA, 21 bp, Artificial sequence
  SiRNA target sequence
actttcttattcacgaggcca

SEQ ID NO: 129862 - DNA, 21 bp, Artificial sequence
  SiRNA target sequence
ctttcttattcacgaggccaa

SEQ ID NO: 129863 - DNA, 21 bp, Artificial sequence
  SiRNA target sequence
tttcttattcacgaggccaat

SEQ ID NO: 129864 - DNA, 21 bp, Artificial sequence
  SiRNA target sequence
ttcttattcacgaggccaatt

SEQ ID NO: 129865 - DNA, 21 bp, Artificial sequence
  SiRNA target sequence
tcttattcacgaggccaatta

SEQ ID NO: 129866 - DNA, 21 bp, Artificial sequence
  SiRNA target sequence
cttattcacgaggccaattat

SEQ ID NO: 129867 - DNA, 21 bp, Artificial sequence
  SiRNA target sequence
ttattcacgaggccaattatt

SEQ ID NO: 129868 - DNA, 21 bp, Artificial sequence
  SiRNA target sequence
tattcacgaggccaattattt

SEQ ID NO: 129869 - DNA, 21 bp, Artificial sequence
  SiRNA target sequence
attcacgaggccaattatttt

SEQ ID NO: 129870 - DNA, 21 bp, Artificial sequence
  SiRNA target sequence
ttcacgaggccaattatttta

SEQ ID NO: 129871 - DNA, 21 bp, Artificial sequence
  SiRNA target sequence
tcacgaggccaattattttac

SEQ ID NO: 129872 - DNA, 21 bp, Artificial sequence
  SiRNA target sequence
cacgaggccaattattttaca

SEQ ID NO: 129873 - DNA, 21 bp, Artificial sequence
  SiRNA target sequence
acgaggccaattattttacag

SEQ ID NO: 129874 - DNA, 21 bp, Artificial sequence
  SiRNA target sequence
cgaggccaattattttacaga

SEQ ID NO: 129875 - DNA, 21 bp, Artificial sequence
  SiRNA target sequence
gaggccaattattttacagat

SEQ ID NO: 129876 - DNA, 21 bp, Artificial sequence
  SiRNA target sequence
aggccaattattttacagatc

SEQ ID NO: 129877 - DNA, 21 bp, Artificial sequence
  SiRNA target sequence
ggccaattattttacagatca

SEQ ID NO: 129878 - DNA, 21 bp, Artificial sequence
  SiRNA target sequence
gccaattattttacagatcac

SEQ ID NO: 129879 - DNA, 21 bp, Artificial sequence
  SiRNA target sequence
ccaattattttacagatcaca

SEQ ID NO: 129880 - DNA, 21 bp, Artificial sequence
  SiRNA target sequence
caattattttacagatcacaa

SEQ ID NO: 129881 - DNA, 21 bp, Artificial sequence
  SiRNA target sequence
aattattttacagatcacaat

SEQ ID NO: 129882 - DNA, 21 bp, Artificial sequence
  SiRNA target sequence
attattttacagatcacaatt

SEQ ID NO: 129883 - DNA, 21 bp, Artificial sequence
  SiRNA target sequence
ttattttacagatcacaattt

SEQ ID NO: 129884 - DNA, 21 bp, Artificial sequence
  SiRNA target sequence
tattttacagatcacaattta

SEQ ID NO: 129885 - DNA, 21 bp, Artificial sequence
  SiRNA target sequence
attttacagatcacaatttaa

SEQ ID NO: 129886 - DNA, 21 bp, Artificial sequence
  SiRNA target sequence
ttttacagatcacaatttaaa

SEQ ID NO: 129887 - DNA, 21 bp, Artificial sequence
  SiRNA target sequence
tttacagatcacaatttaaaa

SEQ ID NO: 129888 - DNA, 21 bp, Artificial sequence
  SiRNA target sequence
ttacagatcacaatttaaaat

SEQ ID NO: 129889 - DNA, 21 bp, Artificial sequence
  SiRNA target sequence
tacagatcacaatttaaaatt

SEQ ID NO: 129890 - DNA, 21 bp, Artificial sequence
  SiRNA target sequence
acagatcacaatttaaaatta

SEQ ID NO: 129891 - DNA, 21 bp, Artificial sequence
  SiRNA target sequence
cagatcacaatttaaaattaa

SEQ ID NO: 129892 - DNA, 21 bp, Artificial sequence
  SiRNA target sequence
agatcacaatttaaaattaac

SEQ ID NO: 129893 - DNA, 21 bp, Artificial sequence
  SiRNA target sequence
gatcacaatttaaaattaaca

SEQ ID NO: 129894 - DNA, 21 bp, Artificial sequence
  SiRNA target sequence
atcacaatttaaaattaacaa

SEQ ID NO: 129895 - DNA, 21 bp, Artificial sequence
  SiRNA target sequence
tcacaatttaaaattaacaaa

SEQ ID NO: 129896 - DNA, 21 bp, Artificial sequence
  SiRNA target sequence
cacaatttaaaattaacaaaa

SEQ ID NO: 129897 - DNA, 21 bp, Artificial sequence
  SiRNA target sequence
acaatttaaaattaacaaaaa

SEQ ID NO: 129898 - DNA, 21 bp, Artificial sequence
  SiRNA target sequence
caatttaaaattaacaaaaaa

SEQ ID NO: 129899 - DNA, 21 bp, Artificial sequence
  SiRNA target sequence
aatttaaaattaacaaaaaaa

SEQ ID NO: 129900 - DNA, 21 bp, Artificial sequence
  SiRNA target sequence
atttaaaattaacaaaaaaag

SEQ ID NO: 129901 - DNA, 21 bp, Artificial sequence
  SiRNA target sequence
tttaaaattaacaaaaaaaga

SEQ ID NO: 129902 - DNA, 21 bp, Artificial sequence
  SiRNA target sequence
ttaaaattaacaaaaaaagat

SEQ ID NO: 129903 - DNA, 21 bp, Artificial sequence
  SiRNA target sequence
taaaattaacaaaaaaagatg

SEQ ID NO: 129904 - DNA, 21 bp, Artificial sequence
  SiRNA target sequence
aaaattaacaaaaaaagatgt

SEQ ID NO: 129905 - DNA, 21 bp, Artificial sequence
  SiRNA target sequence
aaattaacaaaaaaagatgtt

SEQ ID NO: 129906 - DNA, 21 bp, Artificial sequence
  SiRNA target sequence
aattaacaaaaaaagatgttt

SEQ ID NO: 129907 - DNA, 21 bp, Artificial sequence
  SiRNA target sequence
attaacaaaaaaagatgtttt

SEQ ID NO: 129908 - DNA, 21 bp, Artificial sequence
  SiRNA target sequence
ttaacaaaaaaagatgttttg

SEQ ID NO: 129909 - DNA, 21 bp, Artificial sequence
  SiRNA target sequence
taacaaaaaaagatgttttgt

SEQ ID NO: 129910 - DNA, 21 bp, Artificial sequence
  SiRNA target sequence
aacaaaaaaagatgttttgtc

SEQ ID NO: 129911 - DNA, 21 bp, Artificial sequence
  SiRNA target sequence
acaaaaaaagatgttttgtct

SEQ ID NO: 129912 - DNA, 21 bp, Artificial sequence
  SiRNA target sequence
caaaaaaagatgttttgtctg

SEQ ID NO: 129913 - DNA, 21 bp, Artificial sequence
  SiRNA target sequence
aaaaaaagatgttttgtctgt

SEQ ID NO: 129914 - DNA, 21 bp, Artificial sequence
  SiRNA target sequence
aaaaaagatgttttgtctgtt

SEQ ID NO: 129915 - DNA, 21 bp, Artificial sequence
  SiRNA target sequence
aaaaagatgttttgtctgttt

SEQ ID NO: 129916 - DNA, 21 bp, Artificial sequence
  SiRNA target sequence
aaaagatgttttgtctgtttg

SEQ ID NO: 129917 - DNA, 21 bp, Artificial sequence
  SiRNA target sequence
aaagatgttttgtctgtttgg

SEQ ID NO: 129918 - DNA, 21 bp, Artificial sequence
  SiRNA target sequence
aagatgttttgtctgtttgga

SEQ ID NO: 129919 - DNA, 21 bp, Artificial sequence
  SiRNA target sequence
agatgttttgtctgtttggac

SEQ ID NO: 129920 - DNA, 21 bp, Artificial sequence
  SiRNA target sequence
gatgttttgtctgtttggaca

SEQ ID NO: 129921 - DNA, 21 bp, Artificial sequence
  SiRNA target sequence
atgttttgtctgtttggacag

SEQ ID NO: 129922 - DNA, 21 bp, Artificial sequence
  SiRNA target sequence
tgttttgtctgtttggacagg

SEQ ID NO: 129923 - DNA, 21 bp, Artificial sequence
  SiRNA target sequence
gttttgtctgtttggacaggt

SEQ ID NO: 129924 - DNA, 21 bp, Artificial sequence
  SiRNA target sequence
ttttgtctgtttggacaggta

SEQ ID NO: 129925 - DNA, 21 bp, Artificial sequence
  SiRNA target sequence
tttgtctgtttggacaggtat

SEQ ID NO: 129926 - DNA, 21 bp, Artificial sequence
  SiRNA target sequence
ttgtctgtttggacaggtatt

SEQ ID NO: 129927 - DNA, 21 bp, Artificial sequence
  SiRNA target sequence
tgtctgtttggacaggtatta

SEQ ID NO: 129928 - DNA, 21 bp, Artificial sequence
  SiRNA target sequence
gtctgtttggacaggtattag

SEQ ID NO: 129929 - DNA, 21 bp, Artificial sequence
  SiRNA target sequence
tctgtttggacaggtattaga

SEQ ID NO: 129930 - DNA, 21 bp, Artificial sequence
  SiRNA target sequence
ctgtttggacaggtattagac

SEQ ID NO: 129931 - DNA, 21 bp, Artificial sequence
  SiRNA target sequence
tgtttggacaggtattagacc

SEQ ID NO: 129932 - DNA, 21 bp, Artificial sequence
  SiRNA target sequence
gtttggacaggtattagaccg

SEQ ID NO: 129933 - DNA, 21 bp, Artificial sequence
  SiRNA target sequence
tttggacaggtattagaccgt

SEQ ID NO: 129934 - DNA, 21 bp, Artificial sequence
  SiRNA target sequence
ttggacaggtattagaccgtt

SEQ ID NO: 129935 - DNA, 21 bp, Artificial sequence
  SiRNA target sequence
tggacaggtattagaccgtta

SEQ ID NO: 129936 - DNA, 21 bp, Artificial sequence
  SiRNA target sequence
ggacaggtattagaccgttag

SEQ ID NO: 129937 - DNA, 21 bp, Artificial sequence
  SiRNA target sequence
gacaggtattagaccgttagt

SEQ ID NO: 129938 - DNA, 21 bp, Artificial sequence
  SiRNA target sequence
acaggtattagaccgttagtc

SEQ ID NO: 129939 - DNA, 21 bp, Artificial sequence
  SiRNA target sequence
caggtattagaccgttagtca

SEQ ID NO: 129940 - DNA, 21 bp, Artificial sequence
  SiRNA target sequence
aggtattagaccgttagtcaa

SEQ ID NO: 129941 - DNA, 21 bp, Artificial sequence
  SiRNA target sequence
ggtattagaccgttagtcaag

SEQ ID NO: 129942 - DNA, 21 bp, Artificial sequence
  SiRNA target sequence
gtattagaccgttagtcaagg

SEQ ID NO: 129943 - DNA, 21 bp, Artificial sequence
  SiRNA target sequence
tattagaccgttagtcaagga

SEQ ID NO: 129944 - DNA, 21 bp, Artificial sequence
  SiRNA target sequence
attagaccgttagtcaaggat

SEQ ID NO: 129945 - DNA, 21 bp, Artificial sequence
  SiRNA target sequence
ttagaccgttagtcaaggatt

SEQ ID NO: 129946 - DNA, 21 bp, Artificial sequence
  SiRNA target sequence
tagaccgttagtcaaggattt

SEQ ID NO: 129947 - DNA, 21 bp, Artificial sequence
  SiRNA target sequence
agaccgttagtcaaggattta

SEQ ID NO: 129948 - DNA, 21 bp, Artificial sequence
  SiRNA target sequence
gaccgttagtcaaggatttat

SEQ ID NO: 129949 - DNA, 21 bp, Artificial sequence
  SiRNA target sequence
accgttagtcaaggatttatc

SEQ ID NO: 129950 - DNA, 21 bp, Artificial sequence
  SiRNA target sequence
ccgttagtcaaggatttatcg

SEQ ID NO: 129951 - DNA, 21 bp, Artificial sequence
  SiRNA target sequence
cgttagtcaaggatttatcga

SEQ ID NO: 129952 - DNA, 21 bp, Artificial sequence
  SiRNA target sequence
gttagtcaaggatttatcgaa

SEQ ID NO: 129953 - DNA, 21 bp, Artificial sequence
  SiRNA target sequence
ttagtcaaggatttatcgaaa

SEQ ID NO: 129954 - DNA, 21 bp, Artificial sequence
  SiRNA target sequence
tagtcaaggatttatcgaaaa

SEQ ID NO: 129955 - DNA, 21 bp, Artificial sequence
  SiRNA target sequence
agtcaaggatttatcgaaaag

SEQ ID NO: 129956 - DNA, 21 bp, Artificial sequence
  SiRNA target sequence
gtcaaggatttatcgaaaagt

SEQ ID NO: 129957 - DNA, 21 bp, Artificial sequence
  SiRNA target sequence
tcaaggatttatcgaaaagtt

SEQ ID NO: 129958 - DNA, 21 bp, Artificial sequence
  SiRNA target sequence
caaggatttatcgaaaagttc

SEQ ID NO: 129959 - DNA, 21 bp, Artificial sequence
  SiRNA target sequence
aaggatttatcgaaaagttca

SEQ ID NO: 129960 - DNA, 21 bp, Artificial sequence
  SiRNA target sequence
aggatttatcgaaaagttcaa

SEQ ID NO: 129961 - DNA, 21 bp, Artificial sequence
  SiRNA target sequence
ggatttatcgaaaagttcaac

SEQ ID NO: 129962 - DNA, 21 bp, Artificial sequence
  SiRNA target sequence
gatttatcgaaaagttcaaca

SEQ ID NO: 129963 - DNA, 21 bp, Artificial sequence
  SiRNA target sequence
atttatcgaaaagttcaacag

SEQ ID NO: 129964 - DNA, 21 bp, Artificial sequence
  SiRNA target sequence
tttatcgaaaagttcaacaga

SEQ ID NO: 129965 - DNA, 21 bp, Artificial sequence
  SiRNA target sequence
ttatcgaaaagttcaacagaa

SEQ ID NO: 129966 - DNA, 21 bp, Artificial sequence
  SiRNA target sequence
tatcgaaaagttcaacagaaa

SEQ ID NO: 129967 - DNA, 21 bp, Artificial sequence
  SiRNA target sequence
atcgaaaagttcaacagaaaa

SEQ ID NO: 129968 - DNA, 21 bp, Artificial sequence
  SiRNA target sequence
tcgaaaagttcaacagaaaag

SEQ ID NO: 129969 - DNA, 21 bp, Artificial sequence
  SiRNA target sequence
cgaaaagttcaacagaaaaga

SEQ ID NO: 129970 - DNA, 21 bp, Artificial sequence
  SiRNA target sequence
gaaaagttcaacagaaaagat

SEQ ID NO: 129971 - DNA, 21 bp, Artificial sequence
  SiRNA target sequence
aaaagttcaacagaaaagata

SEQ ID NO: 129972 - DNA, 21 bp, Artificial sequence
  SiRNA target sequence
aaagttcaacagaaaagatat

SEQ ID NO: 129973 - DNA, 21 bp, Artificial sequence
  SiRNA target sequence
aagttcaacagaaaagatatg

SEQ ID NO: 129974 - DNA, 21 bp, Artificial sequence
  SiRNA target sequence
agttcaacagaaaagatatgt

SEQ ID NO: 129975 - DNA, 21 bp, Artificial sequence
  SiRNA target sequence
gttcaacagaaaagatatgta

SEQ ID NO: 129976 - DNA, 21 bp, Artificial sequence
  SiRNA target sequence
ttcaacagaaaagatatgtag

SEQ ID NO: 129977 - DNA, 21 bp, Artificial sequence
  SiRNA target sequence
tcaacagaaaagatatgtaga

SEQ ID NO: 129978 - DNA, 21 bp, Artificial sequence
  SiRNA target sequence
caacagaaaagatatgtagaa

SEQ ID NO: 129979 - DNA, 21 bp, Artificial sequence
  SiRNA target sequence
aacagaaaagatatgtagaaa

SEQ ID NO: 129980 - DNA, 21 bp, Artificial sequence
  SiRNA target sequence
acagaaaagatatgtagaaaa

SEQ ID NO: 129981 - DNA, 21 bp, Artificial sequence
  SiRNA target sequence
cagaaaagatatgtagaaaac

SEQ ID NO: 129982 - DNA, 21 bp, Artificial sequence
  SiRNA target sequence
agaaaagatatgtagaaaaca

SEQ ID NO: 129983 - DNA, 21 bp, Artificial sequence
  SiRNA target sequence
gaaaagatatgtagaaaacat

SEQ ID NO: 129984 - DNA, 21 bp, Artificial sequence
  SiRNA target sequence
aaaagatatgtagaaaacata

SEQ ID NO: 129985 - DNA, 21 bp, Artificial sequence
  SiRNA target sequence
aaagatatgtagaaaacatac

SEQ ID NO: 129986 - DNA, 21 bp, Artificial sequence
  SiRNA target sequence
aagatatgtagaaaacatact

SEQ ID NO: 129987 - DNA, 21 bp, Artificial sequence
  SiRNA target sequence
agatatgtagaaaacatacta

SEQ ID NO: 129988 - DNA, 21 bp, Artificial sequence
  SiRNA target sequence
gatatgtagaaaacatactat

SEQ ID NO: 129989 - DNA, 21 bp, Artificial sequence
  SiRNA target sequence
atatgtagaaaacatactata

SEQ ID NO: 129990 - DNA, 21 bp, Artificial sequence
  SiRNA target sequence
tatgtagaaaacatactataa

SEQ ID NO: 129991 - DNA, 21 bp, Artificial sequence
  SiRNA target sequence
atgtagaaaacatactataag

SEQ ID NO: 129992 - DNA, 21 bp, Artificial sequence
  SiRNA target sequence
tgtagaaaacatactataaga

SEQ ID NO: 129993 - DNA, 21 bp, Artificial sequence
  SiRNA target sequence
gtagaaaacatactataagaa

SEQ ID NO: 129994 - DNA, 21 bp, Artificial sequence
  SiRNA target sequence
tagaaaacatactataagaat

SEQ ID NO: 129995 - DNA, 21 bp, Artificial sequence
  SiRNA target sequence
agaaaacatactataagaata

SEQ ID NO: 129996 - DNA, 21 bp, Artificial sequence
  SiRNA target sequence
gaaaacatactataagaatag

SEQ ID NO: 129997 - DNA, 21 bp, Artificial sequence
  SiRNA target sequence
aaaacatactataagaataga

SEQ ID NO: 129998 - DNA, 21 bp, Artificial sequence
  SiRNA target sequence
aaacatactataagaatagat

SEQ ID NO: 129999 - DNA, 21 bp, Artificial sequence
  SiRNA target sequence
aacatactataagaatagata

SEQ ID NO: 130000 - DNA, 21 bp, Artificial sequence
  SiRNA target sequence
acatactataagaatagataa

SEQ ID NO: 130001 - DNA, 21 bp, Artificial sequence
  SiRNA target sequence
catactataagaatagataaa

SEQ ID NO: 130002 - DNA, 21 bp, Artificial sequence
  SiRNA target sequence
atactataagaatagataaag

SEQ ID NO: 130003 - DNA, 21 bp, Artificial sequence
  SiRNA target sequence
tactataagaatagataaaga

SEQ ID NO: 130004 - DNA, 21 bp, Artificial sequence
  SiRNA target sequence
actataagaatagataaagac

SEQ ID NO: 130005 - DNA, 21 bp, Artificial sequence
  SiRNA target sequence
ctataagaatagataaagaca

SEQ ID NO: 130006 - DNA, 21 bp, Artificial sequence
  SiRNA target sequence
tataagaatagataaagacaa

SEQ ID NO: 130007 - DNA, 21 bp, Artificial sequence
  SiRNA target sequence
ataagaatagataaagacaat

SEQ ID NO: 130008 - DNA, 21 bp, Artificial sequence
  SiRNA target sequence
taagaatagataaagacaata

SEQ ID NO: 130009 - DNA, 21 bp, Artificial sequence
  SiRNA target sequence
aagaatagataaagacaatat

SEQ ID NO: 130010 - DNA, 21 bp, Artificial sequence
  SiRNA target sequence
agaatagataaagacaatatg

SEQ ID NO: 130011 - DNA, 21 bp, Artificial sequence
  SiRNA target sequence
gaatagataaagacaatatgg

SEQ ID NO: 130012 - DNA, 21 bp, Artificial sequence
  SiRNA target sequence
aatagataaagacaatatggt

SEQ ID NO: 130013 - DNA, 21 bp, Artificial sequence
  SiRNA target sequence
atagataaagacaatatggta

SEQ ID NO: 130014 - DNA, 21 bp, Artificial sequence
  SiRNA target sequence
tagataaagacaatatggtaa

SEQ ID NO: 130015 - DNA, 21 bp, Artificial sequence
  SiRNA target sequence
agataaagacaatatggtaac

SEQ ID NO: 130016 - DNA, 21 bp, Artificial sequence
  SiRNA target sequence
gataaagacaatatggtaact

SEQ ID NO: 130017 - DNA, 21 bp, Artificial sequence
  SiRNA target sequence
ataaagacaatatggtaactg

SEQ ID NO: 130018 - DNA, 21 bp, Artificial sequence
  SiRNA target sequence
taaagacaatatggtaactgt

SEQ ID NO: 130019 - DNA, 21 bp, Artificial sequence
  SiRNA target sequence
aaagacaatatggtaactgta

SEQ ID NO: 130020 - DNA, 21 bp, Artificial sequence
  SiRNA target sequence
aagacaatatggtaactgtaa

SEQ ID NO: 130021 - DNA, 21 bp, Artificial sequence
  SiRNA target sequence
agacaatatggtaactgtaac

SEQ ID NO: 130022 - DNA, 21 bp, Artificial sequence
  SiRNA target sequence
gacaatatggtaactgtaaca

SEQ ID NO: 130023 - DNA, 21 bp, Artificial sequence
  SiRNA target sequence
acaatatggtaactgtaacag

SEQ ID NO: 130024 - DNA, 21 bp, Artificial sequence
  SiRNA target sequence
caatatggtaactgtaacagg

SEQ ID NO: 130025 - DNA, 21 bp, Artificial sequence
  SiRNA target sequence
aatatggtaactgtaacaggt

SEQ ID NO: 130026 - DNA, 21 bp, Artificial sequence
  SiRNA target sequence
atatggtaactgtaacaggtg

SEQ ID NO: 130027 - DNA, 21 bp, Artificial sequence
  SiRNA target sequence
tatggtaactgtaacaggtgg

SEQ ID NO: 130028 - DNA, 21 bp, Artificial sequence
  SiRNA target sequence
atggtaactgtaacaggtggt

SEQ ID NO: 130029 - DNA, 21 bp, Artificial sequence
  SiRNA target sequence
tggtaactgtaacaggtggta

SEQ ID NO: 130030 - DNA, 21 bp, Artificial sequence
  SiRNA target sequence
ggtaactgtaacaggtggtaa

SEQ ID NO: 130031 - DNA, 21 bp, Artificial sequence
  SiRNA target sequence
gtaactgtaacaggtggtaag

SEQ ID NO: 130032 - DNA, 21 bp, Artificial sequence
  SiRNA target sequence
taactgtaacaggtggtaagt

SEQ ID NO: 130033 - DNA, 21 bp, Artificial sequence
  SiRNA target sequence
aactgtaacaggtggtaagtg

SEQ ID NO: 130034 - DNA, 21 bp, Artificial sequence
  SiRNA target sequence
actgtaacaggtggtaagtgg

SEQ ID NO: 130035 - DNA, 21 bp, Artificial sequence
  SiRNA target sequence
ctgtaacaggtggtaagtgga

SEQ ID NO: 130036 - DNA, 21 bp, Artificial sequence
  SiRNA target sequence
tgtaacaggtggtaagtggac

SEQ ID NO: 130037 - DNA, 21 bp, Artificial sequence
  SiRNA target sequence
gtaacaggtggtaagtggaca

SEQ ID NO: 130038 - DNA, 21 bp, Artificial sequence
  SiRNA target sequence
taacaggtggtaagtggacaa

SEQ ID NO: 130039 - DNA, 21 bp, Artificial sequence
  SiRNA target sequence
aacaggtggtaagtggacaat

SEQ ID NO: 130040 - DNA, 21 bp, Artificial sequence
  SiRNA target sequence
acaggtggtaagtggacaatt

SEQ ID NO: 130041 - DNA, 21 bp, Artificial sequence
  SiRNA target sequence
caggtggtaagtggacaattt

SEQ ID NO: 130042 - DNA, 21 bp, Artificial sequence
  SiRNA target sequence
aggtggtaagtggacaatttt

SEQ ID NO: 130043 - DNA, 21 bp, Artificial sequence
  SiRNA target sequence
ggtggtaagtggacaattttt

SEQ ID NO: 130044 - DNA, 21 bp, Artificial sequence
  SiRNA target sequence
gtggtaagtggacaatttttc

SEQ ID NO: 130045 - DNA, 21 bp, Artificial sequence
  SiRNA target sequence
tggtaagtggacaatttttcg

SEQ ID NO: 130046 - DNA, 21 bp, Artificial sequence
  SiRNA target sequence
ggtaagtggacaatttttcga

SEQ ID NO: 130047 - DNA, 21 bp, Artificial sequence
  SiRNA target sequence
gtaagtggacaatttttcgac

SEQ ID NO: 130048 - DNA, 21 bp, Artificial sequence
  SiRNA target sequence
taagtggacaatttttcgact

SEQ ID NO: 130049 - DNA, 21 bp, Artificial sequence
  SiRNA target sequence
aagtggacaatttttcgactt

SEQ ID NO: 130050 - DNA, 21 bp, Artificial sequence
  SiRNA target sequence
agtggacaatttttcgactta

SEQ ID NO: 130051 - DNA, 21 bp, Artificial sequence
  SiRNA target sequence
gtggacaatttttcgacttat

SEQ ID NO: 130052 - DNA, 21 bp, Artificial sequence
  SiRNA target sequence
tggacaatttttcgacttatg

SEQ ID NO: 130053 - DNA, 21 bp, Artificial sequence
  SiRNA target sequence
ggacaatttttcgacttatgg

SEQ ID NO: 130054 - DNA, 21 bp, Artificial sequence
  SiRNA target sequence
gacaatttttcgacttatggg

SEQ ID NO: 130055 - DNA, 21 bp, Artificial sequence
  SiRNA target sequence
acaatttttcgacttatggga

SEQ ID NO: 130056 - DNA, 21 bp, Artificial sequence
  SiRNA target sequence
caatttttcgacttatgggag

SEQ ID NO: 130057 - DNA, 21 bp, Artificial sequence
  SiRNA target sequence
aatttttcgacttatgggaga

SEQ ID NO: 130058 - DNA, 21 bp, Artificial sequence
  SiRNA target sequence
atttttcgacttatgggagaa

SEQ ID NO: 130059 - DNA, 21 bp, Artificial sequence
  SiRNA target sequence
tttttcgacttatgggagaac

SEQ ID NO: 130060 - DNA, 21 bp, Artificial sequence
  SiRNA target sequence
ttttcgacttatgggagaaca

SEQ ID NO: 130061 - DNA, 21 bp, Artificial sequence
  SiRNA target sequence
tttcgacttatgggagaacag

SEQ ID NO: 130062 - DNA, 21 bp, Artificial sequence
  SiRNA target sequence
ttcgacttatgggagaacaga

SEQ ID NO: 130063 - DNA, 21 bp, Artificial sequence
  SiRNA target sequence
tcgacttatgggagaacagac

SEQ ID NO: 130064 - DNA, 21 bp, Artificial sequence
  SiRNA target sequence
cgacttatgggagaacagaca

SEQ ID NO: 130065 - DNA, 21 bp, Artificial sequence
  SiRNA target sequence
gacttatgggagaacagacaa

SEQ ID NO: 130066 - DNA, 21 bp, Artificial sequence
  SiRNA target sequence
acttatgggagaacagacaat

SEQ ID NO: 130067 - DNA, 21 bp, Artificial sequence
  SiRNA target sequence
cttatgggagaacagacaata

SEQ ID NO: 130068 - DNA, 21 bp, Artificial sequence
  SiRNA target sequence
ttatgggagaacagacaataa

SEQ ID NO: 130069 - DNA, 21 bp, Artificial sequence
  SiRNA target sequence
tatgggagaacagacaataaa

SEQ ID NO: 130070 - DNA, 21 bp, Artificial sequence
  SiRNA target sequence
atgggagaacagacaataaat

SEQ ID NO: 130071 - DNA, 21 bp, Artificial sequence
  SiRNA target sequence
tgggagaacagacaataaatc

SEQ ID NO: 130072 - DNA, 21 bp, Artificial sequence
  SiRNA target sequence
gggagaacagacaataaatca

SEQ ID NO: 130073 - DNA, 21 bp, Artificial sequence
  SiRNA target sequence
ggagaacagacaataaatcaa

SEQ ID NO: 130074 - DNA, 21 bp, Artificial sequence
  SiRNA target sequence
gagaacagacaataaatcaaa

SEQ ID NO: 130075 - DNA, 21 bp, Artificial sequence
  SiRNA target sequence
agaacagacaataaatcaaat

SEQ ID NO: 130076 - DNA, 21 bp, Artificial sequence
  SiRNA target sequence
gaacagacaataaatcaaatt

SEQ ID NO: 130077 - DNA, 21 bp, Artificial sequence
  SiRNA target sequence
aacagacaataaatcaaatta

SEQ ID NO: 130078 - DNA, 21 bp, Artificial sequence
  SiRNA target sequence
acagacaataaatcaaattat

SEQ ID NO: 130079 - DNA, 21 bp, Artificial sequence
  SiRNA target sequence
cagacaataaatcaaattata

SEQ ID NO: 130080 - DNA, 21 bp, Artificial sequence
  SiRNA target sequence
agacaataaatcaaattataa

SEQ ID NO: 130081 - DNA, 21 bp, Artificial sequence
  SiRNA target sequence
gacaataaatcaaattataaa

SEQ ID NO: 130082 - DNA, 21 bp, Artificial sequence
  SiRNA target sequence
acaataaatcaaattataaaa

SEQ ID NO: 130083 - DNA, 21 bp, Artificial sequence
  SiRNA target sequence
caataaatcaaattataaaag

SEQ ID NO: 130084 - DNA, 21 bp, Artificial sequence
  SiRNA target sequence
aataaatcaaattataaaagt

SEQ ID NO: 130085 - DNA, 21 bp, Artificial sequence
  SiRNA target sequence
ataaatcaaattataaaagtt

SEQ ID NO: 130086 - DNA, 21 bp, Artificial sequence
  SiRNA target sequence
taaatcaaattataaaagttt

SEQ ID NO: 130087 - DNA, 21 bp, Artificial sequence
  SiRNA target sequence
aaatcaaattataaaagtttt

SEQ ID NO: 130088 - DNA, 21 bp, Artificial sequence
  SiRNA target sequence
aatcaaattataaaagttttt

SEQ ID NO: 130089 - DNA, 21 bp, Artificial sequence
  SiRNA target sequence
atcaaattataaaagttttta

SEQ ID NO: 130090 - DNA, 21 bp, Artificial sequence
  SiRNA target sequence
tcaaattataaaagtttttaa

SEQ ID NO: 130091 - DNA, 21 bp, Artificial sequence
  SiRNA target sequence
caaattataaaagtttttaat

SEQ ID NO: 130092 - DNA, 21 bp, Artificial sequence
  SiRNA target sequence
aaattataaaagtttttaata

SEQ ID NO: 130093 - DNA, 21 bp, Artificial sequence
  SiRNA target sequence
aattataaaagtttttaatat

SEQ ID NO: 130094 - DNA, 21 bp, Artificial sequence
  SiRNA target sequence
attataaaagtttttaatata

SEQ ID NO: 130095 - DNA, 21 bp, Artificial sequence
  SiRNA target sequence
ttataaaagtttttaatataa

SEQ ID NO: 130096 - DNA, 21 bp, Artificial sequence
  SiRNA target sequence
tataaaagtttttaatataaa

SEQ ID NO: 130097 - DNA, 21 bp, Artificial sequence
  SiRNA target sequence
ataaaagtttttaatataaag

SEQ ID NO: 130098 - DNA, 21 bp, Artificial sequence
  SiRNA target sequence
taaaagtttttaatataaagt

SEQ ID NO: 130099 - DNA, 21 bp, Artificial sequence
  SiRNA target sequence
aaaagtttttaatataaagtc

SEQ ID NO: 130100 - DNA, 21 bp, Artificial sequence
  SiRNA target sequence
aaagtttttaatataaagtct

SEQ ID NO: 130101 - DNA, 21 bp, Artificial sequence
  SiRNA target sequence
aagtttttaatataaagtcta

SEQ ID NO: 130102 - DNA, 21 bp, Artificial sequence
  SiRNA target sequence
agtttttaatataaagtctaa

SEQ ID NO: 130103 - DNA, 21 bp, Artificial sequence
  SiRNA target sequence
gtttttaatataaagtctaat

SEQ ID NO: 130104 - DNA, 21 bp, Artificial sequence
  SiRNA target sequence
tttttaatataaagtctaata

SEQ ID NO: 130105 - DNA, 21 bp, Artificial sequence
  SiRNA target sequence
ttttaatataaagtctaataa

SEQ ID NO: 130106 - DNA, 21 bp, Artificial sequence
  SiRNA target sequence
tttaatataaagtctaataaa

SEQ ID NO: 130107 - DNA, 21 bp, Artificial sequence
  SiRNA target sequence
ttaatataaagtctaataaac

SEQ ID NO: 130108 - DNA, 21 bp, Artificial sequence
  SiRNA target sequence
taatataaagtctaataaacc

SEQ ID NO: 130109 - DNA, 21 bp, Artificial sequence
  SiRNA target sequence
aatataaagtctaataaacca

SEQ ID NO: 130110 - DNA, 21 bp, Artificial sequence
  SiRNA target sequence
atataaagtctaataaaccaa

SEQ ID NO: 130111 - DNA, 21 bp, Artificial sequence
  SiRNA target sequence
tataaagtctaataaaccaag

SEQ ID NO: 130112 - DNA, 21 bp, Artificial sequence
  SiRNA target sequence
ataaagtctaataaaccaagt

SEQ ID NO: 130113 - DNA, 21 bp, Artificial sequence
  SiRNA target sequence
taaagtctaataaaccaagta

SEQ ID NO: 130114 - DNA, 21 bp, Artificial sequence
  SiRNA target sequence
aaagtctaataaaccaagtat

SEQ ID NO: 130115 - DNA, 21 bp, Artificial sequence
  SiRNA target sequence
aagtctaataaaccaagtata

SEQ ID NO: 130116 - DNA, 21 bp, Artificial sequence
  SiRNA target sequence
agtctaataaaccaagtataa

SEQ ID NO: 130117 - DNA, 21 bp, Artificial sequence
  SiRNA target sequence
gtctaataaaccaagtataac

SEQ ID NO: 130118 - DNA, 21 bp, Artificial sequence
  SiRNA target sequence
tctaataaaccaagtataaca

SEQ ID NO: 130119 - DNA, 21 bp, Artificial sequence
  SiRNA target sequence
ctaataaaccaagtataacac

SEQ ID NO: 130120 - DNA, 21 bp, Artificial sequence
  SiRNA target sequence
taataaaccaagtataacaca

SEQ ID NO: 130121 - DNA, 21 bp, Artificial sequence
  SiRNA target sequence
aataaaccaagtataacacaa

SEQ ID NO: 130122 - DNA, 21 bp, Artificial sequence
  SiRNA target sequence
ataaaccaagtataacacaat

SEQ ID NO: 130123 - DNA, 21 bp, Artificial sequence
  SiRNA target sequence
taaaccaagtataacacaata

SEQ ID NO: 130124 - DNA, 21 bp, Artificial sequence
  SiRNA target sequence
aaaccaagtataacacaatat

SEQ ID NO: 130125 - DNA, 21 bp, Artificial sequence
  SiRNA target sequence
aaccaagtataacacaatatc

SEQ ID NO: 130126 - DNA, 21 bp, Artificial sequence
  SiRNA target sequence
accaagtataacacaatatct

SEQ ID NO: 130127 - DNA, 21 bp, Artificial sequence
  SiRNA target sequence
ccaagtataacacaatatctt

SEQ ID NO: 130128 - DNA, 21 bp, Artificial sequence
  SiRNA target sequence
caagtataacacaatatcttc

SEQ ID NO: 130129 - DNA, 21 bp, Artificial sequence
  SiRNA target sequence
aagtataacacaatatcttcc

SEQ ID NO: 130130 - DNA, 21 bp, Artificial sequence
  SiRNA target sequence
agtataacacaatatcttcct

SEQ ID NO: 130131 - DNA, 21 bp, Artificial sequence
  SiRNA target sequence
gtataacacaatatcttcctg

SEQ ID NO: 130132 - DNA, 21 bp, Artificial sequence
  SiRNA target sequence
tataacacaatatcttcctgt

SEQ ID NO: 130133 - DNA, 21 bp, Artificial sequence
  SiRNA target sequence
ataacacaatatcttcctgtt

SEQ ID NO: 130134 - DNA, 21 bp, Artificial sequence
  SiRNA target sequence
taacacaatatcttcctgttt

SEQ ID NO: 130135 - DNA, 21 bp, Artificial sequence
  SiRNA target sequence
aacacaatatcttcctgtttt

SEQ ID NO: 130136 - DNA, 21 bp, Artificial sequence
  SiRNA target sequence
acacaatatcttcctgttttg

SEQ ID NO: 130137 - DNA, 21 bp, Artificial sequence
  SiRNA target sequence
cacaatatcttcctgttttgg

SEQ ID NO: 130138 - DNA, 21 bp, Artificial sequence
  SiRNA target sequence
acaatatcttcctgttttggg

SEQ ID NO: 130139 - DNA, 21 bp, Artificial sequence
  SiRNA target sequence
caatatcttcctgttttggga

SEQ ID NO: 130140 - DNA, 21 bp, Artificial sequence
  SiRNA target sequence
aatatcttcctgttttgggat

SEQ ID NO: 130141 - DNA, 21 bp, Artificial sequence
  SiRNA target sequence
atatcttcctgttttgggatc

SEQ ID NO: 130142 - DNA, 21 bp, Artificial sequence
  SiRNA target sequence
tatcttcctgttttgggatca

SEQ ID NO: 130143 - DNA, 21 bp, Artificial sequence
  SiRNA target sequence
atcttcctgttttgggatcac

SEQ ID NO: 130144 - DNA, 21 bp, Artificial sequence
  SiRNA target sequence
tcttcctgttttgggatcaca

SEQ ID NO: 130145 - DNA, 21 bp, Artificial sequence
  SiRNA target sequence
cttcctgttttgggatcacag

SEQ ID NO: 130146 - DNA, 21 bp, Artificial sequence
  SiRNA target sequence
ttcctgttttgggatcacagg

SEQ ID NO: 130147 - DNA, 21 bp, Artificial sequence
  SiRNA target sequence
tcctgttttgggatcacaggg

SEQ ID NO: 130148 - DNA, 21 bp, Artificial sequence
  SiRNA target sequence
cctgttttgggatcacaggga

SEQ ID NO: 130149 - DNA, 21 bp, Artificial sequence
  SiRNA target sequence
ctgttttgggatcacagggat

SEQ ID NO: 130150 - DNA, 21 bp, Artificial sequence
  SiRNA target sequence
tgttttgggatcacagggata

SEQ ID NO: 130151 - DNA, 21 bp, Artificial sequence
  SiRNA target sequence
gttttgggatcacagggatat

SEQ ID NO: 130152 - DNA, 21 bp, Artificial sequence
  SiRNA target sequence
ttttgggatcacagggatata

SEQ ID NO: 130153 - DNA, 21 bp, Artificial sequence
  SiRNA target sequence
tttgggatcacagggatatac

SEQ ID NO: 130154 - DNA, 21 bp, Artificial sequence
  SiRNA target sequence
ttgggatcacagggatatact

SEQ ID NO: 130155 - DNA, 21 bp, Artificial sequence
  SiRNA target sequence
tgggatcacagggatatacta

SEQ ID NO: 130156 - DNA, 21 bp, Artificial sequence
  SiRNA target sequence
gggatcacagggatatactaa

SEQ ID NO: 130157 - DNA, 21 bp, Artificial sequence
  SiRNA target sequence
ggatcacagggatatactaaa

SEQ ID NO: 130158 - DNA, 21 bp, Artificial sequence
  SiRNA target sequence
gatcacagggatatactaaag

SEQ ID NO: 130159 - DNA, 21 bp, Artificial sequence
  SiRNA target sequence
atcacagggatatactaaagc

SEQ ID NO: 130160 - DNA, 21 bp, Artificial sequence
  SiRNA target sequence
tcacagggatatactaaagct

SEQ ID NO: 130161 - DNA, 21 bp, Artificial sequence
  SiRNA target sequence
cacagggatatactaaagcta

SEQ ID NO: 130162 - DNA, 21 bp, Artificial sequence
  SiRNA target sequence
acagggatatactaaagctac

SEQ ID NO: 130163 - DNA, 21 bp, Artificial sequence
  SiRNA target sequence
cagggatatactaaagctaca

SEQ ID NO: 130164 - DNA, 21 bp, Artificial sequence
  SiRNA target sequence
agggatatactaaagctacag

SEQ ID NO: 130165 - DNA, 21 bp, Artificial sequence
  SiRNA target sequence
gggatatactaaagctacaga

SEQ ID NO: 130166 - DNA, 21 bp, Artificial sequence
  SiRNA target sequence
ggatatactaaagctacagaa

SEQ ID NO: 130167 - DNA, 21 bp, Artificial sequence
  SiRNA target sequence
gatatactaaagctacagaat

SEQ ID NO: 130168 - DNA, 21 bp, Artificial sequence
  SiRNA target sequence
atatactaaagctacagaatt

SEQ ID NO: 130169 - DNA, 21 bp, Artificial sequence
  SiRNA target sequence
tatactaaagctacagaattt

SEQ ID NO: 130170 - DNA, 21 bp, Artificial sequence
  SiRNA target sequence
atactaaagctacagaatttg

SEQ ID NO: 130171 - DNA, 21 bp, Artificial sequence
  SiRNA target sequence
tactaaagctacagaatttga

SEQ ID NO: 130172 - DNA, 21 bp, Artificial sequence
  SiRNA target sequence
actaaagctacagaatttgat

SEQ ID NO: 130173 - DNA, 21 bp, Artificial sequence
  SiRNA target sequence
ctaaagctacagaatttgatt

SEQ ID NO: 130174 - DNA, 21 bp, Artificial sequence
  SiRNA target sequence
taaagctacagaatttgattt

SEQ ID NO: 130175 - DNA, 21 bp, Artificial sequence
  SiRNA target sequence
aaagctacagaatttgatttg

SEQ ID NO: 130176 - DNA, 21 bp, Artificial sequence
  SiRNA target sequence
aagctacagaatttgatttgg

SEQ ID NO: 130177 - DNA, 21 bp, Artificial sequence
  SiRNA target sequence
agctacagaatttgatttggc

SEQ ID NO: 130178 - DNA, 21 bp, Artificial sequence
  SiRNA target sequence
gctacagaatttgatttggca

SEQ ID NO: 130179 - DNA, 21 bp, Artificial sequence
  SiRNA target sequence
ctacagaatttgatttggcac

SEQ ID NO: 130180 - DNA, 21 bp, Artificial sequence
  SiRNA target sequence
tacagaatttgatttggcact

SEQ ID NO: 130181 - DNA, 21 bp, Artificial sequence
  SiRNA target sequence
acagaatttgatttggcactt

SEQ ID NO: 130182 - DNA, 21 bp, Artificial sequence
  SiRNA target sequence
cagaatttgatttggcactta

SEQ ID NO: 130183 - DNA, 21 bp, Artificial sequence
  SiRNA target sequence
agaatttgatttggcacttac

SEQ ID NO: 130184 - DNA, 21 bp, Artificial sequence
  SiRNA target sequence
gaatttgatttggcacttact

SEQ ID NO: 130185 - DNA, 21 bp, Artificial sequence
  SiRNA target sequence
aatttgatttggcacttactt

SEQ ID NO: 130186 - DNA, 21 bp, Artificial sequence
  SiRNA target sequence
atttgatttggcacttacttt

SEQ ID NO: 130187 - DNA, 21 bp, Artificial sequence
  SiRNA target sequence
tttgatttggcacttacttta

SEQ ID NO: 130188 - DNA, 21 bp, Artificial sequence
  SiRNA target sequence
ttgatttggcacttactttaa

SEQ ID NO: 130189 - DNA, 21 bp, Artificial sequence
  SiRNA target sequence
tgatttggcacttactttaaa

SEQ ID NO: 130190 - DNA, 21 bp, Artificial sequence
  SiRNA target sequence
gatttggcacttactttaaat

SEQ ID NO: 130191 - DNA, 21 bp, Artificial sequence
  SiRNA target sequence
atttggcacttactttaaata

SEQ ID NO: 130192 - DNA, 21 bp, Artificial sequence
  SiRNA target sequence
tttggcacttactttaaatat

SEQ ID NO: 130193 - DNA, 21 bp, Artificial sequence
  SiRNA target sequence
ttggcacttactttaaatatt

SEQ ID NO: 130194 - DNA, 21 bp, Artificial sequence
  SiRNA target sequence
tggcacttactttaaatattc

SEQ ID NO: 130195 - DNA, 21 bp, Artificial sequence
  SiRNA target sequence
ggcacttactttaaatattcc

SEQ ID NO: 130196 - DNA, 21 bp, Artificial sequence
  SiRNA target sequence
gcacttactttaaatattcca

SEQ ID NO: 130197 - DNA, 21 bp, Artificial sequence
  SiRNA target sequence
cacttactttaaatattccag

SEQ ID NO: 130198 - DNA, 21 bp, Artificial sequence
  SiRNA target sequence
acttactttaaatattccaga

SEQ ID NO: 130199 - DNA, 21 bp, Artificial sequence
  SiRNA target sequence
cttactttaaatattccagaa

SEQ ID NO: 130200 - DNA, 21 bp, Artificial sequence
  SiRNA target sequence
ttactttaaatattccagaag

SEQ ID NO: 130201 - DNA, 21 bp, Artificial sequence
  SiRNA target sequence
tactttaaatattccagaaga

SEQ ID NO: 130202 - DNA, 21 bp, Artificial sequence
  SiRNA target sequence
actttaaatattccagaagat

SEQ ID NO: 130203 - DNA, 21 bp, Artificial sequence
  SiRNA target sequence
ctttaaatattccagaagata

SEQ ID NO: 130204 - DNA, 21 bp, Artificial sequence
  SiRNA target sequence
tttaaatattccagaagatat

SEQ ID NO: 130205 - DNA, 21 bp, Artificial sequence
  SiRNA target sequence
ttaaatattccagaagatata

SEQ ID NO: 130206 - DNA, 21 bp, Artificial sequence
  SiRNA target sequence
taaatattccagaagatatag

SEQ ID NO: 130207 - DNA, 21 bp, Artificial sequence
  SiRNA target sequence
aaatattccagaagatatagc

SEQ ID NO: 130208 - DNA, 21 bp, Artificial sequence
  SiRNA target sequence
aatattccagaagatatagct

SEQ ID NO: 130209 - DNA, 21 bp, Artificial sequence
  SiRNA target sequence
atattccagaagatatagcta

SEQ ID NO: 130210 - DNA, 21 bp, Artificial sequence
  SiRNA target sequence
tattccagaagatatagctaa

SEQ ID NO: 130211 - DNA, 21 bp, Artificial sequence
  SiRNA target sequence
attccagaagatatagctaag

SEQ ID NO: 130212 - DNA, 21 bp, Artificial sequence
  SiRNA target sequence
ttccagaagatatagctaagc

SEQ ID NO: 130213 - DNA, 21 bp, Artificial sequence
  SiRNA target sequence
tccagaagatatagctaagca

SEQ ID NO: 130214 - DNA, 21 bp, Artificial sequence
  SiRNA target sequence
ccagaagatatagctaagcat

SEQ ID NO: 130215 - DNA, 21 bp, Artificial sequence
  SiRNA target sequence
cagaagatatagctaagcatt

SEQ ID NO: 130216 - DNA, 21 bp, Artificial sequence
  SiRNA target sequence
agaagatatagctaagcattt

SEQ ID NO: 130217 - DNA, 21 bp, Artificial sequence
  SiRNA target sequence
gaagatatagctaagcattta

SEQ ID NO: 130218 - DNA, 21 bp, Artificial sequence
  SiRNA target sequence
aagatatagctaagcatttag

SEQ ID NO: 130219 - DNA, 21 bp, Artificial sequence
  SiRNA target sequence
agatatagctaagcatttagc

SEQ ID NO: 130220 - DNA, 21 bp, Artificial sequence
  SiRNA target sequence
gatatagctaagcatttagct

SEQ ID NO: 130221 - DNA, 21 bp, Artificial sequence
  SiRNA target sequence
atatagctaagcatttagcta

SEQ ID NO: 130222 - DNA, 21 bp, Artificial sequence
  SiRNA target sequence
tatagctaagcatttagctac

SEQ ID NO: 130223 - DNA, 21 bp, Artificial sequence
  SiRNA target sequence
atagctaagcatttagctaca

SEQ ID NO: 130224 - DNA, 21 bp, Artificial sequence
  SiRNA target sequence
tagctaagcatttagctacaa

SEQ ID NO: 130225 - DNA, 21 bp, Artificial sequence
  SiRNA target sequence
agctaagcatttagctacaac

SEQ ID NO: 130226 - DNA, 21 bp, Artificial sequence
  SiRNA target sequence
gctaagcatttagctacaact

SEQ ID NO: 130227 - DNA, 21 bp, Artificial sequence
  SiRNA target sequence
ctaagcatttagctacaactt

SEQ ID NO: 130228 - DNA, 21 bp, Artificial sequence
  SiRNA target sequence
taagcatttagctacaactta

SEQ ID NO: 130229 - DNA, 21 bp, Artificial sequence
  SiRNA target sequence
aagcatttagctacaacttat

SEQ ID NO: 130230 - DNA, 21 bp, Artificial sequence
  SiRNA target sequence
agcatttagctacaacttatg

SEQ ID NO: 130231 - DNA, 21 bp, Artificial sequence
  SiRNA target sequence
gcatttagctacaacttatgg

SEQ ID NO: 130232 - DNA, 21 bp, Artificial sequence
  SiRNA target sequence
catttagctacaacttatggt

SEQ ID NO: 130233 - DNA, 21 bp, Artificial sequence
  SiRNA target sequence
atttagctacaacttatggta

SEQ ID NO: 130234 - DNA, 21 bp, Artificial sequence
  SiRNA target sequence
tttagctacaacttatggtac

SEQ ID NO: 130235 - DNA, 21 bp, Artificial sequence
  SiRNA target sequence
ttagctacaacttatggtacc

SEQ ID NO: 130236 - DNA, 21 bp, Artificial sequence
  SiRNA target sequence
tagctacaacttatggtacca

SEQ ID NO: 130237 - DNA, 21 bp, Artificial sequence
  SiRNA target sequence
agctacaacttatggtaccaa

SEQ ID NO: 130238 - DNA, 21 bp, Artificial sequence
  SiRNA target sequence
gctacaacttatggtaccaaa

SEQ ID NO: 130239 - DNA, 21 bp, Artificial sequence
  SiRNA target sequence
ctacaacttatggtaccaaag

SEQ ID NO: 130240 - DNA, 21 bp, Artificial sequence
  SiRNA target sequence
tacaacttatggtaccaaagc

SEQ ID NO: 130241 - DNA, 21 bp, Artificial sequence
  SiRNA target sequence
acaacttatggtaccaaagct

SEQ ID NO: 130242 - DNA, 21 bp, Artificial sequence
  SiRNA target sequence
caacttatggtaccaaagctt

SEQ ID NO: 130243 - DNA, 21 bp, Artificial sequence
  SiRNA target sequence
aacttatggtaccaaagctta

SEQ ID NO: 130244 - DNA, 21 bp, Artificial sequence
  SiRNA target sequence
acttatggtaccaaagcttac

SEQ ID NO: 130245 - DNA, 21 bp, Artificial sequence
  SiRNA target sequence
cttatggtaccaaagcttaca

SEQ ID NO: 130246 - DNA, 21 bp, Artificial sequence
  SiRNA target sequence
ttatggtaccaaagcttacaa

SEQ ID NO: 130247 - DNA, 21 bp, Artificial sequence
  SiRNA target sequence
tatggtaccaaagcttacaat

SEQ ID NO: 130248 - DNA, 21 bp, Artificial sequence
  SiRNA target sequence
atggtaccaaagcttacaatt

SEQ ID NO: 130249 - DNA, 21 bp, Artificial sequence
  SiRNA target sequence
tggtaccaaagcttacaattt

SEQ ID NO: 130250 - DNA, 21 bp, Artificial sequence
  SiRNA target sequence
ggtaccaaagcttacaatttc

SEQ ID NO: 130251 - DNA, 21 bp, Artificial sequence
  SiRNA target sequence
gtaccaaagcttacaatttct

SEQ ID NO: 130252 - DNA, 21 bp, Artificial sequence
  SiRNA target sequence
taccaaagcttacaatttctc

SEQ ID NO: 130253 - DNA, 21 bp, Artificial sequence
  SiRNA target sequence
accaaagcttacaatttctct

SEQ ID NO: 130254 - DNA, 21 bp, Artificial sequence
  SiRNA target sequence
ccaaagcttacaatttctctg

SEQ ID NO: 130255 - DNA, 21 bp, Artificial sequence
  SiRNA target sequence
caaagcttacaatttctctga

SEQ ID NO: 130256 - DNA, 21 bp, Artificial sequence
  SiRNA target sequence
aaagcttacaatttctctgaa

SEQ ID NO: 130257 - DNA, 21 bp, Artificial sequence
  SiRNA target sequence
aagcttacaatttctctgaat

SEQ ID NO: 130258 - DNA, 21 bp, Artificial sequence
  SiRNA target sequence
agcttacaatttctctgaata

SEQ ID NO: 130259 - DNA, 21 bp, Artificial sequence
  SiRNA target sequence
gcttacaatttctctgaatac

SEQ ID NO: 130260 - DNA, 21 bp, Artificial sequence
  SiRNA target sequence
cttacaatttctctgaatact

SEQ ID NO: 130261 - DNA, 21 bp, Artificial sequence
  SiRNA target sequence
ttacaatttctctgaatactt

SEQ ID NO: 130262 - DNA, 21 bp, Artificial sequence
  SiRNA target sequence
tacaatttctctgaatacttt

SEQ ID NO: 130263 - DNA, 21 bp, Artificial sequence
  SiRNA target sequence
acaatttctctgaatacttta

SEQ ID NO: 130264 - DNA, 21 bp, Artificial sequence
  SiRNA target sequence
caatttctctgaatactttaa

SEQ ID NO: 130265 - DNA, 21 bp, Artificial sequence
  SiRNA target sequence
aatttctctgaatactttaat

SEQ ID NO: 130266 - DNA, 21 bp, Artificial sequence
  SiRNA target sequence
atttctctgaatactttaatg

SEQ ID NO: 130267 - DNA, 21 bp, Artificial sequence
  SiRNA target sequence
tttctctgaatactttaatgg

SEQ ID NO: 130268 - DNA, 21 bp, Artificial sequence
  SiRNA target sequence
ttctctgaatactttaatggg

SEQ ID NO: 130269 - DNA, 21 bp, Artificial sequence
  SiRNA target sequence
tctctgaatactttaatgggt

SEQ ID NO: 130270 - DNA, 21 bp, Artificial sequence
  SiRNA target sequence
ctctgaatactttaatgggtc

SEQ ID NO: 130271 - DNA, 21 bp, Artificial sequence
  SiRNA target sequence
tctgaatactttaatgggtca

SEQ ID NO: 130272 - DNA, 21 bp, Artificial sequence
  SiRNA target sequence
ctgaatactttaatgggtcat

SEQ ID NO: 130273 - DNA, 21 bp, Artificial sequence
  SiRNA target sequence
tgaatactttaatgggtcata

SEQ ID NO: 130274 - DNA, 21 bp, Artificial sequence
  SiRNA target sequence
gaatactttaatgggtcatac

SEQ ID NO: 130275 - DNA, 21 bp, Artificial sequence
  SiRNA target sequence
aatactttaatgggtcataca

SEQ ID NO: 130276 - DNA, 21 bp, Artificial sequence
  SiRNA target sequence
atactttaatgggtcatacac

SEQ ID NO: 130277 - DNA, 21 bp, Artificial sequence
  SiRNA target sequence
tactttaatgggtcatacacc

SEQ ID NO: 130278 - DNA, 21 bp, Artificial sequence
  SiRNA target sequence
actttaatgggtcatacacca

SEQ ID NO: 130279 - DNA, 21 bp, Artificial sequence
  SiRNA target sequence
ctttaatgggtcatacaccag

SEQ ID NO: 130280 - DNA, 21 bp, Artificial sequence
  SiRNA target sequence
tttaatgggtcatacaccaga

SEQ ID NO: 130281 - DNA, 21 bp, Artificial sequence
  SiRNA target sequence
ttaatgggtcatacaccagac

SEQ ID NO: 130282 - DNA, 21 bp, Artificial sequence
  SiRNA target sequence
taatgggtcatacaccagact

SEQ ID NO: 130283 - DNA, 21 bp, Artificial sequence
  SiRNA target sequence
aatgggtcatacaccagactt

SEQ ID NO: 130284 - DNA, 21 bp, Artificial sequence
  SiRNA target sequence
atgggtcatacaccagactta

SEQ ID NO: 130285 - DNA, 21 bp, Artificial sequence
  SiRNA target sequence
tgggtcatacaccagacttac

SEQ ID NO: 130286 - DNA, 21 bp, Artificial sequence
  SiRNA target sequence
gggtcatacaccagacttaca

SEQ ID NO: 130287 - DNA, 21 bp, Artificial sequence
  SiRNA target sequence
ggtcatacaccagacttacag

SEQ ID NO: 130288 - DNA, 21 bp, Artificial sequence
  SiRNA target sequence
gtcatacaccagacttacaga

SEQ ID NO: 130289 - DNA, 21 bp, Artificial sequence
  SiRNA target sequence
tcatacaccagacttacagat

SEQ ID NO: 130290 - DNA, 21 bp, Artificial sequence
  SiRNA target sequence
catacaccagacttacagatg

SEQ ID NO: 130291 - DNA, 21 bp, Artificial sequence
  SiRNA target sequence
atacaccagacttacagatgg

SEQ ID NO: 130292 - DNA, 21 bp, Artificial sequence
  SiRNA target sequence
tacaccagacttacagatggt

SEQ ID NO: 130293 - DNA, 21 bp, Artificial sequence
  SiRNA target sequence
acaccagacttacagatggtt

SEQ ID NO: 130294 - DNA, 21 bp, Artificial sequence
  SiRNA target sequence
caccagacttacagatggtta

SEQ ID NO: 130295 - DNA, 21 bp, Artificial sequence
  SiRNA target sequence
accagacttacagatggttat

SEQ ID NO: 130296 - DNA, 21 bp, Artificial sequence
  SiRNA target sequence
ccagacttacagatggttatc

SEQ ID NO: 130297 - DNA, 21 bp, Artificial sequence
  SiRNA target sequence
cagacttacagatggttatcc

SEQ ID NO: 130298 - DNA, 21 bp, Artificial sequence
  SiRNA target sequence
agacttacagatggttatcct

SEQ ID NO: 130299 - DNA, 21 bp, Artificial sequence
  SiRNA target sequence
gacttacagatggttatcctt

SEQ ID NO: 130300 - DNA, 21 bp, Artificial sequence
  SiRNA target sequence
acttacagatggttatcctta

SEQ ID NO: 130301 - DNA, 21 bp, Artificial sequence
  SiRNA target sequence
cttacagatggttatccttat

SEQ ID NO: 130302 - DNA, 21 bp, Artificial sequence
  SiRNA target sequence
ttacagatggttatccttata

SEQ ID NO: 130303 - DNA, 21 bp, Artificial sequence
  SiRNA target sequence
tacagatggttatccttatac

SEQ ID NO: 130304 - DNA, 21 bp, Artificial sequence
  SiRNA target sequence
acagatggttatccttataca

SEQ ID NO: 130305 - DNA, 21 bp, Artificial sequence
  SiRNA target sequence
cagatggttatccttatacaa

SEQ ID NO: 130306 - DNA, 21 bp, Artificial sequence
  SiRNA target sequence
agatggttatccttatacaaa

SEQ ID NO: 130307 - DNA, 21 bp, Artificial sequence
  SiRNA target sequence
gatggttatccttatacaaaa

SEQ ID NO: 130308 - DNA, 21 bp, Artificial sequence
  SiRNA target sequence
atggttatccttatacaaaag

SEQ ID NO: 130309 - DNA, 21 bp, Artificial sequence
  SiRNA target sequence
tggttatccttatacaaaaga

SEQ ID NO: 130310 - DNA, 21 bp, Artificial sequence
  SiRNA target sequence
ggttatccttatacaaaagaa

SEQ ID NO: 130311 - DNA, 21 bp, Artificial sequence
  SiRNA target sequence
gttatccttatacaaaagaag

SEQ ID NO: 130312 - DNA, 21 bp, Artificial sequence
  SiRNA target sequence
ttatccttatacaaaagaaga

SEQ ID NO: 130313 - DNA, 21 bp, Artificial sequence
  SiRNA target sequence
tatccttatacaaaagaagaa

SEQ ID NO: 130314 - DNA, 21 bp, Artificial sequence
  SiRNA target sequence
atccttatacaaaagaagaaa

SEQ ID NO: 130315 - DNA, 21 bp, Artificial sequence
  SiRNA target sequence
tccttatacaaaagaagaaat

SEQ ID NO: 130316 - DNA, 21 bp, Artificial sequence
  SiRNA target sequence
ccttatacaaaagaagaaata

SEQ ID NO: 130317 - DNA, 21 bp, Artificial sequence
  SiRNA target sequence
cttatacaaaagaagaaatag

SEQ ID NO: 130318 - DNA, 21 bp, Artificial sequence
  SiRNA target sequence
ttatacaaaagaagaaatagt

SEQ ID NO: 130319 - DNA, 21 bp, Artificial sequence
  SiRNA target sequence
tatacaaaagaagaaatagta

SEQ ID NO: 130320 - DNA, 21 bp, Artificial sequence
  SiRNA target sequence
atacaaaagaagaaatagtat

SEQ ID NO: 130321 - DNA, 21 bp, Artificial sequence
  SiRNA target sequence
tacaaaagaagaaatagtata

SEQ ID NO: 130322 - DNA, 21 bp, Artificial sequence
  SiRNA target sequence
acaaaagaagaaatagtatat

SEQ ID NO: 130323 - DNA, 21 bp, Artificial sequence
  SiRNA target sequence
caaaagaagaaatagtatatt

SEQ ID NO: 130324 - DNA, 21 bp, Artificial sequence
  SiRNA target sequence
aaaagaagaaatagtatattg

SEQ ID NO: 130325 - DNA, 21 bp, Artificial sequence
  SiRNA target sequence
aaagaagaaatagtatattgt

SEQ ID NO: 130326 - DNA, 21 bp, Artificial sequence
  SiRNA target sequence
aagaagaaatagtatattgta

SEQ ID NO: 130327 - DNA, 21 bp, Artificial sequence
  SiRNA target sequence
agaagaaatagtatattgtat

SEQ ID NO: 130328 - DNA, 21 bp, Artificial sequence
  SiRNA target sequence
gaagaaatagtatattgtatc

SEQ ID NO: 130329 - DNA, 21 bp, Artificial sequence
  SiRNA target sequence
aagaaatagtatattgtatcg

SEQ ID NO: 130330 - DNA, 21 bp, Artificial sequence
  SiRNA target sequence
agaaatagtatattgtatcga

SEQ ID NO: 130331 - DNA, 21 bp, Artificial sequence
  SiRNA target sequence
gaaatagtatattgtatcgaa

SEQ ID NO: 130332 - DNA, 21 bp, Artificial sequence
  SiRNA target sequence
aaatagtatattgtatcgaac

SEQ ID NO: 130333 - DNA, 21 bp, Artificial sequence
  SiRNA target sequence
aatagtatattgtatcgaaca

SEQ ID NO: 130334 - DNA, 21 bp, Artificial sequence
  SiRNA target sequence
atagtatattgtatcgaacat

SEQ ID NO: 130335 - DNA, 21 bp, Artificial sequence
  SiRNA target sequence
tagtatattgtatcgaacatg

SEQ ID NO: 130336 - DNA, 21 bp, Artificial sequence
  SiRNA target sequence
agtatattgtatcgaacatga

SEQ ID NO: 130337 - DNA, 21 bp, Artificial sequence
  SiRNA target sequence
gtatattgtatcgaacatgaa

SEQ ID NO: 130338 - DNA, 21 bp, Artificial sequence
  SiRNA target sequence
tatattgtatcgaacatgaat

SEQ ID NO: 130339 - DNA, 21 bp, Artificial sequence
  SiRNA target sequence
atattgtatcgaacatgaatt

SEQ ID NO: 130340 - DNA, 21 bp, Artificial sequence
  SiRNA target sequence
tattgtatcgaacatgaattg

SEQ ID NO: 130341 - DNA, 21 bp, Artificial sequence
  SiRNA target sequence
attgtatcgaacatgaattgg

SEQ ID NO: 130342 - DNA, 21 bp, Artificial sequence
  SiRNA target sequence
ttgtatcgaacatgaattggc

SEQ ID NO: 130343 - DNA, 21 bp, Artificial sequence
  SiRNA target sequence
tgtatcgaacatgaattggct

SEQ ID NO: 130344 - DNA, 21 bp, Artificial sequence
  SiRNA target sequence
gtatcgaacatgaattggctt

SEQ ID NO: 130345 - DNA, 21 bp, Artificial sequence
  SiRNA target sequence
tatcgaacatgaattggctta

SEQ ID NO: 130346 - DNA, 21 bp, Artificial sequence
  SiRNA target sequence
atcgaacatgaattggcttat

SEQ ID NO: 130347 - DNA, 21 bp, Artificial sequence
  SiRNA target sequence
tcgaacatgaattggcttatc

SEQ ID NO: 130348 - DNA, 21 bp, Artificial sequence
  SiRNA target sequence
cgaacatgaattggcttatcg

SEQ ID NO: 130349 - DNA, 21 bp, Artificial sequence
  SiRNA target sequence
gaacatgaattggcttatcgc

SEQ ID NO: 130350 - DNA, 21 bp, Artificial sequence
  SiRNA target sequence
aacatgaattggcttatcgca

SEQ ID NO: 130351 - DNA, 21 bp, Artificial sequence
  SiRNA target sequence
acatgaattggcttatcgcat

SEQ ID NO: 130352 - DNA, 21 bp, Artificial sequence
  SiRNA target sequence
catgaattggcttatcgcatc

SEQ ID NO: 130353 - DNA, 21 bp, Artificial sequence
  SiRNA target sequence
atgaattggcttatcgcatca

SEQ ID NO: 130354 - DNA, 21 bp, Artificial sequence
  SiRNA target sequence
tgaattggcttatcgcatcag

SEQ ID NO: 130355 - DNA, 21 bp, Artificial sequence
  SiRNA target sequence
gaattggcttatcgcatcagt

SEQ ID NO: 130356 - DNA, 21 bp, Artificial sequence
  SiRNA target sequence
aattggcttatcgcatcagtg

SEQ ID NO: 130357 - DNA, 21 bp, Artificial sequence
  SiRNA target sequence
attggcttatcgcatcagtga

SEQ ID NO: 130358 - DNA, 21 bp, Artificial sequence
  SiRNA target sequence
ttggcttatcgcatcagtgat

SEQ ID NO: 130359 - DNA, 21 bp, Artificial sequence
  SiRNA target sequence
tggcttatcgcatcagtgata

SEQ ID NO: 130360 - DNA, 21 bp, Artificial sequence
  SiRNA target sequence
ggcttatcgcatcagtgatat

SEQ ID NO: 130361 - DNA, 21 bp, Artificial sequence
  SiRNA target sequence
gcttatcgcatcagtgatata

SEQ ID NO: 130362 - DNA, 21 bp, Artificial sequence
  SiRNA target sequence
cttatcgcatcagtgatatat

SEQ ID NO: 130363 - DNA, 21 bp, Artificial sequence
  SiRNA target sequence
ttatcgcatcagtgatatatt

SEQ ID NO: 130364 - DNA, 21 bp, Artificial sequence
  SiRNA target sequence
tatcgcatcagtgatatatta

SEQ ID NO: 130365 - DNA, 21 bp, Artificial sequence
  SiRNA target sequence
atcgcatcagtgatatattat

SEQ ID NO: 130366 - DNA, 21 bp, Artificial sequence
  SiRNA target sequence
tcgcatcagtgatatattatt

SEQ ID NO: 130367 - DNA, 21 bp, Artificial sequence
  SiRNA target sequence
cgcatcagtgatatattattt

SEQ ID NO: 130368 - DNA, 21 bp, Artificial sequence
  SiRNA target sequence
gcatcagtgatatattattta

SEQ ID NO: 130369 - DNA, 21 bp, Artificial sequence
  SiRNA target sequence
catcagtgatatattatttaa

SEQ ID NO: 130370 - DNA, 21 bp, Artificial sequence
  SiRNA target sequence
atcagtgatatattatttaat

SEQ ID NO: 130371 - DNA, 21 bp, Artificial sequence
  SiRNA target sequence
tcagtgatatattatttaata

SEQ ID NO: 130372 - DNA, 21 bp, Artificial sequence
  SiRNA target sequence
cagtgatatattatttaatag

SEQ ID NO: 130373 - DNA, 21 bp, Artificial sequence
  SiRNA target sequence
agtgatatattatttaatagg

SEQ ID NO: 130374 - DNA, 21 bp, Artificial sequence
  SiRNA target sequence
gtgatatattatttaatagga

SEQ ID NO: 130375 - DNA, 21 bp, Artificial sequence
  SiRNA target sequence
tgatatattatttaataggat

SEQ ID NO: 130376 - DNA, 21 bp, Artificial sequence
  SiRNA target sequence
gatatattatttaataggatg

SEQ ID NO: 130377 - DNA, 21 bp, Artificial sequence
  SiRNA target sequence
atatattatttaataggatga

SEQ ID NO: 130378 - DNA, 21 bp, Artificial sequence
  SiRNA target sequence
tatattatttaataggatgat

SEQ ID NO: 130379 - DNA, 21 bp, Artificial sequence
  SiRNA target sequence
atattatttaataggatgatg

SEQ ID NO: 130380 - DNA, 21 bp, Artificial sequence
  SiRNA target sequence
tattatttaataggatgatga

SEQ ID NO: 130381 - DNA, 21 bp, Artificial sequence
  SiRNA target sequence
attatttaataggatgatgat

SEQ ID NO: 130382 - DNA, 21 bp, Artificial sequence
  SiRNA target sequence
ttatttaataggatgatgata

SEQ ID NO: 130383 - DNA, 21 bp, Artificial sequence
  SiRNA target sequence
tatttaataggatgatgatag

SEQ ID NO: 130384 - DNA, 21 bp, Artificial sequence
  SiRNA target sequence
atttaataggatgatgatagg

SEQ ID NO: 130385 - DNA, 21 bp, Artificial sequence
  SiRNA target sequence
tttaataggatgatgatagga

SEQ ID NO: 130386 - DNA, 21 bp, Artificial sequence
  SiRNA target sequence
ttaataggatgatgataggat

SEQ ID NO: 130387 - DNA, 21 bp, Artificial sequence
  SiRNA target sequence
taataggatgatgataggata

SEQ ID NO: 130388 - DNA, 21 bp, Artificial sequence
  SiRNA target sequence
aataggatgatgataggatac

SEQ ID NO: 130389 - DNA, 21 bp, Artificial sequence
  SiRNA target sequence
ataggatgatgataggataca

SEQ ID NO: 130390 - DNA, 21 bp, Artificial sequence
  SiRNA target sequence
taggatgatgataggatacat

SEQ ID NO: 130391 - DNA, 21 bp, Artificial sequence
  SiRNA target sequence
aggatgatgataggatacatt

SEQ ID NO: 130392 - DNA, 21 bp, Artificial sequence
  SiRNA target sequence
ggatgatgataggatacattg

SEQ ID NO: 130393 - DNA, 21 bp, Artificial sequence
  SiRNA target sequence
gatgatgataggatacattga

SEQ ID NO: 130394 - DNA, 21 bp, Artificial sequence
  SiRNA target sequence
atgatgataggatacattgac

SEQ ID NO: 130395 - DNA, 21 bp, Artificial sequence
  SiRNA target sequence
tgatgataggatacattgacg

SEQ ID NO: 130396 - DNA, 21 bp, Artificial sequence
  SiRNA target sequence
gatgataggatacattgacgt

SEQ ID NO: 130397 - DNA, 21 bp, Artificial sequence
  SiRNA target sequence
atgataggatacattgacgtc

SEQ ID NO: 130398 - DNA, 21 bp, Artificial sequence
  SiRNA target sequence
tgataggatacattgacgtca

SEQ ID NO: 130399 - DNA, 21 bp, Artificial sequence
  SiRNA target sequence
gataggatacattgacgtcag

SEQ ID NO: 130400 - DNA, 21 bp, Artificial sequence
  SiRNA target sequence
ataggatacattgacgtcaga

SEQ ID NO: 130401 - DNA, 21 bp, Artificial sequence
  SiRNA target sequence
taggatacattgacgtcagaa

SEQ ID NO: 130402 - DNA, 21 bp, Artificial sequence
  SiRNA target sequence
aggatacattgacgtcagaag

SEQ ID NO: 130403 - DNA, 21 bp, Artificial sequence
  SiRNA target sequence
ggatacattgacgtcagaaga

SEQ ID NO: 130404 - DNA, 21 bp, Artificial sequence
  SiRNA target sequence
gatacattgacgtcagaagag

SEQ ID NO: 130405 - DNA, 21 bp, Artificial sequence
  SiRNA target sequence
atacattgacgtcagaagagc

SEQ ID NO: 130406 - DNA, 21 bp, Artificial sequence
  SiRNA target sequence
tacattgacgtcagaagagca

SEQ ID NO: 130407 - DNA, 21 bp, Artificial sequence
  SiRNA target sequence
acattgacgtcagaagagcat

SEQ ID NO: 130408 - DNA, 21 bp, Artificial sequence
  SiRNA target sequence
cattgacgtcagaagagcatt

SEQ ID NO: 130409 - DNA, 21 bp, Artificial sequence
  SiRNA target sequence
attgacgtcagaagagcattt

SEQ ID NO: 130410 - DNA, 21 bp, Artificial sequence
  SiRNA target sequence
ttgacgtcagaagagcatttg

SEQ ID NO: 130411 - DNA, 21 bp, Artificial sequence
  SiRNA target sequence
tgacgtcagaagagcatttga

SEQ ID NO: 130412 - DNA, 21 bp, Artificial sequence
  SiRNA target sequence
gacgtcagaagagcatttgat

SEQ ID NO: 130413 - DNA, 21 bp, Artificial sequence
  SiRNA target sequence
acgtcagaagagcatttgatt

SEQ ID NO: 130414 - DNA, 21 bp, Artificial sequence
  SiRNA target sequence
cgtcagaagagcatttgattt

SEQ ID NO: 130415 - DNA, 21 bp, Artificial sequence
  SiRNA target sequence
gtcagaagagcatttgattta

SEQ ID NO: 130416 - DNA, 21 bp, Artificial sequence
  SiRNA target sequence
tcagaagagcatttgatttaa

SEQ ID NO: 130417 - DNA, 21 bp, Artificial sequence
  SiRNA target sequence
cagaagagcatttgatttaat

SEQ ID NO: 130418 - DNA, 21 bp, Artificial sequence
  SiRNA target sequence
agaagagcatttgatttaatt

SEQ ID NO: 130419 - DNA, 21 bp, Artificial sequence
  SiRNA target sequence
gaagagcatttgatttaattg

SEQ ID NO: 130420 - DNA, 21 bp, Artificial sequence
  SiRNA target sequence
aagagcatttgatttaattgg

SEQ ID NO: 130421 - DNA, 21 bp, Artificial sequence
  SiRNA target sequence
agagcatttgatttaattggt

SEQ ID NO: 130422 - DNA, 21 bp, Artificial sequence
  SiRNA target sequence
gagcatttgatttaattggta

SEQ ID NO: 130423 - DNA, 21 bp, Artificial sequence
  SiRNA target sequence
agcatttgatttaattggtat

SEQ ID NO: 130424 - DNA, 21 bp, Artificial sequence
  SiRNA target sequence
gcatttgatttaattggtata

SEQ ID NO: 130425 - DNA, 21 bp, Artificial sequence
  SiRNA target sequence
catttgatttaattggtatag

SEQ ID NO: 130426 - DNA, 21 bp, Artificial sequence
  SiRNA target sequence
atttgatttaattggtatagt

SEQ ID NO: 130427 - DNA, 21 bp, Artificial sequence
  SiRNA target sequence
tttgatttaattggtatagta

SEQ ID NO: 130428 - DNA, 21 bp, Artificial sequence
  SiRNA target sequence
ttgatttaattggtatagtag

SEQ ID NO: 130429 - DNA, 21 bp, Artificial sequence
  SiRNA target sequence
tgatttaattggtatagtagc
